United States Patent 7,777,022 (BIOINFORMATICALLY DETECTABLE GROUP OF NOVEL REGULATORY VIRAL AND VIRAL ASSOCIATED OLIGONUCLEOTIDES AND USES THEREOF) - sequence listing, part 41

SEQ ID NO: 1830219 - RNA, 18 nt, Human herpesvirus 2
ccaugggccccggucugu

SEQ ID NO: 1830220 - RNA, 13 nt, Human herpesvirus 2
cccacggaugccg

SEQ ID NO: 1830221 - RNA, 13 nt, Human herpesvirus 2
cccgucccggcag

SEQ ID NO: 1830222 - RNA, 13 nt, Human herpesvirus 2
cccgucugccagg

SEQ ID NO: 1830223 - RNA, 15 nt, Human herpesvirus 2
ccgaauacgacgccc

SEQ ID NO: 1830224 - RNA, 16 nt, Human herpesvirus 2
ccccggggccgucgcg

SEQ ID NO: 1830225 - RNA, 15 nt, Human herpesvirus 2
cccgacguggcccgc

SEQ ID NO: 1830226 - RNA, 13 nt, Human herpesvirus 2
cccgagcuccggg

SEQ ID NO: 1830227 - RNA, 17 nt, Human herpesvirus 2
ccccgucugucgccucu

SEQ ID NO: 1830228 - RNA, 15 nt, Human herpesvirus 2
ccccggcggccccgg

SEQ ID NO: 1830229 - RNA, 13 nt, Human herpesvirus 2
ccccggcuccgag

SEQ ID NO: 1830230 - RNA, 16 nt, Human herpesvirus 2
ucgccgucaaccccgc

SEQ ID NO: 1830231 - RNA, 11 nt, Human herpesvirus 2
uccggggcggu

SEQ ID NO: 1830232 - RNA, 13 nt, Human herpesvirus 2
uccggcuggcggc

SEQ ID NO: 1830233 - RNA, 23 nt, Human herpesvirus 2
uccgugugauguucuuggcgcgc

SEQ ID NO: 1830234 - RNA, 16 nt, Human herpesvirus 2
uccucacgggggggcu

SEQ ID NO: 1830235 - RNA, 17 nt, Human herpesvirus 2
gcgcgugcagaacaccg

SEQ ID NO: 1830236 - RNA, 18 nt, Human herpesvirus 2
ggcgcccgccccugcgca

SEQ ID NO: 1830237 - RNA, 12 nt, Human herpesvirus 2
ggcggcggcguc

SEQ ID NO: 1830238 - RNA, 16 nt, Human herpesvirus 2
ggcggcccuggagcgc

SEQ ID NO: 1830239 - RNA, 12 nt, Human herpesvirus 2
ggcgcgggcggc

SEQ ID NO: 1830240 - RNA, 23 nt, Human herpesvirus 2
ggcgcggugccugacgccggcca

SEQ ID NO: 1830241 - RNA, 15 nt, Human herpesvirus 2
ggcgcugagggcggc

SEQ ID NO: 1830242 - RNA, 22 nt, Human herpesvirus 2
uccggcggccaccccgccgcag

SEQ ID NO: 1830243 - RNA, 18 nt, Human herpesvirus 2
uccgcgggucccuuccca

SEQ ID NO: 1830244 - RNA, 21 nt, Human herpesvirus 2
uccgcggcuuuaucaccccgc

SEQ ID NO: 1830245 - RNA, 17 nt, Human herpesvirus 2
uccgcgggaagcgccgc

SEQ ID NO: 1830246 - RNA, 22 nt, Human herpesvirus 2
uccgcaauaaacgccuucccgg

SEQ ID NO: 1830247 - RNA, 16 nt, Human herpesvirus 2
gcgcgggcgacgggcg

SEQ ID NO: 1830248 - RNA, 23 nt, Human herpesvirus 2
gcgcgacugccuccacgcccugc

SEQ ID NO: 1830249 - RNA, 17 nt, Human herpesvirus 2
gcgccgcgacggccccg

SEQ ID NO: 1830250 - RNA, 23 nt, Human herpesvirus 2
gcgccgcgacggccccggccgcc

SEQ ID NO: 1830251 - RNA, 18 nt, Human herpesvirus 2
gcgccgccgcgcgggccc

SEQ ID NO: 1830252 - RNA, 12 nt, Human herpesvirus 2
gcgccgggcgcg

SEQ ID NO: 1830253 - RNA, 17 nt, Human herpesvirus 2
gcgccgcgcccgcgugc

SEQ ID NO: 1830254 - RNA, 14 nt, Human herpesvirus 2
gcgccucgggcggc

SEQ ID NO: 1830255 - RNA, 14 nt, Human herpesvirus 2
gcgccgucgggccc

SEQ ID NO: 1830256 - RNA, 18 nt, Human herpesvirus 2
gcgcccuuccgcguccgc

SEQ ID NO: 1830257 - RNA, 17 nt, Human herpesvirus 2
ccgcccaagcggcccga

SEQ ID NO: 1830258 - RNA, 15 nt, Human herpesvirus 2
ccgccuccggcccga

SEQ ID NO: 1830259 - RNA, 22 nt, Human herpesvirus 2
ccgcgaugaccucccggcccgc

SEQ ID NO: 1830260 - RNA, 14 nt, Human herpesvirus 2
ccgcgauuccgagg

SEQ ID NO: 1830261 - RNA, 18 nt, Human herpesvirus 2
cgcgaccgaucuggagcc

SEQ ID NO: 1830262 - RNA, 20 nt, Human herpesvirus 2
cgcgaccaccaaggcccgga

SEQ ID NO: 1830263 - RNA, 13 nt, Human herpesvirus 2
cgcgacacgcgcc

SEQ ID NO: 1830264 - RNA, 13 nt, Human herpesvirus 2
ccggggggcgugg

SEQ ID NO: 1830265 - RNA, 16 nt, Human herpesvirus 2
ccggggggggccucgg

SEQ ID NO: 1830266 - RNA, 12 nt, Human herpesvirus 2
ccggggcccgca

SEQ ID NO: 1830267 - RNA, 16 nt, Human herpesvirus 2
ccggggacacgcggcg

SEQ ID NO: 1830268 - RNA, 17 nt, Human herpesvirus 2
ccggggcacgcggucag

SEQ ID NO: 1830269 - RNA, 15 nt, Human herpesvirus 2
ccgggcccggccgcg

SEQ ID NO: 1830270 - RNA, 18 nt, Human herpesvirus 2
ccgggcgccggggcccca

SEQ ID NO: 1830271 - RNA, 20 nt, Human herpesvirus 2
ccgggauccuccgccagcuc

SEQ ID NO: 1830272 - RNA, 13 nt, Human herpesvirus 2
ccggcgcgggcgg

SEQ ID NO: 1830273 - RNA, 20 nt, Human herpesvirus 2
cucccaauucgucaccuggc

SEQ ID NO: 1830274 - RNA, 15 nt, Human herpesvirus 2
cucagcgcggccgug

SEQ ID NO: 1830275 - RNA, 17 nt, Human herpesvirus 2
cgcgacccaaggucccg

SEQ ID NO: 1830276 - RNA, 14 nt, Human herpesvirus 2
gagccgcgcggcca

SEQ ID NO: 1830277 - RNA, 16 nt, Human herpesvirus 2
cucccagugccccgac

SEQ ID NO: 1830278 - RNA, 14 nt, Human herpesvirus 2
cuccccgcuggagc

SEQ ID NO: 1830279 - RNA, 15 nt, Human herpesvirus 2
gagccccgcgaccac

SEQ ID NO: 1830280 - RNA, 14 nt, Human herpesvirus 2
cucacggccaacga

SEQ ID NO: 1830281 - RNA, 17 nt, Human herpesvirus 2
gaugcgacgccgccccu

SEQ ID NO: 1830282 - RNA, 24 nt, Human herpesvirus 2
gaugaccucccggcccgccgacca

SEQ ID NO: 1830283 - RNA, 17 nt, Human herpesvirus 2
gaucguugacgacggcc

SEQ ID NO: 1830284 - RNA, 24 nt, Human herpesvirus 2
gaugcagcucccccgcgcaggggg

SEQ ID NO: 1830285 - RNA, 15 nt, Human herpesvirus 2
gagcgggcccggggc

SEQ ID NO: 1830286 - RNA, 21 nt, Human herpesvirus 2
gagcgccgucgggccccgggu

SEQ ID NO: 1830287 - RNA, 22 nt, Human herpesvirus 2
gaucucggggagggcggcaccg

SEQ ID NO: 1830288 - RNA, 17 nt, Human herpesvirus 2
gaugaagcgccaggggg

SEQ ID NO: 1830289 - RNA, 15 nt, Human herpesvirus 2
uggcccuccacgccg

SEQ ID NO: 1830290 - RNA, 21 nt, Human herpesvirus 2
uggaggcgccucugcccgacc

SEQ ID NO: 1830291 - RNA, 15 nt, Human herpesvirus 2
uggacugggagccgc

SEQ ID NO: 1830292 - RNA, 13 nt, Human herpesvirus 2
uggacugggccgc

SEQ ID NO: 1830293 - RNA, 11 nt, Human herpesvirus 2
ccacgcccugc

SEQ ID NO: 1830294 - RNA, 14 nt, Human herpesvirus 2
ccaccucgcggcgg

SEQ ID NO: 1830295 - RNA, 13 nt, Human herpesvirus 2
ccaaggaacccaa

SEQ ID NO: 1830296 - RNA, 12 nt, Human herpesvirus 2
caucaggcucau

SEQ ID NO: 1830297 - RNA, 14 nt, Human herpesvirus 2
cauccuuuggcccg

SEQ ID NO: 1830298 - RNA, 16 nt, Human herpesvirus 2
cauccggucgacgucc

SEQ ID NO: 1830299 - RNA, 23 nt, Human herpesvirus 2
auuuacgcggugcgccccgccgg

SEQ ID NO: 1830300 - RNA, 13 nt, Human herpesvirus 2
cauacgcggcgug

SEQ ID NO: 1830301 - RNA, 19 nt, Human herpesvirus 2
auuuaaggagucgccgccc

SEQ ID NO: 1830302 - RNA, 22 nt, Human herpesvirus 2
auuucccaaacacugaggaacu

SEQ ID NO: 1830303 - RNA, 22 nt, Human herpesvirus 2
auuuccccagcacggaggaacu

SEQ ID NO: 1830304 - RNA, 16 nt, Human herpesvirus 2
auucgggggucgggcg

SEQ ID NO: 1830305 - RNA, 16 nt, Human herpesvirus 2
auguguucuccuggac

SEQ ID NO: 1830306 - RNA, 18 nt, Human herpesvirus 2
auguuguguucgccgacc

SEQ ID NO: 1830307 - RNA, 20 nt, Human herpesvirus 2
auuagcaacuuuuaaugggc

SEQ ID NO: 1830308 - RNA, 20 nt, Human herpesvirus 2
auuagcagcuuuuaacgggc

SEQ ID NO: 1830309 - RNA, 17 nt, Human herpesvirus 2
acccguccgaucccggu

SEQ ID NO: 1830310 - RNA, 18 nt, Human herpesvirus 2
acccggacugcagccccg

SEQ ID NO: 1830311 - RNA, 18 nt, Human herpesvirus 2
acccccgaacagccccug

SEQ ID NO: 1830312 - RNA, 20 nt, Human herpesvirus 2
acccgccuaccagccccucg

SEQ ID NO: 1830313 - RNA, 17 nt, Human herpesvirus 2
acccgacaacagccccu

SEQ ID NO: 1830314 - RNA, 18 nt, Human herpesvirus 2
acccgacaacagccccug

SEQ ID NO: 1830315 - RNA, 17 nt, Human herpesvirus 2
accccgauagucccccg

SEQ ID NO: 1830316 - RNA, 17 nt, Human herpesvirus 2
acaaaaaugggacgcac

SEQ ID NO: 1830317 - RNA, 17 nt, Human herpesvirus 2
agcguccggcuggcggc

SEQ ID NO: 1830318 - RNA, 21 nt, Human herpesvirus 2
agcgggggaggggggagaugg

SEQ ID NO: 1830319 - RNA, 17 nt, Human herpesvirus 2
agcugguaucggcgacc

SEQ ID NO: 1830320 - RNA, 14 nt, Human herpesvirus 2
agcggccccgaccc

SEQ ID NO: 1830321 - RNA, 17 nt, Human herpesvirus 2
agcggcccgaggcgacc

SEQ ID NO: 1830322 - RNA, 23 nt, Human herpesvirus 2
aggacaguucauaggccgggagc

SEQ ID NO: 1830323 - RNA, 20 nt, Human herpesvirus 2
aggaccgccugccccgcgga

SEQ ID NO: 1830324 - RNA, 15 nt, Human herpesvirus 2
auaaagguccggcgg

SEQ ID NO: 1830325 - RNA, 22 nt, Human herpesvirus 2
aggcaggggcagcucgcccccg

SEQ ID NO: 1830326 - RNA, 18 nt, Human herpesvirus 2
acgaccaucgcguacagc

SEQ ID NO: 1830327 - RNA, 17 nt, Human herpesvirus 2
acgacccgccucgggcc

SEQ ID NO: 1830328 - RNA, 20 nt, Human herpesvirus 2
agaggucaauagauuucccc

SEQ ID NO: 1830329 - RNA, 20 nt, Human herpesvirus 2
agaguucaauagauuuccca

SEQ ID NO: 1830330 - RNA, 24 nt, Human herpesvirus 2
agcgcccuuccgcguccgcgauga

SEQ ID NO: 1830331 - RNA, 23 nt, Human herpesvirus 2
agcgccccgcggaccccgcccgc

SEQ ID NO: 1830332 - RNA, 19 nt, Human herpesvirus 2
agcaacccuauaucccggg

SEQ ID NO: 1830333 - RNA, 18 nt, Human herpesvirus 2
agccaccgucccgcccgc

SEQ ID NO: 1830334 - RNA, 21 nt, Human herpesvirus 2
aacccaagugguuccguguga

SEQ ID NO: 1830335 - RNA, 20 nt, Human herpesvirus 2
gcggacaaacccgccggggc

SEQ ID NO: 1830336 - RNA, 15 nt, Human herpesvirus 2
gcggacagccagggc

SEQ ID NO: 1830337 - RNA, 17 nt, Human herpesvirus 2
gcggaacccgcgggcgc

SEQ ID NO: 1830338 - RNA, 15 nt, Human herpesvirus 2
gcgcuuggccgggga

SEQ ID NO: 1830339 - RNA, 21 nt, Human herpesvirus 2
gcgcuuuccggcccucccgca

SEQ ID NO: 1830340 - RNA, 19 nt, Human herpesvirus 2
gcggacuggcagccgggac

SEQ ID NO: 1830341 - RNA, 19 nt, Human herpesvirus 2
gcggagccucuuugggccg

SEQ ID NO: 1830342 - RNA, 16 nt, Human herpesvirus 2
gcggagggcggccagc

SEQ ID NO: 1830343 - RNA, 20 nt, Human herpesvirus 2
gcggaguaugaccgucggug

SEQ ID NO: 1830344 - RNA, 15 nt, Human herpesvirus 2
gcgucggcggccccg

SEQ ID NO: 1830345 - RNA, 16 nt, Human herpesvirus 2
gcgucgggggccgggg

SEQ ID NO: 1830346 - RNA, 21 nt, Human herpesvirus 2
gcgucuagcucgcggagggcg

SEQ ID NO: 1830347 - RNA, 23 nt, Human herpesvirus 2
gcgucguggcauggaagcccccg

SEQ ID NO: 1830348 - RNA, 16 nt, Human herpesvirus 2
gcgucucccgggggcg

SEQ ID NO: 1830349 - RNA, 18 nt, Human herpesvirus 2
gcgucgcucucggucccg

SEQ ID NO: 1830350 - RNA, 21 nt, Human herpesvirus 2
gcgugccaacucgcggcaccg

SEQ ID NO: 1830351 - RNA, 13 nt, Human herpesvirus 2
gcucguggcgggc

SEQ ID NO: 1830352 - RNA, 12 nt, Human herpesvirus 2
gcggaggcgugg

SEQ ID NO: 1830353 - RNA, 16 nt, Human herpesvirus 2
gcggcggcaugcgcgg

SEQ ID NO: 1830354 - RNA, 14 nt, Human herpesvirus 2
ggucggugcccccc

SEQ ID NO: 1830355 - RNA, 20 nt, Human herpesvirus 2
ggcacaccggcggggcgggc

SEQ ID NO: 1830356 - RNA, 20 nt, Human herpesvirus 2
ggucgaucucggggagggcg

SEQ ID NO: 1830357 - RNA, 23 nt, Human herpesvirus 2
ggucgggggccacuucgucguag

SEQ ID NO: 1830358 - RNA, 21 nt, Human herpesvirus 2
ggucgcgcuuuuccgccgccg

SEQ ID NO: 1830359 - RNA, 22 nt, Human herpesvirus 2
ggugacggaaaaccugggcggc

SEQ ID NO: 1830360 - RNA, 16 nt, Human herpesvirus 2
ggugcgugcggcccug

SEQ ID NO: 1830361 - RNA, 13 nt, Human herpesvirus 2
gguggugcaguuu

SEQ ID NO: 1830362 - RNA, 16 nt, Human herpesvirus 2
gguguggucgggcgga

SEQ ID NO: 1830363 - RNA, 19 nt, Human herpesvirus 2
gguuacugcacuugccccc

SEQ ID NO: 1830364 - RNA, 23 nt, Human herpesvirus 2
gucccgacgauuagccaccgcgc

SEQ ID NO: 1830365 - RNA, 17 nt, Human herpesvirus 2
guccgcgcggggcgcgc

SEQ ID NO: 1830366 - RNA, 10 nt, Human herpesvirus 2
guccccuuuc

SEQ ID NO: 1830367 - RNA, 12 nt, Human herpesvirus 2
gucccucgcgcg

SEQ ID NO: 1830368 - RNA, 19 nt, Human herpesvirus 2
gucccucgcgcgcauccac

SEQ ID NO: 1830369 - RNA, 13 nt, Human herpesvirus 2
guccgacgaggcc

SEQ ID NO: 1830370 - RNA, 20 nt, Human herpesvirus 2
guccgacgaggccuucccga

SEQ ID NO: 1830371 - RNA, 21 nt, Human herpesvirus 2
gucccgccugugugcucucaa

SEQ ID NO: 1830372 - RNA, 21 nt, Human herpesvirus 2
gucccccgaagcggccccgac

SEQ ID NO: 1830373 - RNA, 14 nt, Human herpesvirus 2
guccccgagcggcg

SEQ ID NO: 1830374 - RNA, 17 nt, Human herpesvirus 2
ggcaacaaagggccucc

SEQ ID NO: 1830375 - RNA, 17 nt, Human herpesvirus 2
ggcaacccccgggcguc

SEQ ID NO: 1830376 - RNA, 20 nt, Human herpesvirus 2
ggcaacccgacggcggggcc

SEQ ID NO: 1830377 - RNA, 13 nt, Human herpesvirus 2
ggagucgccgccc

SEQ ID NO: 1830378 - RNA, 16 nt, Human herpesvirus 2
ggauacgggggcgggg

SEQ ID NO: 1830379 - RNA, 17 nt, Human herpesvirus 2
ggauccaggggagggcg

SEQ ID NO: 1830380 - RNA, 19 nt, Human herpesvirus 2
ggaggggaugggggcgcgc

SEQ ID NO: 1830381 - RNA, 18 nt, Human herpesvirus 2
ggaggaaacgcgcgcccc

SEQ ID NO: 1830382 - RNA, 17 nt, Human herpesvirus 2
gcuucgucaacagggcg

SEQ ID NO: 1830383 - RNA, 15 nt, Human herpesvirus 2
gcuucuucgccgccc

SEQ ID NO: 1830384 - RNA, 21 nt, Human herpesvirus 2
gcuugccccucccccggccca

SEQ ID NO: 1830385 - RNA, 14 nt, Human herpesvirus 2
gcuggcgccgccgg

SEQ ID NO: 1830386 - RNA, 20 nt, Human herpesvirus 2
gcugagggcggcgacguucg

SEQ ID NO: 1830387 - RNA, 13 nt, Human herpesvirus 2
gcucgggcuggcc

SEQ ID NO: 1830388 - RNA, 22 nt, Human herpesvirus 2
gcugccccgcgugcagcgcggg

SEQ ID NO: 1830389 - RNA, 16 nt, Human herpesvirus 2
gcuguucugccgcgcg

SEQ ID NO: 1830390 - RNA, 18 nt, Human herpesvirus 2
gcuuagucccggguccgg

SEQ ID NO: 1830391 - RNA, 23 nt, Human herpesvirus 2
gcuucaccgagagcgccgucggg

SEQ ID NO: 1830392 - RNA, 18 nt, Human herpesvirus 2
gcuguggcccuggcggac

SEQ ID NO: 1830393 - RNA, 15 nt, Human herpesvirus 2
gcugguggccgcggu

SEQ ID NO: 1830394 - RNA, 15 nt, Human herpesvirus 2
gugccgucgccgcgc

SEQ ID NO: 1830395 - RNA, 23 nt, Human herpesvirus 2
gugccucacgguccucaccgagc

SEQ ID NO: 1830396 - RNA, 17 nt, Human herpesvirus 2
gugcgaccgggcggcgc

SEQ ID NO: 1830397 - RNA, 20 nt, Human herpesvirus 2
gugcgaccgggcggcgcgcc

SEQ ID NO: 1830398 - RNA, 17 nt, Human herpesvirus 2
gugcgcaugggccgcca

SEQ ID NO: 1830399 - RNA, 17 nt, Human herpesvirus 2
gugcgcucgcucuccgu

SEQ ID NO: 1830400 - RNA, 22 nt, Human herpesvirus 2
gugcgcucuucgcggcggccgc

SEQ ID NO: 1830401 - RNA, 20 nt, Human herpesvirus 2
guccgcgggaagcgccgcgc

SEQ ID NO: 1830402 - RNA, 19 nt, Human herpesvirus 2
guucuuggcgcgcgcggcg

SEQ ID NO: 1830403 - RNA, 23 nt, Human herpesvirus 2
guugaaccggcgagggcggccuc

SEQ ID NO: 1830404 - RNA, 16 nt, Human herpesvirus 2
guugacgacggccccg

SEQ ID NO: 1830405 - RNA, 13 nt, Human herpesvirus 2
guugcgccuccgu

SEQ ID NO: 1830406 - RNA, 18 nt, Human herpesvirus 2
guugcgcuuuccggcccu

SEQ ID NO: 1830407 - RNA, 14 nt, Human herpesvirus 2
guuggagcggucgc

SEQ ID NO: 1830408 - RNA, 15 nt, Human herpesvirus 2
guuguagggccgcgg

SEQ ID NO: 1830409 - RNA, 18 nt, Human herpesvirus 2
guuguaguuguccgcggg

SEQ ID NO: 1830410 - RNA, 20 nt, Human herpesvirus 2
guuucucuuucuuucccccc

SEQ ID NO: 1830411 - RNA, 16 nt, Human herpesvirus 2
guuucugaccggcgcc

SEQ ID NO: 1830412 - RNA, 23 nt, Human herpesvirus 2
ucaaacaggccaucgccggggac

SEQ ID NO: 1830413 - RNA, 14 nt, Human herpesvirus 2
uauuagcaucgggg

SEQ ID NO: 1830414 - RNA, 16 nt, Human herpesvirus 2
uaagcgcugcggggac

SEQ ID NO: 1830415 - RNA, 21 nt, Human herpesvirus 2
uaaagguccggcggccacccc

SEQ ID NO: 1830416 - RNA, 19 nt, Human herpesvirus 2
uacacggcaacccccgggc

SEQ ID NO: 1830417 - RNA, 12 nt, Human herpesvirus 2
ugccccgaccga

SEQ ID NO: 1830418 - RNA, 19 nt, Human herpesvirus 2
ugcucgaccagcggcccca

SEQ ID NO: 1830419 - RNA, 14 nt, Human herpesvirus 2
ugcuucccccgccc

SEQ ID NO: 1830420 - RNA, 16 nt, Human herpesvirus 2
uggaccccccacgccc

SEQ ID NO: 1830421 - RNA, 15 nt, Human herpesvirus 2
uggacgaucccgggc

SEQ ID NO: 1830422 - RNA, 23 nt, Human herpesvirus 2
uggacgcagcggcguccacgccc

SEQ ID NO: 1830423 - RNA, 18 nt, Human herpesvirus 2
ucaccgggggccccgggu

SEQ ID NO: 1830424 - RNA, 18 nt, Human herpesvirus 2
ugaagccguccgaccauc

SEQ ID NO: 1830425 - RNA, 18 nt, Human herpesvirus 2
ucacgagguuuggggcgg

SEQ ID NO: 1830426 - RNA, 20 nt, Human herpesvirus 2
ucacggcaaccccagggcgu

SEQ ID NO: 1830427 - RNA, 20 nt, Human herpesvirus 2
ucacggucgauuuaaccacu

SEQ ID NO: 1830428 - RNA, 14 nt, Human herpesvirus 2
ugagccgcgcggcc

SEQ ID NO: 1830429 - RNA, 13 nt, Human herpesvirus 2
ugacgacggcccc

SEQ ID NO: 1830430 - RNA, 14 nt, Human herpesvirus 2
ugaccggcgccgau

SEQ ID NO: 1830431 - RNA, 15 nt, Human herpesvirus 2
gcccgcccgccgccc

SEQ ID NO: 1830432 - RNA, 19 nt, Human herpesvirus 2
gcccccgcuggcgggagcc

SEQ ID NO: 1830433 - RNA, 12 nt, Human herpesvirus 2
gcccccggggcc

SEQ ID NO: 1830434 - RNA, 14 nt, Human herpesvirus 2
gccccccgggagcc

SEQ ID NO: 1830435 - RNA, 16 nt, Human herpesvirus 2
gccccccgggagccgc

SEQ ID NO: 1830436 - RNA, 15 nt, Human herpesvirus 2
gcccccgacgggcgc

SEQ ID NO: 1830437 - RNA, 20 nt, Human herpesvirus 2
gccagcucggacaccagcag

SEQ ID NO: 1830438 - RNA, 18 nt, Human herpesvirus 2
gccccagggggcggcgcc

SEQ ID NO: 1830439 - RNA, 13 nt, Human herpesvirus 2
gcccccagcaggu

SEQ ID NO: 1830440 - RNA, 18 nt, Human herpesvirus 2
gccccggucccccggacc

SEQ ID NO: 1830441 - RNA, 14 nt, Human herpesvirus 2
gccccggcggcccc

SEQ ID NO: 1830442 - RNA, 17 nt, Human herpesvirus 2
gccccgcgugcagcgcg

SEQ ID NO: 1830443 - RNA, 23 nt, Human herpesvirus 2
gccccgcgugcagcgcgggcgac

SEQ ID NO: 1830444 - RNA, 17 nt, Human herpesvirus 2
gcccgaccgggcggugc

SEQ ID NO: 1830445 - RNA, 17 nt, Human herpesvirus 2
gccccuguuggagccgg

SEQ ID NO: 1830446 - RNA, 17 nt, Human herpesvirus 2
gcccgaaccccgcggcc

SEQ ID NO: 1830447 - RNA, 21 nt, Human herpesvirus 2
gagacccugccccccggcgcg

SEQ ID NO: 1830448 - RNA, 15 nt, Human herpesvirus 2
gcagcucgcccccgu

SEQ ID NO: 1830449 - RNA, 15 nt, Human herpesvirus 2
gcagcuucaccgaga

SEQ ID NO: 1830450 - RNA, 17 nt, Human herpesvirus 2
gagaggcccgccgcgca

SEQ ID NO: 1830451 - RNA, 14 nt, Human herpesvirus 2
gagagggggaagga

SEQ ID NO: 1830452 - RNA, 15 nt, Human herpesvirus 2
gccacacaguccgug

SEQ ID NO: 1830453 - RNA, 16 nt, Human herpesvirus 2
gccaaccgcgcgccgc

SEQ ID NO: 1830454 - RNA, 16 nt, Human herpesvirus 2
gccaacgcgaccgucg

SEQ ID NO: 1830455 - RNA, 13 nt, Human herpesvirus 2
gcaggugaugggc

SEQ ID NO: 1830456 - RNA, 19 nt, Human herpesvirus 2
gcaggcguguugggaaggg

SEQ ID NO: 1830457 - RNA, 15 nt, Human herpesvirus 2
cgucaacagggcgcu

SEQ ID NO: 1830458 - RNA, 13 nt, Human herpesvirus 2
cguaccccgccgg

SEQ ID NO: 1830459 - RNA, 21 nt, Human herpesvirus 2
cgggauccuccgccagcucgg

SEQ ID NO: 1830460 - RNA, 19 nt, Human herpesvirus 2
cgguggggccggcggucgc

SEQ ID NO: 1830461 - RNA, 15 nt, Human herpesvirus 2
cgguuuugcggucgu

SEQ ID NO: 1830462 - RNA, 19 nt, Human herpesvirus 2
gaacccccagacgaccauc

SEQ ID NO: 1830463 - RNA, 23 nt, Human herpesvirus 2
gaaccgcuggcuggagaccgagc

SEQ ID NO: 1830464 - RNA, 16 nt, Human herpesvirus 2
gaacgccucaccgcgc

SEQ ID NO: 1830465 - RNA, 14 nt, Human herpesvirus 2
gaaaugggggcggg

SEQ ID NO: 1830466 - RNA, 16 nt, Human herpesvirus 2
gaaaaggcccggcccg

SEQ ID NO: 1830467 - RNA, 22 nt, Human herpesvirus 2
gaaagcuggcgucgggggcggg

SEQ ID NO: 1830468 - RNA, 14 nt, Human herpesvirus 2
gacgcccggcccau

SEQ ID NO: 1830469 - RNA, 13 nt, Human herpesvirus 2
gacgcggccagaa

SEQ ID NO: 1830470 - RNA, 18 nt, Human herpesvirus 2
gacgcggggucgagcgcg

SEQ ID NO: 1830471 - RNA, 14 nt, Human herpesvirus 2
gacgcgaggcgcgg

SEQ ID NO: 1830472 - RNA, 21 nt, Human herpesvirus 2
gacucggugcguuccagcgcg

SEQ ID NO: 1830473 - RNA, 16 nt, Human herpesvirus 2
gacgcggcgauggccg

SEQ ID NO: 1830474 - RNA, 16 nt, Human herpesvirus 2
gacggcaccgccgggc

SEQ ID NO: 1830475 - RNA, 16 nt, Human herpesvirus 2
gacacgcgcccggggc

SEQ ID NO: 1830476 - RNA, 14 nt, Human herpesvirus 2
gacagacgcggcga

SEQ ID NO: 1830477 - RNA, 21 nt, Human herpesvirus 2
gacaccagcagcuugcggggc

SEQ ID NO: 1830478 - RNA, 21 nt, Human herpesvirus 2
gccccgauauucaagcccgcg

SEQ ID NO: 1830479 - RNA, 15 nt, Human herpesvirus 2
gcccgccaacccccg

SEQ ID NO: 1830480 - RNA, 14 nt, Human herpesvirus 2
gcccgccagggccg

SEQ ID NO: 1830481 - RNA, 22 nt, Human herpesvirus 2
gcccgccaugcgcggggggggc

SEQ ID NO: 1830482 - RNA, 19 nt, Human herpesvirus 2
gcccgccccagggggcggc

SEQ ID NO: 1830483 - RNA, 17 nt, Human herpesvirus 2
gcccgcccccgacgggc

SEQ ID NO: 1830484 - RNA, 18 nt, Human herpesvirus 2
gcccgcccccgacgggcg

SEQ ID NO: 1830485 - RNA, 22 nt, Human herpesvirus 2
cggcccgauccgaacggcgcac

SEQ ID NO: 1830486 - RNA, 21 nt, Human herpesvirus 2
cggcccgauucuuacggcgcg

SEQ ID NO: 1830487 - RNA, 17 nt, Human herpesvirus 2
cggcaugcagcccagag

SEQ ID NO: 1830488 - RNA, 20 nt, Human herpesvirus 2
cggcgcacgcggugcgucgg

SEQ ID NO: 1830489 - RNA, 18 nt, Human herpesvirus 2
cggcgccaagcgccccgc

SEQ ID NO: 1830490 - RNA, 15 nt, Human herpesvirus 2
cggcgaccgccccgc

SEQ ID NO: 1830491 - RNA, 16 nt, Human herpesvirus 2
cggccgcggacgaccu

SEQ ID NO: 1830492 - RNA, 16 nt, Human herpesvirus 2
cggccuuucccguggc

SEQ ID NO: 1830493 - RNA, 21 nt, Human herpesvirus 2
cggcgaacacugccucggagg

SEQ ID NO: 1830494 - RNA, 16 nt, Human herpesvirus 2
cggccgccauccccgc

SEQ ID NO: 1830495 - RNA, 12 nt, Human herpesvirus 2
cggccgccgcaa

SEQ ID NO: 1830496 - RNA, 15 nt, Human herpesvirus 2
cggccaccccgccgc

SEQ ID NO: 1830497 - RNA, 12 nt, Human herpesvirus 2
cggcccuggagc

SEQ ID NO: 1830498 - RNA, 18 nt, Human herpesvirus 2
cggccggcggagccccgg

SEQ ID NO: 1830499 - RNA, 20 nt, Human herpesvirus 2
cggcgcgggcggcgccgcgc

SEQ ID NO: 1830500 - RNA, 14 nt, Human herpesvirus 2
cggcgccgccccgc

SEQ ID NO: 1830501 - RNA, 17 nt, Human herpesvirus 2
cggcgccgccccgccgc

SEQ ID NO: 1830502 - RNA, 19 nt, Human herpesvirus 2
cggcguggagcgccgggcc

SEQ ID NO: 1830503 - RNA, 16 nt, Human herpesvirus 2
cggcgucuagcucgcg

SEQ ID NO: 1830504 - RNA, 15 nt, Human herpesvirus 2
cggcggccaccccgc

SEQ ID NO: 1830505 - RNA, 13 nt, Human herpesvirus 2
cggcggcuccccc

SEQ ID NO: 1830506 - RNA, 21 nt, Human herpesvirus 2
cgggagcaggacagccgaccc

SEQ ID NO: 1830507 - RNA, 12 nt, Human herpesvirus 2
cgggacgcccgg

SEQ ID NO: 1830508 - RNA, 14 nt, Human herpesvirus 2
cgggacgcccggcc

SEQ ID NO: 1830509 - RNA, 22 nt, Human herpesvirus 2
cgggccguucggcaggcccgcc

SEQ ID NO: 1830510 - RNA, 18 nt, Human herpesvirus 2
cgggccagauggggcccc

SEQ ID NO: 1830511 - RNA, 16 nt, Human herpesvirus 2
cgggaguuccgacgac

SEQ ID NO: 1830512 - RNA, 12 nt, Human herpesvirus 2
ucgcuccccgcg

SEQ ID NO: 1830513 - RNA, 14 nt, Human herpesvirus 2
gguccccgucggaa

SEQ ID NO: 1830514 - RNA, 18 nt, Human herpesvirus 2
gguacugcacugcccccc

SEQ ID NO: 1830515 - RNA, 21 nt, Human herpesvirus 2
ggucacaaaaggcacggcgcc

SEQ ID NO: 1830516 - RNA, 15 nt, Human herpesvirus 2
ggucaccggggcgcc

SEQ ID NO: 1830517 - RNA, 21 nt, Human herpesvirus 2
gguaacuucuacgugcccccc

SEQ ID NO: 1830518 - RNA, 15 nt, Human herpesvirus 2
ggguccgacgaggcc

SEQ ID NO: 1830519 - RNA, 12 nt, Human herpesvirus 2
gggucgagcgcg

SEQ ID NO: 1830520 - RNA, 12 nt, Human herpesvirus 2
gggucgcacgcc

SEQ ID NO: 1830521 - RNA, 12 nt, Human herpesvirus 2
gggucggcaugc

SEQ ID NO: 1830522 - RNA, 20 nt, Human herpesvirus 2
gggcgaaaaggcccggcccg

SEQ ID NO: 1830523 - RNA, 13 nt, Human herpesvirus 2
gggucgggcgggc

SEQ ID NO: 1830524 - RNA, 14 nt, Human herpesvirus 2
gggucgggcgggcg

SEQ ID NO: 1830525 - RNA, 17 nt, Human herpesvirus 2
ggguguguggggagggg

SEQ ID NO: 1830526 - RNA, 13 nt, Human herpesvirus 2
ggguucggggcca

SEQ ID NO: 1830527 - RNA, 16 nt, Human herpesvirus 2
ggguuuuggcggcccg

SEQ ID NO: 1830528 - RNA, 20 nt, Human herpesvirus 2
ggguuuuuuaaccggcccca

SEQ ID NO: 1830529 - RNA, 15 nt, Human herpesvirus 2
ucggacaccagcagc

SEQ ID NO: 1830530 - RNA, 14 nt, Human herpesvirus 2
ucggacggugaucg

SEQ ID NO: 1830531 - RNA, 22 nt, Human herpesvirus 2
ucgcugcucucccguaccccgc

SEQ ID NO: 1830532 - RNA, 16 nt, Human herpesvirus 2
ucggaaagccggcccc

SEQ ID NO: 1830533 - RNA, 20 nt, Human herpesvirus 2
ucgcggggacagccccgggg

SEQ ID NO: 1830534 - RNA, 19 nt, Human herpesvirus 2
ucggccggcggagccccgg

SEQ ID NO: 1830535 - RNA, 13 nt, Human herpesvirus 2
ucggcaggcccgc

SEQ ID NO: 1830536 - RNA, 13 nt, Human herpesvirus 2
ucggcccccgggg

SEQ ID NO: 1830537 - RNA, 14 nt, Human herpesvirus 2
ucggagaggcccgc

SEQ ID NO: 1830538 - RNA, 21 nt, Human herpesvirus 2
ucgggaggggaugggggcgcg

SEQ ID NO: 1830539 - RNA, 20 nt, Human herpesvirus 2
ucgggauccauaacgcgccc

SEQ ID NO: 1830540 - RNA, 20 nt, Human herpesvirus 2
ucggcgauguccggggcggu

SEQ ID NO: 1830541 - RNA, 19 nt, Human herpesvirus 2
ucggcggaaaugcgcgagc

SEQ ID NO: 1830542 - RNA, 15 nt, Human herpesvirus 2
ggcagcucgcccccg

SEQ ID NO: 1830543 - RNA, 16 nt, Human herpesvirus 2
ggcaggcgcgcggguc

SEQ ID NO: 1830544 - RNA, 15 nt, Human herpesvirus 2
ggcaggagggcgggc

SEQ ID NO: 1830545 - RNA, 16 nt, Human herpesvirus 2
ggcaugcgacggcguc

SEQ ID NO: 1830546 - RNA, 14 nt, Human herpesvirus 2
ggcagcgcgccgac

SEQ ID NO: 1830547 - RNA, 21 nt, Human herpesvirus 2
ggccaaccucauccgcggcgc

SEQ ID NO: 1830548 - RNA, 11 nt, Human herpesvirus 2
gcgcgcgcccc

SEQ ID NO: 1830549 - RNA, 18 nt, Human herpesvirus 2
gcgcaggggggccgggga

SEQ ID NO: 1830550 - RNA, 13 nt, Human herpesvirus 2
ggccgugggcguc

SEQ ID NO: 1830551 - RNA, 13 nt, Human herpesvirus 2
ggccgugcccccc

SEQ ID NO: 1830552 - RNA, 16 nt, Human herpesvirus 2
ggccucauccggcccg

SEQ ID NO: 1830553 - RNA, 15 nt, Human herpesvirus 2
ggccgcgguggcguc

SEQ ID NO: 1830554 - RNA, 22 nt, Human herpesvirus 2
ggccaauucuucccggagcgcc

SEQ ID NO: 1830555 - RNA, 24 nt, Human herpesvirus 2
ggccgggagcguggggcgcgcacc

SEQ ID NO: 1830556 - RNA, 12 nt, Human herpesvirus 2
ggccggggcggc

SEQ ID NO: 1830557 - RNA, 19 nt, Human herpesvirus 2
ggccgcugggggggcgggc

SEQ ID NO: 1830558 - RNA, 16 nt, Human herpesvirus 2
ggccggcggagccccg

SEQ ID NO: 1830559 - RNA, 11 nt, Human herpesvirus 2
ggccuucccga

SEQ ID NO: 1830560 - RNA, 22 nt, Human herpesvirus 2
ggccuggcguuugggggcggac

SEQ ID NO: 1830561 - RNA, 14 nt, Human herpesvirus 2
ggcgaccccgcccc

SEQ ID NO: 1830562 - RNA, 17 nt, Human herpesvirus 2
ggcgacgccgcggccga

SEQ ID NO: 1830563 - RNA, 12 nt, Human herpesvirus 2
ggcgagggcggc

SEQ ID NO: 1830564 - RNA, 14 nt, Human herpesvirus 2
ggcgaggggcggga

SEQ ID NO: 1830565 - RNA, 21 nt, Human herpesvirus 2
ggcgaugguggcgaugggcag

SEQ ID NO: 1830566 - RNA, 23 nt, Human herpesvirus 2
ggcuucuucgccgcccucgccca

SEQ ID NO: 1830567 - RNA, 21 nt, Human herpesvirus 2
gggaaggaaaugggggcgggg

SEQ ID NO: 1830568 - RNA, 22 nt, Human herpesvirus 2
gggaauaugcaagcgggcgggg

SEQ ID NO: 1830569 - RNA, 18 nt, Human herpesvirus 2
gggaaucucgggucgccc

SEQ ID NO: 1830570 - RNA, 13 nt, Human herpesvirus 2
gggacggccgggc

SEQ ID NO: 1830571 - RNA, 18 nt, Human herpesvirus 2
gggacucauuugucgccg

SEQ ID NO: 1830572 - RNA, 16 nt, Human herpesvirus 2
gggacugggggcgggg

SEQ ID NO: 1830573 - RNA, 22 nt, Human herpesvirus 2
gggagccacucccgcggccccc

SEQ ID NO: 1830574 - RNA, 16 nt, Human herpesvirus 2
gggagccgcggccccg

SEQ ID NO: 1830575 - RNA, 13 nt, Human herpesvirus 2
gggaggggcggga

SEQ ID NO: 1830576 - RNA, 18 nt, Human herpesvirus 2
gggagguucccccguggc

SEQ ID NO: 1830577 - RNA, 23 nt, Human herpesvirus 2
gggagucgggccccuacucgcca

SEQ ID NO: 1830578 - RNA, 15 nt, Human herpesvirus 2
gggacccgggcgagc

SEQ ID NO: 1830579 - RNA, 20 nt, Human herpesvirus 2
gggcaccaaaaaccaggucu

SEQ ID NO: 1830580 - RNA, 17 nt, Human herpesvirus 2
gggccgcugggggggcg

SEQ ID NO: 1830581 - RNA, 21 nt, Human herpesvirus 2
gggcccuuggguuccgcggac

SEQ ID NO: 1830582 - RNA, 12 nt, Human herpesvirus 2
gggcccaggucc

SEQ ID NO: 1830583 - RNA, 13 nt, Human herpesvirus 2
gggccccagggcu

SEQ ID NO: 1830584 - RNA, 21 nt, Human herpesvirus 2
ggggucccgccucccggccgc

SEQ ID NO: 1830585 - RNA, 14 nt, Human herpesvirus 2
ggggugggucgccg

SEQ ID NO: 1830586 - RNA, 21 nt, Human herpesvirus 2
ggguaauggaugggcggggcc

SEQ ID NO: 1830587 - RNA, 22 nt, Human herpesvirus 2
ggguaauggaugggcggggccc

SEQ ID NO: 1830588 - RNA, 17 nt, Human herpesvirus 2
gggccguucggcaggcc

SEQ ID NO: 1830589 - RNA, 15 nt, Human herpesvirus 2
ccggagacguccuug

SEQ ID NO: 1830590 - RNA, 19 nt, Human herpesvirus 2
ccgcuuuauaggacgcgcu

SEQ ID NO: 1830591 - RNA, 16 nt, Human herpesvirus 2
gagucccccggcuccg

SEQ ID NO: 1830592 - RNA, 17 nt, Human herpesvirus 2
gcacccacgacauccgc

SEQ ID NO: 1830593 - RNA, 17 nt, Human herpesvirus 2
gcacccgggccggguga

SEQ ID NO: 1830594 - RNA, 16 nt, Human herpesvirus 2
gagggcccggcgccgc

SEQ ID NO: 1830595 - RNA, 18 nt, Human herpesvirus 2
gagggcccggcgccgccc

SEQ ID NO: 1830596 - RNA, 17 nt, Human herpesvirus 2
gaggcuguccgccgggc

SEQ ID NO: 1830597 - RNA, 16 nt, Human herpesvirus 2
gagaugugccuuccag

SEQ ID NO: 1830598 - RNA, 19 nt, Human herpesvirus 2
gcaccugcagaugcugccc

SEQ ID NO: 1830599 - RNA, 13 nt, Human herpesvirus 2
gcaccgcuguccc

SEQ ID NO: 1830600 - RNA, 20 nt, Human herpesvirus 2
gcaccgcgcggaccggcccc

SEQ ID NO: 1830601 - RNA, 13 nt, Human herpesvirus 2
gcaccggggcggc

SEQ ID NO: 1830602 - RNA, 19 nt, Human herpesvirus 2
cguggcccuccacgccgug

SEQ ID NO: 1830603 - RNA, 20 nt, Human herpesvirus 2
cgugucggagcucgacgcac

SEQ ID NO: 1830604 - RNA, 19 nt, Human herpesvirus 2
cguggaugccggggccgug

SEQ ID NO: 1830605 - RNA, 14 nt, Human herpesvirus 2
cucgcggcggcucc

SEQ ID NO: 1830606 - RNA, 20 nt, Human herpesvirus 2
gagaguuucuucgcgggcag

SEQ ID NO: 1830607 - RNA, 20 nt, Human herpesvirus 2
cucgcugcgccgggcgcgcc

SEQ ID NO: 1830608 - RNA, 22 nt, Human herpesvirus 2
ccggccaaccucauccgcggcg

SEQ ID NO: 1830609 - RNA, 15 nt, Human herpesvirus 2
cgcggacgccgggcg

SEQ ID NO: 1830610 - RNA, 12 nt, Human herpesvirus 2
cgcggaccaccg

SEQ ID NO: 1830611 - RNA, 17 nt, Human herpesvirus 2
cgcggccgugggcgucc

SEQ ID NO: 1830612 - RNA, 19 nt, Human herpesvirus 2
cgcggcgccaacgcgggcg

SEQ ID NO: 1830613 - RNA, 22 nt, Human herpesvirus 2
cgcggcgccaacgcgggcgucc

SEQ ID NO: 1830614 - RNA, 22 nt, Human herpesvirus 2
ccggccuggucguccgcggccc

SEQ ID NO: 1830615 - RNA, 15 nt, Human herpesvirus 2
ccggcccggcccgcu

SEQ ID NO: 1830616 - RNA, 14 nt, Human herpesvirus 2
ccggcgccaugagc

SEQ ID NO: 1830617 - RNA, 14 nt, Human
aaaaacacaaaagu

SEQ ID NO: 1830618 - RNA, 12 nt, Human
aaaaagaggcua

SEQ ID NO: 1830619 - RNA, 13 nt, Human
aaaaacugauuuu

SEQ ID NO: 1830620 - RNA, 14 nt, Human
aaaaacauggccuu

SEQ ID NO: 1830621 - RNA, 15 nt, Human
aaaaacugauuuuuu

SEQ ID NO: 1830622 - RNA, 12 nt, Human
aaaacacauuuu

SEQ ID NO: 1830623 - RNA, 18 nt, Human
aauuaguggcacuugcuu

SEQ ID NO: 1830624 - RNA, 18 nt, Human
aauuaaaacacaacaucu

SEQ ID NO: 1830625 - RNA, 18 nt, Human
aauguuugccucugccuc

SEQ ID NO: 1830626 - RNA, 19 nt, Human
aauguuugccucugccucu

SEQ ID NO: 1830627 - RNA, 13 nt, Human
aaugggcagagca

SEQ ID NO: 1830628 - RNA, 15 nt, Human
aaugggcagagcaga

SEQ ID NO: 1830629 - RNA, 13 nt, Human
aaugucaguguga

SEQ ID NO: 1830630 - RNA, 16 nt, Human
aaugucagugugacug

SEQ ID NO: 1830631 - RNA, 15 nt, Human
aaugucagugugacu

SEQ ID NO: 1830632 - RNA, 22 nt, Human
aauggucuuucuaaugugugaa

SEQ ID NO: 1830633 - RNA, 21 nt, Human
aaugucagugugacugaucuc

SEQ ID NO: 1830634 - RNA, 17 nt, Human
aaugucagugugacuga

SEQ ID NO: 1830635 - RNA, 22 nt, Human
aaugucuaguuguaacaccaug

SEQ ID NO: 1830636 - RNA, 20 nt, Human
aaugucucuuuaaugucaca

SEQ ID NO: 1830637 - RNA, 20 nt, Human
aauauaggaacuuaaauaau

SEQ ID NO: 1830638 - RNA, 21 nt, Human
aauauaggaacuuaaauaaug

SEQ ID NO: 1830639 - RNA, 18 nt, Human
aauauaggaacuuaaaua

SEQ ID NO: 1830640 - RNA, 19 nt, Human
aaugaugccaugaggaaca

SEQ ID NO: 1830641 - RNA, 13 nt, Human
aaucuccaaaaua

SEQ ID NO: 1830642 - RNA, 14 nt, Human
aaucuccaaaauaa

SEQ ID NO: 1830643 - RNA, 18 nt, Human
aaucuccaaaauaaaacu

SEQ ID NO: 1830644 - RNA, 18 nt, Human
aauccaggguggugguga

SEQ ID NO: 1830645 - RNA, 16 nt, Human
aaugaaccacaucuug

SEQ ID NO: 1830646 - RNA, 17 nt, Human
aaugaaccacaucuugc

SEQ ID NO: 1830647 - RNA, 23 nt, Human
aaugaaccacaucuugcucugcu

SEQ ID NO: 1830648 - RNA, 22 nt, Human
aaucugcuuuuuaaagaaugcu

SEQ ID NO: 1830649 - RNA, 21 nt, Human
aaugaugauccuaggcauuug

SEQ ID NO: 1830650 - RNA, 16 nt, Human
aagucuuagauguaua

SEQ ID NO: 1830651 - RNA, 19 nt, Human
aagucucuggaauuugaaa

SEQ ID NO: 1830652 - RNA, 11 nt, Human
aaggugggagg

SEQ ID NO: 1830653 - RNA, 16 nt, Human
aagguuaauaaaguaa

SEQ ID NO: 1830654 - RNA, 15 nt, Human
aagguuaauaaagua

SEQ ID NO: 1830655 - RNA, 20 nt, Human
aagguuaauguucaucaucc

SEQ ID NO: 1830656 - RNA, 16 nt, Human
aaguaucccuacugua

SEQ ID NO: 1830657 - RNA, 23 nt, Human
aaguccaggcuuuuuuaucaugu

SEQ ID NO: 1830658 - RNA, 15 nt, Human
aaguacuuuuggcau

SEQ ID NO: 1830659 - RNA, 14 nt, Human
aaguacuuuuggca

SEQ ID NO: 1830660 - RNA, 11 nt, Human
aaguacuucuu

SEQ ID NO: 1830661 - RNA, 23 nt, Human
aauaaaauuaaagcugaaaacug

SEQ ID NO: 1830662 - RNA, 19 nt, Human
aauaaacuauuuguaaagu

SEQ ID NO: 1830663 - RNA, 15 nt, Human
aaguuguuaauaaaa

SEQ ID NO: 1830664 - RNA, 13 nt, Human
aagugguauagaa

SEQ ID NO: 1830665 - RNA, 17 nt, Human
aagugguauagaaaugc

SEQ ID NO: 1830666 - RNA, 16 nt, Human
aauaaugugaaacugg

SEQ ID NO: 1830667 - RNA, 19 nt, Human
aauaauguaagacaaauau

SEQ ID NO: 1830668 - RNA, 12 nt, Human
aauaauguaaga

SEQ ID NO: 1830669 - RNA, 21 nt, Human
aauaauccuaaacauaugaau

SEQ ID NO: 1830670 - RNA, 22 nt, Human
aagugcugggauuacaggugug

SEQ ID NO: 1830671 - RNA, 18 nt, Human
aagccauaauuguucuua

SEQ ID NO: 1830672 - RNA, 14 nt, Human
aagcagaggaagga

SEQ ID NO: 1830673 - RNA, 21 nt, Human
aagcagaggaaggagaggaga

SEQ ID NO: 1830674 - RNA, 11 nt, Human
aagcagcucuu

SEQ ID NO: 1830675 - RNA, 22 nt, Human
aagaaauuaugugccagauuua

SEQ ID NO: 1830676 - RNA, 13 nt, Human
aagaaauuaugug

SEQ ID NO: 1830677 - RNA, 21 nt, Human
aagaaauuuccacucaggucu

SEQ ID NO: 1830678 - RNA, 18 nt, Human
aaggcaaggcugucaauu

SEQ ID NO: 1830679 - RNA, 17 nt, Human
aaggcaaggcugucaau

SEQ ID NO: 1830680 - RNA, 12 nt, Human
aagcguggugga

SEQ ID NO: 1830681 - RNA, 20 nt, Human
aagcugcacccucaggcagg

SEQ ID NO: 1830682 - RNA, 21 nt, Human
aagcugcacccucaggcaggu

SEQ ID NO: 1830683 - RNA, 22 nt, Human
aagcugcacccucaggcaggug

SEQ ID NO: 1830684 - RNA, 20 nt, Human
aaggacuaggguccugggga

SEQ ID NO: 1830685 - RNA, 18 nt, Human
aaggacuaggguccuggg

SEQ ID NO: 1830686 - RNA, 21 nt, Human
aaggacccggaggggccuggc

SEQ ID NO: 1830687 - RNA, 15 nt, Human
aaggacuaggguccu

SEQ ID NO: 1830688 - RNA, 18 nt, Human
aaggacccggaggggccu

SEQ ID NO: 1830689 - RNA, 13 nt, Human
aagcugggcaggu

SEQ ID NO: 1830690 - RNA, 15 nt, Human
aagcugggcagguug

SEQ ID NO: 1830691 - RNA, 18 nt, Human
aaggacauugcggacagc

SEQ ID NO: 1830692 - RNA, 11 nt, Human
aagcugggcag

SEQ ID NO: 1830693 - RNA, 16 nt, Human
aaauaguaaaaauaaa

SEQ ID NO: 1830694 - RNA, 13 nt, Human
aaauaguaaaaau

SEQ ID NO: 1830695 - RNA, 14 nt, Human
aaauauaauugaca

SEQ ID NO: 1830696 - RNA, 22 nt, Human
aaauacuguuuuuaacaacuau

SEQ ID NO: 1830697 - RNA, 22 nt, Human
aaauggacguguuaugacucca

SEQ ID NO: 1830698 - RNA, 21 nt, Human
aaauggacguguuaugacucc

SEQ ID NO: 1830699 - RNA, 20 nt, Human
aaauggacguguuaugacuc

SEQ ID NO: 1830700 - RNA, 18 nt, Human
aaauggaagacagcucuu

SEQ ID NO: 1830701 - RNA, 16 nt, Human
aaauggaaaugggcag

SEQ ID NO: 1830702 - RNA, 16 nt, Human
aaagggaacugaacau

SEQ ID NO: 1830703 - RNA, 21 nt, Human
aaagggaacugaacauuccag

SEQ ID NO: 1830704 - RNA, 16 nt, Human
aaagggacugagaaau

SEQ ID NO: 1830705 - RNA, 19 nt, Human
aaagucucuggaauuugaa

SEQ ID NO: 1830706 - RNA, 22 nt, Human
aaagucucuggaauuugaaaca

SEQ ID NO: 1830707 - RNA, 20 nt, Human
aaagucucuggaauuugaaa

SEQ ID NO: 1830708 - RNA, 23 nt, Human
aaagugagacuuugaggguguau

SEQ ID NO: 1830709 - RNA, 11 nt, Human
aaagugcuggg

SEQ ID NO: 1830710 - RNA, 12 nt, Human
aaagugcuggga

SEQ ID NO: 1830711 - RNA, 14 nt, Human
aaagugcugggauu

SEQ ID NO: 1830712 - RNA, 22 nt, Human
aaauaaaauuaaagcugaaaac

SEQ ID NO: 1830713 - RNA, 12 nt, Human
aaauaacaauga

SEQ ID NO: 1830714 - RNA, 20 nt, Human
aaagaaaacuuguauuaugu

SEQ ID NO: 1830715 - RNA, 12 nt, Human
aaagaaaacuug

SEQ ID NO: 1830716 - RNA, 13 nt, Human
aaagaaauuaugu

SEQ ID NO: 1830717 - RNA, 15 nt, Human
aaagaaauuaugugc

SEQ ID NO: 1830718 - RNA, 11 nt, Human
aaagaacaucc

SEQ ID NO: 1830719 - RNA, 12 nt, Human
aaagaguacucu

SEQ ID NO: 1830720 - RNA, 17 nt, Human
aaagaguacucuuguuu

SEQ ID NO: 1830721 - RNA, 13 nt, Human
aaaacacauuuuu

SEQ ID NO: 1830722 - RNA, 15 nt, Human
aaaacacauuuuucu

SEQ ID NO: 1830723 - RNA, 13 nt, Human
aaaauucagugga

SEQ ID NO: 1830724 - RNA, 18 nt, Human
aaacacuguucucugccc

SEQ ID NO: 1830725 - RNA, 17 nt, Human
aaacacucuugaaaaau

SEQ ID NO: 1830726 - RNA, 14 nt, Human
aaacacucuugaaa

SEQ ID NO: 1830727 - RNA, 13 nt, Human
aaacacucuugaa

SEQ ID NO: 1830728 - RNA, 22 nt, Human
aaacacuguucucugcccucca

SEQ ID NO: 1830729 - RNA, 19 nt, Human
aaacacuguucucugcccu

SEQ ID NO: 1830730 - RNA, 13 nt, Human
aacuuugaccucu

SEQ ID NO: 1830731 - RNA, 14 nt, Human
aacuuugaccucug

SEQ ID NO: 1830732 - RNA, 17 nt, Human
aacuuugaccucugcag

SEQ ID NO: 1830733 - RNA, 12 nt, Human
aacuuuuauaaa

SEQ ID NO: 1830734 - RNA, 15 nt, Human
aacuuuuauaaacuu

SEQ ID NO: 1830735 - RNA, 19 nt, Human
aacuuugaccucugcagca

SEQ ID NO: 1830736 - RNA, 20 nt, Human
aacuuugaccucugcagcaa

SEQ ID NO: 1830737 - RNA, 16 nt, Human
aacuuuuauaaacuuu

SEQ ID NO: 1830738 - RNA, 19 nt, Human
aacuuuuauaaacuuuacc

SEQ ID NO: 1830739 - RNA, 20 nt, Human
aacuuuuuuuuaaguuacac

SEQ ID NO: 1830740 - RNA, 14 nt, Human
aacuuuuuuuuaag

SEQ ID NO: 1830741 - RNA, 13 nt, Human
aacuucacauauu

SEQ ID NO: 1830742 - RNA, 16 nt, Human
aacucaccugccccuc

SEQ ID NO: 1830743 - RNA, 15 nt, Human
aacucaccugccccu

SEQ ID NO: 1830744 - RNA, 15 nt, Human
aacucaccccagccc

SEQ ID NO: 1830745 - RNA, 12 nt, Human
aacucaccccag

SEQ ID NO: 1830746 - RNA, 16 nt, Human
aacugaacucugacaa

SEQ ID NO: 1830747 - RNA, 20 nt, Human
aacugaacucugacaacaga

SEQ ID NO: 1830748 - RNA, 19 nt, Human
aacugaacucugacaacag

SEQ ID NO: 1830749 - RNA, 14 nt, Human
aacugaauuuuguc

SEQ ID NO: 1830750 - RNA, 23 nt, Human
aacugaacucugacaacagacuu

SEQ ID NO: 1830751 - RNA, 17 nt, Human
aacuuaaauaaugugaa

SEQ ID NO: 1830752 - RNA, 19 nt, Human
aacuuaaauaaugugaaac

SEQ ID NO: 1830753 - RNA, 15 nt, Human
aacugaauuuugucu

SEQ ID NO: 1830754 - RNA, 19 nt, Human
aacugaccagccuccaugc

SEQ ID NO: 1830755 - RNA, 14 nt, Human
aacugaccagccuc

SEQ ID NO: 1830756 - RNA, 17 nt, Human
aacugauuuuuuuuucc

SEQ ID NO: 1830757 - RNA, 19 nt, Human
aacugauuuuuuuuuccuu

SEQ ID NO: 1830758 - RNA, 17 nt, Human
aacaaagaaauuaugug

SEQ ID NO: 1830759 - RNA, 15 nt, Human
aacaaagaaauuaug

SEQ ID NO: 1830760 - RNA, 18 nt, Human
aaauugcauuuccugaca

SEQ ID NO: 1830761 - RNA, 19 nt, Human
aacacauuuuucuuaggga

SEQ ID NO: 1830762 - RNA, 14 nt, Human
aacccuggugacca

SEQ ID NO: 1830763 - RNA, 12 nt, Human
aaccagaucauu

SEQ ID NO: 1830764 - RNA, 14 nt, Human
aaccagaucauugu

SEQ ID NO: 1830765 - RNA, 21 nt, Human
aacauguaauuaaguacuaug

SEQ ID NO: 1830766 - RNA, 14 nt, Human
aacauguaauuaag

SEQ ID NO: 1830767 - RNA, 23 nt, Human
aacauguaauuaaguacuaugua

SEQ ID NO: 1830768 - RNA, 22 nt, Human
aaccacucuaucaaguauuaua

SEQ ID NO: 1830769 - RNA, 17 nt, Human
aaccaguguuguggauu

SEQ ID NO: 1830770 - RNA, 13 nt, Human
aacagcucgacuu

SEQ ID NO: 1830771 - RNA, 13 nt, Human
aacaugauuuggg

SEQ ID NO: 1830772 - RNA, 21 nt, Human
accugcccaaccugcucuccu

SEQ ID NO: 1830773 - RNA, 13 nt, Human
accugcccaaccu

SEQ ID NO: 1830774 - RNA, 23 nt, Human
accugccccucaacucuccucca

SEQ ID NO: 1830775 - RNA, 18 nt, Human
accugccccuccucucug

SEQ ID NO: 1830776 - RNA, 14 nt, Human
accugccccuccuc

SEQ ID NO: 1830777 - RNA, 18 nt, Human
accucugcacaagcugca

SEQ ID NO: 1830778 - RNA, 16 nt, Human
accucugcacaagcug

SEQ ID NO: 1830779 - RNA, 21 nt, Human
accucugcacaagcugcaccc

SEQ ID NO: 1830780 - RNA, 23 nt, Human
accuuucaauaggaaaaacugau

SEQ ID NO: 1830781 - RNA, 21 nt, Human
accuuucaauaggaaaaacug

SEQ ID NO: 1830782 - RNA, 17 nt, Human
accuuucaauaggaaaa

SEQ ID NO: 1830783 - RNA, 22 nt, Human
accugccccuccucucugcccu

SEQ ID NO: 1830784 - RNA, 20 nt, Human
accugccccuccucucugcc

SEQ ID NO: 1830785 - RNA, 14 nt, Human
accuuggcucaagu

SEQ ID NO: 1830786 - RNA, 12 nt, Human
accuuggcugca

SEQ ID NO: 1830787 - RNA, 12 nt, Human
accuuggcucaa

SEQ ID NO: 1830788 - RNA, 16 nt, Human
accuuucaauaggaaa

SEQ ID NO: 1830789 - RNA, 13 nt, Human
accuuuauucugg

SEQ ID NO: 1830790 - RNA, 12 nt, Human
accuuuauucug

SEQ ID NO: 1830791 - RNA, 14 nt, Human
accuuggcugcagg

SEQ ID NO: 1830792 - RNA, 12 nt, Human
acgauuucuguu

SEQ ID NO: 1830793 - RNA, 13 nt, Human
acgauuucuguuu

SEQ ID NO: 1830794 - RNA, 14 nt, Human
acgauuucuguuua

SEQ ID NO: 1830795 - RNA, 17 nt, Human
acgauuucuguuuagau

SEQ ID NO: 1830796 - RNA, 18 nt, Human
acgccacugcacuauagc

SEQ ID NO: 1830797 - RNA, 15 nt, Human
acuaaguuuuuaugg

SEQ ID NO: 1830798 - RNA, 22 nt, Human
acuaaguuuuuauggcuuuugu

SEQ ID NO: 1830799 - RNA, 19 nt, Human
acgugauuuugcuguagaa

SEQ ID NO: 1830800 - RNA, 18 nt, Human
acgcugugcugcccugcc

SEQ ID NO: 1830801 - RNA, 17 nt, Human
acgcugugcugcccugc

SEQ ID NO: 1830802 - RNA, 16 nt, Human
acgcugugcugcccug

SEQ ID NO: 1830803 - RNA, 15 nt, Human
acgcugugcugcccu

SEQ ID NO: 1830804 - RNA, 15 nt, Human
acguggcugcuucaa

SEQ ID NO: 1830805 - RNA, 14 nt, Human
acguggcugcuuca

SEQ ID NO: 1830806 - RNA, 13 nt, Human
acguggcugcuuc

SEQ ID NO: 1830807 - RNA, 17 nt, Human
acguggcugcuucaagg

SEQ ID NO: 1830808 - RNA, 18 nt, Human
acucuacccucuuagaaa

SEQ ID NO: 1830809 - RNA, 13 nt, Human
acucuacccucuu

SEQ ID NO: 1830810 - RNA, 21 nt, Human
acucuacccucuuagaaaaac

SEQ ID NO: 1830811 - RNA, 18 nt, Human
acucuuaaaacccaagug

SEQ ID NO: 1830812 - RNA, 11 nt, Human
acucuuaaaac

SEQ ID NO: 1830813 - RNA, 16 nt, Human
acucugugucaggugg

SEQ ID NO: 1830814 - RNA, 16 nt, Human
acucuaucaaguauua

SEQ ID NO: 1830815 - RNA, 21 nt, Human
acucuaucaaguauuauaccu

SEQ ID NO: 1830816 - RNA, 14 nt, Human
acucuaucaaguau

SEQ ID NO: 1830817 - RNA, 12 nt, Human
acucccuuucaa

SEQ ID NO: 1830818 - RNA, 13 nt, Human
acucccuuucaac

SEQ ID NO: 1830819 - RNA, 16 nt, Human
acucaaacucuuaaaa

SEQ ID NO: 1830820 - RNA, 17 nt, Human
acucaaacucuuaaaac

SEQ ID NO: 1830821 - RNA, 11 nt, Human
acuauaaugua

SEQ ID NO: 1830822 - RNA, 14 nt, Human
acucccccaggugg

SEQ ID NO: 1830823 - RNA, 17 nt, Human
acuccccugcugggugu

SEQ ID NO: 1830824 - RNA, 13 nt, Human
acuccccugcugg

SEQ ID NO: 1830825 - RNA, 12 nt, Human
acuccccuccuu

SEQ ID NO: 1830826 - RNA, 14 nt, Human
acucaguggggagg

SEQ ID NO: 1830827 - RNA, 16 nt, Human
acuaggguccugggga

SEQ ID NO: 1830828 - RNA, 15 nt, Human
acuaggguccugggg

SEQ ID NO: 1830829 - RNA, 14 nt, Human
acuagcuauggugu

SEQ ID NO: 1830830 - RNA, 21 nt, Human
acuuggucugugagaugcuag

SEQ ID NO: 1830831 - RNA, 18 nt, Human
acuuguaaaugugguaaa

SEQ ID NO: 1830832 - RNA, 20 nt, Human
acuuguaaaugugguaaaga

SEQ ID NO: 1830833 - RNA, 23 nt, Human
acuucacauauugauuuccguua

SEQ ID NO: 1830834 - RNA, 22 nt, Human
acuucugccagcauaauacuug

SEQ ID NO: 1830835 - RNA, 18 nt, Human
acuucugccauauucugu

SEQ ID NO: 1830836 - RNA, 19 nt, Human
acuucugccauauucuguu

SEQ ID NO: 1830837 - RNA, 14 nt, Human
acuuggucugugag

SEQ ID NO: 1830838 - RNA, 15 nt, Human
acuuggucugugaga

SEQ ID NO: 1830839 - RNA, 18 nt, Human
acuuguaaaggaauuuaa

SEQ ID NO: 1830840 - RNA, 20 nt, Human
acuuguaaaggaauuuaaaa

SEQ ID NO: 1830841 - RNA, 19 nt, Human
acuuguaaaggaauuuaaa

SEQ ID NO: 1830842 - RNA, 19 nt, Human
acuucacauauugauuucc

SEQ ID NO: 1830843 - RNA, 15 nt, Human
acuuauuuauauaaa

SEQ ID NO: 1830844 - RNA, 13 nt, Human
acuguuucaaacu

SEQ ID NO: 1830845 - RNA, 20 nt, Human
acugguggcccgacagccug

SEQ ID NO: 1830846 - RNA, 22 nt, Human
acugguggcccgacagccuggc

SEQ ID NO: 1830847 - RNA, 21 nt, Human
acugguggcccgacagccugg

SEQ ID NO: 1830848 - RNA, 23 nt, Human
acugguggcccgacagccuggca

SEQ ID NO: 1830849 - RNA, 12 nt, Human
acugucuucagu

SEQ ID NO: 1830850 - RNA, 16 nt, Human
acugugccaugugcca

SEQ ID NO: 1830851 - RNA, 20 nt, Human
acugcccccucugcccugcg

SEQ ID NO: 1830852 - RNA, 18 nt, Human
acugcccccucugcccug

SEQ ID NO: 1830853 - RNA, 19 nt, Human
acugcccccucugcccugc

SEQ ID NO: 1830854 - RNA, 16 nt, Human
acuggaagcacagcuu

SEQ ID NO: 1830855 - RNA, 15 nt, Human
acuggaagcacagcu

SEQ ID NO: 1830856 - RNA, 14 nt, Human
acuggaagcacagc

SEQ ID NO: 1830857 - RNA, 14 nt, Human
acuggagaaaaugg

SEQ ID NO: 1830858 - RNA, 18 nt, Human
agaaauaaaguuucuguu

SEQ ID NO: 1830859 - RNA, 15 nt, Human
agaaauaaaguuucu

SEQ ID NO: 1830860 - RNA, 20 nt, Human
agaaaggaggggauagagag

SEQ ID NO: 1830861 - RNA, 23 nt, Human
agaaaggaggggauagagagaga

SEQ ID NO: 1830862 - RNA, 23 nt, Human
acuuuagggaaguacuuuuggca

SEQ ID NO: 1830863 - RNA, 23 nt, Human
acuuuccuucauucaacccaccu

SEQ ID NO: 1830864 - RNA, 23 nt, Human
acuuuguucuggcucuuccaggc

SEQ ID NO: 1830865 - RNA, 15 nt, Human
acuuuuauaaacuuu

SEQ ID NO: 1830866 - RNA, 19 nt, Human
acuuuuauaaacuuuaccu

SEQ ID NO: 1830867 - RNA, 22 nt, Human
acuuuuauaaacuuuaccuuuu

SEQ ID NO: 1830868 - RNA, 20 nt, Human
agaaaagggaacugaacauu

SEQ ID NO: 1830869 - RNA, 23 nt, Human
agaaaauggacguguuaugacuc

SEQ ID NO: 1830870 - RNA, 22 nt, Human
agaaaauggacguguuaugacu

SEQ ID NO: 1830871 - RNA, 20 nt, Human
agaaaauggacguguuauga

SEQ ID NO: 1830872 - RNA, 15 nt, Human
agaaaauggacgugu

SEQ ID NO: 1830873 - RNA, 23 nt, Human
agaaaauggaagacagcucuuau

SEQ ID NO: 1830874 - RNA, 14 nt, Human
agaaaauaacaaua

SEQ ID NO: 1830875 - RNA, 18 nt, Human
acacaaacgggcucagca

SEQ ID NO: 1830876 - RNA, 16 nt, Human
acaauuuauuauggca

SEQ ID NO: 1830877 - RNA, 15 nt, Human
acaauuuauuauggc

SEQ ID NO: 1830878 - RNA, 15 nt, Human
acacggacacucaaa

SEQ ID NO: 1830879 - RNA, 14 nt, Human
acacuaaccacgcu

SEQ ID NO: 1830880 - RNA, 15 nt, Human
acacuaaccacgcug

SEQ ID NO: 1830881 - RNA, 14 nt, Human
acacagcucugucc

SEQ ID NO: 1830882 - RNA, 11 nt, Human
acacagcucug

SEQ ID NO: 1830883 - RNA, 12 nt, Human
acacagcucugu

SEQ ID NO: 1830884 - RNA, 14 nt, Human
acaccacuacauuc

SEQ ID NO: 1830885 - RNA, 19 nt, Human
acacgcuccuuccucugag

SEQ ID NO: 1830886 - RNA, 17 nt, Human
acacgcuccuuccucug

SEQ ID NO: 1830887 - RNA, 12 nt, Human
acaccagagccc

SEQ ID NO: 1830888 - RNA, 23 nt, Human
acaaguaugaauaaagacaccua

SEQ ID NO: 1830889 - RNA, 21 nt, Human
acaaguaugaauaaagacacc

SEQ ID NO: 1830890 - RNA, 24 nt, Human
acaacuugcacguauuuuaauagc

SEQ ID NO: 1830891 - RNA, 13 nt, Human
aauuuugaaaaac

SEQ ID NO: 1830892 - RNA, 20 nt, Human
acaaaauguaggguuauaau

SEQ ID NO: 1830893 - RNA, 15 nt, Human
acaaacgggcucagc

SEQ ID NO: 1830894 - RNA, 21 nt, Human
acaaaccuguuucugcagcca

SEQ ID NO: 1830895 - RNA, 18 nt, Human
acaacuaugauuuggaaa

SEQ ID NO: 1830896 - RNA, 13 nt, Human
acaaagacugagu

SEQ ID NO: 1830897 - RNA, 12 nt, Human
acagcuccuucu

SEQ ID NO: 1830898 - RNA, 13 nt, Human
acagcuccuucug

SEQ ID NO: 1830899 - RNA, 14 nt, Human
acagcuccuucugu

SEQ ID NO: 1830900 - RNA, 23 nt, Human
acagcugccugggaucccucauc

SEQ ID NO: 1830901 - RNA, 14 nt, Human
acagcugccuggga

SEQ ID NO: 1830902 - RNA, 13 nt, Human
acagcucuguccu

SEQ ID NO: 1830903 - RNA, 20 nt, Human
acagcucugcauacucauua

SEQ ID NO: 1830904 - RNA, 15 nt, Human
acagcuccuucuguc

SEQ ID NO: 1830905 - RNA, 21 nt, Human
acaggugugagccaccacgcc

SEQ ID NO: 1830906 - RNA, 22 nt, Human
acaggugugagccaccacgccc

SEQ ID NO: 1830907 - RNA, 20 nt, Human
acaggugugaaccaccacac

SEQ ID NO: 1830908 - RNA, 23 nt, Human
acaggugugaaccaccacaccca

SEQ ID NO: 1830909 - RNA, 21 nt, Human
acagcugcucaauaaaguaca

SEQ ID NO: 1830910 - RNA, 19 nt, Human
acaggcaagcaccuccugc

SEQ ID NO: 1830911 - RNA, 18 nt, Human
acaggcaagcaccuccug

SEQ ID NO: 1830912 - RNA, 15 nt, Human
acaggcaagcaccuc

SEQ ID NO: 1830913 - RNA, 16 nt, Human
acaggcaagcaccucc

SEQ ID NO: 1830914 - RNA, 21 nt, Human
acagaacacauaauucaggaa

SEQ ID NO: 1830915 - RNA, 15 nt, Human
acagaagcagcucuu

SEQ ID NO: 1830916 - RNA, 14 nt, Human
acagaagcagcucu

SEQ ID NO: 1830917 - RNA, 13 nt, Human
acagaagcagcuc

SEQ ID NO: 1830918 - RNA, 12 nt, Human
acagaagcagcu

SEQ ID NO: 1830919 - RNA, 15 nt, Human
acagccaugauucuu

SEQ ID NO: 1830920 - RNA, 19 nt, Human
acagccacggccaggccag

SEQ ID NO: 1830921 - RNA, 22 nt, Human
acagaggggguggccucccaac

SEQ ID NO: 1830922 - RNA, 12 nt, Human
acagagucucac

SEQ ID NO: 1830923 - RNA, 14 nt, Human
acagagucucacug

SEQ ID NO: 1830924 - RNA, 17 nt, Human
acagagucucacuguug

SEQ ID NO: 1830925 - RNA, 19 nt, Human
acagagucucacuguugcc

SEQ ID NO: 1830926 - RNA, 17 nt, Human
accagcagccuggaccc

SEQ ID NO: 1830927 - RNA, 14 nt, Human
accagcagccugga

SEQ ID NO: 1830928 - RNA, 13 nt, Human
accagcagccugg

SEQ ID NO: 1830929 - RNA, 15 nt, Human
accacguuucuaaag

SEQ ID NO: 1830930 - RNA, 19 nt, Human
accacguuucuaaaggcua

SEQ ID NO: 1830931 - RNA, 14 nt, Human
accacuacauucug

SEQ ID NO: 1830932 - RNA, 14 nt, Human
accacgcccggcua

SEQ ID NO: 1830933 - RNA, 20 nt, Human
accacgcccggcuaauuuuu

SEQ ID NO: 1830934 - RNA, 13 nt, Human
acauguuacaaca

SEQ ID NO: 1830935 - RNA, 21 nt, Human
acauguuuuucuucucccuca

SEQ ID NO: 1830936 - RNA, 23 nt, Human
acaugcacagcuaacauggaagu

SEQ ID NO: 1830937 - RNA, 20 nt, Human
acaugcacagcuaacaugga

SEQ ID NO: 1830938 - RNA, 19 nt, Human
acaugcaaggucauuuuuu

SEQ ID NO: 1830939 - RNA, 23 nt, Human
acauaaacaagaccacguuucua

SEQ ID NO: 1830940 - RNA, 20 nt, Human
acaucagcacgauuucuguu

SEQ ID NO: 1830941 - RNA, 21 nt, Human
acaucagcacgauuucuguuu

SEQ ID NO: 1830942 - RNA, 22 nt, Human
acaucagcacgauuucuguuua

SEQ ID NO: 1830943 - RNA, 20 nt, Human
accccucaacaccucugcac

SEQ ID NO: 1830944 - RNA, 14 nt, Human
accaucaugucugg

SEQ ID NO: 1830945 - RNA, 22 nt, Human
accaucccugaaggccccgccc

SEQ ID NO: 1830946 - RNA, 21 nt, Human
accaucccugaaggccccgcc

SEQ ID NO: 1830947 - RNA, 18 nt, Human
accaucccugaaggcccc

SEQ ID NO: 1830948 - RNA, 16 nt, Human
accaucaugucuggcu

SEQ ID NO: 1830949 - RNA, 17 nt, Human
accaucaugucuggcua

SEQ ID NO: 1830950 - RNA, 19 nt, Human
acccaugcugcccugugag

SEQ ID NO: 1830951 - RNA, 18 nt, Human
acccaugcugcccuguga

SEQ ID NO: 1830952 - RNA, 17 nt, Human
acccaugcugcccugug

SEQ ID NO: 1830953 - RNA, 15 nt, Human
acccacaagaaauga

SEQ ID NO: 1830954 - RNA, 16 nt, Human
acccaagggccuggcc

SEQ ID NO: 1830955 - RNA, 13 nt, Human
acccaagggccug

SEQ ID NO: 1830956 - RNA, 18 nt, Human
accccgaccaccugccca

SEQ ID NO: 1830957 - RNA, 15 nt, Human
accccggccaccugc

SEQ ID NO: 1830958 - RNA, 22 nt, Human
accccuaaagagauacuuugau

SEQ ID NO: 1830959 - RNA, 16 nt, Human
aguccacaguggaacc

SEQ ID NO: 1830960 - RNA, 13 nt, Human
agugauccuccca

SEQ ID NO: 1830961 - RNA, 20 nt, Human
agucaagugaaaaaggagga

SEQ ID NO: 1830962 - RNA, 16 nt, Human
agucaagugaaaaagg

SEQ ID NO: 1830963 - RNA, 18 nt, Human
agucaaggguaggguggg

SEQ ID NO: 1830964 - RNA, 18 nt, Human
aguuguaccgcaauguga

SEQ ID NO: 1830965 - RNA, 19 nt, Human
aguuguaccgcaaugugac

SEQ ID NO: 1830966 - RNA, 18 nt, Human
aguuacagacaaagcgug

SEQ ID NO: 1830967 - RNA, 16 nt, Human
aguuguuacauuuuua

SEQ ID NO: 1830968 - RNA, 23 nt, Human
aguuguuaauaaaaguacauguu

SEQ ID NO: 1830969 - RNA, 13 nt, Human
aguuguuacauuu

SEQ ID NO: 1830970 - RNA, 15 nt, Human
aguuguuacauuuuu

SEQ ID NO: 1830971 - RNA, 23 nt, Human
agugugacaaggauugcuacugu

SEQ ID NO: 1830972 - RNA, 18 nt, Human
agugauuaccagggacug

SEQ ID NO: 1830973 - RNA, 15 nt, Human
agugauuaccaggga

SEQ ID NO: 1830974 - RNA, 19 nt, Human
agugauucucaugccucag

SEQ ID NO: 1830975 - RNA, 18 nt, Human
agugauucucaugccuca

SEQ ID NO: 1830976 - RNA, 16 nt, Human
auauuuauaaaaauaa

SEQ ID NO: 1830977 - RNA, 18 nt, Human
auauuuaguguucauaaa

SEQ ID NO: 1830978 - RNA, 13 nt, Human
auauucaggaagc

SEQ ID NO: 1830979 - RNA, 16 nt, Human
auauucaggaagcuca

SEQ ID NO: 1830980 - RNA, 14 nt, Human
auauucaggaagcu

SEQ ID NO: 1830981 - RNA, 17 nt, Human
auauucaggaagcucag

SEQ ID NO: 1830982 - RNA, 19 nt, Human
auaugcuuauacacuuaca

SEQ ID NO: 1830983 - RNA, 16 nt, Human
auaugcuuauacacuu

SEQ ID NO: 1830984 - RNA, 14 nt, Human
auaugcuuauacac

SEQ ID NO: 1830985 - RNA, 22 nt, Human
auaugccugggcagaaggaaga

SEQ ID NO: 1830986 - RNA, 17 nt, Human
auaugcaguuuuccuua

SEQ ID NO: 1830987 - RNA, 15 nt, Human
auauaaguguguguu

SEQ ID NO: 1830988 - RNA, 15 nt, Human
auauaagugauugcu

SEQ ID NO: 1830989 - RNA, 16 nt, Human
auaguaugguggcugg

SEQ ID NO: 1830990 - RNA, 16 nt, Human
auacuugaaaauuaac

SEQ ID NO: 1830991 - RNA, 15 nt, Human
auacuugaaaauuaa

SEQ ID NO: 1830992 - RNA, 15 nt, Human
auaguaugguggcug

SEQ ID NO: 1830993 - RNA, 16 nt, Human
auauaggaacuuaaau

SEQ ID NO: 1830994 - RNA, 12 nt, Human
auaccugucccc

SEQ ID NO: 1830995 - RNA, 13 nt, Human
auaccuguccccc

SEQ ID NO: 1830996 - RNA, 14 nt, Human
auaauuacuauguc

SEQ ID NO: 1830997 - RNA, 22 nt, Human
auacccccugcaaagcccagcu

SEQ ID NO: 1830998 - RNA, 15 nt, Human
auaaguggugugugu

SEQ ID NO: 1830999 - RNA, 19 nt, Human
auaaguauuuaauucaugu

SEQ ID NO: 1831000 - RNA, 19 nt, Human
auaaugugaaacuggauua

SEQ ID NO: 1831001 - RNA, 21 nt, Human
auaaugugaaacuggauuaaa

SEQ ID NO: 1831002 - RNA, 22 nt, Human
auaaguguguguuuuucauaaa

SEQ ID NO: 1831003 - RNA, 19 nt, Human
auaaguguguguuuuucau

SEQ ID NO: 1831004 - RNA, 18 nt, Human
auaaugugaaacuggauu

SEQ ID NO: 1831005 - RNA, 20 nt, Human
auggaaaugggcagagcaga

SEQ ID NO: 1831006 - RNA, 19 nt, Human
auggaaaugggcagagcag

SEQ ID NO: 1831007 - RNA, 13 nt, Human
auggaaauguuua

SEQ ID NO: 1831008 - RNA, 15 nt, Human
augggaaugaauguc

SEQ ID NO: 1831009 - RNA, 21 nt, Human
augggaaugaaugucagugug

SEQ ID NO: 1831010 - RNA, 23 nt, Human
auggcugccaaugggagcucaug

SEQ ID NO: 1831011 - RNA, 21 nt, Human
augccuuuguacuuuagggaa

SEQ ID NO: 1831012 - RNA, 23 nt, Human
augauguauguugaagccuuugu

SEQ ID NO: 1831013 - RNA, 16 nt, Human
augaugugugaaaacu

SEQ ID NO: 1831014 - RNA, 17 nt, Human
augcacacauuuuuuaa

SEQ ID NO: 1831015 - RNA, 19 nt, Human
augcacacauuuuuuaaau

SEQ ID NO: 1831016 - RNA, 22 nt, Human
augcacacauuuuuuaaaugca

SEQ ID NO: 1831017 - RNA, 14 nt, Human
augcacagcuaaca

SEQ ID NO: 1831018 - RNA, 23 nt, Human
augcacacauuuuuuaaaugcac

SEQ ID NO: 1831019 - RNA, 21 nt, Human
augcacagcuaacauggaagu

SEQ ID NO: 1831020 - RNA, 10 nt, Human
augcauuuga

SEQ ID NO: 1831021 - RNA, 12 nt, Human
augcauuugaaa

SEQ ID NO: 1831022 - RNA, 18 nt, Human
augcauuugaaaauuuug

SEQ ID NO: 1831023 - RNA, 23 nt, Human
augcaugaaguaauaugcacaca

SEQ ID NO: 1831024 - RNA, 20 nt, Human
augcaugaaguaauaugcac

SEQ ID NO: 1831025 - RNA, 17 nt, Human
augccugggcagaagga

SEQ ID NO: 1831026 - RNA, 23 nt, Human
augccuggauggggcugcaccgg

SEQ ID NO: 1831027 - RNA, 21 nt, Human
augccuggauggggcugcacc

SEQ ID NO: 1831028 - RNA, 15 nt, Human
augccugguggcagc

SEQ ID NO: 1831029 - RNA, 16 nt, Human
augccugguggcagcu

SEQ ID NO: 1831030 - RNA, 17 nt, Human
augccugguggcagcug

SEQ ID NO: 1831031 - RNA, 17 nt, Human
auguaagcucuacugag

SEQ ID NO: 1831032 - RNA, 15 nt, Human
augucacaggcaggu

SEQ ID NO: 1831033 - RNA, 14 nt, Human
augucacaggcagg

SEQ ID NO: 1831034 - RNA, 16 nt, Human
augucacaggcagguc

SEQ ID NO: 1831035 - RNA, 17 nt, Human
augucacaggcaggucc

SEQ ID NO: 1831036 - RNA, 17 nt, Human
auguacauguacugauu

SEQ ID NO: 1831037 - RNA, 14 nt, Human
auguguaaguauuc

SEQ ID NO: 1831038 - RNA, 22 nt, Human
auguucugacccugcuucaaau

SEQ ID NO: 1831039 - RNA, 20 nt, Human
auguucuuaguggauguucu

SEQ ID NO: 1831040 - RNA, 15 nt, Human
auguucuuaauucuu

SEQ ID NO: 1831041 - RNA, 20 nt, Human
auguucuuucacccuuuucu

SEQ ID NO: 1831042 - RNA, 18 nt, Human
auguuucuuuguaaugaa

SEQ ID NO: 1831043 - RNA, 18 nt, Human
auguucucugaggacacu

SEQ ID NO: 1831044 - RNA, 13 nt, Human
auuaaauucuugc

SEQ ID NO: 1831045 - RNA, 16 nt, Human
auuaaaugcccagccc

SEQ ID NO: 1831046 - RNA, 15 nt, Human
auuaaaugcccagcc

SEQ ID NO: 1831047 - RNA, 14 nt, Human
auuaaaugcccagc

SEQ ID NO: 1831048 - RNA, 16 nt, Human
auguuuuaagaggcag

SEQ ID NO: 1831049 - RNA, 18 nt, Human
auguuuuaagaggcaggg

SEQ ID NO: 1831050 - RNA, 17 nt, Human
aucuucuuuauaauucu

SEQ ID NO: 1831051 - RNA, 17 nt, Human
aucuugaagacuuuucu

SEQ ID NO: 1831052 - RNA, 22 nt, Human
aucucucgugauugauaagaac

SEQ ID NO: 1831053 - RNA, 15 nt, Human
aucucucuucuuuuc

SEQ ID NO: 1831054 - RNA, 19 nt, Human
aucuuccaacucaaacucu

SEQ ID NO: 1831055 - RNA, 15 nt, Human
aucugggccagaauu

SEQ ID NO: 1831056 - RNA, 17 nt, Human
aucugggccagaauuuc

SEQ ID NO: 1831057 - RNA, 22 nt, Human
aucuuauaauuuaaaauaugcu

SEQ ID NO: 1831058 - RNA, 14 nt, Human
augagccuggcaag

SEQ ID NO: 1831059 - RNA, 13 nt, Human
augagccuggcaa

SEQ ID NO: 1831060 - RNA, 12 nt, Human
augacccagugg

SEQ ID NO: 1831061 - RNA, 21 nt, Human
augaagcuuuuaugugaaaca

SEQ ID NO: 1831062 - RNA, 20 nt, Human
augaagcuuuuaugugaaac

SEQ ID NO: 1831063 - RNA, 19 nt, Human
augaagcuuuuaugugaaa

SEQ ID NO: 1831064 - RNA, 18 nt, Human
augaagcuuuuaugugaa

SEQ ID NO: 1831065 - RNA, 16 nt, Human
augacuccagaauuuc

SEQ ID NO: 1831066 - RNA, 12 nt, Human
augacuccagaa

SEQ ID NO: 1831067 - RNA, 17 nt, Human
augacuccagaauuucc

SEQ ID NO: 1831068 - RNA, 17 nt, Human
augaaaaaauauauauc

SEQ ID NO: 1831069 - RNA, 14 nt, Human
augaaaaaauauau

SEQ ID NO: 1831070 - RNA, 22 nt, Human
augaaaaaauauauaucaaaua

SEQ ID NO: 1831071 - RNA, 23 nt, Human
augaaaaaauauauaucaaauau

SEQ ID NO: 1831072 - RNA, 23 nt, Human
aucagcugcuacuacuccuguag

SEQ ID NO: 1831073 - RNA, 13 nt, Human
aucagcugcuacu

SEQ ID NO: 1831074 - RNA, 12 nt, Human
aucagcugcuac

SEQ ID NO: 1831075 - RNA, 21 nt, Human
aucagccugggcaaugugaua

SEQ ID NO: 1831076 - RNA, 20 nt, Human
aucagccugggcaaugugau

SEQ ID NO: 1831077 - RNA, 11 nt, Human
aucagccuggg

SEQ ID NO: 1831078 - RNA, 13 nt, Human
aucaccugcccug

SEQ ID NO: 1831079 - RNA, 12 nt, Human
aucaccugcccu

SEQ ID NO: 1831080 - RNA, 22 nt, Human
auccucauacccacccccaccc

SEQ ID NO: 1831081 - RNA, 19 nt, Human
auccucauacccaccccca

SEQ ID NO: 1831082 - RNA, 18 nt, Human
auccucauacccaccccc

SEQ ID NO: 1831083 - RNA, 15 nt, Human
aucccuacuguaauu

SEQ ID NO: 1831084 - RNA, 14 nt, Human
aucccggcugcccu

SEQ ID NO: 1831085 - RNA, 18 nt, Human
auccacccaccucagccu

SEQ ID NO: 1831086 - RNA, 20 nt, Human
auccacccaccucagccucc

SEQ ID NO: 1831087 - RNA, 22 nt, Human
auccuccaggugcacaagcucc

SEQ ID NO: 1831088 - RNA, 19 nt, Human
auccuccaggugcacaagc

SEQ ID NO: 1831089 - RNA, 14 nt, Human
auccuccaggugca

SEQ ID NO: 1831090 - RNA, 13 nt, Human
auccuccaggugc

SEQ ID NO: 1831091 - RNA, 11 nt, Human
auccuccucag

SEQ ID NO: 1831092 - RNA, 23 nt, Human
auccucauacccacccccaccca

SEQ ID NO: 1831093 - RNA, 12 nt, Human
auccucccaggc

SEQ ID NO: 1831094 - RNA, 13 nt, Human
aucgaugcagugc

SEQ ID NO: 1831095 - RNA, 14 nt, Human
auccuccucagauc

SEQ ID NO: 1831096 - RNA, 13 nt, Human
agacaaugacuua

SEQ ID NO: 1831097 - RNA, 17 nt, Human
agacaaugacuuacugu

SEQ ID NO: 1831098 - RNA, 19 nt, Human
agacaaugacuuacuguac

SEQ ID NO: 1831099 - RNA, 15 nt, Human
agacaauuuauuaug

SEQ ID NO: 1831100 - RNA, 21 nt, Human
agacaauuuauuauggcacau

SEQ ID NO: 1831101 - RNA, 18 nt, Human
agacgggggcagagaggg

SEQ ID NO: 1831102 - RNA, 19 nt, Human
agacggagucccaccuugg

SEQ ID NO: 1831103 - RNA, 17 nt, Human
agacagcccgggcucug

SEQ ID NO: 1831104 - RNA, 20 nt, Human
agacagcccgggcucugccu

SEQ ID NO: 1831105 - RNA, 18 nt, Human
agacagcccgggcucugc

SEQ ID NO: 1831106 - RNA, 21 nt, Human
agaccaucccugaaggccccg

SEQ ID NO: 1831107 - RNA, 18 nt, Human
agaccaucccugaaggcc

SEQ ID NO: 1831108 - RNA, 17 nt, Human
agaccaucccugaaggc

SEQ ID NO: 1831109 - RNA, 14 nt, Human
agaccaucccugaa

SEQ ID NO: 1831110 - RNA, 13 nt, Human
agaccaucccuga

SEQ ID NO: 1831111 - RNA, 23 nt, Human
agacugaguacguugugcauuug

SEQ ID NO: 1831112 - RNA, 16 nt, Human
agagaguggcuccucc

SEQ ID NO: 1831113 - RNA, 14 nt, Human
agagaguggcuccu

SEQ ID NO: 1831114 - RNA, 23 nt, Human
agagaggguggugaccucugccu

SEQ ID NO: 1831115 - RNA, 16 nt, Human
agagagcuucuguugc

SEQ ID NO: 1831116 - RNA, 23 nt, Human
agagagcuucuguugcugccuca

SEQ ID NO: 1831117 - RNA, 20 nt, Human
agagagcuucuguugcugcc

SEQ ID NO: 1831118 - RNA, 21 nt, Human
agagaagagauugugguuuca

SEQ ID NO: 1831119 - RNA, 10 nt, Human
agagaagaga

SEQ ID NO: 1831120 - RNA, 18 nt, Human
agagaaaguacuucucca

SEQ ID NO: 1831121 - RNA, 13 nt, Human
agaggagaggggc

SEQ ID NO: 1831122 - RNA, 16 nt, Human
agaggggaagagacuu

SEQ ID NO: 1831123 - RNA, 22 nt, Human
agaggggaacagacuggaagca

SEQ ID NO: 1831124 - RNA, 22 nt, Human
agauacuuggggggcugaggug

SEQ ID NO: 1831125 - RNA, 13 nt, Human
agauagccaaggc

SEQ ID NO: 1831126 - RNA, 23 nt, Human
agauggcugugccucugccuguc

SEQ ID NO: 1831127 - RNA, 16 nt, Human
agauagccaaggccaa

SEQ ID NO: 1831128 - RNA, 15 nt, Human
agauagccaaggcca

SEQ ID NO: 1831129 - RNA, 21 nt, Human
agauaggucagugcaaauacu

SEQ ID NO: 1831130 - RNA, 20 nt, Human
agcccaaagugguauagaaa

SEQ ID NO: 1831131 - RNA, 23 nt, Human
agcccaaagugguauagaaaugc

SEQ ID NO: 1831132 - RNA, 11 nt, Human
agccccauccu

SEQ ID NO: 1831133 - RNA, 20 nt, Human
agccccaucccaaacccuuc

SEQ ID NO: 1831134 - RNA, 23 nt, Human
agccccauaauuuuuuuuuuccu

SEQ ID NO: 1831135 - RNA, 16 nt, Human
agccccagugcccaca

SEQ ID NO: 1831136 - RNA, 15 nt, Human
agcccugagcuuucu

SEQ ID NO: 1831137 - RNA, 19 nt, Human
agccgagaucacgccacug

SEQ ID NO: 1831138 - RNA, 20 nt, Human
agccgagaucacgccacugc

SEQ ID NO: 1831139 - RNA, 19 nt, Human
agccuccugaguagcugga

SEQ ID NO: 1831140 - RNA, 18 nt, Human
agccucccaaagugcugg

SEQ ID NO: 1831141 - RNA, 19 nt, Human
agccucccaaagugcuggg

SEQ ID NO: 1831142 - RNA, 22 nt, Human
agccgcuggggccaguuggucc

SEQ ID NO: 1831143 - RNA, 14 nt, Human
agccgcuggggcca

SEQ ID NO: 1831144 - RNA, 20 nt, Human
agccgagauugcaccacugc

SEQ ID NO: 1831145 - RNA, 19 nt, Human
agccgagauugcaccacug

SEQ ID NO: 1831146 - RNA, 21 nt, Human
agccgagaucacgccacugca

SEQ ID NO: 1831147 - RNA, 20 nt, Human
agccucccaaagugcuggga

SEQ ID NO: 1831148 - RNA, 18 nt, Human
agccucccgaauagcugg

SEQ ID NO: 1831149 - RNA, 19 nt, Human
agccucccgaauagcuggg

SEQ ID NO: 1831150 - RNA, 20 nt, Human
agccucccgaauagcuggga

SEQ ID NO: 1831151 - RNA, 22 nt, Human
agccucccgaauagcugggacu

SEQ ID NO: 1831152 - RNA, 17 nt, Human
agccucccgaguagcug

SEQ ID NO: 1831153 - RNA, 11 nt, Human
agccuccugag

SEQ ID NO: 1831154 - RNA, 22 nt, Human
agccucccgaguagcugggacu

SEQ ID NO: 1831155 - RNA, 23 nt, Human
agccaaggccaaaggaagcacau

SEQ ID NO: 1831156 - RNA, 22 nt, Human
agccaaggccaaaggaagcaca

SEQ ID NO: 1831157 - RNA, 20 nt, Human
agccagaggagagaggaccc

SEQ ID NO: 1831158 - RNA, 12 nt, Human
agcaugccugga

SEQ ID NO: 1831159 - RNA, 14 nt, Human
agcaugcacaaauu

SEQ ID NO: 1831160 - RNA, 19 nt, Human
agccaaagcuaggccuggc

SEQ ID NO: 1831161 - RNA, 20 nt, Human
agccaaagcuaggccuggcc

SEQ ID NO: 1831162 - RNA, 23 nt, Human
agccaaagcuaggccuggccaga

SEQ ID NO: 1831163 - RNA, 21 nt, Human
agaugggagaaucacuugaac

SEQ ID NO: 1831164 - RNA, 14 nt, Human
agauguagaggaga

SEQ ID NO: 1831165 - RNA, 21 nt, Human
agcagccacauuccugaugcu

SEQ ID NO: 1831166 - RNA, 20 nt, Human
agcacuaaggugugcucuga

SEQ ID NO: 1831167 - RNA, 19 nt, Human
agcacuaaggugugcucug

SEQ ID NO: 1831168 - RNA, 17 nt, Human
agguaaggaauaccugu

SEQ ID NO: 1831169 - RNA, 17 nt, Human
agguaaucgaccugccu

SEQ ID NO: 1831170 - RNA, 18 nt, Human
agguaaucgaccugccuc

SEQ ID NO: 1831171 - RNA, 20 nt, Human
aggucccuaauaaagcugug

SEQ ID NO: 1831172 - RNA, 19 nt, Human
aggucccuaauaaagcugu

SEQ ID NO: 1831173 - RNA, 18 nt, Human
aggucccuaauaaagcug

SEQ ID NO: 1831174 - RNA, 17 nt, Human
aggucccuaauaaagcu

SEQ ID NO: 1831175 - RNA, 15 nt, Human
agguggaaauaaacu

SEQ ID NO: 1831176 - RNA, 14 nt, Human
aggucgaggcagga

SEQ ID NO: 1831177 - RNA, 16 nt, Human
aggugcugccauccag

SEQ ID NO: 1831178 - RNA, 17 nt, Human
aggugcugccauccagg

SEQ ID NO: 1831179 - RNA, 15 nt, Human
agguuaauaaaguaa

SEQ ID NO: 1831180 - RNA, 14 nt, Human
agguuaauguucau

SEQ ID NO: 1831181 - RNA, 17 nt, Human
agguucaaagauauuuu

SEQ ID NO: 1831182 - RNA, 17 nt, Human
agguucaugcaaacuuu

SEQ ID NO: 1831183 - RNA, 13 nt, Human
agguucagcuugu

SEQ ID NO: 1831184 - RNA, 15 nt, Human
aggggcacagggucu

SEQ ID NO: 1831185 - RNA, 21 nt, Human
aggggauagagagagaccacu

SEQ ID NO: 1831186 - RNA, 18 nt, Human
agggccuggccugagcug

SEQ ID NO: 1831187 - RNA, 19 nt, Human
agggcgggaggauguucug

SEQ ID NO: 1831188 - RNA, 17 nt, Human
agggcacaccgggcacu

SEQ ID NO: 1831189 - RNA, 17 nt, Human
agggccuggccugagcu

SEQ ID NO: 1831190 - RNA, 16 nt, Human
agggccuggccugagc

SEQ ID NO: 1831191 - RNA, 15 nt, Human
agggccuggccugag

SEQ ID NO: 1831192 - RNA, 22 nt, Human
agggcacagaaaauggaagaca

SEQ ID NO: 1831193 - RNA, 20 nt, Human
agggcacaccgggcacucag

SEQ ID NO: 1831194 - RNA, 21 nt, Human
agggcacaccgggcacucaga

SEQ ID NO: 1831195 - RNA, 14 nt, Human
aggcucuucuccuu

SEQ ID NO: 1831196 - RNA, 21 nt, Human
aggcugaacuuguuuucuggg

SEQ ID NO: 1831197 - RNA, 20 nt, Human
aggcugaacuuguuuucugg

SEQ ID NO: 1831198 - RNA, 23 nt, Human
aggcuagugugguguuuccuggc

SEQ ID NO: 1831199 - RNA, 20 nt, Human
agggacagaggggguggccu

SEQ ID NO: 1831200 - RNA, 13 nt, Human
agggacagagggg

SEQ ID NO: 1831201 - RNA, 12 nt, Human
agggacagaggg

SEQ ID NO: 1831202 - RNA, 21 nt, Human
agggacgcuacccgggaaggg

SEQ ID NO: 1831203 - RNA, 20 nt, Human
agggacucaucauuuccauu

SEQ ID NO: 1831204 - RNA, 18 nt, Human
aggcugccucucccauca

SEQ ID NO: 1831205 - RNA, 15 nt, Human
aggaacuacugagga

SEQ ID NO: 1831206 - RNA, 20 nt, Human
aggaccccuccaugugggcu

SEQ ID NO: 1831207 - RNA, 18 nt, Human
aggagaggggcacagggu

SEQ ID NO: 1831208 - RNA, 16 nt, Human
aggagaggggcacagg

SEQ ID NO: 1831209 - RNA, 14 nt, Human
aggagaggggcaca

SEQ ID NO: 1831210 - RNA, 15 nt, Human
aggagagcuagcagc

SEQ ID NO: 1831211 - RNA, 20 nt, Human
aggaccucaggugagaagca

SEQ ID NO: 1831212 - RNA, 14 nt, Human
aggaccucagguga

SEQ ID NO: 1831213 - RNA, 17 nt, Human
aggacccggaggggccu

SEQ ID NO: 1831214 - RNA, 22 nt, Human
aggcacugcugcccagccucca

SEQ ID NO: 1831215 - RNA, 16 nt, Human
aggcacugcugcccag

SEQ ID NO: 1831216 - RNA, 14 nt, Human
aggcacugcugccc

SEQ ID NO: 1831217 - RNA, 12 nt, Human
aggauucuuccu

SEQ ID NO: 1831218 - RNA, 16 nt, Human
aggauucuuccucccu

SEQ ID NO: 1831219 - RNA, 17 nt, Human
aggaggggauagagaga

SEQ ID NO: 1831220 - RNA, 17 nt, Human
aggauguugaaaaaguu

SEQ ID NO: 1831221 - RNA, 14 nt, Human
aggauguugaaaaa

SEQ ID NO: 1831222 - RNA, 20 nt, Human
aggauguucugggacacagu

SEQ ID NO: 1831223 - RNA, 15 nt, Human
aggaaaaacugauuu

SEQ ID NO: 1831224 - RNA, 13 nt, Human
aggaaaaacugau

SEQ ID NO: 1831225 - RNA, 15 nt, Human
agcuuuucccuuuuu

SEQ ID NO: 1831226 - RNA, 16 nt, Human
agcuuuucccuucuuu

SEQ ID NO: 1831227 - RNA, 21 nt, Human
agcuuuuaugugaaacauguu

SEQ ID NO: 1831228 - RNA, 13 nt, Human
agcuuuucccuuc

SEQ ID NO: 1831229 - RNA, 23 nt, Human
agcuucuguugcugccucaugcu

SEQ ID NO: 1831230 - RNA, 22 nt, Human
aggaacguaaucguguccccua

SEQ ID NO: 1831231 - RNA, 17 nt, Human
aggaaauccaggguggu

SEQ ID NO: 1831232 - RNA, 15 nt, Human
aggaaauccagggug

SEQ ID NO: 1831233 - RNA, 22 nt, Human
agcuucuguugcugccucaugc

SEQ ID NO: 1831234 - RNA, 21 nt, Human
agcuucuguugcugccucaug

SEQ ID NO: 1831235 - RNA, 20 nt, Human
agcuucuguugcugccucau

SEQ ID NO: 1831236 - RNA, 17 nt, Human
agcugggugucaagagg

SEQ ID NO: 1831237 - RNA, 22 nt, Human
agcugggugucaagagggucug

SEQ ID NO: 1831238 - RNA, 21 nt, Human
agcuggucccacucaguccau

SEQ ID NO: 1831239 - RNA, 20 nt, Human
cucuucaacugaccagccuc

SEQ ID NO: 1831240 - RNA, 17 nt, Human
cucuucaacugaccagc

SEQ ID NO: 1831241 - RNA, 16 nt, Human
cucuucaacugaccag

SEQ ID NO: 1831242 - RNA, 18 nt, Human
cucuucagaucucuaacu

SEQ ID NO: 1831243 - RNA, 19 nt, Human
cucuucagaucucuaacuu

SEQ ID NO: 1831244 - RNA, 14 nt, Human
cucuucaaucucuu

SEQ ID NO: 1831245 - RNA, 14 nt, Human
cucuuauugcccac

SEQ ID NO: 1831246 - RNA, 15 nt, Human
cucuuauugcccacg

SEQ ID NO: 1831247 - RNA, 19 nt, Human
cucuuauugcccacgcugg

SEQ ID NO: 1831248 - RNA, 20 nt, Human
cucuuauugcccacgcugga

SEQ ID NO: 1831249 - RNA, 13 nt, Human
cucuuauugccca

SEQ ID NO: 1831250 - RNA, 20 nt, Human
cucugcacuccccugcuggg

SEQ ID NO: 1831251 - RNA, 18 nt, Human
cucugcacuccccugcug

SEQ ID NO: 1831252 - RNA, 21 nt, Human
cucugcacuccccugcugggu

SEQ ID NO: 1831253 - RNA, 13 nt, Human
cucugcagcaaua

SEQ ID NO: 1831254 - RNA, 17 nt, Human
cucugcaggucccuaau

SEQ ID NO: 1831255 - RNA, 16 nt, Human
cucugcaggucccuaa

SEQ ID NO: 1831256 - RNA, 15 nt, Human
cucugcaggucccua

SEQ ID NO: 1831257 - RNA, 14 nt, Human
cucugcaggucccu

SEQ ID NO: 1831258 - RNA, 13 nt, Human
cucugcuccucuc

SEQ ID NO: 1831259 - RNA, 18 nt, Human
cucugcuccucuccccag

SEQ ID NO: 1831260 - RNA, 20 nt, Human
cucugcuccucuccccagca

SEQ ID NO: 1831261 - RNA, 14 nt, Human
cucugguccauaga

SEQ ID NO: 1831262 - RNA, 13 nt, Human
cucugcugacaga

SEQ ID NO: 1831263 - RNA, 14 nt, Human
cucugcugacagac

SEQ ID NO: 1831264 - RNA, 16 nt, Human
cucugcugacagacac

SEQ ID NO: 1831265 - RNA, 12 nt, Human
cucuguccaggc

SEQ ID NO: 1831266 - RNA, 15 nt, Human
cucugguuaucuaau

SEQ ID NO: 1831267 - RNA, 21 nt, Human
cucuugaugccuggcggggug

SEQ ID NO: 1831268 - RNA, 16 nt, Human
cucuugaugccuggcg

SEQ ID NO: 1831269 - RNA, 15 nt, Human
cucuugaugccuggc

SEQ ID NO: 1831270 - RNA, 13 nt, Human
cucuugaugccug

SEQ ID NO: 1831271 - RNA, 22 nt, Human
cugaaaauugaugggauuuggu

SEQ ID NO: 1831272 - RNA, 22 nt, Human
cugaagcuaucguaaaauuaag

SEQ ID NO: 1831273 - RNA, 21 nt, Human
cugaagcuaucguaaaauuaa

SEQ ID NO: 1831274 - RNA, 23 nt, Human
cugaaggacauugcggacagcca

SEQ ID NO: 1831275 - RNA, 21 nt, Human
cugaaggccccgcccaggcuu

SEQ ID NO: 1831276 - RNA, 17 nt, Human
cugaaggcuggguucug

SEQ ID NO: 1831277 - RNA, 19 nt, Human
cugaaggccccgcccaggc

SEQ ID NO: 1831278 - RNA, 23 nt, Human
cugacaacacucauugaccugag

SEQ ID NO: 1831279 - RNA, 22 nt, Human
cugacaacacucauugaccuga

SEQ ID NO: 1831280 - RNA, 23 nt, Human
cucuugagccuugaacuuugacc

SEQ ID NO: 1831281 - RNA, 18 nt, Human
cucuugagccuugaacuu

SEQ ID NO: 1831282 - RNA, 16 nt, Human
cucuugagccuugaac

SEQ ID NO: 1831283 - RNA, 17 nt, Human
cucuugagccuugaacu

SEQ ID NO: 1831284 - RNA, 20 nt, Human
cugaguagcugggauuacag

SEQ ID NO: 1831285 - RNA, 15 nt, Human
cugaguagcugggau

SEQ ID NO: 1831286 - RNA, 14 nt, Human
cugaguagcuggga

SEQ ID NO: 1831287 - RNA, 20 nt, Human
cugaguagcuggauuacagg

SEQ ID NO: 1831288 - RNA, 14 nt, Human
cugaggaccagcca

SEQ ID NO: 1831289 - RNA, 22 nt, Human
cugaggacuuaaaauauuccug

SEQ ID NO: 1831290 - RNA, 18 nt, Human
cugaguacguugugcauu

SEQ ID NO: 1831291 - RNA, 17 nt, Human
cugaguacguugugcau

SEQ ID NO: 1831292 - RNA, 19 nt, Human
cugaguacguugugcauuu

SEQ ID NO: 1831293 - RNA, 20 nt, Human
cugaguacguugugcauuug

SEQ ID NO: 1831294 - RNA, 12 nt, Human
cugaggugggag

SEQ ID NO: 1831295 - RNA, 21 nt, Human
cugaguacguugugcauuugg

SEQ ID NO: 1831296 - RNA, 19 nt, Human
cugaguagcuggauuacag

SEQ ID NO: 1831297 - RNA, 15 nt, Human
cugagcuuucugcua

SEQ ID NO: 1831298 - RNA, 14 nt, Human
cugagcuuucugcu

SEQ ID NO: 1831299 - RNA, 21 nt, Human
cugagaucaaaacgguuuuac

SEQ ID NO: 1831300 - RNA, 23 nt, Human
cugaggacacuaaccacgcugga

SEQ ID NO: 1831301 - RNA, 21 nt, Human
cugaggaauccagacccggcu

SEQ ID NO: 1831302 - RNA, 20 nt, Human
cugaggacacuaaccacgcu

SEQ ID NO: 1831303 - RNA, 17 nt, Human
cugaggaauccagaccc

SEQ ID NO: 1831304 - RNA, 20 nt, Human
cugaggaauccagacccggc

SEQ ID NO: 1831305 - RNA, 22 nt, Human
cugagacucgcgacaaugcaaa

SEQ ID NO: 1831306 - RNA, 17 nt, Human
cugagaguagagucacu

SEQ ID NO: 1831307 - RNA, 21 nt, Human
cugagaggacuuuucuuugug

SEQ ID NO: 1831308 - RNA, 22 nt, Human
cugagaggacuuuucuuugugg

SEQ ID NO: 1831309 - RNA, 22 nt, Human
cugacccaugcugcccugugag

SEQ ID NO: 1831310 - RNA, 21 nt, Human
cugacccaugcugcccuguga

SEQ ID NO: 1831311 - RNA, 21 nt, Human
cugagacucgcgacaaugcaa

SEQ ID NO: 1831312 - RNA, 23 nt, Human
cugagacagcccgggcucugccu

SEQ ID NO: 1831313 - RNA, 19 nt, Human
cugacaacagacuucugaa

SEQ ID NO: 1831314 - RNA, 18 nt, Human
cugacaacagacuucuga

SEQ ID NO: 1831315 - RNA, 15 nt, Human
cugacaacagacuuc

SEQ ID NO: 1831316 - RNA, 15 nt, Human
cuccucucugcccua

SEQ ID NO: 1831317 - RNA, 14 nt, Human
cuccucucugcccu

SEQ ID NO: 1831318 - RNA, 13 nt, Human
cuccucucugccc

SEQ ID NO: 1831319 - RNA, 18 nt, Human
cuccucugcugcuggcug

SEQ ID NO: 1831320 - RNA, 16 nt, Human
cuccucugcugcuggc

SEQ ID NO: 1831321 - RNA, 19 nt, Human
cuccucucugcccuaaugc

SEQ ID NO: 1831322 - RNA, 18 nt, Human
cuccuggcccacugcauc

SEQ ID NO: 1831323 - RNA, 16 nt, Human
cuccuggcccacugca

SEQ ID NO: 1831324 - RNA, 15 nt, Human
cuccuggacuccugc

SEQ ID NO: 1831325 - RNA, 23 nt, Human
cuccucuucaacugaccagccuc

SEQ ID NO: 1831326 - RNA, 18 nt, Human
cuccucuucaacugacca

SEQ ID NO: 1831327 - RNA, 20 nt, Human
cucccccagccccauccucu

SEQ ID NO: 1831328 - RNA, 15 nt, Human
cucccccagccccau

SEQ ID NO: 1831329 - RNA, 22 nt, Human
cucccccagccccauccucugu

SEQ ID NO: 1831330 - RNA, 13 nt, Human
cucccccaucucu

SEQ ID NO: 1831331 - RNA, 22 nt, Human
cuccuggggguucuuucuuccu

SEQ ID NO: 1831332 - RNA, 20 nt, Human
cuccuggggguucuuucuuc

SEQ ID NO: 1831333 - RNA, 18 nt, Human
cuccuggggguucuuucu

SEQ ID NO: 1831334 - RNA, 23 nt, Human
cuccuggggguucuuucuuccuc

SEQ ID NO: 1831335 - RNA, 13 nt, Human
cucgaacuggcug

SEQ ID NO: 1831336 - RNA, 14 nt, Human
cucgaacuggcugc

SEQ ID NO: 1831337 - RNA, 15 nt, Human
cucgaacuggcugca

SEQ ID NO: 1831338 - RNA, 21 nt, Human
cucgugguaggacuguagaaa

SEQ ID NO: 1831339 - RNA, 15 nt, Human
cucuaucaccaagga

SEQ ID NO: 1831340 - RNA, 13 nt, Human
cucagucucccuc

SEQ ID NO: 1831341 - RNA, 17 nt, Human
cucagucucccucccuu

SEQ ID NO: 1831342 - RNA, 16 nt, Human
cucagucucccucccu

SEQ ID NO: 1831343 - RNA, 15 nt, Human
cucagucucccuccc

SEQ ID NO: 1831344 - RNA, 13 nt, Human
cuccacuuggucu

SEQ ID NO: 1831345 - RNA, 15 nt, Human
cuccacuuggucugu

SEQ ID NO: 1831346 - RNA, 17 nt, Human
cuccaagcucccaggca

SEQ ID NO: 1831347 - RNA, 16 nt, Human
cuccacuggauggagg

SEQ ID NO: 1831348 - RNA, 16 nt, Human
cuccacuuggucugug

SEQ ID NO: 1831349 - RNA, 17 nt, Human
cuccacuuggucuguga

SEQ ID NO: 1831350 - RNA, 21 nt, Human
cuccacuuggucugugagaug

SEQ ID NO: 1831351 - RNA, 22 nt, Human
cuccacuuggucugugagaugc

SEQ ID NO: 1831352 - RNA, 16 nt, Human
cuccaagcucccaggc

SEQ ID NO: 1831353 - RNA, 15 nt, Human
cuccaagcucccagg

SEQ ID NO: 1831354 - RNA, 14 nt, Human
cuccaagcucccag

SEQ ID NO: 1831355 - RNA, 13 nt, Human
cuccaagcuccca

SEQ ID NO: 1831356 - RNA, 14 nt, Human
cuccaagcuccauc

SEQ ID NO: 1831357 - RNA, 19 nt, Human
cuccaagcuccaucuccac

SEQ ID NO: 1831358 - RNA, 18 nt, Human
cuccaagcuccaucucca

SEQ ID NO: 1831359 - RNA, 24 nt, Human
cuccaagcaggacauggacaagga

SEQ ID NO: 1831360 - RNA, 22 nt, Human
cuccaagcaggacauggacaag

SEQ ID NO: 1831361 - RNA, 14 nt, Human
cuccaagcaggaca

SEQ ID NO: 1831362 - RNA, 13 nt, Human
cuccaagcaggac

SEQ ID NO: 1831363 - RNA, 22 nt, Human
cuccaagaccuucuccuucacc

SEQ ID NO: 1831364 - RNA, 15 nt, Human
cuccaagaccuucuc

SEQ ID NO: 1831365 - RNA, 12 nt, Human
cucaugccucag

SEQ ID NO: 1831366 - RNA, 16 nt, Human
cucaugccucagccuc

SEQ ID NO: 1831367 - RNA, 23 nt, Human
cuccacuuggucugugagaugcu

SEQ ID NO: 1831368 - RNA, 19 nt, Human
cuccacuuucuagccagag

SEQ ID NO: 1831369 - RNA, 16 nt, Human
cuccacuuucuagcca

SEQ ID NO: 1831370 - RNA, 20 nt, Human
cuccacuuucuagccagagg

SEQ ID NO: 1831371 - RNA, 16 nt, Human
cggagucccaccuugg

SEQ ID NO: 1831372 - RNA, 14 nt, Human
cggggacagcuccu

SEQ ID NO: 1831373 - RNA, 17 nt, Human
cgggcucugccucccau

SEQ ID NO: 1831374 - RNA, 18 nt, Human
cgguguggagaagcggcu

SEQ ID NO: 1831375 - RNA, 15 nt, Human
cggggacagcuccuu

SEQ ID NO: 1831376 - RNA, 16 nt, Human
cgggcucugccuccca

SEQ ID NO: 1831377 - RNA, 14 nt, Human
cgggcucugccucc

SEQ ID NO: 1831378 - RNA, 15 nt, Human
cgggcucagcaaaag

SEQ ID NO: 1831379 - RNA, 11 nt, Human
cgggcucagca

SEQ ID NO: 1831380 - RNA, 17 nt, Human
cgggccacagagaaagu

SEQ ID NO: 1831381 - RNA, 12 nt, Human
cgggccacagag

SEQ ID NO: 1831382 - RNA, 14 nt, Human
cgggccacagagaa

SEQ ID NO: 1831383 - RNA, 13 nt, Human
cggcuccaggcuc

SEQ ID NO: 1831384 - RNA, 14 nt, Human
cggcuccaggcucc

SEQ ID NO: 1831385 - RNA, 15 nt, Human
cggcuccaggcuccu

SEQ ID NO: 1831386 - RNA, 16 nt, Human
cggcuccaggcuccuu

SEQ ID NO: 1831387 - RNA, 18 nt, Human
cggagucccaccuuggcu

SEQ ID NO: 1831388 - RNA, 20 nt, Human
cggagucccaccuuggcugc

SEQ ID NO: 1831389 - RNA, 15 nt, Human
cggcucacugcagcc

SEQ ID NO: 1831390 - RNA, 14 nt, Human
cggcucacugcagc

SEQ ID NO: 1831391 - RNA, 16 nt, Human
cggcucacugcagccu

SEQ ID NO: 1831392 - RNA, 17 nt, Human
cggcucacugcagccuc

SEQ ID NO: 1831393 - RNA, 12 nt, Human
cggcuccaggcu

SEQ ID NO: 1831394 - RNA, 16 nt, Human
cgguuuuacugcagcu

SEQ ID NO: 1831395 - RNA, 23 nt, Human
cgguguuuaagacauuuuuggaa

SEQ ID NO: 1831396 - RNA, 14 nt, Human
cguaaaauuaagaa

SEQ ID NO: 1831397 - RNA, 16 nt, Human
cguaaagcuagaaaug

SEQ ID NO: 1831398 - RNA, 16 nt, Human
cgugaguccuggcaug

SEQ ID NO: 1831399 - RNA, 17 nt, Human
cgugaggccagagacac

SEQ ID NO: 1831400 - RNA, 17 nt, Human
cgugaguccuggcaugg

SEQ ID NO: 1831401 - RNA, 20 nt, Human
cguguaaccauggacccaau

SEQ ID NO: 1831402 - RNA, 18 nt, Human
cgugauuuugcuguagaa

SEQ ID NO: 1831403 - RNA, 14 nt, Human
cgugcacacaccag

SEQ ID NO: 1831404 - RNA, 14 nt, Human
cgauagugguggug

SEQ ID NO: 1831405 - RNA, 13 nt, Human
cgcaggcuggccc

SEQ ID NO: 1831406 - RNA, 22 nt, Human
cgcaggauucuuccucccuccc

SEQ ID NO: 1831407 - RNA, 13 nt, Human
cgccucugcauuc

SEQ ID NO: 1831408 - RNA, 17 nt, Human
cgccagauucuuuccug

SEQ ID NO: 1831409 - RNA, 17 nt, Human
cgacugcccggcagggu

SEQ ID NO: 1831410 - RNA, 17 nt, Human
cgacugccaucuuggac

SEQ ID NO: 1831411 - RNA, 20 nt, Human
cgacccuugccgucuaccug

SEQ ID NO: 1831412 - RNA, 19 nt, Human
cgacccuugccgucuaccu

SEQ ID NO: 1831413 - RNA, 12 nt, Human
cgacaaugcaaa

SEQ ID NO: 1831414 - RNA, 13 nt, Human
cgacaaugcaaac

SEQ ID NO: 1831415 - RNA, 14 nt, Human
cgacagccuggcac

SEQ ID NO: 1831416 - RNA, 13 nt, Human
cgacagccuggca

SEQ ID NO: 1831417 - RNA, 12 nt, Human
cgacagccuggc

SEQ ID NO: 1831418 - RNA, 21 nt, Human
ccuuuuuuagaguugauacua

SEQ ID NO: 1831419 - RNA, 16 nt, Human
ccuugccgucuaccug

SEQ ID NO: 1831420 - RNA, 17 nt, Human
ccuuuugagugccuuac

SEQ ID NO: 1831421 - RNA, 15 nt, Human
ccuuuugagugccuu

SEQ ID NO: 1831422 - RNA, 15 nt, Human
ccuuucacaaccuuc

SEQ ID NO: 1831423 - RNA, 21 nt, Human
ccuuucaauaggaaaaacuga

SEQ ID NO: 1831424 - RNA, 15 nt, Human
cuagccagaggagag

SEQ ID NO: 1831425 - RNA, 13 nt, Human
cuagccagaggag

SEQ ID NO: 1831426 - RNA, 12 nt, Human
cuagccagagga

SEQ ID NO: 1831427 - RNA, 23 nt, Human
cuaguuguuugauucagacagcu

SEQ ID NO: 1831428 - RNA, 22 nt, Human
cuaguuguuugauucagacagc

SEQ ID NO: 1831429 - RNA, 13 nt, Human
cuaguuugauuaa

SEQ ID NO: 1831430 - RNA, 15 nt, Human
cuaguuugauuaaau

SEQ ID NO: 1831431 - RNA, 22 nt, Human
cuaguuugauuaaauucuugca

SEQ ID NO: 1831432 - RNA, 21 nt, Human
cuaguuugauuaaauucuugc

SEQ ID NO: 1831433 - RNA, 18 nt, Human
cuaucaugucaaacguga

SEQ ID NO: 1831434 - RNA, 15 nt, Human
cuaucucccccagcc

SEQ ID NO: 1831435 - RNA, 14 nt, Human
cuaucuaaauguug

SEQ ID NO: 1831436 - RNA, 17 nt, Human
cuaucguaaaauuaaga

SEQ ID NO: 1831437 - RNA, 18 nt, Human
cuaucguaaaauuaagaa

SEQ ID NO: 1831438 - RNA, 17 nt, Human
cucaaaaaaagaaaaag

SEQ ID NO: 1831439 - RNA, 18 nt, Human
cucaaaagcugggcaggu

SEQ ID NO: 1831440 - RNA, 17 nt, Human
cuaucucccccagcccc

SEQ ID NO: 1831441 - RNA, 16 nt, Human
cuaucucccccagccc

SEQ ID NO: 1831442 - RNA, 18 nt, Human
cuaucucccccagcccca

SEQ ID NO: 1831443 - RNA, 11 nt, Human
cucacaaaaga

SEQ ID NO: 1831444 - RNA, 13 nt, Human
cucaaugcacuga

SEQ ID NO: 1831445 - RNA, 15 nt, Human
cucaaugcacugaca

SEQ ID NO: 1831446 - RNA, 14 nt, Human
cucaauaaaguaca

SEQ ID NO: 1831447 - RNA, 14 nt, Human
cucaaacuccugac

SEQ ID NO: 1831448 - RNA, 13 nt, Human
cucaaacuccuga

SEQ ID NO: 1831449 - RNA, 20 nt, Human
cucaaacucuugaccucagg

SEQ ID NO: 1831450 - RNA, 11 nt, Human
cgugugugugu

SEQ ID NO: 1831451 - RNA, 23 nt, Human
cuaaguuuuuauggcuuuugugc

SEQ ID NO: 1831452 - RNA, 21 nt, Human
cuaagugguacuaacuuuccu

SEQ ID NO: 1831453 - RNA, 20 nt, Human
cuaaguuuuuauggcuuuug

SEQ ID NO: 1831454 - RNA, 23 nt, Human
cuaagugauccucccaccucagc

SEQ ID NO: 1831455 - RNA, 19 nt, Human
cuacaguccucccaucuca

SEQ ID NO: 1831456 - RNA, 22 nt, Human
cuacaguugaaaaacagcugag

SEQ ID NO: 1831457 - RNA, 13 nt, Human
cuacaguguacag

SEQ ID NO: 1831458 - RNA, 14 nt, Human
cuacaguguacagu

SEQ ID NO: 1831459 - RNA, 21 nt, Human
cuacaguugaaaaacagcuga

SEQ ID NO: 1831460 - RNA, 19 nt, Human
cuacaguugaaaaacagcu

SEQ ID NO: 1831461 - RNA, 20 nt, Human
cuacaguccucccaucucac

SEQ ID NO: 1831462 - RNA, 20 nt, Human
cuacaugagguacugagagu

SEQ ID NO: 1831463 - RNA, 18 nt, Human
cuacaugagguacugaga

SEQ ID NO: 1831464 - RNA, 17 nt, Human
cuacguuaccaggcagg

SEQ ID NO: 1831465 - RNA, 17 nt, Human
cuaccuuuguauucucu

SEQ ID NO: 1831466 - RNA, 12 nt, Human
cuagaacucccu

SEQ ID NO: 1831467 - RNA, 13 nt, Human
cuagaacucccuu

SEQ ID NO: 1831468 - RNA, 22 nt, Human
cuagaagauuuugaaauuuuua

SEQ ID NO: 1831469 - RNA, 21 nt, Human
cuagcauacguacacauuuua

SEQ ID NO: 1831470 - RNA, 23 nt, Human
cuagcauacguacacauuuuauu

SEQ ID NO: 1831471 - RNA, 11 nt, Human
ccucuuucccu

SEQ ID NO: 1831472 - RNA, 19 nt, Human
ccugccucgaacuggcugc

SEQ ID NO: 1831473 - RNA, 19 nt, Human
ccugcugcaguugccaguc

SEQ ID NO: 1831474 - RNA, 17 nt, Human
ccugcugcaguugccag

SEQ ID NO: 1831475 - RNA, 21 nt, Human
ccugccucgaacuggcugcaa

SEQ ID NO: 1831476 - RNA, 23 nt, Human
ccugccucgaacuggcugcaaag

SEQ ID NO: 1831477 - RNA, 20 nt, Human
ccugcugcaguugccaguca

SEQ ID NO: 1831478 - RNA, 21 nt, Human
ccugcugcaguugccagucac

SEQ ID NO: 1831479 - RNA, 20 nt, Human
ccugcccaccuggccucugc

SEQ ID NO: 1831480 - RNA, 14 nt, Human
ccugcccaccuggc

SEQ ID NO: 1831481 - RNA, 13 nt, Human
ccugcccaccugg

SEQ ID NO: 1831482 - RNA, 12 nt, Human
ccugcccaccug

SEQ ID NO: 1831483 - RNA, 13 nt, Human
ccugcccaggccc

SEQ ID NO: 1831484 - RNA, 17 nt, Human
ccugccccagggcuccc

SEQ ID NO: 1831485 - RNA, 13 nt, Human
ccucuuucccucc

SEQ ID NO: 1831486 - RNA, 16 nt, Human
ccucuuucccucccuu

SEQ ID NO: 1831487 - RNA, 21 nt, Human
ccugaguagcugggauuacag

SEQ ID NO: 1831488 - RNA, 16 nt, Human
ccugcacuugcagacu

SEQ ID NO: 1831489 - RNA, 17 nt, Human
ccugcacuugcagacuc

SEQ ID NO: 1831490 - RNA, 18 nt, Human
ccugcacuugcagacucu

SEQ ID NO: 1831491 - RNA, 19 nt, Human
ccugcacuugcagacucua

SEQ ID NO: 1831492 - RNA, 21 nt, Human
ccuggccucugcacuccccug

SEQ ID NO: 1831493 - RNA, 20 nt, Human
ccuggccucugcacuccccu

SEQ ID NO: 1831494 - RNA, 22 nt, Human
ccuggccuagcauacguacaca

SEQ ID NO: 1831495 - RNA, 22 nt, Human
ccuggccucugcacuccccugc

SEQ ID NO: 1831496 - RNA, 20 nt, Human
ccugggccccaguuguauuu

SEQ ID NO: 1831497 - RNA, 15 nt, Human
ccuguaaucacagcu

SEQ ID NO: 1831498 - RNA, 17 nt, Human
ccuguccugccuaaggc

SEQ ID NO: 1831499 - RNA, 19 nt, Human
ccuguccugccuaaggcug

SEQ ID NO: 1831500 - RNA, 15 nt, Human
ccugguuuccugccc

SEQ ID NO: 1831501 - RNA, 14 nt, Human
ccugguuuccugcc

SEQ ID NO: 1831502 - RNA, 13 nt, Human
ccugguuuccugc

SEQ ID NO: 1831503 - RNA, 18 nt, Human
ccugggggcugggcagag

SEQ ID NO: 1831504 - RNA, 21 nt, Human
ccugguggcagugggagcugc

SEQ ID NO: 1831505 - RNA, 18 nt, Human
ccugugacuucagcucug

SEQ ID NO: 1831506 - RNA, 17 nt, Human
ccugugaacugaacucu

SEQ ID NO: 1831507 - RNA, 16 nt, Human
ccugugaacugaacuc

SEQ ID NO: 1831508 - RNA, 22 nt, Human
ccugucuaaugaaaccuguguc

SEQ ID NO: 1831509 - RNA, 15 nt, Human
ccugucuaaugaaac

SEQ ID NO: 1831510 - RNA, 23 nt, Human
cccugucucaaaaaaagaaaaag

SEQ ID NO: 1831511 - RNA, 20 nt, Human
cccugucucaaaaaaagaaa

SEQ ID NO: 1831512 - RNA, 16 nt, Human
cccugucuaaugaaac

SEQ ID NO: 1831513 - RNA, 17 nt, Human
cccugugauggggcccu

SEQ ID NO: 1831514 - RNA, 19 nt, Human
cccugugauggggcccugc

SEQ ID NO: 1831515 - RNA, 18 nt, Human
cccugugauggggcccug

SEQ ID NO: 1831516 - RNA, 20 nt, Human
cccugugauggggcccugcc

SEQ ID NO: 1831517 - RNA, 13 nt, Human
cccuucgcuccug

SEQ ID NO: 1831518 - RNA, 13 nt, Human
ccggccccugcug

SEQ ID NO: 1831519 - RNA, 23 nt, Human
ccgcaggauuugggcucuuggaa

SEQ ID NO: 1831520 - RNA, 22 nt, Human
cccuucucuccagccccuggau

SEQ ID NO: 1831521 - RNA, 21 nt, Human
cccuucucuccagccccugga

SEQ ID NO: 1831522 - RNA, 14 nt, Human
cccuucgcuccugu

SEQ ID NO: 1831523 - RNA, 15 nt, Human
cccuucgcuccugug

SEQ ID NO: 1831524 - RNA, 14 nt, Human
ccggccccugcugg

SEQ ID NO: 1831525 - RNA, 13 nt, Human
ccucccaucucac

SEQ ID NO: 1831526 - RNA, 16 nt, Human
ccucccaucucacaca

SEQ ID NO: 1831527 - RNA, 23 nt, Human
ccucauuuuugaauacaggcaua

SEQ ID NO: 1831528 - RNA, 15 nt, Human
ccucccaccucagcc

SEQ ID NO: 1831529 - RNA, 17 nt, Human
ccucccaccucagccuc

SEQ ID NO: 1831530 - RNA, 13 nt, Human
cccucagagccac

SEQ ID NO: 1831531 - RNA, 17 nt, Human
ccccuucugacccaugc

SEQ ID NO: 1831532 - RNA, 22 nt, Human
cccuauccuacuuccccuuccu

SEQ ID NO: 1831533 - RNA, 12 nt, Human
cccgggaagggg

SEQ ID NO: 1831534 - RNA, 13 nt, Human
cccggcugcccuu

SEQ ID NO: 1831535 - RNA, 12 nt, Human
cccggcugcccu

SEQ ID NO: 1831536 - RNA, 12 nt, Human
cccggcugcgga

SEQ ID NO: 1831537 - RNA, 15 nt, Human
ccccauucugccugc

SEQ ID NO: 1831538 - RNA, 13 nt, Human
ccccauucugccu

SEQ ID NO: 1831539 - RNA, 14 nt, Human
ccccauucugccug

SEQ ID NO: 1831540 - RNA, 18 nt, Human
ccccugcacuccagccug

SEQ ID NO: 1831541 - RNA, 17 nt, Human
ccccugcaaagcccagc

SEQ ID NO: 1831542 - RNA, 16 nt, Human
ccccugcaaagcccag

SEQ ID NO: 1831543 - RNA, 15 nt, Human
ccccugcaaagccca

SEQ ID NO: 1831544 - RNA, 19 nt, Human
ccccuucgcuccugugucu

SEQ ID NO: 1831545 - RNA, 14 nt, Human
ccccuucgcuccug

SEQ ID NO: 1831546 - RNA, 15 nt, Human
ccccuucgcuccugu

SEQ ID NO: 1831547 - RNA, 17 nt, Human
ccccuucgcuccugugu

SEQ ID NO: 1831548 - RNA, 13 nt, Human
cccaguuguauuu

SEQ ID NO: 1831549 - RNA, 23 nt, Human
cccauaauuuuuuuuuuccuuuu

SEQ ID NO: 1831550 - RNA, 22 nt, Human
cccauaauuuuuuuuuuccuuu

SEQ ID NO: 1831551 - RNA, 23 nt, Human
cccauucugccugcccaggcccc

SEQ ID NO: 1831552 - RNA, 21 nt, Human
ccccagauugcaacaggcugg

SEQ ID NO: 1831553 - RNA, 22 nt, Human
ccccagauugcaacaggcuggg

SEQ ID NO: 1831554 - RNA, 23 nt, Human
ccccagauugcaacaggcugggc

SEQ ID NO: 1831555 - RNA, 17 nt, Human
ccccagcaagugagagc

SEQ ID NO: 1831556 - RNA, 21 nt, Human
ccccauccucuguacagagcc

SEQ ID NO: 1831557 - RNA, 19 nt, Human
ccccauccucuguacagag

SEQ ID NO: 1831558 - RNA, 22 nt, Human
ccccauccucuguacagagccc

SEQ ID NO: 1831559 - RNA, 19 nt, Human
ccccagcaagugagagcug

SEQ ID NO: 1831560 - RNA, 20 nt, Human
ccccagcaagugagagcugg

SEQ ID NO: 1831561 - RNA, 17 nt, Human
ccccauccucuguacag

SEQ ID NO: 1831562 - RNA, 21 nt, Human
ccccagcaagugagagcuggg

SEQ ID NO: 1831563 - RNA, 20 nt, Human
cccauucugccugcccaggc

SEQ ID NO: 1831564 - RNA, 21 nt, Human
cccauucugccugcccaggcc

SEQ ID NO: 1831565 - RNA, 22 nt, Human
cccauucugccugcccaggccc

SEQ ID NO: 1831566 - RNA, 17 nt, Human
cccagcccacuucugcc

SEQ ID NO: 1831567 - RNA, 14 nt, Human
cccagcccacuucu

SEQ ID NO: 1831568 - RNA, 21 nt, Human
cccaggcuggcgugcaguggu

SEQ ID NO: 1831569 - RNA, 20 nt, Human
cccaggcuuagucacugaga

SEQ ID NO: 1831570 - RNA, 15 nt, Human
cccaggcuuagucac

SEQ ID NO: 1831571 - RNA, 22 nt, Human
cccaggaaaggcuccaggagca

SEQ ID NO: 1831572 - RNA, 21 nt, Human
cccaggaaaggcuccaggagc

SEQ ID NO: 1831573 - RNA, 23 nt, Human
cccaggaaaggcuccaggagcag

SEQ ID NO: 1831574 - RNA, 19 nt, Human
cccaggaaaggcuccagga

SEQ ID NO: 1831575 - RNA, 22 nt, Human
cccagcuuaaaggggcuagagu

SEQ ID NO: 1831576 - RNA, 11 nt, Human
cccagcuguuu

SEQ ID NO: 1831577 - RNA, 21 nt, Human
cccagcugugcucuggacagg

SEQ ID NO: 1831578 - RNA, 23 nt, Human
cccagcugugcucuggacaggca

SEQ ID NO: 1831579 - RNA, 19 nt, Human
ccagcagagcaccuuagac

SEQ ID NO: 1831580 - RNA, 23 nt, Human
ccagcagagcaccuuagacaguc

SEQ ID NO: 1831581 - RNA, 21 nt, Human
ccagccccuggaugcagccuc

SEQ ID NO: 1831582 - RNA, 10 nt, Human
ccagccccuu

SEQ ID NO: 1831583 - RNA, 14 nt, Human
ccagcagccuggac

SEQ ID NO: 1831584 - RNA, 15 nt, Human
ccagcagccuggacc

SEQ ID NO: 1831585 - RNA, 20 nt, Human
ccagcagccuggacccugug

SEQ ID NO: 1831586 - RNA, 19 nt, Human
ccagcagccuggacccugu

SEQ ID NO: 1831587 - RNA, 23 nt, Human
ccaggaaaggcuccaggagcagc

SEQ ID NO: 1831588 - RNA, 22 nt, Human
ccaggaaaggcuccaggagcag

SEQ ID NO: 1831589 - RNA, 21 nt, Human
ccaggaaaggcuccaggagca

SEQ ID NO: 1831590 - RNA, 18 nt, Human
ccagcuugaaaccuucac

SEQ ID NO: 1831591 - RNA, 22 nt, Human
ccaggcugggagagccuuccag

SEQ ID NO: 1831592 - RNA, 21 nt, Human
ccaggcugggagagccuucca

SEQ ID NO: 1831593 - RNA, 18 nt, Human
ccaggcugggagagccuu

SEQ ID NO: 1831594 - RNA, 17 nt, Human
ccaggcugggagagccu

SEQ ID NO: 1831595 - RNA, 15 nt, Human
ccaggcugggagagc

SEQ ID NO: 1831596 - RNA, 22 nt, Human
ccaggauguacaaggacagccc

SEQ ID NO: 1831597 - RNA, 14 nt, Human
ccaggcugggagag

SEQ ID NO: 1831598 - RNA, 13 nt, Human
ccaggcugggaga

SEQ ID NO: 1831599 - RNA, 17 nt, Human
ccaggcaacuugggaac

SEQ ID NO: 1831600 - RNA, 14 nt, Human
ccagucccccugcc

SEQ ID NO: 1831601 - RNA, 21 nt, Human
ccagucaccccggccaccugc

SEQ ID NO: 1831602 - RNA, 20 nt, Human
ccagucaccccggccaccug

SEQ ID NO: 1831603 - RNA, 13 nt, Human
ccagucaccccgg

SEQ ID NO: 1831604 - RNA, 12 nt, Human
ccagucaccccg

SEQ ID NO: 1831605 - RNA, 17 nt, Human
ccaugggccuccugugu

SEQ ID NO: 1831606 - RNA, 14 nt, Human
ccaugggccuccug

SEQ ID NO: 1831607 - RNA, 15 nt, Human
ccaugggccuccugu

SEQ ID NO: 1831608 - RNA, 22 nt, Human
ccauccccuguagagugggagc

SEQ ID NO: 1831609 - RNA, 16 nt, Human
ccauccccuguagagu

SEQ ID NO: 1831610 - RNA, 14 nt, Human
ccaugagccucagc

SEQ ID NO: 1831611 - RNA, 18 nt, Human
ccaugagccucagcaucc

SEQ ID NO: 1831612 - RNA, 13 nt, Human
ccaugaguccccu

SEQ ID NO: 1831613 - RNA, 19 nt, Human
ccaugagccucagcauccu

SEQ ID NO: 1831614 - RNA, 15 nt, Human
ccaugaguccccugu

SEQ ID NO: 1831615 - RNA, 14 nt, Human
ccaugaguccccug

SEQ ID NO: 1831616 - RNA, 16 nt, Human
ccaugaguccccuguu

SEQ ID NO: 1831617 - RNA, 13 nt, Human
ccaugggccuccu

SEQ ID NO: 1831618 - RNA, 12 nt, Human
ccaucccagccc

SEQ ID NO: 1831619 - RNA, 23 nt, Human
ccaucccaaacccuucagugcca

SEQ ID NO: 1831620 - RNA, 20 nt, Human
ccauaauuuuuuuuuuccuu

SEQ ID NO: 1831621 - RNA, 12 nt, Human
auuucuguuuag

SEQ ID NO: 1831622 - RNA, 14 nt, Human
auuucuguuuagau

SEQ ID NO: 1831623 - RNA, 16 nt, Human
auuucuguuuagauaa

SEQ ID NO: 1831624 - RNA, 14 nt, Human
auuuaaugaaagac

SEQ ID NO: 1831625 - RNA, 15 nt, Human
auuucagauuuguga

SEQ ID NO: 1831626 - RNA, 16 nt, Human
auuucagcagcugcag

SEQ ID NO: 1831627 - RNA, 13 nt, Human
auuguacaguuuu

SEQ ID NO: 1831628 - RNA, 19 nt, Human
auuguucuuaguuugcagu

SEQ ID NO: 1831629 - RNA, 18 nt, Human
auugaugggauuugguca

SEQ ID NO: 1831630 - RNA, 13 nt, Human
auuguaaaauggu

SEQ ID NO: 1831631 - RNA, 22 nt, Human
auugauccagaaagaaaacuug

SEQ ID NO: 1831632 - RNA, 19 nt, Human
auugauccagaaagaaaac

SEQ ID NO: 1831633 - RNA, 18 nt, Human
auugauccagaaagaaaa

SEQ ID NO: 1831634 - RNA, 15 nt, Human
auuguaaggaaugau

SEQ ID NO: 1831635 - RNA, 18 nt, Human
auuguaagcaugcacaaa

SEQ ID NO: 1831636 - RNA, 16 nt, Human
auuguaaggaaugauu

SEQ ID NO: 1831637 - RNA, 17 nt, Human
auugauccagaaagaaa

SEQ ID NO: 1831638 - RNA, 16 nt, Human
auugauccagaaagaa

SEQ ID NO: 1831639 - RNA, 22 nt, Human
auucuuuccugaggcugggcuc

SEQ ID NO: 1831640 - RNA, 17 nt, Human
auucuuuccugaggcug

SEQ ID NO: 1831641 - RNA, 21 nt, Human
auuccugaugcuucuucagag

SEQ ID NO: 1831642 - RNA, 19 nt, Human
auucucuccuguaccucuu

SEQ ID NO: 1831643 - RNA, 21 nt, Human
auucucuccuguaccucuuga

SEQ ID NO: 1831644 - RNA, 17 nt, Human
auucuugccaaauauaa

SEQ ID NO: 1831645 - RNA, 19 nt, Human
auucauauuuacuucuuau

SEQ ID NO: 1831646 - RNA, 18 nt, Human
auucauauuuacuucuua

SEQ ID NO: 1831647 - RNA, 20 nt, Human
auucauauuuacuucuuaua

SEQ ID NO: 1831648 - RNA, 15 nt, Human
auuauguguguuuua

SEQ ID NO: 1831649 - RNA, 21 nt, Human
auuauguguguuuuaaaauga

SEQ ID NO: 1831650 - RNA, 20 nt, Human
auuauguguguuuuaaaaug

SEQ ID NO: 1831651 - RNA, 20 nt, Human
auuaaauucuugcaaaguau

SEQ ID NO: 1831652 - RNA, 14 nt, Human
auuaaauucuugca

SEQ ID NO: 1831653 - RNA, 18 nt, Human
auuaaauucuugcaaagu

SEQ ID NO: 1831654 - RNA, 18 nt, Human
auucacaagacccaaaag

SEQ ID NO: 1831655 - RNA, 20 nt, Human
caacaccuuguuucccucuc

SEQ ID NO: 1831656 - RNA, 22 nt, Human
caacaccucugcacaagcugca

SEQ ID NO: 1831657 - RNA, 21 nt, Human
caaaguacacuguuucaaacu

SEQ ID NO: 1831658 - RNA, 16 nt, Human
caaaguacacuguuuc

SEQ ID NO: 1831659 - RNA, 20 nt, Human
caaaguacacuguuucaaac

SEQ ID NO: 1831660 - RNA, 14 nt, Human
caaagaugcagccg

SEQ ID NO: 1831661 - RNA, 13 nt, Human
caaagaugcagcc

SEQ ID NO: 1831662 - RNA, 17 nt, Human
caaaucagcugcuacua

SEQ ID NO: 1831663 - RNA, 22 nt, Human
caaauccagccugcugccugcu

SEQ ID NO: 1831664 - RNA, 21 nt, Human
caaaucugcuuuuuaaagaau

SEQ ID NO: 1831665 - RNA, 13 nt, Human
caaaugcagcuuu

SEQ ID NO: 1831666 - RNA, 23 nt, Human
caacaaaccuguuucugcagcca

SEQ ID NO: 1831667 - RNA, 18 nt, Human
caaccacugcgaccacaa

SEQ ID NO: 1831668 - RNA, 13 nt, Human
caagacacaguga

SEQ ID NO: 1831669 - RNA, 19 nt, Human
caagacccuugugguccca

SEQ ID NO: 1831670 - RNA, 18 nt, Human
caagacccuugugguccc

SEQ ID NO: 1831671 - RNA, 22 nt, Human
caagacccuuguggucccaccc

SEQ ID NO: 1831672 - RNA, 15 nt, Human
caacucaccccagcc

SEQ ID NO: 1831673 - RNA, 13 nt, Human
caacucaccccag

SEQ ID NO: 1831674 - RNA, 16 nt, Human
caacucaccccagccc

SEQ ID NO: 1831675 - RNA, 17 nt, Human
caacucaccccagcccc

SEQ ID NO: 1831676 - RNA, 19 nt, Human
caacccaaauguucaucaa

SEQ ID NO: 1831677 - RNA, 14 nt, Human
caaccauuccccau

SEQ ID NO: 1831678 - RNA, 17 nt, Human
caacuaugauuuggaaa

SEQ ID NO: 1831679 - RNA, 22 nt, Human
caacuaugauuuggaaaauaaa

SEQ ID NO: 1831680 - RNA, 19 nt, Human
caacuaugauuuggaaaau

SEQ ID NO: 1831681 - RNA, 18 nt, Human
caacuaugauuuggaaaa

SEQ ID NO: 1831682 - RNA, 15 nt, Human
caacccccagccugc

SEQ ID NO: 1831683 - RNA, 16 nt, Human
caacccccagccugcu

SEQ ID NO: 1831684 - RNA, 17 nt, Human
caacccccagccugcua

SEQ ID NO: 1831685 - RNA, 15 nt, Human
caaaagcugggcagg

SEQ ID NO: 1831686 - RNA, 19 nt, Human
caaaagcugggcagguugg

SEQ ID NO: 1831687 - RNA, 13 nt, Human
auuuuuaagugcu

SEQ ID NO: 1831688 - RNA, 16 nt, Human
auuuuuuuuuccuuca

SEQ ID NO: 1831689 - RNA, 13 nt, Human
auuuuuuuuuccu

SEQ ID NO: 1831690 - RNA, 12 nt, Human
auuuuuuuuucc

SEQ ID NO: 1831691 - RNA, 17 nt, Human
auuuuuuuuuccuucag

SEQ ID NO: 1831692 - RNA, 20 nt, Human
auuuuuaaagaaaaguuuug

SEQ ID NO: 1831693 - RNA, 13 nt, Human
auuuuuaaagaaa

SEQ ID NO: 1831694 - RNA, 13 nt, Human
auuuguuugaacu

SEQ ID NO: 1831695 - RNA, 20 nt, Human
auuuguuugaacugauaaag

SEQ ID NO: 1831696 - RNA, 14 nt, Human
auuuguuugaacug

SEQ ID NO: 1831697 - RNA, 16 nt, Human
auuuguuugaacugau

SEQ ID NO: 1831698 - RNA, 18 nt, Human
auuuugauccaagcuggu

SEQ ID NO: 1831699 - RNA, 16 nt, Human
cacagcuaacauggaa

SEQ ID NO: 1831700 - RNA, 15 nt, Human
cacagcuaacaugga

SEQ ID NO: 1831701 - RNA, 22 nt, Human
cacagacccugcccugugggcc

SEQ ID NO: 1831702 - RNA, 18 nt, Human
cacagacauacuaaccag

SEQ ID NO: 1831703 - RNA, 21 nt, Human
cacagacccugcccugugggc

SEQ ID NO: 1831704 - RNA, 20 nt, Human
cacagacccugcccuguggg

SEQ ID NO: 1831705 - RNA, 19 nt, Human
cacagacccugcccugugg

SEQ ID NO: 1831706 - RNA, 22 nt, Human
cacagcuaacauggaaguacua

SEQ ID NO: 1831707 - RNA, 20 nt, Human
cacagcucuguccugggagu

SEQ ID NO: 1831708 - RNA, 23 nt, Human
cacagcucuguccugggagugag

SEQ ID NO: 1831709 - RNA, 10 nt, Human
cacagcucuu

SEQ ID NO: 1831710 - RNA, 16 nt, Human
cacaguauuacuucug

SEQ ID NO: 1831711 - RNA, 18 nt, Human
cacaguauuacuucugcu

SEQ ID NO: 1831712 - RNA, 19 nt, Human
cacaguauuacuucugcua

SEQ ID NO: 1831713 - RNA, 16 nt, Human
cacccagcccacuucu

SEQ ID NO: 1831714 - RNA, 17 nt, Human
cacccagcccacuucug

SEQ ID NO: 1831715 - RNA, 12 nt, Human
caccagcagccu

SEQ ID NO: 1831716 - RNA, 14 nt, Human
caccagcagccugg

SEQ ID NO: 1831717 - RNA, 23 nt, Human
caccaacauacucccaucuguga

SEQ ID NO: 1831718 - RNA, 15 nt, Human
caccagcagccugga

SEQ ID NO: 1831719 - RNA, 21 nt, Human
caccagcccuuagcagggaaa

SEQ ID NO: 1831720 - RNA, 24 nt, Human
cacccaggagccccgaggccuucu

SEQ ID NO: 1831721 - RNA, 19 nt, Human
cacccagcccacuucugcc

SEQ ID NO: 1831722 - RNA, 20 nt, Human
cacccaggagccccgaggcc

SEQ ID NO: 1831723 - RNA, 23 nt, Human
cacccaggagccccgaggccuuc

SEQ ID NO: 1831724 - RNA, 21 nt, Human
caccaacauacucccaucugu

SEQ ID NO: 1831725 - RNA, 20 nt, Human
caccaacauacucccaucug

SEQ ID NO: 1831726 - RNA, 18 nt, Human
cacauuuuucagauauaa

SEQ ID NO: 1831727 - RNA, 13 nt, Human
cacauuuuucuua

SEQ ID NO: 1831728 - RNA, 14 nt, Human
cacauuuuucuuag

SEQ ID NO: 1831729 - RNA, 17 nt, Human
cacauuuuuuaaaugca

SEQ ID NO: 1831730 - RNA, 21 nt, Human
cacauuuuuuaaaugcaccug

SEQ ID NO: 1831731 - RNA, 15 nt, Human
cacauuuuauuuuau

SEQ ID NO: 1831732 - RNA, 14 nt, Human
cacauuuuucagau

SEQ ID NO: 1831733 - RNA, 19 nt, Human
cacaucuugcucugcugac

SEQ ID NO: 1831734 - RNA, 18 nt, Human
cacaucuugcucugcuga

SEQ ID NO: 1831735 - RNA, 20 nt, Human
cacaucagcacgauuucugu

SEQ ID NO: 1831736 - RNA, 21 nt, Human
cacaucagcacgauuucuguu

SEQ ID NO: 1831737 - RNA, 22 nt, Human
cacaucagcacgauuucuguuu

SEQ ID NO: 1831738 - RNA, 16 nt, Human
cacaucuugcucugcu

SEQ ID NO: 1831739 - RNA, 17 nt, Human
cacaucuugcucugcug

SEQ ID NO: 1831740 - RNA, 22 nt, Human
caaugcugugcccuaaagugua

SEQ ID NO: 1831741 - RNA, 17 nt, Human
caauucuccugccucag

SEQ ID NO: 1831742 - RNA, 19 nt, Human
caauucuccugccucagcc

SEQ ID NO: 1831743 - RNA, 22 nt, Human
caaugcuggcuguuggcugggg

SEQ ID NO: 1831744 - RNA, 23 nt, Human
caaugcuggcuguuggcuggggg

SEQ ID NO: 1831745 - RNA, 14 nt, Human
cacaagccuucggc

SEQ ID NO: 1831746 - RNA, 16 nt, Human
cacaagacccuugugg

SEQ ID NO: 1831747 - RNA, 14 nt, Human
cacaagacccuugu

SEQ ID NO: 1831748 - RNA, 12 nt, Human
caauuuaaaaaa

SEQ ID NO: 1831749 - RNA, 22 nt, Human
caaguaauccaccugccucggc

SEQ ID NO: 1831750 - RNA, 13 nt, Human
caaguauuauacc

SEQ ID NO: 1831751 - RNA, 15 nt, Human
caccuuuguccccac

SEQ ID NO: 1831752 - RNA, 14 nt, Human
caccuuugucccca

SEQ ID NO: 1831753 - RNA, 17 nt, Human
caccuuuguccccaccg

SEQ ID NO: 1831754 - RNA, 14 nt, Human
caccuuugaagaag

SEQ ID NO: 1831755 - RNA, 14 nt, Human
caccuuuauucugg

SEQ ID NO: 1831756 - RNA, 17 nt, Human
caccugccagggacaga

SEQ ID NO: 1831757 - RNA, 19 nt, Human
caccuugacagggcacacc

SEQ ID NO: 1831758 - RNA, 14 nt, Human
caccuuggcucaag

SEQ ID NO: 1831759 - RNA, 13 nt, Human
caccuuggcucaa

SEQ ID NO: 1831760 - RNA, 20 nt, Human
caccuaccaccacgcccggc

SEQ ID NO: 1831761 - RNA, 16 nt, Human
caccugccagggacag

SEQ ID NO: 1831762 - RNA, 14 nt, Human
caccugccagggac

SEQ ID NO: 1831763 - RNA, 21 nt, Human
caccuacaugagguacugaga

SEQ ID NO: 1831764 - RNA, 17 nt, Human
cacucuugaaaaaugca

SEQ ID NO: 1831765 - RNA, 17 nt, Human
cacucuuauugcccacg

SEQ ID NO: 1831766 - RNA, 18 nt, Human
cacucuuauugcccacgc

SEQ ID NO: 1831767 - RNA, 19 nt, Human
cacucuuauugcccacgcu

SEQ ID NO: 1831768 - RNA, 14 nt, Human
cacggccaggccag

SEQ ID NO: 1831769 - RNA, 15 nt, Human
cacggccaggccaga

SEQ ID NO: 1831770 - RNA, 16 nt, Human
cacggccaggccagag

SEQ ID NO: 1831771 - RNA, 20 nt, Human
cacggagggugacgggggug

SEQ ID NO: 1831772 - RNA, 23 nt, Human
cacuacggaauaguuggcuagga

SEQ ID NO: 1831773 - RNA, 15 nt, Human
cagaacacauaauuc

SEQ ID NO: 1831774 - RNA, 17 nt, Human
cagaaauguguuaucac

SEQ ID NO: 1831775 - RNA, 22 nt, Human
cagaauauuagugaccucagcu

SEQ ID NO: 1831776 - RNA, 21 nt, Human
cagaaguuucugccgcagccc

SEQ ID NO: 1831777 - RNA, 20 nt, Human
cagaaguuucugccgcagcc

SEQ ID NO: 1831778 - RNA, 22 nt, Human
cagaaguuucugccgcagcccu

SEQ ID NO: 1831779 - RNA, 22 nt, Human
cacugggcuuggggaccagagc

SEQ ID NO: 1831780 - RNA, 23 nt, Human
cacugggcuuggggaccagagcu

SEQ ID NO: 1831781 - RNA, 17 nt, Human
cacuggugacaugucuu

SEQ ID NO: 1831782 - RNA, 22 nt, Human
cacugguggcccgacagccugg

SEQ ID NO: 1831783 - RNA, 21 nt, Human
cacugguggcccgacagccug

SEQ ID NO: 1831784 - RNA, 13 nt, Human
cacugguggcccg

SEQ ID NO: 1831785 - RNA, 15 nt, Human
cacuguugcccaggc

SEQ ID NO: 1831786 - RNA, 16 nt, Human
cacuguugcccaggcu

SEQ ID NO: 1831787 - RNA, 17 nt, Human
cacuuggucugugagau

SEQ ID NO: 1831788 - RNA, 20 nt, Human
cacuuggucugugagaugcu

SEQ ID NO: 1831789 - RNA, 20 nt, Human
cacuuagaaauugcauuucc

SEQ ID NO: 1831790 - RNA, 19 nt, Human
cacuuagaaauugcauuuc

SEQ ID NO: 1831791 - RNA, 17 nt, Human
cacuuagaaauugcauu

SEQ ID NO: 1831792 - RNA, 19 nt, Human
cacuguuucaaacuuuacu

SEQ ID NO: 1831793 - RNA, 17 nt, Human
cacuguugcccaggcug

SEQ ID NO: 1831794 - RNA, 15 nt, Human
caggccacuugauga

SEQ ID NO: 1831795 - RNA, 18 nt, Human
caggcagauacaggaaaa

SEQ ID NO: 1831796 - RNA, 13 nt, Human
caggccagaggga

SEQ ID NO: 1831797 - RNA, 15 nt, Human
caggccagagggagu

SEQ ID NO: 1831798 - RNA, 23 nt, Human
caggccagcugcuugggcuucau

SEQ ID NO: 1831799 - RNA, 21 nt, Human
caggccagcugcuugggcuuc

SEQ ID NO: 1831800 - RNA, 19 nt, Human
caggccagcugcuugggcu

SEQ ID NO: 1831801 - RNA, 17 nt, Human
caggccagcugcuuggg

SEQ ID NO: 1831802 - RNA, 18 nt, Human
caggccaggcccucugcc

SEQ ID NO: 1831803 - RNA, 17 nt, Human
caggccaggcccucugc

SEQ ID NO: 1831804 - RNA, 19 nt, Human
caggccaggcccucugccc

SEQ ID NO: 1831805 - RNA, 20 nt, Human
caggccaggcccucugccca

SEQ ID NO: 1831806 - RNA, 16 nt, Human
caggccagagggagug

SEQ ID NO: 1831807 - RNA, 19 nt, Human
caggggaaaaucagccugc

SEQ ID NO: 1831808 - RNA, 20 nt, Human
caggggaaaaucagccugcu

SEQ ID NO: 1831809 - RNA, 21 nt, Human
cagggcucagcggggacagcu

SEQ ID NO: 1831810 - RNA, 23 nt, Human
cagggcucagcggggacagcucc

SEQ ID NO: 1831811 - RNA, 21 nt, Human
caggcugggcuucaguggcag

SEQ ID NO: 1831812 - RNA, 22 nt, Human
caggcugggcuucaguggcagc

SEQ ID NO: 1831813 - RNA, 14 nt, Human
caggcugggagagc

SEQ ID NO: 1831814 - RNA, 12 nt, Human
caggcugggaga

SEQ ID NO: 1831815 - RNA, 15 nt, Human
caggcugggagagcc

SEQ ID NO: 1831816 - RNA, 20 nt, Human
caggcugggcuucaguggca

SEQ ID NO: 1831817 - RNA, 20 nt, Human
caguggggaggggcuguggg

SEQ ID NO: 1831818 - RNA, 18 nt, Human
caguggugguuuucuguu

SEQ ID NO: 1831819 - RNA, 21 nt, Human
caguggugcgaucuggguuca

SEQ ID NO: 1831820 - RNA, 17 nt, Human
cagugcaugcugucccu

SEQ ID NO: 1831821 - RNA, 16 nt, Human
cagugcaugcuguccc

SEQ ID NO: 1831822 - RNA, 13 nt, Human
cagugcccacagg

SEQ ID NO: 1831823 - RNA, 15 nt, Human
cagugcccacaggau

SEQ ID NO: 1831824 - RNA, 17 nt, Human
cagugcccacaggauca

SEQ ID NO: 1831825 - RNA, 20 nt, Human
cagugggagcugccuguuca

SEQ ID NO: 1831826 - RNA, 23 nt, Human
cagugggagcugccuguucagcu

SEQ ID NO: 1831827 - RNA, 18 nt, Human
cagugcccacaggaucag

SEQ ID NO: 1831828 - RNA, 14 nt, Human
cagugcaugcuguc

SEQ ID NO: 1831829 - RNA, 13 nt, Human
cagugcaugcugu

SEQ ID NO: 1831830 - RNA, 18 nt, Human
cagugcaucucagcccac

SEQ ID NO: 1831831 - RNA, 17 nt, Human
cagugcaucucagccca

SEQ ID NO: 1831832 - RNA, 16 nt, Human
cagugcaucucagccc

SEQ ID NO: 1831833 - RNA, 15 nt, Human
cagugcaucucagcc

SEQ ID NO: 1831834 - RNA, 15 nt, Human
cagucuggaaugcag

SEQ ID NO: 1831835 - RNA, 17 nt, Human
cagucuggaaugcagug

SEQ ID NO: 1831836 - RNA, 12 nt, Human
cagugcaucuca

SEQ ID NO: 1831837 - RNA, 15 nt, Human
cagucacauuccaag

SEQ ID NO: 1831838 - RNA, 21 nt, Human
caggugauccacccaccucag

SEQ ID NO: 1831839 - RNA, 20 nt, Human
caggugcacaagcuccaagc

SEQ ID NO: 1831840 - RNA, 19 nt, Human
caggugcacaagcuccaag

SEQ ID NO: 1831841 - RNA, 18 nt, Human
caggugcacaagcuccaa

SEQ ID NO: 1831842 - RNA, 17 nt, Human
caggugcacaagcucca

SEQ ID NO: 1831843 - RNA, 15 nt, Human
caggugcacaagcuc

SEQ ID NO: 1831844 - RNA, 22 nt, Human
caggugauccacccaccucagc

SEQ ID NO: 1831845 - RNA, 23 nt, Human
caggugauccacccaccucagcc

SEQ ID NO: 1831846 - RNA, 16 nt, Human
cagguuuuccugaaga

SEQ ID NO: 1831847 - RNA, 12 nt, Human
cagguuuuccug

SEQ ID NO: 1831848 - RNA, 14 nt, Human
cagguuuaagcugu

SEQ ID NO: 1831849 - RNA, 23 nt, Human
caguaaagaacaucccuccuggg

SEQ ID NO: 1831850 - RNA, 23 nt, Human
cagguugucugaagucacugcac

SEQ ID NO: 1831851 - RNA, 22 nt, Human
cagguugucugaagucacugca

SEQ ID NO: 1831852 - RNA, 21 nt, Human
cagguuggugggggccucggu

SEQ ID NO: 1831853 - RNA, 21 nt, Human
caggugcacaagcuccaagcu

SEQ ID NO: 1831854 - RNA, 22 nt, Human
caggugcacaagcuccaagcuc

SEQ ID NO: 1831855 - RNA, 20 nt, Human
cagccgagauagccaaggcc

SEQ ID NO: 1831856 - RNA, 19 nt, Human
cagccgagauagccaaggc

SEQ ID NO: 1831857 - RNA, 17 nt, Human
cagccucugaaaaccaa

SEQ ID NO: 1831858 - RNA, 19 nt, Human
cagccugcuaauuccccag

SEQ ID NO: 1831859 - RNA, 15 nt, Human
cagccugcuccagcu

SEQ ID NO: 1831860 - RNA, 12 nt, Human
cagccugcucca

SEQ ID NO: 1831861 - RNA, 18 nt, Human
cagcggggacagcuccuu

SEQ ID NO: 1831862 - RNA, 19 nt, Human
cagcggggacagcuccuuc

SEQ ID NO: 1831863 - RNA, 21 nt, Human
cagcggggacagcuccuucug

SEQ ID NO: 1831864 - RNA, 18 nt, Human
caggaaaagcugcugaca

SEQ ID NO: 1831865 - RNA, 15 nt, Human
caggaaaagcugcug

SEQ ID NO: 1831866 - RNA, 16 nt, Human
caggaaaagcugcuga

SEQ ID NO: 1831867 - RNA, 14 nt, Human
cagcugccugggau

SEQ ID NO: 1831868 - RNA, 13 nt, Human
cagcugccuggga

SEQ ID NO: 1831869 - RNA, 12 nt, Human
cagcugccugca

SEQ ID NO: 1831870 - RNA, 12 nt, Human
cagcugccuggg

SEQ ID NO: 1831871 - RNA, 19 nt, Human
cagcugagggugagugggu

SEQ ID NO: 1831872 - RNA, 21 nt, Human
cagcuguuuaugcauagauaa

SEQ ID NO: 1831873 - RNA, 24 nt, Human
cagcugugcucuggacaggcaugu

SEQ ID NO: 1831874 - RNA, 20 nt, Human
cagcugugcucuggacaggc

SEQ ID NO: 1831875 - RNA, 13 nt, Human
cagccaguaaaug

SEQ ID NO: 1831876 - RNA, 20 nt, Human
cagcaucauggagguuugaa

SEQ ID NO: 1831877 - RNA, 16 nt, Human
cagcacgauuucuguu

SEQ ID NO: 1831878 - RNA, 18 nt, Human
cagcacgauuucuguuua

SEQ ID NO: 1831879 - RNA, 19 nt, Human
cagcacgauuucuguuuag

SEQ ID NO: 1831880 - RNA, 20 nt, Human
cagcacgauuucuguuuaga

SEQ ID NO: 1831881 - RNA, 22 nt, Human
cagauucuuuccugaggcuggg

SEQ ID NO: 1831882 - RNA, 20 nt, Human
cagauucuuuccugaggcug

SEQ ID NO: 1831883 - RNA, 17 nt, Human
cagauugcaacaggcug

SEQ ID NO: 1831884 - RNA, 17 nt, Human
cagcauagaaguaacuu

SEQ ID NO: 1831885 - RNA, 13 nt, Human
cagcauaauacuu

SEQ ID NO: 1831886 - RNA, 19 nt, Human
cagauucuuuccugaggcu

SEQ ID NO: 1831887 - RNA, 18 nt, Human
cagauucuuuccugaggc

SEQ ID NO: 1831888 - RNA, 17 nt, Human
cagauucuuuccugagg

SEQ ID NO: 1831889 - RNA, 15 nt, Human
cagauucuuuccuga

SEQ ID NO: 1831890 - RNA, 17 nt, Human
cagagguugcagugagc

SEQ ID NO: 1831891 - RNA, 16 nt, Human
cagagguugcagugag

SEQ ID NO: 1831892 - RNA, 20 nt, Human
cagagguccacaacacacag

SEQ ID NO: 1831893 - RNA, 15 nt, Human
cagagguccacaaca

SEQ ID NO: 1831894 - RNA, 21 nt, Human
cagaguaauccaagcaaaugu

SEQ ID NO: 1831895 - RNA, 23 nt, Human
cagaggggguggccucccaacuc

SEQ ID NO: 1831896 - RNA, 22 nt, Human
cagaggggguggccucccaacu

SEQ ID NO: 1831897 - RNA, 15 nt, Human
cagauccccaagccu

SEQ ID NO: 1831898 - RNA, 19 nt, Human
cagauccccaagccuggca

SEQ ID NO: 1831899 - RNA, 16 nt, Human
cauguuggccaggcug

SEQ ID NO: 1831900 - RNA, 14 nt, Human
cauguuggccaggc

SEQ ID NO: 1831901 - RNA, 15 nt, Human
cauguuggccaggcu

SEQ ID NO: 1831902 - RNA, 23 nt, Human
caugucccuaccgagucucuucu

SEQ ID NO: 1831903 - RNA, 19 nt, Human
caugucaaacgugaaaaug

SEQ ID NO: 1831904 - RNA, 14 nt, Human
caugucaaacguga

SEQ ID NO: 1831905 - RNA, 22 nt, Human
caugucccuaccgagucucuuc

SEQ ID NO: 1831906 - RNA, 16 nt, Human
caugucccuaccgagu

SEQ ID NO: 1831907 - RNA, 16 nt, Human
cauucuccaccugcca

SEQ ID NO: 1831908 - RNA, 14 nt, Human
cauucuccaccugc

SEQ ID NO: 1831909 - RNA, 13 nt, Human
cauucuccaccug

SEQ ID NO: 1831910 - RNA, 17 nt, Human
caugggaaugaauguca

SEQ ID NO: 1831911 - RNA, 16 nt, Human
caugggaaugaauguc

SEQ ID NO: 1831912 - RNA, 15 nt, Human
caugggaaugaaugu

SEQ ID NO: 1831913 - RNA, 14 nt, Human
caugggaaugaaug

SEQ ID NO: 1831914 - RNA, 17 nt, Human
cauggcugccaauggga

SEQ ID NO: 1831915 - RNA, 14 nt, Human
caugcuacacacug

SEQ ID NO: 1831916 - RNA, 20 nt, Human
caugcuacacacugcauguu

SEQ ID NO: 1831917 - RNA, 23 nt, Human
caugcuacacacugcauguuugu

SEQ ID NO: 1831918 - RNA, 13 nt, Human
caugauguuuucc

SEQ ID NO: 1831919 - RNA, 23 nt, Human
cauccuggcacccggccccugcu

SEQ ID NO: 1831920 - RNA, 22 nt, Human
cauccuggcacccggccccugc

SEQ ID NO: 1831921 - RNA, 14 nt, Human
caucacuucccuac

SEQ ID NO: 1831922 - RNA, 12 nt, Human
caucacuucccu

SEQ ID NO: 1831923 - RNA, 15 nt, Human
cauccuggcacccgg

SEQ ID NO: 1831924 - RNA, 19 nt, Human
caguggugguuuucuguuc

SEQ ID NO: 1831925 - RNA, 20 nt, Human
caguggugguuuucuguucu

SEQ ID NO: 1831926 - RNA, 21 nt, Human
caguggugguuuucuguucuu

SEQ ID NO: 1831927 - RNA, 22 nt, Human
caguggugguuuucuguucuuu

SEQ ID NO: 1831928 - RNA, 16 nt, Human
cauauuaccacagaca

SEQ ID NO: 1831929 - RNA, 17 nt, Human
cauauucuguuggccag

SEQ ID NO: 1831930 - RNA, 18 nt, Human
cauauucuguuggccagu

SEQ ID NO: 1831931 - RNA, 17 nt, Human
ccacucccugcaaccug

SEQ ID NO: 1831932 - RNA, 14 nt, Human
ccaccaucaagcca

SEQ ID NO: 1831933 - RNA, 13 nt, Human
ccaccaucaagcc

SEQ ID NO: 1831934 - RNA, 14 nt, Human
ccacagcugcucaa

SEQ ID NO: 1831935 - RNA, 17 nt, Human
ccaccacacccagccca

SEQ ID NO: 1831936 - RNA, 15 nt, Human
ccaccaucaagccac

SEQ ID NO: 1831937 - RNA, 23 nt, Human
ccacagcgcuggccgggaccccg

SEQ ID NO: 1831938 - RNA, 19 nt, Human
ccacgcccccacuggugac

SEQ ID NO: 1831939 - RNA, 18 nt, Human
ccacgcccccacugguga

SEQ ID NO: 1831940 - RNA, 13 nt, Human
ccacgcccggcua

SEQ ID NO: 1831941 - RNA, 17 nt, Human
ccacgcccccacuggug

SEQ ID NO: 1831942 - RNA, 16 nt, Human
ccacgcccccacuggu

SEQ ID NO: 1831943 - RNA, 22 nt, Human
ccaccgcagacaggaccaggga

SEQ ID NO: 1831944 - RNA, 13 nt, Human
ccaccgcagacag

SEQ ID NO: 1831945 - RNA, 21 nt, Human
ccaccuuugaagaaguaagga

SEQ ID NO: 1831946 - RNA, 21 nt, Human
ccaaaacucuccucugcugcu

SEQ ID NO: 1831947 - RNA, 20 nt, Human
ccaaaacucuccucugcugc

SEQ ID NO: 1831948 - RNA, 22 nt, Human
cauuuuuuuuaagaaaaaggau

SEQ ID NO: 1831949 - RNA, 17 nt, Human
ccaaugggagcucaugg

SEQ ID NO: 1831950 - RNA, 17 nt, Human
ccaauauuuaccagacc

SEQ ID NO: 1831951 - RNA, 15 nt, Human
ccaaugauggucacc

SEQ ID NO: 1831952 - RNA, 14 nt, Human
ccaaugcacuuugu

SEQ ID NO: 1831953 - RNA, 18 nt, Human
ccaagcucugcuccucuc

SEQ ID NO: 1831954 - RNA, 12 nt, Human
ccaagcucugcu

SEQ ID NO: 1831955 - RNA, 17 nt, Human
ccaagcucugcuccucu

SEQ ID NO: 1831956 - RNA, 13 nt, Human
ccaagcucugcuc

SEQ ID NO: 1831957 - RNA, 17 nt, Human
ccaaauguucaucaaug

SEQ ID NO: 1831958 - RNA, 14 nt, Human
ccaacucaccccag

SEQ ID NO: 1831959 - RNA, 23 nt, Human
ccaaauggaaaugggcagagcag

SEQ ID NO: 1831960 - RNA, 18 nt, Human
ccaaauguucaucaauga

SEQ ID NO: 1831961 - RNA, 18 nt, Human
ccaacucaccccagcccc

SEQ ID NO: 1831962 - RNA, 17 nt, Human
ccaacucaccccagccc

SEQ ID NO: 1831963 - RNA, 16 nt, Human
ccaacucaccccagcc

SEQ ID NO: 1831964 - RNA, 24 nt, Human
cugcccugugaguacuacaguccu

SEQ ID NO: 1831965 - RNA, 21 nt, Human
cugcccugguuuccugcccug

SEQ ID NO: 1831966 - RNA, 19 nt, Human
cugcccugguuuccugccc

SEQ ID NO: 1831967 - RNA, 18 nt, Human
cugcccugguuuccugcc

SEQ ID NO: 1831968 - RNA, 17 nt, Human
cugcccugguuuccugc

SEQ ID NO: 1831969 - RNA, 23 nt, Human
cugcccuggugcugccacacuuc

SEQ ID NO: 1831970 - RNA, 15 nt, Human
cugcccuggugcugc

SEQ ID NO: 1831971 - RNA, 14 nt, Human
cugcccuggugcug

SEQ ID NO: 1831972 - RNA, 13 nt, Human
cugcccuggugcu

SEQ ID NO: 1831973 - RNA, 12 nt, Human
cugcccuggugc

SEQ ID NO: 1831974 - RNA, 23 nt, Human
cugcccuuaccugccaggaagcc

SEQ ID NO: 1831975 - RNA, 22 nt, Human
cugcccuuaccugccaggaagc

SEQ ID NO: 1831976 - RNA, 19 nt, Human
cugcccuuaccugccagga

SEQ ID NO: 1831977 - RNA, 14 nt, Human
cugcccugugggcc

SEQ ID NO: 1831978 - RNA, 20 nt, Human
cugcccugguuuccugcccu

SEQ ID NO: 1831979 - RNA, 12 nt, Human
cugcccuguggg

SEQ ID NO: 1831980 - RNA, 11 nt, Human
cugcccugugg

SEQ ID NO: 1831981 - RNA, 20 nt, Human
cugccucgaacuggcugcaa

SEQ ID NO: 1831982 - RNA, 21 nt, Human
cugccuccuuugugaggaagc

SEQ ID NO: 1831983 - RNA, 17 nt, Human
cugccuccuuugugagg

SEQ ID NO: 1831984 - RNA, 23 nt, Human
cugccuccuuugugaggaagccg

SEQ ID NO: 1831985 - RNA, 14 nt, Human
cugccucgaacugg

SEQ ID NO: 1831986 - RNA, 14 nt, Human
cugccuccuuugug

SEQ ID NO: 1831987 - RNA, 19 nt, Human
cugccuguucccauucuug

SEQ ID NO: 1831988 - RNA, 15 nt, Human
cugccuguucccauu

SEQ ID NO: 1831989 - RNA, 20 nt, Human
cugccuguucagcuccagcu

SEQ ID NO: 1831990 - RNA, 23 nt, Human
cugccuguucagcuccagcucac

SEQ ID NO: 1831991 - RNA, 18 nt, Human
cugcugaaggcucgagca

SEQ ID NO: 1831992 - RNA, 23 nt, Human
cugcugaaggcucgagcaugccu

SEQ ID NO: 1831993 - RNA, 24 nt, Human
cugcugaaggcucgagcaugccug

SEQ ID NO: 1831994 - RNA, 17 nt, Human
cugcuaucaaagagguu

SEQ ID NO: 1831995 - RNA, 15 nt, Human
cuggcucuuccaggc

SEQ ID NO: 1831996 - RNA, 14 nt, Human
cuggcucuuccagg

SEQ ID NO: 1831997 - RNA, 13 nt, Human
cuggcucuuccag

SEQ ID NO: 1831998 - RNA, 17 nt, Human
cugggacuacaggcacc

SEQ ID NO: 1831999 - RNA, 21 nt, Human
cugggacuacaggcacccacc

SEQ ID NO: 1832000 - RNA, 17 nt, Human
cugggacuacaggugug

SEQ ID NO: 1832001 - RNA, 22 nt, Human
cuggcucccacaggcccuuccu

SEQ ID NO: 1832002 - RNA, 18 nt, Human
cuggcucccacaggcccu

SEQ ID NO: 1832003 - RNA, 19 nt, Human
cuggcucccacaggcccuu

SEQ ID NO: 1832004 - RNA, 19 nt, Human
cuggcagcucagagagggu

SEQ ID NO: 1832005 - RNA, 17 nt, Human
cuggcagcucagagagg

SEQ ID NO: 1832006 - RNA, 16 nt, Human
cuggcagcucagagag

SEQ ID NO: 1832007 - RNA, 18 nt, Human
cuggcagccgugccuuca

SEQ ID NO: 1832008 - RNA, 17 nt, Human
cuggcagccgugccuuc

SEQ ID NO: 1832009 - RNA, 22 nt, Human
cuggcagaguugaagacagagc

SEQ ID NO: 1832010 - RNA, 23 nt, Human
cuggcagccccuguucuggcaga

SEQ ID NO: 1832011 - RNA, 13 nt, Human
cuggcagccgugc

SEQ ID NO: 1832012 - RNA, 21 nt, Human
cuggcagaguugaagacagag

SEQ ID NO: 1832013 - RNA, 20 nt, Human
cuggcagaguugaagacaga

SEQ ID NO: 1832014 - RNA, 20 nt, Human
cugcuucaaggauccugagc

SEQ ID NO: 1832015 - RNA, 19 nt, Human
cugcuucaaggauccugag

SEQ ID NO: 1832016 - RNA, 16 nt, Human
cugcuucaaggauccu

SEQ ID NO: 1832017 - RNA, 14 nt, Human
cugcuucaaggauc

SEQ ID NO: 1832018 - RNA, 14 nt, Human
cugcuuccagugag

SEQ ID NO: 1832019 - RNA, 23 nt, Human
cugcuucagccucccgaguagcu

SEQ ID NO: 1832020 - RNA, 23 nt, Human
cuggacuccucuguccaggcacu

SEQ ID NO: 1832021 - RNA, 22 nt, Human
cuggacuccucuguccaggcac

SEQ ID NO: 1832022 - RNA, 21 nt, Human
cuggagaaaauggacguguua

SEQ ID NO: 1832023 - RNA, 20 nt, Human
cuggacuccucuguccaggc

SEQ ID NO: 1832024 - RNA, 17 nt, Human
cuggauccaucaggcca

SEQ ID NO: 1832025 - RNA, 15 nt, Human
cuggagaacuagaga

SEQ ID NO: 1832026 - RNA, 14 nt, Human
cuggagaacuagag

SEQ ID NO: 1832027 - RNA, 17 nt, Human
cuggaugcagccucaca

SEQ ID NO: 1832028 - RNA, 16 nt, Human
cuggaugcagccucac

SEQ ID NO: 1832029 - RNA, 20 nt, Human
cuggaucuccauucucucag

SEQ ID NO: 1832030 - RNA, 19 nt, Human
cuggauccaucaggccacu

SEQ ID NO: 1832031 - RNA, 18 nt, Human
cuggaugcagccucacag

SEQ ID NO: 1832032 - RNA, 12 nt, Human
cuggugccucac

SEQ ID NO: 1832033 - RNA, 18 nt, Human
cuggucuuauuuguaaag

SEQ ID NO: 1832034 - RNA, 21 nt, Human
cuggucucgaacuccugaccu

SEQ ID NO: 1832035 - RNA, 14 nt, Human
cugguuuuucaguu

SEQ ID NO: 1832036 - RNA, 15 nt, Human
cugguuuuucaguuu

SEQ ID NO: 1832037 - RNA, 16 nt, Human
cugguuuuucaguuuu

SEQ ID NO: 1832038 - RNA, 15 nt, Human
cuguagagugggagc

SEQ ID NO: 1832039 - RNA, 21 nt, Human
cuguacuugcucuugaugccu

SEQ ID NO: 1832040 - RNA, 20 nt, Human
cuguacuugcucuugaugcc

SEQ ID NO: 1832041 - RNA, 19 nt, Human
cuguacuugcucuugaugc

SEQ ID NO: 1832042 - RNA, 16 nt, Human
cuguacuugcucuuga

SEQ ID NO: 1832043 - RNA, 22 nt, Human
cugucuaaugaaaccugugucu

SEQ ID NO: 1832044 - RNA, 14 nt, Human
cugucauuugagca

SEQ ID NO: 1832045 - RNA, 13 nt, Human
cuguccugggagu

SEQ ID NO: 1832046 - RNA, 14 nt, Human
cuguccugggagug

SEQ ID NO: 1832047 - RNA, 20 nt, Human
cuguccugggagugagcugg

SEQ ID NO: 1832048 - RNA, 18 nt, Human
cuguaggaagguuaaugu

SEQ ID NO: 1832049 - RNA, 18 nt, Human
cuguucagcugguugagg

SEQ ID NO: 1832050 - RNA, 12 nt, Human
cuguucagcugg

SEQ ID NO: 1832051 - RNA, 16 nt, Human
cuguucagcuccagcu

SEQ ID NO: 1832052 - RNA, 18 nt, Human
cuguucagcuccagcuca

SEQ ID NO: 1832053 - RNA, 19 nt, Human
cuguucagcuccagcucac

SEQ ID NO: 1832054 - RNA, 22 nt, Human
cuguucagcuccagcucaccag

SEQ ID NO: 1832055 - RNA, 13 nt, Human
cuguucacucuac

SEQ ID NO: 1832056 - RNA, 15 nt, Human
cuguucagcuccagc

SEQ ID NO: 1832057 - RNA, 17 nt, Human
cuguuacugucuucagu

SEQ ID NO: 1832058 - RNA, 22 nt, Human
cugugucagguggggcagcuug

SEQ ID NO: 1832059 - RNA, 18 nt, Human
cugugcucuggacaggca

SEQ ID NO: 1832060 - RNA, 19 nt, Human
cugugcucuggacaggcau

SEQ ID NO: 1832061 - RNA, 16 nt, Human
cugugaacugaacucu

SEQ ID NO: 1832062 - RNA, 15 nt, Human
cugugaacugaacuc

SEQ ID NO: 1832063 - RNA, 13 nt, Human
cugugaacugaac

SEQ ID NO: 1832064 - RNA, 23 nt, Human
cugugagaugcuagaacucccuu

SEQ ID NO: 1832065 - RNA, 17 nt, Human
cugugcucuggacaggc

SEQ ID NO: 1832066 - RNA, 12 nt, Human
cuguuggccagu

SEQ ID NO: 1832067 - RNA, 15 nt, Human
cuguuggccagugug

SEQ ID NO: 1832068 - RNA, 13 nt, Human
cuuaaauaaugug

SEQ ID NO: 1832069 - RNA, 14 nt, Human
cuuaaauaauguga

SEQ ID NO: 1832070 - RNA, 16 nt, Human
cuuaaauaaugugaaa

SEQ ID NO: 1832071 - RNA, 19 nt, Human
cuuaaauaaugugaaacug

SEQ ID NO: 1832072 - RNA, 13 nt, Human
cuuaaaaaugguu

SEQ ID NO: 1832073 - RNA, 20 nt, Human
cuuaaaaaugguuuaaaugg

SEQ ID NO: 1832074 - RNA, 14 nt, Human
gaaaauuuuaaaaa

SEQ ID NO: 1832075 - RNA, 18 nt, Human
gaaaauuuugauguuuua

SEQ ID NO: 1832076 - RNA, 18 nt, Human
gaaaacuuguauuaugug

SEQ ID NO: 1832077 - RNA, 19 nt, Human
gaaaacugcaacuuguaaa

SEQ ID NO: 1832078 - RNA, 22 nt, Human
gaaaauuaggauuucaugauuu

SEQ ID NO: 1832079 - RNA, 18 nt, Human
gaaaauuaggauuucaug

SEQ ID NO: 1832080 - RNA, 14 nt, Human
gaaaauuaacauga

SEQ ID NO: 1832081 - RNA, 18 nt, Human
cuuuugccguuauuaaaa

SEQ ID NO: 1832082 - RNA, 15 nt, Human
cuuuuggucugugug

SEQ ID NO: 1832083 - RNA, 16 nt, Human
cuuuuggucuguguga

SEQ ID NO: 1832084 - RNA, 17 nt, Human
cuuuugucuaugggacu

SEQ ID NO: 1832085 - RNA, 21 nt, Human
cuuuuuuuuuuuuuuugacaa

SEQ ID NO: 1832086 - RNA, 19 nt, Human
gaaaaaauauuuuccugcc

SEQ ID NO: 1832087 - RNA, 14 nt, Human
gaaaaaauauauau

SEQ ID NO: 1832088 - RNA, 14 nt, Human
cuuuuuuuuaaguu

SEQ ID NO: 1832089 - RNA, 14 nt, Human
cuuuugugcauuau

SEQ ID NO: 1832090 - RNA, 18 nt, Human
cuuuugugcauuaucuag

SEQ ID NO: 1832091 - RNA, 19 nt, Human
cuuuuaugugaaacauguu

SEQ ID NO: 1832092 - RNA, 18 nt, Human
gaaagaaguggggacaga

SEQ ID NO: 1832093 - RNA, 18 nt, Human
gaaagacuaucuaaaugu

SEQ ID NO: 1832094 - RNA, 18 nt, Human
gaaaggcuccaggagcag

SEQ ID NO: 1832095 - RNA, 17 nt, Human
gaaaggcuccaggagca

SEQ ID NO: 1832096 - RNA, 19 nt, Human
gaaaggcuccaggagcagc

SEQ ID NO: 1832097 - RNA, 22 nt, Human
gaaaguacuucuccacccugcu

SEQ ID NO: 1832098 - RNA, 21 nt, Human
gaaaguacuucuccacccugc

SEQ ID NO: 1832099 - RNA, 18 nt, Human
gaaaugaaagcagggacu

SEQ ID NO: 1832100 - RNA, 18 nt, Human
gaaauuuuuauuaaauua

SEQ ID NO: 1832101 - RNA, 17 nt, Human
gaaaucaccgaaaacgu

SEQ ID NO: 1832102 - RNA, 17 nt, Human
gaacaaauuuacagaga

SEQ ID NO: 1832103 - RNA, 18 nt, Human
gaacaaauuuacagagac

SEQ ID NO: 1832104 - RNA, 19 nt, Human
gaaauuuuuauuaaauuau

SEQ ID NO: 1832105 - RNA, 23 nt, Human
gaacaaauuuacagagacagaaa

SEQ ID NO: 1832106 - RNA, 18 nt, Human
gaacaaggcaaggcuguc

SEQ ID NO: 1832107 - RNA, 17 nt, Human
gaacaaggcaaggcugu

SEQ ID NO: 1832108 - RNA, 15 nt, Human
gaacaaggcaaggcu

SEQ ID NO: 1832109 - RNA, 14 nt, Human
gaacaaggcaaggc

SEQ ID NO: 1832110 - RNA, 21 nt, Human
gaacaaggcaaggcugucaau

SEQ ID NO: 1832111 - RNA, 15 nt, Human
cuugauguguuaucu

SEQ ID NO: 1832112 - RNA, 18 nt, Human
cuugccgucuaccugagg

SEQ ID NO: 1832113 - RNA, 19 nt, Human
cuugccgucuaccugaggg

SEQ ID NO: 1832114 - RNA, 19 nt, Human
cuugauucauaaugacuua

SEQ ID NO: 1832115 - RNA, 15 nt, Human
cuuggauuguccccg

SEQ ID NO: 1832116 - RNA, 20 nt, Human
cuuggauuguccccgacccu

SEQ ID NO: 1832117 - RNA, 18 nt, Human
cuuggauuguccccgacc

SEQ ID NO: 1832118 - RNA, 22 nt, Human
cuuggauuguccccgacccuug

SEQ ID NO: 1832119 - RNA, 23 nt, Human
cuuggcgcugccccuggcagccc

SEQ ID NO: 1832120 - RNA, 22 nt, Human
cuuggcgcugccccuggcagcc

SEQ ID NO: 1832121 - RNA, 21 nt, Human
cuuggcgcugccccuggcagc

SEQ ID NO: 1832122 - RNA, 18 nt, Human
cuuucaauaggaaaaacu

SEQ ID NO: 1832123 - RNA, 17 nt, Human
cuuucaauaggaaaaac

SEQ ID NO: 1832124 - RNA, 22 nt, Human
cuugucuuuggacccugaggcc

SEQ ID NO: 1832125 - RNA, 21 nt, Human
cuugucuuuggacccugaggc

SEQ ID NO: 1832126 - RNA, 15 nt, Human
cuuucaauaggaaaa

SEQ ID NO: 1832127 - RNA, 14 nt, Human
cuuucaauaggaaa

SEQ ID NO: 1832128 - RNA, 22 nt, Human
cuuuaaugucacaggcaggucc

SEQ ID NO: 1832129 - RNA, 17 nt, Human
cuuuaaugucacaggca

SEQ ID NO: 1832130 - RNA, 18 nt, Human
cuuuaaugucacaggcag

SEQ ID NO: 1832131 - RNA, 19 nt, Human
cuuuaaugucacaggcagg

SEQ ID NO: 1832132 - RNA, 20 nt, Human
cuuuaaugucacaggcaggu

SEQ ID NO: 1832133 - RNA, 20 nt, Human
cuugguccugcugcaguugc

SEQ ID NO: 1832134 - RNA, 18 nt, Human
cuugguccugcugcaguu

SEQ ID NO: 1832135 - RNA, 17 nt, Human
cuugguccugcugcagu

SEQ ID NO: 1832136 - RNA, 16 nt, Human
cuugguccugcugcag

SEQ ID NO: 1832137 - RNA, 15 nt, Human
cuugguccugcugca

SEQ ID NO: 1832138 - RNA, 16 nt, Human
cuugguucccauuugc

SEQ ID NO: 1832139 - RNA, 20 nt, Human
cuugguucccauuugcuccu

SEQ ID NO: 1832140 - RNA, 23 nt, Human
cuuggucucagugucaaugcagc

SEQ ID NO: 1832141 - RNA, 22 nt, Human
cuugguccugcugcaguugcca

SEQ ID NO: 1832142 - RNA, 20 nt, Human
cuugucuuuggacccugagg

SEQ ID NO: 1832143 - RNA, 13 nt, Human
cuugucuguagau

SEQ ID NO: 1832144 - RNA, 20 nt, Human
cuuacauuagcaguuugcuu

SEQ ID NO: 1832145 - RNA, 16 nt, Human
cuucuuauacauuuga

SEQ ID NO: 1832146 - RNA, 13 nt, Human
cuucuuauacauu

SEQ ID NO: 1832147 - RNA, 17 nt, Human
cuucugacccaugcugc

SEQ ID NO: 1832148 - RNA, 16 nt, Human
cuucugacccaugcug

SEQ ID NO: 1832149 - RNA, 18 nt, Human
cuucugacccaugcugcc

SEQ ID NO: 1832150 - RNA, 23 nt, Human
cuucugaacuuggcgcugccccu

SEQ ID NO: 1832151 - RNA, 18 nt, Human
cuuccucccucccucuuu

SEQ ID NO: 1832152 - RNA, 14 nt, Human
cuuccucccucccu

SEQ ID NO: 1832153 - RNA, 13 nt, Human
cuuccucccuccc

SEQ ID NO: 1832154 - RNA, 12 nt, Human
cuuccucccucc

SEQ ID NO: 1832155 - RNA, 13 nt, Human
cuuccucugcuga

SEQ ID NO: 1832156 - RNA, 12 nt, Human
cuuccucugcug

SEQ ID NO: 1832157 - RNA, 11 nt, Human
cuuccucugcu

SEQ ID NO: 1832158 - RNA, 21 nt, Human
cuuccucuccacugccuucga

SEQ ID NO: 1832159 - RNA, 19 nt, Human
cuuccucuccacugccuuc

SEQ ID NO: 1832160 - RNA, 17 nt, Human
cuuccucuccacugccu

SEQ ID NO: 1832161 - RNA, 16 nt, Human
cuuccucuccacugcc

SEQ ID NO: 1832162 - RNA, 22 nt, Human
cuucugaacuuggcgcugcccc

SEQ ID NO: 1832163 - RNA, 15 nt, Human
cuucugacccaugcu

SEQ ID NO: 1832164 - RNA, 19 nt, Human
cuucugaacuuggcgcugc

SEQ ID NO: 1832165 - RNA, 17 nt, Human
gauacuguaucaugaca

SEQ ID NO: 1832166 - RNA, 21 nt, Human
gauacuguaucaugacaaaga

SEQ ID NO: 1832167 - RNA, 16 nt, Human
gauacaguuacucaga

SEQ ID NO: 1832168 - RNA, 19 nt, Human
gauacaguuacucagaauu

SEQ ID NO: 1832169 - RNA, 23 nt, Human
gauacaguuacucagaauucucu

SEQ ID NO: 1832170 - RNA, 22 nt, Human
gaucaaaccccgaccaccugcc

SEQ ID NO: 1832171 - RNA, 23 nt, Human
gaucaaaagguuaauaaaguaau

SEQ ID NO: 1832172 - RNA, 20 nt, Human
gaucaaaagguuaauaaagu

SEQ ID NO: 1832173 - RNA, 17 nt, Human
gauauuuuuuucuuuuc

SEQ ID NO: 1832174 - RNA, 15 nt, Human
gauauuuugcuuugu

SEQ ID NO: 1832175 - RNA, 23 nt, Human
gauauuuucaacgcagcccugcu

SEQ ID NO: 1832176 - RNA, 22 nt, Human
gauauuuucaacgcagcccugc

SEQ ID NO: 1832177 - RNA, 21 nt, Human
gauauuuucaacgcagcccug

SEQ ID NO: 1832178 - RNA, 19 nt, Human
gauauuuucaacgcagccc

SEQ ID NO: 1832179 - RNA, 18 nt, Human
gauacuuugauauuuuca

SEQ ID NO: 1832180 - RNA, 22 nt, Human
gauccacccaccucagccuccc

SEQ ID NO: 1832181 - RNA, 20 nt, Human
gauccacccaccucagccuc

SEQ ID NO: 1832182 - RNA, 21 nt, Human
gauccacccaccucagccucc

SEQ ID NO: 1832183 - RNA, 21 nt, Human
gauccaagcuggucccacuca

SEQ ID NO: 1832184 - RNA, 18 nt, Human
gauccacccaccucagcc

SEQ ID NO: 1832185 - RNA, 19 nt, Human
gauccacccaccucagccu

SEQ ID NO: 1832186 - RNA, 12 nt, Human
gauccaagcugg

SEQ ID NO: 1832187 - RNA, 16 nt, Human
gauccaagcugguccc

SEQ ID NO: 1832188 - RNA, 17 nt, Human
gauccaagcugguccca

SEQ ID NO: 1832189 - RNA, 19 nt, Human
gauccaagcuggucccacu

SEQ ID NO: 1832190 - RNA, 17 nt, Human
gaucugaugcaagcaag

SEQ ID NO: 1832191 - RNA, 19 nt, Human
gaucucuugagccugggag

SEQ ID NO: 1832192 - RNA, 18 nt, Human
gaucucuugagccuggga

SEQ ID NO: 1832193 - RNA, 14 nt, Human
gaugauccuaggca

SEQ ID NO: 1832194 - RNA, 13 nt, Human
gaugauccuaggc

SEQ ID NO: 1832195 - RNA, 22 nt, Human
gaugauuggaggggggaggugg

SEQ ID NO: 1832196 - RNA, 20 nt, Human
gaugcuucuucagagacucc

SEQ ID NO: 1832197 - RNA, 17 nt, Human
gaugcuucuucagagac

SEQ ID NO: 1832198 - RNA, 21 nt, Human
gaugcuucuucagagacuccu

SEQ ID NO: 1832199 - RNA, 13 nt, Human
gauucuucugcuu

SEQ ID NO: 1832200 - RNA, 15 nt, Human
gauucuucugcuuca

SEQ ID NO: 1832201 - RNA, 12 nt, Human
gauucuucugcu

SEQ ID NO: 1832202 - RNA, 19 nt, Human
gauuuaacagaaauguaca

SEQ ID NO: 1832203 - RNA, 17 nt, Human
gauuuaacagaaaugua

SEQ ID NO: 1832204 - RNA, 18 nt, Human
gauuuaacagaaauguac

SEQ ID NO: 1832205 - RNA, 16 nt, Human
gauuuaacagaaaugu

SEQ ID NO: 1832206 - RNA, 20 nt, Human
gauucuucugcuucagccuc

SEQ ID NO: 1832207 - RNA, 21 nt, Human
gauuuuuuuuuccuucagugc

SEQ ID NO: 1832208 - RNA, 14 nt, Human
gcaaaaaggcagga

SEQ ID NO: 1832209 - RNA, 22 nt, Human
gcaaaagaugcuucucacugcc

SEQ ID NO: 1832210 - RNA, 17 nt, Human
gcaaaagaugcuucuca

SEQ ID NO: 1832211 - RNA, 18 nt, Human
gauuuuuuuuuccuucag

SEQ ID NO: 1832212 - RNA, 17 nt, Human
gauuuuuuuuuccuuca

SEQ ID NO: 1832213 - RNA, 12 nt, Human
gauuucacucuc

SEQ ID NO: 1832214 - RNA, 16 nt, Human
gauuuuuuuuuccuuc

SEQ ID NO: 1832215 - RNA, 11 nt, Human
gauuucacucu

SEQ ID NO: 1832216 - RNA, 16 nt, Human
gcaagugagagcuggg

SEQ ID NO: 1832217 - RNA, 15 nt, Human
gcaagugagagcugg

SEQ ID NO: 1832218 - RNA, 20 nt, Human
gcaaccuucgccaccugggu

SEQ ID NO: 1832219 - RNA, 20 nt, Human
gcaaccuccgccucuugggu

SEQ ID NO: 1832220 - RNA, 14 nt, Human
gcaacccccagccu

SEQ ID NO: 1832221 - RNA, 15 nt, Human
gcaacccccagccug

SEQ ID NO: 1832222 - RNA, 16 nt, Human
gcaacccccagccugc

SEQ ID NO: 1832223 - RNA, 19 nt, Human
gcaaccuccgccucuuggg

SEQ ID NO: 1832224 - RNA, 18 nt, Human
gcaaccaccaccaaccac

SEQ ID NO: 1832225 - RNA, 16 nt, Human
gcaaccaccaccaacc

SEQ ID NO: 1832226 - RNA, 13 nt, Human
gcaaccaccacca

SEQ ID NO: 1832227 - RNA, 16 nt, Human
gcaacaggcugggcuu

SEQ ID NO: 1832228 - RNA, 19 nt, Human
gcaacaggcugggcuucag

SEQ ID NO: 1832229 - RNA, 14 nt, Human
gcaacaggcugggc

SEQ ID NO: 1832230 - RNA, 15 nt, Human
gcaacaggcugggcu

SEQ ID NO: 1832231 - RNA, 13 nt, Human
gcaacaggcuggg

SEQ ID NO: 1832232 - RNA, 18 nt, Human
gcagcccaccccucaaca

SEQ ID NO: 1832233 - RNA, 15 nt, Human
gcagccacauuccug

SEQ ID NO: 1832234 - RNA, 20 nt, Human
gcacucagaagacacugaug

SEQ ID NO: 1832235 - RNA, 18 nt, Human
gcaagugagagcugggug

SEQ ID NO: 1832236 - RNA, 19 nt, Human
gcaagugagagcugggugu

SEQ ID NO: 1832237 - RNA, 15 nt, Human
gcacuccagccuggg

SEQ ID NO: 1832238 - RNA, 14 nt, Human
gcacuccagccugg

SEQ ID NO: 1832239 - RNA, 14 nt, Human
gcacuccccugcug

SEQ ID NO: 1832240 - RNA, 13 nt, Human
gcacuccccugcu

SEQ ID NO: 1832241 - RNA, 19 nt, Human
gcacuuuguucuggcucuu

SEQ ID NO: 1832242 - RNA, 18 nt, Human
gcacuuuguucuggcucu

SEQ ID NO: 1832243 - RNA, 16 nt, Human
gcacuccccugcuggg

SEQ ID NO: 1832244 - RNA, 15 nt, Human
gcacuccccugcugg

SEQ ID NO: 1832245 - RNA, 22 nt, Human
gcacuuuguucuggcucuucca

SEQ ID NO: 1832246 - RNA, 12 nt, Human
gcagaacaguga

SEQ ID NO: 1832247 - RNA, 13 nt, Human
gcagaacagugau

SEQ ID NO: 1832248 - RNA, 14 nt, Human
gcagagggcacaga

SEQ ID NO: 1832249 - RNA, 23 nt, Human
gcagcauauucaggaagcucagg

SEQ ID NO: 1832250 - RNA, 19 nt, Human
gcagcauauucaggaagcu

SEQ ID NO: 1832251 - RNA, 18 nt, Human
gcagcauauucaggaagc

SEQ ID NO: 1832252 - RNA, 17 nt, Human
gcagcauauucaggaag

SEQ ID NO: 1832253 - RNA, 20 nt, Human
gcagaggaaagcaaaggaga

SEQ ID NO: 1832254 - RNA, 18 nt, Human
gcagaggaaagcaaagga

SEQ ID NO: 1832255 - RNA, 14 nt, Human
gcagaggaaagcaa

SEQ ID NO: 1832256 - RNA, 13 nt, Human
gcagaggaaagca

SEQ ID NO: 1832257 - RNA, 21 nt, Human
gcagaggaaagcaaaggagau

SEQ ID NO: 1832258 - RNA, 18 nt, Human
gcagaacagugauuacca

SEQ ID NO: 1832259 - RNA, 22 nt, Human
gcagaacagugauuaccaggga

SEQ ID NO: 1832260 - RNA, 18 nt, Human
gcauacguacacauuuua

SEQ ID NO: 1832261 - RNA, 15 nt, Human
gcauacguacacauu

SEQ ID NO: 1832262 - RNA, 16 nt, Human
gcauacguacacauuu

SEQ ID NO: 1832263 - RNA, 17 nt, Human
gcauacguacacauuuu

SEQ ID NO: 1832264 - RNA, 17 nt, Human
gcauccaguaucuugaa

SEQ ID NO: 1832265 - RNA, 14 nt, Human
gcauccaguaucuu

SEQ ID NO: 1832266 - RNA, 18 nt, Human
gcauccaguaucuugaag

SEQ ID NO: 1832267 - RNA, 15 nt, Human
gcauugugggaaggg

SEQ ID NO: 1832268 - RNA, 13 nt, Human
gcauugugggaag

SEQ ID NO: 1832269 - RNA, 21 nt, Human
gcaugugaugagaggaaauca

SEQ ID NO: 1832270 - RNA, 18 nt, Human
gcaugugaugagaggaaa

SEQ ID NO: 1832271 - RNA, 19 nt, Human
gcaugugaugagaggaaau

SEQ ID NO: 1832272 - RNA, 18 nt, Human
gcauugugggaaggggag

SEQ ID NO: 1832273 - RNA, 16 nt, Human
gcauugugggaagggg

SEQ ID NO: 1832274 - RNA, 16 nt, Human
gcauuuaaaagauaca

SEQ ID NO: 1832275 - RNA, 17 nt, Human
gcauuuaaaagauacag

SEQ ID NO: 1832276 - RNA, 18 nt, Human
gcauuuaaaagauacagu

SEQ ID NO: 1832277 - RNA, 22 nt, Human
gcauuuaaaagauacaguuacu

SEQ ID NO: 1832278 - RNA, 15 nt, Human
gcauuuacuuugugu

SEQ ID NO: 1832279 - RNA, 21 nt, Human
gcauggcugccaaugggagcu

SEQ ID NO: 1832280 - RNA, 14 nt, Human
gcauccuggcaccc

SEQ ID NO: 1832281 - RNA, 17 nt, Human
gcauccuccgccucccg

SEQ ID NO: 1832282 - RNA, 13 nt, Human
gcauccuggcacc

SEQ ID NO: 1832283 - RNA, 20 nt, Human
gcaucuagcaugucgucaaa

SEQ ID NO: 1832284 - RNA, 19 nt, Human
gacauuguagagcuucugg

SEQ ID NO: 1832285 - RNA, 17 nt, Human
gacauugcggacagcca

SEQ ID NO: 1832286 - RNA, 23 nt, Human
gacauugcggacagccacggcca

SEQ ID NO: 1832287 - RNA, 14 nt, Human
gacagcccgggcuc

SEQ ID NO: 1832288 - RNA, 16 nt, Human
gacagcccgggcucug

SEQ ID NO: 1832289 - RNA, 16 nt, Human
gacagcuccuucuguc

SEQ ID NO: 1832290 - RNA, 17 nt, Human
gacagcuccuucugucc

SEQ ID NO: 1832291 - RNA, 18 nt, Human
gacagcuccuucuguccu

SEQ ID NO: 1832292 - RNA, 20 nt, Human
gacagucccugccaauggac

SEQ ID NO: 1832293 - RNA, 16 nt, Human
gacagucccugccaau

SEQ ID NO: 1832294 - RNA, 15 nt, Human
gacagucccugccaa

SEQ ID NO: 1832295 - RNA, 14 nt, Human
gacagucccugcca

SEQ ID NO: 1832296 - RNA, 11 nt, Human
gacagcucuua

SEQ ID NO: 1832297 - RNA, 12 nt, Human
gacagucccugc

SEQ ID NO: 1832298 - RNA, 10 nt, Human
gacagcucuu

SEQ ID NO: 1832299 - RNA, 12 nt, Human
gacagcucugca

SEQ ID NO: 1832300 - RNA, 19 nt, Human
gacagcuccuucuguccua

SEQ ID NO: 1832301 - RNA, 17 nt, Human
gacccggaggggccugg

SEQ ID NO: 1832302 - RNA, 16 nt, Human
gaccccugagcuugca

SEQ ID NO: 1832303 - RNA, 20 nt, Human
gacccggaggggccuggcag

SEQ ID NO: 1832304 - RNA, 19 nt, Human
gacccggaggggccuggca

SEQ ID NO: 1832305 - RNA, 18 nt, Human
gacccggaggggccuggc

SEQ ID NO: 1832306 - RNA, 14 nt, Human
gaccucaggccugg

SEQ ID NO: 1832307 - RNA, 10 nt, Human
gacccugagg

SEQ ID NO: 1832308 - RNA, 19 nt, Human
gaccucaggugagaagcag

SEQ ID NO: 1832309 - RNA, 18 nt, Human
gaccucaggugagaagca

SEQ ID NO: 1832310 - RNA, 19 nt, Human
gaccucaggccugggggcu

SEQ ID NO: 1832311 - RNA, 23 nt, Human
gaccucagguaaucgaccugccu

SEQ ID NO: 1832312 - RNA, 22 nt, Human
gaccucagguaaucgaccugcc

SEQ ID NO: 1832313 - RNA, 21 nt, Human
gaccucaggugagaagcagag

SEQ ID NO: 1832314 - RNA, 19 nt, Human
gaccucaggugauccaccc

SEQ ID NO: 1832315 - RNA, 20 nt, Human
gaccucaggugauccaccca

SEQ ID NO: 1832316 - RNA, 21 nt, Human
gaccucaggugauccacccac

SEQ ID NO: 1832317 - RNA, 14 nt, Human
gacgcucucuggcc

SEQ ID NO: 1832318 - RNA, 23 nt, Human
gacgcuacccgggaagggggcug

SEQ ID NO: 1832319 - RNA, 22 nt, Human
gacgcuacccgggaagggggcu

SEQ ID NO: 1832320 - RNA, 17 nt, Human
gacgcugugcugcccug

SEQ ID NO: 1832321 - RNA, 16 nt, Human
gacgcugugcugcccu

SEQ ID NO: 1832322 - RNA, 18 nt, Human
gacgcugugcugcccugc

SEQ ID NO: 1832323 - RNA, 16 nt, Human
gaccucugcagcaaua

SEQ ID NO: 1832324 - RNA, 18 nt, Human
gaccucugcagcaauaaa

SEQ ID NO: 1832325 - RNA, 22 nt, Human
gaccucugcagcaauaaagcag

SEQ ID NO: 1832326 - RNA, 21 nt, Human
gacgccaucccagccccaaug

SEQ ID NO: 1832327 - RNA, 15 nt, Human
gacgccaucccagcc

SEQ ID NO: 1832328 - RNA, 13 nt, Human
gacgccaucccag

SEQ ID NO: 1832329 - RNA, 12 nt, Human
gacgccauccca

SEQ ID NO: 1832330 - RNA, 13 nt, Human
gaccucugccuga

SEQ ID NO: 1832331 - RNA, 15 nt, Human
gaauauauaaccagu

SEQ ID NO: 1832332 - RNA, 13 nt, Human
gaauauugcugau

SEQ ID NO: 1832333 - RNA, 12 nt, Human
gaauauugcuga

SEQ ID NO: 1832334 - RNA, 11 nt, Human
gaauauugcug

SEQ ID NO: 1832335 - RNA, 24 nt, Human
gaauauugcugauggugcaaugac

SEQ ID NO: 1832336 - RNA, 23 nt, Human
gaauauugcugauggugcaauga

SEQ ID NO: 1832337 - RNA, 22 nt, Human
gaauauugcugauggugcaaug

SEQ ID NO: 1832338 - RNA, 14 nt, Human
gaaugaauggcuaa

SEQ ID NO: 1832339 - RNA, 15 nt, Human
gaaugaauggcuaag

SEQ ID NO: 1832340 - RNA, 20 nt, Human
gaaugaauggcuaagcaaaa

SEQ ID NO: 1832341 - RNA, 14 nt, Human
gaaugauuaauuaa

SEQ ID NO: 1832342 - RNA, 14 nt, Human
gaaugaugccauga

SEQ ID NO: 1832343 - RNA, 20 nt, Human
gaaugaugauccuaggcauu

SEQ ID NO: 1832344 - RNA, 19 nt, Human
gaaugcacaaacagaggcc

SEQ ID NO: 1832345 - RNA, 16 nt, Human
gaauguuugccucugc

SEQ ID NO: 1832346 - RNA, 17 nt, Human
gaauguuugccucugcc

SEQ ID NO: 1832347 - RNA, 18 nt, Human
gaaugcacaaacagaggc

SEQ ID NO: 1832348 - RNA, 14 nt, Human
gaauuaacacauga

SEQ ID NO: 1832349 - RNA, 15 nt, Human
gaauuaacacaugau

SEQ ID NO: 1832350 - RNA, 18 nt, Human
gaauguuugccucugccu

SEQ ID NO: 1832351 - RNA, 19 nt, Human
gaauguuugccucugccuc

SEQ ID NO: 1832352 - RNA, 21 nt, Human
gacacagcucuucuccaggcu

SEQ ID NO: 1832353 - RNA, 12 nt, Human
gacacagcucuu

SEQ ID NO: 1832354 - RNA, 19 nt, Human
gacacagcucuucuccagg

SEQ ID NO: 1832355 - RNA, 20 nt, Human
gacacagcucuucuccaggc

SEQ ID NO: 1832356 - RNA, 21 nt, Human
gagggccugcaagggagugag

SEQ ID NO: 1832357 - RNA, 17 nt, Human
gagggccugcaagggag

SEQ ID NO: 1832358 - RNA, 14 nt, Human
gagggccugcaagg

SEQ ID NO: 1832359 - RNA, 12 nt, Human
gagggccugggc

SEQ ID NO: 1832360 - RNA, 18 nt, Human
gaggcugagaugggagaa

SEQ ID NO: 1832361 - RNA, 20 nt, Human
gaggcucuggagcccacugu

SEQ ID NO: 1832362 - RNA, 17 nt, Human
gaggcuccacuuggucu

SEQ ID NO: 1832363 - RNA, 15 nt, Human
gaggcuccacuuggu

SEQ ID NO: 1832364 - RNA, 21 nt, Human
gaggcauuuguuugaacugau

SEQ ID NO: 1832365 - RNA, 21 nt, Human
gaggcaugugaugagaggaaa

SEQ ID NO: 1832366 - RNA, 20 nt, Human
gaggcaugugaugagaggaa

SEQ ID NO: 1832367 - RNA, 22 nt, Human
gaggcaugugaugagaggaaau

SEQ ID NO: 1832368 - RNA, 19 nt, Human
gaggcauuuguuugaacug

SEQ ID NO: 1832369 - RNA, 22 nt, Human
gaggcagggucucacucugucg

SEQ ID NO: 1832370 - RNA, 19 nt, Human
gaggcagggucucacucug

SEQ ID NO: 1832371 - RNA, 20 nt, Human
gaggcagggucucacucugu

SEQ ID NO: 1832372 - RNA, 18 nt, Human
gaggcagggucucacucu

SEQ ID NO: 1832373 - RNA, 15 nt, Human
gaggagagaggaccc

SEQ ID NO: 1832374 - RNA, 14 nt, Human
gaggagagaggacc

SEQ ID NO: 1832375 - RNA, 12 nt, Human
gaggagagagga

SEQ ID NO: 1832376 - RNA, 12 nt, Human
gaggagaaacug

SEQ ID NO: 1832377 - RNA, 14 nt, Human
gaggagaaacugga

SEQ ID NO: 1832378 - RNA, 21 nt, Human
gaggacgcucucuggccuucg

SEQ ID NO: 1832379 - RNA, 20 nt, Human
gaggacgcucucuggccuuc

SEQ ID NO: 1832380 - RNA, 16 nt, Human
gaggacuuuucuuugu

SEQ ID NO: 1832381 - RNA, 20 nt, Human
gaggacuuuucuuuguggcu

SEQ ID NO: 1832382 - RNA, 23 nt, Human
gaggacuuuucuuuguggcuucc

SEQ ID NO: 1832383 - RNA, 13 nt, Human
gagcccugguggc

SEQ ID NO: 1832384 - RNA, 14 nt, Human
gagcccugguggca

SEQ ID NO: 1832385 - RNA, 14 nt, Human
gagcaucaggccag

SEQ ID NO: 1832386 - RNA, 16 nt, Human
gagcaucaggccaggc

SEQ ID NO: 1832387 - RNA, 15 nt, Human
gagcaucaggccagg

SEQ ID NO: 1832388 - RNA, 13 nt, Human
gagcaugccugga

SEQ ID NO: 1832389 - RNA, 21 nt, Human
gagcaugccuggauggggcug

SEQ ID NO: 1832390 - RNA, 20 nt, Human
gagcccugggaggcucugga

SEQ ID NO: 1832391 - RNA, 19 nt, Human
gagcccugggaggcucugg

SEQ ID NO: 1832392 - RNA, 18 nt, Human
gagcccugggaggcucug

SEQ ID NO: 1832393 - RNA, 16 nt, Human
gagcccugggaggcuc

SEQ ID NO: 1832394 - RNA, 12 nt, Human
gagcccugggag

SEQ ID NO: 1832395 - RNA, 13 nt, Human
gagccccgaggcc

SEQ ID NO: 1832396 - RNA, 14 nt, Human
gagccccgaggccu

SEQ ID NO: 1832397 - RNA, 17 nt, Human
gagccccgaggccuucu

SEQ ID NO: 1832398 - RNA, 21 nt, Human
gagauugugccccugcacucc

SEQ ID NO: 1832399 - RNA, 14 nt, Human
gagauuggaaggaa

SEQ ID NO: 1832400 - RNA, 20 nt, Human
gagaugcuagaacucccuuu

SEQ ID NO: 1832401 - RNA, 16 nt, Human
gagaugcuagaacucc

SEQ ID NO: 1832402 - RNA, 15 nt, Human
gagauuauguucuuu

SEQ ID NO: 1832403 - RNA, 16 nt, Human
gagagccuuccagggg

SEQ ID NO: 1832404 - RNA, 15 nt, Human
gagagccuuccaggg

SEQ ID NO: 1832405 - RNA, 14 nt, Human
gagacuccugcagg

SEQ ID NO: 1832406 - RNA, 13 nt, Human
gagacuccugcag

SEQ ID NO: 1832407 - RNA, 20 nt, Human
gagagccuuccagggguggg

SEQ ID NO: 1832408 - RNA, 18 nt, Human
gagagccuuccaggggug

SEQ ID NO: 1832409 - RNA, 21 nt, Human
gagagcuagcagcagggaggg

SEQ ID NO: 1832410 - RNA, 15 nt, Human
gagagcuagcagcag

SEQ ID NO: 1832411 - RNA, 13 nt, Human
gagagcugggugu

SEQ ID NO: 1832412 - RNA, 15 nt, Human
gagaggacccccuga

SEQ ID NO: 1832413 - RNA, 12 nt, Human
gagaggaaauca

SEQ ID NO: 1832414 - RNA, 22 nt, Human
gagagcuucuguugcugccuca

SEQ ID NO: 1832415 - RNA, 20 nt, Human
gagagcugggugucaagagg

SEQ ID NO: 1832416 - RNA, 18 nt, Human
gagacgggggcagagagg

SEQ ID NO: 1832417 - RNA, 16 nt, Human
gagacggagucccacc

SEQ ID NO: 1832418 - RNA, 19 nt, Human
gagacggagucccaccuug

SEQ ID NO: 1832419 - RNA, 14 nt, Human
gagacggaguccca

SEQ ID NO: 1832420 - RNA, 15 nt, Human
gagaaugaaagggcc

SEQ ID NO: 1832421 - RNA, 23 nt, Human
gagaaugaaagggcccagagagg

SEQ ID NO: 1832422 - RNA, 20 nt, Human
gacuuuuccaacccucauca

SEQ ID NO: 1832423 - RNA, 19 nt, Human
gacuuuuccaacccucauc

SEQ ID NO: 1832424 - RNA, 14 nt, Human
gacuuuuccaaccc

SEQ ID NO: 1832425 - RNA, 18 nt, Human
gacuuuuauuuccaguga

SEQ ID NO: 1832426 - RNA, 17 nt, Human
gccccuggcagccccug

SEQ ID NO: 1832427 - RNA, 16 nt, Human
gccccuggcagccccu

SEQ ID NO: 1832428 - RNA, 21 nt, Human
gccccugcugguucaggguug

SEQ ID NO: 1832429 - RNA, 21 nt, Human
gcccuuccaugucgccucugc

SEQ ID NO: 1832430 - RNA, 12 nt, Human
gcccuuccaugu

SEQ ID NO: 1832431 - RNA, 12 nt, Human
gcccuuccucuc

SEQ ID NO: 1832432 - RNA, 22 nt, Human
gcccuuccaugucgccucugca

SEQ ID NO: 1832433 - RNA, 15 nt, Human
gcccuuccucuccac

SEQ ID NO: 1832434 - RNA, 14 nt, Human
gcccuuccucucca

SEQ ID NO: 1832435 - RNA, 16 nt, Human
gccuacaggagugagc

SEQ ID NO: 1832436 - RNA, 15 nt, Human
gcccugcccaccugg

SEQ ID NO: 1832437 - RNA, 14 nt, Human
gcccugcccaccug

SEQ ID NO: 1832438 - RNA, 20 nt, Human
gcccugcgggucacaggagg

SEQ ID NO: 1832439 - RNA, 13 nt, Human
gcccugugcucca

SEQ ID NO: 1832440 - RNA, 22 nt, Human
gcccuuaccugccaggaagcca

SEQ ID NO: 1832441 - RNA, 21 nt, Human
gcccuuaccugccaggaagcc

SEQ ID NO: 1832442 - RNA, 17 nt, Human
gcccugugggcccccaa

SEQ ID NO: 1832443 - RNA, 16 nt, Human
gcccugugggccccca

SEQ ID NO: 1832444 - RNA, 19 nt, Human
gcccuuagcagggaaacag

SEQ ID NO: 1832445 - RNA, 23 nt, Human
gcccuuaccugccaggaagccag

SEQ ID NO: 1832446 - RNA, 21 nt, Human
gcccugugggcccccaaaugg

SEQ ID NO: 1832447 - RNA, 12 nt, Human
gccuagcauacg

SEQ ID NO: 1832448 - RNA, 19 nt, Human
gccuagcauacguacacau

SEQ ID NO: 1832449 - RNA, 17 nt, Human
gccuacaggagugagca

SEQ ID NO: 1832450 - RNA, 19 nt, Human
gccucaugcuaagacucag

SEQ ID NO: 1832451 - RNA, 22 nt, Human
gccucauguccacugguucuuc

SEQ ID NO: 1832452 - RNA, 13 nt, Human
gccuccauccuga

SEQ ID NO: 1832453 - RNA, 14 nt, Human
gccuccauccugag

SEQ ID NO: 1832454 - RNA, 15 nt, Human
gccuccauccugagg

SEQ ID NO: 1832455 - RNA, 18 nt, Human
gccuccugcccuuaccug

SEQ ID NO: 1832456 - RNA, 19 nt, Human
gccuccugaguagcuggga

SEQ ID NO: 1832457 - RNA, 16 nt, Human
gccucgaacuggcugc

SEQ ID NO: 1832458 - RNA, 22 nt, Human
gccuccuuugugaggaagccgc

SEQ ID NO: 1832459 - RNA, 13 nt, Human
gccucgaacuggc

SEQ ID NO: 1832460 - RNA, 20 nt, Human
gccccaaaacucuccucugc

SEQ ID NO: 1832461 - RNA, 11 nt, Human
gccccaaaagg

SEQ ID NO: 1832462 - RNA, 21 nt, Human
gccccaaaacucuccucugcu

SEQ ID NO: 1832463 - RNA, 16 nt, Human
gcccccucugcccugc

SEQ ID NO: 1832464 - RNA, 15 nt, Human
gcccccucugcccug

SEQ ID NO: 1832465 - RNA, 17 nt, Human
gcccccucugcccugcg

SEQ ID NO: 1832466 - RNA, 12 nt, Human
gccccugcuggu

SEQ ID NO: 1832467 - RNA, 15 nt, Human
gccccuggcagcccc

SEQ ID NO: 1832468 - RNA, 12 nt, Human
gccccuggcagc

SEQ ID NO: 1832469 - RNA, 15 nt, Human
gccccugcugguuca

SEQ ID NO: 1832470 - RNA, 16 nt, Human
gccccugcugguucag

SEQ ID NO: 1832471 - RNA, 11 nt, Human
gcccaggcagg

SEQ ID NO: 1832472 - RNA, 11 nt, Human
gcccaggcccc

SEQ ID NO: 1832473 - RNA, 12 nt, Human
gcccaggccccu

SEQ ID NO: 1832474 - RNA, 20 nt, Human
gcccaggccccugccacccu

SEQ ID NO: 1832475 - RNA, 21 nt, Human
gcccaggccccugccacccug

SEQ ID NO: 1832476 - RNA, 22 nt, Human
gcccaggccccugccacccugg

SEQ ID NO: 1832477 - RNA, 22 nt, Human
gcccacuguacuugcucuugau

SEQ ID NO: 1832478 - RNA, 20 nt, Human
gcccacuguacuugcucuug

SEQ ID NO: 1832479 - RNA, 15 nt, Human
gcccacuguacuugc

SEQ ID NO: 1832480 - RNA, 23 nt, Human
gcccacgcuggagugcagugagc

SEQ ID NO: 1832481 - RNA, 19 nt, Human
gcccacgcuggagugcagu

SEQ ID NO: 1832482 - RNA, 21 nt, Human
gcccacgcuggagugcaguga

SEQ ID NO: 1832483 - RNA, 23 nt, Human
gcccaggaaaggcuccaggagca

SEQ ID NO: 1832484 - RNA, 22 nt, Human
gcccaggaaaggcuccaggagc

SEQ ID NO: 1832485 - RNA, 24 nt, Human
gcccaggaaaggcuccaggagcag

SEQ ID NO: 1832486 - RNA, 13 nt, Human
gcccacuucugcc

SEQ ID NO: 1832487 - RNA, 21 nt, Human
gcccacgcccccacuggugac

SEQ ID NO: 1832488 - RNA, 17 nt, Human
gcccacgcccccacugg

SEQ ID NO: 1832489 - RNA, 16 nt, Human
gcccacgcccccacug

SEQ ID NO: 1832490 - RNA, 15 nt, Human
gcccacgcccccacu

SEQ ID NO: 1832491 - RNA, 17 nt, Human
gccauugacuucuuccc

SEQ ID NO: 1832492 - RNA, 19 nt, Human
gcauuuaggccaugggaca

SEQ ID NO: 1832493 - RNA, 18 nt, Human
gcauuuacuuuguguuca

SEQ ID NO: 1832494 - RNA, 16 nt, Human
gcgcaggcuggcccug

SEQ ID NO: 1832495 - RNA, 15 nt, Human
gcgcaggcuggcccu

SEQ ID NO: 1832496 - RNA, 21 nt, Human
gcgcagcauauucaggaagcu

SEQ ID NO: 1832497 - RNA, 14 nt, Human
gcgcaggcuggccc

SEQ ID NO: 1832498 - RNA, 23 nt, Human
gcgauucuucugcuucagccucc

SEQ ID NO: 1832499 - RNA, 22 nt, Human
gccuugaccauucuccaccugc

SEQ ID NO: 1832500 - RNA, 16 nt, Human
gccuugaccauucucc

SEQ ID NO: 1832501 - RNA, 23 nt, Human
gccuugaacuuugaccucugcag

SEQ ID NO: 1832502 - RNA, 23 nt, Human
gccuugaccauucuccaccugcc

SEQ ID NO: 1832503 - RNA, 22 nt, Human
gcgauucuucugcuucagccuc

SEQ ID NO: 1832504 - RNA, 14 nt, Human
gccuugaacuuuga

SEQ ID NO: 1832505 - RNA, 21 nt, Human
gccuucuuuucucccuuuuaa

SEQ ID NO: 1832506 - RNA, 15 nt, Human
gccuucucugaagga

SEQ ID NO: 1832507 - RNA, 16 nt, Human
gccuucucugaaggac

SEQ ID NO: 1832508 - RNA, 15 nt, Human
gccuguucagcucca

SEQ ID NO: 1832509 - RNA, 16 nt, Human
gccuguucagcuccag

SEQ ID NO: 1832510 - RNA, 17 nt, Human
gccuguucagcuccagc

SEQ ID NO: 1832511 - RNA, 19 nt, Human
gccugugccucugggacug

SEQ ID NO: 1832512 - RNA, 11 nt, Human
gccugggcaga

SEQ ID NO: 1832513 - RNA, 23 nt, Human
gccugggaucccucauccucaua

SEQ ID NO: 1832514 - RNA, 16 nt, Human
gcggccuuuggcuuca

SEQ ID NO: 1832515 - RNA, 15 nt, Human
gcggcuggcagccca

SEQ ID NO: 1832516 - RNA, 18 nt, Human
gcuaagugauccucccac

SEQ ID NO: 1832517 - RNA, 22 nt, Human
gcuaagugauccucccaccuca

SEQ ID NO: 1832518 - RNA, 21 nt, Human
gcuaggaauuguguuuauaau

SEQ ID NO: 1832519 - RNA, 22 nt, Human
gcuaggaccccuccaugugggc

SEQ ID NO: 1832520 - RNA, 20 nt, Human
gcuaggaccccuccaugugg

SEQ ID NO: 1832521 - RNA, 18 nt, Human
gcuauucaguaauaacuc

SEQ ID NO: 1832522 - RNA, 14 nt, Human
gcuaguugggcuuc

SEQ ID NO: 1832523 - RNA, 16 nt, Human
gcuaguugggcuuccu

SEQ ID NO: 1832524 - RNA, 20 nt, Human
gcucagggccuggcucaggu

SEQ ID NO: 1832525 - RNA, 19 nt, Human
gcucagggccuggcucagg

SEQ ID NO: 1832526 - RNA, 18 nt, Human
gcucagggccuggcucag

SEQ ID NO: 1832527 - RNA, 13 nt, Human
gcucaggaguuug

SEQ ID NO: 1832528 - RNA, 23 nt, Human
gcucaggagcccugggaggcucu

SEQ ID NO: 1832529 - RNA, 22 nt, Human
gcucaggagcccugggaggcuc

SEQ ID NO: 1832530 - RNA, 16 nt, Human
gcucagagcaguguuu

SEQ ID NO: 1832531 - RNA, 21 nt, Human
ggaagccagcaggcucucagg

SEQ ID NO: 1832532 - RNA, 23 nt, Human
ggaagccagcaggcucucaggcc

SEQ ID NO: 1832533 - RNA, 22 nt, Human
ggaagccagcaggcucucaggc

SEQ ID NO: 1832534 - RNA, 18 nt, Human
ggaagccgcuggggccag

SEQ ID NO: 1832535 - RNA, 23 nt, Human
ggaaaucaccgaaaacguggcug

SEQ ID NO: 1832536 - RNA, 16 nt, Human
ggaaauccaggguggu

SEQ ID NO: 1832537 - RNA, 14 nt, Human
ggacauggacaagg

SEQ ID NO: 1832538 - RNA, 13 nt, Human
ggacauggacaag

SEQ ID NO: 1832539 - RNA, 15 nt, Human
ggacagggcauggcc

SEQ ID NO: 1832540 - RNA, 22 nt, Human
ggacagggcauggccagguggc

SEQ ID NO: 1832541 - RNA, 23 nt, Human
ggacacccugugauggggcccug

SEQ ID NO: 1832542 - RNA, 13 nt, Human
ggacacccuguga

SEQ ID NO: 1832543 - RNA, 17 nt, Human
ggacagggaggugaccc

SEQ ID NO: 1832544 - RNA, 12 nt, Human
ggacacccugug

SEQ ID NO: 1832545 - RNA, 14 nt, Human
ggacacagcucuuc

SEQ ID NO: 1832546 - RNA, 13 nt, Human
ggacacagcucuu

SEQ ID NO: 1832547 - RNA, 19 nt, Human
ggaaugaaugucaguguga

SEQ ID NO: 1832548 - RNA, 18 nt, Human
ggaaugaagcaaugcuuc

SEQ ID NO: 1832549 - RNA, 12 nt, Human
ggacacagcucu

SEQ ID NO: 1832550 - RNA, 17 nt, Human
ggaagcucagggccugg

SEQ ID NO: 1832551 - RNA, 16 nt, Human
ggaagcucagggccug

SEQ ID NO: 1832552 - RNA, 15 nt, Human
ggaauaccugucccc

SEQ ID NO: 1832553 - RNA, 21 nt, Human
ggaagcucagggccuggcuca

SEQ ID NO: 1832554 - RNA, 22 nt, Human
ggaagcucagggccuggcucag

SEQ ID NO: 1832555 - RNA, 19 nt, Human
ggaauaccugucccccuga

SEQ ID NO: 1832556 - RNA, 16 nt, Human
ggaauaccuguccccc

SEQ ID NO: 1832557 - RNA, 16 nt, Human
ggaauauauaaccagu

SEQ ID NO: 1832558 - RNA, 21 nt, Human
gcuuggggaccagagcugcca

SEQ ID NO: 1832559 - RNA, 20 nt, Human
gcuuggggaccagagcugcc

SEQ ID NO: 1832560 - RNA, 18 nt, Human
gcuuggggaccagagcug

SEQ ID NO: 1832561 - RNA, 17 nt, Human
gcuuggggaccagagcu

SEQ ID NO: 1832562 - RNA, 22 nt, Human
gcuuggggaccagagcugccac

SEQ ID NO: 1832563 - RNA, 13 nt, Human
gcuuucuacccag

SEQ ID NO: 1832564 - RNA, 19 nt, Human
gcuuucuacccagcgagcc

SEQ ID NO: 1832565 - RNA, 22 nt, Human
gcuuucuacccagcgagcccug

SEQ ID NO: 1832566 - RNA, 23 nt, Human
gcuuucuacccagcgagcccugg

SEQ ID NO: 1832567 - RNA, 16 nt, Human
gcuuggggaccagagc

SEQ ID NO: 1832568 - RNA, 23 nt, Human
gcuugggcuucauccuccucaga

SEQ ID NO: 1832569 - RNA, 19 nt, Human
gcuugaccgugaggccaga

SEQ ID NO: 1832570 - RNA, 18 nt, Human
gcuugaccgugaggccag

SEQ ID NO: 1832571 - RNA, 17 nt, Human
gcuugaccgugaggcca

SEQ ID NO: 1832572 - RNA, 23 nt, Human
gcuucuucagagacuccugcagg

SEQ ID NO: 1832573 - RNA, 21 nt, Human
gcuucuucagagacuccugca

SEQ ID NO: 1832574 - RNA, 19 nt, Human
gcuucuucagagacuccug

SEQ ID NO: 1832575 - RNA, 17 nt, Human
gcuuaacuucacauauu

SEQ ID NO: 1832576 - RNA, 16 nt, Human
gcuucuucagagacuc

SEQ ID NO: 1832577 - RNA, 16 nt, Human
gcuuaacuucacauau

SEQ ID NO: 1832578 - RNA, 21 nt, Human
gcuuuucccuuuuuuuaagua

SEQ ID NO: 1832579 - RNA, 20 nt, Human
gcuuuucccuuuuuuuaagu

SEQ ID NO: 1832580 - RNA, 14 nt, Human
ggaaagaggcucug

SEQ ID NO: 1832581 - RNA, 20 nt, Human
ggaaagacuuuuccaacccu

SEQ ID NO: 1832582 - RNA, 17 nt, Human
ggaaagaguaggaagac

SEQ ID NO: 1832583 - RNA, 16 nt, Human
ggaaagaguaggaaga

SEQ ID NO: 1832584 - RNA, 19 nt, Human
ggaaagcaaaggagauugg

SEQ ID NO: 1832585 - RNA, 16 nt, Human
ggaaagcccugugcuc

SEQ ID NO: 1832586 - RNA, 21 nt, Human
ggaaacuaggugcauauuuau

SEQ ID NO: 1832587 - RNA, 15 nt, Human
ggaaacccagcucug

SEQ ID NO: 1832588 - RNA, 20 nt, Human
ggaaacagcuaaugggacac

SEQ ID NO: 1832589 - RNA, 15 nt, Human
gcuuuuuaauauuga

SEQ ID NO: 1832590 - RNA, 13 nt, Human
gcuuuugugcauu

SEQ ID NO: 1832591 - RNA, 19 nt, Human
gcuuuugugcauuaucuag

SEQ ID NO: 1832592 - RNA, 16 nt, Human
ggaaaaaauaacaaug

SEQ ID NO: 1832593 - RNA, 13 nt, Human
gcugcaccggcug

SEQ ID NO: 1832594 - RNA, 19 nt, Human
gcugcacccucaggcaggu

SEQ ID NO: 1832595 - RNA, 18 nt, Human
gcugcacccucaggcagg

SEQ ID NO: 1832596 - RNA, 19 nt, Human
gcugccccuggcagccccu

SEQ ID NO: 1832597 - RNA, 18 nt, Human
gcugccccuggcagcccc

SEQ ID NO: 1832598 - RNA, 20 nt, Human
gcugccccuggcagccccug

SEQ ID NO: 1832599 - RNA, 21 nt, Human
gcugccugggaucccucaucc

SEQ ID NO: 1832600 - RNA, 23 nt, Human
gcugcucuugaacuccugaccuc

SEQ ID NO: 1832601 - RNA, 17 nt, Human
gcugccuguucagcucc

SEQ ID NO: 1832602 - RNA, 12 nt, Human
gcugccuguuca

SEQ ID NO: 1832603 - RNA, 13 nt, Human
gcugccuguucag

SEQ ID NO: 1832604 - RNA, 20 nt, Human
gcugccugggaucccucauc

SEQ ID NO: 1832605 - RNA, 16 nt, Human
gcugccucucccauca

SEQ ID NO: 1832606 - RNA, 13 nt, Human
gcugccucaugcu

SEQ ID NO: 1832607 - RNA, 16 nt, Human
gcugagaggagagaga

SEQ ID NO: 1832608 - RNA, 14 nt, Human
gcugaggugggagg

SEQ ID NO: 1832609 - RNA, 23 nt, Human
gcugagggugagugggugaauaa

SEQ ID NO: 1832610 - RNA, 21 nt, Human
gcuggguucuacccaggugcu

SEQ ID NO: 1832611 - RNA, 20 nt, Human
gcuggguucuacccaggugc

SEQ ID NO: 1832612 - RNA, 17 nt, Human
gcuggguucuacccagg

SEQ ID NO: 1832613 - RNA, 18 nt, Human
gcuggguucuacccaggu

SEQ ID NO: 1832614 - RNA, 23 nt, Human
gcugggguggggaccucaggccu

SEQ ID NO: 1832615 - RNA, 22 nt, Human
gcugggguggggaccucaggcc

SEQ ID NO: 1832616 - RNA, 19 nt, Human
gcugggguggggaccucag

SEQ ID NO: 1832617 - RNA, 17 nt, Human
gcugggguggggaccuc

SEQ ID NO: 1832618 - RNA, 20 nt, Human
gcugggccccugccucucug

SEQ ID NO: 1832619 - RNA, 18 nt, Human
gcugggccccugccucuc

SEQ ID NO: 1832620 - RNA, 14 nt, Human
gcugggccccugcc

SEQ ID NO: 1832621 - RNA, 13 nt, Human
gcugggccccugc

SEQ ID NO: 1832622 - RNA, 12 nt, Human
gcugggccccug

SEQ ID NO: 1832623 - RNA, 20 nt, Human
gcuggcuguuggcugggggc

SEQ ID NO: 1832624 - RNA, 23 nt, Human
gcuggcuguuggcugggggccuc

SEQ ID NO: 1832625 - RNA, 14 nt, Human
gcuggcgugcagug

SEQ ID NO: 1832626 - RNA, 15 nt, Human
gcuggcgugcagugg

SEQ ID NO: 1832627 - RNA, 18 nt, Human
gcuggcgugcaguggugc

SEQ ID NO: 1832628 - RNA, 11 nt, Human
gcuggcugccu

SEQ ID NO: 1832629 - RNA, 20 nt, Human
gcuggcugccuuagaaccuu

SEQ ID NO: 1832630 - RNA, 14 nt, Human
gcuggcugccuuag

SEQ ID NO: 1832631 - RNA, 18 nt, Human
gcuggcuguuggcugggg

SEQ ID NO: 1832632 - RNA, 19 nt, Human
gcuggcuguuggcuggggg

SEQ ID NO: 1832633 - RNA, 12 nt, Human
gcugcugaaggc

SEQ ID NO: 1832634 - RNA, 17 nt, Human
gcuguaucccaugagcc

SEQ ID NO: 1832635 - RNA, 19 nt, Human
gcuguaucccaugagccuc

SEQ ID NO: 1832636 - RNA, 14 nt, Human
gcugugcugcccug

SEQ ID NO: 1832637 - RNA, 18 nt, Human
gcugugcucuggacaggc

SEQ ID NO: 1832638 - RNA, 15 nt, Human
gcugugcucuggaca

SEQ ID NO: 1832639 - RNA, 16 nt, Human
gcugugcucuggacag

SEQ ID NO: 1832640 - RNA, 16 nt, Human
gcugugccucugccug

SEQ ID NO: 1832641 - RNA, 15 nt, Human
gcugugccucugccu

SEQ ID NO: 1832642 - RNA, 14 nt, Human
gcugugccucugcc

SEQ ID NO: 1832643 - RNA, 13 nt, Human
gcugugcucugga

SEQ ID NO: 1832644 - RNA, 16 nt, Human
gcugugcugcccugcc

SEQ ID NO: 1832645 - RNA, 15 nt, Human
gcugugcugcccugc

SEQ ID NO: 1832646 - RNA, 17 nt, Human
gcugugcugcccugccc

SEQ ID NO: 1832647 - RNA, 15 nt, Human
gcuguuggcuggggg

SEQ ID NO: 1832648 - RNA, 16 nt, Human
gcuguuggcugggggc

SEQ ID NO: 1832649 - RNA, 20 nt, Human
gcuguuggcugggggccuca

SEQ ID NO: 1832650 - RNA, 13 nt, Human
ggcucacugcagc

SEQ ID NO: 1832651 - RNA, 14 nt, Human
ggcucacugcagcc

SEQ ID NO: 1832652 - RNA, 15 nt, Human
ggcucacugcagccu

SEQ ID NO: 1832653 - RNA, 18 nt, Human
ggcugcccuuucugggca

SEQ ID NO: 1832654 - RNA, 14 nt, Human
ggcugcccuuucug

SEQ ID NO: 1832655 - RNA, 11 nt, Human
ggcugcccuuu

SEQ ID NO: 1832656 - RNA, 10 nt, Human
ggcugcccuu

SEQ ID NO: 1832657 - RNA, 12 nt, Human
ggcugcccuggu

SEQ ID NO: 1832658 - RNA, 18 nt, Human
ggcucuuccaggcuggga

SEQ ID NO: 1832659 - RNA, 17 nt, Human
ggcucuuccaggcuggg

SEQ ID NO: 1832660 - RNA, 15 nt, Human
ggcucuuccaggcug

SEQ ID NO: 1832661 - RNA, 13 nt, Human
ggcucccuuccca

SEQ ID NO: 1832662 - RNA, 22 nt, Human
aaaaaacugcugacuguuuucu

SEQ ID NO: 1832663 - RNA, 14 nt, Human
aaaaaggaggaaga

SEQ ID NO: 1832664 - RNA, 12 nt, Human
aaaaaggcagga

SEQ ID NO: 1832665 - RNA, 21 nt, Human
aaaaaggaugcacagaguugu

SEQ ID NO: 1832666 - RNA, 14 nt, Human
aaaaauaaaaaaca

SEQ ID NO: 1832667 - RNA, 22 nt, Human
ggcuggguucuacccaggugcu

SEQ ID NO: 1832668 - RNA, 14 nt, Human
ggcuggguuggagg

SEQ ID NO: 1832669 - RNA, 13 nt, Human
aaaaauacaaaaa

SEQ ID NO: 1832670 - RNA, 15 nt, Human
ggcuggccuggcccc

SEQ ID NO: 1832671 - RNA, 14 nt, Human
ggcuggccuggccc

SEQ ID NO: 1832672 - RNA, 13 nt, Human
ggcuggccuggcc

SEQ ID NO: 1832673 - RNA, 17 nt, Human
ggcuggcccugcccugg

SEQ ID NO: 1832674 - RNA, 19 nt, Human
ggccccugccucucugcag

SEQ ID NO: 1832675 - RNA, 18 nt, Human
ggccccugccucucugca

SEQ ID NO: 1832676 - RNA, 17 nt, Human
ggccccugccucucugc

SEQ ID NO: 1832677 - RNA, 13 nt, Human
ggccccugccucu

SEQ ID NO: 1832678 - RNA, 21 nt, Human
ggccccugccucucugcaggu

SEQ ID NO: 1832679 - RNA, 17 nt, Human
ggccagaugcaccagcc

SEQ ID NO: 1832680 - RNA, 22 nt, Human
ggccagagggagugacagaggc

SEQ ID NO: 1832681 - RNA, 15 nt, Human
ggccagaugcaccag

SEQ ID NO: 1832682 - RNA, 16 nt, Human
ggccagaugcaccagc

SEQ ID NO: 1832683 - RNA, 22 nt, Human
ggccucccaacucaccccagcc

SEQ ID NO: 1832684 - RNA, 20 nt, Human
ggccucccaacucaccccag

SEQ ID NO: 1832685 - RNA, 23 nt, Human
ggccucccaacucaccccagccc

SEQ ID NO: 1832686 - RNA, 19 nt, Human
ggccucccaacucacccca

SEQ ID NO: 1832687 - RNA, 18 nt, Human
ggccucccaacucacccc

SEQ ID NO: 1832688 - RNA, 17 nt, Human
ggccucccaacucaccc

SEQ ID NO: 1832689 - RNA, 13 nt, Human
ggccucagugcca

SEQ ID NO: 1832690 - RNA, 16 nt, Human
ggccugcaagggagug

SEQ ID NO: 1832691 - RNA, 17 nt, Human
ggccuucagggagugag

SEQ ID NO: 1832692 - RNA, 16 nt, Human
ggccuggccagaugca

SEQ ID NO: 1832693 - RNA, 15 nt, Human
ggccuggcagccgug

SEQ ID NO: 1832694 - RNA, 14 nt, Human
ggccuggcagccgu

SEQ ID NO: 1832695 - RNA, 12 nt, Human
ggccuggccaga

SEQ ID NO: 1832696 - RNA, 15 nt, Human
ggccuggccagaugc

SEQ ID NO: 1832697 - RNA, 11 nt, Human
ggccugccugu

SEQ ID NO: 1832698 - RNA, 16 nt, Human
ggcuagagguucaaag

SEQ ID NO: 1832699 - RNA, 14 nt, Human
ggcuaccuuuguau

SEQ ID NO: 1832700 - RNA, 13 nt, Human
ggcuaccuuugua

SEQ ID NO: 1832701 - RNA, 22 nt, Human
ggcuacaccuuagccugcccuc

SEQ ID NO: 1832702 - RNA, 23 nt, Human
ggcuacaccuuagccugcccucc

SEQ ID NO: 1832703 - RNA, 18 nt, Human
ggcuaauuuuuguuuugu

SEQ ID NO: 1832704 - RNA, 16 nt, Human
ggcuaauguacugcau

SEQ ID NO: 1832705 - RNA, 20 nt, Human
ggcuaagugauccucccacc

SEQ ID NO: 1832706 - RNA, 18 nt, Human
ggccuucggccuccaucc

SEQ ID NO: 1832707 - RNA, 22 nt, Human
ggccuucggccuccauccugag

SEQ ID NO: 1832708 - RNA, 16 nt, Human
ggccuucggccuccau

SEQ ID NO: 1832709 - RNA, 18 nt, Human
ggcgugagaccugccccu

SEQ ID NO: 1832710 - RNA, 17 nt, Human
ggcgugagaccugcccc

SEQ ID NO: 1832711 - RNA, 16 nt, Human
ggcgugagaccugccc

SEQ ID NO: 1832712 - RNA, 14 nt, Human
ggcgugagaccugc

SEQ ID NO: 1832713 - RNA, 20 nt, Human
ggcuaagcuucacuguaaaa

SEQ ID NO: 1832714 - RNA, 18 nt, Human
ggcacaccgggcacucag

SEQ ID NO: 1832715 - RNA, 16 nt, Human
ggcacugcuuccagug

SEQ ID NO: 1832716 - RNA, 18 nt, Human
ggcacaucagcacgauuu

SEQ ID NO: 1832717 - RNA, 15 nt, Human
ggcaaaaaggcagga

SEQ ID NO: 1832718 - RNA, 14 nt, Human
ggauuuuugucuug

SEQ ID NO: 1832719 - RNA, 16 nt, Human
ggauuuuugucuugug

SEQ ID NO: 1832720 - RNA, 10 nt, Human
ggcaaaauaa

SEQ ID NO: 1832721 - RNA, 18 nt, Human
ggcaggaggaucacuuga

SEQ ID NO: 1832722 - RNA, 10 nt, Human
ggcagggagg

SEQ ID NO: 1832723 - RNA, 18 nt, Human
ggcagggagggccugggc

SEQ ID NO: 1832724 - RNA, 17 nt, Human
ggcagggagggccuggg

SEQ ID NO: 1832725 - RNA, 20 nt, Human
ggcagggagggccugggccc

SEQ ID NO: 1832726 - RNA, 19 nt, Human
ggcagggagggccugggcc

SEQ ID NO: 1832727 - RNA, 13 nt, Human
ggcagccaggcca

SEQ ID NO: 1832728 - RNA, 14 nt, Human
ggcagccaggccac

SEQ ID NO: 1832729 - RNA, 20 nt, Human
ggcacugcuuccagugaggc

SEQ ID NO: 1832730 - RNA, 22 nt, Human
ggcacugcuuccagugaggcuc

SEQ ID NO: 1832731 - RNA, 16 nt, Human
ggcagccucuucaaaa

SEQ ID NO: 1832732 - RNA, 22 nt, Human
ggcagccccauucugccugccc

SEQ ID NO: 1832733 - RNA, 16 nt, Human
ggcagccccauucugc

SEQ ID NO: 1832734 - RNA, 20 nt, Human
ggcagccccauucugccugc

SEQ ID NO: 1832735 - RNA, 21 nt, Human
ggcagccccauucugccugcc

SEQ ID NO: 1832736 - RNA, 14 nt, Human
ggcauuugcugaau

SEQ ID NO: 1832737 - RNA, 20 nt, Human
ggcaucgcaauguaagacuc

SEQ ID NO: 1832738 - RNA, 19 nt, Human
ggccaaaggaagcacaugc

SEQ ID NO: 1832739 - RNA, 16 nt, Human
ggccaaaggaagcaca

SEQ ID NO: 1832740 - RNA, 14 nt, Human
ggccaaaggaagca

SEQ ID NO: 1832741 - RNA, 17 nt, Human
ggcauuuguuugaacug

SEQ ID NO: 1832742 - RNA, 17 nt, Human
ggccagagacacaagcc

SEQ ID NO: 1832743 - RNA, 18 nt, Human
ggccagagacacaagccu

SEQ ID NO: 1832744 - RNA, 17 nt, Human
ggccagagggagugaca

SEQ ID NO: 1832745 - RNA, 19 nt, Human
ggccagagggagugacaga

SEQ ID NO: 1832746 - RNA, 15 nt, Human
ggaggcucuggagcc

SEQ ID NO: 1832747 - RNA, 14 nt, Human
ggaggggggaggug

SEQ ID NO: 1832748 - RNA, 13 nt, Human
ggaggggggaggu

SEQ ID NO: 1832749 - RNA, 21 nt, Human
ggagggugacgggggugaacu

SEQ ID NO: 1832750 - RNA, 22 nt, Human
ggagguaaggaauaccuguccc

SEQ ID NO: 1832751 - RNA, 23 nt, Human
ggaggugggauccuccaggugca

SEQ ID NO: 1832752 - RNA, 22 nt, Human
ggaggugggauccuccaggugc

SEQ ID NO: 1832753 - RNA, 15 nt, Human
ggaguggccacagaa

SEQ ID NO: 1832754 - RNA, 22 nt, Human
ggagugggcccaaugcacuuug

SEQ ID NO: 1832755 - RNA, 12 nt, Human
ggagugggccca

SEQ ID NO: 1832756 - RNA, 16 nt, Human
ggaguggccacagaaa

SEQ ID NO: 1832757 - RNA, 14 nt, Human
ggaugaaaaaauaa

SEQ ID NO: 1832758 - RNA, 22 nt, Human
ggaucuuuggacagaagcagcu

SEQ ID NO: 1832759 - RNA, 13 nt, Human
ggauuguccccga

SEQ ID NO: 1832760 - RNA, 14 nt, Human
ggauuguaguccca

SEQ ID NO: 1832761 - RNA, 22 nt, Human
ggauuuaacagaaauguacagc

SEQ ID NO: 1832762 - RNA, 16 nt, Human
ggauuuaacagaaaug

SEQ ID NO: 1832763 - RNA, 17 nt, Human
ggauuuaacagaaaugu

SEQ ID NO: 1832764 - RNA, 20 nt, Human
ggauuguccccgacccuugc

SEQ ID NO: 1832765 - RNA, 16 nt, Human
ggauuguccccgaccc

SEQ ID NO: 1832766 - RNA, 12 nt, Human
ggauuuaacaga

SEQ ID NO: 1832767 - RNA, 23 nt, Human
ggauccugagccagauuucacuc

SEQ ID NO: 1832768 - RNA, 20 nt, Human
ggauccugagccagauuuca

SEQ ID NO: 1832769 - RNA, 19 nt, Human
ggauccugagccagauuuc

SEQ ID NO: 1832770 - RNA, 18 nt, Human
ggauccugagccagauuu

SEQ ID NO: 1832771 - RNA, 16 nt, Human
ggauccugagccagau

SEQ ID NO: 1832772 - RNA, 15 nt, Human
ggauccugagccaga

SEQ ID NO: 1832773 - RNA, 16 nt, Human
ggaguucaucuugaau

SEQ ID NO: 1832774 - RNA, 21 nt, Human
ggaucuuuggacagaagcagc

SEQ ID NO: 1832775 - RNA, 18 nt, Human
ggaucucuugagccuggg

SEQ ID NO: 1832776 - RNA, 14 nt, Human
gggccaggagccuc

SEQ ID NO: 1832777 - RNA, 13 nt, Human
gggccaggagccu

SEQ ID NO: 1832778 - RNA, 12 nt, Human
gggccaggagcc

SEQ ID NO: 1832779 - RNA, 15 nt, Human
gggccucagugccac

SEQ ID NO: 1832780 - RNA, 13 nt, Human
gggccucagugcc

SEQ ID NO: 1832781 - RNA, 14 nt, Human
gggccucagugcca

SEQ ID NO: 1832782 - RNA, 22 nt, Human
gggccucgguguggagaagcgg

SEQ ID NO: 1832783 - RNA, 18 nt, Human
gggccucuuaugggcugg

SEQ ID NO: 1832784 - RNA, 19 nt, Human
gggccucuuaugggcuggg

SEQ ID NO: 1832785 - RNA, 19 nt, Human
gggcgugagaccugccccu

SEQ ID NO: 1832786 - RNA, 18 nt, Human
gggcgugagaccugcccc

SEQ ID NO: 1832787 - RNA, 21 nt, Human
gggcggugagaggggaacaga

SEQ ID NO: 1832788 - RNA, 15 nt, Human
gggcgugguggugag

SEQ ID NO: 1832789 - RNA, 19 nt, Human
gggcugcaccggcuggccu

SEQ ID NO: 1832790 - RNA, 17 nt, Human
gggcugcaccggcuggc

SEQ ID NO: 1832791 - RNA, 13 nt, Human
gggcuccagacac

SEQ ID NO: 1832792 - RNA, 10 nt, Human
gggcuccaga

SEQ ID NO: 1832793 - RNA, 21 nt, Human
gggcucagcggggacagcucc

SEQ ID NO: 1832794 - RNA, 20 nt, Human
gggcuaggaaauccagggug

SEQ ID NO: 1832795 - RNA, 15 nt, Human
gggcuaguugggcuu

SEQ ID NO: 1832796 - RNA, 22 nt, Human
gggcucagcaaaagaugcuucu

SEQ ID NO: 1832797 - RNA, 18 nt, Human
gggcuaguugggcuuccu

SEQ ID NO: 1832798 - RNA, 17 nt, Human
gggcucagcggggacag

SEQ ID NO: 1832799 - RNA, 19 nt, Human
gggcucagcggggacagcu

SEQ ID NO: 1832800 - RNA, 15 nt, Human
gggcugggcagagga

SEQ ID NO: 1832801 - RNA, 21 nt, Human
gggcugcaccggcuggccugg

SEQ ID NO: 1832802 - RNA, 20 nt, Human
gggcugcaccggcuggccug

SEQ ID NO: 1832803 - RNA, 16 nt, Human
aaaaugguuuaaaugg

SEQ ID NO: 1832804 - RNA, 18 nt, Human
aaaaugguuuaaaugguc

SEQ ID NO: 1832805 - RNA, 17 nt, Human
gggcuggguucuaccca

SEQ ID NO: 1832806 - RNA, 14 nt, Human
aaaaggaugcacag

SEQ ID NO: 1832807 - RNA, 15 nt, Human
aaaaggaugcacaga

SEQ ID NO: 1832808 - RNA, 19 nt, Human
aaaaggaugcacagaguug

SEQ ID NO: 1832809 - RNA, 22 nt, Human
aaaaggaugcacagaguuguua

SEQ ID NO: 1832810 - RNA, 13 nt, Human
aaaaggaugcaca

SEQ ID NO: 1832811 - RNA, 22 nt, Human
aaaaggagccaauuuaaagaaa

SEQ ID NO: 1832812 - RNA, 16 nt, Human
aaaagguuaauaaagu

SEQ ID NO: 1832813 - RNA, 17 nt, Human
aaaagguuaauaaagua

SEQ ID NO: 1832814 - RNA, 11 nt, Human
aaaaggcagga

SEQ ID NO: 1832815 - RNA, 13 nt, Human
aaaauaccaagga

SEQ ID NO: 1832816 - RNA, 15 nt, Human
aaaauauuccugcau

SEQ ID NO: 1832817 - RNA, 22 nt, Human
aaaauaugaccacacuccagcu

SEQ ID NO: 1832818 - RNA, 16 nt, Human
aaaauauuuuccugcc

SEQ ID NO: 1832819 - RNA, 15 nt, Human
aaaaucugcuaggga

SEQ ID NO: 1832820 - RNA, 12 nt, Human
aaaaugagaaau

SEQ ID NO: 1832821 - RNA, 11 nt, Human
aaaaugagaaa

SEQ ID NO: 1832822 - RNA, 21 nt, Human
aaaaugcuguauuagucacag

SEQ ID NO: 1832823 - RNA, 23 nt, Human
aaaaugcuguauuagucacagag

SEQ ID NO: 1832824 - RNA, 20 nt, Human
aaaauggaagacagcucuua

SEQ ID NO: 1832825 - RNA, 15 nt, Human
ggggcccugccuccu

SEQ ID NO: 1832826 - RNA, 17 nt, Human
gggggaucacagccucu

SEQ ID NO: 1832827 - RNA, 11 nt, Human
gggggcuggga

SEQ ID NO: 1832828 - RNA, 15 nt, Human
gggggcugggcagag

SEQ ID NO: 1832829 - RNA, 13 nt, Human
ggggguggccucc

SEQ ID NO: 1832830 - RNA, 21 nt, Human
ggggucacucuggcagcucag

SEQ ID NO: 1832831 - RNA, 13 nt, Human
ggggaccagagcu

SEQ ID NO: 1832832 - RNA, 12 nt, Human
ggggaccagagc

SEQ ID NO: 1832833 - RNA, 18 nt, Human
aaaauguauguguaagua

SEQ ID NO: 1832834 - RNA, 14 nt, Human
ggggaccagagcug

SEQ ID NO: 1832835 - RNA, 22 nt, Human
aaaccugugucucugagaguag

SEQ ID NO: 1832836 - RNA, 17 nt, Human
aaaccuucacuuaggaa

SEQ ID NO: 1832837 - RNA, 20 nt, Human
gggucacucuggcagcucag

SEQ ID NO: 1832838 - RNA, 14 nt, Human
gggucacucuggca

SEQ ID NO: 1832839 - RNA, 22 nt, Human
gggucacucuggcagcucagag

SEQ ID NO: 1832840 - RNA, 19 nt, Human
aaacauuuugucauauaag

SEQ ID NO: 1832841 - RNA, 19 nt, Human
gguaucaggugcugccauc

SEQ ID NO: 1832842 - RNA, 14 nt, Human
ggucagugcaaaua

SEQ ID NO: 1832843 - RNA, 22 nt, Human
aaacuugauguguuaucucuua

SEQ ID NO: 1832844 - RNA, 20 nt, Human
gguaaggaauaccugucccc

SEQ ID NO: 1832845 - RNA, 20 nt, Human
gguaggguaagugagagagg

SEQ ID NO: 1832846 - RNA, 23 nt, Human
gguagggugggccuucagggagu

SEQ ID NO: 1832847 - RNA, 11 nt, Human
gguaggguggg

SEQ ID NO: 1832848 - RNA, 13 nt, Human
gguauagaaaugc

SEQ ID NO: 1832849 - RNA, 14 nt, Human
gguaucaggugcug

SEQ ID NO: 1832850 - RNA, 21 nt, Human
aaacguggcugcuucaaggau

SEQ ID NO: 1832851 - RNA, 18 nt, Human
gggugggacacccuguga

SEQ ID NO: 1832852 - RNA, 15 nt, Human
gggugggacacccug

SEQ ID NO: 1832853 - RNA, 19 nt, Human
aaacuuaaucuaaauggaa

SEQ ID NO: 1832854 - RNA, 14 nt, Human
aaacuuaaucuaaa

SEQ ID NO: 1832855 - RNA, 22 nt, Human
gguaaaucagacuaugaaguuu

SEQ ID NO: 1832856 - RNA, 13 nt, Human
gguaacaggcaga

SEQ ID NO: 1832857 - RNA, 19 nt, Human
gggugggacacccugugau

SEQ ID NO: 1832858 - RNA, 15 nt, Human
gggugguggugauag

SEQ ID NO: 1832859 - RNA, 20 nt, Human
ggguuuugccauguuggcca

SEQ ID NO: 1832860 - RNA, 23 nt, Human
ggguuuugccauguuggccaggc

SEQ ID NO: 1832861 - RNA, 16 nt, Human
guaaagcuagaaauga

SEQ ID NO: 1832862 - RNA, 15 nt, Human
guaaagcuagaaaug

SEQ ID NO: 1832863 - RNA, 19 nt, Human
guaacaggaaaauuuuaaa

SEQ ID NO: 1832864 - RNA, 16 nt, Human
guaacaagccacccca

SEQ ID NO: 1832865 - RNA, 20 nt, Human
guaacaggaaaauuuuaaaa

SEQ ID NO: 1832866 - RNA, 13 nt, Human
guaaaccuuuuau

SEQ ID NO: 1832867 - RNA, 22 nt, Human
aaaguguauuuuuuuacuaaua

SEQ ID NO: 1832868 - RNA, 22 nt, Human
aaauaaugugaaacuggauuaa

SEQ ID NO: 1832869 - RNA, 14 nt, Human
aaauaaugugaaac

SEQ ID NO: 1832870 - RNA, 15 nt, Human
guaaucgaccugccu

SEQ ID NO: 1832871 - RNA, 23 nt, Human
guaauccuagcacuuugggaggc

SEQ ID NO: 1832872 - RNA, 15 nt, Human
guaauuugugauaca

SEQ ID NO: 1832873 - RNA, 17 nt, Human
guaaucgaccugccucg

SEQ ID NO: 1832874 - RNA, 17 nt, Human
guaauuugugauacaau

SEQ ID NO: 1832875 - RNA, 20 nt, Human
guaauuugugauacaaugcu

SEQ ID NO: 1832876 - RNA, 21 nt, Human
guaauuuuuuuaucgucacug

SEQ ID NO: 1832877 - RNA, 22 nt, Human
guacaaccuguucugcuuuccu

SEQ ID NO: 1832878 - RNA, 23 nt, Human
aaauaucugaaaauguaugugua

SEQ ID NO: 1832879 - RNA, 22 nt, Human
aaauaucugaaaauguaugugu

SEQ ID NO: 1832880 - RNA, 21 nt, Human
aaauaucugaaaauguaugug

SEQ ID NO: 1832881 - RNA, 19 nt, Human
aaauaucugaaaauguaug

SEQ ID NO: 1832882 - RNA, 18 nt, Human
aaauaucugaaaauguau

SEQ ID NO: 1832883 - RNA, 17 nt, Human
aaauaucugaaaaugua

SEQ ID NO: 1832884 - RNA, 14 nt, Human
aaauaucugaaaau

SEQ ID NO: 1832885 - RNA, 12 nt, Human
aaauaucugaaa

SEQ ID NO: 1832886 - RNA, 23 nt, Human
aaaucagccugcuccagcuguuc

SEQ ID NO: 1832887 - RNA, 21 nt, Human
aaaucagccugcuccagcugu

SEQ ID NO: 1832888 - RNA, 19 nt, Human
aaaucagccugcuccagcu

SEQ ID NO: 1832889 - RNA, 19 nt, Human
aaauauuaagaaagacuau

SEQ ID NO: 1832890 - RNA, 20 nt, Human
aaauauuccugcauuuguga

SEQ ID NO: 1832891 - RNA, 22 nt, Human
aaauauauuuuaagacgaaaca

SEQ ID NO: 1832892 - RNA, 16 nt, Human
aaauauauuuuaagac

SEQ ID NO: 1832893 - RNA, 14 nt, Human
aaauauauaucaaa

SEQ ID NO: 1832894 - RNA, 18 nt, Human
aaauauaugcuaagucuu

SEQ ID NO: 1832895 - RNA, 15 nt, Human
aaauauaggaacuua

SEQ ID NO: 1832896 - RNA, 20 nt, Human
aaauaccagccaguaaaugg

SEQ ID NO: 1832897 - RNA, 21 nt, Human
aaauaccagccaguaaauggg

SEQ ID NO: 1832898 - RNA, 19 nt, Human
aaauaccagccaguaaaug

SEQ ID NO: 1832899 - RNA, 16 nt, Human
guacacacacauacac

SEQ ID NO: 1832900 - RNA, 21 nt, Human
aaaguauccugcuucugauau

SEQ ID NO: 1832901 - RNA, 14 nt, Human
aaaguguauuuuuu

SEQ ID NO: 1832902 - RNA, 21 nt, Human
aaaguguauuuuuuuacuaau

SEQ ID NO: 1832903 - RNA, 16 nt, Human
aaagugguauagaaau

SEQ ID NO: 1832904 - RNA, 17 nt, Human
aaagugguauagaaaug

SEQ ID NO: 1832905 - RNA, 20 nt, Human
aaagugguauagaaaugcug

SEQ ID NO: 1832906 - RNA, 19 nt, Human
aaaguacacuguuucaaac

SEQ ID NO: 1832907 - RNA, 18 nt, Human
aaaguacacuguuucaaa

SEQ ID NO: 1832908 - RNA, 22 nt, Human
aaaguagaagucuuagauguau

SEQ ID NO: 1832909 - RNA, 20 nt, Human
aaaguagaagucuuagaugu

SEQ ID NO: 1832910 - RNA, 21 nt, Human
aaaguaucccuacuguaauuu

SEQ ID NO: 1832911 - RNA, 15 nt, Human
gguuuccugcccugg

SEQ ID NO: 1832912 - RNA, 13 nt, Human
gguuuccugcccu

SEQ ID NO: 1832913 - RNA, 12 nt, Human
gguuuccugccc

SEQ ID NO: 1832914 - RNA, 16 nt, Human
gguuucuaaagcugcc

SEQ ID NO: 1832915 - RNA, 19 nt, Human
gguuuccugcccugggagg

SEQ ID NO: 1832916 - RNA, 16 nt, Human
gguuuccugcccuggg

SEQ ID NO: 1832917 - RNA, 22 nt, Human
gguuucuaaagcugccagccga

SEQ ID NO: 1832918 - RNA, 20 nt, Human
gguuuguaaauuaacuuuua

SEQ ID NO: 1832919 - RNA, 12 nt, Human
gguguggagaag

SEQ ID NO: 1832920 - RNA, 23 nt, Human
gguguggagaagcggcuggcagc

SEQ ID NO: 1832921 - RNA, 14 nt, Human
gguguggagaagcg

SEQ ID NO: 1832922 - RNA, 13 nt, Human
ggugggggccucg

SEQ ID NO: 1832923 - RNA, 13 nt, Human
ggugugggggaag

SEQ ID NO: 1832924 - RNA, 11 nt, Human
gguguggggga

SEQ ID NO: 1832925 - RNA, 17 nt, Human
gguguuuccuggcacug

SEQ ID NO: 1832926 - RNA, 19 nt, Human
gguguuuccuggcacugcu

SEQ ID NO: 1832927 - RNA, 17 nt, Human
gguucccauuugcuccu

SEQ ID NO: 1832928 - RNA, 23 nt, Human
gguucccuuugacgccaucccag

SEQ ID NO: 1832929 - RNA, 22 nt, Human
gguucccuuuuuuggcugcuga

SEQ ID NO: 1832930 - RNA, 20 nt, Human
ggugggaggaucucuugagc

SEQ ID NO: 1832931 - RNA, 17 nt, Human
ggugggacacccuguga

SEQ ID NO: 1832932 - RNA, 16 nt, Human
ggugggacacccugug

SEQ ID NO: 1832933 - RNA, 13 nt, Human
ggugggacacccu

SEQ ID NO: 1832934 - RNA, 19 nt, Human
gguggggaccucaggccug

SEQ ID NO: 1832935 - RNA, 21 nt, Human
aaaguaaaaacaaagaaauua

SEQ ID NO: 1832936 - RNA, 18 nt, Human
gguggcuggguuggaggg

SEQ ID NO: 1832937 - RNA, 12 nt, Human
gguggcuggguu

SEQ ID NO: 1832938 - RNA, 18 nt, Human
aaagguucaugcaaacuu

SEQ ID NO: 1832939 - RNA, 20 nt, Human
aaagggcccagagagggugg

SEQ ID NO: 1832940 - RNA, 12 nt, Human
aaacuuuaugcu

SEQ ID NO: 1832941 - RNA, 19 nt, Human
aaacuuuaugcuaagugaa

SEQ ID NO: 1832942 - RNA, 16 nt, Human
aaagcagaacagugau

SEQ ID NO: 1832943 - RNA, 20 nt, Human
gguggcaccagcagccugga

SEQ ID NO: 1832944 - RNA, 14 nt, Human
gguggcaccagcag

SEQ ID NO: 1832945 - RNA, 14 nt, Human
aaagcuguguggca

SEQ ID NO: 1832946 - RNA, 22 nt, Human
aaagcugccagccgagauagcc

SEQ ID NO: 1832947 - RNA, 13 nt, Human
aaagcugccagcc

SEQ ID NO: 1832948 - RNA, 12 nt, Human
aaagcugccagc

SEQ ID NO: 1832949 - RNA, 17 nt, Human
aaagcuaggccuggcca

SEQ ID NO: 1832950 - RNA, 16 nt, Human
aaagcagugcaugcug

SEQ ID NO: 1832951 - RNA, 14 nt, Human
aaagcuagaaauga

SEQ ID NO: 1832952 - RNA, 13 nt, Human
aaagcagugcaug

SEQ ID NO: 1832953 - RNA, 14 nt, Human
aaagcuaggccugg

SEQ ID NO: 1832954 - RNA, 16 nt, Human
aaagcuaggccuggcc

SEQ ID NO: 1832955 - RNA, 15 nt, Human
aaagcagcguuucua

SEQ ID NO: 1832956 - RNA, 14 nt, Human
gugucaccugaaga

SEQ ID NO: 1832957 - RNA, 22 nt, Human
gugucaccugaagacucauucu

SEQ ID NO: 1832958 - RNA, 14 nt, Human
gugucagguggggc

SEQ ID NO: 1832959 - RNA, 18 nt, Human
gugucagguggggcagcu

SEQ ID NO: 1832960 - RNA, 23 nt, Human
gugugaaccaccacacccagccc

SEQ ID NO: 1832961 - RNA, 20 nt, Human
gugucagguggggcagcuug

SEQ ID NO: 1832962 - RNA, 19 nt, Human
gugucagguggggcagcuu

SEQ ID NO: 1832963 - RNA, 20 nt, Human
aagaucaaaagguuaauaaa

SEQ ID NO: 1832964 - RNA, 23 nt, Human
aagaucaaaagguuaauaaagua

SEQ ID NO: 1832965 - RNA, 16 nt, Human
aagauggcugugccuc

SEQ ID NO: 1832966 - RNA, 23 nt, Human
aagauggcacuuauaaccaaagc

SEQ ID NO: 1832967 - RNA, 17 nt, Human
aagcaacccaaauguuc

SEQ ID NO: 1832968 - RNA, 20 nt, Human
aagcaaaugugaaucauuuu

SEQ ID NO: 1832969 - RNA, 11 nt, Human
aagaggcaggg

SEQ ID NO: 1832970 - RNA, 14 nt, Human
aagaggcagggucu

SEQ ID NO: 1832971 - RNA, 22 nt, Human
aagagggagggagggcuccaga

SEQ ID NO: 1832972 - RNA, 21 nt, Human
aagagggagggagggcuccag

SEQ ID NO: 1832973 - RNA, 15 nt, Human
gugguuucagaaaug

SEQ ID NO: 1832974 - RNA, 23 nt, Human
gugcugcccugcccaccuggccu

SEQ ID NO: 1832975 - RNA, 12 nt, Human
aagcaugugaga

SEQ ID NO: 1832976 - RNA, 23 nt, Human
aagcaugcacaaauucugucucu

SEQ ID NO: 1832977 - RNA, 17 nt, Human
aagccaaagcuaggccu

SEQ ID NO: 1832978 - RNA, 18 nt, Human
aagccaaagcuaggccug

SEQ ID NO: 1832979 - RNA, 20 nt, Human
aagccaaagcuaggccuggc

SEQ ID NO: 1832980 - RNA, 20 nt, Human
aagcacaugccucucucagg

SEQ ID NO: 1832981 - RNA, 19 nt, Human
aagcacaugccucucucag

SEQ ID NO: 1832982 - RNA, 16 nt, Human
aagcacaugccucucu

SEQ ID NO: 1832983 - RNA, 15 nt, Human
aagcacaugccucuc

SEQ ID NO: 1832984 - RNA, 14 nt, Human
aagcacaugccucu

SEQ ID NO: 1832985 - RNA, 16 nt, Human
aagcacacuugacauc

SEQ ID NO: 1832986 - RNA, 13 nt, Human
guguuucuuuagu

SEQ ID NO: 1832987 - RNA, 16 nt, Human
guguuucuuuaguuuu

SEQ ID NO: 1832988 - RNA, 21 nt, Human
aagcacaugccucucucaggc

SEQ ID NO: 1832989 - RNA, 13 nt, Human
aagcaccuccugc

SEQ ID NO: 1832990 - RNA, 14 nt, Human
aagcaccuccugcc

SEQ ID NO: 1832991 - RNA, 15 nt, Human
aagcaccuccugccu

SEQ ID NO: 1832992 - RNA, 16 nt, Human
aagcaccuccugccuc

SEQ ID NO: 1832993 - RNA, 17 nt, Human
aagcaccuccugccucg

SEQ ID NO: 1832994 - RNA, 16 nt, Human
aagcacuaaacaaaga

SEQ ID NO: 1832995 - RNA, 17 nt, Human
guucagguaacaggcag

SEQ ID NO: 1832996 - RNA, 18 nt, Human
guucagguaacaggcaga

SEQ ID NO: 1832997 - RNA, 15 nt, Human
aagccguggcuuccc

SEQ ID NO: 1832998 - RNA, 14 nt, Human
aagccguggcuucc

SEQ ID NO: 1832999 - RNA, 13 nt, Human
aagccguggcuuc

SEQ ID NO: 1833000 - RNA, 21 nt, Human
aagccgugauuuucauugcug

SEQ ID NO: 1833001 - RNA, 20 nt, Human
guucaggguuggccccugcc

SEQ ID NO: 1833002 - RNA, 21 nt, Human
guucaggguuggccccugccc

SEQ ID NO: 1833003 - RNA, 22 nt, Human
guucaggguuggccccugcccg

SEQ ID NO: 1833004 - RNA, 23 nt, Human
guucagcuuguaaauagcucagg

SEQ ID NO: 1833005 - RNA, 18 nt, Human
aagccuguuuaagagaca

SEQ ID NO: 1833006 - RNA, 15 nt, Human
aagccuguuuaagag

SEQ ID NO: 1833007 - RNA, 15 nt, Human
aagccuccuccagcc

SEQ ID NO: 1833008 - RNA, 16 nt, Human
aagccucccacgacug

SEQ ID NO: 1833009 - RNA, 18 nt, Human
guuaaucauuagguguga

SEQ ID NO: 1833010 - RNA, 19 nt, Human
guuaauauuuauaggucac

SEQ ID NO: 1833011 - RNA, 23 nt, Human
guuacucuucaguuaagccuuug

SEQ ID NO: 1833012 - RNA, 13 nt, Human
aagcccagcuuga

SEQ ID NO: 1833013 - RNA, 19 nt, Human
guuagagguucccuuugac

SEQ ID NO: 1833014 - RNA, 19 nt, Human
guuauuauauuuacaaaug

SEQ ID NO: 1833015 - RNA, 20 nt, Human
guuauuauauuuacaaaugg

SEQ ID NO: 1833016 - RNA, 22 nt, Human
guucccuuuuuuggcugcugaa

SEQ ID NO: 1833017 - RNA, 21 nt, Human
guucccuuuuuuggcugcuga

SEQ ID NO: 1833018 - RNA, 21 nt, Human
aagcuuuuaugugaaacaugu

SEQ ID NO: 1833019 - RNA, 19 nt, Human
aagcuuuuaugugaaacau

SEQ ID NO: 1833020 - RNA, 15 nt, Human
guuccccaagacauu

SEQ ID NO: 1833021 - RNA, 17 nt, Human
aagcucugcuccucucc

SEQ ID NO: 1833022 - RNA, 19 nt, Human
guucuagcauggcugccaa

SEQ ID NO: 1833023 - RNA, 15 nt, Human
guucucucuucucca

SEQ ID NO: 1833024 - RNA, 12 nt, Human
guucucugagga

SEQ ID NO: 1833025 - RNA, 15 nt, Human
guucucugcccucca

SEQ ID NO: 1833026 - RNA, 14 nt, Human
guucucugaggaca

SEQ ID NO: 1833027 - RNA, 14 nt, Human
guucuuaauucuua

SEQ ID NO: 1833028 - RNA, 17 nt, Human
guucuuaauucuuagcu

SEQ ID NO: 1833029 - RNA, 18 nt, Human
guucucugcccuccaaga

SEQ ID NO: 1833030 - RNA, 17 nt, Human
guucucugcccuccaag

SEQ ID NO: 1833031 - RNA, 13 nt, Human
guucuuaauucuu

SEQ ID NO: 1833032 - RNA, 16 nt, Human
guucuuaagacgugau

SEQ ID NO: 1833033 - RNA, 19 nt, Human
guugauagcacagacccug

SEQ ID NO: 1833034 - RNA, 14 nt, Human
guugauagcacaga

SEQ ID NO: 1833035 - RNA, 15 nt, Human
guucuugguuuguaa

SEQ ID NO: 1833036 - RNA, 18 nt, Human
guucuugguuuguaaauu

SEQ ID NO: 1833037 - RNA, 14 nt, Human
guucuugguuugua

SEQ ID NO: 1833038 - RNA, 13 nt, Human
guuuggagacaga

SEQ ID NO: 1833039 - RNA, 20 nt, Human
guuugcuuuguaugcacuuu

SEQ ID NO: 1833040 - RNA, 21 nt, Human
aaguaauaugcacacauuuuu

SEQ ID NO: 1833041 - RNA, 17 nt, Human
aaguaauaugcacacau

SEQ ID NO: 1833042 - RNA, 18 nt, Human
aaguaauaugcacacauu

SEQ ID NO: 1833043 - RNA, 20 nt, Human
aaguaauaugcacacauuuu

SEQ ID NO: 1833044 - RNA, 14 nt, Human
guuuucuguucuuu

SEQ ID NO: 1833045 - RNA, 15 nt, Human
guuuucuguucuuuc

SEQ ID NO: 1833046 - RNA, 16 nt, Human
guuuucuguucuuucu

SEQ ID NO: 1833047 - RNA, 19 nt, Human
guuuucuguucuuucuggc

SEQ ID NO: 1833048 - RNA, 22 nt, Human
guuuuaaggaugcuuguacaua

SEQ ID NO: 1833049 - RNA, 13 nt, Human
aaguacuauguau

SEQ ID NO: 1833050 - RNA, 17 nt, Human
aaguacuauaauuuacc

SEQ ID NO: 1833051 - RNA, 14 nt, Human
aaguacuauaauuu

SEQ ID NO: 1833052 - RNA, 15 nt, Human
aaguauuauaccuuu

SEQ ID NO: 1833053 - RNA, 18 nt, Human
aaguacuucuccacccug

SEQ ID NO: 1833054 - RNA, 19 nt, Human
aaguacuucuccacccugc

SEQ ID NO: 1833055 - RNA, 20 nt, Human
aaguacuucuccacccugcu

SEQ ID NO: 1833056 - RNA, 23 nt, Human
aaguauucuuauuuaaugaaaga

SEQ ID NO: 1833057 - RNA, 16 nt, Human
aaguauuauaccuuuu

SEQ ID NO: 1833058 - RNA, 19 nt, Human
aaguauuauaccuuuuuua

SEQ ID NO: 1833059 - RNA, 21 nt, Human
aaguauucuuauuuaaugaaa

SEQ ID NO: 1833060 - RNA, 22 nt, Human
aagucacugcacagugcaucuc

SEQ ID NO: 1833061 - RNA, 23 nt, Human
guuguuugauucagacagcugcc

SEQ ID NO: 1833062 - RNA, 22 nt, Human
aaggaaacccagcucuggucca

SEQ ID NO: 1833063 - RNA, 17 nt, Human
aaggaaacccagcucug

SEQ ID NO: 1833064 - RNA, 21 nt, Human
guuuaagugacugauggcuaa

SEQ ID NO: 1833065 - RNA, 14 nt, Human
guuuaugauuccac

SEQ ID NO: 1833066 - RNA, 23 nt, Human
aagguuucagaaagaagugggga

SEQ ID NO: 1833067 - RNA, 23 nt, Human
aagggggcugggacaugggaaag

SEQ ID NO: 1833068 - RNA, 12 nt, Human
aagggggcuggg

SEQ ID NO: 1833069 - RNA, 13 nt, Human
aaggggagaguaa

SEQ ID NO: 1833070 - RNA, 20 nt, Human
aaggcugucaauuacaggaa

SEQ ID NO: 1833071 - RNA, 22 nt, Human
aaggcugggggaagaagcucuc

SEQ ID NO: 1833072 - RNA, 19 nt, Human
aaggcugggggaagaagcu

SEQ ID NO: 1833073 - RNA, 11 nt, Human
guuucagaaau

SEQ ID NO: 1833074 - RNA, 13 nt, Human
guuucagaaaugu

SEQ ID NO: 1833075 - RNA, 14 nt, Human
aaggcugggggaag

SEQ ID NO: 1833076 - RNA, 16 nt, Human
aaggcugggggaagaa

SEQ ID NO: 1833077 - RNA, 21 nt, Human
aaguguguguuuuucauaaag

SEQ ID NO: 1833078 - RNA, 16 nt, Human
aaguguguguuuuuca

SEQ ID NO: 1833079 - RNA, 11 nt, Human
aaguuaagaau

SEQ ID NO: 1833080 - RNA, 23 nt, Human
aaguuaagaauguucuuauguug

SEQ ID NO: 1833081 - RNA, 14 nt, Human
aaguuacacauuuu

SEQ ID NO: 1833082 - RNA, 13 nt, Human
aagugugguagag

SEQ ID NO: 1833083 - RNA, 12 nt, Human
aaguguguguuu

SEQ ID NO: 1833084 - RNA, 23 nt, Human
aaguguauuuuuuuacuaauaga

SEQ ID NO: 1833085 - RNA, 20 nt, Human
aaguucccuacuuccuguga

SEQ ID NO: 1833086 - RNA, 17 nt, Human
aaguucccuacuuccug

SEQ ID NO: 1833087 - RNA, 14 nt, Human
aaguucccuacuuc

SEQ ID NO: 1833088 - RNA, 21 nt, Human
aaguuucugccgcagcccugc

SEQ ID NO: 1833089 - RNA, 19 nt, Human
aaguuucugccgcagcccu

SEQ ID NO: 1833090 - RNA, 9 nt, Human
uaaaauggu

SEQ ID NO: 1833091 - RNA, 20 nt, Human
aaguuugagaucagccuggg

SEQ ID NO: 1833092 - RNA, 20 nt, Human
uaaaaguacauguuaaacuu

SEQ ID NO: 1833093 - RNA, 13 nt, Human
uaaaagucuugug

SEQ ID NO: 1833094 - RNA, 21 nt, Human
uaaaauaccagccaguaaaug

SEQ ID NO: 1833095 - RNA, 13 nt, Human
aagugauccuccc

SEQ ID NO: 1833096 - RNA, 19 nt, Human
aagugauccucccaccuca

SEQ ID NO: 1833097 - RNA, 20 nt, Human
aagugauccucccaccucag

SEQ ID NO: 1833098 - RNA, 17 nt, Human
aagugauucucaugccu

SEQ ID NO: 1833099 - RNA, 21 nt, Human
aagugauucuccugccucagc

SEQ ID NO: 1833100 - RNA, 19 nt, Human
aagugauucucaugccuca

SEQ ID NO: 1833101 - RNA, 16 nt, Human
aagugauucucaugcc

SEQ ID NO: 1833102 - RNA, 13 nt, Human
aagugauucucau

SEQ ID NO: 1833103 - RNA, 23 nt, Human
aagugauccucccaccucagccu

SEQ ID NO: 1833104 - RNA, 12 nt, Human
uaaaacuuuuua

SEQ ID NO: 1833105 - RNA, 15 nt, Human
uaaaacuuuuuaaaa

SEQ ID NO: 1833106 - RNA, 13 nt, Human
uaaaacccaagug

SEQ ID NO: 1833107 - RNA, 23 nt, Human
uaaaaaucucaaauuucuaaauc

SEQ ID NO: 1833108 - RNA, 15 nt, Human
uaaaaaugagguacu

SEQ ID NO: 1833109 - RNA, 22 nt, Human
uaaaaaugagguacucuccugg

SEQ ID NO: 1833110 - RNA, 21 nt, Human
uaaaaaaaaaccugagcccca

SEQ ID NO: 1833111 - RNA, 22 nt, Human
uaaaaagcuccaaaugcagcuu

SEQ ID NO: 1833112 - RNA, 16 nt, Human
gucgaggacagggagg

SEQ ID NO: 1833113 - RNA, 12 nt, Human
gucgaggcagga

SEQ ID NO: 1833114 - RNA, 16 nt, Human
guccuggcaugggaau

SEQ ID NO: 1833115 - RNA, 19 nt, Human
guccugcugcaguugccag

SEQ ID NO: 1833116 - RNA, 14 nt, Human
guccucuuuucuga

SEQ ID NO: 1833117 - RNA, 16 nt, Human
gucuaccugaggggcc

SEQ ID NO: 1833118 - RNA, 15 nt, Human
gucuaccugaggggc

SEQ ID NO: 1833119 - RNA, 13 nt, Human
gucuaccugaggg

SEQ ID NO: 1833120 - RNA, 14 nt, Human
gucuaccugagggg

SEQ ID NO: 1833121 - RNA, 12 nt, Human
gucgccucugca

SEQ ID NO: 1833122 - RNA, 23 nt, Human
gucuaggcaggaccuguggccaa

SEQ ID NO: 1833123 - RNA, 22 nt, Human
gucuaugggacucaaugcacug

SEQ ID NO: 1833124 - RNA, 18 nt, Human
aacaguccauugaaaggg

SEQ ID NO: 1833125 - RNA, 18 nt, Human
guccccuguuuguuucug

SEQ ID NO: 1833126 - RNA, 22 nt, Human
guccccuguuuguuucugaaag

SEQ ID NO: 1833127 - RNA, 12 nt, Human
gucccuaauaaa

SEQ ID NO: 1833128 - RNA, 19 nt, Human
gucccuuacgugaguccug

SEQ ID NO: 1833129 - RNA, 18 nt, Human
gucccuuacgugaguccu

SEQ ID NO: 1833130 - RNA, 18 nt, Human
gucccugguggcagcuca

SEQ ID NO: 1833131 - RNA, 15 nt, Human
gucccuaauaaagcu

SEQ ID NO: 1833132 - RNA, 19 nt, Human
gucccugguggcagcucac

SEQ ID NO: 1833133 - RNA, 18 nt, Human
guccccaccgcagacagg

SEQ ID NO: 1833134 - RNA, 20 nt, Human
gucccaccccacacacgcca

SEQ ID NO: 1833135 - RNA, 22 nt, Human
guccccaccgcagacaggacca

SEQ ID NO: 1833136 - RNA, 15 nt, Human
gucccaccccacaca

SEQ ID NO: 1833137 - RNA, 19 nt, Human
gucauuugagcagggcuca

SEQ ID NO: 1833138 - RNA, 22 nt, Human
guccaugaagauguagaggaga

SEQ ID NO: 1833139 - RNA, 23 nt, Human
guccaugaagauguagaggagaa

SEQ ID NO: 1833140 - RNA, 19 nt, Human
aaauuucuaaaucuccaaa

SEQ ID NO: 1833141 - RNA, 17 nt, Human
aaauuucucuacugucu

SEQ ID NO: 1833142 - RNA, 19 nt, Human
aacacaaacgggcucagca

SEQ ID NO: 1833143 - RNA, 17 nt, Human
aacacucauugaccuga

SEQ ID NO: 1833144 - RNA, 21 nt, Human
aacacugggagaaaugaaaaa

SEQ ID NO: 1833145 - RNA, 21 nt, Human
aacacucacauuuauucugcu

SEQ ID NO: 1833146 - RNA, 19 nt, Human
aacacuguucucugcccuc

SEQ ID NO: 1833147 - RNA, 17 nt, Human
gucauuugagcagggcu

SEQ ID NO: 1833148 - RNA, 18 nt, Human
aacacuguucucugcccu

SEQ ID NO: 1833149 - RNA, 17 nt, Human
aacacuguucucugccc

SEQ ID NO: 1833150 - RNA, 16 nt, Human
aacacuguucucugcc

SEQ ID NO: 1833151 - RNA, 13 nt, Human
aaauuucuaaauc

SEQ ID NO: 1833152 - RNA, 15 nt, Human
aaauuucuaaaucuc

SEQ ID NO: 1833153 - RNA, 12 nt, Human
aaauuucuaaau

SEQ ID NO: 1833154 - RNA, 16 nt, Human
gucagguggggcagcu

SEQ ID NO: 1833155 - RNA, 17 nt, Human
gucagguggggcagcuu

SEQ ID NO: 1833156 - RNA, 18 nt, Human
gucagguggggcagcuug

SEQ ID NO: 1833157 - RNA, 22 nt, Human
gucagguggggcagcuugaggg

SEQ ID NO: 1833158 - RNA, 15 nt, Human
gucacugcuuaacuu

SEQ ID NO: 1833159 - RNA, 21 nt, Human
gucacugcuuaacuucacaua

SEQ ID NO: 1833160 - RNA, 17 nt, Human
gucacuuuguuuuacug

SEQ ID NO: 1833161 - RNA, 21 nt, Human
gucagaaguuucugccgcagc

SEQ ID NO: 1833162 - RNA, 23 nt, Human
gucagaaguuucugccgcagccc

SEQ ID NO: 1833163 - RNA, 23 nt, Human
gucacugagacagcccgggcucu

SEQ ID NO: 1833164 - RNA, 21 nt, Human
gucacugagacagcccgggcu

SEQ ID NO: 1833165 - RNA, 18 nt, Human
gucacugagacagcccgg

SEQ ID NO: 1833166 - RNA, 17 nt, Human
gucacugagacagcccg

SEQ ID NO: 1833167 - RNA, 10 nt, Human
gucacugcuu

SEQ ID NO: 1833168 - RNA, 23 nt, Human
gucacugcacagugcaucucagc

SEQ ID NO: 1833169 - RNA, 20 nt, Human
gucacugcacagugcaucuc

SEQ ID NO: 1833170 - RNA, 16 nt, Human
gucacugagacagccc

SEQ ID NO: 1833171 - RNA, 15 nt, Human
gucacugagacagcc

SEQ ID NO: 1833172 - RNA, 14 nt, Human
gucacugagacagc

SEQ ID NO: 1833173 - RNA, 12 nt, Human
gucaccaagccc

SEQ ID NO: 1833174 - RNA, 15 nt, Human
gucaccaagcccagu

SEQ ID NO: 1833175 - RNA, 23 nt, Human
gucacucuggcagcucagagagg

SEQ ID NO: 1833176 - RNA, 22 nt, Human
gucaauuacaggaaguacugga

SEQ ID NO: 1833177 - RNA, 13 nt, Human
gucacaggaagua

SEQ ID NO: 1833178 - RNA, 15 nt, Human
gucacaggaaguaga

SEQ ID NO: 1833179 - RNA, 21 nt, Human
gucaauuuuguuauguauauu

SEQ ID NO: 1833180 - RNA, 22 nt, Human
gucaccaaaucagcugcuacua

SEQ ID NO: 1833181 - RNA, 20 nt, Human
gucacaggaaguagaggagg

SEQ ID NO: 1833182 - RNA, 18 nt, Human
gucacaggacucugccuc

SEQ ID NO: 1833183 - RNA, 17 nt, Human
gucacaggacucugccu

SEQ ID NO: 1833184 - RNA, 16 nt, Human
gucacaggagggaggg

SEQ ID NO: 1833185 - RNA, 19 nt, Human
gucacaggacucugccucc

SEQ ID NO: 1833186 - RNA, 12 nt, Human
gucacaggcagg

SEQ ID NO: 1833187 - RNA, 18 nt, Human
guauucucuccuguaccu

SEQ ID NO: 1833188 - RNA, 21 nt, Human
guauucucuccuguaccucuu

SEQ ID NO: 1833189 - RNA, 16 nt, Human
aaaucauucauuuucu

SEQ ID NO: 1833190 - RNA, 11 nt, Human
guauuuauuca

SEQ ID NO: 1833191 - RNA, 14 nt, Human
aaaugucuuccugg

SEQ ID NO: 1833192 - RNA, 21 nt, Human
aaaugucucuuuaaugucaca

SEQ ID NO: 1833193 - RNA, 14 nt, Human
aaauuaaucugggc

SEQ ID NO: 1833194 - RNA, 15 nt, Human
aaauguggcuccugg

SEQ ID NO: 1833195 - RNA, 23 nt, Human
aaauuaugugccagauuuaugca

SEQ ID NO: 1833196 - RNA, 19 nt, Human
aaauuaggauuucaugauu

SEQ ID NO: 1833197 - RNA, 18 nt, Human
aaauuaggauuucaugau

SEQ ID NO: 1833198 - RNA, 18 nt, Human
aaauugucagaugcugug

SEQ ID NO: 1833199 - RNA, 17 nt, Human
aaauuguauuacaaauc

SEQ ID NO: 1833200 - RNA, 16 nt, Human
aaauuccccacccuga

SEQ ID NO: 1833201 - RNA, 17 nt, Human
aaauuccaagugauuga

SEQ ID NO: 1833202 - RNA, 18 nt, Human
gugaggcucugcccuugg

SEQ ID NO: 1833203 - RNA, 23 nt, Human
gugaguacuacaguccucccauc

SEQ ID NO: 1833204 - RNA, 17 nt, Human
gugagucaccaagccca

SEQ ID NO: 1833205 - RNA, 21 nt, Human
aacucuccucugcugcuggcu

SEQ ID NO: 1833206 - RNA, 19 nt, Human
aacucuccucugcugcugg

SEQ ID NO: 1833207 - RNA, 19 nt, Human
gugagucaccaagcccagu

SEQ ID NO: 1833208 - RNA, 17 nt, Human
gugaggcucugcccuug

SEQ ID NO: 1833209 - RNA, 16 nt, Human
gugaggcucugcccuu

SEQ ID NO: 1833210 - RNA, 15 nt, Human
gugaggcucugcccu

SEQ ID NO: 1833211 - RNA, 14 nt, Human
gugaggcucugccc

SEQ ID NO: 1833212 - RNA, 13 nt, Human
gugaggcucugcc

SEQ ID NO: 1833213 - RNA, 12 nt, Human
gugaggcucugc

SEQ ID NO: 1833214 - RNA, 18 nt, Human
gugagacucugucucaaa

SEQ ID NO: 1833215 - RNA, 23 nt, Human
aacucuccucugcugcuggcugg

SEQ ID NO: 1833216 - RNA, 22 nt, Human
aacucuccucugcugcuggcug

SEQ ID NO: 1833217 - RNA, 16 nt, Human
aacucugacaacagac

SEQ ID NO: 1833218 - RNA, 16 nt, Human
aacugcauuggcuuug

SEQ ID NO: 1833219 - RNA, 23 nt, Human
aacugauuuuuuuuuccuucagu

SEQ ID NO: 1833220 - RNA, 22 nt, Human
aacugauuuuuuuuuccuucag

SEQ ID NO: 1833221 - RNA, 21 nt, Human
aacugauuuuuuuuuccuuca

SEQ ID NO: 1833222 - RNA, 20 nt, Human
aacugauuuuuuuuuccuuc

SEQ ID NO: 1833223 - RNA, 23 nt, Human
gugacagaggcagccccauucug

SEQ ID NO: 1833224 - RNA, 20 nt, Human
gugacagagugagacucugu

SEQ ID NO: 1833225 - RNA, 22 nt, Human
gugacagagugagacucugucu

SEQ ID NO: 1833226 - RNA, 23 nt, Human
gugaauaauacaguaucucaggg

SEQ ID NO: 1833227 - RNA, 19 nt, Human
gugaaguuuaauugacuua

SEQ ID NO: 1833228 - RNA, 14 nt, Human
aacuccugaccuca

SEQ ID NO: 1833229 - RNA, 12 nt, Human
aacuccugaccu

SEQ ID NO: 1833230 - RNA, 16 nt, Human
gugacuucagcucugu

SEQ ID NO: 1833231 - RNA, 19 nt, Human
gugacaugucuuuucuugc

SEQ ID NO: 1833232 - RNA, 22 nt, Human
gugacauguguuggcagccucu

SEQ ID NO: 1833233 - RNA, 15 nt, Human
gugagaccugccccu

SEQ ID NO: 1833234 - RNA, 14 nt, Human
gugagaccugcccc

SEQ ID NO: 1833235 - RNA, 13 nt, Human
gugagaccugccc

SEQ ID NO: 1833236 - RNA, 22 nt, Human
gugagacccugucucaaaaaaa

SEQ ID NO: 1833237 - RNA, 23 nt, Human
gugagaccugccccuccucucug

SEQ ID NO: 1833238 - RNA, 16 nt, Human
gugagaccugccccuc

SEQ ID NO: 1833239 - RNA, 14 nt, Human
gugagacucugucu

SEQ ID NO: 1833240 - RNA, 16 nt, Human
gugagacucugucuca

SEQ ID NO: 1833241 - RNA, 19 nt, Human
gucucaaaaaaagaaaaag

SEQ ID NO: 1833242 - RNA, 17 nt, Human
gucucaaaaaaagaaaa

SEQ ID NO: 1833243 - RNA, 14 nt, Human
gucucaaaaaaaca

SEQ ID NO: 1833244 - RNA, 20 nt, Human
gucugacaggcaaugcuggc

SEQ ID NO: 1833245 - RNA, 15 nt, Human
gucugacaggcaaug

SEQ ID NO: 1833246 - RNA, 18 nt, Human
gucugacaggcaaugcug

SEQ ID NO: 1833247 - RNA, 12 nt, Human
gucugacaggca

SEQ ID NO: 1833248 - RNA, 13 nt, Human
gucugacaggcaa

SEQ ID NO: 1833249 - RNA, 14 nt, Human
gucugacaggcaau

SEQ ID NO: 1833250 - RNA, 18 nt, Human
gucuggaaugcaguggua

SEQ ID NO: 1833251 - RNA, 15 nt, Human
gucuggaaugcagug

SEQ ID NO: 1833252 - RNA, 16 nt, Human
gucuggaaugcagugg

SEQ ID NO: 1833253 - RNA, 19 nt, Human
gucuuauauauuguagaua

SEQ ID NO: 1833254 - RNA, 22 nt, Human
gucuuguuuuuuuuuuccacuu

SEQ ID NO: 1833255 - RNA, 20 nt, Human
gucuuguguuucuuuaguuu

SEQ ID NO: 1833256 - RNA, 21 nt, Human
aaccuucgccaccuggguucc

SEQ ID NO: 1833257 - RNA, 12 nt, Human
aacgugaaaaug

SEQ ID NO: 1833258 - RNA, 23 nt, Human
aaccuggucacaggacucugccu

SEQ ID NO: 1833259 - RNA, 17 nt, Human
aacuagggaagauaaua

SEQ ID NO: 1833260 - RNA, 21 nt, Human
aacuaggugcauauuuauaaa

SEQ ID NO: 1833261 - RNA, 17 nt, Human
aacguuuuuccuguucu

SEQ ID NO: 1833262 - RNA, 13 nt, Human
aacguggcugcuu

SEQ ID NO: 1833263 - RNA, 12 nt, Human
aacguggcugcu

SEQ ID NO: 1833264 - RNA, 15 nt, Human
aacuauguugauaaa

SEQ ID NO: 1833265 - RNA, 12 nt, Human
aacuauggccug

SEQ ID NO: 1833266 - RNA, 16 nt, Human
gugcucaggagcccug

SEQ ID NO: 1833267 - RNA, 19 nt, Human
gugcuaucucccccagccc

SEQ ID NO: 1833268 - RNA, 18 nt, Human
gugcucaggagcccuggg

SEQ ID NO: 1833269 - RNA, 19 nt, Human
gugcucaggagcccuggga

SEQ ID NO: 1833270 - RNA, 18 nt, Human
gugcuccauggcugccau

SEQ ID NO: 1833271 - RNA, 22 nt, Human
gugcuccauggcugccaucuca

SEQ ID NO: 1833272 - RNA, 15 nt, Human
gugcugcccugccca

SEQ ID NO: 1833273 - RNA, 14 nt, Human
gugcugcccugccc

SEQ ID NO: 1833274 - RNA, 13 nt, Human
gugcugcccugcc

SEQ ID NO: 1833275 - RNA, 12 nt, Human
gugcugcccugc

SEQ ID NO: 1833276 - RNA, 16 nt, Human
gugcucugaucaucca

SEQ ID NO: 1833277 - RNA, 13 nt, Human
gugcucuggacag

SEQ ID NO: 1833278 - RNA, 14 nt, Human
gugcucuggacagg

SEQ ID NO: 1833279 - RNA, 18 nt, Human
gugcuaucucccccagcc

SEQ ID NO: 1833280 - RNA, 15 nt, Human
gugcuaucuccccca

SEQ ID NO: 1833281 - RNA, 17 nt, Human
gugcuaggaacacuccu

SEQ ID NO: 1833282 - RNA, 21 nt, Human
aacuuuaccuuuuuuauacau

SEQ ID NO: 1833283 - RNA, 22 nt, Human
aacuuuaccuuuuuuauacaua

SEQ ID NO: 1833284 - RNA, 23 nt, Human
aacuuuaccuuuuuuauacauaa

SEQ ID NO: 1833285 - RNA, 19 nt, Human
gugccagauuuaugcauau

SEQ ID NO: 1833286 - RNA, 18 nt, Human
aagaaaaagaaaaagaaa

SEQ ID NO: 1833287 - RNA, 13 nt, Human
aagaaaaagaaaa

SEQ ID NO: 1833288 - RNA, 19 nt, Human
aagaaaaaauauuuucccu

SEQ ID NO: 1833289 - RNA, 18 nt, Human
aagaaaaaugagccuggc

SEQ ID NO: 1833290 - RNA, 17 nt, Human
aagaaaaaugagccugg

SEQ ID NO: 1833291 - RNA, 14 nt, Human
aagaaagaaaauca

SEQ ID NO: 1833292 - RNA, 13 nt, Human
aagaaagaaaauc

SEQ ID NO: 1833293 - RNA, 16 nt, Human
aagaaagaaaaucagg

SEQ ID NO: 1833294 - RNA, 19 nt, Human
aagaaagcccuuaggaaga

SEQ ID NO: 1833295 - RNA, 15 nt, Human
aagaaaauaguggug

SEQ ID NO: 1833296 - RNA, 21 nt, Human
aagaaaauaguggugugauuu

SEQ ID NO: 1833297 - RNA, 22 nt, Human
aagaaaauaguggugugauuug

SEQ ID NO: 1833298 - RNA, 13 nt, Human
aacuucagacaua

SEQ ID NO: 1833299 - RNA, 17 nt, Human
aacugcccccucugccc

SEQ ID NO: 1833300 - RNA, 16 nt, Human
aacugcccccucugcc

SEQ ID NO: 1833301 - RNA, 21 nt, Human
aacugcccccucugcccugcg

SEQ ID NO: 1833302 - RNA, 20 nt, Human
aacugcccccucugcccugc

SEQ ID NO: 1833303 - RNA, 19 nt, Human
aacugcccccucugcccug

SEQ ID NO: 1833304 - RNA, 18 nt, Human
aacugcccccucugcccu

SEQ ID NO: 1833305 - RNA, 14 nt, Human
aacuucacauauug

SEQ ID NO: 1833306 - RNA, 22 nt, Human
aacuucacauauugauuuccgu

SEQ ID NO: 1833307 - RNA, 22 nt, Human
aacuucaccauauuaccacaga

SEQ ID NO: 1833308 - RNA, 11 nt, Human
gugauuaccag

SEQ ID NO: 1833309 - RNA, 16 nt, Human
gugauuaccagggacu

SEQ ID NO: 1833310 - RNA, 17 nt, Human
gugauuaccagggacug

SEQ ID NO: 1833311 - RNA, 23 nt, Human
gugaugguuccccuguucacucu

SEQ ID NO: 1833312 - RNA, 21 nt, Human
gugcacaagcuccaagcuccc

SEQ ID NO: 1833313 - RNA, 16 nt, Human
gugcacaagcuccaag

SEQ ID NO: 1833314 - RNA, 13 nt, Human
gugcacaagcucc

SEQ ID NO: 1833315 - RNA, 18 nt, Human
gugcaaugaccuuucaau

SEQ ID NO: 1833316 - RNA, 22 nt, Human
gugcaaugaccuuucaauagga

SEQ ID NO: 1833317 - RNA, 23 nt, Human
gugcacaagcuccaagcucccag

SEQ ID NO: 1833318 - RNA, 21 nt, Human
gugcacaugcacgugugugca

SEQ ID NO: 1833319 - RNA, 17 nt, Human
gugcauuugaggucugu

SEQ ID NO: 1833320 - RNA, 19 nt, Human
gugcauuugaggucuguuc

SEQ ID NO: 1833321 - RNA, 23 nt, Human
gugccaaaaacaacaacaaaaug

SEQ ID NO: 1833322 - RNA, 21 nt, Human
gugcauuuggugguuucagaa

SEQ ID NO: 1833323 - RNA, 19 nt, Human
uagauauaugcucugcaug

SEQ ID NO: 1833324 - RNA, 22 nt, Human
uagaggagaaacuggaacucuc

SEQ ID NO: 1833325 - RNA, 15 nt, Human
uagauauaugcucug

SEQ ID NO: 1833326 - RNA, 19 nt, Human
uagaggagaaacuggaacu

SEQ ID NO: 1833327 - RNA, 22 nt, Human
acaaaggaugcccaaagaugca

SEQ ID NO: 1833328 - RNA, 16 nt, Human
aauuguuacaaauugu

SEQ ID NO: 1833329 - RNA, 20 nt, Human
aauuguguuuauaauuuuaa

SEQ ID NO: 1833330 - RNA, 21 nt, Human
aauuguguuuauaauuuuaaa

SEQ ID NO: 1833331 - RNA, 11 nt, Human
acaaaagcaug

SEQ ID NO: 1833332 - RNA, 22 nt, Human
acaaaagcaugugagacugguu

SEQ ID NO: 1833333 - RNA, 18 nt, Human
acaaaaggauaaugaaua

SEQ ID NO: 1833334 - RNA, 20 nt, Human
acaagacccaaaaggcagaa

SEQ ID NO: 1833335 - RNA, 19 nt, Human
acaagacccuugugguccc

SEQ ID NO: 1833336 - RNA, 19 nt, Human
acaagaccacguuucuaaa

SEQ ID NO: 1833337 - RNA, 21 nt, Human
acaacacucauugaccugagg

SEQ ID NO: 1833338 - RNA, 23 nt, Human
acaacacucauugaccugaggcc

SEQ ID NO: 1833339 - RNA, 15 nt, Human
uagccagaggagaga

SEQ ID NO: 1833340 - RNA, 11 nt, Human
uagccagagga

SEQ ID NO: 1833341 - RNA, 19 nt, Human
acaaauuuacagagacaga

SEQ ID NO: 1833342 - RNA, 18 nt, Human
acaaauuuacagagacag

SEQ ID NO: 1833343 - RNA, 16 nt, Human
uagcauuuugcuaaau

SEQ ID NO: 1833344 - RNA, 22 nt, Human
uagcauuuugcuaaaugugaau

SEQ ID NO: 1833345 - RNA, 21 nt, Human
uagccaaggccaaaggaagca

SEQ ID NO: 1833346 - RNA, 14 nt, Human
uagaugcugacugu

SEQ ID NO: 1833347 - RNA, 23 nt, Human
uagaugcugacuguacuccuccc

SEQ ID NO: 1833348 - RNA, 19 nt, Human
uagcauggcugccaauggg

SEQ ID NO: 1833349 - RNA, 16 nt, Human
uaggaaauccagggug

SEQ ID NO: 1833350 - RNA, 21 nt, Human
uagcuuacaagccagcuggag

SEQ ID NO: 1833351 - RNA, 13 nt, Human
uaggacuguagaa

SEQ ID NO: 1833352 - RNA, 14 nt, Human
uaggacuguagaaa

SEQ ID NO: 1833353 - RNA, 20 nt, Human
uaggcauuugcugaauacag

SEQ ID NO: 1833354 - RNA, 16 nt, Human
uaggcauuugcugaau

SEQ ID NO: 1833355 - RNA, 14 nt, Human
uaggcauuguggga

SEQ ID NO: 1833356 - RNA, 21 nt, Human
uagggaaggauacaaaagcau

SEQ ID NO: 1833357 - RNA, 17 nt, Human
acaaugacuuacuguac

SEQ ID NO: 1833358 - RNA, 18 nt, Human
acaaugacuuacuguaca

SEQ ID NO: 1833359 - RNA, 19 nt, Human
acaaugacuuacuguacau

SEQ ID NO: 1833360 - RNA, 12 nt, Human
acaaugacuuac

SEQ ID NO: 1833361 - RNA, 19 nt, Human
acaaggacuaggguccugg

SEQ ID NO: 1833362 - RNA, 18 nt, Human
acaaggacuaggguccug

SEQ ID NO: 1833363 - RNA, 21 nt, Human
acaaggacagccccuccucca

SEQ ID NO: 1833364 - RNA, 22 nt, Human
acaaggacagccccuccuccau

SEQ ID NO: 1833365 - RNA, 18 nt, Human
acaagaccacguuucuaa

SEQ ID NO: 1833366 - RNA, 21 nt, Human
acaccuuagccugcccuccuu

SEQ ID NO: 1833367 - RNA, 20 nt, Human
acacuaaccacgcuggaccu

SEQ ID NO: 1833368 - RNA, 21 nt, Human
acaccucugcacaagcugcac

SEQ ID NO: 1833369 - RNA, 14 nt, Human
acaccgggccugga

SEQ ID NO: 1833370 - RNA, 16 nt, Human
acaccgggcacucaga

SEQ ID NO: 1833371 - RNA, 15 nt, Human
acacucaaaagcugg

SEQ ID NO: 1833372 - RNA, 15 nt, Human
uauaaguguguguuu

SEQ ID NO: 1833373 - RNA, 20 nt, Human
acacucacauuuauucugcu

SEQ ID NO: 1833374 - RNA, 22 nt, Human
acacucacauuuauucugcuca

SEQ ID NO: 1833375 - RNA, 18 nt, Human
acacaugauccugcaauu

SEQ ID NO: 1833376 - RNA, 21 nt, Human
acacaugagcaucaggccagg

SEQ ID NO: 1833377 - RNA, 14 nt, Human
acacauuuuauuuu

SEQ ID NO: 1833378 - RNA, 19 nt, Human
acacauuuuauuuuauuau

SEQ ID NO: 1833379 - RNA, 20 nt, Human
acacauuuuauuuuauuaug

SEQ ID NO: 1833380 - RNA, 20 nt, Human
uauaaaagccuguuuaagag

SEQ ID NO: 1833381 - RNA, 19 nt, Human
uauaaaaauaaaaaacacu

SEQ ID NO: 1833382 - RNA, 22 nt, Human
uauaaaagggacugagaaauuu

SEQ ID NO: 1833383 - RNA, 19 nt, Human
uauaaaagccuguuuaaga

SEQ ID NO: 1833384 - RNA, 20 nt, Human
uaguuccaccaucaagccac

SEQ ID NO: 1833385 - RNA, 19 nt, Human
acacacagcucuguccugg

SEQ ID NO: 1833386 - RNA, 17 nt, Human
acacacagcucuguccu

SEQ ID NO: 1833387 - RNA, 13 nt, Human
acacacagcucug

SEQ ID NO: 1833388 - RNA, 14 nt, Human
acacacagcucugu

SEQ ID NO: 1833389 - RNA, 22 nt, Human
acacacacgcgugcacacacca

SEQ ID NO: 1833390 - RNA, 21 nt, Human
acacacugcauguuugugauu

SEQ ID NO: 1833391 - RNA, 14 nt, Human
acacaccagagccc

SEQ ID NO: 1833392 - RNA, 15 nt, Human
acacaccagagccca

SEQ ID NO: 1833393 - RNA, 20 nt, Human
acacaccagagcccaccuug

SEQ ID NO: 1833394 - RNA, 21 nt, Human
acacacgcgugcacacaccag

SEQ ID NO: 1833395 - RNA, 21 nt, Human
acaaugcugugcccuaaagug

SEQ ID NO: 1833396 - RNA, 22 nt, Human
acaaugcugugcccuaaagugu

SEQ ID NO: 1833397 - RNA, 23 nt, Human
acaaugcugugcccuaaagugua

SEQ ID NO: 1833398 - RNA, 24 nt, Human
acaaugcugugcccuaaaguguau

SEQ ID NO: 1833399 - RNA, 19 nt, Human
acaauggauaggcacagga

SEQ ID NO: 1833400 - RNA, 17 nt, Human
acaaugugaaaagaaaa

SEQ ID NO: 1833401 - RNA, 19 nt, Human
acaaugugaaaagaaaaau

SEQ ID NO: 1833402 - RNA, 19 nt, Human
acacaguauuacuucugcu

SEQ ID NO: 1833403 - RNA, 22 nt, Human
acacaguauuacuucugcuaca

SEQ ID NO: 1833404 - RNA, 18 nt, Human
acacaguauuacuucugc

SEQ ID NO: 1833405 - RNA, 21 nt, Human
uagugaaucacguaaagcuag

SEQ ID NO: 1833406 - RNA, 17 nt, Human
acagcaaggagauuuac

SEQ ID NO: 1833407 - RNA, 15 nt, Human
acagauuugagcuca

SEQ ID NO: 1833408 - RNA, 14 nt, Human
acagauuugagcuc

SEQ ID NO: 1833409 - RNA, 19 nt, Human
acagagcccacgcccccac

SEQ ID NO: 1833410 - RNA, 18 nt, Human
acagagcccacgccccca

SEQ ID NO: 1833411 - RNA, 15 nt, Human
acagagcccacgccc

SEQ ID NO: 1833412 - RNA, 14 nt, Human
acagagcccacgcc

SEQ ID NO: 1833413 - RNA, 17 nt, Human
acagauccccaagccug

SEQ ID NO: 1833414 - RNA, 18 nt, Human
acagauccccaagccugg

SEQ ID NO: 1833415 - RNA, 22 nt, Human
acagaucucugcuuuggaaauc

SEQ ID NO: 1833416 - RNA, 17 nt, Human
acagcccgggcucugcc

SEQ ID NO: 1833417 - RNA, 21 nt, Human
acagcaaggagauuuacaacu

SEQ ID NO: 1833418 - RNA, 20 nt, Human
acagcccgggcucugccucc

SEQ ID NO: 1833419 - RNA, 19 nt, Human
acagcccgggcucugccuc

SEQ ID NO: 1833420 - RNA, 18 nt, Human
acagcccgggcucugccu

SEQ ID NO: 1833421 - RNA, 18 nt, Human
acagccguuuguucccca

SEQ ID NO: 1833422 - RNA, 11 nt, Human
uaugcauuuga

SEQ ID NO: 1833423 - RNA, 23 nt, Human
uaugcauuugaaaauuuugaugu

SEQ ID NO: 1833424 - RNA, 24 nt, Human
uaugcauuugaaaauuuugauguu

SEQ ID NO: 1833425 - RNA, 17 nt, Human
uaugccugggcagaagg

SEQ ID NO: 1833426 - RNA, 18 nt, Human
uauggcuuuugugcauua

SEQ ID NO: 1833427 - RNA, 21 nt, Human
uauggcuuuugugcauuaucu

SEQ ID NO: 1833428 - RNA, 17 nt, Human
uauggcuuuugugcauu

SEQ ID NO: 1833429 - RNA, 15 nt, Human
uaugcuuauacacuu

SEQ ID NO: 1833430 - RNA, 23 nt, Human
uauggcuuuugugcauuaucuag

SEQ ID NO: 1833431 - RNA, 12 nt, Human
acagccuggcac

SEQ ID NO: 1833432 - RNA, 14 nt, Human
uaucucccccagcc

SEQ ID NO: 1833433 - RNA, 16 nt, Human
uaucucccccagcccc

SEQ ID NO: 1833434 - RNA, 13 nt, Human
uaucucccccagc

SEQ ID NO: 1833435 - RNA, 11 nt, Human
acagagaaagu

SEQ ID NO: 1833436 - RNA, 18 nt, Human
acagagaaaguacuucuc

SEQ ID NO: 1833437 - RNA, 18 nt, Human
uaucaaguauuauaccuu

SEQ ID NO: 1833438 - RNA, 18 nt, Human
acagaaaauucuucucca

SEQ ID NO: 1833439 - RNA, 17 nt, Human
acagaaaauucuucucc

SEQ ID NO: 1833440 - RNA, 20 nt, Human
acagaaaauggaagacagcu

SEQ ID NO: 1833441 - RNA, 14 nt, Human
acagaaauguacag

SEQ ID NO: 1833442 - RNA, 16 nt, Human
acagaaauguacagca

SEQ ID NO: 1833443 - RNA, 17 nt, Human
acagaaauguacagcaa

SEQ ID NO: 1833444 - RNA, 23 nt, Human
uauaaguguguguuuuucauaaa

SEQ ID NO: 1833445 - RNA, 17 nt, Human
uauaaguguguguuuuu

SEQ ID NO: 1833446 - RNA, 16 nt, Human
uauauuuaguaucuuu

SEQ ID NO: 1833447 - RNA, 15 nt, Human
acagacccugcccug

SEQ ID NO: 1833448 - RNA, 14 nt, Human
acagacccugcccu

SEQ ID NO: 1833449 - RNA, 13 nt, Human
acagacccugccc

SEQ ID NO: 1833450 - RNA, 23 nt, Human
acaggaccagggauuuccaugau

SEQ ID NO: 1833451 - RNA, 14 nt, Human
acaggacucugccu

SEQ ID NO: 1833452 - RNA, 14 nt, Human
acaggcauguucuc

SEQ ID NO: 1833453 - RNA, 14 nt, Human
acaggcagguccag

SEQ ID NO: 1833454 - RNA, 16 nt, Human
acaggcagguccaggg

SEQ ID NO: 1833455 - RNA, 16 nt, Human
acaggagugagcacua

SEQ ID NO: 1833456 - RNA, 14 nt, Human
acaggaucagucug

SEQ ID NO: 1833457 - RNA, 13 nt, Human
acaggcaggucca

SEQ ID NO: 1833458 - RNA, 13 nt, Human
acagcuaacaugg

SEQ ID NO: 1833459 - RNA, 11 nt, Human
acagccuggca

SEQ ID NO: 1833460 - RNA, 17 nt, Human
acaggaaguagaggagg

SEQ ID NO: 1833461 - RNA, 13 nt, Human
acaggaaguacug

SEQ ID NO: 1833462 - RNA, 15 nt, Human
acaggaaaagcugcu

SEQ ID NO: 1833463 - RNA, 16 nt, Human
acaggaaaagcugcug

SEQ ID NO: 1833464 - RNA, 17 nt, Human
acaggaaaagcugcuga

SEQ ID NO: 1833465 - RNA, 18 nt, Human
acaggaaaagcugcugac

SEQ ID NO: 1833466 - RNA, 20 nt, Human
uauguggaguucaucuugaa

SEQ ID NO: 1833467 - RNA, 23 nt, Human
uaugugccagauuuaugcauauu

SEQ ID NO: 1833468 - RNA, 17 nt, Human
uaugugaaacauguuuc

SEQ ID NO: 1833469 - RNA, 14 nt, Human
uaugugaaacaugu

SEQ ID NO: 1833470 - RNA, 22 nt, Human
acaggcauguucucugaggaca

SEQ ID NO: 1833471 - RNA, 15 nt, Human
acaggcauguucucu

SEQ ID NO: 1833472 - RNA, 18 nt, Human
acaggcauguucucugag

SEQ ID NO: 1833473 - RNA, 19 nt, Human
acaggcauguucucugagg

SEQ ID NO: 1833474 - RNA, 20 nt, Human
acaggcauguucucugagga

SEQ ID NO: 1833475 - RNA, 19 nt, Human
uauuagugaccucagcuuu

SEQ ID NO: 1833476 - RNA, 21 nt, Human
uauuagugaccucagcuuuga

SEQ ID NO: 1833477 - RNA, 14 nt, Human
uauuacuucugcua

SEQ ID NO: 1833478 - RNA, 13 nt, Human
uauuacuucugcu

SEQ ID NO: 1833479 - RNA, 20 nt, Human
uauucaguaauaacucuacc

SEQ ID NO: 1833480 - RNA, 14 nt, Human
uauucaggaagcuc

SEQ ID NO: 1833481 - RNA, 16 nt, Human
uauucaggaagcucag

SEQ ID NO: 1833482 - RNA, 12 nt, Human
acaggcuccugc

SEQ ID NO: 1833483 - RNA, 14 nt, Human
uauucauaauuauu

SEQ ID NO: 1833484 - RNA, 22 nt, Human
acaggcgugagccaccgugccu

SEQ ID NO: 1833485 - RNA, 21 nt, Human
uauucagcucauggacuucug

SEQ ID NO: 1833486 - RNA, 12 nt, Human
acagggcacacc

SEQ ID NO: 1833487 - RNA, 20 nt, Human
acagggcacaccgggcacuc

SEQ ID NO: 1833488 - RNA, 20 nt, Human
acagggaggacgcucucugg

SEQ ID NO: 1833489 - RNA, 21 nt, Human
acagggaggacgcucucuggc

SEQ ID NO: 1833490 - RNA, 22 nt, Human
acaggcuccugccaccacgccc

SEQ ID NO: 1833491 - RNA, 21 nt, Human
acaggcuccugccaccacgcc

SEQ ID NO: 1833492 - RNA, 15 nt, Human
acaggcuccugccac

SEQ ID NO: 1833493 - RNA, 13 nt, Human
acaggcuccugcc

SEQ ID NO: 1833494 - RNA, 12 nt, Human
acaggcugggcu

SEQ ID NO: 1833495 - RNA, 22 nt, Human
acaggcugggcuucaguggcag

SEQ ID NO: 1833496 - RNA, 23 nt, Human
acaggcugggcuucaguggcagc

SEQ ID NO: 1833497 - RNA, 20 nt, Human
aauguauguguaaguauucu

SEQ ID NO: 1833498 - RNA, 19 nt, Human
aauguauguguaaguauuc

SEQ ID NO: 1833499 - RNA, 11 nt, Human
aaugugugugu

SEQ ID NO: 1833500 - RNA, 19 nt, Human
aaugugaaaagaaaaauga

SEQ ID NO: 1833501 - RNA, 14 nt, Human
aaugugaaacugga

SEQ ID NO: 1833502 - RNA, 15 nt, Human
aaugugaaacuggau

SEQ ID NO: 1833503 - RNA, 22 nt, Human
uacauauaagugauugcugguu

SEQ ID NO: 1833504 - RNA, 23 nt, Human
uacauaaugcgugcauaccacuu

SEQ ID NO: 1833505 - RNA, 24 nt, Human
uacauaaugcgugcauaccacuuu

SEQ ID NO: 1833506 - RNA, 16 nt, Human
uacaggugugagucac

SEQ ID NO: 1833507 - RNA, 11 nt, Human
aauuaacuuuu

SEQ ID NO: 1833508 - RNA, 21 nt, Human
aauguucucucuucuccaccu

SEQ ID NO: 1833509 - RNA, 13 nt, Human
uacauucuguuaa

SEQ ID NO: 1833510 - RNA, 22 nt, Human
aauuaaucugggccagaauuuc

SEQ ID NO: 1833511 - RNA, 21 nt, Human
aauuaagaaaggauaaaguug

SEQ ID NO: 1833512 - RNA, 21 nt, Human
aaugcacuuuguucuggcucu

SEQ ID NO: 1833513 - RNA, 20 nt, Human
aaugaccuuucaauaggaaa

SEQ ID NO: 1833514 - RNA, 17 nt, Human
aaugaccuuucaauagg

SEQ ID NO: 1833515 - RNA, 16 nt, Human
aaugaccuuucaauag

SEQ ID NO: 1833516 - RNA, 18 nt, Human
aaugaccuuucaauagga

SEQ ID NO: 1833517 - RNA, 21 nt, Human
uacaaugcugugcccuaaagu

SEQ ID NO: 1833518 - RNA, 22 nt, Human
aaugcacuuuguucuggcucuu

SEQ ID NO: 1833519 - RNA, 20 nt, Human
aauggacuaacuugucuuug

SEQ ID NO: 1833520 - RNA, 23 nt, Human
aauggacguguuaugacuccaga

SEQ ID NO: 1833521 - RNA, 14 nt, Human
aauggaaccacucu

SEQ ID NO: 1833522 - RNA, 21 nt, Human
aauggaaaugggcagagcaga

SEQ ID NO: 1833523 - RNA, 20 nt, Human
aauggaaaugggcagagcag

SEQ ID NO: 1833524 - RNA, 16 nt, Human
aaugcuucaucccuuu

SEQ ID NO: 1833525 - RNA, 12 nt, Human
aaugcccagccc

SEQ ID NO: 1833526 - RNA, 11 nt, Human
aaugcccagcc

SEQ ID NO: 1833527 - RNA, 13 nt, Human
aaugcccagcccc

SEQ ID NO: 1833528 - RNA, 22 nt, Human
aaugcuguauuagucacagaga

SEQ ID NO: 1833529 - RNA, 15 nt, Human
uacacuaaaagguga

SEQ ID NO: 1833530 - RNA, 23 nt, Human
uacacauuuuauuuuauuaugca

SEQ ID NO: 1833531 - RNA, 21 nt, Human
uacacauuuuauuuuauuaug

SEQ ID NO: 1833532 - RNA, 22 nt, Human
uacacauuuuauuuuauuaugc

SEQ ID NO: 1833533 - RNA, 19 nt, Human
uacacauuuuauuuuauua

SEQ ID NO: 1833534 - RNA, 22 nt, Human
uacagacaacaaaccuguuucu

SEQ ID NO: 1833535 - RNA, 20 nt, Human
uacagauccccaagccuggc

SEQ ID NO: 1833536 - RNA, 23 nt, Human
aauggcacaaucucggcucacug

SEQ ID NO: 1833537 - RNA, 16 nt, Human
aauggcagccuuggca

SEQ ID NO: 1833538 - RNA, 12 nt, Human
aauggcagccuu

SEQ ID NO: 1833539 - RNA, 20 nt, Human
uacuaucaugucaaacguga

SEQ ID NO: 1833540 - RNA, 17 nt, Human
uacuacuccuguaggaa

SEQ ID NO: 1833541 - RNA, 13 nt, Human
uacuacuccugua

SEQ ID NO: 1833542 - RNA, 13 nt, Human
uacuauguaucaa

SEQ ID NO: 1833543 - RNA, 12 nt, Human
uacuauguauca

SEQ ID NO: 1833544 - RNA, 23 nt, Human
uacuauggcccuggccuagcaua

SEQ ID NO: 1833545 - RNA, 23 nt, Human
uacucuccuggaaauauuaagaa

SEQ ID NO: 1833546 - RNA, 22 nt, Human
uacucuccuggaaauauuaaga

SEQ ID NO: 1833547 - RNA, 14 nt, Human
uacuauguaucaau

SEQ ID NO: 1833548 - RNA, 13 nt, Human
uacguacacauuu

SEQ ID NO: 1833549 - RNA, 14 nt, Human
uacguacacauuuu

SEQ ID NO: 1833550 - RNA, 15 nt, Human
uacguugugcauuug

SEQ ID NO: 1833551 - RNA, 16 nt, Human
uacguugugcauuugg

SEQ ID NO: 1833552 - RNA, 12 nt, Human
uacguacacauu

SEQ ID NO: 1833553 - RNA, 18 nt, Human
uacgggaggguaaggcug

SEQ ID NO: 1833554 - RNA, 22 nt, Human
uacgccaggggaaaaucagccu

SEQ ID NO: 1833555 - RNA, 12 nt, Human
aauugcauuucc

SEQ ID NO: 1833556 - RNA, 19 nt, Human
aauugaugggauuugguca

SEQ ID NO: 1833557 - RNA, 22 nt, Human
aauugacccacaagaaaugaaa

SEQ ID NO: 1833558 - RNA, 14 nt, Human
aauugacuuauuua

SEQ ID NO: 1833559 - RNA, 21 nt, Human
aauugacccacaagaaaugaa

SEQ ID NO: 1833560 - RNA, 22 nt, Human
uacuguacaugaaaacacauuu

SEQ ID NO: 1833561 - RNA, 21 nt, Human
uacuguacaugaaaacacauu

SEQ ID NO: 1833562 - RNA, 23 nt, Human
uacuguaauuugugauacaaugc

SEQ ID NO: 1833563 - RNA, 18 nt, Human
uacuguaaggcaaucaug

SEQ ID NO: 1833564 - RNA, 19 nt, Human
uacuguaauuugugauaca

SEQ ID NO: 1833565 - RNA, 20 nt, Human
uacuguaauuugugauacaa

SEQ ID NO: 1833566 - RNA, 18 nt, Human
uacuguaauuugugauac

SEQ ID NO: 1833567 - RNA, 19 nt, Human
uacuguaaggcaaucaugg

SEQ ID NO: 1833568 - RNA, 16 nt, Human
uacuggagaaaaugga

SEQ ID NO: 1833569 - RNA, 21 nt, Human
uacucugugucagguggggca

SEQ ID NO: 1833570 - RNA, 12 nt, Human
uacucuguguca

SEQ ID NO: 1833571 - RNA, 16 nt, Human
aauuauuauuuggccc

SEQ ID NO: 1833572 - RNA, 14 nt, Human
aauuccccacccug

SEQ ID NO: 1833573 - RNA, 12 nt, Human
aauuccccagau

SEQ ID NO: 1833574 - RNA, 22 nt, Human
aauuccacuuauaggaauugac

SEQ ID NO: 1833575 - RNA, 18 nt, Human
aauuccaagugauugaaa

SEQ ID NO: 1833576 - RNA, 17 nt, Human
uaccugucccccugaca

SEQ ID NO: 1833577 - RNA, 16 nt, Human
uaccugucccccugac

SEQ ID NO: 1833578 - RNA, 14 nt, Human
uaccugucccccug

SEQ ID NO: 1833579 - RNA, 13 nt, Human
uaccugucccccu

SEQ ID NO: 1833580 - RNA, 10 nt, Human
uaccuguccc

SEQ ID NO: 1833581 - RNA, 20 nt, Human
uaccugccaggaagccagca

SEQ ID NO: 1833582 - RNA, 18 nt, Human
uaccugccaggaagccag

SEQ ID NO: 1833583 - RNA, 23 nt, Human
uaccugccaggaagccagcaggc

SEQ ID NO: 1833584 - RNA, 11 nt, Human
aauuacaggaa

SEQ ID NO: 1833585 - RNA, 15 nt, Human
aauuagccaagugug

SEQ ID NO: 1833586 - RNA, 18 nt, Human
uaauagacaauuuauuau

SEQ ID NO: 1833587 - RNA, 22 nt, Human
uaauagacaauuuauuauggca

SEQ ID NO: 1833588 - RNA, 19 nt, Human
uaauagcgucauaacuaga

SEQ ID NO: 1833589 - RNA, 16 nt, Human
uaauacaccacuacau

SEQ ID NO: 1833590 - RNA, 18 nt, Human
uaauacaccacuacauuc

SEQ ID NO: 1833591 - RNA, 19 nt, Human
uaauacaccacuacauucu

SEQ ID NO: 1833592 - RNA, 14 nt, Human
uaauagacaauuua

SEQ ID NO: 1833593 - RNA, 16 nt, Human
uaauagacaauuuauu

SEQ ID NO: 1833594 - RNA, 17 nt, Human
uaaugaaugaaacauuu

SEQ ID NO: 1833595 - RNA, 17 nt, Human
aaugaaaccugugucuc

SEQ ID NO: 1833596 - RNA, 17 nt, Human
aaugaaagacuguacaa

SEQ ID NO: 1833597 - RNA, 16 nt, Human
aaugaaagacuguaca

SEQ ID NO: 1833598 - RNA, 17 nt, Human
aaugaaacauuuuguca

SEQ ID NO: 1833599 - RNA, 13 nt, Human
aaucuuucugcag

SEQ ID NO: 1833600 - RNA, 13 nt, Human
aaugaaugucagu

SEQ ID NO: 1833601 - RNA, 22 nt, Human
aaugaauggcuaagcaaaaugu

SEQ ID NO: 1833602 - RNA, 17 nt, Human
aaugaaugcauaaaaug

SEQ ID NO: 1833603 - RNA, 13 nt, Human
aaugacacagucu

SEQ ID NO: 1833604 - RNA, 22 nt, Human
aaugaaugucagugugacugau

SEQ ID NO: 1833605 - RNA, 16 nt, Human
aaucuuuaauuuuaca

SEQ ID NO: 1833606 - RNA, 15 nt, Human
aaucuuuaauuuuac

SEQ ID NO: 1833607 - RNA, 15 nt, Human
uaaugaaugcauaaa

SEQ ID NO: 1833608 - RNA, 13 nt, Human
uaauguacugcau

SEQ ID NO: 1833609 - RNA, 18 nt, Human
uaaugucacaggcagguc

SEQ ID NO: 1833610 - RNA, 19 nt, Human
uaaguauucuuauuuaaug

SEQ ID NO: 1833611 - RNA, 20 nt, Human
uaaguauucuuauuuaauga

SEQ ID NO: 1833612 - RNA, 19 nt, Human
uaaguacuauguaucaaug

SEQ ID NO: 1833613 - RNA, 17 nt, Human
uaaguacuauguaucaa

SEQ ID NO: 1833614 - RNA, 16 nt, Human
uaaguacuauguauca

SEQ ID NO: 1833615 - RNA, 13 nt, Human
uaaguacuaugua

SEQ ID NO: 1833616 - RNA, 18 nt, Human
uaauaaacacucuugaaa

SEQ ID NO: 1833617 - RNA, 12 nt, Human
uaauaaacacuc

SEQ ID NO: 1833618 - RNA, 17 nt, Human
aaucugggccagaauuu

SEQ ID NO: 1833619 - RNA, 16 nt, Human
aaucugggccagaauu

SEQ ID NO: 1833620 - RNA, 19 nt, Human
aaucuacacuccagugaga

SEQ ID NO: 1833621 - RNA, 19 nt, Human
aaucuuauaauuuaaaaua

SEQ ID NO: 1833622 - RNA, 15 nt, Human
aaucauuagguguga

SEQ ID NO: 1833623 - RNA, 17 nt, Human
aaucauuaggugugacu

SEQ ID NO: 1833624 - RNA, 23 nt, Human
aaucauuaggugugacugaauuu

SEQ ID NO: 1833625 - RNA, 12 nt, Human
aauccgcccauc

SEQ ID NO: 1833626 - RNA, 15 nt, Human
aaucgaccugccucg

SEQ ID NO: 1833627 - RNA, 21 nt, Human
aauccuggggaacauagaacu

SEQ ID NO: 1833628 - RNA, 11 nt, Human
aauccuggcug

SEQ ID NO: 1833629 - RNA, 14 nt, Human
aauccuggggaaca

SEQ ID NO: 1833630 - RNA, 15 nt, Human
aauauuguacaguuu

SEQ ID NO: 1833631 - RNA, 17 nt, Human
aauauuguacaguuuuu

SEQ ID NO: 1833632 - RNA, 23 nt, Human
aauauuguacaguuuuuauugcu

SEQ ID NO: 1833633 - RNA, 17 nt, Human
aauauugauaugcuuau

SEQ ID NO: 1833634 - RNA, 12 nt, Human
aauauuuagugu

SEQ ID NO: 1833635 - RNA, 22 nt, Human
aauaugcacacauuuuuuaaau

SEQ ID NO: 1833636 - RNA, 16 nt, Human
aauaugcacacauuuu

SEQ ID NO: 1833637 - RNA, 17 nt, Human
aauaugcacacauuuuu

SEQ ID NO: 1833638 - RNA, 15 nt, Human
uaagagaaaugagcu

SEQ ID NO: 1833639 - RNA, 15 nt, Human
aauauuccugcauuu

SEQ ID NO: 1833640 - RNA, 12 nt, Human
aauauuccagag

SEQ ID NO: 1833641 - RNA, 18 nt, Human
uaagcacacuugacauca

SEQ ID NO: 1833642 - RNA, 22 nt, Human
uaagcuguuacugucuucagua

SEQ ID NO: 1833643 - RNA, 21 nt, Human
uaagauuccagagaguggcuc

SEQ ID NO: 1833644 - RNA, 14 nt, Human
uaagauuccagaga

SEQ ID NO: 1833645 - RNA, 16 nt, Human
aauaguggugugauuu

SEQ ID NO: 1833646 - RNA, 22 nt, Human
aauaguggugugauuuggggau

SEQ ID NO: 1833647 - RNA, 15 nt, Human
aauauauuuuaagac

SEQ ID NO: 1833648 - RNA, 14 nt, Human
aauauauuuuaaga

SEQ ID NO: 1833649 - RNA, 14 nt, Human
aauaguuguugauu

SEQ ID NO: 1833650 - RNA, 13 nt, Human
aauaguuggcuag

SEQ ID NO: 1833651 - RNA, 18 nt, Human
aauauauuuuaagacgaa

SEQ ID NO: 1833652 - RNA, 18 nt, Human
uaacauggacaugaucuu

SEQ ID NO: 1833653 - RNA, 17 nt, Human
uaacauguaauuaagua

SEQ ID NO: 1833654 - RNA, 23 nt, Human
uaacauggacaugaucuucuuua

SEQ ID NO: 1833655 - RNA, 16 nt, Human
uaacuuucugaaauaa

SEQ ID NO: 1833656 - RNA, 13 nt, Human
uaagacaaauaug

SEQ ID NO: 1833657 - RNA, 18 nt, Human
uaagaagugaaaaucuac

SEQ ID NO: 1833658 - RNA, 21 nt, Human
uaacuucacauauugauuucc

SEQ ID NO: 1833659 - RNA, 17 nt, Human
uaacuuccaauuuacau

SEQ ID NO: 1833660 - RNA, 14 nt, Human
uaacuucaccauau

SEQ ID NO: 1833661 - RNA, 12 nt, Human
uaacuagaacug

SEQ ID NO: 1833662 - RNA, 14 nt, Human
uaacuagaacugaa

SEQ ID NO: 1833663 - RNA, 17 nt, Human
uaacuagaacugaauuu

SEQ ID NO: 1833664 - RNA, 20 nt, Human
uaacuagaacugaauuuugu

SEQ ID NO: 1833665 - RNA, 18 nt, Human
uaacauggugugcuucuu

SEQ ID NO: 1833666 - RNA, 20 nt, Human
uaacgauaaaagacagugaa

SEQ ID NO: 1833667 - RNA, 15 nt, Human
accaccacacccagc

SEQ ID NO: 1833668 - RNA, 20 nt, Human
accaccacacccagcccacu

SEQ ID NO: 1833669 - RNA, 24 nt, Human
accacauuggagauguuuaguaau

SEQ ID NO: 1833670 - RNA, 18 nt, Human
accacaugugcacaugca

SEQ ID NO: 1833671 - RNA, 17 nt, Human
accacaucuugcucugc

SEQ ID NO: 1833672 - RNA, 18 nt, Human
accacaucuugcucugcu

SEQ ID NO: 1833673 - RNA, 19 nt, Human
accacaucuugcucugcug

SEQ ID NO: 1833674 - RNA, 15 nt, Human
ucaccauguuggcca

SEQ ID NO: 1833675 - RNA, 22 nt, Human
ucaccauguuggccaggcuggu

SEQ ID NO: 1833676 - RNA, 21 nt, Human
ucaccauguuggccaggcugg

SEQ ID NO: 1833677 - RNA, 20 nt, Human
ucacaguucucuccuucuuc

SEQ ID NO: 1833678 - RNA, 16 nt, Human
ucacaguucucuccuu

SEQ ID NO: 1833679 - RNA, 13 nt, Human
ucacagccucuga

SEQ ID NO: 1833680 - RNA, 21 nt, Human
ucacagaugugugauucacag

SEQ ID NO: 1833681 - RNA, 23 nt, Human
ucacagaugugugauucacagug

SEQ ID NO: 1833682 - RNA, 20 nt, Human
ucacagaugggugcuuggag

SEQ ID NO: 1833683 - RNA, 14 nt, Human
ucacaaccuucugu

SEQ ID NO: 1833684 - RNA, 16 nt, Human
ucaauucuugccaaau

SEQ ID NO: 1833685 - RNA, 17 nt, Human
ucacaaaggaugcccaa

SEQ ID NO: 1833686 - RNA, 17 nt, Human
accacuacauucuguua

SEQ ID NO: 1833687 - RNA, 16 nt, Human
accacuacauucuguu

SEQ ID NO: 1833688 - RNA, 15 nt, Human
accacuacauucugu

SEQ ID NO: 1833689 - RNA, 22 nt, Human
accagcgugugacuacuccccc

SEQ ID NO: 1833690 - RNA, 19 nt, Human
ucacguaaagcuagaaaug

SEQ ID NO: 1833691 - RNA, 20 nt, Human
ucacguaaagcuagaaauga

SEQ ID NO: 1833692 - RNA, 16 nt, Human
ucacuaggcuucuggu

SEQ ID NO: 1833693 - RNA, 18 nt, Human
ucacguaaagcuagaaau

SEQ ID NO: 1833694 - RNA, 23 nt, Human
ucacuugaacccgggaggcagag

SEQ ID NO: 1833695 - RNA, 10 nt, Human
ucacuugagu

SEQ ID NO: 1833696 - RNA, 15 nt, Human
accaguguuguggau

SEQ ID NO: 1833697 - RNA, 17 nt, Human
accaguguuguggauuu

SEQ ID NO: 1833698 - RNA, 20 nt, Human
ucacuaucccggcugcccuu

SEQ ID NO: 1833699 - RNA, 19 nt, Human
ucacuaucccggcugcccu

SEQ ID NO: 1833700 - RNA, 16 nt, Human
ucacugagacagcccg

SEQ ID NO: 1833701 - RNA, 21 nt, Human
ucacugagacagcccgggcuc

SEQ ID NO: 1833702 - RNA, 17 nt, Human
ucacugagacagcccgg

SEQ ID NO: 1833703 - RNA, 22 nt, Human
ucacugagacagcccgggcucu

SEQ ID NO: 1833704 - RNA, 14 nt, Human
ucacugcagccuca

SEQ ID NO: 1833705 - RNA, 15 nt, Human
ucacugcagccucaa

SEQ ID NO: 1833706 - RNA, 13 nt, Human
ucacugcauccuc

SEQ ID NO: 1833707 - RNA, 23 nt, Human
ucacuguugcccaggcuggcgug

SEQ ID NO: 1833708 - RNA, 18 nt, Human
acauuuuauuuuauuaug

SEQ ID NO: 1833709 - RNA, 14 nt, Human
acauuuuauuuuau

SEQ ID NO: 1833710 - RNA, 19 nt, Human
acauuuuauuuuauuaugc

SEQ ID NO: 1833711 - RNA, 20 nt, Human
acauuuuauuuuauuaugca

SEQ ID NO: 1833712 - RNA, 15 nt, Human
acauugcaauagaaa

SEQ ID NO: 1833713 - RNA, 16 nt, Human
acauugcaauagaaau

SEQ ID NO: 1833714 - RNA, 14 nt, Human
acauugcaauagaa

SEQ ID NO: 1833715 - RNA, 21 nt, Human
acauuuuuaagugcugcauuu

SEQ ID NO: 1833716 - RNA, 22 nt, Human
acauuuuuaagugcugcauuua

SEQ ID NO: 1833717 - RNA, 23 nt, Human
acauuuuuaagugcugcauuuaa

SEQ ID NO: 1833718 - RNA, 11 nt, Human
acauuuuguau

SEQ ID NO: 1833719 - RNA, 14 nt, Human
acauuuuuuaaaug

SEQ ID NO: 1833720 - RNA, 16 nt, Human
acauuuuuuaaaugca

SEQ ID NO: 1833721 - RNA, 17 nt, Human
acauuuuuuaaaugcac

SEQ ID NO: 1833722 - RNA, 21 nt, Human
acauuuuuuaaaugcaccugg

SEQ ID NO: 1833723 - RNA, 23 nt, Human
ucaaugaaugaaugaauggcuaa

SEQ ID NO: 1833724 - RNA, 22 nt, Human
ucaauaucuuuuuuuuaauaaa

SEQ ID NO: 1833725 - RNA, 22 nt, Human
ucaaguccucuuuucugagagg

SEQ ID NO: 1833726 - RNA, 23 nt, Human
acaugagguacugagagugaaca

SEQ ID NO: 1833727 - RNA, 15 nt, Human
acaugcuacacacug

SEQ ID NO: 1833728 - RNA, 21 nt, Human
acaugcuacacacugcauguu

SEQ ID NO: 1833729 - RNA, 20 nt, Human
acaugagguacugagaguga

SEQ ID NO: 1833730 - RNA, 12 nt, Human
acagucccugcc

SEQ ID NO: 1833731 - RNA, 20 nt, Human
acaugaauauuuaguguuca

SEQ ID NO: 1833732 - RNA, 22 nt, Human
acauguaauuaaguacuaugua

SEQ ID NO: 1833733 - RNA, 21 nt, Human
acauguaauuaaguacuaugu

SEQ ID NO: 1833734 - RNA, 19 nt, Human
acauguaauuaaguacuau

SEQ ID NO: 1833735 - RNA, 17 nt, Human
acauguaauuaaguacu

SEQ ID NO: 1833736 - RNA, 15 nt, Human
acauguaauuaagua

SEQ ID NO: 1833737 - RNA, 19 nt, Human
acauguccaagaagcccag

SEQ ID NO: 1833738 - RNA, 15 nt, Human
acauguccaagaagc

SEQ ID NO: 1833739 - RNA, 23 nt, Human
acauguaauuaaguacuauguau

SEQ ID NO: 1833740 - RNA, 14 nt, Human
acauuccugaugcu

SEQ ID NO: 1833741 - RNA, 14 nt, Human
ucaaccagcagaug

SEQ ID NO: 1833742 - RNA, 18 nt, Human
ucaaccauuccccauggg

SEQ ID NO: 1833743 - RNA, 15 nt, Human
ucaaccauuccccau

SEQ ID NO: 1833744 - RNA, 20 nt, Human
ucaacugcaucaagauguga

SEQ ID NO: 1833745 - RNA, 13 nt, Human
ucaaauuucuaaa

SEQ ID NO: 1833746 - RNA, 14 nt, Human
ucaaauuucuaaau

SEQ ID NO: 1833747 - RNA, 14 nt, Human
acccugaggcccag

SEQ ID NO: 1833748 - RNA, 18 nt, Human
acccugaaagcccugagc

SEQ ID NO: 1833749 - RNA, 16 nt, Human
acccugaaagcccuga

SEQ ID NO: 1833750 - RNA, 19 nt, Human
acccucgaggcggaucuuu

SEQ ID NO: 1833751 - RNA, 23 nt, Human
acccuuguggucccaccccacac

SEQ ID NO: 1833752 - RNA, 20 nt, Human
acccuuguggucccacccca

SEQ ID NO: 1833753 - RNA, 17 nt, Human
acccuugccgucuaccu

SEQ ID NO: 1833754 - RNA, 15 nt, Human
accgaaaacguggcu

SEQ ID NO: 1833755 - RNA, 15 nt, Human
acccugcccuguggg

SEQ ID NO: 1833756 - RNA, 17 nt, Human
acccugaggcccagagg

SEQ ID NO: 1833757 - RNA, 16 nt, Human
acccugaggcccagag

SEQ ID NO: 1833758 - RNA, 15 nt, Human
acccugaggcccaga

SEQ ID NO: 1833759 - RNA, 22 nt, Human
acccugcccugugggcccccaa

SEQ ID NO: 1833760 - RNA, 17 nt, Human
acccugcccugugggcc

SEQ ID NO: 1833761 - RNA, 12 nt, Human
acccuucuuuuc

SEQ ID NO: 1833762 - RNA, 20 nt, Human
ucaggccaggcccucugccc

SEQ ID NO: 1833763 - RNA, 22 nt, Human
ucaggccaggcccucugcccac

SEQ ID NO: 1833764 - RNA, 21 nt, Human
ucaggccaggcccucugccca

SEQ ID NO: 1833765 - RNA, 14 nt, Human
ucagcuccagcuca

SEQ ID NO: 1833766 - RNA, 15 nt, Human
ucagcuccagcucac

SEQ ID NO: 1833767 - RNA, 21 nt, Human
ucagcuuguaaauagcucagg

SEQ ID NO: 1833768 - RNA, 22 nt, Human
ucagcuuguaaauagcucaggu

SEQ ID NO: 1833769 - RNA, 23 nt, Human
ucaggccaggcccucugcccacu

SEQ ID NO: 1833770 - RNA, 19 nt, Human
ucagggucccugguggcag

SEQ ID NO: 1833771 - RNA, 16 nt, Human
ucaggguuggccccug

SEQ ID NO: 1833772 - RNA, 23 nt, Human
ucagguaacaggcagauacagga

SEQ ID NO: 1833773 - RNA, 21 nt, Human
ucagguaacaggcagauacag

SEQ ID NO: 1833774 - RNA, 22 nt, Human
ucagguaacaggcagauacagg

SEQ ID NO: 1833775 - RNA, 21 nt, Human
acccggaggggccuggcagcc

SEQ ID NO: 1833776 - RNA, 18 nt, Human
acccggaggggccuggca

SEQ ID NO: 1833777 - RNA, 14 nt, Human
acccggccccugcu

SEQ ID NO: 1833778 - RNA, 15 nt, Human
acccggccccugcug

SEQ ID NO: 1833779 - RNA, 16 nt, Human
acccggccccugcugg

SEQ ID NO: 1833780 - RNA, 22 nt, Human
acccggccccugcugguucagg

SEQ ID NO: 1833781 - RNA, 17 nt, Human
acccggccccugcuggu

SEQ ID NO: 1833782 - RNA, 20 nt, Human
acccggccccugcugguuca

SEQ ID NO: 1833783 - RNA, 13 nt, Human
acccgggaagggg

SEQ ID NO: 1833784 - RNA, 12 nt, Human
acccgggaaggg

SEQ ID NO: 1833785 - RNA, 17 nt, Human
acccgggaggcagaggu

SEQ ID NO: 1833786 - RNA, 21 nt, Human
accccuggcuuuucacugcug

SEQ ID NO: 1833787 - RNA, 20 nt, Human
accccuggcuuuucacugcu

SEQ ID NO: 1833788 - RNA, 19 nt, Human
accccuggcuuuucacugc

SEQ ID NO: 1833789 - RNA, 18 nt, Human
accccuggcuuuucacug

SEQ ID NO: 1833790 - RNA, 12 nt, Human
ucagcuccagcu

SEQ ID NO: 1833791 - RNA, 19 nt, Human
ucagcggggacagcuccuu

SEQ ID NO: 1833792 - RNA, 20 nt, Human
ucagcggggacagcuccuuc

SEQ ID NO: 1833793 - RNA, 21 nt, Human
ucagcggggacagcuccuucu

SEQ ID NO: 1833794 - RNA, 23 nt, Human
ucagcggggacagcuccuucugu

SEQ ID NO: 1833795 - RNA, 18 nt, Human
accccaucucuacaaaaa

SEQ ID NO: 1833796 - RNA, 15 nt, Human
accccugagcuugca

SEQ ID NO: 1833797 - RNA, 16 nt, Human
ucagcccucccugccc

SEQ ID NO: 1833798 - RNA, 15 nt, Human
ucagcccucccugcc

SEQ ID NO: 1833799 - RNA, 14 nt, Human
ucagcccucccugc

SEQ ID NO: 1833800 - RNA, 13 nt, Human
ucagcccucccug

SEQ ID NO: 1833801 - RNA, 17 nt, Human
ucagcccucccugcccc

SEQ ID NO: 1833802 - RNA, 19 nt, Human
acccaggagccccgaggcc

SEQ ID NO: 1833803 - RNA, 23 nt, Human
acccaggagccccgaggccuucu

SEQ ID NO: 1833804 - RNA, 17 nt, Human
accccacacacgccaga

SEQ ID NO: 1833805 - RNA, 13 nt, Human
accccagccccaa

SEQ ID NO: 1833806 - RNA, 22 nt, Human
accccagccccaaaacucuccu

SEQ ID NO: 1833807 - RNA, 12 nt, Human
ucagauuugaac

SEQ ID NO: 1833808 - RNA, 21 nt, Human
ucagauuugaacucuucaauc

SEQ ID NO: 1833809 - RNA, 18 nt, Human
accaguguuguggauuua

SEQ ID NO: 1833810 - RNA, 15 nt, Human
ucagcaaaagaugcu

SEQ ID NO: 1833811 - RNA, 23 nt, Human
ucaugcaaacuuuauuuuguguu

SEQ ID NO: 1833812 - RNA, 16 nt, Human
ucaugugaaaucauuc

SEQ ID NO: 1833813 - RNA, 17 nt, Human
ucaugugaaaucauuca

SEQ ID NO: 1833814 - RNA, 13 nt, Human
ucauccauccagg

SEQ ID NO: 1833815 - RNA, 13 nt, Human
ucaucuaggauuu

SEQ ID NO: 1833816 - RNA, 14 nt, Human
ucaugcaaacuuua

SEQ ID NO: 1833817 - RNA, 11 nt, Human
ucaugauuuuu

SEQ ID NO: 1833818 - RNA, 20 nt, Human
accucccacaaaggagagcu

SEQ ID NO: 1833819 - RNA, 16 nt, Human
accgcagacaggacca

SEQ ID NO: 1833820 - RNA, 12 nt, Human
accgcagacagg

SEQ ID NO: 1833821 - RNA, 17 nt, Human
accgcagacaggaccag

SEQ ID NO: 1833822 - RNA, 15 nt, Human
ucagugccuuaugga

SEQ ID NO: 1833823 - RNA, 14 nt, Human
ucagugccuuaugg

SEQ ID NO: 1833824 - RNA, 12 nt, Human
ucagugccuuau

SEQ ID NO: 1833825 - RNA, 11 nt, Human
ucagugccuua

SEQ ID NO: 1833826 - RNA, 10 nt, Human
ucagugccuu

SEQ ID NO: 1833827 - RNA, 9 nt, Human
ucagugccu

SEQ ID NO: 1833828 - RNA, 20 nt, Human
ucagugcccuccaggauaga

SEQ ID NO: 1833829 - RNA, 19 nt, Human
accgaaaacguggcugcuu

SEQ ID NO: 1833830 - RNA, 17 nt, Human
accgaaaacguggcugc

SEQ ID NO: 1833831 - RNA, 16 nt, Human
ucagugccaaaaacaa

SEQ ID NO: 1833832 - RNA, 12 nt, Human
ucagugccacua

SEQ ID NO: 1833833 - RNA, 16 nt, Human
ucaguggggaggggcu

SEQ ID NO: 1833834 - RNA, 12 nt, Human
ucaguggcagcu

SEQ ID NO: 1833835 - RNA, 13 nt, Human
ucaguggcagcug

SEQ ID NO: 1833836 - RNA, 18 nt, Human
ucagugccuuauggaaca

SEQ ID NO: 1833837 - RNA, 16 nt, Human
ucagugccuuauggaa

SEQ ID NO: 1833838 - RNA, 11 nt, Human
ucaguggcagc

SEQ ID NO: 1833839 - RNA, 15 nt, Human
ucaguuuuugugaaa

SEQ ID NO: 1833840 - RNA, 16 nt, Human
ucaguuuucaggagug

SEQ ID NO: 1833841 - RNA, 17 nt, Human
ucaguuuuugugaaaag

SEQ ID NO: 1833842 - RNA, 14 nt, Human
ucauaaccuagccu

SEQ ID NO: 1833843 - RNA, 15 nt, Human
ucauaguaugguggc

SEQ ID NO: 1833844 - RNA, 18 nt, Human
ucauaguaugguggcugg

SEQ ID NO: 1833845 - RNA, 19 nt, Human
ucauaguaugguggcuggg

SEQ ID NO: 1833846 - RNA, 18 nt, Human
ucauauaagauucauauu

SEQ ID NO: 1833847 - RNA, 21 nt, Human
ucauaguaugguggcuggguu

SEQ ID NO: 1833848 - RNA, 16 nt, Human
ucauauuuacuucuua

SEQ ID NO: 1833849 - RNA, 17 nt, Human
accgagucucuucucca

SEQ ID NO: 1833850 - RNA, 16 nt, Human
accgagucucuucucc

SEQ ID NO: 1833851 - RNA, 23 nt, Human
ucauauuuacuucuuauacauuu

SEQ ID NO: 1833852 - RNA, 15 nt, Human
ucauauuuacuucuu

SEQ ID NO: 1833853 - RNA, 11 nt, Human
uccagccuggg

SEQ ID NO: 1833854 - RNA, 20 nt, Human
uccagccugcugccugcuuu

SEQ ID NO: 1833855 - RNA, 13 nt, Human
uccagaccccugg

SEQ ID NO: 1833856 - RNA, 15 nt, Human
uccagaauuucccaa

SEQ ID NO: 1833857 - RNA, 14 nt, Human
uccagaauuuccca

SEQ ID NO: 1833858 - RNA, 18 nt, Human
acgaauauugcugauggu

SEQ ID NO: 1833859 - RNA, 15 nt, Human
acgaauauugcugau

SEQ ID NO: 1833860 - RNA, 23 nt, Human
uccaggcugggagagccuuccag

SEQ ID NO: 1833861 - RNA, 10 nt, Human
uccaggcucc

SEQ ID NO: 1833862 - RNA, 21 nt, Human
uccaggcugggagagccuucc

SEQ ID NO: 1833863 - RNA, 20 nt, Human
uccaggcugggagagccuuc

SEQ ID NO: 1833864 - RNA, 12 nt, Human
uccaggcuccuu

SEQ ID NO: 1833865 - RNA, 22 nt, Human
uccaggcuccuuuagcgcccag

SEQ ID NO: 1833866 - RNA, 17 nt, Human
accuuuguccccaccgc

SEQ ID NO: 1833867 - RNA, 18 nt, Human
accuuugacaaagguaaa

SEQ ID NO: 1833868 - RNA, 17 nt, Human
accuuugacaaagguaa

SEQ ID NO: 1833869 - RNA, 18 nt, Human
accuuuguccccaccgca

SEQ ID NO: 1833870 - RNA, 22 nt, Human
accuuuguuugcaucugaaaau

SEQ ID NO: 1833871 - RNA, 19 nt, Human
accuugaaaacuuuaugcu

SEQ ID NO: 1833872 - RNA, 20 nt, Human
accuugaacuggguacuugu

SEQ ID NO: 1833873 - RNA, 13 nt, Human
accuuuuuuauac

SEQ ID NO: 1833874 - RNA, 22 nt, Human
uccacugguucuucuuggucuc

SEQ ID NO: 1833875 - RNA, 18 nt, Human
uccagaauggucuuucua

SEQ ID NO: 1833876 - RNA, 21 nt, Human
uccacugugccaugugccagg

SEQ ID NO: 1833877 - RNA, 21 nt, Human
acgcuacccgggaagggggcu

SEQ ID NO: 1833878 - RNA, 20 nt, Human
acgcgugcacacaccagagc

SEQ ID NO: 1833879 - RNA, 21 nt, Human
acgaauauugcugauggugca

SEQ ID NO: 1833880 - RNA, 23 nt, Human
acggagucccaccuuggcugcag

SEQ ID NO: 1833881 - RNA, 17 nt, Human
acgcuggagugcaguga

SEQ ID NO: 1833882 - RNA, 18 nt, Human
acgcuggagugcagugag

SEQ ID NO: 1833883 - RNA, 20 nt, Human
acgcuggaccuugaacuggg

SEQ ID NO: 1833884 - RNA, 23 nt, Human
acgcuggaccuugaacuggguac

SEQ ID NO: 1833885 - RNA, 15 nt, Human
acgcuggagugcagu

SEQ ID NO: 1833886 - RNA, 16 nt, Human
acgcuggagugcagug

SEQ ID NO: 1833887 - RNA, 15 nt, Human
acgcuccuuccucug

SEQ ID NO: 1833888 - RNA, 14 nt, Human
acgcuccuuccucu

SEQ ID NO: 1833889 - RNA, 11 nt, Human
acgcucucugg

SEQ ID NO: 1833890 - RNA, 14 nt, Human
acgcucucuggccu

SEQ ID NO: 1833891 - RNA, 13 nt, Human
acgcuggaccuug

SEQ ID NO: 1833892 - RNA, 18 nt, Human
uccaguaucuugaagacu

SEQ ID NO: 1833893 - RNA, 16 nt, Human
uccaguaucuugaaga

SEQ ID NO: 1833894 - RNA, 18 nt, Human
uccagugagacagcucug

SEQ ID NO: 1833895 - RNA, 15 nt, Human
uccagugaggcucug

SEQ ID NO: 1833896 - RNA, 16 nt, Human
uccagugaggcucugc

SEQ ID NO: 1833897 - RNA, 23 nt, Human
uccagugaggcucugcccuuggu

SEQ ID NO: 1833898 - RNA, 22 nt, Human
uccagugaggcucugcccuugg

SEQ ID NO: 1833899 - RNA, 15 nt, Human
uccaguaucuugaag

SEQ ID NO: 1833900 - RNA, 14 nt, Human
uccaguaucuugaa

SEQ ID NO: 1833901 - RNA, 18 nt, Human
acggcuuuuacuuaaacc

SEQ ID NO: 1833902 - RNA, 13 nt, Human
acggccaggccag

SEQ ID NO: 1833903 - RNA, 16 nt, Human
acggcucacugcagcc

SEQ ID NO: 1833904 - RNA, 17 nt, Human
acggcucacugcagccu

SEQ ID NO: 1833905 - RNA, 18 nt, Human
acggcucacugcagccuc

SEQ ID NO: 1833906 - RNA, 12 nt, Human
acggccaggcca

SEQ ID NO: 1833907 - RNA, 21 nt, Human
uccccaggaggccagccuuga

SEQ ID NO: 1833908 - RNA, 20 nt, Human
uccccaggaggccagccuug

SEQ ID NO: 1833909 - RNA, 11 nt, Human
ucccccagccc

SEQ ID NO: 1833910 - RNA, 15 nt, Human
ucccccagccccauc

SEQ ID NO: 1833911 - RNA, 13 nt, Human
ucccccagcccca

SEQ ID NO: 1833912 - RNA, 16 nt, Human
ucccccagccccaucc

SEQ ID NO: 1833913 - RNA, 19 nt, Human
acuagacucccaagcugga

SEQ ID NO: 1833914 - RNA, 12 nt, Human
uccccacccuga

SEQ ID NO: 1833915 - RNA, 18 nt, Human
uccccaggaggccagccu

SEQ ID NO: 1833916 - RNA, 16 nt, Human
uccccaccgcagacag

SEQ ID NO: 1833917 - RNA, 15 nt, Human
uccccaccgcagaca

SEQ ID NO: 1833918 - RNA, 23 nt, Human
uccccacccugaaagcccugagc

SEQ ID NO: 1833919 - RNA, 20 nt, Human
acuauagccuaggugacaga

SEQ ID NO: 1833920 - RNA, 22 nt, Human
acuauagccuaggugacagagu

SEQ ID NO: 1833921 - RNA, 21 nt, Human
acuaucuaaauguugaaagau

SEQ ID NO: 1833922 - RNA, 16 nt, Human
acuaucuaaauguuga

SEQ ID NO: 1833923 - RNA, 17 nt, Human
acuauguugcccaggca

SEQ ID NO: 1833924 - RNA, 15 nt, Human
acuauguugcccagg

SEQ ID NO: 1833925 - RNA, 16 nt, Human
acuauguugcccaggc

SEQ ID NO: 1833926 - RNA, 22 nt, Human
acuauggcccuggccuagcaua

SEQ ID NO: 1833927 - RNA, 14 nt, Human
acuauguugcccag

SEQ ID NO: 1833928 - RNA, 16 nt, Human
acucaaugcacugaca

SEQ ID NO: 1833929 - RNA, 18 nt, Human
acguggcugcuucaagga

SEQ ID NO: 1833930 - RNA, 21 nt, Human
acguggcugcuucaaggaucc

SEQ ID NO: 1833931 - RNA, 19 nt, Human
acguggcugcuucaaggau

SEQ ID NO: 1833932 - RNA, 15 nt, Human
acguuucuaaaggcu

SEQ ID NO: 1833933 - RNA, 16 nt, Human
acguuucuaaaggcua

SEQ ID NO: 1833934 - RNA, 14 nt, Human
acguugugcauuug

SEQ ID NO: 1833935 - RNA, 15 nt, Human
acguugugcauuugg

SEQ ID NO: 1833936 - RNA, 13 nt, Human
acguugugcauuu

SEQ ID NO: 1833937 - RNA, 15 nt, Human
acguuaccaggcagg

SEQ ID NO: 1833938 - RNA, 17 nt, Human
acguaaagcuagaaaug

SEQ ID NO: 1833939 - RNA, 18 nt, Human
acguaaagcuagaaauga

SEQ ID NO: 1833940 - RNA, 12 nt, Human
uccauccugagg

SEQ ID NO: 1833941 - RNA, 15 nt, Human
uccauccugaggcuc

SEQ ID NO: 1833942 - RNA, 19 nt, Human
uccauccugaggcuccacu

SEQ ID NO: 1833943 - RNA, 16 nt, Human
ucccagauacuugggg

SEQ ID NO: 1833944 - RNA, 18 nt, Human
ucccagauacuugggggg

SEQ ID NO: 1833945 - RNA, 22 nt, Human
acguuucuaaaggcuaccuuug

SEQ ID NO: 1833946 - RNA, 15 nt, Human
acuaauuuuaaaaug

SEQ ID NO: 1833947 - RNA, 14 nt, Human
uccugcaggcagcc

SEQ ID NO: 1833948 - RNA, 13 nt, Human
uccugcaggcagc

SEQ ID NO: 1833949 - RNA, 12 nt, Human
uccugcaggcag

SEQ ID NO: 1833950 - RNA, 21 nt, Human
uccugcugcaguugccaguca

SEQ ID NO: 1833951 - RNA, 13 nt, Human
uccugcugggcag

SEQ ID NO: 1833952 - RNA, 12 nt, Human
uccugggaguga

SEQ ID NO: 1833953 - RNA, 14 nt, Human
uccugggagugagc

SEQ ID NO: 1833954 - RNA, 17 nt, Human
uccugggagugagcugg

SEQ ID NO: 1833955 - RNA, 23 nt, Human
uccuggaagugcuaauuuugaaa

SEQ ID NO: 1833956 - RNA, 15 nt, Human
uccuggaaauauuaa

SEQ ID NO: 1833957 - RNA, 20 nt, Human
acugcacuccagccugggug

SEQ ID NO: 1833958 - RNA, 19 nt, Human
acugcacuccagccugggu

SEQ ID NO: 1833959 - RNA, 18 nt, Human
acugcacuccagccuggg

SEQ ID NO: 1833960 - RNA, 17 nt, Human
acugcacuccagccugg

SEQ ID NO: 1833961 - RNA, 14 nt, Human
acugcacuccagcc

SEQ ID NO: 1833962 - RNA, 21 nt, Human
acugcacuauagccuagguga

SEQ ID NO: 1833963 - RNA, 21 nt, Human
uccugaugcuucuucagagac

SEQ ID NO: 1833964 - RNA, 20 nt, Human
uccugaugcuucuucagaga

SEQ ID NO: 1833965 - RNA, 19 nt, Human
uccugaugcuucuucagag

SEQ ID NO: 1833966 - RNA, 22 nt, Human
uccugcacacgcuccuuccucu

SEQ ID NO: 1833967 - RNA, 21 nt, Human
uccugcacacgcuccuuccuc

SEQ ID NO: 1833968 - RNA, 14 nt, Human
uccugcacacgcuc

SEQ ID NO: 1833969 - RNA, 13 nt, Human
acugauaaagaug

SEQ ID NO: 1833970 - RNA, 21 nt, Human
acugauaaagaugagugagca

SEQ ID NO: 1833971 - RNA, 20 nt, Human
acugcaacuuguaaaugugg

SEQ ID NO: 1833972 - RNA, 16 nt, Human
acugcaacuucugccu

SEQ ID NO: 1833973 - RNA, 14 nt, Human
acugcaacuucugc

SEQ ID NO: 1833974 - RNA, 22 nt, Human
acugcacagugcaucucagccc

SEQ ID NO: 1833975 - RNA, 23 nt, Human
acugcacagugcaucucagccca

SEQ ID NO: 1833976 - RNA, 16 nt, Human
acugcaccgggccaca

SEQ ID NO: 1833977 - RNA, 20 nt, Human
acugcacuauagccuaggug

SEQ ID NO: 1833978 - RNA, 14 nt, Human
acugcaccgggcca

SEQ ID NO: 1833979 - RNA, 20 nt, Human
acugaacucugacaacagac

SEQ ID NO: 1833980 - RNA, 13 nt, Human
acugaacauucca

SEQ ID NO: 1833981 - RNA, 16 nt, Human
acugaacauuccagag

SEQ ID NO: 1833982 - RNA, 15 nt, Human
acucuuguuuccuua

SEQ ID NO: 1833983 - RNA, 19 nt, Human
acucuuucuauuguuucuu

SEQ ID NO: 1833984 - RNA, 12 nt, Human
uccucuuuccau

SEQ ID NO: 1833985 - RNA, 11 nt, Human
uccucuuucca

SEQ ID NO: 1833986 - RNA, 14 nt, Human
uccucccucccucu

SEQ ID NO: 1833987 - RNA, 11 nt, Human
uccucccuccc

SEQ ID NO: 1833988 - RNA, 21 nt, Human
uccucuuuggucuacacugug

SEQ ID NO: 1833989 - RNA, 19 nt, Human
uccucuuuggucuacacug

SEQ ID NO: 1833990 - RNA, 19 nt, Human
uccucuuuccaucuacccu

SEQ ID NO: 1833991 - RNA, 21 nt, Human
uccugaauuuuauuuuuuggg

SEQ ID NO: 1833992 - RNA, 22 nt, Human
uccucuuuggucuacacugugc

SEQ ID NO: 1833993 - RNA, 21 nt, Human
acugagacagcccgggcucug

SEQ ID NO: 1833994 - RNA, 18 nt, Human
acugagacagcccgggcu

SEQ ID NO: 1833995 - RNA, 15 nt, Human
acugagacagcccgg

SEQ ID NO: 1833996 - RNA, 21 nt, Human
acugagaaauuuauaaacuuu

SEQ ID NO: 1833997 - RNA, 17 nt, Human
acugagaaauuuauaaa

SEQ ID NO: 1833998 - RNA, 12 nt, Human
acugagaaauuu

SEQ ID NO: 1833999 - RNA, 18 nt, Human
acugagagugaacaaauu

SEQ ID NO: 1834000 - RNA, 23 nt, Human
acugagacagcccgggcucugcc

SEQ ID NO: 1834001 - RNA, 22 nt, Human
acugagacagcccgggcucugc

SEQ ID NO: 1834002 - RNA, 22 nt, Human
acucugagacucgcgacaaugc

SEQ ID NO: 1834003 - RNA, 11 nt, Human
acucugagacu

SEQ ID NO: 1834004 - RNA, 23 nt, Human
acucuccuuggugucgggcauga

SEQ ID NO: 1834005 - RNA, 16 nt, Human
acucuccuuggugucg

SEQ ID NO: 1834006 - RNA, 15 nt, Human
acucuggcagcucag

SEQ ID NO: 1834007 - RNA, 13 nt, Human
acucuggcagcuc

SEQ ID NO: 1834008 - RNA, 16 nt, Human
acucugccuccucuuc

SEQ ID NO: 1834009 - RNA, 12 nt, Human
acucugccuccu

SEQ ID NO: 1834010 - RNA, 15 nt, Human
acucuccuugguguc

SEQ ID NO: 1834011 - RNA, 18 nt, Human
acucuccuggaaauauua

SEQ ID NO: 1834012 - RNA, 16 nt, Human
acucuccucugcugcu

SEQ ID NO: 1834013 - RNA, 14 nt, Human
acucuccucugcug

SEQ ID NO: 1834014 - RNA, 13 nt, Human
acucuccucugcu

SEQ ID NO: 1834015 - RNA, 12 nt, Human
acucuccucugc

SEQ ID NO: 1834016 - RNA, 17 nt, Human
acucuccuccagaguca

SEQ ID NO: 1834017 - RNA, 14 nt, Human
acucuccuccagag

SEQ ID NO: 1834018 - RNA, 24 nt, Human
acuccuugaaaacacuguucucug

SEQ ID NO: 1834019 - RNA, 23 nt, Human
acuccuugaaaacacuguucucu

SEQ ID NO: 1834020 - RNA, 23 nt, Human
uccucauacccacccccacccaa

SEQ ID NO: 1834021 - RNA, 21 nt, Human
uccucccaggcgccccuuccc

SEQ ID NO: 1834022 - RNA, 19 nt, Human
uccucccaggcgccccuuc

SEQ ID NO: 1834023 - RNA, 13 nt, Human
uccucccaggcgc

SEQ ID NO: 1834024 - RNA, 22 nt, Human
uccucauaguaugguggcuggg

SEQ ID NO: 1834025 - RNA, 15 nt, Human
acucuugaccucagg

SEQ ID NO: 1834026 - RNA, 16 nt, Human
acucuugaccucaggu

SEQ ID NO: 1834027 - RNA, 14 nt, Human
acucuugaccucag

SEQ ID NO: 1834028 - RNA, 19 nt, Human
ucccuuuuuuggcugcuga

SEQ ID NO: 1834029 - RNA, 17 nt, Human
ucccuuuuuuggcugcu

SEQ ID NO: 1834030 - RNA, 19 nt, Human
ucccuuugacgccauccca

SEQ ID NO: 1834031 - RNA, 21 nt, Human
ucccuuugacgccaucccagc

SEQ ID NO: 1834032 - RNA, 22 nt, Human
ucccuuuuuuggcugcugaagg

SEQ ID NO: 1834033 - RNA, 20 nt, Human
ucccuuuuuuggcugcugaa

SEQ ID NO: 1834034 - RNA, 23 nt, Human
ucccuuuuuuggcugcugaaggc

SEQ ID NO: 1834035 - RNA, 13 nt, Human
ucccuuuuuuuaa

SEQ ID NO: 1834036 - RNA, 20 nt, Human
ucccuuggauuguccccgac

SEQ ID NO: 1834037 - RNA, 19 nt, Human
ucccuuggauuguccccga

SEQ ID NO: 1834038 - RNA, 23 nt, Human
ucccugguggcagcucaccucuc

SEQ ID NO: 1834039 - RNA, 22 nt, Human
ucccugguggcagcucaccucu

SEQ ID NO: 1834040 - RNA, 18 nt, Human
ucccuuugacgccauccc

SEQ ID NO: 1834041 - RNA, 16 nt, Human
ucccuuugacgccauc

SEQ ID NO: 1834042 - RNA, 21 nt, Human
ucccuuuuuuuaaguaaggaa

SEQ ID NO: 1834043 - RNA, 16 nt, Human
ucccuuuuuuuaagua

SEQ ID NO: 1834044 - RNA, 18 nt, Human
uccgguguuuaagacauu

SEQ ID NO: 1834045 - RNA, 13 nt, Human
uccuacucugugu

SEQ ID NO: 1834046 - RNA, 14 nt, Human
uccuacucuguguc

SEQ ID NO: 1834047 - RNA, 15 nt, Human
uccuacucuguguca

SEQ ID NO: 1834048 - RNA, 13 nt, Human
uccuaggcauuug

SEQ ID NO: 1834049 - RNA, 12 nt, Human
acuccuggccuc

SEQ ID NO: 1834050 - RNA, 13 nt, Human
acuccuggccuca

SEQ ID NO: 1834051 - RNA, 14 nt, Human
acuccuggccucaa

SEQ ID NO: 1834052 - RNA, 14 nt, Human
acuccugcaggcag

SEQ ID NO: 1834053 - RNA, 12 nt, Human
acuccugcaggc

SEQ ID NO: 1834054 - RNA, 12 nt, Human
acuccucccagg

SEQ ID NO: 1834055 - RNA, 16 nt, Human
acuccugcaggcagcc

SEQ ID NO: 1834056 - RNA, 15 nt, Human
acuccugcaggcagc

SEQ ID NO: 1834057 - RNA, 22 nt, Human
acuccugcaggcagccaggcca

SEQ ID NO: 1834058 - RNA, 21 nt, Human
ucccugguggcagcucaccuc

SEQ ID NO: 1834059 - RNA, 20 nt, Human
ucccugguggcagcucaccu

SEQ ID NO: 1834060 - RNA, 19 nt, Human
ucccugguggcagcucacc

SEQ ID NO: 1834061 - RNA, 18 nt, Human
ucccugguggcagcucac

SEQ ID NO: 1834062 - RNA, 17 nt, Human
ucccugguggcagcuca

SEQ ID NO: 1834063 - RNA, 16 nt, Human
ucccugguggcagcuc

SEQ ID NO: 1834064 - RNA, 11 nt, Human
acuccuggccu

SEQ ID NO: 1834065 - RNA, 15 nt, Human
acucaccccagcccc

SEQ ID NO: 1834066 - RNA, 14 nt, Human
acucaccccagccc

SEQ ID NO: 1834067 - RNA, 16 nt, Human
acucaccccagcccca

SEQ ID NO: 1834068 - RNA, 15 nt, Human
acuccagaccccugg

SEQ ID NO: 1834069 - RNA, 13 nt, Human
acuccagaccccu

SEQ ID NO: 1834070 - RNA, 13 nt, Human
acucaccccagcc

SEQ ID NO: 1834071 - RNA, 19 nt, Human
acuccagugagacagcucu

SEQ ID NO: 1834072 - RNA, 21 nt, Human
acuccagaccccuggcuuuuc

SEQ ID NO: 1834073 - RNA, 19 nt, Human
acuccagaccccuggcuuu

SEQ ID NO: 1834074 - RNA, 18 nt, Human
acuccagaccccuggcuu

SEQ ID NO: 1834075 - RNA, 19 nt, Human
ucugcccuccaagaccuuc

SEQ ID NO: 1834076 - RNA, 21 nt, Human
ucugcccacucccugcaaccu

SEQ ID NO: 1834077 - RNA, 18 nt, Human
ucugcccacucccugcaa

SEQ ID NO: 1834078 - RNA, 15 nt, Human
ucugccgcagcccug

SEQ ID NO: 1834079 - RNA, 14 nt, Human
ucugccgcagcccu

SEQ ID NO: 1834080 - RNA, 12 nt, Human
ucugcccugcgg

SEQ ID NO: 1834081 - RNA, 11 nt, Human
ucugcccugcg

SEQ ID NO: 1834082 - RNA, 10 nt, Human
ucugcccugc

SEQ ID NO: 1834083 - RNA, 22 nt, Human
ucugccgcagcccugcagaggg

SEQ ID NO: 1834084 - RNA, 23 nt, Human
ucugccgcagcccugcagagggc

SEQ ID NO: 1834085 - RNA, 21 nt, Human
ucugccugcccaggccccugc

SEQ ID NO: 1834086 - RNA, 22 nt, Human
ucugccugcccaggccccugcc

SEQ ID NO: 1834087 - RNA, 19 nt, Human
ucugcucacauaucuguca

SEQ ID NO: 1834088 - RNA, 20 nt, Human
ucugcucacauaucugucau

SEQ ID NO: 1834089 - RNA, 14 nt, Human
ucugcuucagccuc

SEQ ID NO: 1834090 - RNA, 15 nt, Human
ucugcuucagccucc

SEQ ID NO: 1834091 - RNA, 13 nt, Human
ucugcuucagccu

SEQ ID NO: 1834092 - RNA, 18 nt, Human
agaagauuuugaaauuuu

SEQ ID NO: 1834093 - RNA, 17 nt, Human
ucugcccacucccugca

SEQ ID NO: 1834094 - RNA, 22 nt, Human
agaagcccaggaaaggcuccag

SEQ ID NO: 1834095 - RNA, 21 nt, Human
agaagcccaggaaaggcucca

SEQ ID NO: 1834096 - RNA, 20 nt, Human
agaagcccaggaaaggcucc

SEQ ID NO: 1834097 - RNA, 18 nt, Human
agaagcccaggaaaggcu

SEQ ID NO: 1834098 - RNA, 16 nt, Human
agaagcccaggaaagg

SEQ ID NO: 1834099 - RNA, 12 nt, Human
agaagcccagga

SEQ ID NO: 1834100 - RNA, 20 nt, Human
agaaauugcauuuccugaca

SEQ ID NO: 1834101 - RNA, 17 nt, Human
agaaauugcauuuccug

SEQ ID NO: 1834102 - RNA, 22 nt, Human
agaaagcccuuaggaagaauuu

SEQ ID NO: 1834103 - RNA, 20 nt, Human
agaaagcccuuaggaagaau

SEQ ID NO: 1834104 - RNA, 16 nt, Human
ucuccuuucacaaccu

SEQ ID NO: 1834105 - RNA, 15 nt, Human
ucugaauuauuuucu

SEQ ID NO: 1834106 - RNA, 13 nt, Human
ucugacacacagc

SEQ ID NO: 1834107 - RNA, 14 nt, Human
ucugacacacagcu

SEQ ID NO: 1834108 - RNA, 15 nt, Human
ucugacacacagcuc

SEQ ID NO: 1834109 - RNA, 10 nt, Human
ucugaauuau

SEQ ID NO: 1834110 - RNA, 22 nt, Human
ucugaaggacauugcggacagc

SEQ ID NO: 1834111 - RNA, 21 nt, Human
ucugaaggacauugcggacag

SEQ ID NO: 1834112 - RNA, 18 nt, Human
ucugcagauaaacaguag

SEQ ID NO: 1834113 - RNA, 15 nt, Human
ucugcagauaaacag

SEQ ID NO: 1834114 - RNA, 17 nt, Human
ucugcagcaauaaagca

SEQ ID NO: 1834115 - RNA, 15 nt, Human
ucugcacuccccugc

SEQ ID NO: 1834116 - RNA, 14 nt, Human
ucugcacuccccug

SEQ ID NO: 1834117 - RNA, 16 nt, Human
ucugcacuccccugcu

SEQ ID NO: 1834118 - RNA, 17 nt, Human
ucugcacuccccugcug

SEQ ID NO: 1834119 - RNA, 21 nt, Human
ucugaugcaagcaagaaacac

SEQ ID NO: 1834120 - RNA, 12 nt, Human
ucugcagguccc

SEQ ID NO: 1834121 - RNA, 11 nt, Human
ucugcaggucc

SEQ ID NO: 1834122 - RNA, 13 nt, Human
ucugcaggucccu

SEQ ID NO: 1834123 - RNA, 14 nt, Human
agaaauguacagca

SEQ ID NO: 1834124 - RNA, 15 nt, Human
agaaauguacagcaa

SEQ ID NO: 1834125 - RNA, 21 nt, Human
ucugagacucgcgacaaugca

SEQ ID NO: 1834126 - RNA, 22 nt, Human
ucugagacucgcgacaaugcaa

SEQ ID NO: 1834127 - RNA, 16 nt, Human
ucugaugcaagcaaga

SEQ ID NO: 1834128 - RNA, 17 nt, Human
ucugaucauccacugug

SEQ ID NO: 1834129 - RNA, 21 nt, Human
ucugaucauccacugugccau

SEQ ID NO: 1834130 - RNA, 13 nt, Human
agacagagcuaca

SEQ ID NO: 1834131 - RNA, 20 nt, Human
agacacauguccaagaagcc

SEQ ID NO: 1834132 - RNA, 16 nt, Human
agacacauguccaaga

SEQ ID NO: 1834133 - RNA, 18 nt, Human
agacaccuugacagggca

SEQ ID NO: 1834134 - RNA, 17 nt, Human
agacaccuugacagggc

SEQ ID NO: 1834135 - RNA, 12 nt, Human
agacacaggccc

SEQ ID NO: 1834136 - RNA, 13 nt, Human
agacacaggcccg

SEQ ID NO: 1834137 - RNA, 16 nt, Human
agacacaggcccggcu

SEQ ID NO: 1834138 - RNA, 14 nt, Human
ucugugagaugcua

SEQ ID NO: 1834139 - RNA, 23 nt, Human
ucugugagaugcuagaacucccu

SEQ ID NO: 1834140 - RNA, 17 nt, Human
ucugugagaugcuagaa

SEQ ID NO: 1834141 - RNA, 22 nt, Human
ucugugagaugcuagaacuccc

SEQ ID NO: 1834142 - RNA, 15 nt, Human
ucugggccagaauuu

SEQ ID NO: 1834143 - RNA, 14 nt, Human
ucugggccagaauu

SEQ ID NO: 1834144 - RNA, 22 nt, Human
ucugugaaaggaaagagggagg

SEQ ID NO: 1834145 - RNA, 13 nt, Human
ucuguuuagauaa

SEQ ID NO: 1834146 - RNA, 13 nt, Human
ucuguucuuucca

SEQ ID NO: 1834147 - RNA, 22 nt, Human
ucuguucuuuccaaaguacacu

SEQ ID NO: 1834148 - RNA, 15 nt, Human
ucuguugcugccuca

SEQ ID NO: 1834149 - RNA, 16 nt, Human
ucuguugcccaggcug

SEQ ID NO: 1834150 - RNA, 12 nt, Human
ucuguuggccag

SEQ ID NO: 1834151 - RNA, 17 nt, Human
ucuguuggccaguguga

SEQ ID NO: 1834152 - RNA, 17 nt, Human
agaauaaaauuuuuaau

SEQ ID NO: 1834153 - RNA, 14 nt, Human
agaauaaaauuuuu

SEQ ID NO: 1834154 - RNA, 12 nt, Human
agaauaaaauuu

SEQ ID NO: 1834155 - RNA, 16 nt, Human
agaauagaugcugacu

SEQ ID NO: 1834156 - RNA, 23 nt, Human
agaaguuucugccgcagcccugc

SEQ ID NO: 1834157 - RNA, 22 nt, Human
agaaguuucugccgcagcccug

SEQ ID NO: 1834158 - RNA, 21 nt, Human
agaaguuucugccgcagcccu

SEQ ID NO: 1834159 - RNA, 20 nt, Human
agaaguggggacagagcaga

SEQ ID NO: 1834160 - RNA, 18 nt, Human
ucugcuuuccucuuccug

SEQ ID NO: 1834161 - RNA, 13 nt, Human
ucugcuuuccucu

SEQ ID NO: 1834162 - RNA, 12 nt, Human
ucugcuuuccuc

SEQ ID NO: 1834163 - RNA, 23 nt, Human
agaauuaacacaugauccugcaa

SEQ ID NO: 1834164 - RNA, 15 nt, Human
agaauuaacacauga

SEQ ID NO: 1834165 - RNA, 17 nt, Human
ucucacuauguugccca

SEQ ID NO: 1834166 - RNA, 19 nt, Human
ucucacuauguugcccagg

SEQ ID NO: 1834167 - RNA, 19 nt, Human
ucucaccuccugcugggca

SEQ ID NO: 1834168 - RNA, 17 nt, Human
ucucaccuccugcuggg

SEQ ID NO: 1834169 - RNA, 16 nt, Human
ucucaccuccugcugg

SEQ ID NO: 1834170 - RNA, 15 nt, Human
ucucaccuccugcug

SEQ ID NO: 1834171 - RNA, 14 nt, Human
ucucaccuccugcu

SEQ ID NO: 1834172 - RNA, 23 nt, Human
ucuaugggacucaaugcacugac

SEQ ID NO: 1834173 - RNA, 13 nt, Human
ucuagccagagga

SEQ ID NO: 1834174 - RNA, 12 nt, Human
ucuaggaagacu

SEQ ID NO: 1834175 - RNA, 22 nt, Human
ucuaguuguuugauucagacag

SEQ ID NO: 1834176 - RNA, 22 nt, Human
ucuaguuugauuaaauucuugc

SEQ ID NO: 1834177 - RNA, 21 nt, Human
ucuaguuugauuaaauucuug

SEQ ID NO: 1834178 - RNA, 23 nt, Human
ucuaguuguuugauucagacagc

SEQ ID NO: 1834179 - RNA, 19 nt, Human
acuuccccuuccuaauucc

SEQ ID NO: 1834180 - RNA, 13 nt, Human
acuuccccuuccu

SEQ ID NO: 1834181 - RNA, 16 nt, Human
acuucaucccucuggg

SEQ ID NO: 1834182 - RNA, 18 nt, Human
ucuagcauggcugccaau

SEQ ID NO: 1834183 - RNA, 13 nt, Human
ucuagauacugua

SEQ ID NO: 1834184 - RNA, 20 nt, Human
ucuacagcuaaucagcauuc

SEQ ID NO: 1834185 - RNA, 23 nt, Human
ucuacagcuaaucagcauucuca

SEQ ID NO: 1834186 - RNA, 19 nt, Human
ucuacccagcgagcccugg

SEQ ID NO: 1834187 - RNA, 21 nt, Human
ucuacagaggccaugggccuc

SEQ ID NO: 1834188 - RNA, 18 nt, Human
uccugggagugagcuggu

SEQ ID NO: 1834189 - RNA, 14 nt, Human
ucuacccuggcacu

SEQ ID NO: 1834190 - RNA, 19 nt, Human
ucuacccuggcacuauaau

SEQ ID NO: 1834191 - RNA, 14 nt, Human
ucuacccaggugcu

SEQ ID NO: 1834192 - RNA, 20 nt, Human
ucuacccagcgagcccuggu

SEQ ID NO: 1834193 - RNA, 21 nt, Human
ucuacccuggcacuauaaugu

SEQ ID NO: 1834194 - RNA, 18 nt, Human
acuguucucugcccucca

SEQ ID NO: 1834195 - RNA, 19 nt, Human
acuguucucugcccuccaa

SEQ ID NO: 1834196 - RNA, 17 nt, Human
acuguucucugcccucc

SEQ ID NO: 1834197 - RNA, 16 nt, Human
acuguucucugcccuc

SEQ ID NO: 1834198 - RNA, 13 nt, Human
acuuaagcacacu

SEQ ID NO: 1834199 - RNA, 17 nt, Human
acuuaaucuaaauggaa

SEQ ID NO: 1834200 - RNA, 19 nt, Human
acuuaaucuaaauggaacc

SEQ ID NO: 1834201 - RNA, 22 nt, Human
acuuaaucuaaauggaaccacu

SEQ ID NO: 1834202 - RNA, 16 nt, Human
acuuacacuuuaugca

SEQ ID NO: 1834203 - RNA, 20 nt, Human
acuuaaauaaugugaaacug

SEQ ID NO: 1834204 - RNA, 17 nt, Human
acuuacacuuuaugcac

SEQ ID NO: 1834205 - RNA, 21 nt, Human
acuuacuguacaugaaaacac

SEQ ID NO: 1834206 - RNA, 16 nt, Human
acuuacuguacaugaa

SEQ ID NO: 1834207 - RNA, 22 nt, Human
acuuacuguacaugaaaacaca

SEQ ID NO: 1834208 - RNA, 14 nt, Human
acuuagcugggaga

SEQ ID NO: 1834209 - RNA, 15 nt, Human
acuuagguguggggg

SEQ ID NO: 1834210 - RNA, 20 nt, Human
acuuucugaaauaacauggc

SEQ ID NO: 1834211 - RNA, 14 nt, Human
acuuucugaaauaa

SEQ ID NO: 1834212 - RNA, 12 nt, Human
acuuuaccuuuu

SEQ ID NO: 1834213 - RNA, 16 nt, Human
ucuccucugcugcugg

SEQ ID NO: 1834214 - RNA, 15 nt, Human
ucuccucugcugcug

SEQ ID NO: 1834215 - RNA, 15 nt, Human
ucuccuccagaguca

SEQ ID NO: 1834216 - RNA, 18 nt, Human
ucuccucugcugcuggcu

SEQ ID NO: 1834217 - RNA, 17 nt, Human
ucuccucugcugcuggc

SEQ ID NO: 1834218 - RNA, 19 nt, Human
ucuccaagcaggacaugga

SEQ ID NO: 1834219 - RNA, 18 nt, Human
ucuccaagcaggacaugg

SEQ ID NO: 1834220 - RNA, 23 nt, Human
ucuccccagcaagugagagcugg

SEQ ID NO: 1834221 - RNA, 12 nt, Human
ucuccacccugc

SEQ ID NO: 1834222 - RNA, 17 nt, Human
ucuccgaccagacaccu

SEQ ID NO: 1834223 - RNA, 23 nt, Human
ucuccgaccagacaccuugacag

SEQ ID NO: 1834224 - RNA, 12 nt, Human
acuuugaccucu

SEQ ID NO: 1834225 - RNA, 13 nt, Human
acuuugaccucug

SEQ ID NO: 1834226 - RNA, 20 nt, Human
acuuuguuaguuucuccaag

SEQ ID NO: 1834227 - RNA, 14 nt, Human
acuuuguucuggcu

SEQ ID NO: 1834228 - RNA, 21 nt, Human
acuuuguuaguuucuccaagc

SEQ ID NO: 1834229 - RNA, 12 nt, Human
acuuuuguucuu

SEQ ID NO: 1834230 - RNA, 13 nt, Human
acuuuuguucuug

SEQ ID NO: 1834231 - RNA, 15 nt, Human
acuuuuguucuuggu

SEQ ID NO: 1834232 - RNA, 23 nt, Human
acuuuuguucuugguuuguaaau

SEQ ID NO: 1834233 - RNA, 18 nt, Human
ucuccuucaccuuugucc

SEQ ID NO: 1834234 - RNA, 16 nt, Human
ucuccuucaccuuugu

SEQ ID NO: 1834235 - RNA, 13 nt, Human
ucuccuuguguua

SEQ ID NO: 1834236 - RNA, 21 nt, Human
ucuccuuguguuacuaaguuu

SEQ ID NO: 1834237 - RNA, 15 nt, Human
ucuccuucaccuuug

SEQ ID NO: 1834238 - RNA, 14 nt, Human
ucuccuucaccuuu

SEQ ID NO: 1834239 - RNA, 17 nt, Human
agaaaaaauauuuuccc

SEQ ID NO: 1834240 - RNA, 21 nt, Human
ucucaugccucagccuccuga

SEQ ID NO: 1834241 - RNA, 18 nt, Human
ucucaggccagcugcuug

SEQ ID NO: 1834242 - RNA, 17 nt, Human
ucucaggccagcugcuu

SEQ ID NO: 1834243 - RNA, 21 nt, Human
ucucaggccagcugcuugggc

SEQ ID NO: 1834244 - RNA, 20 nt, Human
ucucaugccucagccuccug

SEQ ID NO: 1834245 - RNA, 16 nt, Human
ucuccaagcaggacau

SEQ ID NO: 1834246 - RNA, 15 nt, Human
ucuccaagcaggaca

SEQ ID NO: 1834247 - RNA, 13 nt, Human
ucuccaaaauaaa

SEQ ID NO: 1834248 - RNA, 16 nt, Human
ucucauuugucacaca

SEQ ID NO: 1834249 - RNA, 19 nt, Human
ucucauuugccaauaauaa

SEQ ID NO: 1834250 - RNA, 14 nt, Human
ucucauuugucaca

SEQ ID NO: 1834251 - RNA, 10 nt, Human
ucucaggcca

SEQ ID NO: 1834252 - RNA, 13 nt, Human
ucucaggccagcu

SEQ ID NO: 1834253 - RNA, 12 nt, Human
ucucaggccagc

SEQ ID NO: 1834254 - RNA, 12 nt, Human
ucucaggccaaa

SEQ ID NO: 1834255 - RNA, 19 nt, Human
acuuguauuauguguguuu

SEQ ID NO: 1834256 - RNA, 18 nt, Human
acuuguauuauguguguu

SEQ ID NO: 1834257 - RNA, 14 nt, Human
acuugcuuuuaaaa

SEQ ID NO: 1834258 - RNA, 21 nt, Human
acuugucuuuggacccugagg

SEQ ID NO: 1834259 - RNA, 18 nt, Human
acuugucuuuggacccug

SEQ ID NO: 1834260 - RNA, 20 nt, Human
acuugucuuuggacccugag

SEQ ID NO: 1834261 - RNA, 19 nt, Human
acuuguggacacagcucuu

SEQ ID NO: 1834262 - RNA, 22 nt, Human
acuuguggacacagcucuucuc

SEQ ID NO: 1834263 - RNA, 20 nt, Human
acuugcucuugaugccuggc

SEQ ID NO: 1834264 - RNA, 18 nt, Human
acuugcucuugaugccug

SEQ ID NO: 1834265 - RNA, 17 nt, Human
acuugcucuugaugccu

SEQ ID NO: 1834266 - RNA, 16 nt, Human
acuugcucuugaugcc

SEQ ID NO: 1834267 - RNA, 23 nt, Human
acuugcagacucuacagaggcca

SEQ ID NO: 1834268 - RNA, 19 nt, Human
acuugcagacucuacagag

SEQ ID NO: 1834269 - RNA, 22 nt, Human
acuugcagacucuacagaggcc

SEQ ID NO: 1834270 - RNA, 20 nt, Human
ucucacuauguugcccaggc

SEQ ID NO: 1834271 - RNA, 21 nt, Human
ucucacuauguugcccaggca

SEQ ID NO: 1834272 - RNA, 22 nt, Human
ucucacuauguugcccaggcag

SEQ ID NO: 1834273 - RNA, 23 nt, Human
ucucacuauguugcccaggcagg

SEQ ID NO: 1834274 - RNA, 18 nt, Human
ucucaccuccugcugggc

SEQ ID NO: 1834275 - RNA, 13 nt, Human
ugaccuuucaaua

SEQ ID NO: 1834276 - RNA, 12 nt, Human
ugaccuuucaau

SEQ ID NO: 1834277 - RNA, 21 nt, Human
ugacucguauaugucucaggu

SEQ ID NO: 1834278 - RNA, 19 nt, Human
ugacuauuuuucagaaucu

SEQ ID NO: 1834279 - RNA, 21 nt, Human
ugacuguuuucucuugagagg

SEQ ID NO: 1834280 - RNA, 15 nt, Human
ugaccuuuaagagaa

SEQ ID NO: 1834281 - RNA, 19 nt, Human
ugaccugccaggcacacug

SEQ ID NO: 1834282 - RNA, 16 nt, Human
ugaccugccaggcaca

SEQ ID NO: 1834283 - RNA, 17 nt, Human
agauuucacucuccuug

SEQ ID NO: 1834284 - RNA, 19 nt, Human
agauuucacucuccuuggu

SEQ ID NO: 1834285 - RNA, 19 nt, Human
agauucauauuuacuucuu

SEQ ID NO: 1834286 - RNA, 21 nt, Human
agauuccagagaguggcuccu

SEQ ID NO: 1834287 - RNA, 22 nt, Human
agauuccagagaguggcuccuc

SEQ ID NO: 1834288 - RNA, 16 nt, Human
agauucauauuuacuu

SEQ ID NO: 1834289 - RNA, 13 nt, Human
agauucauauuua

SEQ ID NO: 1834290 - RNA, 12 nt, Human
ugacuuacugua

SEQ ID NO: 1834291 - RNA, 20 nt, Human
ugacuuacuguacaugaaaa

SEQ ID NO: 1834292 - RNA, 18 nt, Human
agauccccaagccuggca

SEQ ID NO: 1834293 - RNA, 18 nt, Human
agaucucuaacuucacca

SEQ ID NO: 1834294 - RNA, 16 nt, Human
agaucguucucugccu

SEQ ID NO: 1834295 - RNA, 21 nt, Human
agaugcuagaacucccuuuca

SEQ ID NO: 1834296 - RNA, 22 nt, Human
agaugcuagaacucccuuucaa

SEQ ID NO: 1834297 - RNA, 22 nt, Human
agauguagccccucuccuggaa

SEQ ID NO: 1834298 - RNA, 21 nt, Human
agauguagccccucuccugga

SEQ ID NO: 1834299 - RNA, 19 nt, Human
agaugcuagaacucccuuu

SEQ ID NO: 1834300 - RNA, 19 nt, Human
ugacacgaauauugcugau

SEQ ID NO: 1834301 - RNA, 15 nt, Human
ugacacuuaaaaaug

SEQ ID NO: 1834302 - RNA, 22 nt, Human
ugacagagugagacucugucuc

SEQ ID NO: 1834303 - RNA, 16 nt, Human
ugacacgaauauugcu

SEQ ID NO: 1834304 - RNA, 17 nt, Human
ugacaggcaaugcuggc

SEQ ID NO: 1834305 - RNA, 19 nt, Human
ugacaggcaaugcuggcug

SEQ ID NO: 1834306 - RNA, 22 nt, Human
ugacagggcacaccgggcacuc

SEQ ID NO: 1834307 - RNA, 17 nt, Human
agcaccuagccucgcuc

SEQ ID NO: 1834308 - RNA, 22 nt, Human
agcaccuacaguguacagucuu

SEQ ID NO: 1834309 - RNA, 14 nt, Human
agcaccuacagugu

SEQ ID NO: 1834310 - RNA, 15 nt, Human
agcaccuacagugua

SEQ ID NO: 1834311 - RNA, 19 nt, Human
agcaccuacaguguacagu

SEQ ID NO: 1834312 - RNA, 21 nt, Human
agcaccuacaguguacagucu

SEQ ID NO: 1834313 - RNA, 13 nt, Human
agcaccuccugcc

SEQ ID NO: 1834314 - RNA, 14 nt, Human
agcaccuccugccu

SEQ ID NO: 1834315 - RNA, 16 nt, Human
agcaccuccugccucg

SEQ ID NO: 1834316 - RNA, 23 nt, Human
agcacaugccucucucaggccaa

SEQ ID NO: 1834317 - RNA, 22 nt, Human
agcaccaaaagcuuaccaaggg

SEQ ID NO: 1834318 - RNA, 16 nt, Human
agcaccaucucuccuc

SEQ ID NO: 1834319 - RNA, 22 nt, Human
agcacaugccucucucaggcca

SEQ ID NO: 1834320 - RNA, 21 nt, Human
agcacaugccucucucaggcc

SEQ ID NO: 1834321 - RNA, 20 nt, Human
agcacaugccucucucaggc

SEQ ID NO: 1834322 - RNA, 19 nt, Human
agcacaugccucucucagg

SEQ ID NO: 1834323 - RNA, 18 nt, Human
agcacaugccucucucag

SEQ ID NO: 1834324 - RNA, 21 nt, Human
agcacagcuucauuuccugug

SEQ ID NO: 1834325 - RNA, 17 nt, Human
agcaagugagagcuggg

SEQ ID NO: 1834326 - RNA, 21 nt, Human
ugagccagauuucacucuccu

SEQ ID NO: 1834327 - RNA, 20 nt, Human
ugagccagauuucacucucc

SEQ ID NO: 1834328 - RNA, 19 nt, Human
ugagccagauuucacucuc

SEQ ID NO: 1834329 - RNA, 18 nt, Human
ugagccagauuucacucu

SEQ ID NO: 1834330 - RNA, 14 nt, Human
ugagccacugcacc

SEQ ID NO: 1834331 - RNA, 14 nt, Human
ugagcauuagauuu

SEQ ID NO: 1834332 - RNA, 16 nt, Human
ugagcauuagauuucu

SEQ ID NO: 1834333 - RNA, 12 nt, Human
ugagccacugca

SEQ ID NO: 1834334 - RNA, 13 nt, Human
ugagccacugcac

SEQ ID NO: 1834335 - RNA, 17 nt, Human
agcaaggagauuuacaa

SEQ ID NO: 1834336 - RNA, 19 nt, Human
agcaaggagauuuacaacu

SEQ ID NO: 1834337 - RNA, 14 nt, Human
agcaaggagauuua

SEQ ID NO: 1834338 - RNA, 15 nt, Human
agcaagucagaauag

SEQ ID NO: 1834339 - RNA, 16 nt, Human
agcaagugagacccug

SEQ ID NO: 1834340 - RNA, 15 nt, Human
agcaagugagagcug

SEQ ID NO: 1834341 - RNA, 16 nt, Human
agcaagugagagcugg

SEQ ID NO: 1834342 - RNA, 14 nt, Human
ugagauguguucac

SEQ ID NO: 1834343 - RNA, 23 nt, Human
ugagauguagccccucuccugga

SEQ ID NO: 1834344 - RNA, 17 nt, Human
ugagaggaaaucaccga

SEQ ID NO: 1834345 - RNA, 23 nt, Human
ugagaggacuuuucuuuguggcu

SEQ ID NO: 1834346 - RNA, 14 nt, Human
ugagaggaaaucac

SEQ ID NO: 1834347 - RNA, 13 nt, Human
ugagaggaaauca

SEQ ID NO: 1834348 - RNA, 12 nt, Human
ugagaggaaauc

SEQ ID NO: 1834349 - RNA, 11 nt, Human
ugagaggaaau

SEQ ID NO: 1834350 - RNA, 10 nt, Human
ugagaggaaa

SEQ ID NO: 1834351 - RNA, 14 nt, Human
ugagagcugggugu

SEQ ID NO: 1834352 - RNA, 20 nt, Human
ugagacagcccgggcucugc

SEQ ID NO: 1834353 - RNA, 19 nt, Human
ugagacagcccgggcucug

SEQ ID NO: 1834354 - RNA, 18 nt, Human
ugagacagcccgggcucu

SEQ ID NO: 1834355 - RNA, 17 nt, Human
ugagacagcccgggcuc

SEQ ID NO: 1834356 - RNA, 12 nt, Human
ugagacagcucu

SEQ ID NO: 1834357 - RNA, 22 nt, Human
ugagacagcccgggcucugccu

SEQ ID NO: 1834358 - RNA, 20 nt, Human
ugagacucugucucagucca

SEQ ID NO: 1834359 - RNA, 20 nt, Human
ugagacucugucucaaaaaa

SEQ ID NO: 1834360 - RNA, 20 nt, Human
ugagacagaaucucgcucug

SEQ ID NO: 1834361 - RNA, 11 nt, Human
ugagacagagu

SEQ ID NO: 1834362 - RNA, 13 nt, Human
ugagacagcccgg

SEQ ID NO: 1834363 - RNA, 21 nt, Human
ugagacagaguuuucacucuu

SEQ ID NO: 1834364 - RNA, 22 nt, Human
ugaagacaaugacuuacuguac

SEQ ID NO: 1834365 - RNA, 23 nt, Human
ugaagacaaugacuuacuguaca

SEQ ID NO: 1834366 - RNA, 13 nt, Human
ugaagacagagcu

SEQ ID NO: 1834367 - RNA, 15 nt, Human
ugaacuccugaccuc

SEQ ID NO: 1834368 - RNA, 11 nt, Human
ugaacuccugg

SEQ ID NO: 1834369 - RNA, 13 nt, Human
ugaacaaauuuac

SEQ ID NO: 1834370 - RNA, 21 nt, Human
ugaaccaccacacccagccca

SEQ ID NO: 1834371 - RNA, 18 nt, Human
ugaacaaauuuacagaga

SEQ ID NO: 1834372 - RNA, 22 nt, Human
ugaaccaccacacccagcccac

SEQ ID NO: 1834373 - RNA, 22 nt, Human
ugaacccauauuuguacaccaa

SEQ ID NO: 1834374 - RNA, 18 nt, Human
ugaacccgggaggcagag

SEQ ID NO: 1834375 - RNA, 19 nt, Human
ugaaauuuuuauuaaauua

SEQ ID NO: 1834376 - RNA, 20 nt, Human
ugaaauuuuuauuaaauuau

SEQ ID NO: 1834377 - RNA, 23 nt, Human
ugaaauagacccacaagaggcag

SEQ ID NO: 1834378 - RNA, 14 nt, Human
ugaaauaagccaga

SEQ ID NO: 1834379 - RNA, 16 nt, Human
ugaaauaacauggccu

SEQ ID NO: 1834380 - RNA, 17 nt, Human
ugaaauaacauggccuu

SEQ ID NO: 1834381 - RNA, 16 nt, Human
agagauugugguuuca

SEQ ID NO: 1834382 - RNA, 21 nt, Human
agaggcagccccauucugccu

SEQ ID NO: 1834383 - RNA, 22 nt, Human
agaggcagccccauucugccug

SEQ ID NO: 1834384 - RNA, 21 nt, Human
agaggcagggucucacucugu

SEQ ID NO: 1834385 - RNA, 23 nt, Human
agaggcagccccauucugccugc

SEQ ID NO: 1834386 - RNA, 22 nt, Human
agaggcugccucucccaucacu

SEQ ID NO: 1834387 - RNA, 13 nt, Human
agagguucaaaga

SEQ ID NO: 1834388 - RNA, 20 nt, Human
agagggagugacagaggcag

SEQ ID NO: 1834389 - RNA, 15 nt, Human
agagggagguaagga

SEQ ID NO: 1834390 - RNA, 15 nt, Human
agagggagugacaga

SEQ ID NO: 1834391 - RNA, 16 nt, Human
agagguucaaagauau

SEQ ID NO: 1834392 - RNA, 19 nt, Human
agagguucaaagauauuuu

SEQ ID NO: 1834393 - RNA, 20 nt, Human
agagguucaaagauauuuug

SEQ ID NO: 1834394 - RNA, 18 nt, Human
agaguaauccaagcaaau

SEQ ID NO: 1834395 - RNA, 20 nt, Human
agaguaauccaagcaaaugu

SEQ ID NO: 1834396 - RNA, 22 nt, Human
agaguaauccaagcaaauguga

SEQ ID NO: 1834397 - RNA, 15 nt, Human
ugaaguaauaugcac

SEQ ID NO: 1834398 - RNA, 14 nt, Human
ugaaguaagcaaag

SEQ ID NO: 1834399 - RNA, 13 nt, Human
ugaaguaagcaaa

SEQ ID NO: 1834400 - RNA, 16 nt, Human
ugaaguaauaugcaca

SEQ ID NO: 1834401 - RNA, 20 nt, Human
ugaaguaauaugcacacauu

SEQ ID NO: 1834402 - RNA, 21 nt, Human
ugaaguaauaugcacacauuu

SEQ ID NO: 1834403 - RNA, 22 nt, Human
ugaaguaauaugcacacauuuu

SEQ ID NO: 1834404 - RNA, 18 nt, Human
ugaauauuuaguguucau

SEQ ID NO: 1834405 - RNA, 13 nt, Human
ugaauaauacagu

SEQ ID NO: 1834406 - RNA, 23 nt, Human
ugaauaauguaagacaaauaugu

SEQ ID NO: 1834407 - RNA, 12 nt, Human
ugaauaauacag

SEQ ID NO: 1834408 - RNA, 13 nt, Human
ugaagucacacag

SEQ ID NO: 1834409 - RNA, 17 nt, Human
ugaaguacucauacaug

SEQ ID NO: 1834410 - RNA, 15 nt, Human
ugaaguaagcaaaga

SEQ ID NO: 1834411 - RNA, 12 nt, Human
ucuuuccugagg

SEQ ID NO: 1834412 - RNA, 18 nt, Human
ucuuuaaugucacaggca

SEQ ID NO: 1834413 - RNA, 19 nt, Human
ucuuuaaugucacaggcag

SEQ ID NO: 1834414 - RNA, 20 nt, Human
agacaggcaagcaccuccug

SEQ ID NO: 1834415 - RNA, 22 nt, Human
agacaggcaagcaccuccugcc

SEQ ID NO: 1834416 - RNA, 15 nt, Human
ucuuuaaugucacag

SEQ ID NO: 1834417 - RNA, 13 nt, Human
agacuccugcagg

SEQ ID NO: 1834418 - RNA, 21 nt, Human
agacuccagcuggguuggaaa

SEQ ID NO: 1834419 - RNA, 16 nt, Human
agacucccaagcugga

SEQ ID NO: 1834420 - RNA, 19 nt, Human
agagacacaagccuucggc

SEQ ID NO: 1834421 - RNA, 16 nt, Human
agagacacaagccuuc

SEQ ID NO: 1834422 - RNA, 19 nt, Human
agacuuuucuuucagccaa

SEQ ID NO: 1834423 - RNA, 19 nt, Human
agacuuuggaaagaguagg

SEQ ID NO: 1834424 - RNA, 12 nt, Human
agacuuuuauga

SEQ ID NO: 1834425 - RNA, 15 nt, Human
agacuuuuccaaccc

SEQ ID NO: 1834426 - RNA, 15 nt, Human
agacuuuuaugauac

SEQ ID NO: 1834427 - RNA, 15 nt, Human
agacuuuggaaagag

SEQ ID NO: 1834428 - RNA, 17 nt, Human
agacuuuggaaagacuu

SEQ ID NO: 1834429 - RNA, 14 nt, Human
agacuguacaaagu

SEQ ID NO: 1834430 - RNA, 20 nt, Human
agacugguuccauggccucu

SEQ ID NO: 1834431 - RNA, 14 nt, Human
agagacagaaagca

SEQ ID NO: 1834432 - RNA, 15 nt, Human
agagacagaaagcag

SEQ ID NO: 1834433 - RNA, 20 nt, Human
ucuuuguacagacaacaaac

SEQ ID NO: 1834434 - RNA, 15 nt, Human
ucuuuguacagacaa

SEQ ID NO: 1834435 - RNA, 14 nt, Human
ucuuuguacagaca

SEQ ID NO: 1834436 - RNA, 16 nt, Human
ucuuuguaaugaaaac

SEQ ID NO: 1834437 - RNA, 22 nt, Human
ucuuuuuucuaaaguaaaaaca

SEQ ID NO: 1834438 - RNA, 21 nt, Human
ucuuuuuucuaaaguaaaaac

SEQ ID NO: 1834439 - RNA, 14 nt, Human
ucuuuguggcuucc

SEQ ID NO: 1834440 - RNA, 22 nt, Human
ugaaagaaaauaccaaggaaca

SEQ ID NO: 1834441 - RNA, 16 nt, Human
ugaaagacuguacaaa

SEQ ID NO: 1834442 - RNA, 17 nt, Human
ugaaagaggaaugaagu

SEQ ID NO: 1834443 - RNA, 22 nt, Human
ugaaagacuguacaaaguagaa

SEQ ID NO: 1834444 - RNA, 19 nt, Human
ugaaagacuguacaaagua

SEQ ID NO: 1834445 - RNA, 18 nt, Human
ugaaagacuguacaaagu

SEQ ID NO: 1834446 - RNA, 18 nt, Human
ugaaagaggaaugaagua

SEQ ID NO: 1834447 - RNA, 21 nt, Human
agagaccaucccugaaggccc

SEQ ID NO: 1834448 - RNA, 19 nt, Human
agagaccaucccugaaggc

SEQ ID NO: 1834449 - RNA, 23 nt, Human
agagaccaucccugaaggccccg

SEQ ID NO: 1834450 - RNA, 22 nt, Human
agagaccaucccugaaggcccc

SEQ ID NO: 1834451 - RNA, 17 nt, Human
agagaguggcuccuccc

SEQ ID NO: 1834452 - RNA, 14 nt, Human
agagacuccugcag

SEQ ID NO: 1834453 - RNA, 13 nt, Human
agagacuccugca

SEQ ID NO: 1834454 - RNA, 12 nt, Human
agagacuccugc

SEQ ID NO: 1834455 - RNA, 15 nt, Human
agagacuccugcagg

SEQ ID NO: 1834456 - RNA, 15 nt, Human
ugaaaacacauuuuu

SEQ ID NO: 1834457 - RNA, 17 nt, Human
ugaaaacacauuuuucu

SEQ ID NO: 1834458 - RNA, 19 nt, Human
ugaaaacacauuuuucuua

SEQ ID NO: 1834459 - RNA, 20 nt, Human
ugaaaacacauuuuucuuag

SEQ ID NO: 1834460 - RNA, 14 nt, Human
ugaaaacacauuuu

SEQ ID NO: 1834461 - RNA, 12 nt, Human
ugaaaacacauu

SEQ ID NO: 1834462 - RNA, 13 nt, Human
ugaaaacacauuu

SEQ ID NO: 1834463 - RNA, 16 nt, Human
ucuuuuuuugugaugu

SEQ ID NO: 1834464 - RNA, 14 nt, Human
ucuuuuuuugugau

SEQ ID NO: 1834465 - RNA, 23 nt, Human
ucuuuuuuuuuuuuuaaagacag

SEQ ID NO: 1834466 - RNA, 14 nt, Human
ugaaaauuaacaug

SEQ ID NO: 1834467 - RNA, 17 nt, Human
ugaaacuggauuaaacu

SEQ ID NO: 1834468 - RNA, 18 nt, Human
ugaaacuggauuaaacuu

SEQ ID NO: 1834469 - RNA, 13 nt, Human
ugaaagaaaauaa

SEQ ID NO: 1834470 - RNA, 12 nt, Human
ugucccuuuucc

SEQ ID NO: 1834471 - RNA, 17 nt, Human
ugucccuuuuccuuuuu

SEQ ID NO: 1834472 - RNA, 14 nt, Human
ugucccugcacuug

SEQ ID NO: 1834473 - RNA, 16 nt, Human
ugucagccauuccugu

SEQ ID NO: 1834474 - RNA, 19 nt, Human
uguccaggcacugcugccc

SEQ ID NO: 1834475 - RNA, 21 nt, Human
uguccaggcacugcugcccag

SEQ ID NO: 1834476 - RNA, 20 nt, Human
uguccaggcacugcugccca

SEQ ID NO: 1834477 - RNA, 22 nt, Human
ugucccuaccgagucucuucuc

SEQ ID NO: 1834478 - RNA, 21 nt, Human
ugucccuaccgagucucuucu

SEQ ID NO: 1834479 - RNA, 20 nt, Human
ugucccuaccgagucucuuc

SEQ ID NO: 1834480 - RNA, 19 nt, Human
agucagggguucccuuuuu

SEQ ID NO: 1834481 - RNA, 20 nt, Human
agucccaggcugagccucag

SEQ ID NO: 1834482 - RNA, 19 nt, Human
aguccccuguuuguuucug

SEQ ID NO: 1834483 - RNA, 14 nt, Human
aguccccuguuugu

SEQ ID NO: 1834484 - RNA, 21 nt, Human
agucccaccuuggcugcaggg

SEQ ID NO: 1834485 - RNA, 23 nt, Human
agucccaccuuggcugcagggag

SEQ ID NO: 1834486 - RNA, 20 nt, Human
agucccaccuuggcugcagg

SEQ ID NO: 1834487 - RNA, 20 nt, Human
agucacauuccaagccucau

SEQ ID NO: 1834488 - RNA, 15 nt, Human
ugucagcauagaagu

SEQ ID NO: 1834489 - RNA, 17 nt, Human
agucacugagacagccc

SEQ ID NO: 1834490 - RNA, 16 nt, Human
agucacugagacagcc

SEQ ID NO: 1834491 - RNA, 15 nt, Human
agucacugagacagc

SEQ ID NO: 1834492 - RNA, 21 nt, Human
aguauuuaauucauguugccu

SEQ ID NO: 1834493 - RNA, 22 nt, Human
agucacagagauaauucuagcu

SEQ ID NO: 1834494 - RNA, 15 nt, Human
aguauuauaccuuuu

SEQ ID NO: 1834495 - RNA, 14 nt, Human
aguauuauaccuuu

SEQ ID NO: 1834496 - RNA, 17 nt, Human
aguagcuggauuacagg

SEQ ID NO: 1834497 - RNA, 22 nt, Human
aguagcugggacuacaggcacc

SEQ ID NO: 1834498 - RNA, 19 nt, Human
aguagcugggacuacaggc

SEQ ID NO: 1834499 - RNA, 21 nt, Human
aguagcugggacuacaggcac

SEQ ID NO: 1834500 - RNA, 13 nt, Human
aguagcugggacu

SEQ ID NO: 1834501 - RNA, 14 nt, Human
aguagcugggacua

SEQ ID NO: 1834502 - RNA, 19 nt, Human
ugucaaaguggugagaggc

SEQ ID NO: 1834503 - RNA, 16 nt, Human
ugucaaaguggugaga

SEQ ID NO: 1834504 - RNA, 15 nt, Human
ugucaaaguggugag

SEQ ID NO: 1834505 - RNA, 14 nt, Human
ugucaaagugguga

SEQ ID NO: 1834506 - RNA, 11 nt, Human
uguauuaugug

SEQ ID NO: 1834507 - RNA, 21 nt, Human
uguauuaaguuguuaauaaaa

SEQ ID NO: 1834508 - RNA, 15 nt, Human
uguauuagucacaga

SEQ ID NO: 1834509 - RNA, 14 nt, Human
uguauguguaagua

SEQ ID NO: 1834510 - RNA, 15 nt, Human
uguaucccaugagcc

SEQ ID NO: 1834511 - RNA, 16 nt, Human
uguaucccaugagccu

SEQ ID NO: 1834512 - RNA, 12 nt, Human
uguagagccagg

SEQ ID NO: 1834513 - RNA, 15 nt, Human
uguagagccaggguc

SEQ ID NO: 1834514 - RNA, 21 nt, Human
ugucucuugguccugcugcag

SEQ ID NO: 1834515 - RNA, 20 nt, Human
ugucucuugguccugcugca

SEQ ID NO: 1834516 - RNA, 19 nt, Human
ugucucuugguccugcugc

SEQ ID NO: 1834517 - RNA, 18 nt, Human
ugucucuugguccugcug

SEQ ID NO: 1834518 - RNA, 22 nt, Human
ugucucuuuaaugucacaggca

SEQ ID NO: 1834519 - RNA, 22 nt, Human
ugucucuugguccugcugcagu

SEQ ID NO: 1834520 - RNA, 21 nt, Human
ugucucuuuaaugucacaggc

SEQ ID NO: 1834521 - RNA, 17 nt, Human
ugucucuacuaaaaaua

SEQ ID NO: 1834522 - RNA, 21 nt, Human
ugucucgugguaggacuguag

SEQ ID NO: 1834523 - RNA, 18 nt, Human
ugucucgugguaggacug

SEQ ID NO: 1834524 - RNA, 19 nt, Human
ugucucgugguaggacugu

SEQ ID NO: 1834525 - RNA, 20 nt, Human
ugucucgugguaggacugua

SEQ ID NO: 1834526 - RNA, 13 nt, Human
ugucucugagagu

SEQ ID NO: 1834527 - RNA, 22 nt, Human
ugucucuggauuauauuaugaa

SEQ ID NO: 1834528 - RNA, 16 nt, Human
agucccugccaaugga

SEQ ID NO: 1834529 - RNA, 14 nt, Human
agucccugccaaug

SEQ ID NO: 1834530 - RNA, 13 nt, Human
agucccugccaau

SEQ ID NO: 1834531 - RNA, 23 nt, Human
aguccccuguuuguuucugaaag

SEQ ID NO: 1834532 - RNA, 15 nt, Human
ugugaaccaccacac

SEQ ID NO: 1834533 - RNA, 17 nt, Human
ugucuuuaaaugcugcu

SEQ ID NO: 1834534 - RNA, 16 nt, Human
ugugaaccaccacacc

SEQ ID NO: 1834535 - RNA, 17 nt, Human
ugugaaccaccacaccc

SEQ ID NO: 1834536 - RNA, 22 nt, Human
ugugaaccaccacacccagccc

SEQ ID NO: 1834537 - RNA, 23 nt, Human
ugugaaccaccacacccagccca

SEQ ID NO: 1834538 - RNA, 15 nt, Human
ugucuugcaauggca

SEQ ID NO: 1834539 - RNA, 17 nt, Human
ugucuugcaauggcagc

SEQ ID NO: 1834540 - RNA, 18 nt, Human
ugucuugcaauggcagcc

SEQ ID NO: 1834541 - RNA, 20 nt, Human
ugucuugcaauggcagccuu

SEQ ID NO: 1834542 - RNA, 21 nt, Human
ugucuugcaauggcagccuug

SEQ ID NO: 1834543 - RNA, 23 nt, Human
agugaaaaaggaggaagagaaaa

SEQ ID NO: 1834544 - RNA, 20 nt, Human
agugaaaaaggaggaagaga

SEQ ID NO: 1834545 - RNA, 17 nt, Human
agugaaaaaggaggaag

SEQ ID NO: 1834546 - RNA, 11 nt, Human
agugaaaaagg

SEQ ID NO: 1834547 - RNA, 15 nt, Human
agucuuuuccaugaa

SEQ ID NO: 1834548 - RNA, 13 nt, Human
agucuuuuccaug

SEQ ID NO: 1834549 - RNA, 19 nt, Human
ugugagcacaaagguagcu

SEQ ID NO: 1834550 - RNA, 22 nt, Human
ugugagaugcuagaacucccuu

SEQ ID NO: 1834551 - RNA, 23 nt, Human
ugugaacugaacucugacaacag

SEQ ID NO: 1834552 - RNA, 14 nt, Human
ugugaacugaacuc

SEQ ID NO: 1834553 - RNA, 18 nt, Human
agucucccucccuugggg

SEQ ID NO: 1834554 - RNA, 14 nt, Human
agucucccucccuu

SEQ ID NO: 1834555 - RNA, 19 nt, Human
agucuccaaagucucugga

SEQ ID NO: 1834556 - RNA, 18 nt, Human
ugugauggggcccugccu

SEQ ID NO: 1834557 - RNA, 17 nt, Human
ugugauggggcccugcc

SEQ ID NO: 1834558 - RNA, 16 nt, Human
ugugauggggcccugc

SEQ ID NO: 1834559 - RNA, 15 nt, Human
ugugauggggcccug

SEQ ID NO: 1834560 - RNA, 16 nt, Human
agugagccgagauugu

SEQ ID NO: 1834561 - RNA, 14 nt, Human
agugagagcugggu

SEQ ID NO: 1834562 - RNA, 22 nt, Human
agugagacucugucucaaaaaa

SEQ ID NO: 1834563 - RNA, 16 nt, Human
agugagacucugucuc

SEQ ID NO: 1834564 - RNA, 17 nt, Human
agugagacucugucuca

SEQ ID NO: 1834565 - RNA, 17 nt, Human
agugagacccugucuca

SEQ ID NO: 1834566 - RNA, 21 nt, Human
agugagacccugucucaaaaa

SEQ ID NO: 1834567 - RNA, 13 nt, Human
agugagacucugu

SEQ ID NO: 1834568 - RNA, 14 nt, Human
agugagacagcucu

SEQ ID NO: 1834569 - RNA, 17 nt, Human
agugaaagaaaauaaca

SEQ ID NO: 1834570 - RNA, 22 nt, Human
uguaagcucuacugaggugcua

SEQ ID NO: 1834571 - RNA, 15 nt, Human
uguaaggaaugauua

SEQ ID NO: 1834572 - RNA, 14 nt, Human
uguaaggaaugauu

SEQ ID NO: 1834573 - RNA, 13 nt, Human
uguaaggaaugau

SEQ ID NO: 1834574 - RNA, 20 nt, Human
agguugucugaagucacugc

SEQ ID NO: 1834575 - RNA, 16 nt, Human
agguugucugaaguca

SEQ ID NO: 1834576 - RNA, 16 nt, Human
agguggggcagcuuga

SEQ ID NO: 1834577 - RNA, 23 nt, Human
agguggggucacucuggcagcuc

SEQ ID NO: 1834578 - RNA, 14 nt, Human
agguggggcagcuu

SEQ ID NO: 1834579 - RNA, 22 nt, Human
aggugauccacucgccuucauc

SEQ ID NO: 1834580 - RNA, 13 nt, Human
agguggggcagcu

SEQ ID NO: 1834581 - RNA, 18 nt, Human
aggugugacugaauuucu

SEQ ID NO: 1834582 - RNA, 23 nt, Human
aggugugaaccaccacacccagc

SEQ ID NO: 1834583 - RNA, 22 nt, Human
aggugugaaccaccacacccag

SEQ ID NO: 1834584 - RNA, 20 nt, Human
aggugugacugaauuucuuu

SEQ ID NO: 1834585 - RNA, 20 nt, Human
aggugugagccaccacgccc

SEQ ID NO: 1834586 - RNA, 14 nt, Human
aggugugagucacc

SEQ ID NO: 1834587 - RNA, 20 nt, Human
aggugugagucaccaagccc

SEQ ID NO: 1834588 - RNA, 23 nt, Human
uguacaaaguagaagucuuagau

SEQ ID NO: 1834589 - RNA, 19 nt, Human
uguacaaaguagaagucuu

SEQ ID NO: 1834590 - RNA, 17 nt, Human
uguaauuugugauacaa

SEQ ID NO: 1834591 - RNA, 21 nt, Human
uguaauuugugauacaaugcu

SEQ ID NO: 1834592 - RNA, 18 nt, Human
uguaaggaaugauuaauu

SEQ ID NO: 1834593 - RNA, 16 nt, Human
uguaauuugugauaca

SEQ ID NO: 1834594 - RNA, 15 nt, Human
uguaaggcaaucaug

SEQ ID NO: 1834595 - RNA, 17 nt, Human
uguacaugaaaacacau

SEQ ID NO: 1834596 - RNA, 18 nt, Human
uguacaugaaaacacauu

SEQ ID NO: 1834597 - RNA, 19 nt, Human
uguacaugaaaacacauuu

SEQ ID NO: 1834598 - RNA, 20 nt, Human
uguacaugaaaacacauuuu

SEQ ID NO: 1834599 - RNA, 15 nt, Human
uguacuugcucuuga

SEQ ID NO: 1834600 - RNA, 19 nt, Human
uguacuugcucuugaugcc

SEQ ID NO: 1834601 - RNA, 23 nt, Human
ugguggcagcucaccucucccuu

SEQ ID NO: 1834602 - RNA, 20 nt, Human
ugguggcagcucaccucucc

SEQ ID NO: 1834603 - RNA, 19 nt, Human
ugguggcagcucaccucuc

SEQ ID NO: 1834604 - RNA, 16 nt, Human
ugguggcagcucaccu

SEQ ID NO: 1834605 - RNA, 12 nt, Human
ugguggcagcuc

SEQ ID NO: 1834606 - RNA, 15 nt, Human
ugguggcagagugga

SEQ ID NO: 1834607 - RNA, 15 nt, Human
ugguguguguaugcg

SEQ ID NO: 1834608 - RNA, 12 nt, Human
ugguggcagcug

SEQ ID NO: 1834609 - RNA, 20 nt, Human
ugguucaggguuggccccug

SEQ ID NO: 1834610 - RNA, 22 nt, Human
ugguucaggguuggccccugcc

SEQ ID NO: 1834611 - RNA, 23 nt, Human
ugguucaggguuggccccugccc

SEQ ID NO: 1834612 - RNA, 17 nt, Human
ugguguuuccuggcacu

SEQ ID NO: 1834613 - RNA, 15 nt, Human
ugguguuuccuggca

SEQ ID NO: 1834614 - RNA, 14 nt, Human
ugguuucagaaaug

SEQ ID NO: 1834615 - RNA, 15 nt, Human
ugguuucagaaaugu

SEQ ID NO: 1834616 - RNA, 21 nt, Human
ugguuuguaaauuaacuuuua

SEQ ID NO: 1834617 - RNA, 12 nt, Human
ugguuuucuguu

SEQ ID NO: 1834618 - RNA, 18 nt, Human
ugguuuuaguugcaacuu

SEQ ID NO: 1834619 - RNA, 21 nt, Human
aggugauccacccaccucagc

SEQ ID NO: 1834620 - RNA, 23 nt, Human
aggugauccacccaccucagccu

SEQ ID NO: 1834621 - RNA, 13 nt, Human
ugguuuucuguuc

SEQ ID NO: 1834622 - RNA, 15 nt, Human
ugguuuucuguucuu

SEQ ID NO: 1834623 - RNA, 16 nt, Human
uguaaaggaauuuaaa

SEQ ID NO: 1834624 - RNA, 18 nt, Human
uggucugacccacugcuu

SEQ ID NO: 1834625 - RNA, 16 nt, Human
uggucuuauuuguaaa

SEQ ID NO: 1834626 - RNA, 22 nt, Human
uggucugugagaugcuagaacu

SEQ ID NO: 1834627 - RNA, 12 nt, Human
uggucuguguga

SEQ ID NO: 1834628 - RNA, 13 nt, Human
uggucccacccca

SEQ ID NO: 1834629 - RNA, 19 nt, Human
uggucucgaacuccugacc

SEQ ID NO: 1834630 - RNA, 15 nt, Human
uggucucgaacuccu

SEQ ID NO: 1834631 - RNA, 21 nt, Human
uggucucgaacuccugaccuu

SEQ ID NO: 1834632 - RNA, 20 nt, Human
uggucucgaacuccugaccu

SEQ ID NO: 1834633 - RNA, 19 nt, Human
ugguccauagagagcaaga

SEQ ID NO: 1834634 - RNA, 22 nt, Human
ugguccaugggccauaugaaaa

SEQ ID NO: 1834635 - RNA, 13 nt, Human
aggguuggccccu

SEQ ID NO: 1834636 - RNA, 14 nt, Human
aggguuggccccug

SEQ ID NO: 1834637 - RNA, 17 nt, Human
aggguuggccccugccc

SEQ ID NO: 1834638 - RNA, 15 nt, Human
aggguugggcuggug

SEQ ID NO: 1834639 - RNA, 17 nt, Human
aggguggugaccucugc

SEQ ID NO: 1834640 - RNA, 18 nt, Human
aggguggugaccucugcc

SEQ ID NO: 1834641 - RNA, 19 nt, Human
aggguggugaccucugccu

SEQ ID NO: 1834642 - RNA, 21 nt, Human
aggguggugaccucugccuga

SEQ ID NO: 1834643 - RNA, 19 nt, Human
uggugaacagaacaaaagg

SEQ ID NO: 1834644 - RNA, 15 nt, Human
uggugaacauugcaa

SEQ ID NO: 1834645 - RNA, 20 nt, Human
uggugaacauugcaauagaa

SEQ ID NO: 1834646 - RNA, 17 nt, Human
aggguugggcugguguc

SEQ ID NO: 1834647 - RNA, 20 nt, Human
aggguuuauguuuaggaugu

SEQ ID NO: 1834648 - RNA, 17 nt, Human
agguaugcaaucaaauc

SEQ ID NO: 1834649 - RNA, 22 nt, Human
aggucuugaacuccuggccuca

SEQ ID NO: 1834650 - RNA, 17 nt, Human
agguccacaacacacag

SEQ ID NO: 1834651 - RNA, 20 nt, Human
aggucuugaacuccuggccu

SEQ ID NO: 1834652 - RNA, 21 nt, Human
aggucuugaacuccuggccuc

SEQ ID NO: 1834653 - RNA, 22 nt, Human
aggucauuuuuuuuaagaaaaa

SEQ ID NO: 1834654 - RNA, 23 nt, Human
aggucauuuuuuuuaagaaaaag

SEQ ID NO: 1834655 - RNA, 21 nt, Human
aggucaaggcugcagugagcc

SEQ ID NO: 1834656 - RNA, 15 nt, Human
aggucagugcaaaua

SEQ ID NO: 1834657 - RNA, 13 nt, Human
agggggcugggac

SEQ ID NO: 1834658 - RNA, 15 nt, Human
agggggaaggcaggg

SEQ ID NO: 1834659 - RNA, 16 nt, Human
aggggauagagagaga

SEQ ID NO: 1834660 - RNA, 19 nt, Human
aggguacuaaggaaucuuu

SEQ ID NO: 1834661 - RNA, 18 nt, Human
aggguaucaggugcugcc

SEQ ID NO: 1834662 - RNA, 12 nt, Human
aggguagggugg

SEQ ID NO: 1834663 - RNA, 16 nt, Human
aggguaucaggugcug

SEQ ID NO: 1834664 - RNA, 21 nt, Human
uggucaccaaaucagcugcua

SEQ ID NO: 1834665 - RNA, 23 nt, Human
uggucaccaaaucagcugcuacu

SEQ ID NO: 1834666 - RNA, 22 nt, Human
ugguaauuuaagauuccagaga

SEQ ID NO: 1834667 - RNA, 16 nt, Human
ugguccauagagagca

SEQ ID NO: 1834668 - RNA, 15 nt, Human
ugguccauagagagc

SEQ ID NO: 1834669 - RNA, 22 nt, Human
ugggucuuguuuuuuuuuucca

SEQ ID NO: 1834670 - RNA, 14 nt, Human
uggguggaugccug

SEQ ID NO: 1834671 - RNA, 23 nt, Human
uggguggaugccugguggcagcu

SEQ ID NO: 1834672 - RNA, 17 nt, Human
auaaguuaacuuccaau

SEQ ID NO: 1834673 - RNA, 23 nt, Human
auaagaaccuuuugagugccuua

SEQ ID NO: 1834674 - RNA, 22 nt, Human
auaagaaccuuuugagugccuu

SEQ ID NO: 1834675 - RNA, 23 nt, Human
auaauacaccacuacauucuguu

SEQ ID NO: 1834676 - RNA, 21 nt, Human
auaauacaccacuacauucug

SEQ ID NO: 1834677 - RNA, 22 nt, Human
auaaguuaacuuccaauuuaca

SEQ ID NO: 1834678 - RNA, 19 nt, Human
auaauacaguaucucaggg

SEQ ID NO: 1834679 - RNA, 14 nt, Human
auaauucuacuuug

SEQ ID NO: 1834680 - RNA, 14 nt, Human
auaaugaauacuuu

SEQ ID NO: 1834681 - RNA, 16 nt, Human
uuacaggaaguacugg

SEQ ID NO: 1834682 - RNA, 15 nt, Human
uuacaggaaguacug

SEQ ID NO: 1834683 - RNA, 22 nt, Human
uuacaggaaguacuggagaaaa

SEQ ID NO: 1834684 - RNA, 18 nt, Human
uuacaggaaguacuggag

SEQ ID NO: 1834685 - RNA, 23 nt, Human
uuaccauuuugggguacccacug

SEQ ID NO: 1834686 - RNA, 19 nt, Human
auaaauaaaguuuguugaa

SEQ ID NO: 1834687 - RNA, 13 nt, Human
auaaauaaaguuu

SEQ ID NO: 1834688 - RNA, 12 nt, Human
auaaauaacuuu

SEQ ID NO: 1834689 - RNA, 20 nt, Human
auaaccaguguuguggauuu

SEQ ID NO: 1834690 - RNA, 20 nt, Human
auaaccaaagcccaaagugg

SEQ ID NO: 1834691 - RNA, 23 nt, Human
auaaacacucuugaaaaaugcau

SEQ ID NO: 1834692 - RNA, 13 nt, Human
auaaacuuuaccu

SEQ ID NO: 1834693 - RNA, 15 nt, Human
auaaacuuuaccuuu

SEQ ID NO: 1834694 - RNA, 22 nt, Human
auacaaaaaaaaaaaaaaauua

SEQ ID NO: 1834695 - RNA, 12 nt, Human
auacaaaagcau

SEQ ID NO: 1834696 - RNA, 13 nt, Human
auacaaaagcaug

SEQ ID NO: 1834697 - RNA, 15 nt, Human
auacaaaagcaugug

SEQ ID NO: 1834698 - RNA, 18 nt, Human
uuauacccccugcaaagc

SEQ ID NO: 1834699 - RNA, 14 nt, Human
uuagccccauaauu

SEQ ID NO: 1834700 - RNA, 16 nt, Human
uuagcaguuugcuuug

SEQ ID NO: 1834701 - RNA, 16 nt, Human
auacauuugauaaagu

SEQ ID NO: 1834702 - RNA, 20 nt, Human
auacauaaacaagaccacgu

SEQ ID NO: 1834703 - RNA, 14 nt, Human
auacaggaaaagcu

SEQ ID NO: 1834704 - RNA, 19 nt, Human
auacaggaaaagcugcuga

SEQ ID NO: 1834705 - RNA, 20 nt, Human
auacaggaaaagcugcugac

SEQ ID NO: 1834706 - RNA, 22 nt, Human
auacaggaaaagcugcugacag

SEQ ID NO: 1834707 - RNA, 21 nt, Human
auacaguucggugagcuacaa

SEQ ID NO: 1834708 - RNA, 13 nt, Human
auacuacaguuug

SEQ ID NO: 1834709 - RNA, 15 nt, Human
auacuacaguuuguu

SEQ ID NO: 1834710 - RNA, 16 nt, Human
auacuacaguuuguua

SEQ ID NO: 1834711 - RNA, 20 nt, Human
auacuacaguuuguuaguau

SEQ ID NO: 1834712 - RNA, 21 nt, Human
auacuaaccagcagaaaugcc

SEQ ID NO: 1834713 - RNA, 19 nt, Human
auaccagccaguaaauggg

SEQ ID NO: 1834714 - RNA, 22 nt, Human
uuaucaugugaaaucauucauu

SEQ ID NO: 1834715 - RNA, 20 nt, Human
uuaucaugugaaaucauuca

SEQ ID NO: 1834716 - RNA, 18 nt, Human
uuaucaugugaaaucauu

SEQ ID NO: 1834717 - RNA, 17 nt, Human
uuaucaugugaaaucau

SEQ ID NO: 1834718 - RNA, 13 nt, Human
uguugucagcuga

SEQ ID NO: 1834719 - RNA, 16 nt, Human
uguugggccaggagcc

SEQ ID NO: 1834720 - RNA, 13 nt, Human
uguugggccagga

SEQ ID NO: 1834721 - RNA, 17 nt, Human
aguucccuacuuccugu

SEQ ID NO: 1834722 - RNA, 21 nt, Human
aguuauuuuuauuuauuuaaa

SEQ ID NO: 1834723 - RNA, 18 nt, Human
uguucuuuccaaaguaca

SEQ ID NO: 1834724 - RNA, 20 nt, Human
uguucuuuccaaaguacacu

SEQ ID NO: 1834725 - RNA, 20 nt, Human
aguuauuauauuuacaaaug

SEQ ID NO: 1834726 - RNA, 20 nt, Human
agugggggaguggccacaga

SEQ ID NO: 1834727 - RNA, 19 nt, Human
agugggggaguggccacag

SEQ ID NO: 1834728 - RNA, 18 nt, Human
agugggugaauaauacag

SEQ ID NO: 1834729 - RNA, 13 nt, Human
agugggugaauaa

SEQ ID NO: 1834730 - RNA, 18 nt, Human
agugggggaucacagccu

SEQ ID NO: 1834731 - RNA, 14 nt, Human
aguggcagcugcuu

SEQ ID NO: 1834732 - RNA, 20 nt, Human
aguggcagcugcuuuugucu

SEQ ID NO: 1834733 - RNA, 12 nt, Human
aguggcagcugc

SEQ ID NO: 1834734 - RNA, 13 nt, Human
aguggcagcugcu

SEQ ID NO: 1834735 - RNA, 22 nt, Human
aguguacauggaauaacaugua

SEQ ID NO: 1834736 - RNA, 21 nt, Human
aguguacauggaauaacaugu

SEQ ID NO: 1834737 - RNA, 13 nt, Human
aguguacagucuu

SEQ ID NO: 1834738 - RNA, 15 nt, Human
aguguacagucuugu

SEQ ID NO: 1834739 - RNA, 16 nt, Human
aguguacagucuugua

SEQ ID NO: 1834740 - RNA, 19 nt, Human
agugggugaauaauacagu

SEQ ID NO: 1834741 - RNA, 21 nt, Human
agugguuccuaauccucuagg

SEQ ID NO: 1834742 - RNA, 16 nt, Human
aguggugcgaucuggg

SEQ ID NO: 1834743 - RNA, 19 nt, Human
uguucuugguuuguaaauu

SEQ ID NO: 1834744 - RNA, 13 nt, Human
uguucuuuccaaa

SEQ ID NO: 1834745 - RNA, 14 nt, Human
uguucuuuccaaag

SEQ ID NO: 1834746 - RNA, 17 nt, Human
uguucuugguuuguaaa

SEQ ID NO: 1834747 - RNA, 18 nt, Human
uguucuugguuuguaaau

SEQ ID NO: 1834748 - RNA, 16 nt, Human
uguucuuaagacguga

SEQ ID NO: 1834749 - RNA, 14 nt, Human
uguucuuaauucuu

SEQ ID NO: 1834750 - RNA, 16 nt, Human
uguucuuaauucuuag

SEQ ID NO: 1834751 - RNA, 14 nt, Human
uguucugggacaca

SEQ ID NO: 1834752 - RNA, 15 nt, Human
uguucugggacacag

SEQ ID NO: 1834753 - RNA, 13 nt, Human
uguucugggacac

SEQ ID NO: 1834754 - RNA, 23 nt, Human
aguguacauggaauaacauguaa

SEQ ID NO: 1834755 - RNA, 17 nt, Human
aguguacagucuuguau

SEQ ID NO: 1834756 - RNA, 16 nt, Human
uguucccauucuugca

SEQ ID NO: 1834757 - RNA, 21 nt, Human
aguugauagcacagacccugc

SEQ ID NO: 1834758 - RNA, 20 nt, Human
aguugauagcacagacccug

SEQ ID NO: 1834759 - RNA, 19 nt, Human
aguugauagcacagacccu

SEQ ID NO: 1834760 - RNA, 15 nt, Human
aguugauagcacaga

SEQ ID NO: 1834761 - RNA, 14 nt, Human
aguugauagcacag

SEQ ID NO: 1834762 - RNA, 18 nt, Human
aguugauucagcucugca

SEQ ID NO: 1834763 - RNA, 17 nt, Human
aguugauucagcucugc

SEQ ID NO: 1834764 - RNA, 15 nt, Human
aguugauucagcucu

SEQ ID NO: 1834765 - RNA, 14 nt, Human
aguugauucagcuc

SEQ ID NO: 1834766 - RNA, 23 nt, Human
aguugauucagcucugcaagaau

SEQ ID NO: 1834767 - RNA, 19 nt, Human
aguugcaacuuuguauaaa

SEQ ID NO: 1834768 - RNA, 13 nt, Human
aguugauucagcu

SEQ ID NO: 1834769 - RNA, 23 nt, Human
aguugauagcacagacccugccc

SEQ ID NO: 1834770 - RNA, 22 nt, Human
aguugauagcacagacccugcc

SEQ ID NO: 1834771 - RNA, 12 nt, Human
aguucucuccuu

SEQ ID NO: 1834772 - RNA, 13 nt, Human
aguucucuccuuc

SEQ ID NO: 1834773 - RNA, 16 nt, Human
aguucucuccuucuuc

SEQ ID NO: 1834774 - RNA, 15 nt, Human
uguuuucucuugaga

SEQ ID NO: 1834775 - RNA, 17 nt, Human
uguuuucaguguacaug

SEQ ID NO: 1834776 - RNA, 15 nt, Human
uguuuucaguguaca

SEQ ID NO: 1834777 - RNA, 19 nt, Human
uguuuggggaugagaaagg

SEQ ID NO: 1834778 - RNA, 15 nt, Human
uguuuggggaugaga

SEQ ID NO: 1834779 - RNA, 15 nt, Human
uguuugcaucugaaa

SEQ ID NO: 1834780 - RNA, 14 nt, Human
uguuugccucugcc

SEQ ID NO: 1834781 - RNA, 16 nt, Human
uguuugccucugccuc

SEQ ID NO: 1834782 - RNA, 14 nt, Human
uguugucagcugaa

SEQ ID NO: 1834783 - RNA, 13 nt, Human
uuaaauucuugca

SEQ ID NO: 1834784 - RNA, 16 nt, Human
uuaaauucuugcaaag

SEQ ID NO: 1834785 - RNA, 15 nt, Human
aguuucuccaagcag

SEQ ID NO: 1834786 - RNA, 13 nt, Human
aguuucuccaagc

SEQ ID NO: 1834787 - RNA, 21 nt, Human
aguuucuccaagcaggacaug

SEQ ID NO: 1834788 - RNA, 16 nt, Human
aguuucucagcuccca

SEQ ID NO: 1834789 - RNA, 16 nt, Human
aguuucguuuucaaaa

SEQ ID NO: 1834790 - RNA, 15 nt, Human
aguuucguuuucaaa

SEQ ID NO: 1834791 - RNA, 22 nt, Human
aguuuucacucuuauugcccac

SEQ ID NO: 1834792 - RNA, 17 nt, Human
uuaaaccgccaaggcug

SEQ ID NO: 1834793 - RNA, 19 nt, Human
uuaaaauauuccugcauuu

SEQ ID NO: 1834794 - RNA, 16 nt, Human
uuaaaauauuccugca

SEQ ID NO: 1834795 - RNA, 15 nt, Human
uuaaauaaaucauaa

SEQ ID NO: 1834796 - RNA, 13 nt, Human
uuaaauaaaucau

SEQ ID NO: 1834797 - RNA, 20 nt, Human
uuaaauaaugugaaacugga

SEQ ID NO: 1834798 - RNA, 21 nt, Human
uuaaauaaugugaaacuggau

SEQ ID NO: 1834799 - RNA, 19 nt, Human
uuaaauaaugugaaacugg

SEQ ID NO: 1834800 - RNA, 22 nt, Human
uuaaauaaugugaaacuggauu

SEQ ID NO: 1834801 - RNA, 18 nt, Human
uuaaaaaguggaaaaaua

SEQ ID NO: 1834802 - RNA, 20 nt, Human
uuaaaaaugguuuaaauggu

SEQ ID NO: 1834803 - RNA, 17 nt, Human
uuaaaacaacacucaca

SEQ ID NO: 1834804 - RNA, 20 nt, Human
aguugccagucaccccggcc

SEQ ID NO: 1834805 - RNA, 22 nt, Human
aguugcauagguuuaauaauuu

SEQ ID NO: 1834806 - RNA, 20 nt, Human
agccacugcaccgggccaca

SEQ ID NO: 1834807 - RNA, 18 nt, Human
agccacugcaccgggcca

SEQ ID NO: 1834808 - RNA, 19 nt, Human
agccacugcaccgggccac

SEQ ID NO: 1834809 - RNA, 11 nt, Human
agccagaggag

SEQ ID NO: 1834810 - RNA, 10 nt, Human
agccagagga

SEQ ID NO: 1834811 - RNA, 19 nt, Human
ugauuaaccacuucagcug

SEQ ID NO: 1834812 - RNA, 20 nt, Human
ugauuaaauucuugcaaagu

SEQ ID NO: 1834813 - RNA, 17 nt, Human
ugauggugaugaaaugu

SEQ ID NO: 1834814 - RNA, 13 nt, Human
ugauggugcaaug

SEQ ID NO: 1834815 - RNA, 16 nt, Human
ugauggugaugaaaug

SEQ ID NO: 1834816 - RNA, 15 nt, Human
ugauggugaugaaau

SEQ ID NO: 1834817 - RNA, 15 nt, Human
ugauggugcaaugac

SEQ ID NO: 1834818 - RNA, 19 nt, Human
ugauuaaauucuugcaaag

SEQ ID NO: 1834819 - RNA, 20 nt, Human
ugauuaaccacuucagcuga

SEQ ID NO: 1834820 - RNA, 15 nt, Human
agccacgguguucug

SEQ ID NO: 1834821 - RNA, 17 nt, Human
ugauuaauggaaauguu

SEQ ID NO: 1834822 - RNA, 16 nt, Human
agccacugcaccgggc

SEQ ID NO: 1834823 - RNA, 14 nt, Human
ugaugggauuuggu

SEQ ID NO: 1834824 - RNA, 19 nt, Human
ugauggggcccugccuccu

SEQ ID NO: 1834825 - RNA, 16 nt, Human
ugauggggcccugccu

SEQ ID NO: 1834826 - RNA, 15 nt, Human
ugauggggcccugcc

SEQ ID NO: 1834827 - RNA, 14 nt, Human
ugauggggcccugc

SEQ ID NO: 1834828 - RNA, 23 nt, Human
ugaugcuucuucagagacuccug

SEQ ID NO: 1834829 - RNA, 16 nt, Human
ugaugagaggaaauca

SEQ ID NO: 1834830 - RNA, 15 nt, Human
ugaugagaggaaauc

SEQ ID NO: 1834831 - RNA, 14 nt, Human
ugaugagaggaaau

SEQ ID NO: 1834832 - RNA, 13 nt, Human
ugaugagaggaaa

SEQ ID NO: 1834833 - RNA, 16 nt, Human
ugauccuaguuccacc

SEQ ID NO: 1834834 - RNA, 22 nt, Human
ugauccuaaugaaugcauaaaa

SEQ ID NO: 1834835 - RNA, 15 nt, Human
ugauccucccaccuc

SEQ ID NO: 1834836 - RNA, 22 nt, Human
ugauccucccaccucagccucc

SEQ ID NO: 1834837 - RNA, 16 nt, Human
ugauccucccaccuca

SEQ ID NO: 1834838 - RNA, 21 nt, Human
ugauccucccaccucagccuc

SEQ ID NO: 1834839 - RNA, 16 nt, Human
agcccacuguacuugc

SEQ ID NO: 1834840 - RNA, 14 nt, Human
agcccacuguacuu

SEQ ID NO: 1834841 - RNA, 13 nt, Human
agcccacuucugc

SEQ ID NO: 1834842 - RNA, 14 nt, Human
agcccacuucugcc

SEQ ID NO: 1834843 - RNA, 15 nt, Human
agcccacuucugcca

SEQ ID NO: 1834844 - RNA, 13 nt, Human
agccaguaaaugg

SEQ ID NO: 1834845 - RNA, 22 nt, Human
agccaguaaaugggggugcauu

SEQ ID NO: 1834846 - RNA, 21 nt, Human
agccaguaaaugggggugcau

SEQ ID NO: 1834847 - RNA, 22 nt, Human
ugauuuccguuaaaauaccagc

SEQ ID NO: 1834848 - RNA, 17 nt, Human
ugauuucagcucacugc

SEQ ID NO: 1834849 - RNA, 21 nt, Human
ugauuucagcaccuacagugu

SEQ ID NO: 1834850 - RNA, 17 nt, Human
ugauuuggggauauuuu

SEQ ID NO: 1834851 - RNA, 22 nt, Human
ugauucccaagcucugcuccuc

SEQ ID NO: 1834852 - RNA, 23 nt, Human
ugauucccaagcucugcuccucu

SEQ ID NO: 1834853 - RNA, 15 nt, Human
ugauucucaugccuc

SEQ ID NO: 1834854 - RNA, 14 nt, Human
ugauucucaugccu

SEQ ID NO: 1834855 - RNA, 13 nt, Human
ugauucucaugcc

SEQ ID NO: 1834856 - RNA, 16 nt, Human
ugauucucaugccuca

SEQ ID NO: 1834857 - RNA, 13 nt, Human
ugauucuccugcc

SEQ ID NO: 1834858 - RNA, 16 nt, Human
ugauucauaaugacuu

SEQ ID NO: 1834859 - RNA, 18 nt, Human
agcccaggaaaggcucca

SEQ ID NO: 1834860 - RNA, 21 nt, Human
ugauucauaaugacuuaagca

SEQ ID NO: 1834861 - RNA, 14 nt, Human
agcccaggaaaggc

SEQ ID NO: 1834862 - RNA, 23 nt, Human
agcccagcuugaaaccuucacuu

SEQ ID NO: 1834863 - RNA, 20 nt, Human
agccucagucucccucccuu

SEQ ID NO: 1834864 - RNA, 19 nt, Human
agccucagucucccucccu

SEQ ID NO: 1834865 - RNA, 16 nt, Human
agccucagucucccuc

SEQ ID NO: 1834866 - RNA, 13 nt, Human
agccucagucucc

SEQ ID NO: 1834867 - RNA, 22 nt, Human
agccucagucucccucccuugg

SEQ ID NO: 1834868 - RNA, 18 nt, Human
agccucacaguccuuacc

SEQ ID NO: 1834869 - RNA, 17 nt, Human
agccucacaguccuuac

SEQ ID NO: 1834870 - RNA, 20 nt, Human
agccucaaccuccugggcua

SEQ ID NO: 1834871 - RNA, 19 nt, Human
agccucaaccuccugggcu

SEQ ID NO: 1834872 - RNA, 18 nt, Human
agccgagaucacgccacu

SEQ ID NO: 1834873 - RNA, 20 nt, Human
ugcagccucaaccuccuggg

SEQ ID NO: 1834874 - RNA, 21 nt, Human
ugcagccucaaccuccugggc

SEQ ID NO: 1834875 - RNA, 22 nt, Human
ugcagccucaaccuccugggcu

SEQ ID NO: 1834876 - RNA, 23 nt, Human
ugcagccucaaccuccugggcua

SEQ ID NO: 1834877 - RNA, 21 nt, Human
agccuccaagcuccaucucca

SEQ ID NO: 1834878 - RNA, 17 nt, Human
agccuccaugcugccuc

SEQ ID NO: 1834879 - RNA, 23 nt, Human
agccucugaaaaccaauguucuc

SEQ ID NO: 1834880 - RNA, 18 nt, Human
ugcagacucuacagaggc

SEQ ID NO: 1834881 - RNA, 16 nt, Human
ugcagacucuacagag

SEQ ID NO: 1834882 - RNA, 17 nt, Human
ugcagacucuacagagg

SEQ ID NO: 1834883 - RNA, 16 nt, Human
agcccuuagcagggaa

SEQ ID NO: 1834884 - RNA, 21 nt, Human
agcccuuagcagggaaacagc

SEQ ID NO: 1834885 - RNA, 20 nt, Human
agccgagauagccaaggcca

SEQ ID NO: 1834886 - RNA, 21 nt, Human
agccgagauagccaaggccaa

SEQ ID NO: 1834887 - RNA, 17 nt, Human
agccgagaucacgccac

SEQ ID NO: 1834888 - RNA, 11 nt, Human
ugcacacauuu

SEQ ID NO: 1834889 - RNA, 12 nt, Human
ugcacacauuuu

SEQ ID NO: 1834890 - RNA, 13 nt, Human
ugcacacauuuuu

SEQ ID NO: 1834891 - RNA, 15 nt, Human
ugcacacauuuuuua

SEQ ID NO: 1834892 - RNA, 17 nt, Human
ugcacuccccugcuggg

SEQ ID NO: 1834893 - RNA, 16 nt, Human
ugcacuccccugcugg

SEQ ID NO: 1834894 - RNA, 19 nt, Human
ugcacuccccugcugggug

SEQ ID NO: 1834895 - RNA, 14 nt, Human
ugcagaagacagua

SEQ ID NO: 1834896 - RNA, 15 nt, Human
ugcagaagacaguau

SEQ ID NO: 1834897 - RNA, 22 nt, Human
ugcagacaggcaagcaccuccu

SEQ ID NO: 1834898 - RNA, 17 nt, Human
agcccugcuuugggcug

SEQ ID NO: 1834899 - RNA, 20 nt, Human
agcccugcuuugggcugccc

SEQ ID NO: 1834900 - RNA, 19 nt, Human
agcccugcuuugggcugcc

SEQ ID NO: 1834901 - RNA, 22 nt, Human
ugcacacaccagagcccaccuu

SEQ ID NO: 1834902 - RNA, 21 nt, Human
ugcacacaccagagcccaccu

SEQ ID NO: 1834903 - RNA, 17 nt, Human
ugcacacaccagagccc

SEQ ID NO: 1834904 - RNA, 18 nt, Human
ugcacacaccagagccca

SEQ ID NO: 1834905 - RNA, 14 nt, Human
agcccugguggcag

SEQ ID NO: 1834906 - RNA, 15 nt, Human
agcccugguggcagu

SEQ ID NO: 1834907 - RNA, 16 nt, Human
agcccugguggcagug

SEQ ID NO: 1834908 - RNA, 23 nt, Human
agccccauucugccugcccaggc

SEQ ID NO: 1834909 - RNA, 17 nt, Human
agccccaaaacucuccu

SEQ ID NO: 1834910 - RNA, 16 nt, Human
agccccaaaacucucc

SEQ ID NO: 1834911 - RNA, 18 nt, Human
agccccaaaacucuccuc

SEQ ID NO: 1834912 - RNA, 21 nt, Human
agccccauucugccugcccag

SEQ ID NO: 1834913 - RNA, 22 nt, Human
agccccauucugccugcccagg

SEQ ID NO: 1834914 - RNA, 21 nt, Human
ugcaaaccaucauugaaaucu

SEQ ID NO: 1834915 - RNA, 23 nt, Human
ugccucucugcaggucccuaaua

SEQ ID NO: 1834916 - RNA, 15 nt, Human
ugccucucugcaggu

SEQ ID NO: 1834917 - RNA, 14 nt, Human
ugccucugacacac

SEQ ID NO: 1834918 - RNA, 16 nt, Human
ugccucugacacacag

SEQ ID NO: 1834919 - RNA, 21 nt, Human
ugccucucugcaggucccuaa

SEQ ID NO: 1834920 - RNA, 11 nt, Human
ugccucugccu

SEQ ID NO: 1834921 - RNA, 12 nt, Human
ugccucugccuc

SEQ ID NO: 1834922 - RNA, 17 nt, Human
ugccugcccaggccccu

SEQ ID NO: 1834923 - RNA, 18 nt, Human
ugccugcccaggccccug

SEQ ID NO: 1834924 - RNA, 19 nt, Human
ugccugcccaggccccugc

SEQ ID NO: 1834925 - RNA, 23 nt, Human
agcugcuuuugucuaugggacuc

SEQ ID NO: 1834926 - RNA, 24 nt, Human
agcugcuuuugucuaugggacuca

SEQ ID NO: 1834927 - RNA, 13 nt, Human
agcugccuguuca

SEQ ID NO: 1834928 - RNA, 22 nt, Human
agcugcuuuugucuaugggacu

SEQ ID NO: 1834929 - RNA, 22 nt, Human
ugcccuuaccugccaggaagcc

SEQ ID NO: 1834930 - RNA, 18 nt, Human
ugcccugugggcccccaa

SEQ ID NO: 1834931 - RNA, 15 nt, Human
ugcccugugggcccc

SEQ ID NO: 1834932 - RNA, 15 nt, Human
agcucuucuccaggc

SEQ ID NO: 1834933 - RNA, 16 nt, Human
agcucuucuccaggcu

SEQ ID NO: 1834934 - RNA, 17 nt, Human
agcucuucuccaggcug

SEQ ID NO: 1834935 - RNA, 15 nt, Human
ugccucaccccuugc

SEQ ID NO: 1834936 - RNA, 20 nt, Human
ugccgcagcccugcagaggg

SEQ ID NO: 1834937 - RNA, 19 nt, Human
ugcccuuaccugccaggaa

SEQ ID NO: 1834938 - RNA, 17 nt, Human
ugccucucucaggccaa

SEQ ID NO: 1834939 - RNA, 12 nt, Human
ugccucucugca

SEQ ID NO: 1834940 - RNA, 11 nt, Human
ugccucucugc

SEQ ID NO: 1834941 - RNA, 15 nt, Human
ugccucagccucccg

SEQ ID NO: 1834942 - RNA, 15 nt, Human
ugccucagccuccug

SEQ ID NO: 1834943 - RNA, 17 nt, Human
ugccucagccuccugag

SEQ ID NO: 1834944 - RNA, 22 nt, Human
ugccucccaucacccgcuaaga

SEQ ID NO: 1834945 - RNA, 19 nt, Human
agcuccaagcucccaggca

SEQ ID NO: 1834946 - RNA, 18 nt, Human
agcuccaagcucccaggc

SEQ ID NO: 1834947 - RNA, 17 nt, Human
agcuccaagcucccagg

SEQ ID NO: 1834948 - RNA, 14 nt, Human
ugcccugcccaccu

SEQ ID NO: 1834949 - RNA, 13 nt, Human
agcuccagcucac

SEQ ID NO: 1834950 - RNA, 17 nt, Human
agcuccagcucaccagc

SEQ ID NO: 1834951 - RNA, 20 nt, Human
ugcccuaaugcgcaggcugg

SEQ ID NO: 1834952 - RNA, 23 nt, Human
ugcccuaaugcgcaggcuggccc

SEQ ID NO: 1834953 - RNA, 23 nt, Human
agcucugcccauccugccccuga

SEQ ID NO: 1834954 - RNA, 21 nt, Human
agcucugcagagcaggaaaca

SEQ ID NO: 1834955 - RNA, 22 nt, Human
agcuccuucuguccuacucugu

SEQ ID NO: 1834956 - RNA, 23 nt, Human
agcuccuucuguccuacucugug

SEQ ID NO: 1834957 - RNA, 21 nt, Human
agcuccaucuccacuccagau

SEQ ID NO: 1834958 - RNA, 21 nt, Human
agcuccagcucaccagcccca

SEQ ID NO: 1834959 - RNA, 18 nt, Human
agcuccagcucaccagcc

SEQ ID NO: 1834960 - RNA, 19 nt, Human
agcuccagcucaccagccc

SEQ ID NO: 1834961 - RNA, 17 nt, Human
agcuaucguaaaauuaa

SEQ ID NO: 1834962 - RNA, 21 nt, Human
agcuaggccuggccagaugca

SEQ ID NO: 1834963 - RNA, 13 nt, Human
agcgugagccacu

SEQ ID NO: 1834964 - RNA, 13 nt, Human
agcucagggccug

SEQ ID NO: 1834965 - RNA, 12 nt, Human
agcucagggccu

SEQ ID NO: 1834966 - RNA, 19 nt, Human
agcuauucaguaauaacuc

SEQ ID NO: 1834967 - RNA, 19 nt, Human
agcucagggccuggcucag

SEQ ID NO: 1834968 - RNA, 14 nt, Human
agcucagggccugg

SEQ ID NO: 1834969 - RNA, 20 nt, Human
agcucagggccuggcucagg

SEQ ID NO: 1834970 - RNA, 16 nt, Human
agcuccaagcucccag

SEQ ID NO: 1834971 - RNA, 15 nt, Human
agcuccaagcuccca

SEQ ID NO: 1834972 - RNA, 17 nt, Human
agcucaggugucccugc

SEQ ID NO: 1834973 - RNA, 17 nt, Human
ugcccagccccuucuga

SEQ ID NO: 1834974 - RNA, 16 nt, Human
ugcccagccccuucug

SEQ ID NO: 1834975 - RNA, 12 nt, Human
ugcccagccccu

SEQ ID NO: 1834976 - RNA, 13 nt, Human
ugcccagccccuu

SEQ ID NO: 1834977 - RNA, 20 nt, Human
ugcccaaagaugcagccggu

SEQ ID NO: 1834978 - RNA, 17 nt, Human
ugcccaaagaugcagcc

SEQ ID NO: 1834979 - RNA, 15 nt, Human
ugcccaggccccugc

SEQ ID NO: 1834980 - RNA, 17 nt, Human
ugcccaggccccugcca

SEQ ID NO: 1834981 - RNA, 18 nt, Human
ugcccaggccccugccac

SEQ ID NO: 1834982 - RNA, 23 nt, Human
ugccccgaacauguuuuucuucu

SEQ ID NO: 1834983 - RNA, 20 nt, Human
ugcccuaaaguguauuuuuu

SEQ ID NO: 1834984 - RNA, 18 nt, Human
ugcccccucugcccugcg

SEQ ID NO: 1834985 - RNA, 17 nt, Human
ugcccccucugcccugc

SEQ ID NO: 1834986 - RNA, 16 nt, Human
ugcccccucugcccug

SEQ ID NO: 1834987 - RNA, 15 nt, Human
ugcccccucugcccu

SEQ ID NO: 1834988 - RNA, 14 nt, Human
ugcccccucugccc

SEQ ID NO: 1834989 - RNA, 20 nt, Human
ugcauuugaggucuguucuu

SEQ ID NO: 1834990 - RNA, 21 nt, Human
ugcauuugaggucuguucuuu

SEQ ID NO: 1834991 - RNA, 17 nt, Human
ugccacugccucuuccu

SEQ ID NO: 1834992 - RNA, 13 nt, Human
ugccacugccucu

SEQ ID NO: 1834993 - RNA, 20 nt, Human
ugccacugccucuuccuccc

SEQ ID NO: 1834994 - RNA, 19 nt, Human
ugccacugccucuuccucc

SEQ ID NO: 1834995 - RNA, 18 nt, Human
ugccacugccucuuccuc

SEQ ID NO: 1834996 - RNA, 20 nt, Human
ugccagucccccugccccag

SEQ ID NO: 1834997 - RNA, 18 nt, Human
ugccagcuuaucucaggg

SEQ ID NO: 1834998 - RNA, 13 nt, Human
agcggcuggcagc

SEQ ID NO: 1834999 - RNA, 22 nt, Human
agcggggacagcuccuucuguc

SEQ ID NO: 1835000 - RNA, 23 nt, Human
agcggcuggcagcccaccccuca

SEQ ID NO: 1835001 - RNA, 19 nt, Human
agcggggacagcuccuucu

SEQ ID NO: 1835002 - RNA, 20 nt, Human
agcggggacagcuccuucug

SEQ ID NO: 1835003 - RNA, 22 nt, Human
agccuugaccauucuccaccug

SEQ ID NO: 1835004 - RNA, 23 nt, Human
agccuugaacuuugaccucugca

SEQ ID NO: 1835005 - RNA, 16 nt, Human
agccuugaacuuugac

SEQ ID NO: 1835006 - RNA, 22 nt, Human
agccuugaacuuugaccucugc

SEQ ID NO: 1835007 - RNA, 23 nt, Human
agccuugaccauucuccaccugc

SEQ ID NO: 1835008 - RNA, 22 nt, Human
agcgauucuucugcuucagccu

SEQ ID NO: 1835009 - RNA, 15 nt, Human
agccuugaacuuuga

SEQ ID NO: 1835010 - RNA, 18 nt, Human
agccuuccagggguggga

SEQ ID NO: 1835011 - RNA, 20 nt, Human
ugcauuuaaaagauacaguu

SEQ ID NO: 1835012 - RNA, 19 nt, Human
ugcauuugaggucuguucu

SEQ ID NO: 1835013 - RNA, 18 nt, Human
ugcauuugaggucuguuc

SEQ ID NO: 1835014 - RNA, 16 nt, Human
agcgcuggccgggacc

SEQ ID NO: 1835015 - RNA, 22 nt, Human
agcgcuggccgggaccccgagc

SEQ ID NO: 1835016 - RNA, 19 nt, Human
aggagcccugggaggcucu

SEQ ID NO: 1835017 - RNA, 16 nt, Human
ugcuugggcuucaucc

SEQ ID NO: 1835018 - RNA, 12 nt, Human
ugcuugggcuuc

SEQ ID NO: 1835019 - RNA, 21 nt, Human
ugcuuggaggaaggaaaccca

SEQ ID NO: 1835020 - RNA, 15 nt, Human
uggaaauauuaagaa

SEQ ID NO: 1835021 - RNA, 19 nt, Human
ugcuugggcuucauccucc

SEQ ID NO: 1835022 - RNA, 21 nt, Human
ugcuuugggcugcccuggugc

SEQ ID NO: 1835023 - RNA, 20 nt, Human
ugcuuugggcugcccuggug

SEQ ID NO: 1835024 - RNA, 19 nt, Human
ugcuuugggcugcccuggu

SEQ ID NO: 1835025 - RNA, 18 nt, Human
ugcuuugggcugcccugg

SEQ ID NO: 1835026 - RNA, 19 nt, Human
aggacucugccuccucuuc

SEQ ID NO: 1835027 - RNA, 19 nt, Human
aggacauugcggacagcca

SEQ ID NO: 1835028 - RNA, 23 nt, Human
aggacauugcggacagccacggc

SEQ ID NO: 1835029 - RNA, 15 nt, Human
aggacauugcggaca

SEQ ID NO: 1835030 - RNA, 17 nt, Human
aggacauugcggacagc

SEQ ID NO: 1835031 - RNA, 18 nt, Human
aggacauugcggacagcc

SEQ ID NO: 1835032 - RNA, 14 nt, Human
aggagcagccacau

SEQ ID NO: 1835033 - RNA, 18 nt, Human
aggagcccugggaggcuc

SEQ ID NO: 1835034 - RNA, 22 nt, Human
aggagccccgaggccuucucug

SEQ ID NO: 1835035 - RNA, 17 nt, Human
aggagaaacuggaacuc

SEQ ID NO: 1835036 - RNA, 17 nt, Human
aggagauuggaaggaac

SEQ ID NO: 1835037 - RNA, 11 nt, Human
aggagaaacug

SEQ ID NO: 1835038 - RNA, 23 nt, Human
aggacuuuucuuuguggcuuccu

SEQ ID NO: 1835039 - RNA, 23 nt, Human
uggaaaugggcagagcagagacc

SEQ ID NO: 1835040 - RNA, 20 nt, Human
uggaaauauuaagaaagacu

SEQ ID NO: 1835041 - RNA, 21 nt, Human
aggagggagcaucagugcccu

SEQ ID NO: 1835042 - RNA, 14 nt, Human
aggagggaggggga

SEQ ID NO: 1835043 - RNA, 16 nt, Human
aggauccugagccaga

SEQ ID NO: 1835044 - RNA, 15 nt, Human
aggauccugagccag

SEQ ID NO: 1835045 - RNA, 21 nt, Human
aggauacaaaagcaugugaga

SEQ ID NO: 1835046 - RNA, 22 nt, Human
aggaucucuugagccugggagg

SEQ ID NO: 1835047 - RNA, 21 nt, Human
aggaucucuugagccugggag

SEQ ID NO: 1835048 - RNA, 18 nt, Human
aggauccugagccagauu

SEQ ID NO: 1835049 - RNA, 17 nt, Human
aggauccugagccagau

SEQ ID NO: 1835050 - RNA, 17 nt, Human
aggaugaucuaggaaga

SEQ ID NO: 1835051 - RNA, 16 nt, Human
aggaugaucuaggaag

SEQ ID NO: 1835052 - RNA, 15 nt, Human
uggacacagcucuuc

SEQ ID NO: 1835053 - RNA, 16 nt, Human
uggacacagcucuucu

SEQ ID NO: 1835054 - RNA, 18 nt, Human
uggacacagcucuucucc

SEQ ID NO: 1835055 - RNA, 21 nt, Human
uggacacagcucuucuccagg

SEQ ID NO: 1835056 - RNA, 13 nt, Human
uggacccugaggc

SEQ ID NO: 1835057 - RNA, 12 nt, Human
uggacccugagg

SEQ ID NO: 1835058 - RNA, 14 nt, Human
uggacccugaggcc

SEQ ID NO: 1835059 - RNA, 17 nt, Human
aggcaacucaucuuagg

SEQ ID NO: 1835060 - RNA, 14 nt, Human
aggaugcccaaaga

SEQ ID NO: 1835061 - RNA, 20 nt, Human
aggaugaucuaggaagacuu

SEQ ID NO: 1835062 - RNA, 19 nt, Human
aggaugcccaaagaugcag

SEQ ID NO: 1835063 - RNA, 17 nt, Human
aggaugccccguccccc

SEQ ID NO: 1835064 - RNA, 19 nt, Human
aggauuuugauccaagcug

SEQ ID NO: 1835065 - RNA, 21 nt, Human
ugcucugcugacagacacagg

SEQ ID NO: 1835066 - RNA, 22 nt, Human
ugcucugcugacagacacaggc

SEQ ID NO: 1835067 - RNA, 14 nt, Human
ugcugagucugaag

SEQ ID NO: 1835068 - RNA, 15 nt, Human
ugcugagucugaagg

SEQ ID NO: 1835069 - RNA, 14 nt, Human
ugcugacuguacuc

SEQ ID NO: 1835070 - RNA, 20 nt, Human
ugcuccagcuguucagcugg

SEQ ID NO: 1835071 - RNA, 19 nt, Human
ugcuccagcuguucagcug

SEQ ID NO: 1835072 - RNA, 16 nt, Human
ugcuccagcuguucag

SEQ ID NO: 1835073 - RNA, 19 nt, Human
agcugggacuacaggcacc

SEQ ID NO: 1835074 - RNA, 16 nt, Human
agcugggacuacaggc

SEQ ID NO: 1835075 - RNA, 18 nt, Human
agcugggacuacaggcac

SEQ ID NO: 1835076 - RNA, 19 nt, Human
aggaagacuucaucccucu

SEQ ID NO: 1835077 - RNA, 13 nt, Human
aggaagacuucau

SEQ ID NO: 1835078 - RNA, 23 nt, Human
ugcugagucugaaggcuggguuc

SEQ ID NO: 1835079 - RNA, 22 nt, Human
ugcugagucugaaggcuggguu

SEQ ID NO: 1835080 - RNA, 21 nt, Human
ugcugagucugaaggcugggu

SEQ ID NO: 1835081 - RNA, 18 nt, Human
ugcugagucugaaggcug

SEQ ID NO: 1835082 - RNA, 17 nt, Human
ugcugagucugaaggcu

SEQ ID NO: 1835083 - RNA, 16 nt, Human
ugcugagucugaaggc

SEQ ID NO: 1835084 - RNA, 24 nt, Human
aggaagcacaugccucucucaggc

SEQ ID NO: 1835085 - RNA, 23 nt, Human
aggaagcacaugccucucucagg

SEQ ID NO: 1835086 - RNA, 14 nt, Human
aggaagacuuugga

SEQ ID NO: 1835087 - RNA, 13 nt, Human
aggaagacuuugg

SEQ ID NO: 1835088 - RNA, 15 nt, Human
aggaagccagcaggc

SEQ ID NO: 1835089 - RNA, 14 nt, Human
aggaagccagcagg

SEQ ID NO: 1835090 - RNA, 18 nt, Human
aggaagccagcaggcucu

SEQ ID NO: 1835091 - RNA, 17 nt, Human
aggaagccagcaggcuc

SEQ ID NO: 1835092 - RNA, 18 nt, Human
aggaaggaaacccagcuc

SEQ ID NO: 1835093 - RNA, 15 nt, Human
aggaaggagaggaga

SEQ ID NO: 1835094 - RNA, 19 nt, Human
aggaaggaaacccagcucu

SEQ ID NO: 1835095 - RNA, 23 nt, Human
aggaauuguguuuauaauuuuaa

SEQ ID NO: 1835096 - RNA, 23 nt, Human
aggaauugacccacaagaaauga

SEQ ID NO: 1835097 - RNA, 11 nt, Human
aggaauuuaaa

SEQ ID NO: 1835098 - RNA, 13 nt, Human
ugcuggagcucug

SEQ ID NO: 1835099 - RNA, 14 nt, Human
ugcuggagcucugc

SEQ ID NO: 1835100 - RNA, 15 nt, Human
ugcugcccugugagu

SEQ ID NO: 1835101 - RNA, 20 nt, Human
aggaauuuuauuuuuuucug

SEQ ID NO: 1835102 - RNA, 14 nt, Human
ugcugcccugugag

SEQ ID NO: 1835103 - RNA, 13 nt, Human
ugcugcccuguga

SEQ ID NO: 1835104 - RNA, 12 nt, Human
ugcugcccugug

SEQ ID NO: 1835105 - RNA, 21 nt, Human
ugcuggcugccuuagaaccuu

SEQ ID NO: 1835106 - RNA, 14 nt, Human
ugcuggcugccuua

SEQ ID NO: 1835107 - RNA, 15 nt, Human
ugcuggcugccuuag

SEQ ID NO: 1835108 - RNA, 16 nt, Human
ugcuggcugguuagag

SEQ ID NO: 1835109 - RNA, 18 nt, Human
ugcuggcuguuggcuggg

SEQ ID NO: 1835110 - RNA, 22 nt, Human
aggacagggaggugaccccagg

SEQ ID NO: 1835111 - RNA, 14 nt, Human
ugcuucaucccuuu

SEQ ID NO: 1835112 - RNA, 23 nt, Human
aggacacuaaccacgcuggaccu

SEQ ID NO: 1835113 - RNA, 19 nt, Human
aggacacuaaccacgcugg

SEQ ID NO: 1835114 - RNA, 19 nt, Human
ugcuucaaggauccugagc

SEQ ID NO: 1835115 - RNA, 18 nt, Human
ugcuucaaggauccugag

SEQ ID NO: 1835116 - RNA, 16 nt, Human
ugcuucaaggauccug

SEQ ID NO: 1835117 - RNA, 13 nt, Human
ugcuucagccucc

SEQ ID NO: 1835118 - RNA, 14 nt, Human
ugcuucagccuccc

SEQ ID NO: 1835119 - RNA, 12 nt, Human
ugcuucaaggau

SEQ ID NO: 1835120 - RNA, 13 nt, Human
ugcuuauacacuu

SEQ ID NO: 1835121 - RNA, 13 nt, Human
aggccugccuguu

SEQ ID NO: 1835122 - RNA, 15 nt, Human
uggcaugggaaugaa

SEQ ID NO: 1835123 - RNA, 12 nt, Human
uggcaugggaau

SEQ ID NO: 1835124 - RNA, 20 nt, Human
uggccaggcuggucucgaac

SEQ ID NO: 1835125 - RNA, 16 nt, Human
uggccaaguucuuagu

SEQ ID NO: 1835126 - RNA, 15 nt, Human
uggccaggcuggucu

SEQ ID NO: 1835127 - RNA, 17 nt, Human
uggccaggcuggucuca

SEQ ID NO: 1835128 - RNA, 14 nt, Human
aggcccucugccca

SEQ ID NO: 1835129 - RNA, 13 nt, Human
aggcccucugccc

SEQ ID NO: 1835130 - RNA, 15 nt, Human
aggcccucugcccac

SEQ ID NO: 1835131 - RNA, 18 nt, Human
uggccucugcacuccccu

SEQ ID NO: 1835132 - RNA, 17 nt, Human
uggccucugcacucccc

SEQ ID NO: 1835133 - RNA, 15 nt, Human
uggccucugcacucc

SEQ ID NO: 1835134 - RNA, 14 nt, Human
uggccucugcacuc

SEQ ID NO: 1835135 - RNA, 23 nt, Human
aggccugggggcugggcagagga

SEQ ID NO: 1835136 - RNA, 12 nt, Human
uggccuggcccc

SEQ ID NO: 1835137 - RNA, 22 nt, Human
aggccuggccagaugcaccagc

SEQ ID NO: 1835138 - RNA, 23 nt, Human
aggccuggccagaugcaccagcc

SEQ ID NO: 1835139 - RNA, 15 nt, Human
aggccuggccagaug

SEQ ID NO: 1835140 - RNA, 16 nt, Human
aggccuggccagaugc

SEQ ID NO: 1835141 - RNA, 17 nt, Human
aggccuggccagaugca

SEQ ID NO: 1835142 - RNA, 21 nt, Human
aggccuggccagaugcaccag

SEQ ID NO: 1835143 - RNA, 15 nt, Human
uggccgggagccuga

SEQ ID NO: 1835144 - RNA, 23 nt, Human
uggccgggaccccgagccuggcu

SEQ ID NO: 1835145 - RNA, 17 nt, Human
uggccgggaccccgagc

SEQ ID NO: 1835146 - RNA, 15 nt, Human
uggccgggaccccga

SEQ ID NO: 1835147 - RNA, 17 nt, Human
uggcccgacagccuggc

SEQ ID NO: 1835148 - RNA, 16 nt, Human
uggcccgacagccugg

SEQ ID NO: 1835149 - RNA, 15 nt, Human
uggcccgacagccug

SEQ ID NO: 1835150 - RNA, 14 nt, Human
uggcccgacagccu

SEQ ID NO: 1835151 - RNA, 19 nt, Human
uggcccgacagccuggcac

SEQ ID NO: 1835152 - RNA, 18 nt, Human
uggcccgacagccuggca

SEQ ID NO: 1835153 - RNA, 21 nt, Human
uggccccugcccggcugcgga

SEQ ID NO: 1835154 - RNA, 12 nt, Human
uggcagccccug

SEQ ID NO: 1835155 - RNA, 16 nt, Human
uggcagccgugccuuc

SEQ ID NO: 1835156 - RNA, 20 nt, Human
aggccacaagacccuugugg

SEQ ID NO: 1835157 - RNA, 16 nt, Human
uggcagccucuucaaa

SEQ ID NO: 1835158 - RNA, 15 nt, Human
uggcagccucuucaa

SEQ ID NO: 1835159 - RNA, 23 nt, Human
uggcagccgugccuucagcucua

SEQ ID NO: 1835160 - RNA, 12 nt, Human
aggccagagaca

SEQ ID NO: 1835161 - RNA, 13 nt, Human
uggcagccuuggc

SEQ ID NO: 1835162 - RNA, 21 nt, Human
uggcacaucagcacgauuucu

SEQ ID NO: 1835163 - RNA, 15 nt, Human
uggcacccggccccu

SEQ ID NO: 1835164 - RNA, 21 nt, Human
uggcagaguugaagacagagc

SEQ ID NO: 1835165 - RNA, 16 nt, Human
uggcacccggccccug

SEQ ID NO: 1835166 - RNA, 22 nt, Human
uggcagaguugaagacagagcu

SEQ ID NO: 1835167 - RNA, 18 nt, Human
uggcaccagcagccugga

SEQ ID NO: 1835168 - RNA, 20 nt, Human
uggcacaucagcacgauuuc

SEQ ID NO: 1835169 - RNA, 22 nt, Human
uggauuaaacuuaaucuaaaug

SEQ ID NO: 1835170 - RNA, 12 nt, Human
uggauguucuga

SEQ ID NO: 1835171 - RNA, 15 nt, Human
aggccacaagacccu

SEQ ID NO: 1835172 - RNA, 19 nt, Human
uggagucagacagaugugg

SEQ ID NO: 1835173 - RNA, 20 nt, Human
uggaguucaucuugaauugu

SEQ ID NO: 1835174 - RNA, 15 nt, Human
uggaugccugguggc

SEQ ID NO: 1835175 - RNA, 17 nt, Human
uggaguucaucuugaau

SEQ ID NO: 1835176 - RNA, 16 nt, Human
uggaguucaucuugaa

SEQ ID NO: 1835177 - RNA, 20 nt, Human
uggaugccugguggcagcug

SEQ ID NO: 1835178 - RNA, 18 nt, Human
uggaugccugguggcagc

SEQ ID NO: 1835179 - RNA, 19 nt, Human
uggaugccugguggcagcu

SEQ ID NO: 1835180 - RNA, 18 nt, Human
aggccaaggugggaggau

SEQ ID NO: 1835181 - RNA, 22 nt, Human
aggccaacccaaaauaagcagg

SEQ ID NO: 1835182 - RNA, 23 nt, Human
aggccaaaggaagcacaugccuc

SEQ ID NO: 1835183 - RNA, 15 nt, Human
aggccaaaggaagca

SEQ ID NO: 1835184 - RNA, 14 nt, Human
aggccaaaggaagc

SEQ ID NO: 1835185 - RNA, 20 nt, Human
aggccaaacucaccugcccc

SEQ ID NO: 1835186 - RNA, 18 nt, Human
aggcauuuguuugaacug

SEQ ID NO: 1835187 - RNA, 16 nt, Human
aggccaaacucaccug

SEQ ID NO: 1835188 - RNA, 13 nt, Human
aggccaaaaaaau

SEQ ID NO: 1835189 - RNA, 18 nt, Human
uggacgagaaaacaauaa

SEQ ID NO: 1835190 - RNA, 20 nt, Human
aggcucucaggccagcugcu

SEQ ID NO: 1835191 - RNA, 19 nt, Human
aggcucucaggccagcugc

SEQ ID NO: 1835192 - RNA, 18 nt, Human
aggcucucaggccagcug

SEQ ID NO: 1835193 - RNA, 16 nt, Human
aggcucucaggccagc

SEQ ID NO: 1835194 - RNA, 15 nt, Human
aggcucucaggccag

SEQ ID NO: 1835195 - RNA, 14 nt, Human
aggcucucaggcca

SEQ ID NO: 1835196 - RNA, 12 nt, Human
aggcucucaggc

SEQ ID NO: 1835197 - RNA, 11 nt, Human
aggcucucagg

SEQ ID NO: 1835198 - RNA, 15 nt, Human
aggcucugcccuugg

SEQ ID NO: 1835199 - RNA, 14 nt, Human
aggcucugcccuug

SEQ ID NO: 1835200 - RNA, 13 nt, Human
aggcucugcccuu

SEQ ID NO: 1835201 - RNA, 12 nt, Human
aggcucugcccu

SEQ ID NO: 1835202 - RNA, 11 nt, Human
aggcucugccc

SEQ ID NO: 1835203 - RNA, 21 nt, Human
aggcucucaggccagcugcuu

SEQ ID NO: 1835204 - RNA, 19 nt, Human
aggcucgagcaugccugga

SEQ ID NO: 1835205 - RNA, 18 nt, Human
aggcucgagcaugccugg

SEQ ID NO: 1835206 - RNA, 17 nt, Human
aggcucgagcaugccug

SEQ ID NO: 1835207 - RNA, 15 nt, Human
aggcucgagcaugcc

SEQ ID NO: 1835208 - RNA, 21 nt, Human
aggcucgagcaugccuggaug

SEQ ID NO: 1835209 - RNA, 14 nt, Human
aggcuccugccacc

SEQ ID NO: 1835210 - RNA, 20 nt, Human
aggcuccugccaccacgccc

SEQ ID NO: 1835211 - RNA, 12 nt, Human
aggcucgagcau

SEQ ID NO: 1835212 - RNA, 19 nt, Human
aggcuccuuuagcgcccag

SEQ ID NO: 1835213 - RNA, 23 nt, Human
aggcugcucuugaacuccugacc

SEQ ID NO: 1835214 - RNA, 16 nt, Human
aggcucugcccuuggu

SEQ ID NO: 1835215 - RNA, 13 nt, Human
aggcucuggagcc

SEQ ID NO: 1835216 - RNA, 15 nt, Human
aggcucuggagccca

SEQ ID NO: 1835217 - RNA, 14 nt, Human
aggcucuggagccc

SEQ ID NO: 1835218 - RNA, 19 nt, Human
aggcucuggagcccacugu

SEQ ID NO: 1835219 - RNA, 18 nt, Human
aggcucuggagcccacug

SEQ ID NO: 1835220 - RNA, 14 nt, Human
aggcuggcccugcc

SEQ ID NO: 1835221 - RNA, 12 nt, Human
aggcuggcccug

SEQ ID NO: 1835222 - RNA, 18 nt, Human
aggcuggcccugcccugg

SEQ ID NO: 1835223 - RNA, 17 nt, Human
aggcuggcccugcccug

SEQ ID NO: 1835224 - RNA, 16 nt, Human
aggcuggcccugcccu

SEQ ID NO: 1835225 - RNA, 15 nt, Human
aggcuggcccugccc

SEQ ID NO: 1835226 - RNA, 19 nt, Human
aggcuggcccugcccuggu

SEQ ID NO: 1835227 - RNA, 13 nt, Human
aggcuggcgugca

SEQ ID NO: 1835228 - RNA, 17 nt, Human
aggcuggcgugcagugg

SEQ ID NO: 1835229 - RNA, 16 nt, Human
ugggaaaggggaaguu

SEQ ID NO: 1835230 - RNA, 16 nt, Human
uggcuucccgcucagc

SEQ ID NO: 1835231 - RNA, 15 nt, Human
uggcuucccgcucag

SEQ ID NO: 1835232 - RNA, 17 nt, Human
uggcuucccgcucagcc

SEQ ID NO: 1835233 - RNA, 13 nt, Human
ugggaacuagacu

SEQ ID NO: 1835234 - RNA, 23 nt, Human
uggcuucacggaagagccuugcg

SEQ ID NO: 1835235 - RNA, 22 nt, Human
uggcuucacggaagagccuugc

SEQ ID NO: 1835236 - RNA, 14 nt, Human
uggcugugucuccc

SEQ ID NO: 1835237 - RNA, 13 nt, Human
uggcuguuggcug

SEQ ID NO: 1835238 - RNA, 15 nt, Human
uggcuguuggcuggg

SEQ ID NO: 1835239 - RNA, 17 nt, Human
uggcuuaaaacaacacu

SEQ ID NO: 1835240 - RNA, 11 nt, Human
uggcugcugaa

SEQ ID NO: 1835241 - RNA, 20 nt, Human
uggcugccaaugggagcuca

SEQ ID NO: 1835242 - RNA, 18 nt, Human
uggcugccaaugggagcu

SEQ ID NO: 1835243 - RNA, 15 nt, Human
uggcugcagggaguc

SEQ ID NO: 1835244 - RNA, 13 nt, Human
uggcugcagggag

SEQ ID NO: 1835245 - RNA, 14 nt, Human
uggcugcagggagu

SEQ ID NO: 1835246 - RNA, 12 nt, Human
uggcugcaaagg

SEQ ID NO: 1835247 - RNA, 21 nt, Human
uggcucuuccaggcugggaga

SEQ ID NO: 1835248 - RNA, 20 nt, Human
uggcucuuccaggcugggag

SEQ ID NO: 1835249 - RNA, 19 nt, Human
uggcucuuccaggcuggga

SEQ ID NO: 1835250 - RNA, 18 nt, Human
uggcucaaguccucuuuu

SEQ ID NO: 1835251 - RNA, 15 nt, Human
uggcuaugcauuuga

SEQ ID NO: 1835252 - RNA, 17 nt, Human
uggcuaugcauuugaaa

SEQ ID NO: 1835253 - RNA, 14 nt, Human
uggcuaugcauuug

SEQ ID NO: 1835254 - RNA, 19 nt, Human
uggcuaugcauuugaaaau

SEQ ID NO: 1835255 - RNA, 22 nt, Human
uggcuauuagagaucaaccccu

SEQ ID NO: 1835256 - RNA, 14 nt, Human
aggcugggagagcc

SEQ ID NO: 1835257 - RNA, 22 nt, Human
uggcuagagguucaaagauauu

SEQ ID NO: 1835258 - RNA, 18 nt, Human
aggcuggcgugcaguggu

SEQ ID NO: 1835259 - RNA, 20 nt, Human
aggcuggcgugcaguggugc

SEQ ID NO: 1835260 - RNA, 11 nt, Human
uucuucucccu

SEQ ID NO: 1835261 - RNA, 22 nt, Human
uucuucuccacuuucuagccag

SEQ ID NO: 1835262 - RNA, 17 nt, Human
uucuuucuggcuaugca

SEQ ID NO: 1835263 - RNA, 20 nt, Human
uucuuucuggcuaugcauuu

SEQ ID NO: 1835264 - RNA, 12 nt, Human
uucuuucuggcu

SEQ ID NO: 1835265 - RNA, 13 nt, Human
uucuguuuagaua

SEQ ID NO: 1835266 - RNA, 18 nt, Human
uucuguuuagauaauaca

SEQ ID NO: 1835267 - RNA, 23 nt, Human
uucuuaaccagaucauugugaaa

SEQ ID NO: 1835268 - RNA, 22 nt, Human
uucuuaaccagaucauugugaa

SEQ ID NO: 1835269 - RNA, 11 nt, Human
aucccagcccc

SEQ ID NO: 1835270 - RNA, 12 nt, Human
aucccagcccca

SEQ ID NO: 1835271 - RNA, 16 nt, Human
aucccaugagccucag

SEQ ID NO: 1835272 - RNA, 17 nt, Human
aucccugaaggccccgc

SEQ ID NO: 1835273 - RNA, 22 nt, Human
aucccugaaggccccgcccagg

SEQ ID NO: 1835274 - RNA, 17 nt, Human
aucccaugagccucagc

SEQ ID NO: 1835275 - RNA, 18 nt, Human
aucccaugagccucagca

SEQ ID NO: 1835276 - RNA, 14 nt, Human
auccaguaucuuga

SEQ ID NO: 1835277 - RNA, 15 nt, Human
auccaguaucuugaa

SEQ ID NO: 1835278 - RNA, 13 nt, Human
auccaauuggaua

SEQ ID NO: 1835279 - RNA, 17 nt, Human
auccagguucagcuugu

SEQ ID NO: 1835280 - RNA, 15 nt, Human
uucugccugcccagg

SEQ ID NO: 1835281 - RNA, 16 nt, Human
uucugccugcccaggc

SEQ ID NO: 1835282 - RNA, 16 nt, Human
auccaagcaaauguga

SEQ ID NO: 1835283 - RNA, 19 nt, Human
aucauugugaaauuauuca

SEQ ID NO: 1835284 - RNA, 15 nt, Human
aucauugugaaauua

SEQ ID NO: 1835285 - RNA, 13 nt, Human
aucauugugaaau

SEQ ID NO: 1835286 - RNA, 13 nt, Human
aucauugaaaucu

SEQ ID NO: 1835287 - RNA, 12 nt, Human
aucauugaaauc

SEQ ID NO: 1835288 - RNA, 22 nt, Human
uucuccuuucacaaccuucugu

SEQ ID NO: 1835289 - RNA, 18 nt, Human
uucuccuuucacaaccuu

SEQ ID NO: 1835290 - RNA, 21 nt, Human
uucucuaguuugauuaaauuc

SEQ ID NO: 1835291 - RNA, 17 nt, Human
aucaggugcugccaucc

SEQ ID NO: 1835292 - RNA, 19 nt, Human
aucaggugcugccauccag

SEQ ID NO: 1835293 - RNA, 23 nt, Human
aucacuugaacccgggaggcaga

SEQ ID NO: 1835294 - RNA, 15 nt, Human
aucaggugcugccau

SEQ ID NO: 1835295 - RNA, 15 nt, Human
aucagugcccuccag

SEQ ID NO: 1835296 - RNA, 13 nt, Human
aucagugcccucc

SEQ ID NO: 1835297 - RNA, 17 nt, Human
aucagugcccuccagga

SEQ ID NO: 1835298 - RNA, 19 nt, Human
aucagucugauucccaagc

SEQ ID NO: 1835299 - RNA, 15 nt, Human
aucauaaaacuugau

SEQ ID NO: 1835300 - RNA, 16 nt, Human
aucauuaggugugacu

SEQ ID NO: 1835301 - RNA, 21 nt, Human
aucauccacugugccaugugc

SEQ ID NO: 1835302 - RNA, 23 nt, Human
aucauccacugugccaugugcca

SEQ ID NO: 1835303 - RNA, 24 nt, Human
uugaccauucuccaccugccaggg

SEQ ID NO: 1835304 - RNA, 19 nt, Human
uugacacuuaaaaaugguu

SEQ ID NO: 1835305 - RNA, 19 nt, Human
uugacagggcacaccgggc

SEQ ID NO: 1835306 - RNA, 13 nt, Human
uugacaucaacug

SEQ ID NO: 1835307 - RNA, 19 nt, Human
uugaccauucuccaccugc

SEQ ID NO: 1835308 - RNA, 18 nt, Human
uugaccauucuccaccug

SEQ ID NO: 1835309 - RNA, 16 nt, Human
uugaggucuguucuuu

SEQ ID NO: 1835310 - RNA, 15 nt, Human
uugaggucuguucuu

SEQ ID NO: 1835311 - RNA, 12 nt, Human
uugauaaaguaa

SEQ ID NO: 1835312 - RNA, 18 nt, Human
aucgucacugcuuaacuu

SEQ ID NO: 1835313 - RNA, 14 nt, Human
aucgucacugcuua

SEQ ID NO: 1835314 - RNA, 14 nt, Human
aucgugacaacacu

SEQ ID NO: 1835315 - RNA, 15 nt, Human
aucgugacaacacuu

SEQ ID NO: 1835316 - RNA, 19 nt, Human
aucuaaauggaaccacucu

SEQ ID NO: 1835317 - RNA, 15 nt, Human
aucuaaacugccccc

SEQ ID NO: 1835318 - RNA, 15 nt, Human
aucuaaauguugaaa

SEQ ID NO: 1835319 - RNA, 17 nt, Human
uugacacuuaaaaaugg

SEQ ID NO: 1835320 - RNA, 16 nt, Human
auccugcaauuccacu

SEQ ID NO: 1835321 - RNA, 22 nt, Human
auccugaggcuccacuuggucu

SEQ ID NO: 1835322 - RNA, 13 nt, Human
auccugccccuga

SEQ ID NO: 1835323 - RNA, 11 nt, Human
auccugaggcu

SEQ ID NO: 1835324 - RNA, 13 nt, Human
auccugaggcucc

SEQ ID NO: 1835325 - RNA, 16 nt, Human
auccugaggcuccacu

SEQ ID NO: 1835326 - RNA, 18 nt, Human
auccugaggcuccacuug

SEQ ID NO: 1835327 - RNA, 21 nt, Human
auccugagccagauuucacuc

SEQ ID NO: 1835328 - RNA, 17 nt, Human
auccugagccagauuuc

SEQ ID NO: 1835329 - RNA, 15 nt, Human
auccugagccagauu

SEQ ID NO: 1835330 - RNA, 14 nt, Human
auccugagccagau

SEQ ID NO: 1835331 - RNA, 13 nt, Human
auccugagccaga

SEQ ID NO: 1835332 - RNA, 12 nt, Human
auccugagccag

SEQ ID NO: 1835333 - RNA, 11 nt, Human
auccugagcca

SEQ ID NO: 1835334 - RNA, 17 nt, Human
auccucuuugagugaag

SEQ ID NO: 1835335 - RNA, 20 nt, Human
uucuuuugccguuauuaaaa

SEQ ID NO: 1835336 - RNA, 20 nt, Human
auccucuguacagagcccac

SEQ ID NO: 1835337 - RNA, 18 nt, Human
auccucuguacagagccc

SEQ ID NO: 1835338 - RNA, 15 nt, Human
auccuggaguucugg

SEQ ID NO: 1835339 - RNA, 19 nt, Human
auccugcuucugauaugca

SEQ ID NO: 1835340 - RNA, 21 nt, Human
auccugcuucugauaugcagu

SEQ ID NO: 1835341 - RNA, 17 nt, Human
auccuggcacccggccc

SEQ ID NO: 1835342 - RNA, 19 nt, Human
auccuggcacccggccccu

SEQ ID NO: 1835343 - RNA, 20 nt, Human
auccuggcacccggccccug

SEQ ID NO: 1835344 - RNA, 21 nt, Human
auccuggcacccggccccugc

SEQ ID NO: 1835345 - RNA, 22 nt, Human
auccuggcacccggccccugcu

SEQ ID NO: 1835346 - RNA, 23 nt, Human
auccuggcacccggccccugcug

SEQ ID NO: 1835347 - RNA, 20 nt, Human
auccuggcugucgagaaaca

SEQ ID NO: 1835348 - RNA, 17 nt, Human
aucguaaaauuaagaaa

SEQ ID NO: 1835349 - RNA, 14 nt, Human
aucguaaaauuaag

SEQ ID NO: 1835350 - RNA, 13 nt, Human
aucguaaaauuaa

SEQ ID NO: 1835351 - RNA, 12 nt, Human
aucguaaaauua

SEQ ID NO: 1835352 - RNA, 17 nt, Human
auauuaccacagacaua

SEQ ID NO: 1835353 - RNA, 22 nt, Human
auauuaagaaagacuaucuaaa

SEQ ID NO: 1835354 - RNA, 17 nt, Human
auauuaagaaagacuau

SEQ ID NO: 1835355 - RNA, 15 nt, Human
auauuaagaaagacu

SEQ ID NO: 1835356 - RNA, 16 nt, Human
auauuaagaaagacua

SEQ ID NO: 1835357 - RNA, 16 nt, Human
uuccagugaggcucug

SEQ ID NO: 1835358 - RNA, 15 nt, Human
uuccagugaggcucu

SEQ ID NO: 1835359 - RNA, 22 nt, Human
uuccagugaaaucaguuacucu

SEQ ID NO: 1835360 - RNA, 16 nt, Human
auauguucugacauaa

SEQ ID NO: 1835361 - RNA, 22 nt, Human
auauugcugauggugcaaugac

SEQ ID NO: 1835362 - RNA, 12 nt, Human
auauuguacagu

SEQ ID NO: 1835363 - RNA, 19 nt, Human
auauuaccacagacauacu

SEQ ID NO: 1835364 - RNA, 21 nt, Human
auauuccugcauuugugaaau

SEQ ID NO: 1835365 - RNA, 15 nt, Human
auauugauaugcuua

SEQ ID NO: 1835366 - RNA, 17 nt, Human
auauuguuuucagugua

SEQ ID NO: 1835367 - RNA, 13 nt, Human
auauuguuuucag

SEQ ID NO: 1835368 - RNA, 13 nt, Human
auauuguacaguu

SEQ ID NO: 1835369 - RNA, 14 nt, Human
auauuguacaguuu

SEQ ID NO: 1835370 - RNA, 13 nt, Human
auauuuacaaaug

SEQ ID NO: 1835371 - RNA, 21 nt, Human
aucaacugcaucaagauguga

SEQ ID NO: 1835372 - RNA, 15 nt, Human
aucacgccacugcac

SEQ ID NO: 1835373 - RNA, 17 nt, Human
aucacgccacugcacua

SEQ ID NO: 1835374 - RNA, 13 nt, Human
aucaauuuaaaaa

SEQ ID NO: 1835375 - RNA, 16 nt, Human
aucaauucauaucuau

SEQ ID NO: 1835376 - RNA, 21 nt, Human
uuccuaaauauauuuuaagac

SEQ ID NO: 1835377 - RNA, 18 nt, Human
uuccucuccacugccuuc

SEQ ID NO: 1835378 - RNA, 16 nt, Human
uuccucuccacugccu

SEQ ID NO: 1835379 - RNA, 19 nt, Human
uuccucuccacugccuucg

SEQ ID NO: 1835380 - RNA, 13 nt, Human
uuccucugagccu

SEQ ID NO: 1835381 - RNA, 19 nt, Human
uuccuggcacugcuuccag

SEQ ID NO: 1835382 - RNA, 22 nt, Human
uuccucuuuuuauuuaguuccu

SEQ ID NO: 1835383 - RNA, 22 nt, Human
uuccuggcacugcuuccaguga

SEQ ID NO: 1835384 - RNA, 20 nt, Human
uuccuggcacugcuuccagu

SEQ ID NO: 1835385 - RNA, 12 nt, Human
uucccgcucagc

SEQ ID NO: 1835386 - RNA, 15 nt, Human
uucccgcucagcccu

SEQ ID NO: 1835387 - RNA, 14 nt, Human
uucccgcucagccc

SEQ ID NO: 1835388 - RNA, 13 nt, Human
uucccuacuuccu

SEQ ID NO: 1835389 - RNA, 15 nt, Human
uucccuuuuuuuaag

SEQ ID NO: 1835390 - RNA, 23 nt, Human
auauguaccuaacgaaguauccu

SEQ ID NO: 1835391 - RNA, 21 nt, Human
auauguggaguucaucuugaa

SEQ ID NO: 1835392 - RNA, 20 nt, Human
auauguggaguucaucuuga

SEQ ID NO: 1835393 - RNA, 17 nt, Human
uuccagguuuaagcugu

SEQ ID NO: 1835394 - RNA, 18 nt, Human
uuccagguuuaagcuguu

SEQ ID NO: 1835395 - RNA, 17 nt, Human
uuccaggcugggagagc

SEQ ID NO: 1835396 - RNA, 15 nt, Human
uuccaggcugggaga

SEQ ID NO: 1835397 - RNA, 13 nt, Human
uuccaggcuggga

SEQ ID NO: 1835398 - RNA, 18 nt, Human
uuccaccaucaagccacc

SEQ ID NO: 1835399 - RNA, 15 nt, Human
uuccaccuucccaug

SEQ ID NO: 1835400 - RNA, 21 nt, Human
uuccacaagagcccaggccuc

SEQ ID NO: 1835401 - RNA, 22 nt, Human
uuccaauuuacauacucugcuu

SEQ ID NO: 1835402 - RNA, 14 nt, Human
uucaggguuggccc

SEQ ID NO: 1835403 - RNA, 16 nt, Human
uucaggguuggccccu

SEQ ID NO: 1835404 - RNA, 17 nt, Human
uucaggguuggccccug

SEQ ID NO: 1835405 - RNA, 19 nt, Human
uucaggguuggccccugcc

SEQ ID NO: 1835406 - RNA, 22 nt, Human
uucaggguuggccccugcccgg

SEQ ID NO: 1835407 - RNA, 15 nt, Human
uucagguaacaggca

SEQ ID NO: 1835408 - RNA, 16 nt, Human
uucagguaacaggcag

SEQ ID NO: 1835409 - RNA, 14 nt, Human
uucagccaagaauu

SEQ ID NO: 1835410 - RNA, 20 nt, Human
uucagccugccuucuuuucu

SEQ ID NO: 1835411 - RNA, 15 nt, Human
uucagccugccuucu

SEQ ID NO: 1835412 - RNA, 22 nt, Human
uucagauauaaaagacugacca

SEQ ID NO: 1835413 - RNA, 16 nt, Human
uucagaaauguguuau

SEQ ID NO: 1835414 - RNA, 15 nt, Human
auauauuuuaagacg

SEQ ID NO: 1835415 - RNA, 21 nt, Human
auauauguuuuaagaggcagg

SEQ ID NO: 1835416 - RNA, 22 nt, Human
auauauguuuuaagaggcaggg

SEQ ID NO: 1835417 - RNA, 15 nt, Human
uucaucaaugaauga

SEQ ID NO: 1835418 - RNA, 13 nt, Human
auauaugcuaagu

SEQ ID NO: 1835419 - RNA, 17 nt, Human
uucagguaacaggcaga

SEQ ID NO: 1835420 - RNA, 14 nt, Human
uucaguaagccgug

SEQ ID NO: 1835421 - RNA, 20 nt, Human
uucauaucuauuuauuaaau

SEQ ID NO: 1835422 - RNA, 14 nt, Human
uuucacucuccuug

SEQ ID NO: 1835423 - RNA, 17 nt, Human
uuuauuuuuuucugaau

SEQ ID NO: 1835424 - RNA, 16 nt, Human
uuuauuuuuugggaaa

SEQ ID NO: 1835425 - RNA, 12 nt, Human
uuucauaaagca

SEQ ID NO: 1835426 - RNA, 15 nt, Human
uuucaguuuucagga

SEQ ID NO: 1835427 - RNA, 24 nt, Human
uuucacugcuggcugccuuagaac

SEQ ID NO: 1835428 - RNA, 15 nt, Human
uuucacucuccuugg

SEQ ID NO: 1835429 - RNA, 24 nt, Human
uuucacucuuauugcccacgcugg

SEQ ID NO: 1835430 - RNA, 19 nt, Human
uuuccagguuuaagcuguu

SEQ ID NO: 1835431 - RNA, 14 nt, Human
augcuguauauguu

SEQ ID NO: 1835432 - RNA, 19 nt, Human
augcugugcccuaaagugu

SEQ ID NO: 1835433 - RNA, 22 nt, Human
augcuggcuguuggcugggggc

SEQ ID NO: 1835434 - RNA, 13 nt, Human
uuuauuuuuuggg

SEQ ID NO: 1835435 - RNA, 15 nt, Human
auggaauaacaugua

SEQ ID NO: 1835436 - RNA, 14 nt, Human
auggaauaacaugu

SEQ ID NO: 1835437 - RNA, 21 nt, Human
auggaaguacuauaauuuacc

SEQ ID NO: 1835438 - RNA, 17 nt, Human
auggaacacucugagac

SEQ ID NO: 1835439 - RNA, 18 nt, Human
auggaacacucugagacu

SEQ ID NO: 1835440 - RNA, 21 nt, Human
uuuaaagaaaaguuuuguaaa

SEQ ID NO: 1835441 - RNA, 13 nt, Human
uuuaaagaaaagu

SEQ ID NO: 1835442 - RNA, 15 nt, Human
uuuaaagaaaaguuu

SEQ ID NO: 1835443 - RNA, 17 nt, Human
uuuaaagaaaaguuuug

SEQ ID NO: 1835444 - RNA, 23 nt, Human
augcgcaggcuggcccugcccug

SEQ ID NO: 1835445 - RNA, 13 nt, Human
augcuaagugaaa

SEQ ID NO: 1835446 - RNA, 21 nt, Human
uuuaccuuuuuuauacauaaa

SEQ ID NO: 1835447 - RNA, 14 nt, Human
uuuacuaauagaca

SEQ ID NO: 1835448 - RNA, 17 nt, Human
uuuacuaauagacaauu

SEQ ID NO: 1835449 - RNA, 18 nt, Human
uuuacuaauagacaauuu

SEQ ID NO: 1835450 - RNA, 14 nt, Human
uuuaccuuuuuuau

SEQ ID NO: 1835451 - RNA, 19 nt, Human
uuuaccuuuuuuauacaua

SEQ ID NO: 1835452 - RNA, 20 nt, Human
uuuaccuuuuuuauacauaa

SEQ ID NO: 1835453 - RNA, 17 nt, Human
augcuacacacugcaug

SEQ ID NO: 1835454 - RNA, 18 nt, Human
augcuacacacugcaugu

SEQ ID NO: 1835455 - RNA, 15 nt, Human
uuuaugugaaacaug

SEQ ID NO: 1835456 - RNA, 14 nt, Human
uuuaugugaaacau

SEQ ID NO: 1835457 - RNA, 19 nt, Human
uuuauuaaaugcccagccc

SEQ ID NO: 1835458 - RNA, 19 nt, Human
uuuauuaaauguagaaagu

SEQ ID NO: 1835459 - RNA, 15 nt, Human
uuuagauaauacacc

SEQ ID NO: 1835460 - RNA, 18 nt, Human
uuuagaguugauacuaca

SEQ ID NO: 1835461 - RNA, 13 nt, Human
uuuagauaauaca

SEQ ID NO: 1835462 - RNA, 15 nt, Human
uuuccuucagugccu

SEQ ID NO: 1835463 - RNA, 12 nt, Human
uuuccuucagug

SEQ ID NO: 1835464 - RNA, 11 nt, Human
uuuccuucagu

SEQ ID NO: 1835465 - RNA, 19 nt, Human
uuuccuuaaauuaucuaaa

SEQ ID NO: 1835466 - RNA, 17 nt, Human
augggccuccugugugu

SEQ ID NO: 1835467 - RNA, 12 nt, Human
uuuccugugucu

SEQ ID NO: 1835468 - RNA, 21 nt, Human
uuuccuucauucaacccaccu

SEQ ID NO: 1835469 - RNA, 22 nt, Human
uuuccuucagugccuuauggaa

SEQ ID NO: 1835470 - RNA, 21 nt, Human
uuuccuucagugccuuaugga

SEQ ID NO: 1835471 - RNA, 18 nt, Human
uuuccuucagugccuuau

SEQ ID NO: 1835472 - RNA, 23 nt, Human
uuuccuucauucaacccaccugc

SEQ ID NO: 1835473 - RNA, 21 nt, Human
uuuccuuuuaaaacacuucca

SEQ ID NO: 1835474 - RNA, 22 nt, Human
uuucgcaggauucuuccucccu

SEQ ID NO: 1835475 - RNA, 18 nt, Human
uuucgcaggauucuuccu

SEQ ID NO: 1835476 - RNA, 18 nt, Human
auggccucuucagaucuc

SEQ ID NO: 1835477 - RNA, 21 nt, Human
auggacccaauauuuaccaga

SEQ ID NO: 1835478 - RNA, 15 nt, Human
augggacuggccucu

SEQ ID NO: 1835479 - RNA, 13 nt, Human
augggagcucaug

SEQ ID NO: 1835480 - RNA, 19 nt, Human
augggcaacccccagccug

SEQ ID NO: 1835481 - RNA, 21 nt, Human
augggcaacccccagccugcu

SEQ ID NO: 1835482 - RNA, 14 nt, Human
augggcagagcaga

SEQ ID NO: 1835483 - RNA, 13 nt, Human
augggcagagcag

SEQ ID NO: 1835484 - RNA, 15 nt, Human
augggcagagcagag

SEQ ID NO: 1835485 - RNA, 15 nt, Human
augggccuccugugu

SEQ ID NO: 1835486 - RNA, 23 nt, Human
augggcuggguucuacccaggug

SEQ ID NO: 1835487 - RNA, 13 nt, Human
auggggcccugcc

SEQ ID NO: 1835488 - RNA, 14 nt, Human
auggggcccugccu

SEQ ID NO: 1835489 - RNA, 19 nt, Human
uuugaaacacuuugcauaa

SEQ ID NO: 1835490 - RNA, 17 nt, Human
uuugaaacacuuugcau

SEQ ID NO: 1835491 - RNA, 21 nt, Human
uuucuuuaguuuuugugaagu

SEQ ID NO: 1835492 - RNA, 13 nt, Human
uuucuuuguggcu

SEQ ID NO: 1835493 - RNA, 15 nt, Human
uuucuaugacacaug

SEQ ID NO: 1835494 - RNA, 21 nt, Human
uuucuaugacacaugcaaggu

SEQ ID NO: 1835495 - RNA, 14 nt, Human
uuucucaaagaaau

SEQ ID NO: 1835496 - RNA, 15 nt, Human
uuucucaaagaaauu

SEQ ID NO: 1835497 - RNA, 16 nt, Human
uuucucaaagaaauuu

SEQ ID NO: 1835498 - RNA, 16 nt, Human
uuucugccgcagcccu

SEQ ID NO: 1835499 - RNA, 14 nt, Human
uuucugccgcagcc

SEQ ID NO: 1835500 - RNA, 22 nt, Human
uuucucauuugccaauaauaau

SEQ ID NO: 1835501 - RNA, 21 nt, Human
augagcaucaggccaggcccu

SEQ ID NO: 1835502 - RNA, 20 nt, Human
augagcaucaggccaggccc

SEQ ID NO: 1835503 - RNA, 19 nt, Human
augagcaucaggccaggcc

SEQ ID NO: 1835504 - RNA, 18 nt, Human
augagcaucaggccaggc

SEQ ID NO: 1835505 - RNA, 17 nt, Human
augagcaucaggccagg

SEQ ID NO: 1835506 - RNA, 16 nt, Human
augagcaucaggccag

SEQ ID NO: 1835507 - RNA, 15 nt, Human
augagcaucaggcca

SEQ ID NO: 1835508 - RNA, 22 nt, Human
augagcaucaggccaggcccuc

SEQ ID NO: 1835509 - RNA, 18 nt, Human
augagccaccgcgcccag

SEQ ID NO: 1835510 - RNA, 21 nt, Human
augagccaccgcgcccagccu

SEQ ID NO: 1835511 - RNA, 12 nt, Human
augagccucagc

SEQ ID NO: 1835512 - RNA, 15 nt, Human
augagccucagcauc

SEQ ID NO: 1835513 - RNA, 16 nt, Human
augagccucagcaucc

SEQ ID NO: 1835514 - RNA, 15 nt, Human
augagaggaaaucac

SEQ ID NO: 1835515 - RNA, 14 nt, Human
augagaggaaauca

SEQ ID NO: 1835516 - RNA, 16 nt, Human
augagaggaaaucacc

SEQ ID NO: 1835517 - RNA, 13 nt, Human
augagaggaaauc

SEQ ID NO: 1835518 - RNA, 12 nt, Human
augagaggaaau

SEQ ID NO: 1835519 - RNA, 17 nt, Human
augagccucagcauccu

SEQ ID NO: 1835520 - RNA, 18 nt, Human
augagccucagcauccug

SEQ ID NO: 1835521 - RNA, 15 nt, Human
augauaaaacacaaa

SEQ ID NO: 1835522 - RNA, 18 nt, Human
uugucacacacuuuggcu

SEQ ID NO: 1835523 - RNA, 13 nt, Human
uugugaaauuauu

SEQ ID NO: 1835524 - RNA, 22 nt, Human
augcaaaccaucauugaaaucu

SEQ ID NO: 1835525 - RNA, 21 nt, Human
augcaaaccaucauugaaauc

SEQ ID NO: 1835526 - RNA, 20 nt, Human
augcaaaccaucauugaaau

SEQ ID NO: 1835527 - RNA, 19 nt, Human
augcaaaccaucauugaaa

SEQ ID NO: 1835528 - RNA, 18 nt, Human
augcaaaccaucauugaa

SEQ ID NO: 1835529 - RNA, 16 nt, Human
augcaaaccaucauug

SEQ ID NO: 1835530 - RNA, 18 nt, Human
augaucuucuuuauaauu

SEQ ID NO: 1835531 - RNA, 15 nt, Human
augaucuucuuuaua

SEQ ID NO: 1835532 - RNA, 14 nt, Human
augcaaggucauuu

SEQ ID NO: 1835533 - RNA, 16 nt, Human
augcaaggucauuuuu

SEQ ID NO: 1835534 - RNA, 22 nt, Human
augcaaacuuuauuuuguguuu

SEQ ID NO: 1835535 - RNA, 16 nt, Human
augcaccuggaauaua

SEQ ID NO: 1835536 - RNA, 14 nt, Human
augcaccuggaaua

SEQ ID NO: 1835537 - RNA, 22 nt, Human
augcaaggucauuuuuuuuaag

SEQ ID NO: 1835538 - RNA, 19 nt, Human
uuguuuuuuuuuuccacuu

SEQ ID NO: 1835539 - RNA, 17 nt, Human
uuuaaaaaauuaaucug

SEQ ID NO: 1835540 - RNA, 19 nt, Human
augcaccuggaauauauaa

SEQ ID NO: 1835541 - RNA, 18 nt, Human
uuguuuuuuuuuuccacu

SEQ ID NO: 1835542 - RNA, 18 nt, Human
uugugaagguggaaauaa

SEQ ID NO: 1835543 - RNA, 17 nt, Human
uugugaagguggaaaua

SEQ ID NO: 1835544 - RNA, 14 nt, Human
augaucuucuuuau

SEQ ID NO: 1835545 - RNA, 15 nt, Human
augauccuaaugaau

SEQ ID NO: 1835546 - RNA, 15 nt, Human
augaucuaggaagac

SEQ ID NO: 1835547 - RNA, 16 nt, Human
augauccuaggcauuu

SEQ ID NO: 1835548 - RNA, 23 nt, Human
augaucacggcucacugcagccu

SEQ ID NO: 1835549 - RNA, 18 nt, Human
augaucacggcucacugc

SEQ ID NO: 1835550 - RNA, 19 nt, Human
augaucacggcucacugca

SEQ ID NO: 1835551 - RNA, 15 nt, Human
augaucacggcucac

SEQ ID NO: 1835552 - RNA, 19 nt, Human
uuggggaagaacgaagcca

SEQ ID NO: 1835553 - RNA, 17 nt, Human
uugggguacccacugcu

SEQ ID NO: 1835554 - RNA, 20 nt, Human
augaaccacaucuugcucug

SEQ ID NO: 1835555 - RNA, 13 nt, Human
augaaccacaucu

SEQ ID NO: 1835556 - RNA, 14 nt, Human
uuguaaggaaugau

SEQ ID NO: 1835557 - RNA, 22 nt, Human
uuguaagcaugcacaaauucug

SEQ ID NO: 1835558 - RNA, 19 nt, Human
uugguuaggcauuguggga

SEQ ID NO: 1835559 - RNA, 22 nt, Human
uugggguacccacugcucuggu

SEQ ID NO: 1835560 - RNA, 20 nt, Human
uuguaaggaaugauuaauua

SEQ ID NO: 1835561 - RNA, 13 nt, Human
uuguaaugaaaac

SEQ ID NO: 1835562 - RNA, 19 nt, Human
augacacgaauauugcuga

SEQ ID NO: 1835563 - RNA, 20 nt, Human
augacacgaauauugcugau

SEQ ID NO: 1835564 - RNA, 23 nt, Human
uuggaaagaguaggaagacuuug

SEQ ID NO: 1835565 - RNA, 18 nt, Human
uuggaaagaguaggaaga

SEQ ID NO: 1835566 - RNA, 21 nt, Human
uuggcuagagguucaaagaua

SEQ ID NO: 1835567 - RNA, 22 nt, Human
uuggcuagagguucaaagauau

SEQ ID NO: 1835568 - RNA, 22 nt, Human
uuggcuaggaccccuccaugug

SEQ ID NO: 1835569 - RNA, 15 nt, Human
uuggcugcugaaggc

SEQ ID NO: 1835570 - RNA, 11 nt, Human
uuggcugcuga

SEQ ID NO: 1835571 - RNA, 23 nt, Human
uuggcuauuagagaucaaccccu

SEQ ID NO: 1835572 - RNA, 14 nt, Human
uuggcugcagggag

SEQ ID NO: 1835573 - RNA, 13 nt, Human
aucuuucugcaga

SEQ ID NO: 1835574 - RNA, 22 nt, Human
uuggcgcugccccuggcagccc

SEQ ID NO: 1835575 - RNA, 20 nt, Human
augaaagacuguacaaagua

SEQ ID NO: 1835576 - RNA, 23 nt, Human
augaaagauggcugugccucugc

SEQ ID NO: 1835577 - RNA, 20 nt, Human
augaaagauggcugugccuc

SEQ ID NO: 1835578 - RNA, 19 nt, Human
augaaagauggcugugccu

SEQ ID NO: 1835579 - RNA, 14 nt, Human
augaaaugagguca

SEQ ID NO: 1835580 - RNA, 20 nt, Human
uugcuaagugaggaugaaaa

SEQ ID NO: 1835581 - RNA, 19 nt, Human
uugcugaauacagaggcaa

SEQ ID NO: 1835582 - RNA, 16 nt, Human
uugcuuuuaaaaucca

SEQ ID NO: 1835583 - RNA, 17 nt, Human
uuggaaagaguaggaag

SEQ ID NO: 1835584 - RNA, 19 nt, Human
uugcugauggugcaaugac

SEQ ID NO: 1835585 - RNA, 18 nt, Human
uugcugauggugcaauga

SEQ ID NO: 1835586 - RNA, 17 nt, Human
uugcugauggugcaaug

SEQ ID NO: 1835587 - RNA, 14 nt, Human
auuugugauacaau

SEQ ID NO: 1835588 - RNA, 23 nt, Human
auuugugaagguggaaauaaacu

SEQ ID NO: 1835589 - RNA, 15 nt, Human
auuuuaauucaguug

SEQ ID NO: 1835590 - RNA, 17 nt, Human
auuuuaccuuugacaaa

SEQ ID NO: 1835591 - RNA, 17 nt, Human
auuuuacuuuuuccugg

SEQ ID NO: 1835592 - RNA, 16 nt, Human
auuuuacuuuuuccug

SEQ ID NO: 1835593 - RNA, 22 nt, Human
auuuucaguuauuauauuuaca

SEQ ID NO: 1835594 - RNA, 20 nt, Human
auuuucaacgcagcccugcu

SEQ ID NO: 1835595 - RNA, 18 nt, Human
auuuucaacgcagcccug

SEQ ID NO: 1835596 - RNA, 21 nt, Human
auuuuauuuuuuucugaauua

SEQ ID NO: 1835597 - RNA, 18 nt, Human
auugacccacaagaaaug

SEQ ID NO: 1835598 - RNA, 18 nt, Human
auucuuauuuaaugaaag

SEQ ID NO: 1835599 - RNA, 14 nt, Human
auucuuauuuaaug

SEQ ID NO: 1835600 - RNA, 13 nt, Human
auucuuauuuaau

SEQ ID NO: 1835601 - RNA, 13 nt, Human
auucuucuccacu

SEQ ID NO: 1835602 - RNA, 22 nt, Human
auucuuccucccucccucuuuc

SEQ ID NO: 1835603 - RNA, 24 nt, Human
auucugucucuggauuauauuaug

SEQ ID NO: 1835604 - RNA, 17 nt, Human
auucuccuuguguuacu

SEQ ID NO: 1835605 - RNA, 20 nt, Human
auuguccccgacccuugccg

SEQ ID NO: 1835606 - RNA, 19 nt, Human
auuguccccgacccuugcc

SEQ ID NO: 1835607 - RNA, 17 nt, Human
auuguccccgacccuug

SEQ ID NO: 1835608 - RNA, 13 nt, Human
auuguauucagag

SEQ ID NO: 1835609 - RNA, 14 nt, Human
auugugucucuugg

SEQ ID NO: 1835610 - RNA, 18 nt, Human
auugugucucuugguccu

SEQ ID NO: 1835611 - RNA, 14 nt, Human
auuuauucugcuca

SEQ ID NO: 1835612 - RNA, 15 nt, Human
auuuagaaauauaau

SEQ ID NO: 1835613 - RNA, 16 nt, Human
auuuacuucuuauaca

SEQ ID NO: 1835614 - RNA, 14 nt, Human
auuuacuucuuaua

SEQ ID NO: 1835615 - RNA, 17 nt, Human
auuuacuucuuauacau

SEQ ID NO: 1835616 - RNA, 14 nt, Human
auuuaacagaaaug

SEQ ID NO: 1835617 - RNA, 12 nt, Human
auuuaacagaaa

SEQ ID NO: 1835618 - RNA, 20 nt, Human
auuuaguaucuuuuuauuca

SEQ ID NO: 1835619 - RNA, 13 nt, Human
auuuaguguucau

SEQ ID NO: 1835620 - RNA, 22 nt, Human
auuuauaaaaauaaaaaacacu

SEQ ID NO: 1835621 - RNA, 17 nt, Human
auuuauaaaaauaaaaa

SEQ ID NO: 1835622 - RNA, 13 nt, Human
auuuauucugcuc

SEQ ID NO: 1835623 - RNA, 15 nt, Human
auuuccguuaaaaua

SEQ ID NO: 1835624 - RNA, 16 nt, Human
auuuccguuaaaauac

SEQ ID NO: 1835625 - RNA, 15 nt, Human
auuugaaaauuuuga

SEQ ID NO: 1835626 - RNA, 14 nt, Human
auuugaaaauuuug

SEQ ID NO: 1835627 - RNA, 16 nt, Human
auuucaaacggccuca

SEQ ID NO: 1835628 - RNA, 17 nt, Human
auuuccagccaaagccu

SEQ ID NO: 1835629 - RNA, 22 nt, Human
auuucauuugugccagaaugcu

SEQ ID NO: 1835630 - RNA, 20 nt, Human
auuuccagugaaaucaguua

SEQ ID NO: 1835631 - RNA, 12 nt, Human
auugaaaucuuu

SEQ ID NO: 1835632 - RNA, 20 nt, Human
auucuccaccugccagggac

SEQ ID NO: 1835633 - RNA, 19 nt, Human
auucuccaccugccaggga

SEQ ID NO: 1835634 - RNA, 15 nt, Human
auucucaugccucag

SEQ ID NO: 1835635 - RNA, 14 nt, Human
auucucaugccuca

SEQ ID NO: 1835636 - RNA, 16 nt, Human
auucuccuuguguuac

SEQ ID NO: 1835637 - RNA, 18 nt, Human
auucuccugccucagccu

SEQ ID NO: 1835638 - RNA, 20 nt, Human
auucuccugccucagccucc

SEQ ID NO: 1835639 - RNA, 19 nt, Human
auucuccugccucagccuc

SEQ ID NO: 1835640 - RNA, 15 nt, Human
auucuccugccucag

SEQ ID NO: 1835641 - RNA, 17 nt, Human
auucuccugccucagcc

SEQ ID NO: 1835642 - RNA, 21 nt, Human
auucuccaccugccagggaca

SEQ ID NO: 1835643 - RNA, 12 nt, Human
auucuccugccu

SEQ ID NO: 1835644 - RNA, 11 nt, Human
auucuccugcc

SEQ ID NO: 1835645 - RNA, 14 nt, Human
auucuccugccuca

SEQ ID NO: 1835646 - RNA, 13 nt, Human
auucuccugccuc

SEQ ID NO: 1835647 - RNA, 14 nt, Human
auucaggaagcuca

SEQ ID NO: 1835648 - RNA, 17 nt, Human
auucagaguugaugguu

SEQ ID NO: 1835649 - RNA, 19 nt, Human
auucaggaagcucagggcc

SEQ ID NO: 1835650 - RNA, 17 nt, Human
auucaggaagcucaggg

SEQ ID NO: 1835651 - RNA, 20 nt, Human
auucaggaagcucagggccu

SEQ ID NO: 1835652 - RNA, 19 nt, Human
auucaguaauaacucuacc

SEQ ID NO: 1835653 - RNA, 15 nt, Human
auucaguaauaacuc

SEQ ID NO: 1835654 - RNA, 16 nt, Human
auucccaagcucugcu

SEQ ID NO: 1835655 - RNA, 14 nt, Human
auucccaagcucug

SEQ ID NO: 1835656 - RNA, 15 nt, Human
auucccaagcucugc

SEQ ID NO: 1835657 - RNA, 20 nt, Human
auguggaguucaucuugaau

SEQ ID NO: 1835658 - RNA, 24 nt, Human
auguggaguucaucuugaauugua

SEQ ID NO: 1835659 - RNA, 23 nt, Human
auguguguuuuaaaaugagaaau

SEQ ID NO: 1835660 - RNA, 12 nt, Human
augugugugugc

SEQ ID NO: 1835661 - RNA, 20 nt, Human
auggggcccugccuccuuug

SEQ ID NO: 1835662 - RNA, 14 nt, Human
uuuuaauaaacacu

SEQ ID NO: 1835663 - RNA, 22 nt, Human
augugccagguuuuuggucuga

SEQ ID NO: 1835664 - RNA, 20 nt, Human
auguugcccuguugcugccu

SEQ ID NO: 1835665 - RNA, 20 nt, Human
auguugcccaggcaggucuu

SEQ ID NO: 1835666 - RNA, 18 nt, Human
auguucaucaaugaauga

SEQ ID NO: 1835667 - RNA, 18 nt, Human
auguugcauagaauaaaa

SEQ ID NO: 1835668 - RNA, 17 nt, Human
auguugcauagaauaaa

SEQ ID NO: 1835669 - RNA, 17 nt, Human
auguugcccaggcaggu

SEQ ID NO: 1835670 - RNA, 12 nt, Human
auguugcccagg

SEQ ID NO: 1835671 - RNA, 15 nt, Human
auguugcauagaaua

SEQ ID NO: 1835672 - RNA, 21 nt, Human
auguuaaacuuacuuaguguu

SEQ ID NO: 1835673 - RNA, 20 nt, Human
uuuucauuuaggugaggaag

SEQ ID NO: 1835674 - RNA, 13 nt, Human
uuuuauuaugcau

SEQ ID NO: 1835675 - RNA, 20 nt, Human
uuuuaggccaaaaaaaugua

SEQ ID NO: 1835676 - RNA, 11 nt, Human
uuuuauuuuau

SEQ ID NO: 1835677 - RNA, 12 nt, Human
uuuucaguuuuc

SEQ ID NO: 1835678 - RNA, 14 nt, Human
uuuucaguuuucag

SEQ ID NO: 1835679 - RNA, 15 nt, Human
auuaaaaaucucaaa

SEQ ID NO: 1835680 - RNA, 19 nt, Human
auuaaaaaucucaaauuuc

SEQ ID NO: 1835681 - RNA, 20 nt, Human
auuaaaaaucucaaauuucu

SEQ ID NO: 1835682 - RNA, 22 nt, Human
auuaaaaaucucaaauuucuaa

SEQ ID NO: 1835683 - RNA, 23 nt, Human
auuaaaacacaacaucuuuuucu

SEQ ID NO: 1835684 - RNA, 17 nt, Human
auguuuaguaaucauau

SEQ ID NO: 1835685 - RNA, 16 nt, Human
auuaaguacuauguau

SEQ ID NO: 1835686 - RNA, 14 nt, Human
auuaaguuguuaau

SEQ ID NO: 1835687 - RNA, 14 nt, Human
auuaaguacuaugu

SEQ ID NO: 1835688 - RNA, 19 nt, Human
auuaaguuguuaauaaaag

SEQ ID NO: 1835689 - RNA, 20 nt, Human
auuaaguuguuaauaaaagu

SEQ ID NO: 1835690 - RNA, 20 nt, Human
uuuuuauggcuuuugugcau

SEQ ID NO: 1835691 - RNA, 21 nt, Human
uuuuuauggcuuuugugcauu

SEQ ID NO: 1835692 - RNA, 22 nt, Human
uuuuuauggcuuuugugcauua

SEQ ID NO: 1835693 - RNA, 19 nt, Human
uuuuuguagagccaggguc

SEQ ID NO: 1835694 - RNA, 20 nt, Human
uuuuuguagagccagggucu

SEQ ID NO: 1835695 - RNA, 19 nt, Human
uuuuugugaaaagcuccau

SEQ ID NO: 1835696 - RNA, 23 nt, Human
uuuugccauguuggccaggcugg

SEQ ID NO: 1835697 - RNA, 17 nt, Human
uuuugagugccuuacac

SEQ ID NO: 1835698 - RNA, 17 nt, Human
uuuugauccaagcuggu

SEQ ID NO: 1835699 - RNA, 23 nt, Human
uuuugugcauuaucuagauacug

SEQ ID NO: 1835700 - RNA, 17 nt, Human
uuuugugcauuaucuag

SEQ ID NO: 1835701 - RNA, 20 nt, Human
uuuugugcauuaucuagaua

SEQ ID NO: 1835702 - RNA, 21 nt, Human
uuuugugaugucccaacuugu

SEQ ID NO: 1835703 - RNA, 13 nt, Human
uuuugcuguagaa

SEQ ID NO: 1835704 - RNA, 14 nt, Human
uuuugcuguagaag

SEQ ID NO: 1835705 - RNA, 12 nt, Human
uuuuguuucaua

SEQ ID NO: 1835706 - RNA, 19 nt, Human
uuuuguuucauauugaugu

SEQ ID NO: 1835707 - RNA, 21 nt, Human
uuuuguuccacaaguuaaaua

SEQ ID NO: 1835708 - RNA, 15 nt, Human
uuuuguuccacaagu

SEQ ID NO: 1835709 - RNA, 23 nt, Human
uuuuuauacauaaacaagaccac

SEQ ID NO: 1835710 - RNA, 12 nt, Human
uuuuuauggcuu

SEQ ID NO: 1835711 - RNA, 20 nt, Human
uuuuuaucgucacugcuuaa

SEQ ID NO: 1835712 - RNA, 12 nt, Human
uuuuuaucaugu

SEQ ID NO: 1835713 - RNA, 11 nt, Human
uuuuuacuaau

SEQ ID NO: 1835714 - RNA, 22 nt, Human
uuuuuagacagagucucacugu

SEQ ID NO: 1835715 - RNA, 22 nt, Human
cacaguccuuaccagcagagca

SEQ ID NO: 1835716 - RNA, 21 nt, Human
cacaguccuuaccagcagagc

SEQ ID NO: 1835717 - RNA, 15 nt, Human
cacaguccuuaccag

SEQ ID NO: 1835718 - RNA, 13 nt, Human
cacaguccuuacc

SEQ ID NO: 1835719 - RNA, 14 nt, Human
cacagugcaucuca

SEQ ID NO: 1835720 - RNA, 19 nt, Human
cacaggcagguccaggguu

SEQ ID NO: 1835721 - RNA, 22 nt, Human
cacagugagucgaggacaggga

SEQ ID NO: 1835722 - RNA, 21 nt, Human
cacagugagucgaggacaggg

SEQ ID NO: 1835723 - RNA, 15 nt, Human
cacaguucucuccuu

SEQ ID NO: 1835724 - RNA, 14 nt, Human
cacaguucucuccu

SEQ ID NO: 1835725 - RNA, 14 nt, Human
cacaggagggaggg

SEQ ID NO: 1835726 - RNA, 21 nt, Human
cacaggagggagggggaaggc

SEQ ID NO: 1835727 - RNA, 19 nt, Human
cacaggagggagggggaag

SEQ ID NO: 1835728 - RNA, 11 nt, Human
cacaggcaggu

SEQ ID NO: 1835729 - RNA, 14 nt, Human
cacaggcaggucca

SEQ ID NO: 1835730 - RNA, 15 nt, Human
cacaggcagguccag

SEQ ID NO: 1835731 - RNA, 23 nt, Human
cacagcugggguggggaccucag

SEQ ID NO: 1835732 - RNA, 22 nt, Human
cacagcugggguggggaccuca

SEQ ID NO: 1835733 - RNA, 21 nt, Human
cacagcuucauuuccuguguc

SEQ ID NO: 1835734 - RNA, 22 nt, Human
cacagcuucauuuccugugucu

SEQ ID NO: 1835735 - RNA, 21 nt, Human
cacauagugaugguuccccug

SEQ ID NO: 1835736 - RNA, 14 nt, Human
caauaggaaaaacu

SEQ ID NO: 1835737 - RNA, 14 nt, Human
caauguucucucuu

SEQ ID NO: 1835738 - RNA, 21 nt, Human
caaugcacuuuguucuggcuc

SEQ ID NO: 1835739 - RNA, 20 nt, Human
caaugcacuuuguucuggcu

SEQ ID NO: 1835740 - RNA, 22 nt, Human
caaugcacuuuguucuggcucu

SEQ ID NO: 1835741 - RNA, 17 nt, Human
caaugcacuuuguucug

SEQ ID NO: 1835742 - RNA, 17 nt, Human
caaugugauaaaacccc

SEQ ID NO: 1835743 - RNA, 15 nt, Human
caaugugauaaaacc

SEQ ID NO: 1835744 - RNA, 16 nt, Human
caauucuccugccuca

SEQ ID NO: 1835745 - RNA, 15 nt, Human
caauucuccugccuc

SEQ ID NO: 1835746 - RNA, 14 nt, Human
caauucuccugccu

SEQ ID NO: 1835747 - RNA, 16 nt, Human
caauuacaggaaguac

SEQ ID NO: 1835748 - RNA, 13 nt, Human
caauucuccugcc

SEQ ID NO: 1835749 - RNA, 23 nt, Human
caauucucauuugucacacacuu

SEQ ID NO: 1835750 - RNA, 15 nt, Human
caaugacuuacugua

SEQ ID NO: 1835751 - RNA, 21 nt, Human
caaugaccuuucaauaggaaa

SEQ ID NO: 1835752 - RNA, 17 nt, Human
caaugacuuacuguaca

SEQ ID NO: 1835753 - RNA, 18 nt, Human
caaugacuuacuguacau

SEQ ID NO: 1835754 - RNA, 23 nt, Human
caaugaccuuucaauaggaaaaa

SEQ ID NO: 1835755 - RNA, 14 nt, Human
caauauuguacagu

SEQ ID NO: 1835756 - RNA, 15 nt, Human
caauauuguacaguu

SEQ ID NO: 1835757 - RNA, 17 nt, Human
caauauucgcuguguca

SEQ ID NO: 1835758 - RNA, 13 nt, Human
caauaggaaaaac

SEQ ID NO: 1835759 - RNA, 12 nt, Human
caauaggaaaaa

SEQ ID NO: 1835760 - RNA, 15 nt, Human
caaccuccugggcua

SEQ ID NO: 1835761 - RNA, 14 nt, Human
caaccuccugggcu

SEQ ID NO: 1835762 - RNA, 19 nt, Human
caaccuucgccaccugggu

SEQ ID NO: 1835763 - RNA, 20 nt, Human
caaccuguucugcuuuccuc

SEQ ID NO: 1835764 - RNA, 14 nt, Human
caacgucugugcca

SEQ ID NO: 1835765 - RNA, 13 nt, Human
caacgucugugcc

SEQ ID NO: 1835766 - RNA, 17 nt, Human
caacugaccagccucca

SEQ ID NO: 1835767 - RNA, 15 nt, Human
caacugaccagccuc

SEQ ID NO: 1835768 - RNA, 13 nt, Human
caacccucagagc

SEQ ID NO: 1835769 - RNA, 17 nt, Human
caacccuggcacccagg

SEQ ID NO: 1835770 - RNA, 22 nt, Human
caaccccuucgcuccugugucu

SEQ ID NO: 1835771 - RNA, 22 nt, Human
caacacucauugaccugaggcc

SEQ ID NO: 1835772 - RNA, 20 nt, Human
caacacucauugaccugagg

SEQ ID NO: 1835773 - RNA, 18 nt, Human
caacacucauugaccuga

SEQ ID NO: 1835774 - RNA, 22 nt, Human
caacacucacauuuauucugcu

SEQ ID NO: 1835775 - RNA, 17 nt, Human
caagacgcugugcugcc

SEQ ID NO: 1835776 - RNA, 16 nt, Human
caagacgcugugcugc

SEQ ID NO: 1835777 - RNA, 18 nt, Human
caagaccuucuccuucac

SEQ ID NO: 1835778 - RNA, 17 nt, Human
caagaccuucuccuuca

SEQ ID NO: 1835779 - RNA, 16 nt, Human
caagaccuucuccuuc

SEQ ID NO: 1835780 - RNA, 14 nt, Human
caagaccuucuccu

SEQ ID NO: 1835781 - RNA, 20 nt, Human
caagaacuuuccaggaaggc

SEQ ID NO: 1835782 - RNA, 19 nt, Human
caacugaccagccuccaug

SEQ ID NO: 1835783 - RNA, 18 nt, Human
caagacucuuuggacacu

SEQ ID NO: 1835784 - RNA, 15 nt, Human
caagagcccaggccu

SEQ ID NO: 1835785 - RNA, 14 nt, Human
caagagcccaggcc

SEQ ID NO: 1835786 - RNA, 23 nt, Human
caagacgcugugcugcccugccc

SEQ ID NO: 1835787 - RNA, 18 nt, Human
caagacgcugugcugccc

SEQ ID NO: 1835788 - RNA, 19 nt, Human
caagacgcugugcugcccu

SEQ ID NO: 1835789 - RNA, 16 nt, Human
caagagcccaggccuc

SEQ ID NO: 1835790 - RNA, 13 nt, Human
caagagggcacug

SEQ ID NO: 1835791 - RNA, 15 nt, Human
caagagggcacuggu

SEQ ID NO: 1835792 - RNA, 14 nt, Human
caagagggcacugg

SEQ ID NO: 1835793 - RNA, 15 nt, Human
caagcaccuccugcc

SEQ ID NO: 1835794 - RNA, 16 nt, Human
caagcaccuccugccu

SEQ ID NO: 1835795 - RNA, 17 nt, Human
caagcaccuccugccuc

SEQ ID NO: 1835796 - RNA, 15 nt, Human
caaggacugcaggga

SEQ ID NO: 1835797 - RNA, 17 nt, Human
caagcuggucccacuca

SEQ ID NO: 1835798 - RNA, 19 nt, Human
caagcuggucccacucagu

SEQ ID NO: 1835799 - RNA, 22 nt, Human
caaggacugcagggacugccag

SEQ ID NO: 1835800 - RNA, 14 nt, Human
caaggagccaaaca

SEQ ID NO: 1835801 - RNA, 17 nt, Human
caaggcugauuaaacca

SEQ ID NO: 1835802 - RNA, 18 nt, Human
caagccguggcuucccgc

SEQ ID NO: 1835803 - RNA, 19 nt, Human
caagcgauucuucugcuuc

SEQ ID NO: 1835804 - RNA, 14 nt, Human
caagccuggcaagg

SEQ ID NO: 1835805 - RNA, 20 nt, Human
caagcgauucuucugcuuca

SEQ ID NO: 1835806 - RNA, 22 nt, Human
caagcgauucuucugcuucagc

SEQ ID NO: 1835807 - RNA, 14 nt, Human
caagcaggacaugg

SEQ ID NO: 1835808 - RNA, 18 nt, Human
caagcaggacauggacaa

SEQ ID NO: 1835809 - RNA, 14 nt, Human
caagccagcuggag

SEQ ID NO: 1835810 - RNA, 22 nt, Human
caagccaccaacauacucccau

SEQ ID NO: 1835811 - RNA, 23 nt, Human
caaggcugucaauuacaggaagu

SEQ ID NO: 1835812 - RNA, 15 nt, Human
caaggcugcagugag

SEQ ID NO: 1835813 - RNA, 12 nt, Human
caaggcugcagu

SEQ ID NO: 1835814 - RNA, 17 nt, Human
caaggggcccaaauucu

SEQ ID NO: 1835815 - RNA, 18 nt, Human
caaggggcccaaauucuu

SEQ ID NO: 1835816 - RNA, 14 nt, Human
caaggucauuuuuu

SEQ ID NO: 1835817 - RNA, 20 nt, Human
caaggucauuuuuuuuaaga

SEQ ID NO: 1835818 - RNA, 18 nt, Human
caaggguagggugggccu

SEQ ID NO: 1835819 - RNA, 14 nt, Human
caaguccucuuuuc

SEQ ID NO: 1835820 - RNA, 14 nt, Human
caaguuaaauaaau

SEQ ID NO: 1835821 - RNA, 19 nt, Human
caaguggcucccacacccu

SEQ ID NO: 1835822 - RNA, 21 nt, Human
caagugauucucaugccucag

SEQ ID NO: 1835823 - RNA, 20 nt, Human
caagugauucucaugccuca

SEQ ID NO: 1835824 - RNA, 18 nt, Human
caagugauucucaugccu

SEQ ID NO: 1835825 - RNA, 17 nt, Human
caagugauucucaugcc

SEQ ID NO: 1835826 - RNA, 18 nt, Human
caagugagagcugggugu

SEQ ID NO: 1835827 - RNA, 21 nt, Human
caaguccucuuuucugagagg

SEQ ID NO: 1835828 - RNA, 14 nt, Human
caagugagagcugg

SEQ ID NO: 1835829 - RNA, 15 nt, Human
caagugagagcuggg

SEQ ID NO: 1835830 - RNA, 17 nt, Human
caagugagagcugggug

SEQ ID NO: 1835831 - RNA, 16 nt, Human
caaaaaaugcuugcuu

SEQ ID NO: 1835832 - RNA, 22 nt, Human
auuuugggguacccacugcucu

SEQ ID NO: 1835833 - RNA, 23 nt, Human
auuuugggguacccacugcucug

SEQ ID NO: 1835834 - RNA, 21 nt, Human
auuuugggguacccacugcuc

SEQ ID NO: 1835835 - RNA, 13 nt, Human
caaaaaggcagga

SEQ ID NO: 1835836 - RNA, 20 nt, Human
caaaaacauggccuuugcuu

SEQ ID NO: 1835837 - RNA, 23 nt, Human
caaaacuucagacauagaauuaa

SEQ ID NO: 1835838 - RNA, 17 nt, Human
caaaauaaaaaugaggu

SEQ ID NO: 1835839 - RNA, 21 nt, Human
caaaacucuccucugcugcug

SEQ ID NO: 1835840 - RNA, 20 nt, Human
caaaacucuccucugcugcu

SEQ ID NO: 1835841 - RNA, 22 nt, Human
caaaacucuccucugcugcugg

SEQ ID NO: 1835842 - RNA, 23 nt, Human
caaaacucuccucugcugcuggc

SEQ ID NO: 1835843 - RNA, 20 nt, Human
caaagugcugggauuacagg

SEQ ID NO: 1835844 - RNA, 23 nt, Human
caaagugcugggauuacaggugu

SEQ ID NO: 1835845 - RNA, 19 nt, Human
caaagugcugggauuacag

SEQ ID NO: 1835846 - RNA, 19 nt, Human
caaaggguaucaggugcug

SEQ ID NO: 1835847 - RNA, 21 nt, Human
caaauuguaagcaugcacaaa

SEQ ID NO: 1835848 - RNA, 12 nt, Human
caaauuucuaaa

SEQ ID NO: 1835849 - RNA, 14 nt, Human
caaauuucuaaauc

SEQ ID NO: 1835850 - RNA, 11 nt, Human
caaauuucuaa

SEQ ID NO: 1835851 - RNA, 18 nt, Human
caaagccuccuccagccg

SEQ ID NO: 1835852 - RNA, 17 nt, Human
caaagccuccuccagcc

SEQ ID NO: 1835853 - RNA, 17 nt, Human
caaacucaccugccccu

SEQ ID NO: 1835854 - RNA, 14 nt, Human
caaaggaagcacau

SEQ ID NO: 1835855 - RNA, 16 nt, Human
caaaggguaucaggug

SEQ ID NO: 1835856 - RNA, 18 nt, Human
caaaggguaucaggugcu

SEQ ID NO: 1835857 - RNA, 13 nt, Human
caaaggaagcaca

SEQ ID NO: 1835858 - RNA, 12 nt, Human
caaaggaagcac

SEQ ID NO: 1835859 - RNA, 13 nt, Human
caaagcuaggccu

SEQ ID NO: 1835860 - RNA, 14 nt, Human
caaagcuaggccug

SEQ ID NO: 1835861 - RNA, 19 nt, Human
caaagcuaggccuggccag

SEQ ID NO: 1835862 - RNA, 15 nt, Human
caaagcuaggccugg

SEQ ID NO: 1835863 - RNA, 20 nt, Human
caaacccuucagugccaaaa

SEQ ID NO: 1835864 - RNA, 14 nt, Human
caaacccuucagug

SEQ ID NO: 1835865 - RNA, 15 nt, Human
caaacacauacagga

SEQ ID NO: 1835866 - RNA, 16 nt, Human
caaaauuguuacaaau

SEQ ID NO: 1835867 - RNA, 12 nt, Human
caaaauaaaacu

SEQ ID NO: 1835868 - RNA, 14 nt, Human
caaaauaaaacuuu

SEQ ID NO: 1835869 - RNA, 15 nt, Human
caaaauguaggguua

SEQ ID NO: 1835870 - RNA, 18 nt, Human
cacuggacucaccucccc

SEQ ID NO: 1835871 - RNA, 15 nt, Human
cacuggacucaccuc

SEQ ID NO: 1835872 - RNA, 17 nt, Human
cacuggaacacuaauga

SEQ ID NO: 1835873 - RNA, 21 nt, Human
cacugcuuuuggucuguguga

SEQ ID NO: 1835874 - RNA, 16 nt, Human
cacugcuuccagugag

SEQ ID NO: 1835875 - RNA, 15 nt, Human
cacugcuuccaguga

SEQ ID NO: 1835876 - RNA, 14 nt, Human
cacugcuuccagug

SEQ ID NO: 1835877 - RNA, 13 nt, Human
cacugcuuaacuu

SEQ ID NO: 1835878 - RNA, 21 nt, Human
cacugcuggcugccuuagaac

SEQ ID NO: 1835879 - RNA, 16 nt, Human
cacugcuggcugccuu

SEQ ID NO: 1835880 - RNA, 15 nt, Human
cacugcuggcugccu

SEQ ID NO: 1835881 - RNA, 14 nt, Human
cacugcuggcugcc

SEQ ID NO: 1835882 - RNA, 13 nt, Human
cacugcuggcugc

SEQ ID NO: 1835883 - RNA, 12 nt, Human
cacugcuggcug

SEQ ID NO: 1835884 - RNA, 21 nt, Human
cacugcuuccagugaggcucu

SEQ ID NO: 1835885 - RNA, 20 nt, Human
cacugcuuccagugaggcuc

SEQ ID NO: 1835886 - RNA, 19 nt, Human
cacugcuuccagugaggcu

SEQ ID NO: 1835887 - RNA, 18 nt, Human
cacugcuuccagugaggc

SEQ ID NO: 1835888 - RNA, 22 nt, Human
cacugcuuccagugaggcucug

SEQ ID NO: 1835889 - RNA, 20 nt, Human
cacugcuuuuggucugugug

SEQ ID NO: 1835890 - RNA, 16 nt, Human
cacugccucuuccucc

SEQ ID NO: 1835891 - RNA, 23 nt, Human
cacugcacagugcaucucagccc

SEQ ID NO: 1835892 - RNA, 14 nt, Human
cacugcaccgggcc

SEQ ID NO: 1835893 - RNA, 15 nt, Human
cacugcaccgggcca

SEQ ID NO: 1835894 - RNA, 16 nt, Human
cacugcaccgggccac

SEQ ID NO: 1835895 - RNA, 18 nt, Human
cacugcaccgggccacag

SEQ ID NO: 1835896 - RNA, 19 nt, Human
cacugcaccgggccacaga

SEQ ID NO: 1835897 - RNA, 18 nt, Human
cacugcacuauagccuag

SEQ ID NO: 1835898 - RNA, 22 nt, Human
cacugccuucgauacaccgggc

SEQ ID NO: 1835899 - RNA, 20 nt, Human
cacugccuucgauacaccgg

SEQ ID NO: 1835900 - RNA, 17 nt, Human
cacugcugcccagccuc

SEQ ID NO: 1835901 - RNA, 15 nt, Human
cacugcugcccagcc

SEQ ID NO: 1835902 - RNA, 20 nt, Human
cacugcucugaugaagagga

SEQ ID NO: 1835903 - RNA, 12 nt, Human
cacugcucuggu

SEQ ID NO: 1835904 - RNA, 13 nt, Human
cacugagacagcc

SEQ ID NO: 1835905 - RNA, 12 nt, Human
cacugagacagc

SEQ ID NO: 1835906 - RNA, 22 nt, Human
cacugagacagcccgggcucug

SEQ ID NO: 1835907 - RNA, 19 nt, Human
cacugagacagcccgggcu

SEQ ID NO: 1835908 - RNA, 17 nt, Human
cacugagacagcccggg

SEQ ID NO: 1835909 - RNA, 14 nt, Human
cacugagacagccc

SEQ ID NO: 1835910 - RNA, 19 nt, Human
cacucuggcagcucagaga

SEQ ID NO: 1835911 - RNA, 17 nt, Human
cacucuggcagcucaga

SEQ ID NO: 1835912 - RNA, 16 nt, Human
cacucuggcagcucag

SEQ ID NO: 1835913 - RNA, 15 nt, Human
cacucuggcagcuca

SEQ ID NO: 1835914 - RNA, 21 nt, Human
cacucuggcagcucagagagg

SEQ ID NO: 1835915 - RNA, 20 nt, Human
cacucuggcagcucagagag

SEQ ID NO: 1835916 - RNA, 23 nt, Human
cacucuggcagcucagagagggu

SEQ ID NO: 1835917 - RNA, 15 nt, Human
cacucugucgcccag

SEQ ID NO: 1835918 - RNA, 16 nt, Human
cacucugucgcccagu

SEQ ID NO: 1835919 - RNA, 19 nt, Human
cacucugucgcccagucug

SEQ ID NO: 1835920 - RNA, 23 nt, Human
cacugacauuguuggccaaagcc

SEQ ID NO: 1835921 - RNA, 20 nt, Human
cacucugucgcccagucugg

SEQ ID NO: 1835922 - RNA, 22 nt, Human
cacugcacagugcaucucagcc

SEQ ID NO: 1835923 - RNA, 21 nt, Human
cacugcacagugcaucucagc

SEQ ID NO: 1835924 - RNA, 19 nt, Human
cacugcacagugcaucuca

SEQ ID NO: 1835925 - RNA, 18 nt, Human
cacugcacagugcaucuc

SEQ ID NO: 1835926 - RNA, 23 nt, Human
cacugcaaccuucgccaccuggg

SEQ ID NO: 1835927 - RNA, 16 nt, Human
cacugcaacuucugcc

SEQ ID NO: 1835928 - RNA, 22 nt, Human
cacugcaaccuucgccaccugg

SEQ ID NO: 1835929 - RNA, 14 nt, Human
cacugcaaccuucg

SEQ ID NO: 1835930 - RNA, 17 nt, Human
cacugcaacuucugccu

SEQ ID NO: 1835931 - RNA, 23 nt, Human
cacugcaaccuccgccucuuggg

SEQ ID NO: 1835932 - RNA, 14 nt, Human
cacugcaaccuccg

SEQ ID NO: 1835933 - RNA, 16 nt, Human
cacugcaaccuccgcc

SEQ ID NO: 1835934 - RNA, 13 nt, Human
cacugcaaccucc

SEQ ID NO: 1835935 - RNA, 14 nt, Human
cacugaugggcaac

SEQ ID NO: 1835936 - RNA, 18 nt, Human
cacugaugggcaaccccc

SEQ ID NO: 1835937 - RNA, 24 nt, Human
cacugaugggcaacccccagccug

SEQ ID NO: 1835938 - RNA, 23 nt, Human
cacugagacagcccgggcucugc

SEQ ID NO: 1835939 - RNA, 19 nt, Human
cacuguacuugcucuugau

SEQ ID NO: 1835940 - RNA, 18 nt, Human
cacuguacuugcucuuga

SEQ ID NO: 1835941 - RNA, 15 nt, Human
cacuguacuugcucu

SEQ ID NO: 1835942 - RNA, 13 nt, Human
cacugugaagaga

SEQ ID NO: 1835943 - RNA, 14 nt, Human
cacugugccaugug

SEQ ID NO: 1835944 - RNA, 22 nt, Human
cacuguucucugcccuccaaga

SEQ ID NO: 1835945 - RNA, 21 nt, Human
cacuguucucugcccuccaag

SEQ ID NO: 1835946 - RNA, 19 nt, Human
cacuguucucugcccucca

SEQ ID NO: 1835947 - RNA, 17 nt, Human
cacuguucucugcccuc

SEQ ID NO: 1835948 - RNA, 16 nt, Human
cacuguucucugcccu

SEQ ID NO: 1835949 - RNA, 15 nt, Human
cacuguucucugccc

SEQ ID NO: 1835950 - RNA, 14 nt, Human
cacuguucucugcc

SEQ ID NO: 1835951 - RNA, 13 nt, Human
cacuguucucugc

SEQ ID NO: 1835952 - RNA, 22 nt, Human
cacugugcugagucugaaggcu

SEQ ID NO: 1835953 - RNA, 21 nt, Human
cacugugcugagucugaaggc

SEQ ID NO: 1835954 - RNA, 20 nt, Human
cacugugcugagucugaagg

SEQ ID NO: 1835955 - RNA, 17 nt, Human
cacugugcugagucuga

SEQ ID NO: 1835956 - RNA, 15 nt, Human
cacugugcugagucu

SEQ ID NO: 1835957 - RNA, 13 nt, Human
cacugugcugagu

SEQ ID NO: 1835958 - RNA, 18 nt, Human
cacugugccaugugccag

SEQ ID NO: 1835959 - RNA, 15 nt, Human
cacugugccaugugc

SEQ ID NO: 1835960 - RNA, 16 nt, Human
cacugugccaugugcc

SEQ ID NO: 1835961 - RNA, 20 nt, Human
cacuugaacccgggaggcag

SEQ ID NO: 1835962 - RNA, 21 nt, Human
cacuugaacccgggaggcaga

SEQ ID NO: 1835963 - RNA, 23 nt, Human
cacuugaacccgggaggcagagg

SEQ ID NO: 1835964 - RNA, 16 nt, Human
cacuugacaucaacug

SEQ ID NO: 1835965 - RNA, 20 nt, Human
cacuugagaauuacccuuuu

SEQ ID NO: 1835966 - RNA, 17 nt, Human
cacuugagaauuacccu

SEQ ID NO: 1835967 - RNA, 19 nt, Human
cacuugacaucaacugcau

SEQ ID NO: 1835968 - RNA, 13 nt, Human
cacuugaguccag

SEQ ID NO: 1835969 - RNA, 19 nt, Human
cacuugaugacccccaacc

SEQ ID NO: 1835970 - RNA, 13 nt, Human
cacuugcagacuc

SEQ ID NO: 1835971 - RNA, 15 nt, Human
cacuuggucugugag

SEQ ID NO: 1835972 - RNA, 20 nt, Human
cacuuucuagccagaggaga

SEQ ID NO: 1835973 - RNA, 19 nt, Human
cacuuucuagccagaggag

SEQ ID NO: 1835974 - RNA, 24 nt, Human
cacuugcagacucuacagaggcca

SEQ ID NO: 1835975 - RNA, 14 nt, Human
cacuugcagacucu

SEQ ID NO: 1835976 - RNA, 18 nt, Human
cacuugcagacucuacag

SEQ ID NO: 1835977 - RNA, 19 nt, Human
cacuugcagacucuacaga

SEQ ID NO: 1835978 - RNA, 22 nt, Human
cacuugcagacucuacagaggc

SEQ ID NO: 1835979 - RNA, 16 nt, Human
cacuucccuacaugga

SEQ ID NO: 1835980 - RNA, 20 nt, Human
cacuuccauaaucuggacuc

SEQ ID NO: 1835981 - RNA, 22 nt, Human
cacuucugccauauucuguugg

SEQ ID NO: 1835982 - RNA, 23 nt, Human
cacuucgggaggucgaggcagga

SEQ ID NO: 1835983 - RNA, 21 nt, Human
cacuucgggaggucgaggcag

SEQ ID NO: 1835984 - RNA, 21 nt, Human
cacuucagcugacuuuucugu

SEQ ID NO: 1835985 - RNA, 12 nt, Human
cacuucagcuga

SEQ ID NO: 1835986 - RNA, 20 nt, Human
cacuucaggcucuucuccuu

SEQ ID NO: 1835987 - RNA, 16 nt, Human
cacuucaggcucuucu

SEQ ID NO: 1835988 - RNA, 15 nt, Human
cacuucaggcucuuc

SEQ ID NO: 1835989 - RNA, 14 nt, Human
cacuucaggcucuu

SEQ ID NO: 1835990 - RNA, 23 nt, Human
cacuucaggcucuucuccuuuca

SEQ ID NO: 1835991 - RNA, 14 nt, Human
cacuguugcccagg

SEQ ID NO: 1835992 - RNA, 18 nt, Human
cacgcccccacuggugac

SEQ ID NO: 1835993 - RNA, 17 nt, Human
cacgcccccacugguga

SEQ ID NO: 1835994 - RNA, 15 nt, Human
cacgcccccacuggu

SEQ ID NO: 1835995 - RNA, 13 nt, Human
cacgcccccacug

SEQ ID NO: 1835996 - RNA, 23 nt, Human
cacgccagauucuuuccugaggc

SEQ ID NO: 1835997 - RNA, 13 nt, Human
cacgccacugcac

SEQ ID NO: 1835998 - RNA, 22 nt, Human
cacgccagauucuuuccugagg

SEQ ID NO: 1835999 - RNA, 20 nt, Human
cacgccagauucuuuccuga

SEQ ID NO: 1836000 - RNA, 19 nt, Human
cacgccagauucuuuccug

SEQ ID NO: 1836001 - RNA, 15 nt, Human
cacgccacugcacua

SEQ ID NO: 1836002 - RNA, 12 nt, Human
cacgauuucugu

SEQ ID NO: 1836003 - RNA, 14 nt, Human
cacgauuucuguuu

SEQ ID NO: 1836004 - RNA, 16 nt, Human
cacgauuucuguuuag

SEQ ID NO: 1836005 - RNA, 17 nt, Human
cacgcacuucgggaggu

SEQ ID NO: 1836006 - RNA, 18 nt, Human
caccuugacagggcacac

SEQ ID NO: 1836007 - RNA, 15 nt, Human
caccuugacagggca

SEQ ID NO: 1836008 - RNA, 16 nt, Human
caccuugacagggcac

SEQ ID NO: 1836009 - RNA, 14 nt, Human
caccuucccaugcc

SEQ ID NO: 1836010 - RNA, 13 nt, Human
caccuucccaugc

SEQ ID NO: 1836011 - RNA, 13 nt, Human
caccuugacaggg

SEQ ID NO: 1836012 - RNA, 22 nt, Human
cacgaauauugcugauggugca

SEQ ID NO: 1836013 - RNA, 19 nt, Human
cacgaauauugcugauggu

SEQ ID NO: 1836014 - RNA, 16 nt, Human
cacgaauauugcugau

SEQ ID NO: 1836015 - RNA, 16 nt, Human
cacgacugcccggcag

SEQ ID NO: 1836016 - RNA, 17 nt, Human
cacgacugcccggcagg

SEQ ID NO: 1836017 - RNA, 23 nt, Human
caccuuagacagucccugccaau

SEQ ID NO: 1836018 - RNA, 21 nt, Human
caccuuagacagucccugcca

SEQ ID NO: 1836019 - RNA, 22 nt, Human
caccuuagccugcccuccuuuc

SEQ ID NO: 1836020 - RNA, 19 nt, Human
caccuuagacagucccugc

SEQ ID NO: 1836021 - RNA, 18 nt, Human
caccuuagacagucccug

SEQ ID NO: 1836022 - RNA, 16 nt, Human
caccuuagacaguccc

SEQ ID NO: 1836023 - RNA, 14 nt, Human
caccuuagacaguc

SEQ ID NO: 1836024 - RNA, 20 nt, Human
cacgccuguaauccuagcac

SEQ ID NO: 1836025 - RNA, 19 nt, Human
cacgccuguaauccuagca

SEQ ID NO: 1836026 - RNA, 23 nt, Human
cacgcgugcacacaccagagccc

SEQ ID NO: 1836027 - RNA, 15 nt, Human
cacgcgugcacacac

SEQ ID NO: 1836028 - RNA, 16 nt, Human
cacgcgugcacacacc

SEQ ID NO: 1836029 - RNA, 21 nt, Human
cacgcgugcacacaccagagc

SEQ ID NO: 1836030 - RNA, 15 nt, Human
cacgggggccaagga

SEQ ID NO: 1836031 - RNA, 20 nt, Human
cacgcuggaccuugaacugg

SEQ ID NO: 1836032 - RNA, 14 nt, Human
cacgcuccuuccuc

SEQ ID NO: 1836033 - RNA, 17 nt, Human
cacgcuggaccuugaac

SEQ ID NO: 1836034 - RNA, 16 nt, Human
cacggcucacugcagc

SEQ ID NO: 1836035 - RNA, 17 nt, Human
cacggcucacugcagcc

SEQ ID NO: 1836036 - RNA, 19 nt, Human
cacggcucacugcagccuc

SEQ ID NO: 1836037 - RNA, 20 nt, Human
cacggcucacugcagccuca

SEQ ID NO: 1836038 - RNA, 13 nt, Human
cacgugacagccg

SEQ ID NO: 1836039 - RNA, 18 nt, Human
cacguacacacacauaca

SEQ ID NO: 1836040 - RNA, 19 nt, Human
cacguacacacacauacac

SEQ ID NO: 1836041 - RNA, 14 nt, Human
cacguacacacaca

SEQ ID NO: 1836042 - RNA, 19 nt, Human
cacgugguccuaaucuucu

SEQ ID NO: 1836043 - RNA, 16 nt, Human
cacgugguccuaaucu

SEQ ID NO: 1836044 - RNA, 22 nt, Human
cacguucuuacuaguuucccuu

SEQ ID NO: 1836045 - RNA, 12 nt, Human
cacguuucuaaa

SEQ ID NO: 1836046 - RNA, 14 nt, Human
cacguuucuaaagg

SEQ ID NO: 1836047 - RNA, 23 nt, Human
cacguuucuaaaggcuaccuuug

SEQ ID NO: 1836048 - RNA, 13 nt, Human
cacuaaacaaaga

SEQ ID NO: 1836049 - RNA, 22 nt, Human
cacucagaagacacugaugggc

SEQ ID NO: 1836050 - RNA, 18 nt, Human
cacucagaagacacugau

SEQ ID NO: 1836051 - RNA, 19 nt, Human
cacucagaagacacugaug

SEQ ID NO: 1836052 - RNA, 19 nt, Human
cacucacauuuauucugcu

SEQ ID NO: 1836053 - RNA, 20 nt, Human
cacucacauuuauucugcuc

SEQ ID NO: 1836054 - RNA, 12 nt, Human
cacucagaagac

SEQ ID NO: 1836055 - RNA, 16 nt, Human
cacucagaagacacug

SEQ ID NO: 1836056 - RNA, 17 nt, Human
cacucagaagacacuga

SEQ ID NO: 1836057 - RNA, 20 nt, Human
cacucaaaagcugggcaggu

SEQ ID NO: 1836058 - RNA, 19 nt, Human
cacucaaaagcugggcagg

SEQ ID NO: 1836059 - RNA, 18 nt, Human
cacucaaaagcugggcag

SEQ ID NO: 1836060 - RNA, 17 nt, Human
cacucaaaagcugggca

SEQ ID NO: 1836061 - RNA, 15 nt, Human
cacucaaaagcuggg

SEQ ID NO: 1836062 - RNA, 20 nt, Human
cacuauguugcccaggcagg

SEQ ID NO: 1836063 - RNA, 21 nt, Human
cacuauguugcccaggcaggu

SEQ ID NO: 1836064 - RNA, 19 nt, Human
cacuaucccggcugcccuu

SEQ ID NO: 1836065 - RNA, 18 nt, Human
cacuaucccggcugcccu

SEQ ID NO: 1836066 - RNA, 15 nt, Human
cacuauguugcccag

SEQ ID NO: 1836067 - RNA, 16 nt, Human
cacuauguugcccagg

SEQ ID NO: 1836068 - RNA, 17 nt, Human
cacuauguugcccaggc

SEQ ID NO: 1836069 - RNA, 18 nt, Human
cacuauguugcccaggca

SEQ ID NO: 1836070 - RNA, 19 nt, Human
cacuauguugcccaggcag

SEQ ID NO: 1836071 - RNA, 14 nt, Human
cacuauaauguaag

SEQ ID NO: 1836072 - RNA, 18 nt, Human
cacuauaauguaagcucu

SEQ ID NO: 1836073 - RNA, 14 nt, Human
cacuauagccuagg

SEQ ID NO: 1836074 - RNA, 21 nt, Human
cacuauagccuaggugacaga

SEQ ID NO: 1836075 - RNA, 21 nt, Human
cacuaaauugacacuuaaaaa

SEQ ID NO: 1836076 - RNA, 16 nt, Human
cacuaacaugauuugg

SEQ ID NO: 1836077 - RNA, 14 nt, Human
cacuaaccacgcug

SEQ ID NO: 1836078 - RNA, 15 nt, Human
cacuaaccacgcugg

SEQ ID NO: 1836079 - RNA, 16 nt, Human
cacuaaccacgcugga

SEQ ID NO: 1836080 - RNA, 17 nt, Human
cacuaaggugugcucug

SEQ ID NO: 1836081 - RNA, 18 nt, Human
cacuaaggugugcucuga

SEQ ID NO: 1836082 - RNA, 18 nt, Human
cacuaaccacgcuggacc

SEQ ID NO: 1836083 - RNA, 16 nt, Human
cacucccugcaaccug

SEQ ID NO: 1836084 - RNA, 13 nt, Human
cacucccugcaac

SEQ ID NO: 1836085 - RNA, 12 nt, Human
cacucccugcaa

SEQ ID NO: 1836086 - RNA, 22 nt, Human
cacucauugaccugaggcccuu

SEQ ID NO: 1836087 - RNA, 20 nt, Human
cacucauugaccugaggccc

SEQ ID NO: 1836088 - RNA, 19 nt, Human
cacucauugaccugaggcc

SEQ ID NO: 1836089 - RNA, 18 nt, Human
cacucauugaccugaggc

SEQ ID NO: 1836090 - RNA, 15 nt, Human
cacucauugaccuga

SEQ ID NO: 1836091 - RNA, 16 nt, Human
cacucaggucuguuuu

SEQ ID NO: 1836092 - RNA, 16 nt, Human
cacucaguccauagca

SEQ ID NO: 1836093 - RNA, 14 nt, Human
cacuccuaccuggu

SEQ ID NO: 1836094 - RNA, 13 nt, Human
cacuccuaccugg

SEQ ID NO: 1836095 - RNA, 17 nt, Human
cacucccugcaaccuga

SEQ ID NO: 1836096 - RNA, 21 nt, Human
cacuccuucacagaugggugc

SEQ ID NO: 1836097 - RNA, 14 nt, Human
cacuccuucacaga

SEQ ID NO: 1836098 - RNA, 23 nt, Human
cacucugagacucgcgacaaugc

SEQ ID NO: 1836099 - RNA, 12 nt, Human
cacucugagacu

SEQ ID NO: 1836100 - RNA, 12 nt, Human
cacucuccuugg

SEQ ID NO: 1836101 - RNA, 14 nt, Human
cacucuggcagcuc

SEQ ID NO: 1836102 - RNA, 13 nt, Human
cacucuggcagcu

SEQ ID NO: 1836103 - RNA, 12 nt, Human
cacucuggcagc

SEQ ID NO: 1836104 - RNA, 14 nt, Human
cacucuacuuagca

SEQ ID NO: 1836105 - RNA, 16 nt, Human
cacgccagauucuuuc

SEQ ID NO: 1836106 - RNA, 20 nt, Human
cacauauugauuuccguuaa

SEQ ID NO: 1836107 - RNA, 23 nt, Human
cacccugugauggggcccugccu

SEQ ID NO: 1836108 - RNA, 22 nt, Human
cacccugugauggggcccugcc

SEQ ID NO: 1836109 - RNA, 21 nt, Human
cacccugugauggggcccugc

SEQ ID NO: 1836110 - RNA, 20 nt, Human
cacccugugauggggcccug

SEQ ID NO: 1836111 - RNA, 18 nt, Human
cacccugugauggggccc

SEQ ID NO: 1836112 - RNA, 15 nt, Human
cacccugugaugggg

SEQ ID NO: 1836113 - RNA, 12 nt, Human
cacccugugaug

SEQ ID NO: 1836114 - RNA, 11 nt, Human
cacccugugau

SEQ ID NO: 1836115 - RNA, 18 nt, Human
caccgcagacaggaccag

SEQ ID NO: 1836116 - RNA, 17 nt, Human
caccgcagacaggacca

SEQ ID NO: 1836117 - RNA, 15 nt, Human
caccgcagacaggac

SEQ ID NO: 1836118 - RNA, 14 nt, Human
caccgcagacagga

SEQ ID NO: 1836119 - RNA, 13 nt, Human
caccgcagacagg

SEQ ID NO: 1836120 - RNA, 12 nt, Human
caccgcagacag

SEQ ID NO: 1836121 - RNA, 18 nt, Human
caccgaaaacguggcugc

SEQ ID NO: 1836122 - RNA, 15 nt, Human
caccgaaaacguggc

SEQ ID NO: 1836123 - RNA, 21 nt, Human
caccgaaaacguggcugcuuc

SEQ ID NO: 1836124 - RNA, 19 nt, Human
caccgaaaacguggcugcu

SEQ ID NO: 1836125 - RNA, 22 nt, Human
caccgaaaacguggcugcuuca

SEQ ID NO: 1836126 - RNA, 19 nt, Human
cacccgcuaagagggaggg

SEQ ID NO: 1836127 - RNA, 12 nt, Human
cacccggccccu

SEQ ID NO: 1836128 - RNA, 13 nt, Human
cacccggccccug

SEQ ID NO: 1836129 - RNA, 14 nt, Human
cacccggccccugc

SEQ ID NO: 1836130 - RNA, 16 nt, Human
cacccggccccugcug

SEQ ID NO: 1836131 - RNA, 17 nt, Human
cacccggccccugcugg

SEQ ID NO: 1836132 - RNA, 18 nt, Human
cacccggccccugcuggu

SEQ ID NO: 1836133 - RNA, 21 nt, Human
cacccggccccugcugguuca

SEQ ID NO: 1836134 - RNA, 20 nt, Human
caccccucaacaccucugca

SEQ ID NO: 1836135 - RNA, 13 nt, Human
cacauauugauuu

SEQ ID NO: 1836136 - RNA, 15 nt, Human
caccuggccucugca

SEQ ID NO: 1836137 - RNA, 14 nt, Human
caccuggccucugc

SEQ ID NO: 1836138 - RNA, 13 nt, Human
caccuggccucug

SEQ ID NO: 1836139 - RNA, 12 nt, Human
caccuggccucu

SEQ ID NO: 1836140 - RNA, 20 nt, Human
caccuggccucugcacuccc

SEQ ID NO: 1836141 - RNA, 19 nt, Human
caccuggccucugcacucc

SEQ ID NO: 1836142 - RNA, 18 nt, Human
caccuggccucugcacuc

SEQ ID NO: 1836143 - RNA, 17 nt, Human
caccuggccucugcacu

SEQ ID NO: 1836144 - RNA, 23 nt, Human
caccuggccucugcacuccccug

SEQ ID NO: 1836145 - RNA, 20 nt, Human
caccuggaauauauaaccag

SEQ ID NO: 1836146 - RNA, 23 nt, Human
caccugcggugcuaucuccccca

SEQ ID NO: 1836147 - RNA, 19 nt, Human
caccucugcacaagcugca

SEQ ID NO: 1836148 - RNA, 18 nt, Human
caccucugcacaagcugc

SEQ ID NO: 1836149 - RNA, 19 nt, Human
caccucucucacuccuuga

SEQ ID NO: 1836150 - RNA, 18 nt, Human
caccucucucacuccuug

SEQ ID NO: 1836151 - RNA, 17 nt, Human
caccucucucacuccuu

SEQ ID NO: 1836152 - RNA, 15 nt, Human
caccucucucacucc

SEQ ID NO: 1836153 - RNA, 23 nt, Human
caccugaagacucauucuucugu

SEQ ID NO: 1836154 - RNA, 14 nt, Human
caccugaagacuca

SEQ ID NO: 1836155 - RNA, 15 nt, Human
caccugaagacucau

SEQ ID NO: 1836156 - RNA, 17 nt, Human
caccucucccuuggauu

SEQ ID NO: 1836157 - RNA, 14 nt, Human
caccucucccuugg

SEQ ID NO: 1836158 - RNA, 13 nt, Human
caccucucccuug

SEQ ID NO: 1836159 - RNA, 17 nt, Human
caccuccugcugggcag

SEQ ID NO: 1836160 - RNA, 14 nt, Human
caccuccugccucg

SEQ ID NO: 1836161 - RNA, 15 nt, Human
caccuccugcugggc

SEQ ID NO: 1836162 - RNA, 14 nt, Human
caccuccugcuggg

SEQ ID NO: 1836163 - RNA, 13 nt, Human
caccuccugccuc

SEQ ID NO: 1836164 - RNA, 11 nt, Human
caccuccugcc

SEQ ID NO: 1836165 - RNA, 21 nt, Human
caccucccccaucucuucugg

SEQ ID NO: 1836166 - RNA, 14 nt, Human
caccucccccaucu

SEQ ID NO: 1836167 - RNA, 20 nt, Human
caccgugccuggccacgccc

SEQ ID NO: 1836168 - RNA, 15 nt, Human
caccgugccuggcca

SEQ ID NO: 1836169 - RNA, 13 nt, Human
caccgggccugga

SEQ ID NO: 1836170 - RNA, 15 nt, Human
caccggggccucgga

SEQ ID NO: 1836171 - RNA, 15 nt, Human
caccgggcacucaga

SEQ ID NO: 1836172 - RNA, 22 nt, Human
caccgggcacucagaagacacu

SEQ ID NO: 1836173 - RNA, 15 nt, Human
caccgggccacagag

SEQ ID NO: 1836174 - RNA, 18 nt, Human
caccgggccacagagaaa

SEQ ID NO: 1836175 - RNA, 21 nt, Human
caccgcagacaggaccaggga

SEQ ID NO: 1836176 - RNA, 18 nt, Human
caccggcuggccuggccc

SEQ ID NO: 1836177 - RNA, 17 nt, Human
caccggcuggccuggcc

SEQ ID NO: 1836178 - RNA, 20 nt, Human
caccggcuggccuggccccu

SEQ ID NO: 1836179 - RNA, 14 nt, Human
caccgggcacucag

SEQ ID NO: 1836180 - RNA, 16 nt, Human
caccggcuggccuggc

SEQ ID NO: 1836181 - RNA, 15 nt, Human
caccggcuggccugg

SEQ ID NO: 1836182 - RNA, 14 nt, Human
caccggcuggccug

SEQ ID NO: 1836183 - RNA, 21 nt, Human
cagagcagagaccaucccuga

SEQ ID NO: 1836184 - RNA, 19 nt, Human
cagagcagagaccaucccu

SEQ ID NO: 1836185 - RNA, 18 nt, Human
cagagcagagaccauccc

SEQ ID NO: 1836186 - RNA, 17 nt, Human
cagagcagagaccaucc

SEQ ID NO: 1836187 - RNA, 15 nt, Human
cagagcagagaccau

SEQ ID NO: 1836188 - RNA, 14 nt, Human
cagagcagagacca

SEQ ID NO: 1836189 - RNA, 13 nt, Human
cagagcagagacc

SEQ ID NO: 1836190 - RNA, 22 nt, Human
cagagcaccuuagacagucccu

SEQ ID NO: 1836191 - RNA, 21 nt, Human
cagagcaccuuagacaguccc

SEQ ID NO: 1836192 - RNA, 19 nt, Human
cagagcaccuuagacaguc

SEQ ID NO: 1836193 - RNA, 18 nt, Human
cagagcaccuuagacagu

SEQ ID NO: 1836194 - RNA, 12 nt, Human
cagagcagagac

SEQ ID NO: 1836195 - RNA, 11 nt, Human
cagagcagaga

SEQ ID NO: 1836196 - RNA, 23 nt, Human
cagagcaccuuagacagucccug

SEQ ID NO: 1836197 - RNA, 22 nt, Human
cagagccaccccuaaagagaua

SEQ ID NO: 1836198 - RNA, 15 nt, Human
cagagcccaccuugg

SEQ ID NO: 1836199 - RNA, 17 nt, Human
cagagcccaccuuggcu

SEQ ID NO: 1836200 - RNA, 19 nt, Human
cagagcccaccuuggcuca

SEQ ID NO: 1836201 - RNA, 16 nt, Human
cagagcccacgccccc

SEQ ID NO: 1836202 - RNA, 20 nt, Human
cagagcccaccuuggcucaa

SEQ ID NO: 1836203 - RNA, 21 nt, Human
cagagcccacgcccccacugg

SEQ ID NO: 1836204 - RNA, 20 nt, Human
cagagcccacgcccccacug

SEQ ID NO: 1836205 - RNA, 19 nt, Human
cagagcccacgcccccacu

SEQ ID NO: 1836206 - RNA, 17 nt, Human
cagagcccacgccccca

SEQ ID NO: 1836207 - RNA, 23 nt, Human
cagagcccacgcccccacuggug

SEQ ID NO: 1836208 - RNA, 12 nt, Human
cagagccugcag

SEQ ID NO: 1836209 - RNA, 13 nt, Human
cagaggaaggaga

SEQ ID NO: 1836210 - RNA, 13 nt, Human
cagagccugcagu

SEQ ID NO: 1836211 - RNA, 20 nt, Human
cagaggagagaggacccccu

SEQ ID NO: 1836212 - RNA, 11 nt, Human
cagaggcagcc

SEQ ID NO: 1836213 - RNA, 19 nt, Human
cagaggagagaggaccccc

SEQ ID NO: 1836214 - RNA, 15 nt, Human
cagaggagagaggac

SEQ ID NO: 1836215 - RNA, 13 nt, Human
cagaggagagagg

SEQ ID NO: 1836216 - RNA, 16 nt, Human
cagagaccaucccuga

SEQ ID NO: 1836217 - RNA, 14 nt, Human
cagagaccaucccu

SEQ ID NO: 1836218 - RNA, 13 nt, Human
cagagaccauccc

SEQ ID NO: 1836219 - RNA, 15 nt, Human
cagagacacaagccu

SEQ ID NO: 1836220 - RNA, 14 nt, Human
cagagacacaagcc

SEQ ID NO: 1836221 - RNA, 17 nt, Human
cagagacacaagccuuc

SEQ ID NO: 1836222 - RNA, 16 nt, Human
cagagacacaagccuu

SEQ ID NO: 1836223 - RNA, 19 nt, Human
cagagaaugaaagggccca

SEQ ID NO: 1836224 - RNA, 15 nt, Human
cagagaauucucuua

SEQ ID NO: 1836225 - RNA, 20 nt, Human
cagagaaugaaagggcccag

SEQ ID NO: 1836226 - RNA, 21 nt, Human
cagagaaugaaagggcccaga

SEQ ID NO: 1836227 - RNA, 19 nt, Human
cagagacuccugcaggcag

SEQ ID NO: 1836228 - RNA, 18 nt, Human
cagagacuccugcaggca

SEQ ID NO: 1836229 - RNA, 17 nt, Human
cagagacuccugcaggc

SEQ ID NO: 1836230 - RNA, 16 nt, Human
cagagacuccugcagg

SEQ ID NO: 1836231 - RNA, 15 nt, Human
cagagacuccugcag

SEQ ID NO: 1836232 - RNA, 14 nt, Human
cagagacuccugca

SEQ ID NO: 1836233 - RNA, 13 nt, Human
cagagacuccugc

SEQ ID NO: 1836234 - RNA, 20 nt, Human
cagagaccaucccugaaggc

SEQ ID NO: 1836235 - RNA, 19 nt, Human
cagagaccaucccugaagg

SEQ ID NO: 1836236 - RNA, 18 nt, Human
cagagaccaucccugaag

SEQ ID NO: 1836237 - RNA, 17 nt, Human
cagagaccaucccugaa

SEQ ID NO: 1836238 - RNA, 21 nt, Human
cagagaccaucccugaaggcc

SEQ ID NO: 1836239 - RNA, 20 nt, Human
cagagcaagugagacccugu

SEQ ID NO: 1836240 - RNA, 14 nt, Human
cagagcaagugaga

SEQ ID NO: 1836241 - RNA, 16 nt, Human
cagagcaccuuagaca

SEQ ID NO: 1836242 - RNA, 18 nt, Human
cagagcacagcagccccu

SEQ ID NO: 1836243 - RNA, 18 nt, Human
cagagaguggcuccuccc

SEQ ID NO: 1836244 - RNA, 15 nt, Human
cagagaguggcuccu

SEQ ID NO: 1836245 - RNA, 14 nt, Human
cagagaguggcucc

SEQ ID NO: 1836246 - RNA, 13 nt, Human
cagagaguggcuc

SEQ ID NO: 1836247 - RNA, 13 nt, Human
cagaggcugccuc

SEQ ID NO: 1836248 - RNA, 23 nt, Human
cagaggcgcaugaauuugugaag

SEQ ID NO: 1836249 - RNA, 23 nt, Human
cagaggcugccucucccaucacu

SEQ ID NO: 1836250 - RNA, 14 nt, Human
cagagggagugaca

SEQ ID NO: 1836251 - RNA, 16 nt, Human
cagagggagugacaga

SEQ ID NO: 1836252 - RNA, 18 nt, Human
cagagggagugacagagg

SEQ ID NO: 1836253 - RNA, 19 nt, Human
cagagggagugacagaggc

SEQ ID NO: 1836254 - RNA, 23 nt, Human
cagaggcagccccauucugccug

SEQ ID NO: 1836255 - RNA, 19 nt, Human
cagaggccaugggccuccu

SEQ ID NO: 1836256 - RNA, 16 nt, Human
cagaggccaugggccu

SEQ ID NO: 1836257 - RNA, 20 nt, Human
cagaggccaugggccuccug

SEQ ID NO: 1836258 - RNA, 21 nt, Human
cagaggccaugggccuccugu

SEQ ID NO: 1836259 - RNA, 12 nt, Human
cagaggcagccc

SEQ ID NO: 1836260 - RNA, 13 nt, Human
cagaggcagcccc

SEQ ID NO: 1836261 - RNA, 14 nt, Human
cagaggcagcccca

SEQ ID NO: 1836262 - RNA, 15 nt, Human
cagaggcagccccau

SEQ ID NO: 1836263 - RNA, 18 nt, Human
cagaggcagccccauucu

SEQ ID NO: 1836264 - RNA, 19 nt, Human
cagaggcagccccauucug

SEQ ID NO: 1836265 - RNA, 20 nt, Human
cagaggcagccccauucugc

SEQ ID NO: 1836266 - RNA, 22 nt, Human
cagaggcagccccauucugccu

SEQ ID NO: 1836267 - RNA, 13 nt, Human
cagagucucacug

SEQ ID NO: 1836268 - RNA, 17 nt, Human
cagagucucacuguugc

SEQ ID NO: 1836269 - RNA, 19 nt, Human
cagagucucacuguugccc

SEQ ID NO: 1836270 - RNA, 20 nt, Human
cagagucucacuguugccca

SEQ ID NO: 1836271 - RNA, 21 nt, Human
cagagucucacuguugcccag

SEQ ID NO: 1836272 - RNA, 19 nt, Human
cagagggccugcaagggag

SEQ ID NO: 1836273 - RNA, 15 nt, Human
cagagggccugcaag

SEQ ID NO: 1836274 - RNA, 20 nt, Human
cagagggagugacagaggca

SEQ ID NO: 1836275 - RNA, 21 nt, Human
cagagggagugacagaggcag

SEQ ID NO: 1836276 - RNA, 22 nt, Human
cagagggagugacagaggcagc

SEQ ID NO: 1836277 - RNA, 23 nt, Human
cagagggagugacagaggcagcc

SEQ ID NO: 1836278 - RNA, 23 nt, Human
cagagucucgcucuguugcccag

SEQ ID NO: 1836279 - RNA, 22 nt, Human
cagagucucacuguugcccagg

SEQ ID NO: 1836280 - RNA, 23 nt, Human
cagagucucacuguugcccaggc

SEQ ID NO: 1836281 - RNA, 16 nt, Human
cagagugagacucugu

SEQ ID NO: 1836282 - RNA, 17 nt, Human
cagagugagacucuguc

SEQ ID NO: 1836283 - RNA, 18 nt, Human
cagagugagacucugucu

SEQ ID NO: 1836284 - RNA, 19 nt, Human
cagagugagacucugucuc

SEQ ID NO: 1836285 - RNA, 20 nt, Human
cagagugagacucugucuca

SEQ ID NO: 1836286 - RNA, 16 nt, Human
cagaguugaagacaga

SEQ ID NO: 1836287 - RNA, 15 nt, Human
cagaguugaagacag

SEQ ID NO: 1836288 - RNA, 14 nt, Human
cagaguugaagaca

SEQ ID NO: 1836289 - RNA, 20 nt, Human
cagaguugaagacagagcua

SEQ ID NO: 1836290 - RNA, 19 nt, Human
cagaguugaagacagagcu

SEQ ID NO: 1836291 - RNA, 18 nt, Human
cagaguugaagacagagc

SEQ ID NO: 1836292 - RNA, 17 nt, Human
cagaguugaagacagag

SEQ ID NO: 1836293 - RNA, 14 nt, Human
cagaguuguuacau

SEQ ID NO: 1836294 - RNA, 22 nt, Human
cagaguugaagacagagcuaca

SEQ ID NO: 1836295 - RNA, 23 nt, Human
cagauaaauaguuuaugauucca

SEQ ID NO: 1836296 - RNA, 22 nt, Human
cagauaaagguucaugcaaacu

SEQ ID NO: 1836297 - RNA, 14 nt, Human
cagauaaacaguag

SEQ ID NO: 1836298 - RNA, 15 nt, Human
cagaguuguuacauu

SEQ ID NO: 1836299 - RNA, 18 nt, Human
cagaguuguuacauuuuu

SEQ ID NO: 1836300 - RNA, 19 nt, Human
cagaguuguuacauuuuua

SEQ ID NO: 1836301 - RNA, 20 nt, Human
cagaucucuaacuucaccau

SEQ ID NO: 1836302 - RNA, 20 nt, Human
cagauacaggaaaagcugcu

SEQ ID NO: 1836303 - RNA, 21 nt, Human
cagauacaggaaaagcugcug

SEQ ID NO: 1836304 - RNA, 22 nt, Human
cagauacaggaaaagcugcuga

SEQ ID NO: 1836305 - RNA, 17 nt, Human
cagaugcaccagcccuu

SEQ ID NO: 1836306 - RNA, 22 nt, Human
cagaugcaccagcccuuagcag

SEQ ID NO: 1836307 - RNA, 13 nt, Human
cagaugcaccagc

SEQ ID NO: 1836308 - RNA, 14 nt, Human
cagaugcaccagcc

SEQ ID NO: 1836309 - RNA, 16 nt, Human
cagaugcaccagcccu

SEQ ID NO: 1836310 - RNA, 16 nt, Human
cagacaacaaaccugu

SEQ ID NO: 1836311 - RNA, 23 nt, Human
cagaaaauggaagacagcucuua

SEQ ID NO: 1836312 - RNA, 22 nt, Human
cagaaaauggaagacagcucuu

SEQ ID NO: 1836313 - RNA, 21 nt, Human
cagaaaauggaagacagcucu

SEQ ID NO: 1836314 - RNA, 20 nt, Human
cagaaaauggaagacagcuc

SEQ ID NO: 1836315 - RNA, 16 nt, Human
cagaaaauggaagaca

SEQ ID NO: 1836316 - RNA, 21 nt, Human
cagaaaagaaaguucaugcuu

SEQ ID NO: 1836317 - RNA, 23 nt, Human
cagaacagugauuaccagggacu

SEQ ID NO: 1836318 - RNA, 19 nt, Human
cagaaagcagaacagugau

SEQ ID NO: 1836319 - RNA, 18 nt, Human
cagaaagcagaacaguga

SEQ ID NO: 1836320 - RNA, 24 nt, Human
cagaaagaaguggggacagagcag

SEQ ID NO: 1836321 - RNA, 23 nt, Human
cacuuuguucuggcucuuccagg

SEQ ID NO: 1836322 - RNA, 16 nt, Human
cacuuuguucuggcuc

SEQ ID NO: 1836323 - RNA, 14 nt, Human
cacuuuguucuggc

SEQ ID NO: 1836324 - RNA, 13 nt, Human
cacuuuguucugg

SEQ ID NO: 1836325 - RNA, 13 nt, Human
cacuuugggaggc

SEQ ID NO: 1836326 - RNA, 12 nt, Human
cacuuugggagg

SEQ ID NO: 1836327 - RNA, 16 nt, Human
cacuuugggaggccaa

SEQ ID NO: 1836328 - RNA, 22 nt, Human
cacuuucuagccagaggagaga

SEQ ID NO: 1836329 - RNA, 12 nt, Human
cacuuugcauaa

SEQ ID NO: 1836330 - RNA, 18 nt, Human
cacuuuuauuuagcacca

SEQ ID NO: 1836331 - RNA, 22 nt, Human
cacuuuuguucuugguuuguaa

SEQ ID NO: 1836332 - RNA, 14 nt, Human
cacuuuuguucuug

SEQ ID NO: 1836333 - RNA, 18 nt, Human
cagaaucucaaauaacua

SEQ ID NO: 1836334 - RNA, 17 nt, Human
cagaaucucaaauaacu

SEQ ID NO: 1836335 - RNA, 18 nt, Human
cagaaggaagacuucauc

SEQ ID NO: 1836336 - RNA, 17 nt, Human
cagaaggaagacuucau

SEQ ID NO: 1836337 - RNA, 16 nt, Human
cagaaggaagacuuca

SEQ ID NO: 1836338 - RNA, 19 nt, Human
cagaaggaagacuucaucc

SEQ ID NO: 1836339 - RNA, 19 nt, Human
cagaagcaacccaaauguu

SEQ ID NO: 1836340 - RNA, 20 nt, Human
cagaagcaacccaaauguuc

SEQ ID NO: 1836341 - RNA, 13 nt, Human
cagaagcagcucu

SEQ ID NO: 1836342 - RNA, 14 nt, Human
cagaagcagcucuu

SEQ ID NO: 1836343 - RNA, 21 nt, Human
cagaagacacugaugggcaac

SEQ ID NO: 1836344 - RNA, 22 nt, Human
cagaacccuuggagccaaugga

SEQ ID NO: 1836345 - RNA, 15 nt, Human
cagaauucucuaguu

SEQ ID NO: 1836346 - RNA, 18 nt, Human
cagaauucucuaguuuga

SEQ ID NO: 1836347 - RNA, 11 nt, Human
cagaauucuca

SEQ ID NO: 1836348 - RNA, 14 nt, Human
cagaauuucccaaa

SEQ ID NO: 1836349 - RNA, 15 nt, Human
cagaaucucgcucug

SEQ ID NO: 1836350 - RNA, 20 nt, Human
cagaauuucccaaagcagug

SEQ ID NO: 1836351 - RNA, 19 nt, Human
cagaauuucccaaagcagu

SEQ ID NO: 1836352 - RNA, 18 nt, Human
cagaauuucccaaagcag

SEQ ID NO: 1836353 - RNA, 17 nt, Human
cagaauuucccaaagca

SEQ ID NO: 1836354 - RNA, 12 nt, Human
cagacaaagcgu

SEQ ID NO: 1836355 - RNA, 24 nt, Human
cagaauuucccaaagcagugcaug

SEQ ID NO: 1836356 - RNA, 20 nt, Human
cagacaacaaaccuguuucu

SEQ ID NO: 1836357 - RNA, 22 nt, Human
cagacaaagcgugguggacaug

SEQ ID NO: 1836358 - RNA, 23 nt, Human
cagacacauguccaagaagccca

SEQ ID NO: 1836359 - RNA, 22 nt, Human
cagacacauguccaagaagccc

SEQ ID NO: 1836360 - RNA, 21 nt, Human
cagacacauguccaagaagcc

SEQ ID NO: 1836361 - RNA, 17 nt, Human
cagacacauguccaaga

SEQ ID NO: 1836362 - RNA, 14 nt, Human
cagacacaugucca

SEQ ID NO: 1836363 - RNA, 13 nt, Human
cagacacaggccc

SEQ ID NO: 1836364 - RNA, 14 nt, Human
cagacacaggcccg

SEQ ID NO: 1836365 - RNA, 15 nt, Human
cagacacaggcccgg

SEQ ID NO: 1836366 - RNA, 17 nt, Human
cagacacaggcccggcu

SEQ ID NO: 1836367 - RNA, 18 nt, Human
cagacacaggcccggcuc

SEQ ID NO: 1836368 - RNA, 21 nt, Human
cagacacaggcccggcuccag

SEQ ID NO: 1836369 - RNA, 22 nt, Human
cagacacaggcccggcuccagg

SEQ ID NO: 1836370 - RNA, 23 nt, Human
cagacacaggcccggcuccaggc

SEQ ID NO: 1836371 - RNA, 17 nt, Human
cagacauagaauuaaca

SEQ ID NO: 1836372 - RNA, 19 nt, Human
cagacauagaauuaacaca

SEQ ID NO: 1836373 - RNA, 19 nt, Human
cagacauacuaaccagcag

SEQ ID NO: 1836374 - RNA, 20 nt, Human
cagacaguuaagagaaauga

SEQ ID NO: 1836375 - RNA, 19 nt, Human
cagacaccuugacagggca

SEQ ID NO: 1836376 - RNA, 20 nt, Human
cagacaccuugacagggcac

SEQ ID NO: 1836377 - RNA, 22 nt, Human
cagacaccuugacagggcacac

SEQ ID NO: 1836378 - RNA, 20 nt, Human
cagacuuuuuuuaaauagua

SEQ ID NO: 1836379 - RNA, 19 nt, Human
cagagaaaguacuucucca

SEQ ID NO: 1836380 - RNA, 23 nt, Human
cagagaaaguacuucuccacccu

SEQ ID NO: 1836381 - RNA, 20 nt, Human
cagaccacaaaacuuuucua

SEQ ID NO: 1836382 - RNA, 14 nt, Human
cagaccacaaaacu

SEQ ID NO: 1836383 - RNA, 18 nt, Human
cagaccccuggcuuuuca

SEQ ID NO: 1836384 - RNA, 16 nt, Human
cagaccccuggcuuuu

SEQ ID NO: 1836385 - RNA, 15 nt, Human
cagaccccuggcuuu

SEQ ID NO: 1836386 - RNA, 14 nt, Human
cagaccccuggcuu

SEQ ID NO: 1836387 - RNA, 13 nt, Human
cagaccccuggcu

SEQ ID NO: 1836388 - RNA, 21 nt, Human
cagacccugcccugugggccc

SEQ ID NO: 1836389 - RNA, 17 nt, Human
cagacccugcccugugg

SEQ ID NO: 1836390 - RNA, 16 nt, Human
cagacccugcccugug

SEQ ID NO: 1836391 - RNA, 15 nt, Human
cagacccugcccugu

SEQ ID NO: 1836392 - RNA, 22 nt, Human
cagacccugcccugugggcccc

SEQ ID NO: 1836393 - RNA, 14 nt, Human
cagacccugcccug

SEQ ID NO: 1836394 - RNA, 13 nt, Human
cagacccugcccu

SEQ ID NO: 1836395 - RNA, 12 nt, Human
cagacccugccc

SEQ ID NO: 1836396 - RNA, 16 nt, Human
cagacccggcugcgug

SEQ ID NO: 1836397 - RNA, 23 nt, Human
cagaccccuggcuuuucacugcu

SEQ ID NO: 1836398 - RNA, 22 nt, Human
cagaccccuggcuuuucacugc

SEQ ID NO: 1836399 - RNA, 21 nt, Human
cagaccccuggcuuuucacug

SEQ ID NO: 1836400 - RNA, 12 nt, Human
cagacccggcug

SEQ ID NO: 1836401 - RNA, 14 nt, Human
cagacccggcugcg

SEQ ID NO: 1836402 - RNA, 18 nt, Human
cagccuccaugcugccuc

SEQ ID NO: 1836403 - RNA, 14 nt, Human
cagcucaccagccc

SEQ ID NO: 1836404 - RNA, 20 nt, Human
cagcaauucuccugccucag

SEQ ID NO: 1836405 - RNA, 19 nt, Human
cagcaauucuccugccuca

SEQ ID NO: 1836406 - RNA, 18 nt, Human
cagcaauucuccugccuc

SEQ ID NO: 1836407 - RNA, 17 nt, Human
cagcaauucuccugccu

SEQ ID NO: 1836408 - RNA, 16 nt, Human
cagcaauucuccugcc

SEQ ID NO: 1836409 - RNA, 15 nt, Human
cagcaauucuccugc

SEQ ID NO: 1836410 - RNA, 22 nt, Human
cagcaauaaagcagcguuucua

SEQ ID NO: 1836411 - RNA, 13 nt, Human
cagcaauaaagca

SEQ ID NO: 1836412 - RNA, 21 nt, Human
cagcaauaaagcagcguuucu

SEQ ID NO: 1836413 - RNA, 19 nt, Human
cagcaagugagagcugggu

SEQ ID NO: 1836414 - RNA, 21 nt, Human
cagcaagugagagcugggugu

SEQ ID NO: 1836415 - RNA, 14 nt, Human
cagcaagugagagc

SEQ ID NO: 1836416 - RNA, 15 nt, Human
cagcaagugagagcu

SEQ ID NO: 1836417 - RNA, 16 nt, Human
cagcaagugagagcug

SEQ ID NO: 1836418 - RNA, 17 nt, Human
cagcaagugagagcugg

SEQ ID NO: 1836419 - RNA, 12 nt, Human
cagcaagugaga

SEQ ID NO: 1836420 - RNA, 18 nt, Human
cagcaaggagauuuacaa

SEQ ID NO: 1836421 - RNA, 17 nt, Human
cagcaaggagauuuaca

SEQ ID NO: 1836422 - RNA, 15 nt, Human
cagcagaaaugccuu

SEQ ID NO: 1836423 - RNA, 17 nt, Human
cagcagaaaugccuuac

SEQ ID NO: 1836424 - RNA, 19 nt, Human
cagcagaaaugccuuaccc

SEQ ID NO: 1836425 - RNA, 22 nt, Human
cagcagaaaugccuuacccuca

SEQ ID NO: 1836426 - RNA, 13 nt, Human
cagcagagcaccu

SEQ ID NO: 1836427 - RNA, 11 nt, Human
cagcagagcac

SEQ ID NO: 1836428 - RNA, 23 nt, Human
cagcagccccugcacaaagcccu

SEQ ID NO: 1836429 - RNA, 16 nt, Human
cagcagccccugcaca

SEQ ID NO: 1836430 - RNA, 13 nt, Human
cagcagccccugc

SEQ ID NO: 1836431 - RNA, 18 nt, Human
cagaugggugcuuggagg

SEQ ID NO: 1836432 - RNA, 15 nt, Human
cagaugcugugcaaa

SEQ ID NO: 1836433 - RNA, 23 nt, Human
cagaugggugcuuggaggaagga

SEQ ID NO: 1836434 - RNA, 18 nt, Human
cagcaaaagaugcuucuc

SEQ ID NO: 1836435 - RNA, 14 nt, Human
cagauucuuuccug

SEQ ID NO: 1836436 - RNA, 22 nt, Human
cagauuuuuuacagcugccugc

SEQ ID NO: 1836437 - RNA, 19 nt, Human
cagauuuuuuacagcugcc

SEQ ID NO: 1836438 - RNA, 15 nt, Human
cagcccaccccucaa

SEQ ID NO: 1836439 - RNA, 19 nt, Human
cagcccacauagugauggu

SEQ ID NO: 1836440 - RNA, 15 nt, Human
cagcccacuucugcc

SEQ ID NO: 1836441 - RNA, 21 nt, Human
cagccccaaaacucuccucug

SEQ ID NO: 1836442 - RNA, 20 nt, Human
cagccccaaaacucuccucu

SEQ ID NO: 1836443 - RNA, 22 nt, Human
cagccccaaaacucuccucugc

SEQ ID NO: 1836444 - RNA, 18 nt, Human
cagcccacuucugccaua

SEQ ID NO: 1836445 - RNA, 22 nt, Human
cagccaguaaaugggggugcau

SEQ ID NO: 1836446 - RNA, 23 nt, Human
cagccacggccaggccagaggga

SEQ ID NO: 1836447 - RNA, 14 nt, Human
cagccacggccagg

SEQ ID NO: 1836448 - RNA, 15 nt, Human
cagccacggccaggc

SEQ ID NO: 1836449 - RNA, 16 nt, Human
cagccacggccaggcc

SEQ ID NO: 1836450 - RNA, 17 nt, Human
cagccacggccaggcca

SEQ ID NO: 1836451 - RNA, 18 nt, Human
cagccacggccaggccag

SEQ ID NO: 1836452 - RNA, 19 nt, Human
cagccacggccaggccaga

SEQ ID NO: 1836453 - RNA, 21 nt, Human
cagccacggccaggccagagg

SEQ ID NO: 1836454 - RNA, 22 nt, Human
cagccacggccaggccagaggg

SEQ ID NO: 1836455 - RNA, 14 nt, Human
cagccacauuccug

SEQ ID NO: 1836456 - RNA, 17 nt, Human
cagccacauuccugaug

SEQ ID NO: 1836457 - RNA, 15 nt, Human
cagccacauuccuga

SEQ ID NO: 1836458 - RNA, 19 nt, Human
cagccacauuccugaugcu

SEQ ID NO: 1836459 - RNA, 18 nt, Human
cagcagggagggcuucug

SEQ ID NO: 1836460 - RNA, 22 nt, Human
cagcaggcucucaggccagcug

SEQ ID NO: 1836461 - RNA, 20 nt, Human
cagcaggcucucaggccagc

SEQ ID NO: 1836462 - RNA, 19 nt, Human
cagcaggcucucaggccag

SEQ ID NO: 1836463 - RNA, 18 nt, Human
cagcaggcucucaggcca

SEQ ID NO: 1836464 - RNA, 17 nt, Human
cagcaggcucucaggcc

SEQ ID NO: 1836465 - RNA, 16 nt, Human
cagcaggcucucaggc

SEQ ID NO: 1836466 - RNA, 20 nt, Human
cagcagggagggcuucugcc

SEQ ID NO: 1836467 - RNA, 14 nt, Human
cagcauccuggcac

SEQ ID NO: 1836468 - RNA, 15 nt, Human
cagcauccuggcacc

SEQ ID NO: 1836469 - RNA, 16 nt, Human
cagcauccuggcaccc

SEQ ID NO: 1836470 - RNA, 17 nt, Human
cagcauccuggcacccg

SEQ ID NO: 1836471 - RNA, 18 nt, Human
cagcagccuggacccugu

SEQ ID NO: 1836472 - RNA, 15 nt, Human
cagcagccuggaccc

SEQ ID NO: 1836473 - RNA, 14 nt, Human
cagcagccuggacc

SEQ ID NO: 1836474 - RNA, 12 nt, Human
cagcagccugga

SEQ ID NO: 1836475 - RNA, 22 nt, Human
cagcagccuggacccuguggau

SEQ ID NO: 1836476 - RNA, 19 nt, Human
cagcagccuggacccugug

SEQ ID NO: 1836477 - RNA, 15 nt, Human
cagcaggcucucagg

SEQ ID NO: 1836478 - RNA, 14 nt, Human
cagcaggcucucag

SEQ ID NO: 1836479 - RNA, 12 nt, Human
cagcaggcucuc

SEQ ID NO: 1836480 - RNA, 18 nt, Human
cagccaacuauggccugu

SEQ ID NO: 1836481 - RNA, 21 nt, Human
cagccaaagccuccuccagcc

SEQ ID NO: 1836482 - RNA, 18 nt, Human
cagccaaagccuccucca

SEQ ID NO: 1836483 - RNA, 16 nt, Human
cagccaaagccuccuc

SEQ ID NO: 1836484 - RNA, 15 nt, Human
cagccaaagccuccu

SEQ ID NO: 1836485 - RNA, 14 nt, Human
cagcauucucacuc

SEQ ID NO: 1836486 - RNA, 15 nt, Human
cagcauucucacucc

SEQ ID NO: 1836487 - RNA, 21 nt, Human
cagcauccuggcacccggccc

SEQ ID NO: 1836488 - RNA, 19 nt, Human
cagcauccuggcacccggc

SEQ ID NO: 1836489 - RNA, 20 nt, Human
cagcauccuggcacccggcc

SEQ ID NO: 1836490 - RNA, 16 nt, Human
cagcccgggcucugcc

SEQ ID NO: 1836491 - RNA, 15 nt, Human
cagcccgggcucugc

SEQ ID NO: 1836492 - RNA, 14 nt, Human
cagcccgggcucug

SEQ ID NO: 1836493 - RNA, 13 nt, Human
cagcccgggcucu

SEQ ID NO: 1836494 - RNA, 21 nt, Human
cagccccuucugacccaugcu

SEQ ID NO: 1836495 - RNA, 19 nt, Human
cagccccuucugacccaug

SEQ ID NO: 1836496 - RNA, 17 nt, Human
cagccccuucugaccca

SEQ ID NO: 1836497 - RNA, 16 nt, Human
cagccccuucugaccc

SEQ ID NO: 1836498 - RNA, 23 nt, Human
cagccccuucugacccaugcugc

SEQ ID NO: 1836499 - RNA, 22 nt, Human
cagccccuucugacccaugcug

SEQ ID NO: 1836500 - RNA, 24 nt, Human
cagccccuucugacccaugcugcc

SEQ ID NO: 1836501 - RNA, 20 nt, Human
cagcccgggcucugccuccc

SEQ ID NO: 1836502 - RNA, 19 nt, Human
cagcccgggcucugccucc

SEQ ID NO: 1836503 - RNA, 18 nt, Human
cagcccgggcucugccuc

SEQ ID NO: 1836504 - RNA, 17 nt, Human
cagcccgggcucugccu

SEQ ID NO: 1836505 - RNA, 22 nt, Human
cagcccgggcucugccucccau

SEQ ID NO: 1836506 - RNA, 21 nt, Human
cagcccgggcucugccuccca

SEQ ID NO: 1836507 - RNA, 15 nt, Human
cagcccucccugccc

SEQ ID NO: 1836508 - RNA, 13 nt, Human
cagcccucccugc

SEQ ID NO: 1836509 - RNA, 23 nt, Human
cagcccuccaucuaaacugcccc

SEQ ID NO: 1836510 - RNA, 22 nt, Human
cagcccuccaucuaaacugccc

SEQ ID NO: 1836511 - RNA, 13 nt, Human
cagccccagugcc

SEQ ID NO: 1836512 - RNA, 14 nt, Human
cagccccagugccc

SEQ ID NO: 1836513 - RNA, 15 nt, Human
cagccccagugccca

SEQ ID NO: 1836514 - RNA, 16 nt, Human
cagccccagugcccac

SEQ ID NO: 1836515 - RNA, 21 nt, Human
cagccccaucccaaacccuuc

SEQ ID NO: 1836516 - RNA, 11 nt, Human
cagccccaucc

SEQ ID NO: 1836517 - RNA, 17 nt, Human
cagccccagugcccaca

SEQ ID NO: 1836518 - RNA, 18 nt, Human
cagccccagugcccacag

SEQ ID NO: 1836519 - RNA, 21 nt, Human
cagccccuguucuggcagagu

SEQ ID NO: 1836520 - RNA, 20 nt, Human
cagccccuguucuggcagag

SEQ ID NO: 1836521 - RNA, 16 nt, Human
cagccccauucugccu

SEQ ID NO: 1836522 - RNA, 17 nt, Human
cagccccauucugccug

SEQ ID NO: 1836523 - RNA, 23 nt, Human
cagccccuggaugcagccucaca

SEQ ID NO: 1836524 - RNA, 18 nt, Human
cagccccauucugccugc

SEQ ID NO: 1836525 - RNA, 14 nt, Human
cagccccauccucu

SEQ ID NO: 1836526 - RNA, 13 nt, Human
cagccccauccuc

SEQ ID NO: 1836527 - RNA, 12 nt, Human
cagccccauccu

SEQ ID NO: 1836528 - RNA, 22 nt, Human
cagccccaucccaaacccuuca

SEQ ID NO: 1836529 - RNA, 22 nt, Human
cagccccauccucuguacagag

SEQ ID NO: 1836530 - RNA, 16 nt, Human
cagccccauccucugu

SEQ ID NO: 1836531 - RNA, 13 nt, Human
cagccccauucug

SEQ ID NO: 1836532 - RNA, 14 nt, Human
cagccccauucugc

SEQ ID NO: 1836533 - RNA, 21 nt, Human
cagccguguaaccauggaccc

SEQ ID NO: 1836534 - RNA, 20 nt, Human
cagccgugccuucagcucua

SEQ ID NO: 1836535 - RNA, 18 nt, Human
cagccgugccuucagcuc

SEQ ID NO: 1836536 - RNA, 16 nt, Human
cagccgugccuucagc

SEQ ID NO: 1836537 - RNA, 14 nt, Human
cagccgugccuuca

SEQ ID NO: 1836538 - RNA, 9 nt, Human
cagccgugc

SEQ ID NO: 1836539 - RNA, 23 nt, Human
cagcccugcuuugggcugcccug

SEQ ID NO: 1836540 - RNA, 22 nt, Human
cagcccugcuuugggcugcccu

SEQ ID NO: 1836541 - RNA, 21 nt, Human
cagcccugcuuugggcugccc

SEQ ID NO: 1836542 - RNA, 20 nt, Human
cagcccugcuuugggcugcc

SEQ ID NO: 1836543 - RNA, 19 nt, Human
cagcccugcuuugggcugc

SEQ ID NO: 1836544 - RNA, 13 nt, Human
cagcccugcuuug

SEQ ID NO: 1836545 - RNA, 11 nt, Human
cagcccugcuu

SEQ ID NO: 1836546 - RNA, 16 nt, Human
cagcccugcagagggc

SEQ ID NO: 1836547 - RNA, 15 nt, Human
cagcccugcagaggg

SEQ ID NO: 1836548 - RNA, 14 nt, Human
cagcccugcagagg

SEQ ID NO: 1836549 - RNA, 13 nt, Human
cagcccugcagag

SEQ ID NO: 1836550 - RNA, 20 nt, Human
cagcccugcagagggcacag

SEQ ID NO: 1836551 - RNA, 18 nt, Human
cagcccugcagagggcac

SEQ ID NO: 1836552 - RNA, 22 nt, Human
cagcccucccugccccucccuu

SEQ ID NO: 1836553 - RNA, 18 nt, Human
cagcccucccugccccuc

SEQ ID NO: 1836554 - RNA, 17 nt, Human
cagcccucccugccccu

SEQ ID NO: 1836555 - RNA, 16 nt, Human
cagcccucccugcccc

SEQ ID NO: 1836556 - RNA, 14 nt, Human
cagccuccaugcug

SEQ ID NO: 1836557 - RNA, 20 nt, Human
cagccuccaugcugccucca

SEQ ID NO: 1836558 - RNA, 17 nt, Human
cagccuccaugcugccu

SEQ ID NO: 1836559 - RNA, 15 nt, Human
cagccuccaugcugc

SEQ ID NO: 1836560 - RNA, 19 nt, Human
cagccucccaaagugcugg

SEQ ID NO: 1836561 - RNA, 20 nt, Human
cagccucccaaagugcuggg

SEQ ID NO: 1836562 - RNA, 21 nt, Human
cagccucccaaagugcuggga

SEQ ID NO: 1836563 - RNA, 23 nt, Human
cagccucccaaagugcugggauu

SEQ ID NO: 1836564 - RNA, 20 nt, Human
cagccucccgaauagcuggg

SEQ ID NO: 1836565 - RNA, 21 nt, Human
cagccucccgaauagcuggga

SEQ ID NO: 1836566 - RNA, 22 nt, Human
cagccucccgaauagcugggac

SEQ ID NO: 1836567 - RNA, 20 nt, Human
cagccucacaguccuuacca

SEQ ID NO: 1836568 - RNA, 15 nt, Human
cagccucacaguccu

SEQ ID NO: 1836569 - RNA, 14 nt, Human
cagccucacagucc

SEQ ID NO: 1836570 - RNA, 20 nt, Human
cagccuccaagcuccaucuc

SEQ ID NO: 1836571 - RNA, 14 nt, Human
cagccuccaagcuc

SEQ ID NO: 1836572 - RNA, 19 nt, Human
cagccucaaccuccugggc

SEQ ID NO: 1836573 - RNA, 20 nt, Human
cagccucaaccuccugggcu

SEQ ID NO: 1836574 - RNA, 21 nt, Human
cagccucaaccuccugggcua

SEQ ID NO: 1836575 - RNA, 17 nt, Human
cagccucaaccuccugg

SEQ ID NO: 1836576 - RNA, 18 nt, Human
cagccucaaccuccuggg

SEQ ID NO: 1836577 - RNA, 20 nt, Human
cagcucaccucucccuugga

SEQ ID NO: 1836578 - RNA, 19 nt, Human
cagcucaccucucccuugg

SEQ ID NO: 1836579 - RNA, 14 nt, Human
cagcucacugcaac

SEQ ID NO: 1836580 - RNA, 12 nt, Human
cagcucacugca

SEQ ID NO: 1836581 - RNA, 12 nt, Human
cagcucagagag

SEQ ID NO: 1836582 - RNA, 15 nt, Human
cagcucacugcaacc

SEQ ID NO: 1836583 - RNA, 21 nt, Human
cagcucacugcaaccuucgcc

SEQ ID NO: 1836584 - RNA, 17 nt, Human
cagcucaccucucccuu

SEQ ID NO: 1836585 - RNA, 16 nt, Human
cagcucaccucucccu

SEQ ID NO: 1836586 - RNA, 15 nt, Human
cagcucaccucuccc

SEQ ID NO: 1836587 - RNA, 13 nt, Human
cagcucaccucuc

SEQ ID NO: 1836588 - RNA, 22 nt, Human
cagcucaccagccccagugccc

SEQ ID NO: 1836589 - RNA, 20 nt, Human
cagcucaccagccccagugc

SEQ ID NO: 1836590 - RNA, 21 nt, Human
cagcucaccagccccagugcc

SEQ ID NO: 1836591 - RNA, 13 nt, Human
cagcucaccagcc

SEQ ID NO: 1836592 - RNA, 15 nt, Human
cagcucaccagcccc

SEQ ID NO: 1836593 - RNA, 16 nt, Human
cagcucaccagcccca

SEQ ID NO: 1836594 - RNA, 17 nt, Human
cagcucaccagccccag

SEQ ID NO: 1836595 - RNA, 19 nt, Human
cagcucaccagccccagug

SEQ ID NO: 1836596 - RNA, 18 nt, Human
cagcuaacauggaaguac

SEQ ID NO: 1836597 - RNA, 19 nt, Human
cagcuaacauggaaguacu

SEQ ID NO: 1836598 - RNA, 21 nt, Human
cagcgagcccugguggcagug

SEQ ID NO: 1836599 - RNA, 13 nt, Human
cagcgagcccugg

SEQ ID NO: 1836600 - RNA, 16 nt, Human
cagcgagcccuggugg

SEQ ID NO: 1836601 - RNA, 17 nt, Human
cagcgagcccugguggc

SEQ ID NO: 1836602 - RNA, 19 nt, Human
cagcgagcccugguggcag

SEQ ID NO: 1836603 - RNA, 20 nt, Human
cagcgagcccugguggcagu

SEQ ID NO: 1836604 - RNA, 19 nt, Human
cagcuacuugggaggcuga

SEQ ID NO: 1836605 - RNA, 20 nt, Human
cagcuaacauggaaguacua

SEQ ID NO: 1836606 - RNA, 19 nt, Human
cagcuaaucagcauucuca

SEQ ID NO: 1836607 - RNA, 15 nt, Human
cagcuaaugggacac

SEQ ID NO: 1836608 - RNA, 16 nt, Human
cagcuaaugggacacu

SEQ ID NO: 1836609 - RNA, 19 nt, Human
cagccugggcaaugugaua

SEQ ID NO: 1836610 - RNA, 16 nt, Human
cagccugggcaaugug

SEQ ID NO: 1836611 - RNA, 21 nt, Human
cagccuugaccauucuccacc

SEQ ID NO: 1836612 - RNA, 20 nt, Human
cagccuugaccauucuccac

SEQ ID NO: 1836613 - RNA, 17 nt, Human
cagccuugaccauucuc

SEQ ID NO: 1836614 - RNA, 14 nt, Human
cagccugugucuuu

SEQ ID NO: 1836615 - RNA, 23 nt, Human
cagccugugucuuuaaaugcugc

SEQ ID NO: 1836616 - RNA, 24 nt, Human
cagccuugaccauucuccaccugc

SEQ ID NO: 1836617 - RNA, 23 nt, Human
cagccuugaccauucuccaccug

SEQ ID NO: 1836618 - RNA, 22 nt, Human
cagccuugaccauucuccaccu

SEQ ID NO: 1836619 - RNA, 19 nt, Human
cagccuggacccuguggau

SEQ ID NO: 1836620 - RNA, 15 nt, Human
cagccuggacccugu

SEQ ID NO: 1836621 - RNA, 10 nt, Human
cagccuggca

SEQ ID NO: 1836622 - RNA, 21 nt, Human
cagccuggcacagggcagugg

SEQ ID NO: 1836623 - RNA, 20 nt, Human
cagccuggcacagggcagug

SEQ ID NO: 1836624 - RNA, 13 nt, Human
cagccuggcacag

SEQ ID NO: 1836625 - RNA, 20 nt, Human
cagccugcuccagcuguuca

SEQ ID NO: 1836626 - RNA, 15 nt, Human
cagccuccugaguag

SEQ ID NO: 1836627 - RNA, 20 nt, Human
cagccuccugaguagcugga

SEQ ID NO: 1836628 - RNA, 23 nt, Human
cagccucccgaauagcugggacu

SEQ ID NO: 1836629 - RNA, 19 nt, Human
cagccucccgaguagcugg

SEQ ID NO: 1836630 - RNA, 20 nt, Human
cagccucccgaguagcuggg

SEQ ID NO: 1836631 - RNA, 21 nt, Human
cagccucccgaguagcuggga

SEQ ID NO: 1836632 - RNA, 22 nt, Human
cagccucccgaguagcugggac

SEQ ID NO: 1836633 - RNA, 23 nt, Human
cagccucccgaguagcugggacu

SEQ ID NO: 1836634 - RNA, 22 nt, Human
caggaagcucagggccuggcuc

SEQ ID NO: 1836635 - RNA, 21 nt, Human
cagcucugguccauagagagc

SEQ ID NO: 1836636 - RNA, 18 nt, Human
cagcucugguccauagag

SEQ ID NO: 1836637 - RNA, 17 nt, Human
cagcucugguccauaga

SEQ ID NO: 1836638 - RNA, 16 nt, Human
cagcucugguccauag

SEQ ID NO: 1836639 - RNA, 13 nt, Human
cagcucuggucca

SEQ ID NO: 1836640 - RNA, 10 nt, Human
cagcucuggu

SEQ ID NO: 1836641 - RNA, 23 nt, Human
cagcucugguccauagagagcaa

SEQ ID NO: 1836642 - RNA, 22 nt, Human
cagcucugguccauagagagca

SEQ ID NO: 1836643 - RNA, 12 nt, Human
cagcucuguccu

SEQ ID NO: 1836644 - RNA, 13 nt, Human
cagcucuguccug

SEQ ID NO: 1836645 - RNA, 14 nt, Human
cagcucuguccugg

SEQ ID NO: 1836646 - RNA, 16 nt, Human
cagcucuguccuggga

SEQ ID NO: 1836647 - RNA, 17 nt, Human
cagcucuguccugggag

SEQ ID NO: 1836648 - RNA, 18 nt, Human
cagcucuguccugggagu

SEQ ID NO: 1836649 - RNA, 21 nt, Human
cagcucuuauauugccauuuc

SEQ ID NO: 1836650 - RNA, 10 nt, Human
cagcucuuau

SEQ ID NO: 1836651 - RNA, 23 nt, Human
cagcucuguccugggagugagcu

SEQ ID NO: 1836652 - RNA, 13 nt, Human
cagcucuucucca

SEQ ID NO: 1836653 - RNA, 14 nt, Human
cagcucuucuccag

SEQ ID NO: 1836654 - RNA, 15 nt, Human
cagcucuucuccagg

SEQ ID NO: 1836655 - RNA, 16 nt, Human
cagcucuucuccaggc

SEQ ID NO: 1836656 - RNA, 17 nt, Human
cagcucuucuccaggcu

SEQ ID NO: 1836657 - RNA, 18 nt, Human
cagcucuucuccaggcug

SEQ ID NO: 1836658 - RNA, 19 nt, Human
cagcucuucuccaggcugu

SEQ ID NO: 1836659 - RNA, 23 nt, Human
cagcucuucuccaggcuguaucc

SEQ ID NO: 1836660 - RNA, 20 nt, Human
cagcucagagagggugggag

SEQ ID NO: 1836661 - RNA, 19 nt, Human
cagcucagagaggguggga

SEQ ID NO: 1836662 - RNA, 17 nt, Human
cagcucagagagggugg

SEQ ID NO: 1836663 - RNA, 13 nt, Human
cagcucagagagg

SEQ ID NO: 1836664 - RNA, 16 nt, Human
cagcuccuucuguccu

SEQ ID NO: 1836665 - RNA, 17 nt, Human
cagcuccuucuguccua

SEQ ID NO: 1836666 - RNA, 21 nt, Human
cagcuccuucuguccuacucu

SEQ ID NO: 1836667 - RNA, 23 nt, Human
cagcuccuucuguccuacucugu

SEQ ID NO: 1836668 - RNA, 20 nt, Human
cagcucugcauacucauuag

SEQ ID NO: 1836669 - RNA, 21 nt, Human
cagcucugcaagaauugaagc

SEQ ID NO: 1836670 - RNA, 16 nt, Human
cagcucugcaagaauu

SEQ ID NO: 1836671 - RNA, 15 nt, Human
cagcucugcaagaau

SEQ ID NO: 1836672 - RNA, 17 nt, Human
cagcugcuacuacuccu

SEQ ID NO: 1836673 - RNA, 21 nt, Human
cagcugcucaauaaaguacaa

SEQ ID NO: 1836674 - RNA, 22 nt, Human
cagcugcuugggcuucauccuc

SEQ ID NO: 1836675 - RNA, 21 nt, Human
cagcugcuugggcuucauccu

SEQ ID NO: 1836676 - RNA, 19 nt, Human
cagcugcuugggcuucauc

SEQ ID NO: 1836677 - RNA, 18 nt, Human
cagcugcuugggcuucau

SEQ ID NO: 1836678 - RNA, 16 nt, Human
cagcugcuugggcuuc

SEQ ID NO: 1836679 - RNA, 15 nt, Human
cagcugcuugggcuu

SEQ ID NO: 1836680 - RNA, 14 nt, Human
cagcugcuugggcu

SEQ ID NO: 1836681 - RNA, 13 nt, Human
cagcugcuugggc

SEQ ID NO: 1836682 - RNA, 23 nt, Human
cagcugccugggaucccucaucc

SEQ ID NO: 1836683 - RNA, 18 nt, Human
cagcugccugggaucccu

SEQ ID NO: 1836684 - RNA, 18 nt, Human
cagcugcgguccacccag

SEQ ID NO: 1836685 - RNA, 15 nt, Human
cagcugccugggauc

SEQ ID NO: 1836686 - RNA, 19 nt, Human
cagcugcgguccacccagg

SEQ ID NO: 1836687 - RNA, 20 nt, Human
cagcugcgguccacccagga

SEQ ID NO: 1836688 - RNA, 21 nt, Human
cagcugcgguccacccaggag

SEQ ID NO: 1836689 - RNA, 22 nt, Human
cagcugcgguccacccaggagc

SEQ ID NO: 1836690 - RNA, 23 nt, Human
cagcugcgguccacccaggagcc

SEQ ID NO: 1836691 - RNA, 24 nt, Human
cagcugcgguccacccaggagccc

SEQ ID NO: 1836692 - RNA, 17 nt, Human
cagcuggguuggaaaac

SEQ ID NO: 1836693 - RNA, 16 nt, Human
cagcuggguuggaaaa

SEQ ID NO: 1836694 - RNA, 18 nt, Human
cagcugguugagguuuca

SEQ ID NO: 1836695 - RNA, 23 nt, Human
cagcugggguggggaccucaggc

SEQ ID NO: 1836696 - RNA, 22 nt, Human
cagcugggguggggaccucagg

SEQ ID NO: 1836697 - RNA, 21 nt, Human
cagcugggguggggaccucag

SEQ ID NO: 1836698 - RNA, 22 nt, Human
cagcuggggccaggcugggucg

SEQ ID NO: 1836699 - RNA, 21 nt, Human
cagcuggggccaggcuggguc

SEQ ID NO: 1836700 - RNA, 20 nt, Human
cagcuggggccaggcugggu

SEQ ID NO: 1836701 - RNA, 19 nt, Human
cagcuggggccaggcuggg

SEQ ID NO: 1836702 - RNA, 18 nt, Human
cagcuggggccaggcugg

SEQ ID NO: 1836703 - RNA, 23 nt, Human
cagcugggaucacauguggacuu

SEQ ID NO: 1836704 - RNA, 18 nt, Human
cagcuggagaaauauggu

SEQ ID NO: 1836705 - RNA, 19 nt, Human
cagcuggccgggagccuga

SEQ ID NO: 1836706 - RNA, 23 nt, Human
cagcugcuuuugucuaugggacu

SEQ ID NO: 1836707 - RNA, 22 nt, Human
cagcugcuuuugucuaugggac

SEQ ID NO: 1836708 - RNA, 15 nt, Human
caggaaggcuaaagg

SEQ ID NO: 1836709 - RNA, 19 nt, Human
caggaaggcugagaggaga

SEQ ID NO: 1836710 - RNA, 16 nt, Human
caggaaguacuggaga

SEQ ID NO: 1836711 - RNA, 14 nt, Human
caggaaguacugga

SEQ ID NO: 1836712 - RNA, 12 nt, Human
caggaaguacug

SEQ ID NO: 1836713 - RNA, 15 nt, Human
caggaaguagaggag

SEQ ID NO: 1836714 - RNA, 20 nt, Human
caggaaguacuggagaaaau

SEQ ID NO: 1836715 - RNA, 18 nt, Human
caggaaguacuggagaaa

SEQ ID NO: 1836716 - RNA, 17 nt, Human
caggaaguacuggagaa

SEQ ID NO: 1836717 - RNA, 16 nt, Human
caggaaguagaggagg

SEQ ID NO: 1836718 - RNA, 17 nt, Human
caggaccuguggccaag

SEQ ID NO: 1836719 - RNA, 19 nt, Human
caggaagcucagggccugg

SEQ ID NO: 1836720 - RNA, 18 nt, Human
caggaagcucagggccug

SEQ ID NO: 1836721 - RNA, 17 nt, Human
caggaagcucagggccu

SEQ ID NO: 1836722 - RNA, 16 nt, Human
caggaagcucagggcc

SEQ ID NO: 1836723 - RNA, 15 nt, Human
caggaagcucagggc

SEQ ID NO: 1836724 - RNA, 14 nt, Human
caggaagcucaggg

SEQ ID NO: 1836725 - RNA, 13 nt, Human
caggaagcucagg

SEQ ID NO: 1836726 - RNA, 21 nt, Human
caggaagcucagggccuggcu

SEQ ID NO: 1836727 - RNA, 20 nt, Human
caggaagcucagggccuggc

SEQ ID NO: 1836728 - RNA, 23 nt, Human
caggaagcucagggccuggcuca

SEQ ID NO: 1836729 - RNA, 18 nt, Human
caggaagccagcaggcuc

SEQ ID NO: 1836730 - RNA, 17 nt, Human
caggaagccagcaggcu

SEQ ID NO: 1836731 - RNA, 16 nt, Human
caggaagccagcaggc

SEQ ID NO: 1836732 - RNA, 14 nt, Human
caggaagccagcag

SEQ ID NO: 1836733 - RNA, 21 nt, Human
caggaagccagcaggcucuca

SEQ ID NO: 1836734 - RNA, 19 nt, Human
caggaagccagcaggcucu

SEQ ID NO: 1836735 - RNA, 22 nt, Human
caggaagccagcaggcucucag

SEQ ID NO: 1836736 - RNA, 14 nt, Human
caggaagcagcuuu

SEQ ID NO: 1836737 - RNA, 18 nt, Human
cagcuugaggguugggcu

SEQ ID NO: 1836738 - RNA, 19 nt, Human
cagcuugaggguugggcug

SEQ ID NO: 1836739 - RNA, 20 nt, Human
cagcuugaggguugggcugg

SEQ ID NO: 1836740 - RNA, 21 nt, Human
cagcuugaggguugggcuggu

SEQ ID NO: 1836741 - RNA, 21 nt, Human
cagcuugaccgugaggccaga

SEQ ID NO: 1836742 - RNA, 20 nt, Human
cagcuugaccgugaggccag

SEQ ID NO: 1836743 - RNA, 19 nt, Human
cagcuugaccgugaggcca

SEQ ID NO: 1836744 - RNA, 18 nt, Human
cagcuugaccgugaggcc

SEQ ID NO: 1836745 - RNA, 14 nt, Human
cagcuugaggguug

SEQ ID NO: 1836746 - RNA, 15 nt, Human
cagcuugaggguugg

SEQ ID NO: 1836747 - RNA, 20 nt, Human
cagcuucauuuccugugucu

SEQ ID NO: 1836748 - RNA, 21 nt, Human
cagcuucauuuccugugucuu

SEQ ID NO: 1836749 - RNA, 14 nt, Human
cagcuuugauauuu

SEQ ID NO: 1836750 - RNA, 23 nt, Human
cagcuuuguuuguugucagcuga

SEQ ID NO: 1836751 - RNA, 22 nt, Human
cagcuuuguuuguugucagcug

SEQ ID NO: 1836752 - RNA, 21 nt, Human
cagcuuuguuuguugucagcu

SEQ ID NO: 1836753 - RNA, 12 nt, Human
cagcuuuguuug

SEQ ID NO: 1836754 - RNA, 23 nt, Human
cagcuuuccucaaaacuucagac

SEQ ID NO: 1836755 - RNA, 23 nt, Human
cagcuuuccccaugucucgacuc

SEQ ID NO: 1836756 - RNA, 22 nt, Human
cagcuuuaaaaaauuaaucugg

SEQ ID NO: 1836757 - RNA, 21 nt, Human
cagcuuguaaauagcucaggu

SEQ ID NO: 1836758 - RNA, 22 nt, Human
cagcuuguaaauagcucaggug

SEQ ID NO: 1836759 - RNA, 18 nt, Human
cagcuuguaaauagcuca

SEQ ID NO: 1836760 - RNA, 19 nt, Human
cagcuuguaaauagcucag

SEQ ID NO: 1836761 - RNA, 20 nt, Human
cagcuuguaaauagcucagg

SEQ ID NO: 1836762 - RNA, 16 nt, Human
cagucccugccaaugg

SEQ ID NO: 1836763 - RNA, 15 nt, Human
cagucccugccaaug

SEQ ID NO: 1836764 - RNA, 14 nt, Human
cagucccugccaau

SEQ ID NO: 1836765 - RNA, 13 nt, Human
cagucccugccaa

SEQ ID NO: 1836766 - RNA, 12 nt, Human
cagucccugcca

SEQ ID NO: 1836767 - RNA, 15 nt, Human
caguccucccaucuc

SEQ ID NO: 1836768 - RNA, 14 nt, Human
caguccucccaucu

SEQ ID NO: 1836769 - RNA, 13 nt, Human
caguccucccauc

SEQ ID NO: 1836770 - RNA, 12 nt, Human
caguccucccau

SEQ ID NO: 1836771 - RNA, 17 nt, Human
cagucccugccaaugga

SEQ ID NO: 1836772 - RNA, 17 nt, Human
cagucccccugccccag

SEQ ID NO: 1836773 - RNA, 16 nt, Human
cagucccccugcccca

SEQ ID NO: 1836774 - RNA, 23 nt, Human
caguccccgugaaggagagcccu

SEQ ID NO: 1836775 - RNA, 13 nt, Human
caguccaugaaga

SEQ ID NO: 1836776 - RNA, 14 nt, Human
caguccauugaaag

SEQ ID NO: 1836777 - RNA, 16 nt, Human
caguccauagcagaga

SEQ ID NO: 1836778 - RNA, 16 nt, Human
caguauuacuucugcu

SEQ ID NO: 1836779 - RNA, 18 nt, Human
caguauuacuucugcuac

SEQ ID NO: 1836780 - RNA, 19 nt, Human
caguauuacuucugcuaca

SEQ ID NO: 1836781 - RNA, 12 nt, Human
caguagugauag

SEQ ID NO: 1836782 - RNA, 12 nt, Human
caguauggcagc

SEQ ID NO: 1836783 - RNA, 21 nt, Human
caguaucuugaagacuuuucu

SEQ ID NO: 1836784 - RNA, 18 nt, Human
caguaucuugaagacuuu

SEQ ID NO: 1836785 - RNA, 12 nt, Human
caguaucuugaa

SEQ ID NO: 1836786 - RNA, 15 nt, Human
caguaucucagggcc

SEQ ID NO: 1836787 - RNA, 13 nt, Human
caguaucucaggg

SEQ ID NO: 1836788 - RNA, 23 nt, Human
cagugccuuauggaacacucuga

SEQ ID NO: 1836789 - RNA, 13 nt, Human
cagugcuccagcc

SEQ ID NO: 1836790 - RNA, 22 nt, Human
cagugccuuauggaacacucug

SEQ ID NO: 1836791 - RNA, 21 nt, Human
cagugccuuauggaacacucu

SEQ ID NO: 1836792 - RNA, 20 nt, Human
cagugccuuauggaacacuc

SEQ ID NO: 1836793 - RNA, 19 nt, Human
cagugccuuauggaacacu

SEQ ID NO: 1836794 - RNA, 18 nt, Human
cagugccuuauggaacac

SEQ ID NO: 1836795 - RNA, 17 nt, Human
cagugccuuauggaaca

SEQ ID NO: 1836796 - RNA, 16 nt, Human
cagugccuuauggaac

SEQ ID NO: 1836797 - RNA, 15 nt, Human
cagugccuuauggaa

SEQ ID NO: 1836798 - RNA, 13 nt, Human
cagugccuuaugg

SEQ ID NO: 1836799 - RNA, 11 nt, Human
cagugccuuau

SEQ ID NO: 1836800 - RNA, 18 nt, Human
cagugccgagaaggaagc

SEQ ID NO: 1836801 - RNA, 15 nt, Human
cagugccgagaagga

SEQ ID NO: 1836802 - RNA, 19 nt, Human
cagugagucgaggacaggg

SEQ ID NO: 1836803 - RNA, 20 nt, Human
cagugagucgaggacaggga

SEQ ID NO: 1836804 - RNA, 22 nt, Human
cagugagucgaggacagggagg

SEQ ID NO: 1836805 - RNA, 23 nt, Human
cagugagucgaggacagggaggu

SEQ ID NO: 1836806 - RNA, 15 nt, Human
cagugcccuccagga

SEQ ID NO: 1836807 - RNA, 17 nt, Human
cagugauuaccagggac

SEQ ID NO: 1836808 - RNA, 18 nt, Human
cagugauuaccagggacu

SEQ ID NO: 1836809 - RNA, 16 nt, Human
cagugaggcucugccc

SEQ ID NO: 1836810 - RNA, 15 nt, Human
cagugaggcucugcc

SEQ ID NO: 1836811 - RNA, 14 nt, Human
cagugaggcucugc

SEQ ID NO: 1836812 - RNA, 13 nt, Human
cagugaggcucug

SEQ ID NO: 1836813 - RNA, 12 nt, Human
cagugaggcucu

SEQ ID NO: 1836814 - RNA, 24 nt, Human
cagugagccgagauugcaccacug

SEQ ID NO: 1836815 - RNA, 20 nt, Human
cagugaggcucugcccuugg

SEQ ID NO: 1836816 - RNA, 19 nt, Human
cagugaggcucugcccuug

SEQ ID NO: 1836817 - RNA, 18 nt, Human
cagugaggcucugcccuu

SEQ ID NO: 1836818 - RNA, 17 nt, Human
cagugaggcucugcccu

SEQ ID NO: 1836819 - RNA, 21 nt, Human
cagugaggcucugcccuuggu

SEQ ID NO: 1836820 - RNA, 17 nt, Human
cagugagucgaggacag

SEQ ID NO: 1836821 - RNA, 18 nt, Human
cagugagucgaggacagg

SEQ ID NO: 1836822 - RNA, 15 nt, Human
cagugagacagcucu

SEQ ID NO: 1836823 - RNA, 18 nt, Human
cagucuggaaugcagugg

SEQ ID NO: 1836824 - RNA, 21 nt, Human
caguccuuaccagcagagcac

SEQ ID NO: 1836825 - RNA, 20 nt, Human
caguccuuaccagcagagca

SEQ ID NO: 1836826 - RNA, 19 nt, Human
caguccuuaccagcagagc

SEQ ID NO: 1836827 - RNA, 18 nt, Human
caguccuuaccagcagag

SEQ ID NO: 1836828 - RNA, 15 nt, Human
caguccuuaccagca

SEQ ID NO: 1836829 - RNA, 17 nt, Human
caguccucccaucucac

SEQ ID NO: 1836830 - RNA, 16 nt, Human
caguccucccaucuca

SEQ ID NO: 1836831 - RNA, 19 nt, Human
cagucuggaaugcaguggu

SEQ ID NO: 1836832 - RNA, 16 nt, Human
cagucuuggcucacug

SEQ ID NO: 1836833 - RNA, 17 nt, Human
cagucuuguauuaaguu

SEQ ID NO: 1836834 - RNA, 20 nt, Human
cagugaaagaaaauaacaau

SEQ ID NO: 1836835 - RNA, 16 nt, Human
cagugaaagaaaauaa

SEQ ID NO: 1836836 - RNA, 22 nt, Human
caggucccuaauaaagcugugu

SEQ ID NO: 1836837 - RNA, 21 nt, Human
caggucccuaauaaagcugug

SEQ ID NO: 1836838 - RNA, 20 nt, Human
caggucccuaauaaagcugu

SEQ ID NO: 1836839 - RNA, 19 nt, Human
caggucccuaauaaagcug

SEQ ID NO: 1836840 - RNA, 18 nt, Human
caggucuugaacuccugg

SEQ ID NO: 1836841 - RNA, 19 nt, Human
caggucuugaacuccuggc

SEQ ID NO: 1836842 - RNA, 20 nt, Human
caggucuugaacuccuggcc

SEQ ID NO: 1836843 - RNA, 21 nt, Human
caggucuugaacuccuggccu

SEQ ID NO: 1836844 - RNA, 22 nt, Human
caggucuugaacuccuggccuc

SEQ ID NO: 1836845 - RNA, 23 nt, Human
caggucuugaacuccuggccuca

SEQ ID NO: 1836846 - RNA, 21 nt, Human
cagguggccacuccagacccc

SEQ ID NO: 1836847 - RNA, 19 nt, Human
cagguggccacuccagacc

SEQ ID NO: 1836848 - RNA, 16 nt, Human
cagguggccacuccag

SEQ ID NO: 1836849 - RNA, 15 nt, Human
cagguggccacucca

SEQ ID NO: 1836850 - RNA, 20 nt, Human
caggugagaagcagaggaag

SEQ ID NO: 1836851 - RNA, 13 nt, Human
caggugagaagca

SEQ ID NO: 1836852 - RNA, 21 nt, Human
caggugagaagcagaggaagg

SEQ ID NO: 1836853 - RNA, 20 nt, Human
cagguaaucgaccugccucg

SEQ ID NO: 1836854 - RNA, 19 nt, Human
cagguaaucgaccugccuc

SEQ ID NO: 1836855 - RNA, 18 nt, Human
cagguaaucgaccugccu

SEQ ID NO: 1836856 - RNA, 17 nt, Human
cagguaaucgaccugcc

SEQ ID NO: 1836857 - RNA, 20 nt, Human
cagguaacaggcagauacag

SEQ ID NO: 1836858 - RNA, 21 nt, Human
cagguaacaggcagauacagg

SEQ ID NO: 1836859 - RNA, 18 nt, Human
caggucccuaauaaagcu

SEQ ID NO: 1836860 - RNA, 17 nt, Human
caggucccuaauaaagc

SEQ ID NO: 1836861 - RNA, 16 nt, Human
caggucccuaauaaag

SEQ ID NO: 1836862 - RNA, 15 nt, Human
caggucccuaauaaa

SEQ ID NO: 1836863 - RNA, 14 nt, Human
caggucccuaauaa

SEQ ID NO: 1836864 - RNA, 13 nt, Human
caggucccuaaua

SEQ ID NO: 1836865 - RNA, 12 nt, Human
caggucccuaau

SEQ ID NO: 1836866 - RNA, 11 nt, Human
caggucccuaa

SEQ ID NO: 1836867 - RNA, 21 nt, Human
caggggugggacacccuguga

SEQ ID NO: 1836868 - RNA, 20 nt, Human
caggggugggacacccugug

SEQ ID NO: 1836869 - RNA, 15 nt, Human
caggggugggacacc

SEQ ID NO: 1836870 - RNA, 14 nt, Human
caggggugggacac

SEQ ID NO: 1836871 - RNA, 16 nt, Human
caggguuuugccaugu

SEQ ID NO: 1836872 - RNA, 17 nt, Human
cagggucucacucuguc

SEQ ID NO: 1836873 - RNA, 16 nt, Human
cagggucucacucugu

SEQ ID NO: 1836874 - RNA, 14 nt, Human
cagguaacaggcag

SEQ ID NO: 1836875 - RNA, 15 nt, Human
cagguaacaggcaga

SEQ ID NO: 1836876 - RNA, 16 nt, Human
cagguaacaggcagau

SEQ ID NO: 1836877 - RNA, 17 nt, Human
cagguaacaggcagaua

SEQ ID NO: 1836878 - RNA, 18 nt, Human
caggguccuguagcccua

SEQ ID NO: 1836879 - RNA, 23 nt, Human
cagggucccugguggcagcucac

SEQ ID NO: 1836880 - RNA, 21 nt, Human
cagggucucacuauguugccc

SEQ ID NO: 1836881 - RNA, 22 nt, Human
cagggucucacuauguugccca

SEQ ID NO: 1836882 - RNA, 23 nt, Human
cagggucucacuauguugcccag

SEQ ID NO: 1836883 - RNA, 15 nt, Human
cagggucucacucug

SEQ ID NO: 1836884 - RNA, 22 nt, Human
cagggucccugguggcagcuca

SEQ ID NO: 1836885 - RNA, 19 nt, Human
cagggucccugguggcagc

SEQ ID NO: 1836886 - RNA, 18 nt, Human
cagggucccugguggcag

SEQ ID NO: 1836887 - RNA, 15 nt, Human
cagggucccuggugg

SEQ ID NO: 1836888 - RNA, 14 nt, Human
cagggucccuggug

SEQ ID NO: 1836889 - RNA, 12 nt, Human
cagggucccugg

SEQ ID NO: 1836890 - RNA, 20 nt, Human
caggguauuccagagugggg

SEQ ID NO: 1836891 - RNA, 21 nt, Human
caggguauuccagagugggga

SEQ ID NO: 1836892 - RNA, 13 nt, Human
cagguggggcagc

SEQ ID NO: 1836893 - RNA, 14 nt, Human
cagguggggcagcu

SEQ ID NO: 1836894 - RNA, 15 nt, Human
cagguggggcagcuu

SEQ ID NO: 1836895 - RNA, 16 nt, Human
cagguggggcagcuug

SEQ ID NO: 1836896 - RNA, 18 nt, Human
cagguggggucacucugg

SEQ ID NO: 1836897 - RNA, 17 nt, Human
cagguggggcagcuuga

SEQ ID NO: 1836898 - RNA, 22 nt, Human
cagguggggucacucuggcagc

SEQ ID NO: 1836899 - RNA, 21 nt, Human
cagguggggucacucuggcag

SEQ ID NO: 1836900 - RNA, 20 nt, Human
cagguggggucacucuggca

SEQ ID NO: 1836901 - RNA, 19 nt, Human
cagguggggucacucuggc

SEQ ID NO: 1836902 - RNA, 23 nt, Human
cagguggggucacucuggcagcu

SEQ ID NO: 1836903 - RNA, 18 nt, Human
caggugguuauggagagg

SEQ ID NO: 1836904 - RNA, 20 nt, Human
caggugguuauggagagggu

SEQ ID NO: 1836905 - RNA, 11 nt, Human
caggugucccu

SEQ ID NO: 1836906 - RNA, 14 nt, Human
caggugucccugca

SEQ ID NO: 1836907 - RNA, 21 nt, Human
caggugugagccaccacgccc

SEQ ID NO: 1836908 - RNA, 22 nt, Human
caggugugagucaccaagccca

SEQ ID NO: 1836909 - RNA, 23 nt, Human
caggugugagucaccaagcccag

SEQ ID NO: 1836910 - RNA, 18 nt, Human
caggugugagccaccacg

SEQ ID NO: 1836911 - RNA, 16 nt, Human
caggugugagucacca

SEQ ID NO: 1836912 - RNA, 20 nt, Human
caggugugagucaccaagcc

SEQ ID NO: 1836913 - RNA, 21 nt, Human
caggugugagucaccaagccc

SEQ ID NO: 1836914 - RNA, 16 nt, Human
caggugugaaccacca

SEQ ID NO: 1836915 - RNA, 19 nt, Human
caggugugaaccaccacac

SEQ ID NO: 1836916 - RNA, 22 nt, Human
caggugugaaccaccacaccca

SEQ ID NO: 1836917 - RNA, 23 nt, Human
caggugugaaccaccacacccag

SEQ ID NO: 1836918 - RNA, 15 nt, Human
caggugucccugcac

SEQ ID NO: 1836919 - RNA, 16 nt, Human
caggugucccugcacu

SEQ ID NO: 1836920 - RNA, 18 nt, Human
caggugucccugcacuug

SEQ ID NO: 1836921 - RNA, 19 nt, Human
caggugucccugcacuugc

SEQ ID NO: 1836922 - RNA, 12 nt, Human
caggugugaacc

SEQ ID NO: 1836923 - RNA, 22 nt, Human
caguaaaugggggugcauuuga

SEQ ID NO: 1836924 - RNA, 21 nt, Human
caguaaaugggggugcauuug

SEQ ID NO: 1836925 - RNA, 12 nt, Human
cagguucagcuu

SEQ ID NO: 1836926 - RNA, 13 nt, Human
cagguucagcuug

SEQ ID NO: 1836927 - RNA, 13 nt, Human
caguaauaacucu

SEQ ID NO: 1836928 - RNA, 12 nt, Human
caguaauaacuc

SEQ ID NO: 1836929 - RNA, 23 nt, Human
caggaguuugagaccaaccuggg

SEQ ID NO: 1836930 - RNA, 22 nt, Human
caggaguuugagaccaaccugg

SEQ ID NO: 1836931 - RNA, 13 nt, Human
caggauagacuuu

SEQ ID NO: 1836932 - RNA, 21 nt, Human
caggaguuugagaccaaccug

SEQ ID NO: 1836933 - RNA, 19 nt, Human
caggaguuucguuuucaaa

SEQ ID NO: 1836934 - RNA, 16 nt, Human
caggaguuggaagugu

SEQ ID NO: 1836935 - RNA, 17 nt, Human
caggaguggguugauuu

SEQ ID NO: 1836936 - RNA, 19 nt, Human
caggagcccugggaggcuc

SEQ ID NO: 1836937 - RNA, 18 nt, Human
caggagcccugggaggcu

SEQ ID NO: 1836938 - RNA, 16 nt, Human
caggagcccugggagg

SEQ ID NO: 1836939 - RNA, 14 nt, Human
caggagcccuggga

SEQ ID NO: 1836940 - RNA, 11 nt, Human
caggagcccug

SEQ ID NO: 1836941 - RNA, 23 nt, Human
caggagccccgaggccuucucug

SEQ ID NO: 1836942 - RNA, 20 nt, Human
caggagccccgaggccuucu

SEQ ID NO: 1836943 - RNA, 22 nt, Human
caggagccccgaggccuucucu

SEQ ID NO: 1836944 - RNA, 19 nt, Human
caggagcagccacauuccu

SEQ ID NO: 1836945 - RNA, 14 nt, Human
caggagcagccaca

SEQ ID NO: 1836946 - RNA, 13 nt, Human
caggagcagccac

SEQ ID NO: 1836947 - RNA, 12 nt, Human
caggagcagcca

SEQ ID NO: 1836948 - RNA, 15 nt, Human
caggagccccgaggc

SEQ ID NO: 1836949 - RNA, 16 nt, Human
caggagccccgaggcc

SEQ ID NO: 1836950 - RNA, 18 nt, Human
caggagccccgaggccuu

SEQ ID NO: 1836951 - RNA, 21 nt, Human
caggagcccugggaggcucug

SEQ ID NO: 1836952 - RNA, 17 nt, Human
caggagccuccugcccu

SEQ ID NO: 1836953 - RNA, 14 nt, Human
caggagccuccugc

SEQ ID NO: 1836954 - RNA, 20 nt, Human
caggagccuccugcccuuac

SEQ ID NO: 1836955 - RNA, 12 nt, Human
caggagugagca

SEQ ID NO: 1836956 - RNA, 16 nt, Human
caggacucugccuccu

SEQ ID NO: 1836957 - RNA, 15 nt, Human
caggacucugccucc

SEQ ID NO: 1836958 - RNA, 13 nt, Human
caggacucugccu

SEQ ID NO: 1836959 - RNA, 12 nt, Human
caggacucugcc

SEQ ID NO: 1836960 - RNA, 13 nt, Human
caggcccggcucc

SEQ ID NO: 1836961 - RNA, 14 nt, Human
caggcccggcucca

SEQ ID NO: 1836962 - RNA, 15 nt, Human
caggcccggcuccag

SEQ ID NO: 1836963 - RNA, 15 nt, Human
caggccccugccacc

SEQ ID NO: 1836964 - RNA, 17 nt, Human
caggccccugccacccu

SEQ ID NO: 1836965 - RNA, 19 nt, Human
caggccccugccacccugg

SEQ ID NO: 1836966 - RNA, 20 nt, Human
caggccccugccacccuggg

SEQ ID NO: 1836967 - RNA, 22 nt, Human
caggccaggcccucugcccacu

SEQ ID NO: 1836968 - RNA, 21 nt, Human
caggccaggcccucugcccac

SEQ ID NO: 1836969 - RNA, 20 nt, Human
caggccacaagacccuugug

SEQ ID NO: 1836970 - RNA, 18 nt, Human
caggccauuccccgucuc

SEQ ID NO: 1836971 - RNA, 18 nt, Human
caggccacaagacccuug

SEQ ID NO: 1836972 - RNA, 17 nt, Human
caggccacaagacccuu

SEQ ID NO: 1836973 - RNA, 13 nt, Human
caggccacaagac

SEQ ID NO: 1836974 - RNA, 23 nt, Human
caggccaaacucaccugccccuc

SEQ ID NO: 1836975 - RNA, 18 nt, Human
caggccaaacucaccugc

SEQ ID NO: 1836976 - RNA, 21 nt, Human
caggccauuccccgucucugg

SEQ ID NO: 1836977 - RNA, 13 nt, Human
caggccccugcca

SEQ ID NO: 1836978 - RNA, 17 nt, Human
caggcaugguggcccac

SEQ ID NO: 1836979 - RNA, 14 nt, Human
caggcagguccagg

SEQ ID NO: 1836980 - RNA, 15 nt, Human
caggcagguccaggg

SEQ ID NO: 1836981 - RNA, 19 nt, Human
caggcagguccaggguuug

SEQ ID NO: 1836982 - RNA, 12 nt, Human
caggcaggucuu

SEQ ID NO: 1836983 - RNA, 13 nt, Human
caggcaggucuug

SEQ ID NO: 1836984 - RNA, 22 nt, Human
caggcaggucuugaacuccugg

SEQ ID NO: 1836985 - RNA, 15 nt, Human
caggcaggugggaug

SEQ ID NO: 1836986 - RNA, 23 nt, Human
caggcaggucuugaacuccuggc

SEQ ID NO: 1836987 - RNA, 21 nt, Human
caggcauuccccaggaggcca

SEQ ID NO: 1836988 - RNA, 20 nt, Human
caggcauuccccaggaggcc

SEQ ID NO: 1836989 - RNA, 19 nt, Human
caggcauuccccaggaggc

SEQ ID NO: 1836990 - RNA, 18 nt, Human
caggcauuccccaggagg

SEQ ID NO: 1836991 - RNA, 23 nt, Human
caggcauuccccaggaggccagc

SEQ ID NO: 1836992 - RNA, 22 nt, Human
caggcauuccccaggaggccag

SEQ ID NO: 1836993 - RNA, 24 nt, Human
caggcauuccccaggaggccagcc

SEQ ID NO: 1836994 - RNA, 17 nt, Human
caggcauuccccaggag

SEQ ID NO: 1836995 - RNA, 16 nt, Human
caggcauuccccagga

SEQ ID NO: 1836996 - RNA, 15 nt, Human
caggcauuccccagg

SEQ ID NO: 1836997 - RNA, 13 nt, Human
caggcauucccca

SEQ ID NO: 1836998 - RNA, 15 nt, Human
caggcauguucucug

SEQ ID NO: 1836999 - RNA, 18 nt, Human
caggcauguucucugagg

SEQ ID NO: 1837000 - RNA, 19 nt, Human
caggcauguucucugagga

SEQ ID NO: 1837001 - RNA, 20 nt, Human
caggcauguucucugaggac

SEQ ID NO: 1837002 - RNA, 17 nt, Human
caggcagccaggccaca

SEQ ID NO: 1837003 - RNA, 16 nt, Human
caggcagccaggccac

SEQ ID NO: 1837004 - RNA, 20 nt, Human
caggcaggaaggcugagagg

SEQ ID NO: 1837005 - RNA, 13 nt, Human
caggcagguccag

SEQ ID NO: 1837006 - RNA, 15 nt, Human
caggcagccaggcca

SEQ ID NO: 1837007 - RNA, 14 nt, Human
caggcagccaggcc

SEQ ID NO: 1837008 - RNA, 14 nt, Human
caggcaagcaccuc

SEQ ID NO: 1837009 - RNA, 15 nt, Human
caggcaagcaccucc

SEQ ID NO: 1837010 - RNA, 16 nt, Human
caggcaagcaccuccu

SEQ ID NO: 1837011 - RNA, 21 nt, Human
caggcaagcaccuccugccuc

SEQ ID NO: 1837012 - RNA, 20 nt, Human
caggauucuuccucccuccc

SEQ ID NO: 1837013 - RNA, 18 nt, Human
caggauucuuccucccuc

SEQ ID NO: 1837014 - RNA, 17 nt, Human
caggauucuuccucccu

SEQ ID NO: 1837015 - RNA, 19 nt, Human
caggauguacaaggacagc

SEQ ID NO: 1837016 - RNA, 23 nt, Human
caggauggccgggcgcgguggcu

SEQ ID NO: 1837017 - RNA, 22 nt, Human
caggaugaugacuauggaaaga

SEQ ID NO: 1837018 - RNA, 20 nt, Human
caggaugaugacuauggaaa

SEQ ID NO: 1837019 - RNA, 18 nt, Human
caggaugaugacuaugga

SEQ ID NO: 1837020 - RNA, 13 nt, Human
caggaucagucug

SEQ ID NO: 1837021 - RNA, 14 nt, Human
caggaucagucuga

SEQ ID NO: 1837022 - RNA, 21 nt, Human
caggcugagccucagucuccc

SEQ ID NO: 1837023 - RNA, 17 nt, Human
caggcugagccucaguc

SEQ ID NO: 1837024 - RNA, 16 nt, Human
caggcugagccucagu

SEQ ID NO: 1837025 - RNA, 15 nt, Human
caggcugagccucag

SEQ ID NO: 1837026 - RNA, 14 nt, Human
caggcugagccuca

SEQ ID NO: 1837027 - RNA, 13 nt, Human
caggcugagccuc

SEQ ID NO: 1837028 - RNA, 12 nt, Human
caggcucuucuc

SEQ ID NO: 1837029 - RNA, 15 nt, Human
caggcucuucuccuu

SEQ ID NO: 1837030 - RNA, 14 nt, Human
caggcucuucuccu

SEQ ID NO: 1837031 - RNA, 22 nt, Human
caggcucuucuccuuucacaac

SEQ ID NO: 1837032 - RNA, 18 nt, Human
caggcucuucuccuuuca

SEQ ID NO: 1837033 - RNA, 12 nt, Human
caggcugagccu

SEQ ID NO: 1837034 - RNA, 20 nt, Human
caggcugcucuugaacuccu

SEQ ID NO: 1837035 - RNA, 12 nt, Human
caggcugcucuu

SEQ ID NO: 1837036 - RNA, 23 nt, Human
caggcugcucuugaacuccugac

SEQ ID NO: 1837037 - RNA, 16 nt, Human
caggcuggcccugccc

SEQ ID NO: 1837038 - RNA, 15 nt, Human
caggcuggcccugcc

SEQ ID NO: 1837039 - RNA, 14 nt, Human
caggcuggcccugc

SEQ ID NO: 1837040 - RNA, 12 nt, Human
caggcuggcccu

SEQ ID NO: 1837041 - RNA, 23 nt, Human
caggcugggucgcccuggacugu

SEQ ID NO: 1837042 - RNA, 21 nt, Human
caggcugggucgcccuggacu

SEQ ID NO: 1837043 - RNA, 23 nt, Human
caggcugggcuucaguggcagcu

SEQ ID NO: 1837044 - RNA, 21 nt, Human
caggcuuagucacugagacag

SEQ ID NO: 1837045 - RNA, 20 nt, Human
caggcuuagucacugagaca

SEQ ID NO: 1837046 - RNA, 17 nt, Human
caggcuuagucacugag

SEQ ID NO: 1837047 - RNA, 16 nt, Human
caggcuuagucacuga

SEQ ID NO: 1837048 - RNA, 14 nt, Human
caggcugugaguuu

SEQ ID NO: 1837049 - RNA, 22 nt, Human
caggcuguaucccaugagccuc

SEQ ID NO: 1837050 - RNA, 23 nt, Human
caggcuguaucccaugagccuca

SEQ ID NO: 1837051 - RNA, 23 nt, Human
caggcuggucucaaacuccugac

SEQ ID NO: 1837052 - RNA, 12 nt, Human
caggcuggucuc

SEQ ID NO: 1837053 - RNA, 22 nt, Human
caggcuggucucgaacuccuga

SEQ ID NO: 1837054 - RNA, 20 nt, Human
caggcuggucucgaacuccu

SEQ ID NO: 1837055 - RNA, 19 nt, Human
caggcuggucucaaacucu

SEQ ID NO: 1837056 - RNA, 23 nt, Human
caggcuggucucgaacuccugac

SEQ ID NO: 1837057 - RNA, 14 nt, Human
caggcuguauccca

SEQ ID NO: 1837058 - RNA, 20 nt, Human
caggcuguaucccaugagcc

SEQ ID NO: 1837059 - RNA, 21 nt, Human
caggcuguaucccaugagccu

SEQ ID NO: 1837060 - RNA, 23 nt, Human
caggcuuagucacugagacagcc

SEQ ID NO: 1837061 - RNA, 22 nt, Human
caggcuuagucacugagacagc

SEQ ID NO: 1837062 - RNA, 23 nt, Human
caggcuuuuuuaucaugugaaau

SEQ ID NO: 1837063 - RNA, 16 nt, Human
cagggaaacagcuaau

SEQ ID NO: 1837064 - RNA, 22 nt, Human
caggcccucugcccacucccug

SEQ ID NO: 1837065 - RNA, 21 nt, Human
caggcccucugcccacucccu

SEQ ID NO: 1837066 - RNA, 20 nt, Human
caggcccucugcccacuccc

SEQ ID NO: 1837067 - RNA, 19 nt, Human
caggcccucugcccacucc

SEQ ID NO: 1837068 - RNA, 17 nt, Human
caggcccucugcccacu

SEQ ID NO: 1837069 - RNA, 16 nt, Human
caggcccucugcccac

SEQ ID NO: 1837070 - RNA, 15 nt, Human
caggcccuuccucuc

SEQ ID NO: 1837071 - RNA, 17 nt, Human
caggcccuuccucucca

SEQ ID NO: 1837072 - RNA, 16 nt, Human
caggcccuuccucucc

SEQ ID NO: 1837073 - RNA, 23 nt, Human
caggcccuuccucuccacugccu

SEQ ID NO: 1837074 - RNA, 21 nt, Human
caggcccuuccucuccacugc

SEQ ID NO: 1837075 - RNA, 20 nt, Human
caggcccuuccucuccacug

SEQ ID NO: 1837076 - RNA, 19 nt, Human
caggcccuuccucuccacu

SEQ ID NO: 1837077 - RNA, 15 nt, Human
caggcccucugccca

SEQ ID NO: 1837078 - RNA, 14 nt, Human
caggcccucugccc

SEQ ID NO: 1837079 - RNA, 13 nt, Human
caggcccucugcc

SEQ ID NO: 1837080 - RNA, 22 nt, Human
caggcccggcuccaggcuccuu

SEQ ID NO: 1837081 - RNA, 20 nt, Human
caggcccggcuccaggcucc

SEQ ID NO: 1837082 - RNA, 21 nt, Human
caggcccggcuccaggcuccu

SEQ ID NO: 1837083 - RNA, 17 nt, Human
caggcccggcuccaggc

SEQ ID NO: 1837084 - RNA, 16 nt, Human
caggcccggcuccagg

SEQ ID NO: 1837085 - RNA, 18 nt, Human
caggcccggcuccaggcu

SEQ ID NO: 1837086 - RNA, 19 nt, Human
caggcccggcuccaggcuc

SEQ ID NO: 1837087 - RNA, 20 nt, Human
caggcucucaggccagcugc

SEQ ID NO: 1837088 - RNA, 19 nt, Human
caggcucucaggccagcug

SEQ ID NO: 1837089 - RNA, 18 nt, Human
caggcucucaggccagcu

SEQ ID NO: 1837090 - RNA, 17 nt, Human
caggcucucaggccagc

SEQ ID NO: 1837091 - RNA, 23 nt, Human
caggcucucaggccagcugcuug

SEQ ID NO: 1837092 - RNA, 21 nt, Human
caggcucucaggccagcugcu

SEQ ID NO: 1837093 - RNA, 16 nt, Human
caggcucucaggccag

SEQ ID NO: 1837094 - RNA, 15 nt, Human
caggcucucaggcca

SEQ ID NO: 1837095 - RNA, 14 nt, Human
caggcucucaggcc

SEQ ID NO: 1837096 - RNA, 13 nt, Human
caggcucucaggc

SEQ ID NO: 1837097 - RNA, 12 nt, Human
caggcucucagg

SEQ ID NO: 1837098 - RNA, 20 nt, Human
caggcucgggcuccccagcc

SEQ ID NO: 1837099 - RNA, 21 nt, Human
caggcuccuuuagcgcccagu

SEQ ID NO: 1837100 - RNA, 16 nt, Human
caggcuccugccacca

SEQ ID NO: 1837101 - RNA, 15 nt, Human
caggcuccugccacc

SEQ ID NO: 1837102 - RNA, 14 nt, Human
caggcuccugccac

SEQ ID NO: 1837103 - RNA, 13 nt, Human
caggcuccugcca

SEQ ID NO: 1837104 - RNA, 18 nt, Human
caggcuccugccaccacg

SEQ ID NO: 1837105 - RNA, 14 nt, Human
caggcuccuuuagc

SEQ ID NO: 1837106 - RNA, 19 nt, Human
caggcuccuuuagcgccca

SEQ ID NO: 1837107 - RNA, 20 nt, Human
caggcuccuuuagcgcccag

SEQ ID NO: 1837108 - RNA, 15 nt, Human
cagggccuggcucag

SEQ ID NO: 1837109 - RNA, 14 nt, Human
cagggccuggcuca

SEQ ID NO: 1837110 - RNA, 13 nt, Human
cagggccuggcuc

SEQ ID NO: 1837111 - RNA, 19 nt, Human
cagggccuggcucaggugg

SEQ ID NO: 1837112 - RNA, 16 nt, Human
cagggccuggcucagg

SEQ ID NO: 1837113 - RNA, 19 nt, Human
caggggaggguagagcgga

SEQ ID NO: 1837114 - RNA, 22 nt, Human
cagggcacaccgggcacucaga

SEQ ID NO: 1837115 - RNA, 23 nt, Human
cagggcacaccgggcacucagaa

SEQ ID NO: 1837116 - RNA, 15 nt, Human
cagggcacaccgggc

SEQ ID NO: 1837117 - RNA, 17 nt, Human
cagggcacaccgggcac

SEQ ID NO: 1837118 - RNA, 19 nt, Human
cagggcacaccgggcacuc

SEQ ID NO: 1837119 - RNA, 21 nt, Human
cagggcacaccgggcacucag

SEQ ID NO: 1837120 - RNA, 23 nt, Human
cagggacagaggggguggccucc

SEQ ID NO: 1837121 - RNA, 14 nt, Human
cagggcacaccggg

SEQ ID NO: 1837122 - RNA, 20 nt, Human
cagggcauggccagguggcc

SEQ ID NO: 1837123 - RNA, 20 nt, Human
cagggacagaggggguggcc

SEQ ID NO: 1837124 - RNA, 14 nt, Human
cagggacagagggg

SEQ ID NO: 1837125 - RNA, 13 nt, Human
cagggacagaggg

SEQ ID NO: 1837126 - RNA, 17 nt, Human
cagggaaggggacaagg

SEQ ID NO: 1837127 - RNA, 15 nt, Human
cagggaaggggacaa

SEQ ID NO: 1837128 - RNA, 22 nt, Human
cagggaaacagcuaaugggaca

SEQ ID NO: 1837129 - RNA, 19 nt, Human
caucuugcucugcugacag

SEQ ID NO: 1837130 - RNA, 16 nt, Human
caucuugcucugcuga

SEQ ID NO: 1837131 - RNA, 17 nt, Human
caucuugcucugcugac

SEQ ID NO: 1837132 - RNA, 21 nt, Human
caucuugaauuguaaggaaug

SEQ ID NO: 1837133 - RNA, 16 nt, Human
caucuugaauuguaag

SEQ ID NO: 1837134 - RNA, 19 nt, Human
cauccuacaagacacagug

SEQ ID NO: 1837135 - RNA, 17 nt, Human
cauccuacaagacacag

SEQ ID NO: 1837136 - RNA, 18 nt, Human
cauccuacaagacacagu

SEQ ID NO: 1837137 - RNA, 16 nt, Human
caucucuacaaaaagc

SEQ ID NO: 1837138 - RNA, 15 nt, Human
caucucuccuccuuu

SEQ ID NO: 1837139 - RNA, 21 nt, Human
caugaggaacaaggcaaggcu

SEQ ID NO: 1837140 - RNA, 20 nt, Human
caugaggaacaaggcaaggc

SEQ ID NO: 1837141 - RNA, 17 nt, Human
caugaggaacaaggcaa

SEQ ID NO: 1837142 - RNA, 16 nt, Human
caugaggaacaaggca

SEQ ID NO: 1837143 - RNA, 22 nt, Human
caugagccucagcauccuggca

SEQ ID NO: 1837144 - RNA, 23 nt, Human
caugagccucagcauccuggcac

SEQ ID NO: 1837145 - RNA, 23 nt, Human
caugaggaacaaggcaaggcugu

SEQ ID NO: 1837146 - RNA, 16 nt, Human
caugagguacugagag

SEQ ID NO: 1837147 - RNA, 19 nt, Human
caugagguacugagaguga

SEQ ID NO: 1837148 - RNA, 13 nt, Human
caugaguccccug

SEQ ID NO: 1837149 - RNA, 15 nt, Human
caugaguccccuguu

SEQ ID NO: 1837150 - RNA, 14 nt, Human
caugaguccccugu

SEQ ID NO: 1837151 - RNA, 23 nt, Human
caugaguccccuguuuguuucug

SEQ ID NO: 1837152 - RNA, 23 nt, Human
caugagcaucaggccaggcccuc

SEQ ID NO: 1837153 - RNA, 22 nt, Human
caugagcaucaggccaggcccu

SEQ ID NO: 1837154 - RNA, 21 nt, Human
caugagcaucaggccaggccc

SEQ ID NO: 1837155 - RNA, 20 nt, Human
caugagcaucaggccaggcc

SEQ ID NO: 1837156 - RNA, 18 nt, Human
caugagcaucaggccagg

SEQ ID NO: 1837157 - RNA, 17 nt, Human
caugagcaucaggccag

SEQ ID NO: 1837158 - RNA, 16 nt, Human
caugagcaucaggcca

SEQ ID NO: 1837159 - RNA, 15 nt, Human
caugagcaucaggcc

SEQ ID NO: 1837160 - RNA, 12 nt, Human
caugagccucag

SEQ ID NO: 1837161 - RNA, 15 nt, Human
caugagccucagcau

SEQ ID NO: 1837162 - RNA, 17 nt, Human
caugagccucagcaucc

SEQ ID NO: 1837163 - RNA, 18 nt, Human
caugagccucagcauccu

SEQ ID NO: 1837164 - RNA, 19 nt, Human
caugagccucagcauccug

SEQ ID NO: 1837165 - RNA, 20 nt, Human
caugagccucagcauccugg

SEQ ID NO: 1837166 - RNA, 21 nt, Human
caugagccucagcauccuggc

SEQ ID NO: 1837167 - RNA, 13 nt, Human
caugagcaucagg

SEQ ID NO: 1837168 - RNA, 20 nt, Human
caugacucguauaugucuca

SEQ ID NO: 1837169 - RNA, 23 nt, Human
caugacucguauaugucucaggu

SEQ ID NO: 1837170 - RNA, 18 nt, Human
caugaagauguagaggag

SEQ ID NO: 1837171 - RNA, 19 nt, Human
caugaagauguagaggaga

SEQ ID NO: 1837172 - RNA, 13 nt, Human
caugaaaacacau

SEQ ID NO: 1837173 - RNA, 14 nt, Human
caugaaaacacauu

SEQ ID NO: 1837174 - RNA, 15 nt, Human
caugaaaacacauuu

SEQ ID NO: 1837175 - RNA, 16 nt, Human
caugaaaacacauuuu

SEQ ID NO: 1837176 - RNA, 17 nt, Human
caugaaaacacauuuuu

SEQ ID NO: 1837177 - RNA, 19 nt, Human
caugaaaacacauuuuucu

SEQ ID NO: 1837178 - RNA, 21 nt, Human
caugaaaacacauuuuucuua

SEQ ID NO: 1837179 - RNA, 12 nt, Human
caugaagacaga

SEQ ID NO: 1837180 - RNA, 14 nt, Human
caucaacaucuugg

SEQ ID NO: 1837181 - RNA, 19 nt, Human
cauauuguuacugguacca

SEQ ID NO: 1837182 - RNA, 13 nt, Human
cauauuguuacug

SEQ ID NO: 1837183 - RNA, 21 nt, Human
cauauugauuuccguuaaaau

SEQ ID NO: 1837184 - RNA, 17 nt, Human
cauauugauuuccguua

SEQ ID NO: 1837185 - RNA, 22 nt, Human
cauauucuguuggccaguguga

SEQ ID NO: 1837186 - RNA, 16 nt, Human
cauaguaugguggcug

SEQ ID NO: 1837187 - RNA, 17 nt, Human
cauaguaugguggcugg

SEQ ID NO: 1837188 - RNA, 15 nt, Human
cauaguaugguggcu

SEQ ID NO: 1837189 - RNA, 23 nt, Human
cauauaagauucauauuuacuuc

SEQ ID NO: 1837190 - RNA, 16 nt, Human
cauauaagugauugcu

SEQ ID NO: 1837191 - RNA, 19 nt, Human
cauagugaugguuccccug

SEQ ID NO: 1837192 - RNA, 18 nt, Human
cauagugaugguuccccu

SEQ ID NO: 1837193 - RNA, 16 nt, Human
caucauccuaagcuau

SEQ ID NO: 1837194 - RNA, 13 nt, Human
caucaugucuggc

SEQ ID NO: 1837195 - RNA, 14 nt, Human
caucaugucuggcu

SEQ ID NO: 1837196 - RNA, 15 nt, Human
caucaugucuggcua

SEQ ID NO: 1837197 - RNA, 12 nt, Human
caucacccgcua

SEQ ID NO: 1837198 - RNA, 20 nt, Human
caucaccaacgucugugcca

SEQ ID NO: 1837199 - RNA, 13 nt, Human
caucccuccuggg

SEQ ID NO: 1837200 - RNA, 15 nt, Human
caucccucuggggcu

SEQ ID NO: 1837201 - RNA, 17 nt, Human
cauccagguucagcuug

SEQ ID NO: 1837202 - RNA, 12 nt, Human
cauccauccagg

SEQ ID NO: 1837203 - RNA, 14 nt, Human
cauccacugugcca

SEQ ID NO: 1837204 - RNA, 17 nt, Human
cauccacugugccaugu

SEQ ID NO: 1837205 - RNA, 23 nt, Human
cauccacugugccaugugccagg

SEQ ID NO: 1837206 - RNA, 22 nt, Human
cauuaaaaaaaaaaaaaaaagu

SEQ ID NO: 1837207 - RNA, 20 nt, Human
cauguuuuucuucucccuca

SEQ ID NO: 1837208 - RNA, 19 nt, Human
cauguuuuucuucucccuc

SEQ ID NO: 1837209 - RNA, 12 nt, Human
cauguuugugau

SEQ ID NO: 1837210 - RNA, 14 nt, Human
cauguuugugauug

SEQ ID NO: 1837211 - RNA, 14 nt, Human
caugucucgacuca

SEQ ID NO: 1837212 - RNA, 12 nt, Human
caugucuggcua

SEQ ID NO: 1837213 - RNA, 21 nt, Human
caugugaugagaggaaaucac

SEQ ID NO: 1837214 - RNA, 20 nt, Human
caugugaugagaggaaauca

SEQ ID NO: 1837215 - RNA, 18 nt, Human
caugugaugagaggaaau

SEQ ID NO: 1837216 - RNA, 17 nt, Human
caugugaugagaggaaa

SEQ ID NO: 1837217 - RNA, 16 nt, Human
caugugaugagaggaa

SEQ ID NO: 1837218 - RNA, 15 nt, Human
caugugaugagagga

SEQ ID NO: 1837219 - RNA, 14 nt, Human
caugugcacaugca

SEQ ID NO: 1837220 - RNA, 18 nt, Human
cauguguuggcagccucu

SEQ ID NO: 1837221 - RNA, 14 nt, Human
cauguguuccaagg

SEQ ID NO: 1837222 - RNA, 17 nt, Human
cauggucggaaaacaug

SEQ ID NO: 1837223 - RNA, 19 nt, Human
cauggucggaaaacaugcu

SEQ ID NO: 1837224 - RNA, 23 nt, Human
cauggucggaaaacaugcuacac

SEQ ID NO: 1837225 - RNA, 23 nt, Human
caugggacagggaggacgcucuc

SEQ ID NO: 1837226 - RNA, 18 nt, Human
caugggccuccugugugu

SEQ ID NO: 1837227 - RNA, 15 nt, Human
cauggacuuccacug

SEQ ID NO: 1837228 - RNA, 22 nt, Human
cauggacuucugccagcauaau

SEQ ID NO: 1837229 - RNA, 17 nt, Human
caugcgggcuuccuccu

SEQ ID NO: 1837230 - RNA, 15 nt, Human
caugcugucccuuac

SEQ ID NO: 1837231 - RNA, 13 nt, Human
caugcugucccuu

SEQ ID NO: 1837232 - RNA, 17 nt, Human
caugcugucccuuacgu

SEQ ID NO: 1837233 - RNA, 14 nt, Human
caugcagcaucuaa

SEQ ID NO: 1837234 - RNA, 17 nt, Human
cauuugaaaauuuugau

SEQ ID NO: 1837235 - RNA, 19 nt, Human
cauuugaaaauuuugaugu

SEQ ID NO: 1837236 - RNA, 22 nt, Human
cauuuacccuucuuuucugacu

SEQ ID NO: 1837237 - RNA, 18 nt, Human
cauugaccugaggcccuu

SEQ ID NO: 1837238 - RNA, 17 nt, Human
cauugaccugaggcccu

SEQ ID NO: 1837239 - RNA, 15 nt, Human
cauugaccugaggcc

SEQ ID NO: 1837240 - RNA, 14 nt, Human
cauugaccugaggc

SEQ ID NO: 1837241 - RNA, 13 nt, Human
cauugugggaagg

SEQ ID NO: 1837242 - RNA, 15 nt, Human
cauugugggaagggg

SEQ ID NO: 1837243 - RNA, 15 nt, Human
cauuuaaaaaaaauc

SEQ ID NO: 1837244 - RNA, 23 nt, Human
cauuuuaccuuugacaaagguaa

SEQ ID NO: 1837245 - RNA, 23 nt, Human
cauuuuauuuuauuaugcaugaa

SEQ ID NO: 1837246 - RNA, 22 nt, Human
cauuuuauuuuauuaugcauga

SEQ ID NO: 1837247 - RNA, 17 nt, Human
cauuuuacuuuuuccug

SEQ ID NO: 1837248 - RNA, 20 nt, Human
cauuuuacuuuuuccuggcu

SEQ ID NO: 1837249 - RNA, 22 nt, Human
cauuuuacuuuuuccuggcuca

SEQ ID NO: 1837250 - RNA, 16 nt, Human
ccaaacccuucagugc

SEQ ID NO: 1837251 - RNA, 17 nt, Human
cauuuuuaguagagaca

SEQ ID NO: 1837252 - RNA, 21 nt, Human
cauuuuuaagugcugcauuua

SEQ ID NO: 1837253 - RNA, 19 nt, Human
cauuccccaggaggccagc

SEQ ID NO: 1837254 - RNA, 18 nt, Human
cauuccccaggaggccag

SEQ ID NO: 1837255 - RNA, 20 nt, Human
cauuccccaggaggccagcc

SEQ ID NO: 1837256 - RNA, 13 nt, Human
cauuccccauggg

SEQ ID NO: 1837257 - RNA, 17 nt, Human
cauuccccgucucuggu

SEQ ID NO: 1837258 - RNA, 17 nt, Human
cauuccccaggaggcca

SEQ ID NO: 1837259 - RNA, 15 nt, Human
cauuccccaggaggc

SEQ ID NO: 1837260 - RNA, 13 nt, Human
cauuccccaggag

SEQ ID NO: 1837261 - RNA, 17 nt, Human
cauuccaccuucccaug

SEQ ID NO: 1837262 - RNA, 22 nt, Human
cauuccaccuucccaugcccug

SEQ ID NO: 1837263 - RNA, 19 nt, Human
cauucauuuucuggguguu

SEQ ID NO: 1837264 - RNA, 23 nt, Human
cauucuucuguacgucugacagg

SEQ ID NO: 1837265 - RNA, 12 nt, Human
cauucugccugc

SEQ ID NO: 1837266 - RNA, 13 nt, Human
cauucugccugcc

SEQ ID NO: 1837267 - RNA, 15 nt, Human
cauucugccugccca

SEQ ID NO: 1837268 - RNA, 16 nt, Human
cauucugccugcccag

SEQ ID NO: 1837269 - RNA, 17 nt, Human
cauucugccugcccagg

SEQ ID NO: 1837270 - RNA, 18 nt, Human
cauucugccugcccaggc

SEQ ID NO: 1837271 - RNA, 19 nt, Human
cauucugccugcccaggcc

SEQ ID NO: 1837272 - RNA, 20 nt, Human
cauucugccugcccaggccc

SEQ ID NO: 1837273 - RNA, 17 nt, Human
cauucuguuaaucauua

SEQ ID NO: 1837274 - RNA, 13 nt, Human
cauucuggaauaa

SEQ ID NO: 1837275 - RNA, 22 nt, Human
cauuccugaugcuucuucagag

SEQ ID NO: 1837276 - RNA, 19 nt, Human
cauuccugaugcuucuuca

SEQ ID NO: 1837277 - RNA, 16 nt, Human
cauuccugaugcuucu

SEQ ID NO: 1837278 - RNA, 14 nt, Human
cauuccugaugcuu

SEQ ID NO: 1837279 - RNA, 23 nt, Human
cauuccugaugcuucuucagaga

SEQ ID NO: 1837280 - RNA, 24 nt, Human
ccaggugcacaagcuccaagcucc

SEQ ID NO: 1837281 - RNA, 17 nt, Human
ccagguuuuuggucuga

SEQ ID NO: 1837282 - RNA, 18 nt, Human
ccagucuggaaugcagug

SEQ ID NO: 1837283 - RNA, 19 nt, Human
ccagucuggaaugcagugg

SEQ ID NO: 1837284 - RNA, 20 nt, Human
ccagucuggaaugcaguggu

SEQ ID NO: 1837285 - RNA, 21 nt, Human
ccagggcuggaaugauuucag

SEQ ID NO: 1837286 - RNA, 18 nt, Human
ccaggugcacaagcucca

SEQ ID NO: 1837287 - RNA, 20 nt, Human
ccaggugcacaagcuccaag

SEQ ID NO: 1837288 - RNA, 19 nt, Human
ccaggugcacaagcuccaa

SEQ ID NO: 1837289 - RNA, 22 nt, Human
ccagggacagaggggguggccu

SEQ ID NO: 1837290 - RNA, 21 nt, Human
ccagggacagaggggguggcc

SEQ ID NO: 1837291 - RNA, 15 nt, Human
ccagggacagagggg

SEQ ID NO: 1837292 - RNA, 14 nt, Human
ccagggacagaggg

SEQ ID NO: 1837293 - RNA, 20 nt, Human
ccaggcuuagucacugagac

SEQ ID NO: 1837294 - RNA, 16 nt, Human
ccagccuccaugcugc

SEQ ID NO: 1837295 - RNA, 15 nt, Human
ccagccuccaugcug

SEQ ID NO: 1837296 - RNA, 21 nt, Human
ccaggcauuccccaggaggcc

SEQ ID NO: 1837297 - RNA, 19 nt, Human
ccaggcauuccccaggagg

SEQ ID NO: 1837298 - RNA, 18 nt, Human
ccaggcauuccccaggag

SEQ ID NO: 1837299 - RNA, 16 nt, Human
ccaggagccccgaggc

SEQ ID NO: 1837300 - RNA, 19 nt, Human
ccaggagccccgaggccuu

SEQ ID NO: 1837301 - RNA, 12 nt, Human
ccaggagccucc

SEQ ID NO: 1837302 - RNA, 20 nt, Human
ccaggagccccgaggccuuc

SEQ ID NO: 1837303 - RNA, 21 nt, Human
ccaggcccucugcccacuccc

SEQ ID NO: 1837304 - RNA, 20 nt, Human
ccaggcccucugcccacucc

SEQ ID NO: 1837305 - RNA, 23 nt, Human
ccaggcccucugcccacucccug

SEQ ID NO: 1837306 - RNA, 22 nt, Human
ccaggcccucugcccacucccu

SEQ ID NO: 1837307 - RNA, 19 nt, Human
ccaggcgccccuucccccu

SEQ ID NO: 1837308 - RNA, 18 nt, Human
ccaggcgccccuuccccc

SEQ ID NO: 1837309 - RNA, 17 nt, Human
ccaggcuuagucacuga

SEQ ID NO: 1837310 - RNA, 24 nt, Human
ccaggcuguaucccaugagccuca

SEQ ID NO: 1837311 - RNA, 13 nt, Human
ccaucuacccucc

SEQ ID NO: 1837312 - RNA, 17 nt, Human
ccagugaggcucugccc

SEQ ID NO: 1837313 - RNA, 20 nt, Human
ccagugccgagaaggaagcc

SEQ ID NO: 1837314 - RNA, 22 nt, Human
ccagugguuccuaauccucuag

SEQ ID NO: 1837315 - RNA, 15 nt, Human
ccagugaggcucugc

SEQ ID NO: 1837316 - RNA, 14 nt, Human
ccagugaggcucug

SEQ ID NO: 1837317 - RNA, 16 nt, Human
ccagugaggcucugcc

SEQ ID NO: 1837318 - RNA, 22 nt, Human
ccaguguuguggauuuaacaga

SEQ ID NO: 1837319 - RNA, 12 nt, Human
ccauaggucacc

SEQ ID NO: 1837320 - RNA, 21 nt, Human
ccauaguaugggacuggccuc

SEQ ID NO: 1837321 - RNA, 23 nt, Human
ccauauucuguuggccaguguga

SEQ ID NO: 1837322 - RNA, 16 nt, Human
ccaucuaaacugcccc

SEQ ID NO: 1837323 - RNA, 15 nt, Human
ccaucuaaacugccc

SEQ ID NO: 1837324 - RNA, 21 nt, Human
ccaugggaaaugucaacaagu

SEQ ID NO: 1837325 - RNA, 14 nt, Human
ccaucuaaacugcc

SEQ ID NO: 1837326 - RNA, 16 nt, Human
ccaugggacagggagg

SEQ ID NO: 1837327 - RNA, 19 nt, Human
ccaugggacagggaggacg

SEQ ID NO: 1837328 - RNA, 21 nt, Human
ccauguuggccaggcugcucu

SEQ ID NO: 1837329 - RNA, 18 nt, Human
ccauguuggccaggcugc

SEQ ID NO: 1837330 - RNA, 17 nt, Human
ccauguuggccaggcug

SEQ ID NO: 1837331 - RNA, 16 nt, Human
ccauguuggccaggcu

SEQ ID NO: 1837332 - RNA, 18 nt, Human
ccauucuccaccugccag

SEQ ID NO: 1837333 - RNA, 15 nt, Human
cccaacccuggcacc

SEQ ID NO: 1837334 - RNA, 17 nt, Human
cccaaggcucugagcaa

SEQ ID NO: 1837335 - RNA, 22 nt, Human
cccaaauggaaaugggcagagc

SEQ ID NO: 1837336 - RNA, 18 nt, Human
cccaaauggaaaugggca

SEQ ID NO: 1837337 - RNA, 23 nt, Human
cccaaauggaaaugggcagagca

SEQ ID NO: 1837338 - RNA, 21 nt, Human
cccaaagugguauagaaaugc

SEQ ID NO: 1837339 - RNA, 20 nt, Human
cccaaagugguauagaaaug

SEQ ID NO: 1837340 - RNA, 16 nt, Human
cccaaagugcugggau

SEQ ID NO: 1837341 - RNA, 18 nt, Human
cccaaaacucuccucugc

SEQ ID NO: 1837342 - RNA, 16 nt, Human
cccaaaacucuccucu

SEQ ID NO: 1837343 - RNA, 20 nt, Human
cccaaaacucuccucugcug

SEQ ID NO: 1837344 - RNA, 13 nt, Human
cccaaagugcugg

SEQ ID NO: 1837345 - RNA, 15 nt, Human
cccaaagugcuggga

SEQ ID NO: 1837346 - RNA, 14 nt, Human
ccauuuguguuuau

SEQ ID NO: 1837347 - RNA, 20 nt, Human
ccauucuccaccugccaggg

SEQ ID NO: 1837348 - RNA, 19 nt, Human
ccauucuccaccugccagg

SEQ ID NO: 1837349 - RNA, 18 nt, Human
ccagcaauucuccugccu

SEQ ID NO: 1837350 - RNA, 16 nt, Human
ccagcaauucuccugc

SEQ ID NO: 1837351 - RNA, 21 nt, Human
ccagcaauucuccugccucag

SEQ ID NO: 1837352 - RNA, 20 nt, Human
ccagcaauucuccugccuca

SEQ ID NO: 1837353 - RNA, 19 nt, Human
ccagcaauucuccugccuc

SEQ ID NO: 1837354 - RNA, 16 nt, Human
ccagcaagugagagcu

SEQ ID NO: 1837355 - RNA, 20 nt, Human
ccagcaagugagagcugggu

SEQ ID NO: 1837356 - RNA, 21 nt, Human
ccagcaagugagagcugggug

SEQ ID NO: 1837357 - RNA, 22 nt, Human
ccagcaagugagagcugggugu

SEQ ID NO: 1837358 - RNA, 14 nt, Human
ccagauuucacucu

SEQ ID NO: 1837359 - RNA, 15 nt, Human
ccagcaagugagagc

SEQ ID NO: 1837360 - RNA, 19 nt, Human
ccagccgccaugcuccugg

SEQ ID NO: 1837361 - RNA, 18 nt, Human
ccagccgccaugcuccug

SEQ ID NO: 1837362 - RNA, 14 nt, Human
ccagccgccaugcu

SEQ ID NO: 1837363 - RNA, 21 nt, Human
ccagccuccaagcuccaucuc

SEQ ID NO: 1837364 - RNA, 19 nt, Human
ccagccucaucucuuuguu

SEQ ID NO: 1837365 - RNA, 16 nt, Human
ccagccccagugccca

SEQ ID NO: 1837366 - RNA, 21 nt, Human
ccagcccuccuuaucaaagga

SEQ ID NO: 1837367 - RNA, 16 nt, Human
ccagcccuuagcaggg

SEQ ID NO: 1837368 - RNA, 17 nt, Human
ccagcccuuagcaggga

SEQ ID NO: 1837369 - RNA, 23 nt, Human
ccagccccaaaacucuccucugc

SEQ ID NO: 1837370 - RNA, 13 nt, Human
ccagccccagugc

SEQ ID NO: 1837371 - RNA, 15 nt, Human
ccagccccagugccc

SEQ ID NO: 1837372 - RNA, 19 nt, Human
ccagccaaagccuccucca

SEQ ID NO: 1837373 - RNA, 18 nt, Human
ccagccaaagccuccucc

SEQ ID NO: 1837374 - RNA, 15 nt, Human
ccagccaaagccucc

SEQ ID NO: 1837375 - RNA, 23 nt, Human
ccagcauaauacuugcuuuggaa

SEQ ID NO: 1837376 - RNA, 12 nt, Human
ccagauuucacu

SEQ ID NO: 1837377 - RNA, 22 nt, Human
ccagauuuaugcauauuauuuu

SEQ ID NO: 1837378 - RNA, 13 nt, Human
ccagauuuaugca

SEQ ID NO: 1837379 - RNA, 21 nt, Human
ccagauugcaacaggcugggc

SEQ ID NO: 1837380 - RNA, 23 nt, Human
ccagauucuuuccugaggcuggg

SEQ ID NO: 1837381 - RNA, 19 nt, Human
ccagauugcaacaggcugg

SEQ ID NO: 1837382 - RNA, 20 nt, Human
ccagauugcaacaggcuggg

SEQ ID NO: 1837383 - RNA, 22 nt, Human
ccagauucuuuccugaggcugg

SEQ ID NO: 1837384 - RNA, 21 nt, Human
ccagauucuuuccugaggcug

SEQ ID NO: 1837385 - RNA, 20 nt, Human
ccagauucuuuccugaggcu

SEQ ID NO: 1837386 - RNA, 19 nt, Human
ccagauucuuuccugaggc

SEQ ID NO: 1837387 - RNA, 18 nt, Human
ccagauucuuuccugagg

SEQ ID NO: 1837388 - RNA, 16 nt, Human
ccagagggccugcaag

SEQ ID NO: 1837389 - RNA, 15 nt, Human
ccagagggccugcaa

SEQ ID NO: 1837390 - RNA, 13 nt, Human
ccagagggccugc

SEQ ID NO: 1837391 - RNA, 22 nt, Human
ccagagggagugacagaggcag

SEQ ID NO: 1837392 - RNA, 23 nt, Human
ccagagggagugacagaggcagc

SEQ ID NO: 1837393 - RNA, 13 nt, Human
ccagagcugccac

SEQ ID NO: 1837394 - RNA, 12 nt, Human
ccagagcugcca

SEQ ID NO: 1837395 - RNA, 11 nt, Human
ccagagcugcc

SEQ ID NO: 1837396 - RNA, 19 nt, Human
ccagagcugccaccugccu

SEQ ID NO: 1837397 - RNA, 16 nt, Human
ccagagcugccaccug

SEQ ID NO: 1837398 - RNA, 15 nt, Human
ccagagcugccaccu

SEQ ID NO: 1837399 - RNA, 14 nt, Human
ccagagcugccacc

SEQ ID NO: 1837400 - RNA, 16 nt, Human
ccagagggagugacag

SEQ ID NO: 1837401 - RNA, 17 nt, Human
ccagagggagugacaga

SEQ ID NO: 1837402 - RNA, 18 nt, Human
ccagagggagugacagag

SEQ ID NO: 1837403 - RNA, 19 nt, Human
ccagagggagugacagagg

SEQ ID NO: 1837404 - RNA, 20 nt, Human
ccagagggagugacagaggc

SEQ ID NO: 1837405 - RNA, 21 nt, Human
ccagagggagugacagaggca

SEQ ID NO: 1837406 - RNA, 21 nt, Human
ccagaggagagaggacccccu

SEQ ID NO: 1837407 - RNA, 22 nt, Human
ccagaggagagaggacccccug

SEQ ID NO: 1837408 - RNA, 20 nt, Human
ccagacaccuugacagggca

SEQ ID NO: 1837409 - RNA, 21 nt, Human
ccagagaggguggugaccucu

SEQ ID NO: 1837410 - RNA, 23 nt, Human
ccagagaggguggugaccucugc

SEQ ID NO: 1837411 - RNA, 14 nt, Human
ccagagaggguggu

SEQ ID NO: 1837412 - RNA, 20 nt, Human
ccacuguacuugcucuugau

SEQ ID NO: 1837413 - RNA, 17 nt, Human
ccagacaccuugacagg

SEQ ID NO: 1837414 - RNA, 19 nt, Human
ccagacaccuugacagggc

SEQ ID NO: 1837415 - RNA, 19 nt, Human
ccacuguacuugcucuuga

SEQ ID NO: 1837416 - RNA, 18 nt, Human
ccacuguacuugcucuug

SEQ ID NO: 1837417 - RNA, 17 nt, Human
ccacuguacuugcucuu

SEQ ID NO: 1837418 - RNA, 12 nt, Human
ccacacccagcc

SEQ ID NO: 1837419 - RNA, 13 nt, Human
ccacacuccagcu

SEQ ID NO: 1837420 - RNA, 17 nt, Human
ccacacuccagcuggga

SEQ ID NO: 1837421 - RNA, 14 nt, Human
ccacacuccagcug

SEQ ID NO: 1837422 - RNA, 13 nt, Human
ccacacccagccc

SEQ ID NO: 1837423 - RNA, 14 nt, Human
ccacacccagccca

SEQ ID NO: 1837424 - RNA, 19 nt, Human
ccacccaagggccuggccu

SEQ ID NO: 1837425 - RNA, 17 nt, Human
ccacccaagggccuggc

SEQ ID NO: 1837426 - RNA, 16 nt, Human
ccacccaagggccugg

SEQ ID NO: 1837427 - RNA, 20 nt, Human
ccaccaacauacucccaucu

SEQ ID NO: 1837428 - RNA, 14 nt, Human
ccaccacacccagc

SEQ ID NO: 1837429 - RNA, 16 nt, Human
ccaccacacccagccc

SEQ ID NO: 1837430 - RNA, 16 nt, Human
ccacccaccucagccu

SEQ ID NO: 1837431 - RNA, 14 nt, Human
ccacccaccucagc

SEQ ID NO: 1837432 - RNA, 15 nt, Human
ccacccaccucagcc

SEQ ID NO: 1837433 - RNA, 21 nt, Human
ccacccaagggccuggccuga

SEQ ID NO: 1837434 - RNA, 20 nt, Human
ccacccaagggccuggccug

SEQ ID NO: 1837435 - RNA, 22 nt, Human
ccacccaagggccuggccugag

SEQ ID NO: 1837436 - RNA, 13 nt, Human
ccacccaccucag

SEQ ID NO: 1837437 - RNA, 22 nt, Human
ccacauagugaugguuccccug

SEQ ID NO: 1837438 - RNA, 21 nt, Human
ccacauagugaugguuccccu

SEQ ID NO: 1837439 - RNA, 19 nt, Human
ccacauagugaugguuccc

SEQ ID NO: 1837440 - RNA, 23 nt, Human
ccacauagugaugguuccccugu

SEQ ID NO: 1837441 - RNA, 14 nt, Human
ccacaucuugcucu

SEQ ID NO: 1837442 - RNA, 18 nt, Human
ccaccaacauacucccau

SEQ ID NO: 1837443 - RNA, 14 nt, Human
ccaccaacauacuc

SEQ ID NO: 1837444 - RNA, 16 nt, Human
ccacaucuugcucugc

SEQ ID NO: 1837445 - RNA, 22 nt, Human
ccacaucuugcucugcugacag

SEQ ID NO: 1837446 - RNA, 23 nt, Human
ccacaucuugcucugcugacaga

SEQ ID NO: 1837447 - RNA, 19 nt, Human
ccaccccucaacaccucug

SEQ ID NO: 1837448 - RNA, 17 nt, Human
ccacccugaaagcccug

SEQ ID NO: 1837449 - RNA, 16 nt, Human
ccacccugaaagcccu

SEQ ID NO: 1837450 - RNA, 18 nt, Human
ccacccugaaagcccuga

SEQ ID NO: 1837451 - RNA, 12 nt, Human
ccaccucagccu

SEQ ID NO: 1837452 - RNA, 13 nt, Human
ccaccucagccuc

SEQ ID NO: 1837453 - RNA, 14 nt, Human
ccaccucagccucc

SEQ ID NO: 1837454 - RNA, 15 nt, Human
ccaccucagccuccc

SEQ ID NO: 1837455 - RNA, 12 nt, Human
ccacccaggagc

SEQ ID NO: 1837456 - RNA, 14 nt, Human
ccacccaggagccc

SEQ ID NO: 1837457 - RNA, 16 nt, Human
ccaccuggccucugca

SEQ ID NO: 1837458 - RNA, 15 nt, Human
ccaccuggccucugc

SEQ ID NO: 1837459 - RNA, 22 nt, Human
ccaccugcggugcuaucucccc

SEQ ID NO: 1837460 - RNA, 17 nt, Human
ccaccuggccucugcac

SEQ ID NO: 1837461 - RNA, 12 nt, Human
ccacggccaggc

SEQ ID NO: 1837462 - RNA, 13 nt, Human
ccacggccaggcc

SEQ ID NO: 1837463 - RNA, 14 nt, Human
ccacggccaggcca

SEQ ID NO: 1837464 - RNA, 15 nt, Human
ccacggccaggccag

SEQ ID NO: 1837465 - RNA, 17 nt, Human
ccaccucccacaaagga

SEQ ID NO: 1837466 - RNA, 12 nt, Human
ccaccugccagg

SEQ ID NO: 1837467 - RNA, 14 nt, Human
ccaccugcccaacc

SEQ ID NO: 1837468 - RNA, 20 nt, Human
ccaccugccuguugggccag

SEQ ID NO: 1837469 - RNA, 17 nt, Human
ccaccugccuguugggc

SEQ ID NO: 1837470 - RNA, 13 nt, Human
ccacguuucuaaa

SEQ ID NO: 1837471 - RNA, 13 nt, Human
ccacucccugcaa

SEQ ID NO: 1837472 - RNA, 12 nt, Human
ccacucccugca

SEQ ID NO: 1837473 - RNA, 19 nt, Human
ccacuccagaccccuggcu

SEQ ID NO: 1837474 - RNA, 17 nt, Human
ccacuccagaccccugg

SEQ ID NO: 1837475 - RNA, 23 nt, Human
ccacuacggaauaguuggcuagg

SEQ ID NO: 1837476 - RNA, 18 nt, Human
ccacuacauucuguuaau

SEQ ID NO: 1837477 - RNA, 22 nt, Human
ccacuacggaauaguuggcuag

SEQ ID NO: 1837478 - RNA, 20 nt, Human
ccacugcacuccagccuggg

SEQ ID NO: 1837479 - RNA, 19 nt, Human
ccacugcacuccagccugg

SEQ ID NO: 1837480 - RNA, 15 nt, Human
ccacucccugcaacc

SEQ ID NO: 1837481 - RNA, 23 nt, Human
ccacugcacuccagccuggguga

SEQ ID NO: 1837482 - RNA, 16 nt, Human
ccacugcgaccacaag

SEQ ID NO: 1837483 - RNA, 11 nt, Human
ccacugccucu

SEQ ID NO: 1837484 - RNA, 11 nt, Human
ccacugcucug

SEQ ID NO: 1837485 - RNA, 22 nt, Human
ccugccaggaagccagcaggcu

SEQ ID NO: 1837486 - RNA, 21 nt, Human
ccugccaggaagccagcaggc

SEQ ID NO: 1837487 - RNA, 19 nt, Human
ccugccaggaagccagcag

SEQ ID NO: 1837488 - RNA, 18 nt, Human
ccugccaggaagccagca

SEQ ID NO: 1837489 - RNA, 11 nt, Human
ccugccaggga

SEQ ID NO: 1837490 - RNA, 16 nt, Human
ccugccaggcauggug

SEQ ID NO: 1837491 - RNA, 23 nt, Human
ccugccaggaagccagcaggcuc

SEQ ID NO: 1837492 - RNA, 15 nt, Human
ccugccagggacaga

SEQ ID NO: 1837493 - RNA, 14 nt, Human
ccugccagggacag

SEQ ID NO: 1837494 - RNA, 13 nt, Human
ccugccagggaca

SEQ ID NO: 1837495 - RNA, 12 nt, Human
ccugccagggac

SEQ ID NO: 1837496 - RNA, 16 nt, Human
ccugccagggacagag

SEQ ID NO: 1837497 - RNA, 17 nt, Human
ccugccaggaagccagc

SEQ ID NO: 1837498 - RNA, 15 nt, Human
ccugccaggaagcca

SEQ ID NO: 1837499 - RNA, 14 nt, Human
ccugccaggaagcc

SEQ ID NO: 1837500 - RNA, 13 nt, Human
ccugccaggaagc

SEQ ID NO: 1837501 - RNA, 14 nt, Human
ccugcaagaacaag

SEQ ID NO: 1837502 - RNA, 20 nt, Human
ccugcaguacuuuaccuccu

SEQ ID NO: 1837503 - RNA, 18 nt, Human
ccugcaguacuuuaccuc

SEQ ID NO: 1837504 - RNA, 15 nt, Human
ccugcagggccaagc

SEQ ID NO: 1837505 - RNA, 15 nt, Human
ccugauugugucucu

SEQ ID NO: 1837506 - RNA, 14 nt, Human
ccugaggcccuucu

SEQ ID NO: 1837507 - RNA, 22 nt, Human
ccugaugcuucuucagagacuc

SEQ ID NO: 1837508 - RNA, 21 nt, Human
ccugaugcuucuucagagacu

SEQ ID NO: 1837509 - RNA, 20 nt, Human
ccugaugcuucuucagagac

SEQ ID NO: 1837510 - RNA, 19 nt, Human
ccugaugcuucuucagaga

SEQ ID NO: 1837511 - RNA, 12 nt, Human
ccugaggcccuu

SEQ ID NO: 1837512 - RNA, 11 nt, Human
ccugaggcccu

SEQ ID NO: 1837513 - RNA, 19 nt, Human
ccugauugugucucuuggu

SEQ ID NO: 1837514 - RNA, 17 nt, Human
ccugauugugucucuug

SEQ ID NO: 1837515 - RNA, 21 nt, Human
ccugcaaccugauugugucuc

SEQ ID NO: 1837516 - RNA, 22 nt, Human
ccugcaaccugauugugucucu

SEQ ID NO: 1837517 - RNA, 11 nt, Human
ccugagcccca

SEQ ID NO: 1837518 - RNA, 14 nt, Human
ccugagcuuucugc

SEQ ID NO: 1837519 - RNA, 12 nt, Human
ccugagccagau

SEQ ID NO: 1837520 - RNA, 21 nt, Human
ccugaggcccagagggccugc

SEQ ID NO: 1837521 - RNA, 16 nt, Human
ccugagcuuucugcua

SEQ ID NO: 1837522 - RNA, 16 nt, Human
ccugacagaaggacuc

SEQ ID NO: 1837523 - RNA, 23 nt, Human
ccugacaacacucauugaccuga

SEQ ID NO: 1837524 - RNA, 18 nt, Human
ccuggaauauauaaccag

SEQ ID NO: 1837525 - RNA, 13 nt, Human
ccuggcagccccu

SEQ ID NO: 1837526 - RNA, 14 nt, Human
ccuggcagccccug

SEQ ID NO: 1837527 - RNA, 12 nt, Human
ccuggcagcccc

SEQ ID NO: 1837528 - RNA, 22 nt, Human
ccuggcacccggccccugcugg

SEQ ID NO: 1837529 - RNA, 22 nt, Human
ccuggcacuauaauguaagcuc

SEQ ID NO: 1837530 - RNA, 23 nt, Human
ccuggcacccggccccugcuggu

SEQ ID NO: 1837531 - RNA, 22 nt, Human
ccuggcuccaaacccucgaggc

SEQ ID NO: 1837532 - RNA, 17 nt, Human
ccuggcucccacaggcc

SEQ ID NO: 1837533 - RNA, 23 nt, Human
ccuggcucccacaggcccuuccu

SEQ ID NO: 1837534 - RNA, 22 nt, Human
ccuggcagccgugccuucagcu

SEQ ID NO: 1837535 - RNA, 21 nt, Human
ccuggcagccgugccuucagc

SEQ ID NO: 1837536 - RNA, 15 nt, Human
ccuggccagaugcac

SEQ ID NO: 1837537 - RNA, 24 nt, Human
ccuggcuuuucacugcuggcugcc

SEQ ID NO: 1837538 - RNA, 23 nt, Human
ccuggcuuuucacugcuggcugc

SEQ ID NO: 1837539 - RNA, 22 nt, Human
ccuggcuuuucacugcuggcug

SEQ ID NO: 1837540 - RNA, 21 nt, Human
ccuggcuuuucacugcuggcu

SEQ ID NO: 1837541 - RNA, 18 nt, Human
ccuggcuuuucacugcug

SEQ ID NO: 1837542 - RNA, 20 nt, Human
ccuggcuuuucacugcuggc

SEQ ID NO: 1837543 - RNA, 23 nt, Human
ccuggggguucuuucuuccucug

SEQ ID NO: 1837544 - RNA, 22 nt, Human
ccuggggguucuuucuuccucu

SEQ ID NO: 1837545 - RNA, 21 nt, Human
ccuggggguucuuucuuccuc

SEQ ID NO: 1837546 - RNA, 18 nt, Human
ccuggggguucuuucuuc

SEQ ID NO: 1837547 - RNA, 21 nt, Human
ccuggucacaggacucugccu

SEQ ID NO: 1837548 - RNA, 23 nt, Human
ccuggucacaggacucugccucc

SEQ ID NO: 1837549 - RNA, 22 nt, Human
ccuggucacaggacucugccuc

SEQ ID NO: 1837550 - RNA, 22 nt, Human
ccugcggugcuaucucccccag

SEQ ID NO: 1837551 - RNA, 21 nt, Human
ccugcucuccgaccagacacc

SEQ ID NO: 1837552 - RNA, 22 nt, Human
ccugcucuccucuugccacugc

SEQ ID NO: 1837553 - RNA, 21 nt, Human
ccugcucuccucuugccacug

SEQ ID NO: 1837554 - RNA, 19 nt, Human
ccugcucuccucuugccac

SEQ ID NO: 1837555 - RNA, 18 nt, Human
ccugcucuccucuugcca

SEQ ID NO: 1837556 - RNA, 16 nt, Human
ccugcucuccucuugc

SEQ ID NO: 1837557 - RNA, 22 nt, Human
ccugcucuccgaccagacaccu

SEQ ID NO: 1837558 - RNA, 14 nt, Human
ccugcuucaaauau

SEQ ID NO: 1837559 - RNA, 15 nt, Human
ccugcugagucccag

SEQ ID NO: 1837560 - RNA, 23 nt, Human
ccugcuuugggcugcccuggugc

SEQ ID NO: 1837561 - RNA, 22 nt, Human
ccugcuuugggcugcccuggug

SEQ ID NO: 1837562 - RNA, 21 nt, Human
ccugcuuugggcugcccuggu

SEQ ID NO: 1837563 - RNA, 19 nt, Human
ccugcuuugggcugcccug

SEQ ID NO: 1837564 - RNA, 20 nt, Human
ccugcuuugggcugcccugg

SEQ ID NO: 1837565 - RNA, 23 nt, Human
ccugccuguugggccaggagccu

SEQ ID NO: 1837566 - RNA, 11 nt, Human
ccugccucagc

SEQ ID NO: 1837567 - RNA, 22 nt, Human
ccugccccucaacucuccucca

SEQ ID NO: 1837568 - RNA, 17 nt, Human
ccugcggugcuaucucc

SEQ ID NO: 1837569 - RNA, 16 nt, Human
ccugcggugcuaucuc

SEQ ID NO: 1837570 - RNA, 22 nt, Human
ccugcgggucacaggagggagg

SEQ ID NO: 1837571 - RNA, 18 nt, Human
ccugcgggucacaggagg

SEQ ID NO: 1837572 - RNA, 12 nt, Human
ccuucagugccu

SEQ ID NO: 1837573 - RNA, 19 nt, Human
ccuuaccugccaggaagcc

SEQ ID NO: 1837574 - RNA, 19 nt, Human
ccuuacccucauguucuua

SEQ ID NO: 1837575 - RNA, 17 nt, Human
ccuuagaagucacacag

SEQ ID NO: 1837576 - RNA, 14 nt, Human
ccuuagaaguggaa

SEQ ID NO: 1837577 - RNA, 18 nt, Human
ccuuagaagucacacagu

SEQ ID NO: 1837578 - RNA, 20 nt, Human
ccuuaccagcagagcaccuu

SEQ ID NO: 1837579 - RNA, 20 nt, Human
ccuuaccacugcucugauga

SEQ ID NO: 1837580 - RNA, 15 nt, Human
ccuuacccucauguu

SEQ ID NO: 1837581 - RNA, 13 nt, Human
ccuuaccagcaga

SEQ ID NO: 1837582 - RNA, 17 nt, Human
ccuuaccacugcucuga

SEQ ID NO: 1837583 - RNA, 20 nt, Human
ccuuacacaaugguuuucuu

SEQ ID NO: 1837584 - RNA, 14 nt, Human
ccuuacacaauggu

SEQ ID NO: 1837585 - RNA, 17 nt, Human
ccuuaaagaguguggca

SEQ ID NO: 1837586 - RNA, 20 nt, Human
ccugugugugcgccuacagg

SEQ ID NO: 1837587 - RNA, 21 nt, Human
ccugugugugcgccuacagga

SEQ ID NO: 1837588 - RNA, 22 nt, Human
ccugugucuugcaauggcagcc

SEQ ID NO: 1837589 - RNA, 22 nt, Human
ccugugucuuuaaaugcugcuu

SEQ ID NO: 1837590 - RNA, 17 nt, Human
ccugugucuugcaaugg

SEQ ID NO: 1837591 - RNA, 19 nt, Human
ccugugucuugcaauggca

SEQ ID NO: 1837592 - RNA, 21 nt, Human
ccugugucuugcaauggcagc

SEQ ID NO: 1837593 - RNA, 16 nt, Human
ccuguuucugcagcca

SEQ ID NO: 1837594 - RNA, 18 nt, Human
ccuguuuguuucugaaag

SEQ ID NO: 1837595 - RNA, 14 nt, Human
ccuguuuguuucug

SEQ ID NO: 1837596 - RNA, 15 nt, Human
ccuguuuaagagaca

SEQ ID NO: 1837597 - RNA, 12 nt, Human
ccuguuuaagag

SEQ ID NO: 1837598 - RNA, 23 nt, Human
ccuguugggccaggagccuccug

SEQ ID NO: 1837599 - RNA, 12 nt, Human
ccuucagccuga

SEQ ID NO: 1837600 - RNA, 14 nt, Human
ccuucagugccaaa

SEQ ID NO: 1837601 - RNA, 19 nt, Human
ccuucauuuggcauucccc

SEQ ID NO: 1837602 - RNA, 11 nt, Human
ccuucagugcc

SEQ ID NO: 1837603 - RNA, 20 nt, Human
ccuucaccuuuguccccacc

SEQ ID NO: 1837604 - RNA, 19 nt, Human
ccuucaccuuuguccccac

SEQ ID NO: 1837605 - RNA, 17 nt, Human
ccuucacagaugggugc

SEQ ID NO: 1837606 - RNA, 14 nt, Human
ccuuagacaguccc

SEQ ID NO: 1837607 - RNA, 21 nt, Human
ccuucaccuuuguccccaccg

SEQ ID NO: 1837608 - RNA, 14 nt, Human
ccuucacuuaggaa

SEQ ID NO: 1837609 - RNA, 14 nt, Human
ccuucggccuccau

SEQ ID NO: 1837610 - RNA, 19 nt, Human
ccuucggccuccauccuga

SEQ ID NO: 1837611 - RNA, 20 nt, Human
ccuucggccuccauccugag

SEQ ID NO: 1837612 - RNA, 22 nt, Human
ccuucauuuggcauuccccacu

SEQ ID NO: 1837613 - RNA, 13 nt, Human
ccuuccucugagg

SEQ ID NO: 1837614 - RNA, 20 nt, Human
ccuuccucugagccuuggga

SEQ ID NO: 1837615 - RNA, 21 nt, Human
ccuuccucuccacugccuucg

SEQ ID NO: 1837616 - RNA, 16 nt, Human
ccuuccucugagccuu

SEQ ID NO: 1837617 - RNA, 15 nt, Human
ccuuccucugagccu

SEQ ID NO: 1837618 - RNA, 22 nt, Human
ccuugguuaggcauugugggaa

SEQ ID NO: 1837619 - RNA, 21 nt, Human
ccuugguuaggcauuguggga

SEQ ID NO: 1837620 - RNA, 22 nt, Human
ccuuggugucgggcaugacacg

SEQ ID NO: 1837621 - RNA, 12 nt, Human
ccuugggacccc

SEQ ID NO: 1837622 - RNA, 18 nt, Human
ccuuugacgccaucccag

SEQ ID NO: 1837623 - RNA, 17 nt, Human
ccuuugacgccauccca

SEQ ID NO: 1837624 - RNA, 16 nt, Human
ccuuugacgccauccc

SEQ ID NO: 1837625 - RNA, 14 nt, Human
ccuucuguggcuca

SEQ ID NO: 1837626 - RNA, 21 nt, Human
ccuucuguggcucacagaacc

SEQ ID NO: 1837627 - RNA, 19 nt, Human
ccuucuccuucaccuuugu

SEQ ID NO: 1837628 - RNA, 15 nt, Human
ccuucuccuucaccu

SEQ ID NO: 1837629 - RNA, 15 nt, Human
ccuucggcgccuuaa

SEQ ID NO: 1837630 - RNA, 16 nt, Human
ccuucggccuccaucc

SEQ ID NO: 1837631 - RNA, 20 nt, Human
ccuugaaaacuuuaugcuaa

SEQ ID NO: 1837632 - RNA, 13 nt, Human
ccuugaacuagga

SEQ ID NO: 1837633 - RNA, 20 nt, Human
ccuugaguugauucagcucu

SEQ ID NO: 1837634 - RNA, 23 nt, Human
ccuugaccauucuccaccugcca

SEQ ID NO: 1837635 - RNA, 13 nt, Human
ccuugacucuuuc

SEQ ID NO: 1837636 - RNA, 17 nt, Human
cgccaugcuccuggccc

SEQ ID NO: 1837637 - RNA, 20 nt, Human
cgauuucuguuuagauaaua

SEQ ID NO: 1837638 - RNA, 18 nt, Human
cgagcccugguggcagug

SEQ ID NO: 1837639 - RNA, 18 nt, Human
cgagcaugccuggauggg

SEQ ID NO: 1837640 - RNA, 15 nt, Human
cgagcccugguggca

SEQ ID NO: 1837641 - RNA, 16 nt, Human
cgagcccugguggcag

SEQ ID NO: 1837642 - RNA, 21 nt, Human
cgccagauucuuuccugaggc

SEQ ID NO: 1837643 - RNA, 20 nt, Human
cgccagauucuuuccugagg

SEQ ID NO: 1837644 - RNA, 19 nt, Human
cgccagauucuuuccugag

SEQ ID NO: 1837645 - RNA, 22 nt, Human
cgccaggggaaaaucagccugc

SEQ ID NO: 1837646 - RNA, 16 nt, Human
cgcagacaggaccagg

SEQ ID NO: 1837647 - RNA, 15 nt, Human
cgcagacaggaccag

SEQ ID NO: 1837648 - RNA, 14 nt, Human
cgcagcccugcaga

SEQ ID NO: 1837649 - RNA, 10 nt, Human
cgcagcccug

SEQ ID NO: 1837650 - RNA, 12 nt, Human
cgaaagaacagu

SEQ ID NO: 1837651 - RNA, 21 nt, Human
cgaaagaacaguccauugaaa

SEQ ID NO: 1837652 - RNA, 22 nt, Human
cgaaagggacuuggaagcuccg

SEQ ID NO: 1837653 - RNA, 20 nt, Human
cgaaaggaugaaagugacca

SEQ ID NO: 1837654 - RNA, 19 nt, Human
cgaaagggacuuggaagcu

SEQ ID NO: 1837655 - RNA, 14 nt, Human
cgaacuccugaccu

SEQ ID NO: 1837656 - RNA, 12 nt, Human
cgaacuggcugc

SEQ ID NO: 1837657 - RNA, 14 nt, Human
cgaacuggcugcaa

SEQ ID NO: 1837658 - RNA, 20 nt, Human
cgaaaacguggcugcuucaa

SEQ ID NO: 1837659 - RNA, 19 nt, Human
cgaaaacguggcugcuuca

SEQ ID NO: 1837660 - RNA, 18 nt, Human
cgaaaacguggcugcuuc

SEQ ID NO: 1837661 - RNA, 15 nt, Human
cgaaaacguggcugc

SEQ ID NO: 1837662 - RNA, 21 nt, Human
ccuuugacgccaucccagccc

SEQ ID NO: 1837663 - RNA, 20 nt, Human
ccuuugacgccaucccagcc

SEQ ID NO: 1837664 - RNA, 22 nt, Human
ccuuugacgccaucccagcccc

SEQ ID NO: 1837665 - RNA, 20 nt, Human
cgagcaggcuucuucccccc

SEQ ID NO: 1837666 - RNA, 17 nt, Human
cgagcaugccuggaugg

SEQ ID NO: 1837667 - RNA, 16 nt, Human
cgagcaugccuggaug

SEQ ID NO: 1837668 - RNA, 13 nt, Human
cgagcaugccugg

SEQ ID NO: 1837669 - RNA, 14 nt, Human
cgagcaugccugga

SEQ ID NO: 1837670 - RNA, 18 nt, Human
cgagaucacgccacugca

SEQ ID NO: 1837671 - RNA, 20 nt, Human
cgagaucacgccacugcacu

SEQ ID NO: 1837672 - RNA, 20 nt, Human
cgagauugcaccacugcacu

SEQ ID NO: 1837673 - RNA, 18 nt, Human
cgagauagccaaggccaa

SEQ ID NO: 1837674 - RNA, 17 nt, Human
cgagaucacgccacugc

SEQ ID NO: 1837675 - RNA, 13 nt, Human
cgaauagcuggga

SEQ ID NO: 1837676 - RNA, 14 nt, Human
cgaauagcugggac

SEQ ID NO: 1837677 - RNA, 17 nt, Human
cgagaaacagccugugu

SEQ ID NO: 1837678 - RNA, 22 nt, Human
cccaccucucucacuccuugaa

SEQ ID NO: 1837679 - RNA, 23 nt, Human
cccaccgggcugggagcucugca

SEQ ID NO: 1837680 - RNA, 17 nt, Human
cccaccucagccucccg

SEQ ID NO: 1837681 - RNA, 20 nt, Human
cccaccgcagacaggaccag

SEQ ID NO: 1837682 - RNA, 19 nt, Human
cccaccgcagacaggacca

SEQ ID NO: 1837683 - RNA, 18 nt, Human
cccaccaucaugucuggc

SEQ ID NO: 1837684 - RNA, 19 nt, Human
cccacgcuggagugcagug

SEQ ID NO: 1837685 - RNA, 20 nt, Human
cccacgcuggagugcaguga

SEQ ID NO: 1837686 - RNA, 21 nt, Human
cccacgcuggagugcagugag

SEQ ID NO: 1837687 - RNA, 23 nt, Human
cccacuugagaauuacccuuuug

SEQ ID NO: 1837688 - RNA, 12 nt, Human
cccacuucugcc

SEQ ID NO: 1837689 - RNA, 16 nt, Human
cccaccuggccucugc

SEQ ID NO: 1837690 - RNA, 21 nt, Human
cccacgacugcccggcagggu

SEQ ID NO: 1837691 - RNA, 20 nt, Human
cccacgacugcccggcaggg

SEQ ID NO: 1837692 - RNA, 21 nt, Human
cccaccuggccucugcacucc

SEQ ID NO: 1837693 - RNA, 19 nt, Human
cccaccuggccucugcacu

SEQ ID NO: 1837694 - RNA, 17 nt, Human
cccaccuggccucugca

SEQ ID NO: 1837695 - RNA, 19 nt, Human
cccacagcgcuggccggga

SEQ ID NO: 1837696 - RNA, 13 nt, Human
cccacaagaaaug

SEQ ID NO: 1837697 - RNA, 20 nt, Human
cccaaugcacuuuguucugg

SEQ ID NO: 1837698 - RNA, 16 nt, Human
cccaaugcacuuuguu

SEQ ID NO: 1837699 - RNA, 20 nt, Human
cccacaagaaaugaaagcag

SEQ ID NO: 1837700 - RNA, 14 nt, Human
cccagagggccugc

SEQ ID NO: 1837701 - RNA, 15 nt, Human
cccagagggccugca

SEQ ID NO: 1837702 - RNA, 21 nt, Human
cccgaggccuucucugaagga

SEQ ID NO: 1837703 - RNA, 13 nt, Human
cccgaguagcugg

SEQ ID NO: 1837704 - RNA, 14 nt, Human
cccgaguagcuggg

SEQ ID NO: 1837705 - RNA, 15 nt, Human
cccgaguagcuggga

SEQ ID NO: 1837706 - RNA, 16 nt, Human
cccgaguagcugggac

SEQ ID NO: 1837707 - RNA, 17 nt, Human
cccgaguagcugggacu

SEQ ID NO: 1837708 - RNA, 18 nt, Human
cccgaguagcugggacua

SEQ ID NO: 1837709 - RNA, 21 nt, Human
cccgaguagcugggacuacag

SEQ ID NO: 1837710 - RNA, 15 nt, Human
cccgggcucugccuc

SEQ ID NO: 1837711 - RNA, 14 nt, Human
cccgggcucugccu

SEQ ID NO: 1837712 - RNA, 12 nt, Human
cccgggcucugc

SEQ ID NO: 1837713 - RNA, 20 nt, Human
cccgcugucagccauuccug

SEQ ID NO: 1837714 - RNA, 19 nt, Human
cccgcugucagccauuccu

SEQ ID NO: 1837715 - RNA, 22 nt, Human
cccgaguagcugggacuacagg

SEQ ID NO: 1837716 - RNA, 20 nt, Human
cccuacaguugaaaaacagc

SEQ ID NO: 1837717 - RNA, 23 nt, Human
cccuaaugcgcaggcuggcccug

SEQ ID NO: 1837718 - RNA, 17 nt, Human
cccuaaugcgcaggcug

SEQ ID NO: 1837719 - RNA, 22 nt, Human
cccuaaugcgcaggcuggcccu

SEQ ID NO: 1837720 - RNA, 21 nt, Human
cccuaaugcgcaggcuggccc

SEQ ID NO: 1837721 - RNA, 18 nt, Human
cccuaccgagucucuucu

SEQ ID NO: 1837722 - RNA, 21 nt, Human
cccuaccgagucucuucucca

SEQ ID NO: 1837723 - RNA, 15 nt, Human
cccgugggguuccuc

SEQ ID NO: 1837724 - RNA, 22 nt, Human
cccgucucugguuccuccccuc

SEQ ID NO: 1837725 - RNA, 17 nt, Human
cccgucgacguagaacc

SEQ ID NO: 1837726 - RNA, 16 nt, Human
cccgggcucugccucc

SEQ ID NO: 1837727 - RNA, 18 nt, Human
cccggugcccaagaauag

SEQ ID NO: 1837728 - RNA, 15 nt, Human
cccugcaaagcccag

SEQ ID NO: 1837729 - RNA, 23 nt, Human
cccugcacaaagcccuuccaugu

SEQ ID NO: 1837730 - RNA, 20 nt, Human
cccugcaaagcccagcuuga

SEQ ID NO: 1837731 - RNA, 19 nt, Human
cccugcaaagcccagcuug

SEQ ID NO: 1837732 - RNA, 17 nt, Human
cccugcaaagcccagcu

SEQ ID NO: 1837733 - RNA, 16 nt, Human
cccugcaaagcccagc

SEQ ID NO: 1837734 - RNA, 22 nt, Human
cccugcacuugcagacucuaca

SEQ ID NO: 1837735 - RNA, 19 nt, Human
cccugcacuugcagacucu

SEQ ID NO: 1837736 - RNA, 12 nt, Human
cccugcacuugc

SEQ ID NO: 1837737 - RNA, 23 nt, Human
cccugaggcccagagggccugca

SEQ ID NO: 1837738 - RNA, 20 nt, Human
cccugaggcccagagggccu

SEQ ID NO: 1837739 - RNA, 19 nt, Human
cccugaggcccagagggcc

SEQ ID NO: 1837740 - RNA, 18 nt, Human
cccugaggcccagagggc

SEQ ID NO: 1837741 - RNA, 17 nt, Human
cccugaggcccagaggg

SEQ ID NO: 1837742 - RNA, 16 nt, Human
cccugaggcccagagg

SEQ ID NO: 1837743 - RNA, 15 nt, Human
cccugaggcccagag

SEQ ID NO: 1837744 - RNA, 14 nt, Human
cccugaggcccaga

SEQ ID NO: 1837745 - RNA, 16 nt, Human
cccugaaagcccugag

SEQ ID NO: 1837746 - RNA, 13 nt, Human
cccugaggcccag

SEQ ID NO: 1837747 - RNA, 15 nt, Human
cccugaaagcccuga

SEQ ID NO: 1837748 - RNA, 16 nt, Human
cccucuggggcuguuc

SEQ ID NO: 1837749 - RNA, 17 nt, Human
cccugguggcagcucac

SEQ ID NO: 1837750 - RNA, 16 nt, Human
cccugguggcagcuca

SEQ ID NO: 1837751 - RNA, 15 nt, Human
cccugguggcagcuc

SEQ ID NO: 1837752 - RNA, 15 nt, Human
cccuggacugugugc

SEQ ID NO: 1837753 - RNA, 18 nt, Human
cccuggcuuuucacugcu

SEQ ID NO: 1837754 - RNA, 18 nt, Human
cccugggaggcagugaug

SEQ ID NO: 1837755 - RNA, 22 nt, Human
cccuggcuuuucacugcuggcu

SEQ ID NO: 1837756 - RNA, 19 nt, Human
cccuggcuuuucacugcug

SEQ ID NO: 1837757 - RNA, 17 nt, Human
cccugcccaccuggccu

SEQ ID NO: 1837758 - RNA, 14 nt, Human
cccugcccaccugg

SEQ ID NO: 1837759 - RNA, 13 nt, Human
cccugcccaccug

SEQ ID NO: 1837760 - RNA, 21 nt, Human
cccugcuggguguggcgcagc

SEQ ID NO: 1837761 - RNA, 16 nt, Human
cccugcuggguguggc

SEQ ID NO: 1837762 - RNA, 18 nt, Human
cccugcccaccuggccuc

SEQ ID NO: 1837763 - RNA, 22 nt, Human
cccugcuggguguggcgcagca

SEQ ID NO: 1837764 - RNA, 17 nt, Human
cccugcuuugggcugcc

SEQ ID NO: 1837765 - RNA, 19 nt, Human
cccugcuuugggcugcccu

SEQ ID NO: 1837766 - RNA, 18 nt, Human
cccugcuuugggcugccc

SEQ ID NO: 1837767 - RNA, 22 nt, Human
cccugcuuugggcugcccuggu

SEQ ID NO: 1837768 - RNA, 20 nt, Human
cccugcuuugggcugcccug

SEQ ID NO: 1837769 - RNA, 17 nt, Human
ccucccgaauagcuggg

SEQ ID NO: 1837770 - RNA, 16 nt, Human
ccucuaggaggucucu

SEQ ID NO: 1837771 - RNA, 14 nt, Human
ccucgguguggaga

SEQ ID NO: 1837772 - RNA, 16 nt, Human
ccucggugccuuccuc

SEQ ID NO: 1837773 - RNA, 18 nt, Human
ccucgguguggagaagcg

SEQ ID NO: 1837774 - RNA, 23 nt, Human
ccuccugccucgaacuggcugca

SEQ ID NO: 1837775 - RNA, 14 nt, Human
ccuccugggcuaag

SEQ ID NO: 1837776 - RNA, 13 nt, Human
ccuccugcugggc

SEQ ID NO: 1837777 - RNA, 10 nt, Human
ccucccuccc

SEQ ID NO: 1837778 - RNA, 21 nt, Human
ccucccugccccucccuucaa

SEQ ID NO: 1837779 - RNA, 18 nt, Human
ccucccugccccucccuu

SEQ ID NO: 1837780 - RNA, 14 nt, Human
ccuccucagaucuu

SEQ ID NO: 1837781 - RNA, 24 nt, Human
ccucccugccccucccuucaacca

SEQ ID NO: 1837782 - RNA, 22 nt, Human
ccucccugccccucccuucaac

SEQ ID NO: 1837783 - RNA, 13 nt, Human
ccucccugccccu

SEQ ID NO: 1837784 - RNA, 20 nt, Human
ccucccgaguagcugggacu

SEQ ID NO: 1837785 - RNA, 21 nt, Human
ccucccgaguagcugggacua

SEQ ID NO: 1837786 - RNA, 23 nt, Human
ccuccaaucccaccaacccucag

SEQ ID NO: 1837787 - RNA, 20 nt, Human
ccucauccucauacccaccc

SEQ ID NO: 1837788 - RNA, 13 nt, Human
ccucauccucaua

SEQ ID NO: 1837789 - RNA, 21 nt, Human
ccucaucuccccaucauuggu

SEQ ID NO: 1837790 - RNA, 19 nt, Human
ccuaugcagagguccacaa

SEQ ID NO: 1837791 - RNA, 19 nt, Human
ccucagucuggcccuuccu

SEQ ID NO: 1837792 - RNA, 20 nt, Human
ccucagucuggcccuuccuu

SEQ ID NO: 1837793 - RNA, 11 nt, Human
ccucagugcca

SEQ ID NO: 1837794 - RNA, 13 nt, Human
ccucauacccacc

SEQ ID NO: 1837795 - RNA, 18 nt, Human
ccucauagcccucacccu

SEQ ID NO: 1837796 - RNA, 17 nt, Human
ccucauagcccucaccc

SEQ ID NO: 1837797 - RNA, 22 nt, Human
ccucauagcccucacccugggg

SEQ ID NO: 1837798 - RNA, 21 nt, Human
ccucauagcccucacccuggg

SEQ ID NO: 1837799 - RNA, 20 nt, Human
ccucauaguaugguggcugg

SEQ ID NO: 1837800 - RNA, 14 nt, Human
ccucaucaccaacg

SEQ ID NO: 1837801 - RNA, 13 nt, Human
ccucaucaccaac

SEQ ID NO: 1837802 - RNA, 21 nt, Human
ccucauaguaugguggcuggg

SEQ ID NO: 1837803 - RNA, 22 nt, Human
ccucauaguaugguggcugggu

SEQ ID NO: 1837804 - RNA, 21 nt, Human
ccuccaggugcacaagcucca

SEQ ID NO: 1837805 - RNA, 19 nt, Human
ccuccaggugcacaagcuc

SEQ ID NO: 1837806 - RNA, 22 nt, Human
ccuccaggugcacaagcuccaa

SEQ ID NO: 1837807 - RNA, 18 nt, Human
ccuccaucuaaacugccc

SEQ ID NO: 1837808 - RNA, 14 nt, Human
ccuccauccugagg

SEQ ID NO: 1837809 - RNA, 14 nt, Human
ccuccaugcugccu

SEQ ID NO: 1837810 - RNA, 23 nt, Human
ccuccaugugggcuaguugggcu

SEQ ID NO: 1837811 - RNA, 15 nt, Human
ccuccaugcugccuc

SEQ ID NO: 1837812 - RNA, 15 nt, Human
ccucccaaagugcug

SEQ ID NO: 1837813 - RNA, 16 nt, Human
ccucccaaagugcugg

SEQ ID NO: 1837814 - RNA, 17 nt, Human
cccugguuuccugcccu

SEQ ID NO: 1837815 - RNA, 16 nt, Human
cccugguuuccugccc

SEQ ID NO: 1837816 - RNA, 20 nt, Human
cccugguggcagcucaccuc

SEQ ID NO: 1837817 - RNA, 19 nt, Human
cccugguuuccugcccugg

SEQ ID NO: 1837818 - RNA, 18 nt, Human
cccugguuuccugcccug

SEQ ID NO: 1837819 - RNA, 14 nt, Human
ccgaggccuucucu

SEQ ID NO: 1837820 - RNA, 20 nt, Human
ccgaguagcugggacuacag

SEQ ID NO: 1837821 - RNA, 17 nt, Human
ccgaggccuucucugaa

SEQ ID NO: 1837822 - RNA, 17 nt, Human
ccgaguagcugggacua

SEQ ID NO: 1837823 - RNA, 23 nt, Human
ccgcuaagagggagggagggcuc

SEQ ID NO: 1837824 - RNA, 13 nt, Human
ccgcucagcccuc

SEQ ID NO: 1837825 - RNA, 12 nt, Human
ccgcucagcccu

SEQ ID NO: 1837826 - RNA, 11 nt, Human
ccgcucagccc

SEQ ID NO: 1837827 - RNA, 21 nt, Human
ccgcuaagagggagggagggc

SEQ ID NO: 1837828 - RNA, 19 nt, Human
ccgcacugggcuuggggac

SEQ ID NO: 1837829 - RNA, 14 nt, Human
ccgcacugggcuug

SEQ ID NO: 1837830 - RNA, 17 nt, Human
ccgggaccccgagccug

SEQ ID NO: 1837831 - RNA, 20 nt, Human
ccgggaagggggcugggaca

SEQ ID NO: 1837832 - RNA, 18 nt, Human
ccggcuggccuggccccu

SEQ ID NO: 1837833 - RNA, 17 nt, Human
ccggcuggccuggcccc

SEQ ID NO: 1837834 - RNA, 19 nt, Human
ccgcuuucuacccagcgag

SEQ ID NO: 1837835 - RNA, 15 nt, Human
ccggcuggccuggcc

SEQ ID NO: 1837836 - RNA, 22 nt, Human
ccgcucagcccucccugccccu

SEQ ID NO: 1837837 - RNA, 21 nt, Human
ccgcucagcccucccugcccc

SEQ ID NO: 1837838 - RNA, 19 nt, Human
ccgcucagcccucccugcc

SEQ ID NO: 1837839 - RNA, 15 nt, Human
ccgcucagcccuccc

SEQ ID NO: 1837840 - RNA, 12 nt, Human
ccgcuuucuacc

SEQ ID NO: 1837841 - RNA, 13 nt, Human
ccgggcucugccu

SEQ ID NO: 1837842 - RNA, 22 nt, Human
ccgggcucugccucccaucacc

SEQ ID NO: 1837843 - RNA, 19 nt, Human
ccgggcugggagcucugca

SEQ ID NO: 1837844 - RNA, 18 nt, Human
ccgggcugggagcucugc

SEQ ID NO: 1837845 - RNA, 13 nt, Human
ccgggcugggagc

SEQ ID NO: 1837846 - RNA, 16 nt, Human
ccgggcguggugguga

SEQ ID NO: 1837847 - RNA, 20 nt, Human
ccgggcgcgguggcucacgc

SEQ ID NO: 1837848 - RNA, 18 nt, Human
ccgggaccccgagccugg

SEQ ID NO: 1837849 - RNA, 15 nt, Human
ccuacaagacacagu

SEQ ID NO: 1837850 - RNA, 18 nt, Human
ccuaaauauauuuuaaga

SEQ ID NO: 1837851 - RNA, 16 nt, Human
ccuaaauauauuuuaa

SEQ ID NO: 1837852 - RNA, 15 nt, Human
ccuaaaauucagugg

SEQ ID NO: 1837853 - RNA, 23 nt, Human
ccuaccgagucucuucuccacug

SEQ ID NO: 1837854 - RNA, 22 nt, Human
ccuaccgagucucuucuccacu

SEQ ID NO: 1837855 - RNA, 15 nt, Human
ccuacuuccugugac

SEQ ID NO: 1837856 - RNA, 21 nt, Human
ccuacuuccccuuccuaauuc

SEQ ID NO: 1837857 - RNA, 13 nt, Human
ccuacuuccugug

SEQ ID NO: 1837858 - RNA, 23 nt, Human
ccuaguuccaccaucaagccacc

SEQ ID NO: 1837859 - RNA, 21 nt, Human
ccuaguuccaccaucaagcca

SEQ ID NO: 1837860 - RNA, 13 nt, Human
ccuaguuccacca

SEQ ID NO: 1837861 - RNA, 22 nt, Human
ccuauauuguuuucaguguaca

SEQ ID NO: 1837862 - RNA, 18 nt, Human
ccuauauuguuuucagug

SEQ ID NO: 1837863 - RNA, 19 nt, Human
cuguauuagucacagagau

SEQ ID NO: 1837864 - RNA, 17 nt, Human
cuguauuagucacagag

SEQ ID NO: 1837865 - RNA, 21 nt, Human
cuguaucccaugagccucagc

SEQ ID NO: 1837866 - RNA, 22 nt, Human
cuguaucccaugagccucagca

SEQ ID NO: 1837867 - RNA, 20 nt, Human
cuguaucccaugagccucag

SEQ ID NO: 1837868 - RNA, 16 nt, Human
cugucaauuacaggaa

SEQ ID NO: 1837869 - RNA, 15 nt, Human
cugucaauuacagga

SEQ ID NO: 1837870 - RNA, 20 nt, Human
cuguauuuuguuuuugucuu

SEQ ID NO: 1837871 - RNA, 21 nt, Human
cuguacuccucccaggcgccc

SEQ ID NO: 1837872 - RNA, 19 nt, Human
cuguacuccucccaggcgc

SEQ ID NO: 1837873 - RNA, 16 nt, Human
cuguacuccucccagg

SEQ ID NO: 1837874 - RNA, 15 nt, Human
cuguacuccucccag

SEQ ID NO: 1837875 - RNA, 14 nt, Human
cuguacuccuccca

SEQ ID NO: 1837876 - RNA, 19 nt, Human
cuguacgucugacaggcaa

SEQ ID NO: 1837877 - RNA, 20 nt, Human
cuguacgucugacaggcaau

SEQ ID NO: 1837878 - RNA, 17 nt, Human
cuguacaugaaaacaca

SEQ ID NO: 1837879 - RNA, 20 nt, Human
cuguacaugaaaacacauuu

SEQ ID NO: 1837880 - RNA, 21 nt, Human
cuguacaugaaaacacauuuu

SEQ ID NO: 1837881 - RNA, 14 nt, Human
cuguacgucugaca

SEQ ID NO: 1837882 - RNA, 15 nt, Human
cuguacgucugacag

SEQ ID NO: 1837883 - RNA, 16 nt, Human
cuguacgucugacagg

SEQ ID NO: 1837884 - RNA, 18 nt, Human
cuguacgucugacaggca

SEQ ID NO: 1837885 - RNA, 18 nt, Human
cugguggcagcucaccuc

SEQ ID NO: 1837886 - RNA, 17 nt, Human
cugguggcagcucaccu

SEQ ID NO: 1837887 - RNA, 20 nt, Human
cugguggcagcucaccucuc

SEQ ID NO: 1837888 - RNA, 15 nt, Human
cugguggcagcugcg

SEQ ID NO: 1837889 - RNA, 14 nt, Human
cugguggcaguggg

SEQ ID NO: 1837890 - RNA, 18 nt, Human
cugguggcagugggagcu

SEQ ID NO: 1837891 - RNA, 22 nt, Human
cuguacagagcccacgccccca

SEQ ID NO: 1837892 - RNA, 18 nt, Human
cuguacagagcccacgcc

SEQ ID NO: 1837893 - RNA, 15 nt, Human
cuguacagagcccac

SEQ ID NO: 1837894 - RNA, 14 nt, Human
cuguacagagccca

SEQ ID NO: 1837895 - RNA, 14 nt, Human
cuguaauuugugau

SEQ ID NO: 1837896 - RNA, 15 nt, Human
cuguaauuugugaua

SEQ ID NO: 1837897 - RNA, 21 nt, Human
cugguuagagguucccuuuga

SEQ ID NO: 1837898 - RNA, 22 nt, Human
cugguuagagguucccuuugac

SEQ ID NO: 1837899 - RNA, 19 nt, Human
cuguaauccuagcacuuug

SEQ ID NO: 1837900 - RNA, 16 nt, Human
cugggggccucuucug

SEQ ID NO: 1837901 - RNA, 14 nt, Human
cugggggcugggca

SEQ ID NO: 1837902 - RNA, 18 nt, Human
cugggggcugggcagagg

SEQ ID NO: 1837903 - RNA, 18 nt, Human
cugggcuugucuguagau

SEQ ID NO: 1837904 - RNA, 22 nt, Human
cugggcuuggggaccagagcug

SEQ ID NO: 1837905 - RNA, 15 nt, Human
cugggcuucaguggc

SEQ ID NO: 1837906 - RNA, 16 nt, Human
cugggucgcccuggac

SEQ ID NO: 1837907 - RNA, 15 nt, Human
cugggucgcccugga

SEQ ID NO: 1837908 - RNA, 23 nt, Human
cuggggguucuuucuuccucugc

SEQ ID NO: 1837909 - RNA, 20 nt, Human
cuggggguucuuucuuccuc

SEQ ID NO: 1837910 - RNA, 13 nt, Human
cugggucgcccug

SEQ ID NO: 1837911 - RNA, 23 nt, Human
cugggccccugccucucugcagg

SEQ ID NO: 1837912 - RNA, 20 nt, Human
cugggccccugccucucugc

SEQ ID NO: 1837913 - RNA, 19 nt, Human
cugggccccugccucucug

SEQ ID NO: 1837914 - RNA, 18 nt, Human
cugggauuacaggcguga

SEQ ID NO: 1837915 - RNA, 21 nt, Human
cugggauuacaagcgugagcc

SEQ ID NO: 1837916 - RNA, 14 nt, Human
cugugugcucagga

SEQ ID NO: 1837917 - RNA, 20 nt, Human
cugugucuuuuuucacuaca

SEQ ID NO: 1837918 - RNA, 21 nt, Human
cugugucuuuaaaugcugcuu

SEQ ID NO: 1837919 - RNA, 20 nt, Human
cugugucuuuaaaugcugcu

SEQ ID NO: 1837920 - RNA, 19 nt, Human
cugugucuuuaaaugcugc

SEQ ID NO: 1837921 - RNA, 18 nt, Human
cugugugugcgccuacag

SEQ ID NO: 1837922 - RNA, 24 nt, Human
cuguggaucaaauccagccugcug

SEQ ID NO: 1837923 - RNA, 14 nt, Human
cuguggaucaaauc

SEQ ID NO: 1837924 - RNA, 17 nt, Human
cugugccucugccuguc

SEQ ID NO: 1837925 - RNA, 16 nt, Human
cugugccucugccugu

SEQ ID NO: 1837926 - RNA, 15 nt, Human
cugugccucugccug

SEQ ID NO: 1837927 - RNA, 14 nt, Human
cugugccucugccu

SEQ ID NO: 1837928 - RNA, 13 nt, Human
cugugccucugcc

SEQ ID NO: 1837929 - RNA, 12 nt, Human
cugugccucugc

SEQ ID NO: 1837930 - RNA, 21 nt, Human
cuguggguuucuaaagcugcc

SEQ ID NO: 1837931 - RNA, 22 nt, Human
cuguggguuucuaaagcugcca

SEQ ID NO: 1837932 - RNA, 14 nt, Human
cugugccaugugcc

SEQ ID NO: 1837933 - RNA, 19 nt, Human
cugugcccuaaaguguauu

SEQ ID NO: 1837934 - RNA, 15 nt, Human
cugugccaugugcca

SEQ ID NO: 1837935 - RNA, 21 nt, Human
cugugauggggcccugccucc

SEQ ID NO: 1837936 - RNA, 16 nt, Human
cugugauggggcccug

SEQ ID NO: 1837937 - RNA, 23 nt, Human
cugugauggggcccugccuccuu

SEQ ID NO: 1837938 - RNA, 15 nt, Human
cugugauggggcccu

SEQ ID NO: 1837939 - RNA, 22 nt, Human
cugugaaaggaaagagggaggu

SEQ ID NO: 1837940 - RNA, 16 nt, Human
cugugaaaggaaagag

SEQ ID NO: 1837941 - RNA, 23 nt, Human
cugucauuugagcagggcucagc

SEQ ID NO: 1837942 - RNA, 18 nt, Human
cugucaauuacaggaagu

SEQ ID NO: 1837943 - RNA, 21 nt, Human
cugucauuugagcagggcuca

SEQ ID NO: 1837944 - RNA, 22 nt, Human
cugucauuugagcagggcucag

SEQ ID NO: 1837945 - RNA, 18 nt, Human
cugucuucaguaagccgu

SEQ ID NO: 1837946 - RNA, 15 nt, Human
cugugaaaggaaaga

SEQ ID NO: 1837947 - RNA, 21 nt, Human
cugucuuuuuucuaaaguaaa

SEQ ID NO: 1837948 - RNA, 13 nt, Human
cuuccugugacuu

SEQ ID NO: 1837949 - RNA, 16 nt, Human
cuuccugugacuucag

SEQ ID NO: 1837950 - RNA, 15 nt, Human
cuucccccuccaauc

SEQ ID NO: 1837951 - RNA, 12 nt, Human
cuucccccucca

SEQ ID NO: 1837952 - RNA, 16 nt, Human
cuuccacaagagccca

SEQ ID NO: 1837953 - RNA, 16 nt, Human
cuucgauacaccgggc

SEQ ID NO: 1837954 - RNA, 21 nt, Human
cuucgauacaccgggccugga

SEQ ID NO: 1837955 - RNA, 14 nt, Human
cuucgccaccuggg

SEQ ID NO: 1837956 - RNA, 15 nt, Human
cuucgccaccugggu

SEQ ID NO: 1837957 - RNA, 17 nt, Human
cuucgcuccugugucuu

SEQ ID NO: 1837958 - RNA, 20 nt, Human
cuucggccuccauccugagg

SEQ ID NO: 1837959 - RNA, 19 nt, Human
cuucgggaggucgaggcag

SEQ ID NO: 1837960 - RNA, 21 nt, Human
cuucucacugccaugccagcu

SEQ ID NO: 1837961 - RNA, 16 nt, Human
cuucucacugccaugc

SEQ ID NO: 1837962 - RNA, 17 nt, Human
cuucaacugaccagccu

SEQ ID NO: 1837963 - RNA, 23 nt, Human
cuucaacugaccagccuccaugc

SEQ ID NO: 1837964 - RNA, 20 nt, Human
cuucaacugaccagccucca

SEQ ID NO: 1837965 - RNA, 20 nt, Human
cuucaaggauccugagccag

SEQ ID NO: 1837966 - RNA, 19 nt, Human
cuucaaggauccugagcca

SEQ ID NO: 1837967 - RNA, 18 nt, Human
cuucaaggauccugagcc

SEQ ID NO: 1837968 - RNA, 17 nt, Human
cuucaaggauccugagc

SEQ ID NO: 1837969 - RNA, 22 nt, Human
cuuagucacugagacagcccgg

SEQ ID NO: 1837970 - RNA, 20 nt, Human
cuuagucacugagacagccc

SEQ ID NO: 1837971 - RNA, 21 nt, Human
cuuagucacugagacagcccg

SEQ ID NO: 1837972 - RNA, 15 nt, Human
cuucaaauauuuccc

SEQ ID NO: 1837973 - RNA, 23 nt, Human
cuucaaggauccugagccagauu

SEQ ID NO: 1837974 - RNA, 22 nt, Human
cuucaaggauccugagccagau

SEQ ID NO: 1837975 - RNA, 21 nt, Human
cuucaaggauccugagccaga

SEQ ID NO: 1837976 - RNA, 14 nt, Human
cuucacauauugau

SEQ ID NO: 1837977 - RNA, 23 nt, Human
cuucacauauugauuuccguuaa

SEQ ID NO: 1837978 - RNA, 19 nt, Human
cuucagcugacuuuucugu

SEQ ID NO: 1837979 - RNA, 15 nt, Human
cuucagcugacuuuu

SEQ ID NO: 1837980 - RNA, 14 nt, Human
cuucaguaagccgu

SEQ ID NO: 1837981 - RNA, 16 nt, Human
cuucagccucccgagu

SEQ ID NO: 1837982 - RNA, 20 nt, Human
cuucagccucccgaguagcu

SEQ ID NO: 1837983 - RNA, 15 nt, Human
cuucagccugaaaga

SEQ ID NO: 1837984 - RNA, 14 nt, Human
cuucagccucccga

SEQ ID NO: 1837985 - RNA, 15 nt, Human
cuuccacaagagccc

SEQ ID NO: 1837986 - RNA, 14 nt, Human
cuuccacaagagcc

SEQ ID NO: 1837987 - RNA, 13 nt, Human
cuuccacaagagc

SEQ ID NO: 1837988 - RNA, 14 nt, Human
cuucagugccaaaa

SEQ ID NO: 1837989 - RNA, 15 nt, Human
cuucaguaagccgug

SEQ ID NO: 1837990 - RNA, 19 nt, Human
cuuagaauuaguggcacuu

SEQ ID NO: 1837991 - RNA, 18 nt, Human
cuuagaaguuuguuguga

SEQ ID NO: 1837992 - RNA, 21 nt, Human
cuuagguuggcaaaaaggcag

SEQ ID NO: 1837993 - RNA, 23 nt, Human
cuuagguuggcaaaaaggcagga

SEQ ID NO: 1837994 - RNA, 14 nt, Human
cuuagucacugaga

SEQ ID NO: 1837995 - RNA, 20 nt, Human
cuuaccugccaggaagccag

SEQ ID NO: 1837996 - RNA, 20 nt, Human
cuuagaaaaaccaccaccau

SEQ ID NO: 1837997 - RNA, 13 nt, Human
cuuacuguacaug

SEQ ID NO: 1837998 - RNA, 16 nt, Human
cuuagaaauugcauuu

SEQ ID NO: 1837999 - RNA, 16 nt, Human
cuuagaaguggaagua

SEQ ID NO: 1838000 - RNA, 17 nt, Human
cuuagaagucacacagu

SEQ ID NO: 1838001 - RNA, 20 nt, Human
cuuagaagucacacaguauu

SEQ ID NO: 1838002 - RNA, 12 nt, Human
cuuaaaaauggu

SEQ ID NO: 1838003 - RNA, 18 nt, Human
cuuaagaauuuugagcag

SEQ ID NO: 1838004 - RNA, 17 nt, Human
cuuaaccagaucauugu

SEQ ID NO: 1838005 - RNA, 20 nt, Human
cuuaauucuuagcucauucu

SEQ ID NO: 1838006 - RNA, 23 nt, Human
cuguucuuucuggcuaugcauuu

SEQ ID NO: 1838007 - RNA, 12 nt, Human
cuguugcccagg

SEQ ID NO: 1838008 - RNA, 13 nt, Human
cuguugcccaggc

SEQ ID NO: 1838009 - RNA, 14 nt, Human
cuguugcccaggcu

SEQ ID NO: 1838010 - RNA, 15 nt, Human
cuguugcccaggcug

SEQ ID NO: 1838011 - RNA, 16 nt, Human
cuguugcccaggcugg

SEQ ID NO: 1838012 - RNA, 15 nt, Human
cuguucuuuccaaag

SEQ ID NO: 1838013 - RNA, 16 nt, Human
cuguucuuuccaaagu

SEQ ID NO: 1838014 - RNA, 19 nt, Human
cuguucuuuccaaaguaca

SEQ ID NO: 1838015 - RNA, 21 nt, Human
cuguucuuuccaaaguacacu

SEQ ID NO: 1838016 - RNA, 13 nt, Human
cuguucuuucugg

SEQ ID NO: 1838017 - RNA, 14 nt, Human
cuguucuuucuggc

SEQ ID NO: 1838018 - RNA, 21 nt, Human
cuguucuuucuggcuaugcau

SEQ ID NO: 1838019 - RNA, 18 nt, Human
cuguucuuaagacgugau

SEQ ID NO: 1838020 - RNA, 16 nt, Human
cuguuaauaguucagg

SEQ ID NO: 1838021 - RNA, 17 nt, Human
cuuaaaaaguggaaaaa

SEQ ID NO: 1838022 - RNA, 16 nt, Human
cuuaaaaaguggaaaa

SEQ ID NO: 1838023 - RNA, 22 nt, Human
cuguuuuacaaaaaagaaaaga

SEQ ID NO: 1838024 - RNA, 14 nt, Human
cuguuuagauaaua

SEQ ID NO: 1838025 - RNA, 17 nt, Human
cuguuuagauaauacac

SEQ ID NO: 1838026 - RNA, 18 nt, Human
cuguugcccaggcuggcg

SEQ ID NO: 1838027 - RNA, 17 nt, Human
cuguugcccaggcuggc

SEQ ID NO: 1838028 - RNA, 15 nt, Human
cuguuucaaacuuua

SEQ ID NO: 1838029 - RNA, 17 nt, Human
cuguuucaaacuuuacu

SEQ ID NO: 1838030 - RNA, 18 nt, Human
cuguuuagauaauacacc

SEQ ID NO: 1838031 - RNA, 19 nt, Human
cuguuugcuaagugaggau

SEQ ID NO: 1838032 - RNA, 17 nt, Human
cuguuugcuaagugagg

SEQ ID NO: 1838033 - RNA, 21 nt, Human
cuuguguguuuauugucaaag

SEQ ID NO: 1838034 - RNA, 21 nt, Human
cuuguguuucuuuaguuuuug

SEQ ID NO: 1838035 - RNA, 21 nt, Human
cuuguuggauuuuugucuugu

SEQ ID NO: 1838036 - RNA, 23 nt, Human
cuuguuggauuuuugucuugugu

SEQ ID NO: 1838037 - RNA, 20 nt, Human
cuuguguguuuauugucaaa

SEQ ID NO: 1838038 - RNA, 21 nt, Human
cuuguuuuuuuuuuccacuua

SEQ ID NO: 1838039 - RNA, 20 nt, Human
cuuguuuuuuuuuuccacuu

SEQ ID NO: 1838040 - RNA, 19 nt, Human
cuuguuuuuuuuuuccacu

SEQ ID NO: 1838041 - RNA, 14 nt, Human
cuuguuuucuggga

SEQ ID NO: 1838042 - RNA, 22 nt, Human
cuuuccaaaugcccagcuuaaa

SEQ ID NO: 1838043 - RNA, 19 nt, Human
cuuuccaaaugcccagcuu

SEQ ID NO: 1838044 - RNA, 18 nt, Human
cuuuccaaaugcccagcu

SEQ ID NO: 1838045 - RNA, 13 nt, Human
cuuuaguuuuugu

SEQ ID NO: 1838046 - RNA, 15 nt, Human
cuuuaguuuuuguga

SEQ ID NO: 1838047 - RNA, 20 nt, Human
cuuuauucuggcagaggagg

SEQ ID NO: 1838048 - RNA, 17 nt, Human
cuuuauuaaauguagaa

SEQ ID NO: 1838049 - RNA, 21 nt, Human
cuuuauuuucuauaauuuaaa

SEQ ID NO: 1838050 - RNA, 20 nt, Human
cuugcuucaaccccaugaga

SEQ ID NO: 1838051 - RNA, 16 nt, Human
cuugcucugcugacag

SEQ ID NO: 1838052 - RNA, 17 nt, Human
cuugcucugcugacaga

SEQ ID NO: 1838053 - RNA, 16 nt, Human
cuuggaaaugggagac

SEQ ID NO: 1838054 - RNA, 13 nt, Human
cuuggaggaagga

SEQ ID NO: 1838055 - RNA, 13 nt, Human
cuuggaagcuccg

SEQ ID NO: 1838056 - RNA, 14 nt, Human
cuugcucugcugac

SEQ ID NO: 1838057 - RNA, 17 nt, Human
cuucuccacccugcucu

SEQ ID NO: 1838058 - RNA, 18 nt, Human
cuucuccacccugcucuc

SEQ ID NO: 1838059 - RNA, 21 nt, Human
cuucuccacccugcucuccga

SEQ ID NO: 1838060 - RNA, 13 nt, Human
cuugccacugccu

SEQ ID NO: 1838061 - RNA, 15 nt, Human
cuugccacugccucu

SEQ ID NO: 1838062 - RNA, 14 nt, Human
cuugccacugccuc

SEQ ID NO: 1838063 - RNA, 12 nt, Human
cuuggagggcau

SEQ ID NO: 1838064 - RNA, 23 nt, Human
cuuggagggcaugaagacagaua

SEQ ID NO: 1838065 - RNA, 22 nt, Human
cuuggaggaaggaaacccagcu

SEQ ID NO: 1838066 - RNA, 16 nt, Human
cuuggcugcagggagu

SEQ ID NO: 1838067 - RNA, 17 nt, Human
cuuggcugcagggaguc

SEQ ID NO: 1838068 - RNA, 22 nt, Human
cuugggcuucauccuccucaga

SEQ ID NO: 1838069 - RNA, 21 nt, Human
cuuggggaccagagcugccac

SEQ ID NO: 1838070 - RNA, 20 nt, Human
cuuggggaccagagcugcca

SEQ ID NO: 1838071 - RNA, 14 nt, Human
cuugggccacugug

SEQ ID NO: 1838072 - RNA, 13 nt, Human
cuugggcuucauc

SEQ ID NO: 1838073 - RNA, 15 nt, Human
cuuggggggcugagg

SEQ ID NO: 1838074 - RNA, 22 nt, Human
cuuggggaccagagcugccacc

SEQ ID NO: 1838075 - RNA, 22 nt, Human
cuuggggggcugaggugggagg

SEQ ID NO: 1838076 - RNA, 16 nt, Human
cuuggggggcugaggu

SEQ ID NO: 1838077 - RNA, 19 nt, Human
cuuguaaaggaauuuaaaa

SEQ ID NO: 1838078 - RNA, 16 nt, Human
cuuuggacccugaggc

SEQ ID NO: 1838079 - RNA, 15 nt, Human
cuuuggacccugagg

SEQ ID NO: 1838080 - RNA, 21 nt, Human
cuuuggacagaagcagcucuu

SEQ ID NO: 1838081 - RNA, 20 nt, Human
cuuuggacagaagcagcucu

SEQ ID NO: 1838082 - RNA, 19 nt, Human
cuuuggacagaagcagcuc

SEQ ID NO: 1838083 - RNA, 18 nt, Human
cuuuggacagaagcagcu

SEQ ID NO: 1838084 - RNA, 18 nt, Human
cuuuggacccugaggccc

SEQ ID NO: 1838085 - RNA, 17 nt, Human
cuuuggacccugaggcc

SEQ ID NO: 1838086 - RNA, 19 nt, Human
cuuuggacccugaggccca

SEQ ID NO: 1838087 - RNA, 16 nt, Human
cuuucccaucuuccaa

SEQ ID NO: 1838088 - RNA, 14 nt, Human
cuuugugauuuuug

SEQ ID NO: 1838089 - RNA, 22 nt, Human
cuuuguccccaccgcagacagg

SEQ ID NO: 1838090 - RNA, 18 nt, Human
cuuuguccccaccgcaga

SEQ ID NO: 1838091 - RNA, 13 nt, Human
cuuugggaggcca

SEQ ID NO: 1838092 - RNA, 17 nt, Human
cuuugugauuuuuguaa

SEQ ID NO: 1838093 - RNA, 18 nt, Human
cuuugugauuuuuguaau

SEQ ID NO: 1838094 - RNA, 19 nt, Human
cuuugugauuuuuguaauu

SEQ ID NO: 1838095 - RNA, 15 nt, Human
cuuuguucagccugc

SEQ ID NO: 1838096 - RNA, 15 nt, Human
cuuuguucuggcucu

SEQ ID NO: 1838097 - RNA, 14 nt, Human
cuuuguucuggcuc

SEQ ID NO: 1838098 - RNA, 18 nt, Human
cuuuguucuaaagaugga

SEQ ID NO: 1838099 - RNA, 20 nt, Human
cuuuuacguccaucucuugu

SEQ ID NO: 1838100 - RNA, 20 nt, Human
cuuuguuuguugucagcuga

SEQ ID NO: 1838101 - RNA, 18 nt, Human
cuuuguuuguugucagcu

SEQ ID NO: 1838102 - RNA, 22 nt, Human
cuuuucauaaccuagccuuaga

SEQ ID NO: 1838103 - RNA, 17 nt, Human
cuuuucacugcuggcug

SEQ ID NO: 1838104 - RNA, 20 nt, Human
cuuuucacugcuggcugccu

SEQ ID NO: 1838105 - RNA, 18 nt, Human
cuuuucacugcuggcugc

SEQ ID NO: 1838106 - RNA, 20 nt, Human
cuuuucauaaccuagccuua

SEQ ID NO: 1838107 - RNA, 23 nt, Human
cuuuucuguccgagcuuugaaaa

SEQ ID NO: 1838108 - RNA, 18 nt, Human
cuuuucuguccgagcuuu

SEQ ID NO: 1838109 - RNA, 23 nt, Human
cuuuucuugcaugaggcuagugu

SEQ ID NO: 1838110 - RNA, 18 nt, Human
cuuuucuugcaugaggcu

SEQ ID NO: 1838111 - RNA, 16 nt, Human
cuuuucuuucagccaa

SEQ ID NO: 1838112 - RNA, 16 nt, Human
gaaacacuuugcauaa

SEQ ID NO: 1838113 - RNA, 15 nt, Human
gaaacagcucgacuu

SEQ ID NO: 1838114 - RNA, 17 nt, Human
gaaacagccugugucuu

SEQ ID NO: 1838115 - RNA, 16 nt, Human
gaaacagccugugucu

SEQ ID NO: 1838116 - RNA, 20 nt, Human
gaaacagcucgacuuuaaaa

SEQ ID NO: 1838117 - RNA, 18 nt, Human
gaaacagcuaaugggaca

SEQ ID NO: 1838118 - RNA, 22 nt, Human
gaaacacugggcuucuagaacc

SEQ ID NO: 1838119 - RNA, 20 nt, Human
gaaaaucuuauaauuuaaaa

SEQ ID NO: 1838120 - RNA, 13 nt, Human
gaaaagcugcuga

SEQ ID NO: 1838121 - RNA, 17 nt, Human
gaaaagcugcugacagu

SEQ ID NO: 1838122 - RNA, 19 nt, Human
gaaaauaacgauaaaagac

SEQ ID NO: 1838123 - RNA, 14 nt, Human
gaaaaucagccugc

SEQ ID NO: 1838124 - RNA, 18 nt, Human
gaaaaucagccugcucca

SEQ ID NO: 1838125 - RNA, 16 nt, Human
gaaaaucagccugcuc

SEQ ID NO: 1838126 - RNA, 19 nt, Human
gaaaaucuuauaauuuaaa

SEQ ID NO: 1838127 - RNA, 15 nt, Human
cuuuuuuggcugcug

SEQ ID NO: 1838128 - RNA, 14 nt, Human
cuuuuuuggcugcu

SEQ ID NO: 1838129 - RNA, 23 nt, Human
gaaaaaggaugcacagaguuguu

SEQ ID NO: 1838130 - RNA, 17 nt, Human
gaaaaaggaugcacaga

SEQ ID NO: 1838131 - RNA, 21 nt, Human
cuuuugagugccuuacacaau

SEQ ID NO: 1838132 - RNA, 16 nt, Human
cuuuugagcauuuaga

SEQ ID NO: 1838133 - RNA, 14 nt, Human
cuuuuuucuaaagu

SEQ ID NO: 1838134 - RNA, 15 nt, Human
cuuuuuucacuacau

SEQ ID NO: 1838135 - RNA, 19 nt, Human
gaaaaccaagccguggcuu

SEQ ID NO: 1838136 - RNA, 18 nt, Human
gaaaaccaagccguggcu

SEQ ID NO: 1838137 - RNA, 21 nt, Human
gaaaaccaagccguggcuucc

SEQ ID NO: 1838138 - RNA, 16 nt, Human
gaaaacguggcugcuu

SEQ ID NO: 1838139 - RNA, 15 nt, Human
gaaaacguggcugcu

SEQ ID NO: 1838140 - RNA, 18 nt, Human
gaaaacguggcugcuuca

SEQ ID NO: 1838141 - RNA, 19 nt, Human
gaaaacguggcugcuucaa

SEQ ID NO: 1838142 - RNA, 14 nt, Human
gaaaacaugcuaca

SEQ ID NO: 1838143 - RNA, 15 nt, Human
gaaaacaugcuacac

SEQ ID NO: 1838144 - RNA, 12 nt, Human
gaaaacaugcua

SEQ ID NO: 1838145 - RNA, 14 nt, Human
gaaaacacauuuuu

SEQ ID NO: 1838146 - RNA, 13 nt, Human
gaaaacacauuuu

SEQ ID NO: 1838147 - RNA, 22 nt, Human
gaaaacaauaacgauaaaagac

SEQ ID NO: 1838148 - RNA, 23 nt, Human
gaagcccaggaaaggcuccagga

SEQ ID NO: 1838149 - RNA, 22 nt, Human
gaagcccaggaaaggcuccagg

SEQ ID NO: 1838150 - RNA, 21 nt, Human
gaagcccaggaaaggcuccag

SEQ ID NO: 1838151 - RNA, 20 nt, Human
gaagcccaggaaaggcucca

SEQ ID NO: 1838152 - RNA, 14 nt, Human
gaagcggcuggcag

SEQ ID NO: 1838153 - RNA, 11 nt, Human
gaagccuuugu

SEQ ID NO: 1838154 - RNA, 10 nt, Human
gaagccuuug

SEQ ID NO: 1838155 - RNA, 18 nt, Human
gaagcuuuuaugugaaac

SEQ ID NO: 1838156 - RNA, 23 nt, Human
gaagccagcaggcucucaggcca

SEQ ID NO: 1838157 - RNA, 19 nt, Human
gaagccagcaggcucucag

SEQ ID NO: 1838158 - RNA, 16 nt, Human
gaagccagcaggcucu

SEQ ID NO: 1838159 - RNA, 15 nt, Human
gaagccagcaggcuc

SEQ ID NO: 1838160 - RNA, 22 nt, Human
gaagccacgguguucugugaua

SEQ ID NO: 1838161 - RNA, 14 nt, Human
gaagaagcucucuc

SEQ ID NO: 1838162 - RNA, 19 nt, Human
gaagacucauucuucugua

SEQ ID NO: 1838163 - RNA, 21 nt, Human
gaagacucauucuucuguacg

SEQ ID NO: 1838164 - RNA, 15 nt, Human
gaaggccccgcccag

SEQ ID NO: 1838165 - RNA, 14 nt, Human
gaaggccccgccca

SEQ ID NO: 1838166 - RNA, 16 nt, Human
gaaggccccgcccagg

SEQ ID NO: 1838167 - RNA, 14 nt, Human
gaaggcagggaggg

SEQ ID NO: 1838168 - RNA, 13 nt, Human
gaaggcagggagg

SEQ ID NO: 1838169 - RNA, 18 nt, Human
gaaggaaacccagcucug

SEQ ID NO: 1838170 - RNA, 23 nt, Human
gaaggacccggaggggccuggca

SEQ ID NO: 1838171 - RNA, 17 nt, Human
gaaggaaacccagcucu

SEQ ID NO: 1838172 - RNA, 14 nt, Human
gaaggaaacccagc

SEQ ID NO: 1838173 - RNA, 21 nt, Human
gaaggauacaaaagcauguga

SEQ ID NO: 1838174 - RNA, 12 nt, Human
gaaggauacaaa

SEQ ID NO: 1838175 - RNA, 19 nt, Human
gaaggauacaaaagcaugu

SEQ ID NO: 1838176 - RNA, 15 nt, Human
gaauagcugggacua

SEQ ID NO: 1838177 - RNA, 15 nt, Human
gaauagaugcugacu

SEQ ID NO: 1838178 - RNA, 14 nt, Human
gaauagcugggacu

SEQ ID NO: 1838179 - RNA, 14 nt, Human
gaaugaaagggccc

SEQ ID NO: 1838180 - RNA, 19 nt, Human
gaaugaaagggcccagaga

SEQ ID NO: 1838181 - RNA, 16 nt, Human
gaaucucaaauaacua

SEQ ID NO: 1838182 - RNA, 12 nt, Human
gaaguuucugcc

SEQ ID NO: 1838183 - RNA, 12 nt, Human
gaauaaaauuuu

SEQ ID NO: 1838184 - RNA, 14 nt, Human
gaauaaagacaccu

SEQ ID NO: 1838185 - RNA, 14 nt, Human
gaauacuuuauaaa

SEQ ID NO: 1838186 - RNA, 14 nt, Human
gaauaacauguaau

SEQ ID NO: 1838187 - RNA, 15 nt, Human
gaauaaauugcuccu

SEQ ID NO: 1838188 - RNA, 20 nt, Human
gaauaauccuaaacauauga

SEQ ID NO: 1838189 - RNA, 17 nt, Human
gaaauuuguuauaauga

SEQ ID NO: 1838190 - RNA, 19 nt, Human
gaaauugcauuuccugaca

SEQ ID NO: 1838191 - RNA, 20 nt, Human
gaaaugggcagagcagagac

SEQ ID NO: 1838192 - RNA, 14 nt, Human
gaaaugggcagagc

SEQ ID NO: 1838193 - RNA, 23 nt, Human
gaaaugcugguuuuucaguuuuc

SEQ ID NO: 1838194 - RNA, 20 nt, Human
gaaacaugacucguauaugu

SEQ ID NO: 1838195 - RNA, 20 nt, Human
gaaacagccugugucuuuaa

SEQ ID NO: 1838196 - RNA, 13 nt, Human
gaaauauaauuga

SEQ ID NO: 1838197 - RNA, 21 nt, Human
gaaauaucugaaaauguaugu

SEQ ID NO: 1838198 - RNA, 15 nt, Human
gaacagacuggaagc

SEQ ID NO: 1838199 - RNA, 16 nt, Human
gaacagacuggaagca

SEQ ID NO: 1838200 - RNA, 21 nt, Human
gaaccacaucuugcucugcug

SEQ ID NO: 1838201 - RNA, 11 nt, Human
gaaccugaccc

SEQ ID NO: 1838202 - RNA, 12 nt, Human
gaaccugacccc

SEQ ID NO: 1838203 - RNA, 16 nt, Human
gaaccaccacacccag

SEQ ID NO: 1838204 - RNA, 17 nt, Human
gaaccaccacacccagc

SEQ ID NO: 1838205 - RNA, 14 nt, Human
gaacucccuuucaa

SEQ ID NO: 1838206 - RNA, 15 nt, Human
gaacucccuuucaac

SEQ ID NO: 1838207 - RNA, 22 nt, Human
gaacuggguacuuguggacaca

SEQ ID NO: 1838208 - RNA, 16 nt, Human
gaacuuggcgcugccc

SEQ ID NO: 1838209 - RNA, 15 nt, Human
gaacuuggcgcugcc

SEQ ID NO: 1838210 - RNA, 13 nt, Human
gaacuuggcgcug

SEQ ID NO: 1838211 - RNA, 23 nt, Human
gaacuugguucccauuugcuccu

SEQ ID NO: 1838212 - RNA, 21 nt, Human
gaacuuguaaaggaauuuaaa

SEQ ID NO: 1838213 - RNA, 15 nt, Human
cugaggcuccacuug

SEQ ID NO: 1838214 - RNA, 21 nt, Human
cugaggcuccacuuggucugu

SEQ ID NO: 1838215 - RNA, 24 nt, Human
cugaggcccuucucuccagccccu

SEQ ID NO: 1838216 - RNA, 22 nt, Human
cugaggcugggcucccuuccca

SEQ ID NO: 1838217 - RNA, 17 nt, Human
cugaggcugggcucccu

SEQ ID NO: 1838218 - RNA, 16 nt, Human
cugaggcugggcuccc

SEQ ID NO: 1838219 - RNA, 15 nt, Human
cugaggcugggcucc

SEQ ID NO: 1838220 - RNA, 13 nt, Human
cugaggcugggcu

SEQ ID NO: 1838221 - RNA, 19 nt, Human
cugagucugaaggcugggu

SEQ ID NO: 1838222 - RNA, 18 nt, Human
cugagucugaaggcuggg

SEQ ID NO: 1838223 - RNA, 20 nt, Human
cugagucccaggcugagccu

SEQ ID NO: 1838224 - RNA, 15 nt, Human
cugaucaccugcccu

SEQ ID NO: 1838225 - RNA, 16 nt, Human
cugauggugcaaugac

SEQ ID NO: 1838226 - RNA, 15 nt, Human
cugauggugcaauga

SEQ ID NO: 1838227 - RNA, 14 nt, Human
cugauggugcaaug

SEQ ID NO: 1838228 - RNA, 21 nt, Human
cugauccuaguuccaccauca

SEQ ID NO: 1838229 - RNA, 20 nt, Human
cugauccuaguuccaccauc

SEQ ID NO: 1838230 - RNA, 20 nt, Human
cugauuuuuuuuuccuucag

SEQ ID NO: 1838231 - RNA, 19 nt, Human
cugauuuuuuuuuccuuca

SEQ ID NO: 1838232 - RNA, 18 nt, Human
cugauuuuuuuuuccuuc

SEQ ID NO: 1838233 - RNA, 16 nt, Human
cugauuuuuuuuuccu

SEQ ID NO: 1838234 - RNA, 22 nt, Human
cugauuuuuuuuuccuucagug

SEQ ID NO: 1838235 - RNA, 21 nt, Human
cugauuuuuuuuuccuucagu

SEQ ID NO: 1838236 - RNA, 23 nt, Human
cugauuuuuuuuuccuucagugc

SEQ ID NO: 1838237 - RNA, 15 nt, Human
cugcaaagcccagcu

SEQ ID NO: 1838238 - RNA, 13 nt, Human
cugcaaagcccag

SEQ ID NO: 1838239 - RNA, 21 nt, Human
cugauggugcaaugaccuuuc

SEQ ID NO: 1838240 - RNA, 20 nt, Human
cugauggugcaaugaccuuu

SEQ ID NO: 1838241 - RNA, 19 nt, Human
cugauggugcaaugaccuu

SEQ ID NO: 1838242 - RNA, 17 nt, Human
cugauggugcaaugacc

SEQ ID NO: 1838243 - RNA, 17 nt, Human
cugauugugucucuugg

SEQ ID NO: 1838244 - RNA, 21 nt, Human
cugauugugucucuugguccu

SEQ ID NO: 1838245 - RNA, 22 nt, Human
cugcacaagcugcacccucagg

SEQ ID NO: 1838246 - RNA, 13 nt, Human
cugcacacagcac

SEQ ID NO: 1838247 - RNA, 18 nt, Human
cugcaauaaggggagagu

SEQ ID NO: 1838248 - RNA, 22 nt, Human
cugcacacgcuccuuccucuga

SEQ ID NO: 1838249 - RNA, 20 nt, Human
cugcacacgcuccuuccucu

SEQ ID NO: 1838250 - RNA, 14 nt, Human
cugcacacagcacg

SEQ ID NO: 1838251 - RNA, 18 nt, Human
cugcacuccccugcuggg

SEQ ID NO: 1838252 - RNA, 17 nt, Human
cugcacuccccugcugg

SEQ ID NO: 1838253 - RNA, 16 nt, Human
cugcacuccccugcug

SEQ ID NO: 1838254 - RNA, 18 nt, Human
cugcacuugcagacucua

SEQ ID NO: 1838255 - RNA, 22 nt, Human
cugcaccggcuggccuggcccc

SEQ ID NO: 1838256 - RNA, 16 nt, Human
cugcacccucaggcag

SEQ ID NO: 1838257 - RNA, 14 nt, Human
cugcacccucaggc

SEQ ID NO: 1838258 - RNA, 13 nt, Human
cugcacccucagg

SEQ ID NO: 1838259 - RNA, 15 nt, Human
cugcacuccccugcu

SEQ ID NO: 1838260 - RNA, 23 nt, Human
cugcaccggcuggccuggccccu

SEQ ID NO: 1838261 - RNA, 12 nt, Human
cugcaccgggcc

SEQ ID NO: 1838262 - RNA, 15 nt, Human
cugcccaccuggccu

SEQ ID NO: 1838263 - RNA, 14 nt, Human
cugcccaccuggcc

SEQ ID NO: 1838264 - RNA, 13 nt, Human
cugcccaccuggc

SEQ ID NO: 1838265 - RNA, 15 nt, Human
cugccaugccagcuu

SEQ ID NO: 1838266 - RNA, 14 nt, Human
cugccaugccagcu

SEQ ID NO: 1838267 - RNA, 21 nt, Human
cugccaucucaccuccugcug

SEQ ID NO: 1838268 - RNA, 23 nt, Human
cugccaucucaccuccugcuggg

SEQ ID NO: 1838269 - RNA, 13 nt, Human
cugccaggcaugg

SEQ ID NO: 1838270 - RNA, 11 nt, Human
cugccaggcau

SEQ ID NO: 1838271 - RNA, 16 nt, Human
cugcccacucccugca

SEQ ID NO: 1838272 - RNA, 15 nt, Human
cugcccacucccugc

SEQ ID NO: 1838273 - RNA, 14 nt, Human
cugcccacucccug

SEQ ID NO: 1838274 - RNA, 22 nt, Human
cugcccaccuggccucugcacu

SEQ ID NO: 1838275 - RNA, 20 nt, Human
cugcccaccuggccucugca

SEQ ID NO: 1838276 - RNA, 19 nt, Human
cugcccaccuggccucugc

SEQ ID NO: 1838277 - RNA, 18 nt, Human
cugcccaccuggccucug

SEQ ID NO: 1838278 - RNA, 17 nt, Human
cugcccaccuggccucu

SEQ ID NO: 1838279 - RNA, 18 nt, Human
cugcccacucccugcaac

SEQ ID NO: 1838280 - RNA, 17 nt, Human
cugcccagccuccaagc

SEQ ID NO: 1838281 - RNA, 19 nt, Human
cugccaaugggagcucaug

SEQ ID NO: 1838282 - RNA, 18 nt, Human
cugccaaugggagcucau

SEQ ID NO: 1838283 - RNA, 22 nt, Human
cugcaugcgggcuuccuccugg

SEQ ID NO: 1838284 - RNA, 18 nt, Human
cugcaugcgggcuuccuc

SEQ ID NO: 1838285 - RNA, 16 nt, Human
cugcaucguuucaucu

SEQ ID NO: 1838286 - RNA, 20 nt, Human
cugcauccuccgccucccgg

SEQ ID NO: 1838287 - RNA, 19 nt, Human
cugcauccuccgccucccg

SEQ ID NO: 1838288 - RNA, 22 nt, Human
cugcaucguuucaucuuccaac

SEQ ID NO: 1838289 - RNA, 22 nt, Human
cugcaguugccagucaccccgg

SEQ ID NO: 1838290 - RNA, 21 nt, Human
cugcaguugccagucaccccg

SEQ ID NO: 1838291 - RNA, 17 nt, Human
cugcaguugccagucac

SEQ ID NO: 1838292 - RNA, 19 nt, Human
cugcaguugccagucaccc

SEQ ID NO: 1838293 - RNA, 23 nt, Human
cugcacuugcagacucuacagag

SEQ ID NO: 1838294 - RNA, 22 nt, Human
cugccuccagaauggucuuucu

SEQ ID NO: 1838295 - RNA, 14 nt, Human
cugccuccagaaug

SEQ ID NO: 1838296 - RNA, 18 nt, Human
cugccucucugcaggucc

SEQ ID NO: 1838297 - RNA, 17 nt, Human
cugccucucugcagguc

SEQ ID NO: 1838298 - RNA, 16 nt, Human
cugccucucugcaggu

SEQ ID NO: 1838299 - RNA, 15 nt, Human
cugccucucugcagg

SEQ ID NO: 1838300 - RNA, 15 nt, Human
cugccucagccuccc

SEQ ID NO: 1838301 - RNA, 17 nt, Human
cugccucagccucccga

SEQ ID NO: 1838302 - RNA, 19 nt, Human
cugccucagccucccaaag

SEQ ID NO: 1838303 - RNA, 22 nt, Human
cugccgcagcccugcagagggc

SEQ ID NO: 1838304 - RNA, 21 nt, Human
cugccgcagcccugcagaggg

SEQ ID NO: 1838305 - RNA, 20 nt, Human
cugccgcagcccugcagagg

SEQ ID NO: 1838306 - RNA, 19 nt, Human
cugccgcagcccugcagag

SEQ ID NO: 1838307 - RNA, 23 nt, Human
cugccgcagcccugcagagggca

SEQ ID NO: 1838308 - RNA, 13 nt, Human
cugccgcagcccu

SEQ ID NO: 1838309 - RNA, 12 nt, Human
cugccgcagccc

SEQ ID NO: 1838310 - RNA, 21 nt, Human
cugccccuccucucugcccua

SEQ ID NO: 1838311 - RNA, 20 nt, Human
cugccccuccucucugcccu

SEQ ID NO: 1838312 - RNA, 19 nt, Human
cugccucucugcagguccc

SEQ ID NO: 1838313 - RNA, 17 nt, Human
cugccucugacacacag

SEQ ID NO: 1838314 - RNA, 18 nt, Human
cugccucugacacacagc

SEQ ID NO: 1838315 - RNA, 21 nt, Human
cugccucugacacacagcucu

SEQ ID NO: 1838316 - RNA, 21 nt, Human
cugccugcccaggccccugcc

SEQ ID NO: 1838317 - RNA, 22 nt, Human
cugccugcccaggccccugcca

SEQ ID NO: 1838318 - RNA, 19 nt, Human
cugcgguccacccaggagc

SEQ ID NO: 1838319 - RNA, 20 nt, Human
cugcgguccacccaggagcc

SEQ ID NO: 1838320 - RNA, 18 nt, Human
cugcgguccacccaggag

SEQ ID NO: 1838321 - RNA, 18 nt, Human
cucugucgcccagucugg

SEQ ID NO: 1838322 - RNA, 19 nt, Human
cucugucgcccagucugga

SEQ ID NO: 1838323 - RNA, 22 nt, Human
cucugucgcccaggcuggagug

SEQ ID NO: 1838324 - RNA, 18 nt, Human
cucugucgcccaggcugg

SEQ ID NO: 1838325 - RNA, 17 nt, Human
cucugucgcccagucug

SEQ ID NO: 1838326 - RNA, 15 nt, Human
cucugucgcccaggc

SEQ ID NO: 1838327 - RNA, 13 nt, Human
cucugucgcccag

SEQ ID NO: 1838328 - RNA, 14 nt, Human
cucuguccugggag

SEQ ID NO: 1838329 - RNA, 15 nt, Human
cucuguccugggagu

SEQ ID NO: 1838330 - RNA, 22 nt, Human
cucuguccugggagugagcugg

SEQ ID NO: 1838331 - RNA, 21 nt, Human
cucuggccuucggccuccauc

SEQ ID NO: 1838332 - RNA, 22 nt, Human
cucuggccuucggccuccaucc

SEQ ID NO: 1838333 - RNA, 23 nt, Human
cucuggcagcucagagagggugg

SEQ ID NO: 1838334 - RNA, 20 nt, Human
cucuggauuauauuaugaag

SEQ ID NO: 1838335 - RNA, 19 nt, Human
cucuggauuauauuaugaa

SEQ ID NO: 1838336 - RNA, 10 nt, Human
cucugccuga

SEQ ID NO: 1838337 - RNA, 21 nt, Human
cucugccucccaucacccgcu

SEQ ID NO: 1838338 - RNA, 19 nt, Human
cucugccucugacacacag

SEQ ID NO: 1838339 - RNA, 20 nt, Human
cucugccucugacacacagc

SEQ ID NO: 1838340 - RNA, 13 nt, Human
cucuucuccacug

SEQ ID NO: 1838341 - RNA, 12 nt, Human
cucuucuccacu

SEQ ID NO: 1838342 - RNA, 15 nt, Human
cucuucuccaggcug

SEQ ID NO: 1838343 - RNA, 13 nt, Human
cucuucuccaggc

SEQ ID NO: 1838344 - RNA, 20 nt, Human
cucugugucagguggggcag

SEQ ID NO: 1838345 - RNA, 21 nt, Human
cucugugucagguggggcagc

SEQ ID NO: 1838346 - RNA, 22 nt, Human
cucugugucagguggggcagcu

SEQ ID NO: 1838347 - RNA, 23 nt, Human
cucugugucagguggggcagcuu

SEQ ID NO: 1838348 - RNA, 20 nt, Human
cucuguugcccaggcuggag

SEQ ID NO: 1838349 - RNA, 22 nt, Human
cucuguugcccaggcuggagug

SEQ ID NO: 1838350 - RNA, 17 nt, Human
cucugccucccaucacc

SEQ ID NO: 1838351 - RNA, 16 nt, Human
cucugccucccaucac

SEQ ID NO: 1838352 - RNA, 14 nt, Human
cucugccucccauc

SEQ ID NO: 1838353 - RNA, 13 nt, Human
cucugccucccau

SEQ ID NO: 1838354 - RNA, 20 nt, Human
cucugcccuaaugcgcaggc

SEQ ID NO: 1838355 - RNA, 22 nt, Human
cucugcccuaaugcgcaggcug

SEQ ID NO: 1838356 - RNA, 17 nt, Human
cucugcccacucccugc

SEQ ID NO: 1838357 - RNA, 16 nt, Human
cucugcccacucccug

SEQ ID NO: 1838358 - RNA, 15 nt, Human
cucugcccacucccu

SEQ ID NO: 1838359 - RNA, 13 nt, Human
cucugcccacucc

SEQ ID NO: 1838360 - RNA, 20 nt, Human
cucugcccacucccugcaac

SEQ ID NO: 1838361 - RNA, 18 nt, Human
cucugcccacucccugca

SEQ ID NO: 1838362 - RNA, 18 nt, Human
cucugcaggucccuaaua

SEQ ID NO: 1838363 - RNA, 22 nt, Human
cucugcaggucccuaauaaagc

SEQ ID NO: 1838364 - RNA, 21 nt, Human
cucugcaggucccuaauaaag

SEQ ID NO: 1838365 - RNA, 15 nt, Human
cucugcacaagcugc

SEQ ID NO: 1838366 - RNA, 14 nt, Human
cucugcacaagcug

SEQ ID NO: 1838367 - RNA, 20 nt, Human
cucugcaggucccuaauaaa

SEQ ID NO: 1838368 - RNA, 19 nt, Human
cucugcaggucccuaauaa

SEQ ID NO: 1838369 - RNA, 13 nt, Human
cucugcacaagcu

SEQ ID NO: 1838370 - RNA, 23 nt, Human
cucugagacucgcgacaaugcaa

SEQ ID NO: 1838371 - RNA, 16 nt, Human
cucugaggacacuaac

SEQ ID NO: 1838372 - RNA, 12 nt, Human
cucugaggacac

SEQ ID NO: 1838373 - RNA, 14 nt, Human
cucugaggacacua

SEQ ID NO: 1838374 - RNA, 21 nt, Human
cucugagacucgcgacaaugc

SEQ ID NO: 1838375 - RNA, 22 nt, Human
cucugacaacagacuucugaaa

SEQ ID NO: 1838376 - RNA, 21 nt, Human
cucugacaacagacuucugaa

SEQ ID NO: 1838377 - RNA, 14 nt, Human
cucugacacacagc

SEQ ID NO: 1838378 - RNA, 15 nt, Human
cucugacacacagcu

SEQ ID NO: 1838379 - RNA, 16 nt, Human
cucugacacacagcuc

SEQ ID NO: 1838380 - RNA, 17 nt, Human
cucugacacacagcucu

SEQ ID NO: 1838381 - RNA, 18 nt, Human
cucugacacacagcucug

SEQ ID NO: 1838382 - RNA, 23 nt, Human
cucugacagaagaaccccagggu

SEQ ID NO: 1838383 - RNA, 19 nt, Human
cucugacacacagcucugu

SEQ ID NO: 1838384 - RNA, 16 nt, Human
cucugacaacagacuu

SEQ ID NO: 1838385 - RNA, 22 nt, Human
cucugaaggacauugcggacag

SEQ ID NO: 1838386 - RNA, 15 nt, Human
cugaacauuccagag

SEQ ID NO: 1838387 - RNA, 23 nt, Human
cucuuuggucuacacugugcuga

SEQ ID NO: 1838388 - RNA, 22 nt, Human
cucuuuggucuacacugugcug

SEQ ID NO: 1838389 - RNA, 16 nt, Human
cucuucuccaggcugu

SEQ ID NO: 1838390 - RNA, 23 nt, Human
cugaaagggacgcuacccgggaa

SEQ ID NO: 1838391 - RNA, 14 nt, Human
cucuuuucaaaaca

SEQ ID NO: 1838392 - RNA, 20 nt, Human
cucuuuguucuaaagaugga

SEQ ID NO: 1838393 - RNA, 20 nt, Human
cugaagucuuuguacagaca

SEQ ID NO: 1838394 - RNA, 17 nt, Human
cugaagucuuuguacag

SEQ ID NO: 1838395 - RNA, 22 nt, Human
cugaagucccagauacuugggg

SEQ ID NO: 1838396 - RNA, 17 nt, Human
cugaaguucagcugcau

SEQ ID NO: 1838397 - RNA, 15 nt, Human
cugaagucacugcac

SEQ ID NO: 1838398 - RNA, 14 nt, Human
cugaagucacugca

SEQ ID NO: 1838399 - RNA, 13 nt, Human
cugaagucacugc

SEQ ID NO: 1838400 - RNA, 21 nt, Human
cugaagucacacagugagucg

SEQ ID NO: 1838401 - RNA, 18 nt, Human
cugaagucacacagugag

SEQ ID NO: 1838402 - RNA, 19 nt, Human
cugaagucacacagugagu

SEQ ID NO: 1838403 - RNA, 17 nt, Human
cugaagucacacaguga

SEQ ID NO: 1838404 - RNA, 12 nt, Human
cugaauuucuuu

SEQ ID NO: 1838405 - RNA, 12 nt, Human
cugaauuauuuu

SEQ ID NO: 1838406 - RNA, 20 nt, Human
cugaaugguuuucaaaauaa

SEQ ID NO: 1838407 - RNA, 19 nt, Human
cugaaugguuuucaaaaua

SEQ ID NO: 1838408 - RNA, 23 nt, Human
cugaccagccuccaugcugccuc

SEQ ID NO: 1838409 - RNA, 21 nt, Human
cugaccagccuccaugcugcc

SEQ ID NO: 1838410 - RNA, 14 nt, Human
cugaauuucuuuug

SEQ ID NO: 1838411 - RNA, 16 nt, Human
cugacagacacaggcc

SEQ ID NO: 1838412 - RNA, 17 nt, Human
cugaccagccuccaugc

SEQ ID NO: 1838413 - RNA, 17 nt, Human
cugacagacacaggccc

SEQ ID NO: 1838414 - RNA, 18 nt, Human
cugacagacacaggcccg

SEQ ID NO: 1838415 - RNA, 17 nt, Human
cugacuguacuccuccc

SEQ ID NO: 1838416 - RNA, 22 nt, Human
cugagacagcccgggcucugcc

SEQ ID NO: 1838417 - RNA, 21 nt, Human
cugagacagcccgggcucugc

SEQ ID NO: 1838418 - RNA, 19 nt, Human
cugagacagcccgggcucu

SEQ ID NO: 1838419 - RNA, 20 nt, Human
cugagacagcccgggcucug

SEQ ID NO: 1838420 - RNA, 21 nt, Human
cugagcaaauguggcuccugg

SEQ ID NO: 1838421 - RNA, 20 nt, Human
cugagcaaauguggcuccug

SEQ ID NO: 1838422 - RNA, 17 nt, Human
cugagcaaauguggcuc

SEQ ID NO: 1838423 - RNA, 15 nt, Human
cugagcaaauguggc

SEQ ID NO: 1838424 - RNA, 23 nt, Human
cugagauuauaggcaccuaccac

SEQ ID NO: 1838425 - RNA, 14 nt, Human
cugagccagauuuc

SEQ ID NO: 1838426 - RNA, 13 nt, Human
cugagccagauuu

SEQ ID NO: 1838427 - RNA, 15 nt, Human
cugagccagauuuca

SEQ ID NO: 1838428 - RNA, 22 nt, Human
cucgagcaugccuggauggggc

SEQ ID NO: 1838429 - RNA, 15 nt, Human
cucgccuucaucucc

SEQ ID NO: 1838430 - RNA, 23 nt, Human
cucgcucugucgcccaggcugga

SEQ ID NO: 1838431 - RNA, 19 nt, Human
cucgagcaugccuggaugg

SEQ ID NO: 1838432 - RNA, 16 nt, Human
cucgagcaugccugga

SEQ ID NO: 1838433 - RNA, 15 nt, Human
cucgagcaugccugg

SEQ ID NO: 1838434 - RNA, 13 nt, Human
cucgagcaugccu

SEQ ID NO: 1838435 - RNA, 23 nt, Human
cuccuuggugucgggcaugacac

SEQ ID NO: 1838436 - RNA, 22 nt, Human
cuccuuaucaaaggacaccauu

SEQ ID NO: 1838437 - RNA, 17 nt, Human
cuccuuaucaaaggaca

SEQ ID NO: 1838438 - RNA, 12 nt, Human
cuccuggacucc

SEQ ID NO: 1838439 - RNA, 13 nt, Human
cuccuuagaagug

SEQ ID NO: 1838440 - RNA, 17 nt, Human
cuccuuagaaguggaag

SEQ ID NO: 1838441 - RNA, 20 nt, Human
cuccuuagaaguggaaguag

SEQ ID NO: 1838442 - RNA, 14 nt, Human
cuccuggaaauauu

SEQ ID NO: 1838443 - RNA, 13 nt, Human
cuccugcugggca

SEQ ID NO: 1838444 - RNA, 11 nt, Human
cuccuggacuc

SEQ ID NO: 1838445 - RNA, 21 nt, Human
cuccugugugugcgccuacag

SEQ ID NO: 1838446 - RNA, 23 nt, Human
cuccugugugugcgccuacagga

SEQ ID NO: 1838447 - RNA, 24 nt, Human
cuccugugugugcgccuacaggag

SEQ ID NO: 1838448 - RNA, 17 nt, Human
cuccugccucagccucc

SEQ ID NO: 1838449 - RNA, 16 nt, Human
cuccugccucagccuc

SEQ ID NO: 1838450 - RNA, 12 nt, Human
cuccugccucag

SEQ ID NO: 1838451 - RNA, 11 nt, Human
cuccugccuca

SEQ ID NO: 1838452 - RNA, 13 nt, Human
cuccucuccccag

SEQ ID NO: 1838453 - RNA, 15 nt, Human
cuccucuccccagca

SEQ ID NO: 1838454 - RNA, 22 nt, Human
cuccugccucgaacuggcugca

SEQ ID NO: 1838455 - RNA, 19 nt, Human
cuccugccucagccucccg

SEQ ID NO: 1838456 - RNA, 21 nt, Human
cuccugccucagccuccugag

SEQ ID NO: 1838457 - RNA, 18 nt, Human
cuccugccucgaacuggc

SEQ ID NO: 1838458 - RNA, 20 nt, Human
cuccugccucgaacuggcug

SEQ ID NO: 1838459 - RNA, 21 nt, Human
cuccugccucgaacuggcugc

SEQ ID NO: 1838460 - RNA, 15 nt, Human
cuccuccagagucag

SEQ ID NO: 1838461 - RNA, 13 nt, Human
cuccuccagaguc

SEQ ID NO: 1838462 - RNA, 15 nt, Human
cuccuccagccgcca

SEQ ID NO: 1838463 - RNA, 19 nt, Human
cuccuccuggacuccugca

SEQ ID NO: 1838464 - RNA, 15 nt, Human
cuccuccuggacucc

SEQ ID NO: 1838465 - RNA, 14 nt, Human
cuccuccuggacuc

SEQ ID NO: 1838466 - RNA, 23 nt, Human
cuccucccaggcgccccuucccc

SEQ ID NO: 1838467 - RNA, 22 nt, Human
cuccucccaggcgccccuuccc

SEQ ID NO: 1838468 - RNA, 17 nt, Human
cuccucccaggcgcccc

SEQ ID NO: 1838469 - RNA, 18 nt, Human
cuccucagaucuucugug

SEQ ID NO: 1838470 - RNA, 12 nt, Human
cucccuuucaac

SEQ ID NO: 1838471 - RNA, 19 nt, Human
cucccuuggggccuaugca

SEQ ID NO: 1838472 - RNA, 21 nt, Human
cucccugccccucccuucaac

SEQ ID NO: 1838473 - RNA, 20 nt, Human
cucccugccccucccuucaa

SEQ ID NO: 1838474 - RNA, 18 nt, Human
cucccugccccucccuuc

SEQ ID NO: 1838475 - RNA, 17 nt, Human
cucccugccccucccuu

SEQ ID NO: 1838476 - RNA, 14 nt, Human
cucccugccccucc

SEQ ID NO: 1838477 - RNA, 13 nt, Human
cucccugccccuc

SEQ ID NO: 1838478 - RNA, 23 nt, Human
cucccugccccccagcccuccuu

SEQ ID NO: 1838479 - RNA, 17 nt, Human
cucccugccccccagcc

SEQ ID NO: 1838480 - RNA, 21 nt, Human
cucccggugcccaagaauaga

SEQ ID NO: 1838481 - RNA, 15 nt, Human
cucccggugcccaag

SEQ ID NO: 1838482 - RNA, 19 nt, Human
cucccgaguagcugggacu

SEQ ID NO: 1838483 - RNA, 20 nt, Human
cucccgaguagcugggacua

SEQ ID NO: 1838484 - RNA, 20 nt, Human
cuccccuccuccuggacucc

SEQ ID NO: 1838485 - RNA, 12 nt, Human
cuccccuccucc

SEQ ID NO: 1838486 - RNA, 14 nt, Human
cuccauccugaggc

SEQ ID NO: 1838487 - RNA, 13 nt, Human
cuccauccugagg

SEQ ID NO: 1838488 - RNA, 22 nt, Human
cuccccagcaagugagagcugg

SEQ ID NO: 1838489 - RNA, 23 nt, Human
cuccccagcaagugagagcuggg

SEQ ID NO: 1838490 - RNA, 15 nt, Human
cucauacccaccccc

SEQ ID NO: 1838491 - RNA, 14 nt, Human
cucauacucaccuc

SEQ ID NO: 1838492 - RNA, 22 nt, Human
cucauacucaccucaccccacu

SEQ ID NO: 1838493 - RNA, 17 nt, Human
cucauagcccucacccu

SEQ ID NO: 1838494 - RNA, 13 nt, Human
cucauagcccuca

SEQ ID NO: 1838495 - RNA, 21 nt, Human
cucauagcccucacccugggg

SEQ ID NO: 1838496 - RNA, 20 nt, Human
cucauagcccucacccuggg

SEQ ID NO: 1838497 - RNA, 21 nt, Human
cucauaguaugguggcugggu

SEQ ID NO: 1838498 - RNA, 21 nt, Human
cucauacccacccccacccaa

SEQ ID NO: 1838499 - RNA, 19 nt, Human
cucauacccacccccaccc

SEQ ID NO: 1838500 - RNA, 18 nt, Human
cucauacccacccccacc

SEQ ID NO: 1838501 - RNA, 16 nt, Human
cucauacccaccccca

SEQ ID NO: 1838502 - RNA, 22 nt, Human
cucaggugauccacccaccuca

SEQ ID NO: 1838503 - RNA, 20 nt, Human
cucaggugauccacccaccu

SEQ ID NO: 1838504 - RNA, 18 nt, Human
cucaggugauccacccac

SEQ ID NO: 1838505 - RNA, 19 nt, Human
cucaggugauccacccacc

SEQ ID NO: 1838506 - RNA, 22 nt, Human
cucaucaccaacgucugugcca

SEQ ID NO: 1838507 - RNA, 21 nt, Human
cucaucaccaacgucugugcc

SEQ ID NO: 1838508 - RNA, 23 nt, Human
cucauaguaugguggcuggguug

SEQ ID NO: 1838509 - RNA, 15 nt, Human
cucauccucauaccc

SEQ ID NO: 1838510 - RNA, 23 nt, Human
cucaggaguuugagaccaaccug

SEQ ID NO: 1838511 - RNA, 18 nt, Human
cucaggaguuugagacca

SEQ ID NO: 1838512 - RNA, 21 nt, Human
cucagcccacauagugauggu

SEQ ID NO: 1838513 - RNA, 19 nt, Human
cucagcccacauagugaug

SEQ ID NO: 1838514 - RNA, 18 nt, Human
cucagcauccuggcaccc

SEQ ID NO: 1838515 - RNA, 13 nt, Human
cucagggccuggc

SEQ ID NO: 1838516 - RNA, 15 nt, Human
cucagggccuggcuc

SEQ ID NO: 1838517 - RNA, 14 nt, Human
cucagggccuggcu

SEQ ID NO: 1838518 - RNA, 15 nt, Human
cucagggccuggucg

SEQ ID NO: 1838519 - RNA, 16 nt, Human
cucagggccuggcuca

SEQ ID NO: 1838520 - RNA, 20 nt, Human
cucaggugagaagcagagga

SEQ ID NO: 1838521 - RNA, 19 nt, Human
cucaggugagaagcagagg

SEQ ID NO: 1838522 - RNA, 16 nt, Human
cucaggugagaagcag

SEQ ID NO: 1838523 - RNA, 18 nt, Human
cucagggucccugguggc

SEQ ID NO: 1838524 - RNA, 17 nt, Human
cucagggucccuggugg

SEQ ID NO: 1838525 - RNA, 16 nt, Human
cucagggucccuggug

SEQ ID NO: 1838526 - RNA, 15 nt, Human
cucagggucccuggu

SEQ ID NO: 1838527 - RNA, 13 nt, Human
cuccaccugccag

SEQ ID NO: 1838528 - RNA, 12 nt, Human
cuccaccugcca

SEQ ID NO: 1838529 - RNA, 14 nt, Human
cuccaccugccagg

SEQ ID NO: 1838530 - RNA, 15 nt, Human
cuccagccccuggau

SEQ ID NO: 1838531 - RNA, 17 nt, Human
cuccagccccuggaugc

SEQ ID NO: 1838532 - RNA, 16 nt, Human
cuccagccccuggaug

SEQ ID NO: 1838533 - RNA, 20 nt, Human
cuccagccccuggaugcagc

SEQ ID NO: 1838534 - RNA, 12 nt, Human
cuccagccuggg

SEQ ID NO: 1838535 - RNA, 14 nt, Human
cuccagcucaccag

SEQ ID NO: 1838536 - RNA, 17 nt, Human
cuccaggagcagccaca

SEQ ID NO: 1838537 - RNA, 16 nt, Human
cuccaggagcagccac

SEQ ID NO: 1838538 - RNA, 15 nt, Human
cuccaggagcagcca

SEQ ID NO: 1838539 - RNA, 14 nt, Human
cuccaggagcagcc

SEQ ID NO: 1838540 - RNA, 13 nt, Human
cuccaggagcagc

SEQ ID NO: 1838541 - RNA, 11 nt, Human
cuccaggagca

SEQ ID NO: 1838542 - RNA, 23 nt, Human
cuccaggagcagccacauuccug

SEQ ID NO: 1838543 - RNA, 18 nt, Human
cuccaggagcagccacau

SEQ ID NO: 1838544 - RNA, 12 nt, Human
cuccauccugag

SEQ ID NO: 1838545 - RNA, 15 nt, Human
cuccacccugcucuc

SEQ ID NO: 1838546 - RNA, 13 nt, Human
cuccacccugcuc

SEQ ID NO: 1838547 - RNA, 23 nt, Human
cuccaaguccacaguggaaccag

SEQ ID NO: 1838548 - RNA, 22 nt, Human
cuccaaucccaccaacccucag

SEQ ID NO: 1838549 - RNA, 13 nt, Human
cucauuaaaaaaa

SEQ ID NO: 1838550 - RNA, 17 nt, Human
cucauuugucacacacu

SEQ ID NO: 1838551 - RNA, 18 nt, Human
cuccaaaauaaaacuuuu

SEQ ID NO: 1838552 - RNA, 15 nt, Human
cuccaaaauaaaacu

SEQ ID NO: 1838553 - RNA, 16 nt, Human
cuccaaaauaaaacuu

SEQ ID NO: 1838554 - RNA, 18 nt, Human
cucauuugucacacacuu

SEQ ID NO: 1838555 - RNA, 18 nt, Human
cuaugggacucaaugcac

SEQ ID NO: 1838556 - RNA, 22 nt, Human
cuaugggacucaaugcacugac

SEQ ID NO: 1838557 - RNA, 23 nt, Human
cuaugggacucaaugcacugaca

SEQ ID NO: 1838558 - RNA, 15 nt, Human
cuauuagagaagaga

SEQ ID NO: 1838559 - RNA, 20 nt, Human
cuaugcagagguccacaaca

SEQ ID NO: 1838560 - RNA, 13 nt, Human
cuauggccugugg

SEQ ID NO: 1838561 - RNA, 22 nt, Human
cuauaauuuaccugaagucuuu

SEQ ID NO: 1838562 - RNA, 21 nt, Human
cuauaauguaagcucuacuga

SEQ ID NO: 1838563 - RNA, 16 nt, Human
cuauaauguaagcucu

SEQ ID NO: 1838564 - RNA, 17 nt, Human
cuauagccuaggugaca

SEQ ID NO: 1838565 - RNA, 22 nt, Human
cuagguaaauuacaguuccuag

SEQ ID NO: 1838566 - RNA, 23 nt, Human
cgcccaguuggguggaugccugg

SEQ ID NO: 1838567 - RNA, 15 nt, Human
cgccaugcuccuggc

SEQ ID NO: 1838568 - RNA, 20 nt, Human
cgccaucccagccccaauga

SEQ ID NO: 1838569 - RNA, 22 nt, Human
cgcccaguuggguggaugccug

SEQ ID NO: 1838570 - RNA, 14 nt, Human
cuaggugacagagu

SEQ ID NO: 1838571 - RNA, 18 nt, Human
cuaggugacagagugaga

SEQ ID NO: 1838572 - RNA, 24 nt, Human
cuaggugacagagugagacucugu

SEQ ID NO: 1838573 - RNA, 15 nt, Human
cucacaguccuuacc

SEQ ID NO: 1838574 - RNA, 24 nt, Human
cucacacaugagcaucaggccagg

SEQ ID NO: 1838575 - RNA, 22 nt, Human
cucacacaugagcaucaggcca

SEQ ID NO: 1838576 - RNA, 14 nt, Human
cucaagacuuccag

SEQ ID NO: 1838577 - RNA, 17 nt, Human
cucaagugauucuccug

SEQ ID NO: 1838578 - RNA, 16 nt, Human
cucaagacuuccagag

SEQ ID NO: 1838579 - RNA, 21 nt, Human
cucaaguccucuuuucugaga

SEQ ID NO: 1838580 - RNA, 17 nt, Human
cucaccagccccagugc

SEQ ID NO: 1838581 - RNA, 18 nt, Human
cucaccagccccagugcc

SEQ ID NO: 1838582 - RNA, 13 nt, Human
cucaccagcccca

SEQ ID NO: 1838583 - RNA, 14 nt, Human
cucaccagccccag

SEQ ID NO: 1838584 - RNA, 15 nt, Human
cucaccagccccagu

SEQ ID NO: 1838585 - RNA, 23 nt, Human
cucacaguccuuaccagcagagc

SEQ ID NO: 1838586 - RNA, 22 nt, Human
cucacaguccuuaccagcagag

SEQ ID NO: 1838587 - RNA, 19 nt, Human
cucacaguccuuaccagca

SEQ ID NO: 1838588 - RNA, 17 nt, Human
cucacaguccuuaccag

SEQ ID NO: 1838589 - RNA, 22 nt, Human
cucacauuuauucugcucacau

SEQ ID NO: 1838590 - RNA, 15 nt, Human
cucacauuuauucug

SEQ ID NO: 1838591 - RNA, 19 nt, Human
cucacauuuauucugcuca

SEQ ID NO: 1838592 - RNA, 18 nt, Human
cuauuguuagucucuuga

SEQ ID NO: 1838593 - RNA, 19 nt, Human
cuauugucaccagggcugg

SEQ ID NO: 1838594 - RNA, 22 nt, Human
cuauuuaugugauccuuuugga

SEQ ID NO: 1838595 - RNA, 21 nt, Human
cucaacaccucugcacaagcu

SEQ ID NO: 1838596 - RNA, 13 nt, Human
cucaaccuccugg

SEQ ID NO: 1838597 - RNA, 15 nt, Human
cucaaccuccugggc

SEQ ID NO: 1838598 - RNA, 17 nt, Human
cucaaccuccugggcua

SEQ ID NO: 1838599 - RNA, 14 nt, Human
cucagagagggugg

SEQ ID NO: 1838600 - RNA, 18 nt, Human
cucagagagggugggagu

SEQ ID NO: 1838601 - RNA, 21 nt, Human
cucacuguugcccaggcuggc

SEQ ID NO: 1838602 - RNA, 22 nt, Human
cucacuguugcccaggcuggcg

SEQ ID NO: 1838603 - RNA, 22 nt, Human
cucacugccaugccagcuuauc

SEQ ID NO: 1838604 - RNA, 19 nt, Human
cucacugccaugccagcuu

SEQ ID NO: 1838605 - RNA, 20 nt, Human
cucacuguugcccaggcugg

SEQ ID NO: 1838606 - RNA, 15 nt, Human
cucagaucuucugug

SEQ ID NO: 1838607 - RNA, 16 nt, Human
cucagcauccuggcac

SEQ ID NO: 1838608 - RNA, 17 nt, Human
cucagcauccuggcacc

SEQ ID NO: 1838609 - RNA, 15 nt, Human
cucaccccagcccca

SEQ ID NO: 1838610 - RNA, 19 nt, Human
cucacuauguugcccaggc

SEQ ID NO: 1838611 - RNA, 20 nt, Human
cucacuauguugcccaggca

SEQ ID NO: 1838612 - RNA, 15 nt, Human
cucacuccuaccugg

SEQ ID NO: 1838613 - RNA, 13 nt, Human
cucacuccuaccu

SEQ ID NO: 1838614 - RNA, 23 nt, Human
cucacuauguugcccaggcaggu

SEQ ID NO: 1838615 - RNA, 21 nt, Human
cucacuauguugcccaggcag

SEQ ID NO: 1838616 - RNA, 22 nt, Human
cucacuauguugcccaggcagg

SEQ ID NO: 1838617 - RNA, 13 nt, Human
cucacuccuugaa

SEQ ID NO: 1838618 - RNA, 19 nt, Human
cucacuccuaccugguaau

SEQ ID NO: 1838619 - RNA, 17 nt, Human
cucacuccuaccuggua

SEQ ID NO: 1838620 - RNA, 16 nt, Human
cucacuccuaccuggu

SEQ ID NO: 1838621 - RNA, 11 nt, Human
cucacucuguc

SEQ ID NO: 1838622 - RNA, 12 nt, Human
cucacucugucg

SEQ ID NO: 1838623 - RNA, 22 nt, Human
cucacucugucgcccagucugg

SEQ ID NO: 1838624 - RNA, 13 nt, Human
cucacucugucgc

SEQ ID NO: 1838625 - RNA, 21 nt, Human
cucacucugucgcccagucug

SEQ ID NO: 1838626 - RNA, 12 nt, Human
cucacugcagcc

SEQ ID NO: 1838627 - RNA, 13 nt, Human
cucacugcagccu

SEQ ID NO: 1838628 - RNA, 14 nt, Human
cucacugcagccuc

SEQ ID NO: 1838629 - RNA, 15 nt, Human
gagggagggcuccag

SEQ ID NO: 1838630 - RNA, 15 nt, Human
gagggagggagggcu

SEQ ID NO: 1838631 - RNA, 14 nt, Human
gagggagggagggc

SEQ ID NO: 1838632 - RNA, 18 nt, Human
gagggcacugguggcccg

SEQ ID NO: 1838633 - RNA, 16 nt, Human
gagggcacugguggcc

SEQ ID NO: 1838634 - RNA, 22 nt, Human
gaggggccucuuaugggcuggg

SEQ ID NO: 1838635 - RNA, 20 nt, Human
gaggggccuggcagccgugc

SEQ ID NO: 1838636 - RNA, 18 nt, Human
gaggggccuggcagccgu

SEQ ID NO: 1838637 - RNA, 14 nt, Human
gaggggccuggcag

SEQ ID NO: 1838638 - RNA, 13 nt, Human
gaggggccuggca

SEQ ID NO: 1838639 - RNA, 22 nt, Human
gagggcacagaaaauggaagac

SEQ ID NO: 1838640 - RNA, 14 nt, Human
gagggcacagaaaa

SEQ ID NO: 1838641 - RNA, 23 nt, Human
gagggcacagaaaauggaagaca

SEQ ID NO: 1838642 - RNA, 12 nt, Human
gagggcacuggu

SEQ ID NO: 1838643 - RNA, 14 nt, Human
gagggagguaagga

SEQ ID NO: 1838644 - RNA, 13 nt, Human
gagggagugacag

SEQ ID NO: 1838645 - RNA, 14 nt, Human
gagggagugacaga

SEQ ID NO: 1838646 - RNA, 16 nt, Human
gagggagggcuccaga

SEQ ID NO: 1838647 - RNA, 16 nt, Human
gagggagugacagagg

SEQ ID NO: 1838648 - RNA, 15 nt, Human
gaggcugggcucccu

SEQ ID NO: 1838649 - RNA, 14 nt, Human
gaggcugggcuccc

SEQ ID NO: 1838650 - RNA, 13 nt, Human
gaggcugggcucc

SEQ ID NO: 1838651 - RNA, 20 nt, Human
gaggcggccccggccggggu

SEQ ID NO: 1838652 - RNA, 19 nt, Human
gaggcggaucuuuggacag

SEQ ID NO: 1838653 - RNA, 14 nt, Human
gaggccuucucuga

SEQ ID NO: 1838654 - RNA, 23 nt, Human
gaggcccuucucuccagccccug

SEQ ID NO: 1838655 - RNA, 14 nt, Human
gaggcccuucucuc

SEQ ID NO: 1838656 - RNA, 24 nt, Human
gaggcccuucucuccagccccugg

SEQ ID NO: 1838657 - RNA, 13 nt, Human
gaggcccggccuc

SEQ ID NO: 1838658 - RNA, 19 nt, Human
gaggcccccaucuccuuaa

SEQ ID NO: 1838659 - RNA, 12 nt, Human
gaggauguucug

SEQ ID NO: 1838660 - RNA, 17 nt, Human
gaggauguucugggaca

SEQ ID NO: 1838661 - RNA, 20 nt, Human
gaggauguucugggacacag

SEQ ID NO: 1838662 - RNA, 16 nt, Human
gaggauugcuugagcu

SEQ ID NO: 1838663 - RNA, 23 nt, Human
gaggaguuugggguaugggagag

SEQ ID NO: 1838664 - RNA, 13 nt, Human
gaggcagccccau

SEQ ID NO: 1838665 - RNA, 23 nt, Human
gaggcagccccauucugccugcc

SEQ ID NO: 1838666 - RNA, 22 nt, Human
gaggcagccccauucugccugc

SEQ ID NO: 1838667 - RNA, 12 nt, Human
gaggccagccuu

SEQ ID NO: 1838668 - RNA, 13 nt, Human
gaggccagccuug

SEQ ID NO: 1838669 - RNA, 13 nt, Human
gaggacagggagg

SEQ ID NO: 1838670 - RNA, 22 nt, Human
gaggacagggaggugaccccag

SEQ ID NO: 1838671 - RNA, 23 nt, Human
gaggacagggaggugaccccagg

SEQ ID NO: 1838672 - RNA, 22 nt, Human
gaggaaggaaacccagcucugg

SEQ ID NO: 1838673 - RNA, 21 nt, Human
gagcuucuguugcugccucau

SEQ ID NO: 1838674 - RNA, 14 nt, Human
gaggaauccagacc

SEQ ID NO: 1838675 - RNA, 15 nt, Human
gaggaauccagaccc

SEQ ID NO: 1838676 - RNA, 14 nt, Human
gagccuccugcccu

SEQ ID NO: 1838677 - RNA, 18 nt, Human
gagccucagucucccucc

SEQ ID NO: 1838678 - RNA, 20 nt, Human
gagccucagcauccuggcac

SEQ ID NO: 1838679 - RNA, 21 nt, Human
gagccucagcauccuggcacc

SEQ ID NO: 1838680 - RNA, 15 nt, Human
gagcccugguggcag

SEQ ID NO: 1838681 - RNA, 16 nt, Human
gagcccugguggcagu

SEQ ID NO: 1838682 - RNA, 19 nt, Human
gagccucagcauccuggca

SEQ ID NO: 1838683 - RNA, 17 nt, Human
gagcccugguggcagug

SEQ ID NO: 1838684 - RNA, 22 nt, Human
gagccuccugcccuuaccugcc

SEQ ID NO: 1838685 - RNA, 20 nt, Human
gagccuccugcccuuaccug

SEQ ID NO: 1838686 - RNA, 21 nt, Human
gagccugggaggucaaggcug

SEQ ID NO: 1838687 - RNA, 13 nt, Human
gagccugggaggu

SEQ ID NO: 1838688 - RNA, 10 nt, Human
gagccuggca

SEQ ID NO: 1838689 - RNA, 15 nt, Human
gagccuggcaagaau

SEQ ID NO: 1838690 - RNA, 13 nt, Human
gagcuacaaaugc

SEQ ID NO: 1838691 - RNA, 12 nt, Human
gagcuacaaaug

SEQ ID NO: 1838692 - RNA, 16 nt, Human
gagcugccaccugccu

SEQ ID NO: 1838693 - RNA, 15 nt, Human
gagcugccaccugcc

SEQ ID NO: 1838694 - RNA, 13 nt, Human
gagcugccaccug

SEQ ID NO: 1838695 - RNA, 16 nt, Human
gagcucugcagagcag

SEQ ID NO: 1838696 - RNA, 15 nt, Human
gagcuuaacagugug

SEQ ID NO: 1838697 - RNA, 18 nt, Human
gagcuucuguugcugccu

SEQ ID NO: 1838698 - RNA, 14 nt, Human
gagcuucuggcacu

SEQ ID NO: 1838699 - RNA, 23 nt, Human
gagcuacacaggggaaaagagga

SEQ ID NO: 1838700 - RNA, 14 nt, Human
gagcuacaaaugca

SEQ ID NO: 1838701 - RNA, 16 nt, Human
gagaucagccugggca

SEQ ID NO: 1838702 - RNA, 14 nt, Human
gagaucagccuggg

SEQ ID NO: 1838703 - RNA, 13 nt, Human
gagaucagccugg

SEQ ID NO: 1838704 - RNA, 20 nt, Human
gagaucaaccccuucgcucc

SEQ ID NO: 1838705 - RNA, 19 nt, Human
gagcaaaaucgaugcagug

SEQ ID NO: 1838706 - RNA, 23 nt, Human
gagcaagacgcugugcugcccug

SEQ ID NO: 1838707 - RNA, 22 nt, Human
gagcaagacgcugugcugcccu

SEQ ID NO: 1838708 - RNA, 18 nt, Human
gagcaagacgcugugcug

SEQ ID NO: 1838709 - RNA, 21 nt, Human
gagcaagacgcugugcugccc

SEQ ID NO: 1838710 - RNA, 17 nt, Human
gagcaccuuagacaguc

SEQ ID NO: 1838711 - RNA, 19 nt, Human
gagcaccuuagacaguccc

SEQ ID NO: 1838712 - RNA, 11 nt, Human
gagcccacgcc

SEQ ID NO: 1838713 - RNA, 13 nt, Human
gagccagauuuca

SEQ ID NO: 1838714 - RNA, 22 nt, Human
gagccacugcaccgggccacag

SEQ ID NO: 1838715 - RNA, 12 nt, Human
gagcccaggccu

SEQ ID NO: 1838716 - RNA, 16 nt, Human
gagcccacgcccccac

SEQ ID NO: 1838717 - RNA, 15 nt, Human
gagcccacgccccca

SEQ ID NO: 1838718 - RNA, 12 nt, Human
gagcccacgccc

SEQ ID NO: 1838719 - RNA, 14 nt, Human
gagcccaggccucc

SEQ ID NO: 1838720 - RNA, 13 nt, Human
gagcccaggccuc

SEQ ID NO: 1838721 - RNA, 14 nt, Human
gagccaccgugccu

SEQ ID NO: 1838722 - RNA, 18 nt, Human
gagccaccgcgcccagcc

SEQ ID NO: 1838723 - RNA, 20 nt, Human
gagccaccgugccuggccac

SEQ ID NO: 1838724 - RNA, 13 nt, Human
gagccacugcacc

SEQ ID NO: 1838725 - RNA, 18 nt, Human
gagcagccacauuccuga

SEQ ID NO: 1838726 - RNA, 18 nt, Human
gaggugggauccuccagg

SEQ ID NO: 1838727 - RNA, 22 nt, Human
gaggugggauccuccaggugca

SEQ ID NO: 1838728 - RNA, 21 nt, Human
gaggugggauccuccaggugc

SEQ ID NO: 1838729 - RNA, 15 nt, Human
gaggggggagguggg

SEQ ID NO: 1838730 - RNA, 15 nt, Human
gaggggguggccucc

SEQ ID NO: 1838731 - RNA, 18 nt, Human
gagguccacaacacacag

SEQ ID NO: 1838732 - RNA, 22 nt, Human
gaggggggaggugggauccucc

SEQ ID NO: 1838733 - RNA, 19 nt, Human
gaguacuacaguccuccca

SEQ ID NO: 1838734 - RNA, 18 nt, Human
gaguacuacaguccuccc

SEQ ID NO: 1838735 - RNA, 12 nt, Human
gaguagcuggau

SEQ ID NO: 1838736 - RNA, 17 nt, Human
gaguacguugugcauuu

SEQ ID NO: 1838737 - RNA, 18 nt, Human
gaguacguugugcauuug

SEQ ID NO: 1838738 - RNA, 15 nt, Human
gaguacuacaguccu

SEQ ID NO: 1838739 - RNA, 20 nt, Human
gaguacguugugcauuuggu

SEQ ID NO: 1838740 - RNA, 14 nt, Human
gagguucccuuuga

SEQ ID NO: 1838741 - RNA, 19 nt, Human
gagguucaaagauauuuug

SEQ ID NO: 1838742 - RNA, 19 nt, Human
gagguuuuaaaaaaauccc

SEQ ID NO: 1838743 - RNA, 16 nt, Human
gaguacguugugcauu

SEQ ID NO: 1838744 - RNA, 21 nt, Human
gagucugaaggcuggguucug

SEQ ID NO: 1838745 - RNA, 18 nt, Human
gagucucuucuccacugg

SEQ ID NO: 1838746 - RNA, 17 nt, Human
gagucucuucuccacug

SEQ ID NO: 1838747 - RNA, 16 nt, Human
gagucucuucuccacu

SEQ ID NO: 1838748 - RNA, 15 nt, Human
gagucucuucuccac

SEQ ID NO: 1838749 - RNA, 14 nt, Human
gagucucuucucca

SEQ ID NO: 1838750 - RNA, 12 nt, Human
gagucucuucuc

SEQ ID NO: 1838751 - RNA, 23 nt, Human
gagucucgcuauugucaccaggg

SEQ ID NO: 1838752 - RNA, 22 nt, Human
gagucucacuguugcccaggcu

SEQ ID NO: 1838753 - RNA, 23 nt, Human
gagucucacuguugcccaggcug

SEQ ID NO: 1838754 - RNA, 19 nt, Human
gagucucacuguugcccag

SEQ ID NO: 1838755 - RNA, 20 nt, Human
gagucucacuguugcccagg

SEQ ID NO: 1838756 - RNA, 21 nt, Human
gagucucacuguugcccaggc

SEQ ID NO: 1838757 - RNA, 17 nt, Human
gagucgaggacagggag

SEQ ID NO: 1838758 - RNA, 12 nt, Human
gaguccccuguu

SEQ ID NO: 1838759 - RNA, 19 nt, Human
gagucccaggcugagccuc

SEQ ID NO: 1838760 - RNA, 18 nt, Human
gagucccaggcugagccu

SEQ ID NO: 1838761 - RNA, 23 nt, Human
gaguccccuguuuguuucugaaa

SEQ ID NO: 1838762 - RNA, 14 nt, Human
gaguccccuguuug

SEQ ID NO: 1838763 - RNA, 12 nt, Human
gaguagcuggga

SEQ ID NO: 1838764 - RNA, 14 nt, Human
gaguagcugggacu

SEQ ID NO: 1838765 - RNA, 20 nt, Human
gauagcacagacccugcccu

SEQ ID NO: 1838766 - RNA, 19 nt, Human
gauagcacagacccugccc

SEQ ID NO: 1838767 - RNA, 12 nt, Human
gauagccaaggc

SEQ ID NO: 1838768 - RNA, 14 nt, Human
gauagccaaggcca

SEQ ID NO: 1838769 - RNA, 13 nt, Human
gauagccaaggcc

SEQ ID NO: 1838770 - RNA, 21 nt, Human
gauauaaguguguguuuuuca

SEQ ID NO: 1838771 - RNA, 17 nt, Human
gauauaaguguguguuu

SEQ ID NO: 1838772 - RNA, 23 nt, Human
gauauaugcucugcauguuacau

SEQ ID NO: 1838773 - RNA, 21 nt, Human
gaucaaccccuucgcuccugu

SEQ ID NO: 1838774 - RNA, 22 nt, Human
gaucaaccccuucgcuccugug

SEQ ID NO: 1838775 - RNA, 13 nt, Human
gauacaaugcugu

SEQ ID NO: 1838776 - RNA, 18 nt, Human
gauacaaugcugugcccu

SEQ ID NO: 1838777 - RNA, 18 nt, Human
gauagcacagacccugcc

SEQ ID NO: 1838778 - RNA, 17 nt, Human
gauagcacagacccugc

SEQ ID NO: 1838779 - RNA, 15 nt, Human
gaguggcuccucccg

SEQ ID NO: 1838780 - RNA, 13 nt, Human
gaguggcuccucc

SEQ ID NO: 1838781 - RNA, 23 nt, Human
gagugggggaucacagccucuga

SEQ ID NO: 1838782 - RNA, 12 nt, Human
gagugggcccaa

SEQ ID NO: 1838783 - RNA, 19 nt, Human
gagugaacaaauuuacaga

SEQ ID NO: 1838784 - RNA, 22 nt, Human
gagugaacaaauuuacagagac

SEQ ID NO: 1838785 - RNA, 23 nt, Human
gagugaacaaauuuacagagaca

SEQ ID NO: 1838786 - RNA, 23 nt, Human
gaguucaucuugaauuguaagga

SEQ ID NO: 1838787 - RNA, 17 nt, Human
gagugugccugaagucc

SEQ ID NO: 1838788 - RNA, 14 nt, Human
gaguugaagacaga

SEQ ID NO: 1838789 - RNA, 21 nt, Human
gaguugaaaaucuuauaauuu

SEQ ID NO: 1838790 - RNA, 19 nt, Human
gauguugaaaaaguucugc

SEQ ID NO: 1838791 - RNA, 21 nt, Human
gauguucuuucacccuuuucu

SEQ ID NO: 1838792 - RNA, 14 nt, Human
gauguuuuccauga

SEQ ID NO: 1838793 - RNA, 23 nt, Human
gauguuuuccaugaguccccugu

SEQ ID NO: 1838794 - RNA, 15 nt, Human
gauguuuuccaugag

SEQ ID NO: 1838795 - RNA, 12 nt, Human
gauuaaauucuu

SEQ ID NO: 1838796 - RNA, 19 nt, Human
gauuaaauucuugcaaagu

SEQ ID NO: 1838797 - RNA, 21 nt, Human
gauuaaccacuucagcugacu

SEQ ID NO: 1838798 - RNA, 19 nt, Human
gauuaaccacuucagcuga

SEQ ID NO: 1838799 - RNA, 18 nt, Human
gauuaaccacuucagcug

SEQ ID NO: 1838800 - RNA, 19 nt, Human
gauucaacagguuuuccug

SEQ ID NO: 1838801 - RNA, 20 nt, Human
gauggugcaaugaccuuuca

SEQ ID NO: 1838802 - RNA, 19 nt, Human
gaugugcuuguuaacugag

SEQ ID NO: 1838803 - RNA, 23 nt, Human
gauggugcaaugaccuuucaaua

SEQ ID NO: 1838804 - RNA, 20 nt, Human
gaugugcuuguuaacugagu

SEQ ID NO: 1838805 - RNA, 16 nt, Human
gauguucugggacaca

SEQ ID NO: 1838806 - RNA, 12 nt, Human
gauucagacagc

SEQ ID NO: 1838807 - RNA, 22 nt, Human
gauucccaagcucugcuccucu

SEQ ID NO: 1838808 - RNA, 23 nt, Human
gauugacgggacuguugguauug

SEQ ID NO: 1838809 - RNA, 15 nt, Human
gauuguccccgaccc

SEQ ID NO: 1838810 - RNA, 20 nt, Human
gauuguccccgacccuugcc

SEQ ID NO: 1838811 - RNA, 13 nt, Human
gauugugccccug

SEQ ID NO: 1838812 - RNA, 11 nt, Human
gauccuccagg

SEQ ID NO: 1838813 - RNA, 18 nt, Human
gauccuaguuccaccauc

SEQ ID NO: 1838814 - RNA, 15 nt, Human
gaucacgccacugca

SEQ ID NO: 1838815 - RNA, 23 nt, Human
gaucaaccccuucgcuccugugu

SEQ ID NO: 1838816 - RNA, 13 nt, Human
gaucacgccacug

SEQ ID NO: 1838817 - RNA, 14 nt, Human
gaucacgccacugc

SEQ ID NO: 1838818 - RNA, 19 nt, Human
gauccugagccagauuuca

SEQ ID NO: 1838819 - RNA, 15 nt, Human
gauccugagccagau

SEQ ID NO: 1838820 - RNA, 14 nt, Human
gauccugagccaga

SEQ ID NO: 1838821 - RNA, 13 nt, Human
gauccugagccag

SEQ ID NO: 1838822 - RNA, 12 nt, Human
gauccuccaggu

SEQ ID NO: 1838823 - RNA, 19 nt, Human
gauccucccaccucagccu

SEQ ID NO: 1838824 - RNA, 20 nt, Human
gauccucccaccucagccuc

SEQ ID NO: 1838825 - RNA, 21 nt, Human
gauccucccaccucagccucc

SEQ ID NO: 1838826 - RNA, 17 nt, Human
gauccuuuuggagucag

SEQ ID NO: 1838827 - RNA, 15 nt, Human
gauccuuuuggaguc

SEQ ID NO: 1838828 - RNA, 15 nt, Human
gaugaaaaaauaaca

SEQ ID NO: 1838829 - RNA, 16 nt, Human
gaucuuugcagacagg

SEQ ID NO: 1838830 - RNA, 14 nt, Human
gaugacuauggaaa

SEQ ID NO: 1838831 - RNA, 11 nt, Human
gaugagaaagg

SEQ ID NO: 1838832 - RNA, 22 nt, Human
gaugagaaagguugaagcacca

SEQ ID NO: 1838833 - RNA, 21 nt, Human
gaugccuggcgggguggggug

SEQ ID NO: 1838834 - RNA, 21 nt, Human
gauggcacuuauaaccaaagc

SEQ ID NO: 1838835 - RNA, 22 nt, Human
gaugggcaacccccagccugcu

SEQ ID NO: 1838836 - RNA, 14 nt, Human
gcagcucagagagg

SEQ ID NO: 1838837 - RNA, 21 nt, Human
gcagcucaccucucccuugga

SEQ ID NO: 1838838 - RNA, 20 nt, Human
gcagcucaccucucccuugg

SEQ ID NO: 1838839 - RNA, 17 nt, Human
gcagcucaccucucccu

SEQ ID NO: 1838840 - RNA, 16 nt, Human
gcagcucaccucuccc

SEQ ID NO: 1838841 - RNA, 19 nt, Human
gcagcucagagaggguggg

SEQ ID NO: 1838842 - RNA, 18 nt, Human
gcagcucagagagggugg

SEQ ID NO: 1838843 - RNA, 19 nt, Human
gcagcagggagggcuucug

SEQ ID NO: 1838844 - RNA, 18 nt, Human
gcagcagggagggcuucu

SEQ ID NO: 1838845 - RNA, 20 nt, Human
gcagcagggagggcuucugc

SEQ ID NO: 1838846 - RNA, 14 nt, Human
gcagcccugcuuug

SEQ ID NO: 1838847 - RNA, 24 nt, Human
gcagcccugcuuugggcugcccug

SEQ ID NO: 1838848 - RNA, 19 nt, Human
gcagccucacaguccuuac

SEQ ID NO: 1838849 - RNA, 17 nt, Human
gcagccucacaguccuu

SEQ ID NO: 1838850 - RNA, 15 nt, Human
gcagccucacagucc

SEQ ID NO: 1838851 - RNA, 23 nt, Human
gcagagguugcagugagccgaga

SEQ ID NO: 1838852 - RNA, 18 nt, Human
gcagagguugcagugagc

SEQ ID NO: 1838853 - RNA, 21 nt, Human
gcagagguccacaacacacag

SEQ ID NO: 1838854 - RNA, 18 nt, Human
gcagauguccuugaugcu

SEQ ID NO: 1838855 - RNA, 18 nt, Human
gcagauggagaccccuug

SEQ ID NO: 1838856 - RNA, 21 nt, Human
gcagagaccaucccugaaggc

SEQ ID NO: 1838857 - RNA, 20 nt, Human
gcagagaccaucccugaagg

SEQ ID NO: 1838858 - RNA, 22 nt, Human
gcagagaccaucccugaaggcc

SEQ ID NO: 1838859 - RNA, 17 nt, Human
gcagacucuacagaggc

SEQ ID NO: 1838860 - RNA, 18 nt, Human
gcagacucuacagaggcc

SEQ ID NO: 1838861 - RNA, 19 nt, Human
gcagacucuacagaggcca

SEQ ID NO: 1838862 - RNA, 22 nt, Human
gcagacucuacagaggccaugg

SEQ ID NO: 1838863 - RNA, 22 nt, Human
gcacuucgggaggucgaggcag

SEQ ID NO: 1838864 - RNA, 14 nt, Human
gcacuugcagacuc

SEQ ID NO: 1838865 - RNA, 16 nt, Human
gcacuugcagacucua

SEQ ID NO: 1838866 - RNA, 15 nt, Human
gcaccaucucuccuc

SEQ ID NO: 1838867 - RNA, 14 nt, Human
gcaccaucucuccu

SEQ ID NO: 1838868 - RNA, 13 nt, Human
gcaccagcagccu

SEQ ID NO: 1838869 - RNA, 14 nt, Human
gcaccagcagccug

SEQ ID NO: 1838870 - RNA, 17 nt, Human
gcaccaucucuccuccu

SEQ ID NO: 1838871 - RNA, 20 nt, Human
gauugugucucuugguccug

SEQ ID NO: 1838872 - RNA, 16 nt, Human
gcacagggcaguggga

SEQ ID NO: 1838873 - RNA, 23 nt, Human
gcacagcuucauuuccugugucu

SEQ ID NO: 1838874 - RNA, 21 nt, Human
gcacagcuucauuuccugugu

SEQ ID NO: 1838875 - RNA, 19 nt, Human
gcacccucaggcagguggg

SEQ ID NO: 1838876 - RNA, 16 nt, Human
gcacccucaggcaggu

SEQ ID NO: 1838877 - RNA, 14 nt, Human
gcacgugugugcac

SEQ ID NO: 1838878 - RNA, 20 nt, Human
gcacuaaggugugcucugau

SEQ ID NO: 1838879 - RNA, 15 nt, Human
gcacugcuuccagug

SEQ ID NO: 1838880 - RNA, 14 nt, Human
gcacugcuuccagu

SEQ ID NO: 1838881 - RNA, 13 nt, Human
gcacugcuuccag

SEQ ID NO: 1838882 - RNA, 12 nt, Human
gcacugcuucca

SEQ ID NO: 1838883 - RNA, 15 nt, Human
gcacuauaauguaag

SEQ ID NO: 1838884 - RNA, 14 nt, Human
gcacuauaauguaa

SEQ ID NO: 1838885 - RNA, 20 nt, Human
gcacuauaauguaagcucua

SEQ ID NO: 1838886 - RNA, 22 nt, Human
gcacuauaauguaagcucuacu

SEQ ID NO: 1838887 - RNA, 12 nt, Human
gcacugggcuug

SEQ ID NO: 1838888 - RNA, 14 nt, Human
gcacugggcuuggg

SEQ ID NO: 1838889 - RNA, 19 nt, Human
gcacuguuuuauuuuaauu

SEQ ID NO: 1838890 - RNA, 17 nt, Human
gcaggcagccaggccac

SEQ ID NO: 1838891 - RNA, 18 nt, Human
gcaggcagccaggccaca

SEQ ID NO: 1838892 - RNA, 15 nt, Human
gcaggucccuaauaa

SEQ ID NO: 1838893 - RNA, 14 nt, Human
gcaggucccuaaua

SEQ ID NO: 1838894 - RNA, 19 nt, Human
gcaggguccuagaaauucc

SEQ ID NO: 1838895 - RNA, 16 nt, Human
gcagggucucacucug

SEQ ID NO: 1838896 - RNA, 22 nt, Human
gcaggggaggguagagcggaga

SEQ ID NO: 1838897 - RNA, 23 nt, Human
gcaggucccuaauaaagcugugu

SEQ ID NO: 1838898 - RNA, 21 nt, Human
gcaggucccuaauaaagcugu

SEQ ID NO: 1838899 - RNA, 20 nt, Human
gcaggucccuaauaaagcug

SEQ ID NO: 1838900 - RNA, 19 nt, Human
gcaggucccuaauaaagcu

SEQ ID NO: 1838901 - RNA, 18 nt, Human
gcaggucccuaauaaagc

SEQ ID NO: 1838902 - RNA, 17 nt, Human
gcaggucccuaauaaag

SEQ ID NO: 1838903 - RNA, 16 nt, Human
gcaggucccuaauaaa

SEQ ID NO: 1838904 - RNA, 21 nt, Human
gcagugggacagggcauggcc

SEQ ID NO: 1838905 - RNA, 11 nt, Human
gcagugggagc

SEQ ID NO: 1838906 - RNA, 12 nt, Human
gcagugggagcu

SEQ ID NO: 1838907 - RNA, 18 nt, Human
gcaguggugcgaucuggg

SEQ ID NO: 1838908 - RNA, 19 nt, Human
gcaguggugcgaucugggu

SEQ ID NO: 1838909 - RNA, 19 nt, Human
gcauacguacacauuuuau

SEQ ID NO: 1838910 - RNA, 20 nt, Human
gcaguggugguuuucuguuc

SEQ ID NO: 1838911 - RNA, 21 nt, Human
gcaguggugguuuucuguucu

SEQ ID NO: 1838912 - RNA, 19 nt, Human
gcaguggugguuuucuguu

SEQ ID NO: 1838913 - RNA, 22 nt, Human
gcaguggugcgaucuggguuca

SEQ ID NO: 1838914 - RNA, 20 nt, Human
gcaguggugcgaucuggguu

SEQ ID NO: 1838915 - RNA, 21 nt, Human
gcaguggugcgaucuggguuc

SEQ ID NO: 1838916 - RNA, 21 nt, Human
gcauuccccaggaggccagcc

SEQ ID NO: 1838917 - RNA, 20 nt, Human
gcauuccccaggaggccagc

SEQ ID NO: 1838918 - RNA, 19 nt, Human
gcauuccccaggaggccag

SEQ ID NO: 1838919 - RNA, 18 nt, Human
gcauuccccaggaggcca

SEQ ID NO: 1838920 - RNA, 17 nt, Human
gcauuccccaggaggcc

SEQ ID NO: 1838921 - RNA, 16 nt, Human
gcauuccccaggaggc

SEQ ID NO: 1838922 - RNA, 15 nt, Human
gcauuccccaggagg

SEQ ID NO: 1838923 - RNA, 14 nt, Human
gcauuccccaggag

SEQ ID NO: 1838924 - RNA, 22 nt, Human
gcauuccccaggaggccagccu

SEQ ID NO: 1838925 - RNA, 18 nt, Human
gcauuugaggucuguucu

SEQ ID NO: 1838926 - RNA, 19 nt, Human
gcauuaucuagauacugua

SEQ ID NO: 1838927 - RNA, 22 nt, Human
gcauuaucuagauacuguauca

SEQ ID NO: 1838928 - RNA, 24 nt, Human
gcauuaucuagauacuguaucaug

SEQ ID NO: 1838929 - RNA, 15 nt, Human
gcaugccuggauggg

SEQ ID NO: 1838930 - RNA, 13 nt, Human
gcauguuacauaa

SEQ ID NO: 1838931 - RNA, 14 nt, Human
gcauguucucugag

SEQ ID NO: 1838932 - RNA, 14 nt, Human
gcaugccuggaugg

SEQ ID NO: 1838933 - RNA, 12 nt, Human
gcaucaggccag

SEQ ID NO: 1838934 - RNA, 18 nt, Human
gcaucaggccaggcccuc

SEQ ID NO: 1838935 - RNA, 23 nt, Human
gcaucaggccaggcccucugccc

SEQ ID NO: 1838936 - RNA, 15 nt, Human
gcaucagugcccucc

SEQ ID NO: 1838937 - RNA, 23 nt, Human
gcaucagugcccuccaggauaga

SEQ ID NO: 1838938 - RNA, 12 nt, Human
gcaucucagccc

SEQ ID NO: 1838939 - RNA, 14 nt, Human
gcaucucagcccac

SEQ ID NO: 1838940 - RNA, 13 nt, Human
gcaucucagccca

SEQ ID NO: 1838941 - RNA, 22 nt, Human
gcaugacacgaauauugcugau

SEQ ID NO: 1838942 - RNA, 21 nt, Human
gcaugacacgaauauugcuga

SEQ ID NO: 1838943 - RNA, 23 nt, Human
gcaugaaguaauaugcacacauu

SEQ ID NO: 1838944 - RNA, 21 nt, Human
gcaugaaguaauaugcacaca

SEQ ID NO: 1838945 - RNA, 22 nt, Human
gcaugaaguaauaugcacacau

SEQ ID NO: 1838946 - RNA, 20 nt, Human
gcaugaaguaauaugcacac

SEQ ID NO: 1838947 - RNA, 15 nt, Human
gcaucucagcccaca

SEQ ID NO: 1838948 - RNA, 19 nt, Human
gcccagagggccugcaagg

SEQ ID NO: 1838949 - RNA, 18 nt, Human
gcccagagggccugcaag

SEQ ID NO: 1838950 - RNA, 15 nt, Human
gcccagagggccugc

SEQ ID NO: 1838951 - RNA, 14 nt, Human
gcccagagggccug

SEQ ID NO: 1838952 - RNA, 12 nt, Human
gcccagagggcc

SEQ ID NO: 1838953 - RNA, 21 nt, Human
gcccaaugcacuuuguucugg

SEQ ID NO: 1838954 - RNA, 15 nt, Human
gcccagagagggugg

SEQ ID NO: 1838955 - RNA, 21 nt, Human
gcccagagggccugcaaggga

SEQ ID NO: 1838956 - RNA, 20 nt, Human
gcccagagggccugcaaggg

SEQ ID NO: 1838957 - RNA, 22 nt, Human
gcccagagggccugcaagggag

SEQ ID NO: 1838958 - RNA, 9 nt, Human
gcccagccc

SEQ ID NO: 1838959 - RNA, 11 nt, Human
gcccagccccu

SEQ ID NO: 1838960 - RNA, 12 nt, Human
gcccagccccuu

SEQ ID NO: 1838961 - RNA, 17 nt, Human
gcccagccccuucugac

SEQ ID NO: 1838962 - RNA, 16 nt, Human
gcccagccccuucuga

SEQ ID NO: 1838963 - RNA, 14 nt, Human
gcccagccccuucu

SEQ ID NO: 1838964 - RNA, 13 nt, Human
gcccagccccuuc

SEQ ID NO: 1838965 - RNA, 24 nt, Human
gcccagccccuucugacccaugcu

SEQ ID NO: 1838966 - RNA, 20 nt, Human
gcccagccccuucugaccca

SEQ ID NO: 1838967 - RNA, 21 nt, Human
gcccagcuugaaaccuucacu

SEQ ID NO: 1838968 - RNA, 21 nt, Human
gcccaggaaaggcuccaggag

SEQ ID NO: 1838969 - RNA, 20 nt, Human
gcccaggaaaggcuccagga

SEQ ID NO: 1838970 - RNA, 19 nt, Human
gcccaggaaaggcuccagg

SEQ ID NO: 1838971 - RNA, 18 nt, Human
gcccaggaaaggcuccag

SEQ ID NO: 1838972 - RNA, 22 nt, Human
gcccaggcuggcgugcaguggu

SEQ ID NO: 1838973 - RNA, 19 nt, Human
gcccaggcuggcgugcagu

SEQ ID NO: 1838974 - RNA, 20 nt, Human
gcccaggcuggcgugcagug

SEQ ID NO: 1838975 - RNA, 21 nt, Human
gcccaggcuuagucacugaga

SEQ ID NO: 1838976 - RNA, 19 nt, Human
gcccaggcuuagucacuga

SEQ ID NO: 1838977 - RNA, 23 nt, Human
gcccaggcuuagucacugagaca

SEQ ID NO: 1838978 - RNA, 19 nt, Human
gcccagucuggaaugcagu

SEQ ID NO: 1838979 - RNA, 20 nt, Human
gcccagucuggaaugcagug

SEQ ID NO: 1838980 - RNA, 15 nt, Human
gcccaguugggugga

SEQ ID NO: 1838981 - RNA, 18 nt, Human
gccagucaccccggccac

SEQ ID NO: 1838982 - RNA, 17 nt, Human
gccagucaccccggcca

SEQ ID NO: 1838983 - RNA, 20 nt, Human
gccagucaccccggccaccu

SEQ ID NO: 1838984 - RNA, 12 nt, Human
gccaguaaaugg

SEQ ID NO: 1838985 - RNA, 17 nt, Human
gccagguuuuuggucug

SEQ ID NO: 1838986 - RNA, 18 nt, Human
gccagguggccacuccag

SEQ ID NO: 1838987 - RNA, 14 nt, Human
gccaggcugcucuu

SEQ ID NO: 1838988 - RNA, 13 nt, Human
gccaggcugcucu

SEQ ID NO: 1838989 - RNA, 13 nt, Human
gccaggcuggguc

SEQ ID NO: 1838990 - RNA, 22 nt, Human
gccaggcugcucuugaacuccu

SEQ ID NO: 1838991 - RNA, 21 nt, Human
gccagauuucacucuccuugg

SEQ ID NO: 1838992 - RNA, 18 nt, Human
gccagauuucacucuccu

SEQ ID NO: 1838993 - RNA, 16 nt, Human
gccagauuucacucuc

SEQ ID NO: 1838994 - RNA, 18 nt, Human
gccagggacagagggggu

SEQ ID NO: 1838995 - RNA, 16 nt, Human
gccagggacagagggg

SEQ ID NO: 1838996 - RNA, 13 nt, Human
gccagggacagag

SEQ ID NO: 1838997 - RNA, 22 nt, Human
gccaggcuggucucgaacuccu

SEQ ID NO: 1838998 - RNA, 23 nt, Human
gccagggacagaggggguggccu

SEQ ID NO: 1838999 - RNA, 20 nt, Human
gccaugaggaacaaggcaag

SEQ ID NO: 1839000 - RNA, 18 nt, Human
gccaugaggaacaaggca

SEQ ID NO: 1839001 - RNA, 18 nt, Human
gccaugccagcuuaucuc

SEQ ID NO: 1839002 - RNA, 13 nt, Human
gccaugccagcuu

SEQ ID NO: 1839003 - RNA, 19 nt, Human
gccaugccagcuuaucuca

SEQ ID NO: 1839004 - RNA, 21 nt, Human
gccaucucaccuccugcuggg

SEQ ID NO: 1839005 - RNA, 20 nt, Human
gccaucucaccuccugcugg

SEQ ID NO: 1839006 - RNA, 19 nt, Human
gccaucucaccuccugcug

SEQ ID NO: 1839007 - RNA, 14 nt, Human
gcccaaccugcucu

SEQ ID NO: 1839008 - RNA, 23 nt, Human
gccaugggacagggaggacgcuc

SEQ ID NO: 1839009 - RNA, 22 nt, Human
gccaugggacagggaggacgcu

SEQ ID NO: 1839010 - RNA, 20 nt, Human
gccaccugcggugcuaucuc

SEQ ID NO: 1839011 - RNA, 14 nt, Human
gccaccugcggugc

SEQ ID NO: 1839012 - RNA, 22 nt, Human
gccaccugcggugcuaucuccc

SEQ ID NO: 1839013 - RNA, 11 nt, Human
gccaccugggu

SEQ ID NO: 1839014 - RNA, 19 nt, Human
gccacggccaggccagagg

SEQ ID NO: 1839015 - RNA, 20 nt, Human
gccacgcccaacuaauuuuu

SEQ ID NO: 1839016 - RNA, 18 nt, Human
gccacggccaggccagag

SEQ ID NO: 1839017 - RNA, 17 nt, Human
gccacggccaggccaga

SEQ ID NO: 1839018 - RNA, 22 nt, Human
gccaccgugccuggccacgccc

SEQ ID NO: 1839019 - RNA, 17 nt, Human
gccaccgugccuggcca

SEQ ID NO: 1839020 - RNA, 17 nt, Human
gccaccgcgcccagccu

SEQ ID NO: 1839021 - RNA, 17 nt, Human
gccaccugccuguuggg

SEQ ID NO: 1839022 - RNA, 17 nt, Human
gccagaggagagaggac

SEQ ID NO: 1839023 - RNA, 15 nt, Human
gccagaggagagagg

SEQ ID NO: 1839024 - RNA, 13 nt, Human
gccagaggagaga

SEQ ID NO: 1839025 - RNA, 12 nt, Human
gccagaggagag

SEQ ID NO: 1839026 - RNA, 22 nt, Human
gccagaggagagaggacccccu

SEQ ID NO: 1839027 - RNA, 19 nt, Human
gccagaggagagaggaccc

SEQ ID NO: 1839028 - RNA, 21 nt, Human
gccagagggagugacagaggc

SEQ ID NO: 1839029 - RNA, 22 nt, Human
gccagagggagugacagaggca

SEQ ID NO: 1839030 - RNA, 23 nt, Human
gccagagggagugacagaggcag

SEQ ID NO: 1839031 - RNA, 16 nt, Human
gccagaugcaccagcc

SEQ ID NO: 1839032 - RNA, 17 nt, Human
gccagaugcaccagccc

SEQ ID NO: 1839033 - RNA, 18 nt, Human
gccagaugcaccagcccu

SEQ ID NO: 1839034 - RNA, 16 nt, Human
gccagagacacaagcc

SEQ ID NO: 1839035 - RNA, 19 nt, Human
gccagagacacaagccuuc

SEQ ID NO: 1839036 - RNA, 17 nt, Human
gccagagacacaagccu

SEQ ID NO: 1839037 - RNA, 10 nt, Human
gccagaggag

SEQ ID NO: 1839038 - RNA, 20 nt, Human
gccagagacacaagccuucg

SEQ ID NO: 1839039 - RNA, 20 nt, Human
gccacuauuguuagucucuu

SEQ ID NO: 1839040 - RNA, 20 nt, Human
gccaauaauaauaccucccu

SEQ ID NO: 1839041 - RNA, 12 nt, Human
gccaaguucuua

SEQ ID NO: 1839042 - RNA, 21 nt, Human
gccaauggagacugucucaag

SEQ ID NO: 1839043 - RNA, 19 nt, Human
gccaauggagacugucuca

SEQ ID NO: 1839044 - RNA, 16 nt, Human
gccaauggagacuguc

SEQ ID NO: 1839045 - RNA, 21 nt, Human
gccaaggcugggggaagaagc

SEQ ID NO: 1839046 - RNA, 12 nt, Human
gcauuugugaaa

SEQ ID NO: 1839047 - RNA, 19 nt, Human
gcauuugaggucuguucuu

SEQ ID NO: 1839048 - RNA, 20 nt, Human
gcauuugaggucuguucuuu

SEQ ID NO: 1839049 - RNA, 22 nt, Human
gcauuuggugguuucagaaaug

SEQ ID NO: 1839050 - RNA, 23 nt, Human
gcauuuggugguuucagaaaugu

SEQ ID NO: 1839051 - RNA, 23 nt, Human
gccaaggugggaggauugcuuga

SEQ ID NO: 1839052 - RNA, 15 nt, Human
gccaaggugggagga

SEQ ID NO: 1839053 - RNA, 14 nt, Human
gccaaggugggagg

SEQ ID NO: 1839054 - RNA, 22 nt, Human
gccacaagacccuugugguccc

SEQ ID NO: 1839055 - RNA, 16 nt, Human
gccacaagacccuugu

SEQ ID NO: 1839056 - RNA, 23 nt, Human
gccacagagaaaguacuucucca

SEQ ID NO: 1839057 - RNA, 22 nt, Human
gccacacuucaggcucuucucc

SEQ ID NO: 1839058 - RNA, 20 nt, Human
gccacacuucaggcucuucu

SEQ ID NO: 1839059 - RNA, 23 nt, Human
gccacacuucaggcucuucuccu

SEQ ID NO: 1839060 - RNA, 13 nt, Human
gccacagagaaag

SEQ ID NO: 1839061 - RNA, 14 nt, Human
gccacagagaaagu

SEQ ID NO: 1839062 - RNA, 20 nt, Human
gccacagagaaaguacuucu

SEQ ID NO: 1839063 - RNA, 16 nt, Human
ggacagaggggguggc

SEQ ID NO: 1839064 - RNA, 14 nt, Human
ggacagaagcagcu

SEQ ID NO: 1839065 - RNA, 17 nt, Human
ggacagaagcagcucuu

SEQ ID NO: 1839066 - RNA, 16 nt, Human
ggacagaagcagcucu

SEQ ID NO: 1839067 - RNA, 15 nt, Human
ggacagaagcagcuc

SEQ ID NO: 1839068 - RNA, 21 nt, Human
gcuuuuaugugaaacauguuu

SEQ ID NO: 1839069 - RNA, 20 nt, Human
gcuuuuaugugaaacauguu

SEQ ID NO: 1839070 - RNA, 19 nt, Human
gcuuuuaugugaaacaugu

SEQ ID NO: 1839071 - RNA, 12 nt, Human
gcuuuucacugc

SEQ ID NO: 1839072 - RNA, 20 nt, Human
ggacagaggggguggccucc

SEQ ID NO: 1839073 - RNA, 16 nt, Human
ggacagccccuccucc

SEQ ID NO: 1839074 - RNA, 15 nt, Human
ggacagccccuccuc

SEQ ID NO: 1839075 - RNA, 11 nt, Human
ggacagcuccu

SEQ ID NO: 1839076 - RNA, 15 nt, Human
ggacagcuccuucug

SEQ ID NO: 1839077 - RNA, 16 nt, Human
ggacagcuccuucugu

SEQ ID NO: 1839078 - RNA, 17 nt, Human
ggacagcuccuucuguc

SEQ ID NO: 1839079 - RNA, 14 nt, Human
ggaccagagcugcc

SEQ ID NO: 1839080 - RNA, 19 nt, Human
ggaccagagcugccaccug

SEQ ID NO: 1839081 - RNA, 18 nt, Human
ggaccuugaacuggguac

SEQ ID NO: 1839082 - RNA, 14 nt, Human
ggacugagaaauuu

SEQ ID NO: 1839083 - RNA, 16 nt, Human
ggacgcucucuggccu

SEQ ID NO: 1839084 - RNA, 19 nt, Human
ggacgcucucuggccuucg

SEQ ID NO: 1839085 - RNA, 18 nt, Human
ggacugagaaauuuauaa

SEQ ID NO: 1839086 - RNA, 15 nt, Human
ggagccuccugcccu

SEQ ID NO: 1839087 - RNA, 20 nt, Human
ggagcccugggaggcucugg

SEQ ID NO: 1839088 - RNA, 14 nt, Human
ggagccuccugccc

SEQ ID NO: 1839089 - RNA, 19 nt, Human
ggagcccugggaggcucug

SEQ ID NO: 1839090 - RNA, 16 nt, Human
ggagcccugggaggcu

SEQ ID NO: 1839091 - RNA, 21 nt, Human
ggaggggccuggcagccgugc

SEQ ID NO: 1839092 - RNA, 18 nt, Human
ggaggggccuggcagccg

SEQ ID NO: 1839093 - RNA, 14 nt, Human
ggaggggccuggca

SEQ ID NO: 1839094 - RNA, 22 nt, Human
ggagucccaccuuggcugcagg

SEQ ID NO: 1839095 - RNA, 13 nt, Human
ggaggggccuggc

SEQ ID NO: 1839096 - RNA, 19 nt, Human
ggaggggagcaugggaagu

SEQ ID NO: 1839097 - RNA, 13 nt, Human
ggagggccugggc

SEQ ID NO: 1839098 - RNA, 16 nt, Human
ggagggagggcuccag

SEQ ID NO: 1839099 - RNA, 13 nt, Human
ggagggagggcuc

SEQ ID NO: 1839100 - RNA, 17 nt, Human
ggagggagggcuccaga

SEQ ID NO: 1839101 - RNA, 17 nt, Human
ggaggcaggaguuucgu

SEQ ID NO: 1839102 - RNA, 16 nt, Human
ggaggacgcucucugg

SEQ ID NO: 1839103 - RNA, 18 nt, Human
ggaggauguucugggaca

SEQ ID NO: 1839104 - RNA, 21 nt, Human
ggaggauguucugggacacag

SEQ ID NO: 1839105 - RNA, 16 nt, Human
ggccaggcccucugcc

SEQ ID NO: 1839106 - RNA, 15 nt, Human
ggccaggcccucugc

SEQ ID NO: 1839107 - RNA, 17 nt, Human
ggccaggcccucugccc

SEQ ID NO: 1839108 - RNA, 14 nt, Human
ggccaggcccucug

SEQ ID NO: 1839109 - RNA, 13 nt, Human
ggccaggagccuc

SEQ ID NO: 1839110 - RNA, 11 nt, Human
ggccaggagcc

SEQ ID NO: 1839111 - RNA, 20 nt, Human
ggccacugugaagagaacca

SEQ ID NO: 1839112 - RNA, 22 nt, Human
ggccacagaaaauucuucucca

SEQ ID NO: 1839113 - RNA, 20 nt, Human
ggcauguucucugaggacac

SEQ ID NO: 1839114 - RNA, 22 nt, Human
ggcaugacacgaauauugcuga

SEQ ID NO: 1839115 - RNA, 23 nt, Human
ggcaugugaugagaggaaaucac

SEQ ID NO: 1839116 - RNA, 18 nt, Human
ggcaugugaugagaggaa

SEQ ID NO: 1839117 - RNA, 15 nt, Human
ggcaugaugcgggcc

SEQ ID NO: 1839118 - RNA, 17 nt, Human
ggcagguuggugggggc

SEQ ID NO: 1839119 - RNA, 17 nt, Human
ggcagggucucacucug

SEQ ID NO: 1839120 - RNA, 18 nt, Human
ggcagggucucacucugu

SEQ ID NO: 1839121 - RNA, 12 nt, Human
ggcaggguccua

SEQ ID NO: 1839122 - RNA, 23 nt, Human
ggcagcugcgguccacccaggag

SEQ ID NO: 1839123 - RNA, 24 nt, Human
ggcagcugcgguccacccaggagc

SEQ ID NO: 1839124 - RNA, 21 nt, Human
ggcagaguugaagacagagcu

SEQ ID NO: 1839125 - RNA, 19 nt, Human
ggcagaguugaagacagag

SEQ ID NO: 1839126 - RNA, 17 nt, Human
ggcagaguugaagacag

SEQ ID NO: 1839127 - RNA, 21 nt, Human
ggcagcugcgguccacccagg

SEQ ID NO: 1839128 - RNA, 12 nt, Human
ggauuauauuau

SEQ ID NO: 1839129 - RNA, 18 nt, Human
ggaugccugguggcagcu

SEQ ID NO: 1839130 - RNA, 19 nt, Human
ggaugccugguggcagcug

SEQ ID NO: 1839131 - RNA, 20 nt, Human
ggaugccugguggcagcugc

SEQ ID NO: 1839132 - RNA, 21 nt, Human
ggaugccugguggcagcugcg

SEQ ID NO: 1839133 - RNA, 18 nt, Human
ggaugcccaaagaugcag

SEQ ID NO: 1839134 - RNA, 18 nt, Human
ggaugaugacuauggaaa

SEQ ID NO: 1839135 - RNA, 19 nt, Human
ggaugcccaaagaugcagc

SEQ ID NO: 1839136 - RNA, 17 nt, Human
ggaugccccgucccccu

SEQ ID NO: 1839137 - RNA, 13 nt, Human
ggaugccuggugg

SEQ ID NO: 1839138 - RNA, 17 nt, Human
ggaugccugguggcagc

SEQ ID NO: 1839139 - RNA, 22 nt, Human
ggaugaucuaggaagacuuugg

SEQ ID NO: 1839140 - RNA, 18 nt, Human
ggaugaucuaggaagacu

SEQ ID NO: 1839141 - RNA, 16 nt, Human
ggaugaucuaggaaga

SEQ ID NO: 1839142 - RNA, 23 nt, Human
ggagucccaccuuggcugcaggg

SEQ ID NO: 1839143 - RNA, 20 nt, Human
ggcacccaccaucaugucug

SEQ ID NO: 1839144 - RNA, 18 nt, Human
ggcacccggccccugcug

SEQ ID NO: 1839145 - RNA, 19 nt, Human
ggcacccggccccugcugg

SEQ ID NO: 1839146 - RNA, 20 nt, Human
ggcacccggccccugcuggu

SEQ ID NO: 1839147 - RNA, 18 nt, Human
ggcacucagaagacacug

SEQ ID NO: 1839148 - RNA, 19 nt, Human
ggcacucagaagacacuga

SEQ ID NO: 1839149 - RNA, 20 nt, Human
ggcacucagaagacacugau

SEQ ID NO: 1839150 - RNA, 22 nt, Human
ggcagagcagagaccaucccug

SEQ ID NO: 1839151 - RNA, 21 nt, Human
ggcagagguugcagugagccg

SEQ ID NO: 1839152 - RNA, 17 nt, Human
ggcaccagcagccugga

SEQ ID NO: 1839153 - RNA, 18 nt, Human
ggcaagcaccuccugccu

SEQ ID NO: 1839154 - RNA, 19 nt, Human
ggcaagcaccuccugccuc

SEQ ID NO: 1839155 - RNA, 21 nt, Human
ggauucuuccucccucccucu

SEQ ID NO: 1839156 - RNA, 17 nt, Human
ggcaagcaccuccugcc

SEQ ID NO: 1839157 - RNA, 15 nt, Human
ggccgggagccugau

SEQ ID NO: 1839158 - RNA, 23 nt, Human
ggccgggaccccgagccuggcuc

SEQ ID NO: 1839159 - RNA, 22 nt, Human
ggccgggaccccgagccuggcu

SEQ ID NO: 1839160 - RNA, 14 nt, Human
ggcccagagggccu

SEQ ID NO: 1839161 - RNA, 19 nt, Human
ggcccagagggccugcaag

SEQ ID NO: 1839162 - RNA, 17 nt, Human
ggcccagagggccugca

SEQ ID NO: 1839163 - RNA, 20 nt, Human
ggcccagagggccugcaagg

SEQ ID NO: 1839164 - RNA, 20 nt, Human
ggccuagcauacguacacau

SEQ ID NO: 1839165 - RNA, 22 nt, Human
ggccuagcauacguacacauuu

SEQ ID NO: 1839166 - RNA, 14 nt, Human
ggccucaagugauu

SEQ ID NO: 1839167 - RNA, 22 nt, Human
ggccucaagugauucuccugcc

SEQ ID NO: 1839168 - RNA, 14 nt, Human
ggccuccugugugu

SEQ ID NO: 1839169 - RNA, 14 nt, Human
ggccuggccugagc

SEQ ID NO: 1839170 - RNA, 13 nt, Human
ggccuggccugag

SEQ ID NO: 1839171 - RNA, 10 nt, Human
ggccuggccu

SEQ ID NO: 1839172 - RNA, 23 nt, Human
ggccuggccccucagggucccug

SEQ ID NO: 1839173 - RNA, 18 nt, Human
ggccuggccccucagggu

SEQ ID NO: 1839174 - RNA, 17 nt, Human
ggccuggccccucaggg

SEQ ID NO: 1839175 - RNA, 15 nt, Human
ggccuggccccucag

SEQ ID NO: 1839176 - RNA, 14 nt, Human
ggccuggccccuca

SEQ ID NO: 1839177 - RNA, 19 nt, Human
ggccucugcacuccccugc

SEQ ID NO: 1839178 - RNA, 18 nt, Human
ggccucugcacuccccug

SEQ ID NO: 1839179 - RNA, 22 nt, Human
ggccucugcacuccccugcugg

SEQ ID NO: 1839180 - RNA, 13 nt, Human
ggccuggccccuc

SEQ ID NO: 1839181 - RNA, 24 nt, Human
ggcgcagcauauucaggaagcuca

SEQ ID NO: 1839182 - RNA, 23 nt, Human
ggcgcagcauauucaggaagcuc

SEQ ID NO: 1839183 - RNA, 16 nt, Human
ggccuggccugagcug

SEQ ID NO: 1839184 - RNA, 15 nt, Human
ggccuggccugagcu

SEQ ID NO: 1839185 - RNA, 23 nt, Human
ggccugggggcugggcagaggaa

SEQ ID NO: 1839186 - RNA, 11 nt, Human
ggccugggccc

SEQ ID NO: 1839187 - RNA, 12 nt, Human
ggcucugcccuu

SEQ ID NO: 1839188 - RNA, 15 nt, Human
ggcucugccucccau

SEQ ID NO: 1839189 - RNA, 13 nt, Human
ggcucugccuccc

SEQ ID NO: 1839190 - RNA, 15 nt, Human
ggcucugcccuuggu

SEQ ID NO: 1839191 - RNA, 14 nt, Human
ggcucugcccuugg

SEQ ID NO: 1839192 - RNA, 16 nt, Human
ggcucugccucccauc

SEQ ID NO: 1839193 - RNA, 16 nt, Human
ggcucuggagcccacu

SEQ ID NO: 1839194 - RNA, 19 nt, Human
ggcucuggagcccacugua

SEQ ID NO: 1839195 - RNA, 17 nt, Human
ggcucuggagcccacug

SEQ ID NO: 1839196 - RNA, 20 nt, Human
ggcucucaggccagcugcuu

SEQ ID NO: 1839197 - RNA, 19 nt, Human
ggcucucaggccagcugcu

SEQ ID NO: 1839198 - RNA, 18 nt, Human
ggcucucaggccagcugc

SEQ ID NO: 1839199 - RNA, 17 nt, Human
ggcucucaggccagcug

SEQ ID NO: 1839200 - RNA, 16 nt, Human
ggcucucaggccagcu

SEQ ID NO: 1839201 - RNA, 15 nt, Human
ggcucucaggccagc

SEQ ID NO: 1839202 - RNA, 15 nt, Human
ggcuccaggcuccuu

SEQ ID NO: 1839203 - RNA, 14 nt, Human
ggcuccaggcuccu

SEQ ID NO: 1839204 - RNA, 20 nt, Human
ggcuaguaucaaaagaaaga

SEQ ID NO: 1839205 - RNA, 15 nt, Human
ggcgcgguggcucac

SEQ ID NO: 1839206 - RNA, 11 nt, Human
ggcgcugcccc

SEQ ID NO: 1839207 - RNA, 17 nt, Human
ggcgcugccccuggcag

SEQ ID NO: 1839208 - RNA, 16 nt, Human
ggcuccaggagcagcc

SEQ ID NO: 1839209 - RNA, 14 nt, Human
ggcuccaggagcag

SEQ ID NO: 1839210 - RNA, 10 nt, Human
ggcuccagac

SEQ ID NO: 1839211 - RNA, 17 nt, Human
ggcuccaggagcagcca

SEQ ID NO: 1839212 - RNA, 18 nt, Human
ggcuccaggagcagccac

SEQ ID NO: 1839213 - RNA, 12 nt, Human
ggcuccaggcuc

SEQ ID NO: 1839214 - RNA, 13 nt, Human
ggcuccaggcucc

SEQ ID NO: 1839215 - RNA, 12 nt, Human
ggcuaugcauuu

SEQ ID NO: 1839216 - RNA, 13 nt, Human
ggcuaugcauuug

SEQ ID NO: 1839217 - RNA, 14 nt, Human
ggcuaugcauuuga

SEQ ID NO: 1839218 - RNA, 16 nt, Human
ggcuccacuuggucug

SEQ ID NO: 1839219 - RNA, 9 nt, Human
ggcuccaga

SEQ ID NO: 1839220 - RNA, 15 nt, Human
ggcugggagcucugc

SEQ ID NO: 1839221 - RNA, 21 nt, Human
ggcugggcucccuucccaccu

SEQ ID NO: 1839222 - RNA, 20 nt, Human
ggcugggcucccuucccacc

SEQ ID NO: 1839223 - RNA, 11 nt, Human
ggcugggcuuc

SEQ ID NO: 1839224 - RNA, 21 nt, Human
ggcugggcuucaguggcagcu

SEQ ID NO: 1839225 - RNA, 22 nt, Human
ggcugggcuucaguggcagcug

SEQ ID NO: 1839226 - RNA, 16 nt, Human
ggcugggggaagaagc

SEQ ID NO: 1839227 - RNA, 14 nt, Human
ggcugggggccuca

SEQ ID NO: 1839228 - RNA, 19 nt, Human
ggcugcuucaaggauccug

SEQ ID NO: 1839229 - RNA, 15 nt, Human
ggcugcuucaaggau

SEQ ID NO: 1839230 - RNA, 23 nt, Human
ggcucuggagcccacuguacuug

SEQ ID NO: 1839231 - RNA, 20 nt, Human
ggcugcuucaaggauccuga

SEQ ID NO: 1839232 - RNA, 21 nt, Human
ggcugcuucaaggauccugag

SEQ ID NO: 1839233 - RNA, 12 nt, Human
ggcuucacagau

SEQ ID NO: 1839234 - RNA, 21 nt, Human
ggcuucacggaagagccuugc

SEQ ID NO: 1839235 - RNA, 20 nt, Human
ggcuucacggaagagccuug

SEQ ID NO: 1839236 - RNA, 15 nt, Human
ggcuuagucacugag

SEQ ID NO: 1839237 - RNA, 14 nt, Human
ggcuuagucacuga

SEQ ID NO: 1839238 - RNA, 19 nt, Human
ggcuuggggaccagagcug

SEQ ID NO: 1839239 - RNA, 18 nt, Human
ggcuuggggaccagagcu

SEQ ID NO: 1839240 - RNA, 17 nt, Human
ggcuuggggaccagagc

SEQ ID NO: 1839241 - RNA, 11 nt, Human
ggcuugcugcc

SEQ ID NO: 1839242 - RNA, 16 nt, Human
ggcugugccucugccu

SEQ ID NO: 1839243 - RNA, 13 nt, Human
ggcugugccucug

SEQ ID NO: 1839244 - RNA, 14 nt, Human
ggcuguuggcuggg

SEQ ID NO: 1839245 - RNA, 15 nt, Human
ggcuguuggcugggg

SEQ ID NO: 1839246 - RNA, 16 nt, Human
ggcuguuggcuggggg

SEQ ID NO: 1839247 - RNA, 20 nt, Human
ggcuguuggcugggggccuc

SEQ ID NO: 1839248 - RNA, 15 nt, Human
ggcuuaaaacaacac

SEQ ID NO: 1839249 - RNA, 21 nt, Human
gggagccugaucaccugcccu

SEQ ID NO: 1839250 - RNA, 12 nt, Human
gggagcucugca

SEQ ID NO: 1839251 - RNA, 13 nt, Human
gggagcugccugu

SEQ ID NO: 1839252 - RNA, 21 nt, Human
gggagcugccuguucagcucc

SEQ ID NO: 1839253 - RNA, 22 nt, Human
gggagcugccuguucagcucca

SEQ ID NO: 1839254 - RNA, 20 nt, Human
gggaggugggauccuccagg

SEQ ID NO: 1839255 - RNA, 23 nt, Human
gggaggauugcuugagcucagga

SEQ ID NO: 1839256 - RNA, 21 nt, Human
gggagugaguugauagcacag

SEQ ID NO: 1839257 - RNA, 17 nt, Human
gggagugacagaggcag

SEQ ID NO: 1839258 - RNA, 17 nt, Human
gggaggacgcucucugg

SEQ ID NO: 1839259 - RNA, 20 nt, Human
gggaggacgcucucuggccu

SEQ ID NO: 1839260 - RNA, 23 nt, Human
gggaggaucucuugagccuggga

SEQ ID NO: 1839261 - RNA, 21 nt, Human
gggaggauugcuugagcucag

SEQ ID NO: 1839262 - RNA, 22 nt, Human
gggaggauguucugggacacag

SEQ ID NO: 1839263 - RNA, 16 nt, Human
gggaccccgagccugg

SEQ ID NO: 1839264 - RNA, 17 nt, Human
gggacucaaugcacuga

SEQ ID NO: 1839265 - RNA, 19 nt, Human
gggacucaaugcacugaca

SEQ ID NO: 1839266 - RNA, 23 nt, Human
gggacugccagucccccugcccc

SEQ ID NO: 1839267 - RNA, 21 nt, Human
gggacugaggggaggggagca

SEQ ID NO: 1839268 - RNA, 15 nt, Human
gggacugagaaauuu

SEQ ID NO: 1839269 - RNA, 23 nt, Human
gggacucaaugcacugacauugu

SEQ ID NO: 1839270 - RNA, 14 nt, Human
gggacacccuguga

SEQ ID NO: 1839271 - RNA, 19 nt, Human
gggaauguuugccucugcc

SEQ ID NO: 1839272 - RNA, 21 nt, Human
gggaauguuugccucugccuc

SEQ ID NO: 1839273 - RNA, 13 nt, Human
ggcuuuucacugc

SEQ ID NO: 1839274 - RNA, 15 nt, Human
gcuggccuggccccu

SEQ ID NO: 1839275 - RNA, 14 nt, Human
gcuggccuggcccc

SEQ ID NO: 1839276 - RNA, 12 nt, Human
gcuggccuggcc

SEQ ID NO: 1839277 - RNA, 13 nt, Human
gcuggccuggccc

SEQ ID NO: 1839278 - RNA, 21 nt, Human
gcugggcucccuucccaccuc

SEQ ID NO: 1839279 - RNA, 19 nt, Human
gcugggaugauuggagggg

SEQ ID NO: 1839280 - RNA, 21 nt, Human
gcugggcuucaguggcagcug

SEQ ID NO: 1839281 - RNA, 22 nt, Human
gcugggcuucaguggcagcugc

SEQ ID NO: 1839282 - RNA, 20 nt, Human
gcugggcuucaguggcagcu

SEQ ID NO: 1839283 - RNA, 14 nt, Human
gcugggggccucag

SEQ ID NO: 1839284 - RNA, 15 nt, Human
gcugggggccucagu

SEQ ID NO: 1839285 - RNA, 18 nt, Human
gcugggggccucagugcc

SEQ ID NO: 1839286 - RNA, 23 nt, Human
gcuggucucgaacuccugaccuu

SEQ ID NO: 1839287 - RNA, 22 nt, Human
gcuggucucgaacuccugaccu

SEQ ID NO: 1839288 - RNA, 19 nt, Human
gcuggucucgaacuccuga

SEQ ID NO: 1839289 - RNA, 20 nt, Human
gcuggucucaaacuccugac

SEQ ID NO: 1839290 - RNA, 19 nt, Human
gcuggucucaaacuccuga

SEQ ID NO: 1839291 - RNA, 14 nt, Human
gcuggucccacuca

SEQ ID NO: 1839292 - RNA, 15 nt, Human
gcugugucucccuuc

SEQ ID NO: 1839293 - RNA, 16 nt, Human
gcuguguggcagucug

SEQ ID NO: 1839294 - RNA, 16 nt, Human
gcugucccuuuuccuu

SEQ ID NO: 1839295 - RNA, 23 nt, Human
gcugucccuuacgugaguccugg

SEQ ID NO: 1839296 - RNA, 17 nt, Human
gcugucagccauuccug

SEQ ID NO: 1839297 - RNA, 13 nt, Human
gcugucaucucag

SEQ ID NO: 1839298 - RNA, 14 nt, Human
gcuggugucaccug

SEQ ID NO: 1839299 - RNA, 15 nt, Human
gcuggugucaccuga

SEQ ID NO: 1839300 - RNA, 14 nt, Human
gcuuguuggauuuu

SEQ ID NO: 1839301 - RNA, 15 nt, Human
gcuuuuaugugaaac

SEQ ID NO: 1839302 - RNA, 13 nt, Human
gcuuuuaugugaa

SEQ ID NO: 1839303 - RNA, 19 nt, Human
gcuuugggcugcccuggug

SEQ ID NO: 1839304 - RNA, 18 nt, Human
gcuuugggcugcccuggu

SEQ ID NO: 1839305 - RNA, 19 nt, Human
gcuucuguugcugccucau

SEQ ID NO: 1839306 - RNA, 18 nt, Human
gcuucuguugcugccuca

SEQ ID NO: 1839307 - RNA, 17 nt, Human
gcuucuguugcugccuc

SEQ ID NO: 1839308 - RNA, 18 nt, Human
gcuucauuuccugugucu

SEQ ID NO: 1839309 - RNA, 22 nt, Human
gcuucucacugccaugccagcu

SEQ ID NO: 1839310 - RNA, 19 nt, Human
gcuucaguggcagcugcuu

SEQ ID NO: 1839311 - RNA, 13 nt, Human
gcuuaucucaggg

SEQ ID NO: 1839312 - RNA, 20 nt, Human
gcuucaguggcagcugcuuu

SEQ ID NO: 1839313 - RNA, 21 nt, Human
gcucucaggccagcugcuugg

SEQ ID NO: 1839314 - RNA, 21 nt, Human
gcucuugaacuccugaccuca

SEQ ID NO: 1839315 - RNA, 19 nt, Human
gcucuugaacuccugaccu

SEQ ID NO: 1839316 - RNA, 16 nt, Human
gcucuugaacuccuga

SEQ ID NO: 1839317 - RNA, 14 nt, Human
gcucuugaacuccu

SEQ ID NO: 1839318 - RNA, 19 nt, Human
gcucuugaugccuggcggg

SEQ ID NO: 1839319 - RNA, 19 nt, Human
gcucuuggcagguacucag

SEQ ID NO: 1839320 - RNA, 22 nt, Human
gcugacuguuuucucuugagag

SEQ ID NO: 1839321 - RNA, 20 nt, Human
gcugacagacacaggcccgg

SEQ ID NO: 1839322 - RNA, 17 nt, Human
gcugacagacacaggcc

SEQ ID NO: 1839323 - RNA, 18 nt, Human
gcugacagacacaggccc

SEQ ID NO: 1839324 - RNA, 19 nt, Human
gcugacagacacaggcccg

SEQ ID NO: 1839325 - RNA, 13 nt, Human
gcugccaccugcc

SEQ ID NO: 1839326 - RNA, 12 nt, Human
gcugccaccugc

SEQ ID NO: 1839327 - RNA, 23 nt, Human
gcugccacacuucaggcucuucu

SEQ ID NO: 1839328 - RNA, 22 nt, Human
gcugccacacuucaggcucuuc

SEQ ID NO: 1839329 - RNA, 21 nt, Human
gcugccacacuucaggcucuu

SEQ ID NO: 1839330 - RNA, 18 nt, Human
gcugccacacuucaggcu

SEQ ID NO: 1839331 - RNA, 17 nt, Human
gcugccacacuucaggc

SEQ ID NO: 1839332 - RNA, 15 nt, Human
gcugccacacuucag

SEQ ID NO: 1839333 - RNA, 20 nt, Human
gcugccaaugggagcucaug

SEQ ID NO: 1839334 - RNA, 14 nt, Human
gcugcaguugccag

SEQ ID NO: 1839335 - RNA, 13 nt, Human
gcugcaguugcca

SEQ ID NO: 1839336 - RNA, 17 nt, Human
gcugcaguugccaguca

SEQ ID NO: 1839337 - RNA, 18 nt, Human
gcugcauuuaaaagauac

SEQ ID NO: 1839338 - RNA, 19 nt, Human
gcugcauuuaaaagauaca

SEQ ID NO: 1839339 - RNA, 21 nt, Human
gcugauuaaaccaaggcuaga

SEQ ID NO: 1839340 - RNA, 22 nt, Human
gcugcaaaggguaucaggugcu

SEQ ID NO: 1839341 - RNA, 23 nt, Human
gcugcaaaggguaucaggugcug

SEQ ID NO: 1839342 - RNA, 12 nt, Human
gcugcccugccc

SEQ ID NO: 1839343 - RNA, 14 nt, Human
gcugcccugcccac

SEQ ID NO: 1839344 - RNA, 13 nt, Human
gcugcccugccca

SEQ ID NO: 1839345 - RNA, 24 nt, Human
gcugcccugcccaccuggccucug

SEQ ID NO: 1839346 - RNA, 23 nt, Human
gcugcccugcccaccuggccucu

SEQ ID NO: 1839347 - RNA, 22 nt, Human
gcugcccugcccaccuggccuc

SEQ ID NO: 1839348 - RNA, 21 nt, Human
gcugcccugcccaccuggccu

SEQ ID NO: 1839349 - RNA, 20 nt, Human
gcugcccugcccaccuggcc

SEQ ID NO: 1839350 - RNA, 18 nt, Human
gcugcccugcccaccugg

SEQ ID NO: 1839351 - RNA, 16 nt, Human
gcugcccugcccaccu

SEQ ID NO: 1839352 - RNA, 15 nt, Human
gcugccuuagaaccu

SEQ ID NO: 1839353 - RNA, 17 nt, Human
gcugcccuggugcugcc

SEQ ID NO: 1839354 - RNA, 20 nt, Human
gcugccuuagaaccuuucuu

SEQ ID NO: 1839355 - RNA, 20 nt, Human
gcugccuguucagcuccagc

SEQ ID NO: 1839356 - RNA, 22 nt, Human
gcugccuguucagcuccagcuc

SEQ ID NO: 1839357 - RNA, 15 nt, Human
gcugcccuggugcug

SEQ ID NO: 1839358 - RNA, 14 nt, Human
gcugcccuggugcu

SEQ ID NO: 1839359 - RNA, 13 nt, Human
gcugcccuggugc

SEQ ID NO: 1839360 - RNA, 12 nt, Human
gcugcccuggug

SEQ ID NO: 1839361 - RNA, 18 nt, Human
gcugccuguucagcucca

SEQ ID NO: 1839362 - RNA, 19 nt, Human
gcugccuguucagcuccag

SEQ ID NO: 1839363 - RNA, 14 nt, Human
gcugcgguccaccc

SEQ ID NO: 1839364 - RNA, 15 nt, Human
gcugcgguccaccca

SEQ ID NO: 1839365 - RNA, 22 nt, Human
gcugcgguccacccaggagccc

SEQ ID NO: 1839366 - RNA, 16 nt, Human
gcugcgguccacccag

SEQ ID NO: 1839367 - RNA, 21 nt, Human
gcugcgguccacccaggagcc

SEQ ID NO: 1839368 - RNA, 22 nt, Human
gcugcuuuugucuaugggacuc

SEQ ID NO: 1839369 - RNA, 23 nt, Human
gcuggaaugauuucagcucacug

SEQ ID NO: 1839370 - RNA, 19 nt, Human
gcuggcccuggcucccaca

SEQ ID NO: 1839371 - RNA, 16 nt, Human
gcuggcccugcccugg

SEQ ID NO: 1839372 - RNA, 15 nt, Human
gcuggcccugcccug

SEQ ID NO: 1839373 - RNA, 14 nt, Human
gcuggcccugcccu

SEQ ID NO: 1839374 - RNA, 16 nt, Human
gcuggaccuugaacug

SEQ ID NO: 1839375 - RNA, 15 nt, Human
gcuggaccuugaacu

SEQ ID NO: 1839376 - RNA, 21 nt, Human
gcgccuuaaggauguucuagc

SEQ ID NO: 1839377 - RNA, 13 nt, Human
gcgccccuucccc

SEQ ID NO: 1839378 - RNA, 23 nt, Human
gcgcccaguuggguggaugccug

SEQ ID NO: 1839379 - RNA, 21 nt, Human
gcgcugccccuggcagccccu

SEQ ID NO: 1839380 - RNA, 18 nt, Human
gcgcugccccuggcagcc

SEQ ID NO: 1839381 - RNA, 16 nt, Human
gcggagaaaggaaggg

SEQ ID NO: 1839382 - RNA, 19 nt, Human
gcggagacggagucccacc

SEQ ID NO: 1839383 - RNA, 14 nt, Human
gcggggacagcucc

SEQ ID NO: 1839384 - RNA, 18 nt, Human
gcggggacagcuccuucu

SEQ ID NO: 1839385 - RNA, 15 nt, Human
gcggggacagcuccu

SEQ ID NO: 1839386 - RNA, 17 nt, Human
gcggggacagcuccuuc

SEQ ID NO: 1839387 - RNA, 19 nt, Human
gcggugagaggggaacaga

SEQ ID NO: 1839388 - RNA, 13 nt, Human
gcgguccacccag

SEQ ID NO: 1839389 - RNA, 14 nt, Human
gcgguccacccagg

SEQ ID NO: 1839390 - RNA, 15 nt, Human
gccuuacacaauggu

SEQ ID NO: 1839391 - RNA, 16 nt, Human
gccuuacacaaugguu

SEQ ID NO: 1839392 - RNA, 21 nt, Human
gcgacaaugcaaaccaucauu

SEQ ID NO: 1839393 - RNA, 20 nt, Human
gcgacaaugcaaaccaucau

SEQ ID NO: 1839394 - RNA, 13 nt, Human
gcgacaaugcaaa

SEQ ID NO: 1839395 - RNA, 12 nt, Human
gcgacaaugcaa

SEQ ID NO: 1839396 - RNA, 22 nt, Human
gcgcaggcuggcccugcccugg

SEQ ID NO: 1839397 - RNA, 21 nt, Human
gcgcaggcuggcccugcccug

SEQ ID NO: 1839398 - RNA, 20 nt, Human
gcgcaggcuggcccugcccu

SEQ ID NO: 1839399 - RNA, 17 nt, Human
gcgcaggcuggcccugc

SEQ ID NO: 1839400 - RNA, 19 nt, Human
gcgcaggcuggcccugccc

SEQ ID NO: 1839401 - RNA, 18 nt, Human
gcgcaggcuggcccugcc

SEQ ID NO: 1839402 - RNA, 14 nt, Human
gccuggccccucag

SEQ ID NO: 1839403 - RNA, 13 nt, Human
gccuggccccuca

SEQ ID NO: 1839404 - RNA, 21 nt, Human
gccuggcagccgugccuucag

SEQ ID NO: 1839405 - RNA, 20 nt, Human
gccuggcagccgugccuuca

SEQ ID NO: 1839406 - RNA, 12 nt, Human
gccuggcagccg

SEQ ID NO: 1839407 - RNA, 19 nt, Human
gccuggcacagggcagugg

SEQ ID NO: 1839408 - RNA, 18 nt, Human
gccuggcacagggcagug

SEQ ID NO: 1839409 - RNA, 22 nt, Human
gccuggcagccgugccuucagc

SEQ ID NO: 1839410 - RNA, 20 nt, Human
gccuggccagaugcaccagc

SEQ ID NO: 1839411 - RNA, 21 nt, Human
gccuggccagaugcaccagcc

SEQ ID NO: 1839412 - RNA, 22 nt, Human
gccuggccagaugcaccagccc

SEQ ID NO: 1839413 - RNA, 15 nt, Human
gccuguaauccuagc

SEQ ID NO: 1839414 - RNA, 20 nt, Human
gccuguaauccuagcacuuu

SEQ ID NO: 1839415 - RNA, 20 nt, Human
gccuggauggggcugcaccg

SEQ ID NO: 1839416 - RNA, 14 nt, Human
gccuggcacagggc

SEQ ID NO: 1839417 - RNA, 13 nt, Human
gccuggcacaggg

SEQ ID NO: 1839418 - RNA, 18 nt, Human
gccuggauggggcugcac

SEQ ID NO: 1839419 - RNA, 16 nt, Human
gccuggauggggcugc

SEQ ID NO: 1839420 - RNA, 12 nt, Human
gccugagcuggg

SEQ ID NO: 1839421 - RNA, 19 nt, Human
gcccaguuggguggaugcc

SEQ ID NO: 1839422 - RNA, 21 nt, Human
gcccaguuggguggaugccug

SEQ ID NO: 1839423 - RNA, 22 nt, Human
gcccaguuggguggaugccugg

SEQ ID NO: 1839424 - RNA, 16 nt, Human
gccugaagucacacag

SEQ ID NO: 1839425 - RNA, 17 nt, Human
gccugagcgacagugag

SEQ ID NO: 1839426 - RNA, 20 nt, Human
gccugagcgacagugagacu

SEQ ID NO: 1839427 - RNA, 17 nt, Human
gccugaagucacacagu

SEQ ID NO: 1839428 - RNA, 18 nt, Human
gccugaagucacacagug

SEQ ID NO: 1839429 - RNA, 14 nt, Human
gcuccucccggugc

SEQ ID NO: 1839430 - RNA, 23 nt, Human
gcuccuggggguucuuucuuccu

SEQ ID NO: 1839431 - RNA, 24 nt, Human
gcuccgcuuucuacccagcgagcc

SEQ ID NO: 1839432 - RNA, 18 nt, Human
gcuccuuccucugaggcu

SEQ ID NO: 1839433 - RNA, 22 nt, Human
gcuccuuccucugaggcugaaa

SEQ ID NO: 1839434 - RNA, 20 nt, Human
gcuccuuccucugaggcuga

SEQ ID NO: 1839435 - RNA, 12 nt, Human
gcuccugugucu

SEQ ID NO: 1839436 - RNA, 13 nt, Human
gcuccugugucuu

SEQ ID NO: 1839437 - RNA, 13 nt, Human
gcuccuucugucc

SEQ ID NO: 1839438 - RNA, 17 nt, Human
gcuccuuuagcgcccag

SEQ ID NO: 1839439 - RNA, 19 nt, Human
gcucgagcaugccuggaug

SEQ ID NO: 1839440 - RNA, 21 nt, Human
gcucgagcaugccuggauggg

SEQ ID NO: 1839441 - RNA, 21 nt, Human
gcuccagcuguucagcugguu

SEQ ID NO: 1839442 - RNA, 13 nt, Human
gcuccaaacccuc

SEQ ID NO: 1839443 - RNA, 14 nt, Human
gcuccaggagcagc

SEQ ID NO: 1839444 - RNA, 12 nt, Human
gcuccaggagca

SEQ ID NO: 1839445 - RNA, 11 nt, Human
gcuccaggagc

SEQ ID NO: 1839446 - RNA, 18 nt, Human
gcuccaggagcagccaca

SEQ ID NO: 1839447 - RNA, 17 nt, Human
gcuccaggagcagccac

SEQ ID NO: 1839448 - RNA, 16 nt, Human
gcuccaggagcagcca

SEQ ID NO: 1839449 - RNA, 15 nt, Human
gcuccaggagcagcc

SEQ ID NO: 1839450 - RNA, 12 nt, Human
gcuccaggcucc

SEQ ID NO: 1839451 - RNA, 15 nt, Human
gcucccacaggcccu

SEQ ID NO: 1839452 - RNA, 20 nt, Human
gcucccuucccaccucucuc

SEQ ID NO: 1839453 - RNA, 18 nt, Human
gcuccgcuuucuacccag

SEQ ID NO: 1839454 - RNA, 21 nt, Human
gcuccgcuuucuacccagcga

SEQ ID NO: 1839455 - RNA, 22 nt, Human
gcuccgcuuucuacccagcgag

SEQ ID NO: 1839456 - RNA, 23 nt, Human
gcuccgcuuucuacccagcgagc

SEQ ID NO: 1839457 - RNA, 13 nt, Human
gcuaucuccccca

SEQ ID NO: 1839458 - RNA, 17 nt, Human
gcuaucguaaaauuaag

SEQ ID NO: 1839459 - RNA, 16 nt, Human
gcuaucguaaaauuaa

SEQ ID NO: 1839460 - RNA, 15 nt, Human
gcuaucguaaaauua

SEQ ID NO: 1839461 - RNA, 15 nt, Human
gcuaucucccccagc

SEQ ID NO: 1839462 - RNA, 14 nt, Human
gcuaucucccccag

SEQ ID NO: 1839463 - RNA, 18 nt, Human
gcucaaguccucuuuucu

SEQ ID NO: 1839464 - RNA, 19 nt, Human
gcucaaguccucuuuucug

SEQ ID NO: 1839465 - RNA, 22 nt, Human
gcucaaguccucuuuucugaga

SEQ ID NO: 1839466 - RNA, 20 nt, Human
gcuauaacuauguugauaaa

SEQ ID NO: 1839467 - RNA, 22 nt, Human
gcggugcuaucucccccagccc

SEQ ID NO: 1839468 - RNA, 19 nt, Human
gcggugcuaucucccccag

SEQ ID NO: 1839469 - RNA, 21 nt, Human
gcuaguugggcuuccucauag

SEQ ID NO: 1839470 - RNA, 18 nt, Human
gcucaccucucccuugga

SEQ ID NO: 1839471 - RNA, 17 nt, Human
gcucaccucucccuugg

SEQ ID NO: 1839472 - RNA, 16 nt, Human
gcucaccucucccuug

SEQ ID NO: 1839473 - RNA, 14 nt, Human
gcucaccucucccu

SEQ ID NO: 1839474 - RNA, 12 nt, Human
gcucagcccucc

SEQ ID NO: 1839475 - RNA, 16 nt, Human
gcucagcccucccugc

SEQ ID NO: 1839476 - RNA, 15 nt, Human
gcucagcccucccug

SEQ ID NO: 1839477 - RNA, 22 nt, Human
gcucacagaacccuuggagcca

SEQ ID NO: 1839478 - RNA, 16 nt, Human
gcucacauaucuguca

SEQ ID NO: 1839479 - RNA, 12 nt, Human
gcucaccagccc

SEQ ID NO: 1839480 - RNA, 13 nt, Human
gcucaccagcccc

SEQ ID NO: 1839481 - RNA, 14 nt, Human
gcucaccagcccca

SEQ ID NO: 1839482 - RNA, 15 nt, Human
gcucaccagccccag

SEQ ID NO: 1839483 - RNA, 18 nt, Human
gcucaccagccccagugc

SEQ ID NO: 1839484 - RNA, 21 nt, Human
gcucagcccucccugccccuc

SEQ ID NO: 1839485 - RNA, 19 nt, Human
gcucagcccucccugcccc

SEQ ID NO: 1839486 - RNA, 18 nt, Human
gcucagcccucccugccc

SEQ ID NO: 1839487 - RNA, 17 nt, Human
gcucagcccucccugcc

SEQ ID NO: 1839488 - RNA, 16 nt, Human
gcucagcggggacagc

SEQ ID NO: 1839489 - RNA, 17 nt, Human
gcucagcggggacagcu

SEQ ID NO: 1839490 - RNA, 18 nt, Human
gcucagcggggacagcuc

SEQ ID NO: 1839491 - RNA, 19 nt, Human
gcucagcggggacagcucc

SEQ ID NO: 1839492 - RNA, 23 nt, Human
gcucagcggggacagcuccuucu

SEQ ID NO: 1839493 - RNA, 18 nt, Human
gcucauggacuucugcca

SEQ ID NO: 1839494 - RNA, 14 nt, Human
ucacugcuuaacuu

SEQ ID NO: 1839495 - RNA, 22 nt, Human
ucacugcuggcugccuuagaac

SEQ ID NO: 1839496 - RNA, 18 nt, Human
ucacugcuggcugccuua

SEQ ID NO: 1839497 - RNA, 17 nt, Human
ucacugcuggcugccuu

SEQ ID NO: 1839498 - RNA, 12 nt, Human
ucacugcuggcu

SEQ ID NO: 1839499 - RNA, 16 nt, Human
ucacugcuggcugccu

SEQ ID NO: 1839500 - RNA, 15 nt, Human
ucacugcuggcugcc

SEQ ID NO: 1839501 - RNA, 14 nt, Human
ucacugcuggcugc

SEQ ID NO: 1839502 - RNA, 13 nt, Human
ucacugcuggcug

SEQ ID NO: 1839503 - RNA, 18 nt, Human
ucacugccaugccagcuu

SEQ ID NO: 1839504 - RNA, 19 nt, Human
ucacugcauccuccgccuc

SEQ ID NO: 1839505 - RNA, 18 nt, Human
ucacugcauccuccgccu

SEQ ID NO: 1839506 - RNA, 20 nt, Human
ucacucuuauugcccacgcu

SEQ ID NO: 1839507 - RNA, 17 nt, Human
ucacucuuauugcccac

SEQ ID NO: 1839508 - RNA, 13 nt, Human
ucaccagccccag

SEQ ID NO: 1839509 - RNA, 16 nt, Human
ucaccagccccagugc

SEQ ID NO: 1839510 - RNA, 10 nt, Human
ucagaaaugu

SEQ ID NO: 1839511 - RNA, 15 nt, Human
ucagaaauguguuau

SEQ ID NO: 1839512 - RNA, 23 nt, Human
ucagaauucucuaguuugauuaa

SEQ ID NO: 1839513 - RNA, 16 nt, Human
ucagaauucucuaguu

SEQ ID NO: 1839514 - RNA, 14 nt, Human
ucagacagcugccu

SEQ ID NO: 1839515 - RNA, 13 nt, Human
ucagacagcugcc

SEQ ID NO: 1839516 - RNA, 22 nt, Human
ucagaguaauccaagcaaaugu

SEQ ID NO: 1839517 - RNA, 21 nt, Human
ucagaguaauccaagcaaaug

SEQ ID NO: 1839518 - RNA, 20 nt, Human
ucagcauucucacuccuacc

SEQ ID NO: 1839519 - RNA, 17 nt, Human
ucagcauucucacuccu

SEQ ID NO: 1839520 - RNA, 18 nt, Human
ucagauauaaaagacuga

SEQ ID NO: 1839521 - RNA, 20 nt, Human
ucagauauaaaagacugacc

SEQ ID NO: 1839522 - RNA, 14 nt, Human
ucagauauaaaaga

SEQ ID NO: 1839523 - RNA, 17 nt, Human
ucagauauaaaagacug

SEQ ID NO: 1839524 - RNA, 20 nt, Human
ucagccucccgaguagcugg

SEQ ID NO: 1839525 - RNA, 18 nt, Human
ucagccucccgaguagcu

SEQ ID NO: 1839526 - RNA, 21 nt, Human
ucagccucccgaauagcuggg

SEQ ID NO: 1839527 - RNA, 22 nt, Human
ucagccucccgaauagcuggga

SEQ ID NO: 1839528 - RNA, 23 nt, Human
ucagcauucucacuccuaccugg

SEQ ID NO: 1839529 - RNA, 14 nt, Human
ucagccucccaaag

SEQ ID NO: 1839530 - RNA, 19 nt, Human
ucagccucccaaagugcug

SEQ ID NO: 1839531 - RNA, 21 nt, Human
ucagccucccaaagugcuggg

SEQ ID NO: 1839532 - RNA, 16 nt, Human
ucagcugaaccugggu

SEQ ID NO: 1839533 - RNA, 15 nt, Human
ucagcugaaccuggg

SEQ ID NO: 1839534 - RNA, 19 nt, Human
ucagccugcuccagcuguu

SEQ ID NO: 1839535 - RNA, 18 nt, Human
ucagccugcuccagcugu

SEQ ID NO: 1839536 - RNA, 22 nt, Human
ucagccuccugaguagcuggga

SEQ ID NO: 1839537 - RNA, 13 nt, Human
ucagccuccugag

SEQ ID NO: 1839538 - RNA, 21 nt, Human
ucagccuccugaguagcugga

SEQ ID NO: 1839539 - RNA, 20 nt, Human
ucagccuccugaguagcugg

SEQ ID NO: 1839540 - RNA, 21 nt, Human
ucagccucccgaguagcuggg

SEQ ID NO: 1839541 - RNA, 22 nt, Human
ucagccucccgaguagcuggga

SEQ ID NO: 1839542 - RNA, 16 nt, Human
ucaggugagaagcaga

SEQ ID NO: 1839543 - RNA, 15 nt, Human
ucaggugagaagcag

SEQ ID NO: 1839544 - RNA, 16 nt, Human
ucagggccuggcucag

SEQ ID NO: 1839545 - RNA, 14 nt, Human
ucagggccuggcuc

SEQ ID NO: 1839546 - RNA, 21 nt, Human
ucagggagugggcuaagcacg

SEQ ID NO: 1839547 - RNA, 23 nt, Human
ucaggagcccugggaggcucugg

SEQ ID NO: 1839548 - RNA, 20 nt, Human
ucaggagcccugggaggcuc

SEQ ID NO: 1839549 - RNA, 18 nt, Human
ucaggagcccugggaggc

SEQ ID NO: 1839550 - RNA, 19 nt, Human
ucaggagcccugggaggcu

SEQ ID NO: 1839551 - RNA, 18 nt, Human
ucauugugaaauuauuca

SEQ ID NO: 1839552 - RNA, 17 nt, Human
ucauugugaaauuauuc

SEQ ID NO: 1839553 - RNA, 15 nt, Human
ucauugugaaauuau

SEQ ID NO: 1839554 - RNA, 12 nt, Human
ucauugugaaau

SEQ ID NO: 1839555 - RNA, 13 nt, Human
ucauuuccugugu

SEQ ID NO: 1839556 - RNA, 16 nt, Human
ucauuuccugugucuu

SEQ ID NO: 1839557 - RNA, 21 nt, Human
ucauucaacccaccugcgucu

SEQ ID NO: 1839558 - RNA, 23 nt, Human
ucauuccaccuucccaugcccug

SEQ ID NO: 1839559 - RNA, 21 nt, Human
ucaucaccaacgucugugcca

SEQ ID NO: 1839560 - RNA, 20 nt, Human
ucaucaccaacgucugugcc

SEQ ID NO: 1839561 - RNA, 19 nt, Human
ucaucaccaacgucugugc

SEQ ID NO: 1839562 - RNA, 15 nt, Human
ucauacucaccucac

SEQ ID NO: 1839563 - RNA, 21 nt, Human
ucauagcccucacccuggggc

SEQ ID NO: 1839564 - RNA, 21 nt, Human
ucaggugagaagcagaggaag

SEQ ID NO: 1839565 - RNA, 23 nt, Human
ucaggugccucaagagaaggcaa

SEQ ID NO: 1839566 - RNA, 13 nt, Human
ucaggugcugcca

SEQ ID NO: 1839567 - RNA, 14 nt, Human
ucaggugcugccau

SEQ ID NO: 1839568 - RNA, 15 nt, Human
ucaggugcugccauc

SEQ ID NO: 1839569 - RNA, 19 nt, Human
ucaucuugaauuguaagga

SEQ ID NO: 1839570 - RNA, 23 nt, Human
ucaucuuagguuggcaaaaaggc

SEQ ID NO: 1839571 - RNA, 18 nt, Human
uccaggagcagccacauu

SEQ ID NO: 1839572 - RNA, 17 nt, Human
uccaggagcagccacau

SEQ ID NO: 1839573 - RNA, 22 nt, Human
uccaggagcagccacauuccug

SEQ ID NO: 1839574 - RNA, 23 nt, Human
uccaggggugggacacccuguga

SEQ ID NO: 1839575 - RNA, 15 nt, Human
uccaggugcacaagc

SEQ ID NO: 1839576 - RNA, 22 nt, Human
uccaggugcacaagcuccaagc

SEQ ID NO: 1839577 - RNA, 21 nt, Human
uccaggugcacaagcuccaag

SEQ ID NO: 1839578 - RNA, 20 nt, Human
uccaggugcacaagcuccaa

SEQ ID NO: 1839579 - RNA, 18 nt, Human
uccaggugcacaagcucc

SEQ ID NO: 1839580 - RNA, 11 nt, Human
uccaggguggu

SEQ ID NO: 1839581 - RNA, 15 nt, Human
uccagguucagcuug

SEQ ID NO: 1839582 - RNA, 16 nt, Human
uccagguucagcuugu

SEQ ID NO: 1839583 - RNA, 18 nt, Human
uccagcucaccagcccca

SEQ ID NO: 1839584 - RNA, 16 nt, Human
uccagcucaccagccc

SEQ ID NO: 1839585 - RNA, 17 nt, Human
uccagcucaccagcccc

SEQ ID NO: 1839586 - RNA, 16 nt, Human
uccaggagcagccaca

SEQ ID NO: 1839587 - RNA, 17 nt, Human
uccagcuguucagcugg

SEQ ID NO: 1839588 - RNA, 15 nt, Human
uccacuuggucugug

SEQ ID NO: 1839589 - RNA, 16 nt, Human
uccacuuggucuguga

SEQ ID NO: 1839590 - RNA, 15 nt, Human
uccaccuucccaugc

SEQ ID NO: 1839591 - RNA, 17 nt, Human
uccagccacagaaaaga

SEQ ID NO: 1839592 - RNA, 15 nt, Human
uccaccugccaggga

SEQ ID NO: 1839593 - RNA, 17 nt, Human
uccaccugccagggaca

SEQ ID NO: 1839594 - RNA, 21 nt, Human
uccaccugccagggacagagg

SEQ ID NO: 1839595 - RNA, 18 nt, Human
uccaccugccagggacag

SEQ ID NO: 1839596 - RNA, 12 nt, Human
uccacccugcuc

SEQ ID NO: 1839597 - RNA, 18 nt, Human
uccacaagagcccaggcc

SEQ ID NO: 1839598 - RNA, 17 nt, Human
uccacaagagcccaggc

SEQ ID NO: 1839599 - RNA, 16 nt, Human
uccacaagagcccagg

SEQ ID NO: 1839600 - RNA, 18 nt, Human
uccacaaguuaaauaaau

SEQ ID NO: 1839601 - RNA, 17 nt, Human
uccacaaguuaaauaaa

SEQ ID NO: 1839602 - RNA, 20 nt, Human
uccaaaauaaaacuuuuuaa

SEQ ID NO: 1839603 - RNA, 18 nt, Human
uccaaaauaaaacuuuuu

SEQ ID NO: 1839604 - RNA, 18 nt, Human
uccaauuuacauacucug

SEQ ID NO: 1839605 - RNA, 17 nt, Human
uccaauuuacauacucu

SEQ ID NO: 1839606 - RNA, 12 nt, Human
uauuaaauuaug

SEQ ID NO: 1839607 - RNA, 24 nt, Human
uauuaagaaagacuaucuaaaugu

SEQ ID NO: 1839608 - RNA, 16 nt, Human
uauguugcauagaaua

SEQ ID NO: 1839609 - RNA, 13 nt, Human
uauguugcccagg

SEQ ID NO: 1839610 - RNA, 16 nt, Human
uauguugcccaggcag

SEQ ID NO: 1839611 - RNA, 19 nt, Human
uauguugcccaggcagguc

SEQ ID NO: 1839612 - RNA, 20 nt, Human
uauguugcccaggcaggucu

SEQ ID NO: 1839613 - RNA, 12 nt, Human
uauguugcauag

SEQ ID NO: 1839614 - RNA, 14 nt, Human
uauguugauaaaag

SEQ ID NO: 1839615 - RNA, 15 nt, Human
gggaguggccacaga

SEQ ID NO: 1839616 - RNA, 13 nt, Human
gggaguggccaca

SEQ ID NO: 1839617 - RNA, 21 nt, Human
uauuccugcauuugugaaaug

SEQ ID NO: 1839618 - RNA, 20 nt, Human
uauuccugcauuugugaaau

SEQ ID NO: 1839619 - RNA, 19 nt, Human
uauuccugcauuugugaaa

SEQ ID NO: 1839620 - RNA, 17 nt, Human
uauuccugcauuuguga

SEQ ID NO: 1839621 - RNA, 12 nt, Human
uauuguuuucag

SEQ ID NO: 1839622 - RNA, 20 nt, Human
uauuguuuucaguguacaug

SEQ ID NO: 1839623 - RNA, 18 nt, Human
uauuguuuucaguguaca

SEQ ID NO: 1839624 - RNA, 22 nt, Human
uauuguuuucaguguacaugga

SEQ ID NO: 1839625 - RNA, 24 nt, Human
uauuuauaaaaauaaaaaacacug

SEQ ID NO: 1839626 - RNA, 21 nt, Human
uauugauaugcuuauacacuu

SEQ ID NO: 1839627 - RNA, 18 nt, Human
uauucucuccuguaccuc

SEQ ID NO: 1839628 - RNA, 17 nt, Human
uauucucuccuguaccu

SEQ ID NO: 1839629 - RNA, 17 nt, Human
uauugcugauggugcaa

SEQ ID NO: 1839630 - RNA, 22 nt, Human
uauuggaaauuuguuauaauga

SEQ ID NO: 1839631 - RNA, 19 nt, Human
uauugcuuguuggauuuuu

SEQ ID NO: 1839632 - RNA, 21 nt, Human
uauugcuugcacaaaccaauu

SEQ ID NO: 1839633 - RNA, 18 nt, Human
ucacauuuauucugcuca

SEQ ID NO: 1839634 - RNA, 19 nt, Human
ucacauuuauucugcucac

SEQ ID NO: 1839635 - RNA, 17 nt, Human
ucacauuuauucugcuc

SEQ ID NO: 1839636 - RNA, 16 nt, Human
ucaccacaugugcaca

SEQ ID NO: 1839637 - RNA, 20 nt, Human
ucaccaaaucagcugcuacu

SEQ ID NO: 1839638 - RNA, 19 nt, Human
ucaccaaaucagcugcuac

SEQ ID NO: 1839639 - RNA, 14 nt, Human
ucaccaaggcugau

SEQ ID NO: 1839640 - RNA, 13 nt, Human
ucacaagacccaa

SEQ ID NO: 1839641 - RNA, 17 nt, Human
ucacaagacccaaaagg

SEQ ID NO: 1839642 - RNA, 18 nt, Human
ucacaagacccaaaaggc

SEQ ID NO: 1839643 - RNA, 16 nt, Human
ucacagucacauucca

SEQ ID NO: 1839644 - RNA, 19 nt, Human
ucacaguccuuaccagcag

SEQ ID NO: 1839645 - RNA, 23 nt, Human
ucacaguccuuaccagcagagca

SEQ ID NO: 1839646 - RNA, 22 nt, Human
ucacaguccuuaccagcagagc

SEQ ID NO: 1839647 - RNA, 16 nt, Human
ucacaggcagguccag

SEQ ID NO: 1839648 - RNA, 17 nt, Human
ucacaggcagguccagg

SEQ ID NO: 1839649 - RNA, 18 nt, Human
ucacaggcagguccaggg

SEQ ID NO: 1839650 - RNA, 19 nt, Human
ucacaggcagguccagggu

SEQ ID NO: 1839651 - RNA, 23 nt, Human
ucaauuacaggaaguacuggaga

SEQ ID NO: 1839652 - RNA, 21 nt, Human
ucaauuacaggaaguacugga

SEQ ID NO: 1839653 - RNA, 13 nt, Human
ucaaugcagcccc

SEQ ID NO: 1839654 - RNA, 18 nt, Human
ucaacgcagcccugcuuu

SEQ ID NO: 1839655 - RNA, 15 nt, Human
ucaacgcagcccugc

SEQ ID NO: 1839656 - RNA, 14 nt, Human
ucaacgcagcccug

SEQ ID NO: 1839657 - RNA, 20 nt, Human
ucaagugauucuccugccuc

SEQ ID NO: 1839658 - RNA, 18 nt, Human
ucaagugauucuccugcc

SEQ ID NO: 1839659 - RNA, 19 nt, Human
ucaagugauucuccugccu

SEQ ID NO: 1839660 - RNA, 21 nt, Human
ucaagugauucuccugccuca

SEQ ID NO: 1839661 - RNA, 15 nt, Human
ucaaaaaaagaaaaa

SEQ ID NO: 1839662 - RNA, 14 nt, Human
ucaaaaaaagaaaa

SEQ ID NO: 1839663 - RNA, 14 nt, Human
uauuuuuuuacuaa

SEQ ID NO: 1839664 - RNA, 17 nt, Human
uauuuuuuucuuuucuu

SEQ ID NO: 1839665 - RNA, 22 nt, Human
uauuuucccuauuagagaagag

SEQ ID NO: 1839666 - RNA, 13 nt, Human
uauuuauauaaau

SEQ ID NO: 1839667 - RNA, 17 nt, Human
uauuuuauguugcauag

SEQ ID NO: 1839668 - RNA, 14 nt, Human
uauuuuauuaugca

SEQ ID NO: 1839669 - RNA, 17 nt, Human
uauuuuauuaugcauga

SEQ ID NO: 1839670 - RNA, 19 nt, Human
uauuuucaacgcagcccug

SEQ ID NO: 1839671 - RNA, 23 nt, Human
ucaaauauauucagccuggcuuc

SEQ ID NO: 1839672 - RNA, 22 nt, Human
ucaaauauauucagccuggcuu

SEQ ID NO: 1839673 - RNA, 21 nt, Human
ucaaauauauucagccuggcu

SEQ ID NO: 1839674 - RNA, 12 nt, Human
ucaaagaaauuu

SEQ ID NO: 1839675 - RNA, 13 nt, Human
ucaaagaaauuuc

SEQ ID NO: 1839676 - RNA, 19 nt, Human
ucaaagaaauuuccacuca

SEQ ID NO: 1839677 - RNA, 20 nt, Human
ucaaagaaauuuccacucag

SEQ ID NO: 1839678 - RNA, 15 nt, Human
ucaaaugagaaaaug

SEQ ID NO: 1839679 - RNA, 23 nt, Human
ucaaccccuucgcuccugugucu

SEQ ID NO: 1839680 - RNA, 20 nt, Human
ucaaauuguaagcaugcaca

SEQ ID NO: 1839681 - RNA, 17 nt, Human
ucaaauuguaagcaugc

SEQ ID NO: 1839682 - RNA, 14 nt, Human
ucugccugcccagg

SEQ ID NO: 1839683 - RNA, 13 nt, Human
ucugccugcccag

SEQ ID NO: 1839684 - RNA, 15 nt, Human
ucugccugcccaggc

SEQ ID NO: 1839685 - RNA, 16 nt, Human
ucugccugcccaggcc

SEQ ID NO: 1839686 - RNA, 18 nt, Human
ucugcuccucuccccagc

SEQ ID NO: 1839687 - RNA, 21 nt, Human
ucugcuccucuccccagcaag

SEQ ID NO: 1839688 - RNA, 18 nt, Human
ucugcugacagacacagg

SEQ ID NO: 1839689 - RNA, 17 nt, Human
ucugcugacagacacag

SEQ ID NO: 1839690 - RNA, 21 nt, Human
ucuggacaggcauguucucug

SEQ ID NO: 1839691 - RNA, 16 nt, Human
ucuggaaugcaguggu

SEQ ID NO: 1839692 - RNA, 14 nt, Human
ucuggacaggcaug

SEQ ID NO: 1839693 - RNA, 19 nt, Human
ucuggaauaaggagaauga

SEQ ID NO: 1839694 - RNA, 15 nt, Human
ucuggaaugcagugg

SEQ ID NO: 1839695 - RNA, 22 nt, Human
ucugcugauccucccaggcuuc

SEQ ID NO: 1839696 - RNA, 19 nt, Human
ucugcugacagacacaggc

SEQ ID NO: 1839697 - RNA, 20 nt, Human
ucugcugacagacacaggcc

SEQ ID NO: 1839698 - RNA, 21 nt, Human
ucugcugacagacacaggccc

SEQ ID NO: 1839699 - RNA, 22 nt, Human
ucugcugacagacacaggcccg

SEQ ID NO: 1839700 - RNA, 21 nt, Human
ucugguuccuccccuccuccu

SEQ ID NO: 1839701 - RNA, 20 nt, Human
ucugguuccuccccuccucc

SEQ ID NO: 1839702 - RNA, 14 nt, Human
ucuguccuacucug

SEQ ID NO: 1839703 - RNA, 13 nt, Human
ucugguuccuccc

SEQ ID NO: 1839704 - RNA, 22 nt, Human
ucugucucuggauuauauuaug

SEQ ID NO: 1839705 - RNA, 16 nt, Human
ucugucgcccagucug

SEQ ID NO: 1839706 - RNA, 14 nt, Human
ucugucgcccaguc

SEQ ID NO: 1839707 - RNA, 21 nt, Human
ucuguccugggagugagcugg

SEQ ID NO: 1839708 - RNA, 20 nt, Human
ucuguccuacucugugucag

SEQ ID NO: 1839709 - RNA, 15 nt, Human
ucuguccuacucugu

SEQ ID NO: 1839710 - RNA, 19 nt, Human
ucuguccuacucuguguca

SEQ ID NO: 1839711 - RNA, 17 nt, Human
ucuggccuucggccucc

SEQ ID NO: 1839712 - RNA, 18 nt, Human
ucuggccuucggccucca

SEQ ID NO: 1839713 - RNA, 23 nt, Human
ucuggccuucggccuccauccug

SEQ ID NO: 1839714 - RNA, 19 nt, Human
ucuggcuaugcauuugaaa

SEQ ID NO: 1839715 - RNA, 22 nt, Human
ucuggcuaugcauuugaaaauu

SEQ ID NO: 1839716 - RNA, 15 nt, Human
ucuggcuccagcugg

SEQ ID NO: 1839717 - RNA, 23 nt, Human
ucuggcucuuccaggcugggaga

SEQ ID NO: 1839718 - RNA, 18 nt, Human
ucuggcucuuccaggcug

SEQ ID NO: 1839719 - RNA, 23 nt, Human
ucuggugacuuuccucuuugguc

SEQ ID NO: 1839720 - RNA, 14 nt, Human
ucugggacacaguu

SEQ ID NO: 1839721 - RNA, 22 nt, Human
ucuuaaauauguggaguucauc

SEQ ID NO: 1839722 - RNA, 17 nt, Human
ucuuaaccagaucauug

SEQ ID NO: 1839723 - RNA, 16 nt, Human
ucuuaaccagaucauu

SEQ ID NO: 1839724 - RNA, 22 nt, Human
ucuuaaccagaucauugugaaa

SEQ ID NO: 1839725 - RNA, 13 nt, Human
ucuuaaaaagugg

SEQ ID NO: 1839726 - RNA, 12 nt, Human
ucuucuccacug

SEQ ID NO: 1839727 - RNA, 13 nt, Human
ucuucuccuuuca

SEQ ID NO: 1839728 - RNA, 14 nt, Human
ucuucuccuuucac

SEQ ID NO: 1839729 - RNA, 18 nt, Human
ucuucuuuuuuugugaug

SEQ ID NO: 1839730 - RNA, 17 nt, Human
ucuucuuuuuuugugau

SEQ ID NO: 1839731 - RNA, 16 nt, Human
ucuucuuuuuuuguga

SEQ ID NO: 1839732 - RNA, 19 nt, Human
ucuucuuuuugcuucaaaa

SEQ ID NO: 1839733 - RNA, 13 nt, Human
ucuugaaaaaugc

SEQ ID NO: 1839734 - RNA, 19 nt, Human
ucuugaacuccugaccuca

SEQ ID NO: 1839735 - RNA, 17 nt, Human
ucuugaacuccugaccu

SEQ ID NO: 1839736 - RNA, 12 nt, Human
ucuugaacuccu

SEQ ID NO: 1839737 - RNA, 18 nt, Human
ucuucagaucucuaacuu

SEQ ID NO: 1839738 - RNA, 23 nt, Human
ucuucagaucucuaacuucacca

SEQ ID NO: 1839739 - RNA, 17 nt, Human
ucuuccuggauuauuca

SEQ ID NO: 1839740 - RNA, 13 nt, Human
ucugaaaauguau

SEQ ID NO: 1839741 - RNA, 14 nt, Human
ucugaaaauugaug

SEQ ID NO: 1839742 - RNA, 22 nt, Human
ucugaaaauugaugggauuugg

SEQ ID NO: 1839743 - RNA, 14 nt, Human
ucugaaaauguaug

SEQ ID NO: 1839744 - RNA, 16 nt, Human
ucugacacacagcucu

SEQ ID NO: 1839745 - RNA, 17 nt, Human
ucugacacacagcucug

SEQ ID NO: 1839746 - RNA, 18 nt, Human
ucugacacacagcucugu

SEQ ID NO: 1839747 - RNA, 19 nt, Human
ucugacacacagcucuguc

SEQ ID NO: 1839748 - RNA, 12 nt, Human
ucugacaggcaa

SEQ ID NO: 1839749 - RNA, 21 nt, Human
ucugacaggcaaugcuggcug

SEQ ID NO: 1839750 - RNA, 22 nt, Human
ucugacaggcaaugcuggcugu

SEQ ID NO: 1839751 - RNA, 15 nt, Human
ucugacauaaguauu

SEQ ID NO: 1839752 - RNA, 13 nt, Human
ucugacccacugc

SEQ ID NO: 1839753 - RNA, 21 nt, Human
ucugcaagaauugaagcagga

SEQ ID NO: 1839754 - RNA, 20 nt, Human
ucugcaagaauugaagcagg

SEQ ID NO: 1839755 - RNA, 14 nt, Human
ucugcacacagcac

SEQ ID NO: 1839756 - RNA, 23 nt, Human
ucugaggcugaaauucagaauau

SEQ ID NO: 1839757 - RNA, 11 nt, Human
ucugaggcuga

SEQ ID NO: 1839758 - RNA, 14 nt, Human
ucugacccacugcu

SEQ ID NO: 1839759 - RNA, 15 nt, Human
ucugacccacugcuu

SEQ ID NO: 1839760 - RNA, 23 nt, Human
ucugaggaauccagacccggcug

SEQ ID NO: 1839761 - RNA, 17 nt, Human
ucugcauucaggaucaa

SEQ ID NO: 1839762 - RNA, 16 nt, Human
ucucuaguuugauuaa

SEQ ID NO: 1839763 - RNA, 15 nt, Human
ucucuaguuugauua

SEQ ID NO: 1839764 - RNA, 14 nt, Human
ucucugcagguccc

SEQ ID NO: 1839765 - RNA, 13 nt, Human
ucucugcaggucc

SEQ ID NO: 1839766 - RNA, 17 nt, Human
ucucugaggacacuaac

SEQ ID NO: 1839767 - RNA, 14 nt, Human
ucucugaggacacu

SEQ ID NO: 1839768 - RNA, 18 nt, Human
ucucugcaggucccuaau

SEQ ID NO: 1839769 - RNA, 16 nt, Human
ucucugcaggucccua

SEQ ID NO: 1839770 - RNA, 15 nt, Human
ucucugcaggucccu

SEQ ID NO: 1839771 - RNA, 19 nt, Human
ucucuaacuucaccauauu

SEQ ID NO: 1839772 - RNA, 12 nt, Human
ucucuaacuuca

SEQ ID NO: 1839773 - RNA, 22 nt, Human
ucucgugauugauaagaaccuu

SEQ ID NO: 1839774 - RNA, 14 nt, Human
ucucgugauugaua

SEQ ID NO: 1839775 - RNA, 19 nt, Human
ucucgugguaggacuguag

SEQ ID NO: 1839776 - RNA, 21 nt, Human
ucucgugguaggacuguagaa

SEQ ID NO: 1839777 - RNA, 19 nt, Human
ucuccuguaccucuugagc

SEQ ID NO: 1839778 - RNA, 16 nt, Human
ucuccuguaccucuug

SEQ ID NO: 1839779 - RNA, 17 nt, Human
ucuccuguaccucuuga

SEQ ID NO: 1839780 - RNA, 15 nt, Human
ucuccuguaccucuu

SEQ ID NO: 1839781 - RNA, 21 nt, Human
ucuccuggaaauauuaagaaa

SEQ ID NO: 1839782 - RNA, 21 nt, Human
ucuccuggaagugcuaauuuu

SEQ ID NO: 1839783 - RNA, 19 nt, Human
ucuccugccucagccuccc

SEQ ID NO: 1839784 - RNA, 17 nt, Human
ucuccugccucagccuc

SEQ ID NO: 1839785 - RNA, 15 nt, Human
ucuccugccucagcc

SEQ ID NO: 1839786 - RNA, 18 nt, Human
ucucaagagggcacuggu

SEQ ID NO: 1839787 - RNA, 17 nt, Human
ucucaagagggcacugg

SEQ ID NO: 1839788 - RNA, 19 nt, Human
ucucaagagggcacuggug

SEQ ID NO: 1839789 - RNA, 12 nt, Human
ucuccugccuca

SEQ ID NO: 1839790 - RNA, 21 nt, Human
ucuaucaaguauuauaccuuu

SEQ ID NO: 1839791 - RNA, 22 nt, Human
ucuaucaaguauuauaccuuuu

SEQ ID NO: 1839792 - RNA, 15 nt, Human
ucuaucaaguauuau

SEQ ID NO: 1839793 - RNA, 17 nt, Human
ucucaaauaacuaaaag

SEQ ID NO: 1839794 - RNA, 21 nt, Human
ucucaaagaaauuuccacuca

SEQ ID NO: 1839795 - RNA, 22 nt, Human
ucucaaagaaauuuccacucag

SEQ ID NO: 1839796 - RNA, 14 nt, Human
ucuaaugugugaau

SEQ ID NO: 1839797 - RNA, 14 nt, Human
ucuaauauguaaca

SEQ ID NO: 1839798 - RNA, 21 nt, Human
ucuaaaucuccaaaauaaaac

SEQ ID NO: 1839799 - RNA, 22 nt, Human
ucggccucccaaagugcuggga

SEQ ID NO: 1839800 - RNA, 16 nt, Human
ucgugauugauaagaa

SEQ ID NO: 1839801 - RNA, 16 nt, Human
ucgagguuucucaaag

SEQ ID NO: 1839802 - RNA, 22 nt, Human
ucgagguuucucaaagaaauuu

SEQ ID NO: 1839803 - RNA, 18 nt, Human
ucggccuccauccugagg

SEQ ID NO: 1839804 - RNA, 22 nt, Human
uccuguaccucuugagccuuga

SEQ ID NO: 1839805 - RNA, 20 nt, Human
uccuguaccucuugagccuu

SEQ ID NO: 1839806 - RNA, 22 nt, Human
uccuggcacugcuuccagugag

SEQ ID NO: 1839807 - RNA, 18 nt, Human
uccuggcacugcuuccag

SEQ ID NO: 1839808 - RNA, 20 nt, Human
uccuggcacccggccccugc

SEQ ID NO: 1839809 - RNA, 21 nt, Human
uccuggcacccggccccugcu

SEQ ID NO: 1839810 - RNA, 17 nt, Human
uccuggcacugcuucca

SEQ ID NO: 1839811 - RNA, 22 nt, Human
uccuggcacccggccccugcug

SEQ ID NO: 1839812 - RNA, 17 nt, Human
uccugccucagccuccc

SEQ ID NO: 1839813 - RNA, 16 nt, Human
uccugccucagccucc

SEQ ID NO: 1839814 - RNA, 13 nt, Human
uccugccucagcc

SEQ ID NO: 1839815 - RNA, 15 nt, Human
uccugccucagccuc

SEQ ID NO: 1839816 - RNA, 14 nt, Human
uccuggcacccggc

SEQ ID NO: 1839817 - RNA, 16 nt, Human
uccuggcacccggccc

SEQ ID NO: 1839818 - RNA, 19 nt, Human
uccuggcacccggccccug

SEQ ID NO: 1839819 - RNA, 13 nt, Human
uccugagccagau

SEQ ID NO: 1839820 - RNA, 20 nt, Human
uccugccuaagugcagcccc

SEQ ID NO: 1839821 - RNA, 14 nt, Human
uccugagccagauu

SEQ ID NO: 1839822 - RNA, 14 nt, Human
uccugccucagccu

SEQ ID NO: 1839823 - RNA, 18 nt, Human
uccuuuucgcaggauucu

SEQ ID NO: 1839824 - RNA, 15 nt, Human
ucgaacuccugaccu

SEQ ID NO: 1839825 - RNA, 22 nt, Human
ucgaggcggaucuuuggacaga

SEQ ID NO: 1839826 - RNA, 17 nt, Human
ucgaggcggaucuuugg

SEQ ID NO: 1839827 - RNA, 23 nt, Human
uccuuuucacaguucucuccuuc

SEQ ID NO: 1839828 - RNA, 19 nt, Human
uccuuuuaaaacacuucca

SEQ ID NO: 1839829 - RNA, 20 nt, Human
uccuucaccuuuguccccac

SEQ ID NO: 1839830 - RNA, 18 nt, Human
uccuucaccuuugucccc

SEQ ID NO: 1839831 - RNA, 20 nt, Human
uccuuaccagcagagcaccu

SEQ ID NO: 1839832 - RNA, 19 nt, Human
uccuucacagaugggugcu

SEQ ID NO: 1839833 - RNA, 18 nt, Human
uccuucacagaugggugc

SEQ ID NO: 1839834 - RNA, 18 nt, Human
uccuuaccagcagagcac

SEQ ID NO: 1839835 - RNA, 17 nt, Human
uccuuaccagcagagca

SEQ ID NO: 1839836 - RNA, 16 nt, Human
uccuuaccagcagagc

SEQ ID NO: 1839837 - RNA, 22 nt, Human
uccuucaccuuuguccccaccg

SEQ ID NO: 1839838 - RNA, 21 nt, Human
uccuucaccuuuguccccacc

SEQ ID NO: 1839839 - RNA, 16 nt, Human
uccuaaucuucugaac

SEQ ID NO: 1839840 - RNA, 13 nt, Human
uccgaccagacac

SEQ ID NO: 1839841 - RNA, 17 nt, Human
uccgaccagacaccuug

SEQ ID NO: 1839842 - RNA, 18 nt, Human
uccuaauuccacagcugc

SEQ ID NO: 1839843 - RNA, 17 nt, Human
uccuaauuccacagcug

SEQ ID NO: 1839844 - RNA, 16 nt, Human
uccuaauuccacagcu

SEQ ID NO: 1839845 - RNA, 15 nt, Human
uccuaauuccacagc

SEQ ID NO: 1839846 - RNA, 22 nt, Human
uccuaaugaaugcauaaaaugu

SEQ ID NO: 1839847 - RNA, 15 nt, Human
uccuacaagacacag

SEQ ID NO: 1839848 - RNA, 18 nt, Human
uccuacccacccuccuuu

SEQ ID NO: 1839849 - RNA, 17 nt, Human
uccucauuagcauuuug

SEQ ID NO: 1839850 - RNA, 21 nt, Human
uccuauauuguuuucagugua

SEQ ID NO: 1839851 - RNA, 18 nt, Human
uccuauauuguuuucagu

SEQ ID NO: 1839852 - RNA, 17 nt, Human
uccucugcugcuggcug

SEQ ID NO: 1839853 - RNA, 16 nt, Human
uccucugcugcuggcu

SEQ ID NO: 1839854 - RNA, 15 nt, Human
uccucugcugcuggc

SEQ ID NO: 1839855 - RNA, 14 nt, Human
uccucugcugcugg

SEQ ID NO: 1839856 - RNA, 19 nt, Human
uccucuguacagagcccac

SEQ ID NO: 1839857 - RNA, 18 nt, Human
uccucuguacagagccca

SEQ ID NO: 1839858 - RNA, 17 nt, Human
uccucuguacagagccc

SEQ ID NO: 1839859 - RNA, 16 nt, Human
uccucuguacagagcc

SEQ ID NO: 1839860 - RNA, 21 nt, Human
uccucuuccugaauuuuauuu

SEQ ID NO: 1839861 - RNA, 19 nt, Human
uccuccuuuucacaguucu

SEQ ID NO: 1839862 - RNA, 14 nt, Human
uccucuaggagguc

SEQ ID NO: 1839863 - RNA, 20 nt, Human
ucccugccccucccuucaac

SEQ ID NO: 1839864 - RNA, 13 nt, Human
ucccugcacuugc

SEQ ID NO: 1839865 - RNA, 19 nt, Human
ucccugccccucccuucaa

SEQ ID NO: 1839866 - RNA, 14 nt, Human
ucccugcacuugca

SEQ ID NO: 1839867 - RNA, 13 nt, Human
ucccuucccaccu

SEQ ID NO: 1839868 - RNA, 14 nt, Human
ucccuucccaccuc

SEQ ID NO: 1839869 - RNA, 15 nt, Human
ucccuaauaaagcug

SEQ ID NO: 1839870 - RNA, 14 nt, Human
ucccuaauaaagcu

SEQ ID NO: 1839871 - RNA, 16 nt, Human
ucccguggaacguuuu

SEQ ID NO: 1839872 - RNA, 22 nt, Human
ucccguggaacguuuuuccugu

SEQ ID NO: 1839873 - RNA, 23 nt, Human
ucccguggaacguuuuuccuguu

SEQ ID NO: 1839874 - RNA, 20 nt, Human
uccccuguuuguuucugaaa

SEQ ID NO: 1839875 - RNA, 18 nt, Human
uccagguuuaagcuguua

SEQ ID NO: 1839876 - RNA, 17 nt, Human
uccagguuuaagcuguu

SEQ ID NO: 1839877 - RNA, 21 nt, Human
uccccuguuuguuucugaaag

SEQ ID NO: 1839878 - RNA, 13 nt, Human
uccccuucacucc

SEQ ID NO: 1839879 - RNA, 16 nt, Human
ucccuaauaaagcugu

SEQ ID NO: 1839880 - RNA, 16 nt, Human
ucccuauuagagaaga

SEQ ID NO: 1839881 - RNA, 19 nt, Human
ucccuccugggaaugaagc

SEQ ID NO: 1839882 - RNA, 11 nt, Human
ucccuccuggg

SEQ ID NO: 1839883 - RNA, 19 nt, Human
uggugucgggcaugacacg

SEQ ID NO: 1839884 - RNA, 18 nt, Human
uggugucgggcaugacac

SEQ ID NO: 1839885 - RNA, 20 nt, Human
ugguuccccuguucacucua

SEQ ID NO: 1839886 - RNA, 19 nt, Human
ugguuccccuguucacucu

SEQ ID NO: 1839887 - RNA, 18 nt, Human
ugguuccccuguucacuc

SEQ ID NO: 1839888 - RNA, 11 nt, Human
ugguuccccug

SEQ ID NO: 1839889 - RNA, 15 nt, Human
uggugucgggcauga

SEQ ID NO: 1839890 - RNA, 16 nt, Human
uggugucaccugaaga

SEQ ID NO: 1839891 - RNA, 23 nt, Human
ugguuccccuguucacucuacuu

SEQ ID NO: 1839892 - RNA, 23 nt, Human
ugguuccuccccuccuccuggac

SEQ ID NO: 1839893 - RNA, 18 nt, Human
ugguuccuccccuccucc

SEQ ID NO: 1839894 - RNA, 12 nt, Human
ugguuccucccc

SEQ ID NO: 1839895 - RNA, 18 nt, Human
ugguugaugaucuuugca

SEQ ID NO: 1839896 - RNA, 19 nt, Human
uggugguuuucuguucuuu

SEQ ID NO: 1839897 - RNA, 17 nt, Human
uggugguuucagaaaug

SEQ ID NO: 1839898 - RNA, 18 nt, Human
uggugguuucagaaaugu

SEQ ID NO: 1839899 - RNA, 20 nt, Human
ugguggggcugccaggggag

SEQ ID NO: 1839900 - RNA, 18 nt, Human
uggugggggccucggugu

SEQ ID NO: 1839901 - RNA, 16 nt, Human
uggugggggccucggu

SEQ ID NO: 1839902 - RNA, 21 nt, Human
ugguggcccgacagccuggca

SEQ ID NO: 1839903 - RNA, 13 nt, Human
ugguggcuggguu

SEQ ID NO: 1839904 - RNA, 20 nt, Human
uggugcaaugaccuuucaau

SEQ ID NO: 1839905 - RNA, 19 nt, Human
uggugcaaugaccuuucaa

SEQ ID NO: 1839906 - RNA, 14 nt, Human
uggugcaaugaccu

SEQ ID NO: 1839907 - RNA, 19 nt, Human
ugguggcccgacagccugg

SEQ ID NO: 1839908 - RNA, 20 nt, Human
ugguggcagugggagcugcc

SEQ ID NO: 1839909 - RNA, 13 nt, Human
ugguggcaguggg

SEQ ID NO: 1839910 - RNA, 18 nt, Human
ugguggcagugggagcug

SEQ ID NO: 1839911 - RNA, 14 nt, Human
uggugagaggcauc

SEQ ID NO: 1839912 - RNA, 20 nt, Human
uggguacuuguggacacagc

SEQ ID NO: 1839913 - RNA, 23 nt, Human
uggguacuuguggacacagcucu

SEQ ID NO: 1839914 - RNA, 12 nt, Human
uguaaaauggug

SEQ ID NO: 1839915 - RNA, 11 nt, Human
uguaaaauggu

SEQ ID NO: 1839916 - RNA, 21 nt, Human
ugguuuuuaaaaaacugcuga

SEQ ID NO: 1839917 - RNA, 19 nt, Human
ugguuuucuuguguguuua

SEQ ID NO: 1839918 - RNA, 16 nt, Human
ugguuuuucaguuuuc

SEQ ID NO: 1839919 - RNA, 23 nt, Human
ugguuuuuaaaaaacugcugacu

SEQ ID NO: 1839920 - RNA, 20 nt, Human
ugguuguacauauaagugau

SEQ ID NO: 1839921 - RNA, 16 nt, Human
ugguuuucuguucuuu

SEQ ID NO: 1839922 - RNA, 13 nt, Human
ugguugcauccua

SEQ ID NO: 1839923 - RNA, 14 nt, Human
uguaacaagccacc

SEQ ID NO: 1839924 - RNA, 17 nt, Human
uguaacaagccacccca

SEQ ID NO: 1839925 - RNA, 17 nt, Human
uguaaugaaaaccacau

SEQ ID NO: 1839926 - RNA, 13 nt, Human
uguaaugaaaacc

SEQ ID NO: 1839927 - RNA, 12 nt, Human
uguaaugaaaac

SEQ ID NO: 1839928 - RNA, 11 nt, Human
uguaaugaaaa

SEQ ID NO: 1839929 - RNA, 11 nt, Human
uguacagagcc

SEQ ID NO: 1839930 - RNA, 14 nt, Human
uguacagacaacaa

SEQ ID NO: 1839931 - RNA, 14 nt, Human
ugucagugugacug

SEQ ID NO: 1839932 - RNA, 15 nt, Human
ugucagugugacuga

SEQ ID NO: 1839933 - RNA, 19 nt, Human
ugucagugugacugaucuc

SEQ ID NO: 1839934 - RNA, 16 nt, Human
ugucagugugacugau

SEQ ID NO: 1839935 - RNA, 15 nt, Human
ugucacaggcagguc

SEQ ID NO: 1839936 - RNA, 16 nt, Human
ugucacaggcaggucc

SEQ ID NO: 1839937 - RNA, 17 nt, Human
ugucacaggcaggucca

SEQ ID NO: 1839938 - RNA, 21 nt, Human
ugucacaggcagguccagggu

SEQ ID NO: 1839939 - RNA, 13 nt, Human
uguaugcgugugu

SEQ ID NO: 1839940 - RNA, 21 nt, Human
ugucaauuacaggaaguacug

SEQ ID NO: 1839941 - RNA, 13 nt, Human
ugucacacacuuu

SEQ ID NO: 1839942 - RNA, 14 nt, Human
ugucacaggcaggu

SEQ ID NO: 1839943 - RNA, 19 nt, Human
uguauuuuacuaauaaaau

SEQ ID NO: 1839944 - RNA, 13 nt, Human
uguaucugagcag

SEQ ID NO: 1839945 - RNA, 22 nt, Human
uguaugaaagauggcugugccu

SEQ ID NO: 1839946 - RNA, 23 nt, Human
uguacagcaaggagauuuacaac

SEQ ID NO: 1839947 - RNA, 12 nt, Human
uguacagagccc

SEQ ID NO: 1839948 - RNA, 21 nt, Human
uguacagagcccacgccccca

SEQ ID NO: 1839949 - RNA, 13 nt, Human
uguacagagccca

SEQ ID NO: 1839950 - RNA, 22 nt, Human
uguacagcaaggagauuuacaa

SEQ ID NO: 1839951 - RNA, 19 nt, Human
uguccccgcacugggcuug

SEQ ID NO: 1839952 - RNA, 17 nt, Human
uguccccgcacugggcu

SEQ ID NO: 1839953 - RNA, 13 nt, Human
ugucaucucagcu

SEQ ID NO: 1839954 - RNA, 13 nt, Human
uguccccuauccu

SEQ ID NO: 1839955 - RNA, 14 nt, Human
ugucuaaugaaacc

SEQ ID NO: 1839956 - RNA, 22 nt, Human
uguccugccuaaggcugaacuu

SEQ ID NO: 1839957 - RNA, 12 nt, Human
uguccugggagu

SEQ ID NO: 1839958 - RNA, 19 nt, Human
uguccugggagugagcugg

SEQ ID NO: 1839959 - RNA, 20 nt, Human
uguccugggagugagcuggu

SEQ ID NO: 1839960 - RNA, 21 nt, Human
ugucucaaaaaaagaaaaaga

SEQ ID NO: 1839961 - RNA, 18 nt, Human
ugucucaagagggcacug

SEQ ID NO: 1839962 - RNA, 17 nt, Human
ugucucaagagggcacu

SEQ ID NO: 1839963 - RNA, 23 nt, Human
ugucuaguuguuugauucagaca

SEQ ID NO: 1839964 - RNA, 15 nt, Human
ugucuaguuguuuga

SEQ ID NO: 1839965 - RNA, 17 nt, Human
ugucuaggcaggaccug

SEQ ID NO: 1839966 - RNA, 19 nt, Human
ugucuaggcaggaccugug

SEQ ID NO: 1839967 - RNA, 14 nt, Human
ugucuaugggacuc

SEQ ID NO: 1839968 - RNA, 15 nt, Human
ugucuaugggacuca

SEQ ID NO: 1839969 - RNA, 16 nt, Human
ugucuaugggacucaa

SEQ ID NO: 1839970 - RNA, 23 nt, Human
ugucuuuggacccugaggcccag

SEQ ID NO: 1839971 - RNA, 16 nt, Human
ugucuuuucuugcaug

SEQ ID NO: 1839972 - RNA, 20 nt, Human
ugucugaagucacugcacag

SEQ ID NO: 1839973 - RNA, 22 nt, Human
uggccccucagggucccuggug

SEQ ID NO: 1839974 - RNA, 21 nt, Human
uggccccucagggucccuggu

SEQ ID NO: 1839975 - RNA, 20 nt, Human
uggccuagcauacguacaca

SEQ ID NO: 1839976 - RNA, 20 nt, Human
uggccccucagggucccugg

SEQ ID NO: 1839977 - RNA, 13 nt, Human
uggccccucaggg

SEQ ID NO: 1839978 - RNA, 17 nt, Human
uggcagcugcgguccac

SEQ ID NO: 1839979 - RNA, 19 nt, Human
uggcagcugcgguccaccc

SEQ ID NO: 1839980 - RNA, 22 nt, Human
uggccucccaacucaccccagc

SEQ ID NO: 1839981 - RNA, 21 nt, Human
uggccucccaacucaccccag

SEQ ID NO: 1839982 - RNA, 20 nt, Human
uggccucccaacucacccca

SEQ ID NO: 1839983 - RNA, 19 nt, Human
uggccucccaacucacccc

SEQ ID NO: 1839984 - RNA, 14 nt, Human
uggccucccaacuc

SEQ ID NO: 1839985 - RNA, 11 nt, Human
uggccucccaa

SEQ ID NO: 1839986 - RNA, 13 nt, Human
uggccuccaaguc

SEQ ID NO: 1839987 - RNA, 23 nt, Human
uggccuccaaguccacaguggaa

SEQ ID NO: 1839988 - RNA, 23 nt, Human
uggccuagcauacguacacauuu

SEQ ID NO: 1839989 - RNA, 18 nt, Human
uggccucaagugauucuc

SEQ ID NO: 1839990 - RNA, 23 nt, Human
uggccucaagugauucuccugcc

SEQ ID NO: 1839991 - RNA, 14 nt, Human
ugggaaugaagcaa

SEQ ID NO: 1839992 - RNA, 22 nt, Human
uggcuuuucacugcuggcugcc

SEQ ID NO: 1839993 - RNA, 21 nt, Human
uggcuuuucacugcuggcugc

SEQ ID NO: 1839994 - RNA, 19 nt, Human
uggcuuuucacugcuggcu

SEQ ID NO: 1839995 - RNA, 18 nt, Human
uggcuuuucacugcuggc

SEQ ID NO: 1839996 - RNA, 16 nt, Human
uggcuuuucacugcug

SEQ ID NO: 1839997 - RNA, 21 nt, Human
uggcuucccgcucagcccucc

SEQ ID NO: 1839998 - RNA, 20 nt, Human
uggcuucccgcucagcccuc

SEQ ID NO: 1839999 - RNA, 19 nt, Human
uggcuucccgcucagcccu

SEQ ID NO: 1840000 - RNA, 18 nt, Human
uggcuucccgcucagccc

SEQ ID NO: 1840001 - RNA, 22 nt, Human
uggcuucccgcucagcccuccc

SEQ ID NO: 1840002 - RNA, 22 nt, Human
uggcuuccuaaaauucagugga

SEQ ID NO: 1840003 - RNA, 23 nt, Human
uggccuucggccuccauccugag

SEQ ID NO: 1840004 - RNA, 13 nt, Human
uggccucugcacu

SEQ ID NO: 1840005 - RNA, 22 nt, Human
uggccuucggccuccauccuga

SEQ ID NO: 1840006 - RNA, 17 nt, Human
uggcuccagcuggccgg

SEQ ID NO: 1840007 - RNA, 16 nt, Human
uggcugcugaaggcuc

SEQ ID NO: 1840008 - RNA, 14 nt, Human
uggcugcugaaggc

SEQ ID NO: 1840009 - RNA, 13 nt, Human
uggcugcugaagg

SEQ ID NO: 1840010 - RNA, 15 nt, Human
ugggcuucauccucc

SEQ ID NO: 1840011 - RNA, 22 nt, Human
ugggcuucauccuccucagauc

SEQ ID NO: 1840012 - RNA, 22 nt, Human
ugggcuucaguggcagcugcuu

SEQ ID NO: 1840013 - RNA, 21 nt, Human
ugggcuucaguggcagcugcu

SEQ ID NO: 1840014 - RNA, 21 nt, Human
ugggcuugucuguagauuuua

SEQ ID NO: 1840015 - RNA, 17 nt, Human
ugggcuugucuguagau

SEQ ID NO: 1840016 - RNA, 23 nt, Human
ugggcuuggggaccagagcugcc

SEQ ID NO: 1840017 - RNA, 13 nt, Human
uggggcagcuuga

SEQ ID NO: 1840018 - RNA, 17 nt, Human
uggggccaggcuggguc

SEQ ID NO: 1840019 - RNA, 16 nt, Human
ugggggccucagugcc

SEQ ID NO: 1840020 - RNA, 19 nt, Human
uggggggcugaggugggag

SEQ ID NO: 1840021 - RNA, 18 nt, Human
ugggcagagcagagacca

SEQ ID NO: 1840022 - RNA, 17 nt, Human
ugggcagagcagagacc

SEQ ID NO: 1840023 - RNA, 15 nt, Human
ugggcagagcagaga

SEQ ID NO: 1840024 - RNA, 14 nt, Human
ugggcagagcagag

SEQ ID NO: 1840025 - RNA, 14 nt, Human
ugggacagggagga

SEQ ID NO: 1840026 - RNA, 16 nt, Human
ugggaggaucucuuga

SEQ ID NO: 1840027 - RNA, 15 nt, Human
ugggacacccuguga

SEQ ID NO: 1840028 - RNA, 14 nt, Human
ugggacacccugug

SEQ ID NO: 1840029 - RNA, 21 nt, Human
ugggaaugaaugucaguguga

SEQ ID NO: 1840030 - RNA, 16 nt, Human
ugggaaugaaugucag

SEQ ID NO: 1840031 - RNA, 18 nt, Human
ugggaugauuggaggggg

SEQ ID NO: 1840032 - RNA, 23 nt, Human
uggaggggggaggugggauccuc

SEQ ID NO: 1840033 - RNA, 19 nt, Human
uggaucaaauccagccugc

SEQ ID NO: 1840034 - RNA, 21 nt, Human
uggaugcagccucacaguccu

SEQ ID NO: 1840035 - RNA, 13 nt, Human
uggaugcagccuc

SEQ ID NO: 1840036 - RNA, 22 nt, Human
uggaugcagccucacaguccuu

SEQ ID NO: 1840037 - RNA, 21 nt, Human
uggcacuauaauguaagcucu

SEQ ID NO: 1840038 - RNA, 17 nt, Human
uggauuuaacagaaaug

SEQ ID NO: 1840039 - RNA, 15 nt, Human
uggauuuaacagaaa

SEQ ID NO: 1840040 - RNA, 22 nt, Human
uggcacuauaauguaagcucua

SEQ ID NO: 1840041 - RNA, 19 nt, Human
uggcacugcuuccagugag

SEQ ID NO: 1840042 - RNA, 22 nt, Human
uggcacugcuuccagugaggcu

SEQ ID NO: 1840043 - RNA, 23 nt, Human
uggacguguuaugacuccagaau

SEQ ID NO: 1840044 - RNA, 19 nt, Human
uggacguguuaugacucca

SEQ ID NO: 1840045 - RNA, 20 nt, Human
uggacuaacuugucuuugga

SEQ ID NO: 1840046 - RNA, 19 nt, Human
uggacuaacuugucuuugg

SEQ ID NO: 1840047 - RNA, 18 nt, Human
uggacaggcauguucucu

SEQ ID NO: 1840048 - RNA, 22 nt, Human
uggacaggcauguucucugagg

SEQ ID NO: 1840049 - RNA, 23 nt, Human
uggacaggcauguucucugagga

SEQ ID NO: 1840050 - RNA, 17 nt, Human
uggaacacucugagacu

SEQ ID NO: 1840051 - RNA, 15 nt, Human
uggaacacucugaga

SEQ ID NO: 1840052 - RNA, 14 nt, Human
ugcuuguuaacuga

SEQ ID NO: 1840053 - RNA, 16 nt, Human
ugcuuguuaacugagu

SEQ ID NO: 1840054 - RNA, 13 nt, Human
ugcuucuucagag

SEQ ID NO: 1840055 - RNA, 18 nt, Human
ugcuugugaaaggaaaga

SEQ ID NO: 1840056 - RNA, 17 nt, Human
ugcuuuggaaaacccag

SEQ ID NO: 1840057 - RNA, 13 nt, Human
ugcuuuggaaauc

SEQ ID NO: 1840058 - RNA, 19 nt, Human
ugcuuaacuucacauauug

SEQ ID NO: 1840059 - RNA, 13 nt, Human
ugcuuaacuucac

SEQ ID NO: 1840060 - RNA, 14 nt, Human
ugcuuaacuucaca

SEQ ID NO: 1840061 - RNA, 17 nt, Human
ugcuuaacuucacauau

SEQ ID NO: 1840062 - RNA, 18 nt, Human
ugcuuaacuucacauauu

SEQ ID NO: 1840063 - RNA, 23 nt, Human
ugcuuccagugaggcucugcccu

SEQ ID NO: 1840064 - RNA, 22 nt, Human
ugcuuccagugaggcucugccc

SEQ ID NO: 1840065 - RNA, 20 nt, Human
ugaucugaugcaagcaagaa

SEQ ID NO: 1840066 - RNA, 21 nt, Human
ugaucuaggaagacuuuggaa

SEQ ID NO: 1840067 - RNA, 19 nt, Human
ugaucuaggaagacuuugg

SEQ ID NO: 1840068 - RNA, 21 nt, Human
ugauccacccaccucagccuc

SEQ ID NO: 1840069 - RNA, 22 nt, Human
ugauccacccaccucagccucc

SEQ ID NO: 1840070 - RNA, 13 nt, Human
ugaucauccacug

SEQ ID NO: 1840071 - RNA, 24 nt, Human
ugaucauccacugugccaugugcc

SEQ ID NO: 1840072 - RNA, 21 nt, Human
ugauccaagcuggucccacuc

SEQ ID NO: 1840073 - RNA, 15 nt, Human
ugauccacccaccuc

SEQ ID NO: 1840074 - RNA, 16 nt, Human
ugauccacccaccuca

SEQ ID NO: 1840075 - RNA, 20 nt, Human
ugauccacccaccucagccu

SEQ ID NO: 1840076 - RNA, 19 nt, Human
ugauaugcaguuuuccuua

SEQ ID NO: 1840077 - RNA, 22 nt, Human
ugaucacggcucacugcagccu

SEQ ID NO: 1840078 - RNA, 24 nt, Human
ugauaguuguaccgcaaugugacu

SEQ ID NO: 1840079 - RNA, 23 nt, Human
ugauauaaguguguguuuuucau

SEQ ID NO: 1840080 - RNA, 17 nt, Human
ugauauaaguguguguu

SEQ ID NO: 1840081 - RNA, 22 nt, Human
ugaugcuucuucagagacuccu

SEQ ID NO: 1840082 - RNA, 21 nt, Human
ugaugcuucuucagagacucc

SEQ ID NO: 1840083 - RNA, 19 nt, Human
ugaugcuucuucagagacu

SEQ ID NO: 1840084 - RNA, 13 nt, Human
ugauguacaugua

SEQ ID NO: 1840085 - RNA, 21 nt, Human
ugaucuuugcagacaggcaag

SEQ ID NO: 1840086 - RNA, 23 nt, Human
ugaucuuugcagacaggcaagca

SEQ ID NO: 1840087 - RNA, 21 nt, Human
ugaucugaugcaagcaagaaa

SEQ ID NO: 1840088 - RNA, 19 nt, Human
ugaucuuugcagacaggca

SEQ ID NO: 1840089 - RNA, 20 nt, Human
ugaucuuugcagacaggcaa

SEQ ID NO: 1840090 - RNA, 14 nt, Human
ugaugccaugagga

SEQ ID NO: 1840091 - RNA, 22 nt, Human
ugaugaucuuugcagacaggca

SEQ ID NO: 1840092 - RNA, 23 nt, Human
ugaugaucuuugcagacaggcaa

SEQ ID NO: 1840093 - RNA, 20 nt, Human
ugaugaugaaaugaggucag

SEQ ID NO: 1840094 - RNA, 20 nt, Human
ugaggucuguucuuuccaaa

SEQ ID NO: 1840095 - RNA, 14 nt, Human
ugaggucuguucuu

SEQ ID NO: 1840096 - RNA, 15 nt, Human
ugaggucuguucuuu

SEQ ID NO: 1840097 - RNA, 11 nt, Human
ugaggcugggc

SEQ ID NO: 1840098 - RNA, 23 nt, Human
ugaggacuuaaaauauuccugca

SEQ ID NO: 1840099 - RNA, 15 nt, Human
ugaggugcuauguuc

SEQ ID NO: 1840100 - RNA, 16 nt, Human
ugaggugcuauguucu

SEQ ID NO: 1840101 - RNA, 21 nt, Human
ugaguccccuguuuguuucug

SEQ ID NO: 1840102 - RNA, 19 nt, Human
ugagguuucaaaccucccu

SEQ ID NO: 1840103 - RNA, 22 nt, Human
ugaguccuggcaugggaaugaa

SEQ ID NO: 1840104 - RNA, 19 nt, Human
ugaguccuggcaugggaau

SEQ ID NO: 1840105 - RNA, 14 nt, Human
ugagucgaggacag

SEQ ID NO: 1840106 - RNA, 18 nt, Human
ugaguccuggcaugggaa

SEQ ID NO: 1840107 - RNA, 11 nt, Human
ugaguccuggc

SEQ ID NO: 1840108 - RNA, 23 nt, Human
ugaguugauagcacagacccugc

SEQ ID NO: 1840109 - RNA, 21 nt, Human
ugaguugauagcacagacccu

SEQ ID NO: 1840110 - RNA, 15 nt, Human
ugagucgaggacagg

SEQ ID NO: 1840111 - RNA, 16 nt, Human
ugagucgaggacaggg

SEQ ID NO: 1840112 - RNA, 19 nt, Human
ugaguugauucagcucugc

SEQ ID NO: 1840113 - RNA, 16 nt, Human
ugaguugauucagcuc

SEQ ID NO: 1840114 - RNA, 18 nt, Human
ugagucgaggacagggag

SEQ ID NO: 1840115 - RNA, 23 nt, Human
ugauagcacagacccugcccugu

SEQ ID NO: 1840116 - RNA, 22 nt, Human
ugauagcacagacccugcccug

SEQ ID NO: 1840117 - RNA, 18 nt, Human
ugauagguauaaguggug

SEQ ID NO: 1840118 - RNA, 21 nt, Human
ugauagcacagacccugcccu

SEQ ID NO: 1840119 - RNA, 20 nt, Human
ugauagcacagacccugccc

SEQ ID NO: 1840120 - RNA, 18 nt, Human
ugauagcacagacccugc

SEQ ID NO: 1840121 - RNA, 17 nt, Human
ugauagcacagacccug

SEQ ID NO: 1840122 - RNA, 16 nt, Human
ugauagcacagacccu

SEQ ID NO: 1840123 - RNA, 15 nt, Human
ugauagcacagaccc

SEQ ID NO: 1840124 - RNA, 15 nt, Human
ugagcaucaggccag

SEQ ID NO: 1840125 - RNA, 14 nt, Human
ugagcaucaggcca

SEQ ID NO: 1840126 - RNA, 13 nt, Human
ugagccccaaaag

SEQ ID NO: 1840127 - RNA, 13 nt, Human
ugagcaucaggcc

SEQ ID NO: 1840128 - RNA, 14 nt, Human
ugagaugcuagaac

SEQ ID NO: 1840129 - RNA, 16 nt, Human
ugagaugcuagaacuc

SEQ ID NO: 1840130 - RNA, 20 nt, Human
ugagaugcuagaacucccuu

SEQ ID NO: 1840131 - RNA, 13 nt, Human
ugagccucagcau

SEQ ID NO: 1840132 - RNA, 15 nt, Human
ugagccucagcaucc

SEQ ID NO: 1840133 - RNA, 14 nt, Human
ugagacagcucugc

SEQ ID NO: 1840134 - RNA, 16 nt, Human
ugagacagcucugcau

SEQ ID NO: 1840135 - RNA, 12 nt, Human
ugagacccuguc

SEQ ID NO: 1840136 - RNA, 22 nt, Human
ugacuguacuccucccaggcgc

SEQ ID NO: 1840137 - RNA, 18 nt, Human
ugacuguacuccucccag

SEQ ID NO: 1840138 - RNA, 17 nt, Human
ugacuguacuccuccca

SEQ ID NO: 1840139 - RNA, 16 nt, Human
ugacuguacuccuccc

SEQ ID NO: 1840140 - RNA, 13 nt, Human
ugagaaaucuaaa

SEQ ID NO: 1840141 - RNA, 17 nt, Human
ugagaaaucuaaaaaac

SEQ ID NO: 1840142 - RNA, 22 nt, Human
ugagaggcauccaguaucuuga

SEQ ID NO: 1840143 - RNA, 23 nt, Human
ugagaggcauccaguaucuugaa

SEQ ID NO: 1840144 - RNA, 12 nt, Human
ugagacucuguc

SEQ ID NO: 1840145 - RNA, 13 nt, Human
ugagacucugucu

SEQ ID NO: 1840146 - RNA, 14 nt, Human
ugagacucugucuc

SEQ ID NO: 1840147 - RNA, 17 nt, Human
ugagaguagagucacug

SEQ ID NO: 1840148 - RNA, 16 nt, Human
ugacgccaucccagcc

SEQ ID NO: 1840149 - RNA, 15 nt, Human
ugacgccaucccagc

SEQ ID NO: 1840150 - RNA, 14 nt, Human
ugacgccaucccag

SEQ ID NO: 1840151 - RNA, 13 nt, Human
ugacgccauccca

SEQ ID NO: 1840152 - RNA, 22 nt, Human
ugaccuuucaauaggaaaaacu

SEQ ID NO: 1840153 - RNA, 18 nt, Human
ugaccuuucaauaggaaa

SEQ ID NO: 1840154 - RNA, 20 nt, Human
ugacgccaucccagccccaa

SEQ ID NO: 1840155 - RNA, 19 nt, Human
ugacgccaucccagcccca

SEQ ID NO: 1840156 - RNA, 18 nt, Human
ugacgccaucccagcccc

SEQ ID NO: 1840157 - RNA, 17 nt, Human
ugacgccaucccagccc

SEQ ID NO: 1840158 - RNA, 13 nt, Human
ugacugaauuucu

SEQ ID NO: 1840159 - RNA, 14 nt, Human
ugacugaauuucuu

SEQ ID NO: 1840160 - RNA, 15 nt, Human
ugacugaauuucuuu

SEQ ID NO: 1840161 - RNA, 13 nt, Human
ugaccucugcagc

SEQ ID NO: 1840162 - RNA, 16 nt, Human
ugaccucugcagcaau

SEQ ID NO: 1840163 - RNA, 22 nt, Human
ugaccucaggugauccacccac

SEQ ID NO: 1840164 - RNA, 16 nt, Human
ugaccuuucaauagga

SEQ ID NO: 1840165 - RNA, 15 nt, Human
ugaccuuucaauagg

SEQ ID NO: 1840166 - RNA, 14 nt, Human
ugaccuuucaauag

SEQ ID NO: 1840167 - RNA, 18 nt, Human
ugaccucugcagcaauaa

SEQ ID NO: 1840168 - RNA, 21 nt, Human
ugaccucugcagcaauaaagc

SEQ ID NO: 1840169 - RNA, 23 nt, Human
ugaccucugcagcaauaaagcag

SEQ ID NO: 1840170 - RNA, 12 nt, Human
ugaccucugccu

SEQ ID NO: 1840171 - RNA, 22 nt, Human
ugaccauucuccaccugccagg

SEQ ID NO: 1840172 - RNA, 21 nt, Human
ugaccauucuccaccugccag

SEQ ID NO: 1840173 - RNA, 20 nt, Human
ugaccauucuccaccugcca

SEQ ID NO: 1840174 - RNA, 17 nt, Human
ucuugaauuguaaggaa

SEQ ID NO: 1840175 - RNA, 16 nt, Human
ucuugaauaauguaag

SEQ ID NO: 1840176 - RNA, 15 nt, Human
ucuugaacuccuggc

SEQ ID NO: 1840177 - RNA, 21 nt, Human
ugcaccggcuggccuggcccc

SEQ ID NO: 1840178 - RNA, 17 nt, Human
ugcaccuggaauauaua

SEQ ID NO: 1840179 - RNA, 20 nt, Human
ugcaccuggaauauauaacc

SEQ ID NO: 1840180 - RNA, 22 nt, Human
ugcaccuggaauauauaaccag

SEQ ID NO: 1840181 - RNA, 20 nt, Human
ugcaccggcuggccuggccc

SEQ ID NO: 1840182 - RNA, 19 nt, Human
ugcaccggcuggccuggcc

SEQ ID NO: 1840183 - RNA, 18 nt, Human
ugcaccggcuggccuggc

SEQ ID NO: 1840184 - RNA, 17 nt, Human
ugcacagugcaucucag

SEQ ID NO: 1840185 - RNA, 16 nt, Human
ugcacagugcaucuca

SEQ ID NO: 1840186 - RNA, 20 nt, Human
ugcacagaguuguuacauuu

SEQ ID NO: 1840187 - RNA, 15 nt, Human
ugcacagugcaucuc

SEQ ID NO: 1840188 - RNA, 18 nt, Human
ugcacugacauuguuggc

SEQ ID NO: 1840189 - RNA, 21 nt, Human
ugcacugacauuguuggccaa

SEQ ID NO: 1840190 - RNA, 19 nt, Human
ugcagagguccacaacaca

SEQ ID NO: 1840191 - RNA, 19 nt, Human
ugcacaaacagaggccgcc

SEQ ID NO: 1840192 - RNA, 17 nt, Human
ugcacaaacagaggccg

SEQ ID NO: 1840193 - RNA, 20 nt, Human
ugcacaaacagaggccgcca

SEQ ID NO: 1840194 - RNA, 17 nt, Human
ugcacagaguuguuaca

SEQ ID NO: 1840195 - RNA, 17 nt, Human
ugcacaaagcccuucca

SEQ ID NO: 1840196 - RNA, 15 nt, Human
ugcacaaagcccuuc

SEQ ID NO: 1840197 - RNA, 18 nt, Human
ugcacagaguuguuacau

SEQ ID NO: 1840198 - RNA, 19 nt, Human
ugcacagaguuguuacauu

SEQ ID NO: 1840199 - RNA, 16 nt, Human
ugcacaaacagaggcc

SEQ ID NO: 1840200 - RNA, 15 nt, Human
ugcacaaacagaggc

SEQ ID NO: 1840201 - RNA, 13 nt, Human
ugcaauggcagcc

SEQ ID NO: 1840202 - RNA, 14 nt, Human
ugcaauggcagccu

SEQ ID NO: 1840203 - RNA, 15 nt, Human
ugcaauggcagccuu

SEQ ID NO: 1840204 - RNA, 16 nt, Human
ugcaauggcagccuug

SEQ ID NO: 1840205 - RNA, 23 nt, Human
ugcaaugaccuuucaauaggaaa

SEQ ID NO: 1840206 - RNA, 22 nt, Human
ugcaaugaccuuucaauaggaa

SEQ ID NO: 1840207 - RNA, 19 nt, Human
ugcaaugaccuuucaauag

SEQ ID NO: 1840208 - RNA, 17 nt, Human
ugcaaugaccuuucaau

SEQ ID NO: 1840209 - RNA, 16 nt, Human
ugcaaugaccuuucaa

SEQ ID NO: 1840210 - RNA, 13 nt, Human
ugcaaugaccuuu

SEQ ID NO: 1840211 - RNA, 21 nt, Human
ugcaaugacacagucuuggcu

SEQ ID NO: 1840212 - RNA, 22 nt, Human
ugcaaccugauugugucucuug

SEQ ID NO: 1840213 - RNA, 21 nt, Human
ugcaaccuucgccaccugggu

SEQ ID NO: 1840214 - RNA, 18 nt, Human
ugcaaccuucgccaccug

SEQ ID NO: 1840215 - RNA, 18 nt, Human
ugcaacuuuguauaaaag

SEQ ID NO: 1840216 - RNA, 18 nt, Human
ugcaacuuguaaaugugg

SEQ ID NO: 1840217 - RNA, 16 nt, Human
ugcaacuuguaaaugu

SEQ ID NO: 1840218 - RNA, 13 nt, Human
ugcaacuucugcc

SEQ ID NO: 1840219 - RNA, 14 nt, Human
ugcaacuucugccu

SEQ ID NO: 1840220 - RNA, 20 nt, Human
ugcaaccugauugugucucu

SEQ ID NO: 1840221 - RNA, 19 nt, Human
ugcaaccugauugugucuc

SEQ ID NO: 1840222 - RNA, 18 nt, Human
ugcaaccuccgccucuug

SEQ ID NO: 1840223 - RNA, 20 nt, Human
ugcaaccuccgccucuuggg

SEQ ID NO: 1840224 - RNA, 21 nt, Human
ugcaaccuccgccucuugggu

SEQ ID NO: 1840225 - RNA, 13 nt, Human
ugcaaccuccgcc

SEQ ID NO: 1840226 - RNA, 14 nt, Human
ugcaaccuccgccu

SEQ ID NO: 1840227 - RNA, 19 nt, Human
ugcaacaggcugggcuuca

SEQ ID NO: 1840228 - RNA, 20 nt, Human
ugcaacaggcugggcuucag

SEQ ID NO: 1840229 - RNA, 14 nt, Human
ugcaacaggcuggg

SEQ ID NO: 1840230 - RNA, 15 nt, Human
ugcaacaggcugggc

SEQ ID NO: 1840231 - RNA, 16 nt, Human
ugcaacaggcugggcu

SEQ ID NO: 1840232 - RNA, 17 nt, Human
ugcaacaggcugggcuu

SEQ ID NO: 1840233 - RNA, 13 nt, Human
ugauuuucauugc

SEQ ID NO: 1840234 - RNA, 15 nt, Human
ugauuuucauugcug

SEQ ID NO: 1840235 - RNA, 19 nt, Human
ugauuuuuaaagaaaaguu

SEQ ID NO: 1840236 - RNA, 17 nt, Human
ugauuuugcuguagaag

SEQ ID NO: 1840237 - RNA, 19 nt, Human
ugauuuugcuguagaagau

SEQ ID NO: 1840238 - RNA, 14 nt, Human
ugauuuugcuguag

SEQ ID NO: 1840239 - RNA, 16 nt, Human
ugauuuugcuguagaa

SEQ ID NO: 1840240 - RNA, 20 nt, Human
ugauuuuuuuuuccuucagu

SEQ ID NO: 1840241 - RNA, 19 nt, Human
ugauuuuuuuuuccuucag

SEQ ID NO: 1840242 - RNA, 17 nt, Human
ugauuuuuuuuuccuuc

SEQ ID NO: 1840243 - RNA, 16 nt, Human
ugauuuuuuuuuccuu

SEQ ID NO: 1840244 - RNA, 13 nt, Human
ugauuuuuuucca

SEQ ID NO: 1840245 - RNA, 16 nt, Human
ugauuuuuuuuuuuca

SEQ ID NO: 1840246 - RNA, 23 nt, Human
ugauuuuuuuuuccuucagugcc

SEQ ID NO: 1840247 - RNA, 22 nt, Human
ugauuuuuuuuuccuucagugc

SEQ ID NO: 1840248 - RNA, 13 nt, Human
ugccucuuccucc

SEQ ID NO: 1840249 - RNA, 21 nt, Human
ugccucuucucuacucuaggg

SEQ ID NO: 1840250 - RNA, 13 nt, Human
ugccugcccaggc

SEQ ID NO: 1840251 - RNA, 17 nt, Human
ugccugguggcagcugc

SEQ ID NO: 1840252 - RNA, 18 nt, Human
ugccugguggcagcugcg

SEQ ID NO: 1840253 - RNA, 19 nt, Human
ugccugguggcagcugcgg

SEQ ID NO: 1840254 - RNA, 13 nt, Human
ugccucugggacu

SEQ ID NO: 1840255 - RNA, 18 nt, Human
ugccucugccugucuccc

SEQ ID NO: 1840256 - RNA, 14 nt, Human
ugccucugccuguc

SEQ ID NO: 1840257 - RNA, 13 nt, Human
ugccucugccugu

SEQ ID NO: 1840258 - RNA, 20 nt, Human
ugccuccuuugugaggaagc

SEQ ID NO: 1840259 - RNA, 21 nt, Human
ugccuccuuugugaggaagcc

SEQ ID NO: 1840260 - RNA, 22 nt, Human
ugccuccuuugugaggaagccg

SEQ ID NO: 1840261 - RNA, 23 nt, Human
ugcccugcccaccuggccucugc

SEQ ID NO: 1840262 - RNA, 22 nt, Human
ugcccugcccaccuggccucug

SEQ ID NO: 1840263 - RNA, 17 nt, Human
ugcccuaaaguguauuu

SEQ ID NO: 1840264 - RNA, 19 nt, Human
ugcccuaaaguguauuuuu

SEQ ID NO: 1840265 - RNA, 21 nt, Human
ugcccugcccaccuggccucu

SEQ ID NO: 1840266 - RNA, 23 nt, Human
ugcccugcugagucccaggcuga

SEQ ID NO: 1840267 - RNA, 22 nt, Human
ugcccugcugagucccaggcug

SEQ ID NO: 1840268 - RNA, 18 nt, Human
ugcccugcugagucccag

SEQ ID NO: 1840269 - RNA, 19 nt, Human
ugcccugcgggucacagga

SEQ ID NO: 1840270 - RNA, 19 nt, Human
ugccgucuaccugaggggc

SEQ ID NO: 1840271 - RNA, 17 nt, Human
ugccgucuaccugaggg

SEQ ID NO: 1840272 - RNA, 16 nt, Human
ugccgucuaccugagg

SEQ ID NO: 1840273 - RNA, 15 nt, Human
ugccgucuaccugag

SEQ ID NO: 1840274 - RNA, 15 nt, Human
ugcccugguuuccug

SEQ ID NO: 1840275 - RNA, 18 nt, Human
ugcccuggugcugccaca

SEQ ID NO: 1840276 - RNA, 20 nt, Human
ugcccuggugcugccacacu

SEQ ID NO: 1840277 - RNA, 21 nt, Human
ugcccuggugcugccacacuu

SEQ ID NO: 1840278 - RNA, 18 nt, Human
ugcccuggauccaucagg

SEQ ID NO: 1840279 - RNA, 20 nt, Human
ugccaugaggaacaaggcaa

SEQ ID NO: 1840280 - RNA, 23 nt, Human
ugccaugaggaacaaggcaaggc

SEQ ID NO: 1840281 - RNA, 14 nt, Human
ugccaugugccagg

SEQ ID NO: 1840282 - RNA, 15 nt, Human
ugccaugugccaggu

SEQ ID NO: 1840283 - RNA, 13 nt, Human
ugcccacucccug

SEQ ID NO: 1840284 - RNA, 18 nt, Human
ugcccacgcuggagugca

SEQ ID NO: 1840285 - RNA, 12 nt, Human
ugccauguuggc

SEQ ID NO: 1840286 - RNA, 15 nt, Human
ugccauguuggccag

SEQ ID NO: 1840287 - RNA, 20 nt, Human
ugcccaccuggccucugcac

SEQ ID NO: 1840288 - RNA, 16 nt, Human
ugccauguuggccagg

SEQ ID NO: 1840289 - RNA, 19 nt, Human
ugccaggaagccagcaggc

SEQ ID NO: 1840290 - RNA, 18 nt, Human
ugccaggaagccagcagg

SEQ ID NO: 1840291 - RNA, 16 nt, Human
ugccaggaagccagca

SEQ ID NO: 1840292 - RNA, 12 nt, Human
ugccaggaagcc

SEQ ID NO: 1840293 - RNA, 17 nt, Human
ugccagguuuuuggucu

SEQ ID NO: 1840294 - RNA, 15 nt, Human
ugccauccagguuca

SEQ ID NO: 1840295 - RNA, 12 nt, Human
ugccauccaggu

SEQ ID NO: 1840296 - RNA, 12 nt, Human
ugcauuaucuag

SEQ ID NO: 1840297 - RNA, 17 nt, Human
ugcauuaucuagauacu

SEQ ID NO: 1840298 - RNA, 18 nt, Human
ugcauuaucuagauacug

SEQ ID NO: 1840299 - RNA, 15 nt, Human
ugccaccacgcccgg

SEQ ID NO: 1840300 - RNA, 14 nt, Human
ugcauccuccgccu

SEQ ID NO: 1840301 - RNA, 19 nt, Human
ugcagauaaacaguaguga

SEQ ID NO: 1840302 - RNA, 15 nt, Human
ugcauccuccgccuc

SEQ ID NO: 1840303 - RNA, 17 nt, Human
ugcaugguuuagaaagc

SEQ ID NO: 1840304 - RNA, 15 nt, Human
ugcauguuugugauu

SEQ ID NO: 1840305 - RNA, 14 nt, Human
uuuuaaaauccacu

SEQ ID NO: 1840306 - RNA, 23 nt, Human
uuuuaaaauccacuuuaucuuga

SEQ ID NO: 1840307 - RNA, 20 nt, Human
uuuuaaacccuauugguaaa

SEQ ID NO: 1840308 - RNA, 22 nt, Human
uuuguuaguaugaggcauuugu

SEQ ID NO: 1840309 - RNA, 15 nt, Human
uuuguugucagcuga

SEQ ID NO: 1840310 - RNA, 14 nt, Human
uuuguauuuuuagu

SEQ ID NO: 1840311 - RNA, 17 nt, Human
uuuggucuacacugugc

SEQ ID NO: 1840312 - RNA, 15 nt, Human
uuuggucaacacuaa

SEQ ID NO: 1840313 - RNA, 18 nt, Human
uuugcauaacguauaaaa

SEQ ID NO: 1840314 - RNA, 13 nt, Human
uuuggacccugag

SEQ ID NO: 1840315 - RNA, 12 nt, Human
uuuggaaaauaa

SEQ ID NO: 1840316 - RNA, 15 nt, Human
uuuccguuaaaauac

SEQ ID NO: 1840317 - RNA, 17 nt, Human
uuuccguuaaaauacca

SEQ ID NO: 1840318 - RNA, 21 nt, Human
uuugagugccuuacacaaugg

SEQ ID NO: 1840319 - RNA, 13 nt, Human
uuuucuucucccu

SEQ ID NO: 1840320 - RNA, 22 nt, Human
uuuucuuguguguuuauuguca

SEQ ID NO: 1840321 - RNA, 16 nt, Human
uuuucuuucagccaag

SEQ ID NO: 1840322 - RNA, 23 nt, Human
uuuucuacucgaguuacagacaa

SEQ ID NO: 1840323 - RNA, 22 nt, Human
uuuucuacucgaguuacagaca

SEQ ID NO: 1840324 - RNA, 20 nt, Human
uuuucuacucgaguuacaga

SEQ ID NO: 1840325 - RNA, 13 nt, Human
uuuucuacucgag

SEQ ID NO: 1840326 - RNA, 15 nt, Human
uuuucagauauaaaa

SEQ ID NO: 1840327 - RNA, 22 nt, Human
uuuucccuauuagagaagagau

SEQ ID NO: 1840328 - RNA, 18 nt, Human
uuuucccuauuagagaag

SEQ ID NO: 1840329 - RNA, 21 nt, Human
uuuucaaaauuguuacaaauu

SEQ ID NO: 1840330 - RNA, 13 nt, Human
uuuuauacauaaa

SEQ ID NO: 1840331 - RNA, 21 nt, Human
uuuuauacauaaacaagacca

SEQ ID NO: 1840332 - RNA, 17 nt, Human
uuuucaaaauaaaaaug

SEQ ID NO: 1840333 - RNA, 18 nt, Human
uuuuauuuuuagacagag

SEQ ID NO: 1840334 - RNA, 19 nt, Human
uuuuaucgucacugcuuaa

SEQ ID NO: 1840335 - RNA, 15 nt, Human
uuuuacuaauagaca

SEQ ID NO: 1840336 - RNA, 19 nt, Human
uuuuacguccaucucuugu

SEQ ID NO: 1840337 - RNA, 17 nt, Human
uuuuacaauaaaaucuu

SEQ ID NO: 1840338 - RNA, 19 nt, Human
uuuuacaaaaaagaaaaga

SEQ ID NO: 1840339 - RNA, 21 nt, Human
uuuuaaaguaacccuacaaaa

SEQ ID NO: 1840340 - RNA, 12 nt, Human
uuuuuaagaaaa

SEQ ID NO: 1840341 - RNA, 23 nt, Human
uuuuuaagaaaaaggaugcacag

SEQ ID NO: 1840342 - RNA, 16 nt, Human
uuuuuaagugcugcau

SEQ ID NO: 1840343 - RNA, 17 nt, Human
uuuuuaagugcugcauu

SEQ ID NO: 1840344 - RNA, 18 nt, Human
uuuuuaagugcugcauuu

SEQ ID NO: 1840345 - RNA, 19 nt, Human
uuuuuaagugcugcauuua

SEQ ID NO: 1840346 - RNA, 22 nt, Human
uuuuuaagugcugcauuuaaaa

SEQ ID NO: 1840347 - RNA, 23 nt, Human
uuuuuaagugcugcauuuaaaag

SEQ ID NO: 1840348 - RNA, 13 nt, Human
uuuuuaaucuuua

SEQ ID NO: 1840349 - RNA, 18 nt, Human
uuuuuaaguuacacauuu

SEQ ID NO: 1840350 - RNA, 17 nt, Human
uuuuuaauaaagacagg

SEQ ID NO: 1840351 - RNA, 20 nt, Human
uuuuuaauaaagacaggguu

SEQ ID NO: 1840352 - RNA, 12 nt, Human
uuuuucaguuuu

SEQ ID NO: 1840353 - RNA, 15 nt, Human
uuuuucaguuuucag

SEQ ID NO: 1840354 - RNA, 12 nt, Human
uuuuuuuuaaga

SEQ ID NO: 1840355 - RNA, 13 nt, Human
uuuuuuccacuua

SEQ ID NO: 1840356 - RNA, 11 nt, Human
uuuuuuuacua

SEQ ID NO: 1840357 - RNA, 13 nt, Human
uuuuuuuugacaa

SEQ ID NO: 1840358 - RNA, 15 nt, Human
uuguaaauuaacuuu

SEQ ID NO: 1840359 - RNA, 16 nt, Human
uuguaaauuaacuuuu

SEQ ID NO: 1840360 - RNA, 18 nt, Human
uuguaaauuaacuuuuau

SEQ ID NO: 1840361 - RNA, 23 nt, Human
uuguaaauuaacuuuuauaaacu

SEQ ID NO: 1840362 - RNA, 18 nt, Human
uuguacauaaugcgugca

SEQ ID NO: 1840363 - RNA, 21 nt, Human
uuguaaaugugguaaagaguu

SEQ ID NO: 1840364 - RNA, 16 nt, Human
uuguaaaugugguaaa

SEQ ID NO: 1840365 - RNA, 17 nt, Human
uuguaaauagcucaggu

SEQ ID NO: 1840366 - RNA, 21 nt, Human
uuggugaacauugcaauagaa

SEQ ID NO: 1840367 - RNA, 22 nt, Human
uuguaaaaauuaaaaguuaugg

SEQ ID NO: 1840368 - RNA, 16 nt, Human
uuggucugugagaugc

SEQ ID NO: 1840369 - RNA, 13 nt, Human
uuggucuguguga

SEQ ID NO: 1840370 - RNA, 19 nt, Human
uugcacguauuuuaauagc

SEQ ID NO: 1840371 - RNA, 22 nt, Human
uuggguucaagcgauucuucug

SEQ ID NO: 1840372 - RNA, 22 nt, Human
uugucuuaaaaaguggaaaaau

SEQ ID NO: 1840373 - RNA, 20 nt, Human
uugugaaaggaaagaggcuc

SEQ ID NO: 1840374 - RNA, 16 nt, Human
uugugauuuuuguaau

SEQ ID NO: 1840375 - RNA, 17 nt, Human
uugugauuuuuguaauu

SEQ ID NO: 1840376 - RNA, 12 nt, Human
uugugauuuuug

SEQ ID NO: 1840377 - RNA, 14 nt, Human
uugugaaaugaugg

SEQ ID NO: 1840378 - RNA, 20 nt, Human
uugucugaagucacugcaca

SEQ ID NO: 1840379 - RNA, 15 nt, Human
uugucuuaaaaagug

SEQ ID NO: 1840380 - RNA, 21 nt, Human
uugucugaagucacugcacag

SEQ ID NO: 1840381 - RNA, 21 nt, Human
uuguauucagaguugaugguu

SEQ ID NO: 1840382 - RNA, 15 nt, Human
uuguauucucuccug

SEQ ID NO: 1840383 - RNA, 16 nt, Human
uuguauucucuccugu

SEQ ID NO: 1840384 - RNA, 19 nt, Human
uuguauucucuccuguacc

SEQ ID NO: 1840385 - RNA, 17 nt, Human
uugugcauuaucuagau

SEQ ID NO: 1840386 - RNA, 22 nt, Human
uugugcauuaucuagauacugu

SEQ ID NO: 1840387 - RNA, 23 nt, Human
uugugcauuaucuagauacugua

SEQ ID NO: 1840388 - RNA, 12 nt, Human
uugugcauuugg

SEQ ID NO: 1840389 - RNA, 12 nt, Human
uugugccccugc

SEQ ID NO: 1840390 - RNA, 21 nt, Human
uugugccagaaugcuuuagga

SEQ ID NO: 1840391 - RNA, 16 nt, Human
uugugccagaaugcuu

SEQ ID NO: 1840392 - RNA, 17 nt, Human
uuguggacacagcucuu

SEQ ID NO: 1840393 - RNA, 21 nt, Human
uuguggaaaaugaaaauuagg

SEQ ID NO: 1840394 - RNA, 16 nt, Human
uuguggacacagcucu

SEQ ID NO: 1840395 - RNA, 20 nt, Human
uuguggauuuaacagaaaug

SEQ ID NO: 1840396 - RNA, 21 nt, Human
uuguggauuuaacagaaaugu

SEQ ID NO: 1840397 - RNA, 22 nt, Human
uuguggauuuaacagaaaugua

SEQ ID NO: 1840398 - RNA, 23 nt, Human
uuguggauuuaacagaaauguac

SEQ ID NO: 1840399 - RNA, 21 nt, Human
uuguguuuauauauaagccaa

SEQ ID NO: 1840400 - RNA, 19 nt, Human
uuguuaguaugaggcauuu

SEQ ID NO: 1840401 - RNA, 21 nt, Human
uuguuaguaugaggcauuugu

SEQ ID NO: 1840402 - RNA, 14 nt, Human
uuguuacauuuuua

SEQ ID NO: 1840403 - RNA, 21 nt, Human
uuguuaauaaaaguacauguu

SEQ ID NO: 1840404 - RNA, 14 nt, Human
uuguuaauaaaagu

SEQ ID NO: 1840405 - RNA, 19 nt, Human
uuguuaauaaaaguacaug

SEQ ID NO: 1840406 - RNA, 19 nt, Human
uuguguuucuuuaguuuuu

SEQ ID NO: 1840407 - RNA, 20 nt, Human
uuguuagugugucuuagugu

SEQ ID NO: 1840408 - RNA, 22 nt, Human
uuguuaguaugaggcauuuguu

SEQ ID NO: 1840409 - RNA, 18 nt, Human
uuuaagaaaaaggaugca

SEQ ID NO: 1840410 - RNA, 22 nt, Human
uuuaagaaaaaggaugcacaga

SEQ ID NO: 1840411 - RNA, 19 nt, Human
uuuaagacauuuuuggaag

SEQ ID NO: 1840412 - RNA, 20 nt, Human
uuuaagacgaaacauuuguu

SEQ ID NO: 1840413 - RNA, 18 nt, Human
uuuaaguuacacauuuuu

SEQ ID NO: 1840414 - RNA, 18 nt, Human
uuuaacagaaauguacag

SEQ ID NO: 1840415 - RNA, 18 nt, Human
uuguuuggagacagaguc

SEQ ID NO: 1840416 - RNA, 23 nt, Human
uuuaacaacuaugauuuggaaaa

SEQ ID NO: 1840417 - RNA, 19 nt, Human
uuuaacucuauaauguguu

SEQ ID NO: 1840418 - RNA, 23 nt, Human
uuuauaaaaauaaaaaacacugg

SEQ ID NO: 1840419 - RNA, 21 nt, Human
uuuauaaaaauaaaaaacacu

SEQ ID NO: 1840420 - RNA, 12 nt, Human
uuuagacagagu

SEQ ID NO: 1840421 - RNA, 22 nt, Human
uuuacuucuuauacauuugaua

SEQ ID NO: 1840422 - RNA, 19 nt, Human
uuuacuucuuauacauuug

SEQ ID NO: 1840423 - RNA, 14 nt, Human
uuuagaaauauaau

SEQ ID NO: 1840424 - RNA, 22 nt, Human
uuuaauagcgucauaacuagaa

SEQ ID NO: 1840425 - RNA, 21 nt, Human
uuuaauagcgucauaacuaga

SEQ ID NO: 1840426 - RNA, 16 nt, Human
uuuacagcugccugca

SEQ ID NO: 1840427 - RNA, 15 nt, Human
uuuacagcugccugc

SEQ ID NO: 1840428 - RNA, 14 nt, Human
uuucagauauaaaa

SEQ ID NO: 1840429 - RNA, 16 nt, Human
uuucagauauaaaaga

SEQ ID NO: 1840430 - RNA, 18 nt, Human
uuucagauauaaaagacu

SEQ ID NO: 1840431 - RNA, 16 nt, Human
uuucacaaccuucugu

SEQ ID NO: 1840432 - RNA, 22 nt, Human
uuucacaaccuucuguggcuca

SEQ ID NO: 1840433 - RNA, 19 nt, Human
uuucaauaggaaaaacuga

SEQ ID NO: 1840434 - RNA, 17 nt, Human
uuucaauaggaaaaacu

SEQ ID NO: 1840435 - RNA, 14 nt, Human
uuucaauaggaaaa

SEQ ID NO: 1840436 - RNA, 12 nt, Human
uuucaauaggaa

SEQ ID NO: 1840437 - RNA, 18 nt, Human
uuucauuuaggugaggaa

SEQ ID NO: 1840438 - RNA, 14 nt, Human
uuucauuuagguga

SEQ ID NO: 1840439 - RNA, 23 nt, Human
uuucagcaccuacaguguacagu

SEQ ID NO: 1840440 - RNA, 14 nt, Human
uuucaguguacaug

SEQ ID NO: 1840441 - RNA, 13 nt, Human
uuucaguguacau

SEQ ID NO: 1840442 - RNA, 19 nt, Human
uuuauuuaguuccuugagu

SEQ ID NO: 1840443 - RNA, 20 nt, Human
uuucaacgcagcccugcuuu

SEQ ID NO: 1840444 - RNA, 16 nt, Human
uuucaacgcagcccug

SEQ ID NO: 1840445 - RNA, 15 nt, Human
uuucaacgcagcccu

SEQ ID NO: 1840446 - RNA, 21 nt, Human
uuucaacgcagcccugcuuug

SEQ ID NO: 1840447 - RNA, 14 nt, Human
uuuauggcuuuugu

SEQ ID NO: 1840448 - RNA, 16 nt, Human
uuuauggcuuuugugc

SEQ ID NO: 1840449 - RNA, 13 nt, Human
uuuauuaugcaug

SEQ ID NO: 1840450 - RNA, 13 nt, Human
uuuauuauggcac

SEQ ID NO: 1840451 - RNA, 16 nt, Human
uucucuccagccccug

SEQ ID NO: 1840452 - RNA, 15 nt, Human
uucucuccagccccu

SEQ ID NO: 1840453 - RNA, 14 nt, Human
uucucuccuguacc

SEQ ID NO: 1840454 - RNA, 18 nt, Human
uucucuccuguaccucuu

SEQ ID NO: 1840455 - RNA, 14 nt, Human
uucucuccagcccc

SEQ ID NO: 1840456 - RNA, 13 nt, Human
uucucuccagccc

SEQ ID NO: 1840457 - RNA, 22 nt, Human
uucucuccuguaccucuugagc

SEQ ID NO: 1840458 - RNA, 19 nt, Human
uucucuccuguaccucuug

SEQ ID NO: 1840459 - RNA, 12 nt, Human
uucucugcccuc

SEQ ID NO: 1840460 - RNA, 11 nt, Human
uucucugcccu

SEQ ID NO: 1840461 - RNA, 14 nt, Human
uucucugaggacac

SEQ ID NO: 1840462 - RNA, 20 nt, Human
uucucugaggacacuaacca

SEQ ID NO: 1840463 - RNA, 15 nt, Human
uucuccaccugccag

SEQ ID NO: 1840464 - RNA, 14 nt, Human
uucuccaccugcca

SEQ ID NO: 1840465 - RNA, 12 nt, Human
uucuccaccugc

SEQ ID NO: 1840466 - RNA, 21 nt, Human
uucuccaccucccacaaagga

SEQ ID NO: 1840467 - RNA, 18 nt, Human
uucuccaccugccaggga

SEQ ID NO: 1840468 - RNA, 16 nt, Human
uucuccaccugccagg

SEQ ID NO: 1840469 - RNA, 20 nt, Human
uucuccaccugccagggaca

SEQ ID NO: 1840470 - RNA, 12 nt, Human
uucuccacugga

SEQ ID NO: 1840471 - RNA, 20 nt, Human
uucucauuugccaauaauaa

SEQ ID NO: 1840472 - RNA, 16 nt, Human
uucuccacccugcucu

SEQ ID NO: 1840473 - RNA, 19 nt, Human
uucugauccuaguuccacc

SEQ ID NO: 1840474 - RNA, 22 nt, Human
uucugauaugcaguuuuccuua

SEQ ID NO: 1840475 - RNA, 19 nt, Human
uucugcucacauaucuguc

SEQ ID NO: 1840476 - RNA, 21 nt, Human
uucugacccugcuucaaauau

SEQ ID NO: 1840477 - RNA, 18 nt, Human
uucugacccugcuucaaa

SEQ ID NO: 1840478 - RNA, 22 nt, Human
uucugacccaugcugcccugug

SEQ ID NO: 1840479 - RNA, 23 nt, Human
uucugacccaugcugcccuguga

SEQ ID NO: 1840480 - RNA, 17 nt, Human
uucucugcccuccaaga

SEQ ID NO: 1840481 - RNA, 16 nt, Human
uucucugcccuccaag

SEQ ID NO: 1840482 - RNA, 22 nt, Human
uucuacucgaguuacagacaaa

SEQ ID NO: 1840483 - RNA, 14 nt, Human
uucuauagcuuuuc

SEQ ID NO: 1840484 - RNA, 13 nt, Human
uucuacgccaggg

SEQ ID NO: 1840485 - RNA, 13 nt, Human
uucuacuauuuau

SEQ ID NO: 1840486 - RNA, 14 nt, Human
uucuacccaggugc

SEQ ID NO: 1840487 - RNA, 20 nt, Human
uucuacccagcgagcccugg

SEQ ID NO: 1840488 - RNA, 21 nt, Human
uucuacccagcgagcccuggu

SEQ ID NO: 1840489 - RNA, 23 nt, Human
uucuaaugugugaaucagagcac

SEQ ID NO: 1840490 - RNA, 12 nt, Human
uucuacccagcg

SEQ ID NO: 1840491 - RNA, 19 nt, Human
uucuacccagcgagcccug

SEQ ID NO: 1840492 - RNA, 15 nt, Human
uuccugaggcugggc

SEQ ID NO: 1840493 - RNA, 20 nt, Human
uuccugaggcugggcucccu

SEQ ID NO: 1840494 - RNA, 16 nt, Human
uuccauggccucuuca

SEQ ID NO: 1840495 - RNA, 12 nt, Human
uuccauggccuc

SEQ ID NO: 1840496 - RNA, 16 nt, Human
uuccaugucgccucug

SEQ ID NO: 1840497 - RNA, 21 nt, Human
uuccuugaguugauucagcuc

SEQ ID NO: 1840498 - RNA, 18 nt, Human
uucggugagcuacaaaug

SEQ ID NO: 1840499 - RNA, 14 nt, Human
uucuuaguugcugu

SEQ ID NO: 1840500 - RNA, 15 nt, Human
uucuuaguugcugua

SEQ ID NO: 1840501 - RNA, 23 nt, Human
uucuuaguugcuguaugucucgu

SEQ ID NO: 1840502 - RNA, 18 nt, Human
uucuguauuuuguuuuug

SEQ ID NO: 1840503 - RNA, 18 nt, Human
uucugcuuuccucuuccu

SEQ ID NO: 1840504 - RNA, 14 nt, Human
uucugcuucagccu

SEQ ID NO: 1840505 - RNA, 15 nt, Human
uucugcuucagccuc

SEQ ID NO: 1840506 - RNA, 16 nt, Human
uucugcuucagccucc

SEQ ID NO: 1840507 - RNA, 19 nt, Human
uucugcuucagccucccga

SEQ ID NO: 1840508 - RNA, 23 nt, Human
uugaaaacacuguucucugcccu

SEQ ID NO: 1840509 - RNA, 21 nt, Human
uucuuuccaaaguacacuguu

SEQ ID NO: 1840510 - RNA, 20 nt, Human
uugaaaaaccauuuugcugu

SEQ ID NO: 1840511 - RNA, 15 nt, Human
uugaacuccuggccu

SEQ ID NO: 1840512 - RNA, 16 nt, Human
uugaacuccuggccuc

SEQ ID NO: 1840513 - RNA, 12 nt, Human
uucuuucagcca

SEQ ID NO: 1840514 - RNA, 14 nt, Human
uucuuuccaaagua

SEQ ID NO: 1840515 - RNA, 13 nt, Human
uucuuccucccuc

SEQ ID NO: 1840516 - RNA, 21 nt, Human
uucuuguguguuuauugucaa

SEQ ID NO: 1840517 - RNA, 21 nt, Human
uucuuauacauuugauaaagu

SEQ ID NO: 1840518 - RNA, 21 nt, Human
uucuuccacaagagcccaggc

SEQ ID NO: 1840519 - RNA, 21 nt, Human
uugcaaaguaucccuacugua

SEQ ID NO: 1840520 - RNA, 17 nt, Human
uugaugacccccaacca

SEQ ID NO: 1840521 - RNA, 16 nt, Human
uugaugaucuuugcag

SEQ ID NO: 1840522 - RNA, 16 nt, Human
uugaggguugggcugg

SEQ ID NO: 1840523 - RNA, 14 nt, Human
uugagccugggagg

SEQ ID NO: 1840524 - RNA, 13 nt, Human
uugaggguugggc

SEQ ID NO: 1840525 - RNA, 11 nt, Human
uugagccuggg

SEQ ID NO: 1840526 - RNA, 23 nt, Human
uugauauccucuuugagugaagc

SEQ ID NO: 1840527 - RNA, 19 nt, Human
uugacgccaucccagcccc

SEQ ID NO: 1840528 - RNA, 18 nt, Human
uugacgccaucccagccc

SEQ ID NO: 1840529 - RNA, 17 nt, Human
uugacgccaucccagcc

SEQ ID NO: 1840530 - RNA, 16 nt, Human
uugaccucugcagcaa

SEQ ID NO: 1840531 - RNA, 20 nt, Human
uugacgccaucccagcccca

SEQ ID NO: 1840532 - RNA, 14 nt, Human
uugaccucugcagc

SEQ ID NO: 1840533 - RNA, 15 nt, Human
uugaccucugcagca

SEQ ID NO: 1840534 - RNA, 21 nt, Human
uugaccucaggugauccaccc

SEQ ID NO: 1840535 - RNA, 17 nt, Human
uugacccacaagaaaug

SEQ ID NO: 1840536 - RNA, 17 nt, Human
uugaccgugaggccaga

SEQ ID NO: 1840537 - RNA, 14 nt, Human
uugacccacaagaa

SEQ ID NO: 1840538 - RNA, 14 nt, Human
uugaauuguaagga

SEQ ID NO: 1840539 - RNA, 13 nt, Human
uugaacuuugacc

SEQ ID NO: 1840540 - RNA, 17 nt, Human
uugaacuccugaccuca

SEQ ID NO: 1840541 - RNA, 18 nt, Human
uugaacuggguacuugug

SEQ ID NO: 1840542 - RNA, 12 nt, Human
uucagauauaaa

SEQ ID NO: 1840543 - RNA, 14 nt, Human
uucagcucacugca

SEQ ID NO: 1840544 - RNA, 19 nt, Human
uucagauauaaaagacuga

SEQ ID NO: 1840545 - RNA, 14 nt, Human
uucagauauaaaag

SEQ ID NO: 1840546 - RNA, 15 nt, Human
uucagauauaaaaga

SEQ ID NO: 1840547 - RNA, 17 nt, Human
uucagacagcugccugg

SEQ ID NO: 1840548 - RNA, 16 nt, Human
uucagacagcugccug

SEQ ID NO: 1840549 - RNA, 15 nt, Human
uucagacagcugccu

SEQ ID NO: 1840550 - RNA, 14 nt, Human
uucagacagcugcc

SEQ ID NO: 1840551 - RNA, 17 nt, Human
uucacggaagagccuug

SEQ ID NO: 1840552 - RNA, 22 nt, Human
uucaccuuuguccccaccgcag

SEQ ID NO: 1840553 - RNA, 13 nt, Human
uucacggaagagc

SEQ ID NO: 1840554 - RNA, 22 nt, Human
uucacaagacccaaaaggcaga

SEQ ID NO: 1840555 - RNA, 21 nt, Human
uucacaaccuucuguggcuca

SEQ ID NO: 1840556 - RNA, 13 nt, Human
uucacccuuuucu

SEQ ID NO: 1840557 - RNA, 20 nt, Human
uucaccuuuguccccaccgc

SEQ ID NO: 1840558 - RNA, 19 nt, Human
uucaccuuuguccccaccg

SEQ ID NO: 1840559 - RNA, 14 nt, Human
uucaccuuuguccc

SEQ ID NO: 1840560 - RNA, 22 nt, Human
uucaauaggaaaaacugauuuu

SEQ ID NO: 1840561 - RNA, 21 nt, Human
uucaauaggaaaaacugauuu

SEQ ID NO: 1840562 - RNA, 15 nt, Human
uucaaccauucccca

SEQ ID NO: 1840563 - RNA, 18 nt, Human
uucaaaugcuguaacuuu

SEQ ID NO: 1840564 - RNA, 22 nt, Human
uuauuuuggaaaauaaauuauu

SEQ ID NO: 1840565 - RNA, 17 nt, Human
uuauuuuaauucaguug

SEQ ID NO: 1840566 - RNA, 18 nt, Human
uuauuuuauuaugcauga

SEQ ID NO: 1840567 - RNA, 22 nt, Human
uucagcuuguaaauagcucagg

SEQ ID NO: 1840568 - RNA, 14 nt, Human
uucaguggcagcug

SEQ ID NO: 1840569 - RNA, 22 nt, Human
uucagcuccagcucaccagccc

SEQ ID NO: 1840570 - RNA, 12 nt, Human
uucagcuccagc

SEQ ID NO: 1840571 - RNA, 15 nt, Human
uucagcuccagcuca

SEQ ID NO: 1840572 - RNA, 13 nt, Human
uucaguguacaug

SEQ ID NO: 1840573 - RNA, 12 nt, Human
uucaguguacau

SEQ ID NO: 1840574 - RNA, 17 nt, Human
uucaguggcagcugcuu

SEQ ID NO: 1840575 - RNA, 15 nt, Human
uucaguggcagcugc

SEQ ID NO: 1840576 - RNA, 16 nt, Human
uucaguggcagcugcu

SEQ ID NO: 1840577 - RNA, 19 nt, Human
uucauccuccucagaucuu

SEQ ID NO: 1840578 - RNA, 15 nt, Human
uucauccuccucaga

SEQ ID NO: 1840579 - RNA, 15 nt, Human
uucauaaccuagccu

SEQ ID NO: 1840580 - RNA, 20 nt, Human
uucauaaauaaaguuuguug

SEQ ID NO: 1840581 - RNA, 23 nt, Human
uucaguuauuauauuuacaaaug

SEQ ID NO: 1840582 - RNA, 19 nt, Human
uuccaacccucaucaccaa

SEQ ID NO: 1840583 - RNA, 13 nt, Human
uuccagagccuca

SEQ ID NO: 1840584 - RNA, 15 nt, Human
uuccauggacuuugu

SEQ ID NO: 1840585 - RNA, 14 nt, Human
uuccauggacuuug

SEQ ID NO: 1840586 - RNA, 16 nt, Human
uuccaaaguacacugu

SEQ ID NO: 1840587 - RNA, 13 nt, Human
uuccaaaguacac

SEQ ID NO: 1840588 - RNA, 11 nt, Human
uuauacauaaa

SEQ ID NO: 1840589 - RNA, 13 nt, Human
uuauacauaaaca

SEQ ID NO: 1840590 - RNA, 16 nt, Human
uuauauuaugaagcuu

SEQ ID NO: 1840591 - RNA, 15 nt, Human
uuauaauaauguuaa

SEQ ID NO: 1840592 - RNA, 18 nt, Human
uuauaauaauguuaacau

SEQ ID NO: 1840593 - RNA, 15 nt, Human
uuauaaugaaugaaa

SEQ ID NO: 1840594 - RNA, 21 nt, Human
uuauaauuuuaaauguuuuuu

SEQ ID NO: 1840595 - RNA, 17 nt, Human
uuauaauuuuaaauguu

SEQ ID NO: 1840596 - RNA, 12 nt, Human
uuauaauuuuaa

SEQ ID NO: 1840597 - RNA, 12 nt, Human
uuauaauuuaaa

SEQ ID NO: 1840598 - RNA, 15 nt, Human
ugugaaaagaaaaau

SEQ ID NO: 1840599 - RNA, 13 nt, Human
ugugaaaagaaaa

SEQ ID NO: 1840600 - RNA, 17 nt, Human
ugugaaaagaaaaauga

SEQ ID NO: 1840601 - RNA, 21 nt, Human
ugugaaaagaaaaaugagccu

SEQ ID NO: 1840602 - RNA, 19 nt, Human
uuagugaccucagcuuuga

SEQ ID NO: 1840603 - RNA, 16 nt, Human
uuauggcuuuugugca

SEQ ID NO: 1840604 - RNA, 14 nt, Human
uuauggcacaucag

SEQ ID NO: 1840605 - RNA, 17 nt, Human
uuauguugcauagaaua

SEQ ID NO: 1840606 - RNA, 18 nt, Human
uuauggcuuuugugcauu

SEQ ID NO: 1840607 - RNA, 17 nt, Human
uuauggcuuuugugcau

SEQ ID NO: 1840608 - RNA, 20 nt, Human
uuauggaacacucugagacu

SEQ ID NO: 1840609 - RNA, 18 nt, Human
uuauggaacacucugaga

SEQ ID NO: 1840610 - RNA, 21 nt, Human
uuauggacaaugacccagugg

SEQ ID NO: 1840611 - RNA, 17 nt, Human
uuauggaacacucugag

SEQ ID NO: 1840612 - RNA, 16 nt, Human
uuaugauuuuuaaaga

SEQ ID NO: 1840613 - RNA, 19 nt, Human
uuaugauuuuuaaagaaaa

SEQ ID NO: 1840614 - RNA, 21 nt, Human
uuauuaaaugcccagccccuu

SEQ ID NO: 1840615 - RNA, 19 nt, Human
uuauuaaaugcccagcccc

SEQ ID NO: 1840616 - RNA, 23 nt, Human
uuauuaaaaaucucaaauuucua

SEQ ID NO: 1840617 - RNA, 16 nt, Human
uuauauuuacaaaugg

SEQ ID NO: 1840618 - RNA, 14 nt, Human
uuaucuagauacug

SEQ ID NO: 1840619 - RNA, 16 nt, Human
uuaucuugaauaaugu

SEQ ID NO: 1840620 - RNA, 14 nt, Human
uuaucuugaauaau

SEQ ID NO: 1840621 - RNA, 15 nt, Human
aaaaaauauuuuccu

SEQ ID NO: 1840622 - RNA, 18 nt, Human
acucugucucaguccaug

SEQ ID NO: 1840623 - RNA, 20 nt, Human
acucugucucaguccaugaa

SEQ ID NO: 1840624 - RNA, 15 nt, Human
acuggagaaaaugga

SEQ ID NO: 1840625 - RNA, 18 nt, Human
acugguaggaaacuaggu

SEQ ID NO: 1840626 - RNA, 15 nt, Human
acugcccccucugcc

SEQ ID NO: 1840627 - RNA, 14 nt, Human
acugcccccucugc

SEQ ID NO: 1840628 - RNA, 19 nt, Human
acuggaagcacagcuucau

SEQ ID NO: 1840629 - RNA, 17 nt, Human
acugcccccucugcccu

SEQ ID NO: 1840630 - RNA, 16 nt, Human
acugcccccucugccc

SEQ ID NO: 1840631 - RNA, 17 nt, Human
acuggaagcacagcuuc

SEQ ID NO: 1840632 - RNA, 23 nt, Human
acugucucaagagggcacuggug

SEQ ID NO: 1840633 - RNA, 21 nt, Human
acugucucaagagggcacugg

SEQ ID NO: 1840634 - RNA, 20 nt, Human
acugucucaagagggcacug

SEQ ID NO: 1840635 - RNA, 18 nt, Human
acugguuccauggccucu

SEQ ID NO: 1840636 - RNA, 19 nt, Human
acugucucaagagggcacu

SEQ ID NO: 1840637 - RNA, 20 nt, Human
acugugcugagucugaaggc

SEQ ID NO: 1840638 - RNA, 22 nt, Human
acugugcugagucugaaggcug

SEQ ID NO: 1840639 - RNA, 12 nt, Human
acuucagacaua

SEQ ID NO: 1840640 - RNA, 15 nt, Human
acuugggccacugug

SEQ ID NO: 1840641 - RNA, 14 nt, Human
acuugggccacugu

SEQ ID NO: 1840642 - RNA, 16 nt, Human
acuugguuuuuaaaaa

SEQ ID NO: 1840643 - RNA, 16 nt, Human
acuuuucuuucagcca

SEQ ID NO: 1840644 - RNA, 23 nt, Human
acuuuuauuuccagugaaaucag

SEQ ID NO: 1840645 - RNA, 23 nt, Human
acuuuuaugauacuugaaaauua

SEQ ID NO: 1840646 - RNA, 20 nt, Human
acuuuucauaaccuagccuu

SEQ ID NO: 1840647 - RNA, 14 nt, Human
acuuuucuuugugg

SEQ ID NO: 1840648 - RNA, 15 nt, Human
agaaaauaccaagga

SEQ ID NO: 1840649 - RNA, 19 nt, Human
agaaaauaguggugugauu

SEQ ID NO: 1840650 - RNA, 16 nt, Human
agaaaaucaggcuggc

SEQ ID NO: 1840651 - RNA, 13 nt, Human
acuuuuauaaacu

SEQ ID NO: 1840652 - RNA, 16 nt, Human
acuuuuaugauacuug

SEQ ID NO: 1840653 - RNA, 12 nt, Human
acuuuuaugaua

SEQ ID NO: 1840654 - RNA, 19 nt, Human
acuuuguucuggcucuucc

SEQ ID NO: 1840655 - RNA, 20 nt, Human
acuuuguucuggcucuucca

SEQ ID NO: 1840656 - RNA, 22 nt, Human
acuuuaucuugaauaauguaag

SEQ ID NO: 1840657 - RNA, 17 nt, Human
acuuuguucuggcucuu

SEQ ID NO: 1840658 - RNA, 16 nt, Human
acuuuguucuggcucu

SEQ ID NO: 1840659 - RNA, 22 nt, Human
acuuuauuuucuauaauuuaaa

SEQ ID NO: 1840660 - RNA, 23 nt, Human
agaaaguacuucuccacccugcu

SEQ ID NO: 1840661 - RNA, 22 nt, Human
agaaaguacuucuccacccugc

SEQ ID NO: 1840662 - RNA, 16 nt, Human
agaaaggauaaaguug

SEQ ID NO: 1840663 - RNA, 14 nt, Human
agaaaguucaugcu

SEQ ID NO: 1840664 - RNA, 21 nt, Human
accucugcagcaauaaagcag

SEQ ID NO: 1840665 - RNA, 18 nt, Human
accucugcagcaauaaag

SEQ ID NO: 1840666 - RNA, 20 nt, Human
accucugcagcaauaaagca

SEQ ID NO: 1840667 - RNA, 15 nt, Human
accucugcagcaaua

SEQ ID NO: 1840668 - RNA, 20 nt, Human
accugcccugcugaguccca

SEQ ID NO: 1840669 - RNA, 15 nt, Human
accugucccccugac

SEQ ID NO: 1840670 - RNA, 12 nt, Human
accugucccccu

SEQ ID NO: 1840671 - RNA, 16 nt, Human
accugucccccugaca

SEQ ID NO: 1840672 - RNA, 15 nt, Human
accuuuaagagaaau

SEQ ID NO: 1840673 - RNA, 18 nt, Human
accuuucccaucuuccaa

SEQ ID NO: 1840674 - RNA, 13 nt, Human
accuuucccaucu

SEQ ID NO: 1840675 - RNA, 17 nt, Human
accuuggcugcagggag

SEQ ID NO: 1840676 - RNA, 18 nt, Human
accuuggcugcagggagu

SEQ ID NO: 1840677 - RNA, 11 nt, Human
acgugaguccu

SEQ ID NO: 1840678 - RNA, 14 nt, Human
acgcugugcugccc

SEQ ID NO: 1840679 - RNA, 12 nt, Human
acgcugugcugc

SEQ ID NO: 1840680 - RNA, 11 nt, Human
acgcugugcug

SEQ ID NO: 1840681 - RNA, 13 nt, Human
acgucugacaggc

SEQ ID NO: 1840682 - RNA, 14 nt, Human
acgucugacaggca

SEQ ID NO: 1840683 - RNA, 15 nt, Human
acgucugacaggcaa

SEQ ID NO: 1840684 - RNA, 17 nt, Human
acucuagggaaaaacca

SEQ ID NO: 1840685 - RNA, 15 nt, Human
acucuagggaaaaac

SEQ ID NO: 1840686 - RNA, 17 nt, Human
acucuauguucuaagaa

SEQ ID NO: 1840687 - RNA, 23 nt, Human
acucuaucaaguauuauaccuuu

SEQ ID NO: 1840688 - RNA, 19 nt, Human
acucugucgcccagucugg

SEQ ID NO: 1840689 - RNA, 18 nt, Human
acucaaaagcugggcagg

SEQ ID NO: 1840690 - RNA, 13 nt, Human
acucaaaagcugg

SEQ ID NO: 1840691 - RNA, 18 nt, Human
acuauuuuucagaaucuc

SEQ ID NO: 1840692 - RNA, 19 nt, Human
acucaguccauagcagaga

SEQ ID NO: 1840693 - RNA, 21 nt, Human
acaggaugaugacuauggaaa

SEQ ID NO: 1840694 - RNA, 18 nt, Human
acaggcaaugcuggcugu

SEQ ID NO: 1840695 - RNA, 12 nt, Human
acaggcaagcac

SEQ ID NO: 1840696 - RNA, 16 nt, Human
acagcucuucuccagg

SEQ ID NO: 1840697 - RNA, 17 nt, Human
acagcucuucuccaggc

SEQ ID NO: 1840698 - RNA, 15 nt, Human
acaggaucagucuga

SEQ ID NO: 1840699 - RNA, 18 nt, Human
acagcucuucuccaggcu

SEQ ID NO: 1840700 - RNA, 18 nt, Human
acagccacggccaggcca

SEQ ID NO: 1840701 - RNA, 15 nt, Human
acagccacggccagg

SEQ ID NO: 1840702 - RNA, 16 nt, Human
acagccacggccaggc

SEQ ID NO: 1840703 - RNA, 17 nt, Human
acagccacggccaggcc

SEQ ID NO: 1840704 - RNA, 14 nt, Human
acacugcauguuug

SEQ ID NO: 1840705 - RNA, 15 nt, Human
acacugcauguuugu

SEQ ID NO: 1840706 - RNA, 15 nt, Human
acacuguacugcaau

SEQ ID NO: 1840707 - RNA, 13 nt, Human
acagacaaagcgu

SEQ ID NO: 1840708 - RNA, 11 nt, Human
acagacacagg

SEQ ID NO: 1840709 - RNA, 15 nt, Human
acagacacaggcccg

SEQ ID NO: 1840710 - RNA, 19 nt, Human
acagaggcagccccauucu

SEQ ID NO: 1840711 - RNA, 23 nt, Human
acagaggcagccccauucugccu

SEQ ID NO: 1840712 - RNA, 13 nt, Human
acagacacaggcc

SEQ ID NO: 1840713 - RNA, 14 nt, Human
acagacacaggccc

SEQ ID NO: 1840714 - RNA, 14 nt, Human
acagaggcagcccc

SEQ ID NO: 1840715 - RNA, 15 nt, Human
acagaggcagcccca

SEQ ID NO: 1840716 - RNA, 17 nt, Human
acagccaacuauggccu

SEQ ID NO: 1840717 - RNA, 19 nt, Human
acagccaacuauggccugu

SEQ ID NO: 1840718 - RNA, 14 nt, Human
acagaggggguggc

SEQ ID NO: 1840719 - RNA, 15 nt, Human
acagagugagacucu

SEQ ID NO: 1840720 - RNA, 23 nt, Human
acagagucucacuguugcccagg

SEQ ID NO: 1840721 - RNA, 19 nt, Human
acagagugagacucugucu

SEQ ID NO: 1840722 - RNA, 17 nt, Human
acacagauuugagcuca

SEQ ID NO: 1840723 - RNA, 20 nt, Human
acacagcucuguccugggag

SEQ ID NO: 1840724 - RNA, 19 nt, Human
acacagaggcugccucucc

SEQ ID NO: 1840725 - RNA, 12 nt, Human
acacauuuuucu

SEQ ID NO: 1840726 - RNA, 14 nt, Human
acacauuuuucaga

SEQ ID NO: 1840727 - RNA, 20 nt, Human
acacauuuuuuaaaugcacc

SEQ ID NO: 1840728 - RNA, 22 nt, Human
acacauuuuuuaaaugcaccug

SEQ ID NO: 1840729 - RNA, 21 nt, Human
acacauuuuauuuuauuaugc

SEQ ID NO: 1840730 - RNA, 22 nt, Human
acacauuuuauuuuauuaugca

SEQ ID NO: 1840731 - RNA, 11 nt, Human
acacagcucuu

SEQ ID NO: 1840732 - RNA, 13 nt, Human
acacagcucuucu

SEQ ID NO: 1840733 - RNA, 14 nt, Human
acacgcuccuuccu

SEQ ID NO: 1840734 - RNA, 16 nt, Human
acacgcuccuuccucu

SEQ ID NO: 1840735 - RNA, 15 nt, Human
acacgcgugcacaca

SEQ ID NO: 1840736 - RNA, 17 nt, Human
acacgcgugcacacacc

SEQ ID NO: 1840737 - RNA, 15 nt, Human
acaaggcaaggcugu

SEQ ID NO: 1840738 - RNA, 22 nt, Human
acaaaauguaggguuauaauaa

SEQ ID NO: 1840739 - RNA, 14 nt, Human
acaaggcaaggcug

SEQ ID NO: 1840740 - RNA, 12 nt, Human
acaaggcaaggc

SEQ ID NO: 1840741 - RNA, 13 nt, Human
acaagaaaugaaa

SEQ ID NO: 1840742 - RNA, 17 nt, Human
acaaggauugcuacugu

SEQ ID NO: 1840743 - RNA, 17 nt, Human
accagccaguaaauggg

SEQ ID NO: 1840744 - RNA, 15 nt, Human
accagcccagacccu

SEQ ID NO: 1840745 - RNA, 13 nt, Human
accagcagaaaug

SEQ ID NO: 1840746 - RNA, 19 nt, Human
accagagcugccaccugcc

SEQ ID NO: 1840747 - RNA, 13 nt, Human
accagaucauugu

SEQ ID NO: 1840748 - RNA, 12 nt, Human
accaagcccagu

SEQ ID NO: 1840749 - RNA, 19 nt, Human
acauuuguucuauagcuuu

SEQ ID NO: 1840750 - RNA, 15 nt, Human
acauuuauucugcuc

SEQ ID NO: 1840751 - RNA, 14 nt, Human
acauuuauucugcu

SEQ ID NO: 1840752 - RNA, 23 nt, Human
acauaaugcgugcauaccacuuu

SEQ ID NO: 1840753 - RNA, 22 nt, Human
acauaaugcgugcauaccacuu

SEQ ID NO: 1840754 - RNA, 21 nt, Human
acauaaugcgugcauaccacu

SEQ ID NO: 1840755 - RNA, 19 nt, Human
acaggcaaugcuggcuguu

SEQ ID NO: 1840756 - RNA, 23 nt, Human
acaggcaaugcuggcuguuggcu

SEQ ID NO: 1840757 - RNA, 19 nt, Human
acaggguuuugccauguug

SEQ ID NO: 1840758 - RNA, 22 nt, Human
acauguuucuuuguaaugaaaa

SEQ ID NO: 1840759 - RNA, 19 nt, Human
acauguuucuuuguaauga

SEQ ID NO: 1840760 - RNA, 23 nt, Human
acauguuucuuuguaaugaaaac

SEQ ID NO: 1840761 - RNA, 15 nt, Human
acaucagcacgauuu

SEQ ID NO: 1840762 - RNA, 17 nt, Human
acaucagcacgauuucu

SEQ ID NO: 1840763 - RNA, 18 nt, Human
acaucagcacgauuucug

SEQ ID NO: 1840764 - RNA, 19 nt, Human
acaucagcacgauuucugu

SEQ ID NO: 1840765 - RNA, 19 nt, Human
acaugaucuucuuuauaau

SEQ ID NO: 1840766 - RNA, 16 nt, Human
acaugugcacaugcac

SEQ ID NO: 1840767 - RNA, 18 nt, Human
acaugugcacaugcacgu

SEQ ID NO: 1840768 - RNA, 17 nt, Human
accccucauagcccuca

SEQ ID NO: 1840769 - RNA, 16 nt, Human
accccuccaugugggc

SEQ ID NO: 1840770 - RNA, 19 nt, Human
accccuccaugugggcuag

SEQ ID NO: 1840771 - RNA, 14 nt, Human
accauauuaccaca

SEQ ID NO: 1840772 - RNA, 16 nt, Human
accauauuaccacaga

SEQ ID NO: 1840773 - RNA, 22 nt, Human
acccaagggccuggccugagcu

SEQ ID NO: 1840774 - RNA, 19 nt, Human
acccaagggccuggccuga

SEQ ID NO: 1840775 - RNA, 18 nt, Human
acccaagggccuggccug

SEQ ID NO: 1840776 - RNA, 20 nt, Human
accauauuaccacagacaua

SEQ ID NO: 1840777 - RNA, 21 nt, Human
acccacaagaaaugaaagcag

SEQ ID NO: 1840778 - RNA, 17 nt, Human
acccacaagaaaugaaa

SEQ ID NO: 1840779 - RNA, 23 nt, Human
acccaagggccuggccugagcug

SEQ ID NO: 1840780 - RNA, 13 nt, Human
acccaccucagcc

SEQ ID NO: 1840781 - RNA, 14 nt, Human
acccaccucagccu

SEQ ID NO: 1840782 - RNA, 15 nt, Human
acccaccucagccuc

SEQ ID NO: 1840783 - RNA, 16 nt, Human
acccaccucagccucc

SEQ ID NO: 1840784 - RNA, 11 nt, Human
acccccugaau

SEQ ID NO: 1840785 - RNA, 17 nt, Human
acccccugcaaagccca

SEQ ID NO: 1840786 - RNA, 14 nt, Human
acccccugcaaagc

SEQ ID NO: 1840787 - RNA, 20 nt, Human
acccccugcaaagcccagcu

SEQ ID NO: 1840788 - RNA, 18 nt, Human
acccccugcaaagcccag

SEQ ID NO: 1840789 - RNA, 22 nt, Human
acccccugcaaagcccagcuug

SEQ ID NO: 1840790 - RNA, 18 nt, Human
aaaaguucugcagauaaa

SEQ ID NO: 1840791 - RNA, 17 nt, Human
aaaauaaaacuuuuuaa

SEQ ID NO: 1840792 - RNA, 19 nt, Human
aaaauaaaauuaaagcuga

SEQ ID NO: 1840793 - RNA, 22 nt, Human
aaaaucccuuaccucggugccu

SEQ ID NO: 1840794 - RNA, 21 nt, Human
aaaaucuacacuccagugaga

SEQ ID NO: 1840795 - RNA, 15 nt, Human
aaaaagaaaggaggg

SEQ ID NO: 1840796 - RNA, 21 nt, Human
aaacacugggagaaaugaaaa

SEQ ID NO: 1840797 - RNA, 22 nt, Human
aaacacugggagaaaugaaaaa

SEQ ID NO: 1840798 - RNA, 16 nt, Human
aaacacuguucucugc

SEQ ID NO: 1840799 - RNA, 19 nt, Human
aaaaucucaaauuucuaaa

SEQ ID NO: 1840800 - RNA, 22 nt, Human
aaaaucucaaauuucuaaaucu

SEQ ID NO: 1840801 - RNA, 21 nt, Human
aaaauugaugggauuugguca

SEQ ID NO: 1840802 - RNA, 17 nt, Human
aaagauauuuugcuuug

SEQ ID NO: 1840803 - RNA, 20 nt, Human
aaagauauuuugcuuuguga

SEQ ID NO: 1840804 - RNA, 12 nt, Human
aaagauauuuug

SEQ ID NO: 1840805 - RNA, 16 nt, Human
aaagauauuuugcuuu

SEQ ID NO: 1840806 - RNA, 14 nt, Human
aaagaguaggaaga

SEQ ID NO: 1840807 - RNA, 20 nt, Human
aaagaagguuucagaaagaa

SEQ ID NO: 1840808 - RNA, 19 nt, Human
aaagaguguggcaaaauaa

SEQ ID NO: 1840809 - RNA, 17 nt, Human
aaagaaauauaccuaaa

SEQ ID NO: 1840810 - RNA, 15 nt, Human
aaagaaauauaccua

SEQ ID NO: 1840811 - RNA, 18 nt, Human
aaaccaucauugaaaucu

SEQ ID NO: 1840812 - RNA, 18 nt, Human
aaacucuccucugcugcu

SEQ ID NO: 1840813 - RNA, 24 nt, Human
aaacccucgaggcggaucuuugga

SEQ ID NO: 1840814 - RNA, 13 nt, Human
aaacccucgaggc

SEQ ID NO: 1840815 - RNA, 16 nt, Human
aaacccuauugguaaa

SEQ ID NO: 1840816 - RNA, 19 nt, Human
aaagcccuuaggaagaauu

SEQ ID NO: 1840817 - RNA, 13 nt, Human
aaagcccugugcu

SEQ ID NO: 1840818 - RNA, 16 nt, Human
aaagccuccuccagcc

SEQ ID NO: 1840819 - RNA, 23 nt, Human
aaagcccuuccaugucgccucug

SEQ ID NO: 1840820 - RNA, 22 nt, Human
aaagcccuuccaugucgccucu

SEQ ID NO: 1840821 - RNA, 14 nt, Human
aaagcccugugcuc

SEQ ID NO: 1840822 - RNA, 16 nt, Human
aaaggcuccaggagca

SEQ ID NO: 1840823 - RNA, 15 nt, Human
aaaggcuccaggagc

SEQ ID NO: 1840824 - RNA, 14 nt, Human
aaaggcagaagcaa

SEQ ID NO: 1840825 - RNA, 20 nt, Human
aaaggcuccaggagcagcca

SEQ ID NO: 1840826 - RNA, 19 nt, Human
aaaggcuccaggagcagcc

SEQ ID NO: 1840827 - RNA, 13 nt, Human
aaaguggaaaaau

SEQ ID NO: 1840828 - RNA, 19 nt, Human
aaauaaaacuuuuuaaaau

SEQ ID NO: 1840829 - RNA, 13 nt, Human
aaauaaaacuuuu

SEQ ID NO: 1840830 - RNA, 16 nt, Human
aaauaaaacuuuuuaa

SEQ ID NO: 1840831 - RNA, 19 nt, Human
aaaucaaugcuauaacuau

SEQ ID NO: 1840832 - RNA, 24 nt, Human
aaauagcucaggugucccugcacu

SEQ ID NO: 1840833 - RNA, 19 nt, Human
aaauaguggugugauuugg

SEQ ID NO: 1840834 - RNA, 21 nt, Human
aacuuuaugcuaagugaaaua

SEQ ID NO: 1840835 - RNA, 20 nt, Human
aacuuuaugcuaagugaaau

SEQ ID NO: 1840836 - RNA, 15 nt, Human
aacuuaaucuaaaug

SEQ ID NO: 1840837 - RNA, 16 nt, Human
aacuuaaucuaaaugg

SEQ ID NO: 1840838 - RNA, 18 nt, Human
aacuuaaucuaaauggaa

SEQ ID NO: 1840839 - RNA, 16 nt, Human
aacugagugccuuuug

SEQ ID NO: 1840840 - RNA, 14 nt, Human
aacugauaaagaug

SEQ ID NO: 1840841 - RNA, 11 nt, Human
aacgcagcccu

SEQ ID NO: 1840842 - RNA, 21 nt, Human
aacccuuggagccaauggaga

SEQ ID NO: 1840843 - RNA, 15 nt, Human
aacccuauugguaaa

SEQ ID NO: 1840844 - RNA, 13 nt, Human
aaccacgcuggac

SEQ ID NO: 1840845 - RNA, 15 nt, Human
aaccacuucagcuga

SEQ ID NO: 1840846 - RNA, 22 nt, Human
aaccacuggaaaguuuaugguu

SEQ ID NO: 1840847 - RNA, 18 nt, Human
aacaaauuuacagagaca

SEQ ID NO: 1840848 - RNA, 17 nt, Human
aaauuuuuuuuguuuca

SEQ ID NO: 1840849 - RNA, 18 nt, Human
aaauuuuuuuuguuucau

SEQ ID NO: 1840850 - RNA, 21 nt, Human
aaauucuugcaaaguaucccu

SEQ ID NO: 1840851 - RNA, 17 nt, Human
aaauuaaagcugaaaac

SEQ ID NO: 1840852 - RNA, 13 nt, Human
aaauuaaagcuga

SEQ ID NO: 1840853 - RNA, 14 nt, Human
aaauugcuccuuga

SEQ ID NO: 1840854 - RNA, 13 nt, Human
aaauugcuccuug

SEQ ID NO: 1840855 - RNA, 19 nt, Human
aaauugacacuuaaaaaug

SEQ ID NO: 1840856 - RNA, 15 nt, Human
aaaugccuuuguacu

SEQ ID NO: 1840857 - RNA, 17 nt, Human
aaaucuuauaauuuaaa

SEQ ID NO: 1840858 - RNA, 21 nt, Human
aagcgauucuucugcuucagc

SEQ ID NO: 1840859 - RNA, 12 nt, Human
aaggcagggagg

SEQ ID NO: 1840860 - RNA, 15 nt, Human
aaggauguucuagca

SEQ ID NO: 1840861 - RNA, 15 nt, Human
aaggauugcuacugu

SEQ ID NO: 1840862 - RNA, 19 nt, Human
aaggacagccccuccucca

SEQ ID NO: 1840863 - RNA, 13 nt, Human
aaggacagccccu

SEQ ID NO: 1840864 - RNA, 13 nt, Human
aaggacacuagaa

SEQ ID NO: 1840865 - RNA, 18 nt, Human
aagcuguguggcagucug

SEQ ID NO: 1840866 - RNA, 18 nt, Human
aagcuggucccacucagu

SEQ ID NO: 1840867 - RNA, 21 nt, Human
aagcuggucccacucagucca

SEQ ID NO: 1840868 - RNA, 14 nt, Human
aagcagcguuucua

SEQ ID NO: 1840869 - RNA, 17 nt, Human
aagcagcguuucuauga

SEQ ID NO: 1840870 - RNA, 20 nt, Human
aagcagcguuucuaugacac

SEQ ID NO: 1840871 - RNA, 21 nt, Human
aagcagcguuucuaugacaca

SEQ ID NO: 1840872 - RNA, 22 nt, Human
aagcagcguuucuaugacacau

SEQ ID NO: 1840873 - RNA, 23 nt, Human
aagccagcaggcucucaggccag

SEQ ID NO: 1840874 - RNA, 20 nt, Human
aagccagcaggcucucaggc

SEQ ID NO: 1840875 - RNA, 14 nt, Human
aagauaaaugugcu

SEQ ID NO: 1840876 - RNA, 13 nt, Human
aagauaaaugugc

SEQ ID NO: 1840877 - RNA, 12 nt, Human
aagauaaaugug

SEQ ID NO: 1840878 - RNA, 19 nt, Human
aaguggaaaaauagccugc

SEQ ID NO: 1840879 - RNA, 21 nt, Human
aaguggaaaaauagccugccu

SEQ ID NO: 1840880 - RNA, 15 nt, Human
aagucuccaaagucu

SEQ ID NO: 1840881 - RNA, 21 nt, Human
aaguagaagucuuagauguau

SEQ ID NO: 1840882 - RNA, 18 nt, Human
aaguaucccuacuguaau

SEQ ID NO: 1840883 - RNA, 23 nt, Human
aaguaucccuacuguaauuugug

SEQ ID NO: 1840884 - RNA, 17 nt, Human
aaguaucccuacuguaa

SEQ ID NO: 1840885 - RNA, 15 nt, Human
aaguaguggagcccc

SEQ ID NO: 1840886 - RNA, 20 nt, Human
aaggugaggagcuugaaacc

SEQ ID NO: 1840887 - RNA, 20 nt, Human
aaguagaagucuuagaugua

SEQ ID NO: 1840888 - RNA, 19 nt, Human
aaguagaagucuuagaugu

SEQ ID NO: 1840889 - RNA, 18 nt, Human
aaguauccugcuucugau

SEQ ID NO: 1840890 - RNA, 14 nt, Human
aaguccacagugga

SEQ ID NO: 1840891 - RNA, 19 nt, Human
aaguccacaguggaaccag

SEQ ID NO: 1840892 - RNA, 18 nt, Human
aaguccucuuuucugaga

SEQ ID NO: 1840893 - RNA, 14 nt, Human
aagucuccaaaguc

SEQ ID NO: 1840894 - RNA, 22 nt, Human
aaguccucuuuucugagaggac

SEQ ID NO: 1840895 - RNA, 18 nt, Human
aaggucauuuuuuuuaag

SEQ ID NO: 1840896 - RNA, 19 nt, Human
aaggucauuuuuuuuaaga

SEQ ID NO: 1840897 - RNA, 18 nt, Human
aagggacgcuacccggga

SEQ ID NO: 1840898 - RNA, 22 nt, Human
aauguuuuuuuuuaaagacuuu

SEQ ID NO: 1840899 - RNA, 20 nt, Human
aauguuuuuuuuuaaagacu

SEQ ID NO: 1840900 - RNA, 15 nt, Human
aauguuuuuuuuuaa

SEQ ID NO: 1840901 - RNA, 19 nt, Human
aaugcgugcauaccacuuu

SEQ ID NO: 1840902 - RNA, 18 nt, Human
aaugcgugcauaccacuu

SEQ ID NO: 1840903 - RNA, 21 nt, Human
aaugcgcaggcuggcccugcc

SEQ ID NO: 1840904 - RNA, 22 nt, Human
aaugcgcaggcuggcccugccc

SEQ ID NO: 1840905 - RNA, 23 nt, Human
aaugccuuacccucauguucuua

SEQ ID NO: 1840906 - RNA, 23 nt, Human
aaugcuauaacuauguugauaaa

SEQ ID NO: 1840907 - RNA, 12 nt, Human
aauguuuccuuu

SEQ ID NO: 1840908 - RNA, 22 nt, Human
aauguuuacagauccccaagcc

SEQ ID NO: 1840909 - RNA, 13 nt, Human
aauguuuccuuua

SEQ ID NO: 1840910 - RNA, 15 nt, Human
aauguuugccucugc

SEQ ID NO: 1840911 - RNA, 16 nt, Human
aauguuugccucugcc

SEQ ID NO: 1840912 - RNA, 15 nt, Human
aaugugaaaagaaaa

SEQ ID NO: 1840913 - RNA, 17 nt, Human
aaugugaaaagaaaaau

SEQ ID NO: 1840914 - RNA, 22 nt, Human
aauacucuacccucuuagaaaa

SEQ ID NO: 1840915 - RNA, 20 nt, Human
aauacucuacccucuuagaa

SEQ ID NO: 1840916 - RNA, 21 nt, Human
aauauuagugaccucagcuuu

SEQ ID NO: 1840917 - RNA, 14 nt, Human
aaucaccgaaaacg

SEQ ID NO: 1840918 - RNA, 19 nt, Human
aaucacauucgaguguuuc

SEQ ID NO: 1840919 - RNA, 15 nt, Human
aaucaccgaaaacgu

SEQ ID NO: 1840920 - RNA, 13 nt, Human
aauagacaauuua

SEQ ID NO: 1840921 - RNA, 16 nt, Human
aauauauaucaaauau

SEQ ID NO: 1840922 - RNA, 18 nt, Human
aauccaagcaaaugugaa

SEQ ID NO: 1840923 - RNA, 17 nt, Human
aauccaagcaaauguga

SEQ ID NO: 1840924 - RNA, 22 nt, Human
aaugauccccagcuguuuaugc

SEQ ID NO: 1840925 - RNA, 19 nt, Human
aaugauccccagcuguuua

SEQ ID NO: 1840926 - RNA, 20 nt, Human
aaugauccccagcuguuuau

SEQ ID NO: 1840927 - RNA, 16 nt, Human
aaugauccccagcugu

SEQ ID NO: 1840928 - RNA, 17 nt, Human
aaucucaaauuucuaaa

SEQ ID NO: 1840929 - RNA, 18 nt, Human
aaucucaaauuucuaaau

SEQ ID NO: 1840930 - RNA, 16 nt, Human
aaucucuccauucccg

SEQ ID NO: 1840931 - RNA, 16 nt, Human
aaucucaaauuucuaa

SEQ ID NO: 1840932 - RNA, 15 nt, Human
aaucucaaauuucua

SEQ ID NO: 1840933 - RNA, 13 nt, Human
aauccagccugcu

SEQ ID NO: 1840934 - RNA, 19 nt, Human
aauccagacccggcugcgu

SEQ ID NO: 1840935 - RNA, 17 nt, Human
aauccagacccggcugc

SEQ ID NO: 1840936 - RNA, 15 nt, Human
aauccaaugaaauga

SEQ ID NO: 1840937 - RNA, 14 nt, Human
agagcccaggccuc

SEQ ID NO: 1840938 - RNA, 13 nt, Human
agagcccaggccu

SEQ ID NO: 1840939 - RNA, 15 nt, Human
agagcccaggccucc

SEQ ID NO: 1840940 - RNA, 16 nt, Human
agaggaaggagaggag

SEQ ID NO: 1840941 - RNA, 16 nt, Human
agaggagagaggaccc

SEQ ID NO: 1840942 - RNA, 15 nt, Human
agaggagagaggacc

SEQ ID NO: 1840943 - RNA, 14 nt, Human
agaggacuuuucuu

SEQ ID NO: 1840944 - RNA, 12 nt, Human
agagggcacaga

SEQ ID NO: 1840945 - RNA, 20 nt, Human
agaggguggugaccucugcc

SEQ ID NO: 1840946 - RNA, 22 nt, Human
agaggguggugaccucugccug

SEQ ID NO: 1840947 - RNA, 19 nt, Human
agaggguggugaccucugc

SEQ ID NO: 1840948 - RNA, 19 nt, Human
agaguggggauaugauuua

SEQ ID NO: 1840949 - RNA, 23 nt, Human
agaguggcuccucccggugccca

SEQ ID NO: 1840950 - RNA, 11 nt, Human
agagugggagc

SEQ ID NO: 1840951 - RNA, 19 nt, Human
agaguggcuccucccggug

SEQ ID NO: 1840952 - RNA, 23 nt, Human
agaggguggugaccucugccuga

SEQ ID NO: 1840953 - RNA, 14 nt, Human
agagugugccugaa

SEQ ID NO: 1840954 - RNA, 17 nt, Human
agaguguggcaaaauaa

SEQ ID NO: 1840955 - RNA, 14 nt, Human
agauggcugugccu

SEQ ID NO: 1840956 - RNA, 14 nt, Human
agaucuucuguggg

SEQ ID NO: 1840957 - RNA, 19 nt, Human
agauauaugcucugcaugu

SEQ ID NO: 1840958 - RNA, 15 nt, Human
agacagcccgggcuc

SEQ ID NO: 1840959 - RNA, 14 nt, Human
agacagcccgggcu

SEQ ID NO: 1840960 - RNA, 16 nt, Human
agacagcccgggcucu

SEQ ID NO: 1840961 - RNA, 21 nt, Human
agacagauacuccuccaaggu

SEQ ID NO: 1840962 - RNA, 15 nt, Human
agacagauacuccuc

SEQ ID NO: 1840963 - RNA, 17 nt, Human
agacgugauuuugcugu

SEQ ID NO: 1840964 - RNA, 22 nt, Human
agacgcugugcugcccugccca

SEQ ID NO: 1840965 - RNA, 18 nt, Human
agacggagucccaccuug

SEQ ID NO: 1840966 - RNA, 12 nt, Human
agacagcucuua

SEQ ID NO: 1840967 - RNA, 11 nt, Human
agacagcucuu

SEQ ID NO: 1840968 - RNA, 12 nt, Human
agacagcugccu

SEQ ID NO: 1840969 - RNA, 21 nt, Human
agacgcugugcugcccugccc

SEQ ID NO: 1840970 - RNA, 16 nt, Human
agagcccacgccccca

SEQ ID NO: 1840971 - RNA, 17 nt, Human
agagcccacgcccccac

SEQ ID NO: 1840972 - RNA, 13 nt, Human
agagcccacgccc

SEQ ID NO: 1840973 - RNA, 19 nt, Human
agagcccaccuuggcucaa

SEQ ID NO: 1840974 - RNA, 22 nt, Human
agagaggguggugaccucugcc

SEQ ID NO: 1840975 - RNA, 20 nt, Human
agagaggguggugaccucug

SEQ ID NO: 1840976 - RNA, 21 nt, Human
agagaggguggugaccucugc

SEQ ID NO: 1840977 - RNA, 19 nt, Human
agacuggaagcacagcuuc

SEQ ID NO: 1840978 - RNA, 17 nt, Human
agacuggaagcacagcu

SEQ ID NO: 1840979 - RNA, 16 nt, Human
agacuggaagcacagc

SEQ ID NO: 1840980 - RNA, 20 nt, Human
agccagcaggcucucaggcc

SEQ ID NO: 1840981 - RNA, 17 nt, Human
agccagcaggcucucag

SEQ ID NO: 1840982 - RNA, 19 nt, Human
agccagcaggcucucaggc

SEQ ID NO: 1840983 - RNA, 18 nt, Human
agccagcaggcucucagg

SEQ ID NO: 1840984 - RNA, 13 nt, Human
agccccagugccc

SEQ ID NO: 1840985 - RNA, 14 nt, Human
agccccagugccca

SEQ ID NO: 1840986 - RNA, 15 nt, Human
agccccagugcccac

SEQ ID NO: 1840987 - RNA, 17 nt, Human
agcccucacccuggggc

SEQ ID NO: 1840988 - RNA, 13 nt, Human
agccccauucugc

SEQ ID NO: 1840989 - RNA, 16 nt, Human
agccccauucugccug

SEQ ID NO: 1840990 - RNA, 13 nt, Human
agccgcuggggcc

SEQ ID NO: 1840991 - RNA, 21 nt, Human
agccgccaugcuccuggccca

SEQ ID NO: 1840992 - RNA, 14 nt, Human
agccuccuccagcc

SEQ ID NO: 1840993 - RNA, 20 nt, Human
agccucccgaguagcuggga

SEQ ID NO: 1840994 - RNA, 18 nt, Human
agccucccgaguagcugg

SEQ ID NO: 1840995 - RNA, 19 nt, Human
agccucccgaguagcuggg

SEQ ID NO: 1840996 - RNA, 21 nt, Human
agccgggcgugguggugagug

SEQ ID NO: 1840997 - RNA, 16 nt, Human
agccgugccuucagcu

SEQ ID NO: 1840998 - RNA, 15 nt, Human
agccgugccuucagc

SEQ ID NO: 1840999 - RNA, 22 nt, Human
agccucccacgacugcccggca

SEQ ID NO: 1841000 - RNA, 17 nt, Human
agccgugccuucagcuc

SEQ ID NO: 1841001 - RNA, 21 nt, Human
agccucccaaagugcugggau

SEQ ID NO: 1841002 - RNA, 17 nt, Human
agcacagacccugcccu

SEQ ID NO: 1841003 - RNA, 23 nt, Human
agcacacuugacaucaacugcau

SEQ ID NO: 1841004 - RNA, 19 nt, Human
agcacagacccugcccugu

SEQ ID NO: 1841005 - RNA, 18 nt, Human
agcacagacccugcccug

SEQ ID NO: 1841006 - RNA, 20 nt, Human
agcacagacccugcccugug

SEQ ID NO: 1841007 - RNA, 13 nt, Human
agcagcguuucua

SEQ ID NO: 1841008 - RNA, 20 nt, Human
agcagugcaugcugucccuu

SEQ ID NO: 1841009 - RNA, 19 nt, Human
agcagugcaugcugucccu

SEQ ID NO: 1841010 - RNA, 18 nt, Human
agcagugcaugcuguccc

SEQ ID NO: 1841011 - RNA, 23 nt, Human
agcaugccuggauggggcugcac

SEQ ID NO: 1841012 - RNA, 20 nt, Human
agcaugccuggauggggcug

SEQ ID NO: 1841013 - RNA, 23 nt, Human
agccaagugugguagagugugcc

SEQ ID NO: 1841014 - RNA, 22 nt, Human
agcauccuggcacccggccccu

SEQ ID NO: 1841015 - RNA, 23 nt, Human
agcauccuggcacccggccccug

SEQ ID NO: 1841016 - RNA, 21 nt, Human
agcuuuucccuuuuuuuaagu

SEQ ID NO: 1841017 - RNA, 20 nt, Human
aggaauccagacccggcugc

SEQ ID NO: 1841018 - RNA, 21 nt, Human
aggaaucaugugccaagcaga

SEQ ID NO: 1841019 - RNA, 17 nt, Human
aggaauccagacccggc

SEQ ID NO: 1841020 - RNA, 13 nt, Human
aggaccucaggug

SEQ ID NO: 1841021 - RNA, 18 nt, Human
aggaguggguugauuuca

SEQ ID NO: 1841022 - RNA, 21 nt, Human
aggaugcuuguacauaaugcg

SEQ ID NO: 1841023 - RNA, 23 nt, Human
aggaugcuuguacauaaugcgug

SEQ ID NO: 1841024 - RNA, 14 nt, Human
aggauuauuggaaa

SEQ ID NO: 1841025 - RNA, 20 nt, Human
aggauuaaauaauguaaaua

SEQ ID NO: 1841026 - RNA, 14 nt, Human
aggauuaaauaaug

SEQ ID NO: 1841027 - RNA, 18 nt, Human
aggauguucugggacaca

SEQ ID NO: 1841028 - RNA, 22 nt, Human
aggauguucuagcauggcugcc

SEQ ID NO: 1841029 - RNA, 22 nt, Human
aggauguacaaggacagccccu

SEQ ID NO: 1841030 - RNA, 15 nt, Human
aggauguucugggac

SEQ ID NO: 1841031 - RNA, 16 nt, Human
aggauguucugggaca

SEQ ID NO: 1841032 - RNA, 23 nt, Human
agcugagauuauaggcaccuacc

SEQ ID NO: 1841033 - RNA, 12 nt, Human
agcuccuucugu

SEQ ID NO: 1841034 - RNA, 13 nt, Human
agcuccuucuguc

SEQ ID NO: 1841035 - RNA, 20 nt, Human
agcuccgcuuucuacccagc

SEQ ID NO: 1841036 - RNA, 21 nt, Human
agcuccgcuuucuacccagcg

SEQ ID NO: 1841037 - RNA, 23 nt, Human
agcuccgcuuucuacccagcgag

SEQ ID NO: 1841038 - RNA, 19 nt, Human
agcuucuguugcugccuca

SEQ ID NO: 1841039 - RNA, 23 nt, Human
agcugcgguccacccaggagccc

SEQ ID NO: 1841040 - RNA, 17 nt, Human
agggacgcuacccggga

SEQ ID NO: 1841041 - RNA, 23 nt, Human
agggacagaggggguggccuccc

SEQ ID NO: 1841042 - RNA, 22 nt, Human
agggacagaggggguggccucc

SEQ ID NO: 1841043 - RNA, 21 nt, Human
aggcugucaauuacaggaagu

SEQ ID NO: 1841044 - RNA, 20 nt, Human
aggcugucaauuacaggaag

SEQ ID NO: 1841045 - RNA, 13 nt, Human
aggcuguauccca

SEQ ID NO: 1841046 - RNA, 18 nt, Human
aggcuguaucccaugagc

SEQ ID NO: 1841047 - RNA, 21 nt, Human
aggcccuucucuccagccccu

SEQ ID NO: 1841048 - RNA, 20 nt, Human
aggcccuucucuccagcccc

SEQ ID NO: 1841049 - RNA, 18 nt, Human
aggcccuuccucuccacu

SEQ ID NO: 1841050 - RNA, 17 nt, Human
aggcccuuccucuccac

SEQ ID NO: 1841051 - RNA, 15 nt, Human
aggcccuuccucucc

SEQ ID NO: 1841052 - RNA, 13 nt, Human
aggcccuuccucu

SEQ ID NO: 1841053 - RNA, 23 nt, Human
aggcccuucucuccagccccugg

SEQ ID NO: 1841054 - RNA, 22 nt, Human
aggcccuucucuccagccccug

SEQ ID NO: 1841055 - RNA, 19 nt, Human
aggcccuuccucuccacug

SEQ ID NO: 1841056 - RNA, 21 nt, Human
aggcuagaaccaccugccuau

SEQ ID NO: 1841057 - RNA, 23 nt, Human
aggcuacuguaaggcaaucaugg

SEQ ID NO: 1841058 - RNA, 21 nt, Human
aggcgugagccaccgugccug

SEQ ID NO: 1841059 - RNA, 21 nt, Human
aggggccucuuaugggcuggg

SEQ ID NO: 1841060 - RNA, 20 nt, Human
aggggccucuuaugggcugg

SEQ ID NO: 1841061 - RNA, 19 nt, Human
aggggccucuuaugggcug

SEQ ID NO: 1841062 - RNA, 19 nt, Human
aggguaucaggugcugcca

SEQ ID NO: 1841063 - RNA, 15 nt, Human
aggguaucuggugac

SEQ ID NO: 1841064 - RNA, 21 nt, Human
aggguaucaggugcugccauc

SEQ ID NO: 1841065 - RNA, 23 nt, Human
aggguccuggggaaccugacccc

SEQ ID NO: 1841066 - RNA, 21 nt, Human
aggguccuggggaaccugacc

SEQ ID NO: 1841067 - RNA, 15 nt, Human
aggguccuggggaac

SEQ ID NO: 1841068 - RNA, 12 nt, Human
aggguccugggg

SEQ ID NO: 1841069 - RNA, 11 nt, Human
agggucccugg

SEQ ID NO: 1841070 - RNA, 22 nt, Human
aggucuguucuuuccaaaguac

SEQ ID NO: 1841071 - RNA, 23 nt, Human
aggucuguucuuuccaaaguaca

SEQ ID NO: 1841072 - RNA, 18 nt, Human
aggucuguucuuuccaaa

SEQ ID NO: 1841073 - RNA, 16 nt, Human
aggucccuaauaaagc

SEQ ID NO: 1841074 - RNA, 15 nt, Human
aggucccuaauaaag

SEQ ID NO: 1841075 - RNA, 13 nt, Human
aggucccuaauaa

SEQ ID NO: 1841076 - RNA, 11 nt, Human
aggucccuaau

SEQ ID NO: 1841077 - RNA, 12 nt, Human
aggucccuaaua

SEQ ID NO: 1841078 - RNA, 17 nt, Human
agguacaaccuguucug

SEQ ID NO: 1841079 - RNA, 23 nt, Human
agguaaaucagacuaugaaguuu

SEQ ID NO: 1841080 - RNA, 21 nt, Human
agguaaucgaccugccucggc

SEQ ID NO: 1841081 - RNA, 19 nt, Human
agguaaucgaccugccucg

SEQ ID NO: 1841082 - RNA, 18 nt, Human
agguaaaucagacuauga

SEQ ID NO: 1841083 - RNA, 20 nt, Human
agguaaaagcaucacaugaa

SEQ ID NO: 1841084 - RNA, 22 nt, Human
aggugcuaggaacacuccuuca

SEQ ID NO: 1841085 - RNA, 19 nt, Human
aggugcuaggaacacuccu

SEQ ID NO: 1841086 - RNA, 23 nt, Human
aggugcuaggaacacuccuucac

SEQ ID NO: 1841087 - RNA, 23 nt, Human
agguucccuuugacgccauccca

SEQ ID NO: 1841088 - RNA, 13 nt, Human
agguucccuuuga

SEQ ID NO: 1841089 - RNA, 22 nt, Human
agguucccuuugacgccauccc

SEQ ID NO: 1841090 - RNA, 14 nt, Human
agguucaaagauau

SEQ ID NO: 1841091 - RNA, 15 nt, Human
agguucaaagauauu

SEQ ID NO: 1841092 - RNA, 22 nt, Human
auguuugccucugccucugaca

SEQ ID NO: 1841093 - RNA, 19 nt, Human
auguuugccucugccucug

SEQ ID NO: 1841094 - RNA, 13 nt, Human
auguucugggaca

SEQ ID NO: 1841095 - RNA, 11 nt, Human
auguucuggga

SEQ ID NO: 1841096 - RNA, 12 nt, Human
auguucugggac

SEQ ID NO: 1841097 - RNA, 17 nt, Human
auguucuaagaagugaa

SEQ ID NO: 1841098 - RNA, 20 nt, Human
augugggcuaguugggcuuc

SEQ ID NO: 1841099 - RNA, 22 nt, Human
augugaaacuggauuaaacuua

SEQ ID NO: 1841100 - RNA, 14 nt, Human
augugaaaucauuc

SEQ ID NO: 1841101 - RNA, 15 nt, Human
augugaaacauguuu

SEQ ID NO: 1841102 - RNA, 14 nt, Human
augucuuuucuugc

SEQ ID NO: 1841103 - RNA, 13 nt, Human
augucuuccugga

SEQ ID NO: 1841104 - RNA, 19 nt, Human
auggucaccaaaucagcug

SEQ ID NO: 1841105 - RNA, 17 nt, Human
auguaauuaaguacuau

SEQ ID NO: 1841106 - RNA, 15 nt, Human
auguaauuaaguacu

SEQ ID NO: 1841107 - RNA, 15 nt, Human
auggucggaaaacau

SEQ ID NO: 1841108 - RNA, 23 nt, Human
auguaauuaaguacuauguauca

SEQ ID NO: 1841109 - RNA, 17 nt, Human
augcacagaguuguuac

SEQ ID NO: 1841110 - RNA, 18 nt, Human
augcacagaguuguuaca

SEQ ID NO: 1841111 - RNA, 17 nt, Human
augcacaaacagaggcc

SEQ ID NO: 1841112 - RNA, 16 nt, Human
augcacaaacagaggc

SEQ ID NO: 1841113 - RNA, 16 nt, Human
augcacagaguuguua

SEQ ID NO: 1841114 - RNA, 19 nt, Human
augccucucucaggccaaa

SEQ ID NO: 1841115 - RNA, 16 nt, Human
augcaugaaguaauau

SEQ ID NO: 1841116 - RNA, 17 nt, Human
augccucucucaggcca

SEQ ID NO: 1841117 - RNA, 20 nt, Human
augcauauuauuuuauguug

SEQ ID NO: 1841118 - RNA, 16 nt, Human
augcauauuauuuuau

SEQ ID NO: 1841119 - RNA, 17 nt, Human
augaugccaugaggaac

SEQ ID NO: 1841120 - RNA, 16 nt, Human
augaugccaugaggaa

SEQ ID NO: 1841121 - RNA, 15 nt, Human
augcacaaacagagg

SEQ ID NO: 1841122 - RNA, 24 nt, Human
augauguuuuccaugaguccccug

SEQ ID NO: 1841123 - RNA, 20 nt, Human
auggcugugccucugccugu

SEQ ID NO: 1841124 - RNA, 19 nt, Human
auggcugugccucugccug

SEQ ID NO: 1841125 - RNA, 12 nt, Human
augcugcccugu

SEQ ID NO: 1841126 - RNA, 12 nt, Human
augcuuguacau

SEQ ID NO: 1841127 - RNA, 13 nt, Human
augcuuguacaua

SEQ ID NO: 1841128 - RNA, 14 nt, Human
augcuuguacauaa

SEQ ID NO: 1841129 - RNA, 18 nt, Human
auggcugugccucugccu

SEQ ID NO: 1841130 - RNA, 15 nt, Human
auggauuuccagcca

SEQ ID NO: 1841131 - RNA, 16 nt, Human
auggaggaaaaccaag

SEQ ID NO: 1841132 - RNA, 22 nt, Human
auggaggaaaaccaagccgugg

SEQ ID NO: 1841133 - RNA, 16 nt, Human
augcucuuuacuucau

SEQ ID NO: 1841134 - RNA, 11 nt, Human
augcugcccug

SEQ ID NO: 1841135 - RNA, 23 nt, Human
augaccuuucaauaggaaaaacu

SEQ ID NO: 1841136 - RNA, 22 nt, Human
augaccuuucaauaggaaaaac

SEQ ID NO: 1841137 - RNA, 21 nt, Human
augaccuuucaauaggaaaaa

SEQ ID NO: 1841138 - RNA, 22 nt, Human
augaagcuuuuaugugaaacau

SEQ ID NO: 1841139 - RNA, 19 nt, Human
augaaguuuuuuuuauaca

SEQ ID NO: 1841140 - RNA, 19 nt, Human
augaaagacuguacaaagu

SEQ ID NO: 1841141 - RNA, 17 nt, Human
augaaagacuguacaaa

SEQ ID NO: 1841142 - RNA, 16 nt, Human
augaaagacuguacaa

SEQ ID NO: 1841143 - RNA, 13 nt, Human
augaaagacugua

SEQ ID NO: 1841144 - RNA, 22 nt, Human
aucugcuuuuuaaagaaugcuc

SEQ ID NO: 1841145 - RNA, 19 nt, Human
aucuggacuccucugucca

SEQ ID NO: 1841146 - RNA, 18 nt, Human
aucuggacuccucugucc

SEQ ID NO: 1841147 - RNA, 17 nt, Human
aucuggacuccucuguc

SEQ ID NO: 1841148 - RNA, 16 nt, Human
aucuggacuccucugu

SEQ ID NO: 1841149 - RNA, 15 nt, Human
aucuggacuccucug

SEQ ID NO: 1841150 - RNA, 17 nt, Human
aucucugcuuuggaaau

SEQ ID NO: 1841151 - RNA, 15 nt, Human
aucucggcucacugc

SEQ ID NO: 1841152 - RNA, 14 nt, Human
aucucggcucacug

SEQ ID NO: 1841153 - RNA, 16 nt, Human
aucucggcucacugca

SEQ ID NO: 1841154 - RNA, 17 nt, Human
aucuugaauuguaagga

SEQ ID NO: 1841155 - RNA, 18 nt, Human
aucuugaauaauguaaga

SEQ ID NO: 1841156 - RNA, 14 nt, Human
aucuucuuuauaau

SEQ ID NO: 1841157 - RNA, 18 nt, Human
aucuugaagacuuuucuu

SEQ ID NO: 1841158 - RNA, 22 nt, Human
aucuucugaacuuggcgcugcc

SEQ ID NO: 1841159 - RNA, 16 nt, Human
auccagaaagaaaacu

SEQ ID NO: 1841160 - RNA, 18 nt, Human
auccagaaagaaaacuug

SEQ ID NO: 1841161 - RNA, 15 nt, Human
auccagacccggcug

SEQ ID NO: 1841162 - RNA, 15 nt, Human
aucccauuuaaaaaa

SEQ ID NO: 1841163 - RNA, 13 nt, Human
auccccaagccug

SEQ ID NO: 1841164 - RNA, 14 nt, Human
aucccauuuaaaaa

SEQ ID NO: 1841165 - RNA, 15 nt, Human
auccccuguagagug

SEQ ID NO: 1841166 - RNA, 16 nt, Human
auccccaagccuggca

SEQ ID NO: 1841167 - RNA, 11 nt, Human
auccuccaggu

SEQ ID NO: 1841168 - RNA, 23 nt, Human
auccuccaggugcacaagcucca

SEQ ID NO: 1841169 - RNA, 15 nt, Human
auccucccaccucag

SEQ ID NO: 1841170 - RNA, 20 nt, Human
auccucccaccucagccucc

SEQ ID NO: 1841171 - RNA, 18 nt, Human
auccucccaccucagccu

SEQ ID NO: 1841172 - RNA, 19 nt, Human
auccucccaccucagccuc

SEQ ID NO: 1841173 - RNA, 19 nt, Human
aucaccaacgucugugcca

SEQ ID NO: 1841174 - RNA, 18 nt, Human
aucaccaacgucugugcc

SEQ ID NO: 1841175 - RNA, 15 nt, Human
aucacauguggacuu

SEQ ID NO: 1841176 - RNA, 21 nt, Human
aucacagccucugaaaaccaa

SEQ ID NO: 1841177 - RNA, 21 nt, Human
aucaccgaaaacguggcugcu

SEQ ID NO: 1841178 - RNA, 19 nt, Human
aucaccgaaaacguggcug

SEQ ID NO: 1841179 - RNA, 14 nt, Human
aucaccgaaaacgu

SEQ ID NO: 1841180 - RNA, 19 nt, Human
aucagcacgauuucuguuu

SEQ ID NO: 1841181 - RNA, 20 nt, Human
aucagcacgauuucuguuua

SEQ ID NO: 1841182 - RNA, 23 nt, Human
aucagcacgauuucuguuuagau

SEQ ID NO: 1841183 - RNA, 18 nt, Human
aucagccugcuccagcug

SEQ ID NO: 1841184 - RNA, 17 nt, Human
aucagccugcuccagcu

SEQ ID NO: 1841185 - RNA, 19 nt, Human
aucagccugcuccagcugu

SEQ ID NO: 1841186 - RNA, 20 nt, Human
aucagccugcuccagcuguu

SEQ ID NO: 1841187 - RNA, 16 nt, Human
aucaugugaaaucauu

SEQ ID NO: 1841188 - RNA, 14 nt, Human
aucaugugaaauca

SEQ ID NO: 1841189 - RNA, 15 nt, Human
aucaugugaaaucau

SEQ ID NO: 1841190 - RNA, 15 nt, Human
auaucaauuuaaaaa

SEQ ID NO: 1841191 - RNA, 16 nt, Human
auaucaaauauauuca

SEQ ID NO: 1841192 - RNA, 22 nt, Human
auauuaccacagacauacuaac

SEQ ID NO: 1841193 - RNA, 21 nt, Human
auaugcuuauacacuuacacu

SEQ ID NO: 1841194 - RNA, 23 nt, Human
auauuaugaagcuuuuaugugaa

SEQ ID NO: 1841195 - RNA, 19 nt, Human
auauuuacuucuuauacau

SEQ ID NO: 1841196 - RNA, 21 nt, Human
auagccaaggccaaaggaagc

SEQ ID NO: 1841197 - RNA, 15 nt, Human
auagccaaggccaaa

SEQ ID NO: 1841198 - RNA, 18 nt, Human
auagcagcuuauucacaa

SEQ ID NO: 1841199 - RNA, 21 nt, Human
auagguauaaguggugugugu

SEQ ID NO: 1841200 - RNA, 17 nt, Human
auaguaugguggcuggg

SEQ ID NO: 1841201 - RNA, 18 nt, Human
auaguaugguggcugggu

SEQ ID NO: 1841202 - RNA, 15 nt, Human
auagguuuaauaauu

SEQ ID NO: 1841203 - RNA, 20 nt, Human
auaaugcgugcauaccacuu

SEQ ID NO: 1841204 - RNA, 21 nt, Human
auaaugcgugcauaccacuuu

SEQ ID NO: 1841205 - RNA, 18 nt, Human
auacaccacuacauucug

SEQ ID NO: 1841206 - RNA, 21 nt, Human
auacaccacuacauucuguua

SEQ ID NO: 1841207 - RNA, 19 nt, Human
auacaccacuacauucugu

SEQ ID NO: 1841208 - RNA, 20 nt, Human
auacaccacuacauucuguu

SEQ ID NO: 1841209 - RNA, 15 nt, Human
auaauguaagcucua

SEQ ID NO: 1841210 - RNA, 18 nt, Human
auaccugucccccugaca

SEQ ID NO: 1841211 - RNA, 12 nt, Human
auacccaccccc

SEQ ID NO: 1841212 - RNA, 11 nt, Human
auacccacccc

SEQ ID NO: 1841213 - RNA, 17 nt, Human
auaaaacuuuuuaaaau

SEQ ID NO: 1841214 - RNA, 21 nt, Human
auaaacuuuaccuuuuuuaua

SEQ ID NO: 1841215 - RNA, 16 nt, Human
auaaacuuuaccuuuu

SEQ ID NO: 1841216 - RNA, 24 nt, Human
auaaacuuuaccuuuuuuauacau

SEQ ID NO: 1841217 - RNA, 20 nt, Human
auaaacuuuuuucuuacugu

SEQ ID NO: 1841218 - RNA, 15 nt, Human
auaaaacuuuuuaaa

SEQ ID NO: 1841219 - RNA, 11 nt, Human
auaaaacuuuu

SEQ ID NO: 1841220 - RNA, 18 nt, Human
auaaagcuguguggcagu

SEQ ID NO: 1841221 - RNA, 15 nt, Human
auaaagcaggcagaa

SEQ ID NO: 1841222 - RNA, 14 nt, Human
auaaagcagcguuu

SEQ ID NO: 1841223 - RNA, 18 nt, Human
auaaagcagcguuucuau

SEQ ID NO: 1841224 - RNA, 19 nt, Human
auaaagcagcguuucuaug

SEQ ID NO: 1841225 - RNA, 20 nt, Human
auaaagcagcguuucuauga

SEQ ID NO: 1841226 - RNA, 13 nt, Human
auaaagcagcguu

SEQ ID NO: 1841227 - RNA, 11 nt, Human
auaaagacagg

SEQ ID NO: 1841228 - RNA, 12 nt, Human
auaaagacaccu

SEQ ID NO: 1841229 - RNA, 19 nt, Human
auaaauuuuuuuuguuuca

SEQ ID NO: 1841230 - RNA, 22 nt, Human
auaaauuuuuuuuguuucauau

SEQ ID NO: 1841231 - RNA, 18 nt, Human
auaaaggauuaaugucaa

SEQ ID NO: 1841232 - RNA, 16 nt, Human
aguuguuaauaaaagu

SEQ ID NO: 1841233 - RNA, 20 nt, Human
aguuguuugauucagacagc

SEQ ID NO: 1841234 - RNA, 14 nt, Human
aguugaagacagag

SEQ ID NO: 1841235 - RNA, 23 nt, Human
aguugaaaaucuuauaauuuaaa

SEQ ID NO: 1841236 - RNA, 16 nt, Human
aguuacagacaaagcg

SEQ ID NO: 1841237 - RNA, 14 nt, Human
aguuacagacaaag

SEQ ID NO: 1841238 - RNA, 14 nt, Human
aguuaagccuuugg

SEQ ID NO: 1841239 - RNA, 12 nt, Human
aguuaaauaaau

SEQ ID NO: 1841240 - RNA, 13 nt, Human
aguuaagccuuug

SEQ ID NO: 1841241 - RNA, 20 nt, Human
aguucagguaacaggcagau

SEQ ID NO: 1841242 - RNA, 17 nt, Human
aguuacagacaaagcgu

SEQ ID NO: 1841243 - RNA, 19 nt, Human
aguucagguaacaggcaga

SEQ ID NO: 1841244 - RNA, 22 nt, Human
aguugaaaaucuuauaauuuaa

SEQ ID NO: 1841245 - RNA, 21 nt, Human
aguggcuccucccggugccca

SEQ ID NO: 1841246 - RNA, 17 nt, Human
aguggcuccucccggug

SEQ ID NO: 1841247 - RNA, 13 nt, Human
aguggcuccuccc

SEQ ID NO: 1841248 - RNA, 23 nt, Human
aguggcuuaaaacaacacucaca

SEQ ID NO: 1841249 - RNA, 17 nt, Human
aguguauuuuuuuacua

SEQ ID NO: 1841250 - RNA, 18 nt, Human
aguguauuuuuuuacuaa

SEQ ID NO: 1841251 - RNA, 16 nt, Human
agugggagcugccugu

SEQ ID NO: 1841252 - RNA, 15 nt, Human
agugggagcugccug

SEQ ID NO: 1841253 - RNA, 14 nt, Human
agugggagcugccu

SEQ ID NO: 1841254 - RNA, 15 nt, Human
aguaucuugaagacu

SEQ ID NO: 1841255 - RNA, 12 nt, Human
aguaucuugaag

SEQ ID NO: 1841256 - RNA, 11 nt, Human
aguaucuugaa

SEQ ID NO: 1841257 - RNA, 16 nt, Human
aguaucuuuuuauuca

SEQ ID NO: 1841258 - RNA, 16 nt, Human
aguaugaauaaagaca

SEQ ID NO: 1841259 - RNA, 15 nt, Human
aguaugaggcauuug

SEQ ID NO: 1841260 - RNA, 16 nt, Human
aguaugaggcauuugu

SEQ ID NO: 1841261 - RNA, 20 nt, Human
aguaugggacuggccucugc

SEQ ID NO: 1841262 - RNA, 17 nt, Human
aguaugggacuggccuc

SEQ ID NO: 1841263 - RNA, 14 nt, Human
aguaugguggcugg

SEQ ID NO: 1841264 - RNA, 18 nt, Human
agugaccauacuaauuau

SEQ ID NO: 1841265 - RNA, 14 nt, Human
agugaagacaauga

SEQ ID NO: 1841266 - RNA, 16 nt, Human
agugaagacaaugacu

SEQ ID NO: 1841267 - RNA, 20 nt, Human
agucugauucccaagcucug

SEQ ID NO: 1841268 - RNA, 16 nt, Human
agucugauucccaagc

SEQ ID NO: 1841269 - RNA, 18 nt, Human
agucugauucccaagcuc

SEQ ID NO: 1841270 - RNA, 17 nt, Human
agucuggaaugcagugg

SEQ ID NO: 1841271 - RNA, 20 nt, Human
agugaacuugggccacugug

SEQ ID NO: 1841272 - RNA, 18 nt, Human
agucuggaaugcaguggu

SEQ ID NO: 1841273 - RNA, 21 nt, Human
aguccuggcaugggaaugaau

SEQ ID NO: 1841274 - RNA, 20 nt, Human
aguccuggcaugggaaugaa

SEQ ID NO: 1841275 - RNA, 22 nt, Human
aguccuggcaugggaaugaaug

SEQ ID NO: 1841276 - RNA, 15 nt, Human
agucugaaggcuggg

SEQ ID NO: 1841277 - RNA, 13 nt, Human
agucugaaggcug

SEQ ID NO: 1841278 - RNA, 16 nt, Human
agucugaaggcugggu

SEQ ID NO: 1841279 - RNA, 17 nt, Human
agucugaaggcuggguu

SEQ ID NO: 1841280 - RNA, 12 nt, Human
aguccuguaaug

SEQ ID NO: 1841281 - RNA, 13 nt, Human
cucucccuuggau

SEQ ID NO: 1841282 - RNA, 15 nt, Human
cucgugguaggacug

SEQ ID NO: 1841283 - RNA, 16 nt, Human
cucgugguaggacugu

SEQ ID NO: 1841284 - RNA, 17 nt, Human
cucgugguaggacugua

SEQ ID NO: 1841285 - RNA, 20 nt, Human
cucuccuccuuuucacaguu

SEQ ID NO: 1841286 - RNA, 13 nt, Human
cucuccuccuuuu

SEQ ID NO: 1841287 - RNA, 16 nt, Human
cucuccgaccagacac

SEQ ID NO: 1841288 - RNA, 19 nt, Human
cucucuggccuucggccuc

SEQ ID NO: 1841289 - RNA, 22 nt, Human
cucucuggccuucggccuccau

SEQ ID NO: 1841290 - RNA, 17 nt, Human
cucucuggccuucggcc

SEQ ID NO: 1841291 - RNA, 10 nt, Human
cucuccucug

SEQ ID NO: 1841292 - RNA, 16 nt, Human
cucugcacaagcugca

SEQ ID NO: 1841293 - RNA, 17 nt, Human
cucgaacuccugaccuu

SEQ ID NO: 1841294 - RNA, 16 nt, Human
cucgaacuccugaccu

SEQ ID NO: 1841295 - RNA, 13 nt, Human
cucgaacuccuga

SEQ ID NO: 1841296 - RNA, 24 nt, Human
cuccuuuucacaguucucuccuuc

SEQ ID NO: 1841297 - RNA, 22 nt, Human
cuccuagccugugccucuggga

SEQ ID NO: 1841298 - RNA, 16 nt, Human
cuccuuuagcgcccag

SEQ ID NO: 1841299 - RNA, 17 nt, Human
cuccuuuagcgcccagu

SEQ ID NO: 1841300 - RNA, 22 nt, Human
cuccuuuagcgcccaguugggu

SEQ ID NO: 1841301 - RNA, 20 nt, Human
cucguauaugucucaggucc

SEQ ID NO: 1841302 - RNA, 18 nt, Human
cucguauaugucucaggu

SEQ ID NO: 1841303 - RNA, 11 nt, Human
cucggugccuu

SEQ ID NO: 1841304 - RNA, 23 nt, Human
cuccgcuuucuacccagcgagcc

SEQ ID NO: 1841305 - RNA, 22 nt, Human
cuccgcuuucuacccagcgagc

SEQ ID NO: 1841306 - RNA, 21 nt, Human
cuccgcuuucuacccagcgag

SEQ ID NO: 1841307 - RNA, 20 nt, Human
cuccgcuuucuacccagcga

SEQ ID NO: 1841308 - RNA, 19 nt, Human
cucccucuuucccucccuu

SEQ ID NO: 1841309 - RNA, 15 nt, Human
cucccucuuucccuc

SEQ ID NO: 1841310 - RNA, 16 nt, Human
cucccucccucuuucc

SEQ ID NO: 1841311 - RNA, 21 nt, Human
cuccagaauuucccaaagcag

SEQ ID NO: 1841312 - RNA, 17 nt, Human
cucagaaucucaaauaa

SEQ ID NO: 1841313 - RNA, 16 nt, Human
cucagaaucucaaaua

SEQ ID NO: 1841314 - RNA, 11 nt, Human
cuccagacaca

SEQ ID NO: 1841315 - RNA, 22 nt, Human
cuccagaauuucccaaagcagu

SEQ ID NO: 1841316 - RNA, 16 nt, Human
cuccagacacaugucc

SEQ ID NO: 1841317 - RNA, 23 nt, Human
cuccaggcuguaucccaugagcc

SEQ ID NO: 1841318 - RNA, 20 nt, Human
cuccaggugcacaagcucca

SEQ ID NO: 1841319 - RNA, 19 nt, Human
cuccaggugcacaagcucc

SEQ ID NO: 1841320 - RNA, 18 nt, Human
cuccaggugcacaagcuc

SEQ ID NO: 1841321 - RNA, 22 nt, Human
cuccaggugcacaagcuccaag

SEQ ID NO: 1841322 - RNA, 14 nt, Human
cucccaccucagcc

SEQ ID NO: 1841323 - RNA, 16 nt, Human
cucccaccucagccuc

SEQ ID NO: 1841324 - RNA, 17 nt, Human
cucccaccucagccucc

SEQ ID NO: 1841325 - RNA, 14 nt, Human
cugaaaauguaugu

SEQ ID NO: 1841326 - RNA, 13 nt, Human
cugacacacagcu

SEQ ID NO: 1841327 - RNA, 15 nt, Human
cugacacacagcucu

SEQ ID NO: 1841328 - RNA, 16 nt, Human
cugacacacagcucug

SEQ ID NO: 1841329 - RNA, 17 nt, Human
cugacacacagcucugu

SEQ ID NO: 1841330 - RNA, 18 nt, Human
cugacacacagcucuguc

SEQ ID NO: 1841331 - RNA, 19 nt, Human
cugacacacagcucugucc

SEQ ID NO: 1841332 - RNA, 20 nt, Human
cugacacacagcucuguccu

SEQ ID NO: 1841333 - RNA, 21 nt, Human
cugacacacagcucuguccug

SEQ ID NO: 1841334 - RNA, 22 nt, Human
cugacacacagcucuguccugg

SEQ ID NO: 1841335 - RNA, 23 nt, Human
cugacacacagcucuguccuggg

SEQ ID NO: 1841336 - RNA, 17 nt, Human
cugaccccucauagccc

SEQ ID NO: 1841337 - RNA, 21 nt, Human
cugaccccucauagcccucac

SEQ ID NO: 1841338 - RNA, 20 nt, Human
cugaccccucauagcccuca

SEQ ID NO: 1841339 - RNA, 14 nt, Human
cucuugagccuggg

SEQ ID NO: 1841340 - RNA, 13 nt, Human
cucuugagccugg

SEQ ID NO: 1841341 - RNA, 16 nt, Human
cucuugagccugggag

SEQ ID NO: 1841342 - RNA, 15 nt, Human
cucuugagccuggga

SEQ ID NO: 1841343 - RNA, 22 nt, Human
cucuugauucauaaugacuuaa

SEQ ID NO: 1841344 - RNA, 13 nt, Human
cugaaagaggaau

SEQ ID NO: 1841345 - RNA, 17 nt, Human
cugaaagaggaaugaag

SEQ ID NO: 1841346 - RNA, 22 nt, Human
cucuugccacugccucuuccuc

SEQ ID NO: 1841347 - RNA, 24 nt, Human
cucuugauucauaaugacuuaagc

SEQ ID NO: 1841348 - RNA, 19 nt, Human
cucugcacaagcugcaccc

SEQ ID NO: 1841349 - RNA, 18 nt, Human
cucugcacaagcugcacc

SEQ ID NO: 1841350 - RNA, 17 nt, Human
cucugcacaagcugcac

SEQ ID NO: 1841351 - RNA, 19 nt, Human
cugacccugcuucaaauau

SEQ ID NO: 1841352 - RNA, 12 nt, Human
cugagcugggau

SEQ ID NO: 1841353 - RNA, 22 nt, Human
cugagcugggaugauuggaggg

SEQ ID NO: 1841354 - RNA, 22 nt, Human
cugagcuugcagagaugaggcc

SEQ ID NO: 1841355 - RNA, 14 nt, Human
cugaggaauccaga

SEQ ID NO: 1841356 - RNA, 22 nt, Human
cugaggugggaggaucucuuga

SEQ ID NO: 1841357 - RNA, 13 nt, Human
cugaggugggagg

SEQ ID NO: 1841358 - RNA, 14 nt, Human
cugaggggccucuu

SEQ ID NO: 1841359 - RNA, 23 nt, Human
cugaggaauccagacccggcugc

SEQ ID NO: 1841360 - RNA, 18 nt, Human
cugaucucucgugauuga

SEQ ID NO: 1841361 - RNA, 17 nt, Human
cugaucucucgugauug

SEQ ID NO: 1841362 - RNA, 21 nt, Human
cucacacaugagcaucaggcc

SEQ ID NO: 1841363 - RNA, 14 nt, Human
cucacacaugagca

SEQ ID NO: 1841364 - RNA, 12 nt, Human
cucaaauaacua

SEQ ID NO: 1841365 - RNA, 14 nt, Human
cucacaaaggaugc

SEQ ID NO: 1841366 - RNA, 22 nt, Human
cucaaagaaauuuccacucagg

SEQ ID NO: 1841367 - RNA, 18 nt, Human
cucaaaaaaagaaaaaga

SEQ ID NO: 1841368 - RNA, 14 nt, Human
cuauuuuucagaau

SEQ ID NO: 1841369 - RNA, 16 nt, Human
cuauguugcccaggca

SEQ ID NO: 1841370 - RNA, 17 nt, Human
cuauguugcccaggcag

SEQ ID NO: 1841371 - RNA, 20 nt, Human
cuaucucccccagccccauc

SEQ ID NO: 1841372 - RNA, 19 nt, Human
cuauguaucaaugaguaac

SEQ ID NO: 1841373 - RNA, 22 nt, Human
cuauguguagggcgggaggaug

SEQ ID NO: 1841374 - RNA, 15 nt, Human
cuauguugcccaggc

SEQ ID NO: 1841375 - RNA, 23 nt, Human
cuaugucauuugcuggagcucug

SEQ ID NO: 1841376 - RNA, 14 nt, Human
cucacccuggggcu

SEQ ID NO: 1841377 - RNA, 17 nt, Human
cucaccucucccuugga

SEQ ID NO: 1841378 - RNA, 16 nt, Human
cucaccucucccuugg

SEQ ID NO: 1841379 - RNA, 15 nt, Human
cucaccucucccuug

SEQ ID NO: 1841380 - RNA, 14 nt, Human
cucaccucucccuu

SEQ ID NO: 1841381 - RNA, 13 nt, Human
cucaccucucccu

SEQ ID NO: 1841382 - RNA, 16 nt, Human
cucaccucccccaucu

SEQ ID NO: 1841383 - RNA, 13 nt, Human
cucaccuccugcu

SEQ ID NO: 1841384 - RNA, 16 nt, Human
cucaccugccccucaa

SEQ ID NO: 1841385 - RNA, 14 nt, Human
cucaccugccccuc

SEQ ID NO: 1841386 - RNA, 18 nt, Human
cucaccugccccucaacu

SEQ ID NO: 1841387 - RNA, 13 nt, Human
cucaccugccccu

SEQ ID NO: 1841388 - RNA, 14 nt, Human
cucaccuccugcug

SEQ ID NO: 1841389 - RNA, 20 nt, Human
cuacuagggaaaugccuuug

SEQ ID NO: 1841390 - RNA, 23 nt, Human
cuaccugaggggccucuuauggg

SEQ ID NO: 1841391 - RNA, 19 nt, Human
cuaccugaggggccucuua

SEQ ID NO: 1841392 - RNA, 16 nt, Human
cuaccugaggggccuc

SEQ ID NO: 1841393 - RNA, 18 nt, Human
cuaccuuccaguuccuca

SEQ ID NO: 1841394 - RNA, 16 nt, Human
cuagcauacguacaca

SEQ ID NO: 1841395 - RNA, 18 nt, Human
cuagcauacguacacauu

SEQ ID NO: 1841396 - RNA, 19 nt, Human
cuagcauacguacacauuu

SEQ ID NO: 1841397 - RNA, 20 nt, Human
cuagcauacguacacauuuu

SEQ ID NO: 1841398 - RNA, 21 nt, Human
cuagacccacuggacucaccu

SEQ ID NO: 1841399 - RNA, 13 nt, Human
cuaggccugggga

SEQ ID NO: 1841400 - RNA, 12 nt, Human
cuaggccugggg

SEQ ID NO: 1841401 - RNA, 14 nt, Human
cuaggccuggccag

SEQ ID NO: 1841402 - RNA, 15 nt, Human
cuaggccuggccaga

SEQ ID NO: 1841403 - RNA, 18 nt, Human
cuaggccuggccagaugc

SEQ ID NO: 1841404 - RNA, 19 nt, Human
cuaggccuggccagaugca

SEQ ID NO: 1841405 - RNA, 17 nt, Human
cuagccagaggagagag

SEQ ID NO: 1841406 - RNA, 19 nt, Human
cuagccagaggagagagga

SEQ ID NO: 1841407 - RNA, 13 nt, Human
cuaggccuggcca

SEQ ID NO: 1841408 - RNA, 20 nt, Human
cuaguuugauuaaauucuug

SEQ ID NO: 1841409 - RNA, 14 nt, Human
cuagggaagauaau

SEQ ID NO: 1841410 - RNA, 15 nt, Human
cuaggguccugggga

SEQ ID NO: 1841411 - RNA, 14 nt, Human
cuaggguccugggg

SEQ ID NO: 1841412 - RNA, 13 nt, Human
cuaggguccuggg

SEQ ID NO: 1841413 - RNA, 17 nt, Human
cuaguuugauuaaauuc

SEQ ID NO: 1841414 - RNA, 19 nt, Human
cuaguuugauuaaauucuu

SEQ ID NO: 1841415 - RNA, 15 nt, Human
cggagacggaguccc

SEQ ID NO: 1841416 - RNA, 13 nt, Human
cguacacauuuua

SEQ ID NO: 1841417 - RNA, 16 nt, Human
cguacacauuuuauuu

SEQ ID NO: 1841418 - RNA, 13 nt, Human
cgguguggagaag

SEQ ID NO: 1841419 - RNA, 22 nt, Human
cuaaaguguauuuuuuuacuaa

SEQ ID NO: 1841420 - RNA, 17 nt, Human
cuaaaggcuaccuuugu

SEQ ID NO: 1841421 - RNA, 19 nt, Human
cuaaaggcuaccuuuguau

SEQ ID NO: 1841422 - RNA, 14 nt, Human
cuaaagcugccagc

SEQ ID NO: 1841423 - RNA, 21 nt, Human
cuaaagaagguuucagaaaga

SEQ ID NO: 1841424 - RNA, 15 nt, Human
cuaaaggcuaccuuu

SEQ ID NO: 1841425 - RNA, 16 nt, Human
cuaaaggcuaccuuug

SEQ ID NO: 1841426 - RNA, 15 nt, Human
cuaaagcugccagcc

SEQ ID NO: 1841427 - RNA, 14 nt, Human
cguuaccaggcagg

SEQ ID NO: 1841428 - RNA, 13 nt, Human
cguuaaaauacca

SEQ ID NO: 1841429 - RNA, 22 nt, Human
cguguccccuauccuacuuccc

SEQ ID NO: 1841430 - RNA, 20 nt, Human
cgcuggggccaguugguccc

SEQ ID NO: 1841431 - RNA, 17 nt, Human
cgcuggggccaguuggu

SEQ ID NO: 1841432 - RNA, 23 nt, Human
cgcuggccgggaccccgagccug

SEQ ID NO: 1841433 - RNA, 18 nt, Human
cgcuggccgggaccccga

SEQ ID NO: 1841434 - RNA, 16 nt, Human
cgccuuaaggauguuc

SEQ ID NO: 1841435 - RNA, 18 nt, Human
cgcugccccuggcagccc

SEQ ID NO: 1841436 - RNA, 19 nt, Human
cgcuggaccuugaacuggg

SEQ ID NO: 1841437 - RNA, 23 nt, Human
cgcuggaccuugaacuggguacu

SEQ ID NO: 1841438 - RNA, 17 nt, Human
cgcugccccuggcagcc

SEQ ID NO: 1841439 - RNA, 16 nt, Human
cgcugccccuggcagc

SEQ ID NO: 1841440 - RNA, 13 nt, Human
cgcugccccuggc

SEQ ID NO: 1841441 - RNA, 21 nt, Human
cgagguuucucaaagaaauuu

SEQ ID NO: 1841442 - RNA, 21 nt, Human
cgauacaccgggccuggagaa

SEQ ID NO: 1841443 - RNA, 20 nt, Human
cgauacaccgggccuggaga

SEQ ID NO: 1841444 - RNA, 18 nt, Human
cgauacaccgggccugga

SEQ ID NO: 1841445 - RNA, 19 nt, Human
cgaguagcugagauuauag

SEQ ID NO: 1841446 - RNA, 22 nt, Human
cccauccucuguacagagccca

SEQ ID NO: 1841447 - RNA, 21 nt, Human
cccauccucuguacagagccc

SEQ ID NO: 1841448 - RNA, 16 nt, Human
cccaggaaaggcucca

SEQ ID NO: 1841449 - RNA, 15 nt, Human
cccaggaaaggcucc

SEQ ID NO: 1841450 - RNA, 16 nt, Human
cccacuggacucaccu

SEQ ID NO: 1841451 - RNA, 18 nt, Human
cccaggaaaggcuccagg

SEQ ID NO: 1841452 - RNA, 17 nt, Human
cccaggaaaggcuccag

SEQ ID NO: 1841453 - RNA, 17 nt, Human
cccaggcugagccucag

SEQ ID NO: 1841454 - RNA, 16 nt, Human
cccaggcugagccuca

SEQ ID NO: 1841455 - RNA, 15 nt, Human
cccaggcugagccuc

SEQ ID NO: 1841456 - RNA, 22 nt, Human
cccaggcuuagucacugagaca

SEQ ID NO: 1841457 - RNA, 20 nt, Human
cccaggcuggagugcaauga

SEQ ID NO: 1841458 - RNA, 18 nt, Human
cccaggcugagccucagu

SEQ ID NO: 1841459 - RNA, 13 nt, Human
cccaggcuggagu

SEQ ID NO: 1841460 - RNA, 14 nt, Human
ccccgcacugggcu

SEQ ID NO: 1841461 - RNA, 17 nt, Human
ccccagaggcuggguga

SEQ ID NO: 1841462 - RNA, 15 nt, Human
ccccagauugcaaca

SEQ ID NO: 1841463 - RNA, 20 nt, Human
ccccagauugcaacaggcug

SEQ ID NO: 1841464 - RNA, 15 nt, Human
cccauuugcuccuuu

SEQ ID NO: 1841465 - RNA, 19 nt, Human
cccauucugccugcccagg

SEQ ID NO: 1841466 - RNA, 14 nt, Human
cccauucugccugc

SEQ ID NO: 1841467 - RNA, 15 nt, Human
cccauucugccugcc

SEQ ID NO: 1841468 - RNA, 15 nt, Human
cccuccucucugccc

SEQ ID NO: 1841469 - RNA, 16 nt, Human
cccuccucucugcccu

SEQ ID NO: 1841470 - RNA, 21 nt, Human
cccgggaagggggcugggaca

SEQ ID NO: 1841471 - RNA, 18 nt, Human
cccgggaagggggcuggg

SEQ ID NO: 1841472 - RNA, 16 nt, Human
cccucaacaccucugc

SEQ ID NO: 1841473 - RNA, 22 nt, Human
cccgggaagggggcugggacau

SEQ ID NO: 1841474 - RNA, 16 nt, Human
cccucaacucuccucc

SEQ ID NO: 1841475 - RNA, 20 nt, Human
cccucaacucuccuccagag

SEQ ID NO: 1841476 - RNA, 16 nt, Human
cccucacccuggggcu

SEQ ID NO: 1841477 - RNA, 15 nt, Human
cccucacccuggggc

SEQ ID NO: 1841478 - RNA, 16 nt, Human
ccccuucugacccaug

SEQ ID NO: 1841479 - RNA, 14 nt, Human
ccccuucugaccca

SEQ ID NO: 1841480 - RNA, 13 nt, Human
ccccuucugaccc

SEQ ID NO: 1841481 - RNA, 16 nt, Human
cccgaauagcugggac

SEQ ID NO: 1841482 - RNA, 17 nt, Human
cccgaauagcugggacu

SEQ ID NO: 1841483 - RNA, 18 nt, Human
cccgaauagcugggacua

SEQ ID NO: 1841484 - RNA, 22 nt, Human
cccgaauagcugggacuacagg

SEQ ID NO: 1841485 - RNA, 15 nt, Human
cccgggaagggggcu

SEQ ID NO: 1841486 - RNA, 20 nt, Human
cccggcuaauuuuuguauuu

SEQ ID NO: 1841487 - RNA, 15 nt, Human
cccggccccugcugg

SEQ ID NO: 1841488 - RNA, 16 nt, Human
cccggccccugcuggu

SEQ ID NO: 1841489 - RNA, 23 nt, Human
ccccucugcccugcgggucacag

SEQ ID NO: 1841490 - RNA, 20 nt, Human
ccccucugcccugcggguca

SEQ ID NO: 1841491 - RNA, 15 nt, Human
ccccucugcccugcg

SEQ ID NO: 1841492 - RNA, 14 nt, Human
ccccugccacccug

SEQ ID NO: 1841493 - RNA, 16 nt, Human
ccccugccacccuggg

SEQ ID NO: 1841494 - RNA, 13 nt, Human
ccccugcacucca

SEQ ID NO: 1841495 - RNA, 21 nt, Human
ccccugcaaagcccagcuuga

SEQ ID NO: 1841496 - RNA, 20 nt, Human
ccccugcaaagcccagcuug

SEQ ID NO: 1841497 - RNA, 18 nt, Human
ccccugcaaagcccagcu

SEQ ID NO: 1841498 - RNA, 15 nt, Human
ccccugacaacacuc

SEQ ID NO: 1841499 - RNA, 18 nt, Human
ccccucuggcuccagcug

SEQ ID NO: 1841500 - RNA, 16 nt, Human
ccccucuggcuccagc

SEQ ID NO: 1841501 - RNA, 18 nt, Human
ccagucccccugccccag

SEQ ID NO: 1841502 - RNA, 21 nt, Human
ccaggcugcucuugaacuccu

SEQ ID NO: 1841503 - RNA, 23 nt, Human
ccaggcaggucuugaacuccugg

SEQ ID NO: 1841504 - RNA, 12 nt, Human
ccaggcaggucu

SEQ ID NO: 1841505 - RNA, 14 nt, Human
ccaggcaggucuug

SEQ ID NO: 1841506 - RNA, 21 nt, Human
ccaggggaaaaucagccugcu

SEQ ID NO: 1841507 - RNA, 12 nt, Human
ccaggcuggcgu

SEQ ID NO: 1841508 - RNA, 16 nt, Human
ccaggcuggcgugcag

SEQ ID NO: 1841509 - RNA, 24 nt, Human
ccagccccuucugacccaugcugc

SEQ ID NO: 1841510 - RNA, 23 nt, Human
ccagccccuucugacccaugcug

SEQ ID NO: 1841511 - RNA, 12 nt, Human
ccagcagaaaug

SEQ ID NO: 1841512 - RNA, 17 nt, Human
ccagccccauccucugu

SEQ ID NO: 1841513 - RNA, 15 nt, Human
ccagccccauccucu

SEQ ID NO: 1841514 - RNA, 18 nt, Human
ccagccccauccucugua

SEQ ID NO: 1841515 - RNA, 13 nt, Human
ccagcagagcacc

SEQ ID NO: 1841516 - RNA, 12 nt, Human
ccagcagagcac

SEQ ID NO: 1841517 - RNA, 14 nt, Human
ccagcagagcaccu

SEQ ID NO: 1841518 - RNA, 17 nt, Human
ccagccccagugcccac

SEQ ID NO: 1841519 - RNA, 16 nt, Human
cccaacucaccccagc

SEQ ID NO: 1841520 - RNA, 15 nt, Human
cccaacucaccccag

SEQ ID NO: 1841521 - RNA, 22 nt, Human
ccauuucauuugugccagaaug

SEQ ID NO: 1841522 - RNA, 21 nt, Human
ccauuucauuugugccagaau

SEQ ID NO: 1841523 - RNA, 12 nt, Human
cccacucccugc

SEQ ID NO: 1841524 - RNA, 13 nt, Human
cccacucccugca

SEQ ID NO: 1841525 - RNA, 12 nt, Human
cccacccccacc

SEQ ID NO: 1841526 - RNA, 23 nt, Human
cccacugcuuuuggucuguguga

SEQ ID NO: 1841527 - RNA, 13 nt, Human
cccaagcucugcu

SEQ ID NO: 1841528 - RNA, 14 nt, Human
cccaagcucugcuc

SEQ ID NO: 1841529 - RNA, 12 nt, Human
cccaagcucugc

SEQ ID NO: 1841530 - RNA, 15 nt, Human
cccaagcucugcucc

SEQ ID NO: 1841531 - RNA, 20 nt, Human
cccaacuaauuuuuguauuu

SEQ ID NO: 1841532 - RNA, 20 nt, Human
cccaacucaccccagcccca

SEQ ID NO: 1841533 - RNA, 17 nt, Human
cccaacucaccccagcc

SEQ ID NO: 1841534 - RNA, 20 nt, Human
ccaugaggaacaaggcaagg

SEQ ID NO: 1841535 - RNA, 23 nt, Human
ccaugaggaacaaggcaaggcug

SEQ ID NO: 1841536 - RNA, 18 nt, Human
ccaugaguccccuguuug

SEQ ID NO: 1841537 - RNA, 19 nt, Human
ccaugucgccucugcauuc

SEQ ID NO: 1841538 - RNA, 17 nt, Human
ccaugucgccucugcau

SEQ ID NO: 1841539 - RNA, 16 nt, Human
ccaugucgccucugca

SEQ ID NO: 1841540 - RNA, 15 nt, Human
ccaugucgccucugc

SEQ ID NO: 1841541 - RNA, 12 nt, Human
ccaugucgccuc

SEQ ID NO: 1841542 - RNA, 21 nt, Human
ccaucccauaugccugggcag

SEQ ID NO: 1841543 - RNA, 20 nt, Human
ccaucccauaugccugggca

SEQ ID NO: 1841544 - RNA, 19 nt, Human
ccaucccauaugccugggc

SEQ ID NO: 1841545 - RNA, 20 nt, Human
ccaucccaaacccuucagug

SEQ ID NO: 1841546 - RNA, 20 nt, Human
ccaguuggucccccuuccau

SEQ ID NO: 1841547 - RNA, 18 nt, Human
ccaguuggucccccuucc

SEQ ID NO: 1841548 - RNA, 21 nt, Human
ccauaaucuggacuccucugu

SEQ ID NO: 1841549 - RNA, 14 nt, Human
ccauaaucuggacu

SEQ ID NO: 1841550 - RNA, 18 nt, Human
ccauccagguucagcuug

SEQ ID NO: 1841551 - RNA, 19 nt, Human
ccauccagguucagcuugu

SEQ ID NO: 1841552 - RNA, 13 nt, Human
ccaguuggucccc

SEQ ID NO: 1841553 - RNA, 23 nt, Human
ccaguuggguggaugccuggugg

SEQ ID NO: 1841554 - RNA, 21 nt, Human
ccuaaugcgcaggcuggcccu

SEQ ID NO: 1841555 - RNA, 13 nt, Human
ccuaauaaagcug

SEQ ID NO: 1841556 - RNA, 12 nt, Human
ccuaauaaagcu

SEQ ID NO: 1841557 - RNA, 22 nt, Human
ccuagccuuagaagucacacag

SEQ ID NO: 1841558 - RNA, 23 nt, Human
ccuagccugugccucugggacug

SEQ ID NO: 1841559 - RNA, 19 nt, Human
ccuagccuuagaagucaca

SEQ ID NO: 1841560 - RNA, 14 nt, Human
ccgucccccucugg

SEQ ID NO: 1841561 - RNA, 18 nt, Human
ccggccaccugcggugcu

SEQ ID NO: 1841562 - RNA, 17 nt, Human
ccggccaccugcggugc

SEQ ID NO: 1841563 - RNA, 23 nt, Human
ccgcagcccugcagagggcacag

SEQ ID NO: 1841564 - RNA, 18 nt, Human
ccgcagcccugcagaggg

SEQ ID NO: 1841565 - RNA, 14 nt, Human
ccgcagcccugcag

SEQ ID NO: 1841566 - RNA, 15 nt, Human
cccugugggccccca

SEQ ID NO: 1841567 - RNA, 15 nt, Human
cccugugauggggcc

SEQ ID NO: 1841568 - RNA, 23 nt, Human
cccugugaguacuacaguccucc

SEQ ID NO: 1841569 - RNA, 21 nt, Human
cccugugaguacuacaguccu

SEQ ID NO: 1841570 - RNA, 14 nt, Human
cccuccuuucacca

SEQ ID NO: 1841571 - RNA, 23 nt, Human
cccuuuuuuggcugcugaaggcu

SEQ ID NO: 1841572 - RNA, 22 nt, Human
cccuuuuuuggcugcugaaggc

SEQ ID NO: 1841573 - RNA, 21 nt, Human
cccuuuuuuggcugcugaagg

SEQ ID NO: 1841574 - RNA, 19 nt, Human
cccuucucuccagccccug

SEQ ID NO: 1841575 - RNA, 14 nt, Human
cccuucucuccagc

SEQ ID NO: 1841576 - RNA, 12 nt, Human
ccgacagccugg

SEQ ID NO: 1841577 - RNA, 14 nt, Human
ccgacagccuggca

SEQ ID NO: 1841578 - RNA, 13 nt, Human
ccgacagccuggc

SEQ ID NO: 1841579 - RNA, 22 nt, Human
ccgacagccuggcacagggcag

SEQ ID NO: 1841580 - RNA, 15 nt, Human
ccgacagccuggcac

SEQ ID NO: 1841581 - RNA, 14 nt, Human
ccucaaaugagaaa

SEQ ID NO: 1841582 - RNA, 16 nt, Human
ccucaacaccucugca

SEQ ID NO: 1841583 - RNA, 23 nt, Human
ccucaacucuccuccagagucag

SEQ ID NO: 1841584 - RNA, 21 nt, Human
ccucaacucuccuccagaguc

SEQ ID NO: 1841585 - RNA, 19 nt, Human
ccucaacucuccuccagag

SEQ ID NO: 1841586 - RNA, 15 nt, Human
ccucaaccuccuggg

SEQ ID NO: 1841587 - RNA, 18 nt, Human
ccucaggcaggugggaug

SEQ ID NO: 1841588 - RNA, 12 nt, Human
ccucaggcaggu

SEQ ID NO: 1841589 - RNA, 10 nt, Human
ccucaggccu

SEQ ID NO: 1841590 - RNA, 21 nt, Human
ccucauuccaccuucccaugc

SEQ ID NO: 1841591 - RNA, 23 nt, Human
ccucaagugauucuccugccuca

SEQ ID NO: 1841592 - RNA, 16 nt, Human
ccucaaccuccugggc

SEQ ID NO: 1841593 - RNA, 20 nt, Human
ccucaagugauucuccugcc

SEQ ID NO: 1841594 - RNA, 19 nt, Human
ccuccaagaccuucuccuu

SEQ ID NO: 1841595 - RNA, 17 nt, Human
ccuccaagaccuucucc

SEQ ID NO: 1841596 - RNA, 16 nt, Human
ccuccaagaccuucuc

SEQ ID NO: 1841597 - RNA, 12 nt, Human
ccucccaucacc

SEQ ID NO: 1841598 - RNA, 20 nt, Human
ccuccaagaccuucuccuuc

SEQ ID NO: 1841599 - RNA, 17 nt, Human
ccucccaucacccgcua

SEQ ID NO: 1841600 - RNA, 23 nt, Human
ccuccuuugugaggaagccgcug

SEQ ID NO: 1841601 - RNA, 19 nt, Human
ccuccuaucagaaguuucu

SEQ ID NO: 1841602 - RNA, 18 nt, Human
ccuccuuuucacaguucu

SEQ ID NO: 1841603 - RNA, 21 nt, Human
ccucgagguuucucaaagaaa

SEQ ID NO: 1841604 - RNA, 20 nt, Human
ccucggacuuagcugggaga

SEQ ID NO: 1841605 - RNA, 19 nt, Human
ccucggacuuagcugggag

SEQ ID NO: 1841606 - RNA, 13 nt, Human
ccuccgccucuug

SEQ ID NO: 1841607 - RNA, 14 nt, Human
ccuccgccucuugg

SEQ ID NO: 1841608 - RNA, 16 nt, Human
ccucccuucucuucac

SEQ ID NO: 1841609 - RNA, 20 nt, Human
ccucccuuggggccuaugca

SEQ ID NO: 1841610 - RNA, 15 nt, Human
ccugccucucugcag

SEQ ID NO: 1841611 - RNA, 14 nt, Human
ccugccucucugca

SEQ ID NO: 1841612 - RNA, 20 nt, Human
ccugcugagucccaggcuga

SEQ ID NO: 1841613 - RNA, 19 nt, Human
ccugcugagucccaggcug

SEQ ID NO: 1841614 - RNA, 18 nt, Human
ccugcugagucccaggcu

SEQ ID NO: 1841615 - RNA, 13 nt, Human
ccugccucucugc

SEQ ID NO: 1841616 - RNA, 17 nt, Human
ccugccucagccucccg

SEQ ID NO: 1841617 - RNA, 16 nt, Human
ccugccucagccuccc

SEQ ID NO: 1841618 - RNA, 15 nt, Human
ccugccucagccucc

SEQ ID NO: 1841619 - RNA, 21 nt, Human
ccugcccaggccccugccacc

SEQ ID NO: 1841620 - RNA, 22 nt, Human
ccugcccaggccccugccaccc

SEQ ID NO: 1841621 - RNA, 19 nt, Human
ccugcccaccuggccucug

SEQ ID NO: 1841622 - RNA, 18 nt, Human
ccugcccaccuggccucu

SEQ ID NO: 1841623 - RNA, 19 nt, Human
ccugcccaggccccugcca

SEQ ID NO: 1841624 - RNA, 17 nt, Human
ccugcccaccuggccuc

SEQ ID NO: 1841625 - RNA, 15 nt, Human
ccugcccaccuggcc

SEQ ID NO: 1841626 - RNA, 19 nt, Human
ccucuuucccucccuuccu

SEQ ID NO: 1841627 - RNA, 15 nt, Human
ccucuuugagugaag

SEQ ID NO: 1841628 - RNA, 14 nt, Human
ccucuugccacugc

SEQ ID NO: 1841629 - RNA, 22 nt, Human
ccucuugccacugccucuuccu

SEQ ID NO: 1841630 - RNA, 23 nt, Human
ccucuugccacugccucuuccuc

SEQ ID NO: 1841631 - RNA, 18 nt, Human
ccugaccccucauagccc

SEQ ID NO: 1841632 - RNA, 13 nt, Human
ccugcaggcagcc

SEQ ID NO: 1841633 - RNA, 12 nt, Human
ccugcaggcagc

SEQ ID NO: 1841634 - RNA, 14 nt, Human
ccugcaggcagcca

SEQ ID NO: 1841635 - RNA, 22 nt, Human
ccugguuuccugcccugggagg

SEQ ID NO: 1841636 - RNA, 17 nt, Human
ccugucucuacuaaaaa

SEQ ID NO: 1841637 - RNA, 15 nt, Human
ccuggauggggcugc

SEQ ID NO: 1841638 - RNA, 18 nt, Human
ccuggauggggcugcacc

SEQ ID NO: 1841639 - RNA, 17 nt, Human
ccuggauggggcugcac

SEQ ID NO: 1841640 - RNA, 18 nt, Human
ccuggccccucagggucc

SEQ ID NO: 1841641 - RNA, 21 nt, Human
ccuggccccucagggucccug

SEQ ID NO: 1841642 - RNA, 20 nt, Human
ccuggccccucagggucccu

SEQ ID NO: 1841643 - RNA, 22 nt, Human
ccuggccucaagugauucuccu

SEQ ID NO: 1841644 - RNA, 13 nt, Human
ccugguguggaag

SEQ ID NO: 1841645 - RNA, 16 nt, Human
ccugguuuccugcccu

SEQ ID NO: 1841646 - RNA, 21 nt, Human
ccugguuuccugcccugggag

SEQ ID NO: 1841647 - RNA, 20 nt, Human
ccugguuuccugcccuggga

SEQ ID NO: 1841648 - RNA, 19 nt, Human
ccugguuuccugcccuggg

SEQ ID NO: 1841649 - RNA, 18 nt, Human
ccugguuuccugcccugg

SEQ ID NO: 1841650 - RNA, 20 nt, Human
ccugguggcagugggagcug

SEQ ID NO: 1841651 - RNA, 18 nt, Human
ccugguggcagugggagc

SEQ ID NO: 1841652 - RNA, 19 nt, Human
ccugguggcagugggagcu

SEQ ID NO: 1841653 - RNA, 18 nt, Human
ccuggggaaccugacccc

SEQ ID NO: 1841654 - RNA, 15 nt, Human
ccuggggagaaagua

SEQ ID NO: 1841655 - RNA, 19 nt, Human
ccaccgggcugggagcucu

SEQ ID NO: 1841656 - RNA, 18 nt, Human
ccaccaucaugucuggcu

SEQ ID NO: 1841657 - RNA, 19 nt, Human
ccaccaucaugucuggcua

SEQ ID NO: 1841658 - RNA, 22 nt, Human
ccaccgggcugggagcucugca

SEQ ID NO: 1841659 - RNA, 12 nt, Human
ccaccuuggcug

SEQ ID NO: 1841660 - RNA, 14 nt, Human
ccaccuuggcugca

SEQ ID NO: 1841661 - RNA, 15 nt, Human
ccaccuuggcugcag

SEQ ID NO: 1841662 - RNA, 16 nt, Human
ccaccuuggcugcagg

SEQ ID NO: 1841663 - RNA, 13 nt, Human
ccacgcuggagug

SEQ ID NO: 1841664 - RNA, 18 nt, Human
ccacgcuggaccuugaac

SEQ ID NO: 1841665 - RNA, 13 nt, Human
ccacgcccccacu

SEQ ID NO: 1841666 - RNA, 18 nt, Human
ccaccuuggcugcaggga

SEQ ID NO: 1841667 - RNA, 19 nt, Human
ccaccuuggcugcagggag

SEQ ID NO: 1841668 - RNA, 21 nt, Human
ccacacuucaggcucuucucc

SEQ ID NO: 1841669 - RNA, 20 nt, Human
ccacacuucaggcucuucuc

SEQ ID NO: 1841670 - RNA, 16 nt, Human
ccacacuucaggcucu

SEQ ID NO: 1841671 - RNA, 15 nt, Human
ccaccacgcccggcu

SEQ ID NO: 1841672 - RNA, 22 nt, Human
ccacagagaaaguacuucucca

SEQ ID NO: 1841673 - RNA, 15 nt, Human
ccaaggccaaaggaa

SEQ ID NO: 1841674 - RNA, 18 nt, Human
ccaaggaugccccguccc

SEQ ID NO: 1841675 - RNA, 14 nt, Human
ccaagaagcccagg

SEQ ID NO: 1841676 - RNA, 12 nt, Human
ccaagcuggucc

SEQ ID NO: 1841677 - RNA, 19 nt, Human
ccaagcuggucccacucag

SEQ ID NO: 1841678 - RNA, 15 nt, Human
ccaacgucugugcca

SEQ ID NO: 1841679 - RNA, 13 nt, Human
ccaacgucugugc

SEQ ID NO: 1841680 - RNA, 22 nt, Human
ccaaauggaaaugggcagagca

SEQ ID NO: 1841681 - RNA, 16 nt, Human
ccaacgucugugccau

SEQ ID NO: 1841682 - RNA, 13 nt, Human
ccaagaagcccag

SEQ ID NO: 1841683 - RNA, 12 nt, Human
ccaaaugcagcu

SEQ ID NO: 1841684 - RNA, 18 nt, Human
ccaaaugcagcuuuaaaa

SEQ ID NO: 1841685 - RNA, 15 nt, Human
ccaaaugcagcuuua

SEQ ID NO: 1841686 - RNA, 13 nt, Human
ccaaaugcagcuu

SEQ ID NO: 1841687 - RNA, 16 nt, Human
ccaaggccaaaggaag

SEQ ID NO: 1841688 - RNA, 19 nt, Human
cauuuuuuaaaugcaccug

SEQ ID NO: 1841689 - RNA, 15 nt, Human
cauuuuuuaaaugca

SEQ ID NO: 1841690 - RNA, 16 nt, Human
cauuuuuuaaaugcac

SEQ ID NO: 1841691 - RNA, 14 nt, Human
cauuuauucugcuc

SEQ ID NO: 1841692 - RNA, 15 nt, Human
cauuuauucugcuca

SEQ ID NO: 1841693 - RNA, 16 nt, Human
cauuugugaaaugaug

SEQ ID NO: 1841694 - RNA, 14 nt, Human
cauuugugaaauga

SEQ ID NO: 1841695 - RNA, 17 nt, Human
cauuugucacacacuuu

SEQ ID NO: 1841696 - RNA, 15 nt, Human
cauuuggauuggaug

SEQ ID NO: 1841697 - RNA, 15 nt, Human
caucaggccaggccc

SEQ ID NO: 1841698 - RNA, 19 nt, Human
caucaggccaggcccucug

SEQ ID NO: 1841699 - RNA, 16 nt, Human
caucaggccaggcccu

SEQ ID NO: 1841700 - RNA, 20 nt, Human
caucaggccaggcccucugc

SEQ ID NO: 1841701 - RNA, 19 nt, Human
caucccauaugccugggca

SEQ ID NO: 1841702 - RNA, 14 nt, Human
cauccccuguagag

SEQ ID NO: 1841703 - RNA, 21 nt, Human
cauccccuguagagugggagc

SEQ ID NO: 1841704 - RNA, 15 nt, Human
cauauucaggaagcu

SEQ ID NO: 1841705 - RNA, 14 nt, Human
cauauucaggaagc

SEQ ID NO: 1841706 - RNA, 20 nt, Human
cauauucaggaagcucaggg

SEQ ID NO: 1841707 - RNA, 22 nt, Human
cauauucaggaagcucagggcc

SEQ ID NO: 1841708 - RNA, 20 nt, Human
cauaugccugggcagaagga

SEQ ID NO: 1841709 - RNA, 15 nt, Human
cauaugccugggcag

SEQ ID NO: 1841710 - RNA, 22 nt, Human
cauaugccugggcagaaggaag

SEQ ID NO: 1841711 - RNA, 22 nt, Human
cauagcuuacaagccagcugga

SEQ ID NO: 1841712 - RNA, 19 nt, Human
cauagcagagaaugaaagg

SEQ ID NO: 1841713 - RNA, 22 nt, Human
cauagcagagaaugaaagggcc

SEQ ID NO: 1841714 - RNA, 15 nt, Human
cagugggagcugccu

SEQ ID NO: 1841715 - RNA, 15 nt, Human
caugcugcccuguga

SEQ ID NO: 1841716 - RNA, 14 nt, Human
caugcugcccugug

SEQ ID NO: 1841717 - RNA, 13 nt, Human
cauggccaggugg

SEQ ID NO: 1841718 - RNA, 14 nt, Human
cauggccagguggc

SEQ ID NO: 1841719 - RNA, 15 nt, Human
caugaaguaauaugc

SEQ ID NO: 1841720 - RNA, 19 nt, Human
caugaaguaauaugcacac

SEQ ID NO: 1841721 - RNA, 22 nt, Human
caugaaguaauaugcacacauu

SEQ ID NO: 1841722 - RNA, 23 nt, Human
caugaaguaauaugcacacauuu

SEQ ID NO: 1841723 - RNA, 23 nt, Human
caugacacgaauauugcugaugg

SEQ ID NO: 1841724 - RNA, 21 nt, Human
caugacacgaauauugcugau

SEQ ID NO: 1841725 - RNA, 24 nt, Human
caugauuaaccacuucagcugacu

SEQ ID NO: 1841726 - RNA, 12 nt, Human
caugcacaaauu

SEQ ID NO: 1841727 - RNA, 23 nt, Human
caugauuaaccacuucagcugac

SEQ ID NO: 1841728 - RNA, 22 nt, Human
caugauuaaccacuucagcuga

SEQ ID NO: 1841729 - RNA, 13 nt, Human
caugcugcccugu

SEQ ID NO: 1841730 - RNA, 12 nt, Human
caugcugcccug

SEQ ID NO: 1841731 - RNA, 13 nt, Human
caugcuccuggcc

SEQ ID NO: 1841732 - RNA, 16 nt, Human
caugcacgugugugca

SEQ ID NO: 1841733 - RNA, 20 nt, Human
cauguccaagaagcccagga

SEQ ID NO: 1841734 - RNA, 19 nt, Human
cauguccaagaagcccagg

SEQ ID NO: 1841735 - RNA, 18 nt, Human
cauguccaagaagcccag

SEQ ID NO: 1841736 - RNA, 12 nt, Human
cauguuggccag

SEQ ID NO: 1841737 - RNA, 13 nt, Human
cauguuggccagg

SEQ ID NO: 1841738 - RNA, 23 nt, Human
cauuaucuagauacuguaucaug

SEQ ID NO: 1841739 - RNA, 22 nt, Human
cauuaggugugacugaauuucu

SEQ ID NO: 1841740 - RNA, 14 nt, Human
cauucucacuccua

SEQ ID NO: 1841741 - RNA, 18 nt, Human
cauucuagguuugcaaga

SEQ ID NO: 1841742 - RNA, 13 nt, Human
cauucucacuccu

SEQ ID NO: 1841743 - RNA, 12 nt, Human
cauuccuguucc

SEQ ID NO: 1841744 - RNA, 20 nt, Human
cagaggggguggccucccaa

SEQ ID NO: 1841745 - RNA, 19 nt, Human
cagaggggguggccuccca

SEQ ID NO: 1841746 - RNA, 17 nt, Human
cagaggggguggccucc

SEQ ID NO: 1841747 - RNA, 18 nt, Human
cagaggggguggccuccc

SEQ ID NO: 1841748 - RNA, 20 nt, Human
cagagucagaaguuucugcc

SEQ ID NO: 1841749 - RNA, 18 nt, Human
cagagcugccaccugccu

SEQ ID NO: 1841750 - RNA, 16 nt, Human
cagagcugccaccugc

SEQ ID NO: 1841751 - RNA, 23 nt, Human
cagaaguuugagaucagccuggg

SEQ ID NO: 1841752 - RNA, 22 nt, Human
cagaaguuugagaucagccugg

SEQ ID NO: 1841753 - RNA, 20 nt, Human
cagaaguuugagaucagccu

SEQ ID NO: 1841754 - RNA, 19 nt, Human
cagaaguuucugccgcagc

SEQ ID NO: 1841755 - RNA, 23 nt, Human
cagaaguuucugccgcagcccug

SEQ ID NO: 1841756 - RNA, 22 nt, Human
cagagggccugcaagggaguga

SEQ ID NO: 1841757 - RNA, 23 nt, Human
cagcauauucaggaagcucaggg

SEQ ID NO: 1841758 - RNA, 22 nt, Human
cagcauauucaggaagcucagg

SEQ ID NO: 1841759 - RNA, 19 nt, Human
cagcauauucaggaagcuc

SEQ ID NO: 1841760 - RNA, 13 nt, Human
cagccaggccaca

SEQ ID NO: 1841761 - RNA, 12 nt, Human
cagccaggccac

SEQ ID NO: 1841762 - RNA, 22 nt, Human
cagccaggccacaagacccuug

SEQ ID NO: 1841763 - RNA, 15 nt, Human
cagcaccuacagugu

SEQ ID NO: 1841764 - RNA, 20 nt, Human
cagcaccuacaguguacagu

SEQ ID NO: 1841765 - RNA, 13 nt, Human
cagcuccagcuca

SEQ ID NO: 1841766 - RNA, 14 nt, Human
cagcuccagcucac

SEQ ID NO: 1841767 - RNA, 15 nt, Human
cagcuccagcucacc

SEQ ID NO: 1841768 - RNA, 21 nt, Human
cagcucccaaggcucugagca

SEQ ID NO: 1841769 - RNA, 22 nt, Human
cagcuccagcucaccagcccca

SEQ ID NO: 1841770 - RNA, 16 nt, Human
cagcuccagcucacca

SEQ ID NO: 1841771 - RNA, 17 nt, Human
cagcuccagcucaccag

SEQ ID NO: 1841772 - RNA, 18 nt, Human
cagcuccagcucaccagc

SEQ ID NO: 1841773 - RNA, 20 nt, Human
cagcuccagcucaccagccc

SEQ ID NO: 1841774 - RNA, 19 nt, Human
cagcugugcucuggacagg

SEQ ID NO: 1841775 - RNA, 18 nt, Human
cagcugugcucuggacag

SEQ ID NO: 1841776 - RNA, 15 nt, Human
cagcuucauuuccug

SEQ ID NO: 1841777 - RNA, 18 nt, Human
cagcuucauuuccugugu

SEQ ID NO: 1841778 - RNA, 19 nt, Human
cagcuucauuuccuguguc

SEQ ID NO: 1841779 - RNA, 15 nt, Human
caggaaaggcuccag

SEQ ID NO: 1841780 - RNA, 14 nt, Human
caggaaaggcucca

SEQ ID NO: 1841781 - RNA, 15 nt, Human
cagcggggacagcuc

SEQ ID NO: 1841782 - RNA, 16 nt, Human
cagcggggacagcucc

SEQ ID NO: 1841783 - RNA, 17 nt, Human
cagcggggacagcuccu

SEQ ID NO: 1841784 - RNA, 19 nt, Human
cagccugagcgacagugag

SEQ ID NO: 1841785 - RNA, 22 nt, Human
cagccugagcgacagugagacu

SEQ ID NO: 1841786 - RNA, 18 nt, Human
cagccugagcgacaguga

SEQ ID NO: 1841787 - RNA, 14 nt, Human
cagccccuggaugc

SEQ ID NO: 1841788 - RNA, 13 nt, Human
cagccccuggaug

SEQ ID NO: 1841789 - RNA, 12 nt, Human
cagccccuggau

SEQ ID NO: 1841790 - RNA, 21 nt, Human
cagccccuggaugcagccuca

SEQ ID NO: 1841791 - RNA, 19 nt, Human
cagccccuggaugcagccu

SEQ ID NO: 1841792 - RNA, 18 nt, Human
cagccccuggaugcagcc

SEQ ID NO: 1841793 - RNA, 17 nt, Human
cagccccuggaugcagc

SEQ ID NO: 1841794 - RNA, 15 nt, Human
cagcccuuagcaggg

SEQ ID NO: 1841795 - RNA, 22 nt, Human
cagccccuggaugcagccucac

SEQ ID NO: 1841796 - RNA, 16 nt, Human
cagcccuuagcaggga

SEQ ID NO: 1841797 - RNA, 21 nt, Human
cagcccuuagcagggaaacag

SEQ ID NO: 1841798 - RNA, 21 nt, Human
cagccgagauagccaaggcca

SEQ ID NO: 1841799 - RNA, 23 nt, Human
caggccagagggagugacagagg

SEQ ID NO: 1841800 - RNA, 19 nt, Human
caggccagagggagugaca

SEQ ID NO: 1841801 - RNA, 21 nt, Human
caggccagagggagugacaga

SEQ ID NO: 1841802 - RNA, 16 nt, Human
caggaggccagccuug

SEQ ID NO: 1841803 - RNA, 15 nt, Human
caggaggccagccuu

SEQ ID NO: 1841804 - RNA, 14 nt, Human
caggaggccagccu

SEQ ID NO: 1841805 - RNA, 18 nt, Human
caggcacccaccaucaug

SEQ ID NO: 1841806 - RNA, 22 nt, Human
caggcacccaccaucaugucug

SEQ ID NO: 1841807 - RNA, 23 nt, Human
caggcacccaccaucaugucugg

SEQ ID NO: 1841808 - RNA, 15 nt, Human
caggagggaggggga

SEQ ID NO: 1841809 - RNA, 17 nt, Human
caggaggccagccuuga

SEQ ID NO: 1841810 - RNA, 23 nt, Human
caggagggagggggaaggcaggg

SEQ ID NO: 1841811 - RNA, 22 nt, Human
cagggaguccgaaagggacuug

SEQ ID NO: 1841812 - RNA, 16 nt, Human
cagggagggccugggc

SEQ ID NO: 1841813 - RNA, 14 nt, Human
cagggagggccugg

SEQ ID NO: 1841814 - RNA, 18 nt, Human
cagggaggugaccccagg

SEQ ID NO: 1841815 - RNA, 15 nt, Human
caggcgccccuuccc

SEQ ID NO: 1841816 - RNA, 20 nt, Human
caggccugccuguucccauu

SEQ ID NO: 1841817 - RNA, 19 nt, Human
caggcuggcccugcccugg

SEQ ID NO: 1841818 - RNA, 18 nt, Human
caggcuggcccugcccug

SEQ ID NO: 1841819 - RNA, 17 nt, Human
caggcuggcccugcccu

SEQ ID NO: 1841820 - RNA, 17 nt, Human
caggcgccccuuccccc

SEQ ID NO: 1841821 - RNA, 20 nt, Human
caggcuggcccugcccuggu

SEQ ID NO: 1841822 - RNA, 15 nt, Human
caggcuggcgugcag

SEQ ID NO: 1841823 - RNA, 16 nt, Human
caggcugggcuucagu

SEQ ID NO: 1841824 - RNA, 19 nt, Human
cagggaggacgcucucugg

SEQ ID NO: 1841825 - RNA, 13 nt, Human
cagggagggccug

SEQ ID NO: 1841826 - RNA, 12 nt, Human
cagggagggccu

SEQ ID NO: 1841827 - RNA, 17 nt, Human
cagggaggacgcucucu

SEQ ID NO: 1841828 - RNA, 18 nt, Human
cagggaggacgcucucug

SEQ ID NO: 1841829 - RNA, 17 nt, Human
caggcugggcuucagug

SEQ ID NO: 1841830 - RNA, 19 nt, Human
caggcugggcuucaguggc

SEQ ID NO: 1841831 - RNA, 20 nt, Human
caggugcuaggaacacuccu

SEQ ID NO: 1841832 - RNA, 18 nt, Human
caggugcuaggaacacuc

SEQ ID NO: 1841833 - RNA, 14 nt, Human
caggugcgaaagga

SEQ ID NO: 1841834 - RNA, 14 nt, Human
cagguugguggggg

SEQ ID NO: 1841835 - RNA, 20 nt, Human
caggugauccacccaccuca

SEQ ID NO: 1841836 - RNA, 14 nt, Human
caggguuggccccu

SEQ ID NO: 1841837 - RNA, 12 nt, Human
caggguuggccc

SEQ ID NO: 1841838 - RNA, 16 nt, Human
caggugauccacccac

SEQ ID NO: 1841839 - RNA, 17 nt, Human
caggugauccacccacc

SEQ ID NO: 1841840 - RNA, 22 nt, Human
cagggucucacucugucgccca

SEQ ID NO: 1841841 - RNA, 21 nt, Human
cagggucucacucugucgccc

SEQ ID NO: 1841842 - RNA, 18 nt, Human
cagggucucacucugucg

SEQ ID NO: 1841843 - RNA, 18 nt, Human
cagguuuaagcuguuacu

SEQ ID NO: 1841844 - RNA, 16 nt, Human
cagguuuaagcuguua

SEQ ID NO: 1841845 - RNA, 22 nt, Human
cagucaccccggccaccugcgg

SEQ ID NO: 1841846 - RNA, 19 nt, Human
cagucaccccggccaccug

SEQ ID NO: 1841847 - RNA, 20 nt, Human
cagucaccccggccaccugc

SEQ ID NO: 1841848 - RNA, 14 nt, Human
cagucucccucccu

SEQ ID NO: 1841849 - RNA, 23 nt, Human
cagugcaugcugucccuuacgug

SEQ ID NO: 1841850 - RNA, 22 nt, Human
cagugcaugcugucccuuacgu

SEQ ID NO: 1841851 - RNA, 19 nt, Human
cagugcaugcugucccuua

SEQ ID NO: 1841852 - RNA, 19 nt, Human
cagucugauucccaagcuc

SEQ ID NO: 1841853 - RNA, 20 nt, Human
cagucugauucccaagcucu

SEQ ID NO: 1841854 - RNA, 11 nt, Human
cagugggagcu

SEQ ID NO: 1841855 - RNA, 16 nt, Human
cagugggacagggcau

SEQ ID NO: 1841856 - RNA, 19 nt, Human
cagugggacagggcauggc

SEQ ID NO: 1841857 - RNA, 12 nt, Human
cagugcccacag

SEQ ID NO: 1841858 - RNA, 15 nt, Human
cagugccaaaaacaa

SEQ ID NO: 1841859 - RNA, 22 nt, Human
auuuaugcauauuauuuuaugu

SEQ ID NO: 1841860 - RNA, 16 nt, Human
auuuaugcauauuauu

SEQ ID NO: 1841861 - RNA, 21 nt, Human
auuuaaugaaagacuguacaa

SEQ ID NO: 1841862 - RNA, 20 nt, Human
auuuaaugaaagacuguaca

SEQ ID NO: 1841863 - RNA, 15 nt, Human
auuuaaugaaagacu

SEQ ID NO: 1841864 - RNA, 16 nt, Human
auuuaaugaaagacug

SEQ ID NO: 1841865 - RNA, 14 nt, Human
auugcuugcacaaa

SEQ ID NO: 1841866 - RNA, 16 nt, Human
auugcuuguuggauuu

SEQ ID NO: 1841867 - RNA, 15 nt, Human
auuccugcauuugug

SEQ ID NO: 1841868 - RNA, 18 nt, Human
auuccugcauuugugaaa

SEQ ID NO: 1841869 - RNA, 18 nt, Human
auucuccuuguguuacua

SEQ ID NO: 1841870 - RNA, 19 nt, Human
auucuccuuguguuacuaa

SEQ ID NO: 1841871 - RNA, 21 nt, Human
auucuccuuguguuacuaagu

SEQ ID NO: 1841872 - RNA, 22 nt, Human
auucuccuuguguuacuaaguu

SEQ ID NO: 1841873 - RNA, 17 nt, Human
auucucuaguuugauua

SEQ ID NO: 1841874 - RNA, 18 nt, Human
auucucuaguuugauuaa

SEQ ID NO: 1841875 - RNA, 19 nt, Human
auucucuaguuugauuaaa

SEQ ID NO: 1841876 - RNA, 19 nt, Human
auucuucugcuucagccuc

SEQ ID NO: 1841877 - RNA, 20 nt, Human
auucuucugcuucagccucc

SEQ ID NO: 1841878 - RNA, 22 nt, Human
auucuucuguacgucugacagg

SEQ ID NO: 1841879 - RNA, 15 nt, Human
auucuugcaaaguau

SEQ ID NO: 1841880 - RNA, 16 nt, Human
auucuugcaaaguauc

SEQ ID NO: 1841881 - RNA, 14 nt, Human
auucuugcaaagua

SEQ ID NO: 1841882 - RNA, 19 nt, Human
auuaaaugcccagccccuu

SEQ ID NO: 1841883 - RNA, 17 nt, Human
auuaaaugcccagcccc

SEQ ID NO: 1841884 - RNA, 16 nt, Human
auuaggauuucaugau

SEQ ID NO: 1841885 - RNA, 14 nt, Human
auuaggauuucaug

SEQ ID NO: 1841886 - RNA, 11 nt, Human
auuaaauuaug

SEQ ID NO: 1841887 - RNA, 20 nt, Human
auuaguacuccccuccuuga

SEQ ID NO: 1841888 - RNA, 18 nt, Human
auucaacagguuuuccug

SEQ ID NO: 1841889 - RNA, 21 nt, Human
auuuuauaucaauuuaaaaaa

SEQ ID NO: 1841890 - RNA, 16 nt, Human
auuuuuaagugcugca

SEQ ID NO: 1841891 - RNA, 18 nt, Human
auuuuuaagugcugcauu

SEQ ID NO: 1841892 - RNA, 19 nt, Human
auuuuuaagugcugcauuu

SEQ ID NO: 1841893 - RNA, 14 nt, Human
auuuuuagacagag

SEQ ID NO: 1841894 - RNA, 23 nt, Human
auuuuuuuuuccuucagugccuu

SEQ ID NO: 1841895 - RNA, 22 nt, Human
auuuuuuuuuccuucagugccu

SEQ ID NO: 1841896 - RNA, 20 nt, Human
auuuuuuuuuccuucagugc

SEQ ID NO: 1841897 - RNA, 18 nt, Human
auuuuuuuuuccuucagu

SEQ ID NO: 1841898 - RNA, 16 nt, Human
auuuuuuugagacaga

SEQ ID NO: 1841899 - RNA, 21 nt, Human
caaaccccgaccaccugccca

SEQ ID NO: 1841900 - RNA, 18 nt, Human
caaaccccgaccaccugc

SEQ ID NO: 1841901 - RNA, 21 nt, Human
caaaaggauaaugaauacuuu

SEQ ID NO: 1841902 - RNA, 18 nt, Human
caacucaccccagcccca

SEQ ID NO: 1841903 - RNA, 18 nt, Human
caacuaauuuuuguauuu

SEQ ID NO: 1841904 - RNA, 22 nt, Human
caagaauugaagcaggacuaaa

SEQ ID NO: 1841905 - RNA, 14 nt, Human
caacucuccuccag

SEQ ID NO: 1841906 - RNA, 17 nt, Human
caagaccacguuucuaa

SEQ ID NO: 1841907 - RNA, 18 nt, Human
caagaccacguuucuaaa

SEQ ID NO: 1841908 - RNA, 19 nt, Human
caagacccaaaaggcagaa

SEQ ID NO: 1841909 - RNA, 22 nt, Human
caacacacagauuugagcucag

SEQ ID NO: 1841910 - RNA, 21 nt, Human
caacacacagauuugagcuca

SEQ ID NO: 1841911 - RNA, 19 nt, Human
caaaguaucccuacuguaa

SEQ ID NO: 1841912 - RNA, 21 nt, Human
caaaguaucccuacuguaauu

SEQ ID NO: 1841913 - RNA, 22 nt, Human
caaaguagaagucuuagaugua

SEQ ID NO: 1841914 - RNA, 22 nt, Human
caaagguaaaucagacuaugaa

SEQ ID NO: 1841915 - RNA, 14 nt, Human
caaagguaaaucag

SEQ ID NO: 1841916 - RNA, 21 nt, Human
caaagcagugcaugcuguccc

SEQ ID NO: 1841917 - RNA, 18 nt, Human
caaagcagugcaugcugu

SEQ ID NO: 1841918 - RNA, 14 nt, Human
caaagauauuuugc

SEQ ID NO: 1841919 - RNA, 16 nt, Human
caaagauauuuugcuu

SEQ ID NO: 1841920 - RNA, 22 nt, Human
caaagcagugcaugcugucccu

SEQ ID NO: 1841921 - RNA, 18 nt, Human
caaagauauuuugcuuug

SEQ ID NO: 1841922 - RNA, 23 nt, Human
caaaugcuguaacuuucugaaau

SEQ ID NO: 1841923 - RNA, 22 nt, Human
caaaugagaaaaugucuuuauu

SEQ ID NO: 1841924 - RNA, 12 nt, Human
caccuacugagu

SEQ ID NO: 1841925 - RNA, 12 nt, Human
caccucagccuc

SEQ ID NO: 1841926 - RNA, 13 nt, Human
caccugcccaacc

SEQ ID NO: 1841927 - RNA, 19 nt, Human
caccugcccaaccugcucu

SEQ ID NO: 1841928 - RNA, 18 nt, Human
caccugcccaaccugcuc

SEQ ID NO: 1841929 - RNA, 23 nt, Human
caccuuuauucuggcagaggagg

SEQ ID NO: 1841930 - RNA, 18 nt, Human
caccuuggcugcagggag

SEQ ID NO: 1841931 - RNA, 15 nt, Human
caccuuggcugcagg

SEQ ID NO: 1841932 - RNA, 16 nt, Human
caccuuggcugcaggg

SEQ ID NO: 1841933 - RNA, 14 nt, Human
caccuuucccaucu

SEQ ID NO: 1841934 - RNA, 15 nt, Human
cacggcucacugcag

SEQ ID NO: 1841935 - RNA, 14 nt, Human
cacggcucacugca

SEQ ID NO: 1841936 - RNA, 17 nt, Human
cacggccaggccagagg

SEQ ID NO: 1841937 - RNA, 12 nt, Human
cacggccaggcc

SEQ ID NO: 1841938 - RNA, 13 nt, Human
cacggccaggcca

SEQ ID NO: 1841939 - RNA, 23 nt, Human
cacuccagccugagcgacaguga

SEQ ID NO: 1841940 - RNA, 14 nt, Human
cacuccagccuggg

SEQ ID NO: 1841941 - RNA, 13 nt, Human
cacuccagccugg

SEQ ID NO: 1841942 - RNA, 13 nt, Human
cacuccagccuga

SEQ ID NO: 1841943 - RNA, 12 nt, Human
cacuccagccug

SEQ ID NO: 1841944 - RNA, 21 nt, Human
cacuacauucuguuaaucauu

SEQ ID NO: 1841945 - RNA, 16 nt, Human
cacuacauucuguuaa

SEQ ID NO: 1841946 - RNA, 17 nt, Human
cacuacauucuguuaau

SEQ ID NO: 1841947 - RNA, 21 nt, Human
cacuacauuauaaaugucucu

SEQ ID NO: 1841948 - RNA, 20 nt, Human
cacucuuauugcccacgcug

SEQ ID NO: 1841949 - RNA, 21 nt, Human
cacucuuauugcccacgcugg

SEQ ID NO: 1841950 - RNA, 22 nt, Human
cacucuuauugcccacgcugga

SEQ ID NO: 1841951 - RNA, 20 nt, Human
cagaaagguuuucuucuuuu

SEQ ID NO: 1841952 - RNA, 16 nt, Human
cagaaauguacagcaa

SEQ ID NO: 1841953 - RNA, 18 nt, Human
cagaacagugauuaccag

SEQ ID NO: 1841954 - RNA, 19 nt, Human
cagaaguuucucagcuccc

SEQ ID NO: 1841955 - RNA, 15 nt, Human
cagaaguuucucagc

SEQ ID NO: 1841956 - RNA, 16 nt, Human
cagaaguuucugccgc

SEQ ID NO: 1841957 - RNA, 14 nt, Human
cagaaguuucugcc

SEQ ID NO: 1841958 - RNA, 12 nt, Human
cagaacagugau

SEQ ID NO: 1841959 - RNA, 17 nt, Human
cagaacagugauuacca

SEQ ID NO: 1841960 - RNA, 11 nt, Human
cagaacaguga

SEQ ID NO: 1841961 - RNA, 13 nt, Human
cacuuucuagcca

SEQ ID NO: 1841962 - RNA, 17 nt, Human
cacuuucuagccagagg

SEQ ID NO: 1841963 - RNA, 16 nt, Human
cacuuucuagccagag

SEQ ID NO: 1841964 - RNA, 18 nt, Human
cacuuucuagccagagga

SEQ ID NO: 1841965 - RNA, 19 nt, Human
cacuuguugauuaauggaa

SEQ ID NO: 1841966 - RNA, 18 nt, Human
cacuuguguuaugaagca

SEQ ID NO: 1841967 - RNA, 17 nt, Human
cacugccaugccagcuu

SEQ ID NO: 1841968 - RNA, 20 nt, Human
cacugcagccucaaccuccu

SEQ ID NO: 1841969 - RNA, 21 nt, Human
cacugcagccucaaccuccug

SEQ ID NO: 1841970 - RNA, 22 nt, Human
cacugcagccucaaccuccugg

SEQ ID NO: 1841971 - RNA, 23 nt, Human
cacugcagccucaaccuccuggg

SEQ ID NO: 1841972 - RNA, 19 nt, Human
cacugcagccucaaccucc

SEQ ID NO: 1841973 - RNA, 14 nt, Human
cacugcagccucaa

SEQ ID NO: 1841974 - RNA, 19 nt, Human
cacugggagaaaugaaaaa

SEQ ID NO: 1841975 - RNA, 20 nt, Human
cacugggcuuggggaccaga

SEQ ID NO: 1841976 - RNA, 13 nt, Human
cacugggcuucua

SEQ ID NO: 1841977 - RNA, 15 nt, Human
cacuuaaaaaugguu

SEQ ID NO: 1841978 - RNA, 18 nt, Human
cacuguugcccaggcugg

SEQ ID NO: 1841979 - RNA, 19 nt, Human
cacuguugcccaggcuggc

SEQ ID NO: 1841980 - RNA, 23 nt, Human
cacuguugcccaggcuggcgugc

SEQ ID NO: 1841981 - RNA, 14 nt, Human
caccaacgucugug

SEQ ID NO: 1841982 - RNA, 13 nt, Human
caccaacccucag

SEQ ID NO: 1841983 - RNA, 16 nt, Human
caccaacgucugugcc

SEQ ID NO: 1841984 - RNA, 17 nt, Human
caccaacauacucccau

SEQ ID NO: 1841985 - RNA, 19 nt, Human
cacauuuuauuuuauuaug

SEQ ID NO: 1841986 - RNA, 20 nt, Human
cacauuuuauuuuauuaugc

SEQ ID NO: 1841987 - RNA, 21 nt, Human
cacauuuuauuuuauuaugca

SEQ ID NO: 1841988 - RNA, 17 nt, Human
cacauuuuauuuuauua

SEQ ID NO: 1841989 - RNA, 13 nt, Human
caccagggaaggg

SEQ ID NO: 1841990 - RNA, 21 nt, Human
caccagggaaggggacaagga

SEQ ID NO: 1841991 - RNA, 18 nt, Human
caccagggaaggggacaa

SEQ ID NO: 1841992 - RNA, 17 nt, Human
cacccaccucagccucc

SEQ ID NO: 1841993 - RNA, 13 nt, Human
caccagccccagu

SEQ ID NO: 1841994 - RNA, 16 nt, Human
caccagccccagugcc

SEQ ID NO: 1841995 - RNA, 18 nt, Human
cacccaccucagccuccc

SEQ ID NO: 1841996 - RNA, 16 nt, Human
cacccaggagccccga

SEQ ID NO: 1841997 - RNA, 12 nt, Human
cacacauuuuuu

SEQ ID NO: 1841998 - RNA, 16 nt, Human
cacacauuuuuuaaau

SEQ ID NO: 1841999 - RNA, 19 nt, Human
cacacauuuuuuaaaugca

SEQ ID NO: 1842000 - RNA, 20 nt, Human
cacacauuuuuuaaaugcac

SEQ ID NO: 1842001 - RNA, 10 nt, Human
cacacauuuu

SEQ ID NO: 1842002 - RNA, 11 nt, Human
cacacauuuuu

SEQ ID NO: 1842003 - RNA, 13 nt, Human
cacagaacccuug

SEQ ID NO: 1842004 - RNA, 23 nt, Human
cacagaaaagaaaguucaugcuu

SEQ ID NO: 1842005 - RNA, 17 nt, Human
cacagcucuucuccagg

SEQ ID NO: 1842006 - RNA, 14 nt, Human
cacagcucuucucc

SEQ ID NO: 1842007 - RNA, 15 nt, Human
cacagcucuucucca

SEQ ID NO: 1842008 - RNA, 15 nt, Human
cacagcucuguccug

SEQ ID NO: 1842009 - RNA, 16 nt, Human
cacagcucuguccugg

SEQ ID NO: 1842010 - RNA, 18 nt, Human
cacagcucuguccuggga

SEQ ID NO: 1842011 - RNA, 19 nt, Human
cacagcucuguccugggag

SEQ ID NO: 1842012 - RNA, 18 nt, Human
cacagacccugcccugug

SEQ ID NO: 1842013 - RNA, 11 nt, Human
cacagcucugu

SEQ ID NO: 1842014 - RNA, 14 nt, Human
cacagcucuguccu

SEQ ID NO: 1842015 - RNA, 17 nt, Human
cacagacccugcccugu

SEQ ID NO: 1842016 - RNA, 16 nt, Human
cacagacccugcccug

SEQ ID NO: 1842017 - RNA, 14 nt, Human
cacagacccugccc

SEQ ID NO: 1842018 - RNA, 21 nt, Human
cacaagcuccaagcucccagg

SEQ ID NO: 1842019 - RNA, 20 nt, Human
cacaagcuccaagcucccag

SEQ ID NO: 1842020 - RNA, 15 nt, Human
caaugggagcucaug

SEQ ID NO: 1842021 - RNA, 19 nt, Human
cacaagcuccaagcuccca

SEQ ID NO: 1842022 - RNA, 18 nt, Human
cacaagcuccaagcuccc

SEQ ID NO: 1842023 - RNA, 20 nt, Human
cacaagagcccaggccuccu

SEQ ID NO: 1842024 - RNA, 19 nt, Human
cacaagagcccaggccucc

SEQ ID NO: 1842025 - RNA, 18 nt, Human
cacaagagcccaggccuc

SEQ ID NO: 1842026 - RNA, 22 nt, Human
caaucccaccaacccucagagc

SEQ ID NO: 1842027 - RNA, 17 nt, Human
caaucccaccaacccuc

SEQ ID NO: 1842028 - RNA, 16 nt, Human
caaucccaccaacccu

SEQ ID NO: 1842029 - RNA, 23 nt, Human
caaucccaccaacccucagagcc

SEQ ID NO: 1842030 - RNA, 13 nt, Human
caaugcuggcugu

SEQ ID NO: 1842031 - RNA, 20 nt, Human
caaugcuggcuguuggcugg

SEQ ID NO: 1842032 - RNA, 21 nt, Human
caaugcuggcuguuggcuggg

SEQ ID NO: 1842033 - RNA, 20 nt, Human
caaggccaaaggaagcacau

SEQ ID NO: 1842034 - RNA, 19 nt, Human
caaggccaaaggaagcaca

SEQ ID NO: 1842035 - RNA, 21 nt, Human
caaggccaaaggaagcacaug

SEQ ID NO: 1842036 - RNA, 18 nt, Human
caaggcaaggcugucaau

SEQ ID NO: 1842037 - RNA, 16 nt, Human
caaggcaaggcuguca

SEQ ID NO: 1842038 - RNA, 17 nt, Human
caaggcaaggcugucaa

SEQ ID NO: 1842039 - RNA, 12 nt, Human
caagauuucaga

SEQ ID NO: 1842040 - RNA, 15 nt, Human
caaggcucugagcaa

SEQ ID NO: 1842041 - RNA, 20 nt, Human
caauaaaaucuugaaaaugc

SEQ ID NO: 1842042 - RNA, 20 nt, Human
cugaucugaugcaagcaaga

SEQ ID NO: 1842043 - RNA, 22 nt, Human
cugccucucccaucacuucccu

SEQ ID NO: 1842044 - RNA, 15 nt, Human
cugccucucccauca

SEQ ID NO: 1842045 - RNA, 23 nt, Human
cugccucucccaucacuucccua

SEQ ID NO: 1842046 - RNA, 24 nt, Human
cugccuccucuucaacugaccagc

SEQ ID NO: 1842047 - RNA, 15 nt, Human
cugccuccucuucaa

SEQ ID NO: 1842048 - RNA, 14 nt, Human
cugccuccucuuca

SEQ ID NO: 1842049 - RNA, 13 nt, Human
cugccuccucuuc

SEQ ID NO: 1842050 - RNA, 17 nt, Human
cugccuguucagcucca

SEQ ID NO: 1842051 - RNA, 18 nt, Human
cugccuguucagcuccag

SEQ ID NO: 1842052 - RNA, 20 nt, Human
cugccuguugggccaggagc

SEQ ID NO: 1842053 - RNA, 19 nt, Human
cugccuguucagcuccagc

SEQ ID NO: 1842054 - RNA, 22 nt, Human
cugccuguugggccaggagccu

SEQ ID NO: 1842055 - RNA, 21 nt, Human
cugccuguugggccaggagcc

SEQ ID NO: 1842056 - RNA, 23 nt, Human
cugccuguugggccaggagccuc

SEQ ID NO: 1842057 - RNA, 21 nt, Human
cugcugacuguuuucucuuga

SEQ ID NO: 1842058 - RNA, 18 nt, Human
cugcugacuguuuucucu

SEQ ID NO: 1842059 - RNA, 14 nt, Human
cugcuucaaauauu

SEQ ID NO: 1842060 - RNA, 21 nt, Human
cugcuucaaggauccugagcc

SEQ ID NO: 1842061 - RNA, 13 nt, Human
cugcuucaaggau

SEQ ID NO: 1842062 - RNA, 12 nt, Human
cugcuucaagga

SEQ ID NO: 1842063 - RNA, 19 nt, Human
cugcuucaaauauuucccu

SEQ ID NO: 1842064 - RNA, 23 nt, Human
cugcuucaaggauccugagccag

SEQ ID NO: 1842065 - RNA, 22 nt, Human
cugcuucaaggauccugagcca

SEQ ID NO: 1842066 - RNA, 20 nt, Human
cugcuuuugucuaugggacu

SEQ ID NO: 1842067 - RNA, 14 nt, Human
cuggagaaaaugga

SEQ ID NO: 1842068 - RNA, 14 nt, Human
cuggaagcacagcu

SEQ ID NO: 1842069 - RNA, 19 nt, Human
cugcuuuuuaaagaaugcu

SEQ ID NO: 1842070 - RNA, 21 nt, Human
cugcuuuugucuaugggacuc

SEQ ID NO: 1842071 - RNA, 20 nt, Human
cugggcaccggggccucgga

SEQ ID NO: 1842072 - RNA, 15 nt, Human
cugggcagaaggaag

SEQ ID NO: 1842073 - RNA, 12 nt, Human
cugggcagaagg

SEQ ID NO: 1842074 - RNA, 14 nt, Human
cugggccagaauuu

SEQ ID NO: 1842075 - RNA, 12 nt, Human
cugggccagaau

SEQ ID NO: 1842076 - RNA, 15 nt, Human
cuggggccaggcugg

SEQ ID NO: 1842077 - RNA, 15 nt, Human
cuggguucacugcaa

SEQ ID NO: 1842078 - RNA, 18 nt, Human
cuggguucacugcaaccu

SEQ ID NO: 1842079 - RNA, 20 nt, Human
cuggguucacugcaaccucc

SEQ ID NO: 1842080 - RNA, 11 nt, Human
cugggacacag

SEQ ID NO: 1842081 - RNA, 22 nt, Human
cuggccccucagggucccuggu

SEQ ID NO: 1842082 - RNA, 14 nt, Human
cuggcccugcccug

SEQ ID NO: 1842083 - RNA, 13 nt, Human
cuggcccugcccu

SEQ ID NO: 1842084 - RNA, 11 nt, Human
cuggcccugcc

SEQ ID NO: 1842085 - RNA, 22 nt, Human
cuggccgggaccccgagccugg

SEQ ID NO: 1842086 - RNA, 16 nt, Human
cuggccgggagccuga

SEQ ID NO: 1842087 - RNA, 15 nt, Human
cuggcccugcccugg

SEQ ID NO: 1842088 - RNA, 14 nt, Human
cuggccuagcauac

SEQ ID NO: 1842089 - RNA, 18 nt, Human
cuggcagaguugaagaca

SEQ ID NO: 1842090 - RNA, 17 nt, Human
cuggcagaguugaagac

SEQ ID NO: 1842091 - RNA, 13 nt, Human
cuggcagccccug

SEQ ID NO: 1842092 - RNA, 20 nt, Human
cuggcagccgugccuucagc

SEQ ID NO: 1842093 - RNA, 19 nt, Human
cuggcagccgugccuucag

SEQ ID NO: 1842094 - RNA, 22 nt, Human
cuggcagccgugccuucagcuc

SEQ ID NO: 1842095 - RNA, 21 nt, Human
cuggcagccgugccuucagcu

SEQ ID NO: 1842096 - RNA, 12 nt, Human
cuggcagccccu

SEQ ID NO: 1842097 - RNA, 11 nt, Human
cuggcagccca

SEQ ID NO: 1842098 - RNA, 19 nt, Human
cuggcagaguugaagacag

SEQ ID NO: 1842099 - RNA, 14 nt, Human
cuggcagaggaggg

SEQ ID NO: 1842100 - RNA, 21 nt, Human
cuuaaaaaugguuuaaauggu

SEQ ID NO: 1842101 - RNA, 14 nt, Human
cuguuuaagagaca

SEQ ID NO: 1842102 - RNA, 12 nt, Human
cuguuuaagaga

SEQ ID NO: 1842103 - RNA, 14 nt, Human
cuguuggcuggggg

SEQ ID NO: 1842104 - RNA, 19 nt, Human
cuguuggcugggggccuca

SEQ ID NO: 1842105 - RNA, 22 nt, Human
cuguuggcugggggccucagug

SEQ ID NO: 1842106 - RNA, 15 nt, Human
cuuaccagcagagca

SEQ ID NO: 1842107 - RNA, 20 nt, Human
cuuacauuuuacuuuuuccu

SEQ ID NO: 1842108 - RNA, 22 nt, Human
cuuacauuagcaguuugcuuug

SEQ ID NO: 1842109 - RNA, 21 nt, Human
cuuacauuagcaguuugcuuu

SEQ ID NO: 1842110 - RNA, 16 nt, Human
cuuacaagccagcugg

SEQ ID NO: 1842111 - RNA, 17 nt, Human
cuuacaagccagcugga

SEQ ID NO: 1842112 - RNA, 14 nt, Human
cuuaaaacaacacu

SEQ ID NO: 1842113 - RNA, 21 nt, Human
cuuagggaaggauacaaaagc

SEQ ID NO: 1842114 - RNA, 19 nt, Human
cuuagggaaggauacaaaa

SEQ ID NO: 1842115 - RNA, 15 nt, Human
cuuaggaagaauuuu

SEQ ID NO: 1842116 - RNA, 23 nt, Human
cuuagcucauucuccuuguguua

SEQ ID NO: 1842117 - RNA, 13 nt, Human
cuuagcugggaga

SEQ ID NO: 1842118 - RNA, 16 nt, Human
cuuaccagcagagcac

SEQ ID NO: 1842119 - RNA, 22 nt, Human
cuuagcucauucuccuuguguu

SEQ ID NO: 1842120 - RNA, 14 nt, Human
cugugcugcccugc

SEQ ID NO: 1842121 - RNA, 13 nt, Human
cugugcugcccug

SEQ ID NO: 1842122 - RNA, 12 nt, Human
cugugcugcccu

SEQ ID NO: 1842123 - RNA, 19 nt, Human
cugugcugcccugcccacc

SEQ ID NO: 1842124 - RNA, 18 nt, Human
cugugcugcccugcccac

SEQ ID NO: 1842125 - RNA, 17 nt, Human
cugugcugcccugccca

SEQ ID NO: 1842126 - RNA, 15 nt, Human
cugugcugcccugcc

SEQ ID NO: 1842127 - RNA, 19 nt, Human
cugugucagcauagaagua

SEQ ID NO: 1842128 - RNA, 17 nt, Human
cugugucagcauagaag

SEQ ID NO: 1842129 - RNA, 21 nt, Human
cugugcugcccugcccaccug

SEQ ID NO: 1842130 - RNA, 15 nt, Human
cugucgcccagucug

SEQ ID NO: 1842131 - RNA, 16 nt, Human
cugucgcccagucugg

SEQ ID NO: 1842132 - RNA, 21 nt, Human
cuguccugggagugagcuggu

SEQ ID NO: 1842133 - RNA, 23 nt, Human
cugucaauuacaggaaguacugg

SEQ ID NO: 1842134 - RNA, 20 nt, Human
cugucaauuacaggaaguac

SEQ ID NO: 1842135 - RNA, 19 nt, Human
cugucaauuacaggaagua

SEQ ID NO: 1842136 - RNA, 22 nt, Human
cuggugacaugucuuuucuugc

SEQ ID NO: 1842137 - RNA, 14 nt, Human
cugguuuccugccc

SEQ ID NO: 1842138 - RNA, 13 nt, Human
cugguuuccugcc

SEQ ID NO: 1842139 - RNA, 19 nt, Human
cuguagaaaagggaacuga

SEQ ID NO: 1842140 - RNA, 13 nt, Human
cuguagaguggga

SEQ ID NO: 1842141 - RNA, 15 nt, Human
cuuucuacccagcga

SEQ ID NO: 1842142 - RNA, 16 nt, Human
cuuucuacccagcgag

SEQ ID NO: 1842143 - RNA, 17 nt, Human
cuuugacgccaucccag

SEQ ID NO: 1842144 - RNA, 16 nt, Human
cuuugacgccauccca

SEQ ID NO: 1842145 - RNA, 20 nt, Human
cuuuuauaaacuuuaccuuu

SEQ ID NO: 1842146 - RNA, 21 nt, Human
cuuuuauaaacuuuaccuuuu

SEQ ID NO: 1842147 - RNA, 22 nt, Human
cuuuguauucucuccuguaccu

SEQ ID NO: 1842148 - RNA, 17 nt, Human
cuuuguauucucuccug

SEQ ID NO: 1842149 - RNA, 12 nt, Human
cuuuguaugcac

SEQ ID NO: 1842150 - RNA, 16 nt, Human
cuuuguaaugaaaacc

SEQ ID NO: 1842151 - RNA, 15 nt, Human
cuuuguaaugaaaac

SEQ ID NO: 1842152 - RNA, 14 nt, Human
cuuuguaaugaaaa

SEQ ID NO: 1842153 - RNA, 23 nt, Human
cuuuaaugucacaggcaggucca

SEQ ID NO: 1842154 - RNA, 20 nt, Human
cuuucacccuuuucuguuug

SEQ ID NO: 1842155 - RNA, 15 nt, Human
cuuucacccuuuucu

SEQ ID NO: 1842156 - RNA, 14 nt, Human
cuuucacccuuuuc

SEQ ID NO: 1842157 - RNA, 19 nt, Human
cuuggucugugagaugcua

SEQ ID NO: 1842158 - RNA, 16 nt, Human
cuuggucugugagaug

SEQ ID NO: 1842159 - RNA, 14 nt, Human
cuugguccugcugc

SEQ ID NO: 1842160 - RNA, 22 nt, Human
cuugguagaagcccuucuaccu

SEQ ID NO: 1842161 - RNA, 23 nt, Human
cuuggguucaagugauucuccug

SEQ ID NO: 1842162 - RNA, 19 nt, Human
cuugucuuuggacccugag

SEQ ID NO: 1842163 - RNA, 18 nt, Human
cuugucuuuggacccuga

SEQ ID NO: 1842164 - RNA, 15 nt, Human
cuugucuuuggaccc

SEQ ID NO: 1842165 - RNA, 13 nt, Human
cuugucuuuggac

SEQ ID NO: 1842166 - RNA, 20 nt, Human
cuuggugucgggcaugacac

SEQ ID NO: 1842167 - RNA, 19 nt, Human
cuuggugucgggcaugaca

SEQ ID NO: 1842168 - RNA, 13 nt, Human
cuuccuccuggug

SEQ ID NO: 1842169 - RNA, 15 nt, Human
cuuccucugagccuu

SEQ ID NO: 1842170 - RNA, 14 nt, Human
cuuccucugagccu

SEQ ID NO: 1842171 - RNA, 15 nt, Human
cuuccucuccacugc

SEQ ID NO: 1842172 - RNA, 14 nt, Human
cuuccucuccacug

SEQ ID NO: 1842173 - RNA, 13 nt, Human
cuuccucuccacu

SEQ ID NO: 1842174 - RNA, 21 nt, Human
cuuccucuuuccaucuacccu

SEQ ID NO: 1842175 - RNA, 16 nt, Human
cuuccucugaggcuga

SEQ ID NO: 1842176 - RNA, 22 nt, Human
cuuccucuuuccaucuacccuc

SEQ ID NO: 1842177 - RNA, 22 nt, Human
cuuccucugaggcugaaauuca

SEQ ID NO: 1842178 - RNA, 20 nt, Human
cuucucacauuuauauuuuu

SEQ ID NO: 1842179 - RNA, 13 nt, Human
cuucucacauuua

SEQ ID NO: 1842180 - RNA, 18 nt, Human
cuucuucagagacuccug

SEQ ID NO: 1842181 - RNA, 14 nt, Human
cuucuucagagacu

SEQ ID NO: 1842182 - RNA, 13 nt, Human
cuucuucagagac

SEQ ID NO: 1842183 - RNA, 12 nt, Human
cuugauucauaa

SEQ ID NO: 1842184 - RNA, 12 nt, Human
cuugcaaaguau

SEQ ID NO: 1842185 - RNA, 24 nt, Human
cuuggauuguccccgacccuugcc

SEQ ID NO: 1842186 - RNA, 23 nt, Human
cuuggauuguccccgacccuugc

SEQ ID NO: 1842187 - RNA, 18 nt, Human
cuugauguguuaucucuu

SEQ ID NO: 1842188 - RNA, 17 nt, Human
cuugauauccucuuuga

SEQ ID NO: 1842189 - RNA, 22 nt, Human
cuugauauccucuuugagugaa

SEQ ID NO: 1842190 - RNA, 16 nt, Human
cuugacaucaacugca

SEQ ID NO: 1842191 - RNA, 21 nt, Human
gaaaacuuuaugcuaagugaa

SEQ ID NO: 1842192 - RNA, 23 nt, Human
gaaaagaaaaaugagccuggcaa

SEQ ID NO: 1842193 - RNA, 22 nt, Human
gaaaacuuguauuauguguguu

SEQ ID NO: 1842194 - RNA, 19 nt, Human
gaaaacuuguauuaugugu

SEQ ID NO: 1842195 - RNA, 15 nt, Human
gaaaaugugugugug

SEQ ID NO: 1842196 - RNA, 12 nt, Human
gaaaaugugugu

SEQ ID NO: 1842197 - RNA, 18 nt, Human
gaaagaaaaucaggcugg

SEQ ID NO: 1842198 - RNA, 13 nt, Human
gaaacuggauuaa

SEQ ID NO: 1842199 - RNA, 17 nt, Human
gaaacuggauuaaacuu

SEQ ID NO: 1842200 - RNA, 15 nt, Human
gaaaggcuccaggag

SEQ ID NO: 1842201 - RNA, 14 nt, Human
gaaaggcuccagga

SEQ ID NO: 1842202 - RNA, 13 nt, Human
gaaaggcuccagg

SEQ ID NO: 1842203 - RNA, 16 nt, Human
gaaaggcuccaggagc

SEQ ID NO: 1842204 - RNA, 13 nt, Human
gaaagggcccaga

SEQ ID NO: 1842205 - RNA, 20 nt, Human
gaacacauaauucaggaagc

SEQ ID NO: 1842206 - RNA, 17 nt, Human
gaacacauaauucagga

SEQ ID NO: 1842207 - RNA, 11 nt, Human
gaaaugaaaaa

SEQ ID NO: 1842208 - RNA, 17 nt, Human
gaaaugaaagcagggac

SEQ ID NO: 1842209 - RNA, 15 nt, Human
gaaagggcccagaga

SEQ ID NO: 1842210 - RNA, 16 nt, Human
gaaagggcccagagag

SEQ ID NO: 1842211 - RNA, 18 nt, Human
gaaccaccacacccagcc

SEQ ID NO: 1842212 - RNA, 20 nt, Human
gaaccaccacacccagccca

SEQ ID NO: 1842213 - RNA, 21 nt, Human
gaaccaccacacccagcccac

SEQ ID NO: 1842214 - RNA, 22 nt, Human
gaaccaccacacccagcccacu

SEQ ID NO: 1842215 - RNA, 22 nt, Human
gaaccauggucggaaaacaugc

SEQ ID NO: 1842216 - RNA, 23 nt, Human
gaaccaccacacccagcccacuu

SEQ ID NO: 1842217 - RNA, 15 nt, Human
gaacuccuggccuca

SEQ ID NO: 1842218 - RNA, 14 nt, Human
gaacuccuggccuc

SEQ ID NO: 1842219 - RNA, 17 nt, Human
gaacccgggaggcagag

SEQ ID NO: 1842220 - RNA, 19 nt, Human
gaacccgggaggcagaggu

SEQ ID NO: 1842221 - RNA, 14 nt, Human
gaacuccugaccuc

SEQ ID NO: 1842222 - RNA, 13 nt, Human
gaacuccuggccu

SEQ ID NO: 1842223 - RNA, 13 nt, Human
gaagacagcucuu

SEQ ID NO: 1842224 - RNA, 12 nt, Human
gaagacagcucu

SEQ ID NO: 1842225 - RNA, 15 nt, Human
gaagacagagcuaca

SEQ ID NO: 1842226 - RNA, 13 nt, Human
gaagacagagcua

SEQ ID NO: 1842227 - RNA, 21 nt, Human
gaagacacugaugggcaaccc

SEQ ID NO: 1842228 - RNA, 16 nt, Human
gaagacacugaugggc

SEQ ID NO: 1842229 - RNA, 15 nt, Human
gaagacagcucuuau

SEQ ID NO: 1842230 - RNA, 14 nt, Human
gaagacagcucuua

SEQ ID NO: 1842231 - RNA, 12 nt, Human
gaagcagcucuu

SEQ ID NO: 1842232 - RNA, 16 nt, Human
gaagcaccauaacuuu

SEQ ID NO: 1842233 - RNA, 22 nt, Human
gaagcacaugccucucucaggc

SEQ ID NO: 1842234 - RNA, 14 nt, Human
gaagcacaugccuc

SEQ ID NO: 1842235 - RNA, 13 nt, Human
gaagcacagcuuc

SEQ ID NO: 1842236 - RNA, 14 nt, Human
gaagcacagcuuca

SEQ ID NO: 1842237 - RNA, 17 nt, Human
gaagacucauucuucug

SEQ ID NO: 1842238 - RNA, 18 nt, Human
gaagacucauucuucugu

SEQ ID NO: 1842239 - RNA, 16 nt, Human
gaagacucauucuucu

SEQ ID NO: 1842240 - RNA, 15 nt, Human
gacgcugugcugccc

SEQ ID NO: 1842241 - RNA, 13 nt, Human
gacgcugugcugc

SEQ ID NO: 1842242 - RNA, 12 nt, Human
gacgcugugcug

SEQ ID NO: 1842243 - RNA, 17 nt, Human
gagaagcggcuggcagc

SEQ ID NO: 1842244 - RNA, 14 nt, Human
gacuuuggaaagag

SEQ ID NO: 1842245 - RNA, 14 nt, Human
gacuuuggaaagac

SEQ ID NO: 1842246 - RNA, 18 nt, Human
gacuguuuucucuugaga

SEQ ID NO: 1842247 - RNA, 16 nt, Human
gacuguuuucucuuga

SEQ ID NO: 1842248 - RNA, 21 nt, Human
gacuuuucuguccgagcuuug

SEQ ID NO: 1842249 - RNA, 23 nt, Human
gacuuuucuguccgagcuuugaa

SEQ ID NO: 1842250 - RNA, 22 nt, Human
gacuuuguuaguuucuccaagc

SEQ ID NO: 1842251 - RNA, 14 nt, Human
gacucaaugcacug

SEQ ID NO: 1842252 - RNA, 17 nt, Human
gacucaaugcacugaca

SEQ ID NO: 1842253 - RNA, 22 nt, Human
gacuguacaaaguagaagucuu

SEQ ID NO: 1842254 - RNA, 17 nt, Human
gacuguacuccucccag

SEQ ID NO: 1842255 - RNA, 16 nt, Human
gacuguacuccuccca

SEQ ID NO: 1842256 - RNA, 20 nt, Human
gacugugugcucaggagccc

SEQ ID NO: 1842257 - RNA, 17 nt, Human
gacugugugcucaggag

SEQ ID NO: 1842258 - RNA, 16 nt, Human
gacugugugcucagga

SEQ ID NO: 1842259 - RNA, 14 nt, Human
gacugugugcucag

SEQ ID NO: 1842260 - RNA, 21 nt, Human
gacugucucaagagggcacug

SEQ ID NO: 1842261 - RNA, 23 nt, Human
gacugucucaagagggcacuggu

SEQ ID NO: 1842262 - RNA, 22 nt, Human
gacugucucaagagggcacugg

SEQ ID NO: 1842263 - RNA, 15 nt, Human
gaccaucccugaagg

SEQ ID NO: 1842264 - RNA, 14 nt, Human
gaccaucccugaag

SEQ ID NO: 1842265 - RNA, 17 nt, Human
gaccauucuccaccugc

SEQ ID NO: 1842266 - RNA, 13 nt, Human
gaccccuggcuuu

SEQ ID NO: 1842267 - RNA, 16 nt, Human
gaccauucuccaccug

SEQ ID NO: 1842268 - RNA, 17 nt, Human
gaccaucccugaaggcc

SEQ ID NO: 1842269 - RNA, 16 nt, Human
gaccaucccugaaggc

SEQ ID NO: 1842270 - RNA, 16 nt, Human
gacccuauugcugcuu

SEQ ID NO: 1842271 - RNA, 22 nt, Human
gaccccuggcuuuucacugcug

SEQ ID NO: 1842272 - RNA, 21 nt, Human
gaccccuggcuuuucacugcu

SEQ ID NO: 1842273 - RNA, 12 nt, Human
gacccggcugcg

SEQ ID NO: 1842274 - RNA, 13 nt, Human
gacccggcugcgu

SEQ ID NO: 1842275 - RNA, 20 nt, Human
gacaguauggcagcuuuccu

SEQ ID NO: 1842276 - RNA, 17 nt, Human
gacaggguuucaccaug

SEQ ID NO: 1842277 - RNA, 12 nt, Human
gacagccuggca

SEQ ID NO: 1842278 - RNA, 11 nt, Human
gacagccuggc

SEQ ID NO: 1842279 - RNA, 13 nt, Human
gacagcuccuucu

SEQ ID NO: 1842280 - RNA, 14 nt, Human
gacagcuccuucug

SEQ ID NO: 1842281 - RNA, 15 nt, Human
gacagcuccuucugu

SEQ ID NO: 1842282 - RNA, 20 nt, Human
gacagaaagcagaacaguga

SEQ ID NO: 1842283 - RNA, 14 nt, Human
gacagaaagcagaa

SEQ ID NO: 1842284 - RNA, 20 nt, Human
gaggccagagacacaagccu

SEQ ID NO: 1842285 - RNA, 17 nt, Human
gaggcucugcccuuggu

SEQ ID NO: 1842286 - RNA, 15 nt, Human
gaggcucugcccuug

SEQ ID NO: 1842287 - RNA, 19 nt, Human
gaggcucuggagcccacug

SEQ ID NO: 1842288 - RNA, 14 nt, Human
gaggcucuggagcc

SEQ ID NO: 1842289 - RNA, 14 nt, Human
gaggcucugcccuu

SEQ ID NO: 1842290 - RNA, 13 nt, Human
gaggcucugcccu

SEQ ID NO: 1842291 - RNA, 12 nt, Human
gaggcucugccc

SEQ ID NO: 1842292 - RNA, 15 nt, Human
gagggcuccagacac

SEQ ID NO: 1842293 - RNA, 14 nt, Human
gagggcuccagaca

SEQ ID NO: 1842294 - RNA, 13 nt, Human
gagggcuccagac

SEQ ID NO: 1842295 - RNA, 12 nt, Human
gagggcuccaga

SEQ ID NO: 1842296 - RNA, 12 nt, Human
gaggggaacaga

SEQ ID NO: 1842297 - RNA, 14 nt, Human
gaggcugccucucc

SEQ ID NO: 1842298 - RNA, 13 nt, Human
gaggugggauccu

SEQ ID NO: 1842299 - RNA, 16 nt, Human
gaggugggauccucca

SEQ ID NO: 1842300 - RNA, 15 nt, Human
gaggugggauccucc

SEQ ID NO: 1842301 - RNA, 21 nt, Human
gagucacuggaacacuaauga

SEQ ID NO: 1842302 - RNA, 14 nt, Human
gagucacuggaaca

SEQ ID NO: 1842303 - RNA, 17 nt, Human
gaggugggauccuccag

SEQ ID NO: 1842304 - RNA, 18 nt, Human
gagucagaaguuucugcc

SEQ ID NO: 1842305 - RNA, 14 nt, Human
gagugagacucugu

SEQ ID NO: 1842306 - RNA, 18 nt, Human
gagugagacucugucuca

SEQ ID NO: 1842307 - RNA, 19 nt, Human
gaguugauacuacaguuug

SEQ ID NO: 1842308 - RNA, 21 nt, Human
gaguugauagcacagacccug

SEQ ID NO: 1842309 - RNA, 22 nt, Human
gaguugauacuacaguuuguua

SEQ ID NO: 1842310 - RNA, 13 nt, Human
gagugcagugagc

SEQ ID NO: 1842311 - RNA, 18 nt, Human
gagugcagugagccgaga

SEQ ID NO: 1842312 - RNA, 20 nt, Human
gagcugccuguucagcucca

SEQ ID NO: 1842313 - RNA, 17 nt, Human
gagcggagaaaggaagg

SEQ ID NO: 1842314 - RNA, 15 nt, Human
gagcugccuguucag

SEQ ID NO: 1842315 - RNA, 16 nt, Human
gagcugccuguucagc

SEQ ID NO: 1842316 - RNA, 19 nt, Human
gagcugccuguucagcucc

SEQ ID NO: 1842317 - RNA, 13 nt, Human
gagcgacagugag

SEQ ID NO: 1842318 - RNA, 15 nt, Human
gagcgacagugagac

SEQ ID NO: 1842319 - RNA, 13 nt, Human
gagccuuccaggg

SEQ ID NO: 1842320 - RNA, 12 nt, Human
gagccuuccagg

SEQ ID NO: 1842321 - RNA, 17 nt, Human
gagcaucaggccaggcc

SEQ ID NO: 1842322 - RNA, 22 nt, Human
gagcaucaggccaggcccucug

SEQ ID NO: 1842323 - RNA, 20 nt, Human
gagcaucaggccaggcccuc

SEQ ID NO: 1842324 - RNA, 14 nt, Human
gaugaugacuaugg

SEQ ID NO: 1842325 - RNA, 23 nt, Human
gaugcuucucacugccaugccag

SEQ ID NO: 1842326 - RNA, 14 nt, Human
gaugcuuguacaua

SEQ ID NO: 1842327 - RNA, 16 nt, Human
gaugcuuguacauaau

SEQ ID NO: 1842328 - RNA, 23 nt, Human
gauggaggaaaaccaagccgugg

SEQ ID NO: 1842329 - RNA, 22 nt, Human
gauggaaaaaccacccccaaau

SEQ ID NO: 1842330 - RNA, 17 nt, Human
gaugucccaacuuguaa

SEQ ID NO: 1842331 - RNA, 18 nt, Human
gaugucccaacuuguaaa

SEQ ID NO: 1842332 - RNA, 20 nt, Human
gaucuggguucacugcaacc

SEQ ID NO: 1842333 - RNA, 22 nt, Human
gaguugauagcacagacccugc

SEQ ID NO: 1842334 - RNA, 18 nt, Human
gaucuggguucacugcaa

SEQ ID NO: 1842335 - RNA, 19 nt, Human
gauucuccugccucagccu

SEQ ID NO: 1842336 - RNA, 20 nt, Human
gauucuccugccucagccuc

SEQ ID NO: 1842337 - RNA, 21 nt, Human
gauucuccugccucagccucc

SEQ ID NO: 1842338 - RNA, 20 nt, Human
gauuuaacagaaauguacag

SEQ ID NO: 1842339 - RNA, 23 nt, Human
gauuuaacagaaauguacagcaa

SEQ ID NO: 1842340 - RNA, 23 nt, Human
gauucuuauggacaaugacccag

SEQ ID NO: 1842341 - RNA, 21 nt, Human
gauucuucugcuucagccucc

SEQ ID NO: 1842342 - RNA, 23 nt, Human
gauuuuuuuuuccuucagugccu

SEQ ID NO: 1842343 - RNA, 22 nt, Human
gauuuuuuuuuccuucagugcc

SEQ ID NO: 1842344 - RNA, 18 nt, Human
gauuucacucuccuuggu

SEQ ID NO: 1842345 - RNA, 17 nt, Human
gauuucacucuccuugg

SEQ ID NO: 1842346 - RNA, 20 nt, Human
gauuucagcucacugcaacc

SEQ ID NO: 1842347 - RNA, 17 nt, Human
gauuucagcucacugca

SEQ ID NO: 1842348 - RNA, 15 nt, Human
gauuucagcucacug

SEQ ID NO: 1842349 - RNA, 16 nt, Human
gauuucacucuccuug

SEQ ID NO: 1842350 - RNA, 13 nt, Human
gauuucacucucc

SEQ ID NO: 1842351 - RNA, 18 nt, Human
gcaaccuccgccucuugg

SEQ ID NO: 1842352 - RNA, 22 nt, Human
gcaacccuggugaccagcacca

SEQ ID NO: 1842353 - RNA, 15 nt, Human
gcaaaagaugcuucu

SEQ ID NO: 1842354 - RNA, 16 nt, Human
gcaaaagaugcuucuc

SEQ ID NO: 1842355 - RNA, 17 nt, Human
gcaacccccagccugcu

SEQ ID NO: 1842356 - RNA, 18 nt, Human
gcaacccccagccugcua

SEQ ID NO: 1842357 - RNA, 11 nt, Human
gcaauaaagca

SEQ ID NO: 1842358 - RNA, 21 nt, Human
gcaauaaagcagcguuucuau

SEQ ID NO: 1842359 - RNA, 12 nt, Human
gcacacaccaga

SEQ ID NO: 1842360 - RNA, 14 nt, Human
gcacacaccagagc

SEQ ID NO: 1842361 - RNA, 15 nt, Human
gcacacaccagagcc

SEQ ID NO: 1842362 - RNA, 16 nt, Human
gcacacaccagagccc

SEQ ID NO: 1842363 - RNA, 17 nt, Human
gcacacaccagagccca

SEQ ID NO: 1842364 - RNA, 18 nt, Human
gcacacaccagagcccac

SEQ ID NO: 1842365 - RNA, 19 nt, Human
gcacacaccagagcccacc

SEQ ID NO: 1842366 - RNA, 12 nt, Human
gcaccuccugcc

SEQ ID NO: 1842367 - RNA, 16 nt, Human
gcaccggcuggccugg

SEQ ID NO: 1842368 - RNA, 15 nt, Human
gcaccggcuggccug

SEQ ID NO: 1842369 - RNA, 17 nt, Human
gcaccggcuggccuggc

SEQ ID NO: 1842370 - RNA, 18 nt, Human
gcaccuacaguguacagu

SEQ ID NO: 1842371 - RNA, 19 nt, Human
gcaccuacaguguacaguc

SEQ ID NO: 1842372 - RNA, 21 nt, Human
gcaccuacaguguacagucuu

SEQ ID NO: 1842373 - RNA, 18 nt, Human
gcaccuaccaccacgccc

SEQ ID NO: 1842374 - RNA, 17 nt, Human
gcaccuaccaccacgcc

SEQ ID NO: 1842375 - RNA, 12 nt, Human
gcacacauuuuu

SEQ ID NO: 1842376 - RNA, 11 nt, Human
gcacacauuuu

SEQ ID NO: 1842377 - RNA, 20 nt, Human
gcacacaccagagcccaccu

SEQ ID NO: 1842378 - RNA, 11 nt, Human
gcacacagcac

SEQ ID NO: 1842379 - RNA, 23 nt, Human
gcacacagcacgggggccaagga

SEQ ID NO: 1842380 - RNA, 22 nt, Human
gcacuauagccuaggugacaga

SEQ ID NO: 1842381 - RNA, 12 nt, Human
gcacuccccugc

SEQ ID NO: 1842382 - RNA, 17 nt, Human
gcacuccagccugggug

SEQ ID NO: 1842383 - RNA, 17 nt, Human
gcauccuggcacccggc

SEQ ID NO: 1842384 - RNA, 21 nt, Human
gcauccuggcacccggccccu

SEQ ID NO: 1842385 - RNA, 13 nt, Human
gcaucgcaaugua

SEQ ID NO: 1842386 - RNA, 22 nt, Human
gcauccuggcacccggccccug

SEQ ID NO: 1842387 - RNA, 23 nt, Human
gcauccuggcacccggccccugc

SEQ ID NO: 1842388 - RNA, 13 nt, Human
gcauggccaggug

SEQ ID NO: 1842389 - RNA, 17 nt, Human
gcauggccagguggcca

SEQ ID NO: 1842390 - RNA, 14 nt, Human
gcauggccaggugg

SEQ ID NO: 1842391 - RNA, 16 nt, Human
gcaugggaaugaaugu

SEQ ID NO: 1842392 - RNA, 13 nt, Human
gcaugggaaugaa

SEQ ID NO: 1842393 - RNA, 19 nt, Human
gcaugggaaugaaugucag

SEQ ID NO: 1842394 - RNA, 23 nt, Human
gcaugucccuaccgagucucuuc

SEQ ID NO: 1842395 - RNA, 17 nt, Human
gcaugugaugagaggaa

SEQ ID NO: 1842396 - RNA, 18 nt, Human
gccaagaauucuuaaaua

SEQ ID NO: 1842397 - RNA, 14 nt, Human
gccaagaauucuua

SEQ ID NO: 1842398 - RNA, 19 nt, Human
gccaacuauggccugugga

SEQ ID NO: 1842399 - RNA, 15 nt, Human
gccaacuauggccug

SEQ ID NO: 1842400 - RNA, 14 nt, Human
gccaacuauggccu

SEQ ID NO: 1842401 - RNA, 12 nt, Human
gcauuuaaaaga

SEQ ID NO: 1842402 - RNA, 15 nt, Human
gcauuuaaaagauac

SEQ ID NO: 1842403 - RNA, 14 nt, Human
gcauuugaaaauuu

SEQ ID NO: 1842404 - RNA, 16 nt, Human
gcauuugaaaauuuug

SEQ ID NO: 1842405 - RNA, 22 nt, Human
gccaagcaccuagccucgcucu

SEQ ID NO: 1842406 - RNA, 11 nt, Human
gccaaggccaa

SEQ ID NO: 1842407 - RNA, 17 nt, Human
gccaaggccaaaggaag

SEQ ID NO: 1842408 - RNA, 19 nt, Human
gccaaggccaaaggaagca

SEQ ID NO: 1842409 - RNA, 15 nt, Human
gcauaccacuuuugu

SEQ ID NO: 1842410 - RNA, 16 nt, Human
gcauaccacuuuuguu

SEQ ID NO: 1842411 - RNA, 23 nt, Human
gcaguugccagucaccccggcca

SEQ ID NO: 1842412 - RNA, 14 nt, Human
gcaguugccaguca

SEQ ID NO: 1842413 - RNA, 15 nt, Human
gcauaaaaauuagcc

SEQ ID NO: 1842414 - RNA, 22 nt, Human
gcagcugcgguccacccaggag

SEQ ID NO: 1842415 - RNA, 23 nt, Human
gcagcugcgguccacccaggagc

SEQ ID NO: 1842416 - RNA, 13 nt, Human
gcagcugcuuuug

SEQ ID NO: 1842417 - RNA, 20 nt, Human
gcagcugcuuuugucuaugg

SEQ ID NO: 1842418 - RNA, 15 nt, Human
gcagcuuauucacaa

SEQ ID NO: 1842419 - RNA, 16 nt, Human
gcagcuugaggguugg

SEQ ID NO: 1842420 - RNA, 17 nt, Human
gcaggcucucaggccag

SEQ ID NO: 1842421 - RNA, 18 nt, Human
gcaggcucucaggccagc

SEQ ID NO: 1842422 - RNA, 13 nt, Human
gcaggcuggcccu

SEQ ID NO: 1842423 - RNA, 22 nt, Human
gcagggaaacagcuaaugggac

SEQ ID NO: 1842424 - RNA, 16 nt, Human
gcaggcucucaggcca

SEQ ID NO: 1842425 - RNA, 15 nt, Human
gcaggcucucaggcc

SEQ ID NO: 1842426 - RNA, 14 nt, Human
gcaggcucucaggc

SEQ ID NO: 1842427 - RNA, 13 nt, Human
gcaggcucucagg

SEQ ID NO: 1842428 - RNA, 12 nt, Human
gcaggcucucag

SEQ ID NO: 1842429 - RNA, 22 nt, Human
gcaggcucgggcuccccagccc

SEQ ID NO: 1842430 - RNA, 19 nt, Human
gcagcuugaggguugggcu

SEQ ID NO: 1842431 - RNA, 21 nt, Human
gcagcuugaggguugggcugg

SEQ ID NO: 1842432 - RNA, 16 nt, Human
gcacuuuguucuggcu

SEQ ID NO: 1842433 - RNA, 11 nt, Human
gcucugcccuu

SEQ ID NO: 1842434 - RNA, 23 nt, Human
gcucugcaagaauugaagcagga

SEQ ID NO: 1842435 - RNA, 23 nt, Human
gcucugaucauccacugugccau

SEQ ID NO: 1842436 - RNA, 17 nt, Human
gcucugaucauccacug

SEQ ID NO: 1842437 - RNA, 15 nt, Human
gcuccacuuggucug

SEQ ID NO: 1842438 - RNA, 19 nt, Human
gcuccuggcccacugcauc

SEQ ID NO: 1842439 - RNA, 18 nt, Human
gcuccuggcccacugcau

SEQ ID NO: 1842440 - RNA, 20 nt, Human
gcuccuggcccacugcaucg

SEQ ID NO: 1842441 - RNA, 15 nt, Human
gcuccuggcccacug

SEQ ID NO: 1842442 - RNA, 14 nt, Human
gcuccuggcccacu

SEQ ID NO: 1842443 - RNA, 21 nt, Human
gcuccugccaccacgcccggc

SEQ ID NO: 1842444 - RNA, 18 nt, Human
gcuccugccaccacgccc

SEQ ID NO: 1842445 - RNA, 12 nt, Human
gcuccugccacc

SEQ ID NO: 1842446 - RNA, 17 nt, Human
gcucccaggcauucccc

SEQ ID NO: 1842447 - RNA, 22 nt, Human
gcucccacaggcccuuccucuc

SEQ ID NO: 1842448 - RNA, 21 nt, Human
gcucccacaggcccuuccucu

SEQ ID NO: 1842449 - RNA, 20 nt, Human
gcucccacaggcccuuccuc

SEQ ID NO: 1842450 - RNA, 17 nt, Human
gcucccacaggcccuuc

SEQ ID NO: 1842451 - RNA, 16 nt, Human
gcucccacaggcccuu

SEQ ID NO: 1842452 - RNA, 20 nt, Human
gcuccagcucaccagcccca

SEQ ID NO: 1842453 - RNA, 21 nt, Human
gcuccagcucaccagccccag

SEQ ID NO: 1842454 - RNA, 18 nt, Human
gcuccacuuggucuguga

SEQ ID NO: 1842455 - RNA, 19 nt, Human
gcuccacuuggucugugag

SEQ ID NO: 1842456 - RNA, 18 nt, Human
gcuccagcucaccagccc

SEQ ID NO: 1842457 - RNA, 16 nt, Human
gcuagaacucccuuuc

SEQ ID NO: 1842458 - RNA, 18 nt, Human
gcuagaacucccuuucaa

SEQ ID NO: 1842459 - RNA, 12 nt, Human
gcuagaacuccc

SEQ ID NO: 1842460 - RNA, 13 nt, Human
gcuagaacucccu

SEQ ID NO: 1842461 - RNA, 14 nt, Human
gcuagaacucccuu

SEQ ID NO: 1842462 - RNA, 15 nt, Human
gcuagaacucccuuu

SEQ ID NO: 1842463 - RNA, 20 nt, Human
gcgggaggauguucugggac

SEQ ID NO: 1842464 - RNA, 21 nt, Human
gcgggaggauguucugggaca

SEQ ID NO: 1842465 - RNA, 22 nt, Human
gcgggaggauguucugggacac

SEQ ID NO: 1842466 - RNA, 20 nt, Human
gcgugcacacaccagagccc

SEQ ID NO: 1842467 - RNA, 18 nt, Human
gcguuucuaugacacaug

SEQ ID NO: 1842468 - RNA, 23 nt, Human
gcgugcacacaccagagcccacc

SEQ ID NO: 1842469 - RNA, 14 nt, Human
gcuaaucagcauuc

SEQ ID NO: 1842470 - RNA, 22 nt, Human
gcuaaucagcauucucacuccu

SEQ ID NO: 1842471 - RNA, 17 nt, Human
gcuaaucagcauucuca

SEQ ID NO: 1842472 - RNA, 16 nt, Human
gcuaaucagcauucuc

SEQ ID NO: 1842473 - RNA, 23 nt, Human
gcuaagugauccucccaccucag

SEQ ID NO: 1842474 - RNA, 15 nt, Human
gcuaaugggacacua

SEQ ID NO: 1842475 - RNA, 13 nt, Human
gcuaaugggacac

SEQ ID NO: 1842476 - RNA, 16 nt, Human
gcuaggccuggccaga

SEQ ID NO: 1842477 - RNA, 17 nt, Human
gcuaggccuggccagau

SEQ ID NO: 1842478 - RNA, 23 nt, Human
gcuaggccuggccagaugcacca

SEQ ID NO: 1842479 - RNA, 22 nt, Human
gcuagugugguguuuccuggca

SEQ ID NO: 1842480 - RNA, 21 nt, Human
gcuagugugguguuuccuggc

SEQ ID NO: 1842481 - RNA, 12 nt, Human
gcuaugcauuug

SEQ ID NO: 1842482 - RNA, 19 nt, Human
gcuauucaguaauaacucu

SEQ ID NO: 1842483 - RNA, 13 nt, Human
gcuaugcauuuga

SEQ ID NO: 1842484 - RNA, 13 nt, Human
gcucagagagggu

SEQ ID NO: 1842485 - RNA, 20 nt, Human
gcucacugcauccuccgccu

SEQ ID NO: 1842486 - RNA, 14 nt, Human
gcucagagagggug

SEQ ID NO: 1842487 - RNA, 23 nt, Human
gcucagguggggucacucuggca

SEQ ID NO: 1842488 - RNA, 14 nt, Human
gcucaggugucccu

SEQ ID NO: 1842489 - RNA, 16 nt, Human
gcucaggugucccugc

SEQ ID NO: 1842490 - RNA, 17 nt, Human
gcucaggugucccugca

SEQ ID NO: 1842491 - RNA, 16 nt, Human
gcucacugcauccucc

SEQ ID NO: 1842492 - RNA, 17 nt, Human
gcucacugcagccucaa

SEQ ID NO: 1842493 - RNA, 15 nt, Human
gcucacugcagccuc

SEQ ID NO: 1842494 - RNA, 16 nt, Human
gcucacugcagccuca

SEQ ID NO: 1842495 - RNA, 11 nt, Human
gcucacugcag

SEQ ID NO: 1842496 - RNA, 12 nt, Human
gcucacugcagc

SEQ ID NO: 1842497 - RNA, 13 nt, Human
gcucacugcagcc

SEQ ID NO: 1842498 - RNA, 14 nt, Human
gcucacugcagccu

SEQ ID NO: 1842499 - RNA, 20 nt, Human
gcuauucaguaauaacucua

SEQ ID NO: 1842500 - RNA, 22 nt, Human
gccugcccaggccccugccacc

SEQ ID NO: 1842501 - RNA, 15 nt, Human
gccugcccaggcccc

SEQ ID NO: 1842502 - RNA, 12 nt, Human
gccuccauccug

SEQ ID NO: 1842503 - RNA, 17 nt, Human
gccucgaacuggcugca

SEQ ID NO: 1842504 - RNA, 19 nt, Human
gccuccugugugugcgccu

SEQ ID NO: 1842505 - RNA, 23 nt, Human
gccuccugugugugcgccuacag

SEQ ID NO: 1842506 - RNA, 16 nt, Human
gccucccaaagugcug

SEQ ID NO: 1842507 - RNA, 17 nt, Human
gccucccaaagugcugg

SEQ ID NO: 1842508 - RNA, 21 nt, Human
gccucuuaugggcuggguucu

SEQ ID NO: 1842509 - RNA, 14 nt, Human
gccucuuggguuca

SEQ ID NO: 1842510 - RNA, 13 nt, Human
gccugcccaggcc

SEQ ID NO: 1842511 - RNA, 14 nt, Human
gccugcccaggccc

SEQ ID NO: 1842512 - RNA, 16 nt, Human
gccucuuaugggcugg

SEQ ID NO: 1842513 - RNA, 18 nt, Human
gccucuuaugggcugggu

SEQ ID NO: 1842514 - RNA, 17 nt, Human
gccucuuaugggcuggg

SEQ ID NO: 1842515 - RNA, 20 nt, Human
gccucgaacuggcugcaaag

SEQ ID NO: 1842516 - RNA, 22 nt, Human
gccucgaacuggcugcaaaggg

SEQ ID NO: 1842517 - RNA, 20 nt, Human
gcgcagcauauucaggaagc

SEQ ID NO: 1842518 - RNA, 22 nt, Human
gcgaucuggguucacugcaacc

SEQ ID NO: 1842519 - RNA, 21 nt, Human
gccuucggccuccauccugag

SEQ ID NO: 1842520 - RNA, 23 nt, Human
gccuucggccuccauccugaggc

SEQ ID NO: 1842521 - RNA, 20 nt, Human
gccuucggccuccauccuga

SEQ ID NO: 1842522 - RNA, 21 nt, Human
gccuguugggccaggagccuc

SEQ ID NO: 1842523 - RNA, 21 nt, Human
gccuugaccauucuccaccug

SEQ ID NO: 1842524 - RNA, 20 nt, Human
gccuugaccauucuccaccu

SEQ ID NO: 1842525 - RNA, 19 nt, Human
gccuugaccauucuccacc

SEQ ID NO: 1842526 - RNA, 17 nt, Human
gccuugaccauucucca

SEQ ID NO: 1842527 - RNA, 17 nt, Human
gcgagcccugguggcag

SEQ ID NO: 1842528 - RNA, 15 nt, Human
gcgagcccugguggc

SEQ ID NO: 1842529 - RNA, 20 nt, Human
gccuggccugagcugggaug

SEQ ID NO: 1842530 - RNA, 13 nt, Human
gccuggccugagc

SEQ ID NO: 1842531 - RNA, 18 nt, Human
gccuggccugagcuggga

SEQ ID NO: 1842532 - RNA, 14 nt, Human
gccuggccugagcu

SEQ ID NO: 1842533 - RNA, 20 nt, Human
gccuguugggccaggagccu

SEQ ID NO: 1842534 - RNA, 18 nt, Human
gccuguugggccaggagc

SEQ ID NO: 1842535 - RNA, 16 nt, Human
gccuguugggccagga

SEQ ID NO: 1842536 - RNA, 15 nt, Human
gccuguugggccagg

SEQ ID NO: 1842537 - RNA, 14 nt, Human
gccuguugggccag

SEQ ID NO: 1842538 - RNA, 23 nt, Human
gccuguucccauucuugcauggc

SEQ ID NO: 1842539 - RNA, 19 nt, Human
gccuguucccauucuugca

SEQ ID NO: 1842540 - RNA, 17 nt, Human
gccugugccucugggac

SEQ ID NO: 1842541 - RNA, 16 nt, Human
gccugugccucuggga

SEQ ID NO: 1842542 - RNA, 13 nt, Human
gccuggcucaggu

SEQ ID NO: 1842543 - RNA, 23 nt, Human
gccuggcuccaaacccucgaggc

SEQ ID NO: 1842544 - RNA, 18 nt, Human
gccugugccucugggacu

SEQ ID NO: 1842545 - RNA, 12 nt, Human
gcccccacuggu

SEQ ID NO: 1842546 - RNA, 17 nt, Human
gccccugccacccuggg

SEQ ID NO: 1842547 - RNA, 16 nt, Human
gccccugccacccugg

SEQ ID NO: 1842548 - RNA, 23 nt, Human
gcccgggcucugccucccaucac

SEQ ID NO: 1842549 - RNA, 23 nt, Human
gccccugccucucugcagguccc

SEQ ID NO: 1842550 - RNA, 20 nt, Human
gccccugccucucugcaggu

SEQ ID NO: 1842551 - RNA, 15 nt, Human
gccccugcucuggug

SEQ ID NO: 1842552 - RNA, 15 nt, Human
gcccucacccugggg

SEQ ID NO: 1842553 - RNA, 23 nt, Human
gcccuaaugcgcaggcuggcccu

SEQ ID NO: 1842554 - RNA, 20 nt, Human
gcccuaaugcgcaggcuggc

SEQ ID NO: 1842555 - RNA, 19 nt, Human
gcccuaaugcgcaggcugg

SEQ ID NO: 1842556 - RNA, 17 nt, Human
gcccuaaugcgcaggcu

SEQ ID NO: 1842557 - RNA, 16 nt, Human
gcccuaaugcgcaggc

SEQ ID NO: 1842558 - RNA, 18 nt, Human
gcccugcagagggcacag

SEQ ID NO: 1842559 - RNA, 22 nt, Human
gcccugcccaccuggccucugc

SEQ ID NO: 1842560 - RNA, 21 nt, Human
gcccugcccaccuggccucug

SEQ ID NO: 1842561 - RNA, 20 nt, Human
gcccugcccaccuggccucu

SEQ ID NO: 1842562 - RNA, 17 nt, Human
gcccugcccaccuggcc

SEQ ID NO: 1842563 - RNA, 11 nt, Human
gcccugccucc

SEQ ID NO: 1842564 - RNA, 16 nt, Human
gcccugcccugguuuc

SEQ ID NO: 1842565 - RNA, 12 nt, Human
gcccugcccugg

SEQ ID NO: 1842566 - RNA, 11 nt, Human
gcccugcccug

SEQ ID NO: 1842567 - RNA, 20 nt, Human
gccgcagcccugcagagggc

SEQ ID NO: 1842568 - RNA, 22 nt, Human
gcccuuagcagggaaacagcua

SEQ ID NO: 1842569 - RNA, 13 nt, Human
gcccugccuccuu

SEQ ID NO: 1842570 - RNA, 12 nt, Human
gcccugccuccu

SEQ ID NO: 1842571 - RNA, 14 nt, Human
gcccugccuccuuu

SEQ ID NO: 1842572 - RNA, 18 nt, Human
gcccugcccugguuuccu

SEQ ID NO: 1842573 - RNA, 22 nt, Human
gcccuguccugccuaaggcuga

SEQ ID NO: 1842574 - RNA, 20 nt, Human
gcccuuagcagggaaacagc

SEQ ID NO: 1842575 - RNA, 20 nt, Human
gccuaggugacagagugaga

SEQ ID NO: 1842576 - RNA, 20 nt, Human
gccuagcauacguacacauu

SEQ ID NO: 1842577 - RNA, 21 nt, Human
gccuagcauacguacacauuu

SEQ ID NO: 1842578 - RNA, 22 nt, Human
gccuagcauacguacacauuuu

SEQ ID NO: 1842579 - RNA, 23 nt, Human
gccuagcauacguacacauuuua

SEQ ID NO: 1842580 - RNA, 13 nt, Human
gccuaggugacag

SEQ ID NO: 1842581 - RNA, 14 nt, Human
gccuaggugacaga

SEQ ID NO: 1842582 - RNA, 15 nt, Human
gccuaggugacagag

SEQ ID NO: 1842583 - RNA, 15 nt, Human
ggaagccgcuggggc

SEQ ID NO: 1842584 - RNA, 23 nt, Human
ggaagcucagggccuggcucagg

SEQ ID NO: 1842585 - RNA, 15 nt, Human
ggaagcucagggccu

SEQ ID NO: 1842586 - RNA, 11 nt, Human
ggaagcuccgc

SEQ ID NO: 1842587 - RNA, 16 nt, Human
ggaaggaaacccagcu

SEQ ID NO: 1842588 - RNA, 20 nt, Human
ggaaggaaacccagcucugg

SEQ ID NO: 1842589 - RNA, 19 nt, Human
ggaaggaaacccagcucug

SEQ ID NO: 1842590 - RNA, 23 nt, Human
ggacaaggaugaucuaggaagac

SEQ ID NO: 1842591 - RNA, 22 nt, Human
ggacaaggaugaucuaggaaga

SEQ ID NO: 1842592 - RNA, 13 nt, Human
ggacaagagcagg

SEQ ID NO: 1842593 - RNA, 18 nt, Human
ggaauaacauguaauuaa

SEQ ID NO: 1842594 - RNA, 16 nt, Human
ggaauccagacccggc

SEQ ID NO: 1842595 - RNA, 19 nt, Human
ggacaaggacuaggguccu

SEQ ID NO: 1842596 - RNA, 21 nt, Human
ggacacagcucuucuccaggc

SEQ ID NO: 1842597 - RNA, 15 nt, Human
ggacacagcucuucu

SEQ ID NO: 1842598 - RNA, 18 nt, Human
ggacacagcucuucucca

SEQ ID NO: 1842599 - RNA, 17 nt, Human
ggacacuaaccacgcug

SEQ ID NO: 1842600 - RNA, 22 nt, Human
ggacacuaaccacgcuggaccu

SEQ ID NO: 1842601 - RNA, 19 nt, Human
ggacagcuccuucuguccu

SEQ ID NO: 1842602 - RNA, 20 nt, Human
ggacagcuccuucuguccua

SEQ ID NO: 1842603 - RNA, 13 nt, Human
ggaagagaaaaaa

SEQ ID NO: 1842604 - RNA, 18 nt, Human
ggaagacuuuggaaagag

SEQ ID NO: 1842605 - RNA, 15 nt, Human
ggaagagaaaaaaua

SEQ ID NO: 1842606 - RNA, 12 nt, Human
ggaagacuuugg

SEQ ID NO: 1842607 - RNA, 17 nt, Human
ggaagacuuuggaaaga

SEQ ID NO: 1842608 - RNA, 13 nt, Human
ggaagacuuugga

SEQ ID NO: 1842609 - RNA, 14 nt, Human
ggaagacagcucuu

SEQ ID NO: 1842610 - RNA, 13 nt, Human
ggaagacagcucu

SEQ ID NO: 1842611 - RNA, 14 nt, Human
ggaacacucugaga

SEQ ID NO: 1842612 - RNA, 12 nt, Human
ggaacacucuga

SEQ ID NO: 1842613 - RNA, 16 nt, Human
ggaacacucugagacu

SEQ ID NO: 1842614 - RNA, 15 nt, Human
ggaacacucugagac

SEQ ID NO: 1842615 - RNA, 23 nt, Human
ggacaggcauguucucugaggac

SEQ ID NO: 1842616 - RNA, 12 nt, Human
ggacccccugaa

SEQ ID NO: 1842617 - RNA, 15 nt, Human
ggaccccgagccugg

SEQ ID NO: 1842618 - RNA, 11 nt, Human
ggacccugagg

SEQ ID NO: 1842619 - RNA, 18 nt, Human
ggaccccgagccuggcuc

SEQ ID NO: 1842620 - RNA, 13 nt, Human
ggacccugaggcc

SEQ ID NO: 1842621 - RNA, 12 nt, Human
ggacccugaggc

SEQ ID NO: 1842622 - RNA, 13 nt, Human
ggaccucaggccu

SEQ ID NO: 1842623 - RNA, 15 nt, Human
ggaccucaggccugg

SEQ ID NO: 1842624 - RNA, 14 nt, Human
ggaccucaggccug

SEQ ID NO: 1842625 - RNA, 20 nt, Human
ggaccucaggccugggggcu

SEQ ID NO: 1842626 - RNA, 20 nt, Human
ggacguguuaugacuccaga

SEQ ID NO: 1842627 - RNA, 15 nt, Human
ggacucaaugcacug

SEQ ID NO: 1842628 - RNA, 24 nt, Human
ggacuaacuugucuuuggacccug

SEQ ID NO: 1842629 - RNA, 14 nt, Human
ggacuacaggugug

SEQ ID NO: 1842630 - RNA, 20 nt, Human
ggacuaacuugucuuuggac

SEQ ID NO: 1842631 - RNA, 16 nt, Human
ggacucaaugcacuga

SEQ ID NO: 1842632 - RNA, 18 nt, Human
ggacucaaugcacugaca

SEQ ID NO: 1842633 - RNA, 13 nt, Human
ggagaaacuggaa

SEQ ID NO: 1842634 - RNA, 16 nt, Human
ggagaaaggaagggcu

SEQ ID NO: 1842635 - RNA, 9 nt, Human
ggacuuugu

SEQ ID NO: 1842636 - RNA, 14 nt, Human
ggacuuggaagcuc

SEQ ID NO: 1842637 - RNA, 18 nt, Human
gcugcugaaggcucgagc

SEQ ID NO: 1842638 - RNA, 13 nt, Human
gcugcuggcuggu

SEQ ID NO: 1842639 - RNA, 15 nt, Human
gcugcugaaggcucg

SEQ ID NO: 1842640 - RNA, 14 nt, Human
gcugcugaaggcuc

SEQ ID NO: 1842641 - RNA, 13 nt, Human
gcugcugaaggcu

SEQ ID NO: 1842642 - RNA, 23 nt, Human
gcucugguccauagagagcaaga

SEQ ID NO: 1842643 - RNA, 16 nt, Human
gcucugguccauagag

SEQ ID NO: 1842644 - RNA, 15 nt, Human
gcucugguccauaga

SEQ ID NO: 1842645 - RNA, 13 nt, Human
gcucugcccuugg

SEQ ID NO: 1842646 - RNA, 20 nt, Human
gcuggcgugcaguggugcga

SEQ ID NO: 1842647 - RNA, 18 nt, Human
gcuggagugcagugagcc

SEQ ID NO: 1842648 - RNA, 17 nt, Human
gcuggagugcagugagc

SEQ ID NO: 1842649 - RNA, 20 nt, Human
gcuggccuggccccucaggg

SEQ ID NO: 1842650 - RNA, 22 nt, Human
gcuggagugcagugagccgaga

SEQ ID NO: 1842651 - RNA, 23 nt, Human
gcuggguggcaccagcagccugg

SEQ ID NO: 1842652 - RNA, 22 nt, Human
gcuggguggcaccagcagccug

SEQ ID NO: 1842653 - RNA, 21 nt, Human
gcuggguggcaccagcagccu

SEQ ID NO: 1842654 - RNA, 15 nt, Human
gcuggcuguuggcug

SEQ ID NO: 1842655 - RNA, 16 nt, Human
gcuggcuguuggcugg

SEQ ID NO: 1842656 - RNA, 17 nt, Human
gcuggcuguuggcuggg

SEQ ID NO: 1842657 - RNA, 12 nt, Human
gcugggucgccc

SEQ ID NO: 1842658 - RNA, 22 nt, Human
gcugggccccugccucucugca

SEQ ID NO: 1842659 - RNA, 21 nt, Human
gcugggccccugccucucugc

SEQ ID NO: 1842660 - RNA, 23 nt, Human
gcugggccccugccucucugcag

SEQ ID NO: 1842661 - RNA, 22 nt, Human
gcuuccucauaguaugguggcu

SEQ ID NO: 1842662 - RNA, 12 nt, Human
gcuuguacauaa

SEQ ID NO: 1842663 - RNA, 14 nt, Human
gcuugagcucagga

SEQ ID NO: 1842664 - RNA, 20 nt, Human
gcuuguaaauagcucaggug

SEQ ID NO: 1842665 - RNA, 15 nt, Human
gcuucacggaagagc

SEQ ID NO: 1842666 - RNA, 17 nt, Human
gcuucacggaagagccu

SEQ ID NO: 1842667 - RNA, 21 nt, Human
gcuucaaggauccugagccag

SEQ ID NO: 1842668 - RNA, 20 nt, Human
gcuucaaggauccugagcca

SEQ ID NO: 1842669 - RNA, 19 nt, Human
gcuucaaggauccugagcc

SEQ ID NO: 1842670 - RNA, 18 nt, Human
gcuucaaggauccugagc

SEQ ID NO: 1842671 - RNA, 18 nt, Human
gcuucacggaagagccuu

SEQ ID NO: 1842672 - RNA, 19 nt, Human
gcuucacggaagagccuug

SEQ ID NO: 1842673 - RNA, 12 nt, Human
gcuucagccucc

SEQ ID NO: 1842674 - RNA, 13 nt, Human
ggccccugcuggu

SEQ ID NO: 1842675 - RNA, 14 nt, Human
ggccccugcugguu

SEQ ID NO: 1842676 - RNA, 23 nt, Human
ggccccugcugguucaggguugg

SEQ ID NO: 1842677 - RNA, 13 nt, Human
ggcccggcuccag

SEQ ID NO: 1842678 - RNA, 15 nt, Human
ggcccggcuccaggc

SEQ ID NO: 1842679 - RNA, 21 nt, Human
ggcccuucucuccagccccug

SEQ ID NO: 1842680 - RNA, 20 nt, Human
ggcccuucucuccagccccu

SEQ ID NO: 1842681 - RNA, 19 nt, Human
ggcccuucucuccagcccc

SEQ ID NO: 1842682 - RNA, 14 nt, Human
ggccuccauccuga

SEQ ID NO: 1842683 - RNA, 15 nt, Human
ggccuccauccugag

SEQ ID NO: 1842684 - RNA, 16 nt, Human
ggccuccauccugagg

SEQ ID NO: 1842685 - RNA, 19 nt, Human
ggccucacuaggcuucugg

SEQ ID NO: 1842686 - RNA, 23 nt, Human
ggccucaagugauucuccugccu

SEQ ID NO: 1842687 - RNA, 23 nt, Human
ggcccuucucuccagccccugga

SEQ ID NO: 1842688 - RNA, 22 nt, Human
ggcccuucucuccagccccugg

SEQ ID NO: 1842689 - RNA, 17 nt, Human
ggccaguuggucccccu

SEQ ID NO: 1842690 - RNA, 14 nt, Human
ggccaguugguccc

SEQ ID NO: 1842691 - RNA, 20 nt, Human
ggccagugugacaaggauug

SEQ ID NO: 1842692 - RNA, 22 nt, Human
ggcagccccuguucuggcagag

SEQ ID NO: 1842693 - RNA, 20 nt, Human
ggcaguggugguuuucuguu

SEQ ID NO: 1842694 - RNA, 21 nt, Human
ggcaguggugguuuucuguuc

SEQ ID NO: 1842695 - RNA, 16 nt, Human
ggagagaagagaaugc

SEQ ID NO: 1842696 - RNA, 22 nt, Human
ggagacugcugagucaacccaa

SEQ ID NO: 1842697 - RNA, 23 nt, Human
ggcacagaaaauggaagacagcu

SEQ ID NO: 1842698 - RNA, 13 nt, Human
ggcacaucagcac

SEQ ID NO: 1842699 - RNA, 23 nt, Human
ggcacucagaagacacugauggg

SEQ ID NO: 1842700 - RNA, 19 nt, Human
ggcacagaaaauggaagac

SEQ ID NO: 1842701 - RNA, 21 nt, Human
ggcacagaaaauggaagacag

SEQ ID NO: 1842702 - RNA, 20 nt, Human
ggcacagaaaauggaagaca

SEQ ID NO: 1842703 - RNA, 15 nt, Human
ggcacugguggcccg

SEQ ID NO: 1842704 - RNA, 23 nt, Human
ggcagccccauucugccugccca

SEQ ID NO: 1842705 - RNA, 11 nt, Human
ggcagccccug

SEQ ID NO: 1842706 - RNA, 16 nt, Human
ggcugggagagccuuc

SEQ ID NO: 1842707 - RNA, 15 nt, Human
ggcugggagagccuu

SEQ ID NO: 1842708 - RNA, 14 nt, Human
ggcugggagagccu

SEQ ID NO: 1842709 - RNA, 13 nt, Human
ggcugcugaaggc

SEQ ID NO: 1842710 - RNA, 11 nt, Human
ggcucucaggc

SEQ ID NO: 1842711 - RNA, 12 nt, Human
ggcucuuccagg

SEQ ID NO: 1842712 - RNA, 13 nt, Human
ggcucuucuccuu

SEQ ID NO: 1842713 - RNA, 12 nt, Human
ggcucuucuccu

SEQ ID NO: 1842714 - RNA, 14 nt, Human
ggcucuuccaggcu

SEQ ID NO: 1842715 - RNA, 13 nt, Human
ggcucucaggcca

SEQ ID NO: 1842716 - RNA, 14 nt, Human
ggcucucaggccag

SEQ ID NO: 1842717 - RNA, 21 nt, Human
ggcugccaaugggagcucaug

SEQ ID NO: 1842718 - RNA, 13 nt, Human
ggcugcccuggug

SEQ ID NO: 1842719 - RNA, 19 nt, Human
ggcugcccuggugcugcca

SEQ ID NO: 1842720 - RNA, 16 nt, Human
ggcugcccuggugcug

SEQ ID NO: 1842721 - RNA, 15 nt, Human
ggcugcccuggugcu

SEQ ID NO: 1842722 - RNA, 14 nt, Human
ggcugcccuggugc

SEQ ID NO: 1842723 - RNA, 22 nt, Human
ggcugcccuggugcugccacac

SEQ ID NO: 1842724 - RNA, 16 nt, Human
ggcugccuuagaaccu

SEQ ID NO: 1842725 - RNA, 22 nt, Human
ggcugcggaaugaaccacaucu

SEQ ID NO: 1842726 - RNA, 20 nt, Human
ggcugccaaugggagcucau

SEQ ID NO: 1842727 - RNA, 19 nt, Human
ggcugccaaugggagcuca

SEQ ID NO: 1842728 - RNA, 23 nt, Human
ggcucuucuccuuucacaaccuu

SEQ ID NO: 1842729 - RNA, 15 nt, Human
ggcucuucuccuuuc

SEQ ID NO: 1842730 - RNA, 14 nt, Human
ggcucuucuccuuu

SEQ ID NO: 1842731 - RNA, 22 nt, Human
ggcugacagacagcccuccauc

SEQ ID NO: 1842732 - RNA, 16 nt, Human
ggcucuucuccuuuca

SEQ ID NO: 1842733 - RNA, 19 nt, Human
ggcucagcaaaagaugcuu

SEQ ID NO: 1842734 - RNA, 18 nt, Human
ggcucagcggggacagcu

SEQ ID NO: 1842735 - RNA, 20 nt, Human
ggcucagguggggucacucu

SEQ ID NO: 1842736 - RNA, 19 nt, Human
ggcucagguggggucacuc

SEQ ID NO: 1842737 - RNA, 19 nt, Human
ggcucagcggggacagcuc

SEQ ID NO: 1842738 - RNA, 20 nt, Human
ggcucagcggggacagcucc

SEQ ID NO: 1842739 - RNA, 14 nt, Human
ggcuccacuugguc

SEQ ID NO: 1842740 - RNA, 17 nt, Human
ggcuccaaacccucgag

SEQ ID NO: 1842741 - RNA, 19 nt, Human
gggagagccuuccaggggu

SEQ ID NO: 1842742 - RNA, 15 nt, Human
gggagagccuuccag

SEQ ID NO: 1842743 - RNA, 23 nt, Human
gggagcaggcucgggcuccccag

SEQ ID NO: 1842744 - RNA, 16 nt, Human
gggagggagggcucca

SEQ ID NO: 1842745 - RNA, 15 nt, Human
gggagggagggcucc

SEQ ID NO: 1842746 - RNA, 18 nt, Human
gggaggucaaggcugcag

SEQ ID NO: 1842747 - RNA, 15 nt, Human
gggaggucgaggcag

SEQ ID NO: 1842748 - RNA, 21 nt, Human
gggagaaccaaaaagaggcua

SEQ ID NO: 1842749 - RNA, 15 nt, Human
gggacuuggaagcuc

SEQ ID NO: 1842750 - RNA, 17 nt, Human
gggacuuggaagcuccg

SEQ ID NO: 1842751 - RNA, 18 nt, Human
gggacuuggaagcuccgc

SEQ ID NO: 1842752 - RNA, 23 nt, Human
gggacuuggaagcuccgcuuucu

SEQ ID NO: 1842753 - RNA, 17 nt, Human
aaaaaugguuuaaaugg

SEQ ID NO: 1842754 - RNA, 20 nt, Human
gggaccagagcugccaccug

SEQ ID NO: 1842755 - RNA, 14 nt, Human
gggaccagagcugc

SEQ ID NO: 1842756 - RNA, 12 nt, Human
aaaacccaagug

SEQ ID NO: 1842757 - RNA, 13 nt, Human
aaaacaugcuaca

SEQ ID NO: 1842758 - RNA, 14 nt, Human
aaaacaugcuacac

SEQ ID NO: 1842759 - RNA, 22 nt, Human
aaaacuugauguguuaucucuu

SEQ ID NO: 1842760 - RNA, 15 nt, Human
aaaacuucagacaua

SEQ ID NO: 1842761 - RNA, 18 nt, Human
aaaacucuccucugcugc

SEQ ID NO: 1842762 - RNA, 21 nt, Human
ggcuuccuccugguguggaag

SEQ ID NO: 1842763 - RNA, 22 nt, Human
ggcuucccgcucagcccucccu

SEQ ID NO: 1842764 - RNA, 18 nt, Human
gggaagaagcucucuccu

SEQ ID NO: 1842765 - RNA, 13 nt, Human
gggaaccugaccc

SEQ ID NO: 1842766 - RNA, 13 nt, Human
gggaagagacuug

SEQ ID NO: 1842767 - RNA, 13 nt, Human
gggacagagcaga

SEQ ID NO: 1842768 - RNA, 12 nt, Human
gggacagcuccu

SEQ ID NO: 1842769 - RNA, 13 nt, Human
gggacagcuccuu

SEQ ID NO: 1842770 - RNA, 15 nt, Human
gggacagcuccuucu

SEQ ID NO: 1842771 - RNA, 18 nt, Human
ggcuucauccuccucaga

SEQ ID NO: 1842772 - RNA, 22 nt, Human
ggcuucauccuccucagaucuu

SEQ ID NO: 1842773 - RNA, 14 nt, Human
ggcuucccgcucag

SEQ ID NO: 1842774 - RNA, 18 nt, Human
ggcuucccgcucagcccu

SEQ ID NO: 1842775 - RNA, 17 nt, Human
ggcuucccgcucagccc

SEQ ID NO: 1842776 - RNA, 16 nt, Human
ggcuucccgcucagcc

SEQ ID NO: 1842777 - RNA, 15 nt, Human
ggcuucccgcucagc

SEQ ID NO: 1842778 - RNA, 21 nt, Human
ggcuucccgcucagcccuccc

SEQ ID NO: 1842779 - RNA, 19 nt, Human
ggcuucccgcucagcccuc

SEQ ID NO: 1842780 - RNA, 16 nt, Human
ggcuuccucauaguau

SEQ ID NO: 1842781 - RNA, 18 nt, Human
ggcuucaguggcagcugc

SEQ ID NO: 1842782 - RNA, 17 nt, Human
ggcuucaguggcagcug

SEQ ID NO: 1842783 - RNA, 19 nt, Human
ggcuucaguggcagcugcu

SEQ ID NO: 1842784 - RNA, 20 nt, Human
ggcuucaguggcagcugcuu

SEQ ID NO: 1842785 - RNA, 18 nt, Human
ggcuguaucccaugagcc

SEQ ID NO: 1842786 - RNA, 21 nt, Human
ggcuggguucuacccaggugc

SEQ ID NO: 1842787 - RNA, 19 nt, Human
ggcuggguucuacccaggu

SEQ ID NO: 1842788 - RNA, 19 nt, Human
ggcuggguggcaccagcag

SEQ ID NO: 1842789 - RNA, 20 nt, Human
ggcugggucgcccuggacug

SEQ ID NO: 1842790 - RNA, 17 nt, Human
ggcugggucgcccugga

SEQ ID NO: 1842791 - RNA, 14 nt, Human
ggcugggucgcccu

SEQ ID NO: 1842792 - RNA, 15 nt, Human
ggcugggggccucag

SEQ ID NO: 1842793 - RNA, 16 nt, Human
ggcugggggccucagu

SEQ ID NO: 1842794 - RNA, 17 nt, Human
ggcugggggccucagug

SEQ ID NO: 1842795 - RNA, 19 nt, Human
ggcugggggccucagugcc

SEQ ID NO: 1842796 - RNA, 14 nt, Human
aaaaauaacaauga

SEQ ID NO: 1842797 - RNA, 13 nt, Human
gguggaugccugg

SEQ ID NO: 1842798 - RNA, 16 nt, Human
ggugcugggccccugc

SEQ ID NO: 1842799 - RNA, 15 nt, Human
ggugcugggccccug

SEQ ID NO: 1842800 - RNA, 13 nt, Human
ggugcugggcccc

SEQ ID NO: 1842801 - RNA, 11 nt, Human
ggugcugggcc

SEQ ID NO: 1842802 - RNA, 21 nt, Human
ggugcauuugaggucuguucu

SEQ ID NO: 1842803 - RNA, 21 nt, Human
ggugcauauuuauaaaaauaa

SEQ ID NO: 1842804 - RNA, 16 nt, Human
ggugcaaugaccuuuc

SEQ ID NO: 1842805 - RNA, 13 nt, Human
ggugcaaugaccu

SEQ ID NO: 1842806 - RNA, 18 nt, Human
ggugcaaaguucccuacu

SEQ ID NO: 1842807 - RNA, 12 nt, Human
ggugcaaugacc

SEQ ID NO: 1842808 - RNA, 18 nt, Human
ggugauccacccaccuca

SEQ ID NO: 1842809 - RNA, 23 nt, Human
ggugauccacccaccucagccuc

SEQ ID NO: 1842810 - RNA, 24 nt, Human
ggugauccacccaccucagccucc

SEQ ID NO: 1842811 - RNA, 20 nt, Human
ggucgcccuggacugugugc

SEQ ID NO: 1842812 - RNA, 13 nt, Human
ggugaacagaaca

SEQ ID NO: 1842813 - RNA, 14 nt, Human
ggucgcccuggacu

SEQ ID NO: 1842814 - RNA, 13 nt, Human
ggucgaggcagga

SEQ ID NO: 1842815 - RNA, 15 nt, Human
aaagcucacuuuacu

SEQ ID NO: 1842816 - RNA, 15 nt, Human
aaagcugaaaacugc

SEQ ID NO: 1842817 - RNA, 12 nt, Human
aaagcugaaaac

SEQ ID NO: 1842818 - RNA, 13 nt, Human
aaagcugcugaca

SEQ ID NO: 1842819 - RNA, 15 nt, Human
aaagcuuguuaagau

SEQ ID NO: 1842820 - RNA, 22 nt, Human
aaaggaaagagggagguaagga

SEQ ID NO: 1842821 - RNA, 21 nt, Human
aaaggagagcuagcagcaggg

SEQ ID NO: 1842822 - RNA, 17 nt, Human
aaaggagauuggaagga

SEQ ID NO: 1842823 - RNA, 14 nt, Human
aaagguaaaucaga

SEQ ID NO: 1842824 - RNA, 20 nt, Human
aaagggacugagaaauuuau

SEQ ID NO: 1842825 - RNA, 22 nt, Human
aaagggacuuggaagcuccgcu

SEQ ID NO: 1842826 - RNA, 15 nt, Human
aaagaggaaugaagu

SEQ ID NO: 1842827 - RNA, 14 nt, Human
aaagaugcuucuca

SEQ ID NO: 1842828 - RNA, 17 nt, Human
aaagaugcuucucacug

SEQ ID NO: 1842829 - RNA, 19 nt, Human
aaagaugcuucucacugcc

SEQ ID NO: 1842830 - RNA, 13 nt, Human
aaagacuguacaa

SEQ ID NO: 1842831 - RNA, 23 nt, Human
aaagacugaguacguugugcauu

SEQ ID NO: 1842832 - RNA, 14 nt, Human
aaagacuguacaaa

SEQ ID NO: 1842833 - RNA, 22 nt, Human
aaagauggcugugccucugccu

SEQ ID NO: 1842834 - RNA, 21 nt, Human
aaagauggcugugccucugcc

SEQ ID NO: 1842835 - RNA, 23 nt, Human
aaagauggcugugccucugccug

SEQ ID NO: 1842836 - RNA, 14 nt, Human
gguccugcugcagu

SEQ ID NO: 1842837 - RNA, 12 nt, Human
gguccugcugca

SEQ ID NO: 1842838 - RNA, 11 nt, Human
gguccugcugc

SEQ ID NO: 1842839 - RNA, 19 nt, Human
aaacuucagacauagaauu

SEQ ID NO: 1842840 - RNA, 14 nt, Human
ggguggccucccaa

SEQ ID NO: 1842841 - RNA, 16 nt, Human
aaacuuguauuaugug

SEQ ID NO: 1842842 - RNA, 19 nt, Human
aaagacugaccaauauugu

SEQ ID NO: 1842843 - RNA, 9 nt, Human
aaagacaga

SEQ ID NO: 1842844 - RNA, 13 nt, Human
aaagacagugaaa

SEQ ID NO: 1842845 - RNA, 19 nt, Human
gggggugcugggccccugc

SEQ ID NO: 1842846 - RNA, 15 nt, Human
gggucgcccuggacu

SEQ ID NO: 1842847 - RNA, 13 nt, Human
gggucgcccugga

SEQ ID NO: 1842848 - RNA, 15 nt, Human
aaacauuaugaugug

SEQ ID NO: 1842849 - RNA, 16 nt, Human
aaaccaagccguggcu

SEQ ID NO: 1842850 - RNA, 23 nt, Human
aaaccaagucaagugaaaaagga

SEQ ID NO: 1842851 - RNA, 18 nt, Human
aaaccuuuuauauuuagu

SEQ ID NO: 1842852 - RNA, 18 nt, Human
aaaccuuuguuugcaucu

SEQ ID NO: 1842853 - RNA, 15 nt, Human
aaacgggcucagcaa

SEQ ID NO: 1842854 - RNA, 18 nt, Human
aaacuaggugcauauuua

SEQ ID NO: 1842855 - RNA, 22 nt, Human
aaacuaggugcauauuuauaaa

SEQ ID NO: 1842856 - RNA, 17 nt, Human
aaacuuaaucuaaaugg

SEQ ID NO: 1842857 - RNA, 18 nt, Human
aaacuuaaucuaaaugga

SEQ ID NO: 1842858 - RNA, 16 nt, Human
aaacuuaaucuaaaug

SEQ ID NO: 1842859 - RNA, 19 nt, Human
aaacuguuaauaguucagg

SEQ ID NO: 1842860 - RNA, 13 nt, Human
aaacucuccucug

SEQ ID NO: 1842861 - RNA, 22 nt, Human
aaacugcccccucugcccugcg

SEQ ID NO: 1842862 - RNA, 15 nt, Human
ggggccucagugcca

SEQ ID NO: 1842863 - RNA, 12 nt, Human
gggggccucagu

SEQ ID NO: 1842864 - RNA, 15 nt, Human
gggggccucagugcc

SEQ ID NO: 1842865 - RNA, 17 nt, Human
gggggccucagugccac

SEQ ID NO: 1842866 - RNA, 18 nt, Human
gggggccucagugccacu

SEQ ID NO: 1842867 - RNA, 11 nt, Human
ggggagaaagu

SEQ ID NO: 1842868 - RNA, 17 nt, Human
aaacauggccuuugcuu

SEQ ID NO: 1842869 - RNA, 16 nt, Human
aaacauggccuuugcu

SEQ ID NO: 1842870 - RNA, 14 nt, Human
aaacaguagugaua

SEQ ID NO: 1842871 - RNA, 16 nt, Human
ggggaccagagcugcc

SEQ ID NO: 1842872 - RNA, 15 nt, Human
ggggaccagagcugc

SEQ ID NO: 1842873 - RNA, 13 nt, Human
ggggaaggcaggg

SEQ ID NO: 1842874 - RNA, 18 nt, Human
ggggaauguuugccucug

SEQ ID NO: 1842875 - RNA, 22 nt, Human
ggggaauguuugccucugccuc

SEQ ID NO: 1842876 - RNA, 12 nt, Human
aaacacauuuuu

SEQ ID NO: 1842877 - RNA, 11 nt, Human
aaacacauuuu

SEQ ID NO: 1842878 - RNA, 19 nt, Human
aaacacaaacgggcucagc

SEQ ID NO: 1842879 - RNA, 20 nt, Human
aaaauuuugauguuuuaagg

SEQ ID NO: 1842880 - RNA, 19 nt, Human
aaaauuuagaaauauaauu

SEQ ID NO: 1842881 - RNA, 13 nt, Human
gggaugagaaagg

SEQ ID NO: 1842882 - RNA, 20 nt, Human
aaagguauuuuaaucaccaa

SEQ ID NO: 1842883 - RNA, 20 nt, Human
aaaguacacuguuucaaacu

SEQ ID NO: 1842884 - RNA, 16 nt, Human
aaaguacauguuaaac

SEQ ID NO: 1842885 - RNA, 19 nt, Human
aaaguacuucuccacccug

SEQ ID NO: 1842886 - RNA, 18 nt, Human
aaaguaucccuacuguaa

SEQ ID NO: 1842887 - RNA, 23 nt, Human
aaaguacuucuccacccugcucu

SEQ ID NO: 1842888 - RNA, 20 nt, Human
aaaguacuucuccacccugc

SEQ ID NO: 1842889 - RNA, 21 nt, Human
aaaguacuucuccacccugcu

SEQ ID NO: 1842890 - RNA, 23 nt, Human
aaaguucugcagauaaacaguag

SEQ ID NO: 1842891 - RNA, 17 nt, Human
aaaguugguaaaccuuu

SEQ ID NO: 1842892 - RNA, 16 nt, Human
aaaguugguaaaccuu

SEQ ID NO: 1842893 - RNA, 18 nt, Human
aaauaccagccaguaaau

SEQ ID NO: 1842894 - RNA, 17 nt, Human
aaauacagauagauaua

SEQ ID NO: 1842895 - RNA, 20 nt, Human
guaauaggcguaacuaauuu

SEQ ID NO: 1842896 - RNA, 14 nt, Human
guaauaugcacaca

SEQ ID NO: 1842897 - RNA, 16 nt, Human
guaauaugcacacauu

SEQ ID NO: 1842898 - RNA, 17 nt, Human
guaauaugcacacauuu

SEQ ID NO: 1842899 - RNA, 18 nt, Human
guaauaugcacacauuuu

SEQ ID NO: 1842900 - RNA, 21 nt, Human
guaauccaagcaaaugugaau

SEQ ID NO: 1842901 - RNA, 15 nt, Human
guaauccaccugccu

SEQ ID NO: 1842902 - RNA, 22 nt, Human
guaauuugugauacaaugcugu

SEQ ID NO: 1842903 - RNA, 21 nt, Human
aaaucagacuaugaaguuuuu

SEQ ID NO: 1842904 - RNA, 14 nt, Human
aaaucagacuauga

SEQ ID NO: 1842905 - RNA, 15 nt, Human
aaauauuccugcauu

SEQ ID NO: 1842906 - RNA, 18 nt, Human
aaaucagccugcuccagc

SEQ ID NO: 1842907 - RNA, 16 nt, Human
aaaucagcugcuacua

SEQ ID NO: 1842908 - RNA, 12 nt, Human
aaaucagccugc

SEQ ID NO: 1842909 - RNA, 19 nt, Human
aaaucagccguguaaccau

SEQ ID NO: 1842910 - RNA, 15 nt, Human
aaauccacuuuaucu

SEQ ID NO: 1842911 - RNA, 14 nt, Human
guacaugaaaacac

SEQ ID NO: 1842912 - RNA, 15 nt, Human
guacaugaaaacaca

SEQ ID NO: 1842913 - RNA, 16 nt, Human
guacaugaaaacacau

SEQ ID NO: 1842914 - RNA, 17 nt, Human
guacaugaaaacacauu

SEQ ID NO: 1842915 - RNA, 18 nt, Human
guacaugaaaacacauuu

SEQ ID NO: 1842916 - RNA, 19 nt, Human
guacaugaaaacacauuuu

SEQ ID NO: 1842917 - RNA, 20 nt, Human
guacaugaaaacacauuuuu

SEQ ID NO: 1842918 - RNA, 19 nt, Human
guacauggaauaacaugua

SEQ ID NO: 1842919 - RNA, 12 nt, Human
guacccacugcu

SEQ ID NO: 1842920 - RNA, 23 nt, Human
guaccaagacuacuagggaaaug

SEQ ID NO: 1842921 - RNA, 20 nt, Human
guaccaagacuacuagggaa

SEQ ID NO: 1842922 - RNA, 11 nt, Human
guagagacagg

SEQ ID NO: 1842923 - RNA, 12 nt, Human
guagagacaggg

SEQ ID NO: 1842924 - RNA, 15 nt, Human
guagagccagggucu

SEQ ID NO: 1842925 - RNA, 18 nt, Human
guagagccagggucucac

SEQ ID NO: 1842926 - RNA, 13 nt, Human
guagagacagggu

SEQ ID NO: 1842927 - RNA, 10 nt, Human
guagagccag

SEQ ID NO: 1842928 - RNA, 11 nt, Human
guagagccagg

SEQ ID NO: 1842929 - RNA, 18 nt, Human
guagaagcccuucuaccu

SEQ ID NO: 1842930 - RNA, 12 nt, Human
guagaagauggc

SEQ ID NO: 1842931 - RNA, 21 nt, Human
guagaagucuuagauguauau

SEQ ID NO: 1842932 - RNA, 23 nt, Human
guagaaauaucugaaaauguaug

SEQ ID NO: 1842933 - RNA, 21 nt, Human
guagaaauaucugaaaaugua

SEQ ID NO: 1842934 - RNA, 20 nt, Human
guagaaauaucugaaaaugu

SEQ ID NO: 1842935 - RNA, 14 nt, Human
guacuccucccagg

SEQ ID NO: 1842936 - RNA, 17 nt, Human
guacuauguaucaauga

SEQ ID NO: 1842937 - RNA, 15 nt, Human
guacuauguaucaau

SEQ ID NO: 1842938 - RNA, 14 nt, Human
guacucauuaaaaa

SEQ ID NO: 1842939 - RNA, 13 nt, Human
guacuauguauca

SEQ ID NO: 1842940 - RNA, 19 nt, Human
guacuacaguccucccauc

SEQ ID NO: 1842941 - RNA, 18 nt, Human
guacuacaguccucccau

SEQ ID NO: 1842942 - RNA, 13 nt, Human
guacccacugcuc

SEQ ID NO: 1842943 - RNA, 14 nt, Human
guacccacugcucu

SEQ ID NO: 1842944 - RNA, 16 nt, Human
guacuggagaaaaugg

SEQ ID NO: 1842945 - RNA, 21 nt, Human
gugaccagcaccaucucuccu

SEQ ID NO: 1842946 - RNA, 18 nt, Human
gugaccagcaccaucucu

SEQ ID NO: 1842947 - RNA, 18 nt, Human
gugaccauguuuuguuua

SEQ ID NO: 1842948 - RNA, 17 nt, Human
gugaccaaugaugguca

SEQ ID NO: 1842949 - RNA, 14 nt, Human
gugacaugucuuuu

SEQ ID NO: 1842950 - RNA, 16 nt, Human
gugacagaggcagccc

SEQ ID NO: 1842951 - RNA, 18 nt, Human
gugacagaggcagcccca

SEQ ID NO: 1842952 - RNA, 19 nt, Human
gugacagaggcagccccau

SEQ ID NO: 1842953 - RNA, 14 nt, Human
gugaagugaagaca

SEQ ID NO: 1842954 - RNA, 23 nt, Human
gugaagacaaugacuuacuguac

SEQ ID NO: 1842955 - RNA, 12 nt, Human
gugagagcuggg

SEQ ID NO: 1842956 - RNA, 12 nt, Human
gugaccccaggu

SEQ ID NO: 1842957 - RNA, 17 nt, Human
gugaguacuacaguccu

SEQ ID NO: 1842958 - RNA, 15 nt, Human
gugagcaggcuguga

SEQ ID NO: 1842959 - RNA, 21 nt, Human
gugagcacuaaggugugcucu

SEQ ID NO: 1842960 - RNA, 15 nt, Human
gugagcaauccugca

SEQ ID NO: 1842961 - RNA, 13 nt, Human
gugagagcugggu

SEQ ID NO: 1842962 - RNA, 16 nt, Human
gugagaggggaacaga

SEQ ID NO: 1842963 - RNA, 20 nt, Human
gugaguccuggcaugggaau

SEQ ID NO: 1842964 - RNA, 15 nt, Human
gugagucgaggacag

SEQ ID NO: 1842965 - RNA, 21 nt, Human
gugaguacuacaguccuccca

SEQ ID NO: 1842966 - RNA, 19 nt, Human
gugaguacuacaguccucc

SEQ ID NO: 1842967 - RNA, 17 nt, Human
gugaguccuggcauggg

SEQ ID NO: 1842968 - RNA, 14 nt, Human
aacugaacucugac

SEQ ID NO: 1842969 - RNA, 15 nt, Human
aacugaacauuccag

SEQ ID NO: 1842970 - RNA, 18 nt, Human
gucucuuuaaugucacag

SEQ ID NO: 1842971 - RNA, 19 nt, Human
gucucuuuaaugucacagg

SEQ ID NO: 1842972 - RNA, 20 nt, Human
gucucuuuaaugucacaggc

SEQ ID NO: 1842973 - RNA, 19 nt, Human
gucugaaggcuggguucug

SEQ ID NO: 1842974 - RNA, 14 nt, Human
gucugaaggcuggg

SEQ ID NO: 1842975 - RNA, 16 nt, Human
gucugaagucacugca

SEQ ID NO: 1842976 - RNA, 22 nt, Human
gucucuuuaaugucacaggcag

SEQ ID NO: 1842977 - RNA, 23 nt, Human
gucucuuuaaugucacaggcagg

SEQ ID NO: 1842978 - RNA, 17 nt, Human
gucucuugguccugcug

SEQ ID NO: 1842979 - RNA, 19 nt, Human
gucucuugguccugcugca

SEQ ID NO: 1842980 - RNA, 18 nt, Human
gucucuugguccugcugc

SEQ ID NO: 1842981 - RNA, 20 nt, Human
gucucuugguccugcugcag

SEQ ID NO: 1842982 - RNA, 13 nt, Human
gucucuugguccu

SEQ ID NO: 1842983 - RNA, 19 nt, Human
gucugaagucacugcacag

SEQ ID NO: 1842984 - RNA, 17 nt, Human
gucugaagucacugcac

SEQ ID NO: 1842985 - RNA, 21 nt, Human
gucugacaggcaaugcuggcu

SEQ ID NO: 1842986 - RNA, 22 nt, Human
gucugacaggcaaugcuggcug

SEQ ID NO: 1842987 - RNA, 23 nt, Human
gucugacaggcaaugcuggcugu

SEQ ID NO: 1842988 - RNA, 18 nt, Human
aaccugauugugucucuu

SEQ ID NO: 1842989 - RNA, 19 nt, Human
aaccugauugugucucuug

SEQ ID NO: 1842990 - RNA, 17 nt, Human
aaccuguucugcuuucc

SEQ ID NO: 1842991 - RNA, 13 nt, Human
aaccuguucugcu

SEQ ID NO: 1842992 - RNA, 16 nt, Human
gucuuuguacagacaa

SEQ ID NO: 1842993 - RNA, 15 nt, Human
gucuuuguacagaca

SEQ ID NO: 1842994 - RNA, 16 nt, Human
gucuucaguaagccgu

SEQ ID NO: 1842995 - RNA, 17 nt, Human
aacuagaacugaauuuu

SEQ ID NO: 1842996 - RNA, 23 nt, Human
aacguggcugcuucaaggauccu

SEQ ID NO: 1842997 - RNA, 20 nt, Human
gucuaccugaggggccucuu

SEQ ID NO: 1842998 - RNA, 18 nt, Human
gucgcccuggacugugug

SEQ ID NO: 1842999 - RNA, 14 nt, Human
gucgcccuggacug

SEQ ID NO: 1843000 - RNA, 23 nt, Human
gucgcccagucuggaaugcagug

SEQ ID NO: 1843001 - RNA, 14 nt, Human
gucgcccaggcugg

SEQ ID NO: 1843002 - RNA, 20 nt, Human
gucgcccaggcuggagugca

SEQ ID NO: 1843003 - RNA, 15 nt, Human
gucgcccaggcugga

SEQ ID NO: 1843004 - RNA, 13 nt, Human
gucgcccagucug

SEQ ID NO: 1843005 - RNA, 14 nt, Human
gucgcccagucugg

SEQ ID NO: 1843006 - RNA, 14 nt, Human
gucgaggacaggga

SEQ ID NO: 1843007 - RNA, 16 nt, Human
guccugcugcaguugc

SEQ ID NO: 1843008 - RNA, 13 nt, Human
guccugcugcagu

SEQ ID NO: 1843009 - RNA, 17 nt, Human
guccugcugcaguugcc

SEQ ID NO: 1843010 - RNA, 16 nt, Human
aaccaaauauuccaga

SEQ ID NO: 1843011 - RNA, 13 nt, Human
aaccacaucuugc

SEQ ID NO: 1843012 - RNA, 13 nt, Human
gucuccauguuug

SEQ ID NO: 1843013 - RNA, 16 nt, Human
aacauuuugucauaua

SEQ ID NO: 1843014 - RNA, 22 nt, Human
aacauuuguucuauagcuuuuc

SEQ ID NO: 1843015 - RNA, 17 nt, Human
gucucaagagggcacug

SEQ ID NO: 1843016 - RNA, 15 nt, Human
gucucaagagggcac

SEQ ID NO: 1843017 - RNA, 22 nt, Human
gucucaagagggcacugguggc

SEQ ID NO: 1843018 - RNA, 20 nt, Human
gucucaagagggcacuggug

SEQ ID NO: 1843019 - RNA, 16 nt, Human
gucucaaacuccugac

SEQ ID NO: 1843020 - RNA, 22 nt, Human
gucucaaacucuugaccucagg

SEQ ID NO: 1843021 - RNA, 14 nt, Human
gucuaugggacuca

SEQ ID NO: 1843022 - RNA, 15 nt, Human
gucuaugggacucaa

SEQ ID NO: 1843023 - RNA, 23 nt, Human
gucucaguccaugaagauguaga

SEQ ID NO: 1843024 - RNA, 16 nt, Human
gucucaggucccugca

SEQ ID NO: 1843025 - RNA, 15 nt, Human
gucucaggucccugc

SEQ ID NO: 1843026 - RNA, 22 nt, Human
guagcucuaggagggcuggcaa

SEQ ID NO: 1843027 - RNA, 14 nt, Human
gucccccucuggcu

SEQ ID NO: 1843028 - RNA, 12 nt, Human
gucccccucugg

SEQ ID NO: 1843029 - RNA, 19 nt, Human
gucccaccuuggcugcagg

SEQ ID NO: 1843030 - RNA, 20 nt, Human
gucccaccuuggcugcaggg

SEQ ID NO: 1843031 - RNA, 17 nt, Human
gucccaccuuggcugca

SEQ ID NO: 1843032 - RNA, 18 nt, Human
gucccaccuuggcugcag

SEQ ID NO: 1843033 - RNA, 22 nt, Human
guccgaaagggacuuggaagcu

SEQ ID NO: 1843034 - RNA, 13 nt, Human
gucccuuuuccuu

SEQ ID NO: 1843035 - RNA, 21 nt, Human
guccgaaagggacuuggaagc

SEQ ID NO: 1843036 - RNA, 16 nt, Human
guccccgcacugggcu

SEQ ID NO: 1843037 - RNA, 15 nt, Human
guccccgcacugggc

SEQ ID NO: 1843038 - RNA, 13 nt, Human
gucccccugacaa

SEQ ID NO: 1843039 - RNA, 18 nt, Human
gucccccugacaacacuc

SEQ ID NO: 1843040 - RNA, 23 nt, Human
guccccuguuuguuucugaaagg

SEQ ID NO: 1843041 - RNA, 20 nt, Human
aacauacucccaucugugaa

SEQ ID NO: 1843042 - RNA, 16 nt, Human
aacauacucccaucug

SEQ ID NO: 1843043 - RNA, 18 nt, Human
aacauacucccaucugug

SEQ ID NO: 1843044 - RNA, 22 nt, Human
aacauguuuuucuucucccuca

SEQ ID NO: 1843045 - RNA, 14 nt, Human
aacaucaacaucuu

SEQ ID NO: 1843046 - RNA, 13 nt, Human
guccuacccaccc

SEQ ID NO: 1843047 - RNA, 20 nt, Human
aacagacuggaagcacagcu

SEQ ID NO: 1843048 - RNA, 19 nt, Human
aacagguuuuccugaagaa

SEQ ID NO: 1843049 - RNA, 18 nt, Human
guggggggggugcugggc

SEQ ID NO: 1843050 - RNA, 16 nt, Human
gugguguuuccuggca

SEQ ID NO: 1843051 - RNA, 15 nt, Human
gugguguuuccuggc

SEQ ID NO: 1843052 - RNA, 12 nt, Human
gugggagcugag

SEQ ID NO: 1843053 - RNA, 18 nt, Human
gugggauccuccaggugc

SEQ ID NO: 1843054 - RNA, 15 nt, Human
gugggauccuccagg

SEQ ID NO: 1843055 - RNA, 14 nt, Human
guggccucccaacu

SEQ ID NO: 1843056 - RNA, 13 nt, Human
guggccucccaac

SEQ ID NO: 1843057 - RNA, 17 nt, Human
guggcccgacagccugg

SEQ ID NO: 1843058 - RNA, 15 nt, Human
guggccucccaacuc

SEQ ID NO: 1843059 - RNA, 21 nt, Human
guggcuucccgcucagcccuc

SEQ ID NO: 1843060 - RNA, 16 nt, Human
guggcccgacagccug

SEQ ID NO: 1843061 - RNA, 19 nt, Human
aagagauugugguuucauu

SEQ ID NO: 1843062 - RNA, 16 nt, Human
aagagauugugguuuc

SEQ ID NO: 1843063 - RNA, 16 nt, Human
aagacuguacaaagua

SEQ ID NO: 1843064 - RNA, 14 nt, Human
aagagcccaggccu

SEQ ID NO: 1843065 - RNA, 12 nt, Human
aagagcccaggc

SEQ ID NO: 1843066 - RNA, 16 nt, Human
aagagcccaggccucc

SEQ ID NO: 1843067 - RNA, 17 nt, Human
aagacucauucuucugu

SEQ ID NO: 1843068 - RNA, 23 nt, Human
aagacgcugugcugcccugccca

SEQ ID NO: 1843069 - RNA, 22 nt, Human
aagacgcugugcugcccugccc

SEQ ID NO: 1843070 - RNA, 21 nt, Human
aagacgcugugcugcccugcc

SEQ ID NO: 1843071 - RNA, 23 nt, Human
aagaccccuuaccacugcucuga

SEQ ID NO: 1843072 - RNA, 12 nt, Human
aagaccagucca

SEQ ID NO: 1843073 - RNA, 15 nt, Human
gugugguguuuccug

SEQ ID NO: 1843074 - RNA, 13 nt, Human
gugugagucacca

SEQ ID NO: 1843075 - RNA, 18 nt, Human
gugugagucaccaagccc

SEQ ID NO: 1843076 - RNA, 21 nt, Human
gugucuugcaauggcagccuu

SEQ ID NO: 1843077 - RNA, 19 nt, Human
gugucuuuaaaugcugcuu

SEQ ID NO: 1843078 - RNA, 18 nt, Human
gugucuuuaaaugcugcu

SEQ ID NO: 1843079 - RNA, 19 nt, Human
gugucuugcaauggcagcc

SEQ ID NO: 1843080 - RNA, 20 nt, Human
gugucccaaaaagaaaggag

SEQ ID NO: 1843081 - RNA, 14 nt, Human
guguuuaagacauu

SEQ ID NO: 1843082 - RNA, 13 nt, Human
guguuuaagacau

SEQ ID NO: 1843083 - RNA, 19 nt, Human
gugugguguuuccuggcac

SEQ ID NO: 1843084 - RNA, 19 nt, Human
guguguguaugcgugugug

SEQ ID NO: 1843085 - RNA, 17 nt, Human
aagauauuuugcuuugu

SEQ ID NO: 1843086 - RNA, 20 nt, Human
aagauauuuugcuuugugau

SEQ ID NO: 1843087 - RNA, 20 nt, Human
aagaguaggaagacuuugga

SEQ ID NO: 1843088 - RNA, 22 nt, Human
aagauauuuugcuuugugauuu

SEQ ID NO: 1843089 - RNA, 18 nt, Human
gugguuauggagagggug

SEQ ID NO: 1843090 - RNA, 19 nt, Human
gugguguuuccuggcacug

SEQ ID NO: 1843091 - RNA, 15 nt, Human
aagauauuuugcuuu

SEQ ID NO: 1843092 - RNA, 19 nt, Human
aagaguaggaagacuuugg

SEQ ID NO: 1843093 - RNA, 18 nt, Human
aagaguaggaagacuuug

SEQ ID NO: 1843094 - RNA, 16 nt, Human
aagaguaggaagacuu

SEQ ID NO: 1843095 - RNA, 19 nt, Human
aagauguagaggagaaacu

SEQ ID NO: 1843096 - RNA, 13 nt, Human
aagcaaaauguga

SEQ ID NO: 1843097 - RNA, 22 nt, Human
aagauguagaggagaaacugga

SEQ ID NO: 1843098 - RNA, 16 nt, Human
aagcaagauuucagau

SEQ ID NO: 1843099 - RNA, 14 nt, Human
aagcaaaugugaau

SEQ ID NO: 1843100 - RNA, 13 nt, Human
aagcaaaugugaa

SEQ ID NO: 1843101 - RNA, 12 nt, Human
aagcaaaugucu

SEQ ID NO: 1843102 - RNA, 14 nt, Human
gugccaagcagagg

SEQ ID NO: 1843103 - RNA, 15 nt, Human
gugcauuuggugguu

SEQ ID NO: 1843104 - RNA, 21 nt, Human
gugcauuugaggucuguucuu

SEQ ID NO: 1843105 - RNA, 22 nt, Human
gugcauuugaggucuguucuuu

SEQ ID NO: 1843106 - RNA, 20 nt, Human
gugcauuugaggucuguucu

SEQ ID NO: 1843107 - RNA, 12 nt, Human
gugcacacacca

SEQ ID NO: 1843108 - RNA, 14 nt, Human
gugcacacaccaga

SEQ ID NO: 1843109 - RNA, 18 nt, Human
gugcacguacacacacau

SEQ ID NO: 1843110 - RNA, 17 nt, Human
gugcacacaccagagcc

SEQ ID NO: 1843111 - RNA, 15 nt, Human
gugccucugggacug

SEQ ID NO: 1843112 - RNA, 16 nt, Human
gugccuggccacgccc

SEQ ID NO: 1843113 - RNA, 23 nt, Human
aacuugguucccauuugcuccuu

SEQ ID NO: 1843114 - RNA, 17 nt, Human
aacuuggcgcugccccu

SEQ ID NO: 1843115 - RNA, 15 nt, Human
aacuuguaaaugugg

SEQ ID NO: 1843116 - RNA, 14 nt, Human
aacuuggaaauagu

SEQ ID NO: 1843117 - RNA, 14 nt, Human
aacuuggcgcugcc

SEQ ID NO: 1843118 - RNA, 13 nt, Human
aacuuguuuucug

SEQ ID NO: 1843119 - RNA, 22 nt, Human
aagaaaaaggaugcacagaguu

SEQ ID NO: 1843120 - RNA, 19 nt, Human
aagaaaaaggaugcacaga

SEQ ID NO: 1843121 - RNA, 20 nt, Human
aagaaaaaggaugcacagag

SEQ ID NO: 1843122 - RNA, 15 nt, Human
aagaaaaguuuugua

SEQ ID NO: 1843123 - RNA, 16 nt, Human
aagaaaaguuuuguaa

SEQ ID NO: 1843124 - RNA, 21 nt, Human
aagaaaaguuuuguaaauuuc

SEQ ID NO: 1843125 - RNA, 22 nt, Human
aagaaaaguuuuguaaauuucu

SEQ ID NO: 1843126 - RNA, 17 nt, Human
aagaagcccaggaaagg

SEQ ID NO: 1843127 - RNA, 16 nt, Human
aagaagcccaggaaag

SEQ ID NO: 1843128 - RNA, 14 nt, Human
aagaagcucucucc

SEQ ID NO: 1843129 - RNA, 15 nt, Human
aagaagcucucuccu

SEQ ID NO: 1843130 - RNA, 16 nt, Human
aagaaaauaccaagga

SEQ ID NO: 1843131 - RNA, 14 nt, Human
guggacacagcucu

SEQ ID NO: 1843132 - RNA, 15 nt, Human
guggacacagcucuu

SEQ ID NO: 1843133 - RNA, 17 nt, Human
guggacacagcucuucu

SEQ ID NO: 1843134 - RNA, 24 nt, Human
guggacacagcucuucuccaggcu

SEQ ID NO: 1843135 - RNA, 20 nt, Human
gugcugcccugcccaccugg

SEQ ID NO: 1843136 - RNA, 19 nt, Human
gugcugcccugcccaccug

SEQ ID NO: 1843137 - RNA, 21 nt, Human
gugcugcccugcccaccuggc

SEQ ID NO: 1843138 - RNA, 18 nt, Human
gugcugcccugcccaccu

SEQ ID NO: 1843139 - RNA, 23 nt, Human
aagaagguuucagaaagaagugg

SEQ ID NO: 1843140 - RNA, 16 nt, Human
gugcugggccccugcc

SEQ ID NO: 1843141 - RNA, 19 nt, Human
gugcugggccccugccucu

SEQ ID NO: 1843142 - RNA, 21 nt, Human
guggauuuaacagaaauguac

SEQ ID NO: 1843143 - RNA, 23 nt, Human
guggauuuaacagaaauguacag

SEQ ID NO: 1843144 - RNA, 14 nt, Human
guggcaccagcagc

SEQ ID NO: 1843145 - RNA, 13 nt, Human
guggcaccagcag

SEQ ID NO: 1843146 - RNA, 18 nt, Human
guggcaccagcagccugg

SEQ ID NO: 1843147 - RNA, 22 nt, Human
guggcagcucaccucucccuug

SEQ ID NO: 1843148 - RNA, 14 nt, Human
guggcagcugcggu

SEQ ID NO: 1843149 - RNA, 17 nt, Human
guggcagcugcggucca

SEQ ID NO: 1843150 - RNA, 13 nt, Human
aagacccaaaagg

SEQ ID NO: 1843151 - RNA, 13 nt, Human
uaaagucaggggu

SEQ ID NO: 1843152 - RNA, 14 nt, Human
uaaaguguauuuuu

SEQ ID NO: 1843153 - RNA, 15 nt, Human
uaaaguguauuuuuu

SEQ ID NO: 1843154 - RNA, 19 nt, Human
uaaaguguauuuuuuuacu

SEQ ID NO: 1843155 - RNA, 20 nt, Human
uaaaguguauuuuuuuacua

SEQ ID NO: 1843156 - RNA, 16 nt, Human
aauaaaaucuugaaaa

SEQ ID NO: 1843157 - RNA, 14 nt, Human
aauaaaguaauuau

SEQ ID NO: 1843158 - RNA, 16 nt, Human
aauaaaguacaagagc

SEQ ID NO: 1843159 - RNA, 12 nt, Human
aauaaaaauaau

SEQ ID NO: 1843160 - RNA, 15 nt, Human
aauaacuaaaaggua

SEQ ID NO: 1843161 - RNA, 12 nt, Human
aauaaauuauuu

SEQ ID NO: 1843162 - RNA, 22 nt, Human
aauaacauguaauuaaguacua

SEQ ID NO: 1843163 - RNA, 19 nt, Human
aauaacauguaauuaagua

SEQ ID NO: 1843164 - RNA, 12 nt, Human
aauaacauguaa

SEQ ID NO: 1843165 - RNA, 15 nt, Human
aauaacaauaaaaga

SEQ ID NO: 1843166 - RNA, 22 nt, Human
uaaauuaacuuuuauaaacuuu

SEQ ID NO: 1843167 - RNA, 20 nt, Human
uaaauguuuuuuuuuaaaga

SEQ ID NO: 1843168 - RNA, 17 nt, Human
uaaaugauuucauucaa

SEQ ID NO: 1843169 - RNA, 20 nt, Human
uaaaucuccaaaauaaaacu

SEQ ID NO: 1843170 - RNA, 21 nt, Human
uaaaucuccaaaauaaaacuu

SEQ ID NO: 1843171 - RNA, 22 nt, Human
uaaaucuccaaaauaaaacuuu

SEQ ID NO: 1843172 - RNA, 19 nt, Human
uaaauuuuuuuuguuucau

SEQ ID NO: 1843173 - RNA, 22 nt, Human
uaacaacuaugauuuggaaaau

SEQ ID NO: 1843174 - RNA, 21 nt, Human
uaacaacuaugauuuggaaaa

SEQ ID NO: 1843175 - RNA, 16 nt, Human
uaacaacuaugauuug

SEQ ID NO: 1843176 - RNA, 13 nt, Human
uaacaagccaccc

SEQ ID NO: 1843177 - RNA, 20 nt, Human
uaaauaguaaaaauaaaauu

SEQ ID NO: 1843178 - RNA, 19 nt, Human
uaaauaguaaaaauaaaau

SEQ ID NO: 1843179 - RNA, 19 nt, Human
uaaaucuccaaaauaaaac

SEQ ID NO: 1843180 - RNA, 15 nt, Human
aauacaccacuacau

SEQ ID NO: 1843181 - RNA, 16 nt, Human
aauacaccacuacauu

SEQ ID NO: 1843182 - RNA, 18 nt, Human
aauacaccacuacauucu

SEQ ID NO: 1843183 - RNA, 20 nt, Human
aauacaccacuacauucugu

SEQ ID NO: 1843184 - RNA, 21 nt, Human
aauacaccacuacauucuguu

SEQ ID NO: 1843185 - RNA, 13 nt, Human
uaaauaacuuuuu

SEQ ID NO: 1843186 - RNA, 12 nt, Human
uaaacugccccc

SEQ ID NO: 1843187 - RNA, 19 nt, Human
uaaacccaguaguggugac

SEQ ID NO: 1843188 - RNA, 18 nt, Human
uaaaccgccaaggcuggg

SEQ ID NO: 1843189 - RNA, 16 nt, Human
uaaaccgccaaggcug

SEQ ID NO: 1843190 - RNA, 21 nt, Human
uaaaggcuaccuuuguauucu

SEQ ID NO: 1843191 - RNA, 19 nt, Human
uaaaggcuaccuuuguauu

SEQ ID NO: 1843192 - RNA, 13 nt, Human
uaaagauggaaaa

SEQ ID NO: 1843193 - RNA, 18 nt, Human
uaaagaguuaguuugagu

SEQ ID NO: 1843194 - RNA, 14 nt, Human
uaaagaguguggca

SEQ ID NO: 1843195 - RNA, 15 nt, Human
uaaagacaccuacug

SEQ ID NO: 1843196 - RNA, 9 nt, Human
uaaagacag

SEQ ID NO: 1843197 - RNA, 10 nt, Human
uaaagacaga

SEQ ID NO: 1843198 - RNA, 16 nt, Human
uaaagacuuuuaugau

SEQ ID NO: 1843199 - RNA, 14 nt, Human
uaaagaagguuuca

SEQ ID NO: 1843200 - RNA, 14 nt, Human
aaguuuaauugacu

SEQ ID NO: 1843201 - RNA, 17 nt, Human
aaguucugcagauaaac

SEQ ID NO: 1843202 - RNA, 17 nt, Human
aaguucaugcuuuguuc

SEQ ID NO: 1843203 - RNA, 14 nt, Human
aaguuaaauaaauc

SEQ ID NO: 1843204 - RNA, 12 nt, Human
aaguuaaauaaa

SEQ ID NO: 1843205 - RNA, 17 nt, Human
aaguuacacauuuuuca

SEQ ID NO: 1843206 - RNA, 17 nt, Human
guuuuuuuuuaaagacu

SEQ ID NO: 1843207 - RNA, 19 nt, Human
uaaaauuaaagcugaaaac

SEQ ID NO: 1843208 - RNA, 18 nt, Human
uaaaauuaaagcugaaaa

SEQ ID NO: 1843209 - RNA, 16 nt, Human
uaaaauuaaagcugaa

SEQ ID NO: 1843210 - RNA, 17 nt, Human
uaaaauuuuuaaucuuu

SEQ ID NO: 1843211 - RNA, 19 nt, Human
uaaaccaaggcuagaacca

SEQ ID NO: 1843212 - RNA, 19 nt, Human
uaaaauuuuuaaucuuuaa

SEQ ID NO: 1843213 - RNA, 14 nt, Human
aaggggcaguggug

SEQ ID NO: 1843214 - RNA, 17 nt, Human
aaggggcaguggugguu

SEQ ID NO: 1843215 - RNA, 16 nt, Human
aaggguaucuggugac

SEQ ID NO: 1843216 - RNA, 19 nt, Human
aaggguaucaggugcugcc

SEQ ID NO: 1843217 - RNA, 19 nt, Human
aaggcugagaggagagaga

SEQ ID NO: 1843218 - RNA, 15 nt, Human
aagggcccagagagg

SEQ ID NO: 1843219 - RNA, 13 nt, Human
aagggcccagaga

SEQ ID NO: 1843220 - RNA, 18 nt, Human
guuuuacugcagcuuugu

SEQ ID NO: 1843221 - RNA, 16 nt, Human
guuuuacugcagcuuu

SEQ ID NO: 1843222 - RNA, 14 nt, Human
guuuuaagaggcag

SEQ ID NO: 1843223 - RNA, 18 nt, Human
guuuuaaggaugcuugua

SEQ ID NO: 1843224 - RNA, 16 nt, Human
guuuuaagaggcaggg

SEQ ID NO: 1843225 - RNA, 22 nt, Human
guuucugccgcagcccugcaga

SEQ ID NO: 1843226 - RNA, 22 nt, Human
guuucuaugacacaugcaaggu

SEQ ID NO: 1843227 - RNA, 14 nt, Human
guuucucagcuccc

SEQ ID NO: 1843228 - RNA, 13 nt, Human
guuugcuaaguga

SEQ ID NO: 1843229 - RNA, 19 nt, Human
guuugcaucugaaaauuga

SEQ ID NO: 1843230 - RNA, 17 nt, Human
guuugccucugccucug

SEQ ID NO: 1843231 - RNA, 15 nt, Human
aaguacuauguauca

SEQ ID NO: 1843232 - RNA, 16 nt, Human
aaguacuauguaucaa

SEQ ID NO: 1843233 - RNA, 15 nt, Human
aaguacuggagaaaa

SEQ ID NO: 1843234 - RNA, 21 nt, Human
aaguacuucuccacccugcuc

SEQ ID NO: 1843235 - RNA, 22 nt, Human
aaguacuucuccacccugcucu

SEQ ID NO: 1843236 - RNA, 23 nt, Human
aaguacuucuccacccugcucuc

SEQ ID NO: 1843237 - RNA, 12 nt, Human
aagucacugcac

SEQ ID NO: 1843238 - RNA, 14 nt, Human
aagucacugcacag

SEQ ID NO: 1843239 - RNA, 13 nt, Human
aagucacacagug

SEQ ID NO: 1843240 - RNA, 21 nt, Human
aagucaagugaaaaaggagga

SEQ ID NO: 1843241 - RNA, 19 nt, Human
aagucaaggguaggguggg

SEQ ID NO: 1843242 - RNA, 24 nt, Human
aagucacacaguauuacuucugcu

SEQ ID NO: 1843243 - RNA, 19 nt, Human
aaguauucuuauuuaauga

SEQ ID NO: 1843244 - RNA, 18 nt, Human
aaguauucuuauuuaaug

SEQ ID NO: 1843245 - RNA, 16 nt, Human
guuuuugucuuaaaaa

SEQ ID NO: 1843246 - RNA, 15 nt, Human
guuuuuuuuuaaaga

SEQ ID NO: 1843247 - RNA, 18 nt, Human
guuuuucuaggccugggg

SEQ ID NO: 1843248 - RNA, 17 nt, Human
aagucuuagauguauau

SEQ ID NO: 1843249 - RNA, 19 nt, Human
aagucuuagauguauauau

SEQ ID NO: 1843250 - RNA, 18 nt, Human
aagucuuagauguauaua

SEQ ID NO: 1843251 - RNA, 22 nt, Human
aagucuuauauauuguagauaa

SEQ ID NO: 1843252 - RNA, 19 nt, Human
aaggaugcccaaagaugca

SEQ ID NO: 1843253 - RNA, 14 nt, Human
aaggaugcccaaag

SEQ ID NO: 1843254 - RNA, 24 nt, Human
aaggaugcacagaguuguuacauu

SEQ ID NO: 1843255 - RNA, 22 nt, Human
aaggaugcacagaguuguuaca

SEQ ID NO: 1843256 - RNA, 16 nt, Human
aaggccccgcccaggc

SEQ ID NO: 1843257 - RNA, 14 nt, Human
aaggccccgcccag

SEQ ID NO: 1843258 - RNA, 19 nt, Human
aaggccccgcccaggcuua

SEQ ID NO: 1843259 - RNA, 13 nt, Human
aaggcuaccuuug

SEQ ID NO: 1843260 - RNA, 15 nt, Human
aaggcuaccuuugua

SEQ ID NO: 1843261 - RNA, 14 nt, Human
guugcccaggcugg

SEQ ID NO: 1843262 - RNA, 12 nt, Human
guugcugccuca

SEQ ID NO: 1843263 - RNA, 15 nt, Human
guugcccaggcuggc

SEQ ID NO: 1843264 - RNA, 16 nt, Human
guugcccaggcuggcg

SEQ ID NO: 1843265 - RNA, 17 nt, Human
guugcccaggcuggcgu

SEQ ID NO: 1843266 - RNA, 17 nt, Human
guugggcuggugucacc

SEQ ID NO: 1843267 - RNA, 15 nt, Human
aaggaaacccagcuc

SEQ ID NO: 1843268 - RNA, 16 nt, Human
aaggaaacccagcucu

SEQ ID NO: 1843269 - RNA, 18 nt, Human
aaggagauuuacaacugg

SEQ ID NO: 1843270 - RNA, 22 nt, Human
aaggagcaagucagaauagaaa

SEQ ID NO: 1843271 - RNA, 22 nt, Human
aaggauccugagccagauuuca

SEQ ID NO: 1843272 - RNA, 20 nt, Human
aaggauccugagccagauuu

SEQ ID NO: 1843273 - RNA, 13 nt, Human
aaggauccugagc

SEQ ID NO: 1843274 - RNA, 12 nt, Human
aaggauccugag

SEQ ID NO: 1843275 - RNA, 11 nt, Human
aaggauccuga

SEQ ID NO: 1843276 - RNA, 11 nt, Human
aaggauaaagu

SEQ ID NO: 1843277 - RNA, 20 nt, Human
aaggaggaagagaaaaaaua

SEQ ID NO: 1843278 - RNA, 21 nt, Human
aaggauaaaguugguaaaccu

SEQ ID NO: 1843279 - RNA, 23 nt, Human
aaggauaaaguugguaaaccuuu

SEQ ID NO: 1843280 - RNA, 13 nt, Human
aaggauaaugaau

SEQ ID NO: 1843281 - RNA, 18 nt, Human
aagcuguuacugucuuca

SEQ ID NO: 1843282 - RNA, 13 nt, Human
aagcucugcuccu

SEQ ID NO: 1843283 - RNA, 16 nt, Human
aagcuuuuaugugaaa

SEQ ID NO: 1843284 - RNA, 17 nt, Human
guuccccuguucacucu

SEQ ID NO: 1843285 - RNA, 15 nt, Human
guuccccuguucacu

SEQ ID NO: 1843286 - RNA, 19 nt, Human
aaggaaaaaauaacaauga

SEQ ID NO: 1843287 - RNA, 16 nt, Human
aaggaaaaaauaacaa

SEQ ID NO: 1843288 - RNA, 22 nt, Human
aagcucccaggcauuccccagg

SEQ ID NO: 1843289 - RNA, 12 nt, Human
aagcucccaggc

SEQ ID NO: 1843290 - RNA, 23 nt, Human
aagcucccaggcauuccccagga

SEQ ID NO: 1843291 - RNA, 13 nt, Human
guguuuauuguca

SEQ ID NO: 1843292 - RNA, 11 nt, Human
aagcucccagg

SEQ ID NO: 1843293 - RNA, 22 nt, Human
guguuuaagacauuuuuggaag

SEQ ID NO: 1843294 - RNA, 22 nt, Human
guugauagcacagacccugccc

SEQ ID NO: 1843295 - RNA, 23 nt, Human
guugauagcacagacccugcccu

SEQ ID NO: 1843296 - RNA, 12 nt, Human
guucucugcccu

SEQ ID NO: 1843297 - RNA, 13 nt, Human
guucucugcccuc

SEQ ID NO: 1843298 - RNA, 11 nt, Human
guucucugccc

SEQ ID NO: 1843299 - RNA, 16 nt, Human
guucucugaggacacu

SEQ ID NO: 1843300 - RNA, 18 nt, Human
guuccccuguucacucua

SEQ ID NO: 1843301 - RNA, 16 nt, Human
uacccucauguucuua

SEQ ID NO: 1843302 - RNA, 15 nt, Human
uacccucauguucuu

SEQ ID NO: 1843303 - RNA, 20 nt, Human
uacccgggaagggggcuggg

SEQ ID NO: 1843304 - RNA, 22 nt, Human
uacccuggcacuauaauguaag

SEQ ID NO: 1843305 - RNA, 20 nt, Human
uacccuggcacuauaaugua

SEQ ID NO: 1843306 - RNA, 17 nt, Human
uaccacuuuuguucuug

SEQ ID NO: 1843307 - RNA, 17 nt, Human
uaccauccccuguagag

SEQ ID NO: 1843308 - RNA, 15 nt, Human
aaugucacaggcagg

SEQ ID NO: 1843309 - RNA, 18 nt, Human
aauuaacuuuuauaaacu

SEQ ID NO: 1843310 - RNA, 20 nt, Human
aauuaacuuuuauaaacuuu

SEQ ID NO: 1843311 - RNA, 22 nt, Human
aauuaacuuuuauaaacuuuac

SEQ ID NO: 1843312 - RNA, 20 nt, Human
aauuaagaaaggauaaaguu

SEQ ID NO: 1843313 - RNA, 19 nt, Human
aauuaacaugaauauuuag

SEQ ID NO: 1843314 - RNA, 20 nt, Human
uacauuagcaguuugcuuug

SEQ ID NO: 1843315 - RNA, 19 nt, Human
uacauuagcaguuugcuuu

SEQ ID NO: 1843316 - RNA, 13 nt, Human
aauuaaguacuau

SEQ ID NO: 1843317 - RNA, 17 nt, Human
uacauguacugauuacu

SEQ ID NO: 1843318 - RNA, 22 nt, Human
aaugguuuucuuguguguuuau

SEQ ID NO: 1843319 - RNA, 18 nt, Human
aaugguuuucuugugugu

SEQ ID NO: 1843320 - RNA, 17 nt, Human
aaugguuuucuugugug

SEQ ID NO: 1843321 - RNA, 15 nt, Human
aauguaagcucuacu

SEQ ID NO: 1843322 - RNA, 13 nt, Human
aauguaagcucua

SEQ ID NO: 1843323 - RNA, 13 nt, Human
aauguaagacaaa

SEQ ID NO: 1843324 - RNA, 16 nt, Human
aaugguuuaaaugguc

SEQ ID NO: 1843325 - RNA, 22 nt, Human
uacagcaaggagauuuacaacu

SEQ ID NO: 1843326 - RNA, 21 nt, Human
aauguacagcaaggagauuua

SEQ ID NO: 1843327 - RNA, 23 nt, Human
aauguacagcaaggagauuuaca

SEQ ID NO: 1843328 - RNA, 22 nt, Human
aaugugaaacuggauuaaacuu

SEQ ID NO: 1843329 - RNA, 14 nt, Human
aaugucacaggcag

SEQ ID NO: 1843330 - RNA, 14 nt, Human
aauguauuuuuccu

SEQ ID NO: 1843331 - RNA, 13 nt, Human
aaugucacaggca

SEQ ID NO: 1843332 - RNA, 18 nt, Human
uacaguccucccaucuca

SEQ ID NO: 1843333 - RNA, 17 nt, Human
uacaguccucccaucuc

SEQ ID NO: 1843334 - RNA, 15 nt, Human
uacaguccucccauc

SEQ ID NO: 1843335 - RNA, 12 nt, Human
uacaguccuccc

SEQ ID NO: 1843336 - RNA, 18 nt, Human
uacaguaucucagggccu

SEQ ID NO: 1843337 - RNA, 15 nt, Human
uacauaaugcgugca

SEQ ID NO: 1843338 - RNA, 13 nt, Human
uacagucuuguau

SEQ ID NO: 1843339 - RNA, 12 nt, Human
uacagucuugua

SEQ ID NO: 1843340 - RNA, 16 nt, Human
aaugcaaaccaucauu

SEQ ID NO: 1843341 - RNA, 15 nt, Human
aaugaccuuucaaua

SEQ ID NO: 1843342 - RNA, 14 nt, Human
aaugaccuuucaau

SEQ ID NO: 1843343 - RNA, 13 nt, Human
aaugaccuuucaa

SEQ ID NO: 1843344 - RNA, 21 nt, Human
aaugaaugucagugugacuga

SEQ ID NO: 1843345 - RNA, 20 nt, Human
aaugaaugucagugugacug

SEQ ID NO: 1843346 - RNA, 23 nt, Human
aaugcaaaccaucauugaaaucu

SEQ ID NO: 1843347 - RNA, 22 nt, Human
aaugcaaaccaucauugaaauc

SEQ ID NO: 1843348 - RNA, 18 nt, Human
aaugcacaaacagaggcc

SEQ ID NO: 1843349 - RNA, 16 nt, Human
aaugcacuuuguucug

SEQ ID NO: 1843350 - RNA, 13 nt, Human
aaugcacuuuguu

SEQ ID NO: 1843351 - RNA, 20 nt, Human
aaugcacaaacagaggccgc

SEQ ID NO: 1843352 - RNA, 19 nt, Human
aaugcacaaacagaggccg

SEQ ID NO: 1843353 - RNA, 20 nt, Human
aaugcacuuuguucuggcuc

SEQ ID NO: 1843354 - RNA, 19 nt, Human
aaugcacuuuguucuggcu

SEQ ID NO: 1843355 - RNA, 23 nt, Human
uaauuaguuccucauuagcauuu

SEQ ID NO: 1843356 - RNA, 20 nt, Human
uaauuauacccccugcaaag

SEQ ID NO: 1843357 - RNA, 21 nt, Human
uaauuuuuguauuuuuaguag

SEQ ID NO: 1843358 - RNA, 22 nt, Human
uaauuuuuguguuuuuaauaaa

SEQ ID NO: 1843359 - RNA, 13 nt, Human
uaauuuuuuacua

SEQ ID NO: 1843360 - RNA, 18 nt, Human
uaauuuaccugaagucuu

SEQ ID NO: 1843361 - RNA, 17 nt, Human
uaauuuaccugaagucu

SEQ ID NO: 1843362 - RNA, 13 nt, Human
uaauucauguugc

SEQ ID NO: 1843363 - RNA, 15 nt, Human
uacaaaaagcauaaa

SEQ ID NO: 1843364 - RNA, 18 nt, Human
uacaagccagcuggagaa

SEQ ID NO: 1843365 - RNA, 16 nt, Human
uacaaaaacauggccu

SEQ ID NO: 1843366 - RNA, 16 nt, Human
uacaagcgugagccac

SEQ ID NO: 1843367 - RNA, 18 nt, Human
uacaagcgugagccacug

SEQ ID NO: 1843368 - RNA, 19 nt, Human
uacaagcgugagccacugc

SEQ ID NO: 1843369 - RNA, 20 nt, Human
uacaagcgugagccacugca

SEQ ID NO: 1843370 - RNA, 20 nt, Human
uacaauaaaaucuugaaaau

SEQ ID NO: 1843371 - RNA, 21 nt, Human
uacaagcgugagccacugcac

SEQ ID NO: 1843372 - RNA, 17 nt, Human
uaauguaagcucuacug

SEQ ID NO: 1843373 - RNA, 16 nt, Human
uaauguaagcucuacu

SEQ ID NO: 1843374 - RNA, 15 nt, Human
uaauguaagacaaau

SEQ ID NO: 1843375 - RNA, 12 nt, Human
uaaugugaaacu

SEQ ID NO: 1843376 - RNA, 20 nt, Human
uaaugugaaacuggauuaaa

SEQ ID NO: 1843377 - RNA, 22 nt, Human
uaaugugaaacuggauuaaacu

SEQ ID NO: 1843378 - RNA, 23 nt, Human
uaaugugaaacuggauuaaacuu

SEQ ID NO: 1843379 - RNA, 16 nt, Human
uaaugucacaggcagg

SEQ ID NO: 1843380 - RNA, 17 nt, Human
uaaugucacaggcaggu

SEQ ID NO: 1843381 - RNA, 15 nt, Human
uaaugucacaggcag

SEQ ID NO: 1843382 - RNA, 13 nt, Human
aaucuugaaaaug

SEQ ID NO: 1843383 - RNA, 23 nt, Human
aaucuucugaacuuggcgcugcc

SEQ ID NO: 1843384 - RNA, 15 nt, Human
aaugaaugaaugaau

SEQ ID NO: 1843385 - RNA, 14 nt, Human
aaugaaugaaacau

SEQ ID NO: 1843386 - RNA, 14 nt, Human
aaugaaugucagug

SEQ ID NO: 1843387 - RNA, 15 nt, Human
aaugaaugucagugu

SEQ ID NO: 1843388 - RNA, 21 nt, Human
uaauauugauaugcuuauaca

SEQ ID NO: 1843389 - RNA, 22 nt, Human
uaauccaagcaaaugugaauca

SEQ ID NO: 1843390 - RNA, 17 nt, Human
uaaucuuuaauuuuaca

SEQ ID NO: 1843391 - RNA, 13 nt, Human
uaauaccucccuu

SEQ ID NO: 1843392 - RNA, 18 nt, Human
uaauacuugcuuuggaaa

SEQ ID NO: 1843393 - RNA, 22 nt, Human
uaauacaccacuacauucuguu

SEQ ID NO: 1843394 - RNA, 21 nt, Human
uaauacaccacuacauucugu

SEQ ID NO: 1843395 - RNA, 23 nt, Human
uaauacaccacuacauucuguua

SEQ ID NO: 1843396 - RNA, 20 nt, Human
aauacaguaucucagggccu

SEQ ID NO: 1843397 - RNA, 17 nt, Human
uagaagucuuagaugua

SEQ ID NO: 1843398 - RNA, 16 nt, Human
uagaagucuuagaugu

SEQ ID NO: 1843399 - RNA, 16 nt, Human
uagaagucacacagua

SEQ ID NO: 1843400 - RNA, 19 nt, Human
uagaagucuuagauguaua

SEQ ID NO: 1843401 - RNA, 18 nt, Human
uagaagucuuagauguau

SEQ ID NO: 1843402 - RNA, 20 nt, Human
uagaagucuuagauguauau

SEQ ID NO: 1843403 - RNA, 16 nt, Human
uagacaauuuauuaug

SEQ ID NO: 1843404 - RNA, 15 nt, Human
uagaacucccuuuca

SEQ ID NO: 1843405 - RNA, 13 nt, Human
uagaacugaauuu

SEQ ID NO: 1843406 - RNA, 17 nt, Human
uagaacugaauuuuguc

SEQ ID NO: 1843407 - RNA, 22 nt, Human
uagaacugaauuuugucuuuau

SEQ ID NO: 1843408 - RNA, 18 nt, Human
uagaagauggcacuuaua

SEQ ID NO: 1843409 - RNA, 15 nt, Human
uagaagucacacagu

SEQ ID NO: 1843410 - RNA, 18 nt, Human
aauuuuuauuaaauuaug

SEQ ID NO: 1843411 - RNA, 17 nt, Human
aauuuuuauuaaauuau

SEQ ID NO: 1843412 - RNA, 14 nt, Human
uagacagucccugc

SEQ ID NO: 1843413 - RNA, 12 nt, Human
uagacagucccu

SEQ ID NO: 1843414 - RNA, 14 nt, Human
aauuuuuguauuuu

SEQ ID NO: 1843415 - RNA, 13 nt, Human
acaaaaacauggc

SEQ ID NO: 1843416 - RNA, 17 nt, Human
aauuuuuuugagacaga

SEQ ID NO: 1843417 - RNA, 16 nt, Human
acaaaaagcauaaaaa

SEQ ID NO: 1843418 - RNA, 15 nt, Human
uagagcuucuggcac

SEQ ID NO: 1843419 - RNA, 19 nt, Human
uagcacagacccugcccug

SEQ ID NO: 1843420 - RNA, 18 nt, Human
uagcacagacccugcccu

SEQ ID NO: 1843421 - RNA, 17 nt, Human
uagcacagacccugccc

SEQ ID NO: 1843422 - RNA, 16 nt, Human
uagcacagacccugcc

SEQ ID NO: 1843423 - RNA, 22 nt, Human
uagauuuuagacccuauugcug

SEQ ID NO: 1843424 - RNA, 14 nt, Human
uagcaccagggaag

SEQ ID NO: 1843425 - RNA, 13 nt, Human
uagcaccagggaa

SEQ ID NO: 1843426 - RNA, 16 nt, Human
uagcaccagggaaggg

SEQ ID NO: 1843427 - RNA, 18 nt, Human
uagcaugucgucaaagcu

SEQ ID NO: 1843428 - RNA, 21 nt, Human
uagcaugucgucaaagcugaa

SEQ ID NO: 1843429 - RNA, 15 nt, Human
acaacaacaaaauga

SEQ ID NO: 1843430 - RNA, 18 nt, Human
acaaauucugucucugga

SEQ ID NO: 1843431 - RNA, 15 nt, Human
acaacaaccugguca

SEQ ID NO: 1843432 - RNA, 12 nt, Human
acaacacucaca

SEQ ID NO: 1843433 - RNA, 22 nt, Human
acaagaaaugaaagcagggacu

SEQ ID NO: 1843434 - RNA, 13 nt, Human
acaagccagcugg

SEQ ID NO: 1843435 - RNA, 15 nt, Human
acaagccagcuggag

SEQ ID NO: 1843436 - RNA, 12 nt, Human
acaagccacccc

SEQ ID NO: 1843437 - RNA, 13 nt, Human
acaagcugcaccc

SEQ ID NO: 1843438 - RNA, 20 nt, Human
acaagcgugagccacugcac

SEQ ID NO: 1843439 - RNA, 21 nt, Human
acaagcgugagccacugcacc

SEQ ID NO: 1843440 - RNA, 18 nt, Human
acaagagcccaggccucc

SEQ ID NO: 1843441 - RNA, 17 nt, Human
acaagagcccaggccuc

SEQ ID NO: 1843442 - RNA, 18 nt, Human
acaagcacuaaacaaaga

SEQ ID NO: 1843443 - RNA, 22 nt, Human
uacucuucaguuaagccuuugg

SEQ ID NO: 1843444 - RNA, 18 nt, Human
uacucuuauagacaacau

SEQ ID NO: 1843445 - RNA, 16 nt, Human
uacuauguaucaauga

SEQ ID NO: 1843446 - RNA, 16 nt, Human
uacuauaauuuaccug

SEQ ID NO: 1843447 - RNA, 13 nt, Human
uacguugugcauu

SEQ ID NO: 1843448 - RNA, 14 nt, Human
uacguugugcauuu

SEQ ID NO: 1843449 - RNA, 14 nt, Human
uacguuaccaggca

SEQ ID NO: 1843450 - RNA, 14 nt, Human
uacgucugacaggc

SEQ ID NO: 1843451 - RNA, 13 nt, Human
aauugacccacaa

SEQ ID NO: 1843452 - RNA, 16 nt, Human
aauugacccacaagaa

SEQ ID NO: 1843453 - RNA, 19 nt, Human
aauugacccacaagaaaug

SEQ ID NO: 1843454 - RNA, 15 nt, Human
uacguacacauuuua

SEQ ID NO: 1843455 - RNA, 22 nt, Human
aauucuucuccacuuucuagcc

SEQ ID NO: 1843456 - RNA, 14 nt, Human
aauucuugcaaagu

SEQ ID NO: 1843457 - RNA, 20 nt, Human
aauucuugcaaaguaucccu

SEQ ID NO: 1843458 - RNA, 21 nt, Human
aauucuugccaaauauaaaua

SEQ ID NO: 1843459 - RNA, 15 nt, Human
aauuuaccugaaguc

SEQ ID NO: 1843460 - RNA, 17 nt, Human
aauuuagaaauauaauu

SEQ ID NO: 1843461 - RNA, 13 nt, Human
aauuucuaaaucu

SEQ ID NO: 1843462 - RNA, 21 nt, Human
aauuucuaaaucuccaaaaua

SEQ ID NO: 1843463 - RNA, 20 nt, Human
aauuugaaacacuuugcaua

SEQ ID NO: 1843464 - RNA, 16 nt, Human
aauuucucuacugucu

SEQ ID NO: 1843465 - RNA, 19 nt, Human
aauuuacauacucugcuua

SEQ ID NO: 1843466 - RNA, 13 nt, Human
aauuuaaaagucu

SEQ ID NO: 1843467 - RNA, 12 nt, Human
aauugcuccuug

SEQ ID NO: 1843468 - RNA, 22 nt, Human
aauuguuuggggaugagaaagg

SEQ ID NO: 1843469 - RNA, 16 nt, Human
uauuaaaaaucucaaa

SEQ ID NO: 1843470 - RNA, 18 nt, Human
uauuaaaaaucucaaauu

SEQ ID NO: 1843471 - RNA, 20 nt, Human
uauuaaaaaucucaaauuuc

SEQ ID NO: 1843472 - RNA, 22 nt, Human
uauuaaaaaucucaaauuucua

SEQ ID NO: 1843473 - RNA, 17 nt, Human
uauguuuuaagaggcag

SEQ ID NO: 1843474 - RNA, 19 nt, Human
uauguuuuaagaggcaggg

SEQ ID NO: 1843475 - RNA, 23 nt, Human
uauuaaaaaucucaaauuucuaa

SEQ ID NO: 1843476 - RNA, 16 nt, Human
uauuaccacagacaua

SEQ ID NO: 1843477 - RNA, 12 nt, Human
uauuagagaaga

SEQ ID NO: 1843478 - RNA, 23 nt, Human
uauucauagcagcuuauucacaa

SEQ ID NO: 1843479 - RNA, 22 nt, Human
uauucaggaagcucagggccug

SEQ ID NO: 1843480 - RNA, 18 nt, Human
uauucaggaagcucaggg

SEQ ID NO: 1843481 - RNA, 15 nt, Human
uauucagcucaugga

SEQ ID NO: 1843482 - RNA, 15 nt, Human
acaguccucccaucu

SEQ ID NO: 1843483 - RNA, 14 nt, Human
acaguccucccauc

SEQ ID NO: 1843484 - RNA, 13 nt, Human
acaguccucccau

SEQ ID NO: 1843485 - RNA, 15 nt, Human
acagucccugccaau

SEQ ID NO: 1843486 - RNA, 20 nt, Human
acaguccuuaccagcagagc

SEQ ID NO: 1843487 - RNA, 18 nt, Human
acaguccuuaccagcaga

SEQ ID NO: 1843488 - RNA, 17 nt, Human
acaguccucccaucuca

SEQ ID NO: 1843489 - RNA, 13 nt, Human
acagucccugcca

SEQ ID NO: 1843490 - RNA, 15 nt, Human
acaguauuacuucug

SEQ ID NO: 1843491 - RNA, 16 nt, Human
acaguauuacuucugc

SEQ ID NO: 1843492 - RNA, 17 nt, Human
acaguauuacuucugcu

SEQ ID NO: 1843493 - RNA, 19 nt, Human
acaguauuacuucugcuac

SEQ ID NO: 1843494 - RNA, 21 nt, Human
acaguauggcagcuuuccuca

SEQ ID NO: 1843495 - RNA, 21 nt, Human
acaggcugggcuucaguggca

SEQ ID NO: 1843496 - RNA, 14 nt, Human
acaggcugggcuuc

SEQ ID NO: 1843497 - RNA, 17 nt, Human
acaggcugggcuucagu

SEQ ID NO: 1843498 - RNA, 22 nt, Human
acagguuuuccugaagaauuga

SEQ ID NO: 1843499 - RNA, 22 nt, Human
acagggcacaccgggcacucag

SEQ ID NO: 1843500 - RNA, 14 nt, Human
acagugagacucug

SEQ ID NO: 1843501 - RNA, 18 nt, Human
acagugagacucugucuc

SEQ ID NO: 1843502 - RNA, 15 nt, Human
acaguuaagagaaau

SEQ ID NO: 1843503 - RNA, 22 nt, Human
acaguccuuaccagcagagcac

SEQ ID NO: 1843504 - RNA, 21 nt, Human
acaguccuuaccagcagagca

SEQ ID NO: 1843505 - RNA, 14 nt, Human
acagucuuguauua

SEQ ID NO: 1843506 - RNA, 15 nt, Human
acagucuuguauuaa

SEQ ID NO: 1843507 - RNA, 18 nt, Human
acagucuuguauuaaguu

SEQ ID NO: 1843508 - RNA, 22 nt, Human
acagucuuguauuaaguuguua

SEQ ID NO: 1843509 - RNA, 20 nt, Human
acagugaaagaaaauaacaa

SEQ ID NO: 1843510 - RNA, 21 nt, Human
uauuuaaugaaagacuguaca

SEQ ID NO: 1843511 - RNA, 15 nt, Human
uauuuaaugaaagac

SEQ ID NO: 1843512 - RNA, 11 nt, Human
uauuguacagu

SEQ ID NO: 1843513 - RNA, 12 nt, Human
uauuguacaguu

SEQ ID NO: 1843514 - RNA, 13 nt, Human
uauuguacaguuu

SEQ ID NO: 1843515 - RNA, 14 nt, Human
uauuguacaguuuu

SEQ ID NO: 1843516 - RNA, 15 nt, Human
uauuguacaguuuuu

SEQ ID NO: 1843517 - RNA, 17 nt, Human
uauuguacaguuuuuau

SEQ ID NO: 1843518 - RNA, 17 nt, Human
uauugucaaagugguga

SEQ ID NO: 1843519 - RNA, 13 nt, Human
uauugucaaagug

SEQ ID NO: 1843520 - RNA, 14 nt, Human
uauuuauuuaaauu

SEQ ID NO: 1843521 - RNA, 14 nt, Human
uauuuauuuaguau

SEQ ID NO: 1843522 - RNA, 13 nt, Human
uauuuauuuaaau

SEQ ID NO: 1843523 - RNA, 19 nt, Human
uauuuaguguucauaaaua

SEQ ID NO: 1843524 - RNA, 14 nt, Human
uauuuaauucaugu

SEQ ID NO: 1843525 - RNA, 23 nt, Human
uauuuaauuuuuuugagacagag

SEQ ID NO: 1843526 - RNA, 18 nt, Human
uauuuacuucuuauacau

SEQ ID NO: 1843527 - RNA, 20 nt, Human
uauuuagcaccagggaaggg

SEQ ID NO: 1843528 - RNA, 17 nt, Human
acaguucucuccuucuu

SEQ ID NO: 1843529 - RNA, 20 nt, Human
uauucucuccuguaccucuu

SEQ ID NO: 1843530 - RNA, 24 nt, Human
uauucucuccuguaccucuugagc

SEQ ID NO: 1843531 - RNA, 15 nt, Human
uauucuuauuuaaug

SEQ ID NO: 1843532 - RNA, 16 nt, Human
uauucuguuggccagu

SEQ ID NO: 1843533 - RNA, 13 nt, Human
acaguuacucaga

SEQ ID NO: 1843534 - RNA, 20 nt, Human
acaguuacucagaauucucu

SEQ ID NO: 1843535 - RNA, 20 nt, Human
acaguucaauucucauuugu

SEQ ID NO: 1843536 - RNA, 22 nt, Human
acaguucggugagcuacaaaug

SEQ ID NO: 1843537 - RNA, 19 nt, Human
acaguucggugagcuacaa

SEQ ID NO: 1843538 - RNA, 16 nt, Human
acaguucucuccuucu

SEQ ID NO: 1843539 - RNA, 23 nt, Human
acaguucggugagcuacaaaugc

SEQ ID NO: 1843540 - RNA, 20 nt, Human
uauaaccaguguuguggauu

SEQ ID NO: 1843541 - RNA, 21 nt, Human
uauacacuuacacuuuaugca

SEQ ID NO: 1843542 - RNA, 13 nt, Human
uauacauaaacaa

SEQ ID NO: 1843543 - RNA, 14 nt, Human
uauacauaaacaag

SEQ ID NO: 1843544 - RNA, 14 nt, Human
uauacauuugauaa

SEQ ID NO: 1843545 - RNA, 13 nt, Human
uauauaucaaaua

SEQ ID NO: 1843546 - RNA, 23 nt, Human
acacucauugaccugaggcccuu

SEQ ID NO: 1843547 - RNA, 21 nt, Human
acacucauugaccugaggccc

SEQ ID NO: 1843548 - RNA, 19 nt, Human
acacucauugaccugaggc

SEQ ID NO: 1843549 - RNA, 13 nt, Human
uauaggaauugac

SEQ ID NO: 1843550 - RNA, 14 nt, Human
uauaggaauugacc

SEQ ID NO: 1843551 - RNA, 19 nt, Human
uauaggaauugacccacaa

SEQ ID NO: 1843552 - RNA, 20 nt, Human
uauagccuaggugacagagu

SEQ ID NO: 1843553 - RNA, 16 nt, Human
acaccgggccuggaga

SEQ ID NO: 1843554 - RNA, 19 nt, Human
acacccugugauggggccc

SEQ ID NO: 1843555 - RNA, 18 nt, Human
acacccugugauggggcc

SEQ ID NO: 1843556 - RNA, 12 nt, Human
acacccugugau

SEQ ID NO: 1843557 - RNA, 11 nt, Human
acacccuguga

SEQ ID NO: 1843558 - RNA, 21 nt, Human
acacaugcaaggucauuuuuu

SEQ ID NO: 1843559 - RNA, 19 nt, Human
acacccagcccacuucugc

SEQ ID NO: 1843560 - RNA, 20 nt, Human
acacccagcccacuucugcc

SEQ ID NO: 1843561 - RNA, 21 nt, Human
acacccagcccacuucugcca

SEQ ID NO: 1843562 - RNA, 19 nt, Human
acacaugcaaggucauuuu

SEQ ID NO: 1843563 - RNA, 20 nt, Human
acacaugcaaggucauuuuu

SEQ ID NO: 1843564 - RNA, 18 nt, Human
acacaugcaaggucauuu

SEQ ID NO: 1843565 - RNA, 17 nt, Human
uauaaaagccuguuuaa

SEQ ID NO: 1843566 - RNA, 14 nt, Human
uauaaaagccuguu

SEQ ID NO: 1843567 - RNA, 12 nt, Human
uauaaaagccug

SEQ ID NO: 1843568 - RNA, 20 nt, Human
uaguuccucauuagcauuuu

SEQ ID NO: 1843569 - RNA, 23 nt, Human
acaagcugcacccucaggcaggu

SEQ ID NO: 1843570 - RNA, 22 nt, Human
acaagcugcacccucaggcagg

SEQ ID NO: 1843571 - RNA, 21 nt, Human
acaagcugcacccucaggcag

SEQ ID NO: 1843572 - RNA, 19 nt, Human
acaagcugcacccucaggc

SEQ ID NO: 1843573 - RNA, 21 nt, Human
uagucaggugccucaagagaa

SEQ ID NO: 1843574 - RNA, 16 nt, Human
uauauugauccagaaa

SEQ ID NO: 1843575 - RNA, 14 nt, Human
acagacuggaagca

SEQ ID NO: 1843576 - RNA, 20 nt, Human
acagacccugcccugugggc

SEQ ID NO: 1843577 - RNA, 18 nt, Human
acagacccugcccugugg

SEQ ID NO: 1843578 - RNA, 16 nt, Human
acagacccugcccugu

SEQ ID NO: 1843579 - RNA, 17 nt, Human
acagacccugcccugug

SEQ ID NO: 1843580 - RNA, 15 nt, Human
acagacagcccucca

SEQ ID NO: 1843581 - RNA, 13 nt, Human
acagacagcccuc

SEQ ID NO: 1843582 - RNA, 11 nt, Human
acacuccuuca

SEQ ID NO: 1843583 - RNA, 23 nt, Human
acagacacaggcccggcuccagg

SEQ ID NO: 1843584 - RNA, 18 nt, Human
uaucacccagaagaaaau

SEQ ID NO: 1843585 - RNA, 14 nt, Human
uauauuuacaaaug

SEQ ID NO: 1843586 - RNA, 21 nt, Human
uaucaaguauuauaccuuuuu

SEQ ID NO: 1843587 - RNA, 15 nt, Human
uauauuuacaaaugg

SEQ ID NO: 1843588 - RNA, 14 nt, Human
acagacuucugaaa

SEQ ID NO: 1843589 - RNA, 13 nt, Human
acagacuucugaa

SEQ ID NO: 1843590 - RNA, 20 nt, Human
acagagcccacgcccccacu

SEQ ID NO: 1843591 - RNA, 16 nt, Human
acagagcuacacaggg

SEQ ID NO: 1843592 - RNA, 18 nt, Human
acagagcuacacagggga

SEQ ID NO: 1843593 - RNA, 21 nt, Human
acagagugagacucugucuca

SEQ ID NO: 1843594 - RNA, 10 nt, Human
uaucagaauu

SEQ ID NO: 1843595 - RNA, 15 nt, Human
uaucuagauacugua

SEQ ID NO: 1843596 - RNA, 16 nt, Human
uaucuagauacuguau

SEQ ID NO: 1843597 - RNA, 19 nt, Human
uaucuagauacuguaucau

SEQ ID NO: 1843598 - RNA, 17 nt, Human
uaucucccccagcccca

SEQ ID NO: 1843599 - RNA, 18 nt, Human
uaucucccccagccccau

SEQ ID NO: 1843600 - RNA, 18 nt, Human
acagcagccccugcacaa

SEQ ID NO: 1843601 - RNA, 20 nt, Human
acagaguuuucacucuuauu

SEQ ID NO: 1843602 - RNA, 15 nt, Human
acagaguuguuacau

SEQ ID NO: 1843603 - RNA, 18 nt, Human
acagaguuuucacucuua

SEQ ID NO: 1843604 - RNA, 15 nt, Human
uaucuugaagacuuu

SEQ ID NO: 1843605 - RNA, 15 nt, Human
uaucuugaauaaugu

SEQ ID NO: 1843606 - RNA, 13 nt, Human
uaugaggcauuug

SEQ ID NO: 1843607 - RNA, 21 nt, Human
uaugaucacggcucacugcag

SEQ ID NO: 1843608 - RNA, 23 nt, Human
uaugaucacggcucacugcagcc

SEQ ID NO: 1843609 - RNA, 14 nt, Human
uaugaucacggcuc

SEQ ID NO: 1843610 - RNA, 16 nt, Human
uauggcuuuugugcau

SEQ ID NO: 1843611 - RNA, 15 nt, Human
acagccuggcacagg

SEQ ID NO: 1843612 - RNA, 14 nt, Human
acagccuggcacag

SEQ ID NO: 1843613 - RNA, 15 nt, Human
acagcuaacauggaa

SEQ ID NO: 1843614 - RNA, 14 nt, Human
acagcuaacaugga

SEQ ID NO: 1843615 - RNA, 23 nt, Human
acagccugugucuuuaaaugcug

SEQ ID NO: 1843616 - RNA, 18 nt, Human
acagccugugucuuuaaa

SEQ ID NO: 1843617 - RNA, 14 nt, Human
acagccugugucuu

SEQ ID NO: 1843618 - RNA, 17 nt, Human
acagcuaacauggaagu

SEQ ID NO: 1843619 - RNA, 20 nt, Human
acagcuaaucagcauucuca

SEQ ID NO: 1843620 - RNA, 18 nt, Human
uaugcucugcauguuaca

SEQ ID NO: 1843621 - RNA, 14 nt, Human
uaugcucugcaugu

SEQ ID NO: 1843622 - RNA, 14 nt, Human
uauggccuguggau

SEQ ID NO: 1843623 - RNA, 22 nt, Human
uauggccugugagcuaggaauu

SEQ ID NO: 1843624 - RNA, 19 nt, Human
uaugcucugcauguuacau

SEQ ID NO: 1843625 - RNA, 20 nt, Human
uccucagaucuucugugggu

SEQ ID NO: 1843626 - RNA, 16 nt, Human
acucuuauugcccacg

SEQ ID NO: 1843627 - RNA, 19 nt, Human
acucuuauugcccacgcug

SEQ ID NO: 1843628 - RNA, 18 nt, Human
uccucauacccaccccca

SEQ ID NO: 1843629 - RNA, 14 nt, Human
uccucauacccacc

SEQ ID NO: 1843630 - RNA, 22 nt, Human
uccucauacccacccccaccca

SEQ ID NO: 1843631 - RNA, 16 nt, Human
uccuccccuccuccug

SEQ ID NO: 1843632 - RNA, 20 nt, Human
uccuccccuccuccuggacu

SEQ ID NO: 1843633 - RNA, 18 nt, Human
uccuccccuccuccugga

SEQ ID NO: 1843634 - RNA, 22 nt, Human
uccuccccuccuccuggacucc

SEQ ID NO: 1843635 - RNA, 14 nt, Human
uccucuccacugcc

SEQ ID NO: 1843636 - RNA, 13 nt, Human
uccucuccacugc

SEQ ID NO: 1843637 - RNA, 12 nt, Human
uccucuccacug

SEQ ID NO: 1843638 - RNA, 16 nt, Human
uccucuccacugccuu

SEQ ID NO: 1843639 - RNA, 15 nt, Human
uccucuccacugccu

SEQ ID NO: 1843640 - RNA, 12 nt, Human
uccucuccccag

SEQ ID NO: 1843641 - RNA, 15 nt, Human
uccucccucccucuu

SEQ ID NO: 1843642 - RNA, 17 nt, Human
uccucccucccucuuuc

SEQ ID NO: 1843643 - RNA, 19 nt, Human
uccucccucccucuuuccc

SEQ ID NO: 1843644 - RNA, 19 nt, Human
acucuccucugcugcuggc

SEQ ID NO: 1843645 - RNA, 18 nt, Human
acucuccucugcugcugg

SEQ ID NO: 1843646 - RNA, 21 nt, Human
acucuccucugcugcuggcug

SEQ ID NO: 1843647 - RNA, 18 nt, Human
acucgcgacaaugcaaac

SEQ ID NO: 1843648 - RNA, 19 nt, Human
uccuaggcauuugcugaau

SEQ ID NO: 1843649 - RNA, 23 nt, Human
acucgcgacaaugcaaaccauca

SEQ ID NO: 1843650 - RNA, 20 nt, Human
acucgcgacaaugcaaacca

SEQ ID NO: 1843651 - RNA, 17 nt, Human
acucuccucugcugcug

SEQ ID NO: 1843652 - RNA, 22 nt, Human
ucccuuacgugaguccuggcau

SEQ ID NO: 1843653 - RNA, 18 nt, Human
ucccuuacgugaguccug

SEQ ID NO: 1843654 - RNA, 21 nt, Human
ucccuucaaccauuccccaug

SEQ ID NO: 1843655 - RNA, 11 nt, Human
ucccuucaacc

SEQ ID NO: 1843656 - RNA, 22 nt, Human
ucccuuuccaaaugcccagcuu

SEQ ID NO: 1843657 - RNA, 23 nt, Human
acuccugcacacgcuccuuccuc

SEQ ID NO: 1843658 - RNA, 23 nt, Human
ucccuuugacgccaucccagccc

SEQ ID NO: 1843659 - RNA, 22 nt, Human
ucccuuugacgccaucccagcc

SEQ ID NO: 1843660 - RNA, 18 nt, Human
ucccuuuuaauccuggcu

SEQ ID NO: 1843661 - RNA, 14 nt, Human
uccuaggcauuugc

SEQ ID NO: 1843662 - RNA, 20 nt, Human
uccuagcacuuugggaggcc

SEQ ID NO: 1843663 - RNA, 20 nt, Human
acuccagcuggguuggaaaa

SEQ ID NO: 1843664 - RNA, 14 nt, Human
acuccuaccuggua

SEQ ID NO: 1843665 - RNA, 18 nt, Human
acucaucuagguaaauua

SEQ ID NO: 1843666 - RNA, 16 nt, Human
acucaucuagguaaau

SEQ ID NO: 1843667 - RNA, 23 nt, Human
ucccucauuccaccuucccaugc

SEQ ID NO: 1843668 - RNA, 21 nt, Human
ucccucagucuggcccuuccu

SEQ ID NO: 1843669 - RNA, 22 nt, Human
ucccucauccucauacccaccc

SEQ ID NO: 1843670 - RNA, 17 nt, Human
acucaagacuuccagag

SEQ ID NO: 1843671 - RNA, 20 nt, Human
acucaagacuuccagagccu

SEQ ID NO: 1843672 - RNA, 15 nt, Human
ucccgaauagcuggg

SEQ ID NO: 1843673 - RNA, 16 nt, Human
ucccgaauagcuggga

SEQ ID NO: 1843674 - RNA, 20 nt, Human
ucccgcucagcccucccugc

SEQ ID NO: 1843675 - RNA, 16 nt, Human
ucccgcucagcccucc

SEQ ID NO: 1843676 - RNA, 15 nt, Human
ucccgcucagcccuc

SEQ ID NO: 1843677 - RNA, 14 nt, Human
ucccgcucagcccu

SEQ ID NO: 1843678 - RNA, 13 nt, Human
ucccgcucagccc

SEQ ID NO: 1843679 - RNA, 20 nt, Human
ucccgaguagcugggacuac

SEQ ID NO: 1843680 - RNA, 18 nt, Human
ucccgaauagcugggacu

SEQ ID NO: 1843681 - RNA, 18 nt, Human
ucccuauuagagaagaga

SEQ ID NO: 1843682 - RNA, 19 nt, Human
acuauguugcccaggcagg

SEQ ID NO: 1843683 - RNA, 20 nt, Human
acuauguugcccaggcaggu

SEQ ID NO: 1843684 - RNA, 23 nt, Human
acuauguugcccaggcaggucuu

SEQ ID NO: 1843685 - RNA, 18 nt, Human
acuaucccggcugcccuu

SEQ ID NO: 1843686 - RNA, 17 nt, Human
acuaucccggcugcccu

SEQ ID NO: 1843687 - RNA, 16 nt, Human
acuaucccggcugccc

SEQ ID NO: 1843688 - RNA, 22 nt, Human
acuaucaugucaaacgugaaaa

SEQ ID NO: 1843689 - RNA, 22 nt, Human
acuaugaaguuuuuuuuauaca

SEQ ID NO: 1843690 - RNA, 18 nt, Human
acuauguugcccaggcag

SEQ ID NO: 1843691 - RNA, 24 nt, Human
uccccaccgcagacaggaccaggg

SEQ ID NO: 1843692 - RNA, 23 nt, Human
uccccaggaggccagccuugacc

SEQ ID NO: 1843693 - RNA, 23 nt, Human
acuauaauuuaccugaagucuuu

SEQ ID NO: 1843694 - RNA, 17 nt, Human
acuauagccuaggugac

SEQ ID NO: 1843695 - RNA, 18 nt, Human
acuauagccuaggugaca

SEQ ID NO: 1843696 - RNA, 15 nt, Human
uccccaagccuggca

SEQ ID NO: 1843697 - RNA, 19 nt, Human
ucccaucucacacaugagc

SEQ ID NO: 1843698 - RNA, 14 nt, Human
ucccaucucacaca

SEQ ID NO: 1843699 - RNA, 13 nt, Human
ucccaucucacac

SEQ ID NO: 1843700 - RNA, 15 nt, Human
ucccauaugccuggg

SEQ ID NO: 1843701 - RNA, 16 nt, Human
ucccauaugccugggc

SEQ ID NO: 1843702 - RNA, 16 nt, Human
acuacaguccucccau

SEQ ID NO: 1843703 - RNA, 17 nt, Human
acuacaguccucccauc

SEQ ID NO: 1843704 - RNA, 22 nt, Human
ucccagugccgagaaggaagcc

SEQ ID NO: 1843705 - RNA, 19 nt, Human
ucccagugccgagaaggaa

SEQ ID NO: 1843706 - RNA, 14 nt, Human
acguuucuaaaggc

SEQ ID NO: 1843707 - RNA, 13 nt, Human
acuaaaaauacaa

SEQ ID NO: 1843708 - RNA, 24 nt, Human
uccagccugggugacagagcaagu

SEQ ID NO: 1843709 - RNA, 13 nt, Human
uccagccugggug

SEQ ID NO: 1843710 - RNA, 12 nt, Human
acguuucuaaag

SEQ ID NO: 1843711 - RNA, 15 nt, Human
uccagcucaccagcc

SEQ ID NO: 1843712 - RNA, 14 nt, Human
uccagcucaccagc

SEQ ID NO: 1843713 - RNA, 16 nt, Human
acuaaccagcagaaau

SEQ ID NO: 1843714 - RNA, 13 nt, Human
acuaaccacgcug

SEQ ID NO: 1843715 - RNA, 15 nt, Human
acuacaguccuccca

SEQ ID NO: 1843716 - RNA, 17 nt, Human
acuaaccagcagaaaug

SEQ ID NO: 1843717 - RNA, 23 nt, Human
acuacaggugugagucaccaagc

SEQ ID NO: 1843718 - RNA, 22 nt, Human
acuggcugcaaaggguaucagg

SEQ ID NO: 1843719 - RNA, 23 nt, Human
acuggccucugcugauccuccca

SEQ ID NO: 1843720 - RNA, 16 nt, Human
acuggccucugcugau

SEQ ID NO: 1843721 - RNA, 16 nt, Human
uccuuccucugagccu

SEQ ID NO: 1843722 - RNA, 16 nt, Human
uccuuccucugaggcu

SEQ ID NO: 1843723 - RNA, 17 nt, Human
uccuuccucugagccuu

SEQ ID NO: 1843724 - RNA, 13 nt, Human
uccuucagccuga

SEQ ID NO: 1843725 - RNA, 11 nt, Human
uccuucagugc

SEQ ID NO: 1843726 - RNA, 12 nt, Human
uccuucagugcc

SEQ ID NO: 1843727 - RNA, 20 nt, Human
uccuucagugccuuauggaa

SEQ ID NO: 1843728 - RNA, 13 nt, Human
uccuucagugccu

SEQ ID NO: 1843729 - RNA, 22 nt, Human
uccuucagugccuuauggaaca

SEQ ID NO: 1843730 - RNA, 12 nt, Human
acugcucugaug

SEQ ID NO: 1843731 - RNA, 23 nt, Human
acugcuuccagugaggcucugcc

SEQ ID NO: 1843732 - RNA, 22 nt, Human
acugcuuccagugaggcucugc

SEQ ID NO: 1843733 - RNA, 21 nt, Human
acugcuuccagugaggcucug

SEQ ID NO: 1843734 - RNA, 18 nt, Human
acugcuuccagugaggcu

SEQ ID NO: 1843735 - RNA, 21 nt, Human
acugcugcccagccuccaagc

SEQ ID NO: 1843736 - RNA, 18 nt, Human
acugcugcccagccucca

SEQ ID NO: 1843737 - RNA, 16 nt, Human
acugcugcccagccuc

SEQ ID NO: 1843738 - RNA, 12 nt, Human
acugcuggcugc

SEQ ID NO: 1843739 - RNA, 22 nt, Human
acuggauuaaacuuaaucuaaa

SEQ ID NO: 1843740 - RNA, 13 nt, Human
acugcuggcugcc

SEQ ID NO: 1843741 - RNA, 15 nt, Human
ucgagcaugccugga

SEQ ID NO: 1843742 - RNA, 14 nt, Human
ucgagcaugccugg

SEQ ID NO: 1843743 - RNA, 13 nt, Human
ucgaccugccucg

SEQ ID NO: 1843744 - RNA, 14 nt, Human
ucgaggacagggag

SEQ ID NO: 1843745 - RNA, 17 nt, Human
ucgaggacagggaggug

SEQ ID NO: 1843746 - RNA, 13 nt, Human
ucgcgacaaugca

SEQ ID NO: 1843747 - RNA, 14 nt, Human
ucgcgacaaugcaa

SEQ ID NO: 1843748 - RNA, 19 nt, Human
uccuuucacaaccuucugu

SEQ ID NO: 1843749 - RNA, 18 nt, Human
uccuuucacaaccuucug

SEQ ID NO: 1843750 - RNA, 16 nt, Human
uccuuucacaaccuuc

SEQ ID NO: 1843751 - RNA, 20 nt, Human
uccuuucacaaccuucugug

SEQ ID NO: 1843752 - RNA, 15 nt, Human
uccuuucaccacaug

SEQ ID NO: 1843753 - RNA, 14 nt, Human
ucgaacuggcugca

SEQ ID NO: 1843754 - RNA, 13 nt, Human
ucgaacuggcugc

SEQ ID NO: 1843755 - RNA, 15 nt, Human
ucgaacuggcugcaa

SEQ ID NO: 1843756 - RNA, 16 nt, Human
acuguaaggcaaucau

SEQ ID NO: 1843757 - RNA, 20 nt, Human
acuggguacuuguggacaca

SEQ ID NO: 1843758 - RNA, 23 nt, Human
acuggguacuuguggacacagcu

SEQ ID NO: 1843759 - RNA, 19 nt, Human
acuggguacuuguggacac

SEQ ID NO: 1843760 - RNA, 12 nt, Human
ucgcuccugugu

SEQ ID NO: 1843761 - RNA, 17 nt, Human
acugggagaaaugaaaa

SEQ ID NO: 1843762 - RNA, 13 nt, Human
ucgcuccuguguc

SEQ ID NO: 1843763 - RNA, 23 nt, Human
acuguacaugaaaacacauuuuu

SEQ ID NO: 1843764 - RNA, 13 nt, Human
acuguacaugaaa

SEQ ID NO: 1843765 - RNA, 14 nt, Human
acuguacaugaaaa

SEQ ID NO: 1843766 - RNA, 15 nt, Human
acuguacuccuccca

SEQ ID NO: 1843767 - RNA, 23 nt, Human
acuguagaaaagggaacugaaca

SEQ ID NO: 1843768 - RNA, 14 nt, Human
acuguacuccuccc

SEQ ID NO: 1843769 - RNA, 13 nt, Human
acuguacuccucc

SEQ ID NO: 1843770 - RNA, 13 nt, Human
acuguacaaagua

SEQ ID NO: 1843771 - RNA, 19 nt, Human
acuguaauuugugauacaa

SEQ ID NO: 1843772 - RNA, 15 nt, Human
acuguacaaaguaga

SEQ ID NO: 1843773 - RNA, 14 nt, Human
acuguacaaaguag

SEQ ID NO: 1843774 - RNA, 20 nt, Human
acuguacagacagaaaaaac

SEQ ID NO: 1843775 - RNA, 23 nt, Human
acugcaaccuucgccaccugggu

SEQ ID NO: 1843776 - RNA, 20 nt, Human
acugcaaccuucgccaccug

SEQ ID NO: 1843777 - RNA, 16 nt, Human
acugcaaccuccgccu

SEQ ID NO: 1843778 - RNA, 22 nt, Human
acugcaaccuccgccucuuggg

SEQ ID NO: 1843779 - RNA, 13 nt, Human
acugcaaccuccg

SEQ ID NO: 1843780 - RNA, 14 nt, Human
acugcaaccuccgc

SEQ ID NO: 1843781 - RNA, 22 nt, Human
acugaguacguugugcauuugg

SEQ ID NO: 1843782 - RNA, 23 nt, Human
acugaguacguugugcauuuggu

SEQ ID NO: 1843783 - RNA, 16 nt, Human
acugagugccuuuugg

SEQ ID NO: 1843784 - RNA, 19 nt, Human
acugaguacguugugcauu

SEQ ID NO: 1843785 - RNA, 21 nt, Human
acugaguacguugugcauuug

SEQ ID NO: 1843786 - RNA, 18 nt, Human
acugaguacguugugcau

SEQ ID NO: 1843787 - RNA, 15 nt, Human
uccucuccccagcaa

SEQ ID NO: 1843788 - RNA, 14 nt, Human
acugaggaucagag

SEQ ID NO: 1843789 - RNA, 15 nt, Human
acugaggaccagcca

SEQ ID NO: 1843790 - RNA, 17 nt, Human
acugaggggaggggagc

SEQ ID NO: 1843791 - RNA, 22 nt, Human
acugaggggaggggagcauggg

SEQ ID NO: 1843792 - RNA, 18 nt, Human
acugcacagugcaucuca

SEQ ID NO: 1843793 - RNA, 16 nt, Human
acugcacagugcaucu

SEQ ID NO: 1843794 - RNA, 20 nt, Human
uccugaguagcugggauuac

SEQ ID NO: 1843795 - RNA, 19 nt, Human
uccugaguagcuggauuac

SEQ ID NO: 1843796 - RNA, 15 nt, Human
uccugcaggcagcca

SEQ ID NO: 1843797 - RNA, 20 nt, Human
uccugcaggcagccaggcca

SEQ ID NO: 1843798 - RNA, 19 nt, Human
uccugcaggcagccaggcc

SEQ ID NO: 1843799 - RNA, 17 nt, Human
uccugcaggcagccagg

SEQ ID NO: 1843800 - RNA, 16 nt, Human
uccugcaggcagccag

SEQ ID NO: 1843801 - RNA, 22 nt, Human
uccugcaggcagccaggccaca

SEQ ID NO: 1843802 - RNA, 19 nt, Human
uccugccucagccucccaa

SEQ ID NO: 1843803 - RNA, 21 nt, Human
uccugccucgaacuggcugca

SEQ ID NO: 1843804 - RNA, 20 nt, Human
uccugccucgaacuggcugc

SEQ ID NO: 1843805 - RNA, 19 nt, Human
uccuguucccaugagauga

SEQ ID NO: 1843806 - RNA, 19 nt, Human
uccuguucuuaagacguga

SEQ ID NO: 1843807 - RNA, 18 nt, Human
uccugugugugcgccuac

SEQ ID NO: 1843808 - RNA, 13 nt, Human
uccugugugugcg

SEQ ID NO: 1843809 - RNA, 14 nt, Human
uccugugugugcgc

SEQ ID NO: 1843810 - RNA, 23 nt, Human
uccugugucuugcaauggcagcc

SEQ ID NO: 1843811 - RNA, 24 nt, Human
uccugugucuugcaauggcagccu

SEQ ID NO: 1843812 - RNA, 18 nt, Human
acugcagggacugccagu

SEQ ID NO: 1843813 - RNA, 17 nt, Human
acugcagggacugccag

SEQ ID NO: 1843814 - RNA, 16 nt, Human
acugcagggacugcca

SEQ ID NO: 1843815 - RNA, 23 nt, Human
acugcagccucaaccuccugggc

SEQ ID NO: 1843816 - RNA, 13 nt, Human
acugcacuguuuu

SEQ ID NO: 1843817 - RNA, 18 nt, Human
uccuuaaagaguguggca

SEQ ID NO: 1843818 - RNA, 23 nt, Human
uccuuaaagaguguggcaaaaua

SEQ ID NO: 1843819 - RNA, 17 nt, Human
uccuuaaagaguguggc

SEQ ID NO: 1843820 - RNA, 19 nt, Human
acugcagccucaaccuccu

SEQ ID NO: 1843821 - RNA, 21 nt, Human
acugcagccucaaccuccugg

SEQ ID NO: 1843822 - RNA, 22 nt, Human
acugcagccucaaccuccuggg

SEQ ID NO: 1843823 - RNA, 19 nt, Human
uccuggggaaccugacccc

SEQ ID NO: 1843824 - RNA, 18 nt, Human
uccuggggaaccugaccc

SEQ ID NO: 1843825 - RNA, 23 nt, Human
uccuggggguucuuucuuccucu

SEQ ID NO: 1843826 - RNA, 22 nt, Human
uccuggggguucuuucuuccuc

SEQ ID NO: 1843827 - RNA, 21 nt, Human
uccuggggguucuuucuuccu

SEQ ID NO: 1843828 - RNA, 13 nt, Human
uccugcugcaguu

SEQ ID NO: 1843829 - RNA, 18 nt, Human
uccugugacuucagcucu

SEQ ID NO: 1843830 - RNA, 13 nt, Human
uccaagcucccag

SEQ ID NO: 1843831 - RNA, 12 nt, Human
uccaagcuccca

SEQ ID NO: 1843832 - RNA, 15 nt, Human
uccaagcucccaggc

SEQ ID NO: 1843833 - RNA, 14 nt, Human
uccaagcucccagg

SEQ ID NO: 1843834 - RNA, 16 nt, Human
uccaagcucccaggca

SEQ ID NO: 1843835 - RNA, 18 nt, Human
uccaagcuccaucuccac

SEQ ID NO: 1843836 - RNA, 15 nt, Human
uccaaaugcagcuuu

SEQ ID NO: 1843837 - RNA, 14 nt, Human
uccaaaugcagcuu

SEQ ID NO: 1843838 - RNA, 14 nt, Human
uccacagugacucc

SEQ ID NO: 1843839 - RNA, 11 nt, Human
uccaagcuggu

SEQ ID NO: 1843840 - RNA, 16 nt, Human
uccacaguggaaccag

SEQ ID NO: 1843841 - RNA, 20 nt, Human
uccacaguggaaccagccca

SEQ ID NO: 1843842 - RNA, 13 nt, Human
ucauuuuuuuuaa

SEQ ID NO: 1843843 - RNA, 23 nt, Human
uccaaagucucuggaauuugaaa

SEQ ID NO: 1843844 - RNA, 18 nt, Human
ucauuugugccagaaugc

SEQ ID NO: 1843845 - RNA, 21 nt, Human
ucauuugagcagggcucagcg

SEQ ID NO: 1843846 - RNA, 18 nt, Human
accugcggugcuaucucc

SEQ ID NO: 1843847 - RNA, 22 nt, Human
accugaagucuuuguacagaca

SEQ ID NO: 1843848 - RNA, 15 nt, Human
accugaagucuuugu

SEQ ID NO: 1843849 - RNA, 22 nt, Human
accugcggugcuaucuccccca

SEQ ID NO: 1843850 - RNA, 19 nt, Human
accugcggugcuaucuccc

SEQ ID NO: 1843851 - RNA, 23 nt, Human
accugcggugcuaucucccccag

SEQ ID NO: 1843852 - RNA, 17 nt, Human
accugcucuccucuugc

SEQ ID NO: 1843853 - RNA, 18 nt, Human
accugcucuccucuugcc

SEQ ID NO: 1843854 - RNA, 19 nt, Human
accugcucuccucuugcca

SEQ ID NO: 1843855 - RNA, 14 nt, Human
accuggaauauaua

SEQ ID NO: 1843856 - RNA, 17 nt, Human
accuggaauauauaacc

SEQ ID NO: 1843857 - RNA, 19 nt, Human
ucauuugagcagggcucag

SEQ ID NO: 1843858 - RNA, 22 nt, Human
uccagaaguuugagaucagccu

SEQ ID NO: 1843859 - RNA, 23 nt, Human
accuuuguauucucuccuguacc

SEQ ID NO: 1843860 - RNA, 15 nt, Human
accuuuguauucucu

SEQ ID NO: 1843861 - RNA, 19 nt, Human
accuuuguauucucuccug

SEQ ID NO: 1843862 - RNA, 21 nt, Human
uccagccugagcgacagugag

SEQ ID NO: 1843863 - RNA, 20 nt, Human
uccagccugagcgacaguga

SEQ ID NO: 1843864 - RNA, 22 nt, Human
uccagccccuggaugcagccuc

SEQ ID NO: 1843865 - RNA, 23 nt, Human
uccagaccccuggcuuuucacug

SEQ ID NO: 1843866 - RNA, 21 nt, Human
uccagccccuggaugcagccu

SEQ ID NO: 1843867 - RNA, 19 nt, Human
uccagccccuggaugcagc

SEQ ID NO: 1843868 - RNA, 17 nt, Human
uccagccccuggaugca

SEQ ID NO: 1843869 - RNA, 16 nt, Human
uccagccccuggaugc

SEQ ID NO: 1843870 - RNA, 18 nt, Human
uccagaccccuggcuuuu

SEQ ID NO: 1843871 - RNA, 17 nt, Human
uccagaccccuggcuuu

SEQ ID NO: 1843872 - RNA, 16 nt, Human
uccagaccccuggcuu

SEQ ID NO: 1843873 - RNA, 15 nt, Human
uccagaccccuggcu

SEQ ID NO: 1843874 - RNA, 15 nt, Human
uccagccccuggaug

SEQ ID NO: 1843875 - RNA, 14 nt, Human
uccagacccggcug

SEQ ID NO: 1843876 - RNA, 17 nt, Human
accuuagacagucccug

SEQ ID NO: 1843877 - RNA, 14 nt, Human
accuuagccugccc

SEQ ID NO: 1843878 - RNA, 15 nt, Human
uccaccaucaagcca

SEQ ID NO: 1843879 - RNA, 23 nt, Human
accuggucacaggacucugccuc

SEQ ID NO: 1843880 - RNA, 22 nt, Human
accuggucacaggacucugccu

SEQ ID NO: 1843881 - RNA, 13 nt, Human
accuucuccuuca

SEQ ID NO: 1843882 - RNA, 12 nt, Human
accuucuguggc

SEQ ID NO: 1843883 - RNA, 16 nt, Human
accuucuguggcucac

SEQ ID NO: 1843884 - RNA, 15 nt, Human
accuucuguggcuca

SEQ ID NO: 1843885 - RNA, 13 nt, Human
accuucuguggcu

SEQ ID NO: 1843886 - RNA, 16 nt, Human
accuugacagggcaca

SEQ ID NO: 1843887 - RNA, 15 nt, Human
accuugacagggcac

SEQ ID NO: 1843888 - RNA, 15 nt, Human
accuugaaugaugcc

SEQ ID NO: 1843889 - RNA, 14 nt, Human
accuugacagggca

SEQ ID NO: 1843890 - RNA, 12 nt, Human
accuucuccuuc

SEQ ID NO: 1843891 - RNA, 19 nt, Human
ucaugacaaagacugagua

SEQ ID NO: 1843892 - RNA, 19 nt, Human
ucauccacugugccaugug

SEQ ID NO: 1843893 - RNA, 21 nt, Human
ucauccacugugccaugugcc

SEQ ID NO: 1843894 - RNA, 23 nt, Human
ucauccacugugccaugugccag

SEQ ID NO: 1843895 - RNA, 11 nt, Human
ucauguucuua

SEQ ID NO: 1843896 - RNA, 17 nt, Human
ucauguucuuaauucuu

SEQ ID NO: 1843897 - RNA, 14 nt, Human
ucaugugaaaucau

SEQ ID NO: 1843898 - RNA, 13 nt, Human
ucaugucuggcua

SEQ ID NO: 1843899 - RNA, 22 nt, Human
ucauugaccugaggcccuucuc

SEQ ID NO: 1843900 - RNA, 21 nt, Human
ucauucuccuuguguuacuaa

SEQ ID NO: 1843901 - RNA, 19 nt, Human
ucauugaccugaggcccuu

SEQ ID NO: 1843902 - RNA, 17 nt, Human
accucggugccuuccuc

SEQ ID NO: 1843903 - RNA, 19 nt, Human
accucucucacuccuugaa

SEQ ID NO: 1843904 - RNA, 14 nt, Human
accucucucacucc

SEQ ID NO: 1843905 - RNA, 23 nt, Human
accucucccuuggauuguccccg

SEQ ID NO: 1843906 - RNA, 12 nt, Human
accucugcacaa

SEQ ID NO: 1843907 - RNA, 15 nt, Human
accucucccuuggau

SEQ ID NO: 1843908 - RNA, 14 nt, Human
accucucccuugga

SEQ ID NO: 1843909 - RNA, 13 nt, Human
accucucccuugg

SEQ ID NO: 1843910 - RNA, 20 nt, Human
accgcagacaggaccaggga

SEQ ID NO: 1843911 - RNA, 24 nt, Human
accgagucucuucuccacuggaug

SEQ ID NO: 1843912 - RNA, 21 nt, Human
accgagucucuucuccacugg

SEQ ID NO: 1843913 - RNA, 20 nt, Human
accgagucucuucuccacug

SEQ ID NO: 1843914 - RNA, 17 nt, Human
accgccaaggcuggggg

SEQ ID NO: 1843915 - RNA, 18 nt, Human
accgagucucuucuccac

SEQ ID NO: 1843916 - RNA, 22 nt, Human
ucauauuuacuucuuauacauu

SEQ ID NO: 1843917 - RNA, 21 nt, Human
ucauauuuacuucuuauacau

SEQ ID NO: 1843918 - RNA, 20 nt, Human
ucauauuuacuucuuauaca

SEQ ID NO: 1843919 - RNA, 10 nt, Human
acccuuuucu

SEQ ID NO: 1843920 - RNA, 20 nt, Human
accuccgccucuuggguuca

SEQ ID NO: 1843921 - RNA, 13 nt, Human
accuagccuuaga

SEQ ID NO: 1843922 - RNA, 12 nt, Human
accccuggcuuu

SEQ ID NO: 1843923 - RNA, 12 nt, Human
ucagccugggca

SEQ ID NO: 1843924 - RNA, 10 nt, Human
ucagccuggg

SEQ ID NO: 1843925 - RNA, 19 nt, Human
ucagccuggcuucaaauug

SEQ ID NO: 1843926 - RNA, 17 nt, Human
accccuggcuuuucacu

SEQ ID NO: 1843927 - RNA, 15 nt, Human
accccuggcuuuuca

SEQ ID NO: 1843928 - RNA, 14 nt, Human
acccccagccugcu

SEQ ID NO: 1843929 - RNA, 15 nt, Human
acccccagccugcua

SEQ ID NO: 1843930 - RNA, 19 nt, Human
ucagcccucccugccccuc

SEQ ID NO: 1843931 - RNA, 18 nt, Human
ucagcccucccugccccu

SEQ ID NO: 1843932 - RNA, 15 nt, Human
acccagcucuggucc

SEQ ID NO: 1843933 - RNA, 13 nt, Human
acccagcucuggu

SEQ ID NO: 1843934 - RNA, 13 nt, Human
ucagaucuucugu

SEQ ID NO: 1843935 - RNA, 13 nt, Human
ucagaagacacug

SEQ ID NO: 1843936 - RNA, 20 nt, Human
accccuucgcuccugugucu

SEQ ID NO: 1843937 - RNA, 19 nt, Human
acccuuguggucccacccc

SEQ ID NO: 1843938 - RNA, 17 nt, Human
acccuuguggucccacc

SEQ ID NO: 1843939 - RNA, 16 nt, Human
acccuuguggucccac

SEQ ID NO: 1843940 - RNA, 12 nt, Human
acccugcccugu

SEQ ID NO: 1843941 - RNA, 11 nt, Human
acccugcccug

SEQ ID NO: 1843942 - RNA, 13 nt, Human
acccugcccugug

SEQ ID NO: 1843943 - RNA, 14 nt, Human
acccugcccugugg

SEQ ID NO: 1843944 - RNA, 14 nt, Human
acccucuuagaaaa

SEQ ID NO: 1843945 - RNA, 12 nt, Human
ucaggccaggcc

SEQ ID NO: 1843946 - RNA, 11 nt, Human
ucaggccaggc

SEQ ID NO: 1843947 - RNA, 20 nt, Human
ucaggccagcugcuugggcu

SEQ ID NO: 1843948 - RNA, 15 nt, Human
ucaggccagcugcuu

SEQ ID NO: 1843949 - RNA, 18 nt, Human
ucagggucccugguggca

SEQ ID NO: 1843950 - RNA, 14 nt, Human
ucagggucccuggu

SEQ ID NO: 1843951 - RNA, 13 nt, Human
ucagggucccugg

SEQ ID NO: 1843952 - RNA, 13 nt, Human
ucagguaacaggc

SEQ ID NO: 1843953 - RNA, 15 nt, Human
ucagguaacaggcag

SEQ ID NO: 1843954 - RNA, 16 nt, Human
ucagguaacaggcaga

SEQ ID NO: 1843955 - RNA, 19 nt, Human
accccuucgcuccuguguc

SEQ ID NO: 1843956 - RNA, 20 nt, Human
ucaggaagcucagggccugg

SEQ ID NO: 1843957 - RNA, 19 nt, Human
ucaggaagcucagggccug

SEQ ID NO: 1843958 - RNA, 17 nt, Human
ucaggaagcucagggcc

SEQ ID NO: 1843959 - RNA, 16 nt, Human
ucaggaagcucagggc

SEQ ID NO: 1843960 - RNA, 23 nt, Human
ucaggccaaacucaccugccccu

SEQ ID NO: 1843961 - RNA, 20 nt, Human
ucaggccaaacucaccugcc

SEQ ID NO: 1843962 - RNA, 15 nt, Human
ucagcggggacagcu

SEQ ID NO: 1843963 - RNA, 16 nt, Human
ucagcggggacagcuc

SEQ ID NO: 1843964 - RNA, 17 nt, Human
ucagcggggacagcucc

SEQ ID NO: 1843965 - RNA, 18 nt, Human
ucagcggggacagcuccu

SEQ ID NO: 1843966 - RNA, 16 nt, Human
acccagcccacuucug

SEQ ID NO: 1843967 - RNA, 17 nt, Human
acccagcccacuucugc

SEQ ID NO: 1843968 - RNA, 18 nt, Human
acccagcccacuucugcc

SEQ ID NO: 1843969 - RNA, 21 nt, Human
acccaaauguucaucaaugaa

SEQ ID NO: 1843970 - RNA, 18 nt, Human
acccaaaaggcagaagca

SEQ ID NO: 1843971 - RNA, 16 nt, Human
acccagaagaaaauag

SEQ ID NO: 1843972 - RNA, 19 nt, Human
acccacuugcuuuuaaaau

SEQ ID NO: 1843973 - RNA, 18 nt, Human
accauucuccaccugcca

SEQ ID NO: 1843974 - RNA, 16 nt, Human
accauucuccaccugc

SEQ ID NO: 1843975 - RNA, 13 nt, Human
accauucuccacc

SEQ ID NO: 1843976 - RNA, 22 nt, Human
accaugauuaaccacuucagcu

SEQ ID NO: 1843977 - RNA, 23 nt, Human
accaugauuaaccacuucagcug

SEQ ID NO: 1843978 - RNA, 12 nt, Human
accauuccccau

SEQ ID NO: 1843979 - RNA, 15 nt, Human
accauuccccauggg

SEQ ID NO: 1843980 - RNA, 13 nt, Human
acccaaaaggcag

SEQ ID NO: 1843981 - RNA, 15 nt, Human
acccaaaaggcagaa

SEQ ID NO: 1843982 - RNA, 23 nt, Human
accauuuugggguacccacugcu

SEQ ID NO: 1843983 - RNA, 15 nt, Human
ucacugagacagccc

SEQ ID NO: 1843984 - RNA, 14 nt, Human
ucacugagacagcc

SEQ ID NO: 1843985 - RNA, 13 nt, Human
ucacugagacagc

SEQ ID NO: 1843986 - RNA, 16 nt, Human
ucaccugccccucaac

SEQ ID NO: 1843987 - RNA, 16 nt, Human
ucacuguugcccaggc

SEQ ID NO: 1843988 - RNA, 24 nt, Human
ucacugcacagugcaucucagccc

SEQ ID NO: 1843989 - RNA, 22 nt, Human
ucacugcacagugcaucucagc

SEQ ID NO: 1843990 - RNA, 20 nt, Human
ucacugcacagugcaucuca

SEQ ID NO: 1843991 - RNA, 13 nt, Human
ucacugcagccuc

SEQ ID NO: 1843992 - RNA, 12 nt, Human
ucacugcagccu

SEQ ID NO: 1843993 - RNA, 19 nt, Human
ucacuguugcccaggcugg

SEQ ID NO: 1843994 - RNA, 17 nt, Human
ucacuguugcccaggcu

SEQ ID NO: 1843995 - RNA, 18 nt, Human
ucacuguugcccaggcug

SEQ ID NO: 1843996 - RNA, 21 nt, Human
accaguguuguggauuuaaca

SEQ ID NO: 1843997 - RNA, 19 nt, Human
accaggcaacuugggaacu

SEQ ID NO: 1843998 - RNA, 15 nt, Human
ucaccucccccaucu

SEQ ID NO: 1843999 - RNA, 13 nt, Human
ucaccucccccau

SEQ ID NO: 1844000 - RNA, 13 nt, Human
ucaccuccugcug

SEQ ID NO: 1844001 - RNA, 12 nt, Human
ucaccuccugcu

SEQ ID NO: 1844002 - RNA, 19 nt, Human
ucaccugaagacucauucu

SEQ ID NO: 1844003 - RNA, 17 nt, Human
ucaccuccugcugggca

SEQ ID NO: 1844004 - RNA, 15 nt, Human
ucaccuccugcuggg

SEQ ID NO: 1844005 - RNA, 14 nt, Human
ucaccuccugcugg

SEQ ID NO: 1844006 - RNA, 23 nt, Human
ucaccugaagacucauucuucug

SEQ ID NO: 1844007 - RNA, 19 nt, Human
accagagcccaccuuggcu

SEQ ID NO: 1844008 - RNA, 22 nt, Human
accagagcccaccuuggcucaa

SEQ ID NO: 1844009 - RNA, 22 nt, Human
accagacaccuugacagggcac

SEQ ID NO: 1844010 - RNA, 23 nt, Human
accagacaccuugacagggcaca

SEQ ID NO: 1844011 - RNA, 12 nt, Human
accacuuuuguu

SEQ ID NO: 1844012 - RNA, 17 nt, Human
accagacaccuugacag

SEQ ID NO: 1844013 - RNA, 13 nt, Human
accacugcagaag

SEQ ID NO: 1844014 - RNA, 14 nt, Human
accacugcagaaga

SEQ ID NO: 1844015 - RNA, 19 nt, Human
accacugcagaagacagua

SEQ ID NO: 1844016 - RNA, 14 nt, Human
accacuucagcuga

SEQ ID NO: 1844017 - RNA, 13 nt, Human
accacuucagcug

SEQ ID NO: 1844018 - RNA, 15 nt, Human
accacuucagcugac

SEQ ID NO: 1844019 - RNA, 20 nt, Human
accacucuaucaaguauuau

SEQ ID NO: 1844020 - RNA, 16 nt, Human
accacaucuugcucug

SEQ ID NO: 1844021 - RNA, 20 nt, Human
accacaucuugcucugcuga

SEQ ID NO: 1844022 - RNA, 21 nt, Human
accacaucuugcucugcugac

SEQ ID NO: 1844023 - RNA, 24 nt, Human
accacaucuugcucugcugacaga

SEQ ID NO: 1844024 - RNA, 21 nt, Human
accacagacauacuaaccagc

SEQ ID NO: 1844025 - RNA, 22 nt, Human
accacagacauacuaaccagca

SEQ ID NO: 1844026 - RNA, 14 nt, Human
accacaucuugcuc

SEQ ID NO: 1844027 - RNA, 24 nt, Human
ugaggcccuucucuccagccccug

SEQ ID NO: 1844028 - RNA, 23 nt, Human
ugaggcccuucucuccagccccu

SEQ ID NO: 1844029 - RNA, 22 nt, Human
ugaggcccuucucuccagcccc

SEQ ID NO: 1844030 - RNA, 20 nt, Human
ugaggcccuucucuccagcc

SEQ ID NO: 1844031 - RNA, 19 nt, Human
ugaggcccuucucuccagc

SEQ ID NO: 1844032 - RNA, 18 nt, Human
ugaggcccuucucuccag

SEQ ID NO: 1844033 - RNA, 16 nt, Human
ugaggcccuucucucc

SEQ ID NO: 1844034 - RNA, 19 nt, Human
ugagggauacccaucccau

SEQ ID NO: 1844035 - RNA, 15 nt, Human
ugagggauuaucuuu

SEQ ID NO: 1844036 - RNA, 12 nt, Human
ugaggggccucu

SEQ ID NO: 1844037 - RNA, 13 nt, Human
ugaggggccucuu

SEQ ID NO: 1844038 - RNA, 20 nt, Human
agcagagcaccuuagacagu

SEQ ID NO: 1844039 - RNA, 20 nt, Human
agcagagaccaucccugaag

SEQ ID NO: 1844040 - RNA, 19 nt, Human
ugagguacaaccuguucug

SEQ ID NO: 1844041 - RNA, 19 nt, Human
agcagagaccaucccugaa

SEQ ID NO: 1844042 - RNA, 18 nt, Human
agcagagaccaucccuga

SEQ ID NO: 1844043 - RNA, 17 nt, Human
agcagagaccaucccug

SEQ ID NO: 1844044 - RNA, 17 nt, Human
ugaggucagagccugca

SEQ ID NO: 1844045 - RNA, 14 nt, Human
ugaggucagagccu

SEQ ID NO: 1844046 - RNA, 16 nt, Human
ugaggucagagccugc

SEQ ID NO: 1844047 - RNA, 22 nt, Human
ugagguacugagagugaacaaa

SEQ ID NO: 1844048 - RNA, 13 nt, Human
ugaggucagagcc

SEQ ID NO: 1844049 - RNA, 17 nt, Human
ugagguacugagaguga

SEQ ID NO: 1844050 - RNA, 20 nt, Human
ugaggguugggcugguguca

SEQ ID NO: 1844051 - RNA, 19 nt, Human
agcagauggagaccccuug

SEQ ID NO: 1844052 - RNA, 17 nt, Human
agcagaggaaggagagg

SEQ ID NO: 1844053 - RNA, 20 nt, Human
ugaggcccagagggccugca

SEQ ID NO: 1844054 - RNA, 18 nt, Human
ugaggcccagagggccug

SEQ ID NO: 1844055 - RNA, 17 nt, Human
ugaggcccagagggccu

SEQ ID NO: 1844056 - RNA, 15 nt, Human
ugaggcccagagggc

SEQ ID NO: 1844057 - RNA, 22 nt, Human
ugaggcccagagggccugcaag

SEQ ID NO: 1844058 - RNA, 21 nt, Human
ugaggcccagagggccugcaa

SEQ ID NO: 1844059 - RNA, 23 nt, Human
ugaggcccagagggccugcaagg

SEQ ID NO: 1844060 - RNA, 16 nt, Human
ugaggccagagacaca

SEQ ID NO: 1844061 - RNA, 14 nt, Human
ugaggccagagaca

SEQ ID NO: 1844062 - RNA, 20 nt, Human
ugaggccagagacacaagcc

SEQ ID NO: 1844063 - RNA, 13 nt, Human
ugaggcccagagg

SEQ ID NO: 1844064 - RNA, 12 nt, Human
ugaggcccagag

SEQ ID NO: 1844065 - RNA, 12 nt, Human
ugaggccagaga

SEQ ID NO: 1844066 - RNA, 21 nt, Human
ugaggacacuaaccacgcugg

SEQ ID NO: 1844067 - RNA, 21 nt, Human
ugaggaauccagacccggcug

SEQ ID NO: 1844068 - RNA, 22 nt, Human
ugaggaauccagacccggcugc

SEQ ID NO: 1844069 - RNA, 14 nt, Human
ugagcuaggaauug

SEQ ID NO: 1844070 - RNA, 16 nt, Human
ugagcuacaaaugcau

SEQ ID NO: 1844071 - RNA, 14 nt, Human
ugagcuacaaaugc

SEQ ID NO: 1844072 - RNA, 13 nt, Human
ugagcuacaaaug

SEQ ID NO: 1844073 - RNA, 21 nt, Human
ugaggaagccgcuggggccag

SEQ ID NO: 1844074 - RNA, 19 nt, Human
ugaggaagccgcuggggcc

SEQ ID NO: 1844075 - RNA, 18 nt, Human
ugaggaagccgcuggggc

SEQ ID NO: 1844076 - RNA, 17 nt, Human
ugaggaagccgcugggg

SEQ ID NO: 1844077 - RNA, 14 nt, Human
ugaggaagccgcug

SEQ ID NO: 1844078 - RNA, 22 nt, Human
ugaggaagcaaaagcaucuaug

SEQ ID NO: 1844079 - RNA, 15 nt, Human
ugaggaagcaaaagc

SEQ ID NO: 1844080 - RNA, 21 nt, Human
agcagagaaugaaagggccca

SEQ ID NO: 1844081 - RNA, 10 nt, Human
ugagccuggc

SEQ ID NO: 1844082 - RNA, 16 nt, Human
agcagagaccaucccu

SEQ ID NO: 1844083 - RNA, 15 nt, Human
agcagagaccauccc

SEQ ID NO: 1844084 - RNA, 21 nt, Human
agcagagaauucucuuaucca

SEQ ID NO: 1844085 - RNA, 14 nt, Human
agcagagaauucuc

SEQ ID NO: 1844086 - RNA, 22 nt, Human
agcagagaaugaaagggcccag

SEQ ID NO: 1844087 - RNA, 23 nt, Human
agcagagaaugaaagggcccaga

SEQ ID NO: 1844088 - RNA, 13 nt, Human
ugagcgacaguga

SEQ ID NO: 1844089 - RNA, 14 nt, Human
ugagcgacagugag

SEQ ID NO: 1844090 - RNA, 16 nt, Human
ugagcgacagugagac

SEQ ID NO: 1844091 - RNA, 20 nt, Human
ugagcgacagugagacucug

SEQ ID NO: 1844092 - RNA, 15 nt, Human
ugagccuugaacuuu

SEQ ID NO: 1844093 - RNA, 17 nt, Human
ugagccuugaacuuuga

SEQ ID NO: 1844094 - RNA, 18 nt, Human
ugagccuugaacuuugac

SEQ ID NO: 1844095 - RNA, 19 nt, Human
ugagccuugaacuuugacc

SEQ ID NO: 1844096 - RNA, 14 nt, Human
ugagccuugaacuu

SEQ ID NO: 1844097 - RNA, 22 nt, Human
ugagccugggaggucaaggcug

SEQ ID NO: 1844098 - RNA, 19 nt, Human
ugagccugggaggucaagg

SEQ ID NO: 1844099 - RNA, 16 nt, Human
ugagccuggcaagaau

SEQ ID NO: 1844100 - RNA, 11 nt, Human
ugagccuggca

SEQ ID NO: 1844101 - RNA, 14 nt, Human
ugagccugggaggu

SEQ ID NO: 1844102 - RNA, 22 nt, Human
agcaccuuagacagucccugcc

SEQ ID NO: 1844103 - RNA, 21 nt, Human
agcaccuuagacagucccugc

SEQ ID NO: 1844104 - RNA, 20 nt, Human
agcaccuuagacagucccug

SEQ ID NO: 1844105 - RNA, 19 nt, Human
agcaccuuagacagucccu

SEQ ID NO: 1844106 - RNA, 13 nt, Human
agcaccagggaag

SEQ ID NO: 1844107 - RNA, 12 nt, Human
agcaccagggaa

SEQ ID NO: 1844108 - RNA, 10 nt, Human
agcaccaggg

SEQ ID NO: 1844109 - RNA, 16 nt, Human
agcacgauuucuguuu

SEQ ID NO: 1844110 - RNA, 14 nt, Human
agcacgauuucugu

SEQ ID NO: 1844111 - RNA, 15 nt, Human
agcacgauuucuguu

SEQ ID NO: 1844112 - RNA, 13 nt, Human
agcacgauuucug

SEQ ID NO: 1844113 - RNA, 23 nt, Human
agcaccuuagacagucccugcca

SEQ ID NO: 1844114 - RNA, 14 nt, Human
agcagaacagugau

SEQ ID NO: 1844115 - RNA, 19 nt, Human
agcagaaaugccuuacccu

SEQ ID NO: 1844116 - RNA, 12 nt, Human
agcagaaaugcc

SEQ ID NO: 1844117 - RNA, 13 nt, Human
agcagaaaugccu

SEQ ID NO: 1844118 - RNA, 23 nt, Human
agcacuuugggaggccaaggugg

SEQ ID NO: 1844119 - RNA, 22 nt, Human
agcacuuugggaggccaaggug

SEQ ID NO: 1844120 - RNA, 21 nt, Human
agcacagcagccccugcacaa

SEQ ID NO: 1844121 - RNA, 22 nt, Human
agcaagugagagcuggguguca

SEQ ID NO: 1844122 - RNA, 18 nt, Human
agcaagugagagcugggu

SEQ ID NO: 1844123 - RNA, 14 nt, Human
agcaagugagagcu

SEQ ID NO: 1844124 - RNA, 22 nt, Human
ugagccagauuucacucuccuu

SEQ ID NO: 1844125 - RNA, 17 nt, Human
ugagccagauuucacuc

SEQ ID NO: 1844126 - RNA, 20 nt, Human
agcaagugagacccugucuc

SEQ ID NO: 1844127 - RNA, 13 nt, Human
agcaagugagagc

SEQ ID NO: 1844128 - RNA, 16 nt, Human
agcacaugccucucuc

SEQ ID NO: 1844129 - RNA, 14 nt, Human
agcacaugccucuc

SEQ ID NO: 1844130 - RNA, 13 nt, Human
agcacaugccucu

SEQ ID NO: 1844131 - RNA, 16 nt, Human
agcacagcuucauuuc

SEQ ID NO: 1844132 - RNA, 15 nt, Human
ugagcaauccugcaa

SEQ ID NO: 1844133 - RNA, 15 nt, Human
ugagcaaauguggcu

SEQ ID NO: 1844134 - RNA, 19 nt, Human
ugagcaaauguggcuccug

SEQ ID NO: 1844135 - RNA, 18 nt, Human
ugagcaaauguggcuccu

SEQ ID NO: 1844136 - RNA, 16 nt, Human
ugagcaaauguggcuc

SEQ ID NO: 1844137 - RNA, 20 nt, Human
ugagcacuaaggugugcucu

SEQ ID NO: 1844138 - RNA, 21 nt, Human
ugagcacuaaggugugcucug

SEQ ID NO: 1844139 - RNA, 22 nt, Human
ugagcacuaaggugugcucuga

SEQ ID NO: 1844140 - RNA, 23 nt, Human
ugagcacuaaggugugcucugau

SEQ ID NO: 1844141 - RNA, 21 nt, Human
ugagcaucaggccaggcccuc

SEQ ID NO: 1844142 - RNA, 24 nt, Human
ugagcaucaggccaggcccucugc

SEQ ID NO: 1844143 - RNA, 22 nt, Human
ugagcaucaggccaggcccucu

SEQ ID NO: 1844144 - RNA, 14 nt, Human
ugagccaccgugcc

SEQ ID NO: 1844145 - RNA, 15 nt, Human
ugagccaccacgccc

SEQ ID NO: 1844146 - RNA, 21 nt, Human
ugagccaccgugccuggccac

SEQ ID NO: 1844147 - RNA, 20 nt, Human
ugagccaccgugccuggcca

SEQ ID NO: 1844148 - RNA, 19 nt, Human
ugagccaccgugccuggcc

SEQ ID NO: 1844149 - RNA, 18 nt, Human
ugagccaccgugccuggc

SEQ ID NO: 1844150 - RNA, 21 nt, Human
ugagccacugcaccgggccac

SEQ ID NO: 1844151 - RNA, 18 nt, Human
ugagccacugcaccgggc

SEQ ID NO: 1844152 - RNA, 16 nt, Human
ugagccagauuucacu

SEQ ID NO: 1844153 - RNA, 14 nt, Human
ugagccagauuuca

SEQ ID NO: 1844154 - RNA, 13 nt, Human
ugagccagauuuc

SEQ ID NO: 1844155 - RNA, 23 nt, Human
ugagccacugcaccgggccacag

SEQ ID NO: 1844156 - RNA, 21 nt, Human
agcaaaaccaaauauuccaga

SEQ ID NO: 1844157 - RNA, 14 nt, Human
agauuucacucucc

SEQ ID NO: 1844158 - RNA, 13 nt, Human
agauuucacucuc

SEQ ID NO: 1844159 - RNA, 14 nt, Human
agauuuaugcauau

SEQ ID NO: 1844160 - RNA, 16 nt, Human
agauugugccccugca

SEQ ID NO: 1844161 - RNA, 21 nt, Human
agauugugccccugcacucca

SEQ ID NO: 1844162 - RNA, 20 nt, Human
ugacuuauuuauauaaauuu

SEQ ID NO: 1844163 - RNA, 17 nt, Human
ugacuuauuuauauaaa

SEQ ID NO: 1844164 - RNA, 21 nt, Human
ugacuuauuuauauaaauuuu

SEQ ID NO: 1844165 - RNA, 23 nt, Human
ugacuccagaauuucccaaagca

SEQ ID NO: 1844166 - RNA, 20 nt, Human
ugacuccagaauuucccaaa

SEQ ID NO: 1844167 - RNA, 15 nt, Human
ugaccugaggcccuu

SEQ ID NO: 1844168 - RNA, 14 nt, Human
ugaccugaggcccu

SEQ ID NO: 1844169 - RNA, 17 nt, Human
ugaccugaggcccuucu

SEQ ID NO: 1844170 - RNA, 19 nt, Human
ugacuccagaauuucccaa

SEQ ID NO: 1844171 - RNA, 17 nt, Human
ugacuccagaauuuccc

SEQ ID NO: 1844172 - RNA, 20 nt, Human
agauuauaggcaccuaccac

SEQ ID NO: 1844173 - RNA, 16 nt, Human
agauucaaucccagga

SEQ ID NO: 1844174 - RNA, 21 nt, Human
agaucauugugaaauuauuca

SEQ ID NO: 1844175 - RNA, 20 nt, Human
ugaccacacuccagcuggga

SEQ ID NO: 1844176 - RNA, 19 nt, Human
ugaccacacuccagcuggg

SEQ ID NO: 1844177 - RNA, 17 nt, Human
ugaccacacuccagcug

SEQ ID NO: 1844178 - RNA, 12 nt, Human
ugaccacacucc

SEQ ID NO: 1844179 - RNA, 18 nt, Human
ugacauuguagagcuucu

SEQ ID NO: 1844180 - RNA, 18 nt, Human
agauguguucacaaugga

SEQ ID NO: 1844181 - RNA, 15 nt, Human
agauguguucacaau

SEQ ID NO: 1844182 - RNA, 22 nt, Human
ugacccccaaccaaguggcucc

SEQ ID NO: 1844183 - RNA, 17 nt, Human
ugaccccucauagcccu

SEQ ID NO: 1844184 - RNA, 20 nt, Human
ugaccccucauagcccucac

SEQ ID NO: 1844185 - RNA, 19 nt, Human
ugaccccucauagcccuca

SEQ ID NO: 1844186 - RNA, 13 nt, Human
ugaccucugccug

SEQ ID NO: 1844187 - RNA, 12 nt, Human
ugaccugaggcc

SEQ ID NO: 1844188 - RNA, 14 nt, Human
ugaccucugccuga

SEQ ID NO: 1844189 - RNA, 23 nt, Human
agaugcuagaacucccuuucaac

SEQ ID NO: 1844190 - RNA, 16 nt, Human
agaugcuucucacugc

SEQ ID NO: 1844191 - RNA, 18 nt, Human
agaugcuucucacugcca

SEQ ID NO: 1844192 - RNA, 11 nt, Human
ugaagacaaug

SEQ ID NO: 1844193 - RNA, 13 nt, Human
ugaagacaaugac

SEQ ID NO: 1844194 - RNA, 17 nt, Human
ugaagacaaugacuuac

SEQ ID NO: 1844195 - RNA, 16 nt, Human
ugaacuuugaccucug

SEQ ID NO: 1844196 - RNA, 17 nt, Human
ugaacuuugaccucugc

SEQ ID NO: 1844197 - RNA, 21 nt, Human
ucuuuggucuacacugugcug

SEQ ID NO: 1844198 - RNA, 14 nt, Human
ucuuuggucuacac

SEQ ID NO: 1844199 - RNA, 12 nt, Human
ucuuuguaauga

SEQ ID NO: 1844200 - RNA, 11 nt, Human
ugaacuuugac

SEQ ID NO: 1844201 - RNA, 15 nt, Human
ucuuuguaaugaaaa

SEQ ID NO: 1844202 - RNA, 13 nt, Human
ucuuuguaaugaa

SEQ ID NO: 1844203 - RNA, 18 nt, Human
agaggcaacugcauuggc

SEQ ID NO: 1844204 - RNA, 21 nt, Human
agaggaaaucaccgaaaacgu

SEQ ID NO: 1844205 - RNA, 12 nt, Human
agaggaaaucac

SEQ ID NO: 1844206 - RNA, 11 nt, Human
agaggaaauca

SEQ ID NO: 1844207 - RNA, 19 nt, Human
agaggaaagcaaaggagau

SEQ ID NO: 1844208 - RNA, 18 nt, Human
agaggaaagcaaaggaga

SEQ ID NO: 1844209 - RNA, 16 nt, Human
agaggaaagcaaagga

SEQ ID NO: 1844210 - RNA, 12 nt, Human
agaggaaagcaa

SEQ ID NO: 1844211 - RNA, 21 nt, Human
agagcuucuguugcugccuca

SEQ ID NO: 1844212 - RNA, 20 nt, Human
agagcuucuguugcugccuc

SEQ ID NO: 1844213 - RNA, 19 nt, Human
agagcuucuguugcugccu

SEQ ID NO: 1844214 - RNA, 15 nt, Human
agagcuucuggcacu

SEQ ID NO: 1844215 - RNA, 21 nt, Human
ugaagacaaugacuuacugua

SEQ ID NO: 1844216 - RNA, 19 nt, Human
agagcugggugucaagagg

SEQ ID NO: 1844217 - RNA, 21 nt, Human
agaggcgcaugaauuugugaa

SEQ ID NO: 1844218 - RNA, 21 nt, Human
agagggagggagggcuccaga

SEQ ID NO: 1844219 - RNA, 22 nt, Human
agagggagggagggcuccagac

SEQ ID NO: 1844220 - RNA, 17 nt, Human
ugaagauguagaggaga

SEQ ID NO: 1844221 - RNA, 18 nt, Human
ugaagauguagaggagaa

SEQ ID NO: 1844222 - RNA, 16 nt, Human
ugaaugcauaaaaugu

SEQ ID NO: 1844223 - RNA, 15 nt, Human
ugaaugcauaaaaug

SEQ ID NO: 1844224 - RNA, 18 nt, Human
ugaagguggaaauaaacu

SEQ ID NO: 1844225 - RNA, 18 nt, Human
ugaaugucagugugacug

SEQ ID NO: 1844226 - RNA, 15 nt, Human
ugaaugucaguguga

SEQ ID NO: 1844227 - RNA, 14 nt, Human
ugaaugucagugug

SEQ ID NO: 1844228 - RNA, 22 nt, Human
agagugaacaaauuuacagaga

SEQ ID NO: 1844229 - RNA, 15 nt, Human
agagugagacucugu

SEQ ID NO: 1844230 - RNA, 16 nt, Human
agagugagacucuguc

SEQ ID NO: 1844231 - RNA, 20 nt, Human
agagucucacuguugcccag

SEQ ID NO: 1844232 - RNA, 14 nt, Human
agagugaacaaauu

SEQ ID NO: 1844233 - RNA, 22 nt, Human
agagucucacuguugcccaggc

SEQ ID NO: 1844234 - RNA, 21 nt, Human
agaucaaccccuucgcuccug

SEQ ID NO: 1844235 - RNA, 14 nt, Human
agaucaaccccuuc

SEQ ID NO: 1844236 - RNA, 19 nt, Human
agaucaaccccuucgcucc

SEQ ID NO: 1844237 - RNA, 22 nt, Human
agauauuuugcuuugugauuuu

SEQ ID NO: 1844238 - RNA, 19 nt, Human
agauacaggaaaagcugcu

SEQ ID NO: 1844239 - RNA, 18 nt, Human
agauaauucuagcuuuga

SEQ ID NO: 1844240 - RNA, 19 nt, Human
agauaaggguaucugguga

SEQ ID NO: 1844241 - RNA, 19 nt, Human
agagugagacucugucuca

SEQ ID NO: 1844242 - RNA, 23 nt, Human
agacccugcccugugggccccca

SEQ ID NO: 1844243 - RNA, 21 nt, Human
agacccugcccugugggcccc

SEQ ID NO: 1844244 - RNA, 19 nt, Human
agacccugcccugugggcc

SEQ ID NO: 1844245 - RNA, 16 nt, Human
agacccugcccugugg

SEQ ID NO: 1844246 - RNA, 15 nt, Human
agacccuuguggucc

SEQ ID NO: 1844247 - RNA, 13 nt, Human
agacccuuguggu

SEQ ID NO: 1844248 - RNA, 23 nt, Human
agacccuuguggucccaccccac

SEQ ID NO: 1844249 - RNA, 22 nt, Human
agacccuuguggucccacccca

SEQ ID NO: 1844250 - RNA, 20 nt, Human
agacccuuguggucccaccc

SEQ ID NO: 1844251 - RNA, 19 nt, Human
agacccuuguggucccacc

SEQ ID NO: 1844252 - RNA, 19 nt, Human
agaccuaacgagaaauaga

SEQ ID NO: 1844253 - RNA, 14 nt, Human
agacccugcccugu

SEQ ID NO: 1844254 - RNA, 13 nt, Human
agacccugcccug

SEQ ID NO: 1844255 - RNA, 12 nt, Human
agacccugcccu

SEQ ID NO: 1844256 - RNA, 17 nt, Human
ucuugcaauggcagccu

SEQ ID NO: 1844257 - RNA, 13 nt, Human
ucuugcaauggca

SEQ ID NO: 1844258 - RNA, 16 nt, Human
ucuugcaauggcagcc

SEQ ID NO: 1844259 - RNA, 14 nt, Human
ucuugaugccuggc

SEQ ID NO: 1844260 - RNA, 20 nt, Human
ucuugaugccuggcggggug

SEQ ID NO: 1844261 - RNA, 18 nt, Human
agacuaucuaaauguuga

SEQ ID NO: 1844262 - RNA, 17 nt, Human
agacuaucuaaauguug

SEQ ID NO: 1844263 - RNA, 19 nt, Human
agacuaucuaaauguugaa

SEQ ID NO: 1844264 - RNA, 12 nt, Human
agaccugccccu

SEQ ID NO: 1844265 - RNA, 17 nt, Human
agacucauucuucugua

SEQ ID NO: 1844266 - RNA, 18 nt, Human
agacucauucuucuguac

SEQ ID NO: 1844267 - RNA, 17 nt, Human
agacuucaucccucugg

SEQ ID NO: 1844268 - RNA, 14 nt, Human
agacuucaucccuc

SEQ ID NO: 1844269 - RNA, 14 nt, Human
agagaccaucccug

SEQ ID NO: 1844270 - RNA, 13 nt, Human
agagaccaucccu

SEQ ID NO: 1844271 - RNA, 15 nt, Human
agagaccaucccuga

SEQ ID NO: 1844272 - RNA, 18 nt, Human
agagaccaucccugaagg

SEQ ID NO: 1844273 - RNA, 12 nt, Human
agacuuuggaaa

SEQ ID NO: 1844274 - RNA, 14 nt, Human
agacuuuggaaaga

SEQ ID NO: 1844275 - RNA, 18 nt, Human
agagaaugaaagggccca

SEQ ID NO: 1844276 - RNA, 15 nt, Human
agacuuuggaaagac

SEQ ID NO: 1844277 - RNA, 17 nt, Human
agacuccugcaggcagc

SEQ ID NO: 1844278 - RNA, 16 nt, Human
agacuccugcaggcag

SEQ ID NO: 1844279 - RNA, 15 nt, Human
agacuccugcaggca

SEQ ID NO: 1844280 - RNA, 14 nt, Human
agacuccugcaggc

SEQ ID NO: 1844281 - RNA, 16 nt, Human
ucuuuccugaggcugg

SEQ ID NO: 1844282 - RNA, 15 nt, Human
ucuuuccugaggcug

SEQ ID NO: 1844283 - RNA, 14 nt, Human
ucuuuccugaggcu

SEQ ID NO: 1844284 - RNA, 13 nt, Human
ucuuuccugaggc

SEQ ID NO: 1844285 - RNA, 23 nt, Human
agacuccugcaggcagccaggcc

SEQ ID NO: 1844286 - RNA, 20 nt, Human
agacuccugcaggcagccag

SEQ ID NO: 1844287 - RNA, 19 nt, Human
agacuccugcaggcagcca

SEQ ID NO: 1844288 - RNA, 18 nt, Human
agacuccugcaggcagcc

SEQ ID NO: 1844289 - RNA, 19 nt, Human
agacucuacagaggccaug

SEQ ID NO: 1844290 - RNA, 21 nt, Human
agacucgcgacaaugcaaacc

SEQ ID NO: 1844291 - RNA, 17 nt, Human
agacucuacagaggcca

SEQ ID NO: 1844292 - RNA, 15 nt, Human
ucuuuacuucaugga

SEQ ID NO: 1844293 - RNA, 18 nt, Human
ucugguccauagagagca

SEQ ID NO: 1844294 - RNA, 16 nt, Human
ucuggguuccuuccuc

SEQ ID NO: 1844295 - RNA, 11 nt, Human
ucuggggcugu

SEQ ID NO: 1844296 - RNA, 14 nt, Human
ucuggguucacugc

SEQ ID NO: 1844297 - RNA, 16 nt, Human
ucuggguucacugcaa

SEQ ID NO: 1844298 - RNA, 20 nt, Human
ucugucauuugagcagggcu

SEQ ID NO: 1844299 - RNA, 23 nt, Human
ucugucauuugagcagggcucag

SEQ ID NO: 1844300 - RNA, 15 nt, Human
ucugucauuugagca

SEQ ID NO: 1844301 - RNA, 18 nt, Human
agaauuucccaaagcagu

SEQ ID NO: 1844302 - RNA, 17 nt, Human
agaauuucccaaagcag

SEQ ID NO: 1844303 - RNA, 23 nt, Human
agaauuucccaaagcagugcaug

SEQ ID NO: 1844304 - RNA, 21 nt, Human
ucugugaaaggaaagagggag

SEQ ID NO: 1844305 - RNA, 15 nt, Human
ucugugaaaggaaag

SEQ ID NO: 1844306 - RNA, 24 nt, Human
ucuguccaggcacugcugcccagc

SEQ ID NO: 1844307 - RNA, 18 nt, Human
ucuguuggccagugugac

SEQ ID NO: 1844308 - RNA, 19 nt, Human
ucuguuggccagugugaca

SEQ ID NO: 1844309 - RNA, 20 nt, Human
ucuguuggccagugugacaa

SEQ ID NO: 1844310 - RNA, 22 nt, Human
agacagaaucucgcucugucgc

SEQ ID NO: 1844311 - RNA, 18 nt, Human
agacagaaucucgcucug

SEQ ID NO: 1844312 - RNA, 17 nt, Human
agacagucccugccaau

SEQ ID NO: 1844313 - RNA, 16 nt, Human
agacagucccugccaa

SEQ ID NO: 1844314 - RNA, 15 nt, Human
agacagucccugcca

SEQ ID NO: 1844315 - RNA, 19 nt, Human
agacagucccugccaaugg

SEQ ID NO: 1844316 - RNA, 19 nt, Human
agacaggguuucaccaugu

SEQ ID NO: 1844317 - RNA, 21 nt, Human
agacaggguuuugccauguug

SEQ ID NO: 1844318 - RNA, 16 nt, Human
agacaggaccagggau

SEQ ID NO: 1844319 - RNA, 15 nt, Human
agacaggaccaggga

SEQ ID NO: 1844320 - RNA, 23 nt, Human
agacaggcaagcaccuccugccu

SEQ ID NO: 1844321 - RNA, 14 nt, Human
ucuuaugggcuggg

SEQ ID NO: 1844322 - RNA, 16 nt, Human
ucuuaugggcuggguu

SEQ ID NO: 1844323 - RNA, 15 nt, Human
ucuuaugggcugggu

SEQ ID NO: 1844324 - RNA, 18 nt, Human
ucuuaugggcuggguucu

SEQ ID NO: 1844325 - RNA, 14 nt, Human
ucuuauugcccacg

SEQ ID NO: 1844326 - RNA, 18 nt, Human
ucuuauugcccacgcugg

SEQ ID NO: 1844327 - RNA, 22 nt, Human
ucuuauugcccacgcuggagug

SEQ ID NO: 1844328 - RNA, 17 nt, Human
ucuucaaaaugagcccu

SEQ ID NO: 1844329 - RNA, 22 nt, Human
ucuuccaggcugggagagccuu

SEQ ID NO: 1844330 - RNA, 18 nt, Human
acuuuaccuuuuuuauac

SEQ ID NO: 1844331 - RNA, 19 nt, Human
acuuuaccuuuuuuauaca

SEQ ID NO: 1844332 - RNA, 22 nt, Human
acuuuaccuuuuuuauacauaa

SEQ ID NO: 1844333 - RNA, 23 nt, Human
acuuuaccuuuuuuauacauaaa

SEQ ID NO: 1844334 - RNA, 19 nt, Human
acuuugaccucugcagcaa

SEQ ID NO: 1844335 - RNA, 23 nt, Human
acuuugaccucugcagcaauaaa

SEQ ID NO: 1844336 - RNA, 14 nt, Human
acuuuggaaagacu

SEQ ID NO: 1844337 - RNA, 13 nt, Human
acuuuggaaagac

SEQ ID NO: 1844338 - RNA, 19 nt, Human
acuuugaggguguauauuu

SEQ ID NO: 1844339 - RNA, 17 nt, Human
acuuuggaaagacuuuu

SEQ ID NO: 1844340 - RNA, 23 nt, Human
acuuuggaaagacuuuuccaacc

SEQ ID NO: 1844341 - RNA, 22 nt, Human
acuuuuuuuuuuuaagaguaaa

SEQ ID NO: 1844342 - RNA, 15 nt, Human
acuuuuuuuuaaguu

SEQ ID NO: 1844343 - RNA, 14 nt, Human
acuuuuggcauuuu

SEQ ID NO: 1844344 - RNA, 18 nt, Human
ucucccuuggauuguccc

SEQ ID NO: 1844345 - RNA, 11 nt, Human
ucucccuugga

SEQ ID NO: 1844346 - RNA, 18 nt, Human
ucucccaaagugcuggga

SEQ ID NO: 1844347 - RNA, 21 nt, Human
ucucccuuggauuguccccga

SEQ ID NO: 1844348 - RNA, 19 nt, Human
ucucccuuggauugucccc

SEQ ID NO: 1844349 - RNA, 12 nt, Human
ucuccucugcug

SEQ ID NO: 1844350 - RNA, 14 nt, Human
ucuccucugcugcu

SEQ ID NO: 1844351 - RNA, 13 nt, Human
ucuccucugcugc

SEQ ID NO: 1844352 - RNA, 21 nt, Human
acuuguugauuaauggaaaug

SEQ ID NO: 1844353 - RNA, 19 nt, Human
acuuguugauuaauggaaa

SEQ ID NO: 1844354 - RNA, 15 nt, Human
ucucuccagccccug

SEQ ID NO: 1844355 - RNA, 20 nt, Human
ucucuccuguaccucuugag

SEQ ID NO: 1844356 - RNA, 22 nt, Human
ucucuccuguaccucuugagcc

SEQ ID NO: 1844357 - RNA, 14 nt, Human
ucucuccagccccu

SEQ ID NO: 1844358 - RNA, 13 nt, Human
ucucuccagcccc

SEQ ID NO: 1844359 - RNA, 20 nt, Human
ucuccuucaccuuugucccc

SEQ ID NO: 1844360 - RNA, 14 nt, Human
ucucuugagagggu

SEQ ID NO: 1844361 - RNA, 21 nt, Human
ucucuucuggguuccuuccuc

SEQ ID NO: 1844362 - RNA, 20 nt, Human
ucucuucuggguuccuuccu

SEQ ID NO: 1844363 - RNA, 19 nt, Human
ucucuucuggguuccuucc

SEQ ID NO: 1844364 - RNA, 18 nt, Human
ucucuucuggguuccuuc

SEQ ID NO: 1844365 - RNA, 13 nt, Human
ucucuggccuucg

SEQ ID NO: 1844366 - RNA, 16 nt, Human
ucucuggccuucggcc

SEQ ID NO: 1844367 - RNA, 17 nt, Human
ucucuggccuucggccu

SEQ ID NO: 1844368 - RNA, 11 nt, Human
ucucugcccua

SEQ ID NO: 1844369 - RNA, 22 nt, Human
ucucugcccuaaugcgcaggcu

SEQ ID NO: 1844370 - RNA, 13 nt, Human
agaaacuggaacu

SEQ ID NO: 1844371 - RNA, 15 nt, Human
agaaacuggaacucu

SEQ ID NO: 1844372 - RNA, 15 nt, Human
agaaagaagaugaau

SEQ ID NO: 1844373 - RNA, 17 nt, Human
agaaaaaugagccuggc

SEQ ID NO: 1844374 - RNA, 19 nt, Human
agaaaaauaugaccacacu

SEQ ID NO: 1844375 - RNA, 15 nt, Human
ucucuugagccuggg

SEQ ID NO: 1844376 - RNA, 14 nt, Human
ucucuugagccugg

SEQ ID NO: 1844377 - RNA, 13 nt, Human
ucucuugagccug

SEQ ID NO: 1844378 - RNA, 22 nt, Human
ucucuuuaaugucacaggcagg

SEQ ID NO: 1844379 - RNA, 19 nt, Human
ucugauucccaagcucugc

SEQ ID NO: 1844380 - RNA, 20 nt, Human
ucugauucccaagcucugcu

SEQ ID NO: 1844381 - RNA, 21 nt, Human
ucugauucccaagcucugcuc

SEQ ID NO: 1844382 - RNA, 19 nt, Human
ucugacccugcuucaaaua

SEQ ID NO: 1844383 - RNA, 12 nt, Human
ucugcagagcag

SEQ ID NO: 1844384 - RNA, 11 nt, Human
agaaauguguu

SEQ ID NO: 1844385 - RNA, 17 nt, Human
agaaauguacagcaagg

SEQ ID NO: 1844386 - RNA, 16 nt, Human
agaaauguacagcaag

SEQ ID NO: 1844387 - RNA, 15 nt, Human
ucugcagaaacagaa

SEQ ID NO: 1844388 - RNA, 21 nt, Human
agaacucaugacggaagaguu

SEQ ID NO: 1844389 - RNA, 14 nt, Human
agaacucccuuuca

SEQ ID NO: 1844390 - RNA, 15 nt, Human
agaacucccuuucaa

SEQ ID NO: 1844391 - RNA, 17 nt, Human
ucugcucacauaucugu

SEQ ID NO: 1844392 - RNA, 16 nt, Human
ucugcucacauaucug

SEQ ID NO: 1844393 - RNA, 18 nt, Human
ucugcccuccaagaccuu

SEQ ID NO: 1844394 - RNA, 14 nt, Human
ucugcccuccaaga

SEQ ID NO: 1844395 - RNA, 15 nt, Human
ucuggcagcucagag

SEQ ID NO: 1844396 - RNA, 14 nt, Human
ucuggcagcucaga

SEQ ID NO: 1844397 - RNA, 18 nt, Human
ucuggauuauauuaugaa

SEQ ID NO: 1844398 - RNA, 12 nt, Human
ucuggauuauau

SEQ ID NO: 1844399 - RNA, 18 nt, Human
ucuggagguacgaaaaga

SEQ ID NO: 1844400 - RNA, 16 nt, Human
ucuggcagcucagaga

SEQ ID NO: 1844401 - RNA, 16 nt, Human
agaagcggcuggcagc

SEQ ID NO: 1844402 - RNA, 15 nt, Human
agaagcggcuggcag

SEQ ID NO: 1844403 - RNA, 19 nt, Human
ugcagugagccgagauugu

SEQ ID NO: 1844404 - RNA, 12 nt, Human
ugcaguuuuccu

SEQ ID NO: 1844405 - RNA, 11 nt, Human
ugcauaaaaug

SEQ ID NO: 1844406 - RNA, 15 nt, Human
ugcauaauggucaga

SEQ ID NO: 1844407 - RNA, 20 nt, Human
ugcaggucccuaauaaagcu

SEQ ID NO: 1844408 - RNA, 19 nt, Human
ugcaggucccuaauaaagc

SEQ ID NO: 1844409 - RNA, 18 nt, Human
ugcaggucccuaauaaag

SEQ ID NO: 1844410 - RNA, 14 nt, Human
ugcagugagccgag

SEQ ID NO: 1844411 - RNA, 17 nt, Human
ugcaggucccuaauaaa

SEQ ID NO: 1844412 - RNA, 21 nt, Human
ugcaggucccuaauaaagcug

SEQ ID NO: 1844413 - RNA, 17 nt, Human
agccucaaccuccuggg

SEQ ID NO: 1844414 - RNA, 18 nt, Human
agccucaaccuccugggc

SEQ ID NO: 1844415 - RNA, 13 nt, Human
agccucagcaucc

SEQ ID NO: 1844416 - RNA, 14 nt, Human
agccucagcauccu

SEQ ID NO: 1844417 - RNA, 16 nt, Human
agccucagcauccugg

SEQ ID NO: 1844418 - RNA, 15 nt, Human
agccucagcauccug

SEQ ID NO: 1844419 - RNA, 18 nt, Human
agccugagcgacagugag

SEQ ID NO: 1844420 - RNA, 18 nt, Human
ugcagccucaaccuccug

SEQ ID NO: 1844421 - RNA, 19 nt, Human
ugcagccucaaccuccugg

SEQ ID NO: 1844422 - RNA, 19 nt, Human
agccugagcgacagugaga

SEQ ID NO: 1844423 - RNA, 19 nt, Human
agccugaucaccugcccug

SEQ ID NO: 1844424 - RNA, 16 nt, Human
ugcaugcugucccuua

SEQ ID NO: 1844425 - RNA, 18 nt, Human
agccugaucaccugcccu

SEQ ID NO: 1844426 - RNA, 19 nt, Human
agccugccucuucucuacu

SEQ ID NO: 1844427 - RNA, 16 nt, Human
agccugccucuucucu

SEQ ID NO: 1844428 - RNA, 12 nt, Human
agccugcccucc

SEQ ID NO: 1844429 - RNA, 23 nt, Human
agccugcaguuauuaacacuaac

SEQ ID NO: 1844430 - RNA, 21 nt, Human
ugcaugaggcuaguguggugu

SEQ ID NO: 1844431 - RNA, 22 nt, Human
ugcaugaaguaauaugcacaca

SEQ ID NO: 1844432 - RNA, 20 nt, Human
ugcaugaaguaauaugcaca

SEQ ID NO: 1844433 - RNA, 15 nt, Human
ugcaugcugucccuu

SEQ ID NO: 1844434 - RNA, 14 nt, Human
ugcaugcugucccu

SEQ ID NO: 1844435 - RNA, 13 nt, Human
ugcaugcuguccc

SEQ ID NO: 1844436 - RNA, 21 nt, Human
ugcauaccacuuuuguucuug

SEQ ID NO: 1844437 - RNA, 22 nt, Human
ugcauaccacuuuuguucuugg

SEQ ID NO: 1844438 - RNA, 23 nt, Human
ugcacaagcuccaagcucccagg

SEQ ID NO: 1844439 - RNA, 22 nt, Human
ugcacaagcuccaagcucccag

SEQ ID NO: 1844440 - RNA, 20 nt, Human
ugcacaagcuccaagcuccc

SEQ ID NO: 1844441 - RNA, 18 nt, Human
ugcacaagcuccaagcuc

SEQ ID NO: 1844442 - RNA, 16 nt, Human
ugcacaagcuccaagc

SEQ ID NO: 1844443 - RNA, 15 nt, Human
ugcacaagcuccaag

SEQ ID NO: 1844444 - RNA, 14 nt, Human
ugcacaagcugcac

SEQ ID NO: 1844445 - RNA, 15 nt, Human
ugcacacaccagagc

SEQ ID NO: 1844446 - RNA, 15 nt, Human
ugcaccacugcacuc

SEQ ID NO: 1844447 - RNA, 17 nt, Human
ugcacguauuuuaauag

SEQ ID NO: 1844448 - RNA, 14 nt, Human
ugcaccacugcacu

SEQ ID NO: 1844449 - RNA, 13 nt, Human
ugcacuccccugc

SEQ ID NO: 1844450 - RNA, 12 nt, Human
ugcacuccccug

SEQ ID NO: 1844451 - RNA, 22 nt, Human
ugcacuauagccuaggugacag

SEQ ID NO: 1844452 - RNA, 23 nt, Human
agccguuuguuccccaagacauu

SEQ ID NO: 1844453 - RNA, 15 nt, Human
agccuaggugacaga

SEQ ID NO: 1844454 - RNA, 17 nt, Human
agccuaggugacagagu

SEQ ID NO: 1844455 - RNA, 15 nt, Human
agccucaaccuccug

SEQ ID NO: 1844456 - RNA, 14 nt, Human
agcccuucauuugg

SEQ ID NO: 1844457 - RNA, 13 nt, Human
agcccuucauuug

SEQ ID NO: 1844458 - RNA, 23 nt, Human
agcccuuccaugucgccucugca

SEQ ID NO: 1844459 - RNA, 22 nt, Human
agcccuuccaugucgccucugc

SEQ ID NO: 1844460 - RNA, 19 nt, Human
agcccuuccaugucgccuc

SEQ ID NO: 1844461 - RNA, 22 nt, Human
ugcagacucuacagaggccaug

SEQ ID NO: 1844462 - RNA, 15 nt, Human
ugcacuccccugcug

SEQ ID NO: 1844463 - RNA, 19 nt, Human
ugcagacucuacagaggcc

SEQ ID NO: 1844464 - RNA, 20 nt, Human
ugcagacucuacagaggcca

SEQ ID NO: 1844465 - RNA, 18 nt, Human
ugccccgucccccucugg

SEQ ID NO: 1844466 - RNA, 16 nt, Human
ugccccgucccccucu

SEQ ID NO: 1844467 - RNA, 19 nt, Human
ugccccucaacucuccucc

SEQ ID NO: 1844468 - RNA, 12 nt, Human
ugccccccagcc

SEQ ID NO: 1844469 - RNA, 17 nt, Human
ugcccaggccugccugu

SEQ ID NO: 1844470 - RNA, 15 nt, Human
ugcccaggccugccu

SEQ ID NO: 1844471 - RNA, 12 nt, Human
ugcccaggcccc

SEQ ID NO: 1844472 - RNA, 14 nt, Human
ugcccaggccccug

SEQ ID NO: 1844473 - RNA, 20 nt, Human
ugcccaggccccugccaccc

SEQ ID NO: 1844474 - RNA, 22 nt, Human
ugcccaggccccugccacccug

SEQ ID NO: 1844475 - RNA, 14 nt, Human
ugcccacaggauca

SEQ ID NO: 1844476 - RNA, 15 nt, Human
ugcccaggcaggucu

SEQ ID NO: 1844477 - RNA, 16 nt, Human
ugcccaggcaggucuu

SEQ ID NO: 1844478 - RNA, 17 nt, Human
ugcccaggcaggucuug

SEQ ID NO: 1844479 - RNA, 20 nt, Human
ugcccaggcaggucuugaac

SEQ ID NO: 1844480 - RNA, 11 nt, Human
ugcccaggccc

SEQ ID NO: 1844481 - RNA, 22 nt, Human
ugcccaaccugcucuccucuug

SEQ ID NO: 1844482 - RNA, 18 nt, Human
ugcccaaccugcucuccu

SEQ ID NO: 1844483 - RNA, 24 nt, Human
ugcccaaccugcucuccucuugcc

SEQ ID NO: 1844484 - RNA, 23 nt, Human
ugcccaaccugcucuccucuugc

SEQ ID NO: 1844485 - RNA, 18 nt, Human
agcucagggccuggcuca

SEQ ID NO: 1844486 - RNA, 20 nt, Human
ugccauguuggccaggcugg

SEQ ID NO: 1844487 - RNA, 21 nt, Human
ugccauguuggccaggcuggu

SEQ ID NO: 1844488 - RNA, 16 nt, Human
agcucagggccuggcu

SEQ ID NO: 1844489 - RNA, 15 nt, Human
agcucagggccuggc

SEQ ID NO: 1844490 - RNA, 17 nt, Human
agcucagggccuggcuc

SEQ ID NO: 1844491 - RNA, 17 nt, Human
ugccauguuggccaggc

SEQ ID NO: 1844492 - RNA, 18 nt, Human
ugccauguuggccaggcu

SEQ ID NO: 1844493 - RNA, 19 nt, Human
ugccauguuggccaggcug

SEQ ID NO: 1844494 - RNA, 19 nt, Human
agcuauggugucauaggcu

SEQ ID NO: 1844495 - RNA, 20 nt, Human
ugccagucaccccggccacc

SEQ ID NO: 1844496 - RNA, 18 nt, Human
ugccagucaccccggcca

SEQ ID NO: 1844497 - RNA, 16 nt, Human
ugccagucaccccggc

SEQ ID NO: 1844498 - RNA, 15 nt, Human
ugccagucaccccgg

SEQ ID NO: 1844499 - RNA, 12 nt, Human
ugccacacuuca

SEQ ID NO: 1844500 - RNA, 23 nt, Human
ugccacugccucuuccucccuca

SEQ ID NO: 1844501 - RNA, 23 nt, Human
ugccagucaccccggccaccugc

SEQ ID NO: 1844502 - RNA, 22 nt, Human
ugccagucaccccggccaccug

SEQ ID NO: 1844503 - RNA, 17 nt, Human
ugccagucccccugccc

SEQ ID NO: 1844504 - RNA, 19 nt, Human
ugccagucccccugcccca

SEQ ID NO: 1844505 - RNA, 15 nt, Human
ugccauauucuguug

SEQ ID NO: 1844506 - RNA, 16 nt, Human
ugccauauucuguugg

SEQ ID NO: 1844507 - RNA, 17 nt, Human
ugccauauucuguuggc

SEQ ID NO: 1844508 - RNA, 15 nt, Human
agcgugagccacugc

SEQ ID NO: 1844509 - RNA, 16 nt, Human
agcggggacagcuccu

SEQ ID NO: 1844510 - RNA, 17 nt, Human
agcggggacagcuccuu

SEQ ID NO: 1844511 - RNA, 15 nt, Human
agcggggacagcucc

SEQ ID NO: 1844512 - RNA, 20 nt, Human
ugccauauucuguuggccag

SEQ ID NO: 1844513 - RNA, 21 nt, Human
ugccauauucuguuggccagu

SEQ ID NO: 1844514 - RNA, 23 nt, Human
agcgugguggacaugcacagcua

SEQ ID NO: 1844515 - RNA, 20 nt, Human
agcgugguggacaugcacag

SEQ ID NO: 1844516 - RNA, 16 nt, Human
agcgugagccacugca

SEQ ID NO: 1844517 - RNA, 17 nt, Human
agcgugagccacugcac

SEQ ID NO: 1844518 - RNA, 20 nt, Human
agcgcccacuagacccacug

SEQ ID NO: 1844519 - RNA, 14 nt, Human
agccugcuccagcu

SEQ ID NO: 1844520 - RNA, 14 nt, Human
agcgcccaguuggg

SEQ ID NO: 1844521 - RNA, 22 nt, Human
agcgcccaguuggguggaugcc

SEQ ID NO: 1844522 - RNA, 19 nt, Human
ugcauuugaaaauuuugau

SEQ ID NO: 1844523 - RNA, 23 nt, Human
ugcauuugaaaauuuugauguuu

SEQ ID NO: 1844524 - RNA, 13 nt, Human
ugcauuuccugac

SEQ ID NO: 1844525 - RNA, 14 nt, Human
ugcauuuccugaca

SEQ ID NO: 1844526 - RNA, 14 nt, Human
ugccucucucaggc

SEQ ID NO: 1844527 - RNA, 13 nt, Human
ugccucucucagg

SEQ ID NO: 1844528 - RNA, 19 nt, Human
ugccucccaucacccgcua

SEQ ID NO: 1844529 - RNA, 14 nt, Human
ugccucccaucacc

SEQ ID NO: 1844530 - RNA, 13 nt, Human
ugccucccaucac

SEQ ID NO: 1844531 - RNA, 15 nt, Human
ugccucucucaggcc

SEQ ID NO: 1844532 - RNA, 16 nt, Human
ugccucucucaggcca

SEQ ID NO: 1844533 - RNA, 18 nt, Human
ugccucucugcagguccc

SEQ ID NO: 1844534 - RNA, 16 nt, Human
ugccucucugcagguc

SEQ ID NO: 1844535 - RNA, 20 nt, Human
ugccucucugcaggucccua

SEQ ID NO: 1844536 - RNA, 19 nt, Human
ugccucucugcaggucccu

SEQ ID NO: 1844537 - RNA, 20 nt, Human
ugccucugacacacagcucu

SEQ ID NO: 1844538 - RNA, 21 nt, Human
ugccucugacacacagcucug

SEQ ID NO: 1844539 - RNA, 15 nt, Human
ugcccuuucugggca

SEQ ID NO: 1844540 - RNA, 18 nt, Human
agcugcauacaguuugca

SEQ ID NO: 1844541 - RNA, 13 nt, Human
agcugccaccugc

SEQ ID NO: 1844542 - RNA, 14 nt, Human
agcugccagccgag

SEQ ID NO: 1844543 - RNA, 20 nt, Human
ugcccuccaagaccuucucc

SEQ ID NO: 1844544 - RNA, 19 nt, Human
ugcccuccaagaccuucuc

SEQ ID NO: 1844545 - RNA, 22 nt, Human
ugcccuccaagaccuucuccuu

SEQ ID NO: 1844546 - RNA, 17 nt, Human
agcucuaucaccaagga

SEQ ID NO: 1844547 - RNA, 22 nt, Human
agcucuaucaccaaggagccaa

SEQ ID NO: 1844548 - RNA, 16 nt, Human
agcucucuccucccuu

SEQ ID NO: 1844549 - RNA, 20 nt, Human
agcucugguccauagagagc

SEQ ID NO: 1844550 - RNA, 22 nt, Human
agcucugcuccucuccccagca

SEQ ID NO: 1844551 - RNA, 12 nt, Human
agcucugcuccu

SEQ ID NO: 1844552 - RNA, 22 nt, Human
agcugcacccucaggcaggugg

SEQ ID NO: 1844553 - RNA, 20 nt, Human
agcugcacccucaggcaggu

SEQ ID NO: 1844554 - RNA, 19 nt, Human
agcugcacccucaggcagg

SEQ ID NO: 1844555 - RNA, 18 nt, Human
agcugcacccucaggcag

SEQ ID NO: 1844556 - RNA, 17 nt, Human
agcugcacccucaggca

SEQ ID NO: 1844557 - RNA, 13 nt, Human
agcugcacccuca

SEQ ID NO: 1844558 - RNA, 18 nt, Human
agcucuucuccaggcugu

SEQ ID NO: 1844559 - RNA, 12 nt, Human
agcucuguccug

SEQ ID NO: 1844560 - RNA, 14 nt, Human
agcucuguccuggg

SEQ ID NO: 1844561 - RNA, 14 nt, Human
agcugggcagguug

SEQ ID NO: 1844562 - RNA, 23 nt, Human
agcugggauuacaggcuccugcc

SEQ ID NO: 1844563 - RNA, 22 nt, Human
agcugggauuacaggcuccugc

SEQ ID NO: 1844564 - RNA, 17 nt, Human
agcuggggccaggcugg

SEQ ID NO: 1844565 - RNA, 23 nt, Human
agcugggaugauuggagggggga

SEQ ID NO: 1844566 - RNA, 21 nt, Human
agcugggauuacaggcuccug

SEQ ID NO: 1844567 - RNA, 18 nt, Human
agcugggauuacaggcuc

SEQ ID NO: 1844568 - RNA, 22 nt, Human
agcugggaucacauguggacuu

SEQ ID NO: 1844569 - RNA, 17 nt, Human
agcugggacuacaggug

SEQ ID NO: 1844570 - RNA, 19 nt, Human
agcugggacuacaggugug

SEQ ID NO: 1844571 - RNA, 22 nt, Human
ugccucugacacacagcucugu

SEQ ID NO: 1844572 - RNA, 19 nt, Human
agcugccugggaucccuca

SEQ ID NO: 1844573 - RNA, 13 nt, Human
agcugccugggau

SEQ ID NO: 1844574 - RNA, 21 nt, Human
agcugccugggaucccucauc

SEQ ID NO: 1844575 - RNA, 17 nt, Human
agcuggagaaauauggu

SEQ ID NO: 1844576 - RNA, 10 nt, Human
agcugccugu

SEQ ID NO: 1844577 - RNA, 20 nt, Human
agcuggggccaggcuggguc

SEQ ID NO: 1844578 - RNA, 17 nt, Human
ugccuuagaaccuuucu

SEQ ID NO: 1844579 - RNA, 14 nt, Human
ugccuuagaaccuu

SEQ ID NO: 1844580 - RNA, 21 nt, Human
ugccuuagaaccuuucuuaca

SEQ ID NO: 1844581 - RNA, 15 nt, Human
ugccuguucagcucc

SEQ ID NO: 1844582 - RNA, 16 nt, Human
ugccuguucagcucca

SEQ ID NO: 1844583 - RNA, 17 nt, Human
ugccuguucagcuccag

SEQ ID NO: 1844584 - RNA, 19 nt, Human
ugcgaaaggaugaaaguga

SEQ ID NO: 1844585 - RNA, 18 nt, Human
ugcggacagccacggcca

SEQ ID NO: 1844586 - RNA, 13 nt, Human
ugcgaaaggauga

SEQ ID NO: 1844587 - RNA, 19 nt, Human
agcuuugaaaauucagugg

SEQ ID NO: 1844588 - RNA, 18 nt, Human
agcuuugaaaauucagug

SEQ ID NO: 1844589 - RNA, 16 nt, Human
agcuuugaaaauucag

SEQ ID NO: 1844590 - RNA, 12 nt, Human
agcuuugaaaau

SEQ ID NO: 1844591 - RNA, 17 nt, Human
aggaaacccagcucugg

SEQ ID NO: 1844592 - RNA, 16 nt, Human
aggaaacccagcucug

SEQ ID NO: 1844593 - RNA, 15 nt, Human
aggaaacccagcucu

SEQ ID NO: 1844594 - RNA, 20 nt, Human
aggaaacccagcucuggucc

SEQ ID NO: 1844595 - RNA, 18 nt, Human
aggaaacccagcucuggu

SEQ ID NO: 1844596 - RNA, 21 nt, Human
aggaaacccagcucuggucca

SEQ ID NO: 1844597 - RNA, 23 nt, Human
aggaaaccaguuaggucucaaua

SEQ ID NO: 1844598 - RNA, 21 nt, Human
ugcuauaacuauguugauaaa

SEQ ID NO: 1844599 - RNA, 19 nt, Human
aggaaagcaaaggagauug

SEQ ID NO: 1844600 - RNA, 17 nt, Human
aggaaagcaaaggagau

SEQ ID NO: 1844601 - RNA, 16 nt, Human
aggaaagaggcucugg

SEQ ID NO: 1844602 - RNA, 13 nt, Human
aggaaagaggcuc

SEQ ID NO: 1844603 - RNA, 12 nt, Human
aggaaagaggcu

SEQ ID NO: 1844604 - RNA, 15 nt, Human
agcuuaucucagggg

SEQ ID NO: 1844605 - RNA, 14 nt, Human
agcuuaucucaggg

SEQ ID NO: 1844606 - RNA, 12 nt, Human
agcuuaucucag

SEQ ID NO: 1844607 - RNA, 20 nt, Human
agcuuaaaggggcuagagug

SEQ ID NO: 1844608 - RNA, 20 nt, Human
ugcggacagccacggccagg

SEQ ID NO: 1844609 - RNA, 21 nt, Human
ugcggacagccacggccaggc

SEQ ID NO: 1844610 - RNA, 19 nt, Human
agcuuguaaauagcucagg

SEQ ID NO: 1844611 - RNA, 20 nt, Human
agcuuguaaauagcucaggu

SEQ ID NO: 1844612 - RNA, 21 nt, Human
agcuuguaaauagcucaggug

SEQ ID NO: 1844613 - RNA, 22 nt, Human
aggaauuuuauuuuuuucugaa

SEQ ID NO: 1844614 - RNA, 19 nt, Human
ugcugccacacuucaggcu

SEQ ID NO: 1844615 - RNA, 16 nt, Human
ugcugccacacuucag

SEQ ID NO: 1844616 - RNA, 15 nt, Human
ugcugccacacuuca

SEQ ID NO: 1844617 - RNA, 22 nt, Human
ugcugccacacuucaggcucuu

SEQ ID NO: 1844618 - RNA, 11 nt, Human
ugcugccaucc

SEQ ID NO: 1844619 - RNA, 16 nt, Human
ugcugcccagccucca

SEQ ID NO: 1844620 - RNA, 14 nt, Human
ugcugcccagccuc

SEQ ID NO: 1844621 - RNA, 21 nt, Human
ugcugccauccagguucagcu

SEQ ID NO: 1844622 - RNA, 22 nt, Human
ugcugccauccagguucagcuu

SEQ ID NO: 1844623 - RNA, 12 nt, Human
ugcugccaucca

SEQ ID NO: 1844624 - RNA, 13 nt, Human
ugcugccauccag

SEQ ID NO: 1844625 - RNA, 14 nt, Human
ugcugccauccagg

SEQ ID NO: 1844626 - RNA, 15 nt, Human
ugcugccauccaggu

SEQ ID NO: 1844627 - RNA, 15 nt, Human
aggaagacuuuggaa

SEQ ID NO: 1844628 - RNA, 14 nt, Human
aggaagagaaaaaa

SEQ ID NO: 1844629 - RNA, 22 nt, Human
aggaagcucagggccuggcuca

SEQ ID NO: 1844630 - RNA, 18 nt, Human
aggaagcucagggccugg

SEQ ID NO: 1844631 - RNA, 17 nt, Human
aggaagcucagggccug

SEQ ID NO: 1844632 - RNA, 19 nt, Human
aggaauugacccacaagaa

SEQ ID NO: 1844633 - RNA, 23 nt, Human
aggaauccagacccggcugcgug

SEQ ID NO: 1844634 - RNA, 23 nt, Human
aggaaaggcuccaggagcagcca

SEQ ID NO: 1844635 - RNA, 22 nt, Human
aggaaaggcuccaggagcagcc

SEQ ID NO: 1844636 - RNA, 20 nt, Human
aggaaaggcuccaggagcag

SEQ ID NO: 1844637 - RNA, 18 nt, Human
aggaaaggcuccaggagc

SEQ ID NO: 1844638 - RNA, 22 nt, Human
ugcugagucccaggcugagccu

SEQ ID NO: 1844639 - RNA, 18 nt, Human
ugcugagucccaggcuga

SEQ ID NO: 1844640 - RNA, 15 nt, Human
ugcugagucccaggc

SEQ ID NO: 1844641 - RNA, 24 nt, Human
ugcugacuguuuucucuugagagg

SEQ ID NO: 1844642 - RNA, 21 nt, Human
ugcugacuguuuucucuugag

SEQ ID NO: 1844643 - RNA, 19 nt, Human
ugcucugaugaagaggagu

SEQ ID NO: 1844644 - RNA, 18 nt, Human
ugcucugaugaagaggag

SEQ ID NO: 1844645 - RNA, 22 nt, Human
ugcucugaucauccacugugcc

SEQ ID NO: 1844646 - RNA, 19 nt, Human
ugcucugaucauccacugu

SEQ ID NO: 1844647 - RNA, 18 nt, Human
ugcucugcauguuacaua

SEQ ID NO: 1844648 - RNA, 15 nt, Human
ugcucugcauguuac

SEQ ID NO: 1844649 - RNA, 17 nt, Human
ugcucuggacaggcaug

SEQ ID NO: 1844650 - RNA, 17 nt, Human
ugcugacuguuuucucu

SEQ ID NO: 1844651 - RNA, 13 nt, Human
aggccuggccaga

SEQ ID NO: 1844652 - RNA, 12 nt, Human
aggccuggccag

SEQ ID NO: 1844653 - RNA, 17 nt, Human
aggcccggcuccaggcu

SEQ ID NO: 1844654 - RNA, 14 nt, Human
aggcccggcuccag

SEQ ID NO: 1844655 - RNA, 15 nt, Human
aggcccggcuccagg

SEQ ID NO: 1844656 - RNA, 16 nt, Human
aggcccggcuccaggc

SEQ ID NO: 1844657 - RNA, 20 nt, Human
aggcccagagggccugcaag

SEQ ID NO: 1844658 - RNA, 19 nt, Human
aggcccagagggccugcaa

SEQ ID NO: 1844659 - RNA, 13 nt, Human
aggccccugccac

SEQ ID NO: 1844660 - RNA, 15 nt, Human
aggccccugccaccc

SEQ ID NO: 1844661 - RNA, 17 nt, Human
aggccccugccacccug

SEQ ID NO: 1844662 - RNA, 18 nt, Human
aggccccugccacccugg

SEQ ID NO: 1844663 - RNA, 21 nt, Human
aggccccugccacccugggga

SEQ ID NO: 1844664 - RNA, 15 nt, Human
uggcacagggcagug

SEQ ID NO: 1844665 - RNA, 16 nt, Human
uggcacagggcagugg

SEQ ID NO: 1844666 - RNA, 17 nt, Human
uggcaccagcagccugg

SEQ ID NO: 1844667 - RNA, 16 nt, Human
uggcaccagcagccug

SEQ ID NO: 1844668 - RNA, 17 nt, Human
uggcagccgugccuuca

SEQ ID NO: 1844669 - RNA, 18 nt, Human
aggccagagacacaagcc

SEQ ID NO: 1844670 - RNA, 13 nt, Human
aggccagagacac

SEQ ID NO: 1844671 - RNA, 18 nt, Human
uggcagcucagagagggu

SEQ ID NO: 1844672 - RNA, 16 nt, Human
uggcagcucagagagg

SEQ ID NO: 1844673 - RNA, 15 nt, Human
uggcagcucagagag

SEQ ID NO: 1844674 - RNA, 14 nt, Human
uggcagcucagaga

SEQ ID NO: 1844675 - RNA, 21 nt, Human
uggcagccgugccuucagcuc

SEQ ID NO: 1844676 - RNA, 20 nt, Human
uggcagccgugccuucagcu

SEQ ID NO: 1844677 - RNA, 19 nt, Human
uggcagccgugccuucagc

SEQ ID NO: 1844678 - RNA, 18 nt, Human
uggcagccgugccuucag

SEQ ID NO: 1844679 - RNA, 16 nt, Human
aggcccagagggccug

SEQ ID NO: 1844680 - RNA, 15 nt, Human
aggcccagagggccu

SEQ ID NO: 1844681 - RNA, 20 nt, Human
aggccauuccccgucucugg

SEQ ID NO: 1844682 - RNA, 23 nt, Human
aggccagagacacaagccuucgg

SEQ ID NO: 1844683 - RNA, 22 nt, Human
uggcagccgugccuucagcucu

SEQ ID NO: 1844684 - RNA, 18 nt, Human
aggccaugggccuccugu

SEQ ID NO: 1844685 - RNA, 19 nt, Human
uggccucugcacuccccug

SEQ ID NO: 1844686 - RNA, 20 nt, Human
uggccucugcacuccccugc

SEQ ID NO: 1844687 - RNA, 21 nt, Human
uggccucugcugauccuccca

SEQ ID NO: 1844688 - RNA, 13 nt, Human
uggcccugcccug

SEQ ID NO: 1844689 - RNA, 12 nt, Human
uggcccugcccu

SEQ ID NO: 1844690 - RNA, 14 nt, Human
uggcccacugcauc

SEQ ID NO: 1844691 - RNA, 13 nt, Human
uggcccacugcau

SEQ ID NO: 1844692 - RNA, 19 nt, Human
uggcccacgcacuucggga

SEQ ID NO: 1844693 - RNA, 22 nt, Human
uggcaugggaaugaaugucagu

SEQ ID NO: 1844694 - RNA, 14 nt, Human
aggcgccccuuccc

SEQ ID NO: 1844695 - RNA, 17 nt, Human
aggccuucucugaagga

SEQ ID NO: 1844696 - RNA, 18 nt, Human
aggccuucucugaaggac

SEQ ID NO: 1844697 - RNA, 11 nt, Human
aggcuccacuu

SEQ ID NO: 1844698 - RNA, 17 nt, Human
aggcuccacuuggucug

SEQ ID NO: 1844699 - RNA, 21 nt, Human
aggcuccacuuggucugugag

SEQ ID NO: 1844700 - RNA, 22 nt, Human
aggcuccacuuggucugugaga

SEQ ID NO: 1844701 - RNA, 16 nt, Human
aggcuccaggagcagc

SEQ ID NO: 1844702 - RNA, 14 nt, Human
aggcuccaggagca

SEQ ID NO: 1844703 - RNA, 13 nt, Human
aggcuccaggagc

SEQ ID NO: 1844704 - RNA, 21 nt, Human
aggcaggucuugaacuccugg

SEQ ID NO: 1844705 - RNA, 22 nt, Human
aggcagggucucacucugucgc

SEQ ID NO: 1844706 - RNA, 14 nt, Human
aggcagguccaggg

SEQ ID NO: 1844707 - RNA, 19 nt, Human
aggcagggucucacucugu

SEQ ID NO: 1844708 - RNA, 18 nt, Human
aggcagggucucacucug

SEQ ID NO: 1844709 - RNA, 20 nt, Human
aggcagggucucacucuguc

SEQ ID NO: 1844710 - RNA, 21 nt, Human
aggcagggucucacucugucg

SEQ ID NO: 1844711 - RNA, 16 nt, Human
aggcagggagggccug

SEQ ID NO: 1844712 - RNA, 12 nt, Human
aggcaggauggc

SEQ ID NO: 1844713 - RNA, 20 nt, Human
aggcaggaguuucguuuuca

SEQ ID NO: 1844714 - RNA, 15 nt, Human
aggcacccaccauca

SEQ ID NO: 1844715 - RNA, 19 nt, Human
aggcagccccauucugccu

SEQ ID NO: 1844716 - RNA, 20 nt, Human
aggcagccccauucugccug

SEQ ID NO: 1844717 - RNA, 21 nt, Human
aggcagccccauucugccugc

SEQ ID NO: 1844718 - RNA, 22 nt, Human
aggcagccccauucugccugcc

SEQ ID NO: 1844719 - RNA, 24 nt, Human
uggacuuuguuaguuucuccaagc

SEQ ID NO: 1844720 - RNA, 16 nt, Human
uggagcccacuguacu

SEQ ID NO: 1844721 - RNA, 23 nt, Human
uggagcccacuguacuugcucuu

SEQ ID NO: 1844722 - RNA, 19 nt, Human
uggagcccacuguacuugc

SEQ ID NO: 1844723 - RNA, 11 nt, Human
uggacuuuguu

SEQ ID NO: 1844724 - RNA, 22 nt, Human
uggacuuuguuaguuucuccaa

SEQ ID NO: 1844725 - RNA, 23 nt, Human
uggaggaaaaccaagccguggcu

SEQ ID NO: 1844726 - RNA, 21 nt, Human
uggaggaaaaccaagccgugg

SEQ ID NO: 1844727 - RNA, 15 nt, Human
aggcaaugcuggcug

SEQ ID NO: 1844728 - RNA, 16 nt, Human
aggcaaugcuggcugu

SEQ ID NO: 1844729 - RNA, 14 nt, Human
uggaagugcuaauu

SEQ ID NO: 1844730 - RNA, 15 nt, Human
aggaggccagccuug

SEQ ID NO: 1844731 - RNA, 21 nt, Human
aggaguuugagaccaaccugg

SEQ ID NO: 1844732 - RNA, 19 nt, Human
aggaguuucguuuucaaaa

SEQ ID NO: 1844733 - RNA, 17 nt, Human
uggaaguaguggagccc

SEQ ID NO: 1844734 - RNA, 14 nt, Human
uggaaguaguggag

SEQ ID NO: 1844735 - RNA, 20 nt, Human
uggaaguacuauaauuuacc

SEQ ID NO: 1844736 - RNA, 12 nt, Human
uggaacacucug

SEQ ID NO: 1844737 - RNA, 14 nt, Human
uggaacacucugag

SEQ ID NO: 1844738 - RNA, 13 nt, Human
uggaagcuccgcu

SEQ ID NO: 1844739 - RNA, 12 nt, Human
ugcugcccugcc

SEQ ID NO: 1844740 - RNA, 10 nt, Human
ugcugcccug

SEQ ID NO: 1844741 - RNA, 12 nt, Human
aggaucucuuga

SEQ ID NO: 1844742 - RNA, 15 nt, Human
aggaugcuuguacau

SEQ ID NO: 1844743 - RNA, 16 nt, Human
aggaugcuuguacaua

SEQ ID NO: 1844744 - RNA, 21 nt, Human
aggauccugagccagauuuca

SEQ ID NO: 1844745 - RNA, 12 nt, Human
aggaucagucug

SEQ ID NO: 1844746 - RNA, 18 nt, Human
aggaugcuuguacauaau

SEQ ID NO: 1844747 - RNA, 22 nt, Human
aggauugcuacuguccuaccca

SEQ ID NO: 1844748 - RNA, 14 nt, Human
uggaauuugaaaca

SEQ ID NO: 1844749 - RNA, 16 nt, Human
aggcaacuugggaacu

SEQ ID NO: 1844750 - RNA, 19 nt, Human
aggcaacugcauuggcuuu

SEQ ID NO: 1844751 - RNA, 14 nt, Human
aggcaagcaccucc

SEQ ID NO: 1844752 - RNA, 15 nt, Human
uggacaccggaaaca

SEQ ID NO: 1844753 - RNA, 22 nt, Human
aggcugggggaagaagcucucu

SEQ ID NO: 1844754 - RNA, 10 nt, Human
aggcuggguc

SEQ ID NO: 1844755 - RNA, 18 nt, Human
aggcugggucgcccugga

SEQ ID NO: 1844756 - RNA, 15 nt, Human
aggcugggucgcccu

SEQ ID NO: 1844757 - RNA, 17 nt, Human
aggcuggguucugaucc

SEQ ID NO: 1844758 - RNA, 14 nt, Human
aggcuggguucuga

SEQ ID NO: 1844759 - RNA, 21 nt, Human
aggcugggucgcccuggacug

SEQ ID NO: 1844760 - RNA, 20 nt, Human
aggcugggucgcccuggacu

SEQ ID NO: 1844761 - RNA, 18 nt, Human
aggcugggcuucaguggc

SEQ ID NO: 1844762 - RNA, 19 nt, Human
aggcugggcuucaguggca

SEQ ID NO: 1844763 - RNA, 20 nt, Human
aggcugggcuucaguggcag

SEQ ID NO: 1844764 - RNA, 21 nt, Human
aggcugggcuucaguggcagc

SEQ ID NO: 1844765 - RNA, 17 nt, Human
aggcugggggaagaagc

SEQ ID NO: 1844766 - RNA, 22 nt, Human
aggcugggcuucaguggcagcu

SEQ ID NO: 1844767 - RNA, 23 nt, Human
aggcugggcuucaguggcagcug

SEQ ID NO: 1844768 - RNA, 16 nt, Human
aggcugggagagccuu

SEQ ID NO: 1844769 - RNA, 19 nt, Human
aggcugggagagccuucca

SEQ ID NO: 1844770 - RNA, 21 nt, Human
aggcugggagagccuuccagg

SEQ ID NO: 1844771 - RNA, 20 nt, Human
aggcugggagagccuuccag

SEQ ID NO: 1844772 - RNA, 22 nt, Human
aggcugggagagccuuccaggg

SEQ ID NO: 1844773 - RNA, 18 nt, Human
aggcugggcucccuuccc

SEQ ID NO: 1844774 - RNA, 14 nt, Human
aggcugggcucccu

SEQ ID NO: 1844775 - RNA, 13 nt, Human
aggcugggcuccc

SEQ ID NO: 1844776 - RNA, 23 nt, Human
aggcugggcucccuucccaccuc

SEQ ID NO: 1844777 - RNA, 21 nt, Human
aggcugggcucccuucccacc

SEQ ID NO: 1844778 - RNA, 14 nt, Human
aggcugggcuucag

SEQ ID NO: 1844779 - RNA, 23 nt, Human
aggcuucugguugaugccuguga

SEQ ID NO: 1844780 - RNA, 21 nt, Human
aggcuuagucacugagacagc

SEQ ID NO: 1844781 - RNA, 22 nt, Human
aggcuuagucacugagacagcc

SEQ ID NO: 1844782 - RNA, 23 nt, Human
aggcuuagucacugagacagccc

SEQ ID NO: 1844783 - RNA, 21 nt, Human
aggcuuuuuuaucaugugaaa

SEQ ID NO: 1844784 - RNA, 18 nt, Human
aggcuuuuuuaucaugug

SEQ ID NO: 1844785 - RNA, 15 nt, Human
aggcuuuuuuaucau

SEQ ID NO: 1844786 - RNA, 13 nt, Human
uggcucacgccug

SEQ ID NO: 1844787 - RNA, 21 nt, Human
uggcucacugcaacuucugcc

SEQ ID NO: 1844788 - RNA, 19 nt, Human
uggcuaauguacugcauau

SEQ ID NO: 1844789 - RNA, 17 nt, Human
uggcuaauguacugcau

SEQ ID NO: 1844790 - RNA, 23 nt, Human
aggcuccaggagcagccacauuc

SEQ ID NO: 1844791 - RNA, 19 nt, Human
aggcuccaggagcagccac

SEQ ID NO: 1844792 - RNA, 18 nt, Human
aggcuccaggagcagcca

SEQ ID NO: 1844793 - RNA, 17 nt, Human
aggcuccaggagcagcc

SEQ ID NO: 1844794 - RNA, 14 nt, Human
uggcuaaauucaug

SEQ ID NO: 1844795 - RNA, 18 nt, Human
uggcuaagcaaaauguga

SEQ ID NO: 1844796 - RNA, 13 nt, Human
aggcuccugccac

SEQ ID NO: 1844797 - RNA, 19 nt, Human
uggcugugccucugccugu

SEQ ID NO: 1844798 - RNA, 18 nt, Human
uggcugugccucugccug

SEQ ID NO: 1844799 - RNA, 22 nt, Human
uggcugugccucugccugucuc

SEQ ID NO: 1844800 - RNA, 16 nt, Human
uggcuguuggcugggg

SEQ ID NO: 1844801 - RNA, 18 nt, Human
uggcuguuggcugggggc

SEQ ID NO: 1844802 - RNA, 14 nt, Human
uggcuucacggaag

SEQ ID NO: 1844803 - RNA, 23 nt, Human
uggcuguuggcugggggccucag

SEQ ID NO: 1844804 - RNA, 17 nt, Human
uggcugugccucugccu

SEQ ID NO: 1844805 - RNA, 16 nt, Human
uggcugugccucugcc

SEQ ID NO: 1844806 - RNA, 15 nt, Human
uggcugugccucugc

SEQ ID NO: 1844807 - RNA, 14 nt, Human
uggcugugccucug

SEQ ID NO: 1844808 - RNA, 23 nt, Human
uggcugcaaaggguaucaggugc

SEQ ID NO: 1844809 - RNA, 20 nt, Human
ugggaacaccauaggucacc

SEQ ID NO: 1844810 - RNA, 20 nt, Human
uggcuucacggaagagccuu

SEQ ID NO: 1844811 - RNA, 17 nt, Human
uggcuucacggaagagc

SEQ ID NO: 1844812 - RNA, 15 nt, Human
uggcuuuugugcauu

SEQ ID NO: 1844813 - RNA, 16 nt, Human
uggcuuuugugcauua

SEQ ID NO: 1844814 - RNA, 21 nt, Human
uggcuuuugugcauuaucuag

SEQ ID NO: 1844815 - RNA, 18 nt, Human
ugggaaacaaaaggauaa

SEQ ID NO: 1844816 - RNA, 19 nt, Human
agggagggcuccagacaca

SEQ ID NO: 1844817 - RNA, 17 nt, Human
agggagggcuccagaca

SEQ ID NO: 1844818 - RNA, 13 nt, Human
agggagggcucca

SEQ ID NO: 1844819 - RNA, 12 nt, Human
agggagggcucc

SEQ ID NO: 1844820 - RNA, 15 nt, Human
agggagggccugggc

SEQ ID NO: 1844821 - RNA, 13 nt, Human
agggagggccugg

SEQ ID NO: 1844822 - RNA, 22 nt, Human
agggagggcuccagacacaugu

SEQ ID NO: 1844823 - RNA, 20 nt, Human
agggaguccgaaagggacuu

SEQ ID NO: 1844824 - RNA, 23 nt, Human
agggaguccgaaagggacuugga

SEQ ID NO: 1844825 - RNA, 20 nt, Human
agggagugaguugauagcac

SEQ ID NO: 1844826 - RNA, 20 nt, Human
agggagugacagaggcagcc

SEQ ID NO: 1844827 - RNA, 17 nt, Human
agggcauggccaggugg

SEQ ID NO: 1844828 - RNA, 12 nt, Human
agggcccagaga

SEQ ID NO: 1844829 - RNA, 13 nt, Human
agggcccagagag

SEQ ID NO: 1844830 - RNA, 17 nt, Human
agggcacugguggcccg

SEQ ID NO: 1844831 - RNA, 20 nt, Human
agggcuccagacacaugucc

SEQ ID NO: 1844832 - RNA, 14 nt, Human
agggcccagagagg

SEQ ID NO: 1844833 - RNA, 18 nt, Human
agggcccagagagggugg

SEQ ID NO: 1844834 - RNA, 14 nt, Human
ugggcucccuuccc

SEQ ID NO: 1844835 - RNA, 15 nt, Human
ugggcucccuuccca

SEQ ID NO: 1844836 - RNA, 20 nt, Human
ugggcagaaggaagacuuca

SEQ ID NO: 1844837 - RNA, 16 nt, Human
ugggcagaaggaagac

SEQ ID NO: 1844838 - RNA, 23 nt, Human
ugggcagaaggaagacuucaucc

SEQ ID NO: 1844839 - RNA, 13 nt, Human
ugggcagaaggaa

SEQ ID NO: 1844840 - RNA, 16 nt, Human
ugggauuuggucaaca

SEQ ID NO: 1844841 - RNA, 22 nt, Human
ugggagaaccaaaaagaggcua

SEQ ID NO: 1844842 - RNA, 21 nt, Human
ugggagaaccaaaaagaggcu

SEQ ID NO: 1844843 - RNA, 16 nt, Human
ugggagaaaugaaaaa

SEQ ID NO: 1844844 - RNA, 21 nt, Human
ugggaggauugcuugagcuca

SEQ ID NO: 1844845 - RNA, 18 nt, Human
ugggaggauugcuugagc

SEQ ID NO: 1844846 - RNA, 22 nt, Human
ugggaggauugcuugagcucag

SEQ ID NO: 1844847 - RNA, 19 nt, Human
ugggaggcugagaugggag

SEQ ID NO: 1844848 - RNA, 23 nt, Human
ugggaggcucuggagcccacugu

SEQ ID NO: 1844849 - RNA, 17 nt, Human
ugggaggcucuggagcc

SEQ ID NO: 1844850 - RNA, 14 nt, Human
ugggaggcucugga

SEQ ID NO: 1844851 - RNA, 18 nt, Human
agggagcaucagugcccu

SEQ ID NO: 1844852 - RNA, 18 nt, Human
ugggacuacaggcaccca

SEQ ID NO: 1844853 - RNA, 16 nt, Human
ugggacuggccucugc

SEQ ID NO: 1844854 - RNA, 14 nt, Human
ugggacuggccucu

SEQ ID NO: 1844855 - RNA, 15 nt, Human
ugggagaaaugaaaa

SEQ ID NO: 1844856 - RNA, 13 nt, Human
ugggacuggccuc

SEQ ID NO: 1844857 - RNA, 18 nt, Human
ugggacucaaugcacuga

SEQ ID NO: 1844858 - RNA, 16 nt, Human
ugggacuacaggugug

SEQ ID NO: 1844859 - RNA, 20 nt, Human
agggacuuggaagcuccgcu

SEQ ID NO: 1844860 - RNA, 18 nt, Human
agggacuuggaagcuccg

SEQ ID NO: 1844861 - RNA, 19 nt, Human
agggacuuggaagcuccgc

SEQ ID NO: 1844862 - RNA, 15 nt, Human
agggacuuggaagcu

SEQ ID NO: 1844863 - RNA, 15 nt, Human
uguccaagaagccca

SEQ ID NO: 1844864 - RNA, 14 nt, Human
uguccaagaagccc

SEQ ID NO: 1844865 - RNA, 17 nt, Human
ugucagguggggcagcu

SEQ ID NO: 1844866 - RNA, 18 nt, Human
ugucagguggggcagcuu

SEQ ID NO: 1844867 - RNA, 20 nt, Human
ugucagguggggcagcuuga

SEQ ID NO: 1844868 - RNA, 20 nt, Human
ugucauuugagcagggcuca

SEQ ID NO: 1844869 - RNA, 21 nt, Human
ugucauuugagcagggcucag

SEQ ID NO: 1844870 - RNA, 22 nt, Human
ugucauuugagcagggcucagc

SEQ ID NO: 1844871 - RNA, 22 nt, Human
uguccaagaagcccaggaaagg

SEQ ID NO: 1844872 - RNA, 18 nt, Human
uguccaagaagcccagga

SEQ ID NO: 1844873 - RNA, 17 nt, Human
uguccaagaagcccagg

SEQ ID NO: 1844874 - RNA, 16 nt, Human
uguccaagaagcccag

SEQ ID NO: 1844875 - RNA, 20 nt, Human
ugucccugcacuugcagacu

SEQ ID NO: 1844876 - RNA, 22 nt, Human
ugucccugcacuugcagacucu

SEQ ID NO: 1844877 - RNA, 23 nt, Human
ugucccugcacuugcagacucua

SEQ ID NO: 1844878 - RNA, 17 nt, Human
agucaccccggccaccu

SEQ ID NO: 1844879 - RNA, 15 nt, Human
agucaccaagcccag

SEQ ID NO: 1844880 - RNA, 19 nt, Human
aguauucuuauuuaaugaa

SEQ ID NO: 1844881 - RNA, 19 nt, Human
agucccaggcugagccuca

SEQ ID NO: 1844882 - RNA, 18 nt, Human
agucccaggcugagccuc

SEQ ID NO: 1844883 - RNA, 17 nt, Human
agucccaggcugagccu

SEQ ID NO: 1844884 - RNA, 18 nt, Human
agucccaccuuggcugca

SEQ ID NO: 1844885 - RNA, 19 nt, Human
agucccaccuuggcugcag

SEQ ID NO: 1844886 - RNA, 15 nt, Human
agucccaccuuggcu

SEQ ID NO: 1844887 - RNA, 16 nt, Human
agucccaccuuggcug

SEQ ID NO: 1844888 - RNA, 14 nt, Human
ugucgccucugcau

SEQ ID NO: 1844889 - RNA, 23 nt, Human
ugucccuuacgugaguccuggca

SEQ ID NO: 1844890 - RNA, 19 nt, Human
ugucccuuacgugaguccu

SEQ ID NO: 1844891 - RNA, 22 nt, Human
agucagaaguuucugccgcagc

SEQ ID NO: 1844892 - RNA, 16 nt, Human
aguccucccaucucac

SEQ ID NO: 1844893 - RNA, 14 nt, Human
aguccucccaucuc

SEQ ID NO: 1844894 - RNA, 16 nt, Human
agucccccugccccag

SEQ ID NO: 1844895 - RNA, 23 nt, Human
agucucacuguugcccaggcugg

SEQ ID NO: 1844896 - RNA, 12 nt, Human
aggugggaggau

SEQ ID NO: 1844897 - RNA, 16 nt, Human
ugggcugcccuggugc

SEQ ID NO: 1844898 - RNA, 15 nt, Human
ugggcugcccuggug

SEQ ID NO: 1844899 - RNA, 14 nt, Human
ugggcugcccuggu

SEQ ID NO: 1844900 - RNA, 13 nt, Human
ugggcugcccugg

SEQ ID NO: 1844901 - RNA, 16 nt, Human
aggugucccugcacuu

SEQ ID NO: 1844902 - RNA, 20 nt, Human
aggugucccugcacuugcag

SEQ ID NO: 1844903 - RNA, 21 nt, Human
aggugugagucaccaagccca

SEQ ID NO: 1844904 - RNA, 22 nt, Human
aggugugagucaccaagcccag

SEQ ID NO: 1844905 - RNA, 12 nt, Human
aggugugcucug

SEQ ID NO: 1844906 - RNA, 14 nt, Human
agguugcagugagc

SEQ ID NO: 1844907 - RNA, 14 nt, Human
agguugaagcacca

SEQ ID NO: 1844908 - RNA, 14 nt, Human
uguacauauaagug

SEQ ID NO: 1844909 - RNA, 16 nt, Human
uguacaugaaaacaca

SEQ ID NO: 1844910 - RNA, 14 nt, Human
uguacaugaaaaca

SEQ ID NO: 1844911 - RNA, 20 nt, Human
uguaauuuuuuuaucgucac

SEQ ID NO: 1844912 - RNA, 12 nt, Human
uguacaguuuuu

SEQ ID NO: 1844913 - RNA, 19 nt, Human
uguacauaaugcgugcaua

SEQ ID NO: 1844914 - RNA, 20 nt, Human
uguacauaaugcgugcauac

SEQ ID NO: 1844915 - RNA, 18 nt, Human
uguaauuaaguacuaugu

SEQ ID NO: 1844916 - RNA, 21 nt, Human
uguaauuaaguacuauguauc

SEQ ID NO: 1844917 - RNA, 19 nt, Human
uguaauuaaguacuaugua

SEQ ID NO: 1844918 - RNA, 19 nt, Human
agguuucucaaagaaauuu

SEQ ID NO: 1844919 - RNA, 16 nt, Human
agguuucucaaagaaa

SEQ ID NO: 1844920 - RNA, 20 nt, Human
agguuggcaaaaaggcagga

SEQ ID NO: 1844921 - RNA, 22 nt, Human
uguagugaaucacguaaagcua

SEQ ID NO: 1844922 - RNA, 17 nt, Human
uguaggguuauaauaau

SEQ ID NO: 1844923 - RNA, 16 nt, Human
uguaggguuauaauaa

SEQ ID NO: 1844924 - RNA, 22 nt, Human
uguauauauuuccuauauuguu

SEQ ID NO: 1844925 - RNA, 18 nt, Human
uguauauauuuccuauau

SEQ ID NO: 1844926 - RNA, 21 nt, Human
uguacauggaauaacauguaa

SEQ ID NO: 1844927 - RNA, 23 nt, Human
aguaaaaacaaagaaauuaugug

SEQ ID NO: 1844928 - RNA, 16 nt, Human
aguaaaaacaaagaaa

SEQ ID NO: 1844929 - RNA, 21 nt, Human
aguacacuguuucaaacuuua

SEQ ID NO: 1844930 - RNA, 23 nt, Human
aguacacuguuucaaacuuuacu

SEQ ID NO: 1844931 - RNA, 17 nt, Human
aguggauggaaggggcu

SEQ ID NO: 1844932 - RNA, 14 nt, Human
aguggggaggggcu

SEQ ID NO: 1844933 - RNA, 15 nt, Human
aguggggacagagca

SEQ ID NO: 1844934 - RNA, 22 nt, Human
agugggcccaaugcacuuuguu

SEQ ID NO: 1844935 - RNA, 11 nt, Human
aguggcagcug

SEQ ID NO: 1844936 - RNA, 19 nt, Human
uguuacauaagauaaaugu

SEQ ID NO: 1844937 - RNA, 18 nt, Human
uguuacaaauuguagaag

SEQ ID NO: 1844938 - RNA, 17 nt, Human
uguuacaaauuguagaa

SEQ ID NO: 1844939 - RNA, 19 nt, Human
uguuaauaaaaguacaugu

SEQ ID NO: 1844940 - RNA, 13 nt, Human
uguuaauaaaagu

SEQ ID NO: 1844941 - RNA, 18 nt, Human
uguuaauaaaaguacaug

SEQ ID NO: 1844942 - RNA, 22 nt, Human
uguuaaguugauggugaugaaa

SEQ ID NO: 1844943 - RNA, 22 nt, Human
uguuaacugagugccuuuuggu

SEQ ID NO: 1844944 - RNA, 16 nt, Human
uguuaacugagugccu

SEQ ID NO: 1844945 - RNA, 23 nt, Human
uguguuaucacccagaagaaaau

SEQ ID NO: 1844946 - RNA, 22 nt, Human
uguguuaucacccagaagaaaa

SEQ ID NO: 1844947 - RNA, 11 nt, Human
uguguguuuau

SEQ ID NO: 1844948 - RNA, 20 nt, Human
ugugucuugcaauggcagcc

SEQ ID NO: 1844949 - RNA, 16 nt, Human
agugcccuccaggaua

SEQ ID NO: 1844950 - RNA, 16 nt, Human
aguguuguggauuuaa

SEQ ID NO: 1844951 - RNA, 18 nt, Human
aguguguguuuuucauaa

SEQ ID NO: 1844952 - RNA, 19 nt, Human
aguguuguggauuuaacag

SEQ ID NO: 1844953 - RNA, 20 nt, Human
aguguuguggauuuaacaga

SEQ ID NO: 1844954 - RNA, 13 nt, Human
aguuacucagaau

SEQ ID NO: 1844955 - RNA, 23 nt, Human
aguuacuaucaugucaaacguga

SEQ ID NO: 1844956 - RNA, 15 nt, Human
uguucuaagaaguga

SEQ ID NO: 1844957 - RNA, 15 nt, Human
uguugcauagaauaa

SEQ ID NO: 1844958 - RNA, 23 nt, Human
uguugcccaggcuggcgugcagu

SEQ ID NO: 1844959 - RNA, 20 nt, Human
uguugcccaggcuggcgugc

SEQ ID NO: 1844960 - RNA, 22 nt, Human
agugugguguuuccuggcacug

SEQ ID NO: 1844961 - RNA, 17 nt, Human
uguuaugacuccagaau

SEQ ID NO: 1844962 - RNA, 13 nt, Human
uguuaugacucca

SEQ ID NO: 1844963 - RNA, 19 nt, Human
uguuccacaaguuaaauaa

SEQ ID NO: 1844964 - RNA, 21 nt, Human
agugugccugaagucccagau

SEQ ID NO: 1844965 - RNA, 15 nt, Human
aguguggcaaaauaa

SEQ ID NO: 1844966 - RNA, 20 nt, Human
agugugacugaucucucgug

SEQ ID NO: 1844967 - RNA, 14 nt, Human
agugguauagaaau

SEQ ID NO: 1844968 - RNA, 15 nt, Human
agugguauagaaaug

SEQ ID NO: 1844969 - RNA, 16 nt, Human
agugguauagaaaugc

SEQ ID NO: 1844970 - RNA, 18 nt, Human
agugguauagaaaugcug

SEQ ID NO: 1844971 - RNA, 23 nt, Human
agucuuagauguauauauuuccu

SEQ ID NO: 1844972 - RNA, 16 nt, Human
agucuuagauguauau

SEQ ID NO: 1844973 - RNA, 14 nt, Human
agucuuagauguau

SEQ ID NO: 1844974 - RNA, 13 nt, Human
agucuuagaugua

SEQ ID NO: 1844975 - RNA, 12 nt, Human
agucugaaggcu

SEQ ID NO: 1844976 - RNA, 17 nt, Human
agucucuugauucauaa

SEQ ID NO: 1844977 - RNA, 16 nt, Human
agucucuugauucaua

SEQ ID NO: 1844978 - RNA, 21 nt, Human
agucucuucuccacuggaugg

SEQ ID NO: 1844979 - RNA, 19 nt, Human
agucucuucuccacuggau

SEQ ID NO: 1844980 - RNA, 19 nt, Human
agucucgcucuguugccca

SEQ ID NO: 1844981 - RNA, 19 nt, Human
ugugacuucagcucuguuu

SEQ ID NO: 1844982 - RNA, 18 nt, Human
ugugacuucagcucuguu

SEQ ID NO: 1844983 - RNA, 16 nt, Human
ugugacugaucucucg

SEQ ID NO: 1844984 - RNA, 11 nt, Human
ugugaggaagc

SEQ ID NO: 1844985 - RNA, 14 nt, Human
agugagcacuaagg

SEQ ID NO: 1844986 - RNA, 22 nt, Human
agugagcacuaaggugugcucu

SEQ ID NO: 1844987 - RNA, 19 nt, Human
ugugaugagaggaaaucac

SEQ ID NO: 1844988 - RNA, 22 nt, Human
ugugaugaugaaaugaggucag

SEQ ID NO: 1844989 - RNA, 12 nt, Human
agugagcugguu

SEQ ID NO: 1844990 - RNA, 22 nt, Human
agugaacaaauuuacagagaca

SEQ ID NO: 1844991 - RNA, 23 nt, Human
agugaacaaauuuacagagacag

SEQ ID NO: 1844992 - RNA, 16 nt, Human
agugaacuugggccac

SEQ ID NO: 1844993 - RNA, 21 nt, Human
agugacugauggcuaauguac

SEQ ID NO: 1844994 - RNA, 16 nt, Human
agucuuucacauuuaa

SEQ ID NO: 1844995 - RNA, 21 nt, Human
agugaacaaauuuacagagac

SEQ ID NO: 1844996 - RNA, 18 nt, Human
agucuuucacauuuaaau

SEQ ID NO: 1844997 - RNA, 12 nt, Human
ugugcugcccug

SEQ ID NO: 1844998 - RNA, 19 nt, Human
ugugcugagucugaaggcu

SEQ ID NO: 1844999 - RNA, 18 nt, Human
ugugcugagucugaaggc

SEQ ID NO: 1845000 - RNA, 21 nt, Human
ugugcucaggagcccugggag

SEQ ID NO: 1845001 - RNA, 21 nt, Human
ugugcugcccugcccaccugg

SEQ ID NO: 1845002 - RNA, 20 nt, Human
ugugcugcccugcccaccug

SEQ ID NO: 1845003 - RNA, 19 nt, Human
ugugcugcccugcccaccu

SEQ ID NO: 1845004 - RNA, 18 nt, Human
ugugcugcccugcccacc

SEQ ID NO: 1845005 - RNA, 21 nt, Human
uguggaucaaauccagccugc

SEQ ID NO: 1845006 - RNA, 14 nt, Human
uguggaugauaaaa

SEQ ID NO: 1845007 - RNA, 19 nt, Human
uguggauuuaacagaaaug

SEQ ID NO: 1845008 - RNA, 20 nt, Human
uguggauuuaacagaaaugu

SEQ ID NO: 1845009 - RNA, 22 nt, Human
uguggauuuaacagaaauguac

SEQ ID NO: 1845010 - RNA, 23 nt, Human
agugagcugguuuuuagcggaga

SEQ ID NO: 1845011 - RNA, 13 nt, Human
agugaggcucugc

SEQ ID NO: 1845012 - RNA, 12 nt, Human
agugaggcucug

SEQ ID NO: 1845013 - RNA, 16 nt, Human
agugaggaugaaaaaa

SEQ ID NO: 1845014 - RNA, 14 nt, Human
agugccaaaaacaa

SEQ ID NO: 1845015 - RNA, 14 nt, Human
agugcaugcugucc

SEQ ID NO: 1845016 - RNA, 16 nt, Human
agugcaugcugucccu

SEQ ID NO: 1845017 - RNA, 17 nt, Human
agugcagugagccgaga

SEQ ID NO: 1845018 - RNA, 18 nt, Human
auagauaggucagugcaa

SEQ ID NO: 1845019 - RNA, 14 nt, Human
auagagagagacca

SEQ ID NO: 1845020 - RNA, 18 nt, Human
auagacccacaagaggca

SEQ ID NO: 1845021 - RNA, 16 nt, Human
auagacaauuuauuau

SEQ ID NO: 1845022 - RNA, 22 nt, Human
auagacaauuuauuauggcaca

SEQ ID NO: 1845023 - RNA, 23 nt, Human
auagacaauuuauuauggcacau

SEQ ID NO: 1845024 - RNA, 17 nt, Human
auagaauuaacacauga

SEQ ID NO: 1845025 - RNA, 22 nt, Human
auagaauaaaauuuuuaaucuu

SEQ ID NO: 1845026 - RNA, 19 nt, Human
auagaauaaaauuuuuaau

SEQ ID NO: 1845027 - RNA, 14 nt, Human
auagaauaaaauuu

SEQ ID NO: 1845028 - RNA, 22 nt, Human
auagaaaugcugguuuuucagu

SEQ ID NO: 1845029 - RNA, 19 nt, Human
auagaaaugcugguuuuuc

SEQ ID NO: 1845030 - RNA, 13 nt, Human
auagaaaugcugg

SEQ ID NO: 1845031 - RNA, 13 nt, Human
auagaaguaaaaa

SEQ ID NO: 1845032 - RNA, 12 nt, Human
uuauuaugcaug

SEQ ID NO: 1845033 - RNA, 15 nt, Human
uuauuauauuuacaa

SEQ ID NO: 1845034 - RNA, 14 nt, Human
uuauuauauuuaca

SEQ ID NO: 1845035 - RNA, 13 nt, Human
uuauuaugcauga

SEQ ID NO: 1845036 - RNA, 20 nt, Human
uuauucacuuuuauuuagca

SEQ ID NO: 1845037 - RNA, 12 nt, Human
uuauucauaauu

SEQ ID NO: 1845038 - RNA, 14 nt, Human
auacucccaucugu

SEQ ID NO: 1845039 - RNA, 17 nt, Human
auacuccuccaagguua

SEQ ID NO: 1845040 - RNA, 16 nt, Human
auacucugcuuagaau

SEQ ID NO: 1845041 - RNA, 18 nt, Human
auacucuuauagacaaca

SEQ ID NO: 1845042 - RNA, 16 nt, Human
auacucauuaggaugg

SEQ ID NO: 1845043 - RNA, 11 nt, Human
auacucccauc

SEQ ID NO: 1845044 - RNA, 17 nt, Human
uuaucacccagaagaaa

SEQ ID NO: 1845045 - RNA, 18 nt, Human
uuaucacccagaagaaaa

SEQ ID NO: 1845046 - RNA, 19 nt, Human
uuaucacccagaagaaaau

SEQ ID NO: 1845047 - RNA, 21 nt, Human
uuaucacccagaagaaaauag

SEQ ID NO: 1845048 - RNA, 20 nt, Human
uuaugaagcuuuuaugugaa

SEQ ID NO: 1845049 - RNA, 20 nt, Human
uuaugauacuugaaaauuaa

SEQ ID NO: 1845050 - RNA, 11 nt, Human
uuaugacucca

SEQ ID NO: 1845051 - RNA, 22 nt, Human
uuaugugccagauuuaugcaua

SEQ ID NO: 1845052 - RNA, 15 nt, Human
uuaugugaaacaugu

SEQ ID NO: 1845053 - RNA, 13 nt, Human
uuaugugaaacau

SEQ ID NO: 1845054 - RNA, 19 nt, Human
uuauggcuuuugugcauua

SEQ ID NO: 1845055 - RNA, 13 nt, Human
uuaugggcugggu

SEQ ID NO: 1845056 - RNA, 22 nt, Human
uuaugggcuggguucuacccag

SEQ ID NO: 1845057 - RNA, 13 nt, Human
auacuaaccagca

SEQ ID NO: 1845058 - RNA, 19 nt, Human
auacuaaccagcagaaaug

SEQ ID NO: 1845059 - RNA, 20 nt, Human
auacuaaccagcagaaaugc

SEQ ID NO: 1845060 - RNA, 17 nt, Human
auaccacuuuuguucuu

SEQ ID NO: 1845061 - RNA, 18 nt, Human
auaccacuuuuguucuug

SEQ ID NO: 1845062 - RNA, 17 nt, Human
auaccagccaguaaaug

SEQ ID NO: 1845063 - RNA, 14 nt, Human
auaccuuuuuuaga

SEQ ID NO: 1845064 - RNA, 14 nt, Human
auacguacacauuu

SEQ ID NO: 1845065 - RNA, 15 nt, Human
auacguacacauuuu

SEQ ID NO: 1845066 - RNA, 16 nt, Human
auacguacacauuuua

SEQ ID NO: 1845067 - RNA, 13 nt, Human
auacgauaaauaa

SEQ ID NO: 1845068 - RNA, 13 nt, Human
auacguacacauu

SEQ ID NO: 1845069 - RNA, 21 nt, Human
auacaggaugaugacuaugga

SEQ ID NO: 1845070 - RNA, 18 nt, Human
auacaguuacucagaauu

SEQ ID NO: 1845071 - RNA, 23 nt, Human
auacagauagauauaugcucugc

SEQ ID NO: 1845072 - RNA, 23 nt, Human
auacaggaaaagcugcugacagu

SEQ ID NO: 1845073 - RNA, 20 nt, Human
auacaguuacucagaauucu

SEQ ID NO: 1845074 - RNA, 17 nt, Human
uuauaaacuuuaccuuu

SEQ ID NO: 1845075 - RNA, 18 nt, Human
uuauaaacuuuaccuuuu

SEQ ID NO: 1845076 - RNA, 16 nt, Human
uuauaaacuuuuuucu

SEQ ID NO: 1845077 - RNA, 12 nt, Human
uuauaaacuuuu

SEQ ID NO: 1845078 - RNA, 22 nt, Human
uuauaaacuuuuuucuuacugu

SEQ ID NO: 1845079 - RNA, 17 nt, Human
auacagaggcaacugca

SEQ ID NO: 1845080 - RNA, 16 nt, Human
auacagaggcaacugc

SEQ ID NO: 1845081 - RNA, 12 nt, Human
uuaacagaaaug

SEQ ID NO: 1845082 - RNA, 13 nt, Human
uuaacagaaaugu

SEQ ID NO: 1845083 - RNA, 14 nt, Human
uuaacagaaaugua

SEQ ID NO: 1845084 - RNA, 16 nt, Human
uuaacagaaauguaca

SEQ ID NO: 1845085 - RNA, 19 nt, Human
aguuucugccgcagcccug

SEQ ID NO: 1845086 - RNA, 22 nt, Human
aguuuguuaguaugaggcauuu

SEQ ID NO: 1845087 - RNA, 15 nt, Human
aguuuguugaaacac

SEQ ID NO: 1845088 - RNA, 15 nt, Human
aguuucugccgcagc

SEQ ID NO: 1845089 - RNA, 15 nt, Human
aguuucucagcuccc

SEQ ID NO: 1845090 - RNA, 13 nt, Human
aguuucucagcuc

SEQ ID NO: 1845091 - RNA, 14 nt, Human
aguuucucuuuuca

SEQ ID NO: 1845092 - RNA, 19 nt, Human
uuaaaaugagaaaucuaaa

SEQ ID NO: 1845093 - RNA, 12 nt, Human
uuaaaaugagaa

SEQ ID NO: 1845094 - RNA, 19 nt, Human
uuaaaaaucucaaauuucu

SEQ ID NO: 1845095 - RNA, 20 nt, Human
uuaaaaaucucaaauuucua

SEQ ID NO: 1845096 - RNA, 20 nt, Human
aguuuaaauuguaauaggcg

SEQ ID NO: 1845097 - RNA, 17 nt, Human
aguuuaaauuguaauag

SEQ ID NO: 1845098 - RNA, 15 nt, Human
aguuuuuuuuauaca

SEQ ID NO: 1845099 - RNA, 23 nt, Human
uuaacuuuuauaaacuuuaccuu

SEQ ID NO: 1845100 - RNA, 22 nt, Human
uuaacuuuuauaaacuuuaccu

SEQ ID NO: 1845101 - RNA, 22 nt, Human
auaaaagggacugagaaauuua

SEQ ID NO: 1845102 - RNA, 20 nt, Human
auaaaagccuguuuaagaga

SEQ ID NO: 1845103 - RNA, 19 nt, Human
auaaaagccuguuuaagag

SEQ ID NO: 1845104 - RNA, 18 nt, Human
uuaagacauuuuuggaag

SEQ ID NO: 1845105 - RNA, 23 nt, Human
uuaagacauuuuuggaaggggac

SEQ ID NO: 1845106 - RNA, 19 nt, Human
uuaagacgaaacauuuguu

SEQ ID NO: 1845107 - RNA, 19 nt, Human
uuaagaaaaaggaugcaca

SEQ ID NO: 1845108 - RNA, 17 nt, Human
uuaaucuuuaauuuuac

SEQ ID NO: 1845109 - RNA, 13 nt, Human
uuaaucuuuaauu

SEQ ID NO: 1845110 - RNA, 22 nt, Human
uuaagacgaaacauuuguucua

SEQ ID NO: 1845111 - RNA, 16 nt, Human
uuaauaaaaguacaug

SEQ ID NO: 1845112 - RNA, 15 nt, Human
uuaaucuaaauggaa

SEQ ID NO: 1845113 - RNA, 16 nt, Human
auaaauugcuccuuga

SEQ ID NO: 1845114 - RNA, 13 nt, Human
auaaauugcuccu

SEQ ID NO: 1845115 - RNA, 19 nt, Human
uuaccagcagagcaccuua

SEQ ID NO: 1845116 - RNA, 20 nt, Human
uuacagggaugagccaccgc

SEQ ID NO: 1845117 - RNA, 14 nt, Human
uuacaggugugaac

SEQ ID NO: 1845118 - RNA, 15 nt, Human
auaacuauguugaua

SEQ ID NO: 1845119 - RNA, 18 nt, Human
auaaauugcuccuugaca

SEQ ID NO: 1845120 - RNA, 16 nt, Human
uuagaagucacacagu

SEQ ID NO: 1845121 - RNA, 14 nt, Human
auaagauucauauu

SEQ ID NO: 1845122 - RNA, 18 nt, Human
auaacuuuuuuuuaaguu

SEQ ID NO: 1845123 - RNA, 13 nt, Human
uuacuguacauga

SEQ ID NO: 1845124 - RNA, 14 nt, Human
uuacuguacaugaa

SEQ ID NO: 1845125 - RNA, 22 nt, Human
uuacuguacaugaaaacacauu

SEQ ID NO: 1845126 - RNA, 23 nt, Human
uuacuguacaugaaaacacauuu

SEQ ID NO: 1845127 - RNA, 12 nt, Human
uuacuguacaug

SEQ ID NO: 1845128 - RNA, 23 nt, Human
uuacuguacagacagaaaaaacu

SEQ ID NO: 1845129 - RNA, 15 nt, Human
uuacugcagcuuugu

SEQ ID NO: 1845130 - RNA, 13 nt, Human
auaauuuuaaaug

SEQ ID NO: 1845131 - RNA, 12 nt, Human
auaauuuuaaau

SEQ ID NO: 1845132 - RNA, 14 nt, Human
auaauuuuaaaugu

SEQ ID NO: 1845133 - RNA, 20 nt, Human
auaauucaggaagcagcuuu

SEQ ID NO: 1845134 - RNA, 23 nt, Human
auaauucacauuguauucagagu

SEQ ID NO: 1845135 - RNA, 22 nt, Human
auaaucuggacuccucugucca

SEQ ID NO: 1845136 - RNA, 22 nt, Human
auaagccaaaaaaugcuugcuu

SEQ ID NO: 1845137 - RNA, 21 nt, Human
auaagauucauauuuacuucu

SEQ ID NO: 1845138 - RNA, 14 nt, Human
auaagccagacauc

SEQ ID NO: 1845139 - RNA, 18 nt, Human
uuagguuggcaaaaaggc

SEQ ID NO: 1845140 - RNA, 13 nt, Human
uuaguaaucauau

SEQ ID NO: 1845141 - RNA, 14 nt, Human
uuaguaaucauauu

SEQ ID NO: 1845142 - RNA, 15 nt, Human
uuaggugaggaagca

SEQ ID NO: 1845143 - RNA, 19 nt, Human
uuaggugugggggaagcac

SEQ ID NO: 1845144 - RNA, 22 nt, Human
uuauaaaaauaaaaaacacugg

SEQ ID NO: 1845145 - RNA, 21 nt, Human
uuauaaaaauaaaaaacacug

SEQ ID NO: 1845146 - RNA, 13 nt, Human
uuauaaacuuuac

SEQ ID NO: 1845147 - RNA, 15 nt, Human
uuauaaaaauaaaaa

SEQ ID NO: 1845148 - RNA, 21 nt, Human
uuaguuuuugugaaguuuaau

SEQ ID NO: 1845149 - RNA, 18 nt, Human
uuaguuuuugugaaguuu

SEQ ID NO: 1845150 - RNA, 14 nt, Human
uuaguagagacagg

SEQ ID NO: 1845151 - RNA, 19 nt, Human
uuaguacuccccuccuuga

SEQ ID NO: 1845152 - RNA, 13 nt, Human
uuaguagagacag

SEQ ID NO: 1845153 - RNA, 17 nt, Human
aucugugaaaggaaaga

SEQ ID NO: 1845154 - RNA, 17 nt, Human
aucuggugacuuuccuc

SEQ ID NO: 1845155 - RNA, 16 nt, Human
aucuggugacuuuccu

SEQ ID NO: 1845156 - RNA, 10 nt, Human
aucuggugac

SEQ ID NO: 1845157 - RNA, 20 nt, Human
aucugcuagggaauaucaau

SEQ ID NO: 1845158 - RNA, 18 nt, Human
aucugugaaaggaaagag

SEQ ID NO: 1845159 - RNA, 23 nt, Human
aucugugaaaggaaagagggagg

SEQ ID NO: 1845160 - RNA, 20 nt, Human
aucuuggucagauuugaacu

SEQ ID NO: 1845161 - RNA, 13 nt, Human
aucuugcucugcu

SEQ ID NO: 1845162 - RNA, 14 nt, Human
aucuuauaauuuaa

SEQ ID NO: 1845163 - RNA, 12 nt, Human
uugcuccuugac

SEQ ID NO: 1845164 - RNA, 22 nt, Human
aucuuuucauuuaggugaggaa

SEQ ID NO: 1845165 - RNA, 17 nt, Human
aucuuugcagacaggca

SEQ ID NO: 1845166 - RNA, 18 nt, Human
augaaagggcccagagag

SEQ ID NO: 1845167 - RNA, 11 nt, Human
uuggagacaga

SEQ ID NO: 1845168 - RNA, 14 nt, Human
uugcuugaaagaaa

SEQ ID NO: 1845169 - RNA, 16 nt, Human
uuggagggugucccaa

SEQ ID NO: 1845170 - RNA, 18 nt, Human
uuggccccugcccggcug

SEQ ID NO: 1845171 - RNA, 23 nt, Human
augaauggcuaagcaaaauguga

SEQ ID NO: 1845172 - RNA, 21 nt, Human
augaauauuuaguguucauaa

SEQ ID NO: 1845173 - RNA, 18 nt, Human
uuggggaccagagcugcc

SEQ ID NO: 1845174 - RNA, 11 nt, Human
augaagaggag

SEQ ID NO: 1845175 - RNA, 16 nt, Human
augaauauuuaguguu

SEQ ID NO: 1845176 - RNA, 18 nt, Human
augaacuuguaaaggaau

SEQ ID NO: 1845177 - RNA, 19 nt, Human
augaaagggcccagagagg

SEQ ID NO: 1845178 - RNA, 12 nt, Human
uugagacagagu

SEQ ID NO: 1845179 - RNA, 16 nt, Human
uugagaucagccuggg

SEQ ID NO: 1845180 - RNA, 15 nt, Human
uugagaucagccugg

SEQ ID NO: 1845181 - RNA, 16 nt, Human
uugagauguguucaca

SEQ ID NO: 1845182 - RNA, 20 nt, Human
uugagugaagcugggagaac

SEQ ID NO: 1845183 - RNA, 20 nt, Human
uugaguugauucagcucugc

SEQ ID NO: 1845184 - RNA, 15 nt, Human
uugauacuacaguuu

SEQ ID NO: 1845185 - RNA, 18 nt, Human
aucuaauauguaacaagc

SEQ ID NO: 1845186 - RNA, 19 nt, Human
aucuacacuccagugagac

SEQ ID NO: 1845187 - RNA, 18 nt, Human
aucuacacuccagugaga

SEQ ID NO: 1845188 - RNA, 20 nt, Human
aucuaauauguaacaagcca

SEQ ID NO: 1845189 - RNA, 17 nt, Human
aucuaaauggaaccacu

SEQ ID NO: 1845190 - RNA, 18 nt, Human
aucuaaauggaaccacuc

SEQ ID NO: 1845191 - RNA, 13 nt, Human
aucuaaauggaac

SEQ ID NO: 1845192 - RNA, 14 nt, Human
aucguucucugccu

SEQ ID NO: 1845193 - RNA, 17 nt, Human
auccucuguacagagcc

SEQ ID NO: 1845194 - RNA, 16 nt, Human
auccucuguacagagc

SEQ ID NO: 1845195 - RNA, 13 nt, Human
uugaaucacagua

SEQ ID NO: 1845196 - RNA, 13 nt, Human
uugaagccuuugu

SEQ ID NO: 1845197 - RNA, 17 nt, Human
uugaagggaaauuucag

SEQ ID NO: 1845198 - RNA, 23 nt, Human
aucugaaaauguauguguaagua

SEQ ID NO: 1845199 - RNA, 13 nt, Human
uugauuaaauucu

SEQ ID NO: 1845200 - RNA, 23 nt, Human
uugauguuuuaaggaugcuugua

SEQ ID NO: 1845201 - RNA, 14 nt, Human
uugauuaaauucuu

SEQ ID NO: 1845202 - RNA, 18 nt, Human
uugcaccacugcacucca

SEQ ID NO: 1845203 - RNA, 16 nt, Human
uugcaccacugcacuc

SEQ ID NO: 1845204 - RNA, 15 nt, Human
uugcaccacugcacu

SEQ ID NO: 1845205 - RNA, 14 nt, Human
uugcaccacugcac

SEQ ID NO: 1845206 - RNA, 16 nt, Human
uugcaauggcagccuu

SEQ ID NO: 1845207 - RNA, 17 nt, Human
uugcaauggcagccuug

SEQ ID NO: 1845208 - RNA, 19 nt, Human
uugcaauggcagccuuggc

SEQ ID NO: 1845209 - RNA, 16 nt, Human
aucucagggccugguc

SEQ ID NO: 1845210 - RNA, 17 nt, Human
aucuccaaaauaaaacu

SEQ ID NO: 1845211 - RNA, 20 nt, Human
aucuccaaaauaaaacuuuu

SEQ ID NO: 1845212 - RNA, 21 nt, Human
aucuccaaaauaaaacuuuuu

SEQ ID NO: 1845213 - RNA, 14 nt, Human
aucuccaaaauaaa

SEQ ID NO: 1845214 - RNA, 15 nt, Human
aucucuugagccugg

SEQ ID NO: 1845215 - RNA, 14 nt, Human
aucugaaaauguau

SEQ ID NO: 1845216 - RNA, 18 nt, Human
aucucuugagccugggag

SEQ ID NO: 1845217 - RNA, 22 nt, Human
aucugaaaauguauguguaagu

SEQ ID NO: 1845218 - RNA, 20 nt, Human
aucugaaaauguauguguaa

SEQ ID NO: 1845219 - RNA, 19 nt, Human
aucugaaaauguaugugua

SEQ ID NO: 1845220 - RNA, 16 nt, Human
aucugaaaauguaugu

SEQ ID NO: 1845221 - RNA, 21 nt, Human
aucucuucuggguuccuuccu

SEQ ID NO: 1845222 - RNA, 21 nt, Human
aucucccccagccccauccuc

SEQ ID NO: 1845223 - RNA, 17 nt, Human
aucucccccagccccau

SEQ ID NO: 1845224 - RNA, 16 nt, Human
aucucccccagcccca

SEQ ID NO: 1845225 - RNA, 15 nt, Human
aucucccccagcccc

SEQ ID NO: 1845226 - RNA, 23 nt, Human
uucuaagaagugaaaaucuacac

SEQ ID NO: 1845227 - RNA, 13 nt, Human
uucuaagaaguga

SEQ ID NO: 1845228 - RNA, 16 nt, Human
uucuagcauggcugcc

SEQ ID NO: 1845229 - RNA, 15 nt, Human
uucggccuccauccu

SEQ ID NO: 1845230 - RNA, 19 nt, Human
uucuaaaggcuaccuuugu

SEQ ID NO: 1845231 - RNA, 20 nt, Human
uucuaaaggcuaccuuugua

SEQ ID NO: 1845232 - RNA, 21 nt, Human
uucuaaaggcuaccuuuguau

SEQ ID NO: 1845233 - RNA, 21 nt, Human
uucuaaaucuccaaaauaaaa

SEQ ID NO: 1845234 - RNA, 13 nt, Human
uucuaaaguaaaa

SEQ ID NO: 1845235 - RNA, 15 nt, Human
uucgcuccugugucu

SEQ ID NO: 1845236 - RNA, 19 nt, Human
uucgcuccugugucuugca

SEQ ID NO: 1845237 - RNA, 14 nt, Human
uucggccuccaucc

SEQ ID NO: 1845238 - RNA, 11 nt, Human
aucagaauucu

SEQ ID NO: 1845239 - RNA, 18 nt, Human
aucagaaguuucucagcu

SEQ ID NO: 1845240 - RNA, 18 nt, Human
uucucacuccuaccuggu

SEQ ID NO: 1845241 - RNA, 16 nt, Human
uucucacuccuaccug

SEQ ID NO: 1845242 - RNA, 18 nt, Human
aucaggccaggcccucug

SEQ ID NO: 1845243 - RNA, 16 nt, Human
aucaggccaggcccuc

SEQ ID NO: 1845244 - RNA, 15 nt, Human
aucaggccaggcccu

SEQ ID NO: 1845245 - RNA, 13 nt, Human
aucagcacgauuu

SEQ ID NO: 1845246 - RNA, 12 nt, Human
aucagaauucuc

SEQ ID NO: 1845247 - RNA, 20 nt, Human
aucaggccaggcccucugcc

SEQ ID NO: 1845248 - RNA, 18 nt, Human
aucacggcucacugcagc

SEQ ID NO: 1845249 - RNA, 19 nt, Human
aucacggcucacugcagcc

SEQ ID NO: 1845250 - RNA, 13 nt, Human
aucacgccacugc

SEQ ID NO: 1845251 - RNA, 14 nt, Human
aucacgccacugca

SEQ ID NO: 1845252 - RNA, 15 nt, Human
aucacggcucacugc

SEQ ID NO: 1845253 - RNA, 14 nt, Human
aucaaugaguaaca

SEQ ID NO: 1845254 - RNA, 20 nt, Human
auauuuuuuguuaaaugauu

SEQ ID NO: 1845255 - RNA, 18 nt, Human
auauuuuuuguuaaauga

SEQ ID NO: 1845256 - RNA, 14 nt, Human
aucaacagauaaau

SEQ ID NO: 1845257 - RNA, 11 nt, Human
uuccugugucu

SEQ ID NO: 1845258 - RNA, 22 nt, Human
uuccucuuuccaucuacccucc

SEQ ID NO: 1845259 - RNA, 17 nt, Human
uuccucuuuccaucuac

SEQ ID NO: 1845260 - RNA, 13 nt, Human
uuccucuuuccau

SEQ ID NO: 1845261 - RNA, 18 nt, Human
uuccugaagaauugaaaa

SEQ ID NO: 1845262 - RNA, 14 nt, Human
uuccugaaccgaug

SEQ ID NO: 1845263 - RNA, 21 nt, Human
uuccucugaggcugaaauuca

SEQ ID NO: 1845264 - RNA, 17 nt, Human
uuccucugagccuuggg

SEQ ID NO: 1845265 - RNA, 14 nt, Human
uuccucugagccuu

SEQ ID NO: 1845266 - RNA, 18 nt, Human
uuccuaauuccacagcug

SEQ ID NO: 1845267 - RNA, 17 nt, Human
uuccuaauuccacagcu

SEQ ID NO: 1845268 - RNA, 16 nt, Human
uuccuaauuccacagc

SEQ ID NO: 1845269 - RNA, 20 nt, Human
uuccuaaauauauuuuaaga

SEQ ID NO: 1845270 - RNA, 17 nt, Human
uuccuaauccucuagga

SEQ ID NO: 1845271 - RNA, 22 nt, Human
uucccgcucagcccucccugcc

SEQ ID NO: 1845272 - RNA, 21 nt, Human
uucccgcucagcccucccugc

SEQ ID NO: 1845273 - RNA, 18 nt, Human
uucccgcucagcccuccc

SEQ ID NO: 1845274 - RNA, 16 nt, Human
uucccgcucagcccuc

SEQ ID NO: 1845275 - RNA, 20 nt, Human
uucccucaccuuucccaucu

SEQ ID NO: 1845276 - RNA, 15 nt, Human
uucccuauuagagaa

SEQ ID NO: 1845277 - RNA, 23 nt, Human
uucccguggaacguuuuuccugu

SEQ ID NO: 1845278 - RNA, 14 nt, Human
uuccguuaaaauac

SEQ ID NO: 1845279 - RNA, 16 nt, Human
uuccguuaaaauacca

SEQ ID NO: 1845280 - RNA, 19 nt, Human
uuccguagguuauuuucag

SEQ ID NO: 1845281 - RNA, 14 nt, Human
uucuuuuuuuguga

SEQ ID NO: 1845282 - RNA, 16 nt, Human
uucuuuguaaugaaaa

SEQ ID NO: 1845283 - RNA, 15 nt, Human
uucuuuguaaugaaa

SEQ ID NO: 1845284 - RNA, 17 nt, Human
uucuucuuuuugcuuca

SEQ ID NO: 1845285 - RNA, 21 nt, Human
uucuucuuuuugcuucaaaaa

SEQ ID NO: 1845286 - RNA, 20 nt, Human
uucuucugcuucagccuccc

SEQ ID NO: 1845287 - RNA, 13 nt, Human
uucuucucccuca

SEQ ID NO: 1845288 - RNA, 21 nt, Human
uucuuaagacgugauuuugcu

SEQ ID NO: 1845289 - RNA, 23 nt, Human
uucuuaagacgugauuuugcugu

SEQ ID NO: 1845290 - RNA, 14 nt, Human
uucuucucccucag

SEQ ID NO: 1845291 - RNA, 13 nt, Human
uucuucugcuuca

SEQ ID NO: 1845292 - RNA, 15 nt, Human
uucuucugcuucagc

SEQ ID NO: 1845293 - RNA, 24 nt, Human
aucccauaugccugggcagaagga

SEQ ID NO: 1845294 - RNA, 14 nt, Human
aucccucauccuca

SEQ ID NO: 1845295 - RNA, 13 nt, Human
aucccaugagccu

SEQ ID NO: 1845296 - RNA, 23 nt, Human
aucccucauccucauacccaccc

SEQ ID NO: 1845297 - RNA, 21 nt, Human
aucccucauccucauacccac

SEQ ID NO: 1845298 - RNA, 13 nt, Human
aucccucauccuc

SEQ ID NO: 1845299 - RNA, 16 nt, Human
auccuaggcauuugcu

SEQ ID NO: 1845300 - RNA, 16 nt, Human
auccuccucagaucuu

SEQ ID NO: 1845301 - RNA, 12 nt, Human
auccuaagcuau

SEQ ID NO: 1845302 - RNA, 19 nt, Human
auccuacaagacacaguga

SEQ ID NO: 1845303 - RNA, 18 nt, Human
auccuacaagacacagug

SEQ ID NO: 1845304 - RNA, 21 nt, Human
auccuaagcuauucaguaaua

SEQ ID NO: 1845305 - RNA, 19 nt, Human
uugaacccgggaggcagag

SEQ ID NO: 1845306 - RNA, 17 nt, Human
uugaaauuguauuacaa

SEQ ID NO: 1845307 - RNA, 22 nt, Human
uucugaacuuggcgcugccccu

SEQ ID NO: 1845308 - RNA, 19 nt, Human
uucugaacuuggcgcugcc

SEQ ID NO: 1845309 - RNA, 23 nt, Human
uucugaacuuggcgcugccccug

SEQ ID NO: 1845310 - RNA, 15 nt, Human
uucugccauauucug

SEQ ID NO: 1845311 - RNA, 21 nt, Human
uucugccugcccaggccccug

SEQ ID NO: 1845312 - RNA, 17 nt, Human
uucugccugcccaggcc

SEQ ID NO: 1845313 - RNA, 18 nt, Human
uucugccugcccaggccc

SEQ ID NO: 1845314 - RNA, 17 nt, Human
uucuggcucuuccaggc

SEQ ID NO: 1845315 - RNA, 16 nt, Human
uucuggcucuuccagg

SEQ ID NO: 1845316 - RNA, 17 nt, Human
uucuccuuucacaaccu

SEQ ID NO: 1845317 - RNA, 15 nt, Human
uucucuaguuugauu

SEQ ID NO: 1845318 - RNA, 17 nt, Human
uucucuaguuugauuaa

SEQ ID NO: 1845319 - RNA, 20 nt, Human
uucucuaguuugauuaaauu

SEQ ID NO: 1845320 - RNA, 21 nt, Human
uucuccuuguguuacuaaguu

SEQ ID NO: 1845321 - RNA, 18 nt, Human
aucaguagccagcaucug

SEQ ID NO: 1845322 - RNA, 14 nt, Human
aucaggugcugcca

SEQ ID NO: 1845323 - RNA, 20 nt, Human
aucccaaacccuucagugcc

SEQ ID NO: 1845324 - RNA, 19 nt, Human
aucccaaacccuucagugc

SEQ ID NO: 1845325 - RNA, 18 nt, Human
aucccauaugccugggca

SEQ ID NO: 1845326 - RNA, 21 nt, Human
auccaguaucuugaagacuuu

SEQ ID NO: 1845327 - RNA, 13 nt, Human
auccaucaggcca

SEQ ID NO: 1845328 - RNA, 20 nt, Human
aucauuuuaccuuugacaaa

SEQ ID NO: 1845329 - RNA, 18 nt, Human
auccaagcaaaugugaau

SEQ ID NO: 1845330 - RNA, 18 nt, Human
auccaagcuggucccacu

SEQ ID NO: 1845331 - RNA, 21 nt, Human
auccaagcuggucccacucag

SEQ ID NO: 1845332 - RNA, 13 nt, Human
auccacccaccuc

SEQ ID NO: 1845333 - RNA, 15 nt, Human
auccacccaccucag

SEQ ID NO: 1845334 - RNA, 16 nt, Human
auccaguaucuugaag

SEQ ID NO: 1845335 - RNA, 16 nt, Human
auccacccaccucagc

SEQ ID NO: 1845336 - RNA, 18 nt, Human
auggagacugucucaaga

SEQ ID NO: 1845337 - RNA, 19 nt, Human
auggcuaagcaaaauguga

SEQ ID NO: 1845338 - RNA, 18 nt, Human
auggcuaauguacugcau

SEQ ID NO: 1845339 - RNA, 15 nt, Human
augggagagaagaga

SEQ ID NO: 1845340 - RNA, 19 nt, Human
augggagagaagagaaugc

SEQ ID NO: 1845341 - RNA, 12 nt, Human
auggacuuuguu

SEQ ID NO: 1845342 - RNA, 11 nt, Human
auggacuuugu

SEQ ID NO: 1845343 - RNA, 19 nt, Human
auggacuaacuugucuuug

SEQ ID NO: 1845344 - RNA, 18 nt, Human
uuuccaugaguccccugu

SEQ ID NO: 1845345 - RNA, 17 nt, Human
uuuccaugaguccccug

SEQ ID NO: 1845346 - RNA, 13 nt, Human
augcuucucacug

SEQ ID NO: 1845347 - RNA, 22 nt, Human
augcugugcccuaaaguguauu

SEQ ID NO: 1845348 - RNA, 13 nt, Human
augcugcuuuuuc

SEQ ID NO: 1845349 - RNA, 22 nt, Human
uuucaaaauuguuacaaauugu

SEQ ID NO: 1845350 - RNA, 16 nt, Human
uuucaaacuuuacuau

SEQ ID NO: 1845351 - RNA, 22 nt, Human
uuucaaacuuuacuauggcccu

SEQ ID NO: 1845352 - RNA, 20 nt, Human
uuuauuuuguguuuaggaac

SEQ ID NO: 1845353 - RNA, 16 nt, Human
uuuauuuuguguuuag

SEQ ID NO: 1845354 - RNA, 16 nt, Human
augcuaagacucagug

SEQ ID NO: 1845355 - RNA, 18 nt, Human
uuuaucaugugaaaucau

SEQ ID NO: 1845356 - RNA, 17 nt, Human
uuuaucaugugaaauca

SEQ ID NO: 1845357 - RNA, 20 nt, Human
augcuagaacucccuuucaa

SEQ ID NO: 1845358 - RNA, 21 nt, Human
augcuagaacucccuuucaac

SEQ ID NO: 1845359 - RNA, 22 nt, Human
augcuagaacucccuuucaaca

SEQ ID NO: 1845360 - RNA, 20 nt, Human
augcacuuuguucuggcucu

SEQ ID NO: 1845361 - RNA, 19 nt, Human
augcacuuuguucuggcuc

SEQ ID NO: 1845362 - RNA, 17 nt, Human
augcacuuuguucuggc

SEQ ID NO: 1845363 - RNA, 13 nt, Human
augcaccuggaau

SEQ ID NO: 1845364 - RNA, 22 nt, Human
augcaccagcccuuagcaggga

SEQ ID NO: 1845365 - RNA, 13 nt, Human
uuuaaagaaugcu

SEQ ID NO: 1845366 - RNA, 20 nt, Human
augaucuaggaagacuuugg

SEQ ID NO: 1845367 - RNA, 17 nt, Human
augaucuaggaagacuu

SEQ ID NO: 1845368 - RNA, 17 nt, Human
augauacuugaaaauua

SEQ ID NO: 1845369 - RNA, 21 nt, Human
augauacuugaaaauuaacau

SEQ ID NO: 1845370 - RNA, 13 nt, Human
uuguguuacuaag

SEQ ID NO: 1845371 - RNA, 15 nt, Human
uuguguuacuaaguu

SEQ ID NO: 1845372 - RNA, 20 nt, Human
uuguguuacuaaguuuuuau

SEQ ID NO: 1845373 - RNA, 21 nt, Human
uuguuccacaaguuaaauaaa

SEQ ID NO: 1845374 - RNA, 13 nt, Human
uuguguucaccuu

SEQ ID NO: 1845375 - RNA, 16 nt, Human
augcgggccagugcuc

SEQ ID NO: 1845376 - RNA, 21 nt, Human
augcgggccagugcuccagcc

SEQ ID NO: 1845377 - RNA, 14 nt, Human
augcccagccccuu

SEQ ID NO: 1845378 - RNA, 13 nt, Human
augcccagccccu

SEQ ID NO: 1845379 - RNA, 12 nt, Human
augcccagcccc

SEQ ID NO: 1845380 - RNA, 14 nt, Human
augcccuggaucca

SEQ ID NO: 1845381 - RNA, 16 nt, Human
augccucagccuccug

SEQ ID NO: 1845382 - RNA, 13 nt, Human
augcagugcuucc

SEQ ID NO: 1845383 - RNA, 23 nt, Human
augcagugguaugaucacggcuc

SEQ ID NO: 1845384 - RNA, 11 nt, Human
augcccagccc

SEQ ID NO: 1845385 - RNA, 18 nt, Human
augcagccucacaguccu

SEQ ID NO: 1845386 - RNA, 17 nt, Human
augcagcaucuaaguaa

SEQ ID NO: 1845387 - RNA, 19 nt, Human
uuuaauuuuuuugagacag

SEQ ID NO: 1845388 - RNA, 12 nt, Human
uuuaauucaguu

SEQ ID NO: 1845389 - RNA, 18 nt, Human
uuuaaauauaugcuaagu

SEQ ID NO: 1845390 - RNA, 19 nt, Human
augugaugagaggaaauca

SEQ ID NO: 1845391 - RNA, 17 nt, Human
augugaugagaggaaau

SEQ ID NO: 1845392 - RNA, 16 nt, Human
augugaugagaggaaa

SEQ ID NO: 1845393 - RNA, 23 nt, Human
augucucuuuaaugucacaggca

SEQ ID NO: 1845394 - RNA, 23 nt, Human
augugcacaugcacgugugugca

SEQ ID NO: 1845395 - RNA, 12 nt, Human
uuuguauaaaag

SEQ ID NO: 1845396 - RNA, 14 nt, Human
uuuguaaugaaaac

SEQ ID NO: 1845397 - RNA, 13 nt, Human
uuuguaaugaaaa

SEQ ID NO: 1845398 - RNA, 22 nt, Human
uuugugaaaugauggugaaagu

SEQ ID NO: 1845399 - RNA, 21 nt, Human
uuugucuuguguuucuuuagu

SEQ ID NO: 1845400 - RNA, 19 nt, Human
uuugucuuuggugaacauu

SEQ ID NO: 1845401 - RNA, 20 nt, Human
uuugugaagguggaaauaaa

SEQ ID NO: 1845402 - RNA, 15 nt, Human
augucgccucugcau

SEQ ID NO: 1845403 - RNA, 22 nt, Human
augucucaggucccugcagggc

SEQ ID NO: 1845404 - RNA, 17 nt, Human
augucucaggucccugc

SEQ ID NO: 1845405 - RNA, 14 nt, Human
augucgccucugca

SEQ ID NO: 1845406 - RNA, 13 nt, Human
augucgccucugc

SEQ ID NO: 1845407 - RNA, 15 nt, Human
augucucgugguagg

SEQ ID NO: 1845408 - RNA, 16 nt, Human
augucucgugguagga

SEQ ID NO: 1845409 - RNA, 17 nt, Human
augucucugagcauuag

SEQ ID NO: 1845410 - RNA, 19 nt, Human
augucucgugguaggacug

SEQ ID NO: 1845411 - RNA, 17 nt, Human
auguccacugguucuuc

SEQ ID NO: 1845412 - RNA, 13 nt, Human
augucagugugac

SEQ ID NO: 1845413 - RNA, 12 nt, Human
augucaguguga

SEQ ID NO: 1845414 - RNA, 16 nt, Human
auguauguguaaguau

SEQ ID NO: 1845415 - RNA, 15 nt, Human
auguauguguaagua

SEQ ID NO: 1845416 - RNA, 18 nt, Human
auguaugagguacaaccu

SEQ ID NO: 1845417 - RNA, 19 nt, Human
auguaugaggaauuucugu

SEQ ID NO: 1845418 - RNA, 22 nt, Human
uuugauguucuuucacccuuuu

SEQ ID NO: 1845419 - RNA, 13 nt, Human
uuugauuaaauuc

SEQ ID NO: 1845420 - RNA, 18 nt, Human
uuugauuaaauucuugca

SEQ ID NO: 1845421 - RNA, 21 nt, Human
uuugauuaaauucuugcaaag

SEQ ID NO: 1845422 - RNA, 21 nt, Human
uuugauucagacagcugccug

SEQ ID NO: 1845423 - RNA, 23 nt, Human
uuugauuaaauucuugcaaagua

SEQ ID NO: 1845424 - RNA, 19 nt, Human
uuugacgccaucccagccc

SEQ ID NO: 1845425 - RNA, 16 nt, Human
uuugacgccaucccag

SEQ ID NO: 1845426 - RNA, 14 nt, Human
uuugacgccauccc

SEQ ID NO: 1845427 - RNA, 13 nt, Human
uuugacgccaucc

SEQ ID NO: 1845428 - RNA, 20 nt, Human
uuugacgccaucccagcccc

SEQ ID NO: 1845429 - RNA, 13 nt, Human
uuugccucugccu

SEQ ID NO: 1845430 - RNA, 22 nt, Human
uuugauucagacagcugccugg

SEQ ID NO: 1845431 - RNA, 15 nt, Human
uuugccguuauuaaa

SEQ ID NO: 1845432 - RNA, 12 nt, Human
uuugaccucugc

SEQ ID NO: 1845433 - RNA, 19 nt, Human
auguagccccucuccugga

SEQ ID NO: 1845434 - RNA, 17 nt, Human
auguagaggagaaacug

SEQ ID NO: 1845435 - RNA, 19 nt, Human
auguagaggagaaacugga

SEQ ID NO: 1845436 - RNA, 12 nt, Human
auguagaggaga

SEQ ID NO: 1845437 - RNA, 13 nt, Human
auguagaggagaa

SEQ ID NO: 1845438 - RNA, 15 nt, Human
augguuuucaaaaua

SEQ ID NO: 1845439 - RNA, 14 nt, Human
augguuuucaaaau

SEQ ID NO: 1845440 - RNA, 14 nt, Human
augguuuucuugug

SEQ ID NO: 1845441 - RNA, 16 nt, Human
augguuuucaaaauaa

SEQ ID NO: 1845442 - RNA, 20 nt, Human
augguuccccuguucacucu

SEQ ID NO: 1845443 - RNA, 19 nt, Human
augguuccccuguucacuc

SEQ ID NO: 1845444 - RNA, 13 nt, Human
augguuguacaua

SEQ ID NO: 1845445 - RNA, 17 nt, Human
auguaaaagacuuuuuu

SEQ ID NO: 1845446 - RNA, 17 nt, Human
auggugcaaugaccuuu

SEQ ID NO: 1845447 - RNA, 16 nt, Human
auggugcaaugaccuu

SEQ ID NO: 1845448 - RNA, 19 nt, Human
auggugcaaugaccuuuca

SEQ ID NO: 1845449 - RNA, 15 nt, Human
auggugcaaugaccu

SEQ ID NO: 1845450 - RNA, 13 nt, Human
auggugcaaugac

SEQ ID NO: 1845451 - RNA, 12 nt, Human
auggugcaauga

SEQ ID NO: 1845452 - RNA, 20 nt, Human
auggugagggauacccaucc

SEQ ID NO: 1845453 - RNA, 15 nt, Human
augggugcuuggagg

SEQ ID NO: 1845454 - RNA, 14 nt, Human
auggugaugaaaug

SEQ ID NO: 1845455 - RNA, 17 nt, Human
auggugaugaaauguaa

SEQ ID NO: 1845456 - RNA, 16 nt, Human
auggugaugaaaugua

SEQ ID NO: 1845457 - RNA, 12 nt, Human
augguggcuggg

SEQ ID NO: 1845458 - RNA, 13 nt, Human
augguggcugggu

SEQ ID NO: 1845459 - RNA, 15 nt, Human
augguggcuggguug

SEQ ID NO: 1845460 - RNA, 17 nt, Human
augguggcuggguugga

SEQ ID NO: 1845461 - RNA, 21 nt, Human
uuucugcagccacuauuguua

SEQ ID NO: 1845462 - RNA, 23 nt, Human
uuucugggcaccggggccucgga

SEQ ID NO: 1845463 - RNA, 14 nt, Human
uuucugcagaaaca

SEQ ID NO: 1845464 - RNA, 19 nt, Human
uuucugcagccacuauugu

SEQ ID NO: 1845465 - RNA, 15 nt, Human
uuucuggcuaugcau

SEQ ID NO: 1845466 - RNA, 16 nt, Human
uuucuggcuaugcauu

SEQ ID NO: 1845467 - RNA, 18 nt, Human
uuucuggcuaugcauuug

SEQ ID NO: 1845468 - RNA, 19 nt, Human
uuucuggcuaugcauuuga

SEQ ID NO: 1845469 - RNA, 18 nt, Human
augggcaacccccagccu

SEQ ID NO: 1845470 - RNA, 15 nt, Human
augggauccuggagu

SEQ ID NO: 1845471 - RNA, 15 nt, Human
augggggugcauuug

SEQ ID NO: 1845472 - RNA, 12 nt, Human
auggggcugcac

SEQ ID NO: 1845473 - RNA, 24 nt, Human
auggggcugcaccggcuggccugg

SEQ ID NO: 1845474 - RNA, 14 nt, Human
augggggugcauuu

SEQ ID NO: 1845475 - RNA, 17 nt, Human
augggggcacugaggac

SEQ ID NO: 1845476 - RNA, 18 nt, Human
augggccuccugugugug

SEQ ID NO: 1845477 - RNA, 20 nt, Human
augggcuggguucuacccag

SEQ ID NO: 1845478 - RNA, 14 nt, Human
auucuuaaauaugu

SEQ ID NO: 1845479 - RNA, 13 nt, Human
auucuuccucccu

SEQ ID NO: 1845480 - RNA, 18 nt, Human
auugaaaucuuuuugcuu

SEQ ID NO: 1845481 - RNA, 17 nt, Human
auugaaaucuuuuugcu

SEQ ID NO: 1845482 - RNA, 20 nt, Human
auugaaaucuuuuugcuuug

SEQ ID NO: 1845483 - RNA, 15 nt, Human
auugaaaaaccauuu

SEQ ID NO: 1845484 - RNA, 19 nt, Human
auugacacuuaaaaauggu

SEQ ID NO: 1845485 - RNA, 17 nt, Human
auugaccugaggcccuu

SEQ ID NO: 1845486 - RNA, 11 nt, Human
auugacuucuu

SEQ ID NO: 1845487 - RNA, 15 nt, Human
auugacacuuaaaaa

SEQ ID NO: 1845488 - RNA, 17 nt, Human
auugacacuuaaaaaug

SEQ ID NO: 1845489 - RNA, 11 nt, Human
auucugccugc

SEQ ID NO: 1845490 - RNA, 13 nt, Human
auucugccugccc

SEQ ID NO: 1845491 - RNA, 14 nt, Human
auucugccugccca

SEQ ID NO: 1845492 - RNA, 15 nt, Human
auucugccugcccag

SEQ ID NO: 1845493 - RNA, 16 nt, Human
auucugccugcccagg

SEQ ID NO: 1845494 - RNA, 17 nt, Human
auucugccugcccaggc

SEQ ID NO: 1845495 - RNA, 18 nt, Human
auucugccugcccaggcc

SEQ ID NO: 1845496 - RNA, 19 nt, Human
auucugccugcccaggccc

SEQ ID NO: 1845497 - RNA, 22 nt, Human
auucucaugccucagccuccug

SEQ ID NO: 1845498 - RNA, 17 nt, Human
auucucauuugucacac

SEQ ID NO: 1845499 - RNA, 15 nt, Human
auucuagcuuugagc

SEQ ID NO: 1845500 - RNA, 21 nt, Human
auucucaugccucagccuccu

SEQ ID NO: 1845501 - RNA, 18 nt, Human
auucugcucacauaucug

SEQ ID NO: 1845502 - RNA, 20 nt, Human
auucugccugcccaggcccc

SEQ ID NO: 1845503 - RNA, 21 nt, Human
auucugccugcccaggccccu

SEQ ID NO: 1845504 - RNA, 19 nt, Human
auucugcucacauaucugu

SEQ ID NO: 1845505 - RNA, 20 nt, Human
auucugcucacauaucuguc

SEQ ID NO: 1845506 - RNA, 21 nt, Human
auucugcucacauaucuguca

SEQ ID NO: 1845507 - RNA, 22 nt, Human
auucugcucacauaucugucau

SEQ ID NO: 1845508 - RNA, 19 nt, Human
auucuguuggccaguguga

SEQ ID NO: 1845509 - RNA, 21 nt, Human
auucuguuggccagugugaca

SEQ ID NO: 1845510 - RNA, 14 nt, Human
auucuguuggccag

SEQ ID NO: 1845511 - RNA, 13 nt, Human
auucaggaagcuc

SEQ ID NO: 1845512 - RNA, 19 nt, Human
auuccagagaguggcuccu

SEQ ID NO: 1845513 - RNA, 21 nt, Human
auuccagagaguggcuccucc

SEQ ID NO: 1845514 - RNA, 19 nt, Human
auuccagagcguguaguga

SEQ ID NO: 1845515 - RNA, 23 nt, Human
auuccccgucucugguuccuccc

SEQ ID NO: 1845516 - RNA, 17 nt, Human
auucagacagcugccug

SEQ ID NO: 1845517 - RNA, 16 nt, Human
auucagacagcugccu

SEQ ID NO: 1845518 - RNA, 15 nt, Human
auucagacagcugcc

SEQ ID NO: 1845519 - RNA, 14 nt, Human
auucagacagcugc

SEQ ID NO: 1845520 - RNA, 12 nt, Human
auucaggaagcu

SEQ ID NO: 1845521 - RNA, 22 nt, Human
auucaggaagcagcuuucccca

SEQ ID NO: 1845522 - RNA, 18 nt, Human
auucagacagcugccugg

SEQ ID NO: 1845523 - RNA, 20 nt, Human
auucacauuguauucagagu

SEQ ID NO: 1845524 - RNA, 13 nt, Human
auucacauuguau

SEQ ID NO: 1845525 - RNA, 13 nt, Human
auucagacagcug

SEQ ID NO: 1845526 - RNA, 12 nt, Human
auucagacagcu

SEQ ID NO: 1845527 - RNA, 11 nt, Human
auucagacagc

SEQ ID NO: 1845528 - RNA, 19 nt, Human
auuaucuaaaaucugcuag

SEQ ID NO: 1845529 - RNA, 14 nt, Human
auuaucuagauacu

SEQ ID NO: 1845530 - RNA, 18 nt, Human
auuaucuagauacuguau

SEQ ID NO: 1845531 - RNA, 15 nt, Human
auuauuauuuggccc

SEQ ID NO: 1845532 - RNA, 19 nt, Human
auucagacagcugccuggg

SEQ ID NO: 1845533 - RNA, 11 nt, Human
uuuguggaaaa

SEQ ID NO: 1845534 - RNA, 19 nt, Human
auuauacccccugcaaagc

SEQ ID NO: 1845535 - RNA, 14 nt, Human
auuauauuaugaag

SEQ ID NO: 1845536 - RNA, 15 nt, Human
auuauauuuacaaau

SEQ ID NO: 1845537 - RNA, 22 nt, Human
auuuuucuuagggaaggauaca

SEQ ID NO: 1845538 - RNA, 16 nt, Human
auuuuucagauauaaa

SEQ ID NO: 1845539 - RNA, 21 nt, Human
auuuuucuuagggaaggauac

SEQ ID NO: 1845540 - RNA, 21 nt, Human
auuuuguuuuugucuuaaaaa

SEQ ID NO: 1845541 - RNA, 19 nt, Human
auuuuuuacagcugccugc

SEQ ID NO: 1845542 - RNA, 18 nt, Human
auuuuuuguuaaaugauu

SEQ ID NO: 1845543 - RNA, 13 nt, Human
auuuuuuaaaugc

SEQ ID NO: 1845544 - RNA, 14 nt, Human
auuuuuuaaaugca

SEQ ID NO: 1845545 - RNA, 18 nt, Human
auuuuuuaaauugaauuc

SEQ ID NO: 1845546 - RNA, 12 nt, Human
auuuuuguaauu

SEQ ID NO: 1845547 - RNA, 19 nt, Human
auuuuuguagagccagggu

SEQ ID NO: 1845548 - RNA, 14 nt, Human
auuuuugucuugug

SEQ ID NO: 1845549 - RNA, 22 nt, Human
auuuuugugauuuugugauuga

SEQ ID NO: 1845550 - RNA, 20 nt, Human
auuuuggaaaauaaauuauu

SEQ ID NO: 1845551 - RNA, 19 nt, Human
auuuuggaaaauaaauuau

SEQ ID NO: 1845552 - RNA, 14 nt, Human
auuuuggaaaauaa

SEQ ID NO: 1845553 - RNA, 12 nt, Human
auuuugcuuugu

SEQ ID NO: 1845554 - RNA, 20 nt, Human
auuuugcuguagaagauggc

SEQ ID NO: 1845555 - RNA, 18 nt, Human
auuuugcuuugugauuuu

SEQ ID NO: 1845556 - RNA, 20 nt, Human
auuuugcuuugugauuuuug

SEQ ID NO: 1845557 - RNA, 18 nt, Human
auuuuguauauuuguauu

SEQ ID NO: 1845558 - RNA, 19 nt, Human
auuuugugcccccauguaa

SEQ ID NO: 1845559 - RNA, 12 nt, Human
auuuugucuuua

SEQ ID NO: 1845560 - RNA, 23 nt, Human
auuuugucauauaagauucauau

SEQ ID NO: 1845561 - RNA, 17 nt, Human
auuuuguguuuaggaac

SEQ ID NO: 1845562 - RNA, 20 nt, Human
auuuugcuaaaugugaauga

SEQ ID NO: 1845563 - RNA, 21 nt, Human
auuuugcugucccuuuuccuu

SEQ ID NO: 1845564 - RNA, 18 nt, Human
auuuugccagugggaacu

SEQ ID NO: 1845565 - RNA, 15 nt, Human
auuuugauguuuuaa

SEQ ID NO: 1845566 - RNA, 17 nt, Human
auuuugauguuuuaagg

SEQ ID NO: 1845567 - RNA, 19 nt, Human
auuuugauccaagcugguc

SEQ ID NO: 1845568 - RNA, 17 nt, Human
auuuuaauaaacacucu

SEQ ID NO: 1845569 - RNA, 16 nt, Human
auuuuaauaaacacuc

SEQ ID NO: 1845570 - RNA, 15 nt, Human
auuuuaauaaacacu

SEQ ID NO: 1845571 - RNA, 19 nt, Human
auuuucccuauuagagaag

SEQ ID NO: 1845572 - RNA, 16 nt, Human
auuuuccugccaggca

SEQ ID NO: 1845573 - RNA, 15 nt, Human
auuuucuauaauuua

SEQ ID NO: 1845574 - RNA, 14 nt, Human
auuuucuauaauuu

SEQ ID NO: 1845575 - RNA, 13 nt, Human
auugugggaaggg

SEQ ID NO: 1845576 - RNA, 14 nt, Human
auugugggaagggg

SEQ ID NO: 1845577 - RNA, 16 nt, Human
auugucaaagugguga

SEQ ID NO: 1845578 - RNA, 23 nt, Human
auugucaaaguggugagaggcau

SEQ ID NO: 1845579 - RNA, 14 nt, Human
auuguacaguuuuu

SEQ ID NO: 1845580 - RNA, 15 nt, Human
auuguacaguuuuua

SEQ ID NO: 1845581 - RNA, 21 nt, Human
auuguacaguuuuuauugcuu

SEQ ID NO: 1845582 - RNA, 14 nt, Human
auuuaaaagauaca

SEQ ID NO: 1845583 - RNA, 16 nt, Human
auuuaaaagauacagu

SEQ ID NO: 1845584 - RNA, 17 nt, Human
auuuaaaagauacaguu

SEQ ID NO: 1845585 - RNA, 13 nt, Human
auuuaaaagauac

SEQ ID NO: 1845586 - RNA, 21 nt, Human
auuguuuggggaugagaaagg

SEQ ID NO: 1845587 - RNA, 18 nt, Human
auugguaaagaauggaag

SEQ ID NO: 1845588 - RNA, 16 nt, Human
auuggauuugucuuug

SEQ ID NO: 1845589 - RNA, 21 nt, Human
auugauuuccguuaaaauacc

SEQ ID NO: 1845590 - RNA, 19 nt, Human
auuggacaguaaaauccac

SEQ ID NO: 1845591 - RNA, 22 nt, Human
auuuuaaaaauacagauagaua

SEQ ID NO: 1845592 - RNA, 23 nt, Human
auuugugaaaugauggugaaagu

SEQ ID NO: 1845593 - RNA, 21 nt, Human
auuugugaagguggaaauaaa

SEQ ID NO: 1845594 - RNA, 18 nt, Human
auuugugaagguggaaau

SEQ ID NO: 1845595 - RNA, 15 nt, Human
auuugucaacaaagu

SEQ ID NO: 1845596 - RNA, 13 nt, Human
auuugucaacaaa

SEQ ID NO: 1845597 - RNA, 19 nt, Human
auuucccaaagcagugcau

SEQ ID NO: 1845598 - RNA, 16 nt, Human
auuuccacucaggucu

SEQ ID NO: 1845599 - RNA, 22 nt, Human
auuuccacucaggucuguuuuc

SEQ ID NO: 1845600 - RNA, 14 nt, Human
auuuauuuaaauuu

SEQ ID NO: 1845601 - RNA, 12 nt, Human
auuuauuuaaau

SEQ ID NO: 1845602 - RNA, 23 nt, Human
auuucuuccacaagagcccaggc

SEQ ID NO: 1845603 - RNA, 20 nt, Human
auuucuuccacaagagccca

SEQ ID NO: 1845604 - RNA, 18 nt, Human
auuugaaacacuuugcau

SEQ ID NO: 1845605 - RNA, 16 nt, Human
auuugaaaauuuugau

SEQ ID NO: 1845606 - RNA, 20 nt, Human
auuucuugagguaaaagcau

SEQ ID NO: 1845607 - RNA, 15 nt, Human
caccccuaaagagau

SEQ ID NO: 1845608 - RNA, 17 nt, Human
caccccggccaccugcg

SEQ ID NO: 1845609 - RNA, 16 nt, Human
caccccggccaccugc

SEQ ID NO: 1845610 - RNA, 15 nt, Human
caccccggccaccug

SEQ ID NO: 1845611 - RNA, 14 nt, Human
caccccggccaccu

SEQ ID NO: 1845612 - RNA, 14 nt, Human
caccccuaaagaga

SEQ ID NO: 1845613 - RNA, 22 nt, Human
cacccccacccaagggccuggc

SEQ ID NO: 1845614 - RNA, 18 nt, Human
cacccaagggccuggccu

SEQ ID NO: 1845615 - RNA, 17 nt, Human
cacccaagggccuggcc

SEQ ID NO: 1845616 - RNA, 16 nt, Human
cacccaagggccuggc

SEQ ID NO: 1845617 - RNA, 23 nt, Human
cacccaagggccuggccugagcu

SEQ ID NO: 1845618 - RNA, 21 nt, Human
cacccaagggccuggccugag

SEQ ID NO: 1845619 - RNA, 20 nt, Human
cacccaagggccuggccuga

SEQ ID NO: 1845620 - RNA, 19 nt, Human
cacccaagggccuggccug

SEQ ID NO: 1845621 - RNA, 13 nt, Human
caccccagcccca

SEQ ID NO: 1845622 - RNA, 12 nt, Human
caccccagcccc

SEQ ID NO: 1845623 - RNA, 12 nt, Human
cacccaccucag

SEQ ID NO: 1845624 - RNA, 13 nt, Human
cacccaccucagc

SEQ ID NO: 1845625 - RNA, 14 nt, Human
cacccaccucagcc

SEQ ID NO: 1845626 - RNA, 16 nt, Human
cacccaccucagccuc

SEQ ID NO: 1845627 - RNA, 20 nt, Human
cacccaccaucaugucuggc

SEQ ID NO: 1845628 - RNA, 22 nt, Human
cacccaccaucaugucuggcua

SEQ ID NO: 1845629 - RNA, 16 nt, Human
cacauuccugaugcuu

SEQ ID NO: 1845630 - RNA, 13 nt, Human
cacauguggacuu

SEQ ID NO: 1845631 - RNA, 17 nt, Human
cacaugugcacaugcac

SEQ ID NO: 1845632 - RNA, 14 nt, Human
cacaugugcacaug

SEQ ID NO: 1845633 - RNA, 15 nt, Human
cacaugugcacaugc

SEQ ID NO: 1845634 - RNA, 19 nt, Human
cacaugccucucucaggcc

SEQ ID NO: 1845635 - RNA, 18 nt, Human
cacaugccucucucaggc

SEQ ID NO: 1845636 - RNA, 17 nt, Human
cacaugccucucucagg

SEQ ID NO: 1845637 - RNA, 13 nt, Human
cacaugccucucu

SEQ ID NO: 1845638 - RNA, 19 nt, Human
cacaucagcacgauuucug

SEQ ID NO: 1845639 - RNA, 18 nt, Human
cacaucagcacgauuucu

SEQ ID NO: 1845640 - RNA, 12 nt, Human
cacauaucuguc

SEQ ID NO: 1845641 - RNA, 14 nt, Human
cacauaucugucau

SEQ ID NO: 1845642 - RNA, 19 nt, Human
caccacaugugcacaugca

SEQ ID NO: 1845643 - RNA, 15 nt, Human
caccacaugugcaca

SEQ ID NO: 1845644 - RNA, 18 nt, Human
caccacaugugcacaugc

SEQ ID NO: 1845645 - RNA, 14 nt, Human
caccaccucuuugg

SEQ ID NO: 1845646 - RNA, 16 nt, Human
caccacuacauucugu

SEQ ID NO: 1845647 - RNA, 17 nt, Human
caccacuacauucuguu

SEQ ID NO: 1845648 - RNA, 18 nt, Human
caccacuacauucuguua

SEQ ID NO: 1845649 - RNA, 19 nt, Human
caccacuacauucuguuaa

SEQ ID NO: 1845650 - RNA, 20 nt, Human
caccacuacauucuguuaau

SEQ ID NO: 1845651 - RNA, 13 nt, Human
caccacacccagc

SEQ ID NO: 1845652 - RNA, 15 nt, Human
caccacacccagccc

SEQ ID NO: 1845653 - RNA, 17 nt, Human
caccacacccagcccac

SEQ ID NO: 1845654 - RNA, 18 nt, Human
cacauuggagauguuuag

SEQ ID NO: 1845655 - RNA, 15 nt, Human
caccaagcccaguua

SEQ ID NO: 1845656 - RNA, 19 nt, Human
cacagugagucgaggacag

SEQ ID NO: 1845657 - RNA, 20 nt, Human
cacagugagucgaggacagg

SEQ ID NO: 1845658 - RNA, 15 nt, Human
cacaggcccuuccuc

SEQ ID NO: 1845659 - RNA, 18 nt, Human
cacagugagucgaggaca

SEQ ID NO: 1845660 - RNA, 20 nt, Human
cacaggcccggcuccaggcu

SEQ ID NO: 1845661 - RNA, 23 nt, Human
cacaggcccggcuccaggcuccu

SEQ ID NO: 1845662 - RNA, 22 nt, Human
cacauaauucaggaagcagcuu

SEQ ID NO: 1845663 - RNA, 17 nt, Human
cacauacacacacacgc

SEQ ID NO: 1845664 - RNA, 10 nt, Human
cacaggcagg

SEQ ID NO: 1845665 - RNA, 16 nt, Human
cacaggcccggcucca

SEQ ID NO: 1845666 - RNA, 17 nt, Human
cacaggcccggcuccag

SEQ ID NO: 1845667 - RNA, 18 nt, Human
cacaggcccggcuccagg

SEQ ID NO: 1845668 - RNA, 19 nt, Human
cacaggcccggcuccaggc

SEQ ID NO: 1845669 - RNA, 12 nt, Human
cacaggaucagu

SEQ ID NO: 1845670 - RNA, 15 nt, Human
cacaggaucagucug

SEQ ID NO: 1845671 - RNA, 16 nt, Human
cacaggaucagucuga

SEQ ID NO: 1845672 - RNA, 15 nt, Human
cacaggaaguagagg

SEQ ID NO: 1845673 - RNA, 18 nt, Human
cacagaugggugcuugga

SEQ ID NO: 1845674 - RNA, 14 nt, Human
cacagaugggugcu

SEQ ID NO: 1845675 - RNA, 20 nt, Human
cacagaguuguuacauuuuu

SEQ ID NO: 1845676 - RNA, 20 nt, Human
cacagaugggugcuuggagg

SEQ ID NO: 1845677 - RNA, 20 nt, Human
cacagcacgggggccaagga

SEQ ID NO: 1845678 - RNA, 16 nt, Human
cacagcagccccugca

SEQ ID NO: 1845679 - RNA, 19 nt, Human
caaugugaaaagaaaaaug

SEQ ID NO: 1845680 - RNA, 22 nt, Human
caaugaaugaaugaauggcuaa

SEQ ID NO: 1845681 - RNA, 14 nt, Human
caaugacacagucu

SEQ ID NO: 1845682 - RNA, 19 nt, Human
caaugacacagucuuggcu

SEQ ID NO: 1845683 - RNA, 21 nt, Human
caaugacacagucuuggcuca

SEQ ID NO: 1845684 - RNA, 13 nt, Human
caaugaccuuuca

SEQ ID NO: 1845685 - RNA, 18 nt, Human
caaugcaaaccaucauug

SEQ ID NO: 1845686 - RNA, 17 nt, Human
caaugcaaaccaucauu

SEQ ID NO: 1845687 - RNA, 20 nt, Human
caaugcaaaccaucauugaa

SEQ ID NO: 1845688 - RNA, 19 nt, Human
caaugcaaaccaucauuga

SEQ ID NO: 1845689 - RNA, 23 nt, Human
caaugcacuuuguucuggcucuu

SEQ ID NO: 1845690 - RNA, 20 nt, Human
caauaggaaaaacugauuuu

SEQ ID NO: 1845691 - RNA, 21 nt, Human
caauaggaaaaacugauuuuu

SEQ ID NO: 1845692 - RNA, 21 nt, Human
cacaaauucugucucuggauu

SEQ ID NO: 1845693 - RNA, 22 nt, Human
cacaacacacagauuugagcuc

SEQ ID NO: 1845694 - RNA, 23 nt, Human
cacaaccuucuguggcucacaga

SEQ ID NO: 1845695 - RNA, 19 nt, Human
cacaaccuucuguggcuca

SEQ ID NO: 1845696 - RNA, 18 nt, Human
cacaaccuucuguggcuc

SEQ ID NO: 1845697 - RNA, 17 nt, Human
cacaaccuucuguggcu

SEQ ID NO: 1845698 - RNA, 16 nt, Human
cacaaaaguuucucuu

SEQ ID NO: 1845699 - RNA, 18 nt, Human
cacaaaaguuucucuuuu

SEQ ID NO: 1845700 - RNA, 17 nt, Human
cacacuucaggcucuuc

SEQ ID NO: 1845701 - RNA, 14 nt, Human
cacacuucaggcuc

SEQ ID NO: 1845702 - RNA, 22 nt, Human
cacacuucaggcucuucuccuu

SEQ ID NO: 1845703 - RNA, 21 nt, Human
cacacuucaggcucuucuccu

SEQ ID NO: 1845704 - RNA, 20 nt, Human
cacacuucaggcucuucucc

SEQ ID NO: 1845705 - RNA, 18 nt, Human
cacacuucaggcucuucu

SEQ ID NO: 1845706 - RNA, 21 nt, Human
cacacuugacaucaacugcau

SEQ ID NO: 1845707 - RNA, 16 nt, Human
cacagaguuguuacau

SEQ ID NO: 1845708 - RNA, 17 nt, Human
cacagaguuguuacauu

SEQ ID NO: 1845709 - RNA, 12 nt, Human
cacagagaaagu

SEQ ID NO: 1845710 - RNA, 19 nt, Human
cacacagaggcugccucuc

SEQ ID NO: 1845711 - RNA, 12 nt, Human
cacacagcucug

SEQ ID NO: 1845712 - RNA, 14 nt, Human
cacacaccagagcc

SEQ ID NO: 1845713 - RNA, 13 nt, Human
cacacccagccca

SEQ ID NO: 1845714 - RNA, 15 nt, Human
cacaccagagcccac

SEQ ID NO: 1845715 - RNA, 12 nt, Human
cacaccagagcc

SEQ ID NO: 1845716 - RNA, 13 nt, Human
cacaccagagccc

SEQ ID NO: 1845717 - RNA, 14 nt, Human
cacacccuguuuua

SEQ ID NO: 1845718 - RNA, 17 nt, Human
cacaccgggcacucaga

SEQ ID NO: 1845719 - RNA, 12 nt, Human
caaauauauuca

SEQ ID NO: 1845720 - RNA, 21 nt, Human
caaaggaugcccaaagaugca

SEQ ID NO: 1845721 - RNA, 16 nt, Human
caaaucagcugcuacu

SEQ ID NO: 1845722 - RNA, 18 nt, Human
caaaugucuuccuggauu

SEQ ID NO: 1845723 - RNA, 15 nt, Human
caaaugucuuccugg

SEQ ID NO: 1845724 - RNA, 13 nt, Human
caaaucagcugcu

SEQ ID NO: 1845725 - RNA, 21 nt, Human
caaauguucaucaaugaauga

SEQ ID NO: 1845726 - RNA, 20 nt, Human
caaauguucaucaaugaaug

SEQ ID NO: 1845727 - RNA, 14 nt, Human
caaauguggcuccu

SEQ ID NO: 1845728 - RNA, 22 nt, Human
caaauucugcuugcuugcuuuu

SEQ ID NO: 1845729 - RNA, 16 nt, Human
caaagcuuguuaagau

SEQ ID NO: 1845730 - RNA, 20 nt, Human
caaagccaaagcuaggccug

SEQ ID NO: 1845731 - RNA, 21 nt, Human
caaagccaaagcuaggccugg

SEQ ID NO: 1845732 - RNA, 22 nt, Human
caaagccaaagcuaggccuggc

SEQ ID NO: 1845733 - RNA, 16 nt, Human
caaagcuaggccuggc

SEQ ID NO: 1845734 - RNA, 17 nt, Human
caaagcuaggccuggcc

SEQ ID NO: 1845735 - RNA, 18 nt, Human
caaagcuaggccuggcca

SEQ ID NO: 1845736 - RNA, 18 nt, Human
auuuuuuuacuaauagac

SEQ ID NO: 1845737 - RNA, 16 nt, Human
caaccugauugugucu

SEQ ID NO: 1845738 - RNA, 19 nt, Human
caacucuccuccagaguca

SEQ ID NO: 1845739 - RNA, 18 nt, Human
caacgcagcccugcuuug

SEQ ID NO: 1845740 - RNA, 15 nt, Human
caacgcagcccugcu

SEQ ID NO: 1845741 - RNA, 13 nt, Human
caacgcagcccug

SEQ ID NO: 1845742 - RNA, 12 nt, Human
caacgcagcccu

SEQ ID NO: 1845743 - RNA, 15 nt, Human
caacccucaucacca

SEQ ID NO: 1845744 - RNA, 12 nt, Human
caacccucauca

SEQ ID NO: 1845745 - RNA, 20 nt, Human
caacucuccuccagagucag

SEQ ID NO: 1845746 - RNA, 16 nt, Human
caacugcauuggcuuu

SEQ ID NO: 1845747 - RNA, 12 nt, Human
caacuuuguaua

SEQ ID NO: 1845748 - RNA, 11 nt, Human
caacuuuguau

SEQ ID NO: 1845749 - RNA, 18 nt, Human
caacccucagagccaccc

SEQ ID NO: 1845750 - RNA, 21 nt, Human
caacccucagagccaccccua

SEQ ID NO: 1845751 - RNA, 21 nt, Human
caaccccuucgcuccuguguc

SEQ ID NO: 1845752 - RNA, 18 nt, Human
caaccccuucgcuccugu

SEQ ID NO: 1845753 - RNA, 19 nt, Human
caaccccuucgcuccugug

SEQ ID NO: 1845754 - RNA, 15 nt, Human
caacagguuuuccug

SEQ ID NO: 1845755 - RNA, 18 nt, Human
caacaggguuuuuuucca

SEQ ID NO: 1845756 - RNA, 19 nt, Human
caacagguuuuccugaaga

SEQ ID NO: 1845757 - RNA, 22 nt, Human
caacaucuuggucagauuugaa

SEQ ID NO: 1845758 - RNA, 15 nt, Human
caaauuuacagagac

SEQ ID NO: 1845759 - RNA, 23 nt, Human
caacaggcugggcuucaguggca

SEQ ID NO: 1845760 - RNA, 24 nt, Human
caacaggcugggcuucaguggcag

SEQ ID NO: 1845761 - RNA, 18 nt, Human
caaauucugucucuggau

SEQ ID NO: 1845762 - RNA, 15 nt, Human
caaauucugucucug

SEQ ID NO: 1845763 - RNA, 14 nt, Human
caaauuuacagaga

SEQ ID NO: 1845764 - RNA, 21 nt, Human
caaggaugaucuaggaagacu

SEQ ID NO: 1845765 - RNA, 19 nt, Human
caaggaugccccguccccc

SEQ ID NO: 1845766 - RNA, 13 nt, Human
caaggauccugag

SEQ ID NO: 1845767 - RNA, 14 nt, Human
caaggacuaggguc

SEQ ID NO: 1845768 - RNA, 17 nt, Human
caagcgugagccacugc

SEQ ID NO: 1845769 - RNA, 18 nt, Human
caagcgugagccacugca

SEQ ID NO: 1845770 - RNA, 18 nt, Human
caaggacagccccuccuc

SEQ ID NO: 1845771 - RNA, 21 nt, Human
caagccaccaacauacuccca

SEQ ID NO: 1845772 - RNA, 16 nt, Human
caagccguggcuuccc

SEQ ID NO: 1845773 - RNA, 15 nt, Human
caagccguggcuucc

SEQ ID NO: 1845774 - RNA, 14 nt, Human
caagccguggcuuc

SEQ ID NO: 1845775 - RNA, 17 nt, Human
caagccguggcuucccg

SEQ ID NO: 1845776 - RNA, 16 nt, Human
caagcgugagccacug

SEQ ID NO: 1845777 - RNA, 18 nt, Human
caagcaccuccugccucg

SEQ ID NO: 1845778 - RNA, 17 nt, Human
caagcacuaaacaaaga

SEQ ID NO: 1845779 - RNA, 23 nt, Human
caaggugggaggauugcuugagc

SEQ ID NO: 1845780 - RNA, 12 nt, Human
caaggugggagg

SEQ ID NO: 1845781 - RNA, 19 nt, Human
caagggccuggccugagcu

SEQ ID NO: 1845782 - RNA, 15 nt, Human
caaggauugcuacug

SEQ ID NO: 1845783 - RNA, 19 nt, Human
caaggauugcuacuguccu

SEQ ID NO: 1845784 - RNA, 22 nt, Human
caagugugguagagugugccug

SEQ ID NO: 1845785 - RNA, 14 nt, Human
caagugauucuccu

SEQ ID NO: 1845786 - RNA, 21 nt, Human
caagugauucuccugccucag

SEQ ID NO: 1845787 - RNA, 22 nt, Human
caagugauucuccugccucagc

SEQ ID NO: 1845788 - RNA, 19 nt, Human
caagugaaaaaggaggaag

SEQ ID NO: 1845789 - RNA, 22 nt, Human
caagugauucucaugccucagc

SEQ ID NO: 1845790 - RNA, 16 nt, Human
caagugauucuccugc

SEQ ID NO: 1845791 - RNA, 17 nt, Human
caagugauucuccugcc

SEQ ID NO: 1845792 - RNA, 14 nt, Human
cccacgcuggagug

SEQ ID NO: 1845793 - RNA, 19 nt, Human
cccacgcccccacugguga

SEQ ID NO: 1845794 - RNA, 17 nt, Human
cccacgcccccacuggu

SEQ ID NO: 1845795 - RNA, 16 nt, Human
cccaccuuggcugcag

SEQ ID NO: 1845796 - RNA, 15 nt, Human
cccaccuuggcucaa

SEQ ID NO: 1845797 - RNA, 22 nt, Human
cccaccuuggcucaaguccucu

SEQ ID NO: 1845798 - RNA, 14 nt, Human
cccaccuuggcugc

SEQ ID NO: 1845799 - RNA, 15 nt, Human
cccaccuuggcugca

SEQ ID NO: 1845800 - RNA, 12 nt, Human
cccaccucagcc

SEQ ID NO: 1845801 - RNA, 14 nt, Human
cccaccucagccuc

SEQ ID NO: 1845802 - RNA, 15 nt, Human
cccaccucagccucc

SEQ ID NO: 1845803 - RNA, 19 nt, Human
cccaccucucucacuccuu

SEQ ID NO: 1845804 - RNA, 12 nt, Human
cccaccuuggcu

SEQ ID NO: 1845805 - RNA, 17 nt, Human
cccaccucucucacucc

SEQ ID NO: 1845806 - RNA, 14 nt, Human
cccaccucucucac

SEQ ID NO: 1845807 - RNA, 13 nt, Human
cccaccucucuca

SEQ ID NO: 1845808 - RNA, 21 nt, Human
cccaccucagccucccaaagu

SEQ ID NO: 1845809 - RNA, 14 nt, Human
cccaagggccuggc

SEQ ID NO: 1845810 - RNA, 12 nt, Human
cccaagggccug

SEQ ID NO: 1845811 - RNA, 21 nt, Human
ccauuuuguauuuuacuaaua

SEQ ID NO: 1845812 - RNA, 20 nt, Human
ccauuuugcugucccuuuuc

SEQ ID NO: 1845813 - RNA, 16 nt, Human
cccaagggccuggccu

SEQ ID NO: 1845814 - RNA, 17 nt, Human
cccaagggccuggccug

SEQ ID NO: 1845815 - RNA, 18 nt, Human
cccacaggcccuuccucu

SEQ ID NO: 1845816 - RNA, 16 nt, Human
cccacaggcccuuccu

SEQ ID NO: 1845817 - RNA, 19 nt, Human
cccacauagugaugguucc

SEQ ID NO: 1845818 - RNA, 13 nt, Human
cccacagcgcugg

SEQ ID NO: 1845819 - RNA, 17 nt, Human
cccacaggaucagucug

SEQ ID NO: 1845820 - RNA, 13 nt, Human
cccacaggaucag

SEQ ID NO: 1845821 - RNA, 14 nt, Human
ccauucuccaccug

SEQ ID NO: 1845822 - RNA, 13 nt, Human
ccauuugcuccuu

SEQ ID NO: 1845823 - RNA, 15 nt, Human
ccauucugccugccc

SEQ ID NO: 1845824 - RNA, 18 nt, Human
ccauguuuuguuuacggu

SEQ ID NO: 1845825 - RNA, 23 nt, Human
ccaggcugggagagccuuccagg

SEQ ID NO: 1845826 - RNA, 16 nt, Human
ccaggcccucugccca

SEQ ID NO: 1845827 - RNA, 15 nt, Human
ccaggcccucugccc

SEQ ID NO: 1845828 - RNA, 16 nt, Human
ccaggcugggucgccc

SEQ ID NO: 1845829 - RNA, 12 nt, Human
ccaggcuggguc

SEQ ID NO: 1845830 - RNA, 24 nt, Human
ccaggcugggucgcccuggacugu

SEQ ID NO: 1845831 - RNA, 23 nt, Human
ccaggcugggucgcccuggacug

SEQ ID NO: 1845832 - RNA, 22 nt, Human
ccaggcugggucgcccuggacu

SEQ ID NO: 1845833 - RNA, 21 nt, Human
ccaggcugggucgcccuggac

SEQ ID NO: 1845834 - RNA, 23 nt, Human
ccaggcuuagucacugagacagc

SEQ ID NO: 1845835 - RNA, 22 nt, Human
ccaggcuuagucacugagacag

SEQ ID NO: 1845836 - RNA, 21 nt, Human
ccaggcuuagucacugagaca

SEQ ID NO: 1845837 - RNA, 14 nt, Human
ccaggcuggucuca

SEQ ID NO: 1845838 - RNA, 20 nt, Human
ccaggaggccagccuugacc

SEQ ID NO: 1845839 - RNA, 18 nt, Human
ccaggaggccagccuuga

SEQ ID NO: 1845840 - RNA, 15 nt, Human
ccaggaggccagccu

SEQ ID NO: 1845841 - RNA, 14 nt, Human
ccaggcccucugcc

SEQ ID NO: 1845842 - RNA, 13 nt, Human
ccaggcccucugc

SEQ ID NO: 1845843 - RNA, 12 nt, Human
ccaggccagagg

SEQ ID NO: 1845844 - RNA, 14 nt, Human
ccaggccccugcca

SEQ ID NO: 1845845 - RNA, 15 nt, Human
ccaggccccugccac

SEQ ID NO: 1845846 - RNA, 16 nt, Human
ccaggccccugccacc

SEQ ID NO: 1845847 - RNA, 23 nt, Human
ccagugcccacaggaucagucug

SEQ ID NO: 1845848 - RNA, 20 nt, Human
ccaguaaaugggggugcauu

SEQ ID NO: 1845849 - RNA, 21 nt, Human
ccaguaaaugggggugcauuu

SEQ ID NO: 1845850 - RNA, 22 nt, Human
ccaguaaaugggggugcauuug

SEQ ID NO: 1845851 - RNA, 13 nt, Human
ccagguuuaagcu

SEQ ID NO: 1845852 - RNA, 16 nt, Human
ccagguuucuaugugu

SEQ ID NO: 1845853 - RNA, 21 nt, Human
ccagguggccacuccagaccc

SEQ ID NO: 1845854 - RNA, 16 nt, Human
ccagguggccacucca

SEQ ID NO: 1845855 - RNA, 21 nt, Human
ccaggugcuaggaacacuccu

SEQ ID NO: 1845856 - RNA, 13 nt, Human
ccagugaggcucu

SEQ ID NO: 1845857 - RNA, 23 nt, Human
ccaguaaaugggggugcauuuga

SEQ ID NO: 1845858 - RNA, 20 nt, Human
ccauccugaggcuccacuug

SEQ ID NO: 1845859 - RNA, 18 nt, Human
ccauccugaggcuccacu

SEQ ID NO: 1845860 - RNA, 17 nt, Human
ccaucauugaaaucuuu

SEQ ID NO: 1845861 - RNA, 16 nt, Human
ccaucauugaaaucuu

SEQ ID NO: 1845862 - RNA, 14 nt, Human
ccaucauugaaauc

SEQ ID NO: 1845863 - RNA, 15 nt, Human
ccaucucuccuccuu

SEQ ID NO: 1845864 - RNA, 17 nt, Human
ccaucucaccuccugcu

SEQ ID NO: 1845865 - RNA, 21 nt, Human
ccaucucacacaugagcauca

SEQ ID NO: 1845866 - RNA, 20 nt, Human
ccaucucacacaugagcauc

SEQ ID NO: 1845867 - RNA, 18 nt, Human
ccaucucacacaugagca

SEQ ID NO: 1845868 - RNA, 17 nt, Human
ccaucucacacaugagc

SEQ ID NO: 1845869 - RNA, 15 nt, Human
ccaucucacacauga

SEQ ID NO: 1845870 - RNA, 14 nt, Human
ccaucucacacaug

SEQ ID NO: 1845871 - RNA, 14 nt, Human
ccaucaagccacca

SEQ ID NO: 1845872 - RNA, 13 nt, Human
ccaucaagccacc

SEQ ID NO: 1845873 - RNA, 16 nt, Human
ccaucaagccaccaac

SEQ ID NO: 1845874 - RNA, 19 nt, Human
ccauauuaccacagacaua

SEQ ID NO: 1845875 - RNA, 12 nt, Human
ccaucaugucug

SEQ ID NO: 1845876 - RNA, 12 nt, Human
ccaucauugaaa

SEQ ID NO: 1845877 - RNA, 13 nt, Human
ccaucaugucugg

SEQ ID NO: 1845878 - RNA, 15 nt, Human
ccauaugccugggca

SEQ ID NO: 1845879 - RNA, 12 nt, Human
ccaucaagccac

SEQ ID NO: 1845880 - RNA, 13 nt, Human
ccauaugccuggg

SEQ ID NO: 1845881 - RNA, 14 nt, Human
ccagugugacaagg

SEQ ID NO: 1845882 - RNA, 23 nt, Human
ccagugugacaaggauugcuacu

SEQ ID NO: 1845883 - RNA, 13 nt, Human
ccaccuuggcuca

SEQ ID NO: 1845884 - RNA, 19 nt, Human
ccacccccacccaagggcc

SEQ ID NO: 1845885 - RNA, 14 nt, Human
ccacccuccuuuca

SEQ ID NO: 1845886 - RNA, 16 nt, Human
ccaccugccagggaca

SEQ ID NO: 1845887 - RNA, 15 nt, Human
ccaccugccagggac

SEQ ID NO: 1845888 - RNA, 14 nt, Human
ccaccugccaggga

SEQ ID NO: 1845889 - RNA, 13 nt, Human
ccaccugccaggg

SEQ ID NO: 1845890 - RNA, 20 nt, Human
ccaccuggccucugcacucc

SEQ ID NO: 1845891 - RNA, 18 nt, Human
ccaccuggccucugcacu

SEQ ID NO: 1845892 - RNA, 13 nt, Human
ccaccuggccucu

SEQ ID NO: 1845893 - RNA, 14 nt, Human
ccaccuggccucug

SEQ ID NO: 1845894 - RNA, 20 nt, Human
ccaccucucucacuccuuga

SEQ ID NO: 1845895 - RNA, 19 nt, Human
ccaccucucucacuccuug

SEQ ID NO: 1845896 - RNA, 16 nt, Human
ccaccucucucacucc

SEQ ID NO: 1845897 - RNA, 14 nt, Human
ccaccucucucacu

SEQ ID NO: 1845898 - RNA, 11 nt, Human
ccacccugcuc

SEQ ID NO: 1845899 - RNA, 12 nt, Human
ccacccugcucu

SEQ ID NO: 1845900 - RNA, 22 nt, Human
ccagaagaaaauagugguguga

SEQ ID NO: 1845901 - RNA, 18 nt, Human
ccagaaaccuuuguuugc

SEQ ID NO: 1845902 - RNA, 19 nt, Human
ccacugugccaugugccag

SEQ ID NO: 1845903 - RNA, 15 nt, Human
ccacugugccaugug

SEQ ID NO: 1845904 - RNA, 16 nt, Human
ccacugugccaugugc

SEQ ID NO: 1845905 - RNA, 23 nt, Human
ccacugcaucguuucaucuucca

SEQ ID NO: 1845906 - RNA, 21 nt, Human
ccacugcaucguuucaucuuc

SEQ ID NO: 1845907 - RNA, 14 nt, Human
ccaccuucccaugc

SEQ ID NO: 1845908 - RNA, 16 nt, Human
ccacugccucuuccuc

SEQ ID NO: 1845909 - RNA, 13 nt, Human
ccacugccucuuc

SEQ ID NO: 1845910 - RNA, 15 nt, Human
ccacugguucuucuu

SEQ ID NO: 1845911 - RNA, 23 nt, Human
ccacuggugacaugucuuuucuu

SEQ ID NO: 1845912 - RNA, 15 nt, Human
ccacugugaagagaa

SEQ ID NO: 1845913 - RNA, 14 nt, Human
ccacugugaagaga

SEQ ID NO: 1845914 - RNA, 22 nt, Human
ccacugcuuuuggucuguguga

SEQ ID NO: 1845915 - RNA, 21 nt, Human
ccacugccuucgauacaccgg

SEQ ID NO: 1845916 - RNA, 20 nt, Human
ccacugcuuuuggucugugu

SEQ ID NO: 1845917 - RNA, 12 nt, Human
ccacugcucugg

SEQ ID NO: 1845918 - RNA, 13 nt, Human
ccacugcucuggu

SEQ ID NO: 1845919 - RNA, 15 nt, Human
ccacugcucugguua

SEQ ID NO: 1845920 - RNA, 22 nt, Human
ccagagaguggcuccucccggu

SEQ ID NO: 1845921 - RNA, 18 nt, Human
ccagagaguggcuccucc

SEQ ID NO: 1845922 - RNA, 16 nt, Human
ccagagaguggcuccu

SEQ ID NO: 1845923 - RNA, 15 nt, Human
ccagagaguggcucc

SEQ ID NO: 1845924 - RNA, 14 nt, Human
ccagagaguggcuc

SEQ ID NO: 1845925 - RNA, 16 nt, Human
ccagacccggcugcgu

SEQ ID NO: 1845926 - RNA, 14 nt, Human
ccagacccggcugc

SEQ ID NO: 1845927 - RNA, 15 nt, Human
ccagacccggcugcg

SEQ ID NO: 1845928 - RNA, 20 nt, Human
ccagacacauguccaagaag

SEQ ID NO: 1845929 - RNA, 17 nt, Human
ccagacacauguccaag

SEQ ID NO: 1845930 - RNA, 22 nt, Human
ccagacacauguccaagaagcc

SEQ ID NO: 1845931 - RNA, 14 nt, Human
ccagacaucaacag

SEQ ID NO: 1845932 - RNA, 18 nt, Human
ccagaccccuggcuuuuc

SEQ ID NO: 1845933 - RNA, 24 nt, Human
ccagaccccuggcuuuucacugcu

SEQ ID NO: 1845934 - RNA, 23 nt, Human
ccagcaggcucucaggccagcug

SEQ ID NO: 1845935 - RNA, 21 nt, Human
ccagcaggcucucaggccagc

SEQ ID NO: 1845936 - RNA, 20 nt, Human
ccagcaggcucucaggccag

SEQ ID NO: 1845937 - RNA, 19 nt, Human
ccagcaggcucucaggcca

SEQ ID NO: 1845938 - RNA, 16 nt, Human
ccagcccacuucugcc

SEQ ID NO: 1845939 - RNA, 17 nt, Human
ccagcccacuucugcca

SEQ ID NO: 1845940 - RNA, 19 nt, Human
ccagccccaaaacucuccu

SEQ ID NO: 1845941 - RNA, 22 nt, Human
ccagccgagauagccaaggcca

SEQ ID NO: 1845942 - RNA, 20 nt, Human
ccagccgagauagccaaggc

SEQ ID NO: 1845943 - RNA, 17 nt, Human
ccagccgagauagccaa

SEQ ID NO: 1845944 - RNA, 23 nt, Human
ccagccgagauagccaaggccaa

SEQ ID NO: 1845945 - RNA, 23 nt, Human
ccagccuugaccauucuccaccu

SEQ ID NO: 1845946 - RNA, 13 nt, Human
ccagcgagcccug

SEQ ID NO: 1845947 - RNA, 13 nt, Human
ccagccuggguga

SEQ ID NO: 1845948 - RNA, 19 nt, Human
ccagccugagcgacaguga

SEQ ID NO: 1845949 - RNA, 20 nt, Human
ccagagccucaaaugagaaa

SEQ ID NO: 1845950 - RNA, 23 nt, Human
ccagagccucaaaugagaaaaug

SEQ ID NO: 1845951 - RNA, 14 nt, Human
ccagagcccaccuu

SEQ ID NO: 1845952 - RNA, 14 nt, Human
ccagauugcaacag

SEQ ID NO: 1845953 - RNA, 16 nt, Human
ccagauugcaacaggc

SEQ ID NO: 1845954 - RNA, 15 nt, Human
ccagauuucacucuc

SEQ ID NO: 1845955 - RNA, 19 nt, Human
ccagauuucacucuccuug

SEQ ID NO: 1845956 - RNA, 18 nt, Human
ccagauuucacucuccuu

SEQ ID NO: 1845957 - RNA, 23 nt, Human
ccagauugcaacaggcugggcuu

SEQ ID NO: 1845958 - RNA, 18 nt, Human
ccagauugcaacaggcug

SEQ ID NO: 1845959 - RNA, 22 nt, Human
ccagauugcaacaggcugggcu

SEQ ID NO: 1845960 - RNA, 24 nt, Human
ccagauuuuuuacagcugccugca

SEQ ID NO: 1845961 - RNA, 17 nt, Human
ccagcaagugagagcug

SEQ ID NO: 1845962 - RNA, 18 nt, Human
ccagcaagugagagcugg

SEQ ID NO: 1845963 - RNA, 19 nt, Human
ccagcaagugagagcuggg

SEQ ID NO: 1845964 - RNA, 18 nt, Human
ccagcaggcucucaggcc

SEQ ID NO: 1845965 - RNA, 17 nt, Human
ccagcaggcucucaggc

SEQ ID NO: 1845966 - RNA, 16 nt, Human
ccagcaggcucucagg

SEQ ID NO: 1845967 - RNA, 18 nt, Human
ccagcaccaucucuccuc

SEQ ID NO: 1845968 - RNA, 17 nt, Human
ccagcaccaucucuccu

SEQ ID NO: 1845969 - RNA, 18 nt, Human
ccccuggcuuuucacugc

SEQ ID NO: 1845970 - RNA, 22 nt, Human
ccccuggcuuuucacugcuggc

SEQ ID NO: 1845971 - RNA, 20 nt, Human
ccccuggcuuuucacugcug

SEQ ID NO: 1845972 - RNA, 20 nt, Human
ccccuuccauggacuuuguu

SEQ ID NO: 1845973 - RNA, 13 nt, Human
ccccuuccaugga

SEQ ID NO: 1845974 - RNA, 14 nt, Human
cccgacagccuggc

SEQ ID NO: 1845975 - RNA, 15 nt, Human
ccccuguucacucua

SEQ ID NO: 1845976 - RNA, 18 nt, Human
cccgacagccuggcacag

SEQ ID NO: 1845977 - RNA, 15 nt, Human
cccgacagccuggca

SEQ ID NO: 1845978 - RNA, 15 nt, Human
cccgagccuggcucc

SEQ ID NO: 1845979 - RNA, 13 nt, Human
cccgagccuggcu

SEQ ID NO: 1845980 - RNA, 23 nt, Human
cccgcuaagagggagggagggcu

SEQ ID NO: 1845981 - RNA, 22 nt, Human
cccgcccaggcuuagucacuga

SEQ ID NO: 1845982 - RNA, 20 nt, Human
cccgcccaggcuuagucacu

SEQ ID NO: 1845983 - RNA, 19 nt, Human
ccccugccucucugcaggu

SEQ ID NO: 1845984 - RNA, 17 nt, Human
ccccugccucucugcag

SEQ ID NO: 1845985 - RNA, 16 nt, Human
ccccugccucucugca

SEQ ID NO: 1845986 - RNA, 15 nt, Human
ccccugccucucugc

SEQ ID NO: 1845987 - RNA, 14 nt, Human
ccccugccucucug

SEQ ID NO: 1845988 - RNA, 12 nt, Human
ccccucugcccu

SEQ ID NO: 1845989 - RNA, 14 nt, Human
ccccucugcccugc

SEQ ID NO: 1845990 - RNA, 13 nt, Human
ccccucugcccug

SEQ ID NO: 1845991 - RNA, 17 nt, Human
ccccugcccggcugcgg

SEQ ID NO: 1845992 - RNA, 19 nt, Human
ccccugcccggcugcggaa

SEQ ID NO: 1845993 - RNA, 17 nt, Human
ccccugcuggguguggc

SEQ ID NO: 1845994 - RNA, 14 nt, Human
ccccugcugggugu

SEQ ID NO: 1845995 - RNA, 11 nt, Human
ccccugcuggu

SEQ ID NO: 1845996 - RNA, 13 nt, Human
ccccugcugguuc

SEQ ID NO: 1845997 - RNA, 15 nt, Human
ccccugcugguucag

SEQ ID NO: 1845998 - RNA, 20 nt, Human
ccccugcugguucaggguug

SEQ ID NO: 1845999 - RNA, 15 nt, Human
ccccuggaugcagcc

SEQ ID NO: 1846000 - RNA, 19 nt, Human
ccccuggaugcagccucac

SEQ ID NO: 1846001 - RNA, 18 nt, Human
ccccuggaugcagccuca

SEQ ID NO: 1846002 - RNA, 13 nt, Human
cccccacccaagg

SEQ ID NO: 1846003 - RNA, 24 nt, Human
cccccacccaagggccuggccuga

SEQ ID NO: 1846004 - RNA, 14 nt, Human
ccccauccucugua

SEQ ID NO: 1846005 - RNA, 17 nt, Human
ccccaucauugguaccc

SEQ ID NO: 1846006 - RNA, 13 nt, Human
cccccacugguga

SEQ ID NO: 1846007 - RNA, 11 nt, Human
cccccacuggu

SEQ ID NO: 1846008 - RNA, 15 nt, Human
cccccacuggugaca

SEQ ID NO: 1846009 - RNA, 22 nt, Human
ccccauaauuuuuuuuuuccuu

SEQ ID NO: 1846010 - RNA, 14 nt, Human
ccccagugcccaca

SEQ ID NO: 1846011 - RNA, 15 nt, Human
ccccagugcccacag

SEQ ID NO: 1846012 - RNA, 16 nt, Human
ccccagugcccacagg

SEQ ID NO: 1846013 - RNA, 20 nt, Human
ccccagugcccacaggauca

SEQ ID NO: 1846014 - RNA, 15 nt, Human
ccccucaacaccucu

SEQ ID NO: 1846015 - RNA, 23 nt, Human
ccccucaacucuccuccagaguc

SEQ ID NO: 1846016 - RNA, 16 nt, Human
ccccucaacaccucug

SEQ ID NO: 1846017 - RNA, 12 nt, Human
cccccagccugc

SEQ ID NO: 1846018 - RNA, 19 nt, Human
cccccugacaacacucauu

SEQ ID NO: 1846019 - RNA, 19 nt, Human
cccccugcaaagcccagcu

SEQ ID NO: 1846020 - RNA, 18 nt, Human
cccccugcaaagcccagc

SEQ ID NO: 1846021 - RNA, 21 nt, Human
cccccugcaaagcccagcuug

SEQ ID NO: 1846022 - RNA, 19 nt, Human
cccccucuggcuccagcug

SEQ ID NO: 1846023 - RNA, 12 nt, Human
cccccucuggcu

SEQ ID NO: 1846024 - RNA, 17 nt, Human
cccccugacaacacuca

SEQ ID NO: 1846025 - RNA, 21 nt, Human
cccccucuggcuccagcuggc

SEQ ID NO: 1846026 - RNA, 20 nt, Human
ccccucauagcccucacccu

SEQ ID NO: 1846027 - RNA, 23 nt, Human
ccccuccaaucccaccaacccuc

SEQ ID NO: 1846028 - RNA, 16 nt, Human
ccccucagggucccug

SEQ ID NO: 1846029 - RNA, 15 nt, Human
ccccucccuucaacc

SEQ ID NO: 1846030 - RNA, 12 nt, Human
ccccuccaugug

SEQ ID NO: 1846031 - RNA, 18 nt, Human
ccccuccuccuggacucc

SEQ ID NO: 1846032 - RNA, 22 nt, Human
ccccuccuccuggacuccugca

SEQ ID NO: 1846033 - RNA, 17 nt, Human
ccccuccucucugcccu

SEQ ID NO: 1846034 - RNA, 15 nt, Human
ccccuccucucugcc

SEQ ID NO: 1846035 - RNA, 21 nt, Human
ccccacccaagggccuggccu

SEQ ID NO: 1846036 - RNA, 19 nt, Human
ccccaccgcagacaggacc

SEQ ID NO: 1846037 - RNA, 15 nt, Human
ccccaccgcagacag

SEQ ID NO: 1846038 - RNA, 14 nt, Human
cccaucucuucugg

SEQ ID NO: 1846039 - RNA, 14 nt, Human
cccaguugggugga

SEQ ID NO: 1846040 - RNA, 19 nt, Human
cccaucucuacaaaaagca

SEQ ID NO: 1846041 - RNA, 12 nt, Human
cccaucugugaa

SEQ ID NO: 1846042 - RNA, 14 nt, Human
cccaugagccucag

SEQ ID NO: 1846043 - RNA, 19 nt, Human
ccgagauugcaccacugca

SEQ ID NO: 1846044 - RNA, 15 nt, Human
ccgagauugcaccac

SEQ ID NO: 1846045 - RNA, 21 nt, Human
ccgagauugcaccacugcacu

SEQ ID NO: 1846046 - RNA, 18 nt, Human
ccgagauagccaaggcca

SEQ ID NO: 1846047 - RNA, 23 nt, Human
ccgcacugggcuuggggaccaga

SEQ ID NO: 1846048 - RNA, 21 nt, Human
ccgagucucuucuccacugga

SEQ ID NO: 1846049 - RNA, 20 nt, Human
ccgagucucuucuccacugg

SEQ ID NO: 1846050 - RNA, 19 nt, Human
ccgagucucuucuccacug

SEQ ID NO: 1846051 - RNA, 15 nt, Human
ccgcagacaggacca

SEQ ID NO: 1846052 - RNA, 19 nt, Human
ccgagcuuugaaaauucag

SEQ ID NO: 1846053 - RNA, 18 nt, Human
ccgagucucuucuccacu

SEQ ID NO: 1846054 - RNA, 16 nt, Human
ccgagucucuucucca

SEQ ID NO: 1846055 - RNA, 14 nt, Human
ccgagucucuucuc

SEQ ID NO: 1846056 - RNA, 20 nt, Human
ccgaguagcugagauuauag

SEQ ID NO: 1846057 - RNA, 14 nt, Human
ccgaguagcuggga

SEQ ID NO: 1846058 - RNA, 16 nt, Human
ccgaguagcugggacu

SEQ ID NO: 1846059 - RNA, 11 nt, Human
ccgcuggggcc

SEQ ID NO: 1846060 - RNA, 14 nt, Human
ccgcuggggccagu

SEQ ID NO: 1846061 - RNA, 14 nt, Human
ccggaggggccugg

SEQ ID NO: 1846062 - RNA, 16 nt, Human
ccggaggggccuggca

SEQ ID NO: 1846063 - RNA, 15 nt, Human
ccggaggggccuggc

SEQ ID NO: 1846064 - RNA, 15 nt, Human
ccgggcucugccucc

SEQ ID NO: 1846065 - RNA, 14 nt, Human
ccgggcucugccuc

SEQ ID NO: 1846066 - RNA, 18 nt, Human
ccgggcucugccucccau

SEQ ID NO: 1846067 - RNA, 18 nt, Human
ccgugaggccagagacac

SEQ ID NO: 1846068 - RNA, 16 nt, Human
ccggcuccaggcuccu

SEQ ID NO: 1846069 - RNA, 21 nt, Human
ccggcuccaggcuccuuuagc

SEQ ID NO: 1846070 - RNA, 22 nt, Human
ccgggcacucagaagacacuga

SEQ ID NO: 1846071 - RNA, 13 nt, Human
ccgggccacagag

SEQ ID NO: 1846072 - RNA, 14 nt, Human
ccguggcuucccgc

SEQ ID NO: 1846073 - RNA, 15 nt, Human
ccuaacgaaguaucc

SEQ ID NO: 1846074 - RNA, 18 nt, Human
ccuacaggagugagcacu

SEQ ID NO: 1846075 - RNA, 15 nt, Human
ccuacaguguacagu

SEQ ID NO: 1846076 - RNA, 11 nt, Human
ccguggcuucc

SEQ ID NO: 1846077 - RNA, 18 nt, Human
ccuaggugacagagugag

SEQ ID NO: 1846078 - RNA, 20 nt, Human
ccuaccgagucucuucucca

SEQ ID NO: 1846079 - RNA, 19 nt, Human
ccuaccgagucucuucucc

SEQ ID NO: 1846080 - RNA, 21 nt, Human
ccuaccgagucucuucuccac

SEQ ID NO: 1846081 - RNA, 21 nt, Human
ccuacaguugaaaaacagcug

SEQ ID NO: 1846082 - RNA, 16 nt, Human
ccuacaguguacaguc

SEQ ID NO: 1846083 - RNA, 20 nt, Human
ccuacaguguacagucuugu

SEQ ID NO: 1846084 - RNA, 17 nt, Human
ccuaccgagucucuucu

SEQ ID NO: 1846085 - RNA, 16 nt, Human
ccuaccgagucucuuc

SEQ ID NO: 1846086 - RNA, 15 nt, Human
cccgcucagcccucc

SEQ ID NO: 1846087 - RNA, 14 nt, Human
cccucccugccccu

SEQ ID NO: 1846088 - RNA, 23 nt, Human
cccucccucuuucccucccuucc

SEQ ID NO: 1846089 - RNA, 14 nt, Human
cccgcucagcccuc

SEQ ID NO: 1846090 - RNA, 12 nt, Human
cccucccacagc

SEQ ID NO: 1846091 - RNA, 13 nt, Human
cccgcucagcccu

SEQ ID NO: 1846092 - RNA, 12 nt, Human
cccgcucagccc

SEQ ID NO: 1846093 - RNA, 14 nt, Human
cccucccacagcgc

SEQ ID NO: 1846094 - RNA, 12 nt, Human
cccucuggggcu

SEQ ID NO: 1846095 - RNA, 21 nt, Human
cccucuguucugcacacagca

SEQ ID NO: 1846096 - RNA, 20 nt, Human
cccucuguucugcacacagc

SEQ ID NO: 1846097 - RNA, 22 nt, Human
cccucuggcuccagcuggccgg

SEQ ID NO: 1846098 - RNA, 17 nt, Human
cccucuggcuccagcug

SEQ ID NO: 1846099 - RNA, 16 nt, Human
cccucuggcuccagcu

SEQ ID NO: 1846100 - RNA, 12 nt, Human
cccucuggcucc

SEQ ID NO: 1846101 - RNA, 20 nt, Human
cccucuuucccucccuuccu

SEQ ID NO: 1846102 - RNA, 17 nt, Human
cccucuuucccucccuu

SEQ ID NO: 1846103 - RNA, 12 nt, Human
cccucuuucccu

SEQ ID NO: 1846104 - RNA, 14 nt, Human
cccucugcccugcg

SEQ ID NO: 1846105 - RNA, 13 nt, Human
cccucugcccugc

SEQ ID NO: 1846106 - RNA, 12 nt, Human
cccucugcccug

SEQ ID NO: 1846107 - RNA, 19 nt, Human
cccucugcccacucccugc

SEQ ID NO: 1846108 - RNA, 18 nt, Human
cccucugcccacucccug

SEQ ID NO: 1846109 - RNA, 15 nt, Human
cccucugcccacucc

SEQ ID NO: 1846110 - RNA, 11 nt, Human
cccucugccca

SEQ ID NO: 1846111 - RNA, 16 nt, Human
cccuggugcugccaca

SEQ ID NO: 1846112 - RNA, 11 nt, Human
cccugccuccu

SEQ ID NO: 1846113 - RNA, 14 nt, Human
cccugccucucugc

SEQ ID NO: 1846114 - RNA, 13 nt, Human
cccugccucucug

SEQ ID NO: 1846115 - RNA, 12 nt, Human
cccugaggccca

SEQ ID NO: 1846116 - RNA, 21 nt, Human
cccugcgggucacaggaggga

SEQ ID NO: 1846117 - RNA, 19 nt, Human
cccugcgggucacaggagg

SEQ ID NO: 1846118 - RNA, 15 nt, Human
cccugccucucugca

SEQ ID NO: 1846119 - RNA, 23 nt, Human
cccugcugagucccaggcugagc

SEQ ID NO: 1846120 - RNA, 21 nt, Human
cccugcugagucccaggcuga

SEQ ID NO: 1846121 - RNA, 22 nt, Human
cccugcucuccgaccagacacc

SEQ ID NO: 1846122 - RNA, 21 nt, Human
cccugcucuccgaccagacac

SEQ ID NO: 1846123 - RNA, 18 nt, Human
cccuucaaccauucccca

SEQ ID NO: 1846124 - RNA, 14 nt, Human
cccuucaaccauuc

SEQ ID NO: 1846125 - RNA, 12 nt, Human
cccuuccaugga

SEQ ID NO: 1846126 - RNA, 20 nt, Human
cccuuccaugucgccucugc

SEQ ID NO: 1846127 - RNA, 23 nt, Human
cccuuagcagggaaacagcuaau

SEQ ID NO: 1846128 - RNA, 17 nt, Human
cccuuacgugaguccug

SEQ ID NO: 1846129 - RNA, 15 nt, Human
cccuuacgugagucc

SEQ ID NO: 1846130 - RNA, 20 nt, Human
cccuuagaaguuuguuguga

SEQ ID NO: 1846131 - RNA, 14 nt, Human
cccuuagcagggaa

SEQ ID NO: 1846132 - RNA, 14 nt, Human
cccuggugcugcca

SEQ ID NO: 1846133 - RNA, 13 nt, Human
cccuggugcugcc

SEQ ID NO: 1846134 - RNA, 21 nt, Human
cccuggugaccagcaccaucu

SEQ ID NO: 1846135 - RNA, 21 nt, Human
cccugguggcagcucaccucu

SEQ ID NO: 1846136 - RNA, 13 nt, Human
cccugguggcagu

SEQ ID NO: 1846137 - RNA, 14 nt, Human
cccugguggcagug

SEQ ID NO: 1846138 - RNA, 15 nt, Human
cccugguggcagugg

SEQ ID NO: 1846139 - RNA, 15 nt, Human
cccuggugcugccac

SEQ ID NO: 1846140 - RNA, 14 nt, Human
cccuguucuggcag

SEQ ID NO: 1846141 - RNA, 13 nt, Human
cccuguucuggca

SEQ ID NO: 1846142 - RNA, 23 nt, Human
cccuuaccugccaggaagccagc

SEQ ID NO: 1846143 - RNA, 20 nt, Human
cccuuaccugccaggaagcc

SEQ ID NO: 1846144 - RNA, 17 nt, Human
cccuuaccugccaggaa

SEQ ID NO: 1846145 - RNA, 19 nt, Human
cccuguuuguuucugaaag

SEQ ID NO: 1846146 - RNA, 13 nt, Human
cguuuucaaaauu

SEQ ID NO: 1846147 - RNA, 23 nt, Human
cuaagagggagggagggcuccag

SEQ ID NO: 1846148 - RNA, 22 nt, Human
cuaagagggagggagggcucca

SEQ ID NO: 1846149 - RNA, 15 nt, Human
cuaagagggagggag

SEQ ID NO: 1846150 - RNA, 13 nt, Human
cuaagagggaggg

SEQ ID NO: 1846151 - RNA, 19 nt, Human
cuaaauugacacuuaaaaa

SEQ ID NO: 1846152 - RNA, 16 nt, Human
cuaaauucaugcugcu

SEQ ID NO: 1846153 - RNA, 12 nt, Human
cuaaccacgcug

SEQ ID NO: 1846154 - RNA, 14 nt, Human
cuaaccacgcugga

SEQ ID NO: 1846155 - RNA, 20 nt, Human
cguuuguuccccaagacauu

SEQ ID NO: 1846156 - RNA, 23 nt, Human
cgggaggauguucugggacacag

SEQ ID NO: 1846157 - RNA, 20 nt, Human
cgggaggcagagguugcagu

SEQ ID NO: 1846158 - RNA, 23 nt, Human
cgggaccccgagccuggcuccaa

SEQ ID NO: 1846159 - RNA, 21 nt, Human
cuaaacugcccccucugcccu

SEQ ID NO: 1846160 - RNA, 21 nt, Human
cuaaaucuccaaaauaaaacu

SEQ ID NO: 1846161 - RNA, 17 nt, Human
cuaaauauauuuuaaga

SEQ ID NO: 1846162 - RNA, 22 nt, Human
cuaaaugaaaaucgugacaaca

SEQ ID NO: 1846163 - RNA, 13 nt, Human
cuaaacugccccc

SEQ ID NO: 1846164 - RNA, 12 nt, Human
cuaaacugcccc

SEQ ID NO: 1846165 - RNA, 17 nt, Human
cuaauagacaauuuauu

SEQ ID NO: 1846166 - RNA, 19 nt, Human
cuaauagacaauuuauuau

SEQ ID NO: 1846167 - RNA, 23 nt, Human
cuaauagacaauuuauuauggca

SEQ ID NO: 1846168 - RNA, 14 nt, Human
cuaauaaagcugug

SEQ ID NO: 1846169 - RNA, 22 nt, Human
cuaagcuauucaguaauaacuc

SEQ ID NO: 1846170 - RNA, 21 nt, Human
cuaagcuucacuguaaaauaa

SEQ ID NO: 1846171 - RNA, 22 nt, Human
cuaauuauacccccugcaaagc

SEQ ID NO: 1846172 - RNA, 23 nt, Human
cuaaugcgcaggcuggcccugcc

SEQ ID NO: 1846173 - RNA, 22 nt, Human
cuaaugcgcaggcuggcccugc

SEQ ID NO: 1846174 - RNA, 12 nt, Human
cuaaugggacac

SEQ ID NO: 1846175 - RNA, 13 nt, Human
cuaaugggacacu

SEQ ID NO: 1846176 - RNA, 20 nt, Human
cuaaugcgcaggcuggcccu

SEQ ID NO: 1846177 - RNA, 19 nt, Human
cuaaugcgcaggcuggccc

SEQ ID NO: 1846178 - RNA, 16 nt, Human
cuaaugcgcaggcugg

SEQ ID NO: 1846179 - RNA, 15 nt, Human
cuaaugcgcaggcug

SEQ ID NO: 1846180 - RNA, 21 nt, Human
cuaaucagcauucucacuccu

SEQ ID NO: 1846181 - RNA, 20 nt, Human
cuaaucagcauucucacucc

SEQ ID NO: 1846182 - RNA, 18 nt, Human
cuaauauguaacaagcca

SEQ ID NO: 1846183 - RNA, 21 nt, Human
cuacacaggggaaaagaggag

SEQ ID NO: 1846184 - RNA, 14 nt, Human
cuaauuccacagcu

SEQ ID NO: 1846185 - RNA, 16 nt, Human
cuaauuccacagcugc

SEQ ID NO: 1846186 - RNA, 15 nt, Human
cuaauuccacagcug

SEQ ID NO: 1846187 - RNA, 23 nt, Human
cuacacgagauacagaauuuuau

SEQ ID NO: 1846188 - RNA, 15 nt, Human
cuacaggcacccacc

SEQ ID NO: 1846189 - RNA, 17 nt, Human
cuacaggcacccaccau

SEQ ID NO: 1846190 - RNA, 14 nt, Human
cuacaggagugagc

SEQ ID NO: 1846191 - RNA, 15 nt, Human
cuacaggagugagca

SEQ ID NO: 1846192 - RNA, 16 nt, Human
cuacaggagugagcac

SEQ ID NO: 1846193 - RNA, 14 nt, Human
cuacaggugugagu

SEQ ID NO: 1846194 - RNA, 16 nt, Human
cuacaggugugaguca

SEQ ID NO: 1846195 - RNA, 20 nt, Human
cuacauggaguauaugucaa

SEQ ID NO: 1846196 - RNA, 18 nt, Human
cuacauggaguauauguc

SEQ ID NO: 1846197 - RNA, 13 nt, Human
cuacaguccuccc

SEQ ID NO: 1846198 - RNA, 22 nt, Human
cuacagcuugaccgugaggcca

SEQ ID NO: 1846199 - RNA, 19 nt, Human
cuacagcuugaccgugagg

SEQ ID NO: 1846200 - RNA, 23 nt, Human
cuacagcuugaccgugaggccag

SEQ ID NO: 1846201 - RNA, 19 nt, Human
cuacagcuaaucagcauuc

SEQ ID NO: 1846202 - RNA, 18 nt, Human
cuacagcuaaucagcauu

SEQ ID NO: 1846203 - RNA, 22 nt, Human
cuacagcuaaucagcauucuca

SEQ ID NO: 1846204 - RNA, 21 nt, Human
cuacagcuaaucagcauucuc

SEQ ID NO: 1846205 - RNA, 17 nt, Human
cuacacugugcugaguc

SEQ ID NO: 1846206 - RNA, 14 nt, Human
cuacacugugcuga

SEQ ID NO: 1846207 - RNA, 13 nt, Human
cuacacugugcug

SEQ ID NO: 1846208 - RNA, 22 nt, Human
cuacagaggccaugggccuccu

SEQ ID NO: 1846209 - RNA, 18 nt, Human
cuacagaggccaugggcc

SEQ ID NO: 1846210 - RNA, 20 nt, Human
cuacagaggccaugggccuc

SEQ ID NO: 1846211 - RNA, 17 nt, Human
cuacccucuuagaaaaa

SEQ ID NO: 1846212 - RNA, 13 nt, Human
cuacccaggugcu

SEQ ID NO: 1846213 - RNA, 18 nt, Human
cuacccagcgagcccugg

SEQ ID NO: 1846214 - RNA, 13 nt, Human
cuacccacccucc

SEQ ID NO: 1846215 - RNA, 15 nt, Human
cuacccagcgagccc

SEQ ID NO: 1846216 - RNA, 17 nt, Human
cuacccagcgagcccug

SEQ ID NO: 1846217 - RNA, 13 nt, Human
cuacauucuguua

SEQ ID NO: 1846218 - RNA, 14 nt, Human
cuacauucuguuaa

SEQ ID NO: 1846219 - RNA, 22 nt, Human
cuacauuauaaaugucucuuua

SEQ ID NO: 1846220 - RNA, 18 nt, Human
cuaccauccccuguagag

SEQ ID NO: 1846221 - RNA, 24 nt, Human
cuagauacuguaucaugacaaaga

SEQ ID NO: 1846222 - RNA, 13 nt, Human
cuagauacuguau

SEQ ID NO: 1846223 - RNA, 16 nt, Human
cuagauacuguaucau

SEQ ID NO: 1846224 - RNA, 19 nt, Human
cuagccugugccucuggga

SEQ ID NO: 1846225 - RNA, 21 nt, Human
cuagccugugccucugggacu

SEQ ID NO: 1846226 - RNA, 22 nt, Human
cuagccugugccucugggacug

SEQ ID NO: 1846227 - RNA, 21 nt, Human
cuagccuuagaagucacacag

SEQ ID NO: 1846228 - RNA, 22 nt, Human
cuagccuuagaagucacacagu

SEQ ID NO: 1846229 - RNA, 23 nt, Human
cuagccuuagaagucacacagua

SEQ ID NO: 1846230 - RNA, 12 nt, Human
cuacucuguguc

SEQ ID NO: 1846231 - RNA, 13 nt, Human
cuacucuguguca

SEQ ID NO: 1846232 - RNA, 19 nt, Human
cuacuguccuacccacccu

SEQ ID NO: 1846233 - RNA, 22 nt, Human
cuaccgagucucuucuccacug

SEQ ID NO: 1846234 - RNA, 21 nt, Human
cuaccgagucucuucuccacu

SEQ ID NO: 1846235 - RNA, 23 nt, Human
cuaccgagucucuucuccacugg

SEQ ID NO: 1846236 - RNA, 19 nt, Human
cuaccgagucucuucucca

SEQ ID NO: 1846237 - RNA, 17 nt, Human
cuaccgagucucuucuc

SEQ ID NO: 1846238 - RNA, 19 nt, Human
cuacucgaguuacagacaa

SEQ ID NO: 1846239 - RNA, 16 nt, Human
cuacucgaguuacaga

SEQ ID NO: 1846240 - RNA, 15 nt, Human
cuacucgaguuacag

SEQ ID NO: 1846241 - RNA, 17 nt, Human
cuagagguucaaagaua

SEQ ID NO: 1846242 - RNA, 18 nt, Human
cuagagguucaaagauau

SEQ ID NO: 1846243 - RNA, 21 nt, Human
cuagagguucaaagauauuuu

SEQ ID NO: 1846244 - RNA, 22 nt, Human
cuacuuagcaugucccuaccga

SEQ ID NO: 1846245 - RNA, 17 nt, Human
cuacuuagcaugucccu

SEQ ID NO: 1846246 - RNA, 20 nt, Human
cuacuguccuacccacccuc

SEQ ID NO: 1846247 - RNA, 23 nt, Human
cuagaaaugauccccagcuguuu

SEQ ID NO: 1846248 - RNA, 16 nt, Human
cuauugcugcuugagg

SEQ ID NO: 1846249 - RNA, 11 nt, Human
cuauugguaaa

SEQ ID NO: 1846250 - RNA, 17 nt, Human
cucacagaacccuugga

SEQ ID NO: 1846251 - RNA, 23 nt, Human
cucacacggacacucaaaagcug

SEQ ID NO: 1846252 - RNA, 14 nt, Human
cucaaguccucuuu

SEQ ID NO: 1846253 - RNA, 18 nt, Human
cucaacucuccuccagag

SEQ ID NO: 1846254 - RNA, 16 nt, Human
cucaacucuccuccag

SEQ ID NO: 1846255 - RNA, 14 nt, Human
cucaaauuucuaaa

SEQ ID NO: 1846256 - RNA, 15 nt, Human
cucaaauuucuaaau

SEQ ID NO: 1846257 - RNA, 17 nt, Human
cucaaauuucuaaaucu

SEQ ID NO: 1846258 - RNA, 14 nt, Human
cucaacucuccucc

SEQ ID NO: 1846259 - RNA, 23 nt, Human
cuauucaguaauaacucuacccu

SEQ ID NO: 1846260 - RNA, 17 nt, Human
cuauucaguaauaacuc

SEQ ID NO: 1846261 - RNA, 16 nt, Human
cuauguaucaaugagu

SEQ ID NO: 1846262 - RNA, 13 nt, Human
cuauguaucaaug

SEQ ID NO: 1846263 - RNA, 19 nt, Human
cuaugggggcacugaggac

SEQ ID NO: 1846264 - RNA, 22 nt, Human
cuaugaaguuuuuuuuauacag

SEQ ID NO: 1846265 - RNA, 15 nt, Human
cuaugauuuggaaaa

SEQ ID NO: 1846266 - RNA, 19 nt, Human
cuaugauuuggaaaauaaa

SEQ ID NO: 1846267 - RNA, 19 nt, Human
cuauagccuaggugacaga

SEQ ID NO: 1846268 - RNA, 18 nt, Human
cuauagccuaggugacag

SEQ ID NO: 1846269 - RNA, 20 nt, Human
cuauagccuaggugacagag

SEQ ID NO: 1846270 - RNA, 21 nt, Human
cuauagccuaggugacagagu

SEQ ID NO: 1846271 - RNA, 17 nt, Human
cuaggaagacuuuggaa

SEQ ID NO: 1846272 - RNA, 15 nt, Human
cuaggaagacuuugg

SEQ ID NO: 1846273 - RNA, 20 nt, Human
cuaggaacacuccuucacag

SEQ ID NO: 1846274 - RNA, 13 nt, Human
cuauaauuuaaau

SEQ ID NO: 1846275 - RNA, 12 nt, Human
cuauaauuuaaa

SEQ ID NO: 1846276 - RNA, 22 nt, Human
cuccaaguccacaguggaacca

SEQ ID NO: 1846277 - RNA, 13 nt, Human
cuccacugccuuc

SEQ ID NO: 1846278 - RNA, 13 nt, Human
cuccacuggaugg

SEQ ID NO: 1846279 - RNA, 16 nt, Human
cuccacugccuucgau

SEQ ID NO: 1846280 - RNA, 15 nt, Human
cuccacugccuucga

SEQ ID NO: 1846281 - RNA, 14 nt, Human
cuccacugccuucg

SEQ ID NO: 1846282 - RNA, 14 nt, Human
cuccagccccugga

SEQ ID NO: 1846283 - RNA, 13 nt, Human
cuccagccccugg

SEQ ID NO: 1846284 - RNA, 11 nt, Human
cuccagccccu

SEQ ID NO: 1846285 - RNA, 15 nt, Human
cuccagcucaccagc

SEQ ID NO: 1846286 - RNA, 16 nt, Human
cuccagcucaccagcc

SEQ ID NO: 1846287 - RNA, 18 nt, Human
cuccagcucaccagcccc

SEQ ID NO: 1846288 - RNA, 14 nt, Human
cuccacuggaugga

SEQ ID NO: 1846289 - RNA, 21 nt, Human
cuccagaccccuggcuuuuca

SEQ ID NO: 1846290 - RNA, 16 nt, Human
cuccagagucagaagu

SEQ ID NO: 1846291 - RNA, 21 nt, Human
cucauugaccugaggcccuuc

SEQ ID NO: 1846292 - RNA, 19 nt, Human
cucauugaccugaggcccu

SEQ ID NO: 1846293 - RNA, 18 nt, Human
cucauucuccuuguguua

SEQ ID NO: 1846294 - RNA, 22 nt, Human
cucauucuccuuguguuacuaa

SEQ ID NO: 1846295 - RNA, 17 nt, Human
cucauugaccugaggcc

SEQ ID NO: 1846296 - RNA, 12 nt, Human
cucauucuucug

SEQ ID NO: 1846297 - RNA, 17 nt, Human
cuccaaacccucgaggc

SEQ ID NO: 1846298 - RNA, 15 nt, Human
cuccaaacccucgag

SEQ ID NO: 1846299 - RNA, 21 nt, Human
cuccaaacccucgaggcggau

SEQ ID NO: 1846300 - RNA, 21 nt, Human
cucauuugucacacacuuugg

SEQ ID NO: 1846301 - RNA, 23 nt, Human
cuccccugcuggguguggcgcag

SEQ ID NO: 1846302 - RNA, 21 nt, Human
cuccccugcuggguguggcgc

SEQ ID NO: 1846303 - RNA, 20 nt, Human
cuccccagccccaucccaaa

SEQ ID NO: 1846304 - RNA, 18 nt, Human
cucccucagucuggcccu

SEQ ID NO: 1846305 - RNA, 15 nt, Human
cucccuucauccuuc

SEQ ID NO: 1846306 - RNA, 23 nt, Human
cucccuucaaccauuccccaugg

SEQ ID NO: 1846307 - RNA, 22 nt, Human
cucccuucaaccauuccccaug

SEQ ID NO: 1846308 - RNA, 21 nt, Human
cucccuucaaccauuccccau

SEQ ID NO: 1846309 - RNA, 20 nt, Human
cucccgaauagcugggacua

SEQ ID NO: 1846310 - RNA, 23 nt, Human
cucccgaauagcugggacuacag

SEQ ID NO: 1846311 - RNA, 17 nt, Human
cuccaugcugccuccag

SEQ ID NO: 1846312 - RNA, 16 nt, Human
cuccaugcugccucca

SEQ ID NO: 1846313 - RNA, 15 nt, Human
cuccaugcugccucc

SEQ ID NO: 1846314 - RNA, 14 nt, Human
cuccaugcugccuc

SEQ ID NO: 1846315 - RNA, 13 nt, Human
cuccaugcugccu

SEQ ID NO: 1846316 - RNA, 23 nt, Human
cuccagcuggccgggagccugau

SEQ ID NO: 1846317 - RNA, 22 nt, Human
cuccagcuggccgggagccuga

SEQ ID NO: 1846318 - RNA, 15 nt, Human
cucccaacucacccc

SEQ ID NO: 1846319 - RNA, 14 nt, Human
cucccaacucaccc

SEQ ID NO: 1846320 - RNA, 15 nt, Human
cucccacaaaggaga

SEQ ID NO: 1846321 - RNA, 16 nt, Human
cucccaacucacccca

SEQ ID NO: 1846322 - RNA, 16 nt, Human
cucccaaagugcuggg

SEQ ID NO: 1846323 - RNA, 23 nt, Human
cucccaaagugcugggauuacag

SEQ ID NO: 1846324 - RNA, 16 nt, Human
cucccaucacuucccu

SEQ ID NO: 1846325 - RNA, 22 nt, Human
cucccaggcgccccuucccccu

SEQ ID NO: 1846326 - RNA, 20 nt, Human
cucccaggcgccccuucccc

SEQ ID NO: 1846327 - RNA, 19 nt, Human
cucccaggcgccccuuccc

SEQ ID NO: 1846328 - RNA, 17 nt, Human
cucccaggcgccccuuc

SEQ ID NO: 1846329 - RNA, 22 nt, Human
cucagggucccugguggcagcu

SEQ ID NO: 1846330 - RNA, 21 nt, Human
cucagggucccugguggcagc

SEQ ID NO: 1846331 - RNA, 20 nt, Human
cucagggucccugguggcag

SEQ ID NO: 1846332 - RNA, 14 nt, Human
cucagggccugguc

SEQ ID NO: 1846333 - RNA, 24 nt, Human
cucagggucccugguggcagcuca

SEQ ID NO: 1846334 - RNA, 24 nt, Human
cucagguaaucgaccugccucggc

SEQ ID NO: 1846335 - RNA, 22 nt, Human
cucagguaaucgaccugccucg

SEQ ID NO: 1846336 - RNA, 20 nt, Human
cucagguaaucgaccugccu

SEQ ID NO: 1846337 - RNA, 21 nt, Human
cucagguggggucacucuggc

SEQ ID NO: 1846338 - RNA, 20 nt, Human
cucagguggggucacucugg

SEQ ID NO: 1846339 - RNA, 19 nt, Human
cucagguggggucacucug

SEQ ID NO: 1846340 - RNA, 23 nt, Human
cucaggugauccacccaccucag

SEQ ID NO: 1846341 - RNA, 20 nt, Human
cucagggccuggcucaggug

SEQ ID NO: 1846342 - RNA, 19 nt, Human
cucagggccuggcucaggu

SEQ ID NO: 1846343 - RNA, 18 nt, Human
cucagggccuggcucagg

SEQ ID NO: 1846344 - RNA, 18 nt, Human
cucaggcaggugggaugg

SEQ ID NO: 1846345 - RNA, 15 nt, Human
cucaggcagguggga

SEQ ID NO: 1846346 - RNA, 24 nt, Human
cucaggagcccugggaggcucugg

SEQ ID NO: 1846347 - RNA, 23 nt, Human
cucaggagcccugggaggcucug

SEQ ID NO: 1846348 - RNA, 22 nt, Human
cucaggagcccugggaggcucu

SEQ ID NO: 1846349 - RNA, 21 nt, Human
cucaggagcccugggaggcuc

SEQ ID NO: 1846350 - RNA, 20 nt, Human
cucaggagcccugggaggcu

SEQ ID NO: 1846351 - RNA, 17 nt, Human
cucaggagcccugggag

SEQ ID NO: 1846352 - RNA, 16 nt, Human
cucaggagcccuggga

SEQ ID NO: 1846353 - RNA, 15 nt, Human
cucaggagcccuggg

SEQ ID NO: 1846354 - RNA, 14 nt, Human
cucaggagcccugg

SEQ ID NO: 1846355 - RNA, 13 nt, Human
cucaggagcccug

SEQ ID NO: 1846356 - RNA, 12 nt, Human
cucaggagcccu

SEQ ID NO: 1846357 - RNA, 14 nt, Human
cucacuguugccca

SEQ ID NO: 1846358 - RNA, 15 nt, Human
cucacuguugcccag

SEQ ID NO: 1846359 - RNA, 20 nt, Human
cucacugcauccuccgccuc

SEQ ID NO: 1846360 - RNA, 15 nt, Human
cucacugcagccuca

SEQ ID NO: 1846361 - RNA, 16 nt, Human
cucacugcagccucaa

SEQ ID NO: 1846362 - RNA, 16 nt, Human
cucagaucuucugugg

SEQ ID NO: 1846363 - RNA, 19 nt, Human
cucagagagggugggagug

SEQ ID NO: 1846364 - RNA, 23 nt, Human
cucagagagggugggagugggcc

SEQ ID NO: 1846365 - RNA, 15 nt, Human
cucagagccaccccu

SEQ ID NO: 1846366 - RNA, 16 nt, Human
cucacuguugcccagg

SEQ ID NO: 1846367 - RNA, 17 nt, Human
cucacuguugcccaggc

SEQ ID NO: 1846368 - RNA, 18 nt, Human
cucacuguugcccaggcu

SEQ ID NO: 1846369 - RNA, 19 nt, Human
cucacuguugcccaggcug

SEQ ID NO: 1846370 - RNA, 21 nt, Human
cucagcccucccugccccucc

SEQ ID NO: 1846371 - RNA, 20 nt, Human
cucagcccucccugccccuc

SEQ ID NO: 1846372 - RNA, 19 nt, Human
cucagcccucccugccccu

SEQ ID NO: 1846373 - RNA, 14 nt, Human
cucagcccucccug

SEQ ID NO: 1846374 - RNA, 15 nt, Human
cucagcauccuggca

SEQ ID NO: 1846375 - RNA, 21 nt, Human
cucagcaaaagaugcuucuca

SEQ ID NO: 1846376 - RNA, 16 nt, Human
cucagcaggggagggu

SEQ ID NO: 1846377 - RNA, 20 nt, Human
cucagcaaaagaugcuucuc

SEQ ID NO: 1846378 - RNA, 19 nt, Human
cucagcaaaagaugcuucu

SEQ ID NO: 1846379 - RNA, 13 nt, Human
cucagcauccugg

SEQ ID NO: 1846380 - RNA, 21 nt, Human
cucagcauccuggcacccggc

SEQ ID NO: 1846381 - RNA, 22 nt, Human
cucagcauccuggcacccggcc

SEQ ID NO: 1846382 - RNA, 14 nt, Human
cucagcggggacag

SEQ ID NO: 1846383 - RNA, 15 nt, Human
cucagcggggacagc

SEQ ID NO: 1846384 - RNA, 16 nt, Human
cucagcggggacagcu

SEQ ID NO: 1846385 - RNA, 18 nt, Human
cucagcggggacagcucc

SEQ ID NO: 1846386 - RNA, 19 nt, Human
cucagcggggacagcuccu

SEQ ID NO: 1846387 - RNA, 20 nt, Human
cucagcggggacagcuccuu

SEQ ID NO: 1846388 - RNA, 21 nt, Human
cucagcggggacagcuccuuc

SEQ ID NO: 1846389 - RNA, 15 nt, Human
cucagcucccaaggc

SEQ ID NO: 1846390 - RNA, 19 nt, Human
cucagcucccaaggcucug

SEQ ID NO: 1846391 - RNA, 23 nt, Human
cucagcggggacagcuccuucug

SEQ ID NO: 1846392 - RNA, 13 nt, Human
cgcacugggcuug

SEQ ID NO: 1846393 - RNA, 17 nt, Human
cgcagcccugcagaggg

SEQ ID NO: 1846394 - RNA, 15 nt, Human
cgcagcccugcagag

SEQ ID NO: 1846395 - RNA, 20 nt, Human
cgcagcauauucaggaagcu

SEQ ID NO: 1846396 - RNA, 19 nt, Human
cgcagcauauucaggaagc

SEQ ID NO: 1846397 - RNA, 17 nt, Human
cgcacugggcuugggga

SEQ ID NO: 1846398 - RNA, 23 nt, Human
cgcacuucgggaggucgaggcag

SEQ ID NO: 1846399 - RNA, 13 nt, Human
cgagccuggcucc

SEQ ID NO: 1846400 - RNA, 19 nt, Human
cgagcccugguggcagugg

SEQ ID NO: 1846401 - RNA, 16 nt, Human
cgaggacagggaggug

SEQ ID NO: 1846402 - RNA, 20 nt, Human
cgggaauuuucaucuaggau

SEQ ID NO: 1846403 - RNA, 20 nt, Human
cgggaagggggcugggacau

SEQ ID NO: 1846404 - RNA, 19 nt, Human
cgggaagggggcugggaca

SEQ ID NO: 1846405 - RNA, 16 nt, Human
cgggaagggggcuggg

SEQ ID NO: 1846406 - RNA, 18 nt, Human
cgggaauuuucaucuagg

SEQ ID NO: 1846407 - RNA, 13 nt, Human
cggcuggccuggc

SEQ ID NO: 1846408 - RNA, 23 nt, Human
cggcuggcagcccaccccucaac

SEQ ID NO: 1846409 - RNA, 14 nt, Human
cggcuggccuggcc

SEQ ID NO: 1846410 - RNA, 14 nt, Human
cggcuggcagccca

SEQ ID NO: 1846411 - RNA, 11 nt, Human
cggccaggcca

SEQ ID NO: 1846412 - RNA, 12 nt, Human
cggccaggccag

SEQ ID NO: 1846413 - RNA, 20 nt, Human
cggccaggccagagggagug

SEQ ID NO: 1846414 - RNA, 17 nt, Human
cggagaaaggaagggcu

SEQ ID NO: 1846415 - RNA, 15 nt, Human
cggagaaaggaaggg

SEQ ID NO: 1846416 - RNA, 17 nt, Human
cggacuuagcugggaga

SEQ ID NO: 1846417 - RNA, 16 nt, Human
cggacuuagcugggag

SEQ ID NO: 1846418 - RNA, 21 nt, Human
cggacagccacggccaggcca

SEQ ID NO: 1846419 - RNA, 22 nt, Human
cggacagccacggccaggccag

SEQ ID NO: 1846420 - RNA, 16 nt, Human
cgcuuucuacccagcg

SEQ ID NO: 1846421 - RNA, 14 nt, Human
cgcuuucuacccag

SEQ ID NO: 1846422 - RNA, 16 nt, Human
cggaauaguuggcuag

SEQ ID NO: 1846423 - RNA, 17 nt, Human
cggaauaguuggcuagg

SEQ ID NO: 1846424 - RNA, 14 nt, Human
cgcugugcugcccu

SEQ ID NO: 1846425 - RNA, 13 nt, Human
cgcugugcugccc

SEQ ID NO: 1846426 - RNA, 11 nt, Human
cgcugugcugc

SEQ ID NO: 1846427 - RNA, 19 nt, Human
cgcugugcugcccugccca

SEQ ID NO: 1846428 - RNA, 23 nt, Human
cgcugugcugcccugcccaccug

SEQ ID NO: 1846429 - RNA, 21 nt, Human
cgcugugcugcccugcccacc

SEQ ID NO: 1846430 - RNA, 19 nt, Human
cgcagcccugcagagggca

SEQ ID NO: 1846431 - RNA, 18 nt, Human
cgcagcccugcagagggc

SEQ ID NO: 1846432 - RNA, 24 nt, Human
cgcagcccugcuuugggcugcccu

SEQ ID NO: 1846433 - RNA, 15 nt, Human
cgcagcccugcuuug

SEQ ID NO: 1846434 - RNA, 13 nt, Human
cgcagcccugcuu

SEQ ID NO: 1846435 - RNA, 18 nt, Human
cgcccaacuaauuuuugu

SEQ ID NO: 1846436 - RNA, 13 nt, Human
cgcccagucugga

SEQ ID NO: 1846437 - RNA, 19 nt, Human
cgcccagucuggaaugcag

SEQ ID NO: 1846438 - RNA, 18 nt, Human
cgcccggcuaauuuuugu

SEQ ID NO: 1846439 - RNA, 21 nt, Human
cgcccagucuggaaugcagug

SEQ ID NO: 1846440 - RNA, 13 nt, Human
cgccccuuccccc

SEQ ID NO: 1846441 - RNA, 14 nt, Human
cgcgacaaugcaaa

SEQ ID NO: 1846442 - RNA, 19 nt, Human
cgcgguggcucacgccugu

SEQ ID NO: 1846443 - RNA, 15 nt, Human
cgcgacaaugcaaac

SEQ ID NO: 1846444 - RNA, 24 nt, Human
cgcuacccgggaagggggcuggga

SEQ ID NO: 1846445 - RNA, 21 nt, Human
cgcuacccgggaagggggcug

SEQ ID NO: 1846446 - RNA, 18 nt, Human
cgcuacccgggaaggggg

SEQ ID NO: 1846447 - RNA, 19 nt, Human
ccuucucuccagccccugg

SEQ ID NO: 1846448 - RNA, 20 nt, Human
ccuuggugucgggcaugaca

SEQ ID NO: 1846449 - RNA, 19 nt, Human
ccuuggugucgggcaugac

SEQ ID NO: 1846450 - RNA, 21 nt, Human
ccuuggugucgggcaugacac

SEQ ID NO: 1846451 - RNA, 14 nt, Human
ccuuggggagcagg

SEQ ID NO: 1846452 - RNA, 16 nt, Human
ccuuggcugcagggag

SEQ ID NO: 1846453 - RNA, 23 nt, Human
ccuugacauuguagagcuucugg

SEQ ID NO: 1846454 - RNA, 18 nt, Human
ccuucucuccagccccug

SEQ ID NO: 1846455 - RNA, 17 nt, Human
ccuucucuccagccccu

SEQ ID NO: 1846456 - RNA, 18 nt, Human
ccuugacagggcacaccg

SEQ ID NO: 1846457 - RNA, 21 nt, Human
ccuugacagggcacaccgggc

SEQ ID NO: 1846458 - RNA, 15 nt, Human
ccuuggauugucccc

SEQ ID NO: 1846459 - RNA, 19 nt, Human
ccuuggauuguccccgacc

SEQ ID NO: 1846460 - RNA, 22 nt, Human
ccuuggcucaaguccucuuuuc

SEQ ID NO: 1846461 - RNA, 20 nt, Human
ccugugggcccccaaaugga

SEQ ID NO: 1846462 - RNA, 20 nt, Human
ccuguggaugauaaaacaca

SEQ ID NO: 1846463 - RNA, 18 nt, Human
ccuguggaucaaauccag

SEQ ID NO: 1846464 - RNA, 20 nt, Human
ccugugccucugggacugga

SEQ ID NO: 1846465 - RNA, 16 nt, Human
ccuucucuccagcccc

SEQ ID NO: 1846466 - RNA, 15 nt, Human
ccuucucuccagccc

SEQ ID NO: 1846467 - RNA, 13 nt, Human
ccuucucuccagc

SEQ ID NO: 1846468 - RNA, 12 nt, Human
ccuucucuccag

SEQ ID NO: 1846469 - RNA, 13 nt, Human
ccuuccaggggug

SEQ ID NO: 1846470 - RNA, 17 nt, Human
ccuuccauggacuuugu

SEQ ID NO: 1846471 - RNA, 18 nt, Human
ccuuccaugucgccucug

SEQ ID NO: 1846472 - RNA, 17 nt, Human
ccuucggccuccauccu

SEQ ID NO: 1846473 - RNA, 18 nt, Human
ccuucggccuccauccug

SEQ ID NO: 1846474 - RNA, 17 nt, Human
cgaauauugcugauggu

SEQ ID NO: 1846475 - RNA, 15 nt, Human
cgaauauugcugaug

SEQ ID NO: 1846476 - RNA, 14 nt, Human
cgaauauugcugau

SEQ ID NO: 1846477 - RNA, 12 nt, Human
cgaauauugcug

SEQ ID NO: 1846478 - RNA, 11 nt, Human
cgaauauugcu

SEQ ID NO: 1846479 - RNA, 16 nt, Human
cgaauagcugggacua

SEQ ID NO: 1846480 - RNA, 15 nt, Human
cgaauagcugggacu

SEQ ID NO: 1846481 - RNA, 23 nt, Human
cgaacauguuuuucuucucccuc

SEQ ID NO: 1846482 - RNA, 21 nt, Human
cgaacauguuuuucuucuccc

SEQ ID NO: 1846483 - RNA, 22 nt, Human
ccuuuuuuggcugcugaaggcu

SEQ ID NO: 1846484 - RNA, 20 nt, Human
ccuuuuuuggcugcugaagg

SEQ ID NO: 1846485 - RNA, 18 nt, Human
ccuuuuuuggcugcugaa

SEQ ID NO: 1846486 - RNA, 17 nt, Human
ccuuuuuuggcugcuga

SEQ ID NO: 1846487 - RNA, 23 nt, Human
cgaaagggacuuggaagcuccgc

SEQ ID NO: 1846488 - RNA, 14 nt, Human
ccuuuguccccacc

SEQ ID NO: 1846489 - RNA, 18 nt, Human
ccuuuguccccaccgcag

SEQ ID NO: 1846490 - RNA, 16 nt, Human
ccuuuguccccaccgc

SEQ ID NO: 1846491 - RNA, 24 nt, Human
ccuuuguauucucuccuguaccuc

SEQ ID NO: 1846492 - RNA, 23 nt, Human
ccuuuguaaauugucagaugcug

SEQ ID NO: 1846493 - RNA, 22 nt, Human
ccuuuguauucucuccuguacc

SEQ ID NO: 1846494 - RNA, 23 nt, Human
ccuuuguauucucuccuguaccu

SEQ ID NO: 1846495 - RNA, 21 nt, Human
ccuuuguaaauugucagaugc

SEQ ID NO: 1846496 - RNA, 14 nt, Human
ccuuugugaggaag

SEQ ID NO: 1846497 - RNA, 23 nt, Human
ccuuuguccccaccgcagacagg

SEQ ID NO: 1846498 - RNA, 22 nt, Human
ccuuuguccccaccgcagacag

SEQ ID NO: 1846499 - RNA, 23 nt, Human
ccuuugugaggaagccgcugggg

SEQ ID NO: 1846500 - RNA, 17 nt, Human
ccuuugugaggaagccg

SEQ ID NO: 1846501 - RNA, 16 nt, Human
ccuuugugaggaagcc

SEQ ID NO: 1846502 - RNA, 15 nt, Human
ccuuugugaggaagc

SEQ ID NO: 1846503 - RNA, 15 nt, Human
ccuuuuuuggcugcu

SEQ ID NO: 1846504 - RNA, 22 nt, Human
ccugccuguugggccaggagcc

SEQ ID NO: 1846505 - RNA, 14 nt, Human
ccugcccugugggc

SEQ ID NO: 1846506 - RNA, 12 nt, Human
ccugcccugugg

SEQ ID NO: 1846507 - RNA, 11 nt, Human
ccugcccugug

SEQ ID NO: 1846508 - RNA, 23 nt, Human
ccugcccugguuuccugcccugg

SEQ ID NO: 1846509 - RNA, 22 nt, Human
ccugcccugguuuccugcccug

SEQ ID NO: 1846510 - RNA, 21 nt, Human
ccugcccugguuuccugcccu

SEQ ID NO: 1846511 - RNA, 20 nt, Human
ccugcccugguuuccugccc

SEQ ID NO: 1846512 - RNA, 19 nt, Human
ccugcccugguuuccugcc

SEQ ID NO: 1846513 - RNA, 14 nt, Human
ccugcccugguuuc

SEQ ID NO: 1846514 - RNA, 22 nt, Human
ccugcccugggaggcagugaug

SEQ ID NO: 1846515 - RNA, 20 nt, Human
ccugcccugggaggcaguga

SEQ ID NO: 1846516 - RNA, 15 nt, Human
ccugcccugggaggc

SEQ ID NO: 1846517 - RNA, 14 nt, Human
ccugcccugggagg

SEQ ID NO: 1846518 - RNA, 12 nt, Human
ccugcccuggga

SEQ ID NO: 1846519 - RNA, 10 nt, Human
ccugcccugg

SEQ ID NO: 1846520 - RNA, 22 nt, Human
ccugcccuuaccugccaggaag

SEQ ID NO: 1846521 - RNA, 21 nt, Human
ccugcccuuaccugccaggaa

SEQ ID NO: 1846522 - RNA, 19 nt, Human
ccugcccuuaccugccagg

SEQ ID NO: 1846523 - RNA, 15 nt, Human
ccugcccugugggcc

SEQ ID NO: 1846524 - RNA, 12 nt, Human
ccugccucagcc

SEQ ID NO: 1846525 - RNA, 13 nt, Human
ccugccucagccu

SEQ ID NO: 1846526 - RNA, 14 nt, Human
ccugccucagccuc

SEQ ID NO: 1846527 - RNA, 14 nt, Human
ccugccuguugggc

SEQ ID NO: 1846528 - RNA, 22 nt, Human
ccugccuguucccauucuugca

SEQ ID NO: 1846529 - RNA, 12 nt, Human
ccugccaggcau

SEQ ID NO: 1846530 - RNA, 14 nt, Human
ccugccccccagcc

SEQ ID NO: 1846531 - RNA, 15 nt, Human
ccugccaggcauggu

SEQ ID NO: 1846532 - RNA, 22 nt, Human
ccugccagggacagagggggug

SEQ ID NO: 1846533 - RNA, 17 nt, Human
ccugccccugagcccau

SEQ ID NO: 1846534 - RNA, 22 nt, Human
ccugccccuccucucugcccua

SEQ ID NO: 1846535 - RNA, 21 nt, Human
ccugccccuccucucugcccu

SEQ ID NO: 1846536 - RNA, 20 nt, Human
ccugccccuccucucugccc

SEQ ID NO: 1846537 - RNA, 19 nt, Human
ccugccccuccucucugcc

SEQ ID NO: 1846538 - RNA, 14 nt, Human
ccugccccucccuu

SEQ ID NO: 1846539 - RNA, 18 nt, Human
ccugccccuccucucugc

SEQ ID NO: 1846540 - RNA, 18 nt, Human
ccugccccucccuucaac

SEQ ID NO: 1846541 - RNA, 16 nt, Human
ccugccccucccuuca

SEQ ID NO: 1846542 - RNA, 15 nt, Human
ccugccccucccuuc

SEQ ID NO: 1846543 - RNA, 14 nt, Human
ccugcccggcugcg

SEQ ID NO: 1846544 - RNA, 16 nt, Human
ccugcccggcugcgga

SEQ ID NO: 1846545 - RNA, 21 nt, Human
ccugcacacgcuccuuccucu

SEQ ID NO: 1846546 - RNA, 23 nt, Human
ccugcacaaagcccuuccauguc

SEQ ID NO: 1846547 - RNA, 14 nt, Human
ccugcaaagcccag

SEQ ID NO: 1846548 - RNA, 16 nt, Human
ccugcaaagcccagcu

SEQ ID NO: 1846549 - RNA, 15 nt, Human
ccugcaaagcccagc

SEQ ID NO: 1846550 - RNA, 20 nt, Human
ccugcacaaagcccuuccau

SEQ ID NO: 1846551 - RNA, 22 nt, Human
ccugcacaaagcccuuccaugu

SEQ ID NO: 1846552 - RNA, 18 nt, Human
ccugcaaagcccagcuug

SEQ ID NO: 1846553 - RNA, 17 nt, Human
ccugcaaagcccagcuu

SEQ ID NO: 1846554 - RNA, 16 nt, Human
ccugccacccugggga

SEQ ID NO: 1846555 - RNA, 22 nt, Human
ccugccacccuggggagaaagu

SEQ ID NO: 1846556 - RNA, 14 nt, Human
ccugccacccuggg

SEQ ID NO: 1846557 - RNA, 12 nt, Human
ccugccacccug

SEQ ID NO: 1846558 - RNA, 13 nt, Human
ccugccacccugg

SEQ ID NO: 1846559 - RNA, 23 nt, Human
ccugcauuugugaaaugauggug

SEQ ID NO: 1846560 - RNA, 19 nt, Human
ccugccaauggacuaacuu

SEQ ID NO: 1846561 - RNA, 19 nt, Human
ccugccaccacgcccggcu

SEQ ID NO: 1846562 - RNA, 15 nt, Human
ccugccaccacgccc

SEQ ID NO: 1846563 - RNA, 20 nt, Human
ccugagccagauuucacucu

SEQ ID NO: 1846564 - RNA, 22 nt, Human
ccugaagucuuuguacagacaa

SEQ ID NO: 1846565 - RNA, 19 nt, Human
ccugaaguaagcaaagacu

SEQ ID NO: 1846566 - RNA, 20 nt, Human
ccugaagucacacagugagu

SEQ ID NO: 1846567 - RNA, 19 nt, Human
ccugaagucacacagugag

SEQ ID NO: 1846568 - RNA, 18 nt, Human
ccugagccagauuucacu

SEQ ID NO: 1846569 - RNA, 16 nt, Human
ccugagccagauuuca

SEQ ID NO: 1846570 - RNA, 15 nt, Human
ccugagccagauuuc

SEQ ID NO: 1846571 - RNA, 18 nt, Human
ccugaggcccagagggcc

SEQ ID NO: 1846572 - RNA, 17 nt, Human
ccugaggcccagagggc

SEQ ID NO: 1846573 - RNA, 16 nt, Human
ccugaggcccagaggg

SEQ ID NO: 1846574 - RNA, 15 nt, Human
ccugaggcccagagg

SEQ ID NO: 1846575 - RNA, 12 nt, Human
ccugagcuggga

SEQ ID NO: 1846576 - RNA, 16 nt, Human
ccugaggcugggcucc

SEQ ID NO: 1846577 - RNA, 15 nt, Human
ccugaggcugggcuc

SEQ ID NO: 1846578 - RNA, 14 nt, Human
ccugaggcugggcu

SEQ ID NO: 1846579 - RNA, 13 nt, Human
ccugaggcugggc

SEQ ID NO: 1846580 - RNA, 13 nt, Human
ccugaggcuccac

SEQ ID NO: 1846581 - RNA, 14 nt, Human
ccugaggcuccacu

SEQ ID NO: 1846582 - RNA, 17 nt, Human
ccugaggcuccacuugg

SEQ ID NO: 1846583 - RNA, 15 nt, Human
ccugagcugggauga

SEQ ID NO: 1846584 - RNA, 21 nt, Human
ccugaaggccccgcccaggcu

SEQ ID NO: 1846585 - RNA, 20 nt, Human
ccugaaggccccgcccaggc

SEQ ID NO: 1846586 - RNA, 22 nt, Human
ccugaaggccccgcccaggcuu

SEQ ID NO: 1846587 - RNA, 19 nt, Human
ccugaaggccccgcccagg

SEQ ID NO: 1846588 - RNA, 18 nt, Human
ccugaaggccccgcccag

SEQ ID NO: 1846589 - RNA, 14 nt, Human
ccugaaggccccgc

SEQ ID NO: 1846590 - RNA, 18 nt, Human
ccugaaagcccugagcuu

SEQ ID NO: 1846591 - RNA, 14 nt, Human
ccugaaagcccuga

SEQ ID NO: 1846592 - RNA, 13 nt, Human
ccugaaagcccug

SEQ ID NO: 1846593 - RNA, 13 nt, Human
ccugaaagaggaa

SEQ ID NO: 1846594 - RNA, 11 nt, Human
ccucuuccuga

SEQ ID NO: 1846595 - RNA, 14 nt, Human
ccuggcaugggaau

SEQ ID NO: 1846596 - RNA, 19 nt, Human
ccugccuguugggccagga

SEQ ID NO: 1846597 - RNA, 18 nt, Human
ccugccuguugggccagg

SEQ ID NO: 1846598 - RNA, 20 nt, Human
ccugccuguugggccaggag

SEQ ID NO: 1846599 - RNA, 21 nt, Human
ccugcuaauuccccagauugc

SEQ ID NO: 1846600 - RNA, 13 nt, Human
ccuggagaacuag

SEQ ID NO: 1846601 - RNA, 12 nt, Human
ccuggagaacua

SEQ ID NO: 1846602 - RNA, 16 nt, Human
ccuggagaacuagaga

SEQ ID NO: 1846603 - RNA, 19 nt, Human
ccuggcacccggccccugc

SEQ ID NO: 1846604 - RNA, 12 nt, Human
ccuggcacugcu

SEQ ID NO: 1846605 - RNA, 20 nt, Human
ccuggcacccggccccugcu

SEQ ID NO: 1846606 - RNA, 21 nt, Human
ccuggcacccggccccugcug

SEQ ID NO: 1846607 - RNA, 13 nt, Human
ccuggcaugggaa

SEQ ID NO: 1846608 - RNA, 16 nt, Human
ccuggcacugcuucca

SEQ ID NO: 1846609 - RNA, 13 nt, Human
ccuggcacugcuu

SEQ ID NO: 1846610 - RNA, 14 nt, Human
ccuggcccacugca

SEQ ID NO: 1846611 - RNA, 13 nt, Human
ccuggcccacugc

SEQ ID NO: 1846612 - RNA, 13 nt, Human
ccuggccacgccc

SEQ ID NO: 1846613 - RNA, 21 nt, Human
ccuggccagaugcaccagccc

SEQ ID NO: 1846614 - RNA, 23 nt, Human
ccuggccagaugcaccagcccuu

SEQ ID NO: 1846615 - RNA, 20 nt, Human
ccuggccagaugcaccagcc

SEQ ID NO: 1846616 - RNA, 16 nt, Human
ccuggcccacugcauc

SEQ ID NO: 1846617 - RNA, 16 nt, Human
ccuggcuuuucacugc

SEQ ID NO: 1846618 - RNA, 17 nt, Human
ccuggcuuuucacugcu

SEQ ID NO: 1846619 - RNA, 19 nt, Human
ccugggggcugggcagagg

SEQ ID NO: 1846620 - RNA, 21 nt, Human
ccugggggcugggcagaggaa

SEQ ID NO: 1846621 - RNA, 20 nt, Human
ccugggggcugggcagagga

SEQ ID NO: 1846622 - RNA, 22 nt, Human
ccugggaggucaaggcugcagu

SEQ ID NO: 1846623 - RNA, 16 nt, Human
ccugggagugagcugg

SEQ ID NO: 1846624 - RNA, 16 nt, Human
ccugggcagaaggaag

SEQ ID NO: 1846625 - RNA, 18 nt, Human
ccugggagugagcugguu

SEQ ID NO: 1846626 - RNA, 15 nt, Human
ccugggcagaaggaa

SEQ ID NO: 1846627 - RNA, 21 nt, Human
ccugguggcagcucaccucuc

SEQ ID NO: 1846628 - RNA, 19 nt, Human
ccugguggcagcucaccuc

SEQ ID NO: 1846629 - RNA, 22 nt, Human
ccugguggcagcucaccucucc

SEQ ID NO: 1846630 - RNA, 14 nt, Human
ccugguggcagcug

SEQ ID NO: 1846631 - RNA, 15 nt, Human
ccugguggcagcugc

SEQ ID NO: 1846632 - RNA, 16 nt, Human
ccugguggcagcugcg

SEQ ID NO: 1846633 - RNA, 17 nt, Human
ccugguggcagcugcgg

SEQ ID NO: 1846634 - RNA, 18 nt, Human
ccugguggcagcugcggu

SEQ ID NO: 1846635 - RNA, 15 nt, Human
ccugucccccugaca

SEQ ID NO: 1846636 - RNA, 14 nt, Human
ccugucccccugac

SEQ ID NO: 1846637 - RNA, 13 nt, Human
ccugucccccuga

SEQ ID NO: 1846638 - RNA, 12 nt, Human
ccugucccccug

SEQ ID NO: 1846639 - RNA, 10 nt, Human
ccuguaccuc

SEQ ID NO: 1846640 - RNA, 12 nt, Human
ccuguaccucuu

SEQ ID NO: 1846641 - RNA, 15 nt, Human
ccugguggcaguggg

SEQ ID NO: 1846642 - RNA, 13 nt, Human
ccugguggcagug

SEQ ID NO: 1846643 - RNA, 14 nt, Human
ccugguggcagugg

SEQ ID NO: 1846644 - RNA, 16 nt, Human
ccuguagagugggagc

SEQ ID NO: 1846645 - RNA, 15 nt, Human
ccuguagagugggag

SEQ ID NO: 1846646 - RNA, 13 nt, Human
ccuguagcccuaa

SEQ ID NO: 1846647 - RNA, 22 nt, Human
gaaagcagaacagugauuacca

SEQ ID NO: 1846648 - RNA, 17 nt, Human
gaaagcagaacagugau

SEQ ID NO: 1846649 - RNA, 16 nt, Human
gaaagaguaggaagac

SEQ ID NO: 1846650 - RNA, 15 nt, Human
gaaagaguaggaaga

SEQ ID NO: 1846651 - RNA, 21 nt, Human
gaaagaguacucuuguuuccu

SEQ ID NO: 1846652 - RNA, 21 nt, Human
gaaagaggaaugaaguacuca

SEQ ID NO: 1846653 - RNA, 19 nt, Human
gaaagacuuuuccaacccu

SEQ ID NO: 1846654 - RNA, 14 nt, Human
gaaagcagggacuu

SEQ ID NO: 1846655 - RNA, 22 nt, Human
gaaagcccugagcuuucugcua

SEQ ID NO: 1846656 - RNA, 21 nt, Human
gaaagcccugagcuuucugcu

SEQ ID NO: 1846657 - RNA, 17 nt, Human
gaaagcccugagcuuuc

SEQ ID NO: 1846658 - RNA, 17 nt, Human
gaaagcccugugcucca

SEQ ID NO: 1846659 - RNA, 19 nt, Human
gaaacccagcucuggucca

SEQ ID NO: 1846660 - RNA, 18 nt, Human
gaaacccagcucuggucc

SEQ ID NO: 1846661 - RNA, 16 nt, Human
gaaacccagcucuggu

SEQ ID NO: 1846662 - RNA, 15 nt, Human
gaaacccagcucugg

SEQ ID NO: 1846663 - RNA, 14 nt, Human
gaaacccagcucug

SEQ ID NO: 1846664 - RNA, 13 nt, Human
gaaacccagcucu

SEQ ID NO: 1846665 - RNA, 23 nt, Human
gaaacccagcucugguccauaga

SEQ ID NO: 1846666 - RNA, 14 nt, Human
gaaacccugucucu

SEQ ID NO: 1846667 - RNA, 19 nt, Human
gaaacuaggugcauauuua

SEQ ID NO: 1846668 - RNA, 22 nt, Human
gaaaacacuguucucugcccuc

SEQ ID NO: 1846669 - RNA, 24 nt, Human
gaaaacacuguucucugcccucca

SEQ ID NO: 1846670 - RNA, 22 nt, Human
gaaaacguggcugcuucaagga

SEQ ID NO: 1846671 - RNA, 20 nt, Human
gaaaacguggcugcuucaag

SEQ ID NO: 1846672 - RNA, 19 nt, Human
gaaaagcugcugacagugu

SEQ ID NO: 1846673 - RNA, 18 nt, Human
gaaaagggaacugaacau

SEQ ID NO: 1846674 - RNA, 19 nt, Human
gaaaaguuuuguaaauuuc

SEQ ID NO: 1846675 - RNA, 22 nt, Human
gaaaaucagccugcuccagcug

SEQ ID NO: 1846676 - RNA, 20 nt, Human
gaaaaucagccugcuccagc

SEQ ID NO: 1846677 - RNA, 22 nt, Human
gaaaaucuacacuccagugaga

SEQ ID NO: 1846678 - RNA, 18 nt, Human
gaaaaucuuauaauuuaa

SEQ ID NO: 1846679 - RNA, 22 nt, Human
cuuuuuuggcugcugaaggcuc

SEQ ID NO: 1846680 - RNA, 20 nt, Human
cuuuuuuggcugcugaaggc

SEQ ID NO: 1846681 - RNA, 17 nt, Human
cuuuuuuggcugcugaa

SEQ ID NO: 1846682 - RNA, 16 nt, Human
cuuuuuuggcugcuga

SEQ ID NO: 1846683 - RNA, 15 nt, Human
gaaaaaggaggaaga

SEQ ID NO: 1846684 - RNA, 12 nt, Human
gaaaaaggagga

SEQ ID NO: 1846685 - RNA, 18 nt, Human
gaaaacacauuuuucuua

SEQ ID NO: 1846686 - RNA, 19 nt, Human
gaaaacacauuuuucuuag

SEQ ID NO: 1846687 - RNA, 18 nt, Human
gaaaacacuguucucugc

SEQ ID NO: 1846688 - RNA, 11 nt, Human
cuuuuguucuu

SEQ ID NO: 1846689 - RNA, 12 nt, Human
cuuuuguucuug

SEQ ID NO: 1846690 - RNA, 18 nt, Human
cuuuguuaguuucuccaa

SEQ ID NO: 1846691 - RNA, 20 nt, Human
cuuuuguucuugguuuguaa

SEQ ID NO: 1846692 - RNA, 17 nt, Human
cuuuuuauggccuguga

SEQ ID NO: 1846693 - RNA, 21 nt, Human
cuuuaucuugaauaauguaag

SEQ ID NO: 1846694 - RNA, 18 nt, Human
cuuuaucuugaauaaugu

SEQ ID NO: 1846695 - RNA, 15 nt, Human
cuuuaugcacaaaau

SEQ ID NO: 1846696 - RNA, 23 nt, Human
cuuuaucuugaauaauguaagac

SEQ ID NO: 1846697 - RNA, 19 nt, Human
cuuuauaauucuacuuuga

SEQ ID NO: 1846698 - RNA, 13 nt, Human
cuuuauaauucua

SEQ ID NO: 1846699 - RNA, 14 nt, Human
cuuuagcgcccagu

SEQ ID NO: 1846700 - RNA, 15 nt, Human
cuuuagcgcccaguu

SEQ ID NO: 1846701 - RNA, 22 nt, Human
cuuuaccuuuuuuauacauaaa

SEQ ID NO: 1846702 - RNA, 13 nt, Human
cuuuacuauggcc

SEQ ID NO: 1846703 - RNA, 17 nt, Human
cuuguacuuuauuuucu

SEQ ID NO: 1846704 - RNA, 15 nt, Human
cuuguacauaaugcg

SEQ ID NO: 1846705 - RNA, 12 nt, Human
cuuguacauaau

SEQ ID NO: 1846706 - RNA, 17 nt, Human
cuuguaaauagcucagg

SEQ ID NO: 1846707 - RNA, 18 nt, Human
cuuguaaauagcucaggu

SEQ ID NO: 1846708 - RNA, 19 nt, Human
cuuguacauaaugcgugca

SEQ ID NO: 1846709 - RNA, 21 nt, Human
cuuguacauaaugcgugcaua

SEQ ID NO: 1846710 - RNA, 22 nt, Human
cuuguacauaaugcgugcauac

SEQ ID NO: 1846711 - RNA, 21 nt, Human
cuuguaaauagcucagguguc

SEQ ID NO: 1846712 - RNA, 16 nt, Human
cuuguaaauagcucag

SEQ ID NO: 1846713 - RNA, 23 nt, Human
cuuggggggcugaggugggagga

SEQ ID NO: 1846714 - RNA, 19 nt, Human
cuugaguuuaaauuguaau

SEQ ID NO: 1846715 - RNA, 17 nt, Human
cuuucuggcuaugcauu

SEQ ID NO: 1846716 - RNA, 18 nt, Human
cuuucuggcuaugcauuu

SEQ ID NO: 1846717 - RNA, 19 nt, Human
cuuucuggcuaugcauuug

SEQ ID NO: 1846718 - RNA, 20 nt, Human
cuuucuggcuaugcauuuga

SEQ ID NO: 1846719 - RNA, 20 nt, Human
cuuucugggcaccggggccu

SEQ ID NO: 1846720 - RNA, 11 nt, Human
cuuucuuccuc

SEQ ID NO: 1846721 - RNA, 15 nt, Human
cuuuccugaggcugg

SEQ ID NO: 1846722 - RNA, 13 nt, Human
cuuuccugaggcu

SEQ ID NO: 1846723 - RNA, 16 nt, Human
cuuucccucccuuccu

SEQ ID NO: 1846724 - RNA, 14 nt, Human
cuuucccucccuuc

SEQ ID NO: 1846725 - RNA, 13 nt, Human
cuuucccucccuu

SEQ ID NO: 1846726 - RNA, 11 nt, Human
cuuucccuccc

SEQ ID NO: 1846727 - RNA, 12 nt, Human
cuuuccugaggc

SEQ ID NO: 1846728 - RNA, 15 nt, Human
cuuuccaggaaggcu

SEQ ID NO: 1846729 - RNA, 15 nt, Human
cuuuccaucuacccu

SEQ ID NO: 1846730 - RNA, 14 nt, Human
cuuugaccucugca

SEQ ID NO: 1846731 - RNA, 15 nt, Human
cuuugaccucugcag

SEQ ID NO: 1846732 - RNA, 15 nt, Human
cuuucuuccucugcu

SEQ ID NO: 1846733 - RNA, 14 nt, Human
cuuucuuccucugc

SEQ ID NO: 1846734 - RNA, 13 nt, Human
cuuucuuccucug

SEQ ID NO: 1846735 - RNA, 12 nt, Human
cuuucuuccucu

SEQ ID NO: 1846736 - RNA, 17 nt, Human
cuuugaccucugcagca

SEQ ID NO: 1846737 - RNA, 18 nt, Human
cuuugaccucugcagcaa

SEQ ID NO: 1846738 - RNA, 20 nt, Human
cuuugaccucugcagcaaua

SEQ ID NO: 1846739 - RNA, 24 nt, Human
cuuugaccucugcagcaauaaagc

SEQ ID NO: 1846740 - RNA, 22 nt, Human
cuuugcauaacguauaaaagcc

SEQ ID NO: 1846741 - RNA, 16 nt, Human
cuuugcagacaggcaa

SEQ ID NO: 1846742 - RNA, 13 nt, Human
cuuugaccucugc

SEQ ID NO: 1846743 - RNA, 20 nt, Human
cuuugcagacaggcaagcac

SEQ ID NO: 1846744 - RNA, 15 nt, Human
cuuuguccccaccgc

SEQ ID NO: 1846745 - RNA, 15 nt, Human
cuuugugaggaagcc

SEQ ID NO: 1846746 - RNA, 14 nt, Human
cuuuguccccaccg

SEQ ID NO: 1846747 - RNA, 19 nt, Human
cuuuggcuauuagagauca

SEQ ID NO: 1846748 - RNA, 19 nt, Human
cuucucuccagccccugga

SEQ ID NO: 1846749 - RNA, 17 nt, Human
cuucucuccagccccug

SEQ ID NO: 1846750 - RNA, 15 nt, Human
cuucucuccagcccc

SEQ ID NO: 1846751 - RNA, 13 nt, Human
cuucucuccagcc

SEQ ID NO: 1846752 - RNA, 12 nt, Human
cuucucuccagc

SEQ ID NO: 1846753 - RNA, 19 nt, Human
cuucuccuucaccuuuguc

SEQ ID NO: 1846754 - RNA, 20 nt, Human
cuucuccuuagaaguggaag

SEQ ID NO: 1846755 - RNA, 13 nt, Human
cuucucugaagga

SEQ ID NO: 1846756 - RNA, 17 nt, Human
cuucuccacuggaugga

SEQ ID NO: 1846757 - RNA, 12 nt, Human
cuucuccaggcu

SEQ ID NO: 1846758 - RNA, 13 nt, Human
cuucuccaggcug

SEQ ID NO: 1846759 - RNA, 20 nt, Human
cuucuccacuuucuagccag

SEQ ID NO: 1846760 - RNA, 11 nt, Human
cuucuccacuu

SEQ ID NO: 1846761 - RNA, 13 nt, Human
cuucuccacugga

SEQ ID NO: 1846762 - RNA, 15 nt, Human
cuucuccacuggaug

SEQ ID NO: 1846763 - RNA, 14 nt, Human
cuucuccacuggau

SEQ ID NO: 1846764 - RNA, 15 nt, Human
cuuccucccucauuc

SEQ ID NO: 1846765 - RNA, 23 nt, Human
cuucuggguuccuuccucugagc

SEQ ID NO: 1846766 - RNA, 17 nt, Human
cuucuggguuccuuccu

SEQ ID NO: 1846767 - RNA, 16 nt, Human
cuucuggguuccuucc

SEQ ID NO: 1846768 - RNA, 14 nt, Human
cuucugguugaugc

SEQ ID NO: 1846769 - RNA, 13 nt, Human
cuucugcuucagc

SEQ ID NO: 1846770 - RNA, 21 nt, Human
cuucuguacgucugacaggca

SEQ ID NO: 1846771 - RNA, 14 nt, Human
cuucuguacgucug

SEQ ID NO: 1846772 - RNA, 15 nt, Human
cuucuguacgucuga

SEQ ID NO: 1846773 - RNA, 18 nt, Human
cuucuguacgucugacag

SEQ ID NO: 1846774 - RNA, 20 nt, Human
cuucuguacgucugacaggc

SEQ ID NO: 1846775 - RNA, 16 nt, Human
cuucuguccuacucug

SEQ ID NO: 1846776 - RNA, 17 nt, Human
cuucuguccuacucugu

SEQ ID NO: 1846777 - RNA, 18 nt, Human
cuucuguccuacucugug

SEQ ID NO: 1846778 - RNA, 19 nt, Human
cuucuguccuacucugugu

SEQ ID NO: 1846779 - RNA, 21 nt, Human
cuucuguccuacucuguguca

SEQ ID NO: 1846780 - RNA, 16 nt, Human
cuugagccugggaggu

SEQ ID NO: 1846781 - RNA, 17 nt, Human
cuugagccuugaacuuu

SEQ ID NO: 1846782 - RNA, 18 nt, Human
cuugagccuugaacuuug

SEQ ID NO: 1846783 - RNA, 15 nt, Human
cuugagccuugaacu

SEQ ID NO: 1846784 - RNA, 21 nt, Human
cuugaggguugggcugguguc

SEQ ID NO: 1846785 - RNA, 19 nt, Human
cuugaggguugggcuggug

SEQ ID NO: 1846786 - RNA, 20 nt, Human
cuugaggguugggcuggugu

SEQ ID NO: 1846787 - RNA, 23 nt, Human
cuugaccauucuccaccugccag

SEQ ID NO: 1846788 - RNA, 22 nt, Human
cuugaccauucuccaccugcca

SEQ ID NO: 1846789 - RNA, 17 nt, Human
cuugaccgugaggccag

SEQ ID NO: 1846790 - RNA, 16 nt, Human
cuugaagacuuuucuu

SEQ ID NO: 1846791 - RNA, 20 nt, Human
cuugaccgugaggccagaga

SEQ ID NO: 1846792 - RNA, 18 nt, Human
cuugaccgugaggccaga

SEQ ID NO: 1846793 - RNA, 21 nt, Human
cuugaccgugaggccagagac

SEQ ID NO: 1846794 - RNA, 13 nt, Human
cuugaccucaggu

SEQ ID NO: 1846795 - RNA, 17 nt, Human
cuugaacuuugaccucu

SEQ ID NO: 1846796 - RNA, 21 nt, Human
cuugaacuuugaccucugcag

SEQ ID NO: 1846797 - RNA, 18 nt, Human
cuugaacuccugaccuca

SEQ ID NO: 1846798 - RNA, 16 nt, Human
cuugaacuccugaccu

SEQ ID NO: 1846799 - RNA, 13 nt, Human
cuugaacuccuga

SEQ ID NO: 1846800 - RNA, 13 nt, Human
cuugaacuccugg

SEQ ID NO: 1846801 - RNA, 18 nt, Human
cuugaaaauuaacaugaa

SEQ ID NO: 1846802 - RNA, 13 nt, Human
cuugaaaauuaac

SEQ ID NO: 1846803 - RNA, 12 nt, Human
cuugaaaauuaa

SEQ ID NO: 1846804 - RNA, 23 nt, Human
cuugaaaacacuguucucugccc

SEQ ID NO: 1846805 - RNA, 14 nt, Human
cuugaaaacacugu

SEQ ID NO: 1846806 - RNA, 18 nt, Human
cuugaaaaaugcauguug

SEQ ID NO: 1846807 - RNA, 12 nt, Human
cuugaaaaaugc

SEQ ID NO: 1846808 - RNA, 22 nt, Human
cuucuuuauaauucuacuuuga

SEQ ID NO: 1846809 - RNA, 21 nt, Human
cuucuguggguuucuaaagcu

SEQ ID NO: 1846810 - RNA, 14 nt, Human
cuucuguggguuuc

SEQ ID NO: 1846811 - RNA, 13 nt, Human
cuucuguggguuu

SEQ ID NO: 1846812 - RNA, 22 nt, Human
cuucuguggcucacagaacccu

SEQ ID NO: 1846813 - RNA, 15 nt, Human
cuucuguggcucaca

SEQ ID NO: 1846814 - RNA, 13 nt, Human
cuucuguggcuca

SEQ ID NO: 1846815 - RNA, 15 nt, Human
cuucuguugcugccu

SEQ ID NO: 1846816 - RNA, 14 nt, Human
cuuccaggcuggga

SEQ ID NO: 1846817 - RNA, 12 nt, Human
cuuccaggcugg

SEQ ID NO: 1846818 - RNA, 21 nt, Human
cuuccacaagagcccaggccu

SEQ ID NO: 1846819 - RNA, 19 nt, Human
cuuccacaagagcccaggc

SEQ ID NO: 1846820 - RNA, 17 nt, Human
cuuccacaagagcccag

SEQ ID NO: 1846821 - RNA, 20 nt, Human
cuucauucaacccaccugcg

SEQ ID NO: 1846822 - RNA, 17 nt, Human
cuucaguggcagcugcu

SEQ ID NO: 1846823 - RNA, 23 nt, Human
cuucaguaagccgugauuuucau

SEQ ID NO: 1846824 - RNA, 16 nt, Human
cuucaguaagccguga

SEQ ID NO: 1846825 - RNA, 15 nt, Human
cuucagggagugagg

SEQ ID NO: 1846826 - RNA, 22 nt, Human
cuucaggcucuucuccuuucac

SEQ ID NO: 1846827 - RNA, 19 nt, Human
cuucaggcucuucuccuuu

SEQ ID NO: 1846828 - RNA, 22 nt, Human
cuucagugccuuauggaacacu

SEQ ID NO: 1846829 - RNA, 18 nt, Human
cuucagugccuuauggaa

SEQ ID NO: 1846830 - RNA, 13 nt, Human
cuucaguggcagc

SEQ ID NO: 1846831 - RNA, 14 nt, Human
cuucaguggcagcu

SEQ ID NO: 1846832 - RNA, 15 nt, Human
cuucaguggcagcug

SEQ ID NO: 1846833 - RNA, 16 nt, Human
cuucaguggcagcugc

SEQ ID NO: 1846834 - RNA, 21 nt, Human
cuuccaggggugggacacccu

SEQ ID NO: 1846835 - RNA, 17 nt, Human
cuuccaggggugggaca

SEQ ID NO: 1846836 - RNA, 15 nt, Human
cuuccagggguggga

SEQ ID NO: 1846837 - RNA, 14 nt, Human
cuuccagggguggg

SEQ ID NO: 1846838 - RNA, 19 nt, Human
cuuccaggcugggagagcc

SEQ ID NO: 1846839 - RNA, 16 nt, Human
cuuccaggcugggaga

SEQ ID NO: 1846840 - RNA, 15 nt, Human
cuuccaggcugggag

SEQ ID NO: 1846841 - RNA, 19 nt, Human
cuuccuaauuccacagcug

SEQ ID NO: 1846842 - RNA, 18 nt, Human
cuuccuaauuccacagcu

SEQ ID NO: 1846843 - RNA, 17 nt, Human
cuuccuaauuccacagc

SEQ ID NO: 1846844 - RNA, 13 nt, Human
cuuccuaauucca

SEQ ID NO: 1846845 - RNA, 13 nt, Human
cuuccucccucau

SEQ ID NO: 1846846 - RNA, 17 nt, Human
cuucccuacaguugaaa

SEQ ID NO: 1846847 - RNA, 19 nt, Human
cuucccgcucagcccuccc

SEQ ID NO: 1846848 - RNA, 23 nt, Human
cuucccgcucagcccucccugcc

SEQ ID NO: 1846849 - RNA, 14 nt, Human
cuuauagacaacau

SEQ ID NO: 1846850 - RNA, 13 nt, Human
cuuauauuaugga

SEQ ID NO: 1846851 - RNA, 19 nt, Human
cuuagucacugagacagcc

SEQ ID NO: 1846852 - RNA, 18 nt, Human
cuuagucacugagacagc

SEQ ID NO: 1846853 - RNA, 13 nt, Human
cuuagauguauau

SEQ ID NO: 1846854 - RNA, 16 nt, Human
cuuagucacugagaca

SEQ ID NO: 1846855 - RNA, 19 nt, Human
cuuagauguauauauuucc

SEQ ID NO: 1846856 - RNA, 16 nt, Human
cuguucuggcagaguu

SEQ ID NO: 1846857 - RNA, 16 nt, Human
cuguucugcacacagc

SEQ ID NO: 1846858 - RNA, 17 nt, Human
cuucaaagcaaaugucu

SEQ ID NO: 1846859 - RNA, 18 nt, Human
cuuauuuaaugaaagacu

SEQ ID NO: 1846860 - RNA, 17 nt, Human
cuuauuuaaugaaagac

SEQ ID NO: 1846861 - RNA, 16 nt, Human
cuucaaggauccugag

SEQ ID NO: 1846862 - RNA, 15 nt, Human
cuucaaggauccuga

SEQ ID NO: 1846863 - RNA, 13 nt, Human
cuucaaggauccu

SEQ ID NO: 1846864 - RNA, 10 nt, Human
cuucaaggau

SEQ ID NO: 1846865 - RNA, 16 nt, Human
cuucaacucccugccc

SEQ ID NO: 1846866 - RNA, 20 nt, Human
cuucaaccauuccccauggg

SEQ ID NO: 1846867 - RNA, 16 nt, Human
cuucaaccauucccca

SEQ ID NO: 1846868 - RNA, 23 nt, Human
cuucacagaugggugcuuggagg

SEQ ID NO: 1846869 - RNA, 13 nt, Human
cuguacagagccc

SEQ ID NO: 1846870 - RNA, 13 nt, Human
cugucaauuacag

SEQ ID NO: 1846871 - RNA, 17 nt, Human
cuguccaggcacugcug

SEQ ID NO: 1846872 - RNA, 23 nt, Human
cuguccaggcacugcugcccagc

SEQ ID NO: 1846873 - RNA, 23 nt, Human
cuguaucccaugagccucagcau

SEQ ID NO: 1846874 - RNA, 22 nt, Human
cuguccccgcacugggcuuggg

SEQ ID NO: 1846875 - RNA, 19 nt, Human
cuguccccgcacugggcuu

SEQ ID NO: 1846876 - RNA, 18 nt, Human
cuguccccgcacugggcu

SEQ ID NO: 1846877 - RNA, 17 nt, Human
cuguccccgcacugggc

SEQ ID NO: 1846878 - RNA, 20 nt, Human
cugucccuuacgugaguccu

SEQ ID NO: 1846879 - RNA, 14 nt, Human
cuguccgagcuuug

SEQ ID NO: 1846880 - RNA, 18 nt, Human
cugucucaaaaaaagaaa

SEQ ID NO: 1846881 - RNA, 22 nt, Human
cugucucaagagggcacuggug

SEQ ID NO: 1846882 - RNA, 16 nt, Human
cugucucaaaaaaaga

SEQ ID NO: 1846883 - RNA, 23 nt, Human
cugucucaaaaaaacacaaaagu

SEQ ID NO: 1846884 - RNA, 14 nt, Human
cuguccuacccacc

SEQ ID NO: 1846885 - RNA, 15 nt, Human
cuguccgagcuuuga

SEQ ID NO: 1846886 - RNA, 22 nt, Human
cugucccuuacgugaguccugg

SEQ ID NO: 1846887 - RNA, 17 nt, Human
cuggguucuacccaggu

SEQ ID NO: 1846888 - RNA, 16 nt, Human
cuggguucuacccagg

SEQ ID NO: 1846889 - RNA, 15 nt, Human
cuggguucuacccag

SEQ ID NO: 1846890 - RNA, 14 nt, Human
cuggguucuaccca

SEQ ID NO: 1846891 - RNA, 20 nt, Human
cuggguaacuagggaagaua

SEQ ID NO: 1846892 - RNA, 22 nt, Human
cuggguaacuagggaagauaau

SEQ ID NO: 1846893 - RNA, 24 nt, Human
cugggcuucaguggcagcugcuuu

SEQ ID NO: 1846894 - RNA, 13 nt, Human
cugggggaagaag

SEQ ID NO: 1846895 - RNA, 22 nt, Human
cugggggggauuguaaaauggu

SEQ ID NO: 1846896 - RNA, 19 nt, Human
cugggggcugggcagagga

SEQ ID NO: 1846897 - RNA, 15 nt, Human
cugggggaagaagcu

SEQ ID NO: 1846898 - RNA, 15 nt, Human
cuguacaaaguagaa

SEQ ID NO: 1846899 - RNA, 13 nt, Human
cuguacaaaguag

SEQ ID NO: 1846900 - RNA, 20 nt, Human
cuguaauccuagcacuuugg

SEQ ID NO: 1846901 - RNA, 23 nt, Human
cuguaaucacagcuacuugggag

SEQ ID NO: 1846902 - RNA, 13 nt, Human
cugguuccucccc

SEQ ID NO: 1846903 - RNA, 16 nt, Human
cugguuccauggccuc

SEQ ID NO: 1846904 - RNA, 12 nt, Human
cugguuccuccc

SEQ ID NO: 1846905 - RNA, 18 nt, Human
cuggucacaggacucugc

SEQ ID NO: 1846906 - RNA, 22 nt, Human
cuggugcugccacacuucaggc

SEQ ID NO: 1846907 - RNA, 20 nt, Human
cuggugcugccacacuucag

SEQ ID NO: 1846908 - RNA, 13 nt, Human
cuggugcugccac

SEQ ID NO: 1846909 - RNA, 12 nt, Human
cuggugcugcca

SEQ ID NO: 1846910 - RNA, 23 nt, Human
cugguggcagcucaccucucccu

SEQ ID NO: 1846911 - RNA, 21 nt, Human
cugguggcagcucaccucucc

SEQ ID NO: 1846912 - RNA, 23 nt, Human
cugguggcccgacagccuggcac

SEQ ID NO: 1846913 - RNA, 22 nt, Human
cugguggcccgacagccuggca

SEQ ID NO: 1846914 - RNA, 21 nt, Human
cugguggcccgacagccuggc

SEQ ID NO: 1846915 - RNA, 20 nt, Human
cugguggcccgacagccugg

SEQ ID NO: 1846916 - RNA, 13 nt, Human
cugguggcagcug

SEQ ID NO: 1846917 - RNA, 14 nt, Human
cugguggcagcugc

SEQ ID NO: 1846918 - RNA, 21 nt, Human
cuguucagcugguugagguuu

SEQ ID NO: 1846919 - RNA, 19 nt, Human
cuguucagcugguugaggu

SEQ ID NO: 1846920 - RNA, 13 nt, Human
cuguuacugucuu

SEQ ID NO: 1846921 - RNA, 18 nt, Human
cuguucccauucuugcau

SEQ ID NO: 1846922 - RNA, 17 nt, Human
cuguucucugcccucca

SEQ ID NO: 1846923 - RNA, 16 nt, Human
cuguucucugcccucc

SEQ ID NO: 1846924 - RNA, 15 nt, Human
cuguucucugcccuc

SEQ ID NO: 1846925 - RNA, 14 nt, Human
cuguucucugcccu

SEQ ID NO: 1846926 - RNA, 19 nt, Human
cuguucucugcccuccaag

SEQ ID NO: 1846927 - RNA, 18 nt, Human
cuguucucugcccuccaa

SEQ ID NO: 1846928 - RNA, 20 nt, Human
cuguucucugcccuccaaga

SEQ ID NO: 1846929 - RNA, 13 nt, Human
cuguucucugccc

SEQ ID NO: 1846930 - RNA, 21 nt, Human
cugugugcucaggagcccugg

SEQ ID NO: 1846931 - RNA, 20 nt, Human
cugugugcucaggagcccug

SEQ ID NO: 1846932 - RNA, 16 nt, Human
cugugugcucaggagc

SEQ ID NO: 1846933 - RNA, 19 nt, Human
cugugugcucaggagcccu

SEQ ID NO: 1846934 - RNA, 15 nt, Human
cuguguggcagucug

SEQ ID NO: 1846935 - RNA, 23 nt, Human
cugugugcucaggagcccuggga

SEQ ID NO: 1846936 - RNA, 23 nt, Human
cugugggcgugagaccugccccu

SEQ ID NO: 1846937 - RNA, 21 nt, Human
cugugucuugcaauggcagcc

SEQ ID NO: 1846938 - RNA, 22 nt, Human
cugugucuugcaauggcagccu

SEQ ID NO: 1846939 - RNA, 23 nt, Human
cugugucuugcaauggcagccuu

SEQ ID NO: 1846940 - RNA, 20 nt, Human
cugugugugcgccuacagga

SEQ ID NO: 1846941 - RNA, 23 nt, Human
cugucucaagagggcacuggugg

SEQ ID NO: 1846942 - RNA, 18 nt, Human
cugucuccauguuugaug

SEQ ID NO: 1846943 - RNA, 21 nt, Human
cugugaguacuacaguccucc

SEQ ID NO: 1846944 - RNA, 20 nt, Human
cugugaguacuacaguccuc

SEQ ID NO: 1846945 - RNA, 23 nt, Human
cugugaguacuacaguccuccca

SEQ ID NO: 1846946 - RNA, 17 nt, Human
cugugauggggcccugc

SEQ ID NO: 1846947 - RNA, 18 nt, Human
cugugauggggcccugcc

SEQ ID NO: 1846948 - RNA, 14 nt, Human
cugugccauuuugu

SEQ ID NO: 1846949 - RNA, 22 nt, Human
cugugccauuuuguauuuuacu

SEQ ID NO: 1846950 - RNA, 16 nt, Human
cugugccaugugccag

SEQ ID NO: 1846951 - RNA, 18 nt, Human
cugugccaugugccaggu

SEQ ID NO: 1846952 - RNA, 20 nt, Human
cugugauggggcccugccuc

SEQ ID NO: 1846953 - RNA, 19 nt, Human
cugugauggggcccugccu

SEQ ID NO: 1846954 - RNA, 14 nt, Human
cugugggcccccaa

SEQ ID NO: 1846955 - RNA, 22 nt, Human
cugugggcgugagaccugcccc

SEQ ID NO: 1846956 - RNA, 21 nt, Human
cugugggcgugagaccugccc

SEQ ID NO: 1846957 - RNA, 18 nt, Human
cuguggccaaguucuuag

SEQ ID NO: 1846958 - RNA, 16 nt, Human
cuguggccaaguucuu

SEQ ID NO: 1846959 - RNA, 17 nt, Human
cuguggaugauaaaaca

SEQ ID NO: 1846960 - RNA, 18 nt, Human
cugugccucugggacugg

SEQ ID NO: 1846961 - RNA, 17 nt, Human
cugugccucugggacug

SEQ ID NO: 1846962 - RNA, 22 nt, Human
cugugcugcccugcccaccugg

SEQ ID NO: 1846963 - RNA, 16 nt, Human
cugugccucugggacu

SEQ ID NO: 1846964 - RNA, 14 nt, Human
cugugccucuggga

SEQ ID NO: 1846965 - RNA, 11 nt, Human
cugugccucug

SEQ ID NO: 1846966 - RNA, 13 nt, Human
cuggaauuugaaa

SEQ ID NO: 1846967 - RNA, 23 nt, Human
cuggacaggcauguucucugagg

SEQ ID NO: 1846968 - RNA, 14 nt, Human
cuggacaggcaugu

SEQ ID NO: 1846969 - RNA, 17 nt, Human
cuggacaggcauguucu

SEQ ID NO: 1846970 - RNA, 16 nt, Human
cuggaccuugaacugg

SEQ ID NO: 1846971 - RNA, 15 nt, Human
cuggacccuguggau

SEQ ID NO: 1846972 - RNA, 19 nt, Human
cuggacuccucuguccagg

SEQ ID NO: 1846973 - RNA, 18 nt, Human
cuggacuccucuguccag

SEQ ID NO: 1846974 - RNA, 17 nt, Human
cuggacuccucugucca

SEQ ID NO: 1846975 - RNA, 14 nt, Human
cuggacuccucugu

SEQ ID NO: 1846976 - RNA, 17 nt, Human
cuggaccuugaacuggg

SEQ ID NO: 1846977 - RNA, 20 nt, Human
cuggaccuugaacuggguac

SEQ ID NO: 1846978 - RNA, 21 nt, Human
cuggaccuugaacuggguacu

SEQ ID NO: 1846979 - RNA, 16 nt, Human
cuggagcucugcccau

SEQ ID NO: 1846980 - RNA, 12 nt, Human
cuggagcucugc

SEQ ID NO: 1846981 - RNA, 13 nt, Human
cuggagcucugcc

SEQ ID NO: 1846982 - RNA, 17 nt, Human
cuggagguacgaaaaga

SEQ ID NO: 1846983 - RNA, 22 nt, Human
cuggagguacgaaaagagggga

SEQ ID NO: 1846984 - RNA, 14 nt, Human
cuggagugcaguga

SEQ ID NO: 1846985 - RNA, 15 nt, Human
cuggagugcagugag

SEQ ID NO: 1846986 - RNA, 16 nt, Human
cuggagugcagugagc

SEQ ID NO: 1846987 - RNA, 17 nt, Human
cuggagugcagugagcc

SEQ ID NO: 1846988 - RNA, 14 nt, Human
cuggccagaugcac

SEQ ID NO: 1846989 - RNA, 19 nt, Human
cuggcaguggaacuaagaa

SEQ ID NO: 1846990 - RNA, 15 nt, Human
cuggcccacugcauc

SEQ ID NO: 1846991 - RNA, 21 nt, Human
cuggcacuuggagacuuguau

SEQ ID NO: 1846992 - RNA, 14 nt, Human
cuggcacuuggaga

SEQ ID NO: 1846993 - RNA, 23 nt, Human
cuggcacugcuuccagugaggcu

SEQ ID NO: 1846994 - RNA, 20 nt, Human
cuggcacugcuuccagugag

SEQ ID NO: 1846995 - RNA, 19 nt, Human
cuggcacugcuuccaguga

SEQ ID NO: 1846996 - RNA, 22 nt, Human
cuggcacccggccccugcuggu

SEQ ID NO: 1846997 - RNA, 20 nt, Human
cuggcacccggccccugcug

SEQ ID NO: 1846998 - RNA, 21 nt, Human
cuggcacccggccccugcugg

SEQ ID NO: 1846999 - RNA, 19 nt, Human
cuggcacccggccccugcu

SEQ ID NO: 1847000 - RNA, 20 nt, Human
cuggagugcagugagccgag

SEQ ID NO: 1847001 - RNA, 22 nt, Human
cuggccuucggccuccauccug

SEQ ID NO: 1847002 - RNA, 24 nt, Human
cuggccuggccccucagggucccu

SEQ ID NO: 1847003 - RNA, 13 nt, Human
cuggccuggcccc

SEQ ID NO: 1847004 - RNA, 20 nt, Human
cuggccucugcacuccccug

SEQ ID NO: 1847005 - RNA, 18 nt, Human
cuggccucugcacucccc

SEQ ID NO: 1847006 - RNA, 21 nt, Human
cuggccucugcacuccccugc

SEQ ID NO: 1847007 - RNA, 24 nt, Human
cuggcucuuccaggcugggagagc

SEQ ID NO: 1847008 - RNA, 22 nt, Human
cuggcucuuccaggcugggaga

SEQ ID NO: 1847009 - RNA, 21 nt, Human
cuggcucuuccaggcugggag

SEQ ID NO: 1847010 - RNA, 23 nt, Human
cuggccuucggccuccauccuga

SEQ ID NO: 1847011 - RNA, 14 nt, Human
cuggccugugucua

SEQ ID NO: 1847012 - RNA, 14 nt, Human
cuggcgugcagugg

SEQ ID NO: 1847013 - RNA, 15 nt, Human
cuggcgugcaguggu

SEQ ID NO: 1847014 - RNA, 15 nt, Human
cugcugcuggcuggu

SEQ ID NO: 1847015 - RNA, 23 nt, Human
cugcuuccagugaggcucugccc

SEQ ID NO: 1847016 - RNA, 21 nt, Human
cugcuuccagugaggcucugc

SEQ ID NO: 1847017 - RNA, 20 nt, Human
cugcuuccagugaggcucug

SEQ ID NO: 1847018 - RNA, 19 nt, Human
cugcuuccagugaggcucu

SEQ ID NO: 1847019 - RNA, 18 nt, Human
cugcuuccagugaggcuc

SEQ ID NO: 1847020 - RNA, 16 nt, Human
cugcuuccagugaggc

SEQ ID NO: 1847021 - RNA, 15 nt, Human
cugcuuccagugagg

SEQ ID NO: 1847022 - RNA, 12 nt, Human
cugcuggcugcc

SEQ ID NO: 1847023 - RNA, 13 nt, Human
cugcugguucagg

SEQ ID NO: 1847024 - RNA, 15 nt, Human
cugcugguucagggu

SEQ ID NO: 1847025 - RNA, 23 nt, Human
cugcugguucaggguuggccccu

SEQ ID NO: 1847026 - RNA, 11 nt, Human
cugcugaaggc

SEQ ID NO: 1847027 - RNA, 21 nt, Human
cugcucuccucuugccacugc

SEQ ID NO: 1847028 - RNA, 18 nt, Human
cugcugaaggaauaaauu

SEQ ID NO: 1847029 - RNA, 17 nt, Human
cugcugaaggaauaaau

SEQ ID NO: 1847030 - RNA, 22 nt, Human
cugcugcccagccuccaagcuc

SEQ ID NO: 1847031 - RNA, 15 nt, Human
cugcugcccagccuc

SEQ ID NO: 1847032 - RNA, 12 nt, Human
cugcugcccagc

SEQ ID NO: 1847033 - RNA, 20 nt, Human
cugcucuccucuugccacug

SEQ ID NO: 1847034 - RNA, 14 nt, Human
cugcucuccucuug

SEQ ID NO: 1847035 - RNA, 19 nt, Human
cugcucuccgaccagacac

SEQ ID NO: 1847036 - RNA, 20 nt, Human
cugcuccagcuguucagcug

SEQ ID NO: 1847037 - RNA, 19 nt, Human
cugcuccagcuguucagcu

SEQ ID NO: 1847038 - RNA, 19 nt, Human
cugcgaccacaagaaggau

SEQ ID NO: 1847039 - RNA, 14 nt, Human
cugccgcagcccug

SEQ ID NO: 1847040 - RNA, 15 nt, Human
cugccgcagcccugc

SEQ ID NO: 1847041 - RNA, 21 nt, Human
cugcccuuucugggcaccggg

SEQ ID NO: 1847042 - RNA, 18 nt, Human
cugccgcagcccugcaga

SEQ ID NO: 1847043 - RNA, 17 nt, Human
cugccgcagcccugcag

SEQ ID NO: 1847044 - RNA, 17 nt, Human
cucccuucccaccucuc

SEQ ID NO: 1847045 - RNA, 16 nt, Human
cucccuucccaccucu

SEQ ID NO: 1847046 - RNA, 15 nt, Human
cucccuucccaccuc

SEQ ID NO: 1847047 - RNA, 14 nt, Human
cucccuucccaccu

SEQ ID NO: 1847048 - RNA, 12 nt, Human
cugcccuccaag

SEQ ID NO: 1847049 - RNA, 20 nt, Human
cugcccugcgggucacagga

SEQ ID NO: 1847050 - RNA, 22 nt, Human
cugcccugcugagucccaggcu

SEQ ID NO: 1847051 - RNA, 11 nt, Human
cugccucccau

SEQ ID NO: 1847052 - RNA, 19 nt, Human
cugccucccaucacccgcu

SEQ ID NO: 1847053 - RNA, 16 nt, Human
cugccucccaucaccc

SEQ ID NO: 1847054 - RNA, 14 nt, Human
cugccucccaucac

SEQ ID NO: 1847055 - RNA, 12 nt, Human
cugccucccauc

SEQ ID NO: 1847056 - RNA, 22 nt, Human
cugccucucugcaggucccuaa

SEQ ID NO: 1847057 - RNA, 15 nt, Human
cugccucugacacac

SEQ ID NO: 1847058 - RNA, 22 nt, Human
cugccucugacacacagcucug

SEQ ID NO: 1847059 - RNA, 23 nt, Human
cugccucugacacacagcucugu

SEQ ID NO: 1847060 - RNA, 21 nt, Human
cugccucucugcaggucccua

SEQ ID NO: 1847061 - RNA, 20 nt, Human
cugccucucugcaggucccu

SEQ ID NO: 1847062 - RNA, 21 nt, Human
cugccugggaucccucauccu

SEQ ID NO: 1847063 - RNA, 20 nt, Human
cugccugcccaggccccugc

SEQ ID NO: 1847064 - RNA, 15 nt, Human
cugccugaagucaca

SEQ ID NO: 1847065 - RNA, 16 nt, Human
cugccugcccaggccc

SEQ ID NO: 1847066 - RNA, 17 nt, Human
cugccugcccaggcccc

SEQ ID NO: 1847067 - RNA, 15 nt, Human
cugccucuucucuac

SEQ ID NO: 1847068 - RNA, 17 nt, Human
gagaugaggccgccaug

SEQ ID NO: 1847069 - RNA, 19 nt, Human
gagauagccaaggccaaag

SEQ ID NO: 1847070 - RNA, 18 nt, Human
gagaucacgccacugcac

SEQ ID NO: 1847071 - RNA, 19 nt, Human
gagaucacgccacugcacu

SEQ ID NO: 1847072 - RNA, 14 nt, Human
gagauagccaaggc

SEQ ID NO: 1847073 - RNA, 16 nt, Human
gagauagccaaggcca

SEQ ID NO: 1847074 - RNA, 23 nt, Human
gagaucaaccccuucgcuccugu

SEQ ID NO: 1847075 - RNA, 20 nt, Human
gagcaccuuagacagucccu

SEQ ID NO: 1847076 - RNA, 21 nt, Human
gagcacuaaggugugcucuga

SEQ ID NO: 1847077 - RNA, 22 nt, Human
gagcaccuuagacagucccugc

SEQ ID NO: 1847078 - RNA, 21 nt, Human
gagcaccuuagacagucccug

SEQ ID NO: 1847079 - RNA, 15 nt, Human
gagcacuaaggugug

SEQ ID NO: 1847080 - RNA, 21 nt, Human
gagcauuagauuucucauuug

SEQ ID NO: 1847081 - RNA, 15 nt, Human
gagcauuagauuucu

SEQ ID NO: 1847082 - RNA, 20 nt, Human
gagccagauuucacucuccu

SEQ ID NO: 1847083 - RNA, 19 nt, Human
gagccaauuuaaagaaaac

SEQ ID NO: 1847084 - RNA, 16 nt, Human
gagcagagaauucucu

SEQ ID NO: 1847085 - RNA, 12 nt, Human
gagcagagacca

SEQ ID NO: 1847086 - RNA, 21 nt, Human
gagccagcagccuggcucucc

SEQ ID NO: 1847087 - RNA, 14 nt, Human
gagccagggucuca

SEQ ID NO: 1847088 - RNA, 23 nt, Human
gagccagauuucacucuccuugg

SEQ ID NO: 1847089 - RNA, 23 nt, Human
gagcccacuguacuugcucuuga

SEQ ID NO: 1847090 - RNA, 19 nt, Human
gagccagggucucacuaug

SEQ ID NO: 1847091 - RNA, 18 nt, Human
gagcccugguggcagugg

SEQ ID NO: 1847092 - RNA, 21 nt, Human
gagacuccugcaggcagccag

SEQ ID NO: 1847093 - RNA, 20 nt, Human
gagacuccugcaggcagcca

SEQ ID NO: 1847094 - RNA, 19 nt, Human
gagacuccugcaggcagcc

SEQ ID NO: 1847095 - RNA, 21 nt, Human
gagacucgcgacaaugcaaac

SEQ ID NO: 1847096 - RNA, 20 nt, Human
gagacucgcgacaaugcaaa

SEQ ID NO: 1847097 - RNA, 13 nt, Human
gagacucugucuc

SEQ ID NO: 1847098 - RNA, 21 nt, Human
gagaccaucccugaaggcccc

SEQ ID NO: 1847099 - RNA, 18 nt, Human
gagaccaucccugaaggc

SEQ ID NO: 1847100 - RNA, 14 nt, Human
gagaccaucccuga

SEQ ID NO: 1847101 - RNA, 22 nt, Human
gagacaggguuuugccauguug

SEQ ID NO: 1847102 - RNA, 20 nt, Human
gagacagcucugcauacuca

SEQ ID NO: 1847103 - RNA, 23 nt, Human
gagaaugcacaaacagaggccgc

SEQ ID NO: 1847104 - RNA, 22 nt, Human
gagagagcuucuguugcugccu

SEQ ID NO: 1847105 - RNA, 19 nt, Human
gagagagcuucuguugcug

SEQ ID NO: 1847106 - RNA, 16 nt, Human
gagagcccuucauuug

SEQ ID NO: 1847107 - RNA, 13 nt, Human
gagaggggcacag

SEQ ID NO: 1847108 - RNA, 19 nt, Human
gagaggggaacagacugga

SEQ ID NO: 1847109 - RNA, 16 nt, Human
gagagggugggagugg

SEQ ID NO: 1847110 - RNA, 20 nt, Human
gagagggugggagugggccc

SEQ ID NO: 1847111 - RNA, 14 nt, Human
gagagggugggagu

SEQ ID NO: 1847112 - RNA, 13 nt, Human
gagaguggcuccu

SEQ ID NO: 1847113 - RNA, 21 nt, Human
gagaguggcuccucccggugc

SEQ ID NO: 1847114 - RNA, 16 nt, Human
gagaguggcuccuccc

SEQ ID NO: 1847115 - RNA, 14 nt, Human
gacucauucuucug

SEQ ID NO: 1847116 - RNA, 15 nt, Human
gacucauucuucugu

SEQ ID NO: 1847117 - RNA, 18 nt, Human
gacuacaggugugaguca

SEQ ID NO: 1847118 - RNA, 21 nt, Human
gacuacaggugugagucacca

SEQ ID NO: 1847119 - RNA, 13 nt, Human
gacuacaggugug

SEQ ID NO: 1847120 - RNA, 13 nt, Human
gacucgcgacaau

SEQ ID NO: 1847121 - RNA, 13 nt, Human
gacuccugcaggc

SEQ ID NO: 1847122 - RNA, 23 nt, Human
gacuccugcacacgcuccuuccu

SEQ ID NO: 1847123 - RNA, 12 nt, Human
gacuccugcagg

SEQ ID NO: 1847124 - RNA, 14 nt, Human
gacuccucugucca

SEQ ID NO: 1847125 - RNA, 11 nt, Human
gacuccucugu

SEQ ID NO: 1847126 - RNA, 14 nt, Human
gacuggaagcacag

SEQ ID NO: 1847127 - RNA, 15 nt, Human
gacuggaagcacagc

SEQ ID NO: 1847128 - RNA, 16 nt, Human
gacuggaagcacagcu

SEQ ID NO: 1847129 - RNA, 18 nt, Human
gacuggaagcacagcuuc

SEQ ID NO: 1847130 - RNA, 23 nt, Human
gacugaguacguugugcauuugg

SEQ ID NO: 1847131 - RNA, 13 nt, Human
gacugcccggcag

SEQ ID NO: 1847132 - RNA, 15 nt, Human
gacugcccggcaggg

SEQ ID NO: 1847133 - RNA, 17 nt, Human
gacucgcgacaaugcaa

SEQ ID NO: 1847134 - RNA, 21 nt, Human
gacugaguacguugugcauuu

SEQ ID NO: 1847135 - RNA, 22 nt, Human
gacugaguacguugugcauuug

SEQ ID NO: 1847136 - RNA, 16 nt, Human
gagaagcagaggaagg

SEQ ID NO: 1847137 - RNA, 16 nt, Human
gagaagagaaugcaca

SEQ ID NO: 1847138 - RNA, 14 nt, Human
gagaagagaaugca

SEQ ID NO: 1847139 - RNA, 14 nt, Human
gagaaaugagcuug

SEQ ID NO: 1847140 - RNA, 21 nt, Human
gagaaaugaaaaaauauauau

SEQ ID NO: 1847141 - RNA, 22 nt, Human
gagaaaguacuucuccacccug

SEQ ID NO: 1847142 - RNA, 16 nt, Human
gagaaagguugaagca

SEQ ID NO: 1847143 - RNA, 19 nt, Human
gacuuaagcacacuugaca

SEQ ID NO: 1847144 - RNA, 19 nt, Human
gacuuaaaauauuccugca

SEQ ID NO: 1847145 - RNA, 13 nt, Human
gacuuggaagcuc

SEQ ID NO: 1847146 - RNA, 21 nt, Human
gacagcugccugggaucccuc

SEQ ID NO: 1847147 - RNA, 18 nt, Human
gacagcugccugggaucc

SEQ ID NO: 1847148 - RNA, 17 nt, Human
gacagcugccugggauc

SEQ ID NO: 1847149 - RNA, 16 nt, Human
gacagcugccugggau

SEQ ID NO: 1847150 - RNA, 20 nt, Human
gacagccacggccaggccag

SEQ ID NO: 1847151 - RNA, 21 nt, Human
gacagccacggccaggccaga

SEQ ID NO: 1847152 - RNA, 20 nt, Human
gacagagugagacucugucu

SEQ ID NO: 1847153 - RNA, 22 nt, Human
gacagagugagacucugucuca

SEQ ID NO: 1847154 - RNA, 14 nt, Human
gacagccacggcca

SEQ ID NO: 1847155 - RNA, 17 nt, Human
gacagccacggccaggc

SEQ ID NO: 1847156 - RNA, 18 nt, Human
gacagccacggccaggcc

SEQ ID NO: 1847157 - RNA, 19 nt, Human
gacagccacggccaggcca

SEQ ID NO: 1847158 - RNA, 21 nt, Human
gacagagcaagugagacccug

SEQ ID NO: 1847159 - RNA, 14 nt, Human
gacagaggcagccc

SEQ ID NO: 1847160 - RNA, 16 nt, Human
gacagaggcagcccca

SEQ ID NO: 1847161 - RNA, 19 nt, Human
gacagaggggguggccucc

SEQ ID NO: 1847162 - RNA, 18 nt, Human
gacagaggggguggccuc

SEQ ID NO: 1847163 - RNA, 15 nt, Human
gacagaggggguggc

SEQ ID NO: 1847164 - RNA, 17 nt, Human
gacagaggcagccccau

SEQ ID NO: 1847165 - RNA, 22 nt, Human
gacagaggggguggccucccaa

SEQ ID NO: 1847166 - RNA, 21 nt, Human
gacagaggggguggccuccca

SEQ ID NO: 1847167 - RNA, 23 nt, Human
gacagaggggguggccucccaac

SEQ ID NO: 1847168 - RNA, 14 nt, Human
gacagagucucacu

SEQ ID NO: 1847169 - RNA, 20 nt, Human
gacauagaauuaacacauga

SEQ ID NO: 1847170 - RNA, 22 nt, Human
gacaguuaagagaaaugagcuu

SEQ ID NO: 1847171 - RNA, 14 nt, Human
gacaugggaaaggg

SEQ ID NO: 1847172 - RNA, 14 nt, Human
gacaugaucuucuu

SEQ ID NO: 1847173 - RNA, 17 nt, Human
gacagggaggacgcucu

SEQ ID NO: 1847174 - RNA, 23 nt, Human
gacaggaccagggauuuccauga

SEQ ID NO: 1847175 - RNA, 15 nt, Human
gacaggaccagggau

SEQ ID NO: 1847176 - RNA, 14 nt, Human
gacaggaccaggga

SEQ ID NO: 1847177 - RNA, 14 nt, Human
gacaguuaagagaa

SEQ ID NO: 1847178 - RNA, 24 nt, Human
gacagggcacaccgggcacucaga

SEQ ID NO: 1847179 - RNA, 23 nt, Human
gacagggcacaccgggcacucag

SEQ ID NO: 1847180 - RNA, 18 nt, Human
gacagggaggacgcucuc

SEQ ID NO: 1847181 - RNA, 16 nt, Human
gacagggaggugaccc

SEQ ID NO: 1847182 - RNA, 17 nt, Human
gaccgugaggccagaga

SEQ ID NO: 1847183 - RNA, 16 nt, Human
gaccgugaggccagag

SEQ ID NO: 1847184 - RNA, 18 nt, Human
gaccgugaggccagagac

SEQ ID NO: 1847185 - RNA, 19 nt, Human
gaccgugaggccagagaca

SEQ ID NO: 1847186 - RNA, 21 nt, Human
gacccuuguggucccacccca

SEQ ID NO: 1847187 - RNA, 20 nt, Human
gacccuuguggucccacccc

SEQ ID NO: 1847188 - RNA, 19 nt, Human
gacccuuguggucccaccc

SEQ ID NO: 1847189 - RNA, 12 nt, Human
gacccugucuca

SEQ ID NO: 1847190 - RNA, 16 nt, Human
gacccaaaaggcagaa

SEQ ID NO: 1847191 - RNA, 15 nt, Human
gacccacaagaaaug

SEQ ID NO: 1847192 - RNA, 22 nt, Human
gacccacaagaaaugaaagcag

SEQ ID NO: 1847193 - RNA, 21 nt, Human
gacccccaaccaaguggcucc

SEQ ID NO: 1847194 - RNA, 12 nt, Human
gacccccaacca

SEQ ID NO: 1847195 - RNA, 23 nt, Human
gacccugaggcccagagggccug

SEQ ID NO: 1847196 - RNA, 14 nt, Human
gaccccuccaugug

SEQ ID NO: 1847197 - RNA, 18 nt, Human
gaccccuccaugugggcu

SEQ ID NO: 1847198 - RNA, 22 nt, Human
gacccugaggcccagagggccu

SEQ ID NO: 1847199 - RNA, 21 nt, Human
gaccccuccaugugggcuagu

SEQ ID NO: 1847200 - RNA, 17 nt, Human
gaccagagcugccaccu

SEQ ID NO: 1847201 - RNA, 15 nt, Human
gaccagagcugccac

SEQ ID NO: 1847202 - RNA, 14 nt, Human
gaccagagcugcca

SEQ ID NO: 1847203 - RNA, 13 nt, Human
gaccagagcugcc

SEQ ID NO: 1847204 - RNA, 19 nt, Human
gaccagagcugccaccugc

SEQ ID NO: 1847205 - RNA, 18 nt, Human
gaccagagcugccaccug

SEQ ID NO: 1847206 - RNA, 20 nt, Human
gaccagccuccaugcugccu

SEQ ID NO: 1847207 - RNA, 22 nt, Human
gaccagccuccaugcugccucc

SEQ ID NO: 1847208 - RNA, 21 nt, Human
gaccagccuccaugcugccuc

SEQ ID NO: 1847209 - RNA, 22 nt, Human
gaccauucuccaccugccaggg

SEQ ID NO: 1847210 - RNA, 21 nt, Human
gaccauucuccaccugccagg

SEQ ID NO: 1847211 - RNA, 20 nt, Human
gaccauucuccaccugccag

SEQ ID NO: 1847212 - RNA, 19 nt, Human
gaccauucuccaccugcca

SEQ ID NO: 1847213 - RNA, 18 nt, Human
gacaugggaaaggggaag

SEQ ID NO: 1847214 - RNA, 14 nt, Human
gaccaccugcccaa

SEQ ID NO: 1847215 - RNA, 13 nt, Human
gaccaccugccca

SEQ ID NO: 1847216 - RNA, 21 nt, Human
gaccacugcagaagacaguau

SEQ ID NO: 1847217 - RNA, 14 nt, Human
gaccacguuucuaa

SEQ ID NO: 1847218 - RNA, 11 nt, Human
gaccagagcug

SEQ ID NO: 1847219 - RNA, 13 nt, Human
gaaugucagugug

SEQ ID NO: 1847220 - RNA, 16 nt, Human
gaauugacccacaaga

SEQ ID NO: 1847221 - RNA, 21 nt, Human
gaauugacccacaagaaauga

SEQ ID NO: 1847222 - RNA, 15 nt, Human
gaauguuugccucug

SEQ ID NO: 1847223 - RNA, 12 nt, Human
gaaaggcuccag

SEQ ID NO: 1847224 - RNA, 18 nt, Human
gaauccagacccggcugc

SEQ ID NO: 1847225 - RNA, 20 nt, Human
gaauccagacccggcugcgu

SEQ ID NO: 1847226 - RNA, 20 nt, Human
gaaugcacaaacagaggccg

SEQ ID NO: 1847227 - RNA, 21 nt, Human
gaaugaaagggcccagagagg

SEQ ID NO: 1847228 - RNA, 21 nt, Human
gaaugcacaaacagaggccgc

SEQ ID NO: 1847229 - RNA, 15 nt, Human
gaaugcuguauaugu

SEQ ID NO: 1847230 - RNA, 22 nt, Human
gaauuucuuuugccguuauuaa

SEQ ID NO: 1847231 - RNA, 21 nt, Human
gaauuucuucaacucccugcc

SEQ ID NO: 1847232 - RNA, 15 nt, Human
gaauuguaaggaaug

SEQ ID NO: 1847233 - RNA, 23 nt, Human
gacaacacucauugaccugaggc

SEQ ID NO: 1847234 - RNA, 22 nt, Human
gacaacacucauugaccugagg

SEQ ID NO: 1847235 - RNA, 16 nt, Human
gacaacagacuucuga

SEQ ID NO: 1847236 - RNA, 23 nt, Human
gacacauguccaagaagcccagg

SEQ ID NO: 1847237 - RNA, 20 nt, Human
gacacauguccaagaagccc

SEQ ID NO: 1847238 - RNA, 15 nt, Human
gacacauguccaaga

SEQ ID NO: 1847239 - RNA, 19 nt, Human
gacacaugcaaggucauuu

SEQ ID NO: 1847240 - RNA, 14 nt, Human
gacacaugcaaggu

SEQ ID NO: 1847241 - RNA, 20 nt, Human
gacacaggcccggcuccagg

SEQ ID NO: 1847242 - RNA, 21 nt, Human
gacacaggcccggcuccaggc

SEQ ID NO: 1847243 - RNA, 16 nt, Human
gacacaagccuucggc

SEQ ID NO: 1847244 - RNA, 22 nt, Human
gacacaagccuucggcgccuua

SEQ ID NO: 1847245 - RNA, 19 nt, Human
gacacaggcccggcuccag

SEQ ID NO: 1847246 - RNA, 20 nt, Human
gacaaugugaaaagaaaaau

SEQ ID NO: 1847247 - RNA, 19 nt, Human
gacaaugugaaaagaaaaa

SEQ ID NO: 1847248 - RNA, 18 nt, Human
gacaaugugaaaagaaaa

SEQ ID NO: 1847249 - RNA, 12 nt, Human
gacaaugugaaa

SEQ ID NO: 1847250 - RNA, 22 nt, Human
gacaaugcaaaccaucauugaa

SEQ ID NO: 1847251 - RNA, 21 nt, Human
gacaaggaugaucuaggaaga

SEQ ID NO: 1847252 - RNA, 18 nt, Human
gacaaggauugcuacugu

SEQ ID NO: 1847253 - RNA, 19 nt, Human
gacaaggauugcuacuguc

SEQ ID NO: 1847254 - RNA, 21 nt, Human
gacaaggauugcuacuguccu

SEQ ID NO: 1847255 - RNA, 16 nt, Human
gacaaggaaaaaauaa

SEQ ID NO: 1847256 - RNA, 12 nt, Human
gcaaaccaucau

SEQ ID NO: 1847257 - RNA, 16 nt, Human
gauuuugcuguagaag

SEQ ID NO: 1847258 - RNA, 21 nt, Human
gauuuugaaauuuuuauuaaa

SEQ ID NO: 1847259 - RNA, 19 nt, Human
gauuuugauccaagcuggu

SEQ ID NO: 1847260 - RNA, 15 nt, Human
gcaaauguggcuccu

SEQ ID NO: 1847261 - RNA, 23 nt, Human
gcaaaugugaaucauuuuaccuu

SEQ ID NO: 1847262 - RNA, 15 nt, Human
gcaaaccaucauuga

SEQ ID NO: 1847263 - RNA, 15 nt, Human
gauuuaacagaaaug

SEQ ID NO: 1847264 - RNA, 22 nt, Human
gauuuccguuaaaauaccagcc

SEQ ID NO: 1847265 - RNA, 16 nt, Human
gauuugagcucagccc

SEQ ID NO: 1847266 - RNA, 13 nt, Human
gauuuaacagaaa

SEQ ID NO: 1847267 - RNA, 14 nt, Human
gauuuaacagaaau

SEQ ID NO: 1847268 - RNA, 12 nt, Human
gauuuaaaucag

SEQ ID NO: 1847269 - RNA, 21 nt, Human
gauuacaggcuccugccacca

SEQ ID NO: 1847270 - RNA, 18 nt, Human
gauuacaggcuccugcca

SEQ ID NO: 1847271 - RNA, 18 nt, Human
gauuacagggaugagcca

SEQ ID NO: 1847272 - RNA, 20 nt, Human
gauuacagggaugagccacc

SEQ ID NO: 1847273 - RNA, 16 nt, Human
gauucucaugccucag

SEQ ID NO: 1847274 - RNA, 14 nt, Human
gauucuccugccuc

SEQ ID NO: 1847275 - RNA, 15 nt, Human
gauugcaacaggcug

SEQ ID NO: 1847276 - RNA, 19 nt, Human
gaugggugcuuggaggaag

SEQ ID NO: 1847277 - RNA, 15 nt, Human
gauggggcugcaccg

SEQ ID NO: 1847278 - RNA, 19 nt, Human
gauggggcugcaccggcug

SEQ ID NO: 1847279 - RNA, 13 nt, Human
gauggggcugcac

SEQ ID NO: 1847280 - RNA, 22 nt, Human
gauggccgggcgcgguggcuca

SEQ ID NO: 1847281 - RNA, 20 nt, Human
gaugggcaacccccagccug

SEQ ID NO: 1847282 - RNA, 24 nt, Human
gauggggcccugccuccuuuguga

SEQ ID NO: 1847283 - RNA, 21 nt, Human
gaugggcaacccccagccugc

SEQ ID NO: 1847284 - RNA, 20 nt, Human
gaugcccaaagaugcagccg

SEQ ID NO: 1847285 - RNA, 19 nt, Human
gaugcccaaagaugcagcc

SEQ ID NO: 1847286 - RNA, 18 nt, Human
gaugcuagaacucccuuu

SEQ ID NO: 1847287 - RNA, 16 nt, Human
gaugccccgucccccu

SEQ ID NO: 1847288 - RNA, 20 nt, Human
gaugcuagaacucccuuuca

SEQ ID NO: 1847289 - RNA, 22 nt, Human
gaugcuagaacucccuuucaac

SEQ ID NO: 1847290 - RNA, 20 nt, Human
gaugcugacuguacuccucc

SEQ ID NO: 1847291 - RNA, 17 nt, Human
gaugcugacuguacucc

SEQ ID NO: 1847292 - RNA, 21 nt, Human
gaugccccgucccccucuggc

SEQ ID NO: 1847293 - RNA, 16 nt, Human
gauguuuaguaaucau

SEQ ID NO: 1847294 - RNA, 17 nt, Human
gauuacaggcuccugcc

SEQ ID NO: 1847295 - RNA, 20 nt, Human
gauuacaggcgugagccacc

SEQ ID NO: 1847296 - RNA, 18 nt, Human
gauuacaggcaugugcca

SEQ ID NO: 1847297 - RNA, 23 nt, Human
gauuacaagcgugagccacugca

SEQ ID NO: 1847298 - RNA, 15 nt, Human
gauuaaacuuaaucu

SEQ ID NO: 1847299 - RNA, 22 nt, Human
gauuacaagcgugagccacugc

SEQ ID NO: 1847300 - RNA, 16 nt, Human
gauggugcaaugaccu

SEQ ID NO: 1847301 - RNA, 15 nt, Human
gauggugcaaugacc

SEQ ID NO: 1847302 - RNA, 17 nt, Human
gauggugcaaugaccuu

SEQ ID NO: 1847303 - RNA, 14 nt, Human
gauggugcaaugac

SEQ ID NO: 1847304 - RNA, 12 nt, Human
gauggugcaaug

SEQ ID NO: 1847305 - RNA, 21 nt, Human
gaugguuccccuguucacucu

SEQ ID NO: 1847306 - RNA, 18 nt, Human
gaugguuccccuguucac

SEQ ID NO: 1847307 - RNA, 13 nt, Human
gaugguuccccug

SEQ ID NO: 1847308 - RNA, 17 nt, Human
gcacaagcuccaagcuc

SEQ ID NO: 1847309 - RNA, 15 nt, Human
gcacaagcuccaagc

SEQ ID NO: 1847310 - RNA, 18 nt, Human
gcacaagcuccaagcucc

SEQ ID NO: 1847311 - RNA, 21 nt, Human
gcacaagcuccaagcucccag

SEQ ID NO: 1847312 - RNA, 23 nt, Human
gcacaaauucugucucuggauua

SEQ ID NO: 1847313 - RNA, 20 nt, Human
gcacagaaaauggaagacag

SEQ ID NO: 1847314 - RNA, 21 nt, Human
gcacagacccugcccuguggg

SEQ ID NO: 1847315 - RNA, 20 nt, Human
gcacagacccugcccugugg

SEQ ID NO: 1847316 - RNA, 19 nt, Human
gcacagacccugcccugug

SEQ ID NO: 1847317 - RNA, 18 nt, Human
gcacagacccugcccugu

SEQ ID NO: 1847318 - RNA, 22 nt, Human
gcacagacccugcccugugggc

SEQ ID NO: 1847319 - RNA, 15 nt, Human
gcacagaguuguuac

SEQ ID NO: 1847320 - RNA, 17 nt, Human
gcacagacccugcccug

SEQ ID NO: 1847321 - RNA, 16 nt, Human
gcacagacccugcccu

SEQ ID NO: 1847322 - RNA, 15 nt, Human
gcacagacccugccc

SEQ ID NO: 1847323 - RNA, 14 nt, Human
gcacagacccugcc

SEQ ID NO: 1847324 - RNA, 22 nt, Human
gcacagaaaauggaagacagcu

SEQ ID NO: 1847325 - RNA, 21 nt, Human
gcacagaaaauggaagacagc

SEQ ID NO: 1847326 - RNA, 23 nt, Human
gcacagaaaauggaagacagcuc

SEQ ID NO: 1847327 - RNA, 14 nt, Human
gcaacucaucuuag

SEQ ID NO: 1847328 - RNA, 15 nt, Human
gcaauggcagccuug

SEQ ID NO: 1847329 - RNA, 14 nt, Human
gcaaugugauaaaa

SEQ ID NO: 1847330 - RNA, 14 nt, Human
gcacaaacagaggc

SEQ ID NO: 1847331 - RNA, 16 nt, Human
gcacaaacagaggccg

SEQ ID NO: 1847332 - RNA, 15 nt, Human
gcacaaacagaggcc

SEQ ID NO: 1847333 - RNA, 17 nt, Human
gcaauucuccugccuca

SEQ ID NO: 1847334 - RNA, 16 nt, Human
gcaauucuccugccuc

SEQ ID NO: 1847335 - RNA, 15 nt, Human
gcaauucuccugccu

SEQ ID NO: 1847336 - RNA, 14 nt, Human
gcaauucuccugcc

SEQ ID NO: 1847337 - RNA, 19 nt, Human
gcaauucuccugccucagc

SEQ ID NO: 1847338 - RNA, 18 nt, Human
gcaauucuccugccucag

SEQ ID NO: 1847339 - RNA, 20 nt, Human
gcaauucuccugccucagcc

SEQ ID NO: 1847340 - RNA, 19 nt, Human
gcacugguggcccgacagc

SEQ ID NO: 1847341 - RNA, 14 nt, Human
gcacugguggcccg

SEQ ID NO: 1847342 - RNA, 23 nt, Human
gcacugcuuccagugaggcucug

SEQ ID NO: 1847343 - RNA, 16 nt, Human
gcacgauuucuguuua

SEQ ID NO: 1847344 - RNA, 20 nt, Human
gcacugcugcccagccucca

SEQ ID NO: 1847345 - RNA, 18 nt, Human
gcacugcugcccagccuc

SEQ ID NO: 1847346 - RNA, 15 nt, Human
gcacugcugcccagc

SEQ ID NO: 1847347 - RNA, 14 nt, Human
gcacugcugcccag

SEQ ID NO: 1847348 - RNA, 12 nt, Human
gcagacaggcaa

SEQ ID NO: 1847349 - RNA, 13 nt, Human
gcagacaggcaag

SEQ ID NO: 1847350 - RNA, 14 nt, Human
gcagacaggcaagc

SEQ ID NO: 1847351 - RNA, 13 nt, Human
gcacgauuucugu

SEQ ID NO: 1847352 - RNA, 15 nt, Human
gcacgauuucuguuu

SEQ ID NO: 1847353 - RNA, 21 nt, Human
gcaccuuagacagucccugcc

SEQ ID NO: 1847354 - RNA, 20 nt, Human
gcaccuuagacagucccugc

SEQ ID NO: 1847355 - RNA, 12 nt, Human
gcaccauaacuu

SEQ ID NO: 1847356 - RNA, 22 nt, Human
gcaccccagcuggggccaggcu

SEQ ID NO: 1847357 - RNA, 16 nt, Human
gcacagaguuguuaca

SEQ ID NO: 1847358 - RNA, 18 nt, Human
gcacagaguuguuacauu

SEQ ID NO: 1847359 - RNA, 19 nt, Human
gcacagaguuguuacauuu

SEQ ID NO: 1847360 - RNA, 21 nt, Human
gcacagaguuguuacauuuuu

SEQ ID NO: 1847361 - RNA, 22 nt, Human
gcacagaguuguuacauuuuua

SEQ ID NO: 1847362 - RNA, 13 nt, Human
gcacagugcaucu

SEQ ID NO: 1847363 - RNA, 18 nt, Human
gcacagugcaucucagcc

SEQ ID NO: 1847364 - RNA, 15 nt, Human
gcacagugcaucuca

SEQ ID NO: 1847365 - RNA, 20 nt, Human
gaggcugggcucccuuccca

SEQ ID NO: 1847366 - RNA, 19 nt, Human
gagggagggcuccagacac

SEQ ID NO: 1847367 - RNA, 21 nt, Human
gagggagugacagaggcagcc

SEQ ID NO: 1847368 - RNA, 22 nt, Human
gagggagugacagaggcagccc

SEQ ID NO: 1847369 - RNA, 20 nt, Human
gagggagggcuccagacaca

SEQ ID NO: 1847370 - RNA, 20 nt, Human
gagggagggggaaggcaggg

SEQ ID NO: 1847371 - RNA, 18 nt, Human
gagggagugacagaggca

SEQ ID NO: 1847372 - RNA, 17 nt, Human
gaggggcugugggcgug

SEQ ID NO: 1847373 - RNA, 17 nt, Human
gaggggguggccuccca

SEQ ID NO: 1847374 - RNA, 13 nt, Human
gaggguaaggcug

SEQ ID NO: 1847375 - RNA, 21 nt, Human
gagguaaggaauaccuguccc

SEQ ID NO: 1847376 - RNA, 24 nt, Human
gagguaaggaauaccugucccccu

SEQ ID NO: 1847377 - RNA, 14 nt, Human
gaggguugggcugg

SEQ ID NO: 1847378 - RNA, 15 nt, Human
gaggguugggcuggu

SEQ ID NO: 1847379 - RNA, 17 nt, Human
gaggucaaggcugcagu

SEQ ID NO: 1847380 - RNA, 12 nt, Human
gaggucagagcc

SEQ ID NO: 1847381 - RNA, 13 nt, Human
gaggucagagccu

SEQ ID NO: 1847382 - RNA, 21 nt, Human
gagggugaagugaagacaaug

SEQ ID NO: 1847383 - RNA, 12 nt, Human
gaggguggaaua

SEQ ID NO: 1847384 - RNA, 15 nt, Human
gagggugggaguggg

SEQ ID NO: 1847385 - RNA, 14 nt, Human
gaggguggugaccu

SEQ ID NO: 1847386 - RNA, 21 nt, Human
gaggguggugaccucugccug

SEQ ID NO: 1847387 - RNA, 22 nt, Human
gagggugucccaaaaagaaagg

SEQ ID NO: 1847388 - RNA, 13 nt, Human
gagggucugagga

SEQ ID NO: 1847389 - RNA, 14 nt, Human
gagggucugaggaa

SEQ ID NO: 1847390 - RNA, 20 nt, Human
gaggcccuucucuccagccc

SEQ ID NO: 1847391 - RNA, 15 nt, Human
gaggcccuucucucc

SEQ ID NO: 1847392 - RNA, 21 nt, Human
gaggcccuucucuccagcccc

SEQ ID NO: 1847393 - RNA, 22 nt, Human
gaggcccuucucuccagccccu

SEQ ID NO: 1847394 - RNA, 16 nt, Human
gaggcccagagggccu

SEQ ID NO: 1847395 - RNA, 15 nt, Human
gaggcccagagggcc

SEQ ID NO: 1847396 - RNA, 19 nt, Human
gaggcccagagggccugca

SEQ ID NO: 1847397 - RNA, 14 nt, Human
gaggcccagagggc

SEQ ID NO: 1847398 - RNA, 13 nt, Human
gaggcccagaggg

SEQ ID NO: 1847399 - RNA, 11 nt, Human
gaggcccagag

SEQ ID NO: 1847400 - RNA, 21 nt, Human
gaggcgcaugaauuugugaag

SEQ ID NO: 1847401 - RNA, 16 nt, Human
gaggcugggcucccuu

SEQ ID NO: 1847402 - RNA, 16 nt, Human
gaggccuucucugaag

SEQ ID NO: 1847403 - RNA, 18 nt, Human
gaggccuucucugaagga

SEQ ID NO: 1847404 - RNA, 19 nt, Human
gaggccuucucugaaggac

SEQ ID NO: 1847405 - RNA, 20 nt, Human
gaggauugcuugagcucagg

SEQ ID NO: 1847406 - RNA, 19 nt, Human
gaggaucucuugagccugg

SEQ ID NO: 1847407 - RNA, 16 nt, Human
gaggaucucuugagcc

SEQ ID NO: 1847408 - RNA, 22 nt, Human
gaggaucucuugagccugggag

SEQ ID NO: 1847409 - RNA, 22 nt, Human
gagcccuguccugccuaaggcu

SEQ ID NO: 1847410 - RNA, 13 nt, Human
gaggaucucuuga

SEQ ID NO: 1847411 - RNA, 14 nt, Human
gaggccaugggccu

SEQ ID NO: 1847412 - RNA, 17 nt, Human
gaggccaugggccuccu

SEQ ID NO: 1847413 - RNA, 18 nt, Human
gaggccaugggccuccug

SEQ ID NO: 1847414 - RNA, 20 nt, Human
gaggccaugggccuccugug

SEQ ID NO: 1847415 - RNA, 21 nt, Human
gaggccaugggccuccugugu

SEQ ID NO: 1847416 - RNA, 23 nt, Human
gaggccaugggccuccugugugu

SEQ ID NO: 1847417 - RNA, 21 nt, Human
gaggcagccccauucugccug

SEQ ID NO: 1847418 - RNA, 20 nt, Human
gaggcagccccauucugccu

SEQ ID NO: 1847419 - RNA, 9 nt, Human
gaggcaggg

SEQ ID NO: 1847420 - RNA, 19 nt, Human
gaggcagagguugcaguga

SEQ ID NO: 1847421 - RNA, 19 nt, Human
gaggcagccccauucugcc

SEQ ID NO: 1847422 - RNA, 18 nt, Human
gaggcagccccauucugc

SEQ ID NO: 1847423 - RNA, 13 nt, Human
gagucugaaggcu

SEQ ID NO: 1847424 - RNA, 12 nt, Human
gagucugaaggc

SEQ ID NO: 1847425 - RNA, 14 nt, Human
gagucugaaggcug

SEQ ID NO: 1847426 - RNA, 15 nt, Human
gagucugaaggcugg

SEQ ID NO: 1847427 - RNA, 17 nt, Human
gagugaagcugggagaa

SEQ ID NO: 1847428 - RNA, 14 nt, Human
gagugacagaggca

SEQ ID NO: 1847429 - RNA, 15 nt, Human
gagugacagaggcag

SEQ ID NO: 1847430 - RNA, 16 nt, Human
gagugacagaggcagc

SEQ ID NO: 1847431 - RNA, 11 nt, Human
gaguauauguc

SEQ ID NO: 1847432 - RNA, 19 nt, Human
gaguaggaagacuuuggaa

SEQ ID NO: 1847433 - RNA, 18 nt, Human
gaguaggaagacuuugga

SEQ ID NO: 1847434 - RNA, 15 nt, Human
gagucgaggacaggg

SEQ ID NO: 1847435 - RNA, 16 nt, Human
gagucgaggacaggga

SEQ ID NO: 1847436 - RNA, 19 nt, Human
gaguccgaaagggacuugg

SEQ ID NO: 1847437 - RNA, 14 nt, Human
gagucgaggacagg

SEQ ID NO: 1847438 - RNA, 20 nt, Human
gaguacuacaguccucccau

SEQ ID NO: 1847439 - RNA, 22 nt, Human
gaguaauccaagcaaaugugaa

SEQ ID NO: 1847440 - RNA, 23 nt, Human
gaguacuacaguccucccaucuc

SEQ ID NO: 1847441 - RNA, 21 nt, Human
gaguacuacaguccucccauc

SEQ ID NO: 1847442 - RNA, 19 nt, Human
gaguagcugggacuacagg

SEQ ID NO: 1847443 - RNA, 17 nt, Human
gaguaggaagacuuugg

SEQ ID NO: 1847444 - RNA, 13 nt, Human
gaguaggaagacu

SEQ ID NO: 1847445 - RNA, 12 nt, Human
gaguaggaagac

SEQ ID NO: 1847446 - RNA, 22 nt, Human
gaguagcugggacuacaggcac

SEQ ID NO: 1847447 - RNA, 16 nt, Human
gagguuucaaaccucc

SEQ ID NO: 1847448 - RNA, 20 nt, Human
gagguuucucaaagaaauuu

SEQ ID NO: 1847449 - RNA, 17 nt, Human
gagguugggaggccauu

SEQ ID NO: 1847450 - RNA, 15 nt, Human
gagguugggaggcca

SEQ ID NO: 1847451 - RNA, 17 nt, Human
gaggucagagccugcag

SEQ ID NO: 1847452 - RNA, 20 nt, Human
gaggucagagccugcaguua

SEQ ID NO: 1847453 - RNA, 15 nt, Human
gauauaagugugugu

SEQ ID NO: 1847454 - RNA, 18 nt, Human
gaucacggcucacugcag

SEQ ID NO: 1847455 - RNA, 15 nt, Human
gaucacggcucacug

SEQ ID NO: 1847456 - RNA, 16 nt, Human
gaucacggcucacugc

SEQ ID NO: 1847457 - RNA, 22 nt, Human
gauagccaaggccaaaggaagc

SEQ ID NO: 1847458 - RNA, 15 nt, Human
gauagcacagacccu

SEQ ID NO: 1847459 - RNA, 16 nt, Human
gauagcacagacccug

SEQ ID NO: 1847460 - RNA, 21 nt, Human
gauacaggaaaagcugcugac

SEQ ID NO: 1847461 - RNA, 23 nt, Human
gauacaggaaaagcugcugacag

SEQ ID NO: 1847462 - RNA, 22 nt, Human
gauaagaaccuuuugagugccu

SEQ ID NO: 1847463 - RNA, 20 nt, Human
gauacaggaaaagcugcuga

SEQ ID NO: 1847464 - RNA, 13 nt, Human
gagugggugaaua

SEQ ID NO: 1847465 - RNA, 15 nt, Human
gaguggguugauuuc

SEQ ID NO: 1847466 - RNA, 17 nt, Human
gagugacagaggcagcc

SEQ ID NO: 1847467 - RNA, 20 nt, Human
gagugugccugaagucccag

SEQ ID NO: 1847468 - RNA, 12 nt, Human
gaguuacagaca

SEQ ID NO: 1847469 - RNA, 15 nt, Human
gaguuacagacaaag

SEQ ID NO: 1847470 - RNA, 13 nt, Human
gaguuacagacaa

SEQ ID NO: 1847471 - RNA, 20 nt, Human
gaguucaucuugaauuguaa

SEQ ID NO: 1847472 - RNA, 19 nt, Human
gaguucaucuugaauugua

SEQ ID NO: 1847473 - RNA, 14 nt, Human
gaguucaucuugaa

SEQ ID NO: 1847474 - RNA, 20 nt, Human
gaguucauacccuguuacca

SEQ ID NO: 1847475 - RNA, 21 nt, Human
gaguugaagacagagcuacac

SEQ ID NO: 1847476 - RNA, 17 nt, Human
gaguugaagacagagcu

SEQ ID NO: 1847477 - RNA, 15 nt, Human
gaguugaagacagag

SEQ ID NO: 1847478 - RNA, 23 nt, Human
ggcgcugccccuggcagccccug

SEQ ID NO: 1847479 - RNA, 21 nt, Human
ggcgcugccccuggcagcccc

SEQ ID NO: 1847480 - RNA, 19 nt, Human
ggcgcugccccuggcagcc

SEQ ID NO: 1847481 - RNA, 18 nt, Human
ggcgcugccccuggcagc

SEQ ID NO: 1847482 - RNA, 22 nt, Human
ggccugggggcugggcagagga

SEQ ID NO: 1847483 - RNA, 20 nt, Human
ggccugggggcugggcagag

SEQ ID NO: 1847484 - RNA, 14 nt, Human
ggccugggggcugg

SEQ ID NO: 1847485 - RNA, 11 nt, Human
ggccugugagc

SEQ ID NO: 1847486 - RNA, 19 nt, Human
ggccuggccugagcuggga

SEQ ID NO: 1847487 - RNA, 17 nt, Human
ggcuagagguucaaaga

SEQ ID NO: 1847488 - RNA, 22 nt, Human
ggcuagagguucaaagauauuu

SEQ ID NO: 1847489 - RNA, 22 nt, Human
ggcuaggaccccuccauguggg

SEQ ID NO: 1847490 - RNA, 16 nt, Human
ggcuaggaccccucca

SEQ ID NO: 1847491 - RNA, 15 nt, Human
ggcuaugcauuugaa

SEQ ID NO: 1847492 - RNA, 19 nt, Human
ggcuaugggggcacugagg

SEQ ID NO: 1847493 - RNA, 16 nt, Human
ggcuaguugggcuucc

SEQ ID NO: 1847494 - RNA, 23 nt, Human
ggcuagugugguguuuccuggca

SEQ ID NO: 1847495 - RNA, 15 nt, Human
ggcuaguugggcuuc

SEQ ID NO: 1847496 - RNA, 19 nt, Human
ggcuccaggagcagccaca

SEQ ID NO: 1847497 - RNA, 13 nt, Human
ggcuccaggagca

SEQ ID NO: 1847498 - RNA, 12 nt, Human
ggcuccaggagc

SEQ ID NO: 1847499 - RNA, 12 nt, Human
ggcuccagcugg

SEQ ID NO: 1847500 - RNA, 15 nt, Human
ggcucaaguccucuu

SEQ ID NO: 1847501 - RNA, 21 nt, Human
ggcucaaguccucuuuucuga

SEQ ID NO: 1847502 - RNA, 11 nt, Human
ggcuccaggcu

SEQ ID NO: 1847503 - RNA, 19 nt, Human
ggcucccacaggcccuucc

SEQ ID NO: 1847504 - RNA, 18 nt, Human
ggcucccacaggcccuuc

SEQ ID NO: 1847505 - RNA, 17 nt, Human
ggcucccacaggcccuu

SEQ ID NO: 1847506 - RNA, 16 nt, Human
ggcuccaggcuccuuu

SEQ ID NO: 1847507 - RNA, 16 nt, Human
ggccucugcacucccc

SEQ ID NO: 1847508 - RNA, 15 nt, Human
ggccucugcacuccc

SEQ ID NO: 1847509 - RNA, 14 nt, Human
ggccucugcacucc

SEQ ID NO: 1847510 - RNA, 13 nt, Human
ggccucugcacuc

SEQ ID NO: 1847511 - RNA, 17 nt, Human
ggccucuuaugggcugg

SEQ ID NO: 1847512 - RNA, 20 nt, Human
ggccucgguguggagaagcg

SEQ ID NO: 1847513 - RNA, 18 nt, Human
ggccucuuaugggcuggg

SEQ ID NO: 1847514 - RNA, 17 nt, Human
ggccucggacuuagcug

SEQ ID NO: 1847515 - RNA, 20 nt, Human
ggccucggacuuagcuggga

SEQ ID NO: 1847516 - RNA, 22 nt, Human
ggccucggacuuagcugggaga

SEQ ID NO: 1847517 - RNA, 23 nt, Human
ggccuagcauacguacacauuuu

SEQ ID NO: 1847518 - RNA, 13 nt, Human
ggcccugccuccu

SEQ ID NO: 1847519 - RNA, 20 nt, Human
ggcccugcccugguuuccug

SEQ ID NO: 1847520 - RNA, 13 nt, Human
ggcccugcccugg

SEQ ID NO: 1847521 - RNA, 12 nt, Human
ggcccugcccug

SEQ ID NO: 1847522 - RNA, 11 nt, Human
ggcccugcccu

SEQ ID NO: 1847523 - RNA, 22 nt, Human
ggcccuggcucccacaggcccu

SEQ ID NO: 1847524 - RNA, 13 nt, Human
ggcccuggcuccc

SEQ ID NO: 1847525 - RNA, 15 nt, Human
ggcccugccuccuuu

SEQ ID NO: 1847526 - RNA, 14 nt, Human
ggcccugccuccuu

SEQ ID NO: 1847527 - RNA, 22 nt, Human
ggcccugcccugguuuccugcc

SEQ ID NO: 1847528 - RNA, 11 nt, Human
ggcccagagag

SEQ ID NO: 1847529 - RNA, 12 nt, Human
ggcccagagagg

SEQ ID NO: 1847530 - RNA, 17 nt, Human
ggcccucugcccacucc

SEQ ID NO: 1847531 - RNA, 16 nt, Human
ggcccucugcccacuc

SEQ ID NO: 1847532 - RNA, 15 nt, Human
ggcccucugcccacu

SEQ ID NO: 1847533 - RNA, 13 nt, Human
ggcccucugccca

SEQ ID NO: 1847534 - RNA, 20 nt, Human
ggcccucugcccacucccug

SEQ ID NO: 1847535 - RNA, 19 nt, Human
ggcccucugcccacucccu

SEQ ID NO: 1847536 - RNA, 21 nt, Human
ggcccucugcccacucccugc

SEQ ID NO: 1847537 - RNA, 18 nt, Human
ggcaugacacgaauauug

SEQ ID NO: 1847538 - RNA, 15 nt, Human
ggcaugaagacagau

SEQ ID NO: 1847539 - RNA, 18 nt, Human
ggcauggccagguggcca

SEQ ID NO: 1847540 - RNA, 17 nt, Human
ggcauggccagguggcc

SEQ ID NO: 1847541 - RNA, 19 nt, Human
ggcagggucucacucuguc

SEQ ID NO: 1847542 - RNA, 20 nt, Human
ggcagggucucacucugucg

SEQ ID NO: 1847543 - RNA, 13 nt, Human
ggcagugggagcu

SEQ ID NO: 1847544 - RNA, 14 nt, Human
ggcagugggagcug

SEQ ID NO: 1847545 - RNA, 21 nt, Human
ggcagugggacagggcauggc

SEQ ID NO: 1847546 - RNA, 16 nt, Human
ggcagugggagcugcc

SEQ ID NO: 1847547 - RNA, 14 nt, Human
ggcagcucaccucu

SEQ ID NO: 1847548 - RNA, 12 nt, Human
ggcagcucaccu

SEQ ID NO: 1847549 - RNA, 21 nt, Human
ggcagcucagagaggguggga

SEQ ID NO: 1847550 - RNA, 13 nt, Human
ggcagcucagaga

SEQ ID NO: 1847551 - RNA, 16 nt, Human
ggcagcucaccucucc

SEQ ID NO: 1847552 - RNA, 22 nt, Human
ggcagcugcuuuugucuauggg

SEQ ID NO: 1847553 - RNA, 17 nt, Human
ggcagcuugaggguugg

SEQ ID NO: 1847554 - RNA, 17 nt, Human
ggccagcugcuugggcu

SEQ ID NO: 1847555 - RNA, 22 nt, Human
ggccagccuugaccauucucca

SEQ ID NO: 1847556 - RNA, 20 nt, Human
ggccagccuugaccauucuc

SEQ ID NO: 1847557 - RNA, 18 nt, Human
ggccaggcccucugccca

SEQ ID NO: 1847558 - RNA, 23 nt, Human
ggccagcugcuugggcuucaucc

SEQ ID NO: 1847559 - RNA, 11 nt, Human
ggccaggcugc

SEQ ID NO: 1847560 - RNA, 15 nt, Human
ggccaggcugcucuu

SEQ ID NO: 1847561 - RNA, 14 nt, Human
ggccaggcugcucu

SEQ ID NO: 1847562 - RNA, 16 nt, Human
ggccaggcugcucuug

SEQ ID NO: 1847563 - RNA, 16 nt, Human
ggccaugggccuccug

SEQ ID NO: 1847564 - RNA, 17 nt, Human
ggccacuccagaccccu

SEQ ID NO: 1847565 - RNA, 18 nt, Human
ggcaugggaaugaauguc

SEQ ID NO: 1847566 - RNA, 17 nt, Human
ggcauuccccaggaggc

SEQ ID NO: 1847567 - RNA, 22 nt, Human
ggcaugggaaugaaugucagug

SEQ ID NO: 1847568 - RNA, 19 nt, Human
ggcauuccccaggaggcca

SEQ ID NO: 1847569 - RNA, 18 nt, Human
ggcauuccccaggaggcc

SEQ ID NO: 1847570 - RNA, 16 nt, Human
ggcauuccccaggagg

SEQ ID NO: 1847571 - RNA, 12 nt, Human
ggagugcaguga

SEQ ID NO: 1847572 - RNA, 20 nt, Human
ggagugcaaugacacagucu

SEQ ID NO: 1847573 - RNA, 14 nt, Human
ggagugcagugagc

SEQ ID NO: 1847574 - RNA, 18 nt, Human
ggauacaaaagcauguga

SEQ ID NO: 1847575 - RNA, 22 nt, Human
ggaucaaaccccgaccaccugc

SEQ ID NO: 1847576 - RNA, 17 nt, Human
ggaucccucauccucau

SEQ ID NO: 1847577 - RNA, 13 nt, Human
ggaucccucaucc

SEQ ID NO: 1847578 - RNA, 22 nt, Human
ggaucccucauccucauaccca

SEQ ID NO: 1847579 - RNA, 13 nt, Human
ggauccuccaggu

SEQ ID NO: 1847580 - RNA, 12 nt, Human
ggauccuccagg

SEQ ID NO: 1847581 - RNA, 17 nt, Human
ggaugcagccucacagu

SEQ ID NO: 1847582 - RNA, 16 nt, Human
ggaugcagccucacag

SEQ ID NO: 1847583 - RNA, 21 nt, Human
ggaugauuggaggggggaggu

SEQ ID NO: 1847584 - RNA, 23 nt, Human
ggaugcacagaguuguuacauuu

SEQ ID NO: 1847585 - RNA, 19 nt, Human
ggaugcagccucacagucc

SEQ ID NO: 1847586 - RNA, 15 nt, Human
ggaugcuuguacaua

SEQ ID NO: 1847587 - RNA, 19 nt, Human
ggauuacaagcgugagcca

SEQ ID NO: 1847588 - RNA, 19 nt, Human
ggcaaucauggugcucaga

SEQ ID NO: 1847589 - RNA, 18 nt, Human
ggcaacccccagccugcu

SEQ ID NO: 1847590 - RNA, 14 nt, Human
ggcaaugcuggcug

SEQ ID NO: 1847591 - RNA, 15 nt, Human
ggcaaugcuggcugu

SEQ ID NO: 1847592 - RNA, 23 nt, Human
ggcaaugcuggcuguuggcuggg

SEQ ID NO: 1847593 - RNA, 18 nt, Human
ggcaccggggccucggac

SEQ ID NO: 1847594 - RNA, 22 nt, Human
ggcacccggccccugcugguuc

SEQ ID NO: 1847595 - RNA, 23 nt, Human
ggcacccaccaucaugucuggcu

SEQ ID NO: 1847596 - RNA, 17 nt, Human
ggauugcuacuguccua

SEQ ID NO: 1847597 - RNA, 15 nt, Human
ggauuguaaaauggu

SEQ ID NO: 1847598 - RNA, 16 nt, Human
ggcaacccccagccug

SEQ ID NO: 1847599 - RNA, 17 nt, Human
ggcaacccccagccugc

SEQ ID NO: 1847600 - RNA, 16 nt, Human
ggauucuuccucccuc

SEQ ID NO: 1847601 - RNA, 16 nt, Human
ggauucuuauggacaa

SEQ ID NO: 1847602 - RNA, 19 nt, Human
ggauuacaggcuccugcca

SEQ ID NO: 1847603 - RNA, 23 nt, Human
ggauuacaagcgugagccacugc

SEQ ID NO: 1847604 - RNA, 19 nt, Human
gcuuaucucaggggugugc

SEQ ID NO: 1847605 - RNA, 20 nt, Human
gcuuauacacuuacacuuua

SEQ ID NO: 1847606 - RNA, 12 nt, Human
gcuuauacacuu

SEQ ID NO: 1847607 - RNA, 16 nt, Human
gcuucaguggcagcug

SEQ ID NO: 1847608 - RNA, 17 nt, Human
gcuucaguggcagcugc

SEQ ID NO: 1847609 - RNA, 18 nt, Human
gcuucaguggcagcugcu

SEQ ID NO: 1847610 - RNA, 15 nt, Human
gcuucauccuccuca

SEQ ID NO: 1847611 - RNA, 12 nt, Human
gcuucauccucc

SEQ ID NO: 1847612 - RNA, 13 nt, Human
gcuucauuuccug

SEQ ID NO: 1847613 - RNA, 16 nt, Human
gcuucauuuccugugu

SEQ ID NO: 1847614 - RNA, 18 nt, Human
gcuuccagugaggcucug

SEQ ID NO: 1847615 - RNA, 16 nt, Human
gcuuccagugaggcuc

SEQ ID NO: 1847616 - RNA, 17 nt, Human
gcuucauuuccuguguc

SEQ ID NO: 1847617 - RNA, 21 nt, Human
gcuucauccuccucagaucuu

SEQ ID NO: 1847618 - RNA, 15 nt, Human
gcuuccagugaggcu

SEQ ID NO: 1847619 - RNA, 16 nt, Human
gcuugaggguugggcu

SEQ ID NO: 1847620 - RNA, 17 nt, Human
gcuuagucacugagaca

SEQ ID NO: 1847621 - RNA, 15 nt, Human
gcuuagucacugaga

SEQ ID NO: 1847622 - RNA, 20 nt, Human
gcuuagucacugagacagcc

SEQ ID NO: 1847623 - RNA, 19 nt, Human
gcuuagucacugagacagc

SEQ ID NO: 1847624 - RNA, 21 nt, Human
gcuuagucacugagacagccc

SEQ ID NO: 1847625 - RNA, 14 nt, Human
gcuguucagcuggu

SEQ ID NO: 1847626 - RNA, 20 nt, Human
gcugugggcgugagaccugc

SEQ ID NO: 1847627 - RNA, 22 nt, Human
gcugugggcgugagaccugccc

SEQ ID NO: 1847628 - RNA, 21 nt, Human
gcugugggcgugagaccugcc

SEQ ID NO: 1847629 - RNA, 19 nt, Human
gcugccaaugggagcucau

SEQ ID NO: 1847630 - RNA, 16 nt, Human
gcugccaaugggagcu

SEQ ID NO: 1847631 - RNA, 15 nt, Human
gcugccaaugggagc

SEQ ID NO: 1847632 - RNA, 16 nt, Human
ggaacaggaaacugau

SEQ ID NO: 1847633 - RNA, 14 nt, Human
ggaaaucaccgaaa

SEQ ID NO: 1847634 - RNA, 21 nt, Human
ggaaaucaccgaaaacguggc

SEQ ID NO: 1847635 - RNA, 21 nt, Human
ggaaaggcuccaggagcagcc

SEQ ID NO: 1847636 - RNA, 20 nt, Human
ggaaaggcuccaggagcagc

SEQ ID NO: 1847637 - RNA, 19 nt, Human
ggaaaggcuccaggagcag

SEQ ID NO: 1847638 - RNA, 17 nt, Human
ggaaaggcuccaggagc

SEQ ID NO: 1847639 - RNA, 22 nt, Human
ggaaaggcuccaggagcagcca

SEQ ID NO: 1847640 - RNA, 14 nt, Human
ggaaaggcuccagg

SEQ ID NO: 1847641 - RNA, 13 nt, Human
ggaaaggcuccag

SEQ ID NO: 1847642 - RNA, 12 nt, Human
ggaaaggcucca

SEQ ID NO: 1847643 - RNA, 19 nt, Human
ggaaaaucagccugcucca

SEQ ID NO: 1847644 - RNA, 23 nt, Human
ggaaaaucagccugcuccagcug

SEQ ID NO: 1847645 - RNA, 21 nt, Human
ggaaaaccaagccguggcuuc

SEQ ID NO: 1847646 - RNA, 14 nt, Human
ggaaaagcugcuga

SEQ ID NO: 1847647 - RNA, 18 nt, Human
ggaaaagcugcugacagu

SEQ ID NO: 1847648 - RNA, 20 nt, Human
ggaaaagcugcugacagugu

SEQ ID NO: 1847649 - RNA, 18 nt, Human
ggaaaacaugcuacacac

SEQ ID NO: 1847650 - RNA, 23 nt, Human
gcuuuucacugcuggcugccuua

SEQ ID NO: 1847651 - RNA, 22 nt, Human
gcuuuucacugcuggcugccuu

SEQ ID NO: 1847652 - RNA, 21 nt, Human
gcuuuguuuguugucagcuga

SEQ ID NO: 1847653 - RNA, 18 nt, Human
gcuuuucacugcuggcug

SEQ ID NO: 1847654 - RNA, 14 nt, Human
gcuuuucacugcug

SEQ ID NO: 1847655 - RNA, 13 nt, Human
gcuuuucacugcu

SEQ ID NO: 1847656 - RNA, 22 nt, Human
gcuugaggguugggcugguguc

SEQ ID NO: 1847657 - RNA, 18 nt, Human
gcuugaggguugggcugg

SEQ ID NO: 1847658 - RNA, 20 nt, Human
gcuugaggguugggcuggug

SEQ ID NO: 1847659 - RNA, 15 nt, Human
gcuuugugauuuuug

SEQ ID NO: 1847660 - RNA, 15 nt, Human
gcuuuguaugcacuu

SEQ ID NO: 1847661 - RNA, 17 nt, Human
ggacugugugcucagga

SEQ ID NO: 1847662 - RNA, 15 nt, Human
ggagaaucacuugaa

SEQ ID NO: 1847663 - RNA, 19 nt, Human
ggagaaucacuugaacccg

SEQ ID NO: 1847664 - RNA, 18 nt, Human
ggagaagcggcuggcagc

SEQ ID NO: 1847665 - RNA, 17 nt, Human
ggagaagcggcuggcag

SEQ ID NO: 1847666 - RNA, 18 nt, Human
ggacuggccucugcugau

SEQ ID NO: 1847667 - RNA, 13 nt, Human
ggacgcucucugg

SEQ ID NO: 1847668 - RNA, 14 nt, Human
ggacgcucucuggc

SEQ ID NO: 1847669 - RNA, 15 nt, Human
ggacgcucucuggcc

SEQ ID NO: 1847670 - RNA, 23 nt, Human
ggaccucaggugagaagcagagg

SEQ ID NO: 1847671 - RNA, 19 nt, Human
ggaccucaggugagaagca

SEQ ID NO: 1847672 - RNA, 13 nt, Human
ggaccagagcugc

SEQ ID NO: 1847673 - RNA, 20 nt, Human
ggacgcuacccgggaagggg

SEQ ID NO: 1847674 - RNA, 19 nt, Human
ggacgcuacccgggaaggg

SEQ ID NO: 1847675 - RNA, 17 nt, Human
ggacgcuacccgggaag

SEQ ID NO: 1847676 - RNA, 15 nt, Human
ggaccuugaacuggg

SEQ ID NO: 1847677 - RNA, 17 nt, Human
ggaccuugaacugggua

SEQ ID NO: 1847678 - RNA, 22 nt, Human
ggacacucaaaagcugggcagg

SEQ ID NO: 1847679 - RNA, 17 nt, Human
ggacacucaaaagcugg

SEQ ID NO: 1847680 - RNA, 15 nt, Human
ggacagccacggcca

SEQ ID NO: 1847681 - RNA, 19 nt, Human
ggacagccacggccaggcc

SEQ ID NO: 1847682 - RNA, 20 nt, Human
ggacagccacggccaggcca

SEQ ID NO: 1847683 - RNA, 21 nt, Human
ggacagccacggccaggccag

SEQ ID NO: 1847684 - RNA, 22 nt, Human
ggacagccacggccaggccaga

SEQ ID NO: 1847685 - RNA, 20 nt, Human
ggacauugcggacagccacg

SEQ ID NO: 1847686 - RNA, 24 nt, Human
ggaaugauuaauuaaaacacaaca

SEQ ID NO: 1847687 - RNA, 12 nt, Human
ggaaugcagugg

SEQ ID NO: 1847688 - RNA, 19 nt, Human
ggaauguuugccucugccu

SEQ ID NO: 1847689 - RNA, 12 nt, Human
ggaauuguguuu

SEQ ID NO: 1847690 - RNA, 19 nt, Human
ggaauuuucaucuaggauu

SEQ ID NO: 1847691 - RNA, 23 nt, Human
ggaaggggagauaaggguaucug

SEQ ID NO: 1847692 - RNA, 17 nt, Human
ggaaggcugagaggaga

SEQ ID NO: 1847693 - RNA, 14 nt, Human
ggaaggcagggagg

SEQ ID NO: 1847694 - RNA, 13 nt, Human
ggaaccugacccc

SEQ ID NO: 1847695 - RNA, 20 nt, Human
ggaagugacgguuuaauggg

SEQ ID NO: 1847696 - RNA, 18 nt, Human
ggaagugcuaauuuugaa

SEQ ID NO: 1847697 - RNA, 14 nt, Human
ggaaugauuaauua

SEQ ID NO: 1847698 - RNA, 16 nt, Human
ggaaguacuggagaaa

SEQ ID NO: 1847699 - RNA, 12 nt, Human
ggaaguacugga

SEQ ID NO: 1847700 - RNA, 18 nt, Human
ggaaguacuggagaaaau

SEQ ID NO: 1847701 - RNA, 21 nt, Human
gcccugggaggcucuggagcc

SEQ ID NO: 1847702 - RNA, 19 nt, Human
gcccugggaggcucuggag

SEQ ID NO: 1847703 - RNA, 18 nt, Human
gcccugggaggcucugga

SEQ ID NO: 1847704 - RNA, 17 nt, Human
gcccugggaggcucugg

SEQ ID NO: 1847705 - RNA, 23 nt, Human
gcccugggaggcucuggagccca

SEQ ID NO: 1847706 - RNA, 16 nt, Human
gcccugggaggcagug

SEQ ID NO: 1847707 - RNA, 21 nt, Human
gcccuggugcugccacacuuc

SEQ ID NO: 1847708 - RNA, 17 nt, Human
gcccuggugcugccaca

SEQ ID NO: 1847709 - RNA, 16 nt, Human
gcccuggugcugccac

SEQ ID NO: 1847710 - RNA, 15 nt, Human
gcccuggugcugcca

SEQ ID NO: 1847711 - RNA, 16 nt, Human
gcccugggaggcucug

SEQ ID NO: 1847712 - RNA, 15 nt, Human
gcccugggaggcucu

SEQ ID NO: 1847713 - RNA, 14 nt, Human
gcccugggaggcuc

SEQ ID NO: 1847714 - RNA, 13 nt, Human
gcccugggaggcu

SEQ ID NO: 1847715 - RNA, 14 nt, Human
gcccugggaggcag

SEQ ID NO: 1847716 - RNA, 11 nt, Human
gcccugggagg

SEQ ID NO: 1847717 - RNA, 20 nt, Human
gcccuggcucccacaggccc

SEQ ID NO: 1847718 - RNA, 19 nt, Human
gcccuggcucccacaggcc

SEQ ID NO: 1847719 - RNA, 15 nt, Human
gcccuggcucccaca

SEQ ID NO: 1847720 - RNA, 15 nt, Human
gcccugguuuccugc

SEQ ID NO: 1847721 - RNA, 14 nt, Human
gcccugguuuccug

SEQ ID NO: 1847722 - RNA, 23 nt, Human
gcccugguuuccugcccugggag

SEQ ID NO: 1847723 - RNA, 21 nt, Human
gcccugguuuccugcccuggg

SEQ ID NO: 1847724 - RNA, 20 nt, Human
gcccugguuuccugcccugg

SEQ ID NO: 1847725 - RNA, 19 nt, Human
gcccugguuuccugcccug

SEQ ID NO: 1847726 - RNA, 18 nt, Human
gcccugguuuccugcccu

SEQ ID NO: 1847727 - RNA, 17 nt, Human
gcccugguuuccugccc

SEQ ID NO: 1847728 - RNA, 14 nt, Human
gcccugguggcagu

SEQ ID NO: 1847729 - RNA, 17 nt, Human
gcccugguggcaguggg

SEQ ID NO: 1847730 - RNA, 18 nt, Human
gcccugguggcaguggga

SEQ ID NO: 1847731 - RNA, 19 nt, Human
gcccugguggcagugggag

SEQ ID NO: 1847732 - RNA, 20 nt, Human
gcccugguggcagugggagc

SEQ ID NO: 1847733 - RNA, 21 nt, Human
gcccugguggcagugggagcu

SEQ ID NO: 1847734 - RNA, 22 nt, Human
gcccugguggcagugggagcug

SEQ ID NO: 1847735 - RNA, 23 nt, Human
gcccugguggcagugggagcugc

SEQ ID NO: 1847736 - RNA, 16 nt, Human
gccgagaucacgccac

SEQ ID NO: 1847737 - RNA, 17 nt, Human
gccgagauugcaccacu

SEQ ID NO: 1847738 - RNA, 18 nt, Human
gccgagauugcaccacug

SEQ ID NO: 1847739 - RNA, 18 nt, Human
gccgagaucacgccacug

SEQ ID NO: 1847740 - RNA, 19 nt, Human
gccgagaucacgccacugc

SEQ ID NO: 1847741 - RNA, 19 nt, Human
gcccuucucuccagccccu

SEQ ID NO: 1847742 - RNA, 21 nt, Human
gcccuuccucuccacugccuu

SEQ ID NO: 1847743 - RNA, 19 nt, Human
gcccuuccucuccacugcc

SEQ ID NO: 1847744 - RNA, 18 nt, Human
gcccuuccucuccacugc

SEQ ID NO: 1847745 - RNA, 16 nt, Human
gcccuuccucuccacu

SEQ ID NO: 1847746 - RNA, 17 nt, Human
gcccuuccucuccacug

SEQ ID NO: 1847747 - RNA, 22 nt, Human
gcccuucucuccagccccugga

SEQ ID NO: 1847748 - RNA, 21 nt, Human
gcccuucucuccagccccugg

SEQ ID NO: 1847749 - RNA, 23 nt, Human
gcccuucucuccagccccuggau

SEQ ID NO: 1847750 - RNA, 20 nt, Human
gcccuuccucuccacugccu

SEQ ID NO: 1847751 - RNA, 19 nt, Human
gccccuccucucugcccua

SEQ ID NO: 1847752 - RNA, 18 nt, Human
gccccuccucucugcccu

SEQ ID NO: 1847753 - RNA, 15 nt, Human
gccccucccuucaac

SEQ ID NO: 1847754 - RNA, 14 nt, Human
gccccucccuucaa

SEQ ID NO: 1847755 - RNA, 12 nt, Human
gccccucccuuc

SEQ ID NO: 1847756 - RNA, 15 nt, Human
gcagacucuacagag

SEQ ID NO: 1847757 - RNA, 13 nt, Human
gccccugccaccc

SEQ ID NO: 1847758 - RNA, 21 nt, Human
gccccuguucuggcagaguug

SEQ ID NO: 1847759 - RNA, 14 nt, Human
gccccugccacccu

SEQ ID NO: 1847760 - RNA, 15 nt, Human
gccccugccacccug

SEQ ID NO: 1847761 - RNA, 19 nt, Human
gcccgacagccuggcacag

SEQ ID NO: 1847762 - RNA, 17 nt, Human
gcccgacagccuggcac

SEQ ID NO: 1847763 - RNA, 16 nt, Human
gcccgacagccuggca

SEQ ID NO: 1847764 - RNA, 12 nt, Human
gccccuuccccc

SEQ ID NO: 1847765 - RNA, 16 nt, Human
gcccggcuccaggcuc

SEQ ID NO: 1847766 - RNA, 22 nt, Human
gcccuggacugugugcucagga

SEQ ID NO: 1847767 - RNA, 16 nt, Human
gcccuggacugugugc

SEQ ID NO: 1847768 - RNA, 12 nt, Human
gcccuggacugu

SEQ ID NO: 1847769 - RNA, 23 nt, Human
gcccugcuuugggcugcccuggu

SEQ ID NO: 1847770 - RNA, 22 nt, Human
gcccugcuuugggcugcccugg

SEQ ID NO: 1847771 - RNA, 19 nt, Human
gcccugcuuugggcugccc

SEQ ID NO: 1847772 - RNA, 21 nt, Human
gcccugcuuugggcugcccug

SEQ ID NO: 1847773 - RNA, 20 nt, Human
gcccugcuuugggcugcccu

SEQ ID NO: 1847774 - RNA, 17 nt, Human
gcccggcuccaggcucc

SEQ ID NO: 1847775 - RNA, 18 nt, Human
gcccggcuccaggcuccu

SEQ ID NO: 1847776 - RNA, 16 nt, Human
gcccugagcuuucugc

SEQ ID NO: 1847777 - RNA, 12 nt, Human
gcccucugccca

SEQ ID NO: 1847778 - RNA, 19 nt, Human
gccucucugcaggucccua

SEQ ID NO: 1847779 - RNA, 21 nt, Human
gccucggacuuagcugggaga

SEQ ID NO: 1847780 - RNA, 20 nt, Human
gccucggacuuagcugggag

SEQ ID NO: 1847781 - RNA, 17 nt, Human
gccucccgaguagcugg

SEQ ID NO: 1847782 - RNA, 23 nt, Human
gccucccgaauagcugggacuac

SEQ ID NO: 1847783 - RNA, 15 nt, Human
gccucccgaguagcu

SEQ ID NO: 1847784 - RNA, 23 nt, Human
gccucccaacucaccccagcccc

SEQ ID NO: 1847785 - RNA, 22 nt, Human
gccucccaacucaccccagccc

SEQ ID NO: 1847786 - RNA, 21 nt, Human
gccucccaacucaccccagcc

SEQ ID NO: 1847787 - RNA, 15 nt, Human
gccucagugccacua

SEQ ID NO: 1847788 - RNA, 21 nt, Human
gccucccgaauagcugggacu

SEQ ID NO: 1847789 - RNA, 14 nt, Human
gccucccacgacug

SEQ ID NO: 1847790 - RNA, 21 nt, Human
gccucccacgacugcccggca

SEQ ID NO: 1847791 - RNA, 14 nt, Human
gccucagccucccg

SEQ ID NO: 1847792 - RNA, 16 nt, Human
gccucagccuccugag

SEQ ID NO: 1847793 - RNA, 18 nt, Human
gccucagccuccugagua

SEQ ID NO: 1847794 - RNA, 23 nt, Human
gccucagccucccaaagugcugg

SEQ ID NO: 1847795 - RNA, 18 nt, Human
gccucagucucccucccu

SEQ ID NO: 1847796 - RNA, 15 nt, Human
gccucagucucccuc

SEQ ID NO: 1847797 - RNA, 12 nt, Human
gccucagugcca

SEQ ID NO: 1847798 - RNA, 14 nt, Human
gccucagugccacu

SEQ ID NO: 1847799 - RNA, 22 nt, Human
gccuauauuuuuuguuaaauga

SEQ ID NO: 1847800 - RNA, 17 nt, Human
gccuaagugcagccccg

SEQ ID NO: 1847801 - RNA, 16 nt, Human
gccuaaggcugaacuu

SEQ ID NO: 1847802 - RNA, 14 nt, Human
gccucaaccuccug

SEQ ID NO: 1847803 - RNA, 16 nt, Human
gccucaaccuccuggg

SEQ ID NO: 1847804 - RNA, 17 nt, Human
gccucaaccuccugggc

SEQ ID NO: 1847805 - RNA, 19 nt, Human
gccucaagugauucuccug

SEQ ID NO: 1847806 - RNA, 20 nt, Human
gccucaagugauucuccugc

SEQ ID NO: 1847807 - RNA, 21 nt, Human
gccucaagugauucuccugcc

SEQ ID NO: 1847808 - RNA, 17 nt, Human
gccugggcagaaggaag

SEQ ID NO: 1847809 - RNA, 16 nt, Human
gccugggcagaaggaa

SEQ ID NO: 1847810 - RNA, 18 nt, Human
gccugggcagaaggaaga

SEQ ID NO: 1847811 - RNA, 20 nt, Human
gccugggggcugggcagagg

SEQ ID NO: 1847812 - RNA, 21 nt, Human
gccugggggcugggcagagga

SEQ ID NO: 1847813 - RNA, 13 nt, Human
gccuggccacgcc

SEQ ID NO: 1847814 - RNA, 14 nt, Human
gccuggauggggcu

SEQ ID NO: 1847815 - RNA, 15 nt, Human
gccuggauggggcug

SEQ ID NO: 1847816 - RNA, 15 nt, Human
gccugggcagaagga

SEQ ID NO: 1847817 - RNA, 16 nt, Human
gccuggccagaugcac

SEQ ID NO: 1847818 - RNA, 14 nt, Human
gccuggccagaugc

SEQ ID NO: 1847819 - RNA, 15 nt, Human
gccuggccagaugca

SEQ ID NO: 1847820 - RNA, 21 nt, Human
gccucucugcaggucccuaau

SEQ ID NO: 1847821 - RNA, 20 nt, Human
gccucucugcaggucccuaa

SEQ ID NO: 1847822 - RNA, 18 nt, Human
gccucucugcaggucccu

SEQ ID NO: 1847823 - RNA, 23 nt, Human
gccucucugcaggucccuaauaa

SEQ ID NO: 1847824 - RNA, 12 nt, Human
gccucugccugu

SEQ ID NO: 1847825 - RNA, 13 nt, Human
gccucugccuguc

SEQ ID NO: 1847826 - RNA, 18 nt, Human
gccucugcugauccuccc

SEQ ID NO: 1847827 - RNA, 19 nt, Human
gccucugcugauccuccca

SEQ ID NO: 1847828 - RNA, 22 nt, Human
gccugaagucacacagugaguc

SEQ ID NO: 1847829 - RNA, 22 nt, Human
gccugcuuuuuauggccuguga

SEQ ID NO: 1847830 - RNA, 19 nt, Human
gccugcuuuuuauggccug

SEQ ID NO: 1847831 - RNA, 18 nt, Human
gccugcuuuuuauggccu

SEQ ID NO: 1847832 - RNA, 18 nt, Human
gccugcuccagcuguuca

SEQ ID NO: 1847833 - RNA, 16 nt, Human
gccugcuccagcuguu

SEQ ID NO: 1847834 - RNA, 15 nt, Human
gccugcuccagcugu

SEQ ID NO: 1847835 - RNA, 19 nt, Human
gcugagucugaaggcuggg

SEQ ID NO: 1847836 - RNA, 18 nt, Human
gcugagucugaaggcugg

SEQ ID NO: 1847837 - RNA, 16 nt, Human
gcugagucugaaggcu

SEQ ID NO: 1847838 - RNA, 15 nt, Human
gcugagucugaaggc

SEQ ID NO: 1847839 - RNA, 22 nt, Human
gcugagucccaggcugagccuc

SEQ ID NO: 1847840 - RNA, 21 nt, Human
gcugagucccaggcugagccu

SEQ ID NO: 1847841 - RNA, 17 nt, Human
gcugagucccaggcuga

SEQ ID NO: 1847842 - RNA, 21 nt, Human
gcugacuguacuccucccagg

SEQ ID NO: 1847843 - RNA, 23 nt, Human
gcugagugggggaucacagccuc

SEQ ID NO: 1847844 - RNA, 22 nt, Human
gcugagugggggaucacagccu

SEQ ID NO: 1847845 - RNA, 16 nt, Human
gcugauggugcaauga

SEQ ID NO: 1847846 - RNA, 15 nt, Human
gcugauggugcaaug

SEQ ID NO: 1847847 - RNA, 17 nt, Human
gcugcauuuaaaagaua

SEQ ID NO: 1847848 - RNA, 20 nt, Human
gcugcaguugccagucaccc

SEQ ID NO: 1847849 - RNA, 18 nt, Human
gcugcaguugccagucac

SEQ ID NO: 1847850 - RNA, 21 nt, Human
gcugcaguugccagucacccc

SEQ ID NO: 1847851 - RNA, 21 nt, Human
gcugauggugcaaugaccuuu

SEQ ID NO: 1847852 - RNA, 18 nt, Human
gcugauggugcaaugacc

SEQ ID NO: 1847853 - RNA, 19 nt, Human
gcugacuguacuccuccca

SEQ ID NO: 1847854 - RNA, 18 nt, Human
gcugacuguacuccuccc

SEQ ID NO: 1847855 - RNA, 17 nt, Human
gcucuugaugccuggcg

SEQ ID NO: 1847856 - RNA, 17 nt, Human
gcugacagacagcccuc

SEQ ID NO: 1847857 - RNA, 21 nt, Human
gcugacagacacaggcccggc

SEQ ID NO: 1847858 - RNA, 16 nt, Human
gcucuugaugccuggc

SEQ ID NO: 1847859 - RNA, 15 nt, Human
gcucuugaugccugg

SEQ ID NO: 1847860 - RNA, 14 nt, Human
gcucuugaugccug

SEQ ID NO: 1847861 - RNA, 23 nt, Human
gcucuucuccuuucacaaccuuc

SEQ ID NO: 1847862 - RNA, 13 nt, Human
gcucuucuccuuu

SEQ ID NO: 1847863 - RNA, 21 nt, Human
gcucuucuccuuucacaaccu

SEQ ID NO: 1847864 - RNA, 17 nt, Human
gcucuucuccuuucaca

SEQ ID NO: 1847865 - RNA, 14 nt, Human
gcucuucuccaggc

SEQ ID NO: 1847866 - RNA, 16 nt, Human
gcucuucuccaggcug

SEQ ID NO: 1847867 - RNA, 18 nt, Human
gcucuuccaggcugggag

SEQ ID NO: 1847868 - RNA, 19 nt, Human
gcucuuccaggcugggaga

SEQ ID NO: 1847869 - RNA, 22 nt, Human
gcucuuccaggcugggagagcc

SEQ ID NO: 1847870 - RNA, 12 nt, Human
gcucuucuccag

SEQ ID NO: 1847871 - RNA, 14 nt, Human
gcucuggacaggca

SEQ ID NO: 1847872 - RNA, 15 nt, Human
gcucuggacaggcau

SEQ ID NO: 1847873 - RNA, 16 nt, Human
gcucuggacaggcaug

SEQ ID NO: 1847874 - RNA, 21 nt, Human
gcucuggacaggcauguucuc

SEQ ID NO: 1847875 - RNA, 22 nt, Human
gcucuggacaggcauguucucu

SEQ ID NO: 1847876 - RNA, 19 nt, Human
gcucugcuccucuccccag

SEQ ID NO: 1847877 - RNA, 21 nt, Human
gcucugcuccucuccccagca

SEQ ID NO: 1847878 - RNA, 13 nt, Human
gcucugcugacag

SEQ ID NO: 1847879 - RNA, 14 nt, Human
gcucugcugacaga

SEQ ID NO: 1847880 - RNA, 18 nt, Human
gcucugcugacagacaca

SEQ ID NO: 1847881 - RNA, 19 nt, Human
gcucugcugacagacacag

SEQ ID NO: 1847882 - RNA, 20 nt, Human
gcucugcugacagacacagg

SEQ ID NO: 1847883 - RNA, 23 nt, Human
gcucugcugacagacacaggccc

SEQ ID NO: 1847884 - RNA, 22 nt, Human
gcucugccucccaucacccgcu

SEQ ID NO: 1847885 - RNA, 15 nt, Human
gcucugccucccauc

SEQ ID NO: 1847886 - RNA, 14 nt, Human
gcucugccucccau

SEQ ID NO: 1847887 - RNA, 13 nt, Human
gcucugccuccca

SEQ ID NO: 1847888 - RNA, 13 nt, Human
gcucugcuccucu

SEQ ID NO: 1847889 - RNA, 14 nt, Human
gcucugcuccucuc

SEQ ID NO: 1847890 - RNA, 14 nt, Human
gcucucuggccuuc

SEQ ID NO: 1847891 - RNA, 15 nt, Human
gcucucuggccuucg

SEQ ID NO: 1847892 - RNA, 19 nt, Human
gcucucuggccuucggccu

SEQ ID NO: 1847893 - RNA, 20 nt, Human
gcucucuggccuucggccuc

SEQ ID NO: 1847894 - RNA, 11 nt, Human
gcucugccucc

SEQ ID NO: 1847895 - RNA, 23 nt, Human
gcucugcccuugguuaggcauug

SEQ ID NO: 1847896 - RNA, 14 nt, Human
gcucugcccuuggu

SEQ ID NO: 1847897 - RNA, 18 nt, Human
gcucccuucccaccucuc

SEQ ID NO: 1847898 - RNA, 16 nt, Human
gcucccuucccaccuc

SEQ ID NO: 1847899 - RNA, 15 nt, Human
gcucccuucccaccu

SEQ ID NO: 1847900 - RNA, 15 nt, Human
gcuccuucuguccua

SEQ ID NO: 1847901 - RNA, 19 nt, Human
gcucccuucccaccucucu

SEQ ID NO: 1847902 - RNA, 21 nt, Human
gcuccuucuguccuacucugu

SEQ ID NO: 1847903 - RNA, 17 nt, Human
gcucgagcaugccugga

SEQ ID NO: 1847904 - RNA, 16 nt, Human
gcucgagcaugccugg

SEQ ID NO: 1847905 - RNA, 11 nt, Human
gcucucuggcc

SEQ ID NO: 1847906 - RNA, 12 nt, Human
gcucucuggccu

SEQ ID NO: 1847907 - RNA, 13 nt, Human
gcucucuggccuu

SEQ ID NO: 1847908 - RNA, 15 nt, Human
gcucuccucuugcca

SEQ ID NO: 1847909 - RNA, 22 nt, Human
gcucuccucuugccacugccuc

SEQ ID NO: 1847910 - RNA, 19 nt, Human
gcucuccucuugccacugc

SEQ ID NO: 1847911 - RNA, 19 nt, Human
gcucuccgaccagacaccu

SEQ ID NO: 1847912 - RNA, 13 nt, Human
gcucuccgaccag

SEQ ID NO: 1847913 - RNA, 17 nt, Human
gcucuccgaccagacac

SEQ ID NO: 1847914 - RNA, 23 nt, Human
gcucagcaaaagaugcuucucac

SEQ ID NO: 1847915 - RNA, 22 nt, Human
gcucagcaaaagaugcuucuca

SEQ ID NO: 1847916 - RNA, 20 nt, Human
gcucagcaaaagaugcuucu

SEQ ID NO: 1847917 - RNA, 17 nt, Human
gcucagcaaaagaugcu

SEQ ID NO: 1847918 - RNA, 20 nt, Human
gcucaccagccccagugccc

SEQ ID NO: 1847919 - RNA, 23 nt, Human
gcucaccagccccagugcccaca

SEQ ID NO: 1847920 - RNA, 19 nt, Human
gcucaccagccccagugcc

SEQ ID NO: 1847921 - RNA, 16 nt, Human
gcuccaaacccucgag

SEQ ID NO: 1847922 - RNA, 18 nt, Human
gcuccaaacccucgaggc

SEQ ID NO: 1847923 - RNA, 17 nt, Human
gcuccaaacccucgagg

SEQ ID NO: 1847924 - RNA, 19 nt, Human
gcucaggugucccugcacu

SEQ ID NO: 1847925 - RNA, 15 nt, Human
gcucagcggggacag

SEQ ID NO: 1847926 - RNA, 20 nt, Human
gcucagcggggacagcuccu

SEQ ID NO: 1847927 - RNA, 21 nt, Human
gcucagcggggacagcuccuu

SEQ ID NO: 1847928 - RNA, 22 nt, Human
gcucagcggggacagcuccuuc

SEQ ID NO: 1847929 - RNA, 18 nt, Human
gcucaggugucccugcac

SEQ ID NO: 1847930 - RNA, 19 nt, Human
gcuccaagcucccaggcau

SEQ ID NO: 1847931 - RNA, 18 nt, Human
gcuccaagcucccaggca

SEQ ID NO: 1847932 - RNA, 17 nt, Human
gcuccaagcucccaggc

SEQ ID NO: 1847933 - RNA, 16 nt, Human
gcuccaagcucccagg

SEQ ID NO: 1847934 - RNA, 21 nt, Human
gcuccaagcucccaggcauuc

SEQ ID NO: 1847935 - RNA, 23 nt, Human
gcuccagcuggccgggagccuga

SEQ ID NO: 1847936 - RNA, 17 nt, Human
gcuccagcuggccggga

SEQ ID NO: 1847937 - RNA, 15 nt, Human
gcuccaagcucccag

SEQ ID NO: 1847938 - RNA, 14 nt, Human
gcuccaagcuccca

SEQ ID NO: 1847939 - RNA, 13 nt, Human
gcuccaagcuccc

SEQ ID NO: 1847940 - RNA, 16 nt, Human
gcuccaaaugcagcuu

SEQ ID NO: 1847941 - RNA, 19 nt, Human
gcuccaaacccucgaggcg

SEQ ID NO: 1847942 - RNA, 20 nt, Human
gcuccauuuuuagugaaaua

SEQ ID NO: 1847943 - RNA, 11 nt, Human
gcuccagcugu

SEQ ID NO: 1847944 - RNA, 13 nt, Human
gcuccaggcuccu

SEQ ID NO: 1847945 - RNA, 16 nt, Human
gcuccaggcuccuuua

SEQ ID NO: 1847946 - RNA, 23 nt, Human
gcuccaggcuccuuuagcgccca

SEQ ID NO: 1847947 - RNA, 20 nt, Human
gcuccagcuguucagcuggu

SEQ ID NO: 1847948 - RNA, 24 nt, Human
gcuccaggcuccuuuagcgcccag

SEQ ID NO: 1847949 - RNA, 14 nt, Human
gcuccaucuccacu

SEQ ID NO: 1847950 - RNA, 15 nt, Human
gcuccauggcugcca

SEQ ID NO: 1847951 - RNA, 23 nt, Human
gccugugagcuaggaauuguguu

SEQ ID NO: 1847952 - RNA, 17 nt, Human
gccugugaacugaacuc

SEQ ID NO: 1847953 - RNA, 15 nt, Human
gcgggcuuccuccug

SEQ ID NO: 1847954 - RNA, 12 nt, Human
gcggggacagcu

SEQ ID NO: 1847955 - RNA, 13 nt, Human
gcggggacagcuc

SEQ ID NO: 1847956 - RNA, 16 nt, Human
gcgguccacccaggag

SEQ ID NO: 1847957 - RNA, 18 nt, Human
gcgguccacccaggagcc

SEQ ID NO: 1847958 - RNA, 19 nt, Human
gcgguccacccaggagccc

SEQ ID NO: 1847959 - RNA, 22 nt, Human
gcuaagagggagggagggcucc

SEQ ID NO: 1847960 - RNA, 21 nt, Human
gcuaagagggagggagggcuc

SEQ ID NO: 1847961 - RNA, 16 nt, Human
gcuaaaugugaaugau

SEQ ID NO: 1847962 - RNA, 13 nt, Human
gcuaaaugugaau

SEQ ID NO: 1847963 - RNA, 15 nt, Human
gcgugagaccugccc

SEQ ID NO: 1847964 - RNA, 18 nt, Human
gcgugagccacugcaccg

SEQ ID NO: 1847965 - RNA, 23 nt, Human
gcgugagccacugcaccgggcca

SEQ ID NO: 1847966 - RNA, 22 nt, Human
gcuaucucccccagccccaucc

SEQ ID NO: 1847967 - RNA, 21 nt, Human
gcuaucucccccagccccauc

SEQ ID NO: 1847968 - RNA, 20 nt, Human
gcuaucucccccagccccau

SEQ ID NO: 1847969 - RNA, 19 nt, Human
gcuaucucccccagcccca

SEQ ID NO: 1847970 - RNA, 23 nt, Human
gcuaucucccccagccccauccu

SEQ ID NO: 1847971 - RNA, 18 nt, Human
gcuaucucccccagcccc

SEQ ID NO: 1847972 - RNA, 17 nt, Human
gcuaucucccccagccc

SEQ ID NO: 1847973 - RNA, 16 nt, Human
gcuaucucccccagcc

SEQ ID NO: 1847974 - RNA, 18 nt, Human
gcuagagguucaaagaua

SEQ ID NO: 1847975 - RNA, 19 nt, Human
gcuagagguucaaagauau

SEQ ID NO: 1847976 - RNA, 21 nt, Human
gcuagagguucaaagauauuu

SEQ ID NO: 1847977 - RNA, 21 nt, Human
gcuacccgggaagggggcugg

SEQ ID NO: 1847978 - RNA, 15 nt, Human
gcuacccgggaaggg

SEQ ID NO: 1847979 - RNA, 14 nt, Human
gcuacccgggaagg

SEQ ID NO: 1847980 - RNA, 17 nt, Human
gcuaagcaaaaugugau

SEQ ID NO: 1847981 - RNA, 23 nt, Human
gcuaagagggagggagggcucca

SEQ ID NO: 1847982 - RNA, 23 nt, Human
guacuaaggaaucuuucugcuuu

SEQ ID NO: 1847983 - RNA, 15 nt, Human
guacuaaggaaucuu

SEQ ID NO: 1847984 - RNA, 17 nt, Human
guacguugugcauuugg

SEQ ID NO: 1847985 - RNA, 17 nt, Human
guacuacaguccuccca

SEQ ID NO: 1847986 - RNA, 14 nt, Human
guacuucuccaccc

SEQ ID NO: 1847987 - RNA, 15 nt, Human
guacuucuccacccu

SEQ ID NO: 1847988 - RNA, 15 nt, Human
guacguugugcauuu

SEQ ID NO: 1847989 - RNA, 16 nt, Human
guacguugugcauuug

SEQ ID NO: 1847990 - RNA, 14 nt, Human
guacguugugcauu

SEQ ID NO: 1847991 - RNA, 17 nt, Human
guacgucugacaggcaa

SEQ ID NO: 1847992 - RNA, 14 nt, Human
guacgucugacagg

SEQ ID NO: 1847993 - RNA, 15 nt, Human
guacgucugacaggc

SEQ ID NO: 1847994 - RNA, 13 nt, Human
guaccucuugagc

SEQ ID NO: 1847995 - RNA, 21 nt, Human
guaccucuugagccuugaacu

SEQ ID NO: 1847996 - RNA, 22 nt, Human
guaccucuugagccuugaacuu

SEQ ID NO: 1847997 - RNA, 16 nt, Human
guacccacugcucugg

SEQ ID NO: 1847998 - RNA, 15 nt, Human
guaccgcaaugugac

SEQ ID NO: 1847999 - RNA, 19 nt, Human
guacuugcucuugaugccu

SEQ ID NO: 1848000 - RNA, 18 nt, Human
guacuugcucuugaugcc

SEQ ID NO: 1848001 - RNA, 16 nt, Human
guacuugcucuugaug

SEQ ID NO: 1848002 - RNA, 15 nt, Human
guacuugcucuugau

SEQ ID NO: 1848003 - RNA, 22 nt, Human
guacuugcucuugaugccuggc

SEQ ID NO: 1848004 - RNA, 16 nt, Human
guacuuguggacacag

SEQ ID NO: 1848005 - RNA, 20 nt, Human
guacuuguggacacagcucu

SEQ ID NO: 1848006 - RNA, 14 nt, Human
guacuugcucuuga

SEQ ID NO: 1848007 - RNA, 20 nt, Human
guacuucuccacccugcucu

SEQ ID NO: 1848008 - RNA, 21 nt, Human
guacuucuccacccugcucuc

SEQ ID NO: 1848009 - RNA, 16 nt, Human
guacuucuccacccug

SEQ ID NO: 1848010 - RNA, 17 nt, Human
guacuucuccacccugc

SEQ ID NO: 1848011 - RNA, 18 nt, Human
guacuucuccacccugcu

SEQ ID NO: 1848012 - RNA, 19 nt, Human
guacuucuccacccugcuc

SEQ ID NO: 1848013 - RNA, 15 nt, Human
guagaggagaaacug

SEQ ID NO: 1848014 - RNA, 16 nt, Human
guagagcggagaaagg

SEQ ID NO: 1848015 - RNA, 20 nt, Human
guagaaaagggaacugaaca

SEQ ID NO: 1848016 - RNA, 21 nt, Human
guacuuguggacacagcucuu

SEQ ID NO: 1848017 - RNA, 23 nt, Human
guacuuuauuuucuauaauuuaa

SEQ ID NO: 1848018 - RNA, 18 nt, Human
guacacuguuucaaacuu

SEQ ID NO: 1848019 - RNA, 20 nt, Human
guaauuaaguacuauguauc

SEQ ID NO: 1848020 - RNA, 17 nt, Human
guaauuaaguacuaugu

SEQ ID NO: 1848021 - RNA, 14 nt, Human
guaauuaaguacua

SEQ ID NO: 1848022 - RNA, 21 nt, Human
guaauuaaguacuauguauca

SEQ ID NO: 1848023 - RNA, 13 nt, Human
guaaugaaaacca

SEQ ID NO: 1848024 - RNA, 11 nt, Human
guaaugaaaac

SEQ ID NO: 1848025 - RNA, 15 nt, Human
guaaucguguccccu

SEQ ID NO: 1848026 - RNA, 18 nt, Human
guaaugaugucguuugaa

SEQ ID NO: 1848027 - RNA, 20 nt, Human
guacagcaaggagauuuaca

SEQ ID NO: 1848028 - RNA, 22 nt, Human
guacagagcccacgcccccacu

SEQ ID NO: 1848029 - RNA, 18 nt, Human
guacagagcccacgcccc

SEQ ID NO: 1848030 - RNA, 12 nt, Human
guacagagccca

SEQ ID NO: 1848031 - RNA, 19 nt, Human
guacacuguuucaaacuuu

SEQ ID NO: 1848032 - RNA, 20 nt, Human
guacacuguuucaaacuuua

SEQ ID NO: 1848033 - RNA, 21 nt, Human
guacacuguuucaaacuuuac

SEQ ID NO: 1848034 - RNA, 15 nt, Human
guacagacagaaaaa

SEQ ID NO: 1848035 - RNA, 16 nt, Human
guacagacaacaaacc

SEQ ID NO: 1848036 - RNA, 16 nt, Human
guacagucuuguauua

SEQ ID NO: 1848037 - RNA, 13 nt, Human
guacagucuugua

SEQ ID NO: 1848038 - RNA, 14 nt, Human
guacagucuuguau

SEQ ID NO: 1848039 - RNA, 20 nt, Human
guacauaaugcgugcauacc

SEQ ID NO: 1848040 - RNA, 12 nt, Human
guacaguuuuua

SEQ ID NO: 1848041 - RNA, 13 nt, Human
guacaguuuuuau

SEQ ID NO: 1848042 - RNA, 15 nt, Human
guacccacugcucug

SEQ ID NO: 1848043 - RNA, 19 nt, Human
guaagaucguucucugccu

SEQ ID NO: 1848044 - RNA, 23 nt, Human
guaaauuaacuuuuauaaacuuu

SEQ ID NO: 1848045 - RNA, 22 nt, Human
guaaguauucuuauuuaaugaa

SEQ ID NO: 1848046 - RNA, 13 nt, Human
guaaggaaugauu

SEQ ID NO: 1848047 - RNA, 23 nt, Human
guaaggaauaccugucccccuga

SEQ ID NO: 1848048 - RNA, 21 nt, Human
guaaggaauaccugucccccu

SEQ ID NO: 1848049 - RNA, 20 nt, Human
guaaggaauaccuguccccc

SEQ ID NO: 1848050 - RNA, 18 nt, Human
guaaggaauaccuguccc

SEQ ID NO: 1848051 - RNA, 15 nt, Human
guaaauuaacuuuua

SEQ ID NO: 1848052 - RNA, 16 nt, Human
guaaauuaacuuuuau

SEQ ID NO: 1848053 - RNA, 17 nt, Human
guaaauuaacuuuuaua

SEQ ID NO: 1848054 - RNA, 21 nt, Human
guaaauuaacuuuuauaaacu

SEQ ID NO: 1848055 - RNA, 22 nt, Human
guaaauuaacuuuuauaaacuu

SEQ ID NO: 1848056 - RNA, 18 nt, Human
guaaaugggggugcauuu

SEQ ID NO: 1848057 - RNA, 19 nt, Human
guaaaugggggugcauuug

SEQ ID NO: 1848058 - RNA, 20 nt, Human
guaaaugggggugcauuuga

SEQ ID NO: 1848059 - RNA, 14 nt, Human
gguugggcuggugu

SEQ ID NO: 1848060 - RNA, 18 nt, Human
gguuggcaaaaaggcagg

SEQ ID NO: 1848061 - RNA, 13 nt, Human
gguuuaagcuguu

SEQ ID NO: 1848062 - RNA, 13 nt, Human
gguuggugggggc

SEQ ID NO: 1848063 - RNA, 20 nt, Human
gguucacugcaaccuccgcc

SEQ ID NO: 1848064 - RNA, 22 nt, Human
gguucaagcgauucuucugcuu

SEQ ID NO: 1848065 - RNA, 23 nt, Human
gguucaagcgauucuucugcuuc

SEQ ID NO: 1848066 - RNA, 17 nt, Human
gguucuuucuuccucug

SEQ ID NO: 1848067 - RNA, 12 nt, Human
gguucagcuugu

SEQ ID NO: 1848068 - RNA, 18 nt, Human
gguucuuucuuccucugc

SEQ ID NO: 1848069 - RNA, 14 nt, Human
gguugaagcaccaa

SEQ ID NO: 1848070 - RNA, 20 nt, Human
gguggcccgacagccuggca

SEQ ID NO: 1848071 - RNA, 19 nt, Human
gguggcccgacagccuggc

SEQ ID NO: 1848072 - RNA, 18 nt, Human
gguggcccgacagccugg

SEQ ID NO: 1848073 - RNA, 17 nt, Human
gguggcccgacagccug

SEQ ID NO: 1848074 - RNA, 16 nt, Human
gguggcccgacagccu

SEQ ID NO: 1848075 - RNA, 13 nt, Human
gguggccucccaa

SEQ ID NO: 1848076 - RNA, 17 nt, Human
gguggccucccaacuca

SEQ ID NO: 1848077 - RNA, 21 nt, Human
gguucaagcgauucuucugcu

SEQ ID NO: 1848078 - RNA, 15 nt, Human
guaaaagacuuuuuu

SEQ ID NO: 1848079 - RNA, 20 nt, Human
guaaaaacaaagaaauuaug

SEQ ID NO: 1848080 - RNA, 18 nt, Human
guaaaaacaaagaaauua

SEQ ID NO: 1848081 - RNA, 14 nt, Human
guaaaaauaaaauu

SEQ ID NO: 1848082 - RNA, 13 nt, Human
guaaaaauaaaau

SEQ ID NO: 1848083 - RNA, 12 nt, Human
gguuuucuguuc

SEQ ID NO: 1848084 - RNA, 13 nt, Human
gguuuucuguucu

SEQ ID NO: 1848085 - RNA, 15 nt, Human
gguuuucuguucuuu

SEQ ID NO: 1848086 - RNA, 23 nt, Human
gguuuugccauguuggccaggcu

SEQ ID NO: 1848087 - RNA, 17 nt, Human
ggucccuaauaaagcug

SEQ ID NO: 1848088 - RNA, 16 nt, Human
ggucccuaauaaagcu

SEQ ID NO: 1848089 - RNA, 13 nt, Human
ggucccuaauaaa

SEQ ID NO: 1848090 - RNA, 12 nt, Human
ggucccuaauaa

SEQ ID NO: 1848091 - RNA, 14 nt, Human
ggucccugguggca

SEQ ID NO: 1848092 - RNA, 18 nt, Human
ggucccuaauaaagcugu

SEQ ID NO: 1848093 - RNA, 22 nt, Human
ggucccugguggcagcucaccu

SEQ ID NO: 1848094 - RNA, 23 nt, Human
gguccuagaaauuccccacccug

SEQ ID NO: 1848095 - RNA, 22 nt, Human
ggucucacuauguugcccaggc

SEQ ID NO: 1848096 - RNA, 12 nt, Human
ggucucacucug

SEQ ID NO: 1848097 - RNA, 16 nt, Human
ggucucacucugucgc

SEQ ID NO: 1848098 - RNA, 20 nt, Human
ggucucgaacuccugaccuu

SEQ ID NO: 1848099 - RNA, 19 nt, Human
ggucucgaacuccugaccu

SEQ ID NO: 1848100 - RNA, 15 nt, Human
ggucugacccacugc

SEQ ID NO: 1848101 - RNA, 16 nt, Human
ggucugacccacugcu

SEQ ID NO: 1848102 - RNA, 16 nt, Human
ggugaacuugguuccc

SEQ ID NO: 1848103 - RNA, 14 nt, Human
ggugaacauugcaa

SEQ ID NO: 1848104 - RNA, 19 nt, Human
ggucugaggaauccagacc

SEQ ID NO: 1848105 - RNA, 18 nt, Human
ggugaagugaagacaaug

SEQ ID NO: 1848106 - RNA, 21 nt, Human
ggugacagagugagacucugu

SEQ ID NO: 1848107 - RNA, 14 nt, Human
ggugaccucugccu

SEQ ID NO: 1848108 - RNA, 16 nt, Human
ggugaccucugccuga

SEQ ID NO: 1848109 - RNA, 21 nt, Human
ggugaccucugccugaaguca

SEQ ID NO: 1848110 - RNA, 22 nt, Human
ggugauagguauaaguggugug

SEQ ID NO: 1848111 - RNA, 22 nt, Human
ggugcuaucucccccagcccca

SEQ ID NO: 1848112 - RNA, 23 nt, Human
ggugcuaucucccccagccccau

SEQ ID NO: 1848113 - RNA, 15 nt, Human
ggugcgaucuggguu

SEQ ID NO: 1848114 - RNA, 16 nt, Human
gguggcagugggagcu

SEQ ID NO: 1848115 - RNA, 15 nt, Human
gguggcagcugcggu

SEQ ID NO: 1848116 - RNA, 23 nt, Human
gguggcagcugcgguccacccag

SEQ ID NO: 1848117 - RNA, 13 nt, Human
gguggcagcucac

SEQ ID NO: 1848118 - RNA, 11 nt, Human
gguggcagcug

SEQ ID NO: 1848119 - RNA, 12 nt, Human
gguggcagcugc

SEQ ID NO: 1848120 - RNA, 13 nt, Human
gguggcagcugcg

SEQ ID NO: 1848121 - RNA, 22 nt, Human
ggucccaccccacacacgccag

SEQ ID NO: 1848122 - RNA, 22 nt, Human
ggucccacucaguccauagcag

SEQ ID NO: 1848123 - RNA, 12 nt, Human
ggucccacucag

SEQ ID NO: 1848124 - RNA, 14 nt, Human
ggucccacucaguc

SEQ ID NO: 1848125 - RNA, 23 nt, Human
ggucccccuuccauggacuuugu

SEQ ID NO: 1848126 - RNA, 18 nt, Human
ggucccccuuccauggac

SEQ ID NO: 1848127 - RNA, 13 nt, Human
ggucccccuucca

SEQ ID NO: 1848128 - RNA, 20 nt, Human
ggucacucuggcagcucaga

SEQ ID NO: 1848129 - RNA, 16 nt, Human
ggucacucuggcagcu

SEQ ID NO: 1848130 - RNA, 22 nt, Human
ggucacucuggcagcucagaga

SEQ ID NO: 1848131 - RNA, 12 nt, Human
ggucagagccug

SEQ ID NO: 1848132 - RNA, 13 nt, Human
ggucagagccugc

SEQ ID NO: 1848133 - RNA, 14 nt, Human
ggucagagccugca

SEQ ID NO: 1848134 - RNA, 15 nt, Human
ggucagagccugcag

SEQ ID NO: 1848135 - RNA, 16 nt, Human
ggucagagccugcagu

SEQ ID NO: 1848136 - RNA, 19 nt, Human
gggugcugggccccugccu

SEQ ID NO: 1848137 - RNA, 22 nt, Human
ggguuccagcaauucuccugcc

SEQ ID NO: 1848138 - RNA, 17 nt, Human
ggguucuacccaggugc

SEQ ID NO: 1848139 - RNA, 22 nt, Human
ggguucuacccaggugcuagga

SEQ ID NO: 1848140 - RNA, 23 nt, Human
ggguucccuuuuuuggcugcuga

SEQ ID NO: 1848141 - RNA, 16 nt, Human
ggguuggccccugccc

SEQ ID NO: 1848142 - RNA, 14 nt, Human
ggguucuuucuucc

SEQ ID NO: 1848143 - RNA, 19 nt, Human
ggguuggccccugcccggc

SEQ ID NO: 1848144 - RNA, 20 nt, Human
ggguuucaccauguuggcca

SEQ ID NO: 1848145 - RNA, 17 nt, Human
gguacccacugcucugg

SEQ ID NO: 1848146 - RNA, 15 nt, Human
ggguugggcuggugu

SEQ ID NO: 1848147 - RNA, 22 nt, Human
gguacuuguggacacagcucuu

SEQ ID NO: 1848148 - RNA, 21 nt, Human
gguacuuguggacacagcucu

SEQ ID NO: 1848149 - RNA, 20 nt, Human
gggcucugccucccaucacc

SEQ ID NO: 1848150 - RNA, 17 nt, Human
gggcucugccucccauc

SEQ ID NO: 1848151 - RNA, 16 nt, Human
gggcucugccucccau

SEQ ID NO: 1848152 - RNA, 15 nt, Human
gggcucugccuccca

SEQ ID NO: 1848153 - RNA, 13 nt, Human
gggcucugccucc

SEQ ID NO: 1848154 - RNA, 14 nt, Human
gggcuucaguggca

SEQ ID NO: 1848155 - RNA, 14 nt, Human
gggcugcaccggcu

SEQ ID NO: 1848156 - RNA, 16 nt, Human
gggcugaggugggagg

SEQ ID NO: 1848157 - RNA, 23 nt, Human
gggcucccuucccaccucucuca

SEQ ID NO: 1848158 - RNA, 18 nt, Human
gggcucccuucccaccuc

SEQ ID NO: 1848159 - RNA, 17 nt, Human
gggcucccuucccaccu

SEQ ID NO: 1848160 - RNA, 14 nt, Human
gggcucccuuccca

SEQ ID NO: 1848161 - RNA, 16 nt, Human
gggcgcgguggcucac

SEQ ID NO: 1848162 - RNA, 13 nt, Human
gggcucccuuccc

SEQ ID NO: 1848163 - RNA, 16 nt, Human
gggccuggcucaggug

SEQ ID NO: 1848164 - RNA, 14 nt, Human
gggccuggcucagg

SEQ ID NO: 1848165 - RNA, 18 nt, Human
gggccuggucguuuucaa

SEQ ID NO: 1848166 - RNA, 12 nt, Human
gggccuggccug

SEQ ID NO: 1848167 - RNA, 22 nt, Human
gggccuggcagccgugccuuca

SEQ ID NO: 1848168 - RNA, 10 nt, Human
gggccuggca

SEQ ID NO: 1848169 - RNA, 12 nt, Human
gggccuggcuca

SEQ ID NO: 1848170 - RNA, 21 nt, Human
ggcucccacaggcccuuccuc

SEQ ID NO: 1848171 - RNA, 20 nt, Human
ggcucccacaggcccuuccu

SEQ ID NO: 1848172 - RNA, 14 nt, Human
ggggcugccagggg

SEQ ID NO: 1848173 - RNA, 17 nt, Human
ggggcugggcagaggaa

SEQ ID NO: 1848174 - RNA, 16 nt, Human
ggggcugggcagagga

SEQ ID NO: 1848175 - RNA, 13 nt, Human
ggggcugggacau

SEQ ID NO: 1848176 - RNA, 23 nt, Human
gggguucccuuuuuuggcugcug

SEQ ID NO: 1848177 - RNA, 22 nt, Human
gggguucuuucuuccucugcug

SEQ ID NO: 1848178 - RNA, 20 nt, Human
gggguucuuucuuccucugc

SEQ ID NO: 1848179 - RNA, 18 nt, Human
ggguacccacugcucugg

SEQ ID NO: 1848180 - RNA, 13 nt, Human
ggguacccacugc

SEQ ID NO: 1848181 - RNA, 15 nt, Human
ggguacccacugcuc

SEQ ID NO: 1848182 - RNA, 19 nt, Human
ggguacuuguggacacagc

SEQ ID NO: 1848183 - RNA, 22 nt, Human
ggguacuuguggacacagcucu

SEQ ID NO: 1848184 - RNA, 23 nt, Human
ggguagagcggagaaaggaaggg

SEQ ID NO: 1848185 - RNA, 23 nt, Human
ggguacuuguggacacagcucuu

SEQ ID NO: 1848186 - RNA, 20 nt, Human
gggcuuggggaccagagcug

SEQ ID NO: 1848187 - RNA, 20 nt, Human
gggcuucauccuccucagau

SEQ ID NO: 1848188 - RNA, 19 nt, Human
gggcuucauccuccucaga

SEQ ID NO: 1848189 - RNA, 19 nt, Human
gggcuucaguggcagcugc

SEQ ID NO: 1848190 - RNA, 20 nt, Human
gggcuucaguggcagcugcu

SEQ ID NO: 1848191 - RNA, 15 nt, Human
gggcuucaguggcag

SEQ ID NO: 1848192 - RNA, 16 nt, Human
gggcuucaguggcagc

SEQ ID NO: 1848193 - RNA, 17 nt, Human
gggcuucaguggcagcu

SEQ ID NO: 1848194 - RNA, 18 nt, Human
gggcuucaguggcagcug

SEQ ID NO: 1848195 - RNA, 13 nt, Human
ggggaguggccac

SEQ ID NO: 1848196 - RNA, 21 nt, Human
gggcuuggggaccagagcugc

SEQ ID NO: 1848197 - RNA, 17 nt, Human
ggggaucacagccucug

SEQ ID NO: 1848198 - RNA, 17 nt, Human
gucauaacuagaacuga

SEQ ID NO: 1848199 - RNA, 22 nt, Human
gucauaacuagaacugaauuuu

SEQ ID NO: 1848200 - RNA, 16 nt, Human
gucaucucagcuggau

SEQ ID NO: 1848201 - RNA, 21 nt, Human
gucauauaagauucauauuua

SEQ ID NO: 1848202 - RNA, 14 nt, Human
guccacccaggagc

SEQ ID NO: 1848203 - RNA, 15 nt, Human
guccacccaggagcc

SEQ ID NO: 1848204 - RNA, 16 nt, Human
guccacccaggagccc

SEQ ID NO: 1848205 - RNA, 17 nt, Human
gucccagauacuugggg

SEQ ID NO: 1848206 - RNA, 14 nt, Human
gucccacucagucc

SEQ ID NO: 1848207 - RNA, 15 nt, Human
gucccacucagucca

SEQ ID NO: 1848208 - RNA, 13 nt, Human
guagagugggagc

SEQ ID NO: 1848209 - RNA, 15 nt, Human
guagagugggagcug

SEQ ID NO: 1848210 - RNA, 13 nt, Human
guauuacuucugc

SEQ ID NO: 1848211 - RNA, 14 nt, Human
guauuacuucugcu

SEQ ID NO: 1848212 - RNA, 15 nt, Human
guauuacuucugcua

SEQ ID NO: 1848213 - RNA, 15 nt, Human
guauuauguguguuu

SEQ ID NO: 1848214 - RNA, 14 nt, Human
guauuauaccuuuu

SEQ ID NO: 1848215 - RNA, 19 nt, Human
guauuuauuuaguauuuau

SEQ ID NO: 1848216 - RNA, 15 nt, Human
gucaauuacaggaag

SEQ ID NO: 1848217 - RNA, 13 nt, Human
gucaauuacagga

SEQ ID NO: 1848218 - RNA, 16 nt, Human
gucaauuacaggaagu

SEQ ID NO: 1848219 - RNA, 15 nt, Human
gucaccccggccacc

SEQ ID NO: 1848220 - RNA, 13 nt, Human
gucaccccggcca

SEQ ID NO: 1848221 - RNA, 20 nt, Human
gucaccugaagacucauucu

SEQ ID NO: 1848222 - RNA, 18 nt, Human
gucaagagggucugagga

SEQ ID NO: 1848223 - RNA, 19 nt, Human
gucaagagggucugaggaa

SEQ ID NO: 1848224 - RNA, 18 nt, Human
gucaagugaaaaaggagg

SEQ ID NO: 1848225 - RNA, 16 nt, Human
gucaagugaaaaagga

SEQ ID NO: 1848226 - RNA, 19 nt, Human
gucaagugaaaaaggagga

SEQ ID NO: 1848227 - RNA, 14 nt, Human
guccucccaucuca

SEQ ID NO: 1848228 - RNA, 13 nt, Human
guccucccaucuc

SEQ ID NO: 1848229 - RNA, 12 nt, Human
guccucccaucu

SEQ ID NO: 1848230 - RNA, 23 nt, Human
guccucccaucucacacaugagc

SEQ ID NO: 1848231 - RNA, 15 nt, Human
guccugggagugagc

SEQ ID NO: 1848232 - RNA, 16 nt, Human
guccugggagugagcu

SEQ ID NO: 1848233 - RNA, 17 nt, Human
guccuggcaugggaaug

SEQ ID NO: 1848234 - RNA, 20 nt, Human
guccuggggaaccugacccc

SEQ ID NO: 1848235 - RNA, 19 nt, Human
guccuggggaaccugaccc

SEQ ID NO: 1848236 - RNA, 19 nt, Human
guccugggagugagcuggu

SEQ ID NO: 1848237 - RNA, 17 nt, Human
guccugggagugagcug

SEQ ID NO: 1848238 - RNA, 18 nt, Human
guccugggagugagcugg

SEQ ID NO: 1848239 - RNA, 23 nt, Human
guccuagaaauuccccacccuga

SEQ ID NO: 1848240 - RNA, 15 nt, Human
guccuacucuguguc

SEQ ID NO: 1848241 - RNA, 23 nt, Human
guccuacucugugucaggugggg

SEQ ID NO: 1848242 - RNA, 16 nt, Human
gucccugguggcagcu

SEQ ID NO: 1848243 - RNA, 17 nt, Human
gucccugguggcagcuc

SEQ ID NO: 1848244 - RNA, 13 nt, Human
guccuacucugug

SEQ ID NO: 1848245 - RNA, 12 nt, Human
gucccagugccg

SEQ ID NO: 1848246 - RNA, 13 nt, Human
gucucgugguagg

SEQ ID NO: 1848247 - RNA, 14 nt, Human
gucucuucuccacu

SEQ ID NO: 1848248 - RNA, 16 nt, Human
gucucuucuccacugg

SEQ ID NO: 1848249 - RNA, 15 nt, Human
gucucuucuccacug

SEQ ID NO: 1848250 - RNA, 13 nt, Human
gucugacccacug

SEQ ID NO: 1848251 - RNA, 14 nt, Human
gucugacccacugc

SEQ ID NO: 1848252 - RNA, 17 nt, Human
gucucuucuccacugga

SEQ ID NO: 1848253 - RNA, 15 nt, Human
gucugacccacugcu

SEQ ID NO: 1848254 - RNA, 18 nt, Human
gucugaggaauccagacc

SEQ ID NO: 1848255 - RNA, 19 nt, Human
gucugaggaauccagaccc

SEQ ID NO: 1848256 - RNA, 20 nt, Human
gucugauucccaagcucugc

SEQ ID NO: 1848257 - RNA, 21 nt, Human
gucugauucccaagcucugcu

SEQ ID NO: 1848258 - RNA, 17 nt, Human
gucugauucccaagcuc

SEQ ID NO: 1848259 - RNA, 18 nt, Human
gucugauucccaagcucu

SEQ ID NO: 1848260 - RNA, 19 nt, Human
gucugauucccaagcucug

SEQ ID NO: 1848261 - RNA, 21 nt, Human
gucugaggaauccagacccgg

SEQ ID NO: 1848262 - RNA, 20 nt, Human
gucucacuauguugcccagg

SEQ ID NO: 1848263 - RNA, 21 nt, Human
gucucacuauguugcccaggc

SEQ ID NO: 1848264 - RNA, 13 nt, Human
gucucacuguugc

SEQ ID NO: 1848265 - RNA, 23 nt, Human
gucucacuauguugcccaggcag

SEQ ID NO: 1848266 - RNA, 16 nt, Human
gucucacuguugccca

SEQ ID NO: 1848267 - RNA, 17 nt, Human
gucucacuguugcccag

SEQ ID NO: 1848268 - RNA, 18 nt, Human
gucucacuguugcccagg

SEQ ID NO: 1848269 - RNA, 19 nt, Human
gucucacuguugcccaggc

SEQ ID NO: 1848270 - RNA, 20 nt, Human
gucucacuguugcccaggcu

SEQ ID NO: 1848271 - RNA, 21 nt, Human
gucucacuguugcccaggcug

SEQ ID NO: 1848272 - RNA, 22 nt, Human
gucucacuguugcccaggcugg

SEQ ID NO: 1848273 - RNA, 23 nt, Human
gucucacuguugcccaggcuggc

SEQ ID NO: 1848274 - RNA, 15 nt, Human
gucuacacugugcug

SEQ ID NO: 1848275 - RNA, 17 nt, Human
guccuuaccagcagagc

SEQ ID NO: 1848276 - RNA, 16 nt, Human
guccuuaccagcagag

SEQ ID NO: 1848277 - RNA, 15 nt, Human
guccuuaccagcaga

SEQ ID NO: 1848278 - RNA, 20 nt, Human
gugauucucaugccucagcc

SEQ ID NO: 1848279 - RNA, 14 nt, Human
gugauucuccugcc

SEQ ID NO: 1848280 - RNA, 16 nt, Human
gugauucuccugccuc

SEQ ID NO: 1848281 - RNA, 17 nt, Human
gugauucuccugccuca

SEQ ID NO: 1848282 - RNA, 18 nt, Human
gugauucuccugccucag

SEQ ID NO: 1848283 - RNA, 19 nt, Human
gugauucuccugccucagc

SEQ ID NO: 1848284 - RNA, 20 nt, Human
gugauucuccugccucagcc

SEQ ID NO: 1848285 - RNA, 22 nt, Human
gugauucuccugccucagccuc

SEQ ID NO: 1848286 - RNA, 16 nt, Human
gugauuuugcuguaga

SEQ ID NO: 1848287 - RNA, 13 nt, Human
gugauucuccugc

SEQ ID NO: 1848288 - RNA, 23 nt, Human
gugauucuccugccucagccucc

SEQ ID NO: 1848289 - RNA, 20 nt, Human
gugauucacagugugaaucu

SEQ ID NO: 1848290 - RNA, 23 nt, Human
gugauccucccaccucagccucc

SEQ ID NO: 1848291 - RNA, 20 nt, Human
gugauccucccaccucagcc

SEQ ID NO: 1848292 - RNA, 22 nt, Human
gugauccucccaccucagccuc

SEQ ID NO: 1848293 - RNA, 14 nt, Human
gugauccacucgcc

SEQ ID NO: 1848294 - RNA, 14 nt, Human
gugauccucccacc

SEQ ID NO: 1848295 - RNA, 15 nt, Human
gugauccucccaccu

SEQ ID NO: 1848296 - RNA, 18 nt, Human
gugauccucccaccucag

SEQ ID NO: 1848297 - RNA, 11 nt, Human
gugaggccaga

SEQ ID NO: 1848298 - RNA, 23 nt, Human
gugaggauuaaauaauguaaaua

SEQ ID NO: 1848299 - RNA, 13 nt, Human
gugaggccagaga

SEQ ID NO: 1848300 - RNA, 15 nt, Human
gugauccacccaccu

SEQ ID NO: 1848301 - RNA, 18 nt, Human
gugauccacccaccucag

SEQ ID NO: 1848302 - RNA, 20 nt, Human
gugauccacccaccucagcc

SEQ ID NO: 1848303 - RNA, 23 nt, Human
gugcccaagaauagaugcugacu

SEQ ID NO: 1848304 - RNA, 20 nt, Human
gugcccacaggaucagucug

SEQ ID NO: 1848305 - RNA, 13 nt, Human
gugcauaccacuu

SEQ ID NO: 1848306 - RNA, 14 nt, Human
gugcauaccacuuu

SEQ ID NO: 1848307 - RNA, 21 nt, Human
gugcauaccacuuuuguucuu

SEQ ID NO: 1848308 - RNA, 15 nt, Human
gugcaucucagccca

SEQ ID NO: 1848309 - RNA, 18 nt, Human
gugcaucucagcccacau

SEQ ID NO: 1848310 - RNA, 14 nt, Human
gugcaucucagccc

SEQ ID NO: 1848311 - RNA, 18 nt, Human
gugcaugcagcaucuaag

SEQ ID NO: 1848312 - RNA, 20 nt, Human
gugccagguuuuuggucuga

SEQ ID NO: 1848313 - RNA, 22 nt, Human
gugccagguuuuuggucugacc

SEQ ID NO: 1848314 - RNA, 22 nt, Human
gugcaaaguucccuacuuccug

SEQ ID NO: 1848315 - RNA, 19 nt, Human
gugcauaaguuaacuucca

SEQ ID NO: 1848316 - RNA, 14 nt, Human
gugaaucagagcac

SEQ ID NO: 1848317 - RNA, 18 nt, Human
gugaaucacguaaagcua

SEQ ID NO: 1848318 - RNA, 16 nt, Human
gugaaucacguaaagc

SEQ ID NO: 1848319 - RNA, 19 nt, Human
gugaaaggaaagagggagg

SEQ ID NO: 1848320 - RNA, 13 nt, Human
gugaaaucauuca

SEQ ID NO: 1848321 - RNA, 20 nt, Human
gugaaauuauucauaauuau

SEQ ID NO: 1848322 - RNA, 18 nt, Human
gugaaauuauucauaauu

SEQ ID NO: 1848323 - RNA, 23 nt, Human
gugaaaagaaaaaugagccuggc

SEQ ID NO: 1848324 - RNA, 14 nt, Human
gugaaaagaaaaau

SEQ ID NO: 1848325 - RNA, 16 nt, Human
gugaaaaugugugugu

SEQ ID NO: 1848326 - RNA, 12 nt, Human
gugaaacuggau

SEQ ID NO: 1848327 - RNA, 19 nt, Human
gugaaagaaaauaacaaua

SEQ ID NO: 1848328 - RNA, 16 nt, Human
gugacugaauuucuuu

SEQ ID NO: 1848329 - RNA, 18 nt, Human
gugacugaauuucuuuug

SEQ ID NO: 1848330 - RNA, 15 nt, Human
gugacugaauuucuu

SEQ ID NO: 1848331 - RNA, 16 nt, Human
gugaccucagcuuuga

SEQ ID NO: 1848332 - RNA, 16 nt, Human
gugacaacacuugugu

SEQ ID NO: 1848333 - RNA, 17 nt, Human
gugagcaggcugugagu

SEQ ID NO: 1848334 - RNA, 17 nt, Human
gugacugaucucucgug

SEQ ID NO: 1848335 - RNA, 15 nt, Human
gugagccaccacgcc

SEQ ID NO: 1848336 - RNA, 15 nt, Human
gugagccaccgugcc

SEQ ID NO: 1848337 - RNA, 16 nt, Human
gugagccaccacgccc

SEQ ID NO: 1848338 - RNA, 21 nt, Human
gugagccaccgugccuggcca

SEQ ID NO: 1848339 - RNA, 17 nt, Human
gugagccaccgugccug

SEQ ID NO: 1848340 - RNA, 13 nt, Human
gugagccacugca

SEQ ID NO: 1848341 - RNA, 19 nt, Human
gugaggaagccgcuggggc

SEQ ID NO: 1848342 - RNA, 16 nt, Human
gugaggaagccgcugg

SEQ ID NO: 1848343 - RNA, 11 nt, Human
gugaggaagcc

SEQ ID NO: 1848344 - RNA, 16 nt, Human
gugagcuccuaagcca

SEQ ID NO: 1848345 - RNA, 22 nt, Human
gugagccaccgugccuggccac

SEQ ID NO: 1848346 - RNA, 14 nt, Human
gugagccacugcac

SEQ ID NO: 1848347 - RNA, 14 nt, Human
gugagcuacaaaug

SEQ ID NO: 1848348 - RNA, 21 nt, Human
guggccacuccagaccccugg

SEQ ID NO: 1848349 - RNA, 14 nt, Human
guggccaaguucuu

SEQ ID NO: 1848350 - RNA, 19 nt, Human
guggcagugggagcugccu

SEQ ID NO: 1848351 - RNA, 21 nt, Human
guggcagugggagcugccugu

SEQ ID NO: 1848352 - RNA, 11 nt, Human
guggcagucug

SEQ ID NO: 1848353 - RNA, 15 nt, Human
guggcagugggagcu

SEQ ID NO: 1848354 - RNA, 16 nt, Human
guggcagugggagcug

SEQ ID NO: 1848355 - RNA, 17 nt, Human
guggcagugggagcugc

SEQ ID NO: 1848356 - RNA, 19 nt, Human
guggcagcugcgguccacc

SEQ ID NO: 1848357 - RNA, 20 nt, Human
guggaugccugguggcagcu

SEQ ID NO: 1848358 - RNA, 21 nt, Human
guggcagcugcgguccaccca

SEQ ID NO: 1848359 - RNA, 22 nt, Human
guggcagcugcgguccacccag

SEQ ID NO: 1848360 - RNA, 23 nt, Human
guggcagcugcgguccacccagg

SEQ ID NO: 1848361 - RNA, 12 nt, Human
guggcagcugcu

SEQ ID NO: 1848362 - RNA, 13 nt, Human
guggcagcugcuu

SEQ ID NO: 1848363 - RNA, 19 nt, Human
guggcagcugcuuuugucu

SEQ ID NO: 1848364 - RNA, 18 nt, Human
guggagaggcccggccuc

SEQ ID NO: 1848365 - RNA, 20 nt, Human
guggagaagcggcuggcagc

SEQ ID NO: 1848366 - RNA, 13 nt, Human
guggacuuuuauu

SEQ ID NO: 1848367 - RNA, 22 nt, Human
guggaacguuuuuccuguucuu

SEQ ID NO: 1848368 - RNA, 17 nt, Human
guggaguucaucuugaa

SEQ ID NO: 1848369 - RNA, 16 nt, Human
guggaugccugguggc

SEQ ID NO: 1848370 - RNA, 18 nt, Human
guggaugccugguggcag

SEQ ID NO: 1848371 - RNA, 19 nt, Human
gugcugagucugaaggcug

SEQ ID NO: 1848372 - RNA, 18 nt, Human
gugcugagucugaaggcu

SEQ ID NO: 1848373 - RNA, 17 nt, Human
gugcugagucugaaggc

SEQ ID NO: 1848374 - RNA, 16 nt, Human
gugcugagucugaagg

SEQ ID NO: 1848375 - RNA, 12 nt, Human
gugcugagucug

SEQ ID NO: 1848376 - RNA, 12 nt, Human
gugcugcauuua

SEQ ID NO: 1848377 - RNA, 19 nt, Human
gugcugcauuuaaaagaua

SEQ ID NO: 1848378 - RNA, 20 nt, Human
gugcugcauuuaaaagauac

SEQ ID NO: 1848379 - RNA, 12 nt, Human
gugcugccacac

SEQ ID NO: 1848380 - RNA, 15 nt, Human
gugcugccauccagg

SEQ ID NO: 1848381 - RNA, 18 nt, Human
gugcugccauccagguuc

SEQ ID NO: 1848382 - RNA, 19 nt, Human
gugcugccauccagguuca

SEQ ID NO: 1848383 - RNA, 20 nt, Human
gugcugaaugguuuucaaaa

SEQ ID NO: 1848384 - RNA, 19 nt, Human
gugcugaaugguuuucaaa

SEQ ID NO: 1848385 - RNA, 23 nt, Human
gugcugaaugguuuucaaaauaa

SEQ ID NO: 1848386 - RNA, 17 nt, Human
gugcucuggacaggcau

SEQ ID NO: 1848387 - RNA, 18 nt, Human
gugcucuggacaggcaug

SEQ ID NO: 1848388 - RNA, 21 nt, Human
gugccuuggggacaagagcag

SEQ ID NO: 1848389 - RNA, 22 nt, Human
gugccgagaaggaagccuccca

SEQ ID NO: 1848390 - RNA, 15 nt, Human
gugcucuggacaggc

SEQ ID NO: 1848391 - RNA, 16 nt, Human
gugcucuggacaggca

SEQ ID NO: 1848392 - RNA, 18 nt, Human
guggaaaaauagccugcc

SEQ ID NO: 1848393 - RNA, 18 nt, Human
gugcuuauguaugaggua

SEQ ID NO: 1848394 - RNA, 15 nt, Human
gugcuuggaggaagg

SEQ ID NO: 1848395 - RNA, 13 nt, Human
gugcuuggaggaa

SEQ ID NO: 1848396 - RNA, 12 nt, Human
gugcuuggagga

SEQ ID NO: 1848397 - RNA, 11 nt, Human
gugcugcccug

SEQ ID NO: 1848398 - RNA, 21 nt, Human
gugcugccacacuucaggcuc

SEQ ID NO: 1848399 - RNA, 22 nt, Human
gugcugccauccagguucagcu

SEQ ID NO: 1848400 - RNA, 19 nt, Human
uauauguuuuaagaggcag

SEQ ID NO: 1848401 - RNA, 16 nt, Human
uaucuaaauguugaaa

SEQ ID NO: 1848402 - RNA, 18 nt, Human
uaucguaaaauuaagaaa

SEQ ID NO: 1848403 - RNA, 15 nt, Human
uaucguaaaauuaag

SEQ ID NO: 1848404 - RNA, 15 nt, Human
uauccuucagccuga

SEQ ID NO: 1848405 - RNA, 14 nt, Human
uauccuucagccug

SEQ ID NO: 1848406 - RNA, 16 nt, Human
uaucgucacugcuuaa

SEQ ID NO: 1848407 - RNA, 21 nt, Human
uaucuaauauguaacaagcca

SEQ ID NO: 1848408 - RNA, 22 nt, Human
uaugacacaugcaaggucauuu

SEQ ID NO: 1848409 - RNA, 12 nt, Human
uaugacacaugc

SEQ ID NO: 1848410 - RNA, 19 nt, Human
uaugaccacacuccagcug

SEQ ID NO: 1848411 - RNA, 14 nt, Human
uaugaccacacucc

SEQ ID NO: 1848412 - RNA, 12 nt, Human
uaugaauaacau

SEQ ID NO: 1848413 - RNA, 14 nt, Human
uaucuugaagacuu

SEQ ID NO: 1848414 - RNA, 18 nt, Human
uaugaauaaagacaccua

SEQ ID NO: 1848415 - RNA, 20 nt, Human
uaugaaguuuuuuuuauaca

SEQ ID NO: 1848416 - RNA, 20 nt, Human
uaucugucauuugagcaggg

SEQ ID NO: 1848417 - RNA, 21 nt, Human
uaucugucauuugagcagggc

SEQ ID NO: 1848418 - RNA, 23 nt, Human
uaucugucauuugagcagggcuc

SEQ ID NO: 1848419 - RNA, 19 nt, Human
uauggaacacucugagacu

SEQ ID NO: 1848420 - RNA, 17 nt, Human
uauggacaaugacccag

SEQ ID NO: 1848421 - RNA, 18 nt, Human
uauggaacacucugagac

SEQ ID NO: 1848422 - RNA, 17 nt, Human
uauggaacacucugaga

SEQ ID NO: 1848423 - RNA, 16 nt, Human
uauggaacacucugag

SEQ ID NO: 1848424 - RNA, 13 nt, Human
uauggaacacucu

SEQ ID NO: 1848425 - RNA, 22 nt, Human
uaugcuuauacacuuacacuuu

SEQ ID NO: 1848426 - RNA, 13 nt, Human
uaugcaugaagua

SEQ ID NO: 1848427 - RNA, 18 nt, Human
uaugcaugaaguaauaug

SEQ ID NO: 1848428 - RNA, 20 nt, Human
uaugcauauuauuuuauguu

SEQ ID NO: 1848429 - RNA, 18 nt, Human
uaugcagagguccacaac

SEQ ID NO: 1848430 - RNA, 18 nt, Human
uaugcaaucaaaucugcu

SEQ ID NO: 1848431 - RNA, 13 nt, Human
uaugcacacauuu

SEQ ID NO: 1848432 - RNA, 14 nt, Human
uaugcacacauuuu

SEQ ID NO: 1848433 - RNA, 23 nt, Human
uaugauuuuuaaagaaaaguuuu

SEQ ID NO: 1848434 - RNA, 18 nt, Human
uaugauuuggaaaauaaa

SEQ ID NO: 1848435 - RNA, 12 nt, Human
uaugauuuuuaa

SEQ ID NO: 1848436 - RNA, 17 nt, Human
uaugauuuggaaaauaa

SEQ ID NO: 1848437 - RNA, 15 nt, Human
uaugauuuggaaaau

SEQ ID NO: 1848438 - RNA, 23 nt, Human
uaugacuccagaauuucccaaag

SEQ ID NO: 1848439 - RNA, 17 nt, Human
uaugacuccagaauuuc

SEQ ID NO: 1848440 - RNA, 16 nt, Human
uaugacuccagaauuu

SEQ ID NO: 1848441 - RNA, 15 nt, Human
uauaauucacauugu

SEQ ID NO: 1848442 - RNA, 18 nt, Human
uauacgauaaauaacuuu

SEQ ID NO: 1848443 - RNA, 23 nt, Human
uauauaaauuuuuuuuguuucau

SEQ ID NO: 1848444 - RNA, 21 nt, Human
uauaugcucugcauguuacau

SEQ ID NO: 1848445 - RNA, 13 nt, Human
uaguaucaaaaga

SEQ ID NO: 1848446 - RNA, 21 nt, Human
uaggugauccacucgccuuca

SEQ ID NO: 1848447 - RNA, 23 nt, Human
uaggugacagagugagacucugu

SEQ ID NO: 1848448 - RNA, 20 nt, Human
uaguugcaacuuuguauaaa

SEQ ID NO: 1848449 - RNA, 13 nt, Human
uaguguucauaaa

SEQ ID NO: 1848450 - RNA, 15 nt, Human
uaggccuggccagau

SEQ ID NO: 1848451 - RNA, 18 nt, Human
uaggccuggccagaugca

SEQ ID NO: 1848452 - RNA, 16 nt, Human
uaggccaugggacagg

SEQ ID NO: 1848453 - RNA, 18 nt, Human
uaggccaugggacaggga

SEQ ID NO: 1848454 - RNA, 16 nt, Human
uaggaauuguguuuau

SEQ ID NO: 1848455 - RNA, 12 nt, Human
uaggaauugacc

SEQ ID NO: 1848456 - RNA, 21 nt, Human
uagggaaaaaccagcguguga

SEQ ID NO: 1848457 - RNA, 20 nt, Human
uagggaaaaaccagcgugug

SEQ ID NO: 1848458 - RNA, 19 nt, Human
uagggaaaaaccagcgugu

SEQ ID NO: 1848459 - RNA, 20 nt, Human
uagguauaaguggugugugu

SEQ ID NO: 1848460 - RNA, 16 nt, Human
uagguaaauuacaguu

SEQ ID NO: 1848461 - RNA, 15 nt, Human
uaggucucaauaccu

SEQ ID NO: 1848462 - RNA, 16 nt, Human
uaggucagugcaaaua

SEQ ID NO: 1848463 - RNA, 17 nt, Human
ucaaggauccugagcca

SEQ ID NO: 1848464 - RNA, 16 nt, Human
ucaaggauccugagcc

SEQ ID NO: 1848465 - RNA, 15 nt, Human
ucaaggauccugagc

SEQ ID NO: 1848466 - RNA, 14 nt, Human
ucaaggauccugag

SEQ ID NO: 1848467 - RNA, 13 nt, Human
ucaaggauccuga

SEQ ID NO: 1848468 - RNA, 20 nt, Human
ucaagccaccaacauacucc

SEQ ID NO: 1848469 - RNA, 12 nt, Human
ucaagccaccaa

SEQ ID NO: 1848470 - RNA, 21 nt, Human
ucaagcgauucuucugcuuca

SEQ ID NO: 1848471 - RNA, 18 nt, Human
ucaagcgauucuucugcu

SEQ ID NO: 1848472 - RNA, 19 nt, Human
ucaagcgauucuucugcuu

SEQ ID NO: 1848473 - RNA, 22 nt, Human
ucaacucccugccccccagccc

SEQ ID NO: 1848474 - RNA, 21 nt, Human
ucaacucccugccccccagcc

SEQ ID NO: 1848475 - RNA, 15 nt, Human
ucaacucccugcccc

SEQ ID NO: 1848476 - RNA, 14 nt, Human
ucaacucccugccc

SEQ ID NO: 1848477 - RNA, 18 nt, Human
ucaacugaccagccucca

SEQ ID NO: 1848478 - RNA, 24 nt, Human
ucaacugaccagccuccaugcugc

SEQ ID NO: 1848479 - RNA, 20 nt, Human
ucaacucuccuccagaguca

SEQ ID NO: 1848480 - RNA, 16 nt, Human
ucaaccuccugggcua

SEQ ID NO: 1848481 - RNA, 20 nt, Human
ucaaccccuucgcuccugug

SEQ ID NO: 1848482 - RNA, 15 nt, Human
ucaaccuccugggcu

SEQ ID NO: 1848483 - RNA, 18 nt, Human
ucaaccccuucgcuccug

SEQ ID NO: 1848484 - RNA, 19 nt, Human
ucaaccccuucgcuccugu

SEQ ID NO: 1848485 - RNA, 23 nt, Human
ucaaagagguuuuaaaaaaaucc

SEQ ID NO: 1848486 - RNA, 12 nt, Human
ucaaagagguuu

SEQ ID NO: 1848487 - RNA, 20 nt, Human
ucaaaccccgaccaccugcc

SEQ ID NO: 1848488 - RNA, 19 nt, Human
ucaaaccccgaccaccugc

SEQ ID NO: 1848489 - RNA, 23 nt, Human
ucaaaccccgaccaccugcccaa

SEQ ID NO: 1848490 - RNA, 19 nt, Human
ucacaggagggagggggaa

SEQ ID NO: 1848491 - RNA, 23 nt, Human
ucacaggacucugccuccucuuc

SEQ ID NO: 1848492 - RNA, 19 nt, Human
ucacaggacucugccuccu

SEQ ID NO: 1848493 - RNA, 16 nt, Human
ucacaggacucugccu

SEQ ID NO: 1848494 - RNA, 18 nt, Human
ucacaggacucugccucc

SEQ ID NO: 1848495 - RNA, 17 nt, Human
ucacaggacucugccuc

SEQ ID NO: 1848496 - RNA, 23 nt, Human
ucacacaugagcaucaggccagg

SEQ ID NO: 1848497 - RNA, 22 nt, Human
ucacacaugagcaucaggccag

SEQ ID NO: 1848498 - RNA, 15 nt, Human
ucacacacuuuggcu

SEQ ID NO: 1848499 - RNA, 22 nt, Human
ucacaagacccaaaaggcagaa

SEQ ID NO: 1848500 - RNA, 14 nt, Human
ucaccgaaaacgug

SEQ ID NO: 1848501 - RNA, 12 nt, Human
ucacccuuuucu

SEQ ID NO: 1848502 - RNA, 20 nt, Human
ucacccuggggcuaggaaau

SEQ ID NO: 1848503 - RNA, 19 nt, Human
ucacccgcuaagagggagg

SEQ ID NO: 1848504 - RNA, 21 nt, Human
ucaccgaaaacguggcugcuu

SEQ ID NO: 1848505 - RNA, 20 nt, Human
ucaccgaaaacguggcugcu

SEQ ID NO: 1848506 - RNA, 19 nt, Human
ucaccgaaaacguggcugc

SEQ ID NO: 1848507 - RNA, 15 nt, Human
ucaccgaaaacgugg

SEQ ID NO: 1848508 - RNA, 23 nt, Human
ucaccgaaaacguggcugcuuca

SEQ ID NO: 1848509 - RNA, 22 nt, Human
ucaccgaaaacguggcugcuuc

SEQ ID NO: 1848510 - RNA, 18 nt, Human
ucacccgcuaagagggag

SEQ ID NO: 1848511 - RNA, 13 nt, Human
ucaccaagcccag

SEQ ID NO: 1848512 - RNA, 18 nt, Human
ucaccaacgucugugcca

SEQ ID NO: 1848513 - RNA, 17 nt, Human
ucaccaacgucugugcc

SEQ ID NO: 1848514 - RNA, 21 nt, Human
ucaccaaaucagcugcuacua

SEQ ID NO: 1848515 - RNA, 14 nt, Human
ucacauuuauucug

SEQ ID NO: 1848516 - RNA, 22 nt, Human
ucacauuguauucagaguugau

SEQ ID NO: 1848517 - RNA, 12 nt, Human
ucacauuuaaau

SEQ ID NO: 1848518 - RNA, 17 nt, Human
uauuuaugggauccugg

SEQ ID NO: 1848519 - RNA, 22 nt, Human
uauuuauuaaaugcccagcccc

SEQ ID NO: 1848520 - RNA, 22 nt, Human
uauugcugauggugcaaugacc

SEQ ID NO: 1848521 - RNA, 23 nt, Human
uauugcugauggugcaaugaccu

SEQ ID NO: 1848522 - RNA, 15 nt, Human
uauugcuugcacaaa

SEQ ID NO: 1848523 - RNA, 13 nt, Human
uauugcccacgcu

SEQ ID NO: 1848524 - RNA, 14 nt, Human
uauugcccacgcug

SEQ ID NO: 1848525 - RNA, 15 nt, Human
uauugcccacgcugg

SEQ ID NO: 1848526 - RNA, 20 nt, Human
uauugauaugcuuauacacu

SEQ ID NO: 1848527 - RNA, 22 nt, Human
uauugcagcgauuaauaacagg

SEQ ID NO: 1848528 - RNA, 19 nt, Human
uauuaaaugcccagccccu

SEQ ID NO: 1848529 - RNA, 17 nt, Human
uauuaaaugcccagccc

SEQ ID NO: 1848530 - RNA, 15 nt, Human
uauuaaaugcccagc

SEQ ID NO: 1848531 - RNA, 16 nt, Human
uauuaagaaagacuau

SEQ ID NO: 1848532 - RNA, 17 nt, Human
uauguucuaagaaguga

SEQ ID NO: 1848533 - RNA, 22 nt, Human
uauguucuuaguggauguucug

SEQ ID NO: 1848534 - RNA, 18 nt, Human
uauguugguagauucuaa

SEQ ID NO: 1848535 - RNA, 17 nt, Human
uauguugaagccuuugu

SEQ ID NO: 1848536 - RNA, 21 nt, Human
uauguugcccaggcaggucuu

SEQ ID NO: 1848537 - RNA, 13 nt, Human
uauguguguuuua

SEQ ID NO: 1848538 - RNA, 14 nt, Human
uauggaggcaggag

SEQ ID NO: 1848539 - RNA, 20 nt, Human
uauuauggaggcaggaguuu

SEQ ID NO: 1848540 - RNA, 14 nt, Human
uauuaaggaagaca

SEQ ID NO: 1848541 - RNA, 15 nt, Human
uauuaaguuguuaau

SEQ ID NO: 1848542 - RNA, 12 nt, Human
uauuauaccuuu

SEQ ID NO: 1848543 - RNA, 13 nt, Human
uauuauaccuuuu

SEQ ID NO: 1848544 - RNA, 14 nt, Human
uauuauaccuuuuu

SEQ ID NO: 1848545 - RNA, 17 nt, Human
uauuauauuuacaaaug

SEQ ID NO: 1848546 - RNA, 16 nt, Human
ucaucuccccaucauu

SEQ ID NO: 1848547 - RNA, 18 nt, Human
ucauccacugugccaugu

SEQ ID NO: 1848548 - RNA, 14 nt, Human
ucauccacugugcc

SEQ ID NO: 1848549 - RNA, 17 nt, Human
ucauccacugugccaug

SEQ ID NO: 1848550 - RNA, 20 nt, Human
ucaguguacauggaauaaca

SEQ ID NO: 1848551 - RNA, 11 nt, Human
ucauagcagcu

SEQ ID NO: 1848552 - RNA, 12 nt, Human
ucauagcagcuu

SEQ ID NO: 1848553 - RNA, 17 nt, Human
ucaucaaugaaugaaug

SEQ ID NO: 1848554 - RNA, 14 nt, Human
ucaucauccuaagc

SEQ ID NO: 1848555 - RNA, 14 nt, Human
ucauggugcucaga

SEQ ID NO: 1848556 - RNA, 16 nt, Human
ucauuaggauggcuag

SEQ ID NO: 1848557 - RNA, 13 nt, Human
uccaaaguacacu

SEQ ID NO: 1848558 - RNA, 21 nt, Human
ucaggcucuucuccuuucaca

SEQ ID NO: 1848559 - RNA, 16 nt, Human
ucaggcucuucuccuu

SEQ ID NO: 1848560 - RNA, 12 nt, Human
ucaggucccugc

SEQ ID NO: 1848561 - RNA, 23 nt, Human
ucaggugagaagcagaggaagga

SEQ ID NO: 1848562 - RNA, 16 nt, Human
ucaggugauccaccca

SEQ ID NO: 1848563 - RNA, 23 nt, Human
ucaggugauccacccaccucagc

SEQ ID NO: 1848564 - RNA, 18 nt, Human
ucagguggggcagcuuga

SEQ ID NO: 1848565 - RNA, 19 nt, Human
ucagguggggcagcuugag

SEQ ID NO: 1848566 - RNA, 21 nt, Human
ucagucugauucccaagcucu

SEQ ID NO: 1848567 - RNA, 22 nt, Human
ucagucugauucccaagcucug

SEQ ID NO: 1848568 - RNA, 23 nt, Human
ucagucugauucccaagcucugc

SEQ ID NO: 1848569 - RNA, 16 nt, Human
ucagucucccucccuu

SEQ ID NO: 1848570 - RNA, 20 nt, Human
ucagguggggcagcuugagg

SEQ ID NO: 1848571 - RNA, 23 nt, Human
ucaggaagcucagggccuggcuc

SEQ ID NO: 1848572 - RNA, 23 nt, Human
ucagcucugcaagaauugaagca

SEQ ID NO: 1848573 - RNA, 23 nt, Human
ucagcuccagcucaccagcccca

SEQ ID NO: 1848574 - RNA, 24 nt, Human
ucagcuccagcucaccagccccag

SEQ ID NO: 1848575 - RNA, 15 nt, Human
ucaggagcccuggga

SEQ ID NO: 1848576 - RNA, 14 nt, Human
ucaggagcccuggg

SEQ ID NO: 1848577 - RNA, 12 nt, Human
ucaggagcccug

SEQ ID NO: 1848578 - RNA, 11 nt, Human
ucaggagcccu

SEQ ID NO: 1848579 - RNA, 20 nt, Human
ucaggaucaaaccccgacca

SEQ ID NO: 1848580 - RNA, 15 nt, Human
ucaggcucuucuccu

SEQ ID NO: 1848581 - RNA, 21 nt, Human
ucaggccugggggcugggcag

SEQ ID NO: 1848582 - RNA, 24 nt, Human
ucccaggcauuccccaggaggcca

SEQ ID NO: 1848583 - RNA, 23 nt, Human
ucccaggcauuccccaggaggcc

SEQ ID NO: 1848584 - RNA, 23 nt, Human
ucccagcugugcucuggacaggc

SEQ ID NO: 1848585 - RNA, 21 nt, Human
ucccagcugugcucuggacag

SEQ ID NO: 1848586 - RNA, 22 nt, Human
ucccagcugugcucuggacagg

SEQ ID NO: 1848587 - RNA, 15 nt, Human
ucccaucuuccaagg

SEQ ID NO: 1848588 - RNA, 16 nt, Human
ucccaggcgccccuuc

SEQ ID NO: 1848589 - RNA, 21 nt, Human
ucccaucugugaaaggaaaga

SEQ ID NO: 1848590 - RNA, 18 nt, Human
ucccaugagccucagcau

SEQ ID NO: 1848591 - RNA, 19 nt, Human
ucccaugagccucagcauc

SEQ ID NO: 1848592 - RNA, 22 nt, Human
ucccaccucucucacuccuuga

SEQ ID NO: 1848593 - RNA, 20 nt, Human
uccaugugggcuaguugggc

SEQ ID NO: 1848594 - RNA, 13 nt, Human
ucccaccuuggcu

SEQ ID NO: 1848595 - RNA, 16 nt, Human
ucccaccuuggcugca

SEQ ID NO: 1848596 - RNA, 17 nt, Human
ucccaccuuggcugcag

SEQ ID NO: 1848597 - RNA, 20 nt, Human
ucccagcugugcucuggaca

SEQ ID NO: 1848598 - RNA, 18 nt, Human
ucccaccuuggcugcagg

SEQ ID NO: 1848599 - RNA, 14 nt, Human
uccccaggaggcca

SEQ ID NO: 1848600 - RNA, 17 nt, Human
uccccaggaggccagcc

SEQ ID NO: 1848601 - RNA, 17 nt, Human
ucccccagccccauccu

SEQ ID NO: 1848602 - RNA, 16 nt, Human
uccccaggaggccagc

SEQ ID NO: 1848603 - RNA, 15 nt, Human
uccccaggaggccag

SEQ ID NO: 1848604 - RNA, 21 nt, Human
ucccccagccccauccucugu

SEQ ID NO: 1848605 - RNA, 20 nt, Human
ucccccagccccauccucug

SEQ ID NO: 1848606 - RNA, 22 nt, Human
ucccccagccccauccucugua

SEQ ID NO: 1848607 - RNA, 19 nt, Human
uccccagauugcaacaggc

SEQ ID NO: 1848608 - RNA, 20 nt, Human
uccccagauugcaacaggcu

SEQ ID NO: 1848609 - RNA, 22 nt, Human
uccccagauugcaacaggcugg

SEQ ID NO: 1848610 - RNA, 23 nt, Human
uccccagauugcaacaggcuggg

SEQ ID NO: 1848611 - RNA, 20 nt, Human
uccccagcaagugagagcug

SEQ ID NO: 1848612 - RNA, 21 nt, Human
uccccagcaagugagagcugg

SEQ ID NO: 1848613 - RNA, 22 nt, Human
uccccagcaagugagagcuggg

SEQ ID NO: 1848614 - RNA, 20 nt, Human
ucccaugagccucagcaucc

SEQ ID NO: 1848615 - RNA, 13 nt, Human
uccccagauugca

SEQ ID NO: 1848616 - RNA, 18 nt, Human
uccccagauugcaacagg

SEQ ID NO: 1848617 - RNA, 21 nt, Human
uccacuuggucugugagaugc

SEQ ID NO: 1848618 - RNA, 17 nt, Human
uccacuuggucugugag

SEQ ID NO: 1848619 - RNA, 14 nt, Human
uccaaaguacacug

SEQ ID NO: 1848620 - RNA, 16 nt, Human
uccaaaguacacuguu

SEQ ID NO: 1848621 - RNA, 19 nt, Human
uccacuuucuagccagagg

SEQ ID NO: 1848622 - RNA, 23 nt, Human
uccacuuggucugugagaugcua

SEQ ID NO: 1848623 - RNA, 21 nt, Human
uccacuuucuagccagaggag

SEQ ID NO: 1848624 - RNA, 20 nt, Human
uccacuuucuagccagagga

SEQ ID NO: 1848625 - RNA, 23 nt, Human
uccagaaagaaaacuuguauuau

SEQ ID NO: 1848626 - RNA, 15 nt, Human
uccaggagcagccac

SEQ ID NO: 1848627 - RNA, 14 nt, Human
uccaggagcagcca

SEQ ID NO: 1848628 - RNA, 13 nt, Human
uccaggagcagcc

SEQ ID NO: 1848629 - RNA, 12 nt, Human
uccaggagcagc

SEQ ID NO: 1848630 - RNA, 20 nt, Human
uccaggggugggacacccug

SEQ ID NO: 1848631 - RNA, 19 nt, Human
uccaggggugggacacccu

SEQ ID NO: 1848632 - RNA, 22 nt, Human
uccagcaauucuccugccucag

SEQ ID NO: 1848633 - RNA, 22 nt, Human
uccaggggugggacacccugug

SEQ ID NO: 1848634 - RNA, 20 nt, Human
uccagguuuaagcuguuacu

SEQ ID NO: 1848635 - RNA, 22 nt, Human
uccauaaucuggacuccucugu

SEQ ID NO: 1848636 - RNA, 15 nt, Human
uccaugcugccucca

SEQ ID NO: 1848637 - RNA, 14 nt, Human
uccaugcugccucc

SEQ ID NO: 1848638 - RNA, 20 nt, Human
uccaugggccauaugaaaag

SEQ ID NO: 1848639 - RNA, 21 nt, Human
uccauaaucuggacuccucug

SEQ ID NO: 1848640 - RNA, 15 nt, Human
uccauagagagcaag

SEQ ID NO: 1848641 - RNA, 14 nt, Human
uccauagagagcaa

SEQ ID NO: 1848642 - RNA, 14 nt, Human
uccaucaggccacu

SEQ ID NO: 1848643 - RNA, 17 nt, Human
uccugccccugagccca

SEQ ID NO: 1848644 - RNA, 18 nt, Human
uccugccccugagcccau

SEQ ID NO: 1848645 - RNA, 10 nt, Human
uccugcccug

SEQ ID NO: 1848646 - RNA, 14 nt, Human
uccugccaggcaug

SEQ ID NO: 1848647 - RNA, 13 nt, Human
uccugccaggcau

SEQ ID NO: 1848648 - RNA, 16 nt, Human
uccugccaccacgccc

SEQ ID NO: 1848649 - RNA, 11 nt, Human
uccugccacca

SEQ ID NO: 1848650 - RNA, 19 nt, Human
uccugaggcuccacuuggu

SEQ ID NO: 1848651 - RNA, 20 nt, Human
uccugaggcuccacuugguc

SEQ ID NO: 1848652 - RNA, 21 nt, Human
uccugaggcuccacuuggucu

SEQ ID NO: 1848653 - RNA, 16 nt, Human
uccugcauuugugaaa

SEQ ID NO: 1848654 - RNA, 17 nt, Human
uccugcccuuaccugcc

SEQ ID NO: 1848655 - RNA, 21 nt, Human
uccugcccugggaggcaguga

SEQ ID NO: 1848656 - RNA, 15 nt, Human
uccugcccugggagg

SEQ ID NO: 1848657 - RNA, 14 nt, Human
uccugcccugggag

SEQ ID NO: 1848658 - RNA, 12 nt, Human
uccugcccuggg

SEQ ID NO: 1848659 - RNA, 11 nt, Human
uccugcccugg

SEQ ID NO: 1848660 - RNA, 20 nt, Human
uccugcccuuaccugccagg

SEQ ID NO: 1848661 - RNA, 14 nt, Human
uccuggaguucugg

SEQ ID NO: 1848662 - RNA, 19 nt, Human
uccugccuaaggcugaacu

SEQ ID NO: 1848663 - RNA, 16 nt, Human
uccugccuaaggcuga

SEQ ID NO: 1848664 - RNA, 13 nt, Human
uccuguagcccua

SEQ ID NO: 1848665 - RNA, 11 nt, Human
uccuguagccc

SEQ ID NO: 1848666 - RNA, 12 nt, Human
uccuggccucaa

SEQ ID NO: 1848667 - RNA, 16 nt, Human
uccuggcacugcuucc

SEQ ID NO: 1848668 - RNA, 13 nt, Human
uccuggcacugcu

SEQ ID NO: 1848669 - RNA, 23 nt, Human
uccuggcacccggccccugcugg

SEQ ID NO: 1848670 - RNA, 15 nt, Human
ucccccuuccaugga

SEQ ID NO: 1848671 - RNA, 22 nt, Human
ucccuucaaccauuccccaugg

SEQ ID NO: 1848672 - RNA, 16 nt, Human
ucccuuccucuuucca

SEQ ID NO: 1848673 - RNA, 15 nt, Human
ucccuuccucuuucc

SEQ ID NO: 1848674 - RNA, 14 nt, Human
uccgccucuugggu

SEQ ID NO: 1848675 - RNA, 21 nt, Human
uccuaagcuauucaguaauaa

SEQ ID NO: 1848676 - RNA, 20 nt, Human
uccuaagcuauucaguaaua

SEQ ID NO: 1848677 - RNA, 18 nt, Human
uccgcuuucuacccagcg

SEQ ID NO: 1848678 - RNA, 20 nt, Human
uccgcuuucuacccagcgag

SEQ ID NO: 1848679 - RNA, 16 nt, Human
uccgcuuucuacccag

SEQ ID NO: 1848680 - RNA, 12 nt, Human
uccucccaccuc

SEQ ID NO: 1848681 - RNA, 13 nt, Human
uccucccaccuca

SEQ ID NO: 1848682 - RNA, 10 nt, Human
uccuccaggu

SEQ ID NO: 1848683 - RNA, 18 nt, Human
uccucauuagcauuuugc

SEQ ID NO: 1848684 - RNA, 17 nt, Human
uccuaucagaaguuucu

SEQ ID NO: 1848685 - RNA, 23 nt, Human
uccuauauuguuuucaguguaca

SEQ ID NO: 1848686 - RNA, 12 nt, Human
uccuaguuccac

SEQ ID NO: 1848687 - RNA, 15 nt, Human
ucuccagccccugga

SEQ ID NO: 1848688 - RNA, 14 nt, Human
ucuccagccccugg

SEQ ID NO: 1848689 - RNA, 13 nt, Human
ucuccagccccug

SEQ ID NO: 1848690 - RNA, 12 nt, Human
ucuccagccccu

SEQ ID NO: 1848691 - RNA, 14 nt, Human
ucuccacugccuuc

SEQ ID NO: 1848692 - RNA, 18 nt, Human
ucuccagccccuggaugc

SEQ ID NO: 1848693 - RNA, 16 nt, Human
ucuccagccccuggau

SEQ ID NO: 1848694 - RNA, 22 nt, Human
ucuccagccccuggaugcagcc

SEQ ID NO: 1848695 - RNA, 14 nt, Human
ucucccucccuugg

SEQ ID NO: 1848696 - RNA, 23 nt, Human
ucucccucagucuggcccuuccu

SEQ ID NO: 1848697 - RNA, 18 nt, Human
ucucccucagucuggccc

SEQ ID NO: 1848698 - RNA, 11 nt, Human
ucuccaggcug

SEQ ID NO: 1848699 - RNA, 12 nt, Human
ucucccccagcc

SEQ ID NO: 1848700 - RNA, 13 nt, Human
ucucccccagccc

SEQ ID NO: 1848701 - RNA, 16 nt, Human
ucuccaccugccaggg

SEQ ID NO: 1848702 - RNA, 15 nt, Human
ucuccaccugccagg

SEQ ID NO: 1848703 - RNA, 14 nt, Human
ucuccaccugccag

SEQ ID NO: 1848704 - RNA, 19 nt, Human
ucuccaccugccagggaca

SEQ ID NO: 1848705 - RNA, 17 nt, Human
ucuccaccugccaggga

SEQ ID NO: 1848706 - RNA, 22 nt, Human
ucuccaccugccagggacagag

SEQ ID NO: 1848707 - RNA, 13 nt, Human
ucuccacuccaga

SEQ ID NO: 1848708 - RNA, 13 nt, Human
ucucaugccucag

SEQ ID NO: 1848709 - RNA, 19 nt, Human
ucucaugccucagccuccu

SEQ ID NO: 1848710 - RNA, 16 nt, Human
ucucaugccucagccu

SEQ ID NO: 1848711 - RNA, 13 nt, Human
ucuccacccugcu

SEQ ID NO: 1848712 - RNA, 17 nt, Human
ucuccacccugcucucc

SEQ ID NO: 1848713 - RNA, 14 nt, Human
ucuccacccugcuc

SEQ ID NO: 1848714 - RNA, 16 nt, Human
ucuccacccugcucuc

SEQ ID NO: 1848715 - RNA, 18 nt, Human
ucucauacucaccucacc

SEQ ID NO: 1848716 - RNA, 16 nt, Human
ucucauacucaccuca

SEQ ID NO: 1848717 - RNA, 19 nt, Human
ucuaugggacucaaugcac

SEQ ID NO: 1848718 - RNA, 12 nt, Human
ucuaugggacuc

SEQ ID NO: 1848719 - RNA, 13 nt, Human
ucuaugggacuca

SEQ ID NO: 1848720 - RNA, 23 nt, Human
ucucaguccaugaagauguagag

SEQ ID NO: 1848721 - RNA, 14 nt, Human
ucuaccuuccugca

SEQ ID NO: 1848722 - RNA, 15 nt, Human
ucuacagaggccaug

SEQ ID NO: 1848723 - RNA, 16 nt, Human
ucuacagaggccaugg

SEQ ID NO: 1848724 - RNA, 21 nt, Human
ucuaggaagacuuuggaaaga

SEQ ID NO: 1848725 - RNA, 19 nt, Human
ucuaggaagacuuuggaaa

SEQ ID NO: 1848726 - RNA, 16 nt, Human
ucuaggaagacuuugg

SEQ ID NO: 1848727 - RNA, 15 nt, Human
ucuaggaagacuuug

SEQ ID NO: 1848728 - RNA, 14 nt, Human
ucuaugacacaugc

SEQ ID NO: 1848729 - RNA, 17 nt, Human
ucuaugacacaugcaag

SEQ ID NO: 1848730 - RNA, 14 nt, Human
ucuaucaccaagga

SEQ ID NO: 1848731 - RNA, 18 nt, Human
ucuaaaggcuaccuuugu

SEQ ID NO: 1848732 - RNA, 17 nt, Human
ucuaaaggcuaccuuug

SEQ ID NO: 1848733 - RNA, 19 nt, Human
ucuaaaggcuaccuuugua

SEQ ID NO: 1848734 - RNA, 20 nt, Human
ucuaaaggcuaccuuuguau

SEQ ID NO: 1848735 - RNA, 16 nt, Human
ucguguccccuauccu

SEQ ID NO: 1848736 - RNA, 14 nt, Human
ucgugguaggacug

SEQ ID NO: 1848737 - RNA, 15 nt, Human
ucgugguaggacugu

SEQ ID NO: 1848738 - RNA, 20 nt, Human
ucgugguaggacuguagaaa

SEQ ID NO: 1848739 - RNA, 18 nt, Human
ucggacuuagcugggaga

SEQ ID NO: 1848740 - RNA, 14 nt, Human
uccuuagaagugga

SEQ ID NO: 1848741 - RNA, 13 nt, Human
ucgugacaacacu

SEQ ID NO: 1848742 - RNA, 23 nt, Human
ugaaucauuuuaccuuugacaaa

SEQ ID NO: 1848743 - RNA, 22 nt, Human
ugaaucauuuuaccuuugacaa

SEQ ID NO: 1848744 - RNA, 15 nt, Human
ugaauaaagacaccu

SEQ ID NO: 1848745 - RNA, 14 nt, Human
ugaauaaagacacc

SEQ ID NO: 1848746 - RNA, 23 nt, Human
ugaaugaugauccuaggcauuug

SEQ ID NO: 1848747 - RNA, 16 nt, Human
ugaauuauuuucucuc

SEQ ID NO: 1848748 - RNA, 20 nt, Human
ugaaggaauaaauugcuccu

SEQ ID NO: 1848749 - RNA, 16 nt, Human
ugaacucugacaacag

SEQ ID NO: 1848750 - RNA, 17 nt, Human
ugaacuccuggccucaa

SEQ ID NO: 1848751 - RNA, 16 nt, Human
ugaaggccccgcccag

SEQ ID NO: 1848752 - RNA, 15 nt, Human
ugaaggccccgccca

SEQ ID NO: 1848753 - RNA, 16 nt, Human
ugaaggagagcccuuc

SEQ ID NO: 1848754 - RNA, 22 nt, Human
ugaaggacauugcggacagcca

SEQ ID NO: 1848755 - RNA, 19 nt, Human
ugaaggacauugcggacag

SEQ ID NO: 1848756 - RNA, 20 nt, Human
ugaaggacauugcggacagc

SEQ ID NO: 1848757 - RNA, 17 nt, Human
ugaaggccccgcccagg

SEQ ID NO: 1848758 - RNA, 20 nt, Human
ugaccgugaggccagagaca

SEQ ID NO: 1848759 - RNA, 16 nt, Human
ugaccgugaggccaga

SEQ ID NO: 1848760 - RNA, 14 nt, Human
ugaccgugaggcca

SEQ ID NO: 1848761 - RNA, 13 nt, Human
ugaccgugaggcc

SEQ ID NO: 1848762 - RNA, 19 nt, Human
ugaccauucuccaccugcc

SEQ ID NO: 1848763 - RNA, 18 nt, Human
ugaccauucuccaccugc

SEQ ID NO: 1848764 - RNA, 17 nt, Human
ugaccauucuccaccug

SEQ ID NO: 1848765 - RNA, 16 nt, Human
ugaccauucuccaccu

SEQ ID NO: 1848766 - RNA, 20 nt, Human
ugaccagcaccaucucuccu

SEQ ID NO: 1848767 - RNA, 20 nt, Human
ugaccacugcagaagacagu

SEQ ID NO: 1848768 - RNA, 19 nt, Human
ugaccagcaccaucucucc

SEQ ID NO: 1848769 - RNA, 15 nt, Human
ugacaugucuuuucu

SEQ ID NO: 1848770 - RNA, 13 nt, Human
ugacaugucuuuu

SEQ ID NO: 1848771 - RNA, 16 nt, Human
ugacagacagcccucc

SEQ ID NO: 1848772 - RNA, 13 nt, Human
ugacagaggcagc

SEQ ID NO: 1848773 - RNA, 20 nt, Human
ugacagacacaggcccggcu

SEQ ID NO: 1848774 - RNA, 23 nt, Human
ugacagacacaggcccggcucca

SEQ ID NO: 1848775 - RNA, 14 nt, Human
ugacagaggcagcc

SEQ ID NO: 1848776 - RNA, 15 nt, Human
ugacagaggcagccc

SEQ ID NO: 1848777 - RNA, 16 nt, Human
ugacagaggcagcccc

SEQ ID NO: 1848778 - RNA, 17 nt, Human
ugacagaggcagcccca

SEQ ID NO: 1848779 - RNA, 18 nt, Human
ugacagaggcagccccau

SEQ ID NO: 1848780 - RNA, 23 nt, Human
ugacagaggcagccccauucugc

SEQ ID NO: 1848781 - RNA, 14 nt, Human
ugacagagugagac

SEQ ID NO: 1848782 - RNA, 17 nt, Human
ugacagagugagacucu

SEQ ID NO: 1848783 - RNA, 23 nt, Human
ugacauaaguauuuaauucaugu

SEQ ID NO: 1848784 - RNA, 19 nt, Human
ugacagagugagacucugu

SEQ ID NO: 1848785 - RNA, 18 nt, Human
ugacaaggauugcuacug

SEQ ID NO: 1848786 - RNA, 21 nt, Human
ucuuguguguuuauugucaaa

SEQ ID NO: 1848787 - RNA, 12 nt, Human
ucuuguguuucu

SEQ ID NO: 1848788 - RNA, 16 nt, Human
ucuuguguguuuauug

SEQ ID NO: 1848789 - RNA, 23 nt, Human
ucuuucacccuuuucuguuugcu

SEQ ID NO: 1848790 - RNA, 17 nt, Human
ucuuucacauuuaaaua

SEQ ID NO: 1848791 - RNA, 17 nt, Human
ucuccucuugccacugc

SEQ ID NO: 1848792 - RNA, 22 nt, Human
ucuccucuugccacugccucuu

SEQ ID NO: 1848793 - RNA, 23 nt, Human
ucuugcaauggcagccuuggcaa

SEQ ID NO: 1848794 - RNA, 20 nt, Human
ucuccucugcugcuggcugg

SEQ ID NO: 1848795 - RNA, 16 nt, Human
ucucccuucauccuuc

SEQ ID NO: 1848796 - RNA, 16 nt, Human
ucuccucuugccacug

SEQ ID NO: 1848797 - RNA, 13 nt, Human
ucuccucuugcca

SEQ ID NO: 1848798 - RNA, 15 nt, Human
ucuugcaugaggcua

SEQ ID NO: 1848799 - RNA, 21 nt, Human
ucuuucagccaagaauucuua

SEQ ID NO: 1848800 - RNA, 20 nt, Human
ucuuucagccaagaauucuu

SEQ ID NO: 1848801 - RNA, 19 nt, Human
ucuuucagccaagaauucu

SEQ ID NO: 1848802 - RNA, 16 nt, Human
ucuuucagccaagaau

SEQ ID NO: 1848803 - RNA, 13 nt, Human
ucuuuccaaagua

SEQ ID NO: 1848804 - RNA, 14 nt, Human
ucuuuccaaaguac

SEQ ID NO: 1848805 - RNA, 17 nt, Human
ucuuuccaaaguacacu

SEQ ID NO: 1848806 - RNA, 17 nt, Human
ucuuuggacacucacac

SEQ ID NO: 1848807 - RNA, 19 nt, Human
ucuuuggacagaagcagcu

SEQ ID NO: 1848808 - RNA, 22 nt, Human
ucuuuggacagaagcagcucuu

SEQ ID NO: 1848809 - RNA, 21 nt, Human
ucuuuggacagaagcagcucu

SEQ ID NO: 1848810 - RNA, 12 nt, Human
ucuuugccaagu

SEQ ID NO: 1848811 - RNA, 18 nt, Human
ugaacauugcaauagaaa

SEQ ID NO: 1848812 - RNA, 22 nt, Human
ugaaccaagaacuuuccaggaa

SEQ ID NO: 1848813 - RNA, 19 nt, Human
ugaaccacaucuugcucug

SEQ ID NO: 1848814 - RNA, 23 nt, Human
ugaaccacaucuugcucugcuga

SEQ ID NO: 1848815 - RNA, 17 nt, Human
ugaaccaccacacccag

SEQ ID NO: 1848816 - RNA, 20 nt, Human
ugaaccaccacacccagccc

SEQ ID NO: 1848817 - RNA, 16 nt, Human
ugaacuccuggccuca

SEQ ID NO: 1848818 - RNA, 17 nt, Human
ugaaaucaguuacucuu

SEQ ID NO: 1848819 - RNA, 16 nt, Human
ugaaaucaguuacucu

SEQ ID NO: 1848820 - RNA, 12 nt, Human
ugaaauuauuca

SEQ ID NO: 1848821 - RNA, 18 nt, Human
ugaaagcccugagcuuuc

SEQ ID NO: 1848822 - RNA, 18 nt, Human
ugaaagauggcugugccu

SEQ ID NO: 1848823 - RNA, 19 nt, Human
ugaaagauggcugugccuc

SEQ ID NO: 1848824 - RNA, 23 nt, Human
ugaaagggaguauuacaaaaaca

SEQ ID NO: 1848825 - RNA, 13 nt, Human
ugaaagggcccag

SEQ ID NO: 1848826 - RNA, 14 nt, Human
ugaaacauuuuguc

SEQ ID NO: 1848827 - RNA, 19 nt, Human
ugaaaauuuugauguuuua

SEQ ID NO: 1848828 - RNA, 21 nt, Human
ugaaaauuuugauguuuuaag

SEQ ID NO: 1848829 - RNA, 13 nt, Human
ugaaaauuuugau

SEQ ID NO: 1848830 - RNA, 20 nt, Human
ugaaaagcuccauuuuuagu

SEQ ID NO: 1848831 - RNA, 19 nt, Human
ugaguccagaaguuugaga

SEQ ID NO: 1848832 - RNA, 13 nt, Human
ugaguccagaagu

SEQ ID NO: 1848833 - RNA, 21 nt, Human
ugaggugggaggaucucuuga

SEQ ID NO: 1848834 - RNA, 15 nt, Human
ugagucccaggcuga

SEQ ID NO: 1848835 - RNA, 19 nt, Human
ugagucccaggcugagccu

SEQ ID NO: 1848836 - RNA, 19 nt, Human
ugagucgaggacagggagg

SEQ ID NO: 1848837 - RNA, 18 nt, Human
ugagucugaaggcugggu

SEQ ID NO: 1848838 - RNA, 17 nt, Human
ugagucugaaggcuggg

SEQ ID NO: 1848839 - RNA, 15 nt, Human
ugagucugaaggcug

SEQ ID NO: 1848840 - RNA, 13 nt, Human
ugagucugaaggc

SEQ ID NO: 1848841 - RNA, 20 nt, Human
ugaguugauagcacagaccc

SEQ ID NO: 1848842 - RNA, 16 nt, Human
ugaguugauagcacag

SEQ ID NO: 1848843 - RNA, 14 nt, Human
ugagugagcaugcc

SEQ ID NO: 1848844 - RNA, 23 nt, Human
ugaguuugggccccagaggcugg

SEQ ID NO: 1848845 - RNA, 22 nt, Human
ugaguuugggccccagaggcug

SEQ ID NO: 1848846 - RNA, 12 nt, Human
ugaggcauuugu

SEQ ID NO: 1848847 - RNA, 23 nt, Human
ugaggcaucgcaauguaagacuc

SEQ ID NO: 1848848 - RNA, 19 nt, Human
ugaggcauuuguuugaacu

SEQ ID NO: 1848849 - RNA, 20 nt, Human
ugaggcauuuguuugaacug

SEQ ID NO: 1848850 - RNA, 17 nt, Human
ugaggcuaguguggugu

SEQ ID NO: 1848851 - RNA, 21 nt, Human
ugaggcauuuguuugaacuga

SEQ ID NO: 1848852 - RNA, 23 nt, Human
ugaggcuagugugguguuuccug

SEQ ID NO: 1848853 - RNA, 23 nt, Human
ugaggcauuuguuugaacugaua

SEQ ID NO: 1848854 - RNA, 13 nt, Human
ugagcugggauga

SEQ ID NO: 1848855 - RNA, 16 nt, Human
ugaggagcuugaaacc

SEQ ID NO: 1848856 - RNA, 13 nt, Human
ugaggugggagga

SEQ ID NO: 1848857 - RNA, 12 nt, Human
ugaggugggagg

SEQ ID NO: 1848858 - RNA, 18 nt, Human
ugaggcuccacuuggucu

SEQ ID NO: 1848859 - RNA, 20 nt, Human
ugaggcuccacuuggucugu

SEQ ID NO: 1848860 - RNA, 14 nt, Human
ugaggcucugcccu

SEQ ID NO: 1848861 - RNA, 13 nt, Human
ugaggcucugccc

SEQ ID NO: 1848862 - RNA, 17 nt, Human
ugagggaacagagaggu

SEQ ID NO: 1848863 - RNA, 17 nt, Human
ugagaaauuuauaaacu

SEQ ID NO: 1848864 - RNA, 16 nt, Human
ugaccucagcuuugau

SEQ ID NO: 1848865 - RNA, 22 nt, Human
ugaccucagcuuugauauuuca

SEQ ID NO: 1848866 - RNA, 20 nt, Human
ugaccucaggugauccaccc

SEQ ID NO: 1848867 - RNA, 21 nt, Human
ugaccucaggugauccaccca

SEQ ID NO: 1848868 - RNA, 19 nt, Human
ugagacucgcgacaaugca

SEQ ID NO: 1848869 - RNA, 15 nt, Human
ugagaucagccuggg

SEQ ID NO: 1848870 - RNA, 14 nt, Human
ugagaucagccugg

SEQ ID NO: 1848871 - RNA, 15 nt, Human
ugagaucaaaacggu

SEQ ID NO: 1848872 - RNA, 12 nt, Human
ugagcagggcuc

SEQ ID NO: 1848873 - RNA, 13 nt, Human
ugagcagggcuca

SEQ ID NO: 1848874 - RNA, 14 nt, Human
ugagcagggcucag

SEQ ID NO: 1848875 - RNA, 15 nt, Human
ugagcagggcucagc

SEQ ID NO: 1848876 - RNA, 23 nt, Human
ugagacucgcgacaaugcaaacc

SEQ ID NO: 1848877 - RNA, 22 nt, Human
ugagacucgcgacaaugcaaac

SEQ ID NO: 1848878 - RNA, 21 nt, Human
ugagacucgcgacaaugcaaa

SEQ ID NO: 1848879 - RNA, 20 nt, Human
ugagacucgcgacaaugcaa

SEQ ID NO: 1848880 - RNA, 16 nt, Human
ugagagugaacaaauu

SEQ ID NO: 1848881 - RNA, 18 nt, Human
ugagcccuguccugccua

SEQ ID NO: 1848882 - RNA, 19 nt, Human
ugagccgagaucacgccac

SEQ ID NO: 1848883 - RNA, 21 nt, Human
ugagccgagaucacgccacug

SEQ ID NO: 1848884 - RNA, 17 nt, Human
ugagccucagcauccug

SEQ ID NO: 1848885 - RNA, 14 nt, Human
ugagccucagucuc

SEQ ID NO: 1848886 - RNA, 22 nt, Human
ugagccucagcauccuggcacc

SEQ ID NO: 1848887 - RNA, 18 nt, Human
ugagccucagcauccugg

SEQ ID NO: 1848888 - RNA, 21 nt, Human
ugagccucagcauccuggcac

SEQ ID NO: 1848889 - RNA, 20 nt, Human
ugagcaucaggccaggcccu

SEQ ID NO: 1848890 - RNA, 19 nt, Human
ugagcaucaggccaggccc

SEQ ID NO: 1848891 - RNA, 18 nt, Human
ugagcaucaggccaggcc

SEQ ID NO: 1848892 - RNA, 19 nt, Human
ugagcagggcucagcgggg

SEQ ID NO: 1848893 - RNA, 16 nt, Human
ugagcagggcucagcg

SEQ ID NO: 1848894 - RNA, 17 nt, Human
ugagcagggcucagcgg

SEQ ID NO: 1848895 - RNA, 16 nt, Human
ugagcaucaggccagg

SEQ ID NO: 1848896 - RNA, 13 nt, Human
ugauccaagcugg

SEQ ID NO: 1848897 - RNA, 14 nt, Human
ugauccaagcuggu

SEQ ID NO: 1848898 - RNA, 15 nt, Human
ugauccaagcugguc

SEQ ID NO: 1848899 - RNA, 17 nt, Human
ugauccaagcugguccc

SEQ ID NO: 1848900 - RNA, 14 nt, Human
ugauagcacagacc

SEQ ID NO: 1848901 - RNA, 13 nt, Human
ugauagcacagac

SEQ ID NO: 1848902 - RNA, 20 nt, Human
ugaucuucuuuauaauucua

SEQ ID NO: 1848903 - RNA, 15 nt, Human
ugaucugugggcaca

SEQ ID NO: 1848904 - RNA, 17 nt, Human
ugaucucucgugauuga

SEQ ID NO: 1848905 - RNA, 17 nt, Human
ugauccacccaccucag

SEQ ID NO: 1848906 - RNA, 18 nt, Human
ugauccacccaccucagc

SEQ ID NO: 1848907 - RNA, 19 nt, Human
ugauccacccaccucagcc

SEQ ID NO: 1848908 - RNA, 16 nt, Human
ugauguguuaucucuu

SEQ ID NO: 1848909 - RNA, 19 nt, Human
ugaugucccaacuuguaaa

SEQ ID NO: 1848910 - RNA, 18 nt, Human
ugaugcuucuucagagac

SEQ ID NO: 1848911 - RNA, 17 nt, Human
ugaugcuucuucagaga

SEQ ID NO: 1848912 - RNA, 16 nt, Human
ugaugcuucuucagag

SEQ ID NO: 1848913 - RNA, 21 nt, Human
ugaugguuguacauauaagug

SEQ ID NO: 1848914 - RNA, 14 nt, Human
ugaugguuguacau

SEQ ID NO: 1848915 - RNA, 13 nt, Human
ugaugguuguaca

SEQ ID NO: 1848916 - RNA, 14 nt, Human
ugaugguuccccug

SEQ ID NO: 1848917 - RNA, 18 nt, Human
ugaucuuugcagacaggc

SEQ ID NO: 1848918 - RNA, 16 nt, Human
ugaucuuugcagacag

SEQ ID NO: 1848919 - RNA, 11 nt, Human
ugaugccuggc

SEQ ID NO: 1848920 - RNA, 20 nt, Human
ugaugccugugaacugaacu

SEQ ID NO: 1848921 - RNA, 15 nt, Human
ugaugccugugaacu

SEQ ID NO: 1848922 - RNA, 20 nt, Human
ugaugcuacaggauuugaaa

SEQ ID NO: 1848923 - RNA, 21 nt, Human
ugaugccugugaacugaacuc

SEQ ID NO: 1848924 - RNA, 23 nt, Human
ugaugcgggccagugcuccagcc

SEQ ID NO: 1848925 - RNA, 23 nt, Human
ugaugcuacaggauuugaaauug

SEQ ID NO: 1848926 - RNA, 21 nt, Human
ugauuggaggggggagguggg

SEQ ID NO: 1848927 - RNA, 13 nt, Human
ugauuggaggggg

SEQ ID NO: 1848928 - RNA, 20 nt, Human
ugauuggcaggaguuggaag

SEQ ID NO: 1848929 - RNA, 16 nt, Human
ugauugugucucuugg

SEQ ID NO: 1848930 - RNA, 21 nt, Human
ugauucagacagcugccuggg

SEQ ID NO: 1848931 - RNA, 20 nt, Human
ugauucagacagcugccugg

SEQ ID NO: 1848932 - RNA, 19 nt, Human
ugauucagacagcugccug

SEQ ID NO: 1848933 - RNA, 18 nt, Human
ugauucagacagcugccu

SEQ ID NO: 1848934 - RNA, 23 nt, Human
ugauucagacagcugccugggau

SEQ ID NO: 1848935 - RNA, 21 nt, Human
ugauucuccugccucagccuc

SEQ ID NO: 1848936 - RNA, 16 nt, Human
ugauuaccagggacug

SEQ ID NO: 1848937 - RNA, 20 nt, Human
ugauguucuuucacccuuuu

SEQ ID NO: 1848938 - RNA, 13 nt, Human
ugauuauauguca

SEQ ID NO: 1848939 - RNA, 12 nt, Human
ugauucacagug

SEQ ID NO: 1848940 - RNA, 16 nt, Human
ugauucagacagcugc

SEQ ID NO: 1848941 - RNA, 15 nt, Human
ugauucagacagcug

SEQ ID NO: 1848942 - RNA, 14 nt, Human
ugauucagacagcu

SEQ ID NO: 1848943 - RNA, 13 nt, Human
ugauucagacagc

SEQ ID NO: 1848944 - RNA, 20 nt, Human
ugauucaacagguuuuccug

SEQ ID NO: 1848945 - RNA, 13 nt, Human
ugcuggguguggc

SEQ ID NO: 1848946 - RNA, 20 nt, Human
ugcugggggggauuguaaaa

SEQ ID NO: 1848947 - RNA, 17 nt, Human
ugcugggcuugucugua

SEQ ID NO: 1848948 - RNA, 13 nt, Human
ugcugguuuuagu

SEQ ID NO: 1848949 - RNA, 12 nt, Human
ugcugguuuuuc

SEQ ID NO: 1848950 - RNA, 15 nt, Human
ugcugguuuuucagu

SEQ ID NO: 1848951 - RNA, 16 nt, Human
ugcugguuuuucaguu

SEQ ID NO: 1848952 - RNA, 18 nt, Human
ugcugguuuuucaguuuu

SEQ ID NO: 1848953 - RNA, 18 nt, Human
ugcuguaacuuucugaaa

SEQ ID NO: 1848954 - RNA, 17 nt, Human
ugcugcauuuaaaagau

SEQ ID NO: 1848955 - RNA, 18 nt, Human
ugcugcauuuaaaagaua

SEQ ID NO: 1848956 - RNA, 19 nt, Human
ugcugcauuuaaaagauac

SEQ ID NO: 1848957 - RNA, 23 nt, Human
ugcugcauuuaaaagauacaguu

SEQ ID NO: 1848958 - RNA, 14 nt, Human
ugcugcauuuaaaa

SEQ ID NO: 1848959 - RNA, 17 nt, Human
ugcugccugcuuuuuau

SEQ ID NO: 1848960 - RNA, 15 nt, Human
ugcugccugcuuuuu

SEQ ID NO: 1848961 - RNA, 24 nt, Human
ugcugggccccugccucucugcag

SEQ ID NO: 1848962 - RNA, 23 nt, Human
ugcugggccccugccucucugca

SEQ ID NO: 1848963 - RNA, 22 nt, Human
ugcugggccccugccucucugc

SEQ ID NO: 1848964 - RNA, 21 nt, Human
ugcugggccccugccucucug

SEQ ID NO: 1848965 - RNA, 19 nt, Human
ugcugggccccugccucuc

SEQ ID NO: 1848966 - RNA, 18 nt, Human
ugcugggccccugccucu

SEQ ID NO: 1848967 - RNA, 17 nt, Human
ugcugggccccugccuc

SEQ ID NO: 1848968 - RNA, 16 nt, Human
ugcugggccccugccu

SEQ ID NO: 1848969 - RNA, 12 nt, Human
ugcugcuugagg

SEQ ID NO: 1848970 - RNA, 14 nt, Human
ugcugggccccugc

SEQ ID NO: 1848971 - RNA, 19 nt, Human
ugcugcuugaggcaacuca

SEQ ID NO: 1848972 - RNA, 20 nt, Human
ugcugggauuacagguguga

SEQ ID NO: 1848973 - RNA, 23 nt, Human
ugcgcaggcuggcccugcccugg

SEQ ID NO: 1848974 - RNA, 22 nt, Human
ugcgcaggcuggcccugcccug

SEQ ID NO: 1848975 - RNA, 21 nt, Human
ugcgcaggcuggcccugcccu

SEQ ID NO: 1848976 - RNA, 20 nt, Human
ugccuugcauaauggucaga

SEQ ID NO: 1848977 - RNA, 22 nt, Human
ugcuaagacucaguggggaggg

SEQ ID NO: 1848978 - RNA, 21 nt, Human
ugcuacuguccuacccacccu

SEQ ID NO: 1848979 - RNA, 22 nt, Human
ugcuacuguccuacccacccuc

SEQ ID NO: 1848980 - RNA, 17 nt, Human
ugcggacagccacggcc

SEQ ID NO: 1848981 - RNA, 20 nt, Human
ugcuaggaacacuccuucac

SEQ ID NO: 1848982 - RNA, 21 nt, Human
ugcuaggaacacuccuucaca

SEQ ID NO: 1848983 - RNA, 22 nt, Human
ugcuaggaacacuccuucacag

SEQ ID NO: 1848984 - RNA, 13 nt, Human
ugcuagaacuccc

SEQ ID NO: 1848985 - RNA, 14 nt, Human
ugcuagaacucccu

SEQ ID NO: 1848986 - RNA, 15 nt, Human
ugcuagaacucccuu

SEQ ID NO: 1848987 - RNA, 17 nt, Human
ugcuagaacucccuuuc

SEQ ID NO: 1848988 - RNA, 20 nt, Human
ugcucaggagcccugggagg

SEQ ID NO: 1848989 - RNA, 19 nt, Human
ugcucaggagcccugggag

SEQ ID NO: 1848990 - RNA, 18 nt, Human
ugcucaggagcccuggga

SEQ ID NO: 1848991 - RNA, 17 nt, Human
ugcucacauaucuguca

SEQ ID NO: 1848992 - RNA, 15 nt, Human
ugcucaggagcccug

SEQ ID NO: 1848993 - RNA, 17 nt, Human
ugcucuugaugccuggc

SEQ ID NO: 1848994 - RNA, 14 nt, Human
ugcucuccucuugc

SEQ ID NO: 1848995 - RNA, 12 nt, Human
ugcucuccucuu

SEQ ID NO: 1848996 - RNA, 23 nt, Human
ugcucuccgaccagacaccuuga

SEQ ID NO: 1848997 - RNA, 21 nt, Human
ugcauuuggugguuucagaaa

SEQ ID NO: 1848998 - RNA, 23 nt, Human
ugcauuuggugguuucagaaaug

SEQ ID NO: 1848999 - RNA, 14 nt, Human
ugccaggcauggug

SEQ ID NO: 1849000 - RNA, 22 nt, Human
ugccaggaagccagcaggcucu

SEQ ID NO: 1849001 - RNA, 20 nt, Human
ugccaggaagccagcaggcu

SEQ ID NO: 1849002 - RNA, 16 nt, Human
ugccacuaaauugaca

SEQ ID NO: 1849003 - RNA, 18 nt, Human
ugcauauuauuuuauguu

SEQ ID NO: 1849004 - RNA, 16 nt, Human
ugcaguugccagucac

SEQ ID NO: 1849005 - RNA, 13 nt, Human
ugcagggaguccg

SEQ ID NO: 1849006 - RNA, 21 nt, Human
ugcaguuacacuaaaagguga

SEQ ID NO: 1849007 - RNA, 21 nt, Human
ugcaguggugcgaucuggguu

SEQ ID NO: 1849008 - RNA, 18 nt, Human
ugcccaggcuggcgugca

SEQ ID NO: 1849009 - RNA, 19 nt, Human
ugcccaggcuggcgugcag

SEQ ID NO: 1849010 - RNA, 20 nt, Human
ugcccaggcuggcgugcagu

SEQ ID NO: 1849011 - RNA, 12 nt, Human
ugcccggcugcg

SEQ ID NO: 1849012 - RNA, 14 nt, Human
ugcccggcugcgga

SEQ ID NO: 1849013 - RNA, 16 nt, Human
ugccccuggcagcccc

SEQ ID NO: 1849014 - RNA, 20 nt, Human
ugccccuccucucugcccua

SEQ ID NO: 1849015 - RNA, 19 nt, Human
ugccccuccucucugcccu

SEQ ID NO: 1849016 - RNA, 18 nt, Human
ugccccuccucucugccc

SEQ ID NO: 1849017 - RNA, 17 nt, Human
ugccccuccucucugcc

SEQ ID NO: 1849018 - RNA, 16 nt, Human
ugccccucccuucaac

SEQ ID NO: 1849019 - RNA, 15 nt, Human
ugccccucccuucaa

SEQ ID NO: 1849020 - RNA, 23 nt, Human
ugcccugugaguacuacaguccu

SEQ ID NO: 1849021 - RNA, 23 nt, Human
ugcccugguuuccugcccuggga

SEQ ID NO: 1849022 - RNA, 20 nt, Human
ugcccugguuuccugcccug

SEQ ID NO: 1849023 - RNA, 19 nt, Human
ugcccugguuuccugcccu

SEQ ID NO: 1849024 - RNA, 18 nt, Human
ugcccugguuuccugccc

SEQ ID NO: 1849025 - RNA, 17 nt, Human
ugcccugguuuccugcc

SEQ ID NO: 1849026 - RNA, 17 nt, Human
ugcccuggugcugccac

SEQ ID NO: 1849027 - RNA, 16 nt, Human
ugcccuggugcugcca

SEQ ID NO: 1849028 - RNA, 14 nt, Human
ugcccuggugcugc

SEQ ID NO: 1849029 - RNA, 12 nt, Human
ugcccuggugcu

SEQ ID NO: 1849030 - RNA, 20 nt, Human
ugcccugcccaccuggccuc

SEQ ID NO: 1849031 - RNA, 16 nt, Human
ugcccugcccaccugg

SEQ ID NO: 1849032 - RNA, 15 nt, Human
ugcccugcccaccug

SEQ ID NO: 1849033 - RNA, 18 nt, Human
ugcccugggaggcaguga

SEQ ID NO: 1849034 - RNA, 17 nt, Human
ugcccugggaggcagug

SEQ ID NO: 1849035 - RNA, 15 nt, Human
ugcccugggaggcag

SEQ ID NO: 1849036 - RNA, 13 nt, Human
ugcccugggaggc

SEQ ID NO: 1849037 - RNA, 16 nt, Human
ugccuccucuucaacu

SEQ ID NO: 1849038 - RNA, 14 nt, Human
ugccuccucuucaa

SEQ ID NO: 1849039 - RNA, 14 nt, Human
ugccucaagagaag

SEQ ID NO: 1849040 - RNA, 15 nt, Human
ugccucaagagaagg

SEQ ID NO: 1849041 - RNA, 12 nt, Human
ugggccuucagg

SEQ ID NO: 1849042 - RNA, 15 nt, Human
ugggccuucagggag

SEQ ID NO: 1849043 - RNA, 20 nt, Human
uggggccaguuggucccccu

SEQ ID NO: 1849044 - RNA, 22 nt, Human
uggggccaggcugggucgcccu

SEQ ID NO: 1849045 - RNA, 21 nt, Human
uggggccaggcugggucgccc

SEQ ID NO: 1849046 - RNA, 15 nt, Human
uggggaugagaaagg

SEQ ID NO: 1849047 - RNA, 20 nt, Human
uggggccaggcugggucgcc

SEQ ID NO: 1849048 - RNA, 23 nt, Human
uggggaugagaaagguugaagca

SEQ ID NO: 1849049 - RNA, 16 nt, Human
ugggggaguggccaca

SEQ ID NO: 1849050 - RNA, 13 nt, Human
uggggggggugcu

SEQ ID NO: 1849051 - RNA, 22 nt, Human
uggggguucuuucuuccucugc

SEQ ID NO: 1849052 - RNA, 20 nt, Human
uggggguucuuucuuccucu

SEQ ID NO: 1849053 - RNA, 19 nt, Human
uggggguucuuucuuccuc

SEQ ID NO: 1849054 - RNA, 15 nt, Human
uggggguucuuucuu

SEQ ID NO: 1849055 - RNA, 17 nt, Human
uggguacuuguggacac

SEQ ID NO: 1849056 - RNA, 18 nt, Human
uggguacuuguggacaca

SEQ ID NO: 1849057 - RNA, 13 nt, Human
ugggauccuccag

SEQ ID NO: 1849058 - RNA, 12 nt, Human
ugggauccucca

SEQ ID NO: 1849059 - RNA, 14 nt, Human
ugggauccuccagg

SEQ ID NO: 1849060 - RNA, 22 nt, Human
ugggcagagcagagaccauccc

SEQ ID NO: 1849061 - RNA, 17 nt, Human
ugggauuacaggcguga

SEQ ID NO: 1849062 - RNA, 22 nt, Human
ugggauuacaagcgugagccac

SEQ ID NO: 1849063 - RNA, 16 nt, Human
ugggagugggcccaau

SEQ ID NO: 1849064 - RNA, 14 nt, Human
ugggagugggccca

SEQ ID NO: 1849065 - RNA, 19 nt, Human
ugggaucacauguggacuu

SEQ ID NO: 1849066 - RNA, 16 nt, Human
uggcugggggccucag

SEQ ID NO: 1849067 - RNA, 17 nt, Human
uggcugggggccucagu

SEQ ID NO: 1849068 - RNA, 20 nt, Human
uggcugggggccucagugcc

SEQ ID NO: 1849069 - RNA, 14 nt, Human
ugggccuggcuccc

SEQ ID NO: 1849070 - RNA, 11 nt, Human
ugggccuucag

SEQ ID NO: 1849071 - RNA, 23 nt, Human
ugggccccugccucucugcaggu

SEQ ID NO: 1849072 - RNA, 21 nt, Human
ugggccccugccucucugcag

SEQ ID NO: 1849073 - RNA, 23 nt, Human
ugggcagagcagagaccaucccu

SEQ ID NO: 1849074 - RNA, 14 nt, Human
uggucggaaaacau

SEQ ID NO: 1849075 - RNA, 17 nt, Human
uggucggaaaacaugcu

SEQ ID NO: 1849076 - RNA, 18 nt, Human
uggucuacacugugcuga

SEQ ID NO: 1849077 - RNA, 17 nt, Human
uggucuacacugugcug

SEQ ID NO: 1849078 - RNA, 16 nt, Human
uggucuacacugugcu

SEQ ID NO: 1849079 - RNA, 15 nt, Human
uggucuacacugugc

SEQ ID NO: 1849080 - RNA, 19 nt, Human
uggucuacacugugcugag

SEQ ID NO: 1849081 - RNA, 13 nt, Human
uggugaccucugc

SEQ ID NO: 1849082 - RNA, 14 nt, Human
uggugaccucugcc

SEQ ID NO: 1849083 - RNA, 21 nt, Human
uggugcaaugaccuuucaaua

SEQ ID NO: 1849084 - RNA, 19 nt, Human
uggugacuuuccucuuugg

SEQ ID NO: 1849085 - RNA, 15 nt, Human
uggugaccucugccu

SEQ ID NO: 1849086 - RNA, 16 nt, Human
uggugaccucugccug

SEQ ID NO: 1849087 - RNA, 17 nt, Human
uggugaccucugccuga

SEQ ID NO: 1849088 - RNA, 22 nt, Human
uggugaccucugccugaaguca

SEQ ID NO: 1849089 - RNA, 22 nt, Human
uggucacaggaaguagaggagg

SEQ ID NO: 1849090 - RNA, 18 nt, Human
uggucacaggacucugcc

SEQ ID NO: 1849091 - RNA, 19 nt, Human
uggucacaggacucugccu

SEQ ID NO: 1849092 - RNA, 14 nt, Human
uggucccccuucca

SEQ ID NO: 1849093 - RNA, 23 nt, Human
ugguccugcugcaguugccaguc

SEQ ID NO: 1849094 - RNA, 15 nt, Human
ugguccugcugcagu

SEQ ID NO: 1849095 - RNA, 13 nt, Human
ugguccugcugca

SEQ ID NO: 1849096 - RNA, 19 nt, Human
ugguccuaaucuucugaac

SEQ ID NO: 1849097 - RNA, 17 nt, Human
ugguccuaaucuucuga

SEQ ID NO: 1849098 - RNA, 23 nt, Human
uggucccccuuccauggacuuug

SEQ ID NO: 1849099 - RNA, 18 nt, Human
uggucccccuuccaugga

SEQ ID NO: 1849100 - RNA, 16 nt, Human
uggucccccuuccaug

SEQ ID NO: 1849101 - RNA, 15 nt, Human
uggucccccuuccau

SEQ ID NO: 1849102 - RNA, 23 nt, Human
uggcgcugccccuggcagccccu

SEQ ID NO: 1849103 - RNA, 16 nt, Human
uggcgcugccccuggc

SEQ ID NO: 1849104 - RNA, 23 nt, Human
uggcgcagcauauucaggaagcu

SEQ ID NO: 1849105 - RNA, 22 nt, Human
uggcgcagcauauucaggaagc

SEQ ID NO: 1849106 - RNA, 23 nt, Human
uggccucccaacucaccccagcc

SEQ ID NO: 1849107 - RNA, 15 nt, Human
uggcgggguggggug

SEQ ID NO: 1849108 - RNA, 20 nt, Human
uggcucccacaggcccuucc

SEQ ID NO: 1849109 - RNA, 17 nt, Human
uggcucccacaggcccu

SEQ ID NO: 1849110 - RNA, 14 nt, Human
uggcucccacaggc

SEQ ID NO: 1849111 - RNA, 16 nt, Human
uggcugcuucaaggau

SEQ ID NO: 1849112 - RNA, 15 nt, Human
uggcugcuucaagga

SEQ ID NO: 1849113 - RNA, 11 nt, Human
uggcugcuuca

SEQ ID NO: 1849114 - RNA, 16 nt, Human
uggcuccucccggugc

SEQ ID NO: 1849115 - RNA, 14 nt, Human
uggcuccucccggu

SEQ ID NO: 1849116 - RNA, 19 nt, Human
uggcuccucccggugccca

SEQ ID NO: 1849117 - RNA, 18 nt, Human
uggcuccucccggugccc

SEQ ID NO: 1849118 - RNA, 20 nt, Human
uggccccugcccggcugcgg

SEQ ID NO: 1849119 - RNA, 14 nt, Human
uggccccugcccgg

SEQ ID NO: 1849120 - RNA, 15 nt, Human
uggccccugcccggc

SEQ ID NO: 1849121 - RNA, 16 nt, Human
uggccccugcccggcu

SEQ ID NO: 1849122 - RNA, 20 nt, Human
uggccaggcugcucuugaac

SEQ ID NO: 1849123 - RNA, 13 nt, Human
uggccaggcuggu

SEQ ID NO: 1849124 - RNA, 17 nt, Human
uggccaggcugcucuug

SEQ ID NO: 1849125 - RNA, 16 nt, Human
uggccaggcugcucuu

SEQ ID NO: 1849126 - RNA, 19 nt, Human
uggccagaugcaccagccc

SEQ ID NO: 1849127 - RNA, 15 nt, Human
uggcagaguugaaga

SEQ ID NO: 1849128 - RNA, 12 nt, Human
uggcagaggagg

SEQ ID NO: 1849129 - RNA, 21 nt, Human
uggcagaguggauucuugaac

SEQ ID NO: 1849130 - RNA, 19 nt, Human
uggcagaguugaagacaga

SEQ ID NO: 1849131 - RNA, 17 nt, Human
uggcagaguugaagaca

SEQ ID NO: 1849132 - RNA, 17 nt, Human
uggccagaugcaccagc

SEQ ID NO: 1849133 - RNA, 18 nt, Human
uggccagaugcaccagcc

SEQ ID NO: 1849134 - RNA, 16 nt, Human
uggcacuauaauguaa

SEQ ID NO: 1849135 - RNA, 15 nt, Human
uggcacuauaaugua

SEQ ID NO: 1849136 - RNA, 12 nt, Human
uggcaaaaaggc

SEQ ID NO: 1849137 - RNA, 17 nt, Human
uggauuuuugucuugug

SEQ ID NO: 1849138 - RNA, 16 nt, Human
uggcaaaaaggcagga

SEQ ID NO: 1849139 - RNA, 23 nt, Human
uggaggaaggaaacccagcucug

SEQ ID NO: 1849140 - RNA, 21 nt, Human
uggaggaaggaaacccagcuc

SEQ ID NO: 1849141 - RNA, 14 nt, Human
uggagacugucuca

SEQ ID NO: 1849142 - RNA, 21 nt, Human
uggagaagcucccugaaguaa

SEQ ID NO: 1849143 - RNA, 14 nt, Human
uggacuccucuguc

SEQ ID NO: 1849144 - RNA, 13 nt, Human
uggacuccucugu

SEQ ID NO: 1849145 - RNA, 22 nt, Human
uuaauauugauaugcuuauaca

SEQ ID NO: 1849146 - RNA, 18 nt, Human
uuaauauugauaugcuua

SEQ ID NO: 1849147 - RNA, 16 nt, Human
uuaagccuuuggaaac

SEQ ID NO: 1849148 - RNA, 15 nt, Human
uuaagccuuuggaaa

SEQ ID NO: 1849149 - RNA, 17 nt, Human
uuaagcuguuacugucu

SEQ ID NO: 1849150 - RNA, 21 nt, Human
uuacaagcgugagccacugca

SEQ ID NO: 1849151 - RNA, 20 nt, Human
uuacaagcgugagccacugc

SEQ ID NO: 1849152 - RNA, 18 nt, Human
uuaacuuuuauaaacuuu

SEQ ID NO: 1849153 - RNA, 16 nt, Human
uuaacuuuuauaaacu

SEQ ID NO: 1849154 - RNA, 17 nt, Human
uuaacuuuuauaaacuu

SEQ ID NO: 1849155 - RNA, 15 nt, Human
uuaacuuuuauaaac

SEQ ID NO: 1849156 - RNA, 16 nt, Human
uuaacuucacauauug

SEQ ID NO: 1849157 - RNA, 17 nt, Human
uuaaccacuucagcuga

SEQ ID NO: 1849158 - RNA, 11 nt, Human
uuaaagacaga

SEQ ID NO: 1849159 - RNA, 12 nt, Human
uuaaagacagag

SEQ ID NO: 1849160 - RNA, 23 nt, Human
uuaaauguuuuuuuuuaaagacu

SEQ ID NO: 1849161 - RNA, 21 nt, Human
uuaaauguuuuuuuuuaaaga

SEQ ID NO: 1849162 - RNA, 21 nt, Human
uuaaaauaccagccaguaaau

SEQ ID NO: 1849163 - RNA, 17 nt, Human
uguuuuguuuggagaca

SEQ ID NO: 1849164 - RNA, 18 nt, Human
uguuuuaaggaugcuugu

SEQ ID NO: 1849165 - RNA, 22 nt, Human
uguuuuaagaggcagggucuca

SEQ ID NO: 1849166 - RNA, 19 nt, Human
uguuuuaaggaugcuugua

SEQ ID NO: 1849167 - RNA, 14 nt, Human
uuaaaagauacagu

SEQ ID NO: 1849168 - RNA, 17 nt, Human
uuaaaagauacaguuac

SEQ ID NO: 1849169 - RNA, 18 nt, Human
uguuuuuuuuuaaagacu

SEQ ID NO: 1849170 - RNA, 19 nt, Human
uguuuuuuuuuuccacuua

SEQ ID NO: 1849171 - RNA, 18 nt, Human
uguuuuuuuuuuccacuu

SEQ ID NO: 1849172 - RNA, 13 nt, Human
uguuugugauuga

SEQ ID NO: 1849173 - RNA, 20 nt, Human
uguuuuaagaggcagggucu

SEQ ID NO: 1849174 - RNA, 16 nt, Human
uguuuagauaauacac

SEQ ID NO: 1849175 - RNA, 15 nt, Human
uguuucaaacuuuac

SEQ ID NO: 1849176 - RNA, 20 nt, Human
uguuucauauugaugugugu

SEQ ID NO: 1849177 - RNA, 14 nt, Human
uuagaguugauacu

SEQ ID NO: 1849178 - RNA, 22 nt, Human
uuagauaauacaccacuacauu

SEQ ID NO: 1849179 - RNA, 12 nt, Human
uuagcugggaga

SEQ ID NO: 1849180 - RNA, 17 nt, Human
uuaguagagacaggguu

SEQ ID NO: 1849181 - RNA, 22 nt, Human
uuaggccaaaaaaauguaagau

SEQ ID NO: 1849182 - RNA, 18 nt, Human
uuaggauguugaaaaagu

SEQ ID NO: 1849183 - RNA, 14 nt, Human
uuaguguucauaaa

SEQ ID NO: 1849184 - RNA, 18 nt, Human
uuaguaugaggcauuugu

SEQ ID NO: 1849185 - RNA, 16 nt, Human
uuaguaugaggcauuu

SEQ ID NO: 1849186 - RNA, 17 nt, Human
uuacuuuaaaaggagcc

SEQ ID NO: 1849187 - RNA, 18 nt, Human
uuacuuuaaaaggagcca

SEQ ID NO: 1849188 - RNA, 14 nt, Human
uuacuuuguguuca

SEQ ID NO: 1849189 - RNA, 15 nt, Human
uuagacagucccugc

SEQ ID NO: 1849190 - RNA, 18 nt, Human
uuagacagucccugccaa

SEQ ID NO: 1849191 - RNA, 17 nt, Human
uuagacagucccugcca

SEQ ID NO: 1849192 - RNA, 16 nt, Human
uuagacagucccugcc

SEQ ID NO: 1849193 - RNA, 13 nt, Human
uuacuaaguuuuu

SEQ ID NO: 1849194 - RNA, 14 nt, Human
uuacuaaguuuuua

SEQ ID NO: 1849195 - RNA, 16 nt, Human
uuacuaauagacaauu

SEQ ID NO: 1849196 - RNA, 17 nt, Human
uuacuaguuucccuugc

SEQ ID NO: 1849197 - RNA, 19 nt, Human
uuacuaucaugucaaacgu

SEQ ID NO: 1849198 - RNA, 21 nt, Human
uuacuaucaugucaaacguga

SEQ ID NO: 1849199 - RNA, 21 nt, Human
uuacuuaaaccgccaaggcug

SEQ ID NO: 1849200 - RNA, 17 nt, Human
uuacugucuuuuuucua

SEQ ID NO: 1849201 - RNA, 19 nt, Human
uuacugucuuuuuucuaaa

SEQ ID NO: 1849202 - RNA, 19 nt, Human
uuacuauggcccuggccua

SEQ ID NO: 1849203 - RNA, 11 nt, Human
uuacuucugcu

SEQ ID NO: 1849204 - RNA, 23 nt, Human
uuacuucuuauacauuugauaaa

SEQ ID NO: 1849205 - RNA, 12 nt, Human
uuacuucugcua

SEQ ID NO: 1849206 - RNA, 18 nt, Human
uuacuuagguguggggga

SEQ ID NO: 1849207 - RNA, 19 nt, Human
uucccccuccaaucccacc

SEQ ID NO: 1849208 - RNA, 13 nt, Human
uuccucauuagca

SEQ ID NO: 1849209 - RNA, 20 nt, Human
uucccuuugacgccauccca

SEQ ID NO: 1849210 - RNA, 22 nt, Human
uucccuuugacgccaucccagc

SEQ ID NO: 1849211 - RNA, 21 nt, Human
uucccuuugacgccaucccag

SEQ ID NO: 1849212 - RNA, 20 nt, Human
uucgggaggucgaggcagga

SEQ ID NO: 1849213 - RNA, 17 nt, Human
uucuaaagcugccagcc

SEQ ID NO: 1849214 - RNA, 13 nt, Human
uucuaaagcugcc

SEQ ID NO: 1849215 - RNA, 15 nt, Human
uucuaaagauggaaa

SEQ ID NO: 1849216 - RNA, 15 nt, Human
uuccugaugcuucuu

SEQ ID NO: 1849217 - RNA, 19 nt, Human
uuccugaugcuucuucaga

SEQ ID NO: 1849218 - RNA, 18 nt, Human
uuccugaugcuucuucag

SEQ ID NO: 1849219 - RNA, 15 nt, Human
uuccugcauuuguga

SEQ ID NO: 1849220 - RNA, 23 nt, Human
uuccugaugcuucuucagagacu

SEQ ID NO: 1849221 - RNA, 18 nt, Human
uuccugcauuugugaaau

SEQ ID NO: 1849222 - RNA, 16 nt, Human
uuccugcauuugugaa

SEQ ID NO: 1849223 - RNA, 17 nt, Human
uuccugccaggcauggu

SEQ ID NO: 1849224 - RNA, 14 nt, Human
uuccuggcacugcu

SEQ ID NO: 1849225 - RNA, 20 nt, Human
uuccuugaguugauucagcu

SEQ ID NO: 1849226 - RNA, 13 nt, Human
uucaggaagcuca

SEQ ID NO: 1849227 - RNA, 11 nt, Human
uucaggaagcu

SEQ ID NO: 1849228 - RNA, 21 nt, Human
uucaucuugaauuguaaggaa

SEQ ID NO: 1849229 - RNA, 17 nt, Human
uucaugcaaacuuuauu

SEQ ID NO: 1849230 - RNA, 15 nt, Human
uucauuuccuguguc

SEQ ID NO: 1849231 - RNA, 16 nt, Human
uucauuuccugugucu

SEQ ID NO: 1849232 - RNA, 21 nt, Human
uuccagagaguggcuccuccc

SEQ ID NO: 1849233 - RNA, 20 nt, Human
uuccagagaguggcuccucc

SEQ ID NO: 1849234 - RNA, 19 nt, Human
uuccagagaguggcuccuc

SEQ ID NO: 1849235 - RNA, 18 nt, Human
uuccagagaguggcuccu

SEQ ID NO: 1849236 - RNA, 17 nt, Human
uuccagagaguggcucc

SEQ ID NO: 1849237 - RNA, 18 nt, Human
uuccacucaggucuguuu

SEQ ID NO: 1849238 - RNA, 15 nt, Human
uuccaaauucugcuu

SEQ ID NO: 1849239 - RNA, 20 nt, Human
uuccccaggaggccagccuu

SEQ ID NO: 1849240 - RNA, 19 nt, Human
uuccccaggaggccagccu

SEQ ID NO: 1849241 - RNA, 18 nt, Human
uuccccaggaggccagcc

SEQ ID NO: 1849242 - RNA, 17 nt, Human
uuccccaggaggccagc

SEQ ID NO: 1849243 - RNA, 21 nt, Human
uuccccaggaggccagccuug

SEQ ID NO: 1849244 - RNA, 11 nt, Human
uuccccauggg

SEQ ID NO: 1849245 - RNA, 19 nt, Human
uuccccaugucucgacuca

SEQ ID NO: 1849246 - RNA, 20 nt, Human
uucccucccuuccucuuucc

SEQ ID NO: 1849247 - RNA, 17 nt, Human
uucccucccuuccucuu

SEQ ID NO: 1849248 - RNA, 11 nt, Human
uucccucccuu

SEQ ID NO: 1849249 - RNA, 14 nt, Human
uucccauucuugca

SEQ ID NO: 1849250 - RNA, 16 nt, Human
uuccccaggaggccag

SEQ ID NO: 1849251 - RNA, 15 nt, Human
uuccccaggaggcca

SEQ ID NO: 1849252 - RNA, 16 nt, Human
uucccauuugcuccuu

SEQ ID NO: 1849253 - RNA, 23 nt, Human
uuccagcaauucuccugccucag

SEQ ID NO: 1849254 - RNA, 22 nt, Human
uuccagcaauucuccugccuca

SEQ ID NO: 1849255 - RNA, 21 nt, Human
uuccagcaauucuccugccuc

SEQ ID NO: 1849256 - RNA, 20 nt, Human
uuccagcaauucuccugccu

SEQ ID NO: 1849257 - RNA, 11 nt, Human
uuauucugcuc

SEQ ID NO: 1849258 - RNA, 19 nt, Human
uuauugcagcgauuaauaa

SEQ ID NO: 1849259 - RNA, 15 nt, Human
uuauugcccacgcug

SEQ ID NO: 1849260 - RNA, 13 nt, Human
uuaguugcaacuu

SEQ ID NO: 1849261 - RNA, 14 nt, Human
uuaguuccuugagu

SEQ ID NO: 1849262 - RNA, 16 nt, Human
uuaguuccucauuagc

SEQ ID NO: 1849263 - RNA, 16 nt, Human
uuaucuagauacugua

SEQ ID NO: 1849264 - RNA, 20 nt, Human
uuaguugcaacuuuguauaa

SEQ ID NO: 1849265 - RNA, 13 nt, Human
uuaguugcuguau

SEQ ID NO: 1849266 - RNA, 15 nt, Human
uuaguugcuguaugu

SEQ ID NO: 1849267 - RNA, 20 nt, Human
uuaucuugaauaauguaaga

SEQ ID NO: 1849268 - RNA, 17 nt, Human
uuaucuagauacuguau

SEQ ID NO: 1849269 - RNA, 16 nt, Human
uuaugcaugaaguaau

SEQ ID NO: 1849270 - RNA, 14 nt, Human
uuaugcauagauaa

SEQ ID NO: 1849271 - RNA, 22 nt, Human
uuaugcaugaaguaauaugcac

SEQ ID NO: 1849272 - RNA, 16 nt, Human
uuauggaacacucuga

SEQ ID NO: 1849273 - RNA, 19 nt, Human
uucaacgcagcccugcuuu

SEQ ID NO: 1849274 - RNA, 16 nt, Human
uucaacgcagcccugc

SEQ ID NO: 1849275 - RNA, 20 nt, Human
uucaacgcagcccugcuuug

SEQ ID NO: 1849276 - RNA, 17 nt, Human
uucaacugaccagccuc

SEQ ID NO: 1849277 - RNA, 20 nt, Human
uuauuuuauguugcauagaa

SEQ ID NO: 1849278 - RNA, 18 nt, Human
uuauugucaaagugguga

SEQ ID NO: 1849279 - RNA, 17 nt, Human
uuauugucaaaguggug

SEQ ID NO: 1849280 - RNA, 13 nt, Human
uucacucuccuug

SEQ ID NO: 1849281 - RNA, 16 nt, Human
uucagacauagaauua

SEQ ID NO: 1849282 - RNA, 21 nt, Human
uucagacagcugccugggauc

SEQ ID NO: 1849283 - RNA, 20 nt, Human
uucagacauagaauuaacac

SEQ ID NO: 1849284 - RNA, 19 nt, Human
uucagagacuccugcaggc

SEQ ID NO: 1849285 - RNA, 22 nt, Human
uucagaguugaugguuguacau

SEQ ID NO: 1849286 - RNA, 21 nt, Human
uucagaguugaugguuguaca

SEQ ID NO: 1849287 - RNA, 20 nt, Human
uucaauaggaaaaacugauu

SEQ ID NO: 1849288 - RNA, 18 nt, Human
uucaauaggaaaaacuga

SEQ ID NO: 1849289 - RNA, 15 nt, Human
uucaauaggaaaaac

SEQ ID NO: 1849290 - RNA, 13 nt, Human
uucaauaggaaaa

SEQ ID NO: 1849291 - RNA, 18 nt, Human
uucacggaagagccuugc

SEQ ID NO: 1849292 - RNA, 15 nt, Human
uucacgugguccuaa

SEQ ID NO: 1849293 - RNA, 21 nt, Human
uuugaggguguauauuuucug

SEQ ID NO: 1849294 - RNA, 17 nt, Human
uuugagaucagccuggg

SEQ ID NO: 1849295 - RNA, 16 nt, Human
uuugagaucagccugg

SEQ ID NO: 1849296 - RNA, 18 nt, Human
uuucuuaaccagaucauu

SEQ ID NO: 1849297 - RNA, 23 nt, Human
uuucugaucugaugcaagcaaga

SEQ ID NO: 1849298 - RNA, 19 nt, Human
uuucuuguguguuuauugu

SEQ ID NO: 1849299 - RNA, 21 nt, Human
uuugaaauuguauuacaaauc

SEQ ID NO: 1849300 - RNA, 15 nt, Human
uuuguauucucuccu

SEQ ID NO: 1849301 - RNA, 16 nt, Human
uuuguaugcacuuugu

SEQ ID NO: 1849302 - RNA, 14 nt, Human
uuugauccaagcug

SEQ ID NO: 1849303 - RNA, 19 nt, Human
uuuggacccugaggcccag

SEQ ID NO: 1849304 - RNA, 15 nt, Human
uuuggacccugaggc

SEQ ID NO: 1849305 - RNA, 14 nt, Human
uuugcuugaaagaa

SEQ ID NO: 1849306 - RNA, 16 nt, Human
uuugcuugaaagaaaa

SEQ ID NO: 1849307 - RNA, 23 nt, Human
uuuccuggcacugcuuccaguga

SEQ ID NO: 1849308 - RNA, 22 nt, Human
uuuccucuuagucgagccaagu

SEQ ID NO: 1849309 - RNA, 19 nt, Human
uuuccuggcacugcuucca

SEQ ID NO: 1849310 - RNA, 19 nt, Human
uuucuaaaucuccaaaaua

SEQ ID NO: 1849311 - RNA, 22 nt, Human
uuucuaaaguaaaaacaaagaa

SEQ ID NO: 1849312 - RNA, 17 nt, Human
uuucuaaaguaaaaaca

SEQ ID NO: 1849313 - RNA, 22 nt, Human
uuucuacccagcgagcccuggu

SEQ ID NO: 1849314 - RNA, 15 nt, Human
uuucuacccagcgag

SEQ ID NO: 1849315 - RNA, 18 nt, Human
uuucuacccagcgagccc

SEQ ID NO: 1849316 - RNA, 14 nt, Human
uuucugaaauaaca

SEQ ID NO: 1849317 - RNA, 22 nt, Human
uuuaugauacuugaaaauuaac

SEQ ID NO: 1849318 - RNA, 17 nt, Human
uuucagccaagaauucu

SEQ ID NO: 1849319 - RNA, 17 nt, Human
uuuccacucaggucugu

SEQ ID NO: 1849320 - RNA, 20 nt, Human
uuuccuaaauauauuuuaag

SEQ ID NO: 1849321 - RNA, 12 nt, Human
uuuauacauaaa

SEQ ID NO: 1849322 - RNA, 20 nt, Human
uuuauacauaaacaagacca

SEQ ID NO: 1849323 - RNA, 18 nt, Human
uuuauaaacuuuaccuuu

SEQ ID NO: 1849324 - RNA, 22 nt, Human
uuuagacccuauugcugcuuga

SEQ ID NO: 1849325 - RNA, 18 nt, Human
uuuaguugcaacuuugua

SEQ ID NO: 1849326 - RNA, 17 nt, Human
uuuaguugcaacuuugu

SEQ ID NO: 1849327 - RNA, 19 nt, Human
uuuagacccuauugcugcu

SEQ ID NO: 1849328 - RNA, 14 nt, Human
uuuaacagaaaugu

SEQ ID NO: 1849329 - RNA, 15 nt, Human
uuuaacagaaaugua

SEQ ID NO: 1849330 - RNA, 15 nt, Human
uuuaauaaacacucu

SEQ ID NO: 1849331 - RNA, 14 nt, Human
uuuaauaaacacuc

SEQ ID NO: 1849332 - RNA, 13 nt, Human
uuuaauaaaccau

SEQ ID NO: 1849333 - RNA, 22 nt, Human
uuuaauaaacacucuugaaaaa

SEQ ID NO: 1849334 - RNA, 13 nt, Human
uuuacagagacag

SEQ ID NO: 1849335 - RNA, 13 nt, Human
uuuacagcugccu

SEQ ID NO: 1849336 - RNA, 15 nt, Human
uugucuuuggacccu

SEQ ID NO: 1849337 - RNA, 24 nt, Human
uugucuuuggacccugaggcccag

SEQ ID NO: 1849338 - RNA, 20 nt, Human
uugucuuuggacccugaggc

SEQ ID NO: 1849339 - RNA, 19 nt, Human
uugucuuuggugaacauug

SEQ ID NO: 1849340 - RNA, 20 nt, Human
uuguuuggggaugagaaagg

SEQ ID NO: 1849341 - RNA, 13 nt, Human
uuuaaaagauaca

SEQ ID NO: 1849342 - RNA, 13 nt, Human
uuuaacagaaaug

SEQ ID NO: 1849343 - RNA, 16 nt, Human
uuuaaaaugagaaauc

SEQ ID NO: 1849344 - RNA, 12 nt, Human
uuuaaaaugucu

SEQ ID NO: 1849345 - RNA, 18 nt, Human
uugucugaagucacugca

SEQ ID NO: 1849346 - RNA, 17 nt, Human
uugucugaagucacugc

SEQ ID NO: 1849347 - RNA, 20 nt, Human
uugucuaugggacucaaugc

SEQ ID NO: 1849348 - RNA, 20 nt, Human
uuguaugauccuaaugaaug

SEQ ID NO: 1849349 - RNA, 22 nt, Human
uuguaugaaagauggcugugcc

SEQ ID NO: 1849350 - RNA, 22 nt, Human
uugucaaaguggugagaggcau

SEQ ID NO: 1849351 - RNA, 14 nt, Human
uugucuaugggacu

SEQ ID NO: 1849352 - RNA, 18 nt, Human
uuguacuuuagggaagua

SEQ ID NO: 1849353 - RNA, 20 nt, Human
uuguaaaauggugugaccac

SEQ ID NO: 1849354 - RNA, 16 nt, Human
uuguaccgcaauguga

SEQ ID NO: 1849355 - RNA, 23 nt, Human
uuggcuucacggaagagccuugc

SEQ ID NO: 1849356 - RNA, 15 nt, Human
uuggucugugagaug

SEQ ID NO: 1849357 - RNA, 12 nt, Human
uuguaaaauggu

SEQ ID NO: 1849358 - RNA, 13 nt, Human
uuguaaaauggug

SEQ ID NO: 1849359 - RNA, 20 nt, Human
uuggucugacccacugcuuu

SEQ ID NO: 1849360 - RNA, 18 nt, Human
uugcugucccuuuuccuu

SEQ ID NO: 1849361 - RNA, 16 nt, Human
uugcugucccuuuucc

SEQ ID NO: 1849362 - RNA, 16 nt, Human
uugcugcuugaggcaa

SEQ ID NO: 1849363 - RNA, 14 nt, Human
uugcugcuugaggc

SEQ ID NO: 1849364 - RNA, 20 nt, Human
uugccauguuggccaggcug

SEQ ID NO: 1849365 - RNA, 21 nt, Human
uugccauguuggccaggcugg

SEQ ID NO: 1849366 - RNA, 21 nt, Human
uuggacccugaggcccagagg

SEQ ID NO: 1849367 - RNA, 19 nt, Human
uuggacccugaggcccaga

SEQ ID NO: 1849368 - RNA, 18 nt, Human
uuggacccugaggcccag

SEQ ID NO: 1849369 - RNA, 15 nt, Human
uuggacccugaggcc

SEQ ID NO: 1849370 - RNA, 15 nt, Human
uuggauuguccccga

SEQ ID NO: 1849371 - RNA, 19 nt, Human
uuggaagcuccgcuuucua

SEQ ID NO: 1849372 - RNA, 19 nt, Human
uuggacagaagcagcucuu

SEQ ID NO: 1849373 - RNA, 16 nt, Human
uuggacagaagcagcu

SEQ ID NO: 1849374 - RNA, 17 nt, Human
uugauucauaaugacuu

SEQ ID NO: 1849375 - RNA, 13 nt, Human
uugauucauaaug

SEQ ID NO: 1849376 - RNA, 19 nt, Human
uugcagcgauuaauaacag

SEQ ID NO: 1849377 - RNA, 18 nt, Human
uugcagcgauuaauaaca

SEQ ID NO: 1849378 - RNA, 23 nt, Human
uugcagacaggcaagcaccuccu

SEQ ID NO: 1849379 - RNA, 16 nt, Human
uugcauaacguauaaa

SEQ ID NO: 1849380 - RNA, 13 nt, Human
uugccagucaccc

SEQ ID NO: 1849381 - RNA, 16 nt, Human
uugccauguuggccag

SEQ ID NO: 1849382 - RNA, 17 nt, Human
uugccauguuggccagg

SEQ ID NO: 1849383 - RNA, 18 nt, Human
uugccauguuggccaggc

SEQ ID NO: 1849384 - RNA, 19 nt, Human
uugccauguuggccaggcu

SEQ ID NO: 1849385 - RNA, 14 nt, Human
uugagccuugaacu

SEQ ID NO: 1849386 - RNA, 15 nt, Human
uugagccuugaacuu

SEQ ID NO: 1849387 - RNA, 16 nt, Human
uugagccuugaacuuu

SEQ ID NO: 1849388 - RNA, 13 nt, Human
uugagcucagccc

SEQ ID NO: 1849389 - RNA, 19 nt, Human
uugagccuugaacuuugac

SEQ ID NO: 1849390 - RNA, 16 nt, Human
uugauucagcucugca

SEQ ID NO: 1849391 - RNA, 23 nt, Human
uugauucagacagcugccuggga

SEQ ID NO: 1849392 - RNA, 21 nt, Human
uugauucagacagcugccugg

SEQ ID NO: 1849393 - RNA, 17 nt, Human
uugauucagacagcugc

SEQ ID NO: 1849394 - RNA, 17 nt, Human
uugauccagaaagaaaa

SEQ ID NO: 1849395 - RNA, 16 nt, Human
uugauaugcuuauaca

SEQ ID NO: 1849396 - RNA, 22 nt, Human
uugauauuuucaacgcagcccu

SEQ ID NO: 1849397 - RNA, 14 nt, Human
uucuuguguguuua

SEQ ID NO: 1849398 - RNA, 17 nt, Human
uucuuagggaaggauac

SEQ ID NO: 1849399 - RNA, 13 nt, Human
uucuucagagacu

SEQ ID NO: 1849400 - RNA, 17 nt, Human
uucuuauguugcccagu

SEQ ID NO: 1849401 - RNA, 16 nt, Human
uucuggcuaugcauuu

SEQ ID NO: 1849402 - RNA, 20 nt, Human
uucuggcagaguugaagaca

SEQ ID NO: 1849403 - RNA, 15 nt, Human
uucuggcagaggagg

SEQ ID NO: 1849404 - RNA, 13 nt, Human
uucugugcagcca

SEQ ID NO: 1849405 - RNA, 20 nt, Human
uugaacuuugaccucugcag

SEQ ID NO: 1849406 - RNA, 17 nt, Human
uugaacuuugaccucug

SEQ ID NO: 1849407 - RNA, 18 nt, Human
uugaacuuugaccucugc

SEQ ID NO: 1849408 - RNA, 16 nt, Human
uugaaugaugccauga

SEQ ID NO: 1849409 - RNA, 12 nt, Human
uugaaugaugcc

SEQ ID NO: 1849410 - RNA, 15 nt, Human
uugaacuuugaccuc

SEQ ID NO: 1849411 - RNA, 18 nt, Human
uugaaaauuaacaugaau

SEQ ID NO: 1849412 - RNA, 21 nt, Human
uucuuuccugaggcugggcuc

SEQ ID NO: 1849413 - RNA, 21 nt, Human
uugaaaaucuuauaauuuaaa

SEQ ID NO: 1849414 - RNA, 14 nt, Human
auguucuuaauucu

SEQ ID NO: 1849415 - RNA, 15 nt, Human
auguuugccucugcc

SEQ ID NO: 1849416 - RNA, 17 nt, Human
auguuugccucugccuc

SEQ ID NO: 1849417 - RNA, 14 nt, Human
auguuugccucugc

SEQ ID NO: 1849418 - RNA, 15 nt, Human
auguucugggacaca

SEQ ID NO: 1849419 - RNA, 17 nt, Human
auguucucugaggacac

SEQ ID NO: 1849420 - RNA, 14 nt, Human
auguucugggacac

SEQ ID NO: 1849421 - RNA, 16 nt, Human
auguucucucuucucc

SEQ ID NO: 1849422 - RNA, 17 nt, Human
auguucucucuucucca

SEQ ID NO: 1849423 - RNA, 13 nt, Human
auguucucugagg

SEQ ID NO: 1849424 - RNA, 13 nt, Human
auguguaaguauu

SEQ ID NO: 1849425 - RNA, 23 nt, Human
augggugcuuggaggaaggaaac

SEQ ID NO: 1849426 - RNA, 21 nt, Human
augggugcuuggaggaaggaa

SEQ ID NO: 1849427 - RNA, 20 nt, Human
augggugcuuggaggaagga

SEQ ID NO: 1849428 - RNA, 14 nt, Human
augugaaacauguu

SEQ ID NO: 1849429 - RNA, 19 nt, Human
augucacaggcagguccag

SEQ ID NO: 1849430 - RNA, 18 nt, Human
augugaaaucauucauuu

SEQ ID NO: 1849431 - RNA, 17 nt, Human
augugaaaucauucauu

SEQ ID NO: 1849432 - RNA, 13 nt, Human
augucacaggcag

SEQ ID NO: 1849433 - RNA, 19 nt, Human
augcugacuguacuccucc

SEQ ID NO: 1849434 - RNA, 21 nt, Human
augcugacuguacuccuccca

SEQ ID NO: 1849435 - RNA, 20 nt, Human
augcugacuguacuccuccc

SEQ ID NO: 1849436 - RNA, 15 nt, Human
augcugcccugugag

SEQ ID NO: 1849437 - RNA, 14 nt, Human
augcugcccuguga

SEQ ID NO: 1849438 - RNA, 13 nt, Human
augcugcccugug

SEQ ID NO: 1849439 - RNA, 16 nt, Human
augcugcccugugagu

SEQ ID NO: 1849440 - RNA, 15 nt, Human
augcugccuccagaa

SEQ ID NO: 1849441 - RNA, 12 nt, Human
augcugccucca

SEQ ID NO: 1849442 - RNA, 18 nt, Human
auggcuuuugugcauuau

SEQ ID NO: 1849443 - RNA, 16 nt, Human
auggcuuuugugcauu

SEQ ID NO: 1849444 - RNA, 17 nt, Human
auggcuuuugugcauua

SEQ ID NO: 1849445 - RNA, 16 nt, Human
augcuuguacauaaug

SEQ ID NO: 1849446 - RNA, 15 nt, Human
augcuuguacauaau

SEQ ID NO: 1849447 - RNA, 18 nt, Human
augcuuuaggauguacag

SEQ ID NO: 1849448 - RNA, 17 nt, Human
auggcugugccucugcc

SEQ ID NO: 1849449 - RNA, 16 nt, Human
auggcugugccucugc

SEQ ID NO: 1849450 - RNA, 15 nt, Human
auggcugugccucug

SEQ ID NO: 1849451 - RNA, 17 nt, Human
auggauaggcacaggaa

SEQ ID NO: 1849452 - RNA, 18 nt, Human
auggauaggcacaggaaa

SEQ ID NO: 1849453 - RNA, 13 nt, Human
augcacacauuuu

SEQ ID NO: 1849454 - RNA, 14 nt, Human
augcacacauuuuu

SEQ ID NO: 1849455 - RNA, 15 nt, Human
augcacacauuuuuu

SEQ ID NO: 1849456 - RNA, 19 nt, Human
augcacagaguuguuacau

SEQ ID NO: 1849457 - RNA, 21 nt, Human
augcacagaguuguuacauuu

SEQ ID NO: 1849458 - RNA, 22 nt, Human
augcacagaguuguuacauuuu

SEQ ID NO: 1849459 - RNA, 23 nt, Human
augcacagaguuguuacauuuuu

SEQ ID NO: 1849460 - RNA, 20 nt, Human
augccuggauggggcugcac

SEQ ID NO: 1849461 - RNA, 19 nt, Human
augccuggauggggcugca

SEQ ID NO: 1849462 - RNA, 18 nt, Human
augaucuuugcagacagg

SEQ ID NO: 1849463 - RNA, 19 nt, Human
augaucuuugcagacaggc

SEQ ID NO: 1849464 - RNA, 21 nt, Human
augaucuuugcagacaggcaa

SEQ ID NO: 1849465 - RNA, 17 nt, Human
augaucuuugcagacag

SEQ ID NO: 1849466 - RNA, 23 nt, Human
augcacaaauucugucucuggau

SEQ ID NO: 1849467 - RNA, 22 nt, Human
augcacaaauucugucucugga

SEQ ID NO: 1849468 - RNA, 15 nt, Human
augcacaaauucugu

SEQ ID NO: 1849469 - RNA, 18 nt, Human
augcacaaacagaggccg

SEQ ID NO: 1849470 - RNA, 15 nt, Human
augaugauccuaggc

SEQ ID NO: 1849471 - RNA, 23 nt, Human
augaugaaaugaggucagagccu

SEQ ID NO: 1849472 - RNA, 18 nt, Human
augaugaaaugaggucag

SEQ ID NO: 1849473 - RNA, 16 nt, Human
augaaaacacauuuuu

SEQ ID NO: 1849474 - RNA, 14 nt, Human
augaaaacacauuu

SEQ ID NO: 1849475 - RNA, 15 nt, Human
augaaaacacauuuu

SEQ ID NO: 1849476 - RNA, 13 nt, Human
augaggcauuugu

SEQ ID NO: 1849477 - RNA, 14 nt, Human
augaggcauuuguu

SEQ ID NO: 1849478 - RNA, 21 nt, Human
augaggcauuuguuugaacug

SEQ ID NO: 1849479 - RNA, 22 nt, Human
augaggcauuuguuugaacuga

SEQ ID NO: 1849480 - RNA, 15 nt, Human
augaccacacuccag

SEQ ID NO: 1849481 - RNA, 18 nt, Human
augaccacacuccagcug

SEQ ID NO: 1849482 - RNA, 21 nt, Human
augaaguacucauacauguua

SEQ ID NO: 1849483 - RNA, 16 nt, Human
aucucugcuuuggaaa

SEQ ID NO: 1849484 - RNA, 22 nt, Human
aucuggacuccucuguccaggc

SEQ ID NO: 1849485 - RNA, 18 nt, Human
aucugggggccucuucug

SEQ ID NO: 1849486 - RNA, 23 nt, Human
aucaaagagguuuuaaaaaaauc

SEQ ID NO: 1849487 - RNA, 20 nt, Human
aucaaagagguuuuaaaaaa

SEQ ID NO: 1849488 - RNA, 14 nt, Human
aucaaauauauuca

SEQ ID NO: 1849489 - RNA, 13 nt, Human
aucacagccucug

SEQ ID NO: 1849490 - RNA, 22 nt, Human
aucaaauauauucagccuggcu

SEQ ID NO: 1849491 - RNA, 20 nt, Human
aucaccaacgucugugccau

SEQ ID NO: 1849492 - RNA, 13 nt, Human
aucaccagacagg

SEQ ID NO: 1849493 - RNA, 23 nt, Human
aucacccgcuaagagggagggag

SEQ ID NO: 1849494 - RNA, 12 nt, Human
aucaugugaaau

SEQ ID NO: 1849495 - RNA, 14 nt, Human
aucaugucuggcua

SEQ ID NO: 1849496 - RNA, 13 nt, Human
auccacucgccuu

SEQ ID NO: 1849497 - RNA, 19 nt, Human
auccagacccggcugcgug

SEQ ID NO: 1849498 - RNA, 18 nt, Human
auccccaagccuggcaag

SEQ ID NO: 1849499 - RNA, 19 nt, Human
aucccaugagccucagcau

SEQ ID NO: 1849500 - RNA, 15 nt, Human
aucccggcugcccuu

SEQ ID NO: 1849501 - RNA, 19 nt, Human
auccucaguuuuugugaaa

SEQ ID NO: 1849502 - RNA, 17 nt, Human
auccucauacccacccc

SEQ ID NO: 1849503 - RNA, 22 nt, Human
auauuauuuuauguugcauaga

SEQ ID NO: 1849504 - RNA, 15 nt, Human
auauuauuuuauguu

SEQ ID NO: 1849505 - RNA, 14 nt, Human
auauuauuuuaugu

SEQ ID NO: 1849506 - RNA, 19 nt, Human
auauucaggaagcucaggg

SEQ ID NO: 1849507 - RNA, 20 nt, Human
auaugcucugcauguuacau

SEQ ID NO: 1849508 - RNA, 16 nt, Human
auaugcaguuuuccuu

SEQ ID NO: 1849509 - RNA, 17 nt, Human
auaugcucugcauguua

SEQ ID NO: 1849510 - RNA, 16 nt, Human
auaugcucugcauguu

SEQ ID NO: 1849511 - RNA, 14 nt, Human
auaguaaaaauaaa

SEQ ID NO: 1849512 - RNA, 13 nt, Human
auaguaaaaauaa

SEQ ID NO: 1849513 - RNA, 15 nt, Human
auagccuaggugaca

SEQ ID NO: 1849514 - RNA, 17 nt, Human
auagccuaggugacaga

SEQ ID NO: 1849515 - RNA, 15 nt, Human
auagcagcuuauuca

SEQ ID NO: 1849516 - RNA, 15 nt, Human
auagcacagacccug

SEQ ID NO: 1849517 - RNA, 18 nt, Human
auagcacagacccugccc

SEQ ID NO: 1849518 - RNA, 17 nt, Human
auagcacagacccugcc

SEQ ID NO: 1849519 - RNA, 19 nt, Human
aguuguuacauuuuuaagu

SEQ ID NO: 1849520 - RNA, 20 nt, Human
aguuguuacauuuuuaagug

SEQ ID NO: 1849521 - RNA, 22 nt, Human
aguuguuacauuuuuaagugcu

SEQ ID NO: 1849522 - RNA, 17 nt, Human
aguuugauuaaauucuu

SEQ ID NO: 1849523 - RNA, 18 nt, Human
aguuugauuaaauucuug

SEQ ID NO: 1849524 - RNA, 20 nt, Human
aguuugauuaaauucuugca

SEQ ID NO: 1849525 - RNA, 22 nt, Human
aguuugauuaaauucuugcaaa

SEQ ID NO: 1849526 - RNA, 19 nt, Human
aguuugagaucagccuggg

SEQ ID NO: 1849527 - RNA, 18 nt, Human
aguuugagaucagccugg

SEQ ID NO: 1849528 - RNA, 20 nt, Human
aguuugagaucagccugggc

SEQ ID NO: 1849529 - RNA, 16 nt, Human
aguuugauuaaauucu

SEQ ID NO: 1849530 - RNA, 23 nt, Human
aguuugauuaaauucuugcaaag

SEQ ID NO: 1849531 - RNA, 18 nt, Human
auaacauguaauuaagua

SEQ ID NO: 1849532 - RNA, 13 nt, Human
auaacauguaauu

SEQ ID NO: 1849533 - RNA, 12 nt, Human
auaacauguaau

SEQ ID NO: 1849534 - RNA, 20 nt, Human
auaacauguaauuaaguacu

SEQ ID NO: 1849535 - RNA, 14 nt, Human
auaacaaugaaagu

SEQ ID NO: 1849536 - RNA, 17 nt, Human
auaccugucccccugac

SEQ ID NO: 1849537 - RNA, 20 nt, Human
auacccccugcaaagcccag

SEQ ID NO: 1849538 - RNA, 16 nt, Human
auaccugucccccuga

SEQ ID NO: 1849539 - RNA, 15 nt, Human
auaccugucccccug

SEQ ID NO: 1849540 - RNA, 14 nt, Human
auaccugucccccu

SEQ ID NO: 1849541 - RNA, 21 nt, Human
auacccccugcaaagcccagc

SEQ ID NO: 1849542 - RNA, 17 nt, Human
auacccacccccaccca

SEQ ID NO: 1849543 - RNA, 19 nt, Human
auacccccugcaaagccca

SEQ ID NO: 1849544 - RNA, 17 nt, Human
auacccccugcaaagcc

SEQ ID NO: 1849545 - RNA, 16 nt, Human
auacccacccccaccc

SEQ ID NO: 1849546 - RNA, 14 nt, Human
auacccacccccac

SEQ ID NO: 1849547 - RNA, 13 nt, Human
auacccaccccca

SEQ ID NO: 1849548 - RNA, 22 nt, Human
auacacuuacacuuuaugcaca

SEQ ID NO: 1849549 - RNA, 13 nt, Human
auacacuuacacu

SEQ ID NO: 1849550 - RNA, 14 nt, Human
auacaaugcugugc

SEQ ID NO: 1849551 - RNA, 17 nt, Human
auacaaugcugugcccu

SEQ ID NO: 1849552 - RNA, 21 nt, Human
auaagccagacaucaacagau

SEQ ID NO: 1849553 - RNA, 22 nt, Human
auaagccagacaucaacagaua

SEQ ID NO: 1849554 - RNA, 14 nt, Human
auaauguaagcucu

SEQ ID NO: 1849555 - RNA, 15 nt, Human
auaauguaaauaaag

SEQ ID NO: 1849556 - RNA, 13 nt, Human
auaauggucagag

SEQ ID NO: 1849557 - RNA, 18 nt, Human
auaaggguaucuggugac

SEQ ID NO: 1849558 - RNA, 22 nt, Human
aguucaucuugaauuguaagga

SEQ ID NO: 1849559 - RNA, 16 nt, Human
aguugauacuacaguu

SEQ ID NO: 1849560 - RNA, 19 nt, Human
aguucaucuugaauuguaa

SEQ ID NO: 1849561 - RNA, 15 nt, Human
aguucaucuugaauu

SEQ ID NO: 1849562 - RNA, 13 nt, Human
aguucaucuugaa

SEQ ID NO: 1849563 - RNA, 18 nt, Human
aguucagguaacaggcag

SEQ ID NO: 1849564 - RNA, 20 nt, Human
agugcuaauuuugaaaaacu

SEQ ID NO: 1849565 - RNA, 18 nt, Human
agugcuaauuuugaaaaa

SEQ ID NO: 1849566 - RNA, 15 nt, Human
agugccuuauggaac

SEQ ID NO: 1849567 - RNA, 14 nt, Human
agugccuuauggaa

SEQ ID NO: 1849568 - RNA, 13 nt, Human
agugccuuaugga

SEQ ID NO: 1849569 - RNA, 10 nt, Human
agugccuuau

SEQ ID NO: 1849570 - RNA, 15 nt, Human
agugcuaauuuugaa

SEQ ID NO: 1849571 - RNA, 16 nt, Human
agugccuuauggaaca

SEQ ID NO: 1849572 - RNA, 18 nt, Human
agugccuuauggaacacu

SEQ ID NO: 1849573 - RNA, 21 nt, Human
agugauucucaugccucagcc

SEQ ID NO: 1849574 - RNA, 20 nt, Human
agugauggguuaguggaugg

SEQ ID NO: 1849575 - RNA, 14 nt, Human
agugauucuccugc

SEQ ID NO: 1849576 - RNA, 18 nt, Human
agugccuuacacaauggu

SEQ ID NO: 1849577 - RNA, 15 nt, Human
agugauucuccugcc

SEQ ID NO: 1849578 - RNA, 17 nt, Human
agugauucuccugccuc

SEQ ID NO: 1849579 - RNA, 14 nt, Human
agugauccucccac

SEQ ID NO: 1849580 - RNA, 15 nt, Human
agugauccucccacc

SEQ ID NO: 1849581 - RNA, 18 nt, Human
agugauccucccaccuca

SEQ ID NO: 1849582 - RNA, 24 nt, Human
agugauccucccaccucagccucc

SEQ ID NO: 1849583 - RNA, 21 nt, Human
agugggacagggcauggccag

SEQ ID NO: 1849584 - RNA, 19 nt, Human
agugggacagggcauggcc

SEQ ID NO: 1849585 - RNA, 19 nt, Human
agugucaaugcagccccca

SEQ ID NO: 1849586 - RNA, 19 nt, Human
agucaugcguuuaaucaca

SEQ ID NO: 1849587 - RNA, 22 nt, Human
aguccucuuuucugagaggacu

SEQ ID NO: 1849588 - RNA, 20 nt, Human
aguccuuaccagcagagcac

SEQ ID NO: 1849589 - RNA, 19 nt, Human
aguccucuuuucugagagg

SEQ ID NO: 1849590 - RNA, 18 nt, Human
agugaccucagcuuugau

SEQ ID NO: 1849591 - RNA, 17 nt, Human
agugaccucagcuuuga

SEQ ID NO: 1849592 - RNA, 19 nt, Human
aguccuuaccagcagagca

SEQ ID NO: 1849593 - RNA, 18 nt, Human
aguaaaugggggugcauu

SEQ ID NO: 1849594 - RNA, 13 nt, Human
aggucuguucuuu

SEQ ID NO: 1849595 - RNA, 15 nt, Human
aggucuguucuuucc

SEQ ID NO: 1849596 - RNA, 16 nt, Human
aggucuguucuuucca

SEQ ID NO: 1849597 - RNA, 15 nt, Human
aguacguugugcauu

SEQ ID NO: 1849598 - RNA, 14 nt, Human
aguacguugugcau

SEQ ID NO: 1849599 - RNA, 16 nt, Human
aguacguugugcauuu

SEQ ID NO: 1849600 - RNA, 17 nt, Human
aguacguugugcauuug

SEQ ID NO: 1849601 - RNA, 18 nt, Human
aguacguugugcauuugg

SEQ ID NO: 1849602 - RNA, 22 nt, Human
aguacuacaguccucccaucuc

SEQ ID NO: 1849603 - RNA, 19 nt, Human
aguacuacaguccucccau

SEQ ID NO: 1849604 - RNA, 14 nt, Human
aguacuauaauuua

SEQ ID NO: 1849605 - RNA, 17 nt, Human
aguacuucuccacccug

SEQ ID NO: 1849606 - RNA, 12 nt, Human
aguacuucuuuu

SEQ ID NO: 1849607 - RNA, 14 nt, Human
aguacuauguauca

SEQ ID NO: 1849608 - RNA, 12 nt, Human
aguacuauguau

SEQ ID NO: 1849609 - RNA, 13 nt, Human
aguacucauacau

SEQ ID NO: 1849610 - RNA, 22 nt, Human
agucacacaguauuacuucugc

SEQ ID NO: 1849611 - RNA, 23 nt, Human
aguaugaggcauuuguuugaacu

SEQ ID NO: 1849612 - RNA, 17 nt, Human
aguaugaggcauuuguu

SEQ ID NO: 1849613 - RNA, 15 nt, Human
aguaucucagggccu

SEQ ID NO: 1849614 - RNA, 20 nt, Human
aguaugaggcauuuguuuga

SEQ ID NO: 1849615 - RNA, 21 nt, Human
aguaugaggcauuuguuugaa

SEQ ID NO: 1849616 - RNA, 15 nt, Human
agagcccuucauuug

SEQ ID NO: 1849617 - RNA, 14 nt, Human
agagccucaaauga

SEQ ID NO: 1849618 - RNA, 17 nt, Human
agagccucaaaugagaa

SEQ ID NO: 1849619 - RNA, 13 nt, Human
agagcccaccuug

SEQ ID NO: 1849620 - RNA, 13 nt, Human
agagccagggucu

SEQ ID NO: 1849621 - RNA, 16 nt, Human
agagagaccacuuuuc

SEQ ID NO: 1849622 - RNA, 16 nt, Human
agacgcugugcugccc

SEQ ID NO: 1849623 - RNA, 18 nt, Human
agacucugucucaaaaaa

SEQ ID NO: 1849624 - RNA, 13 nt, Human
agacucugucuca

SEQ ID NO: 1849625 - RNA, 18 nt, Human
agacucugucucagucca

SEQ ID NO: 1849626 - RNA, 20 nt, Human
agacugaguacguugugcau

SEQ ID NO: 1849627 - RNA, 22 nt, Human
agacugaccaauauuguacagu

SEQ ID NO: 1849628 - RNA, 22 nt, Human
agacugaguacguugugcauuu

SEQ ID NO: 1849629 - RNA, 21 nt, Human
agaggacuuuucuuuguggcu

SEQ ID NO: 1849630 - RNA, 22 nt, Human
agaggacuuuucuuuguggcuu

SEQ ID NO: 1849631 - RNA, 23 nt, Human
agaggagggagcaucagugcccu

SEQ ID NO: 1849632 - RNA, 23 nt, Human
agaggacuuuucuuuguggcuuc

SEQ ID NO: 1849633 - RNA, 16 nt, Human
agagggccugcaaggg

SEQ ID NO: 1849634 - RNA, 13 nt, Human
agagggccugcaa

SEQ ID NO: 1849635 - RNA, 19 nt, Human
agaggggguggccucccaa

SEQ ID NO: 1849636 - RNA, 17 nt, Human
agaggggguggccuccc

SEQ ID NO: 1849637 - RNA, 13 nt, Human
agaggaaugaagu

SEQ ID NO: 1849638 - RNA, 14 nt, Human
agaaguaacuuacu

SEQ ID NO: 1849639 - RNA, 18 nt, Human
agaagguuucagaaagaa

SEQ ID NO: 1849640 - RNA, 13 nt, Human
agaagacacugau

SEQ ID NO: 1849641 - RNA, 21 nt, Human
agaagacacugaugggcaacc

SEQ ID NO: 1849642 - RNA, 21 nt, Human
acuuuccucuuuggucuacac

SEQ ID NO: 1849643 - RNA, 21 nt, Human
acuuuccucuuagucgagcca

SEQ ID NO: 1849644 - RNA, 21 nt, Human
agaagagauugugguuucauu

SEQ ID NO: 1849645 - RNA, 22 nt, Human
agaaugcacaaacagaggccgc

SEQ ID NO: 1849646 - RNA, 19 nt, Human
agaaugcacaaacagaggc

SEQ ID NO: 1849647 - RNA, 21 nt, Human
agaagugaaaaucuacacucc

SEQ ID NO: 1849648 - RNA, 18 nt, Human
agaaugaaagggcccaga

SEQ ID NO: 1849649 - RNA, 20 nt, Human
agacaaugacuuacuguaca

SEQ ID NO: 1849650 - RNA, 21 nt, Human
agacaaugacuuacuguacau

SEQ ID NO: 1849651 - RNA, 22 nt, Human
agacaaugacuuacuguacaug

SEQ ID NO: 1849652 - RNA, 15 nt, Human
agacagagcuacaca

SEQ ID NO: 1849653 - RNA, 23 nt, Human
agacaaugacuuacuguacauga

SEQ ID NO: 1849654 - RNA, 11 nt, Human
agacagagucu

SEQ ID NO: 1849655 - RNA, 19 nt, Human
agacagagucucacuguug

SEQ ID NO: 1849656 - RNA, 20 nt, Human
agacagagucucacuguugc

SEQ ID NO: 1849657 - RNA, 15 nt, Human
agaccacguuucuaa

SEQ ID NO: 1849658 - RNA, 22 nt, Human
agacagccaacuauggccugug

SEQ ID NO: 1849659 - RNA, 22 nt, Human
agacagauacuccuccaagguu

SEQ ID NO: 1849660 - RNA, 23 nt, Human
agacagagucucacuguugccca

SEQ ID NO: 1849661 - RNA, 21 nt, Human
agacagagucucacuguugcc

SEQ ID NO: 1849662 - RNA, 19 nt, Human
agacccaaaaggcagaagc

SEQ ID NO: 1849663 - RNA, 23 nt, Human
agccccauccucuguacagagcc

SEQ ID NO: 1849664 - RNA, 17 nt, Human
agccccauccucuguac

SEQ ID NO: 1849665 - RNA, 15 nt, Human
agccccauccucugu

SEQ ID NO: 1849666 - RNA, 17 nt, Human
agccccauucugccugc

SEQ ID NO: 1849667 - RNA, 18 nt, Human
agccccauucugccugcc

SEQ ID NO: 1849668 - RNA, 19 nt, Human
agccccauucugccugccc

SEQ ID NO: 1849669 - RNA, 21 nt, Human
agcccgggcucugccucccau

SEQ ID NO: 1849670 - RNA, 20 nt, Human
agcccgggcucugccuccca

SEQ ID NO: 1849671 - RNA, 18 nt, Human
agcccgggcucugccucc

SEQ ID NO: 1849672 - RNA, 17 nt, Human
agcccgggcucugccuc

SEQ ID NO: 1849673 - RNA, 13 nt, Human
agcccucccugcc

SEQ ID NO: 1849674 - RNA, 12 nt, Human
agcccucccugc

SEQ ID NO: 1849675 - RNA, 23 nt, Human
agcccuccaucuaaacugccccc

SEQ ID NO: 1849676 - RNA, 21 nt, Human
agcccuccaucuaaacugccc

SEQ ID NO: 1849677 - RNA, 20 nt, Human
agccccauucugccugccca

SEQ ID NO: 1849678 - RNA, 13 nt, Human
agcauccuggcac

SEQ ID NO: 1849679 - RNA, 16 nt, Human
agccagcaggcucuca

SEQ ID NO: 1849680 - RNA, 15 nt, Human
agcccaccccucaac

SEQ ID NO: 1849681 - RNA, 16 nt, Human
agcccaccuuggcuca

SEQ ID NO: 1849682 - RNA, 14 nt, Human
agcccaccuuggcu

SEQ ID NO: 1849683 - RNA, 15 nt, Human
agcccacgcccccac

SEQ ID NO: 1849684 - RNA, 14 nt, Human
agcccacgccccca

SEQ ID NO: 1849685 - RNA, 23 nt, Human
agcccacgcccccacuggugaca

SEQ ID NO: 1849686 - RNA, 18 nt, Human
agccagaggagagaggac

SEQ ID NO: 1849687 - RNA, 17 nt, Human
agccagaggagagagga

SEQ ID NO: 1849688 - RNA, 14 nt, Human
agccagcaggcucu

SEQ ID NO: 1849689 - RNA, 15 nt, Human
agccagaggagagag

SEQ ID NO: 1849690 - RNA, 13 nt, Human
agccagaggagag

SEQ ID NO: 1849691 - RNA, 20 nt, Human
agccaaggccaaaggaagca

SEQ ID NO: 1849692 - RNA, 16 nt, Human
agccaaagcuaggccu

SEQ ID NO: 1849693 - RNA, 18 nt, Human
agccaaagcuaggccugg

SEQ ID NO: 1849694 - RNA, 14 nt, Human
agcauccuggcacc

SEQ ID NO: 1849695 - RNA, 17 nt, Human
agcauccuggcacccgg

SEQ ID NO: 1849696 - RNA, 18 nt, Human
agcauccuggcacccggc

SEQ ID NO: 1849697 - RNA, 16 nt, Human
agcacagacccugccc

SEQ ID NO: 1849698 - RNA, 17 nt, Human
agcacgauuucuguuua

SEQ ID NO: 1849699 - RNA, 19 nt, Human
agcacgauuucuguuuaga

SEQ ID NO: 1849700 - RNA, 21 nt, Human
agcacgauuucuguuuagaua

SEQ ID NO: 1849701 - RNA, 12 nt, Human
agcacagacccu

SEQ ID NO: 1849702 - RNA, 15 nt, Human
agcacagacccugcc

SEQ ID NO: 1849703 - RNA, 14 nt, Human
agcacagacccugc

SEQ ID NO: 1849704 - RNA, 20 nt, Human
agcaaaggagauuggaagga

SEQ ID NO: 1849705 - RNA, 16 nt, Human
agcaaauguggcuccu

SEQ ID NO: 1849706 - RNA, 20 nt, Human
agcaaaugucuuccuggauu

SEQ ID NO: 1849707 - RNA, 17 nt, Human
agcaaaugucuuccugg

SEQ ID NO: 1849708 - RNA, 21 nt, Human
agauucuuuccugaggcuggg

SEQ ID NO: 1849709 - RNA, 19 nt, Human
agauucuuuccugaggcug

SEQ ID NO: 1849710 - RNA, 23 nt, Human
agauugcaacaggcugggcuuca

SEQ ID NO: 1849711 - RNA, 20 nt, Human
agauugcaacaggcugggcu

SEQ ID NO: 1849712 - RNA, 21 nt, Human
agauugcaacaggcugggcuu

SEQ ID NO: 1849713 - RNA, 18 nt, Human
agcaaaagaugcuucuca

SEQ ID NO: 1849714 - RNA, 16 nt, Human
agauguagaggagaaa

SEQ ID NO: 1849715 - RNA, 19 nt, Human
agauguagaggagaaacug

SEQ ID NO: 1849716 - RNA, 14 nt, Human
agaugagugagcau

SEQ ID NO: 1849717 - RNA, 18 nt, Human
aggcuggguucugauccu

SEQ ID NO: 1849718 - RNA, 15 nt, Human
aggcuaccuuuguau

SEQ ID NO: 1849719 - RNA, 13 nt, Human
aggcuaccuuugu

SEQ ID NO: 1849720 - RNA, 14 nt, Human
aggcuaccuuugua

SEQ ID NO: 1849721 - RNA, 15 nt, Human
agggacugaggggag

SEQ ID NO: 1849722 - RNA, 23 nt, Human
agggacugccagucccccugccc

SEQ ID NO: 1849723 - RNA, 15 nt, Human
agggacccuccacca

SEQ ID NO: 1849724 - RNA, 18 nt, Human
aggcuuagucacugagac

SEQ ID NO: 1849725 - RNA, 23 nt, Human
aggcuggucucgaacuccugacc

SEQ ID NO: 1849726 - RNA, 22 nt, Human
aggcuggucucaaacuccugac

SEQ ID NO: 1849727 - RNA, 20 nt, Human
aggcuguaucccaugagccu

SEQ ID NO: 1849728 - RNA, 21 nt, Human
aggcuguaucccaugagccuc

SEQ ID NO: 1849729 - RNA, 17 nt, Human
aggcuuagucacugaga

SEQ ID NO: 1849730 - RNA, 22 nt, Human
aggcuguaucccaugagccuca

SEQ ID NO: 1849731 - RNA, 15 nt, Human
aggcaugguggccca

SEQ ID NO: 1849732 - RNA, 17 nt, Human
aggcaugugaugagagg

SEQ ID NO: 1849733 - RNA, 20 nt, Human
aggcaugugaugagaggaaa

SEQ ID NO: 1849734 - RNA, 19 nt, Human
aggcaugugaugagaggaa

SEQ ID NO: 1849735 - RNA, 21 nt, Human
aggcaugugaugagaggaaau

SEQ ID NO: 1849736 - RNA, 17 nt, Human
aggcauguucucugagg

SEQ ID NO: 1849737 - RNA, 17 nt, Human
aggcauuccccaggagg

SEQ ID NO: 1849738 - RNA, 18 nt, Human
aggcauuccccaggaggc

SEQ ID NO: 1849739 - RNA, 18 nt, Human
aggcauguucucugagga

SEQ ID NO: 1849740 - RNA, 19 nt, Human
aggcauguucucugaggac

SEQ ID NO: 1849741 - RNA, 14 nt, Human
aggccaggcccucu

SEQ ID NO: 1849742 - RNA, 13 nt, Human
aggccaggcccuc

SEQ ID NO: 1849743 - RNA, 20 nt, Human
aggcauuccccaggaggcca

SEQ ID NO: 1849744 - RNA, 19 nt, Human
aggcauuccccaggaggcc

SEQ ID NO: 1849745 - RNA, 15 nt, Human
aggccaggcccucug

SEQ ID NO: 1849746 - RNA, 19 nt, Human
aggcccuucucuccagccc

SEQ ID NO: 1849747 - RNA, 15 nt, Human
aggcccuucucucca

SEQ ID NO: 1849748 - RNA, 12 nt, Human
aggcccuucucu

SEQ ID NO: 1849749 - RNA, 22 nt, Human
aggcccuuccucuccacugccu

SEQ ID NO: 1849750 - RNA, 23 nt, Human
aggcccucugcccacucccugca

SEQ ID NO: 1849751 - RNA, 22 nt, Human
aggcccucugcccacucccugc

SEQ ID NO: 1849752 - RNA, 14 nt, Human
agggccuggccuga

SEQ ID NO: 1849753 - RNA, 22 nt, Human
aggggcccaaauucuuucagug

SEQ ID NO: 1849754 - RNA, 22 nt, Human
agggucccugguggcagcucac

SEQ ID NO: 1849755 - RNA, 20 nt, Human
agggucccugguggcagcuc

SEQ ID NO: 1849756 - RNA, 17 nt, Human
agggucccugguggcag

SEQ ID NO: 1849757 - RNA, 16 nt, Human
agggucccugguggca

SEQ ID NO: 1849758 - RNA, 13 nt, Human
aggguauuccaga

SEQ ID NO: 1849759 - RNA, 21 nt, Human
aggguaucuggugacuuuccu

SEQ ID NO: 1849760 - RNA, 12 nt, Human
aggggccuggca

SEQ ID NO: 1849761 - RNA, 13 nt, Human
aggggccuggcag

SEQ ID NO: 1849762 - RNA, 14 nt, Human
agggucccuggugg

SEQ ID NO: 1849763 - RNA, 12 nt, Human
agggucccuggu

SEQ ID NO: 1849764 - RNA, 16 nt, Human
agggauacccauccca

SEQ ID NO: 1849765 - RNA, 13 nt, Human
agggccuggccug

SEQ ID NO: 1849766 - RNA, 12 nt, Human
agggccuggccu

SEQ ID NO: 1849767 - RNA, 15 nt, Human
agggccugcaaggga

SEQ ID NO: 1849768 - RNA, 14 nt, Human
agggccugcaaggg

SEQ ID NO: 1849769 - RNA, 20 nt, Human
agggucucacuauguugccc

SEQ ID NO: 1849770 - RNA, 22 nt, Human
aggguuuugccauguuggccag

SEQ ID NO: 1849771 - RNA, 23 nt, Human
aggguuuugccauguuggccagg

SEQ ID NO: 1849772 - RNA, 23 nt, Human
aggucccuaauaaagcugugugg

SEQ ID NO: 1849773 - RNA, 14 nt, Human
agguacucuccugg

SEQ ID NO: 1849774 - RNA, 13 nt, Human
agguacucuccug

SEQ ID NO: 1849775 - RNA, 16 nt, Human
agguaacaggcagaua

SEQ ID NO: 1849776 - RNA, 22 nt, Human
agguacgaaaagaggggaagag

SEQ ID NO: 1849777 - RNA, 13 nt, Human
agguaacaggcag

SEQ ID NO: 1849778 - RNA, 14 nt, Human
agguaacaggcaga

SEQ ID NO: 1849779 - RNA, 22 nt, Human
agcugguuuuuagcggagacgg

SEQ ID NO: 1849780 - RNA, 18 nt, Human
agcuggucccacucaguc

SEQ ID NO: 1849781 - RNA, 19 nt, Human
agcuggucccacucagucc

SEQ ID NO: 1849782 - RNA, 13 nt, Human
agcugcugacagu

SEQ ID NO: 1849783 - RNA, 14 nt, Human
agcugcugacagug

SEQ ID NO: 1849784 - RNA, 16 nt, Human
agcuggucccacucag

SEQ ID NO: 1849785 - RNA, 17 nt, Human
agcuggucccacucagu

SEQ ID NO: 1849786 - RNA, 21 nt, Human
agcugcgguccacccaggagc

SEQ ID NO: 1849787 - RNA, 12 nt, Human
agcugcugacag

SEQ ID NO: 1849788 - RNA, 19 nt, Human
agcugcgguccacccagga

SEQ ID NO: 1849789 - RNA, 20 nt, Human
agcugcgguccacccaggag

SEQ ID NO: 1849790 - RNA, 13 nt, Human
agcugcgguccac

SEQ ID NO: 1849791 - RNA, 16 nt, Human
agcugcgguccaccca

SEQ ID NO: 1849792 - RNA, 17 nt, Human
agcugcgguccacccag

SEQ ID NO: 1849793 - RNA, 18 nt, Human
agcugcgguccacccagg

SEQ ID NO: 1849794 - RNA, 15 nt, Human
agcugaaccugggua

SEQ ID NO: 1849795 - RNA, 20 nt, Human
agccugggaggucaaggcug

SEQ ID NO: 1849796 - RNA, 12 nt, Human
agccugggaggu

SEQ ID NO: 1849797 - RNA, 18 nt, Human
agccuggcuucaaauugu

SEQ ID NO: 1849798 - RNA, 17 nt, Human
agccuggcuucaaauug

SEQ ID NO: 1849799 - RNA, 22 nt, Human
agccuggcuccaaacccucgag

SEQ ID NO: 1849800 - RNA, 23 nt, Human
agcccucccugccccucccuuca

SEQ ID NO: 1849801 - RNA, 22 nt, Human
agcccucccugccccucccuuc

SEQ ID NO: 1849802 - RNA, 20 nt, Human
agccuggcuccaaacccucg

SEQ ID NO: 1849803 - RNA, 13 nt, Human
agccuggcuccaa

SEQ ID NO: 1849804 - RNA, 19 nt, Human
agcccucccugccccuccc

SEQ ID NO: 1849805 - RNA, 17 nt, Human
agcccucccugccccuc

SEQ ID NO: 1849806 - RNA, 16 nt, Human
agcccucccugccccu

SEQ ID NO: 1849807 - RNA, 15 nt, Human
agcccucccugcccc

SEQ ID NO: 1849808 - RNA, 15 nt, Human
agccuuuggaaacag

SEQ ID NO: 1849809 - RNA, 13 nt, Human
agcgagcccuggu

SEQ ID NO: 1849810 - RNA, 19 nt, Human
agcgagcccugguggcagu

SEQ ID NO: 1849811 - RNA, 14 nt, Human
agcucagagagggu

SEQ ID NO: 1849812 - RNA, 18 nt, Human
agcucagagaggguggga

SEQ ID NO: 1849813 - RNA, 12 nt, Human
agcucagagagg

SEQ ID NO: 1849814 - RNA, 19 nt, Human
agcucaccucucccuugga

SEQ ID NO: 1849815 - RNA, 18 nt, Human
agcucaccucucccuugg

SEQ ID NO: 1849816 - RNA, 15 nt, Human
agcucaccucucccu

SEQ ID NO: 1849817 - RNA, 12 nt, Human
agcucaccucuc

SEQ ID NO: 1849818 - RNA, 19 nt, Human
agcucaccagccccagugc

SEQ ID NO: 1849819 - RNA, 20 nt, Human
agcucaccagccccagugcc

SEQ ID NO: 1849820 - RNA, 16 nt, Human
agcuaaucagcauucu

SEQ ID NO: 1849821 - RNA, 21 nt, Human
agcuaaucagcauucucacuc

SEQ ID NO: 1849822 - RNA, 16 nt, Human
agcucaccagccccag

SEQ ID NO: 1849823 - RNA, 19 nt, Human
aggaacaaggcaaggcugu

SEQ ID NO: 1849824 - RNA, 17 nt, Human
aggaacaaggcaaggcu

SEQ ID NO: 1849825 - RNA, 16 nt, Human
aggaacaaggcaaggc

SEQ ID NO: 1849826 - RNA, 13 nt, Human
aggaacaaggcaa

SEQ ID NO: 1849827 - RNA, 12 nt, Human
aggaacaaggca

SEQ ID NO: 1849828 - RNA, 15 nt, Human
agcuuuuaugugaaa

SEQ ID NO: 1849829 - RNA, 23 nt, Human
aggaacaaggcaaggcugucaau

SEQ ID NO: 1849830 - RNA, 20 nt, Human
aggaacaaggcaaggcuguc

SEQ ID NO: 1849831 - RNA, 21 nt, Human
aggaacuuaaauaaugugaaa

SEQ ID NO: 1849832 - RNA, 18 nt, Human
aggaauaccugucccccu

SEQ ID NO: 1849833 - RNA, 15 nt, Human
aggaauaccuguccc

SEQ ID NO: 1849834 - RNA, 22 nt, Human
aggaauaccugucccccugaca

SEQ ID NO: 1849835 - RNA, 19 nt, Human
aggaauaaauugcuccuug

SEQ ID NO: 1849836 - RNA, 20 nt, Human
aggaauaaauugcuccuuga

SEQ ID NO: 1849837 - RNA, 23 nt, Human
aggaacuuaaauaaugugaaacu

SEQ ID NO: 1849838 - RNA, 22 nt, Human
aggaaggcugagaggagagaga

SEQ ID NO: 1849839 - RNA, 23 nt, Human
agcuuuguuuguugucagcugaa

SEQ ID NO: 1849840 - RNA, 16 nt, Human
agcuuuuaaacccuau

SEQ ID NO: 1849841 - RNA, 19 nt, Human
agcuucauuuccugugucu

SEQ ID NO: 1849842 - RNA, 18 nt, Human
agcuucauuuccuguguc

SEQ ID NO: 1849843 - RNA, 18 nt, Human
agcuucacuguaaaauaa

SEQ ID NO: 1849844 - RNA, 21 nt, Human
aggaccuguggccaaguucuu

SEQ ID NO: 1849845 - RNA, 16 nt, Human
aggaccuguggccaag

SEQ ID NO: 1849846 - RNA, 15 nt, Human
aggagaggagagggg

SEQ ID NO: 1849847 - RNA, 22 nt, Human
aggacccggaggggccuggcag

SEQ ID NO: 1849848 - RNA, 21 nt, Human
aggacccggaggggccuggca

SEQ ID NO: 1849849 - RNA, 20 nt, Human
aggacccggaggggccuggc

SEQ ID NO: 1849850 - RNA, 18 nt, Human
aggacccggaggggccug

SEQ ID NO: 1849851 - RNA, 17 nt, Human
aaacagcuaaugggaca

SEQ ID NO: 1849852 - RNA, 15 nt, Human
aaacagccugugucu

SEQ ID NO: 1849853 - RNA, 15 nt, Human
aaaauaaaaaacacu

SEQ ID NO: 1849854 - RNA, 21 nt, Human
aaaauccacuuuaucuugaau

SEQ ID NO: 1849855 - RNA, 12 nt, Human
aaaauuaagaaa

SEQ ID NO: 1849856 - RNA, 22 nt, Human
aaaauuaacaugaauauuuagu

SEQ ID NO: 1849857 - RNA, 23 nt, Human
aaaauuaaucugggccagaauuu

SEQ ID NO: 1849858 - RNA, 20 nt, Human
aaaauuaagaaaggauaaag

SEQ ID NO: 1849859 - RNA, 13 nt, Human
aaaauuaagaaag

SEQ ID NO: 1849860 - RNA, 19 nt, Human
aaaauuaggauuucaugau

SEQ ID NO: 1849861 - RNA, 15 nt, Human
aaaauuagccaagug

SEQ ID NO: 1849862 - RNA, 11 nt, Human
aaagagguuuu

SEQ ID NO: 1849863 - RNA, 15 nt, Human
aaagauacaguuacu

SEQ ID NO: 1849864 - RNA, 19 nt, Human
aaacugauuuuuuuuuccu

SEQ ID NO: 1849865 - RNA, 13 nt, Human
aaacugauuuuuu

SEQ ID NO: 1849866 - RNA, 20 nt, Human
aaacugauuuuuuuuuccuu

SEQ ID NO: 1849867 - RNA, 17 nt, Human
aaaccccaucucuacaa

SEQ ID NO: 1849868 - RNA, 21 nt, Human
aaacccugucucuacuaaaaa

SEQ ID NO: 1849869 - RNA, 14 nt, Human
aaacccuucagugc

SEQ ID NO: 1849870 - RNA, 17 nt, Human
aaacucuugaccucagg

SEQ ID NO: 1849871 - RNA, 15 nt, Human
aaagccaaagcuagg

SEQ ID NO: 1849872 - RNA, 21 nt, Human
aaaggcuccaggagcagccac

SEQ ID NO: 1849873 - RNA, 22 nt, Human
aaaggcuccaggagcagccaca

SEQ ID NO: 1849874 - RNA, 17 nt, Human
aaaggcuaccuuuguau

SEQ ID NO: 1849875 - RNA, 14 nt, Human
aaaggcuaccuuug

SEQ ID NO: 1849876 - RNA, 14 nt, Human
aaaggcuccaggag

SEQ ID NO: 1849877 - RNA, 18 nt, Human
aaagcccaaagugguaua

SEQ ID NO: 1849878 - RNA, 19 nt, Human
aaaggcagaagcaacccaa

SEQ ID NO: 1849879 - RNA, 11 nt, Human
aaauaaauuau

SEQ ID NO: 1849880 - RNA, 18 nt, Human
aacucaccccagccccaa

SEQ ID NO: 1849881 - RNA, 17 nt, Human
aacucaccccagcccca

SEQ ID NO: 1849882 - RNA, 16 nt, Human
aacucaccccagcccc

SEQ ID NO: 1849883 - RNA, 17 nt, Human
aacucaaacucuuaaaa

SEQ ID NO: 1849884 - RNA, 13 nt, Human
aacgucugugcca

SEQ ID NO: 1849885 - RNA, 15 nt, Human
aacguauaaaagccu

SEQ ID NO: 1849886 - RNA, 22 nt, Human
aacauccuacaagacacaguga

SEQ ID NO: 1849887 - RNA, 15 nt, Human
aacauccuacaagac

SEQ ID NO: 1849888 - RNA, 15 nt, Human
aacaucccuccuggg

SEQ ID NO: 1849889 - RNA, 16 nt, Human
aacagcuaaugggaca

SEQ ID NO: 1849890 - RNA, 22 nt, Human
aacaugcuacacacugcauguu

SEQ ID NO: 1849891 - RNA, 15 nt, Human
aacauggaaguacua

SEQ ID NO: 1849892 - RNA, 19 nt, Human
aaccaguguuguggauuua

SEQ ID NO: 1849893 - RNA, 13 nt, Human
aacccuucagugc

SEQ ID NO: 1849894 - RNA, 20 nt, Human
aaauguucaucaaugaauga

SEQ ID NO: 1849895 - RNA, 21 nt, Human
aaauguuuuuuuuuaaagacu

SEQ ID NO: 1849896 - RNA, 18 nt, Human
aaauguuuuuuuuuaaag

SEQ ID NO: 1849897 - RNA, 18 nt, Human
aaauugaugggauuuggu

SEQ ID NO: 1849898 - RNA, 13 nt, Human
aaauuaacuuuua

SEQ ID NO: 1849899 - RNA, 14 nt, Human
aaauuaacuuuuau

SEQ ID NO: 1849900 - RNA, 22 nt, Human
aaauugacacuuaaaaaugguu

SEQ ID NO: 1849901 - RNA, 12 nt, Human
aaauuaacuuuu

SEQ ID NO: 1849902 - RNA, 22 nt, Human
aaauguuuuuuuuuaaagacuu

SEQ ID NO: 1849903 - RNA, 19 nt, Human
aacaccucugcacaagcug

SEQ ID NO: 1849904 - RNA, 17 nt, Human
aacacuaacaugauuug

SEQ ID NO: 1849905 - RNA, 21 nt, Human
aacacauacaggaagguagaa

SEQ ID NO: 1849906 - RNA, 22 nt, Human
aacaaaccuguuucugcagcca

SEQ ID NO: 1849907 - RNA, 14 nt, Human
aaauggacguguua

SEQ ID NO: 1849908 - RNA, 17 nt, Human
aaauggacguguuauga

SEQ ID NO: 1849909 - RNA, 15 nt, Human
aaauggacguguuau

SEQ ID NO: 1849910 - RNA, 22 nt, Human
aaaucuccaaaauaaaacuuuu

SEQ ID NO: 1849911 - RNA, 18 nt, Human
aaaucugcuuuuuaaaga

SEQ ID NO: 1849912 - RNA, 18 nt, Human
aaguugauggugaugaaa

SEQ ID NO: 1849913 - RNA, 12 nt, Human
aauaaaauuuuu

SEQ ID NO: 1849914 - RNA, 10 nt, Human
aauaaaccau

SEQ ID NO: 1849915 - RNA, 19 nt, Human
aauaaagcuguguggcagu

SEQ ID NO: 1849916 - RNA, 11 nt, Human
aauaaagcugu

SEQ ID NO: 1849917 - RNA, 15 nt, Human
aaguggggacagagc

SEQ ID NO: 1849918 - RNA, 22 nt, Human
aaguucuuaguugcuguauguc

SEQ ID NO: 1849919 - RNA, 15 nt, Human
aaguucuuaguugcu

SEQ ID NO: 1849920 - RNA, 14 nt, Human
aagugcugcauuua

SEQ ID NO: 1849921 - RNA, 13 nt, Human
aagugcugcauuu

SEQ ID NO: 1849922 - RNA, 16 nt, Human
aauauaggaacuuaaa

SEQ ID NO: 1849923 - RNA, 17 nt, Human
aauagaaauggggaacu

SEQ ID NO: 1849924 - RNA, 16 nt, Human
aauagaaauccaauug

SEQ ID NO: 1849925 - RNA, 21 nt, Human
aaugcgugcauaccacuuuug

SEQ ID NO: 1849926 - RNA, 23 nt, Human
aaugcgugcauaccacuuuuguu

SEQ ID NO: 1849927 - RNA, 14 nt, Human
aaugcgcaggcugg

SEQ ID NO: 1849928 - RNA, 15 nt, Human
aaugcgcaggcuggc

SEQ ID NO: 1849929 - RNA, 20 nt, Human
aaugcgcaggcuggcccugc

SEQ ID NO: 1849930 - RNA, 19 nt, Human
aaugcgcaggcuggcccug

SEQ ID NO: 1849931 - RNA, 18 nt, Human
aaugcgcaggcuggcccu

SEQ ID NO: 1849932 - RNA, 17 nt, Human
aaugcgcaggcuggccc

SEQ ID NO: 1849933 - RNA, 15 nt, Human
aaugggggugcauuu

SEQ ID NO: 1849934 - RNA, 17 nt, Human
aaugggggugcauuuga

SEQ ID NO: 1849935 - RNA, 14 nt, Human
aaugggagcucaug

SEQ ID NO: 1849936 - RNA, 13 nt, Human
aaugggacacuaa

SEQ ID NO: 1849937 - RNA, 23 nt, Human
aaugcucuuuacuucauggacuu

SEQ ID NO: 1849938 - RNA, 13 nt, Human
aaugauuaauuaa

SEQ ID NO: 1849939 - RNA, 12 nt, Human
aaugauuaauua

SEQ ID NO: 1849940 - RNA, 16 nt, Human
aaugauuaauuaaaac

SEQ ID NO: 1849941 - RNA, 23 nt, Human
aaugauguauguugaagccuuug

SEQ ID NO: 1849942 - RNA, 15 nt, Human
aaugauagcuacugu

SEQ ID NO: 1849943 - RNA, 23 nt, Human
aaucucgcucugucgcccaggcu

SEQ ID NO: 1849944 - RNA, 18 nt, Human
aaucucggcucacugcau

SEQ ID NO: 1849945 - RNA, 20 nt, Human
aaucuggacuccucugucca

SEQ ID NO: 1849946 - RNA, 18 nt, Human
aaucuggacuccucuguc

SEQ ID NO: 1849947 - RNA, 17 nt, Human
aaucuggacuccucugu

SEQ ID NO: 1849948 - RNA, 16 nt, Human
aaucuggacuccucug

SEQ ID NO: 1849949 - RNA, 15 nt, Human
aaucuggacuccucu

SEQ ID NO: 1849950 - RNA, 18 nt, Human
aauccaccugccucggcc

SEQ ID NO: 1849951 - RNA, 19 nt, Human
aauccaccugccucggccu

SEQ ID NO: 1849952 - RNA, 21 nt, Human
aagccaccaacauacucccau

SEQ ID NO: 1849953 - RNA, 18 nt, Human
aagccagcaggcucucag

SEQ ID NO: 1849954 - RNA, 19 nt, Human
aagccagcaggcucucagg

SEQ ID NO: 1849955 - RNA, 15 nt, Human
aagccagcaggcucu

SEQ ID NO: 1849956 - RNA, 15 nt, Human
aagcgauucuucugc

SEQ ID NO: 1849957 - RNA, 14 nt, Human
aagcgauucuucug

SEQ ID NO: 1849958 - RNA, 16 nt, Human
aagcgauucuucugcu

SEQ ID NO: 1849959 - RNA, 17 nt, Human
aagcgauucuucugcuu

SEQ ID NO: 1849960 - RNA, 16 nt, Human
aagcugcugacagugu

SEQ ID NO: 1849961 - RNA, 23 nt, Human
aaggaaugauuaauuaaaacaca

SEQ ID NO: 1849962 - RNA, 21 nt, Human
aagcgugagccacugcaccgg

SEQ ID NO: 1849963 - RNA, 17 nt, Human
aagcgugagccacugca

SEQ ID NO: 1849964 - RNA, 20 nt, Human
aagcgugagccacugcaccg

SEQ ID NO: 1849965 - RNA, 12 nt, Human
aagcugccagcc

SEQ ID NO: 1849966 - RNA, 11 nt, Human
aagcugccagc

SEQ ID NO: 1849967 - RNA, 22 nt, Human
aagcugccagccgagauagcca

SEQ ID NO: 1849968 - RNA, 14 nt, Human
aagcugcugacagu

SEQ ID NO: 1849969 - RNA, 13 nt, Human
aaggacuaggguc

SEQ ID NO: 1849970 - RNA, 12 nt, Human
aaggaauuuuau

SEQ ID NO: 1849971 - RNA, 22 nt, Human
aaggacccggaggggccuggca

SEQ ID NO: 1849972 - RNA, 12 nt, Human
aaguagaggagg

SEQ ID NO: 1849973 - RNA, 17 nt, Human
aagggacugagaaauuu

SEQ ID NO: 1849974 - RNA, 15 nt, Human
aagggacugagaaau

SEQ ID NO: 1849975 - RNA, 20 nt, Human
aagggacuuggaagcuccgc

SEQ ID NO: 1849976 - RNA, 15 nt, Human
aagacuuuuaugaua

SEQ ID NO: 1849977 - RNA, 14 nt, Human
aacuuacuuagugu

SEQ ID NO: 1849978 - RNA, 16 nt, Human
aagacuuuggaaagag

SEQ ID NO: 1849979 - RNA, 23 nt, Human
aagacagugaaagaaaauaacaa

SEQ ID NO: 1849980 - RNA, 15 nt, Human
aagcagggacuugaa

SEQ ID NO: 1849981 - RNA, 19 nt, Human
aagccaccaacauacuccc

SEQ ID NO: 1849982 - RNA, 19 nt, Human
aagauuuugaaauuuuuau

SEQ ID NO: 1849983 - RNA, 17 nt, Human
aagauucaaucccagga

SEQ ID NO: 1849984 - RNA, 20 nt, Human
aagauucauauuuacuucuu

SEQ ID NO: 1849985 - RNA, 23 nt, Human
accaucauugaaaucuuuuugcu

SEQ ID NO: 1849986 - RNA, 16 nt, Human
accaucccugaaggcc

SEQ ID NO: 1849987 - RNA, 15 nt, Human
accaucaagccacca

SEQ ID NO: 1849988 - RNA, 15 nt, Human
accaucauugaaauc

SEQ ID NO: 1849989 - RNA, 12 nt, Human
accaucauugaa

SEQ ID NO: 1849990 - RNA, 14 nt, Human
accaucaagccacc

SEQ ID NO: 1849991 - RNA, 17 nt, Human
accauaggucaccuuua

SEQ ID NO: 1849992 - RNA, 21 nt, Human
accauacuaauuauacccccu

SEQ ID NO: 1849993 - RNA, 16 nt, Human
accauacuaauuauac

SEQ ID NO: 1849994 - RNA, 13 nt, Human
accauacuaauua

SEQ ID NO: 1849995 - RNA, 15 nt, Human
acccacccccaccca

SEQ ID NO: 1849996 - RNA, 17 nt, Human
acccacccccacccaag

SEQ ID NO: 1849997 - RNA, 13 nt, Human
acccaugcugccc

SEQ ID NO: 1849998 - RNA, 15 nt, Human
acccacccuccuuuc

SEQ ID NO: 1849999 - RNA, 19 nt, Human
acaugccucucucaggcca

SEQ ID NO: 1850000 - RNA, 23 nt, Human
acaugucuuuucuugcaugaggc

SEQ ID NO: 1850001 - RNA, 17 nt, Human
acauuuccuaaauauau

SEQ ID NO: 1850002 - RNA, 16 nt, Human
acauuuccuaaauaua

SEQ ID NO: 1850003 - RNA, 13 nt, Human
accagcagagcac

SEQ ID NO: 1850004 - RNA, 12 nt, Human
accagcagagca

SEQ ID NO: 1850005 - RNA, 14 nt, Human
accagcagaaaugc

SEQ ID NO: 1850006 - RNA, 16 nt, Human
accagccccagugccc

SEQ ID NO: 1850007 - RNA, 17 nt, Human
accagccccagugccca

SEQ ID NO: 1850008 - RNA, 18 nt, Human
accagccccagugcccac

SEQ ID NO: 1850009 - RNA, 19 nt, Human
accagccccagugcccaca

SEQ ID NO: 1850010 - RNA, 20 nt, Human
accagccccagugcccacag

SEQ ID NO: 1850011 - RNA, 12 nt, Human
accaccugccca

SEQ ID NO: 1850012 - RNA, 20 nt, Human
accaaggcugauuaaaccaa

SEQ ID NO: 1850013 - RNA, 19 nt, Human
accaaggcugauuaaacca

SEQ ID NO: 1850014 - RNA, 13 nt, Human
acagcugccuggg

SEQ ID NO: 1850015 - RNA, 16 nt, Human
acagcugccugcagua

SEQ ID NO: 1850016 - RNA, 12 nt, Human
acagcugccugc

SEQ ID NO: 1850017 - RNA, 20 nt, Human
acaggcaagcaccuccugcc

SEQ ID NO: 1850018 - RNA, 23 nt, Human
acaggcaagcaccuccugccucg

SEQ ID NO: 1850019 - RNA, 16 nt, Human
acagcucuguccuggg

SEQ ID NO: 1850020 - RNA, 17 nt, Human
acagcucuguccuggga

SEQ ID NO: 1850021 - RNA, 21 nt, Human
acagaggggguggccucccaa

SEQ ID NO: 1850022 - RNA, 19 nt, Human
acagaggggguggccuccc

SEQ ID NO: 1850023 - RNA, 18 nt, Human
acagaggggguggccucc

SEQ ID NO: 1850024 - RNA, 17 nt, Human
acagaggggguggccuc

SEQ ID NO: 1850025 - RNA, 16 nt, Human
acagcuccuucugucc

SEQ ID NO: 1850026 - RNA, 18 nt, Human
acagcuccuucuguccua

SEQ ID NO: 1850027 - RNA, 23 nt, Human
acagcuccuucuguccuacucug

SEQ ID NO: 1850028 - RNA, 14 nt, Human
acagcucuguccug

SEQ ID NO: 1850029 - RNA, 22 nt, Human
acagugagucgaggacagggag

SEQ ID NO: 1850030 - RNA, 19 nt, Human
acaggugugaaccaccaca

SEQ ID NO: 1850031 - RNA, 22 nt, Human
acaggugugagucaccaagccc

SEQ ID NO: 1850032 - RNA, 23 nt, Human
acaggugugagucaccaagccca

SEQ ID NO: 1850033 - RNA, 14 nt, Human
acaggcaaugcugg

SEQ ID NO: 1850034 - RNA, 15 nt, Human
acaguguacagucuu

SEQ ID NO: 1850035 - RNA, 17 nt, Human
acaguguacagucuugu

SEQ ID NO: 1850036 - RNA, 18 nt, Human
acaguguacagucuugua

SEQ ID NO: 1850037 - RNA, 12 nt, Human
acaguguacagu

SEQ ID NO: 1850038 - RNA, 13 nt, Human
acaguguacaguc

SEQ ID NO: 1850039 - RNA, 21 nt, Human
acagugauuaccagggacuga

SEQ ID NO: 1850040 - RNA, 20 nt, Human
acagugauuaccagggacug

SEQ ID NO: 1850041 - RNA, 23 nt, Human
acagugagucgaggacagggagg

SEQ ID NO: 1850042 - RNA, 20 nt, Human
acauaauucaggaagcagcu

SEQ ID NO: 1850043 - RNA, 16 nt, Human
acauaagauaaaugug

SEQ ID NO: 1850044 - RNA, 18 nt, Human
acaugccucucucaggcc

SEQ ID NO: 1850045 - RNA, 17 nt, Human
acaugccucucucaggc

SEQ ID NO: 1850046 - RNA, 16 nt, Human
acaugccucucucagg

SEQ ID NO: 1850047 - RNA, 15 nt, Human
acaugccucucucag

SEQ ID NO: 1850048 - RNA, 18 nt, Human
acaugcaaggucauuuuu

SEQ ID NO: 1850049 - RNA, 17 nt, Human
acaugcaaggucauuuu

SEQ ID NO: 1850050 - RNA, 16 nt, Human
acaugcaaggucauuu

SEQ ID NO: 1850051 - RNA, 15 nt, Human
acauccuacaagaca

SEQ ID NO: 1850052 - RNA, 20 nt, Human
acacugggagaaaugaaaaa

SEQ ID NO: 1850053 - RNA, 17 nt, Human
acacugugcugagucug

SEQ ID NO: 1850054 - RNA, 22 nt, Human
acacugugcugagucugaaggc

SEQ ID NO: 1850055 - RNA, 13 nt, Human
acagaggcagccc

SEQ ID NO: 1850056 - RNA, 17 nt, Human
acagaggccaugggccu

SEQ ID NO: 1850057 - RNA, 21 nt, Human
acagaggccaugggccuccug

SEQ ID NO: 1850058 - RNA, 23 nt, Human
acagaggccaugggccuccugug

SEQ ID NO: 1850059 - RNA, 14 nt, Human
acagacaaagcgug

SEQ ID NO: 1850060 - RNA, 21 nt, Human
acacgaauauugcugauggug

SEQ ID NO: 1850061 - RNA, 15 nt, Human
acacgaauauugcug

SEQ ID NO: 1850062 - RNA, 21 nt, Human
acaccacuacauucuguuaau

SEQ ID NO: 1850063 - RNA, 16 nt, Human
acacauuuuuuaaaug

SEQ ID NO: 1850064 - RNA, 18 nt, Human
acacauuuuuuaaaugca

SEQ ID NO: 1850065 - RNA, 19 nt, Human
acacauuuuuuaaaugcac

SEQ ID NO: 1850066 - RNA, 15 nt, Human
acaccacuacauucu

SEQ ID NO: 1850067 - RNA, 14 nt, Human
acacgaauauugcu

SEQ ID NO: 1850068 - RNA, 12 nt, Human
acacgaauauug

SEQ ID NO: 1850069 - RNA, 17 nt, Human
acaccacuacauucugu

SEQ ID NO: 1850070 - RNA, 20 nt, Human
acaccacuacauucuguuaa

SEQ ID NO: 1850071 - RNA, 19 nt, Human
acacagcucuucuccaggc

SEQ ID NO: 1850072 - RNA, 19 nt, Human
acacaaaaguuucucuuuu

SEQ ID NO: 1850073 - RNA, 14 nt, Human
acacauuuuuuaaa

SEQ ID NO: 1850074 - RNA, 22 nt, Human
acacagcucuucuccaggcugu

SEQ ID NO: 1850075 - RNA, 20 nt, Human
acacagcucuucuccaggcu

SEQ ID NO: 1850076 - RNA, 21 nt, Human
acacagcucuucuccaggcug

SEQ ID NO: 1850077 - RNA, 20 nt, Human
acaaggaugaucuaggaaga

SEQ ID NO: 1850078 - RNA, 16 nt, Human
acaaggauugcuacug

SEQ ID NO: 1850079 - RNA, 14 nt, Human
acaauuuauuaugg

SEQ ID NO: 1850080 - RNA, 13 nt, Human
acaauuuauuaug

SEQ ID NO: 1850081 - RNA, 12 nt, Human
aauuguaaggaa

SEQ ID NO: 1850082 - RNA, 16 nt, Human
aauuguaaggaaugau

SEQ ID NO: 1850083 - RNA, 16 nt, Human
aaugucacaggcaggu

SEQ ID NO: 1850084 - RNA, 19 nt, Human
aaugucacaggcaggucca

SEQ ID NO: 1850085 - RNA, 20 nt, Human
aauuuauuuaugggauccug

SEQ ID NO: 1850086 - RNA, 15 nt, Human
acaagaaaugaaagc

SEQ ID NO: 1850087 - RNA, 16 nt, Human
acaagaaaugaaagca

SEQ ID NO: 1850088 - RNA, 18 nt, Human
acaaccuucuguggcuca

SEQ ID NO: 1850089 - RNA, 22 nt, Human
acaaaaugaaacgcaaccacca

SEQ ID NO: 1850090 - RNA, 13 nt, Human
acaaaaugaaacg

SEQ ID NO: 1850091 - RNA, 16 nt, Human
acaaagaaauuaugug

SEQ ID NO: 1850092 - RNA, 14 nt, Human
acaaagaaauuaug

SEQ ID NO: 1850093 - RNA, 12 nt, Human
acaaagaaauua

SEQ ID NO: 1850094 - RNA, 18 nt, Human
aauuuucaucuaggauuu

SEQ ID NO: 1850095 - RNA, 14 nt, Human
aauuuugauguuuu

SEQ ID NO: 1850096 - RNA, 16 nt, Human
aauuuugugcccccau

SEQ ID NO: 1850097 - RNA, 15 nt, Human
acugcccggcagggu

SEQ ID NO: 1850098 - RNA, 18 nt, Human
acugccagucccccugcc

SEQ ID NO: 1850099 - RNA, 19 nt, Human
acugccagucccccugccc

SEQ ID NO: 1850100 - RNA, 16 nt, Human
acugcuuuuggucugu

SEQ ID NO: 1850101 - RNA, 20 nt, Human
acugcuuuuggucuguguga

SEQ ID NO: 1850102 - RNA, 22 nt, Human
acugcccggcaggguccuagaa

SEQ ID NO: 1850103 - RNA, 15 nt, Human
acugcuuuuggucug

SEQ ID NO: 1850104 - RNA, 14 nt, Human
acuauuuuucagaa

SEQ ID NO: 1850105 - RNA, 20 nt, Human
acucuacuuagcaugucccu

SEQ ID NO: 1850106 - RNA, 21 nt, Human
acucuacuuagcaugucccua

SEQ ID NO: 1850107 - RNA, 19 nt, Human
acucugucucaaaaaaaca

SEQ ID NO: 1850108 - RNA, 15 nt, Human
acucugucucagucc

SEQ ID NO: 1850109 - RNA, 17 nt, Human
acucugucucaguccau

SEQ ID NO: 1850110 - RNA, 21 nt, Human
acucugugucagguggggcag

SEQ ID NO: 1850111 - RNA, 19 nt, Human
acucugugucagguggggc

SEQ ID NO: 1850112 - RNA, 22 nt, Human
acugauuuuuuuuuccuucagu

SEQ ID NO: 1850113 - RNA, 21 nt, Human
acugauuuuuuuuuccuucag

SEQ ID NO: 1850114 - RNA, 23 nt, Human
acugauuuuuuuuuccuucagug

SEQ ID NO: 1850115 - RNA, 13 nt, Human
acugaccagccuc

SEQ ID NO: 1850116 - RNA, 20 nt, Human
acugaccagccuccaugcug

SEQ ID NO: 1850117 - RNA, 15 nt, Human
acugaccagccucca

SEQ ID NO: 1850118 - RNA, 22 nt, Human
acugaccaauauuguacaguuu

SEQ ID NO: 1850119 - RNA, 20 nt, Human
acugaccaauauuguacagu

SEQ ID NO: 1850120 - RNA, 21 nt, Human
acugaccaauauuguacaguu

SEQ ID NO: 1850121 - RNA, 22 nt, Human
acugacauuguuggccaaagcc

SEQ ID NO: 1850122 - RNA, 23 nt, Human
acugacauuguuggccaaagcca

SEQ ID NO: 1850123 - RNA, 13 nt, Human
acugaucucucgu

SEQ ID NO: 1850124 - RNA, 23 nt, Human
acugaccagccuccaugcugccu

SEQ ID NO: 1850125 - RNA, 22 nt, Human
acugauggcuaauguacugcau

SEQ ID NO: 1850126 - RNA, 12 nt, Human
acugaugggcaa

SEQ ID NO: 1850127 - RNA, 22 nt, Human
acugaugggcaacccccagccu

SEQ ID NO: 1850128 - RNA, 22 nt, Human
acuuucaggccacauggcuaaa

SEQ ID NO: 1850129 - RNA, 12 nt, Human
acuuuaugcuaa

SEQ ID NO: 1850130 - RNA, 17 nt, Human
acuuuaugcuaagugaa

SEQ ID NO: 1850131 - RNA, 15 nt, Human
acuuuauuuuguguu

SEQ ID NO: 1850132 - RNA, 22 nt, Human
acuugggaggcugagaugggag

SEQ ID NO: 1850133 - RNA, 14 nt, Human
acuuaaauaaugug

SEQ ID NO: 1850134 - RNA, 22 nt, Human
acuuaaaauauuccugcauuug

SEQ ID NO: 1850135 - RNA, 21 nt, Human
acuuaaaaaugguuuaaaugg

SEQ ID NO: 1850136 - RNA, 20 nt, Human
acuuaaaauauuccugcauu

SEQ ID NO: 1850137 - RNA, 13 nt, Human
acuuaaaaauggu

SEQ ID NO: 1850138 - RNA, 14 nt, Human
acuuaaaaaugguu

SEQ ID NO: 1850139 - RNA, 18 nt, Human
acuucuuauacauuugau

SEQ ID NO: 1850140 - RNA, 17 nt, Human
acuucuuauacauuuga

SEQ ID NO: 1850141 - RNA, 13 nt, Human
acuucugccucuu

SEQ ID NO: 1850142 - RNA, 13 nt, Human
acuucagcucugu

SEQ ID NO: 1850143 - RNA, 20 nt, Human
acuucugccauauucuguug

SEQ ID NO: 1850144 - RNA, 17 nt, Human
accucuugagccuugaa

SEQ ID NO: 1850145 - RNA, 19 nt, Human
accucuugagccuugaacu

SEQ ID NO: 1850146 - RNA, 20 nt, Human
accucuugagccuugaacuu

SEQ ID NO: 1850147 - RNA, 21 nt, Human
accucuugagccuugaacuuu

SEQ ID NO: 1850148 - RNA, 11 nt, Human
accugccaggg

SEQ ID NO: 1850149 - RNA, 13 nt, Human
accugccagggac

SEQ ID NO: 1850150 - RNA, 12 nt, Human
accugccaggga

SEQ ID NO: 1850151 - RNA, 18 nt, Human
accugccagggacagagg

SEQ ID NO: 1850152 - RNA, 16 nt, Human
accugccagggacaga

SEQ ID NO: 1850153 - RNA, 15 nt, Human
accugccagggacag

SEQ ID NO: 1850154 - RNA, 23 nt, Human
accugccccuccucucugcccua

SEQ ID NO: 1850155 - RNA, 18 nt, Human
accucaggugagaagcag

SEQ ID NO: 1850156 - RNA, 23 nt, Human
accucagguaaucgaccugccuc

SEQ ID NO: 1850157 - RNA, 13 nt, Human
accucaggccugg

SEQ ID NO: 1850158 - RNA, 12 nt, Human
accucaggccug

SEQ ID NO: 1850159 - RNA, 17 nt, Human
accgugaggccagagac

SEQ ID NO: 1850160 - RNA, 16 nt, Human
accgugaggccagaga

SEQ ID NO: 1850161 - RNA, 22 nt, Human
accucaggccugggggcugggc

SEQ ID NO: 1850162 - RNA, 14 nt, Human
accucaggccuggg

SEQ ID NO: 1850163 - RNA, 22 nt, Human
accucagguaaucgaccugccu

SEQ ID NO: 1850164 - RNA, 15 nt, Human
accggcuggccuggc

SEQ ID NO: 1850165 - RNA, 14 nt, Human
accggcuggccugg

SEQ ID NO: 1850166 - RNA, 18 nt, Human
accggcuggccuggcccc

SEQ ID NO: 1850167 - RNA, 17 nt, Human
accggcuggccuggccc

SEQ ID NO: 1850168 - RNA, 19 nt, Human
accggcuggccuggccccu

SEQ ID NO: 1850169 - RNA, 20 nt, Human
accgggcacucagaagacac

SEQ ID NO: 1850170 - RNA, 14 nt, Human
accgugaggccaga

SEQ ID NO: 1850171 - RNA, 20 nt, Human
accgggccacagagaaagua

SEQ ID NO: 1850172 - RNA, 15 nt, Human
accgggccacagaga

SEQ ID NO: 1850173 - RNA, 19 nt, Human
accgggccacagagaaagu

SEQ ID NO: 1850174 - RNA, 16 nt, Human
accccacacacgccag

SEQ ID NO: 1850175 - RNA, 22 nt, Human
acccugugauggggcccugccu

SEQ ID NO: 1850176 - RNA, 15 nt, Human
acccaugcugcccug

SEQ ID NO: 1850177 - RNA, 14 nt, Human
acccaugcugcccu

SEQ ID NO: 1850178 - RNA, 16 nt, Human
acccaugcugcccugu

SEQ ID NO: 1850179 - RNA, 17 nt, Human
acccuguuaccauuuug

SEQ ID NO: 1850180 - RNA, 14 nt, Human
acuaaucuuucugc

SEQ ID NO: 1850181 - RNA, 17 nt, Human
acuagggaagauaauau

SEQ ID NO: 1850182 - RNA, 16 nt, Human
acuauuguuagucucu

SEQ ID NO: 1850183 - RNA, 17 nt, Human
acuauugcuugcacaaa

SEQ ID NO: 1850184 - RNA, 11 nt, Human
accugugucuc

SEQ ID NO: 1850185 - RNA, 18 nt, Human
accuguggccaaguucuu

SEQ ID NO: 1850186 - RNA, 19 nt, Human
accuguggccaaguucuua

SEQ ID NO: 1850187 - RNA, 19 nt, Human
acgcuggagugcagugagc

SEQ ID NO: 1850188 - RNA, 16 nt, Human
acggaagagccuugcg

SEQ ID NO: 1850189 - RNA, 15 nt, Human
acggaagagccuugc

SEQ ID NO: 1850190 - RNA, 19 nt, Human
acggacgaaccuugaaaac

SEQ ID NO: 1850191 - RNA, 15 nt, Human
acggaauaguuggcu

SEQ ID NO: 1850192 - RNA, 11 nt, Human
acguggcugcu

SEQ ID NO: 1850193 - RNA, 15 nt, Human
acuaauagacaauuu

SEQ ID NO: 1850194 - RNA, 23 nt, Human
acgucugacaggcaaugcuggcu

SEQ ID NO: 1850195 - RNA, 20 nt, Human
cucgggauuaguacacacuu

SEQ ID NO: 1850196 - RNA, 14 nt, Human
cucucacuccuuga

SEQ ID NO: 1850197 - RNA, 12 nt, Human
cucucacuccuu

SEQ ID NO: 1850198 - RNA, 19 nt, Human
cucucagauuguaccauug

SEQ ID NO: 1850199 - RNA, 15 nt, Human
cucucacuccuugaa

SEQ ID NO: 1850200 - RNA, 12 nt, Human
cucucuggccuu

SEQ ID NO: 1850201 - RNA, 11 nt, Human
cucucuggccu

SEQ ID NO: 1850202 - RNA, 15 nt, Human
cucugaaggacauug

SEQ ID NO: 1850203 - RNA, 21 nt, Human
cucuccgaccagacaccuuga

SEQ ID NO: 1850204 - RNA, 14 nt, Human
cucugcacuccccu

SEQ ID NO: 1850205 - RNA, 23 nt, Human
cucugcagcaauaaagcagcguu

SEQ ID NO: 1850206 - RNA, 18 nt, Human
cucugcagcaauaaagca

SEQ ID NO: 1850207 - RNA, 19 nt, Human
cucugcagcaauaaagcag

SEQ ID NO: 1850208 - RNA, 18 nt, Human
cucugguccauagagagc

SEQ ID NO: 1850209 - RNA, 16 nt, Human
cucugguccauagaga

SEQ ID NO: 1850210 - RNA, 19 nt, Human
cucugguccauagagagca

SEQ ID NO: 1850211 - RNA, 14 nt, Human
cucugguuccuccc

SEQ ID NO: 1850212 - RNA, 17 nt, Human
cucugcugacagacaca

SEQ ID NO: 1850213 - RNA, 18 nt, Human
cucugcugacagacacag

SEQ ID NO: 1850214 - RNA, 19 nt, Human
cucugcugacagacacagg

SEQ ID NO: 1850215 - RNA, 15 nt, Human
cucugguccauagag

SEQ ID NO: 1850216 - RNA, 21 nt, Human
cucuguacagagcccacgccc

SEQ ID NO: 1850217 - RNA, 17 nt, Human
cucuguacagagcccac

SEQ ID NO: 1850218 - RNA, 16 nt, Human
cucuugccacugccuc

SEQ ID NO: 1850219 - RNA, 20 nt, Human
cucuugccacugccucuucc

SEQ ID NO: 1850220 - RNA, 19 nt, Human
cucuugccacugccucuuc

SEQ ID NO: 1850221 - RNA, 18 nt, Human
cucuugccacugccucuu

SEQ ID NO: 1850222 - RNA, 17 nt, Human
cucuugccacugccucu

SEQ ID NO: 1850223 - RNA, 16 nt, Human
cugaaaauguaugugu

SEQ ID NO: 1850224 - RNA, 22 nt, Human
cugaaggaauaaauugcuccuu

SEQ ID NO: 1850225 - RNA, 18 nt, Human
cugaaggccccgcccagg

SEQ ID NO: 1850226 - RNA, 17 nt, Human
cugaaggccccgcccag

SEQ ID NO: 1850227 - RNA, 14 nt, Human
cugaaggccccgcc

SEQ ID NO: 1850228 - RNA, 13 nt, Human
cugaaggccccgc

SEQ ID NO: 1850229 - RNA, 19 nt, Human
cugaaggacauugcggaca

SEQ ID NO: 1850230 - RNA, 20 nt, Human
cugaaggacauugcggacag

SEQ ID NO: 1850231 - RNA, 21 nt, Human
cugaaggacauugcggacagc

SEQ ID NO: 1850232 - RNA, 15 nt, Human
cugacagacacaggc

SEQ ID NO: 1850233 - RNA, 12 nt, Human
cugacagacaca

SEQ ID NO: 1850234 - RNA, 14 nt, Human
cugacagacacagg

SEQ ID NO: 1850235 - RNA, 14 nt, Human
cugacagaaggacu

SEQ ID NO: 1850236 - RNA, 20 nt, Human
cugacccaugcugcccugug

SEQ ID NO: 1850237 - RNA, 19 nt, Human
cugacccaugcugcccugu

SEQ ID NO: 1850238 - RNA, 17 nt, Human
cugacccaugcugcccu

SEQ ID NO: 1850239 - RNA, 18 nt, Human
cugacccaugcugcccug

SEQ ID NO: 1850240 - RNA, 23 nt, Human
cugacccugcuucaaauauuucc

SEQ ID NO: 1850241 - RNA, 15 nt, Human
cuccgccucccgggu

SEQ ID NO: 1850242 - RNA, 19 nt, Human
cuccgcuuucuacccagcg

SEQ ID NO: 1850243 - RNA, 12 nt, Human
cucccaccucag

SEQ ID NO: 1850244 - RNA, 13 nt, Human
cucccaccucagc

SEQ ID NO: 1850245 - RNA, 21 nt, Human
cuccagugagacagcucugca

SEQ ID NO: 1850246 - RNA, 19 nt, Human
cuccagacacauguccaag

SEQ ID NO: 1850247 - RNA, 17 nt, Human
cuccagacacaugucca

SEQ ID NO: 1850248 - RNA, 18 nt, Human
cuccagaauuucccaaag

SEQ ID NO: 1850249 - RNA, 15 nt, Human
cuccagaauuuccca

SEQ ID NO: 1850250 - RNA, 22 nt, Human
cuccacuuucuagccagaggag

SEQ ID NO: 1850251 - RNA, 21 nt, Human
cuccaagaccuucuccuucac

SEQ ID NO: 1850252 - RNA, 18 nt, Human
cuccaagaccuucuccuu

SEQ ID NO: 1850253 - RNA, 17 nt, Human
cuccaagaccuucuccu

SEQ ID NO: 1850254 - RNA, 16 nt, Human
cuccaagaccuucucc

SEQ ID NO: 1850255 - RNA, 11 nt, Human
cuccaggugca

SEQ ID NO: 1850256 - RNA, 12 nt, Human
cucauguucuua

SEQ ID NO: 1850257 - RNA, 14 nt, Human
cucauguucuuaau

SEQ ID NO: 1850258 - RNA, 18 nt, Human
cucauguucuuaauucuu

SEQ ID NO: 1850259 - RNA, 19 nt, Human
cucauguucuuaauucuua

SEQ ID NO: 1850260 - RNA, 20 nt, Human
cucaugccucagccuccuga

SEQ ID NO: 1850261 - RNA, 18 nt, Human
cucaugccucagccuccu

SEQ ID NO: 1850262 - RNA, 16 nt, Human
cuccaaagucucugga

SEQ ID NO: 1850263 - RNA, 13 nt, Human
cucagugccacua

SEQ ID NO: 1850264 - RNA, 18 nt, Human
cucagucuggcccuuccu

SEQ ID NO: 1850265 - RNA, 17 nt, Human
cucagucuggcccuucc

SEQ ID NO: 1850266 - RNA, 21 nt, Human
cucaggccugggggcugggca

SEQ ID NO: 1850267 - RNA, 20 nt, Human
cucaggccugggggcugggc

SEQ ID NO: 1850268 - RNA, 14 nt, Human
cucaggccuggggg

SEQ ID NO: 1850269 - RNA, 13 nt, Human
cucaggccugggg

SEQ ID NO: 1850270 - RNA, 22 nt, Human
cucagccucccaaagugcuggg

SEQ ID NO: 1850271 - RNA, 13 nt, Human
cucagccucccga

SEQ ID NO: 1850272 - RNA, 23 nt, Human
cucagccucccgaauagcuggga

SEQ ID NO: 1850273 - RNA, 17 nt, Human
cuaucccggcugcccuu

SEQ ID NO: 1850274 - RNA, 21 nt, Human
cucagccucccaaagugcugg

SEQ ID NO: 1850275 - RNA, 14 nt, Human
cucagccucccaaa

SEQ ID NO: 1850276 - RNA, 16 nt, Human
cucagccucccaaagu

SEQ ID NO: 1850277 - RNA, 16 nt, Human
cuaucccggcugcccu

SEQ ID NO: 1850278 - RNA, 15 nt, Human
cuaucccggcugccc

SEQ ID NO: 1850279 - RNA, 13 nt, Human
cucagccucccaa

SEQ ID NO: 1850280 - RNA, 13 nt, Human
cucagccuccuga

SEQ ID NO: 1850281 - RNA, 12 nt, Human
cucagccuccug

SEQ ID NO: 1850282 - RNA, 14 nt, Human
cucagccuccugag

SEQ ID NO: 1850283 - RNA, 22 nt, Human
cucagccuccugaguagcugga

SEQ ID NO: 1850284 - RNA, 22 nt, Human
cucaggccagcugcuugggcuu

SEQ ID NO: 1850285 - RNA, 21 nt, Human
cucaggccagcugcuugggcu

SEQ ID NO: 1850286 - RNA, 15 nt, Human
cucaggccagcugcu

SEQ ID NO: 1850287 - RNA, 14 nt, Human
cucaggccagcugc

SEQ ID NO: 1850288 - RNA, 13 nt, Human
cucaggccagcug

SEQ ID NO: 1850289 - RNA, 14 nt, Human
cucagcgaaugaau

SEQ ID NO: 1850290 - RNA, 13 nt, Human
cucagcggggaca

SEQ ID NO: 1850291 - RNA, 15 nt, Human
cuaacuucaccauau

SEQ ID NO: 1850292 - RNA, 16 nt, Human
cuaacuucaccauauu

SEQ ID NO: 1850293 - RNA, 17 nt, Human
cggcucuggccuccaag

SEQ ID NO: 1850294 - RNA, 23 nt, Human
cgugagccaccgugccuggccac

SEQ ID NO: 1850295 - RNA, 16 nt, Human
cgugagaccugccccu

SEQ ID NO: 1850296 - RNA, 14 nt, Human
cgugagaccugccc

SEQ ID NO: 1850297 - RNA, 13 nt, Human
cgugagaccugcc

SEQ ID NO: 1850298 - RNA, 23 nt, Human
cuaaacugcccccucugcccugc

SEQ ID NO: 1850299 - RNA, 22 nt, Human
cuaaacugcccccucugcccug

SEQ ID NO: 1850300 - RNA, 20 nt, Human
cuaagugaaauaagccagac

SEQ ID NO: 1850301 - RNA, 23 nt, Human
cuaagugaaauaagccagacauc

SEQ ID NO: 1850302 - RNA, 18 nt, Human
cuacauacaauuccaaac

SEQ ID NO: 1850303 - RNA, 15 nt, Human
cuacaugagguacug

SEQ ID NO: 1850304 - RNA, 20 nt, Human
cuacaguguacagucuugua

SEQ ID NO: 1850305 - RNA, 13 nt, Human
cuacaguugaaaa

SEQ ID NO: 1850306 - RNA, 15 nt, Human
cuacaguguacaguc

SEQ ID NO: 1850307 - RNA, 16 nt, Human
cuacaguguacagucu

SEQ ID NO: 1850308 - RNA, 17 nt, Human
cuacaguguacagucuu

SEQ ID NO: 1850309 - RNA, 18 nt, Human
cuacaguccucccaucuc

SEQ ID NO: 1850310 - RNA, 17 nt, Human
cuacaguccucccaucu

SEQ ID NO: 1850311 - RNA, 16 nt, Human
cuacaguccucccauc

SEQ ID NO: 1850312 - RNA, 15 nt, Human
cuacaguccucccau

SEQ ID NO: 1850313 - RNA, 18 nt, Human
cuaagugaggaugaaaaa

SEQ ID NO: 1850314 - RNA, 20 nt, Human
cuaagugauccucccaccuc

SEQ ID NO: 1850315 - RNA, 22 nt, Human
cuaagugauccucccaccucag

SEQ ID NO: 1850316 - RNA, 16 nt, Human
cuagaacucccuuuca

SEQ ID NO: 1850317 - RNA, 17 nt, Human
cuagaacucccuuucaa

SEQ ID NO: 1850318 - RNA, 18 nt, Human
cuagaacucccuuucaac

SEQ ID NO: 1850319 - RNA, 19 nt, Human
cuagaacucccuuucaaca

SEQ ID NO: 1850320 - RNA, 22 nt, Human
cuagcagcagggagggcuucug

SEQ ID NO: 1850321 - RNA, 15 nt, Human
cuagaacugaauuuu

SEQ ID NO: 1850322 - RNA, 17 nt, Human
cuagcauggcugccaau

SEQ ID NO: 1850323 - RNA, 23 nt, Human
cuagcagcagggagggcuucugc

SEQ ID NO: 1850324 - RNA, 19 nt, Human
cuagaaauuccccacccug

SEQ ID NO: 1850325 - RNA, 14 nt, Human
cuaccugaggggcc

SEQ ID NO: 1850326 - RNA, 11 nt, Human
cuaccugaggg

SEQ ID NO: 1850327 - RNA, 15 nt, Human
cuaccugaggggccu

SEQ ID NO: 1850328 - RNA, 19 nt, Human
cuagggaaaaaccagcgug

SEQ ID NO: 1850329 - RNA, 21 nt, Human
cuagggaaaaaccagcgugug

SEQ ID NO: 1850330 - RNA, 20 nt, Human
cuaguuccaccaucaagcca

SEQ ID NO: 1850331 - RNA, 18 nt, Human
cuaguuccaccaucaagc

SEQ ID NO: 1850332 - RNA, 22 nt, Human
cuaguuccaccaucaagccacc

SEQ ID NO: 1850333 - RNA, 16 nt, Human
cgaccugccucggccu

SEQ ID NO: 1850334 - RNA, 12 nt, Human
cgccaaggcugg

SEQ ID NO: 1850335 - RNA, 20 nt, Human
cgcaggcuggcccugcccug

SEQ ID NO: 1850336 - RNA, 19 nt, Human
cgcaggcuggcccugcccu

SEQ ID NO: 1850337 - RNA, 18 nt, Human
cgcaggcuggcccugccc

SEQ ID NO: 1850338 - RNA, 17 nt, Human
cgcaggcuggcccugcc

SEQ ID NO: 1850339 - RNA, 15 nt, Human
cgcaggcuggcccug

SEQ ID NO: 1850340 - RNA, 14 nt, Human
cgcaggcuggcccu

SEQ ID NO: 1850341 - RNA, 16 nt, Human
cgccaaggcuggggga

SEQ ID NO: 1850342 - RNA, 13 nt, Human
cgccaaggcuggg

SEQ ID NO: 1850343 - RNA, 23 nt, Human
cgccaaggcugggggaagaagcu

SEQ ID NO: 1850344 - RNA, 14 nt, Human
cgccuacaggagug

SEQ ID NO: 1850345 - RNA, 18 nt, Human
cgaguuacagacaaagcg

SEQ ID NO: 1850346 - RNA, 17 nt, Human
cgaguuacagacaaagc

SEQ ID NO: 1850347 - RNA, 13 nt, Human
cgaguagcuggga

SEQ ID NO: 1850348 - RNA, 14 nt, Human
cgaguagcugggac

SEQ ID NO: 1850349 - RNA, 15 nt, Human
cgaguagcugggacu

SEQ ID NO: 1850350 - RNA, 16 nt, Human
cgaguagcugggacua

SEQ ID NO: 1850351 - RNA, 18 nt, Human
cggaggggccuggcagcc

SEQ ID NO: 1850352 - RNA, 16 nt, Human
cggaggggccuggcag

SEQ ID NO: 1850353 - RNA, 14 nt, Human
cggagucccaccuu

SEQ ID NO: 1850354 - RNA, 21 nt, Human
cggcucacugcauccuccgcc

SEQ ID NO: 1850355 - RNA, 17 nt, Human
cggcucacugcauccuc

SEQ ID NO: 1850356 - RNA, 19 nt, Human
cggcucacugcagccucaa

SEQ ID NO: 1850357 - RNA, 18 nt, Human
cggcucacugcagccuca

SEQ ID NO: 1850358 - RNA, 22 nt, Human
ccuucugacccaugcugcccug

SEQ ID NO: 1850359 - RNA, 21 nt, Human
ccuucugacccaugcugcccu

SEQ ID NO: 1850360 - RNA, 23 nt, Human
ccuucugacccaugcugcccugu

SEQ ID NO: 1850361 - RNA, 22 nt, Human
ccuucuggaauaaggagaauga

SEQ ID NO: 1850362 - RNA, 20 nt, Human
ccuucugacccaugcugccc

SEQ ID NO: 1850363 - RNA, 17 nt, Human
ccuucugacccaugcug

SEQ ID NO: 1850364 - RNA, 16 nt, Human
ccuucugacccaugcu

SEQ ID NO: 1850365 - RNA, 12 nt, Human
ccuucugaccca

SEQ ID NO: 1850366 - RNA, 15 nt, Human
ccuggccugagcugg

SEQ ID NO: 1850367 - RNA, 14 nt, Human
ccuggccugagcug

SEQ ID NO: 1850368 - RNA, 20 nt, Human
ccuggccugagcugggauga

SEQ ID NO: 1850369 - RNA, 20 nt, Human
ccuucugaaaaaguauccug

SEQ ID NO: 1850370 - RNA, 20 nt, Human
ccuugccgucuaccugaggg

SEQ ID NO: 1850371 - RNA, 17 nt, Human
ccuugccgucuaccuga

SEQ ID NO: 1850372 - RNA, 14 nt, Human
ccuuuagcgcccag

SEQ ID NO: 1850373 - RNA, 20 nt, Human
ccuuuagcgcccaguugggu

SEQ ID NO: 1850374 - RNA, 15 nt, Human
cgacagugagacucu

SEQ ID NO: 1850375 - RNA, 16 nt, Human
cgacagugagacucug

SEQ ID NO: 1850376 - RNA, 17 nt, Human
ccuuuuuuauacauaaa

SEQ ID NO: 1850377 - RNA, 18 nt, Human
ccuuuuuuauacauaaac

SEQ ID NO: 1850378 - RNA, 19 nt, Human
ccuuuuuuauacauaaaca

SEQ ID NO: 1850379 - RNA, 14 nt, Human
cgaccaccugccca

SEQ ID NO: 1850380 - RNA, 12 nt, Human
cgaccaccugcc

SEQ ID NO: 1850381 - RNA, 23 nt, Human
cgaccagacaccuugacagggca

SEQ ID NO: 1850382 - RNA, 12 nt, Human
ccuuuuuuauac

SEQ ID NO: 1850383 - RNA, 23 nt, Human
ccagaugcaccagcccuuagcag

SEQ ID NO: 1850384 - RNA, 18 nt, Human
ccagaugcaccagcccuu

SEQ ID NO: 1850385 - RNA, 17 nt, Human
ccagaugcaccagcccu

SEQ ID NO: 1850386 - RNA, 15 nt, Human
ccagaugcaccagcc

SEQ ID NO: 1850387 - RNA, 20 nt, Human
ccagagggccugcaagggag

SEQ ID NO: 1850388 - RNA, 19 nt, Human
ccagagggccugcaaggga

SEQ ID NO: 1850389 - RNA, 18 nt, Human
ccagagggccugcaaggg

SEQ ID NO: 1850390 - RNA, 17 nt, Human
ccagagggccugcaagg

SEQ ID NO: 1850391 - RNA, 16 nt, Human
ccaccuuggcucaagu

SEQ ID NO: 1850392 - RNA, 13 nt, Human
ccaggaagccagc

SEQ ID NO: 1850393 - RNA, 14 nt, Human
ccaggaagccagca

SEQ ID NO: 1850394 - RNA, 12 nt, Human
ccaggaagccag

SEQ ID NO: 1850395 - RNA, 15 nt, Human
ccaggaaaggcucca

SEQ ID NO: 1850396 - RNA, 14 nt, Human
ccaggaaaggcucc

SEQ ID NO: 1850397 - RNA, 16 nt, Human
ccaggaaaggcuccag

SEQ ID NO: 1850398 - RNA, 12 nt, Human
ccagccccugga

SEQ ID NO: 1850399 - RNA, 11 nt, Human
ccagccccugg

SEQ ID NO: 1850400 - RNA, 19 nt, Human
ccagcuuaaaggggcuaga

SEQ ID NO: 1850401 - RNA, 16 nt, Human
ccagcuuaucucaggg

SEQ ID NO: 1850402 - RNA, 17 nt, Human
ccagcuguucagcuggu

SEQ ID NO: 1850403 - RNA, 15 nt, Human
ccagcucaccagccc

SEQ ID NO: 1850404 - RNA, 16 nt, Human
ccagcucaccagcccc

SEQ ID NO: 1850405 - RNA, 16 nt, Human
ccagcuguucagcugg

SEQ ID NO: 1850406 - RNA, 22 nt, Human
ccagcucaccagccccagugcc

SEQ ID NO: 1850407 - RNA, 15 nt, Human
ccagcaggcucucag

SEQ ID NO: 1850408 - RNA, 13 nt, Human
ccagcaggcucuc

SEQ ID NO: 1850409 - RNA, 18 nt, Human
ccaggcacugcugcccag

SEQ ID NO: 1850410 - RNA, 16 nt, Human
ccaggcacugcugccc

SEQ ID NO: 1850411 - RNA, 17 nt, Human
ccaggggugggacaccc

SEQ ID NO: 1850412 - RNA, 14 nt, Human
ccaggggugggaca

SEQ ID NO: 1850413 - RNA, 19 nt, Human
ccaggggugggacacccug

SEQ ID NO: 1850414 - RNA, 23 nt, Human
ccaggggugggacacccugugau

SEQ ID NO: 1850415 - RNA, 13 nt, Human
ccaggggugggac

SEQ ID NO: 1850416 - RNA, 20 nt, Human
ccaggggaaaaucagccugc

SEQ ID NO: 1850417 - RNA, 19 nt, Human
ccaggggaaaaucagccug

SEQ ID NO: 1850418 - RNA, 20 nt, Human
ccaggcuccuuuagcgccca

SEQ ID NO: 1850419 - RNA, 21 nt, Human
ccaggcuccuuuagcgcccag

SEQ ID NO: 1850420 - RNA, 19 nt, Human
ccaggcuggcgugcagugg

SEQ ID NO: 1850421 - RNA, 17 nt, Human
ccaggcuggcgugcagu

SEQ ID NO: 1850422 - RNA, 18 nt, Human
ccaggcuggcgugcagug

SEQ ID NO: 1850423 - RNA, 17 nt, Human
ccaguuggguggaugcc

SEQ ID NO: 1850424 - RNA, 19 nt, Human
ccaguuggguggaugccug

SEQ ID NO: 1850425 - RNA, 20 nt, Human
ccaguuggguggaugccugg

SEQ ID NO: 1850426 - RNA, 20 nt, Human
ccaucccugaaggccccgcc

SEQ ID NO: 1850427 - RNA, 17 nt, Human
ccaucccugaaggcccc

SEQ ID NO: 1850428 - RNA, 15 nt, Human
ccaucccugaaggcc

SEQ ID NO: 1850429 - RNA, 14 nt, Human
ccaucccugaaggc

SEQ ID NO: 1850430 - RNA, 13 nt, Human
ccaucccagcccc

SEQ ID NO: 1850431 - RNA, 15 nt, Human
ccaucccagccccaa

SEQ ID NO: 1850432 - RNA, 14 nt, Human
ccaucccagcccca

SEQ ID NO: 1850433 - RNA, 23 nt, Human
ccaguuggucccccuuccaugga

SEQ ID NO: 1850434 - RNA, 21 nt, Human
ccaugagccucagcauccugg

SEQ ID NO: 1850435 - RNA, 23 nt, Human
ccaugagccucagcauccuggca

SEQ ID NO: 1850436 - RNA, 20 nt, Human
ccauggucggaaaacaugcu

SEQ ID NO: 1850437 - RNA, 22 nt, Human
cccacccaagggccuggccuga

SEQ ID NO: 1850438 - RNA, 21 nt, Human
cccacccaagggccuggccug

SEQ ID NO: 1850439 - RNA, 20 nt, Human
cccacccaagggccuggccu

SEQ ID NO: 1850440 - RNA, 15 nt, Human
cccacccccacccaa

SEQ ID NO: 1850441 - RNA, 17 nt, Human
cccacccccacccaagg

SEQ ID NO: 1850442 - RNA, 18 nt, Human
cccacccugaaagcccug

SEQ ID NO: 1850443 - RNA, 22 nt, Human
cccacugcuuuuggucugugug

SEQ ID NO: 1850444 - RNA, 19 nt, Human
cccacugcuuuuggucugu

SEQ ID NO: 1850445 - RNA, 12 nt, Human
cccacugcucug

SEQ ID NO: 1850446 - RNA, 13 nt, Human
cccacugcucugg

SEQ ID NO: 1850447 - RNA, 18 nt, Human
cccacuagacccacugga

SEQ ID NO: 1850448 - RNA, 23 nt, Human
cccagcucugguccauagagagc

SEQ ID NO: 1850449 - RNA, 13 nt, Human
cccauccucugua

SEQ ID NO: 1850450 - RNA, 15 nt, Human
cccagcuugaaaccu

SEQ ID NO: 1850451 - RNA, 13 nt, Human
cccaggcuggcgu

SEQ ID NO: 1850452 - RNA, 17 nt, Human
cccaggcuggcgugcag

SEQ ID NO: 1850453 - RNA, 20 nt, Human
cccauauuuguacaccaaua

SEQ ID NO: 1850454 - RNA, 19 nt, Human
ccccucuggcuccagcugg

SEQ ID NO: 1850455 - RNA, 14 nt, Human
cccgaauagcuggg

SEQ ID NO: 1850456 - RNA, 14 nt, Human
cccggccaccugcg

SEQ ID NO: 1850457 - RNA, 13 nt, Human
cccggccaccugc

SEQ ID NO: 1850458 - RNA, 11 nt, Human
cccggcuccag

SEQ ID NO: 1850459 - RNA, 12 nt, Human
cccggcuccagg

SEQ ID NO: 1850460 - RNA, 13 nt, Human
cccggcuccaggc

SEQ ID NO: 1850461 - RNA, 14 nt, Human
cccggcuccaggcu

SEQ ID NO: 1850462 - RNA, 15 nt, Human
cccggcuccaggcuc

SEQ ID NO: 1850463 - RNA, 16 nt, Human
cccggcuccaggcucc

SEQ ID NO: 1850464 - RNA, 17 nt, Human
cccggccaccugcggug

SEQ ID NO: 1850465 - RNA, 23 nt, Human
cccgggaggcagagguugcagug

SEQ ID NO: 1850466 - RNA, 18 nt, Human
cccuauuagagaagagau

SEQ ID NO: 1850467 - RNA, 17 nt, Human
cccuauugguaaagaau

SEQ ID NO: 1850468 - RNA, 23 nt, Human
ccccgaggccuucucugaaggac

SEQ ID NO: 1850469 - RNA, 23 nt, Human
ccccaaaacucuccucugcugcu

SEQ ID NO: 1850470 - RNA, 22 nt, Human
cccauuguggucacaggaagua

SEQ ID NO: 1850471 - RNA, 23 nt, Human
cccauuguggucacaggaaguag

SEQ ID NO: 1850472 - RNA, 22 nt, Human
ccccaaaacucuccucugcugc

SEQ ID NO: 1850473 - RNA, 22 nt, Human
cccccaaauggaaaugggcaga

SEQ ID NO: 1850474 - RNA, 23 nt, Human
ccccgacccuugccgucuaccug

SEQ ID NO: 1850475 - RNA, 13 nt, Human
ccccagaggcugg

SEQ ID NO: 1850476 - RNA, 22 nt, Human
ccccagcaagugagagcugggu

SEQ ID NO: 1850477 - RNA, 15 nt, Human
ccuggccucugcacu

SEQ ID NO: 1850478 - RNA, 14 nt, Human
ccuggccucugcac

SEQ ID NO: 1850479 - RNA, 13 nt, Human
ccuggccugagcu

SEQ ID NO: 1850480 - RNA, 16 nt, Human
ccuggccucugcacuc

SEQ ID NO: 1850481 - RNA, 12 nt, Human
ccuggccucugc

SEQ ID NO: 1850482 - RNA, 20 nt, Human
ccugcuggguguggcgcagc

SEQ ID NO: 1850483 - RNA, 14 nt, Human
ccugcugggugugg

SEQ ID NO: 1850484 - RNA, 21 nt, Human
ccugcuggguguggcgcagca

SEQ ID NO: 1850485 - RNA, 12 nt, Human
ccugcugggugu

SEQ ID NO: 1850486 - RNA, 14 nt, Human
ccugcccaggcccc

SEQ ID NO: 1850487 - RNA, 15 nt, Human
ccugcccaggccccu

SEQ ID NO: 1850488 - RNA, 16 nt, Human
ccugcccaggccccug

SEQ ID NO: 1850489 - RNA, 18 nt, Human
ccugcccaggccccugcc

SEQ ID NO: 1850490 - RNA, 13 nt, Human
ccuggaugcagcc

SEQ ID NO: 1850491 - RNA, 21 nt, Human
ccuggauccaucaggccacuu

SEQ ID NO: 1850492 - RNA, 17 nt, Human
ccuggaugcagccucac

SEQ ID NO: 1850493 - RNA, 14 nt, Human
ccuggaugcagccu

SEQ ID NO: 1850494 - RNA, 19 nt, Human
ccuggaugcagccucacag

SEQ ID NO: 1850495 - RNA, 17 nt, Human
ccuggaguucugguucc

SEQ ID NO: 1850496 - RNA, 16 nt, Human
ccuggaguucugguuc

SEQ ID NO: 1850497 - RNA, 15 nt, Human
ccuggaguucugguu

SEQ ID NO: 1850498 - RNA, 18 nt, Human
ccuggcacagggcagugg

SEQ ID NO: 1850499 - RNA, 17 nt, Human
ccuggcacagggcagug

SEQ ID NO: 1850500 - RNA, 16 nt, Human
ccuggcacagggcagu

SEQ ID NO: 1850501 - RNA, 18 nt, Human
ccuggcacccggccccug

SEQ ID NO: 1850502 - RNA, 13 nt, Human
ccucuugagccuu

SEQ ID NO: 1850503 - RNA, 19 nt, Human
ccucuugagccuugaacuu

SEQ ID NO: 1850504 - RNA, 13 nt, Human
ccucuuggguuca

SEQ ID NO: 1850505 - RNA, 20 nt, Human
ccugaguagcuggauuacag

SEQ ID NO: 1850506 - RNA, 15 nt, Human
ccugaguagcuggau

SEQ ID NO: 1850507 - RNA, 19 nt, Human
ccugaguagcuggauuaca

SEQ ID NO: 1850508 - RNA, 22 nt, Human
ccugcacuugcagacucuacag

SEQ ID NO: 1850509 - RNA, 12 nt, Human
ccucucucaggc

SEQ ID NO: 1850510 - RNA, 17 nt, Human
ccucucucacuccuuga

SEQ ID NO: 1850511 - RNA, 15 nt, Human
ccucucucacuccuu

SEQ ID NO: 1850512 - RNA, 14 nt, Human
ccucucucacuccu

SEQ ID NO: 1850513 - RNA, 13 nt, Human
ccucucucacucc

SEQ ID NO: 1850514 - RNA, 14 nt, Human
ccucucucaggcca

SEQ ID NO: 1850515 - RNA, 20 nt, Human
ccucucugcaggucccuaau

SEQ ID NO: 1850516 - RNA, 15 nt, Human
ccucucugcaggucc

SEQ ID NO: 1850517 - RNA, 13 nt, Human
ccucucugcaggu

SEQ ID NO: 1850518 - RNA, 18 nt, Human
ccucugcugcuggcuggu

SEQ ID NO: 1850519 - RNA, 17 nt, Human
ccucugcugcuggcugg

SEQ ID NO: 1850520 - RNA, 16 nt, Human
ccucugcugcuggcug

SEQ ID NO: 1850521 - RNA, 15 nt, Human
ccucugcugcuggcu

SEQ ID NO: 1850522 - RNA, 14 nt, Human
ccucugcugcuggc

SEQ ID NO: 1850523 - RNA, 13 nt, Human
ccucugcugcugg

SEQ ID NO: 1850524 - RNA, 18 nt, Human
ccucugcugauccuccca

SEQ ID NO: 1850525 - RNA, 15 nt, Human
ccucugcugauccuc

SEQ ID NO: 1850526 - RNA, 22 nt, Human
ccucucugcaggucccuaauaa

SEQ ID NO: 1850527 - RNA, 21 nt, Human
ccucucugcaggucccuaaua

SEQ ID NO: 1850528 - RNA, 23 nt, Human
ccucucugcaggucccuaauaaa

SEQ ID NO: 1850529 - RNA, 12 nt, Human
ccucucugcccu

SEQ ID NO: 1850530 - RNA, 12 nt, Human
ccucugccuguc

SEQ ID NO: 1850531 - RNA, 22 nt, Human
ccucugccugaagucacacagu

SEQ ID NO: 1850532 - RNA, 23 nt, Human
cccuucugacccaugcugcccug

SEQ ID NO: 1850533 - RNA, 22 nt, Human
cccuucugacccaugcugcccu

SEQ ID NO: 1850534 - RNA, 21 nt, Human
cccuucugacccaugcugccc

SEQ ID NO: 1850535 - RNA, 16 nt, Human
cccuucuaccuuccug

SEQ ID NO: 1850536 - RNA, 16 nt, Human
cccuucgcuccugugu

SEQ ID NO: 1850537 - RNA, 18 nt, Human
cccuucgcuccugugucu

SEQ ID NO: 1850538 - RNA, 20 nt, Human
ccgcccaggcuuagucacug

SEQ ID NO: 1850539 - RNA, 16 nt, Human
ccgccaugcuccuggc

SEQ ID NO: 1850540 - RNA, 17 nt, Human
ccgccaaggcuggggga

SEQ ID NO: 1850541 - RNA, 16 nt, Human
ccgacccuugccgucu

SEQ ID NO: 1850542 - RNA, 20 nt, Human
ccgaauagcugggacuacag

SEQ ID NO: 1850543 - RNA, 13 nt, Human
cccuggcagcccc

SEQ ID NO: 1850544 - RNA, 12 nt, Human
cccuggcagccc

SEQ ID NO: 1850545 - RNA, 21 nt, Human
cccugcccugugggcccccaa

SEQ ID NO: 1850546 - RNA, 20 nt, Human
cccugcccugugggccccca

SEQ ID NO: 1850547 - RNA, 16 nt, Human
cccugcccugugggcc

SEQ ID NO: 1850548 - RNA, 15 nt, Human
cccugcccugugggc

SEQ ID NO: 1850549 - RNA, 14 nt, Human
cccugcccuguggg

SEQ ID NO: 1850550 - RNA, 11 nt, Human
cccugcccugu

SEQ ID NO: 1850551 - RNA, 12 nt, Human
cccugcccugug

SEQ ID NO: 1850552 - RNA, 13 nt, Human
cccugcccugugg

SEQ ID NO: 1850553 - RNA, 17 nt, Human
cccuggcuuuucacugc

SEQ ID NO: 1850554 - RNA, 13 nt, Human
cccuggcuuuuca

SEQ ID NO: 1850555 - RNA, 19 nt, Human
cccuggcucccacaggccc

SEQ ID NO: 1850556 - RNA, 17 nt, Human
cccuggcucccacaggc

SEQ ID NO: 1850557 - RNA, 16 nt, Human
cccuggcagccccugu

SEQ ID NO: 1850558 - RNA, 14 nt, Human
cccuggcagccccu

SEQ ID NO: 1850559 - RNA, 15 nt, Human
ccuauuuuaauaaac

SEQ ID NO: 1850560 - RNA, 15 nt, Human
ccucaagagaaggca

SEQ ID NO: 1850561 - RNA, 15 nt, Human
ccucaacucuccucc

SEQ ID NO: 1850562 - RNA, 11 nt, Human
ccucagccucc

SEQ ID NO: 1850563 - RNA, 22 nt, Human
ccucagccucccaaagugcugg

SEQ ID NO: 1850564 - RNA, 20 nt, Human
ccucccaggcgccccuuccc

SEQ ID NO: 1850565 - RNA, 14 nt, Human
ccucccaggcgccc

SEQ ID NO: 1850566 - RNA, 22 nt, Human
ccucccaaggggcccaaauucu

SEQ ID NO: 1850567 - RNA, 22 nt, Human
ccuccaaucccaccaacccuca

SEQ ID NO: 1850568 - RNA, 18 nt, Human
ccuccaaguccacagugg

SEQ ID NO: 1850569 - RNA, 21 nt, Human
ccuccaaguccacaguggaac

SEQ ID NO: 1850570 - RNA, 18 nt, Human
ccucauuagcauuuugcu

SEQ ID NO: 1850571 - RNA, 22 nt, Human
ccuccaagcuccaucuccacuc

SEQ ID NO: 1850572 - RNA, 21 nt, Human
ccuccaagcuccaucuccacu

SEQ ID NO: 1850573 - RNA, 19 nt, Human
ccucauguucuuaauucuu

SEQ ID NO: 1850574 - RNA, 20 nt, Human
ccucauguccacugguucuu

SEQ ID NO: 1850575 - RNA, 14 nt, Human
ccucagccuccuga

SEQ ID NO: 1850576 - RNA, 13 nt, Human
ccucauguucuua

SEQ ID NO: 1850577 - RNA, 15 nt, Human
ccucauguccacugg

SEQ ID NO: 1850578 - RNA, 13 nt, Human
ccucagccuccug

SEQ ID NO: 1850579 - RNA, 23 nt, Human
ccucagccucccaaagugcuggg

SEQ ID NO: 1850580 - RNA, 22 nt, Human
ccucagccucccgaauagcugg

SEQ ID NO: 1850581 - RNA, 23 nt, Human
ccuaggcauuugcugaauacaga

SEQ ID NO: 1850582 - RNA, 18 nt, Human
ccgucucugguuccuccc

SEQ ID NO: 1850583 - RNA, 14 nt, Human
ccuaauaaagcugu

SEQ ID NO: 1850584 - RNA, 23 nt, Human
ccuaauaaagcuguguggcaguc

SEQ ID NO: 1850585 - RNA, 19 nt, Human
ccggcuaauuuuuguauuu

SEQ ID NO: 1850586 - RNA, 17 nt, Human
ccggcuaugggggcacu

SEQ ID NO: 1850587 - RNA, 23 nt, Human
ccggcuaugggggcacugaggac

SEQ ID NO: 1850588 - RNA, 22 nt, Human
ccggcuaugggggcacugagga

SEQ ID NO: 1850589 - RNA, 16 nt, Human
ccguagguuauuuuca

SEQ ID NO: 1850590 - RNA, 20 nt, Human
auugcuacuguccuacccac

SEQ ID NO: 1850591 - RNA, 22 nt, Human
auugcuacuguccuacccaccc

SEQ ID NO: 1850592 - RNA, 17 nt, Human
auugauaugcuuauaca

SEQ ID NO: 1850593 - RNA, 15 nt, Human
auugcuacuguccua

SEQ ID NO: 1850594 - RNA, 21 nt, Human
auugauaagaaccuuuugagu

SEQ ID NO: 1850595 - RNA, 13 nt, Human
auucuuuccugag

SEQ ID NO: 1850596 - RNA, 11 nt, Human
auucuucugcu

SEQ ID NO: 1850597 - RNA, 12 nt, Human
auucuucugcuu

SEQ ID NO: 1850598 - RNA, 11 nt, Human
auucuuuccug

SEQ ID NO: 1850599 - RNA, 14 nt, Human
auucuucugcuuca

SEQ ID NO: 1850600 - RNA, 19 nt, Human
auugcugauggugcaauga

SEQ ID NO: 1850601 - RNA, 18 nt, Human
auugcugauggugcaaug

SEQ ID NO: 1850602 - RNA, 16 nt, Human
auugcugauggugcaa

SEQ ID NO: 1850603 - RNA, 15 nt, Human
auugcugauggugca

SEQ ID NO: 1850604 - RNA, 12 nt, Human
auugcuccuuga

SEQ ID NO: 1850605 - RNA, 14 nt, Human
auugcuugagcuca

SEQ ID NO: 1850606 - RNA, 23 nt, Human
auugcugauggugcaaugaccuu

SEQ ID NO: 1850607 - RNA, 12 nt, Human
auugcugcuuga

SEQ ID NO: 1850608 - RNA, 14 nt, Human
auuguaaaauggug

SEQ ID NO: 1850609 - RNA, 18 nt, Human
auugcuugagcucaggag

SEQ ID NO: 1850610 - RNA, 23 nt, Human
auuguaauaggcguaacuaauuu

SEQ ID NO: 1850611 - RNA, 23 nt, Human
auugugucucuugguccugcugc

SEQ ID NO: 1850612 - RNA, 21 nt, Human
auugugucucuugguccugcu

SEQ ID NO: 1850613 - RNA, 16 nt, Human
auuguuagucucuuga

SEQ ID NO: 1850614 - RNA, 19 nt, Human
auucauagcagcuuauuca

SEQ ID NO: 1850615 - RNA, 22 nt, Human
auucauagcagcuuauucacaa

SEQ ID NO: 1850616 - RNA, 19 nt, Human
auucauaaugacuuaagca

SEQ ID NO: 1850617 - RNA, 21 nt, Human
auucauaauuauuauuuggcc

SEQ ID NO: 1850618 - RNA, 15 nt, Human
auucauaaugacuua

SEQ ID NO: 1850619 - RNA, 14 nt, Human
auucauaaugacuu

SEQ ID NO: 1850620 - RNA, 23 nt, Human
auuaugcaugaaguaauaugcac

SEQ ID NO: 1850621 - RNA, 19 nt, Human
auucacaagacccaaaagg

SEQ ID NO: 1850622 - RNA, 21 nt, Human
auuaggugugacugaauuucu

SEQ ID NO: 1850623 - RNA, 16 nt, Human
auuaggugugacugaa

SEQ ID NO: 1850624 - RNA, 18 nt, Human
auuaggugugacugaauu

SEQ ID NO: 1850625 - RNA, 23 nt, Human
auguuugggagacugcugaguca

SEQ ID NO: 1850626 - RNA, 18 nt, Human
auguuugccucugccucu

SEQ ID NO: 1850627 - RNA, 16 nt, Human
auuacaggugugaacc

SEQ ID NO: 1850628 - RNA, 17 nt, Human
auuacaggaaguacugg

SEQ ID NO: 1850629 - RNA, 17 nt, Human
auuagcaguuugcuuug

SEQ ID NO: 1850630 - RNA, 19 nt, Human
auuagcauuugucaacaaa

SEQ ID NO: 1850631 - RNA, 23 nt, Human
auuagauuucucauuugccaaua

SEQ ID NO: 1850632 - RNA, 15 nt, Human
auuugugauacaaug

SEQ ID NO: 1850633 - RNA, 17 nt, Human
auuugugauacaaugcu

SEQ ID NO: 1850634 - RNA, 20 nt, Human
auuugugauacaaugcugug

SEQ ID NO: 1850635 - RNA, 14 nt, Human
auuugugccagaau

SEQ ID NO: 1850636 - RNA, 12 nt, Human
auuuggaaaaua

SEQ ID NO: 1850637 - RNA, 13 nt, Human
auuuggaaaauaa

SEQ ID NO: 1850638 - RNA, 13 nt, Human
auuugcuccuuuc

SEQ ID NO: 1850639 - RNA, 22 nt, Human
auuuguuugaacugauaaagau

SEQ ID NO: 1850640 - RNA, 23 nt, Human
auuuguuugaacugauaaagaug

SEQ ID NO: 1850641 - RNA, 19 nt, Human
auuuuauagcuacuaauuu

SEQ ID NO: 1850642 - RNA, 17 nt, Human
auuuuauagcuacuaau

SEQ ID NO: 1850643 - RNA, 15 nt, Human
auuugccaauaauaa

SEQ ID NO: 1850644 - RNA, 16 nt, Human
auuugccaauaauaau

SEQ ID NO: 1850645 - RNA, 17 nt, Human
caaagcagugcaugcug

SEQ ID NO: 1850646 - RNA, 15 nt, Human
caaagcagugcaugc

SEQ ID NO: 1850647 - RNA, 22 nt, Human
caaaguacacuguuucaaacuu

SEQ ID NO: 1850648 - RNA, 21 nt, Human
caaaguagaagucuuagaugu

SEQ ID NO: 1850649 - RNA, 14 nt, Human
caaaguagaagucu

SEQ ID NO: 1850650 - RNA, 21 nt, Human
caaagucucuggaauuugaaa

SEQ ID NO: 1850651 - RNA, 22 nt, Human
caaagauauuuugcuuugugau

SEQ ID NO: 1850652 - RNA, 23 nt, Human
caaagauauuuugcuuugugauu

SEQ ID NO: 1850653 - RNA, 14 nt, Human
caacacuaacauga

SEQ ID NO: 1850654 - RNA, 20 nt, Human
caacaccucugcacaagcug

SEQ ID NO: 1850655 - RNA, 22 nt, Human
caaauggaaaugggcagagcag

SEQ ID NO: 1850656 - RNA, 21 nt, Human
caaauggaaaugggcagagca

SEQ ID NO: 1850657 - RNA, 20 nt, Human
caaauggaaaugggcagagc

SEQ ID NO: 1850658 - RNA, 20 nt, Human
caaagauauuuugcuuugug

SEQ ID NO: 1850659 - RNA, 19 nt, Human
caaaccaucauugaaaucu

SEQ ID NO: 1850660 - RNA, 21 nt, Human
caaaccaucauugaaaucuuu

SEQ ID NO: 1850661 - RNA, 15 nt, Human
caaaaggcagaagca

SEQ ID NO: 1850662 - RNA, 18 nt, Human
caaaagaugcuucucacu

SEQ ID NO: 1850663 - RNA, 20 nt, Human
caaaaaaaaaaaaaaauuag

SEQ ID NO: 1850664 - RNA, 16 nt, Human
caaaagaugcuucuca

SEQ ID NO: 1850665 - RNA, 11 nt, Human
caccccagccc

SEQ ID NO: 1850666 - RNA, 16 nt, Human
caccugccccucaacu

SEQ ID NO: 1850667 - RNA, 15 nt, Human
caccugccccucaac

SEQ ID NO: 1850668 - RNA, 14 nt, Human
caccugccccucaa

SEQ ID NO: 1850669 - RNA, 23 nt, Human
caccugccucggccucccaaagu

SEQ ID NO: 1850670 - RNA, 13 nt, Human
caccuacagugua

SEQ ID NO: 1850671 - RNA, 16 nt, Human
caccuacaguguacag

SEQ ID NO: 1850672 - RNA, 17 nt, Human
caccuacaguguacagu

SEQ ID NO: 1850673 - RNA, 17 nt, Human
cacccuggggagaaagu

SEQ ID NO: 1850674 - RNA, 14 nt, Human
caccucagccuccc

SEQ ID NO: 1850675 - RNA, 20 nt, Human
caccuacaguguacagucuu

SEQ ID NO: 1850676 - RNA, 23 nt, Human
caccuacaguguacagucuugua

SEQ ID NO: 1850677 - RNA, 13 nt, Human
caccucagccucc

SEQ ID NO: 1850678 - RNA, 14 nt, Human
cacccucaggcagg

SEQ ID NO: 1850679 - RNA, 17 nt, Human
cacccugaaagcccuga

SEQ ID NO: 1850680 - RNA, 15 nt, Human
cacccuggggagaaa

SEQ ID NO: 1850681 - RNA, 16 nt, Human
cacccuggggagaaag

SEQ ID NO: 1850682 - RNA, 24 nt, Human
caccugccuguugggccaggagcc

SEQ ID NO: 1850683 - RNA, 19 nt, Human
caccugccuguugggccag

SEQ ID NO: 1850684 - RNA, 17 nt, Human
caccugccuguugggcc

SEQ ID NO: 1850685 - RNA, 14 nt, Human
caccuuggcugcag

SEQ ID NO: 1850686 - RNA, 15 nt, Human
caccuuggcucaagu

SEQ ID NO: 1850687 - RNA, 13 nt, Human
caccuuggcugca

SEQ ID NO: 1850688 - RNA, 16 nt, Human
cacuccagccugggug

SEQ ID NO: 1850689 - RNA, 15 nt, Human
cacuccagcugggau

SEQ ID NO: 1850690 - RNA, 12 nt, Human
cacuccagcugg

SEQ ID NO: 1850691 - RNA, 11 nt, Human
cacuccagcug

SEQ ID NO: 1850692 - RNA, 14 nt, Human
cacuaggcuucugg

SEQ ID NO: 1850693 - RNA, 15 nt, Human
cacuccccugcuggg

SEQ ID NO: 1850694 - RNA, 14 nt, Human
cacuccccugcugg

SEQ ID NO: 1850695 - RNA, 13 nt, Human
cacuccccugcug

SEQ ID NO: 1850696 - RNA, 12 nt, Human
cacuccccugcu

SEQ ID NO: 1850697 - RNA, 22 nt, Human
cacugguucuucuuggucucag

SEQ ID NO: 1850698 - RNA, 23 nt, Human
cacugguggcccgacagccuggc

SEQ ID NO: 1850699 - RNA, 18 nt, Human
cacuuacacuuuaugcac

SEQ ID NO: 1850700 - RNA, 16 nt, Human
cacuuacacuuuaugc

SEQ ID NO: 1850701 - RNA, 24 nt, Human
cacuuagaaauugcauuuccugac

SEQ ID NO: 1850702 - RNA, 23 nt, Human
cacuuaggaacguaaucgugucc

SEQ ID NO: 1850703 - RNA, 18 nt, Human
cacugggagaaaugaaaa

SEQ ID NO: 1850704 - RNA, 18 nt, Human
cacugcauccuccgccuc

SEQ ID NO: 1850705 - RNA, 16 nt, Human
cacugcauguuuguga

SEQ ID NO: 1850706 - RNA, 16 nt, Human
cacugcauccuccgcc

SEQ ID NO: 1850707 - RNA, 14 nt, Human
cacugcauccuccg

SEQ ID NO: 1850708 - RNA, 13 nt, Human
cacugcagccuca

SEQ ID NO: 1850709 - RNA, 19 nt, Human
cacugcacuauagccuagg

SEQ ID NO: 1850710 - RNA, 19 nt, Human
cacugcacuccagccuggg

SEQ ID NO: 1850711 - RNA, 18 nt, Human
cacugcacuccagccugg

SEQ ID NO: 1850712 - RNA, 16 nt, Human
cacugcacuccagccu

SEQ ID NO: 1850713 - RNA, 15 nt, Human
cacugcacuccagcc

SEQ ID NO: 1850714 - RNA, 20 nt, Human
cacugcacuccagccugggu

SEQ ID NO: 1850715 - RNA, 21 nt, Human
cacugcagaagacaguauggc

SEQ ID NO: 1850716 - RNA, 12 nt, Human
cacugcagccuc

SEQ ID NO: 1850717 - RNA, 19 nt, Human
caauaaagcagcguuucua

SEQ ID NO: 1850718 - RNA, 12 nt, Human
caagcuccaagc

SEQ ID NO: 1850719 - RNA, 19 nt, Human
caagcucuaucaccaagga

SEQ ID NO: 1850720 - RNA, 13 nt, Human
caagcucugcucc

SEQ ID NO: 1850721 - RNA, 20 nt, Human
caagcugcacccucaggcag

SEQ ID NO: 1850722 - RNA, 18 nt, Human
caagcugcacccucaggc

SEQ ID NO: 1850723 - RNA, 14 nt, Human
caagcugcacccuc

SEQ ID NO: 1850724 - RNA, 13 nt, Human
caagcugcacccu

SEQ ID NO: 1850725 - RNA, 14 nt, Human
caagcucugcuccu

SEQ ID NO: 1850726 - RNA, 16 nt, Human
caaggccaaaggaagc

SEQ ID NO: 1850727 - RNA, 15 nt, Human
caaggccaaaggaag

SEQ ID NO: 1850728 - RNA, 18 nt, Human
caaggccaaaggaagcac

SEQ ID NO: 1850729 - RNA, 17 nt, Human
caaggccaaaggaagca

SEQ ID NO: 1850730 - RNA, 16 nt, Human
caaguaugaauaaaga

SEQ ID NO: 1850731 - RNA, 17 nt, Human
caagucaagugaaaaag

SEQ ID NO: 1850732 - RNA, 13 nt, Human
caagucaagugaa

SEQ ID NO: 1850733 - RNA, 21 nt, Human
caaguaugaauaaagacaccu

SEQ ID NO: 1850734 - RNA, 19 nt, Human
caaguaugaauaaagacac

SEQ ID NO: 1850735 - RNA, 17 nt, Human
caaguccacaguggaac

SEQ ID NO: 1850736 - RNA, 23 nt, Human
cacaggcccuuccucuccacugc

SEQ ID NO: 1850737 - RNA, 22 nt, Human
cacaggcccuuccucuccacug

SEQ ID NO: 1850738 - RNA, 22 nt, Human
cacagcgcuggccgggaccccg

SEQ ID NO: 1850739 - RNA, 19 nt, Human
cacagcgcuggccgggacc

SEQ ID NO: 1850740 - RNA, 18 nt, Human
cacaggggaaaagaggag

SEQ ID NO: 1850741 - RNA, 17 nt, Human
cacaggggaaaagagga

SEQ ID NO: 1850742 - RNA, 19 nt, Human
cacaggggaaaagaggagu

SEQ ID NO: 1850743 - RNA, 20 nt, Human
cacaguauuacuucugcuac

SEQ ID NO: 1850744 - RNA, 21 nt, Human
cacaguauuacuucugcuaca

SEQ ID NO: 1850745 - RNA, 22 nt, Human
cacagaaaauggaagacagcuc

SEQ ID NO: 1850746 - RNA, 20 nt, Human
cacagaaaauggaagacagc

SEQ ID NO: 1850747 - RNA, 19 nt, Human
cacagaaaauggaagacag

SEQ ID NO: 1850748 - RNA, 18 nt, Human
cacagaaaauggaagaca

SEQ ID NO: 1850749 - RNA, 22 nt, Human
cacacaugagcaucaggccagg

SEQ ID NO: 1850750 - RNA, 21 nt, Human
cacacaugagcaucaggccag

SEQ ID NO: 1850751 - RNA, 19 nt, Human
cacagaaaauucuucucca

SEQ ID NO: 1850752 - RNA, 23 nt, Human
cacagaaaauggaagacagcucu

SEQ ID NO: 1850753 - RNA, 13 nt, Human
cacagacccugcc

SEQ ID NO: 1850754 - RNA, 11 nt, Human
cacagccucug

SEQ ID NO: 1850755 - RNA, 19 nt, Human
cacagacauacuaaccagc

SEQ ID NO: 1850756 - RNA, 21 nt, Human
cacagacauacuaaccagcag

SEQ ID NO: 1850757 - RNA, 18 nt, Human
cacacagugagucgagga

SEQ ID NO: 1850758 - RNA, 20 nt, Human
cacacaguauuacuucugcu

SEQ ID NO: 1850759 - RNA, 23 nt, Human
cacacaguauuacuucugcuaca

SEQ ID NO: 1850760 - RNA, 20 nt, Human
cacacaugagcaucaggcca

SEQ ID NO: 1850761 - RNA, 15 nt, Human
cacacauacacacac

SEQ ID NO: 1850762 - RNA, 21 nt, Human
cacacagugagucgaggacag

SEQ ID NO: 1850763 - RNA, 23 nt, Human
cacacagugagucgaggacaggg

SEQ ID NO: 1850764 - RNA, 17 nt, Human
cacacagcucuguccug

SEQ ID NO: 1850765 - RNA, 20 nt, Human
cacacagcucuguccuggga

SEQ ID NO: 1850766 - RNA, 14 nt, Human
cacaagagcccagg

SEQ ID NO: 1850767 - RNA, 13 nt, Human
caauuuauuaugg

SEQ ID NO: 1850768 - RNA, 15 nt, Human
cacaagcuccaagcu

SEQ ID NO: 1850769 - RNA, 14 nt, Human
cacaagcuccaagc

SEQ ID NO: 1850770 - RNA, 13 nt, Human
cacaagcuccaag

SEQ ID NO: 1850771 - RNA, 16 nt, Human
cacaagagcccaggcc

SEQ ID NO: 1850772 - RNA, 23 nt, Human
cacaagcugcacccucaggcagg

SEQ ID NO: 1850773 - RNA, 17 nt, Human
cacaagcugcacccuca

SEQ ID NO: 1850774 - RNA, 23 nt, Human
cacaagcuccaagcucccaggca

SEQ ID NO: 1850775 - RNA, 17 nt, Human
cacaagcuccaagcucc

SEQ ID NO: 1850776 - RNA, 17 nt, Human
cacaagagcccaggccu

SEQ ID NO: 1850777 - RNA, 20 nt, Human
caauggagacugucucaaga

SEQ ID NO: 1850778 - RNA, 11 nt, Human
caauggcagcc

SEQ ID NO: 1850779 - RNA, 12 nt, Human
caauggcagccu

SEQ ID NO: 1850780 - RNA, 15 nt, Human
caauucuugccaaau

SEQ ID NO: 1850781 - RNA, 18 nt, Human
cagucaccccggccaccu

SEQ ID NO: 1850782 - RNA, 19 nt, Human
cauaaucuggacuccucug

SEQ ID NO: 1850783 - RNA, 20 nt, Human
cauaaucuggacuccucugu

SEQ ID NO: 1850784 - RNA, 22 nt, Human
cauaaucuggacuccucugucc

SEQ ID NO: 1850785 - RNA, 21 nt, Human
cauaaucuggacuccucuguc

SEQ ID NO: 1850786 - RNA, 14 nt, Human
cauaaugcgugcau

SEQ ID NO: 1850787 - RNA, 17 nt, Human
cauaaugcgugcauacc

SEQ ID NO: 1850788 - RNA, 23 nt, Human
cauaaucuggacuccucugucca

SEQ ID NO: 1850789 - RNA, 21 nt, Human
caguuugcuuuguaugcacuu

SEQ ID NO: 1850790 - RNA, 14 nt, Human
caguuugcuuugua

SEQ ID NO: 1850791 - RNA, 12 nt, Human
caguuugcuuug

SEQ ID NO: 1850792 - RNA, 15 nt, Human
cauacaauuccaaac

SEQ ID NO: 1850793 - RNA, 21 nt, Human
cauaaugcgugcauaccacuu

SEQ ID NO: 1850794 - RNA, 12 nt, Human
cauagcccucac

SEQ ID NO: 1850795 - RNA, 19 nt, Human
cauagcccucacccugggg

SEQ ID NO: 1850796 - RNA, 15 nt, Human
cauagcccucacccu

SEQ ID NO: 1850797 - RNA, 17 nt, Human
cauauuaccacagacau

SEQ ID NO: 1850798 - RNA, 20 nt, Human
cauauuaccacagacauacu

SEQ ID NO: 1850799 - RNA, 21 nt, Human
cauauuaccacagacauacua

SEQ ID NO: 1850800 - RNA, 14 nt, Human
caugacacgaauau

SEQ ID NO: 1850801 - RNA, 14 nt, Human
caugaauuugugaa

SEQ ID NO: 1850802 - RNA, 18 nt, Human
caugacacgaauauugcu

SEQ ID NO: 1850803 - RNA, 17 nt, Human
caugacacgaauauugc

SEQ ID NO: 1850804 - RNA, 18 nt, Human
caugcugcccugugagua

SEQ ID NO: 1850805 - RNA, 16 nt, Human
caugcugcccugugag

SEQ ID NO: 1850806 - RNA, 19 nt, Human
cauggccuuugcuugaaag

SEQ ID NO: 1850807 - RNA, 22 nt, Human
cauggccuuugcuugaaagaaa

SEQ ID NO: 1850808 - RNA, 14 nt, Human
caugcugccuccag

SEQ ID NO: 1850809 - RNA, 12 nt, Human
caugcugccucc

SEQ ID NO: 1850810 - RNA, 17 nt, Human
caugcaaggucauuuuu

SEQ ID NO: 1850811 - RNA, 18 nt, Human
caugcaaggucauuuuuu

SEQ ID NO: 1850812 - RNA, 22 nt, Human
caugcaaggucauuuuuuuuaa

SEQ ID NO: 1850813 - RNA, 19 nt, Human
caucagcacgauuucuguu

SEQ ID NO: 1850814 - RNA, 13 nt, Human
caucaggccaggc

SEQ ID NO: 1850815 - RNA, 17 nt, Human
caucagcacgauuucug

SEQ ID NO: 1850816 - RNA, 18 nt, Human
caucagcacgauuucugu

SEQ ID NO: 1850817 - RNA, 23 nt, Human
caucaggccaggcccucugccca

SEQ ID NO: 1850818 - RNA, 22 nt, Human
caucaggccaggcccucugccc

SEQ ID NO: 1850819 - RNA, 21 nt, Human
caucaggccaggcccucugcc

SEQ ID NO: 1850820 - RNA, 14 nt, Human
caucaggccaggcc

SEQ ID NO: 1850821 - RNA, 14 nt, Human
caucccagccccaa

SEQ ID NO: 1850822 - RNA, 13 nt, Human
caucccagcccca

SEQ ID NO: 1850823 - RNA, 16 nt, Human
caucccagccccaaug

SEQ ID NO: 1850824 - RNA, 17 nt, Human
caucccagccccaauga

SEQ ID NO: 1850825 - RNA, 22 nt, Human
caucuuagguuggcaaaaaggc

SEQ ID NO: 1850826 - RNA, 21 nt, Human
caucuuagguuggcaaaaagg

SEQ ID NO: 1850827 - RNA, 12 nt, Human
caucgcaaugua

SEQ ID NO: 1850828 - RNA, 19 nt, Human
caucugugaaaggaaagag

SEQ ID NO: 1850829 - RNA, 18 nt, Human
caucugugaaaggaaaga

SEQ ID NO: 1850830 - RNA, 17 nt, Human
ccaccaucaagccacca

SEQ ID NO: 1850831 - RNA, 16 nt, Human
ccaccaucaagccacc

SEQ ID NO: 1850832 - RNA, 22 nt, Human
ccacacuucaggcucuucuccu

SEQ ID NO: 1850833 - RNA, 23 nt, Human
ccacagaaaagaaaguucaugcu

SEQ ID NO: 1850834 - RNA, 18 nt, Human
ccaccgcagacaggacca

SEQ ID NO: 1850835 - RNA, 19 nt, Human
ccaccgcagacaggaccag

SEQ ID NO: 1850836 - RNA, 23 nt, Human
ccaccgggcugggagcucugcag

SEQ ID NO: 1850837 - RNA, 14 nt, Human
ccaccuuggcucaa

SEQ ID NO: 1850838 - RNA, 15 nt, Human
ccaccuuggcucaag

SEQ ID NO: 1850839 - RNA, 17 nt, Human
ccaccgcagacaggacc

SEQ ID NO: 1850840 - RNA, 14 nt, Human
ccaccgcagacagg

SEQ ID NO: 1850841 - RNA, 20 nt, Human
ccaccaucaagccaccaaca

SEQ ID NO: 1850842 - RNA, 18 nt, Human
ccaccaucaccagacagg

SEQ ID NO: 1850843 - RNA, 13 nt, Human
ccacccugcucuc

SEQ ID NO: 1850844 - RNA, 22 nt, Human
ccaaagugcugggauuacaggc

SEQ ID NO: 1850845 - RNA, 22 nt, Human
ccaaagugcugggauuacaggg

SEQ ID NO: 1850846 - RNA, 19 nt, Human
ccaaagugcugggauuaca

SEQ ID NO: 1850847 - RNA, 11 nt, Human
ccaacuuguaa

SEQ ID NO: 1850848 - RNA, 22 nt, Human
ccaaagugcugggauuacaggu

SEQ ID NO: 1850849 - RNA, 19 nt, Human
ccaaagugguauagaaaug

SEQ ID NO: 1850850 - RNA, 22 nt, Human
ccaaagugguauagaaaugcug

SEQ ID NO: 1850851 - RNA, 20 nt, Human
ccaauguucucucuucucca

SEQ ID NO: 1850852 - RNA, 22 nt, Human
ccaaugcacuuuguucuggcuc

SEQ ID NO: 1850853 - RNA, 20 nt, Human
ccaaugcacuuuguucuggc

SEQ ID NO: 1850854 - RNA, 23 nt, Human
ccaaugcacuuuguucuggcucu

SEQ ID NO: 1850855 - RNA, 20 nt, Human
ccaagcuggucccacucagu

SEQ ID NO: 1850856 - RNA, 22 nt, Human
cauggcugccaaugggagcuca

SEQ ID NO: 1850857 - RNA, 15 nt, Human
cauuaggauggcuag

SEQ ID NO: 1850858 - RNA, 12 nt, Human
cauuaucuagau

SEQ ID NO: 1850859 - RNA, 16 nt, Human
cauuaucuagauacug

SEQ ID NO: 1850860 - RNA, 17 nt, Human
cauuaucuagauacugu

SEQ ID NO: 1850861 - RNA, 15 nt, Human
cauguucucugagga

SEQ ID NO: 1850862 - RNA, 16 nt, Human
cauucuccuuguguua

SEQ ID NO: 1850863 - RNA, 18 nt, Human
cauuaucuagauacugua

SEQ ID NO: 1850864 - RNA, 13 nt, Human
cauuaugaugugu

SEQ ID NO: 1850865 - RNA, 16 nt, Human
cauucucacuccuacc

SEQ ID NO: 1850866 - RNA, 17 nt, Human
cauucucacuccuaccu

SEQ ID NO: 1850867 - RNA, 18 nt, Human
cauugcugggcuugucug

SEQ ID NO: 1850868 - RNA, 14 nt, Human
cauugcggacagcc

SEQ ID NO: 1850869 - RNA, 15 nt, Human
cauugcggacagcca

SEQ ID NO: 1850870 - RNA, 17 nt, Human
cauugcggacagccacg

SEQ ID NO: 1850871 - RNA, 21 nt, Human
cauugcggacagccacggcca

SEQ ID NO: 1850872 - RNA, 18 nt, Human
cauuucauuugugccaga

SEQ ID NO: 1850873 - RNA, 16 nt, Human
cauuuauucugcucac

SEQ ID NO: 1850874 - RNA, 22 nt, Human
cauuuggugguuucagaaaugu

SEQ ID NO: 1850875 - RNA, 23 nt, Human
cauuuggugguuucagaaaugug

SEQ ID NO: 1850876 - RNA, 20 nt, Human
cauuuuugaauacaggcaua

SEQ ID NO: 1850877 - RNA, 18 nt, Human
cauuuuugaauacaggca

SEQ ID NO: 1850878 - RNA, 17 nt, Human
ccaaaaaaugcuugcuu

SEQ ID NO: 1850879 - RNA, 17 nt, Human
ccaaaacucuccucugc

SEQ ID NO: 1850880 - RNA, 18 nt, Human
cagauuucacucuccuug

SEQ ID NO: 1850881 - RNA, 16 nt, Human
cagauuucacucuccu

SEQ ID NO: 1850882 - RNA, 15 nt, Human
cagauuucacucucc

SEQ ID NO: 1850883 - RNA, 14 nt, Human
cagauuugagcuca

SEQ ID NO: 1850884 - RNA, 13 nt, Human
cagauuugagcuc

SEQ ID NO: 1850885 - RNA, 16 nt, Human
cagauuugagcucagc

SEQ ID NO: 1850886 - RNA, 21 nt, Human
cagauugcaacaggcugggcu

SEQ ID NO: 1850887 - RNA, 18 nt, Human
cagcauauucaggaagcu

SEQ ID NO: 1850888 - RNA, 17 nt, Human
cagcauauucaggaagc

SEQ ID NO: 1850889 - RNA, 16 nt, Human
cagcauauucaggaag

SEQ ID NO: 1850890 - RNA, 19 nt, Human
cagcguuucuaugacacau

SEQ ID NO: 1850891 - RNA, 16 nt, Human
cagcguuucuaugaca

SEQ ID NO: 1850892 - RNA, 14 nt, Human
cagcguuucuauga

SEQ ID NO: 1850893 - RNA, 14 nt, Human
cagcggggacagcu

SEQ ID NO: 1850894 - RNA, 23 nt, Human
cagccugagcgacagugagacuc

SEQ ID NO: 1850895 - RNA, 13 nt, Human
cagcccuuagcag

SEQ ID NO: 1850896 - RNA, 23 nt, Human
cagccgccaugcuccuggcccac

SEQ ID NO: 1850897 - RNA, 23 nt, Human
cagccccauucugccugcccagg

SEQ ID NO: 1850898 - RNA, 24 nt, Human
cagccccauucugccugcccaggc

SEQ ID NO: 1850899 - RNA, 19 nt, Human
cagccccauucugccugcc

SEQ ID NO: 1850900 - RNA, 20 nt, Human
cagccccauucugccugccc

SEQ ID NO: 1850901 - RNA, 22 nt, Human
cagccccauucugccugcccag

SEQ ID NO: 1850902 - RNA, 13 nt, Human
cagccccugcaca

SEQ ID NO: 1850903 - RNA, 19 nt, Human
cagccccgugggguuccuc

SEQ ID NO: 1850904 - RNA, 20 nt, Human
cagagacuccugcaggcagc

SEQ ID NO: 1850905 - RNA, 22 nt, Human
cagagacuccugcaggcagcca

SEQ ID NO: 1850906 - RNA, 21 nt, Human
cagagacuccugcaggcagcc

SEQ ID NO: 1850907 - RNA, 23 nt, Human
cagagacuccugcaggcagccag

SEQ ID NO: 1850908 - RNA, 22 nt, Human
cagagcuacacaggggaaaaga

SEQ ID NO: 1850909 - RNA, 17 nt, Human
cagagcuacacagggga

SEQ ID NO: 1850910 - RNA, 16 nt, Human
cagagagggugggagu

SEQ ID NO: 1850911 - RNA, 22 nt, Human
cagagagggugggagugggccc

SEQ ID NO: 1850912 - RNA, 20 nt, Human
cagagagggugggagugggc

SEQ ID NO: 1850913 - RNA, 14 nt, Human
cagagccugcaguu

SEQ ID NO: 1850914 - RNA, 16 nt, Human
cagaucauugugaaau

SEQ ID NO: 1850915 - RNA, 22 nt, Human
cagaucauugugaaauuauuca

SEQ ID NO: 1850916 - RNA, 23 nt, Human
cagauacaggaaaagcugcugac

SEQ ID NO: 1850917 - RNA, 22 nt, Human
caggaaaggcuccaggagcagc

SEQ ID NO: 1850918 - RNA, 21 nt, Human
caggaaaggcuccaggagcag

SEQ ID NO: 1850919 - RNA, 23 nt, Human
caggaaaggcuccaggagcagcc

SEQ ID NO: 1850920 - RNA, 19 nt, Human
caggaaaagcugcugacag

SEQ ID NO: 1850921 - RNA, 20 nt, Human
caggaaaagcugcugacagu

SEQ ID NO: 1850922 - RNA, 16 nt, Human
cagcuuauucacaaga

SEQ ID NO: 1850923 - RNA, 17 nt, Human
cagcuuauucacaagac

SEQ ID NO: 1850924 - RNA, 15 nt, Human
cagcuguucagcugg

SEQ ID NO: 1850925 - RNA, 16 nt, Human
cagcuguucagcuggu

SEQ ID NO: 1850926 - RNA, 19 nt, Human
cagcuguucagcugguuga

SEQ ID NO: 1850927 - RNA, 16 nt, Human
caggccaggcccucug

SEQ ID NO: 1850928 - RNA, 15 nt, Human
caggccaggcccucu

SEQ ID NO: 1850929 - RNA, 14 nt, Human
caggccaggcccuc

SEQ ID NO: 1850930 - RNA, 13 nt, Human
caggccaggcccu

SEQ ID NO: 1850931 - RNA, 15 nt, Human
caggccagcugcuug

SEQ ID NO: 1850932 - RNA, 13 nt, Human
caggccagcugcu

SEQ ID NO: 1850933 - RNA, 23 nt, Human
caggcacugcugcccagccucca

SEQ ID NO: 1850934 - RNA, 17 nt, Human
caggcacugcugcccag

SEQ ID NO: 1850935 - RNA, 16 nt, Human
caggcacugcugccca

SEQ ID NO: 1850936 - RNA, 21 nt, Human
caggcaaugcuggcuguuggc

SEQ ID NO: 1850937 - RNA, 13 nt, Human
caggaggccagcc

SEQ ID NO: 1850938 - RNA, 12 nt, Human
caggaggccagc

SEQ ID NO: 1850939 - RNA, 19 nt, Human
caggcaaugcuggcuguug

SEQ ID NO: 1850940 - RNA, 20 nt, Human
caggcaaugcuggcuguugg

SEQ ID NO: 1850941 - RNA, 21 nt, Human
caggaccagggauuuccauga

SEQ ID NO: 1850942 - RNA, 13 nt, Human
caggaccagggau

SEQ ID NO: 1850943 - RNA, 13 nt, Human
caggaccucaggu

SEQ ID NO: 1850944 - RNA, 22 nt, Human
caggccugggggcugggcagag

SEQ ID NO: 1850945 - RNA, 20 nt, Human
caggccugggggcugggcag

SEQ ID NO: 1850946 - RNA, 20 nt, Human
caggcugggagagccuucca

SEQ ID NO: 1850947 - RNA, 19 nt, Human
caggcugggagagccuucc

SEQ ID NO: 1850948 - RNA, 18 nt, Human
caggcugggagagccuuc

SEQ ID NO: 1850949 - RNA, 16 nt, Human
caggcugggagagccu

SEQ ID NO: 1850950 - RNA, 23 nt, Human
caggccugggggcugggcagagg

SEQ ID NO: 1850951 - RNA, 17 nt, Human
caggcuggcgugcagug

SEQ ID NO: 1850952 - RNA, 18 nt, Human
caggcuggcgugcagugg

SEQ ID NO: 1850953 - RNA, 19 nt, Human
caggcuggcgugcaguggu

SEQ ID NO: 1850954 - RNA, 16 nt, Human
cagggagggcuucugc

SEQ ID NO: 1850955 - RNA, 18 nt, Human
cagggagggccugggccc

SEQ ID NO: 1850956 - RNA, 17 nt, Human
cagggagggccugggcc

SEQ ID NO: 1850957 - RNA, 20 nt, Human
cagggcucagcggggacagc

SEQ ID NO: 1850958 - RNA, 12 nt, Human
cagggcucagcg

SEQ ID NO: 1850959 - RNA, 15 nt, Human
cagggcucagcgggg

SEQ ID NO: 1850960 - RNA, 14 nt, Human
caggcugggcuuca

SEQ ID NO: 1850961 - RNA, 22 nt, Human
cagggaggacgcucucuggccu

SEQ ID NO: 1850962 - RNA, 15 nt, Human
caggcugggcuucag

SEQ ID NO: 1850963 - RNA, 21 nt, Human
cagggucucuaccauccccug

SEQ ID NO: 1850964 - RNA, 15 nt, Human
caggguuggccccug

SEQ ID NO: 1850965 - RNA, 16 nt, Human
caggguuggccccugc

SEQ ID NO: 1850966 - RNA, 23 nt, Human
cagggucucacucugucgcccag

SEQ ID NO: 1850967 - RNA, 17 nt, Human
cagucaccccggccacc

SEQ ID NO: 1850968 - RNA, 16 nt, Human
cagucaccccggccac

SEQ ID NO: 1850969 - RNA, 14 nt, Human
cagucaccccggcc

SEQ ID NO: 1850970 - RNA, 19 nt, Human
caguaaaugggggugcauu

SEQ ID NO: 1850971 - RNA, 20 nt, Human
caguaaaugggggugcauuu

SEQ ID NO: 1850972 - RNA, 18 nt, Human
caguaaaugggggugcau

SEQ ID NO: 1850973 - RNA, 13 nt, Human
caggugcugccau

SEQ ID NO: 1850974 - RNA, 14 nt, Human
caggugcugccauc

SEQ ID NO: 1850975 - RNA, 17 nt, Human
caggguuggccccugcc

SEQ ID NO: 1850976 - RNA, 21 nt, Human
caggguuggccccugcccggc

SEQ ID NO: 1850977 - RNA, 23 nt, Human
cagguuuuuggucugacccacug

SEQ ID NO: 1850978 - RNA, 13 nt, Human
gccugcuccagcu

SEQ ID NO: 1850979 - RNA, 13 nt, Human
gccucggacuuag

SEQ ID NO: 1850980 - RNA, 17 nt, Human
gccugcuaauuccccag

SEQ ID NO: 1850981 - RNA, 23 nt, Human
gccugcuaauuccccagauugca

SEQ ID NO: 1850982 - RNA, 16 nt, Human
gccuccauccugaggc

SEQ ID NO: 1850983 - RNA, 20 nt, Human
gccuccauccugaggcucca

SEQ ID NO: 1850984 - RNA, 21 nt, Human
gccuccuuugugaggaagccg

SEQ ID NO: 1850985 - RNA, 20 nt, Human
gccuccuuugugaggaagcc

SEQ ID NO: 1850986 - RNA, 19 nt, Human
gccuccuuugugaggaagc

SEQ ID NO: 1850987 - RNA, 11 nt, Human
gccuccaugcu

SEQ ID NO: 1850988 - RNA, 17 nt, Human
gccuccaagcuccaucu

SEQ ID NO: 1850989 - RNA, 13 nt, Human
gcgauucuucugc

SEQ ID NO: 1850990 - RNA, 17 nt, Human
gcgauucuucugcuuca

SEQ ID NO: 1850991 - RNA, 14 nt, Human
gcgauucuucugcu

SEQ ID NO: 1850992 - RNA, 17 nt, Human
gcuacuugggaggcuga

SEQ ID NO: 1850993 - RNA, 11 nt, Human
gcuagaaauga

SEQ ID NO: 1850994 - RNA, 19 nt, Human
gcuacuguaaggcaaucau

SEQ ID NO: 1850995 - RNA, 18 nt, Human
gcuacuguaaggcaauca

SEQ ID NO: 1850996 - RNA, 19 nt, Human
gcuacuguccuacccaccc

SEQ ID NO: 1850997 - RNA, 20 nt, Human
gcuacuguccuacccacccu

SEQ ID NO: 1850998 - RNA, 17 nt, Human
gcguuucuaugacacau

SEQ ID NO: 1850999 - RNA, 18 nt, Human
gcuaauuuugaaaaacug

SEQ ID NO: 1851000 - RNA, 16 nt, Human
gcuaauuuuucauuuu

SEQ ID NO: 1851001 - RNA, 20 nt, Human
gcgugguggacaugcacagc

SEQ ID NO: 1851002 - RNA, 19 nt, Human
gcgugcacacaccagagcc

SEQ ID NO: 1851003 - RNA, 18 nt, Human
gcgugcacacaccagagc

SEQ ID NO: 1851004 - RNA, 14 nt, Human
gcgugcacacacca

SEQ ID NO: 1851005 - RNA, 16 nt, Human
gccccugccucucugc

SEQ ID NO: 1851006 - RNA, 15 nt, Human
gccccugccucucug

SEQ ID NO: 1851007 - RNA, 18 nt, Human
gccccugccucucugcag

SEQ ID NO: 1851008 - RNA, 17 nt, Human
gccccugccucucugca

SEQ ID NO: 1851009 - RNA, 22 nt, Human
gccccugcugguucaggguugg

SEQ ID NO: 1851010 - RNA, 17 nt, Human
gcccucacccuggggcu

SEQ ID NO: 1851011 - RNA, 16 nt, Human
gcccucacccuggggc

SEQ ID NO: 1851012 - RNA, 15 nt, Human
gccccuggaugcagc

SEQ ID NO: 1851013 - RNA, 17 nt, Human
gcccaggccccugccac

SEQ ID NO: 1851014 - RNA, 18 nt, Human
gcccaggccccugccacc

SEQ ID NO: 1851015 - RNA, 13 nt, Human
gcccaggcagguc

SEQ ID NO: 1851016 - RNA, 12 nt, Human
gcccaggcaggu

SEQ ID NO: 1851017 - RNA, 14 nt, Human
gcccaggcaggucu

SEQ ID NO: 1851018 - RNA, 16 nt, Human
gcccaggcaggucuug

SEQ ID NO: 1851019 - RNA, 15 nt, Human
gcccaggccccugcc

SEQ ID NO: 1851020 - RNA, 13 nt, Human
gcccaggccccug

SEQ ID NO: 1851021 - RNA, 15 nt, Human
gccauguguuccaag

SEQ ID NO: 1851022 - RNA, 16 nt, Human
gccauguguuccaagg

SEQ ID NO: 1851023 - RNA, 14 nt, Human
gccaugugccaggu

SEQ ID NO: 1851024 - RNA, 14 nt, Human
gccaggcccucugc

SEQ ID NO: 1851025 - RNA, 13 nt, Human
gccaggcccucug

SEQ ID NO: 1851026 - RNA, 18 nt, Human
gccaggccacaagacccu

SEQ ID NO: 1851027 - RNA, 13 nt, Human
gccaggccacaag

SEQ ID NO: 1851028 - RNA, 21 nt, Human
gccaggccacaagacccuugu

SEQ ID NO: 1851029 - RNA, 15 nt, Human
gccaggccagaggga

SEQ ID NO: 1851030 - RNA, 22 nt, Human
gccaggccagagggagugacag

SEQ ID NO: 1851031 - RNA, 13 nt, Human
gccaguugguccc

SEQ ID NO: 1851032 - RNA, 13 nt, Human
gccagugugacaa

SEQ ID NO: 1851033 - RNA, 15 nt, Human
gccagugcuccagcc

SEQ ID NO: 1851034 - RNA, 21 nt, Human
gccaguuggucccccuuccau

SEQ ID NO: 1851035 - RNA, 20 nt, Human
gccaguuggucccccuucca

SEQ ID NO: 1851036 - RNA, 18 nt, Human
gccaguuggucccccuuc

SEQ ID NO: 1851037 - RNA, 16 nt, Human
gccaguuggucccccu

SEQ ID NO: 1851038 - RNA, 23 nt, Human
gccaguuggucccccuuccaugg

SEQ ID NO: 1851039 - RNA, 22 nt, Human
gccaguuggucccccuuccaug

SEQ ID NO: 1851040 - RNA, 16 nt, Human
gccauaugaaaaggcu

SEQ ID NO: 1851041 - RNA, 15 nt, Human
gcuuuuggucugugu

SEQ ID NO: 1851042 - RNA, 18 nt, Human
gcuuuugucuaugggacu

SEQ ID NO: 1851043 - RNA, 12 nt, Human
gcuuuugugcau

SEQ ID NO: 1851044 - RNA, 20 nt, Human
gcuuuuuuaucaugugaaau

SEQ ID NO: 1851045 - RNA, 18 nt, Human
gcuuuuuuaucaugugaa

SEQ ID NO: 1851046 - RNA, 15 nt, Human
gcuuuuuuaucaugu

SEQ ID NO: 1851047 - RNA, 16 nt, Human
ggaaacccagcucugg

SEQ ID NO: 1851048 - RNA, 18 nt, Human
ggaaaauuuuaaaaauac

SEQ ID NO: 1851049 - RNA, 17 nt, Human
gcuuugaucccuucuua

SEQ ID NO: 1851050 - RNA, 14 nt, Human
gcuuugaucccuuc

SEQ ID NO: 1851051 - RNA, 20 nt, Human
ggaagacuucaucccucugg

SEQ ID NO: 1851052 - RNA, 17 nt, Human
ggaagacuucaucccuc

SEQ ID NO: 1851053 - RNA, 22 nt, Human
ggaagacaaugugaaaagaaaa

SEQ ID NO: 1851054 - RNA, 19 nt, Human
ggaacacuccuucacagau

SEQ ID NO: 1851055 - RNA, 17 nt, Human
ggaacugaacauuccag

SEQ ID NO: 1851056 - RNA, 15 nt, Human
ggaacacuccuucac

SEQ ID NO: 1851057 - RNA, 23 nt, Human
ggaacaaggcaaggcugucaauu

SEQ ID NO: 1851058 - RNA, 13 nt, Human
ggaacaccuccuc

SEQ ID NO: 1851059 - RNA, 17 nt, Human
ggaacaccauaggucac

SEQ ID NO: 1851060 - RNA, 16 nt, Human
ggaagacaaugugaaa

SEQ ID NO: 1851061 - RNA, 14 nt, Human
ggaagacaauguga

SEQ ID NO: 1851062 - RNA, 21 nt, Human
ggaacaaggcaaggcugucaa

SEQ ID NO: 1851063 - RNA, 17 nt, Human
ggaacaaggcaaggcug

SEQ ID NO: 1851064 - RNA, 15 nt, Human
ggaacaaggcaaggc

SEQ ID NO: 1851065 - RNA, 17 nt, Human
ggaaaugucaacaagua

SEQ ID NO: 1851066 - RNA, 22 nt, Human
ggaaaugggcagagcagagacc

SEQ ID NO: 1851067 - RNA, 18 nt, Human
ggaaaugggcagagcaga

SEQ ID NO: 1851068 - RNA, 17 nt, Human
ggaaaugggcagagcag

SEQ ID NO: 1851069 - RNA, 16 nt, Human
ggaaaugggcagagca

SEQ ID NO: 1851070 - RNA, 14 nt, Human
ggaaaugggcagag

SEQ ID NO: 1851071 - RNA, 22 nt, Human
gcuuccagugaggcucugcccu

SEQ ID NO: 1851072 - RNA, 23 nt, Human
gcuuccagugaggcucugcccuu

SEQ ID NO: 1851073 - RNA, 12 nt, Human
gcuucuucagag

SEQ ID NO: 1851074 - RNA, 15 nt, Human
gcuucuucagagacu

SEQ ID NO: 1851075 - RNA, 20 nt, Human
gcuugaccgugaggccagag

SEQ ID NO: 1851076 - RNA, 16 nt, Human
gcuuuccucuuccuga

SEQ ID NO: 1851077 - RNA, 21 nt, Human
gcuuuccccaugucucgacuc

SEQ ID NO: 1851078 - RNA, 22 nt, Human
gcuuuccccaugucucgacuca

SEQ ID NO: 1851079 - RNA, 18 nt, Human
gcuuguaaauagcucagg

SEQ ID NO: 1851080 - RNA, 19 nt, Human
gcuuguaaauagcucaggu

SEQ ID NO: 1851081 - RNA, 18 nt, Human
gcuugaccuuuaagagaa

SEQ ID NO: 1851082 - RNA, 23 nt, Human
gcuugaccgugaggccagagaca

SEQ ID NO: 1851083 - RNA, 22 nt, Human
gcuugaccuuuaagagaaauga

SEQ ID NO: 1851084 - RNA, 16 nt, Human
gcuugaccgugaggcc

SEQ ID NO: 1851085 - RNA, 17 nt, Human
gcuuguaaauagcucag

SEQ ID NO: 1851086 - RNA, 14 nt, Human
gcuucaaggauccu

SEQ ID NO: 1851087 - RNA, 16 nt, Human
gcuucaaauuguaagc

SEQ ID NO: 1851088 - RNA, 15 nt, Human
gcuucaguggcagcu

SEQ ID NO: 1851089 - RNA, 14 nt, Human
gcuucaguggcagc

SEQ ID NO: 1851090 - RNA, 13 nt, Human
gcuuacaagccag

SEQ ID NO: 1851091 - RNA, 19 nt, Human
gcuuacaagccagcuggag

SEQ ID NO: 1851092 - RNA, 22 nt, Human
gcuuacaagccagcuggagaaa

SEQ ID NO: 1851093 - RNA, 13 nt, Human
gcuguuggcuggg

SEQ ID NO: 1851094 - RNA, 14 nt, Human
gcuguuggcugggg

SEQ ID NO: 1851095 - RNA, 12 nt, Human
gcugugccucug

SEQ ID NO: 1851096 - RNA, 23 nt, Human
gcugguucaggguuggccccugc

SEQ ID NO: 1851097 - RNA, 19 nt, Human
gcuguauuagucacagaga

SEQ ID NO: 1851098 - RNA, 20 nt, Human
gcucucaggccagcugcuug

SEQ ID NO: 1851099 - RNA, 19 nt, Human
gcucucaggccagcugcuu

SEQ ID NO: 1851100 - RNA, 18 nt, Human
gcucucaggccagcugcu

SEQ ID NO: 1851101 - RNA, 17 nt, Human
gcucucaggccagcugc

SEQ ID NO: 1851102 - RNA, 18 nt, Human
gcucucaaguuaucaggg

SEQ ID NO: 1851103 - RNA, 19 nt, Human
gcucuacugaggugcuaug

SEQ ID NO: 1851104 - RNA, 16 nt, Human
gcuccucuccccagca

SEQ ID NO: 1851105 - RNA, 19 nt, Human
gcuccucuccccagcaagu

SEQ ID NO: 1851106 - RNA, 20 nt, Human
gcuccacuuggucugugaga

SEQ ID NO: 1851107 - RNA, 9 nt, Human
gcuccagac

SEQ ID NO: 1851108 - RNA, 21 nt, Human
gcuccagacacauguccaaga

SEQ ID NO: 1851109 - RNA, 18 nt, Human
gcuccagacacaugucca

SEQ ID NO: 1851110 - RNA, 23 nt, Human
gcuccagacacauguccaagaag

SEQ ID NO: 1851111 - RNA, 16 nt, Human
gcuccucccggugccc

SEQ ID NO: 1851112 - RNA, 19 nt, Human
gcuccucccggugcccaag

SEQ ID NO: 1851113 - RNA, 15 nt, Human
gcuccucuccccagc

SEQ ID NO: 1851114 - RNA, 17 nt, Human
gcuccagcucaccagcc

SEQ ID NO: 1851115 - RNA, 13 nt, Human
gcuccagcucacc

SEQ ID NO: 1851116 - RNA, 14 nt, Human
gcuccagcucacca

SEQ ID NO: 1851117 - RNA, 20 nt, Human
gcucugaucauccacugugc

SEQ ID NO: 1851118 - RNA, 21 nt, Human
gcucugcccauccugccccug

SEQ ID NO: 1851119 - RNA, 16 nt, Human
gcucuggagcccacug

SEQ ID NO: 1851120 - RNA, 15 nt, Human
gcucuggagcccacu

SEQ ID NO: 1851121 - RNA, 15 nt, Human
gcucugcccauccug

SEQ ID NO: 1851122 - RNA, 21 nt, Human
gcucugaucauccacugugcc

SEQ ID NO: 1851123 - RNA, 22 nt, Human
gcucugaucauccacugugcca

SEQ ID NO: 1851124 - RNA, 17 nt, Human
gcugaauacagaggcaa

SEQ ID NO: 1851125 - RNA, 23 nt, Human
gcugaaggcucgagcaugccugg

SEQ ID NO: 1851126 - RNA, 20 nt, Human
gcugaacuuguuuucuggga

SEQ ID NO: 1851127 - RNA, 16 nt, Human
gcugagccucagucuc

SEQ ID NO: 1851128 - RNA, 12 nt, Human
gcugagccucag

SEQ ID NO: 1851129 - RNA, 13 nt, Human
gcugacagacaca

SEQ ID NO: 1851130 - RNA, 17 nt, Human
gcucuggagcccacugu

SEQ ID NO: 1851131 - RNA, 23 nt, Human
gcucugucgcccaggcuggagug

SEQ ID NO: 1851132 - RNA, 15 nt, Human
gcugaggugggagga

SEQ ID NO: 1851133 - RNA, 15 nt, Human
gcugcacccucaggc

SEQ ID NO: 1851134 - RNA, 13 nt, Human
gcugcacccucag

SEQ ID NO: 1851135 - RNA, 16 nt, Human
gcugcacccucaggca

SEQ ID NO: 1851136 - RNA, 12 nt, Human
gcugccauccag

SEQ ID NO: 1851137 - RNA, 13 nt, Human
gcugccauccagg

SEQ ID NO: 1851138 - RNA, 17 nt, Human
gcugccccuggcagccc

SEQ ID NO: 1851139 - RNA, 16 nt, Human
gcugccccuggcagcc

SEQ ID NO: 1851140 - RNA, 15 nt, Human
gcugccccuggcagc

SEQ ID NO: 1851141 - RNA, 13 nt, Human
gcugccccuggca

SEQ ID NO: 1851142 - RNA, 17 nt, Human
gcugccauccagguuca

SEQ ID NO: 1851143 - RNA, 12 nt, Human
gcugcugacagu

SEQ ID NO: 1851144 - RNA, 16 nt, Human
ggccagugugacaagg

SEQ ID NO: 1851145 - RNA, 15 nt, Human
ggccagugcuccagc

SEQ ID NO: 1851146 - RNA, 13 nt, Human
ggccagugcucca

SEQ ID NO: 1851147 - RNA, 16 nt, Human
ggccaggcuggucuca

SEQ ID NO: 1851148 - RNA, 18 nt, Human
ggccaggcuggucucaaa

SEQ ID NO: 1851149 - RNA, 14 nt, Human
ggccaggcuggucu

SEQ ID NO: 1851150 - RNA, 21 nt, Human
ggccaaacucaccugccccuc

SEQ ID NO: 1851151 - RNA, 17 nt, Human
ggccaaacucaccugcc

SEQ ID NO: 1851152 - RNA, 17 nt, Human
ggcagugggagcugccu

SEQ ID NO: 1851153 - RNA, 16 nt, Human
ggcaccagcagccugg

SEQ ID NO: 1851154 - RNA, 15 nt, Human
ggcaccagcagccug

SEQ ID NO: 1851155 - RNA, 24 nt, Human
ggcacugcuuccagugaggcucug

SEQ ID NO: 1851156 - RNA, 18 nt, Human
ggcagugggagcugccug

SEQ ID NO: 1851157 - RNA, 19 nt, Human
ggcagugggagcugccugu

SEQ ID NO: 1851158 - RNA, 18 nt, Human
ggcauccaguaucuugaa

SEQ ID NO: 1851159 - RNA, 18 nt, Human
ggcauuuuacuguacaga

SEQ ID NO: 1851160 - RNA, 18 nt, Human
ggcccuucucuccagccc

SEQ ID NO: 1851161 - RNA, 17 nt, Human
ggcccuuccucuccacu

SEQ ID NO: 1851162 - RNA, 17 nt, Human
ggcccuucucuccagcc

SEQ ID NO: 1851163 - RNA, 16 nt, Human
ggcccuucucuccagc

SEQ ID NO: 1851164 - RNA, 15 nt, Human
ggcccuuccucucca

SEQ ID NO: 1851165 - RNA, 13 nt, Human
ggcccuuccucuc

SEQ ID NO: 1851166 - RNA, 19 nt, Human
ggcucacugcauccuccgc

SEQ ID NO: 1851167 - RNA, 16 nt, Human
ggcucacugcauccuc

SEQ ID NO: 1851168 - RNA, 17 nt, Human
ggcucacugcagccuca

SEQ ID NO: 1851169 - RNA, 16 nt, Human
ggcucacugcagccuc

SEQ ID NO: 1851170 - RNA, 14 nt, Human
ggcgugcaguggug

SEQ ID NO: 1851171 - RNA, 19 nt, Human
ggcgugcaguggugcgauc

SEQ ID NO: 1851172 - RNA, 23 nt, Human
ggcucagcaaaagaugcuucuca

SEQ ID NO: 1851173 - RNA, 21 nt, Human
ggcucagcggggacagcuccu

SEQ ID NO: 1851174 - RNA, 22 nt, Human
ggcucagcggggacagcuccuu

SEQ ID NO: 1851175 - RNA, 23 nt, Human
ggcucagcggggacagcuccuuc

SEQ ID NO: 1851176 - RNA, 13 nt, Human
ggccuccauccug

SEQ ID NO: 1851177 - RNA, 23 nt, Human
ggccuccaaguccacaguggaac

SEQ ID NO: 1851178 - RNA, 15 nt, Human
ggccugagcugggau

SEQ ID NO: 1851179 - RNA, 12 nt, Human
ggccugagcugg

SEQ ID NO: 1851180 - RNA, 15 nt, Human
ggccuucucugaagg

SEQ ID NO: 1851181 - RNA, 16 nt, Human
ggccuucucugaagga

SEQ ID NO: 1851182 - RNA, 13 nt, Human
ggccuuuggcuuc

SEQ ID NO: 1851183 - RNA, 14 nt, Human
ggccuuuggcuuca

SEQ ID NO: 1851184 - RNA, 21 nt, Human
ggccuggccagaugcaccagc

SEQ ID NO: 1851185 - RNA, 21 nt, Human
ggccugugucuaguuguuuga

SEQ ID NO: 1851186 - RNA, 20 nt, Human
ggccuguggaucaaauccag

SEQ ID NO: 1851187 - RNA, 23 nt, Human
ggccuucggccuccauccugagg

SEQ ID NO: 1851188 - RNA, 12 nt, Human
ggccuucucuga

SEQ ID NO: 1851189 - RNA, 20 nt, Human
ggaggucaaggcugcaguga

SEQ ID NO: 1851190 - RNA, 14 nt, Human
ggaggucgaggcag

SEQ ID NO: 1851191 - RNA, 14 nt, Human
ggaggugaccccag

SEQ ID NO: 1851192 - RNA, 16 nt, Human
ggaggggggagguggg

SEQ ID NO: 1851193 - RNA, 11 nt, Human
ggaggccagcc

SEQ ID NO: 1851194 - RNA, 12 nt, Human
ggaggccagccu

SEQ ID NO: 1851195 - RNA, 19 nt, Human
ggaggaaggaaacccagcu

SEQ ID NO: 1851196 - RNA, 23 nt, Human
ggaggaaggaaacccagcucugg

SEQ ID NO: 1851197 - RNA, 20 nt, Human
ggaggaaggaaacccagcuc

SEQ ID NO: 1851198 - RNA, 16 nt, Human
ggagccaauggagacu

SEQ ID NO: 1851199 - RNA, 16 nt, Human
ggagccccgaggccuu

SEQ ID NO: 1851200 - RNA, 22 nt, Human
ggagccccgaggccuucucuga

SEQ ID NO: 1851201 - RNA, 12 nt, Human
ggagcugccugu

SEQ ID NO: 1851202 - RNA, 21 nt, Human
ggagcugccuguucagcucca

SEQ ID NO: 1851203 - RNA, 16 nt, Human
ggagcaucagugcccu

SEQ ID NO: 1851204 - RNA, 24 nt, Human
ggcacagaaaauggaagacagcuc

SEQ ID NO: 1851205 - RNA, 22 nt, Human
ggcacaaucucggcucacugca

SEQ ID NO: 1851206 - RNA, 16 nt, Human
ggcacagggcaguggg

SEQ ID NO: 1851207 - RNA, 22 nt, Human
ggauguugaaaaaguucugcag

SEQ ID NO: 1851208 - RNA, 16 nt, Human
ggauguucugggacac

SEQ ID NO: 1851209 - RNA, 15 nt, Human
ggauguucugggaca

SEQ ID NO: 1851210 - RNA, 15 nt, Human
ggagugcagugagcc

SEQ ID NO: 1851211 - RNA, 14 nt, Human
ggauccugagccag

SEQ ID NO: 1851212 - RNA, 13 nt, Human
ggauccugagcca

SEQ ID NO: 1851213 - RNA, 14 nt, Human
ggauccuccaggug

SEQ ID NO: 1851214 - RNA, 15 nt, Human
ggauccuccaggugc

SEQ ID NO: 1851215 - RNA, 16 nt, Human
ggauggggcugcaccg

SEQ ID NO: 1851216 - RNA, 21 nt, Human
ggauguacaaggacagccccu

SEQ ID NO: 1851217 - RNA, 18 nt, Human
ggauggauuuccagccaa

SEQ ID NO: 1851218 - RNA, 14 nt, Human
ggaguggccacaga

SEQ ID NO: 1851219 - RNA, 15 nt, Human
ggaguucugguuccu

SEQ ID NO: 1851220 - RNA, 21 nt, Human
ggaguuggaagugugugaucu

SEQ ID NO: 1851221 - RNA, 16 nt, Human
gggacagcuccuucug

SEQ ID NO: 1851222 - RNA, 23 nt, Human
gggacagaggggguggccuccca

SEQ ID NO: 1851223 - RNA, 22 nt, Human
gggacagaggggguggccuccc

SEQ ID NO: 1851224 - RNA, 13 nt, Human
gggacagaggggg

SEQ ID NO: 1851225 - RNA, 13 nt, Human
gggaaggauacaa

SEQ ID NO: 1851226 - RNA, 16 nt, Human
gggaaggauacaaaag

SEQ ID NO: 1851227 - RNA, 21 nt, Human
gggacagcuccuucuguccua

SEQ ID NO: 1851228 - RNA, 23 nt, Human
aaaaauaugaccacacuccagcu

SEQ ID NO: 1851229 - RNA, 21 nt, Human
aaaaauaugaccacacuccag

SEQ ID NO: 1851230 - RNA, 13 nt, Human
aaaagaugcuucu

SEQ ID NO: 1851231 - RNA, 23 nt, Human
aaaacugcugacuguuuucucuu

SEQ ID NO: 1851232 - RNA, 22 nt, Human
aaaacugcugacuguuuucucu

SEQ ID NO: 1851233 - RNA, 15 nt, Human
aaaacccagauaaag

SEQ ID NO: 1851234 - RNA, 21 nt, Human
aaaaccaauguucucucuucu

SEQ ID NO: 1851235 - RNA, 15 nt, Human
aaaacaugcuacaca

SEQ ID NO: 1851236 - RNA, 14 nt, Human
aaaaaucucaaauu

SEQ ID NO: 1851237 - RNA, 17 nt, Human
aaaaaucucaaauuucu

SEQ ID NO: 1851238 - RNA, 19 nt, Human
aaaagggacugagaaauuu

SEQ ID NO: 1851239 - RNA, 19 nt, Human
aaaagguaugcaaucaaau

SEQ ID NO: 1851240 - RNA, 21 nt, Human
gggauuacaggcuccugccac

SEQ ID NO: 1851241 - RNA, 16 nt, Human
gggauuacaggcuccu

SEQ ID NO: 1851242 - RNA, 13 nt, Human
gggauuacaggcu

SEQ ID NO: 1851243 - RNA, 14 nt, Human
gggauuacaggcgu

SEQ ID NO: 1851244 - RNA, 12 nt, Human
gggauuacaggu

SEQ ID NO: 1851245 - RNA, 15 nt, Human
gggauuacaggugug

SEQ ID NO: 1851246 - RNA, 16 nt, Human
gggauuguaaaauggu

SEQ ID NO: 1851247 - RNA, 17 nt, Human
gggauuguaaaauggug

SEQ ID NO: 1851248 - RNA, 23 nt, Human
gggcagagcagagaccaucccug

SEQ ID NO: 1851249 - RNA, 14 nt, Human
gggcagaggaaagc

SEQ ID NO: 1851250 - RNA, 22 nt, Human
gggcagagcagagaccaucccu

SEQ ID NO: 1851251 - RNA, 17 nt, Human
gggcagagcagagacca

SEQ ID NO: 1851252 - RNA, 16 nt, Human
gggcaacccccagccu

SEQ ID NO: 1851253 - RNA, 18 nt, Human
gggcaacccccagccugc

SEQ ID NO: 1851254 - RNA, 16 nt, Human
gggcagagcagagacc

SEQ ID NO: 1851255 - RNA, 19 nt, Human
gggaggucgaggcaggagg

SEQ ID NO: 1851256 - RNA, 18 nt, Human
gggaggucgaggcaggag

SEQ ID NO: 1851257 - RNA, 17 nt, Human
gggaggucgaggcagga

SEQ ID NO: 1851258 - RNA, 18 nt, Human
gggagggcuccagacaca

SEQ ID NO: 1851259 - RNA, 17 nt, Human
gggagggcuccagacac

SEQ ID NO: 1851260 - RNA, 15 nt, Human
gggagggcuccagac

SEQ ID NO: 1851261 - RNA, 14 nt, Human
gggagggcuccaga

SEQ ID NO: 1851262 - RNA, 22 nt, Human
gggaggcucuggagcccacugu

SEQ ID NO: 1851263 - RNA, 23 nt, Human
gggcuacaccuuagccugcccuc

SEQ ID NO: 1851264 - RNA, 15 nt, Human
gggcgggaggauguu

SEQ ID NO: 1851265 - RNA, 22 nt, Human
gggccucggacuuagcugggag

SEQ ID NO: 1851266 - RNA, 15 nt, Human
gggccuccugugugu

SEQ ID NO: 1851267 - RNA, 13 nt, Human
gggccuccugugu

SEQ ID NO: 1851268 - RNA, 20 nt, Human
gggccucuuaugggcugggu

SEQ ID NO: 1851269 - RNA, 23 nt, Human
gggccaguuggucccccuuccau

SEQ ID NO: 1851270 - RNA, 22 nt, Human
gggccaguuggucccccuucca

SEQ ID NO: 1851271 - RNA, 18 nt, Human
gggccaguuggucccccu

SEQ ID NO: 1851272 - RNA, 14 nt, Human
gggccaguuggucc

SEQ ID NO: 1851273 - RNA, 18 nt, Human
gggccagugcuccagcca

SEQ ID NO: 1851274 - RNA, 21 nt, Human
aaaaugagccuggcaagaaug

SEQ ID NO: 1851275 - RNA, 14 nt, Human
aaaaugagccuggc

SEQ ID NO: 1851276 - RNA, 11 nt, Human
gggccaggagc

SEQ ID NO: 1851277 - RNA, 13 nt, Human
gggccaggcuggg

SEQ ID NO: 1851278 - RNA, 21 nt, Human
gggccaggcugggucgcccug

SEQ ID NO: 1851279 - RNA, 15 nt, Human
gggccaggcuggguc

SEQ ID NO: 1851280 - RNA, 14 nt, Human
gggccaggcugggu

SEQ ID NO: 1851281 - RNA, 14 nt, Human
gggccagugcucca

SEQ ID NO: 1851282 - RNA, 20 nt, Human
gggcuggguucuacccaggu

SEQ ID NO: 1851283 - RNA, 12 nt, Human
gggcugggcaga

SEQ ID NO: 1851284 - RNA, 18 nt, Human
gggcugggagcucugcag

SEQ ID NO: 1851285 - RNA, 16 nt, Human
gggcugggagcucugc

SEQ ID NO: 1851286 - RNA, 21 nt, Human
gggcugcccuggugcugccac

SEQ ID NO: 1851287 - RNA, 15 nt, Human
gggcugcccuggugc

SEQ ID NO: 1851288 - RNA, 14 nt, Human
gggcugcccuggug

SEQ ID NO: 1851289 - RNA, 13 nt, Human
gggcugcccuggu

SEQ ID NO: 1851290 - RNA, 18 nt, Human
gggcucagcaaaagaugc

SEQ ID NO: 1851291 - RNA, 22 nt, Human
gggcugcaccggcuggccuggc

SEQ ID NO: 1851292 - RNA, 10 nt, Human
gggcucagca

SEQ ID NO: 1851293 - RNA, 18 nt, Human
gggcugcaugcgggcuuc

SEQ ID NO: 1851294 - RNA, 21 nt, Human
gggcugcaugcgggcuuccuc

SEQ ID NO: 1851295 - RNA, 15 nt, Human
aaaaugugauaugua

SEQ ID NO: 1851296 - RNA, 22 nt, Human
gggcuggguucuacccaggugc

SEQ ID NO: 1851297 - RNA, 13 nt, Human
aaaaugucuuuau

SEQ ID NO: 1851298 - RNA, 12 nt, Human
aaaaugugugug

SEQ ID NO: 1851299 - RNA, 20 nt, Human
aaacaagaccacguuucuaa

SEQ ID NO: 1851300 - RNA, 16 nt, Human
aaacacauuuuucuua

SEQ ID NO: 1851301 - RNA, 20 nt, Human
aaacaagcacuaaacaaaga

SEQ ID NO: 1851302 - RNA, 22 nt, Human
aaacauccuacaagacacagug

SEQ ID NO: 1851303 - RNA, 18 nt, Human
aaacauccuacaagacac

SEQ ID NO: 1851304 - RNA, 12 nt, Human
ggggacagcucc

SEQ ID NO: 1851305 - RNA, 14 nt, Human
ggggacagcuccuu

SEQ ID NO: 1851306 - RNA, 20 nt, Human
ggggacagcuccuucugucc

SEQ ID NO: 1851307 - RNA, 21 nt, Human
aaaguucccuacuuccuguga

SEQ ID NO: 1851308 - RNA, 12 nt, Human
aaaguggugaga

SEQ ID NO: 1851309 - RNA, 23 nt, Human
aaaguucccuacuuccugugacu

SEQ ID NO: 1851310 - RNA, 16 nt, Human
aaaguuuguugaaaca

SEQ ID NO: 1851311 - RNA, 21 nt, Human
aaaguuucucuuuucaaaaca

SEQ ID NO: 1851312 - RNA, 23 nt, Human
aaaguuucucuuuucaaaacauu

SEQ ID NO: 1851313 - RNA, 13 nt, Human
aaauaaugugaaa

SEQ ID NO: 1851314 - RNA, 12 nt, Human
aaauaaugugaa

SEQ ID NO: 1851315 - RNA, 15 nt, Human
ggugggauccuccag

SEQ ID NO: 1851316 - RNA, 14 nt, Human
ggugggauccucca

SEQ ID NO: 1851317 - RNA, 20 nt, Human
ggugggaggauugcuugagc

SEQ ID NO: 1851318 - RNA, 18 nt, Human
aaagccuguuuaagagac

SEQ ID NO: 1851319 - RNA, 16 nt, Human
aaagccuguuuaagag

SEQ ID NO: 1851320 - RNA, 19 nt, Human
ggugggauccuccaggugc

SEQ ID NO: 1851321 - RNA, 13 nt, Human
gguggggcagcuu

SEQ ID NO: 1851322 - RNA, 17 nt, Human
gguggggcagcuugagg

SEQ ID NO: 1851323 - RNA, 23 nt, Human
gguggggucacucuggcagcuca

SEQ ID NO: 1851324 - RNA, 15 nt, Human
gguggggucacucug

SEQ ID NO: 1851325 - RNA, 17 nt, Human
gguggggggggugcugg

SEQ ID NO: 1851326 - RNA, 16 nt, Human
ggugucgggcaugaca

SEQ ID NO: 1851327 - RNA, 13 nt, Human
ggugucgggcaug

SEQ ID NO: 1851328 - RNA, 16 nt, Human
ggugugaccacugcag

SEQ ID NO: 1851329 - RNA, 16 nt, Human
ggugugacugaauuuc

SEQ ID NO: 1851330 - RNA, 18 nt, Human
ggugugagucaccaagcc

SEQ ID NO: 1851331 - RNA, 12 nt, Human
gguguggaagag

SEQ ID NO: 1851332 - RNA, 21 nt, Human
ggugugcggccuuuggcuuca

SEQ ID NO: 1851333 - RNA, 13 nt, Human
ggugugcucugau

SEQ ID NO: 1851334 - RNA, 22 nt, Human
gguucaggguuggccccugccc

SEQ ID NO: 1851335 - RNA, 18 nt, Human
gguucaggguuggccccu

SEQ ID NO: 1851336 - RNA, 21 nt, Human
gguucaggguuggccccugcc

SEQ ID NO: 1851337 - RNA, 24 nt, Human
gguuccagcaauucuccugccuca

SEQ ID NO: 1851338 - RNA, 15 nt, Human
gguuccccuguucac

SEQ ID NO: 1851339 - RNA, 23 nt, Human
gguuccagcaauucuccugccuc

SEQ ID NO: 1851340 - RNA, 22 nt, Human
gguucccuuugacgccauccca

SEQ ID NO: 1851341 - RNA, 16 nt, Human
gguuccuccccuccuc

SEQ ID NO: 1851342 - RNA, 21 nt, Human
gguucccuuugacgccauccc

SEQ ID NO: 1851343 - RNA, 14 nt, Human
gguuucagaaaugu

SEQ ID NO: 1851344 - RNA, 15 nt, Human
gguuucagaaaugug

SEQ ID NO: 1851345 - RNA, 12 nt, Human
gguuucagaaau

SEQ ID NO: 1851346 - RNA, 13 nt, Human
gguuucagaaaug

SEQ ID NO: 1851347 - RNA, 19 nt, Human
gguuucaccauguuggcca

SEQ ID NO: 1851348 - RNA, 20 nt, Human
gguuccuuccucugagccuu

SEQ ID NO: 1851349 - RNA, 19 nt, Human
gguuccuuccucugagccu

SEQ ID NO: 1851350 - RNA, 16 nt, Human
gguuuagaaagcuugc

SEQ ID NO: 1851351 - RNA, 14 nt, Human
gguagcuuuucccu

SEQ ID NO: 1851352 - RNA, 16 nt, Human
gguccacaacacacag

SEQ ID NO: 1851353 - RNA, 14 nt, Human
gguaugcaaucaaa

SEQ ID NO: 1851354 - RNA, 22 nt, Human
gguaugaucacggcucacugca

SEQ ID NO: 1851355 - RNA, 17 nt, Human
gguccacccaggagccc

SEQ ID NO: 1851356 - RNA, 12 nt, Human
gguccacccagg

SEQ ID NO: 1851357 - RNA, 13 nt, Human
gguccacccagga

SEQ ID NO: 1851358 - RNA, 15 nt, Human
gguccacccaggagc

SEQ ID NO: 1851359 - RNA, 16 nt, Human
gguccacccaggagcc

SEQ ID NO: 1851360 - RNA, 17 nt, Human
aaagacuaucuaaaugu

SEQ ID NO: 1851361 - RNA, 19 nt, Human
aaagacaccuacugagugg

SEQ ID NO: 1851362 - RNA, 13 nt, Human
aaagacaccuacu

SEQ ID NO: 1851363 - RNA, 18 nt, Human
aaagaaguggggacagag

SEQ ID NO: 1851364 - RNA, 12 nt, Human
aaacuuuacuau

SEQ ID NO: 1851365 - RNA, 18 nt, Human
aaacuuuacuauggcccu

SEQ ID NO: 1851366 - RNA, 17 nt, Human
aaacuuuaccuuuuuua

SEQ ID NO: 1851367 - RNA, 22 nt, Human
aaacuuuaccuuuuuuauacau

SEQ ID NO: 1851368 - RNA, 15 nt, Human
gguccauagagagca

SEQ ID NO: 1851369 - RNA, 18 nt, Human
ggguggggggggugcugg

SEQ ID NO: 1851370 - RNA, 15 nt, Human
ggguggggggggugc

SEQ ID NO: 1851371 - RNA, 12 nt, Human
ggguggugaccu

SEQ ID NO: 1851372 - RNA, 17 nt, Human
ggguguggcgcagcaua

SEQ ID NO: 1851373 - RNA, 20 nt, Human
ggguggggaccucaggccug

SEQ ID NO: 1851374 - RNA, 19 nt, Human
ggguggcaccagcagccug

SEQ ID NO: 1851375 - RNA, 12 nt, Human
ggggccuggcag

SEQ ID NO: 1851376 - RNA, 11 nt, Human
ggggccuggca

SEQ ID NO: 1851377 - RNA, 13 nt, Human
ggguggaugccug

SEQ ID NO: 1851378 - RNA, 15 nt, Human
ggguggcaccagcag

SEQ ID NO: 1851379 - RNA, 17 nt, Human
ggguggaugccuggugg

SEQ ID NO: 1851380 - RNA, 23 nt, Human
gguacaaccuguucugcuuuccu

SEQ ID NO: 1851381 - RNA, 24 nt, Human
gguacaaccuguucugcuuuccuc

SEQ ID NO: 1851382 - RNA, 18 nt, Human
gguaaucgaccugccucg

SEQ ID NO: 1851383 - RNA, 17 nt, Human
gguaaucgaccugccuc

SEQ ID NO: 1851384 - RNA, 14 nt, Human
gguaaucgaccugc

SEQ ID NO: 1851385 - RNA, 17 nt, Human
ggguuucuaaagcugcc

SEQ ID NO: 1851386 - RNA, 18 nt, Human
gguaacuagggaagauaa

SEQ ID NO: 1851387 - RNA, 14 nt, Human
gguaacaggcagau

SEQ ID NO: 1851388 - RNA, 20 nt, Human
gguaacaggcagauacagga

SEQ ID NO: 1851389 - RNA, 20 nt, Human
ggugcaaugaccuuucaaua

SEQ ID NO: 1851390 - RNA, 19 nt, Human
ggugcaaugaccuuucaau

SEQ ID NO: 1851391 - RNA, 18 nt, Human
ggugcaaugaccuuucaa

SEQ ID NO: 1851392 - RNA, 20 nt, Human
ggugcugggccccugccucu

SEQ ID NO: 1851393 - RNA, 19 nt, Human
ggugcugggccccugccuc

SEQ ID NO: 1851394 - RNA, 17 nt, Human
aaagcagggacuugaac

SEQ ID NO: 1851395 - RNA, 19 nt, Human
aaagcaggcagaacucauc

SEQ ID NO: 1851396 - RNA, 17 nt, Human
aaagcaggcagaacuca

SEQ ID NO: 1851397 - RNA, 16 nt, Human
aaagcagcguuucuau

SEQ ID NO: 1851398 - RNA, 18 nt, Human
aaagcagcguuucuauga

SEQ ID NO: 1851399 - RNA, 22 nt, Human
aaagcagcguuucuaugacaca

SEQ ID NO: 1851400 - RNA, 14 nt, Human
gguggaugccuggu

SEQ ID NO: 1851401 - RNA, 21 nt, Human
gguggaugccugguggcagcu

SEQ ID NO: 1851402 - RNA, 14 nt, Human
ggucggaaaacaug

SEQ ID NO: 1851403 - RNA, 17 nt, Human
ggucuacacugugcuga

SEQ ID NO: 1851404 - RNA, 13 nt, Human
ggucggaaaacau

SEQ ID NO: 1851405 - RNA, 13 nt, Human
aaagcaaaggaga

SEQ ID NO: 1851406 - RNA, 23 nt, Human
gguccugcugcaguugccaguca

SEQ ID NO: 1851407 - RNA, 21 nt, Human
gguccugcugcaguugccagu

SEQ ID NO: 1851408 - RNA, 13 nt, Human
aaagcaaaugucu

SEQ ID NO: 1851409 - RNA, 13 nt, Human
gaggucuguucuu

SEQ ID NO: 1851410 - RNA, 14 nt, Human
gaggucuguucuuu

SEQ ID NO: 1851411 - RNA, 11 nt, Human
gaggugggagg

SEQ ID NO: 1851412 - RNA, 12 nt, Human
gaggugggaucc

SEQ ID NO: 1851413 - RNA, 16 nt, Human
gagucccaccuuggcu

SEQ ID NO: 1851414 - RNA, 20 nt, Human
gagucccaccuuggcugcag

SEQ ID NO: 1851415 - RNA, 15 nt, Human
gagucaccaagccca

SEQ ID NO: 1851416 - RNA, 13 nt, Human
gagucaccaagcc

SEQ ID NO: 1851417 - RNA, 14 nt, Human
gagucaccaagccc

SEQ ID NO: 1851418 - RNA, 11 nt, Human
gagugcaguga

SEQ ID NO: 1851419 - RNA, 12 nt, Human
gagugcagugag

SEQ ID NO: 1851420 - RNA, 24 nt, Human
gagugagcacuaaggugugcucug

SEQ ID NO: 1851421 - RNA, 21 nt, Human
gagucccaccuuggcugcagg

SEQ ID NO: 1851422 - RNA, 12 nt, Human
gagugagcuggu

SEQ ID NO: 1851423 - RNA, 20 nt, Human
gaguuugggguaugggagag

SEQ ID NO: 1851424 - RNA, 16 nt, Human
gaguuguuacauuuuu

SEQ ID NO: 1851425 - RNA, 20 nt, Human
gaguuguuacauuuuuaagu

SEQ ID NO: 1851426 - RNA, 18 nt, Human
gagugccuuacacaaugg

SEQ ID NO: 1851427 - RNA, 14 nt, Human
gauacccaucccau

SEQ ID NO: 1851428 - RNA, 13 nt, Human
gauacccauccca

SEQ ID NO: 1851429 - RNA, 16 nt, Human
gauacuacaguuuguu

SEQ ID NO: 1851430 - RNA, 11 nt, Human
gauacuacagu

SEQ ID NO: 1851431 - RNA, 17 nt, Human
gauacgacaacuugcac

SEQ ID NO: 1851432 - RNA, 17 nt, Human
gauacuugaaaauuaac

SEQ ID NO: 1851433 - RNA, 18 nt, Human
gauaugcaguuuuccuua

SEQ ID NO: 1851434 - RNA, 16 nt, Human
gauacuugaaaauuaa

SEQ ID NO: 1851435 - RNA, 20 nt, Human
gauauguaccuaacgaagua

SEQ ID NO: 1851436 - RNA, 21 nt, Human
gaugaugaaaugaggucagag

SEQ ID NO: 1851437 - RNA, 20 nt, Human
gaugaucuuugcagacaggc

SEQ ID NO: 1851438 - RNA, 21 nt, Human
gaugaucuuugcagacaggca

SEQ ID NO: 1851439 - RNA, 14 nt, Human
gaugaucuuugcag

SEQ ID NO: 1851440 - RNA, 17 nt, Human
gaucucuugagccuggg

SEQ ID NO: 1851441 - RNA, 16 nt, Human
gaucucuugagccugg

SEQ ID NO: 1851442 - RNA, 12 nt, Human
gaucucuugagc

SEQ ID NO: 1851443 - RNA, 16 nt, Human
gauauuuugcuuugug

SEQ ID NO: 1851444 - RNA, 15 nt, Human
gauauuuuuuucuuu

SEQ ID NO: 1851445 - RNA, 15 nt, Human
gaucucuaacuucac

SEQ ID NO: 1851446 - RNA, 20 nt, Human
gauuacaggugugagccacc

SEQ ID NO: 1851447 - RNA, 20 nt, Human
gauuacaggugugaaccacc

SEQ ID NO: 1851448 - RNA, 18 nt, Human
gauuacugccuauuuuaa

SEQ ID NO: 1851449 - RNA, 14 nt, Human
gauuaccagggacu

SEQ ID NO: 1851450 - RNA, 16 nt, Human
gcagccacauuccuga

SEQ ID NO: 1851451 - RNA, 14 nt, Human
gcagccacuauugu

SEQ ID NO: 1851452 - RNA, 12 nt, Human
gcagccaggcca

SEQ ID NO: 1851453 - RNA, 14 nt, Human
gcagccaggccaca

SEQ ID NO: 1851454 - RNA, 13 nt, Human
gcagccaggccac

SEQ ID NO: 1851455 - RNA, 16 nt, Human
gcagccaggccacaag

SEQ ID NO: 1851456 - RNA, 14 nt, Human
gcauacguacacau

SEQ ID NO: 1851457 - RNA, 22 nt, Human
gcauaacguauaaaagccuguu

SEQ ID NO: 1851458 - RNA, 17 nt, Human
gcauaccacuuuuguuc

SEQ ID NO: 1851459 - RNA, 20 nt, Human
gcauaccacuuuuguucuug

SEQ ID NO: 1851460 - RNA, 23 nt, Human
gcaggcucucaggccagcugcuu

SEQ ID NO: 1851461 - RNA, 14 nt, Human
gcaggcuggcccug

SEQ ID NO: 1851462 - RNA, 18 nt, Human
gcaggcuggcccugcccu

SEQ ID NO: 1851463 - RNA, 17 nt, Human
gcaggcuggcccugccc

SEQ ID NO: 1851464 - RNA, 16 nt, Human
gcaggcuggcccugcc

SEQ ID NO: 1851465 - RNA, 15 nt, Human
gcaggcuggcccugc

SEQ ID NO: 1851466 - RNA, 21 nt, Human
gcaggcuggcccugcccuggu

SEQ ID NO: 1851467 - RNA, 20 nt, Human
gcaggcuggcccugcccugg

SEQ ID NO: 1851468 - RNA, 19 nt, Human
gcaggcuggcccugcccug

SEQ ID NO: 1851469 - RNA, 22 nt, Human
gcaggcucucaggccagcugcu

SEQ ID NO: 1851470 - RNA, 20 nt, Human
gcaggcucucaggccagcug

SEQ ID NO: 1851471 - RNA, 17 nt, Human
gcagcugcgguccaccc

SEQ ID NO: 1851472 - RNA, 19 nt, Human
gcagcugcgguccacccag

SEQ ID NO: 1851473 - RNA, 13 nt, Human
gcagggagggccu

SEQ ID NO: 1851474 - RNA, 10 nt, Human
gcagggaggg

SEQ ID NO: 1851475 - RNA, 19 nt, Human
gcagggacuugaacccaua

SEQ ID NO: 1851476 - RNA, 13 nt, Human
gcagggaaacagc

SEQ ID NO: 1851477 - RNA, 13 nt, Human
gcaagugagagcu

SEQ ID NO: 1851478 - RNA, 14 nt, Human
gcacaagcugcacc

SEQ ID NO: 1851479 - RNA, 23 nt, Human
gcacaagcuccaagcucccaggc

SEQ ID NO: 1851480 - RNA, 22 nt, Human
gcacaagcuccaagcucccagg

SEQ ID NO: 1851481 - RNA, 23 nt, Human
gcaauaaggggagaguaacccug

SEQ ID NO: 1851482 - RNA, 19 nt, Human
gcaccggcuggccuggccc

SEQ ID NO: 1851483 - RNA, 23 nt, Human
gcaccggcuggccuggccccuca

SEQ ID NO: 1851484 - RNA, 21 nt, Human
gcaccggcuggccuggccccu

SEQ ID NO: 1851485 - RNA, 18 nt, Human
gcaccggcuggccuggcc

SEQ ID NO: 1851486 - RNA, 19 nt, Human
gcacaugccucucucaggc

SEQ ID NO: 1851487 - RNA, 18 nt, Human
gcacaugccucucucagg

SEQ ID NO: 1851488 - RNA, 17 nt, Human
gcacaugccucucucag

SEQ ID NO: 1851489 - RNA, 14 nt, Human
gcacaugccucucu

SEQ ID NO: 1851490 - RNA, 21 nt, Human
gcacaugccucucucaggcca

SEQ ID NO: 1851491 - RNA, 20 nt, Human
gcacaugccucucucaggcc

SEQ ID NO: 1851492 - RNA, 22 nt, Human
gcacaugccucucucaggccaa

SEQ ID NO: 1851493 - RNA, 21 nt, Human
gcacaaucucggcucacugca

SEQ ID NO: 1851494 - RNA, 22 nt, Human
gcacaaucucggcucacugcau

SEQ ID NO: 1851495 - RNA, 19 nt, Human
gcacaucagcacgauuucu

SEQ ID NO: 1851496 - RNA, 20 nt, Human
gcacaucagcacgauuucug

SEQ ID NO: 1851497 - RNA, 21 nt, Human
gcacaucagcacgauuucugu

SEQ ID NO: 1851498 - RNA, 13 nt, Human
gcacaugccucuc

SEQ ID NO: 1851499 - RNA, 12 nt, Human
gcacugacauug

SEQ ID NO: 1851500 - RNA, 23 nt, Human
gcagagcaccuuagacagucccu

SEQ ID NO: 1851501 - RNA, 22 nt, Human
gcagagcaccuuagacaguccc

SEQ ID NO: 1851502 - RNA, 19 nt, Human
gcagagcaccuuagacagu

SEQ ID NO: 1851503 - RNA, 15 nt, Human
gcagagcagagacca

SEQ ID NO: 1851504 - RNA, 14 nt, Human
gcagagcagagacc

SEQ ID NO: 1851505 - RNA, 12 nt, Human
gcagagcagaga

SEQ ID NO: 1851506 - RNA, 24 nt, Human
gcagagcaccuuagacagucccug

SEQ ID NO: 1851507 - RNA, 20 nt, Human
gcagagcagagaccaucccu

SEQ ID NO: 1851508 - RNA, 19 nt, Human
gcagagcagagaccauccc

SEQ ID NO: 1851509 - RNA, 22 nt, Human
gaaugaaugucagugugacuga

SEQ ID NO: 1851510 - RNA, 18 nt, Human
gaaugaaugucaguguga

SEQ ID NO: 1851511 - RNA, 14 nt, Human
gaaugaaugucagu

SEQ ID NO: 1851512 - RNA, 11 nt, Human
gaaugaauguc

SEQ ID NO: 1851513 - RNA, 15 nt, Human
gaagcucagggccug

SEQ ID NO: 1851514 - RNA, 14 nt, Human
gaagcucagggccu

SEQ ID NO: 1851515 - RNA, 19 nt, Human
gaagcucagggccuggcuc

SEQ ID NO: 1851516 - RNA, 18 nt, Human
gaagcucagggccuggcu

SEQ ID NO: 1851517 - RNA, 17 nt, Human
gaagcucagggccuggc

SEQ ID NO: 1851518 - RNA, 16 nt, Human
gaagcucagggccugg

SEQ ID NO: 1851519 - RNA, 21 nt, Human
gaagcucagggccuggcucag

SEQ ID NO: 1851520 - RNA, 20 nt, Human
gaagcucagggccuggcuca

SEQ ID NO: 1851521 - RNA, 23 nt, Human
gaagcucagggccuggcucaggu

SEQ ID NO: 1851522 - RNA, 18 nt, Human
gaaauccagggugguggu

SEQ ID NO: 1851523 - RNA, 13 nt, Human
gaaauccagggug

SEQ ID NO: 1851524 - RNA, 15 nt, Human
gaaguggggacagag

SEQ ID NO: 1851525 - RNA, 18 nt, Human
gaagucuuuguacagaca

SEQ ID NO: 1851526 - RNA, 20 nt, Human
gaagucuuuguacagacaac

SEQ ID NO: 1851527 - RNA, 19 nt, Human
gaagucuuuguacagacaa

SEQ ID NO: 1851528 - RNA, 19 nt, Human
gaaggcucgagcaugccug

SEQ ID NO: 1851529 - RNA, 17 nt, Human
gaaggcucgagcaugcc

SEQ ID NO: 1851530 - RNA, 16 nt, Human
gaaggcucgagcaugc

SEQ ID NO: 1851531 - RNA, 21 nt, Human
gacacacagcucuguccuggg

SEQ ID NO: 1851532 - RNA, 19 nt, Human
gaauuuuggcugugucucc

SEQ ID NO: 1851533 - RNA, 21 nt, Human
gaauuuuauuuuuugggaaaa

SEQ ID NO: 1851534 - RNA, 20 nt, Human
gaauuugugaagguggaaau

SEQ ID NO: 1851535 - RNA, 21 nt, Human
gaauuuugugcccccauguaa

SEQ ID NO: 1851536 - RNA, 20 nt, Human
gaauuuugugcccccaugua

SEQ ID NO: 1851537 - RNA, 23 nt, Human
gaauuuuggcugugucucccuuc

SEQ ID NO: 1851538 - RNA, 15 nt, Human
gacacacagcucugu

SEQ ID NO: 1851539 - RNA, 17 nt, Human
gacacacagcucugucc

SEQ ID NO: 1851540 - RNA, 18 nt, Human
gacacacagcucuguccu

SEQ ID NO: 1851541 - RNA, 19 nt, Human
gacacacagcucuguccug

SEQ ID NO: 1851542 - RNA, 14 nt, Human
gacacacagcucug

SEQ ID NO: 1851543 - RNA, 13 nt, Human
gacacugaugggc

SEQ ID NO: 1851544 - RNA, 16 nt, Human
gacacuuaaaaauggu

SEQ ID NO: 1851545 - RNA, 15 nt, Human
gacacugaugggcaa

SEQ ID NO: 1851546 - RNA, 23 nt, Human
gacagcccgggcucugccuccca

SEQ ID NO: 1851547 - RNA, 22 nt, Human
gacagcccgggcucugccuccc

SEQ ID NO: 1851548 - RNA, 21 nt, Human
gacagcccgggcucugccucc

SEQ ID NO: 1851549 - RNA, 12 nt, Human
gacagacacagg

SEQ ID NO: 1851550 - RNA, 20 nt, Human
gacaggguuuugccauguug

SEQ ID NO: 1851551 - RNA, 22 nt, Human
gacaggguuuugccauguuggc

SEQ ID NO: 1851552 - RNA, 19 nt, Human
gacagccuggcacagggca

SEQ ID NO: 1851553 - RNA, 13 nt, Human
gacagccuggcac

SEQ ID NO: 1851554 - RNA, 13 nt, Human
gacagcccuccau

SEQ ID NO: 1851555 - RNA, 11 nt, Human
gacagcuccuu

SEQ ID NO: 1851556 - RNA, 14 nt, Human
gacagugaaagaaa

SEQ ID NO: 1851557 - RNA, 22 nt, Human
gacuaucuaaauguugaaagau

SEQ ID NO: 1851558 - RNA, 18 nt, Human
gacuaggguccuggggaa

SEQ ID NO: 1851559 - RNA, 16 nt, Human
gacuaggguccugggg

SEQ ID NO: 1851560 - RNA, 15 nt, Human
gacuaggguccuggg

SEQ ID NO: 1851561 - RNA, 12 nt, Human
gacucugucuca

SEQ ID NO: 1851562 - RNA, 23 nt, Human
gacuuuucuuucagccaagaauu

SEQ ID NO: 1851563 - RNA, 21 nt, Human
gacuuuucuuuguggcuuccu

SEQ ID NO: 1851564 - RNA, 11 nt, Human
gacuuuccucu

SEQ ID NO: 1851565 - RNA, 15 nt, Human
gagaagcggcuggca

SEQ ID NO: 1851566 - RNA, 13 nt, Human
gagaagcggcugg

SEQ ID NO: 1851567 - RNA, 16 nt, Human
gagaagcggcuggcag

SEQ ID NO: 1851568 - RNA, 12 nt, Human
gagaaggaagcc

SEQ ID NO: 1851569 - RNA, 20 nt, Human
gagaaggacccggaggggcc

SEQ ID NO: 1851570 - RNA, 23 nt, Human
gagaaggacccggaggggccugg

SEQ ID NO: 1851571 - RNA, 22 nt, Human
gagaaggacccggaggggccug

SEQ ID NO: 1851572 - RNA, 13 nt, Human
gagaccugccccu

SEQ ID NO: 1851573 - RNA, 12 nt, Human
gagaccugcccc

SEQ ID NO: 1851574 - RNA, 11 nt, Human
gagaccugccc

SEQ ID NO: 1851575 - RNA, 21 nt, Human
gagacccugucucaaaaaaag

SEQ ID NO: 1851576 - RNA, 14 nt, Human
gagaaucacuugaa

SEQ ID NO: 1851577 - RNA, 15 nt, Human
gagaaucacuugaac

SEQ ID NO: 1851578 - RNA, 14 nt, Human
gagcagggcucagc

SEQ ID NO: 1851579 - RNA, 22 nt, Human
gagcaugccuggauggggcugc

SEQ ID NO: 1851580 - RNA, 13 nt, Human
gagcaucaggcca

SEQ ID NO: 1851581 - RNA, 12 nt, Human
gagcaucaggcc

SEQ ID NO: 1851582 - RNA, 21 nt, Human
gagcagggcucagcggggaca

SEQ ID NO: 1851583 - RNA, 18 nt, Human
gagcugggugucaagagg

SEQ ID NO: 1851584 - RNA, 17 nt, Human
gagccuuccaggggugg

SEQ ID NO: 1851585 - RNA, 16 nt, Human
gagccuuccaggggug

SEQ ID NO: 1851586 - RNA, 15 nt, Human
gagccuuccaggggu

SEQ ID NO: 1851587 - RNA, 14 nt, Human
gagccuuccagggg

SEQ ID NO: 1851588 - RNA, 22 nt, Human
gagccuugaacuuugaccucug

SEQ ID NO: 1851589 - RNA, 19 nt, Human
gagccuugaacuuugaccu

SEQ ID NO: 1851590 - RNA, 21 nt, Human
gagcggagaaaggaagggcug

SEQ ID NO: 1851591 - RNA, 18 nt, Human
gagcggagaaaggaaggg

SEQ ID NO: 1851592 - RNA, 21 nt, Human
gagcugccuguucagcuccag

SEQ ID NO: 1851593 - RNA, 22 nt, Human
gagcugccuguucagcuccagc

SEQ ID NO: 1851594 - RNA, 22 nt, Human
gagaggcauccaguaucuugaa

SEQ ID NO: 1851595 - RNA, 21 nt, Human
gagaugaugccaugggcccuc

SEQ ID NO: 1851596 - RNA, 16 nt, Human
gagacuccugcaggca

SEQ ID NO: 1851597 - RNA, 15 nt, Human
gagacuccugcaggc

SEQ ID NO: 1851598 - RNA, 18 nt, Human
gagacuccugcaggcagc

SEQ ID NO: 1851599 - RNA, 17 nt, Human
gagacuccugcaggcag

SEQ ID NO: 1851600 - RNA, 14 nt, Human
gagaggcauccagu

SEQ ID NO: 1851601 - RNA, 13 nt, Human
gagauuuacaacu

SEQ ID NO: 1851602 - RNA, 14 nt, Human
gagauguagccccu

SEQ ID NO: 1851603 - RNA, 18 nt, Human
gagauugcaccacugcac

SEQ ID NO: 1851604 - RNA, 21 nt, Human
gagauugcaccacugcacucc

SEQ ID NO: 1851605 - RNA, 20 nt, Human
cuuucagccaagaauucuua

SEQ ID NO: 1851606 - RNA, 23 nt, Human
cuuucagccaagaauucuuaaau

SEQ ID NO: 1851607 - RNA, 16 nt, Human
cuuucacaaccuucug

SEQ ID NO: 1851608 - RNA, 23 nt, Human
cuuucaauaggaaaaacugauuu

SEQ ID NO: 1851609 - RNA, 14 nt, Human
cuuucacaaccuuc

SEQ ID NO: 1851610 - RNA, 22 nt, Human
cuuuccugaggcugggcucccu

SEQ ID NO: 1851611 - RNA, 13 nt, Human
cuuuguaaugaaa

SEQ ID NO: 1851612 - RNA, 15 nt, Human
cuuuguaaauuguca

SEQ ID NO: 1851613 - RNA, 21 nt, Human
cuuugggcugcccuggugcug

SEQ ID NO: 1851614 - RNA, 20 nt, Human
cuuugggcugcccuggugcu

SEQ ID NO: 1851615 - RNA, 19 nt, Human
cuuugggcugcccuggugc

SEQ ID NO: 1851616 - RNA, 15 nt, Human
cuuugggcugcccug

SEQ ID NO: 1851617 - RNA, 14 nt, Human
cuuugggcugcccu

SEQ ID NO: 1851618 - RNA, 16 nt, Human
cuuucuagccagagga

SEQ ID NO: 1851619 - RNA, 22 nt, Human
cuuugauauuuucaacgcagcc

SEQ ID NO: 1851620 - RNA, 15 nt, Human
cuuucuagccagagg

SEQ ID NO: 1851621 - RNA, 17 nt, Human
cuuucuacccagcgagc

SEQ ID NO: 1851622 - RNA, 13 nt, Human
cuuuuauaaacuu

SEQ ID NO: 1851623 - RNA, 14 nt, Human
cuuuuauaaacuuu

SEQ ID NO: 1851624 - RNA, 18 nt, Human
cuuuuaugugaaacaugu

SEQ ID NO: 1851625 - RNA, 14 nt, Human
cuuuuaugugaaac

SEQ ID NO: 1851626 - RNA, 15 nt, Human
gaaaauguaugugua

SEQ ID NO: 1851627 - RNA, 23 nt, Human
gaaaauggacguguuaugacucc

SEQ ID NO: 1851628 - RNA, 19 nt, Human
gaaaauggacguguuauga

SEQ ID NO: 1851629 - RNA, 14 nt, Human
gaaaaacugauuuu

SEQ ID NO: 1851630 - RNA, 18 nt, Human
gaaaagaaaaaugagccu

SEQ ID NO: 1851631 - RNA, 21 nt, Human
gaaaauggaagacagcucuua

SEQ ID NO: 1851632 - RNA, 23 nt, Human
gaaaaugcuguauuagucacaga

SEQ ID NO: 1851633 - RNA, 13 nt, Human
cuuuugccauuga

SEQ ID NO: 1851634 - RNA, 13 nt, Human
cuuuuggagucag

SEQ ID NO: 1851635 - RNA, 16 nt, Human
cuuuugccguuauuaa

SEQ ID NO: 1851636 - RNA, 23 nt, Human
cuuuugcccacacuugggagcaa

SEQ ID NO: 1851637 - RNA, 15 nt, Human
cuuuuggcauuuuac

SEQ ID NO: 1851638 - RNA, 18 nt, Human
cuuuugucuaugggacuc

SEQ ID NO: 1851639 - RNA, 21 nt, Human
cuuuuuuuuuuuugagacaga

SEQ ID NO: 1851640 - RNA, 22 nt, Human
cuuuuuuuuuuuuuaaagacag

SEQ ID NO: 1851641 - RNA, 23 nt, Human
cuuuuuuuuuuuuuaaagacaga

SEQ ID NO: 1851642 - RNA, 23 nt, Human
cuuuuuuggcugcugaaggcucg

SEQ ID NO: 1851643 - RNA, 12 nt, Human
cuuuugugcauu

SEQ ID NO: 1851644 - RNA, 13 nt, Human
cuuuugugcauua

SEQ ID NO: 1851645 - RNA, 20 nt, Human
cuuuuuuuuuuuugagacag

SEQ ID NO: 1851646 - RNA, 22 nt, Human
gaaaggcuccaggagcagccac

SEQ ID NO: 1851647 - RNA, 20 nt, Human
gaaaggcuccaggagcagcc

SEQ ID NO: 1851648 - RNA, 21 nt, Human
gaaaggcuccaggagcagcca

SEQ ID NO: 1851649 - RNA, 20 nt, Human
gaaagacuaucuaaauguug

SEQ ID NO: 1851650 - RNA, 21 nt, Human
gaaagaaaauaccaaggaaca

SEQ ID NO: 1851651 - RNA, 19 nt, Human
gaaaucaccgaaaacgugg

SEQ ID NO: 1851652 - RNA, 20 nt, Human
gaaagggacgcuacccggga

SEQ ID NO: 1851653 - RNA, 19 nt, Human
gaaagggacuuggaagcuc

SEQ ID NO: 1851654 - RNA, 22 nt, Human
gaaagggacuuggaagcuccgc

SEQ ID NO: 1851655 - RNA, 13 nt, Human
cuucuagaaccag

SEQ ID NO: 1851656 - RNA, 17 nt, Human
cuucuagaaccaggcaa

SEQ ID NO: 1851657 - RNA, 17 nt, Human
cuuccugcaacaccuug

SEQ ID NO: 1851658 - RNA, 23 nt, Human
cuucugacccaugcugcccugug

SEQ ID NO: 1851659 - RNA, 22 nt, Human
cuucugacccaugcugcccugu

SEQ ID NO: 1851660 - RNA, 21 nt, Human
cuucugacccaugcugcccug

SEQ ID NO: 1851661 - RNA, 20 nt, Human
cuucugacccaugcugcccu

SEQ ID NO: 1851662 - RNA, 21 nt, Human
cuucuguugcugccucaugcu

SEQ ID NO: 1851663 - RNA, 23 nt, Human
cuucuucagagacuccugcaggc

SEQ ID NO: 1851664 - RNA, 20 nt, Human
cuucuguugcugccucaugc

SEQ ID NO: 1851665 - RNA, 19 nt, Human
cuucuguugcugccucaug

SEQ ID NO: 1851666 - RNA, 18 nt, Human
cuucuguugcugccucau

SEQ ID NO: 1851667 - RNA, 17 nt, Human
cuucuguugcugccuca

SEQ ID NO: 1851668 - RNA, 19 nt, Human
cuugaauuguaaggaauga

SEQ ID NO: 1851669 - RNA, 18 nt, Human
cuugaauuguaaggaaug

SEQ ID NO: 1851670 - RNA, 14 nt, Human
cuugacagggcaca

SEQ ID NO: 1851671 - RNA, 15 nt, Human
cuugacagggcacac

SEQ ID NO: 1851672 - RNA, 13 nt, Human
cuugacagggcac

SEQ ID NO: 1851673 - RNA, 20 nt, Human
cuugacagggcacaccgggc

SEQ ID NO: 1851674 - RNA, 20 nt, Human
cuuggcgcugccccuggcag

SEQ ID NO: 1851675 - RNA, 17 nt, Human
cuuggcgcugccccugg

SEQ ID NO: 1851676 - RNA, 14 nt, Human
cuuggcgcugcccc

SEQ ID NO: 1851677 - RNA, 12 nt, Human
cuuggcgcugcc

SEQ ID NO: 1851678 - RNA, 13 nt, Human
cuugaugccuggc

SEQ ID NO: 1851679 - RNA, 12 nt, Human
cuugaugccugg

SEQ ID NO: 1851680 - RNA, 16 nt, Human
cuuauggaacacucug

SEQ ID NO: 1851681 - RNA, 13 nt, Human
cuuauggaacacu

SEQ ID NO: 1851682 - RNA, 19 nt, Human
cuucacggaagagccuugc

SEQ ID NO: 1851683 - RNA, 15 nt, Human
cuucacggaagagcc

SEQ ID NO: 1851684 - RNA, 22 nt, Human
cuucaccuuuguccccaccgca

SEQ ID NO: 1851685 - RNA, 21 nt, Human
cuucaccuuuguccccaccgc

SEQ ID NO: 1851686 - RNA, 21 nt, Human
cuuauggaacacucugagacu

SEQ ID NO: 1851687 - RNA, 20 nt, Human
cuuauggaacacucugagac

SEQ ID NO: 1851688 - RNA, 19 nt, Human
cuuauggaacacucugaga

SEQ ID NO: 1851689 - RNA, 17 nt, Human
cuuauggaacacucuga

SEQ ID NO: 1851690 - RNA, 19 nt, Human
cugugcugagucugaaggc

SEQ ID NO: 1851691 - RNA, 14 nt, Human
cugugcugagucug

SEQ ID NO: 1851692 - RNA, 12 nt, Human
cugugcugaguc

SEQ ID NO: 1851693 - RNA, 23 nt, Human
cuucccaccucucucacuccuug

SEQ ID NO: 1851694 - RNA, 21 nt, Human
cuucccaccucucucacuccu

SEQ ID NO: 1851695 - RNA, 21 nt, Human
cuuccauaaucuggacuccuc

SEQ ID NO: 1851696 - RNA, 11 nt, Human
cuuccauaauc

SEQ ID NO: 1851697 - RNA, 11 nt, Human
cuucccaccuc

SEQ ID NO: 1851698 - RNA, 23 nt, Human
cuuccagugaggcucugcccuug

SEQ ID NO: 1851699 - RNA, 22 nt, Human
cuuccagugaggcucugcccuu

SEQ ID NO: 1851700 - RNA, 21 nt, Human
cuuccagugaggcucugcccu

SEQ ID NO: 1851701 - RNA, 19 nt, Human
cuucagagacuccugcagg

SEQ ID NO: 1851702 - RNA, 18 nt, Human
cuucagagacuccugcag

SEQ ID NO: 1851703 - RNA, 20 nt, Human
cuucagagacuccugcaggc

SEQ ID NO: 1851704 - RNA, 17 nt, Human
cuucagagacuccugca

SEQ ID NO: 1851705 - RNA, 15 nt, Human
cuucacuguaaaaua

SEQ ID NO: 1851706 - RNA, 16 nt, Human
cugucgcccaggcugg

SEQ ID NO: 1851707 - RNA, 13 nt, Human
cugucgcccaguc

SEQ ID NO: 1851708 - RNA, 19 nt, Human
cugucgagaaacagccugu

SEQ ID NO: 1851709 - RNA, 15 nt, Human
cugugaagagaacca

SEQ ID NO: 1851710 - RNA, 16 nt, Human
cugugagaugcuagaa

SEQ ID NO: 1851711 - RNA, 21 nt, Human
cugugagaugcuagaacuccc

SEQ ID NO: 1851712 - RNA, 14 nt, Human
cugugcucuggaca

SEQ ID NO: 1851713 - RNA, 15 nt, Human
cugugcucuggacag

SEQ ID NO: 1851714 - RNA, 19 nt, Human
cugugcuccauggcugcca

SEQ ID NO: 1851715 - RNA, 22 nt, Human
cugguuuccugcccugggaggc

SEQ ID NO: 1851716 - RNA, 16 nt, Human
cugguuuccugcccug

SEQ ID NO: 1851717 - RNA, 21 nt, Human
cugguuuccugcccugggagg

SEQ ID NO: 1851718 - RNA, 18 nt, Human
cugguuuccugcccuggg

SEQ ID NO: 1851719 - RNA, 18 nt, Human
cugucagccauuccuguu

SEQ ID NO: 1851720 - RNA, 12 nt, Human
cuguccugccua

SEQ ID NO: 1851721 - RNA, 20 nt, Human
cugucauuugagcagggcuc

SEQ ID NO: 1851722 - RNA, 17 nt, Human
cugucauuugagcaggg

SEQ ID NO: 1851723 - RNA, 18 nt, Human
cugucauuugagcagggc

SEQ ID NO: 1851724 - RNA, 16 nt, Human
cugucauuugagcagg

SEQ ID NO: 1851725 - RNA, 23 nt, Human
cuguacuugcucuugaugccugg

SEQ ID NO: 1851726 - RNA, 22 nt, Human
cuguacuugcucuugaugccug

SEQ ID NO: 1851727 - RNA, 21 nt, Human
cuguaggaagguuaauguuca

SEQ ID NO: 1851728 - RNA, 15 nt, Human
cuggcagcucagaga

SEQ ID NO: 1851729 - RNA, 13 nt, Human
cuggccccucagg

SEQ ID NO: 1851730 - RNA, 16 nt, Human
cuggacugugugcuca

SEQ ID NO: 1851731 - RNA, 14 nt, Human
cuggcagcucagag

SEQ ID NO: 1851732 - RNA, 13 nt, Human
cuggcagcucaga

SEQ ID NO: 1851733 - RNA, 12 nt, Human
cuggcagcucag

SEQ ID NO: 1851734 - RNA, 21 nt, Human
cuggccccucagggucccugg

SEQ ID NO: 1851735 - RNA, 20 nt, Human
cuggccccucagggucccug

SEQ ID NO: 1851736 - RNA, 18 nt, Human
cuggccccucaggguccc

SEQ ID NO: 1851737 - RNA, 17 nt, Human
cuggccccucagggucc

SEQ ID NO: 1851738 - RNA, 20 nt, Human
cuggcuccaaacccucgagg

SEQ ID NO: 1851739 - RNA, 19 nt, Human
cuggcuccaaacccucgag

SEQ ID NO: 1851740 - RNA, 13 nt, Human
cuggcucaucucu

SEQ ID NO: 1851741 - RNA, 20 nt, Human
cuggcuccagcuggccggga

SEQ ID NO: 1851742 - RNA, 18 nt, Human
cuggcuccagcuggccgg

SEQ ID NO: 1851743 - RNA, 14 nt, Human
cuggcuccagcugg

SEQ ID NO: 1851744 - RNA, 13 nt, Human
cuggcuccagcug

SEQ ID NO: 1851745 - RNA, 15 nt, Human
cuggcucccacaggc

SEQ ID NO: 1851746 - RNA, 12 nt, Human
cugggacacagu

SEQ ID NO: 1851747 - RNA, 13 nt, Human
cugggacacaguu

SEQ ID NO: 1851748 - RNA, 17 nt, Human
cugggcagaaggaagac

SEQ ID NO: 1851749 - RNA, 17 nt, Human
cuggggaaccugacccc

SEQ ID NO: 1851750 - RNA, 16 nt, Human
cuggggaaccugaccc

SEQ ID NO: 1851751 - RNA, 15 nt, Human
cuggggaaccugacc

SEQ ID NO: 1851752 - RNA, 16 nt, Human
cugggcagaaggaaga

SEQ ID NO: 1851753 - RNA, 18 nt, Human
cugggcagaaggaagacu

SEQ ID NO: 1851754 - RNA, 16 nt, Human
cuggggccgaaagaac

SEQ ID NO: 1851755 - RNA, 18 nt, Human
cuggggccaggcuggguc

SEQ ID NO: 1851756 - RNA, 23 nt, Human
cuggugacuuuccucuuuggucu

SEQ ID NO: 1851757 - RNA, 17 nt, Human
cuggguguggcgcagca

SEQ ID NO: 1851758 - RNA, 16 nt, Human
cuggguguggcgcagc

SEQ ID NO: 1851759 - RNA, 22 nt, Human
cuggguggcaccagcagccugg

SEQ ID NO: 1851760 - RNA, 23 nt, Human
cuggguggcaccagcagccugga

SEQ ID NO: 1851761 - RNA, 21 nt, Human
cuggugacuuuccucuuuggu

SEQ ID NO: 1851762 - RNA, 20 nt, Human
cuggugacuuuccucuuugg

SEQ ID NO: 1851763 - RNA, 15 nt, Human
cuggugacuuuccuc

SEQ ID NO: 1851764 - RNA, 23 nt, Human
cuggguuccuuccucugagccuu

SEQ ID NO: 1851765 - RNA, 22 nt, Human
cuggguuccuuccucugagccu

SEQ ID NO: 1851766 - RNA, 18 nt, Human
cuggguuccuuccucuga

SEQ ID NO: 1851767 - RNA, 22 nt, Human
cuggguuccagcaauucuccug

SEQ ID NO: 1851768 - RNA, 14 nt, Human
cuggguucacugca

SEQ ID NO: 1851769 - RNA, 14 nt, Human
cugccuguucagcu

SEQ ID NO: 1851770 - RNA, 15 nt, Human
cugccuguucagcuc

SEQ ID NO: 1851771 - RNA, 23 nt, Human
cugccugggaucccucauccuca

SEQ ID NO: 1851772 - RNA, 15 nt, Human
cugccucgaacuggc

SEQ ID NO: 1851773 - RNA, 17 nt, Human
cugccucgaacuggcug

SEQ ID NO: 1851774 - RNA, 18 nt, Human
cugccucgaacuggcugc

SEQ ID NO: 1851775 - RNA, 19 nt, Human
cugccucgaacuggcugca

SEQ ID NO: 1851776 - RNA, 22 nt, Human
cugccugggaucccucauccuc

SEQ ID NO: 1851777 - RNA, 15 nt, Human
cugcuacagagcaga

SEQ ID NO: 1851778 - RNA, 19 nt, Human
cugccuguugggccaggag

SEQ ID NO: 1851779 - RNA, 18 nt, Human
cugccuguugggccagga

SEQ ID NO: 1851780 - RNA, 14 nt, Human
cugccuguugggcc

SEQ ID NO: 1851781 - RNA, 16 nt, Human
cugccuguugggccag

SEQ ID NO: 1851782 - RNA, 16 nt, Human
cugcuaauuccccaga

SEQ ID NO: 1851783 - RNA, 15 nt, Human
cugcugacagacaca

SEQ ID NO: 1851784 - RNA, 18 nt, Human
cugcugacagacacaggc

SEQ ID NO: 1851785 - RNA, 19 nt, Human
cugcugacagacacaggcc

SEQ ID NO: 1851786 - RNA, 20 nt, Human
cugcugacagacacaggccc

SEQ ID NO: 1851787 - RNA, 21 nt, Human
cugcugacagacacaggcccg

SEQ ID NO: 1851788 - RNA, 23 nt, Human
cugcugacagacacaggcccggc

SEQ ID NO: 1851789 - RNA, 11 nt, Human
cugcugacagu

SEQ ID NO: 1851790 - RNA, 13 nt, Human
cugcuuaacuuca

SEQ ID NO: 1851791 - RNA, 22 nt, Human
cugcuuuuuaaagaaugcucuu

SEQ ID NO: 1851792 - RNA, 17 nt, Human
cugcuuuuuauggccug

SEQ ID NO: 1851793 - RNA, 14 nt, Human
cugcuucagccucc

SEQ ID NO: 1851794 - RNA, 16 nt, Human
cugcuucagccucccg

SEQ ID NO: 1851795 - RNA, 15 nt, Human
cugcuuaacuucaca

SEQ ID NO: 1851796 - RNA, 17 nt, Human
cugcuuaacuucacaua

SEQ ID NO: 1851797 - RNA, 13 nt, Human
cugcuucagccuc

SEQ ID NO: 1851798 - RNA, 13 nt, Human
cuggacugugugc

SEQ ID NO: 1851799 - RNA, 17 nt, Human
cuggaacacuaaugagg

SEQ ID NO: 1851800 - RNA, 16 nt, Human
cuggaaauauuaagaa

SEQ ID NO: 1851801 - RNA, 18 nt, Human
cugcuuuuuauggccugu

SEQ ID NO: 1851802 - RNA, 20 nt, Human
cugagacucgcgacaaugca

SEQ ID NO: 1851803 - RNA, 19 nt, Human
cugagacucgcgacaaugc

SEQ ID NO: 1851804 - RNA, 17 nt, Human
cugagacucgcgacaau

SEQ ID NO: 1851805 - RNA, 20 nt, Human
cugcauuuaaaagauacagu

SEQ ID NO: 1851806 - RNA, 22 nt, Human
cugcauuuaaaagauacaguua

SEQ ID NO: 1851807 - RNA, 13 nt, Human
cugcauuugugaa

SEQ ID NO: 1851808 - RNA, 20 nt, Human
cugcauucaggaucaaaccc

SEQ ID NO: 1851809 - RNA, 13 nt, Human
cugcauguuacau

SEQ ID NO: 1851810 - RNA, 15 nt, Human
cugcauguuugugau

SEQ ID NO: 1851811 - RNA, 17 nt, Human
cugccaaugggagcuca

SEQ ID NO: 1851812 - RNA, 15 nt, Human
cugccaaugggagcu

SEQ ID NO: 1851813 - RNA, 22 nt, Human
cugcauuugugaaaugauggug

SEQ ID NO: 1851814 - RNA, 17 nt, Human
cugcauuugugaaauga

SEQ ID NO: 1851815 - RNA, 15 nt, Human
cugcauuugugaaau

SEQ ID NO: 1851816 - RNA, 14 nt, Human
cugcauuugugaaa

SEQ ID NO: 1851817 - RNA, 18 nt, Human
cugcccugugggccccca

SEQ ID NO: 1851818 - RNA, 16 nt, Human
cugcccugugggcccc

SEQ ID NO: 1851819 - RNA, 15 nt, Human
cugcccugugggccc

SEQ ID NO: 1851820 - RNA, 13 nt, Human
cugcccugugagu

SEQ ID NO: 1851821 - RNA, 12 nt, Human
cugcccugugag

SEQ ID NO: 1851822 - RNA, 23 nt, Human
cugcccugguuuccugcccuggg

SEQ ID NO: 1851823 - RNA, 22 nt, Human
cugcccugguuuccugcccugg

SEQ ID NO: 1851824 - RNA, 21 nt, Human
cugcccuggugcugccacacu

SEQ ID NO: 1851825 - RNA, 20 nt, Human
cugcccuggugcugccacac

SEQ ID NO: 1851826 - RNA, 22 nt, Human
cugccccucaacucuccuccag

SEQ ID NO: 1851827 - RNA, 14 nt, Human
cugccccucaacuc

SEQ ID NO: 1851828 - RNA, 19 nt, Human
cugcccccucugcccugcg

SEQ ID NO: 1851829 - RNA, 18 nt, Human
cugcccccucugcccugc

SEQ ID NO: 1851830 - RNA, 17 nt, Human
cugcccccucugcccug

SEQ ID NO: 1851831 - RNA, 16 nt, Human
cugcccccucugcccu

SEQ ID NO: 1851832 - RNA, 19 nt, Human
cugcccuggugcugccaca

SEQ ID NO: 1851833 - RNA, 18 nt, Human
cugcccuggugcugccac

SEQ ID NO: 1851834 - RNA, 16 nt, Human
cugcccuggugcugcc

SEQ ID NO: 1851835 - RNA, 17 nt, Human
cugcccuggugcugcca

SEQ ID NO: 1851836 - RNA, 19 nt, Human
cugccccagggcucccggc

SEQ ID NO: 1851837 - RNA, 15 nt, Human
cugcccccucugccc

SEQ ID NO: 1851838 - RNA, 14 nt, Human
cugcccccucugcc

SEQ ID NO: 1851839 - RNA, 12 nt, Human
cugccauccagg

SEQ ID NO: 1851840 - RNA, 15 nt, Human
cugccagggacagag

SEQ ID NO: 1851841 - RNA, 12 nt, Human
cugccagggaca

SEQ ID NO: 1851842 - RNA, 11 nt, Human
cugccagggac

SEQ ID NO: 1851843 - RNA, 20 nt, Human
cugccauauucuguuggcca

SEQ ID NO: 1851844 - RNA, 21 nt, Human
cugccauauucuguuggccag

SEQ ID NO: 1851845 - RNA, 22 nt, Human
cugccauauucuguuggccagu

SEQ ID NO: 1851846 - RNA, 23 nt, Human
cugccauauucuguuggccagug

SEQ ID NO: 1851847 - RNA, 14 nt, Human
gugaugagaggaaa

SEQ ID NO: 1851848 - RNA, 16 nt, Human
gugaugagaggaaauc

SEQ ID NO: 1851849 - RNA, 18 nt, Human
gugauggggcccugccuc

SEQ ID NO: 1851850 - RNA, 17 nt, Human
gugauggggcccugccu

SEQ ID NO: 1851851 - RNA, 16 nt, Human
gugauggggcccugcc

SEQ ID NO: 1851852 - RNA, 14 nt, Human
gugauggggcccug

SEQ ID NO: 1851853 - RNA, 22 nt, Human
gugaugcgcaugucacggaggg

SEQ ID NO: 1851854 - RNA, 13 nt, Human
aacuuccaauuua

SEQ ID NO: 1851855 - RNA, 22 nt, Human
aacuucuccccugguagaaaga

SEQ ID NO: 1851856 - RNA, 23 nt, Human
gugcauuaucuagauacuguauc

SEQ ID NO: 1851857 - RNA, 19 nt, Human
gugcauguguguucaugca

SEQ ID NO: 1851858 - RNA, 15 nt, Human
gugcauuaucuagau

SEQ ID NO: 1851859 - RNA, 19 nt, Human
gugcauuaucuagauacug

SEQ ID NO: 1851860 - RNA, 12 nt, Human
gugccucugccu

SEQ ID NO: 1851861 - RNA, 19 nt, Human
gugauggggcccugccucc

SEQ ID NO: 1851862 - RNA, 16 nt, Human
gugaugguuccccugu

SEQ ID NO: 1851863 - RNA, 14 nt, Human
gugaugguuccccu

SEQ ID NO: 1851864 - RNA, 22 nt, Human
gugaugguuccccuguucacuc

SEQ ID NO: 1851865 - RNA, 21 nt, Human
gugcacacaccagagcccacc

SEQ ID NO: 1851866 - RNA, 22 nt, Human
gugcaugcugucccuuacguga

SEQ ID NO: 1851867 - RNA, 21 nt, Human
aacucuucaaucucuugcacu

SEQ ID NO: 1851868 - RNA, 20 nt, Human
aacucugacaacagacuucu

SEQ ID NO: 1851869 - RNA, 23 nt, Human
aacucugacaacagacuucugaa

SEQ ID NO: 1851870 - RNA, 22 nt, Human
aacucugacaacagacuucuga

SEQ ID NO: 1851871 - RNA, 22 nt, Human
gugagucgaggacagggaggug

SEQ ID NO: 1851872 - RNA, 22 nt, Human
gugaggccagagacacaagccu

SEQ ID NO: 1851873 - RNA, 17 nt, Human
gugaggccagagacaca

SEQ ID NO: 1851874 - RNA, 21 nt, Human
gugagaugcuagaacucccuu

SEQ ID NO: 1851875 - RNA, 19 nt, Human
gugaacuugggccacugug

SEQ ID NO: 1851876 - RNA, 17 nt, Human
gugaacuugggccacug

SEQ ID NO: 1851877 - RNA, 15 nt, Human
aacugcugacuguuu

SEQ ID NO: 1851878 - RNA, 21 nt, Human
aacugcugacuguuuucucuu

SEQ ID NO: 1851879 - RNA, 20 nt, Human
aacugcugacuguuuucucu

SEQ ID NO: 1851880 - RNA, 23 nt, Human
aacugcugacuguuuucucuuga

SEQ ID NO: 1851881 - RNA, 16 nt, Human
aacuggauuaaacuua

SEQ ID NO: 1851882 - RNA, 11 nt, Human
aacuggcugca

SEQ ID NO: 1851883 - RNA, 15 nt, Human
aacuggauuaaacuu

SEQ ID NO: 1851884 - RNA, 21 nt, Human
aacugggggagggugaaguga

SEQ ID NO: 1851885 - RNA, 22 nt, Human
aacugggggagggugaagugaa

SEQ ID NO: 1851886 - RNA, 16 nt, Human
aacuggguacuugugg

SEQ ID NO: 1851887 - RNA, 21 nt, Human
aacuggguacuuguggacaca

SEQ ID NO: 1851888 - RNA, 10 nt, Human
aacccagcuc

SEQ ID NO: 1851889 - RNA, 14 nt, Human
aacccagauaaagg

SEQ ID NO: 1851890 - RNA, 16 nt, Human
aacccgggaggcagag

SEQ ID NO: 1851891 - RNA, 18 nt, Human
aaccugagccccaaaagg

SEQ ID NO: 1851892 - RNA, 11 nt, Human
aaccugacccc

SEQ ID NO: 1851893 - RNA, 21 nt, Human
aaccucgagguuucucaaaga

SEQ ID NO: 1851894 - RNA, 22 nt, Human
aaccucgagguuucucaaagaa

SEQ ID NO: 1851895 - RNA, 23 nt, Human
aacccaaauguucaucaaugaau

SEQ ID NO: 1851896 - RNA, 23 nt, Human
aaccauuuugcugucccuuuucc

SEQ ID NO: 1851897 - RNA, 13 nt, Human
aacccaauaguug

SEQ ID NO: 1851898 - RNA, 18 nt, Human
aaccaucauugaaaucuu

SEQ ID NO: 1851899 - RNA, 17 nt, Human
aaccaucauugaaaucu

SEQ ID NO: 1851900 - RNA, 12 nt, Human
aaccaucauuga

SEQ ID NO: 1851901 - RNA, 21 nt, Human
aaccaccacacccagcccacu

SEQ ID NO: 1851902 - RNA, 18 nt, Human
aaccaagccguggcuucc

SEQ ID NO: 1851903 - RNA, 16 nt, Human
aaccaagccguggcuu

SEQ ID NO: 1851904 - RNA, 19 nt, Human
gucucgaacuccugaccuu

SEQ ID NO: 1851905 - RNA, 18 nt, Human
gucucgaacuccugaccu

SEQ ID NO: 1851906 - RNA, 13 nt, Human
gucucgaacuccu

SEQ ID NO: 1851907 - RNA, 20 nt, Human
aaccacauuggagauguuua

SEQ ID NO: 1851908 - RNA, 19 nt, Human
aaccaccacacccagccca

SEQ ID NO: 1851909 - RNA, 15 nt, Human
aaccaagucaaguga

SEQ ID NO: 1851910 - RNA, 20 nt, Human
aaccugagccccaaaaggua

SEQ ID NO: 1851911 - RNA, 14 nt, Human
gucuggcccuuccu

SEQ ID NO: 1851912 - RNA, 16 nt, Human
gucuuuggugaacauu

SEQ ID NO: 1851913 - RNA, 16 nt, Human
gucuuucacauuuaaa

SEQ ID NO: 1851914 - RNA, 17 nt, Human
gucuuuaaaugcugcuu

SEQ ID NO: 1851915 - RNA, 15 nt, Human
gucuuuaaaugcugc

SEQ ID NO: 1851916 - RNA, 18 nt, Human
aacucuccuccagaguca

SEQ ID NO: 1851917 - RNA, 15 nt, Human
aacucuccuccagag

SEQ ID NO: 1851918 - RNA, 16 nt, Human
aacucuccucugcugc

SEQ ID NO: 1851919 - RNA, 17 nt, Human
aacucuccucugcugcu

SEQ ID NO: 1851920 - RNA, 22 nt, Human
gugaaccaccacacccagccca

SEQ ID NO: 1851921 - RNA, 23 nt, Human
gugaaccaccacacccagcccac

SEQ ID NO: 1851922 - RNA, 12 nt, Human
aacuccuggccu

SEQ ID NO: 1851923 - RNA, 22 nt, Human
aacucaucuagguaaauuacag

SEQ ID NO: 1851924 - RNA, 21 nt, Human
aacuaugauuuggaaaauaaa

SEQ ID NO: 1851925 - RNA, 16 nt, Human
aacuaugauuuggaaa

SEQ ID NO: 1851926 - RNA, 20 nt, Human
aacuagacucccaagcugga

SEQ ID NO: 1851927 - RNA, 23 nt, Human
aacuagacucccaagcuggacua

SEQ ID NO: 1851928 - RNA, 18 nt, Human
aaccuugaaaacuuuaug

SEQ ID NO: 1851929 - RNA, 12 nt, Human
aaccugugucuc

SEQ ID NO: 1851930 - RNA, 12 nt, Human
aaaugugugugu

SEQ ID NO: 1851931 - RNA, 14 nt, Human
aaauuaagaaagga

SEQ ID NO: 1851932 - RNA, 19 nt, Human
aaaugucuaguuguaacac

SEQ ID NO: 1851933 - RNA, 24 nt, Human
aaaugucuaguuguaacaccauga

SEQ ID NO: 1851934 - RNA, 17 nt, Human
gucaacacuaacaugau

SEQ ID NO: 1851935 - RNA, 21 nt, Human
gucaacaaguaugaauaaaga

SEQ ID NO: 1851936 - RNA, 14 nt, Human
gucaaacgugaaaa

SEQ ID NO: 1851937 - RNA, 17 nt, Human
gucaaacgugaaaaugc

SEQ ID NO: 1851938 - RNA, 15 nt, Human
gucaaacgugaaaau

SEQ ID NO: 1851939 - RNA, 22 nt, Human
guauuuuguuuuugucuuaaaa

SEQ ID NO: 1851940 - RNA, 20 nt, Human
aaauuguaagcaugcacaaa

SEQ ID NO: 1851941 - RNA, 18 nt, Human
aaauucugucucuggauu

SEQ ID NO: 1851942 - RNA, 19 nt, Human
aaauuguaagcaugcacaa

SEQ ID NO: 1851943 - RNA, 16 nt, Human
aaauucugucucugga

SEQ ID NO: 1851944 - RNA, 19 nt, Human
guauaaaagggacugagaa

SEQ ID NO: 1851945 - RNA, 14 nt, Human
aaauguaagaucgu

SEQ ID NO: 1851946 - RNA, 22 nt, Human
aaauguaagaucguucucugcc

SEQ ID NO: 1851947 - RNA, 22 nt, Human
guaacaggaaaauuuuaaaaau

SEQ ID NO: 1851948 - RNA, 12 nt, Human
guaacaggcaga

SEQ ID NO: 1851949 - RNA, 19 nt, Human
guaucccaugagccucagc

SEQ ID NO: 1851950 - RNA, 22 nt, Human
guaucaggugcugccauccagg

SEQ ID NO: 1851951 - RNA, 15 nt, Human
guaugcgugugugug

SEQ ID NO: 1851952 - RNA, 21 nt, Human
guaucccaugagccucagcau

SEQ ID NO: 1851953 - RNA, 15 nt, Human
guaugguggcugggu

SEQ ID NO: 1851954 - RNA, 16 nt, Human
guaugguggcuggguu

SEQ ID NO: 1851955 - RNA, 14 nt, Human
guaugguggcuggg

SEQ ID NO: 1851956 - RNA, 15 nt, Human
guauaaguggugugu

SEQ ID NO: 1851957 - RNA, 16 nt, Human
guauauuuuauaucaa

SEQ ID NO: 1851958 - RNA, 22 nt, Human
guauauuuguauuuaaaugaaa

SEQ ID NO: 1851959 - RNA, 16 nt, Human
guaucaggugcugcca

SEQ ID NO: 1851960 - RNA, 18 nt, Human
guaucaggugcugccauc

SEQ ID NO: 1851961 - RNA, 18 nt, Human
gucccccuuccauggacu

SEQ ID NO: 1851962 - RNA, 16 nt, Human
gucccccuuccaugga

SEQ ID NO: 1851963 - RNA, 14 nt, Human
gucccccuuccaug

SEQ ID NO: 1851964 - RNA, 12 nt, Human
aacagaaaugua

SEQ ID NO: 1851965 - RNA, 13 nt, Human
aacagaaauguac

SEQ ID NO: 1851966 - RNA, 14 nt, Human
aacagaaauguaca

SEQ ID NO: 1851967 - RNA, 15 nt, Human
aacagaaauguacag

SEQ ID NO: 1851968 - RNA, 16 nt, Human
guccuacccacccucc

SEQ ID NO: 1851969 - RNA, 15 nt, Human
guccuacccacccuc

SEQ ID NO: 1851970 - RNA, 12 nt, Human
guccuacucugu

SEQ ID NO: 1851971 - RNA, 15 nt, Human
aacagugauuaccag

SEQ ID NO: 1851972 - RNA, 22 nt, Human
aacagugauuaccagggacuga

SEQ ID NO: 1851973 - RNA, 16 nt, Human
aacagauaaauaguuu

SEQ ID NO: 1851974 - RNA, 19 nt, Human
gucauuuuuuuuaagaaaa

SEQ ID NO: 1851975 - RNA, 21 nt, Human
gucauuuuuuuuaagaaaaag

SEQ ID NO: 1851976 - RNA, 18 nt, Human
guccaagaagcccaggaa

SEQ ID NO: 1851977 - RNA, 17 nt, Human
guccaagaagcccagga

SEQ ID NO: 1851978 - RNA, 20 nt, Human
guccaagaagcccaggaaag

SEQ ID NO: 1851979 - RNA, 16 nt, Human
guccaagaagcccagg

SEQ ID NO: 1851980 - RNA, 15 nt, Human
guccaagaagcccag

SEQ ID NO: 1851981 - RNA, 13 nt, Human
guccaagaagccc

SEQ ID NO: 1851982 - RNA, 21 nt, Human
gucccaccccacacacgccag

SEQ ID NO: 1851983 - RNA, 14 nt, Human
guccauagagagca

SEQ ID NO: 1851984 - RNA, 13 nt, Human
guccauagagagc

SEQ ID NO: 1851985 - RNA, 14 nt, Human
gucccaccuuggcu

SEQ ID NO: 1851986 - RNA, 15 nt, Human
gucccaccuuggcug

SEQ ID NO: 1851987 - RNA, 16 nt, Human
gucccaccuuggcugc

SEQ ID NO: 1851988 - RNA, 13 nt, Human
gucauaacuagaa

SEQ ID NO: 1851989 - RNA, 15 nt, Human
gucagugugacugau

SEQ ID NO: 1851990 - RNA, 18 nt, Human
aaauuuguuauaaugaau

SEQ ID NO: 1851991 - RNA, 13 nt, Human
gucagaauagaaa

SEQ ID NO: 1851992 - RNA, 17 nt, Human
gucagaauagaaauuag

SEQ ID NO: 1851993 - RNA, 21 nt, Human
gucacacaguauuacuucugc

SEQ ID NO: 1851994 - RNA, 22 nt, Human
gucacacaguauuacuucugcu

SEQ ID NO: 1851995 - RNA, 21 nt, Human
aacaaggcaaggcugucaauu

SEQ ID NO: 1851996 - RNA, 18 nt, Human
aacaaggcaaggcuguca

SEQ ID NO: 1851997 - RNA, 12 nt, Human
aacaauaaaaga

SEQ ID NO: 1851998 - RNA, 18 nt, Human
aaauuuugauguuuuaag

SEQ ID NO: 1851999 - RNA, 23 nt, Human
aaauuuugauguuuuaaggaugc

SEQ ID NO: 1852000 - RNA, 16 nt, Human
aacaaggcaaggcugu

SEQ ID NO: 1852001 - RNA, 15 nt, Human
aacaaggcaaggcug

SEQ ID NO: 1852002 - RNA, 15 nt, Human
aaggaaagagggagg

SEQ ID NO: 1852003 - RNA, 20 nt, Human
aagcuccaucuccacuccag

SEQ ID NO: 1852004 - RNA, 14 nt, Human
aagcuccaucucca

SEQ ID NO: 1852005 - RNA, 17 nt, Human
aaggaauaccugucccc

SEQ ID NO: 1852006 - RNA, 21 nt, Human
aaggaauaaauugcuccuuga

SEQ ID NO: 1852007 - RNA, 16 nt, Human
aaggaagcacaugccu

SEQ ID NO: 1852008 - RNA, 13 nt, Human
aaggaagcacaug

SEQ ID NO: 1852009 - RNA, 15 nt, Human
aaggaagacuucauc

SEQ ID NO: 1852010 - RNA, 14 nt, Human
aaggaagacuucau

SEQ ID NO: 1852011 - RNA, 18 nt, Human
aaggaggaagagaaaaaa

SEQ ID NO: 1852012 - RNA, 20 nt, Human
aaggaggggauagagagaga

SEQ ID NO: 1852013 - RNA, 17 nt, Human
aaggagauuuacaacug

SEQ ID NO: 1852014 - RNA, 14 nt, Human
aaggagauuuacaa

SEQ ID NO: 1852015 - RNA, 11 nt, Human
aaggagagcua

SEQ ID NO: 1852016 - RNA, 18 nt, Human
aaggaauaccuguccccc

SEQ ID NO: 1852017 - RNA, 13 nt, Human
aaggauacaaaag

SEQ ID NO: 1852018 - RNA, 21 nt, Human
aaggauacaaaagcaugugag

SEQ ID NO: 1852019 - RNA, 16 nt, Human
aaggccaaaggaagca

SEQ ID NO: 1852020 - RNA, 23 nt, Human
guugcccaggcaggucuugaacu

SEQ ID NO: 1852021 - RNA, 12 nt, Human
guugcccaggcu

SEQ ID NO: 1852022 - RNA, 13 nt, Human
guugcccaggcug

SEQ ID NO: 1852023 - RNA, 17 nt, Human
guuucaaacuuuacuau

SEQ ID NO: 1852024 - RNA, 15 nt, Human
aaggcuccaggagca

SEQ ID NO: 1852025 - RNA, 18 nt, Human
aaggcuccaggagcagcc

SEQ ID NO: 1852026 - RNA, 16 nt, Human
aaggcuccaggagcag

SEQ ID NO: 1852027 - RNA, 14 nt, Human
guuucaaacuuuac

SEQ ID NO: 1852028 - RNA, 16 nt, Human
guuucaaacuuuacua

SEQ ID NO: 1852029 - RNA, 13 nt, Human
guuucaaacuuua

SEQ ID NO: 1852030 - RNA, 18 nt, Human
aaggcucgagcaugccug

SEQ ID NO: 1852031 - RNA, 16 nt, Human
aaggcucgagcaugcc

SEQ ID NO: 1852032 - RNA, 22 nt, Human
aaggcuccaggagcagccacau

SEQ ID NO: 1852033 - RNA, 19 nt, Human
aaggcuccaggagcagcca

SEQ ID NO: 1852034 - RNA, 20 nt, Human
aaggcucgagcaugccugga

SEQ ID NO: 1852035 - RNA, 19 nt, Human
aaggcucgagcaugccugg

SEQ ID NO: 1852036 - RNA, 22 nt, Human
aaggcucgagcaugccuggaug

SEQ ID NO: 1852037 - RNA, 13 nt, Human
guuuauugucaaa

SEQ ID NO: 1852038 - RNA, 17 nt, Human
guugggccaggagccuc

SEQ ID NO: 1852039 - RNA, 15 nt, Human
guugggccaggagcc

SEQ ID NO: 1852040 - RNA, 13 nt, Human
guugggcuggugu

SEQ ID NO: 1852041 - RNA, 15 nt, Human
guugggcugguguca

SEQ ID NO: 1852042 - RNA, 16 nt, Human
aaguaaggaauuuuau

SEQ ID NO: 1852043 - RNA, 13 nt, Human
aaguaagcaaaga

SEQ ID NO: 1852044 - RNA, 12 nt, Human
aaggucauuuuu

SEQ ID NO: 1852045 - RNA, 18 nt, Human
guuucugaaagggacgcu

SEQ ID NO: 1852046 - RNA, 17 nt, Human
guuucucaaagaaauuu

SEQ ID NO: 1852047 - RNA, 18 nt, Human
guuucucaaagaaauuuc

SEQ ID NO: 1852048 - RNA, 14 nt, Human
guuucucaaagaaa

SEQ ID NO: 1852049 - RNA, 19 nt, Human
guuucuauguguagggcgg

SEQ ID NO: 1852050 - RNA, 20 nt, Human
aagguagaaauaucugaaaa

SEQ ID NO: 1852051 - RNA, 23 nt, Human
aaggcucugagcaaauguggcuc

SEQ ID NO: 1852052 - RNA, 22 nt, Human
aaggggcccaaauucuuucagu

SEQ ID NO: 1852053 - RNA, 13 nt, Human
aaguacacuguuu

SEQ ID NO: 1852054 - RNA, 18 nt, Human
aaguacacuguuucaaac

SEQ ID NO: 1852055 - RNA, 21 nt, Human
aaguaauccaccugccucggc

SEQ ID NO: 1852056 - RNA, 15 nt, Human
guuucugccgcagcc

SEQ ID NO: 1852057 - RNA, 18 nt, Human
guuucugccgcagcccug

SEQ ID NO: 1852058 - RNA, 14 nt, Human
guuucugccgcagc

SEQ ID NO: 1852059 - RNA, 16 nt, Human
guuuugccauguuggc

SEQ ID NO: 1852060 - RNA, 20 nt, Human
guuuugccauguuggccagg

SEQ ID NO: 1852061 - RNA, 21 nt, Human
guuuugccauguuggccaggc

SEQ ID NO: 1852062 - RNA, 22 nt, Human
guuuugccauguuggccaggcu

SEQ ID NO: 1852063 - RNA, 23 nt, Human
aaguacacuguuucaaacuuuac

SEQ ID NO: 1852064 - RNA, 19 nt, Human
aaguacacuguuucaaacu

SEQ ID NO: 1852065 - RNA, 20 nt, Human
aaguacacuguuucaaacuu

SEQ ID NO: 1852066 - RNA, 21 nt, Human
aagugaaaaaggaggaagaga

SEQ ID NO: 1852067 - RNA, 17 nt, Human
aagugaagacaaugacu

SEQ ID NO: 1852068 - RNA, 19 nt, Human
aagugaagacaaugacuua

SEQ ID NO: 1852069 - RNA, 18 nt, Human
aagugagacuuugagggu

SEQ ID NO: 1852070 - RNA, 19 nt, Human
guuuuuccuguucuuaaga

SEQ ID NO: 1852071 - RNA, 14 nt, Human
guuuuucaguuuuc

SEQ ID NO: 1852072 - RNA, 15 nt, Human
guuuuucauaaagca

SEQ ID NO: 1852073 - RNA, 15 nt, Human
aagugagagcugggu

SEQ ID NO: 1852074 - RNA, 12 nt, Human
aagugagagagg

SEQ ID NO: 1852075 - RNA, 14 nt, Human
aagugagagcuggg

SEQ ID NO: 1852076 - RNA, 21 nt, Human
aagucaugcguuuaaucacau

SEQ ID NO: 1852077 - RNA, 16 nt, Human
aagucuuucacauuua

SEQ ID NO: 1852078 - RNA, 19 nt, Human
uaaaaaucucaaauuucua

SEQ ID NO: 1852079 - RNA, 20 nt, Human
uaaaaaucucaaauuucuaa

SEQ ID NO: 1852080 - RNA, 21 nt, Human
uaaaaaucucaaauuucuaaa

SEQ ID NO: 1852081 - RNA, 22 nt, Human
uaaaacuugauguguuaucucu

SEQ ID NO: 1852082 - RNA, 20 nt, Human
uaaaacuugauguguuaucu

SEQ ID NO: 1852083 - RNA, 15 nt, Human
guuuuucuucucccu

SEQ ID NO: 1852084 - RNA, 15 nt, Human
uaaaaaguggaaaaa

SEQ ID NO: 1852085 - RNA, 19 nt, Human
uaaaaauaaaaaacacugg

SEQ ID NO: 1852086 - RNA, 18 nt, Human
uaaaaauaaaaaacacug

SEQ ID NO: 1852087 - RNA, 21 nt, Human
uaaaaauaaaaaacacuggga

SEQ ID NO: 1852088 - RNA, 16 nt, Human
uaaaaaucucaaauuu

SEQ ID NO: 1852089 - RNA, 17 nt, Human
uaaaaaucucaaauuuc

SEQ ID NO: 1852090 - RNA, 15 nt, Human
uaaaaaucucaaauu

SEQ ID NO: 1852091 - RNA, 16 nt, Human
aagugaggaugaaaaa

SEQ ID NO: 1852092 - RNA, 20 nt, Human
aagugauucucaugccucag

SEQ ID NO: 1852093 - RNA, 22 nt, Human
uaaaauauuccugcauuuguga

SEQ ID NO: 1852094 - RNA, 13 nt, Human
uaaaauauuccug

SEQ ID NO: 1852095 - RNA, 21 nt, Human
aagugauucucaugccucagc

SEQ ID NO: 1852096 - RNA, 20 nt, Human
aagugauucuccugccucag

SEQ ID NO: 1852097 - RNA, 19 nt, Human
aagugauucuccugccuca

SEQ ID NO: 1852098 - RNA, 15 nt, Human
aagugauucuccugc

SEQ ID NO: 1852099 - RNA, 16 nt, Human
aagugauucuccugcc

SEQ ID NO: 1852100 - RNA, 17 nt, Human
aagugauucuccugccu

SEQ ID NO: 1852101 - RNA, 18 nt, Human
aagugauucuccugccuc

SEQ ID NO: 1852102 - RNA, 22 nt, Human
uaaaauaccagccaguaaaugg

SEQ ID NO: 1852103 - RNA, 13 nt, Human
uaaaagacuuuuu

SEQ ID NO: 1852104 - RNA, 20 nt, Human
uaaaagacagugaaagaaaa

SEQ ID NO: 1852105 - RNA, 20 nt, Human
aagccgcuggggccaguugg

SEQ ID NO: 1852106 - RNA, 23 nt, Human
aagcccuuccaugucgccucugc

SEQ ID NO: 1852107 - RNA, 20 nt, Human
aagcccuuccaugucgccuc

SEQ ID NO: 1852108 - RNA, 15 nt, Human
aagcccuuccauguc

SEQ ID NO: 1852109 - RNA, 21 nt, Human
aagcccugugcuccauggcug

SEQ ID NO: 1852110 - RNA, 19 nt, Human
aagcccugagcuuucugcu

SEQ ID NO: 1852111 - RNA, 22 nt, Human
aagcccaggaaaggcuccagga

SEQ ID NO: 1852112 - RNA, 19 nt, Human
aagcccaggaaaggcucca

SEQ ID NO: 1852113 - RNA, 17 nt, Human
aagcccaggaaaggcuc

SEQ ID NO: 1852114 - RNA, 14 nt, Human
aagcccaggaaagg

SEQ ID NO: 1852115 - RNA, 22 nt, Human
aagccaaagcuaggccuggcca

SEQ ID NO: 1852116 - RNA, 16 nt, Human
aagcauuuacuuugug

SEQ ID NO: 1852117 - RNA, 20 nt, Human
aagcagugcaugcugucccu

SEQ ID NO: 1852118 - RNA, 15 nt, Human
aagcagugcaugcug

SEQ ID NO: 1852119 - RNA, 14 nt, Human
aagcagugcaugcu

SEQ ID NO: 1852120 - RNA, 12 nt, Human
aagcagugcaug

SEQ ID NO: 1852121 - RNA, 21 nt, Human
gugugugcgccuacaggagug

SEQ ID NO: 1852122 - RNA, 18 nt, Human
aagcuccaagcucccagg

SEQ ID NO: 1852123 - RNA, 17 nt, Human
aagcuccaagcucccag

SEQ ID NO: 1852124 - RNA, 19 nt, Human
aagcucagggccuggcuca

SEQ ID NO: 1852125 - RNA, 18 nt, Human
aagcucagggccuggcuc

SEQ ID NO: 1852126 - RNA, 20 nt, Human
aagcucagggccuggcucag

SEQ ID NO: 1852127 - RNA, 17 nt, Human
aagcucagggccuggcu

SEQ ID NO: 1852128 - RNA, 16 nt, Human
aagcucagggccuggc

SEQ ID NO: 1852129 - RNA, 13 nt, Human
aagcucagggccu

SEQ ID NO: 1852130 - RNA, 12 nt, Human
aagcucagggcc

SEQ ID NO: 1852131 - RNA, 15 nt, Human
guucagcuccagcuc

SEQ ID NO: 1852132 - RNA, 13 nt, Human
guucagcuccagc

SEQ ID NO: 1852133 - RNA, 13 nt, Human
guucagccugccu

SEQ ID NO: 1852134 - RNA, 20 nt, Human
aagccugaguuugcuuucaa

SEQ ID NO: 1852135 - RNA, 12 nt, Human
aagcuaggccug

SEQ ID NO: 1852136 - RNA, 16 nt, Human
aagcuaggccuggcca

SEQ ID NO: 1852137 - RNA, 12 nt, Human
guuaagagaaau

SEQ ID NO: 1852138 - RNA, 11 nt, Human
guuaagagaaa

SEQ ID NO: 1852139 - RNA, 18 nt, Human
guuaagagaaaugagcuu

SEQ ID NO: 1852140 - RNA, 20 nt, Human
guuaggcauugugggaaggg

SEQ ID NO: 1852141 - RNA, 19 nt, Human
guuaggcauugugggaagg

SEQ ID NO: 1852142 - RNA, 18 nt, Human
guucaagcgauucuucug

SEQ ID NO: 1852143 - RNA, 21 nt, Human
guucaaagauauuuugcuuug

SEQ ID NO: 1852144 - RNA, 22 nt, Human
guucaaagauauuuugcuuugu

SEQ ID NO: 1852145 - RNA, 20 nt, Human
guucaaagauauuuugcuuu

SEQ ID NO: 1852146 - RNA, 23 nt, Human
guuauuuuuauuuauuuaaauuu

SEQ ID NO: 1852147 - RNA, 23 nt, Human
aagagggagggagggcuccagac

SEQ ID NO: 1852148 - RNA, 12 nt, Human
aagaguaggaag

SEQ ID NO: 1852149 - RNA, 22 nt, Human
aagagggucugaggaauccaga

SEQ ID NO: 1852150 - RNA, 22 nt, Human
guggggucacucuggcagcuca

SEQ ID NO: 1852151 - RNA, 21 nt, Human
guggggucacucuggcagcuc

SEQ ID NO: 1852152 - RNA, 20 nt, Human
guggggucacucuggcagcu

SEQ ID NO: 1852153 - RNA, 17 nt, Human
guggggucacucuggca

SEQ ID NO: 1852154 - RNA, 16 nt, Human
aagaugcuucucacug

SEQ ID NO: 1852155 - RNA, 17 nt, Human
aagaugcuucucacugc

SEQ ID NO: 1852156 - RNA, 18 nt, Human
aagauggcugugccucug

SEQ ID NO: 1852157 - RNA, 19 nt, Human
aagaugcuucucacugcca

SEQ ID NO: 1852158 - RNA, 23 nt, Human
aagauggcugugccucugccugu

SEQ ID NO: 1852159 - RNA, 21 nt, Human
aagauggcugugccucugccu

SEQ ID NO: 1852160 - RNA, 20 nt, Human
aagauggcugugccucugcc

SEQ ID NO: 1852161 - RNA, 14 nt, Human
aagaguaggaagac

SEQ ID NO: 1852162 - RNA, 13 nt, Human
aagaguaggaaga

SEQ ID NO: 1852163 - RNA, 16 nt, Human
aagaucguucucugcc

SEQ ID NO: 1852164 - RNA, 17 nt, Human
aagaucguucucugccu

SEQ ID NO: 1852165 - RNA, 16 nt, Human
gugucagcauagaagu

SEQ ID NO: 1852166 - RNA, 17 nt, Human
guguauuuuuuuacuaa

SEQ ID NO: 1852167 - RNA, 23 nt, Human
guguauuuuuuuacuaauagaca

SEQ ID NO: 1852168 - RNA, 20 nt, Human
gugucaagagggucugagga

SEQ ID NO: 1852169 - RNA, 13 nt, Human
aagauguagagga

SEQ ID NO: 1852170 - RNA, 20 nt, Human
gugugugaaaaugugugugu

SEQ ID NO: 1852171 - RNA, 16 nt, Human
gugugguagagugugc

SEQ ID NO: 1852172 - RNA, 22 nt, Human
gugugacaaggauugcuacugu

SEQ ID NO: 1852173 - RNA, 21 nt, Human
gugugaccacugcagaagaca

SEQ ID NO: 1852174 - RNA, 22 nt, Human
guggcgcagcauauucaggaag

SEQ ID NO: 1852175 - RNA, 13 nt, Human
gugggacacccug

SEQ ID NO: 1852176 - RNA, 15 nt, Human
gugggacacccugug

SEQ ID NO: 1852177 - RNA, 14 nt, Human
gugggagcugccug

SEQ ID NO: 1852178 - RNA, 15 nt, Human
guggggucacucugg

SEQ ID NO: 1852179 - RNA, 15 nt, Human
gugggagcugccugu

SEQ ID NO: 1852180 - RNA, 18 nt, Human
gugggagcugccuguuca

SEQ ID NO: 1852181 - RNA, 23 nt, Human
gugggaggaucucuugagccugg

SEQ ID NO: 1852182 - RNA, 17 nt, Human
gugggaagggcuacacc

SEQ ID NO: 1852183 - RNA, 23 nt, Human
aagaggaaugaaguacucauaca

SEQ ID NO: 1852184 - RNA, 22 nt, Human
guggccucccaacucaccccag

SEQ ID NO: 1852185 - RNA, 21 nt, Human
guggccucccaacucacccca

SEQ ID NO: 1852186 - RNA, 16 nt, Human
aagacuuuggaaagac

SEQ ID NO: 1852187 - RNA, 16 nt, Human
aagacuuccagagccu

SEQ ID NO: 1852188 - RNA, 18 nt, Human
aagacuuccagagccuca

SEQ ID NO: 1852189 - RNA, 23 nt, Human
aagacugaguacguugugcauuu

SEQ ID NO: 1852190 - RNA, 23 nt, Human
aagacgugauuuugcuguagaag

SEQ ID NO: 1852191 - RNA, 16 nt, Human
aagacgugauuuugcu

SEQ ID NO: 1852192 - RNA, 22 nt, Human
aagacgugauuuugcuguagaa

SEQ ID NO: 1852193 - RNA, 20 nt, Human
aagacgcugugcugcccugc

SEQ ID NO: 1852194 - RNA, 19 nt, Human
aagacgcugugcugcccug

SEQ ID NO: 1852195 - RNA, 18 nt, Human
aagacgcugugcugcccu

SEQ ID NO: 1852196 - RNA, 17 nt, Human
aagacgcugugcugccc

SEQ ID NO: 1852197 - RNA, 15 nt, Human
aagacgcugugcugc

SEQ ID NO: 1852198 - RNA, 13 nt, Human
aagacgcugugcu

SEQ ID NO: 1852199 - RNA, 19 nt, Human
aagaccuucuccuucaccu

SEQ ID NO: 1852200 - RNA, 18 nt, Human
aagaccuucuccuucacc

SEQ ID NO: 1852201 - RNA, 15 nt, Human
aagaccuucuccuuc

SEQ ID NO: 1852202 - RNA, 19 nt, Human
uaacaugaauauuuagugu

SEQ ID NO: 1852203 - RNA, 19 nt, Human
uaacauguaauuaaguacu

SEQ ID NO: 1852204 - RNA, 14 nt, Human
uaacaugaauauuu

SEQ ID NO: 1852205 - RNA, 21 nt, Human
uaacaugaauauuuaguguuc

SEQ ID NO: 1852206 - RNA, 20 nt, Human
uaacaugaauauuuaguguu

SEQ ID NO: 1852207 - RNA, 21 nt, Human
aauauauuuuaagacgaaaca

SEQ ID NO: 1852208 - RNA, 21 nt, Human
aauauauucagccuggcuuca

SEQ ID NO: 1852209 - RNA, 21 nt, Human
aauaguucagguaacaggcag

SEQ ID NO: 1852210 - RNA, 13 nt, Human
uaagaagugaaaa

SEQ ID NO: 1852211 - RNA, 20 nt, Human
uaacuugucuuuggacccug

SEQ ID NO: 1852212 - RNA, 16 nt, Human
uaacuugucuuuggac

SEQ ID NO: 1852213 - RNA, 13 nt, Human
uaacuucacauau

SEQ ID NO: 1852214 - RNA, 17 nt, Human
uaacguauaaaagccug

SEQ ID NO: 1852215 - RNA, 13 nt, Human
uaacguauaaaag

SEQ ID NO: 1852216 - RNA, 19 nt, Human
uaaauuaacuuuuauaaac

SEQ ID NO: 1852217 - RNA, 20 nt, Human
uaaauuaacuuuuauaaacu

SEQ ID NO: 1852218 - RNA, 13 nt, Human
uaaaugugguaaa

SEQ ID NO: 1852219 - RNA, 18 nt, Human
aaguguauuuuuuuacua

SEQ ID NO: 1852220 - RNA, 21 nt, Human
aaguguauuuuuuuacuaaua

SEQ ID NO: 1852221 - RNA, 18 nt, Human
uaaaugaaaaucgugaca

SEQ ID NO: 1852222 - RNA, 21 nt, Human
uaaauuaacuuuuauaaacuu

SEQ ID NO: 1852223 - RNA, 13 nt, Human
aauacagaggcaa

SEQ ID NO: 1852224 - RNA, 12 nt, Human
aauaccaaggaa

SEQ ID NO: 1852225 - RNA, 19 nt, Human
aauaccagccaguaaaugg

SEQ ID NO: 1852226 - RNA, 17 nt, Human
aauaccagccaguaaau

SEQ ID NO: 1852227 - RNA, 21 nt, Human
aauaccugucccccugacaac

SEQ ID NO: 1852228 - RNA, 19 nt, Human
aauaccugucccccugaca

SEQ ID NO: 1852229 - RNA, 18 nt, Human
aauaccugucccccugac

SEQ ID NO: 1852230 - RNA, 15 nt, Human
aauaccugucccccu

SEQ ID NO: 1852231 - RNA, 18 nt, Human
aauagcgucauaacuaga

SEQ ID NO: 1852232 - RNA, 21 nt, Human
uaagcuauucaguaauaacuc

SEQ ID NO: 1852233 - RNA, 15 nt, Human
uaagcaaaaugugau

SEQ ID NO: 1852234 - RNA, 21 nt, Human
uaagcaaaaugugauauguac

SEQ ID NO: 1852235 - RNA, 14 nt, Human
uaagcaaaauguga

SEQ ID NO: 1852236 - RNA, 14 nt, Human
uaagauucauauuu

SEQ ID NO: 1852237 - RNA, 9 nt, Human
uaaggaaua

SEQ ID NO: 1852238 - RNA, 13 nt, Human
uaaggaagacaau

SEQ ID NO: 1852239 - RNA, 18 nt, Human
uaaggaauaccugucccc

SEQ ID NO: 1852240 - RNA, 17 nt, Human
uaaggaauaccuguccc

SEQ ID NO: 1852241 - RNA, 22 nt, Human
uaaggaauuuuauuuuuuucug

SEQ ID NO: 1852242 - RNA, 18 nt, Human
aaucagccugcuccagcu

SEQ ID NO: 1852243 - RNA, 13 nt, Human
aaucagccugcuc

SEQ ID NO: 1852244 - RNA, 19 nt, Human
aaucagccugcuccagcug

SEQ ID NO: 1852245 - RNA, 19 nt, Human
aaucagcauucucacuccu

SEQ ID NO: 1852246 - RNA, 18 nt, Human
aaucagcauucucacucc

SEQ ID NO: 1852247 - RNA, 11 nt, Human
aaucagccugc

SEQ ID NO: 1852248 - RNA, 15 nt, Human
aauauuuauagguca

SEQ ID NO: 1852249 - RNA, 21 nt, Human
aaucacguaaagcuagaaaug

SEQ ID NO: 1852250 - RNA, 20 nt, Human
aaucacguaaagcuagaaau

SEQ ID NO: 1852251 - RNA, 21 nt, Human
uaaguauucuuauuuaaugaa

SEQ ID NO: 1852252 - RNA, 21 nt, Human
uaaguuacacauuuuucagau

SEQ ID NO: 1852253 - RNA, 17 nt, Human
uaaguguguguuuuuca

SEQ ID NO: 1852254 - RNA, 18 nt, Human
aaucugggccagaauuuc

SEQ ID NO: 1852255 - RNA, 13 nt, Human
aaucucaaauaac

SEQ ID NO: 1852256 - RNA, 17 nt, Human
aaucccauuuaaaaaaa

SEQ ID NO: 1852257 - RNA, 12 nt, Human
aaucccaggaug

SEQ ID NO: 1852258 - RNA, 20 nt, Human
aauccucaguuuuugugaaa

SEQ ID NO: 1852259 - RNA, 13 nt, Human
uacaaugcugugc

SEQ ID NO: 1852260 - RNA, 14 nt, Human
uacaaugcugugcc

SEQ ID NO: 1852261 - RNA, 16 nt, Human
uacaaugcugugcccu

SEQ ID NO: 1852262 - RNA, 15 nt, Human
uaauuuuuguauuuu

SEQ ID NO: 1852263 - RNA, 21 nt, Human
uacaaaaaaaaaaaaaaauua

SEQ ID NO: 1852264 - RNA, 22 nt, Human
uaauuuuuuuuuuccuuuuaaa

SEQ ID NO: 1852265 - RNA, 18 nt, Human
uaauuuuuuugagacaga

SEQ ID NO: 1852266 - RNA, 21 nt, Human
aaugcuggcuguuggcugggg

SEQ ID NO: 1852267 - RNA, 22 nt, Human
aaugcuggcuguuggcuggggg

SEQ ID NO: 1852268 - RNA, 18 nt, Human
aaugcugguuuuucaguu

SEQ ID NO: 1852269 - RNA, 13 nt, Human
aauggaagacagc

SEQ ID NO: 1852270 - RNA, 16 nt, Human
aauggaagacagcucu

SEQ ID NO: 1852271 - RNA, 18 nt, Human
aauggaagacagcucuua

SEQ ID NO: 1852272 - RNA, 14 nt, Human
aaugguuuucaaaa

SEQ ID NO: 1852273 - RNA, 12 nt, Human
aauguaaauaaa

SEQ ID NO: 1852274 - RNA, 16 nt, Human
aaugguuuucuugugu

SEQ ID NO: 1852275 - RNA, 16 nt, Human
aaugguuuucaaaaua

SEQ ID NO: 1852276 - RNA, 17 nt, Human
uacagagacagaaagca

SEQ ID NO: 1852277 - RNA, 19 nt, Human
uacagacaaagcguggugg

SEQ ID NO: 1852278 - RNA, 22 nt, Human
uacagagcccacgcccccacug

SEQ ID NO: 1852279 - RNA, 19 nt, Human
uacagagcccacgccccca

SEQ ID NO: 1852280 - RNA, 23 nt, Human
uacagagcagacaguuaagagaa

SEQ ID NO: 1852281 - RNA, 15 nt, Human
uacagacaaagcgug

SEQ ID NO: 1852282 - RNA, 14 nt, Human
uacagacaaagcgu

SEQ ID NO: 1852283 - RNA, 13 nt, Human
uacagacaaagcg

SEQ ID NO: 1852284 - RNA, 17 nt, Human
uacaccgggccuggaga

SEQ ID NO: 1852285 - RNA, 15 nt, Human
uacaccgggccugga

SEQ ID NO: 1852286 - RNA, 24 nt, Human
aaugauuucagcucacugcaaccu

SEQ ID NO: 1852287 - RNA, 13 nt, Human
aaugagccuggca

SEQ ID NO: 1852288 - RNA, 12 nt, Human
aaugagccuggc

SEQ ID NO: 1852289 - RNA, 14 nt, Human
aaugagccuggcaa

SEQ ID NO: 1852290 - RNA, 16 nt, Human
aaugaggucagagccu

SEQ ID NO: 1852291 - RNA, 18 nt, Human
aaugaggucagagccugc

SEQ ID NO: 1852292 - RNA, 21 nt, Human
aaugaccuuucaauaggaaaa

SEQ ID NO: 1852293 - RNA, 20 nt, Human
aaugagaaaaugucuuuauu

SEQ ID NO: 1852294 - RNA, 11 nt, Human
aaugagccugg

SEQ ID NO: 1852295 - RNA, 22 nt, Human
aaugagaaaucuaaaaaacgaa

SEQ ID NO: 1852296 - RNA, 12 nt, Human
aaugagaaaucu

SEQ ID NO: 1852297 - RNA, 13 nt, Human
aaugcaccuggaa

SEQ ID NO: 1852298 - RNA, 16 nt, Human
aaugauuucauucaau

SEQ ID NO: 1852299 - RNA, 13 nt, Human
aaugauuuuuaaa

SEQ ID NO: 1852300 - RNA, 11 nt, Human
aaugcaaacca

SEQ ID NO: 1852301 - RNA, 12 nt, Human
aaugcaaaccau

SEQ ID NO: 1852302 - RNA, 14 nt, Human
aaugcaaaccauca

SEQ ID NO: 1852303 - RNA, 22 nt, Human
uaauuccguagguuauuuucag

SEQ ID NO: 1852304 - RNA, 12 nt, Human
uacauucuguua

SEQ ID NO: 1852305 - RNA, 13 nt, Human
uacauuuccuaaa

SEQ ID NO: 1852306 - RNA, 12 nt, Human
uaccagcagagc

SEQ ID NO: 1852307 - RNA, 14 nt, Human
uaccagcagagcac

SEQ ID NO: 1852308 - RNA, 13 nt, Human
uaccagcagagca

SEQ ID NO: 1852309 - RNA, 22 nt, Human
uaccagcagagcaccuuagaca

SEQ ID NO: 1852310 - RNA, 18 nt, Human
uaccagccaguaaauggg

SEQ ID NO: 1852311 - RNA, 23 nt, Human
uacccccugcaaagcccagcuug

SEQ ID NO: 1852312 - RNA, 19 nt, Human
uacccccugcaaagcccag

SEQ ID NO: 1852313 - RNA, 15 nt, Human
uacccccugcaaagc

SEQ ID NO: 1852314 - RNA, 19 nt, Human
uaccagggacugaggggag

SEQ ID NO: 1852315 - RNA, 12 nt, Human
aauuaacuuuua

SEQ ID NO: 1852316 - RNA, 13 nt, Human
aauuaacuuuuau

SEQ ID NO: 1852317 - RNA, 17 nt, Human
aauuaaguacuauguau

SEQ ID NO: 1852318 - RNA, 16 nt, Human
aauuaaguacuaugua

SEQ ID NO: 1852319 - RNA, 15 nt, Human
aauuaacuuuuauaa

SEQ ID NO: 1852320 - RNA, 16 nt, Human
aauuaacuuuuauaaa

SEQ ID NO: 1852321 - RNA, 16 nt, Human
aauguucaucaaugaa

SEQ ID NO: 1852322 - RNA, 20 nt, Human
aauguucaucaaugaaugaa

SEQ ID NO: 1852323 - RNA, 21 nt, Human
aaugugcugaaugguuuucaa

SEQ ID NO: 1852324 - RNA, 23 nt, Human
uacagagcccacgcccccacugg

SEQ ID NO: 1852325 - RNA, 13 nt, Human
aauguucaucaau

SEQ ID NO: 1852326 - RNA, 16 nt, Human
uaccugccaggaagcc

SEQ ID NO: 1852327 - RNA, 16 nt, Human
uaccugaggggccucu

SEQ ID NO: 1852328 - RNA, 20 nt, Human
aauuacaggaaguacuggag

SEQ ID NO: 1852329 - RNA, 19 nt, Human
aauuacaggaaguacugga

SEQ ID NO: 1852330 - RNA, 17 nt, Human
aauuacaggaaguacug

SEQ ID NO: 1852331 - RNA, 22 nt, Human
uaccucuugagccuugaacuuu

SEQ ID NO: 1852332 - RNA, 23 nt, Human
uaccucuugagccuugaacuuug

SEQ ID NO: 1852333 - RNA, 23 nt, Human
uacccgggaagggggcugggaca

SEQ ID NO: 1852334 - RNA, 14 nt, Human
uaccugaagucuuu

SEQ ID NO: 1852335 - RNA, 13 nt, Human
uaccugaagucuu

SEQ ID NO: 1852336 - RNA, 23 nt, Human
uaccugaagcuaucguaaaauua

SEQ ID NO: 1852337 - RNA, 15 nt, Human
uaccugaggggccuc

SEQ ID NO: 1852338 - RNA, 13 nt, Human
uaccugaggggcc

SEQ ID NO: 1852339 - RNA, 16 nt, Human
uaccugaagucuuugu

SEQ ID NO: 1852340 - RNA, 11 nt, Human
aauucaguugu

SEQ ID NO: 1852341 - RNA, 22 nt, Human
aauucaguuguuagugugucuu

SEQ ID NO: 1852342 - RNA, 17 nt, Human
aauucaguuguuagugu

SEQ ID NO: 1852343 - RNA, 22 nt, Human
aauuauuuauuaaaugcccagc

SEQ ID NO: 1852344 - RNA, 21 nt, Human
aauuauuuauuaaaugcccag

SEQ ID NO: 1852345 - RNA, 22 nt, Human
aauuaugugccagauuuaugca

SEQ ID NO: 1852346 - RNA, 15 nt, Human
uaucccggcugcccu

SEQ ID NO: 1852347 - RNA, 19 nt, Human
uauccaacaucaacaucuu

SEQ ID NO: 1852348 - RNA, 17 nt, Human
uaucagaauucucagaa

SEQ ID NO: 1852349 - RNA, 19 nt, Human
uaucacccagaagaaaaua

SEQ ID NO: 1852350 - RNA, 22 nt, Human
uaucacccagaagaaaauagug

SEQ ID NO: 1852351 - RNA, 16 nt, Human
acacuuacacuuuaug

SEQ ID NO: 1852352 - RNA, 20 nt, Human
acacuguuucaaacuuuacu

SEQ ID NO: 1852353 - RNA, 17 nt, Human
acacucauugaccugag

SEQ ID NO: 1852354 - RNA, 17 nt, Human
acacuguuucaaacuuu

SEQ ID NO: 1852355 - RNA, 18 nt, Human
acacuguuucaaacuuua

SEQ ID NO: 1852356 - RNA, 14 nt, Human
acacuuccauaauc

SEQ ID NO: 1852357 - RNA, 22 nt, Human
acacuucaggcucuucuccuuu

SEQ ID NO: 1852358 - RNA, 19 nt, Human
acacuucaggcucuucucc

SEQ ID NO: 1852359 - RNA, 15 nt, Human
acacuucaggcucuu

SEQ ID NO: 1852360 - RNA, 21 nt, Human
acacuuacacuuuaugcacaa

SEQ ID NO: 1852361 - RNA, 18 nt, Human
acacuuacacuuuaugca

SEQ ID NO: 1852362 - RNA, 16 nt, Human
acagaaagguuuucuu

SEQ ID NO: 1852363 - RNA, 18 nt, Human
acagacauacuaaccagc

SEQ ID NO: 1852364 - RNA, 19 nt, Human
acagacauacuaaccagca

SEQ ID NO: 1852365 - RNA, 13 nt, Human
acagaaauguaca

SEQ ID NO: 1852366 - RNA, 19 nt, Human
uauaagugauugcugguuu

SEQ ID NO: 1852367 - RNA, 21 nt, Human
acacucaaaagcugggcaggu

SEQ ID NO: 1852368 - RNA, 22 nt, Human
acacuaaugaggaaacugcacu

SEQ ID NO: 1852369 - RNA, 15 nt, Human
acacuaaugaggaaa

SEQ ID NO: 1852370 - RNA, 20 nt, Human
uagucacugagacagcccgg

SEQ ID NO: 1852371 - RNA, 17 nt, Human
uagucacugagacagcc

SEQ ID NO: 1852372 - RNA, 22 nt, Human
uauacacuuacacuuuaugcac

SEQ ID NO: 1852373 - RNA, 21 nt, Human
uauaauuuaccugaagucuuu

SEQ ID NO: 1852374 - RNA, 18 nt, Human
uauaauuuaccugaaguc

SEQ ID NO: 1852375 - RNA, 16 nt, Human
acacucauugaccuga

SEQ ID NO: 1852376 - RNA, 12 nt, Human
uauaggaauuga

SEQ ID NO: 1852377 - RNA, 23 nt, Human
uauaggaacuuaaauaaugugaa

SEQ ID NO: 1852378 - RNA, 15 nt, Human
uauaggcaccuacca

SEQ ID NO: 1852379 - RNA, 18 nt, Human
uauagccuaggugacaga

SEQ ID NO: 1852380 - RNA, 21 nt, Human
uaugucucgugguaggacugu

SEQ ID NO: 1852381 - RNA, 22 nt, Human
acaggcccuuccucuccacugc

SEQ ID NO: 1852382 - RNA, 15 nt, Human
acaggcccuuccucu

SEQ ID NO: 1852383 - RNA, 13 nt, Human
acaggcccuuccu

SEQ ID NO: 1852384 - RNA, 18 nt, Human
acaggcccggcuccaggc

SEQ ID NO: 1852385 - RNA, 20 nt, Human
acaggcccggcuccaggcuc

SEQ ID NO: 1852386 - RNA, 21 nt, Human
acaggcccggcuccaggcucc

SEQ ID NO: 1852387 - RNA, 22 nt, Human
acaggcccggcuccaggcuccu

SEQ ID NO: 1852388 - RNA, 16 nt, Human
acaggcccggcuccag

SEQ ID NO: 1852389 - RNA, 17 nt, Human
acaggcccggcuccagg

SEQ ID NO: 1852390 - RNA, 20 nt, Human
acaggaaaauuuuaaaaaua

SEQ ID NO: 1852391 - RNA, 15 nt, Human
acaggacucugccuc

SEQ ID NO: 1852392 - RNA, 16 nt, Human
acaggacucugccucc

SEQ ID NO: 1852393 - RNA, 15 nt, Human
acaggcagauacagg

SEQ ID NO: 1852394 - RNA, 23 nt, Human
acagcuugaccgugaggccagag

SEQ ID NO: 1852395 - RNA, 22 nt, Human
acagcuugaccgugaggccaga

SEQ ID NO: 1852396 - RNA, 19 nt, Human
acaggaaaagcugcugaca

SEQ ID NO: 1852397 - RNA, 20 nt, Human
acaggaaaagcugcugacag

SEQ ID NO: 1852398 - RNA, 21 nt, Human
acaggaaaagcugcugacagu

SEQ ID NO: 1852399 - RNA, 21 nt, Human
acagcuugaccgugaggccag

SEQ ID NO: 1852400 - RNA, 20 nt, Human
acagcuugaccgugaggcca

SEQ ID NO: 1852401 - RNA, 17 nt, Human
acagcuugaccgugagg

SEQ ID NO: 1852402 - RNA, 17 nt, Human
acagcuucauuuccugu

SEQ ID NO: 1852403 - RNA, 19 nt, Human
acagcuucauuuccugugu

SEQ ID NO: 1852404 - RNA, 21 nt, Human
acagcuucauuuccugugucu

SEQ ID NO: 1852405 - RNA, 15 nt, Human
acagcuaaugggaca

SEQ ID NO: 1852406 - RNA, 16 nt, Human
acagcuaaugggacac

SEQ ID NO: 1852407 - RNA, 17 nt, Human
acagcuaaugggacacu

SEQ ID NO: 1852408 - RNA, 19 nt, Human
acagcuaaugggacacuaa

SEQ ID NO: 1852409 - RNA, 14 nt, Human
uaugaggcauuugu

SEQ ID NO: 1852410 - RNA, 15 nt, Human
uaugaggcauuuguu

SEQ ID NO: 1852411 - RNA, 21 nt, Human
uaugaggcauuuguuugaacu

SEQ ID NO: 1852412 - RNA, 23 nt, Human
uaugaggcauuuguuugaacuga

SEQ ID NO: 1852413 - RNA, 23 nt, Human
uaugaagcuuuuaugugaaacau

SEQ ID NO: 1852414 - RNA, 22 nt, Human
uaugaagcuuuuaugugaaaca

SEQ ID NO: 1852415 - RNA, 20 nt, Human
uaugaagcuuuuaugugaaa

SEQ ID NO: 1852416 - RNA, 16 nt, Human
acagcccgggcucugc

SEQ ID NO: 1852417 - RNA, 23 nt, Human
acagcccuccaucuaaacugccc

SEQ ID NO: 1852418 - RNA, 15 nt, Human
acagcccgggcucug

SEQ ID NO: 1852419 - RNA, 16 nt, Human
acagccccuccuccau

SEQ ID NO: 1852420 - RNA, 14 nt, Human
acagccccuccucc

SEQ ID NO: 1852421 - RNA, 17 nt, Human
acagcagccccugcaca

SEQ ID NO: 1852422 - RNA, 19 nt, Human
acagcacgggggccaagga

SEQ ID NO: 1852423 - RNA, 22 nt, Human
acagauuugagcucagcccugg

SEQ ID NO: 1852424 - RNA, 22 nt, Human
uaugcaugaaguaauaugcaca

SEQ ID NO: 1852425 - RNA, 17 nt, Human
uaugauacuugaaaauu

SEQ ID NO: 1852426 - RNA, 22 nt, Human
acagcuaaucagcauucucacu

SEQ ID NO: 1852427 - RNA, 20 nt, Human
uauggcccuggccuagcaua

SEQ ID NO: 1852428 - RNA, 21 nt, Human
uauggcccuggccuagcauac

SEQ ID NO: 1852429 - RNA, 22 nt, Human
uauggcccuggccuagcauacg

SEQ ID NO: 1852430 - RNA, 10 nt, Human
uaugggagag

SEQ ID NO: 1852431 - RNA, 16 nt, Human
uaugggacucaaugca

SEQ ID NO: 1852432 - RNA, 23 nt, Human
uaugggacucaaugcacugacau

SEQ ID NO: 1852433 - RNA, 12 nt, Human
aauuuuacauuu

SEQ ID NO: 1852434 - RNA, 22 nt, Human
uagagcggagaaaggaagggcu

SEQ ID NO: 1852435 - RNA, 14 nt, Human
uagagccagggucu

SEQ ID NO: 1852436 - RNA, 15 nt, Human
uagcacagacccugc

SEQ ID NO: 1852437 - RNA, 21 nt, Human
uagcacagacccugcccugug

SEQ ID NO: 1852438 - RNA, 20 nt, Human
uagcacagacccugcccugu

SEQ ID NO: 1852439 - RNA, 14 nt, Human
uagcacagacccug

SEQ ID NO: 1852440 - RNA, 13 nt, Human
uagccaaggccaa

SEQ ID NO: 1852441 - RNA, 14 nt, Human
uagccaaggccaaa

SEQ ID NO: 1852442 - RNA, 12 nt, Human
uagccaaggcca

SEQ ID NO: 1852443 - RNA, 24 nt, Human
uagcacagacccugcccugugggc

SEQ ID NO: 1852444 - RNA, 22 nt, Human
uagcacagacccugcccugugg

SEQ ID NO: 1852445 - RNA, 14 nt, Human
aauuccacagcugc

SEQ ID NO: 1852446 - RNA, 13 nt, Human
aauuccacagcug

SEQ ID NO: 1852447 - RNA, 12 nt, Human
aauuccacagcu

SEQ ID NO: 1852448 - RNA, 17 nt, Human
uagaacucccuuucaac

SEQ ID NO: 1852449 - RNA, 18 nt, Human
uagaacucccuuucaaca

SEQ ID NO: 1852450 - RNA, 16 nt, Human
uagaacucccuuucaa

SEQ ID NO: 1852451 - RNA, 18 nt, Human
uagacaauuuauuauggc

SEQ ID NO: 1852452 - RNA, 16 nt, Human
uagacagucccugcca

SEQ ID NO: 1852453 - RNA, 10 nt, Human
uagacagagu

SEQ ID NO: 1852454 - RNA, 18 nt, Human
aauuugggggaaaauuua

SEQ ID NO: 1852455 - RNA, 14 nt, Human
aauuugugauacaa

SEQ ID NO: 1852456 - RNA, 17 nt, Human
aauuugugauacaaugc

SEQ ID NO: 1852457 - RNA, 18 nt, Human
aauuugugauacaaugcu

SEQ ID NO: 1852458 - RNA, 20 nt, Human
aauuugugauacaaugcugu

SEQ ID NO: 1852459 - RNA, 21 nt, Human
uagacagucccugccaaugga

SEQ ID NO: 1852460 - RNA, 17 nt, Human
uagacagucccugccaa

SEQ ID NO: 1852461 - RNA, 21 nt, Human
uagacagagucucacuguugc

SEQ ID NO: 1852462 - RNA, 12 nt, Human
uaguaaucauau

SEQ ID NO: 1852463 - RNA, 14 nt, Human
uaguagagacaggg

SEQ ID NO: 1852464 - RNA, 14 nt, Human
uagucacugagaca

SEQ ID NO: 1852465 - RNA, 13 nt, Human
uaguagagacggg

SEQ ID NO: 1852466 - RNA, 15 nt, Human
uaguagagacagggu

SEQ ID NO: 1852467 - RNA, 22 nt, Human
uaguagagacaggguuuugcca

SEQ ID NO: 1852468 - RNA, 16 nt, Human
uaguaaaaauaaaauu

SEQ ID NO: 1852469 - RNA, 13 nt, Human
uaguaaaaauaaa

SEQ ID NO: 1852470 - RNA, 16 nt, Human
acacaguauuacuucu

SEQ ID NO: 1852471 - RNA, 23 nt, Human
acacacagauuugagcucagccc

SEQ ID NO: 1852472 - RNA, 16 nt, Human
acacaggcccggcucc

SEQ ID NO: 1852473 - RNA, 17 nt, Human
acacaggcccggcucca

SEQ ID NO: 1852474 - RNA, 18 nt, Human
acacaggcccggcuccag

SEQ ID NO: 1852475 - RNA, 23 nt, Human
acacaggcccggcuccaggcucc

SEQ ID NO: 1852476 - RNA, 24 nt, Human
acacaggcccggcuccaggcuccu

SEQ ID NO: 1852477 - RNA, 19 nt, Human
acacaggcccggcuccagg

SEQ ID NO: 1852478 - RNA, 20 nt, Human
acacaggcccggcuccaggc

SEQ ID NO: 1852479 - RNA, 21 nt, Human
acacaggcccggcuccaggcu

SEQ ID NO: 1852480 - RNA, 22 nt, Human
acacaggcccggcuccaggcuc

SEQ ID NO: 1852481 - RNA, 18 nt, Human
acaaugcaaaccaucauu

SEQ ID NO: 1852482 - RNA, 17 nt, Human
acaaugcaaaccaucau

SEQ ID NO: 1852483 - RNA, 16 nt, Human
acaaugcaaaccauca

SEQ ID NO: 1852484 - RNA, 11 nt, Human
acaaugcaaac

SEQ ID NO: 1852485 - RNA, 20 nt, Human
acaaugacuuacuguacaug

SEQ ID NO: 1852486 - RNA, 22 nt, Human
acaaugacuuacuguacaugaa

SEQ ID NO: 1852487 - RNA, 19 nt, Human
uaggguaagugagagaggg

SEQ ID NO: 1852488 - RNA, 13 nt, Human
uaggguccugggg

SEQ ID NO: 1852489 - RNA, 17 nt, Human
uaggguuauaauaaugu

SEQ ID NO: 1852490 - RNA, 15 nt, Human
uaggguuauaauaau

SEQ ID NO: 1852491 - RNA, 15 nt, Human
uagggugggccuuca

SEQ ID NO: 1852492 - RNA, 21 nt, Human
acaaugcaaaccaucauugaa

SEQ ID NO: 1852493 - RNA, 19 nt, Human
acaaugcaaaccaucauug

SEQ ID NO: 1852494 - RNA, 23 nt, Human
acaaugcaaaccaucauugaaau

SEQ ID NO: 1852495 - RNA, 13 nt, Human
uaggauguugaaa

SEQ ID NO: 1852496 - RNA, 14 nt, Human
uaggcaggaccugu

SEQ ID NO: 1852497 - RNA, 15 nt, Human
uaggcaggaccugug

SEQ ID NO: 1852498 - RNA, 17 nt, Human
uaggaaaaacugauuuu

SEQ ID NO: 1852499 - RNA, 16 nt, Human
uaggaaaaacugauuu

SEQ ID NO: 1852500 - RNA, 13 nt, Human
uagggaagauaau

SEQ ID NO: 1852501 - RNA, 19 nt, Human
uagggauggggcugugggg

SEQ ID NO: 1852502 - RNA, 14 nt, Human
uaggaaaaacugau

SEQ ID NO: 1852503 - RNA, 13 nt, Human
uaggaaaaacuga

SEQ ID NO: 1852504 - RNA, 13 nt, Human
uagcuuuucccuu

SEQ ID NO: 1852505 - RNA, 20 nt, Human
uagccuuagaagucacacag

SEQ ID NO: 1852506 - RNA, 21 nt, Human
uagccuuagaagucacacagu

SEQ ID NO: 1852507 - RNA, 14 nt, Human
uagcgcccaguugg

SEQ ID NO: 1852508 - RNA, 17 nt, Human
uagcgcccaguugggug

SEQ ID NO: 1852509 - RNA, 22 nt, Human
ucccugaaggccccgcccaggc

SEQ ID NO: 1852510 - RNA, 21 nt, Human
ucccugaaggccccgcccagg

SEQ ID NO: 1852511 - RNA, 18 nt, Human
ucccugaaggccccgccc

SEQ ID NO: 1852512 - RNA, 20 nt, Human
acucaccucccccaucucuu

SEQ ID NO: 1852513 - RNA, 19 nt, Human
acucaccucccccaucucu

SEQ ID NO: 1852514 - RNA, 17 nt, Human
acucaccccagccccaa

SEQ ID NO: 1852515 - RNA, 23 nt, Human
ucccugaaggccccgcccaggcu

SEQ ID NO: 1852516 - RNA, 13 nt, Human
ucccucuuucccu

SEQ ID NO: 1852517 - RNA, 11 nt, Human
ucccucuuucc

SEQ ID NO: 1852518 - RNA, 20 nt, Human
ucccucagucuggcccuucc

SEQ ID NO: 1852519 - RNA, 18 nt, Human
ucccucagucuggcccuu

SEQ ID NO: 1852520 - RNA, 22 nt, Human
acucauugaccugaggcccuuc

SEQ ID NO: 1852521 - RNA, 18 nt, Human
acucauugaccugaggcc

SEQ ID NO: 1852522 - RNA, 17 nt, Human
acucauugaccugaggc

SEQ ID NO: 1852523 - RNA, 16 nt, Human
acucauugaccugagg

SEQ ID NO: 1852524 - RNA, 21 nt, Human
acucaucuagguaaauuacag

SEQ ID NO: 1852525 - RNA, 12 nt, Human
acucaucuuagg

SEQ ID NO: 1852526 - RNA, 23 nt, Human
acucaucuagguaaauuacaguu

SEQ ID NO: 1852527 - RNA, 19 nt, Human
acucaccugccccucaacu

SEQ ID NO: 1852528 - RNA, 14 nt, Human
acucaccugccccu

SEQ ID NO: 1852529 - RNA, 21 nt, Human
acucaccugccccucaacucu

SEQ ID NO: 1852530 - RNA, 14 nt, Human
acucagaagacacu

SEQ ID NO: 1852531 - RNA, 15 nt, Human
acucagaagacacug

SEQ ID NO: 1852532 - RNA, 16 nt, Human
acucagaagacacuga

SEQ ID NO: 1852533 - RNA, 17 nt, Human
acucagaagacacugau

SEQ ID NO: 1852534 - RNA, 18 nt, Human
acucagaagacacugaug

SEQ ID NO: 1852535 - RNA, 21 nt, Human
acucagaauucucuaguuuga

SEQ ID NO: 1852536 - RNA, 22 nt, Human
acucagaauucucuaguuugau

SEQ ID NO: 1852537 - RNA, 14 nt, Human
acucagaauucucu

SEQ ID NO: 1852538 - RNA, 21 nt, Human
acuauaauguaagcucuacug

SEQ ID NO: 1852539 - RNA, 15 nt, Human
acuaugauuuggaaa

SEQ ID NO: 1852540 - RNA, 16 nt, Human
acuaugauuuggaaaa

SEQ ID NO: 1852541 - RNA, 14 nt, Human
acuauaauguaagc

SEQ ID NO: 1852542 - RNA, 13 nt, Human
acuauaauguaag

SEQ ID NO: 1852543 - RNA, 12 nt, Human
acuauaauguaa

SEQ ID NO: 1852544 - RNA, 12 nt, Human
acuauguaucaa

SEQ ID NO: 1852545 - RNA, 13 nt, Human
acuauguugauaa

SEQ ID NO: 1852546 - RNA, 21 nt, Human
acucacauuuauucugcucac

SEQ ID NO: 1852547 - RNA, 19 nt, Human
acucacauuuauucugcuc

SEQ ID NO: 1852548 - RNA, 20 nt, Human
acucacauuuauucugcuca

SEQ ID NO: 1852549 - RNA, 14 nt, Human
acucaaugcacuga

SEQ ID NO: 1852550 - RNA, 13 nt, Human
acguacacauuuu

SEQ ID NO: 1852551 - RNA, 14 nt, Human
acguacacauuuua

SEQ ID NO: 1852552 - RNA, 12 nt, Human
acguacacauuu

SEQ ID NO: 1852553 - RNA, 13 nt, Human
acguacacacaca

SEQ ID NO: 1852554 - RNA, 17 nt, Human
acuagaacugaauuuug

SEQ ID NO: 1852555 - RNA, 18 nt, Human
acuagaacugaauuuugu

SEQ ID NO: 1852556 - RNA, 19 nt, Human
acuagaacugaauuuuguc

SEQ ID NO: 1852557 - RNA, 23 nt, Human
acuagaacugaauuuugucuuua

SEQ ID NO: 1852558 - RNA, 14 nt, Human
acuacuagggaaau

SEQ ID NO: 1852559 - RNA, 16 nt, Human
acuagaacugaauuuu

SEQ ID NO: 1852560 - RNA, 18 nt, Human
acuacggaauaguuggcu

SEQ ID NO: 1852561 - RNA, 15 nt, Human
uccugaagaauugaa

SEQ ID NO: 1852562 - RNA, 12 nt, Human
uccucugcugcu

SEQ ID NO: 1852563 - RNA, 19 nt, Human
uccucuugccacugccucu

SEQ ID NO: 1852564 - RNA, 14 nt, Human
uccucugaggcuga

SEQ ID NO: 1852565 - RNA, 23 nt, Human
uccucuuuggucuacacugugcu

SEQ ID NO: 1852566 - RNA, 19 nt, Human
acucuugaaaaaugcaugu

SEQ ID NO: 1852567 - RNA, 14 nt, Human
acucuugaaaaaug

SEQ ID NO: 1852568 - RNA, 21 nt, Human
acucuugaaaaaugcauguug

SEQ ID NO: 1852569 - RNA, 14 nt, Human
uccucccaccucag

SEQ ID NO: 1852570 - RNA, 15 nt, Human
uccucccaccucagc

SEQ ID NO: 1852571 - RNA, 16 nt, Human
uccucccaccucagcc

SEQ ID NO: 1852572 - RNA, 18 nt, Human
uccucccaccucagccuc

SEQ ID NO: 1852573 - RNA, 20 nt, Human
uccucccaccucagccuccc

SEQ ID NO: 1852574 - RNA, 21 nt, Human
uccucccaccucagccucccg

SEQ ID NO: 1852575 - RNA, 18 nt, Human
uccucuccacugccuucg

SEQ ID NO: 1852576 - RNA, 17 nt, Human
uccucuccacugccuuc

SEQ ID NO: 1852577 - RNA, 17 nt, Human
uccucugagccuuggga

SEQ ID NO: 1852578 - RNA, 13 nt, Human
uccucugagccuu

SEQ ID NO: 1852579 - RNA, 12 nt, Human
uccucugagccu

SEQ ID NO: 1852580 - RNA, 15 nt, Human
uccucucugcccuaa

SEQ ID NO: 1852581 - RNA, 14 nt, Human
uccucucugcccua

SEQ ID NO: 1852582 - RNA, 13 nt, Human
uccucucugcccu

SEQ ID NO: 1852583 - RNA, 12 nt, Human
uccucucugccc

SEQ ID NO: 1852584 - RNA, 16 nt, Human
acucgcgacaaugcaa

SEQ ID NO: 1852585 - RNA, 15 nt, Human
acucgcgacaaugca

SEQ ID NO: 1852586 - RNA, 17 nt, Human
acucgcgacaaugcaaa

SEQ ID NO: 1852587 - RNA, 14 nt, Human
acucguauaugucu

SEQ ID NO: 1852588 - RNA, 17 nt, Human
acucugacaacagacuu

SEQ ID NO: 1852589 - RNA, 13 nt, Human
acucugacaacag

SEQ ID NO: 1852590 - RNA, 23 nt, Human
acucugacaacagacuucugaaa

SEQ ID NO: 1852591 - RNA, 22 nt, Human
acucugacaacagacuucugaa

SEQ ID NO: 1852592 - RNA, 20 nt, Human
acucugacaacagacuucug

SEQ ID NO: 1852593 - RNA, 18 nt, Human
acucugacaacagacuuc

SEQ ID NO: 1852594 - RNA, 13 nt, Human
acucuugaaaaau

SEQ ID NO: 1852595 - RNA, 21 nt, Human
acucuucaguuaagccuuugg

SEQ ID NO: 1852596 - RNA, 20 nt, Human
acucuucaguuaagccuuug

SEQ ID NO: 1852597 - RNA, 17 nt, Human
acucuggcagcucagag

SEQ ID NO: 1852598 - RNA, 16 nt, Human
acucuggcagcucaga

SEQ ID NO: 1852599 - RNA, 20 nt, Human
acucuggcagcucagagagg

SEQ ID NO: 1852600 - RNA, 19 nt, Human
acucuggcagcucagagag

SEQ ID NO: 1852601 - RNA, 21 nt, Human
acucuuauugcccacgcugga

SEQ ID NO: 1852602 - RNA, 16 nt, Human
acucgaguuacagaca

SEQ ID NO: 1852603 - RNA, 21 nt, Human
uccuagccugugccucuggga

SEQ ID NO: 1852604 - RNA, 12 nt, Human
uccuacucugug

SEQ ID NO: 1852605 - RNA, 15 nt, Human
uccguuaaaauacca

SEQ ID NO: 1852606 - RNA, 13 nt, Human
uccguuaaaauac

SEQ ID NO: 1852607 - RNA, 17 nt, Human
accuucccaugcccugg

SEQ ID NO: 1852608 - RNA, 17 nt, Human
accuucgccaccugggu

SEQ ID NO: 1852609 - RNA, 15 nt, Human
accuucgccaccugg

SEQ ID NO: 1852610 - RNA, 21 nt, Human
accuggguaacuagggaagau

SEQ ID NO: 1852611 - RNA, 13 nt, Human
accuuugucccca

SEQ ID NO: 1852612 - RNA, 22 nt, Human
accuucuccuucaccuuugucc

SEQ ID NO: 1852613 - RNA, 14 nt, Human
accuucuccuucac

SEQ ID NO: 1852614 - RNA, 14 nt, Human
accuuuuuuauaca

SEQ ID NO: 1852615 - RNA, 16 nt, Human
accuuuguccccaccg

SEQ ID NO: 1852616 - RNA, 15 nt, Human
accuuuguccccacc

SEQ ID NO: 1852617 - RNA, 14 nt, Human
accuuuguccccac

SEQ ID NO: 1852618 - RNA, 16 nt, Human
accuuuuuuauacaua

SEQ ID NO: 1852619 - RNA, 17 nt, Human
accuuuuuuauacauaa

SEQ ID NO: 1852620 - RNA, 18 nt, Human
accuuuuuuauacauaaa

SEQ ID NO: 1852621 - RNA, 13 nt, Human
accuggccucugc

SEQ ID NO: 1852622 - RNA, 12 nt, Human
accuggccucug

SEQ ID NO: 1852623 - RNA, 18 nt, Human
uccaccaucaagccacca

SEQ ID NO: 1852624 - RNA, 12 nt, Human
uccacccaccuc

SEQ ID NO: 1852625 - RNA, 13 nt, Human
uccacccaccuca

SEQ ID NO: 1852626 - RNA, 17 nt, Human
uccacccaggagccccg

SEQ ID NO: 1852627 - RNA, 20 nt, Human
uccacccaggagccccgagg

SEQ ID NO: 1852628 - RNA, 19 nt, Human
uccaaaugcagcuuuaaaa

SEQ ID NO: 1852629 - RNA, 18 nt, Human
uccaaggguacuaaggaa

SEQ ID NO: 1852630 - RNA, 21 nt, Human
accugcgucucauacucaccu

SEQ ID NO: 1852631 - RNA, 16 nt, Human
accugcggugcuaucu

SEQ ID NO: 1852632 - RNA, 23 nt, Human
accugccuguugggccaggagcc

SEQ ID NO: 1852633 - RNA, 12 nt, Human
accugcucuccu

SEQ ID NO: 1852634 - RNA, 20 nt, Human
accuggaauauauaaccagu

SEQ ID NO: 1852635 - RNA, 16 nt, Human
ucauuugucacacacu

SEQ ID NO: 1852636 - RNA, 14 nt, Human
ucauuugucacaca

SEQ ID NO: 1852637 - RNA, 17 nt, Human
ucauuuuuuuuaagaaa

SEQ ID NO: 1852638 - RNA, 18 nt, Human
ucauuuuuuuuaagaaaa

SEQ ID NO: 1852639 - RNA, 14 nt, Human
ucauuuuugaauac

SEQ ID NO: 1852640 - RNA, 19 nt, Human
ucauuuuuaguagagacag

SEQ ID NO: 1852641 - RNA, 17 nt, Human
accugccaggaagccag

SEQ ID NO: 1852642 - RNA, 16 nt, Human
accugccaggaagcca

SEQ ID NO: 1852643 - RNA, 19 nt, Human
accugccaggaagccagca

SEQ ID NO: 1852644 - RNA, 18 nt, Human
accugccaggaagccagc

SEQ ID NO: 1852645 - RNA, 17 nt, Human
accugccucggccuccc

SEQ ID NO: 1852646 - RNA, 14 nt, Human
accugaggggccuc

SEQ ID NO: 1852647 - RNA, 16 nt, Human
accugaggggccucuu

SEQ ID NO: 1852648 - RNA, 14 nt, Human
accugauugugucu

SEQ ID NO: 1852649 - RNA, 12 nt, Human
accugagcccca

SEQ ID NO: 1852650 - RNA, 17 nt, Human
accugagccccaaaagg

SEQ ID NO: 1852651 - RNA, 23 nt, Human
accugaggcccuucucuccagcc

SEQ ID NO: 1852652 - RNA, 17 nt, Human
accugaccccugacccc

SEQ ID NO: 1852653 - RNA, 22 nt, Human
accugaagcuaucguaaaauua

SEQ ID NO: 1852654 - RNA, 19 nt, Human
accugaauuuuggcugugu

SEQ ID NO: 1852655 - RNA, 18 nt, Human
accugaagacucauucuu

SEQ ID NO: 1852656 - RNA, 12 nt, Human
ucauaaugacuu

SEQ ID NO: 1852657 - RNA, 16 nt, Human
ucauaauaaguugcau

SEQ ID NO: 1852658 - RNA, 18 nt, Human
acgccaucccagccccaa

SEQ ID NO: 1852659 - RNA, 17 nt, Human
acgccaucccagcccca

SEQ ID NO: 1852660 - RNA, 16 nt, Human
acgccaucccagcccc

SEQ ID NO: 1852661 - RNA, 15 nt, Human
acgccaucccagccc

SEQ ID NO: 1852662 - RNA, 14 nt, Human
acgccaucccagcc

SEQ ID NO: 1852663 - RNA, 11 nt, Human
acgccauccca

SEQ ID NO: 1852664 - RNA, 23 nt, Human
acgccaggggaaaaucagccugc

SEQ ID NO: 1852665 - RNA, 18 nt, Human
acgccaggggaaaaucag

SEQ ID NO: 1852666 - RNA, 15 nt, Human
acgacugcccggcag

SEQ ID NO: 1852667 - RNA, 17 nt, Human
uccaggcugggagagcc

SEQ ID NO: 1852668 - RNA, 14 nt, Human
uccaggcugggaga

SEQ ID NO: 1852669 - RNA, 18 nt, Human
uccaggcugggagagccu

SEQ ID NO: 1852670 - RNA, 14 nt, Human
acgaauauugcuga

SEQ ID NO: 1852671 - RNA, 19 nt, Human
acggagucccaccuuggcu

SEQ ID NO: 1852672 - RNA, 17 nt, Human
acgcucucuggccuucg

SEQ ID NO: 1852673 - RNA, 16 nt, Human
acggccaggccagagg

SEQ ID NO: 1852674 - RNA, 21 nt, Human
acggagucccaccuuggcugc

SEQ ID NO: 1852675 - RNA, 17 nt, Human
acgcuacccgggaaggg

SEQ ID NO: 1852676 - RNA, 13 nt, Human
acgcuacccggga

SEQ ID NO: 1852677 - RNA, 15 nt, Human
acgcucucuggccuu

SEQ ID NO: 1852678 - RNA, 16 nt, Human
acgcucucuggccuuc

SEQ ID NO: 1852679 - RNA, 18 nt, Human
acgcuacccgggaagggg

SEQ ID NO: 1852680 - RNA, 14 nt, Human
acgcccccacuggu

SEQ ID NO: 1852681 - RNA, 23 nt, Human
acgcgugcacacaccagagccca

SEQ ID NO: 1852682 - RNA, 14 nt, Human
uccagugagacagc

SEQ ID NO: 1852683 - RNA, 17 nt, Human
uccagugaggcucugcc

SEQ ID NO: 1852684 - RNA, 19 nt, Human
uccagugaggcucugcccu

SEQ ID NO: 1852685 - RNA, 18 nt, Human
uccagugaggcucugccc

SEQ ID NO: 1852686 - RNA, 20 nt, Human
uccagugaggcucugcccuu

SEQ ID NO: 1852687 - RNA, 15 nt, Human
acggcucacugcagc

SEQ ID NO: 1852688 - RNA, 14 nt, Human
acggcucacugcag

SEQ ID NO: 1852689 - RNA, 11 nt, Human
uccauccugag

SEQ ID NO: 1852690 - RNA, 20 nt, Human
uccaucucuuguuuaaauuc

SEQ ID NO: 1852691 - RNA, 22 nt, Human
uccaugaagauguagaggagaa

SEQ ID NO: 1852692 - RNA, 17 nt, Human
uccaugaguccccuguu

SEQ ID NO: 1852693 - RNA, 16 nt, Human
uccaugaguccccugu

SEQ ID NO: 1852694 - RNA, 15 nt, Human
uccaugaguccccug

SEQ ID NO: 1852695 - RNA, 14 nt, Human
ucccaccccacaca

SEQ ID NO: 1852696 - RNA, 11 nt, Human
ucccaccccac

SEQ ID NO: 1852697 - RNA, 19 nt, Human
ucccaccaacccucagagc

SEQ ID NO: 1852698 - RNA, 22 nt, Human
ucccacaggcccuuccucucca

SEQ ID NO: 1852699 - RNA, 21 nt, Human
ucccacaggcccuuccucucc

SEQ ID NO: 1852700 - RNA, 17 nt, Human
ucccacaggcccuuccu

SEQ ID NO: 1852701 - RNA, 15 nt, Human
ucccacaggcccuuc

SEQ ID NO: 1852702 - RNA, 14 nt, Human
ucccacaaaggaga

SEQ ID NO: 1852703 - RNA, 21 nt, Human
ucccaaagugcugggauuaca

SEQ ID NO: 1852704 - RNA, 20 nt, Human
ucccaaagugcugggauuac

SEQ ID NO: 1852705 - RNA, 16 nt, Human
ucccaaagugcuggga

SEQ ID NO: 1852706 - RNA, 15 nt, Human
ucccaaagugcuggg

SEQ ID NO: 1852707 - RNA, 17 nt, Human
uauuuuaauaaacacuc

SEQ ID NO: 1852708 - RNA, 14 nt, Human
uauuuuaauaaaca

SEQ ID NO: 1852709 - RNA, 20 nt, Human
uauuuugcuuugugauuuuu

SEQ ID NO: 1852710 - RNA, 13 nt, Human
uauuuugcuuugu

SEQ ID NO: 1852711 - RNA, 15 nt, Human
uauuuugcuuuguga

SEQ ID NO: 1852712 - RNA, 17 nt, Human
uauuuuuguagagccag

SEQ ID NO: 1852713 - RNA, 20 nt, Human
uauuuuguguuuaggaacua

SEQ ID NO: 1852714 - RNA, 17 nt, Human
uauuuuguguuuaggaa

SEQ ID NO: 1852715 - RNA, 19 nt, Human
acaucuuggucagauuuga

SEQ ID NO: 1852716 - RNA, 22 nt, Human
acaucuugcucugcugacagac

SEQ ID NO: 1852717 - RNA, 17 nt, Human
acaucuugcucugcuga

SEQ ID NO: 1852718 - RNA, 19 nt, Human
uaugugccagauuuaugca

SEQ ID NO: 1852719 - RNA, 14 nt, Human
uaugugccagauuu

SEQ ID NO: 1852720 - RNA, 15 nt, Human
acaucuugcucugcu

SEQ ID NO: 1852721 - RNA, 16 nt, Human
acaucuugcucugcug

SEQ ID NO: 1852722 - RNA, 15 nt, Human
acaugaaaacacauu

SEQ ID NO: 1852723 - RNA, 16 nt, Human
acaugaaaacacauuu

SEQ ID NO: 1852724 - RNA, 22 nt, Human
uauuuuaagacgaaacauuugu

SEQ ID NO: 1852725 - RNA, 14 nt, Human
uauuuuaagacgaa

SEQ ID NO: 1852726 - RNA, 16 nt, Human
acaugagguacugaga

SEQ ID NO: 1852727 - RNA, 14 nt, Human
acauggaaguacua

SEQ ID NO: 1852728 - RNA, 18 nt, Human
acauggaauaacauguaa

SEQ ID NO: 1852729 - RNA, 20 nt, Human
acauggaauaacauguaauu

SEQ ID NO: 1852730 - RNA, 23 nt, Human
acaugagcaucaggccaggcccu

SEQ ID NO: 1852731 - RNA, 19 nt, Human
acauggaguauaugucaag

SEQ ID NO: 1852732 - RNA, 15 nt, Human
acauggaguauaugu

SEQ ID NO: 1852733 - RNA, 14 nt, Human
acauggccuuugcu

SEQ ID NO: 1852734 - RNA, 21 nt, Human
acaugucuuuucuugcaugag

SEQ ID NO: 1852735 - RNA, 16 nt, Human
ucaaaagcugggcagg

SEQ ID NO: 1852736 - RNA, 13 nt, Human
ucaaagauauuuu

SEQ ID NO: 1852737 - RNA, 20 nt, Human
ucaaagauauuuugcuuugu

SEQ ID NO: 1852738 - RNA, 22 nt, Human
ucaaagauauuuugcuuuguga

SEQ ID NO: 1852739 - RNA, 23 nt, Human
ucaaagcaaaugucuuccuggau

SEQ ID NO: 1852740 - RNA, 15 nt, Human
ucaaagcaaaugucu

SEQ ID NO: 1852741 - RNA, 13 nt, Human
ucaaauauauuca

SEQ ID NO: 1852742 - RNA, 23 nt, Human
acaugaaaacacauuuuucuuag

SEQ ID NO: 1852743 - RNA, 22 nt, Human
acaugaaaacacauuuuucuua

SEQ ID NO: 1852744 - RNA, 13 nt, Human
acaugagcaucag

SEQ ID NO: 1852745 - RNA, 12 nt, Human
ucaauuuaaaaa

SEQ ID NO: 1852746 - RNA, 13 nt, Human
ucaauuuaaaaaa

SEQ ID NO: 1852747 - RNA, 21 nt, Human
ucacagaacccuuggagccaa

SEQ ID NO: 1852748 - RNA, 16 nt, Human
ucacagccacuuggga

SEQ ID NO: 1852749 - RNA, 14 nt, Human
ucacagaugggugc

SEQ ID NO: 1852750 - RNA, 15 nt, Human
ucacagaugggugcu

SEQ ID NO: 1852751 - RNA, 16 nt, Human
ucacauauugauuucc

SEQ ID NO: 1852752 - RNA, 18 nt, Human
ucacauauugauuuccgu

SEQ ID NO: 1852753 - RNA, 20 nt, Human
ucacauauugauuuccguua

SEQ ID NO: 1852754 - RNA, 17 nt, Human
ucaccagccccagugcc

SEQ ID NO: 1852755 - RNA, 17 nt, Human
accacacagaggcugcc

SEQ ID NO: 1852756 - RNA, 15 nt, Human
accacacccagccca

SEQ ID NO: 1852757 - RNA, 16 nt, Human
accacacccagcccac

SEQ ID NO: 1852758 - RNA, 20 nt, Human
accacacccagcccacuucu

SEQ ID NO: 1852759 - RNA, 21 nt, Human
accacacccagcccacuucug

SEQ ID NO: 1852760 - RNA, 23 nt, Human
accacacccagcccacuucugcc

SEQ ID NO: 1852761 - RNA, 15 nt, Human
accaacccucagagc

SEQ ID NO: 1852762 - RNA, 19 nt, Human
accaaaucagcugcuacua

SEQ ID NO: 1852763 - RNA, 16 nt, Human
accaaaucagcugcua

SEQ ID NO: 1852764 - RNA, 16 nt, Human
accaacauacucccau

SEQ ID NO: 1852765 - RNA, 17 nt, Human
accaacauacucccauc

SEQ ID NO: 1852766 - RNA, 20 nt, Human
accaaccacugcgaccacaa

SEQ ID NO: 1852767 - RNA, 21 nt, Human
acauugcggacagccacggcc

SEQ ID NO: 1852768 - RNA, 22 nt, Human
acauugcggacagccacggcca

SEQ ID NO: 1852769 - RNA, 18 nt, Human
acauuuuacuuuuuccug

SEQ ID NO: 1852770 - RNA, 15 nt, Human
acauuuuuaagugcu

SEQ ID NO: 1852771 - RNA, 18 nt, Human
acauuuuuaagugcugca

SEQ ID NO: 1852772 - RNA, 19 nt, Human
acauuuuuaagugcugcau

SEQ ID NO: 1852773 - RNA, 21 nt, Human
acauuuuucagauauaaaaga

SEQ ID NO: 1852774 - RNA, 13 nt, Human
acauuuuucuuag

SEQ ID NO: 1852775 - RNA, 23 nt, Human
acauuuuucuuagggaaggauac

SEQ ID NO: 1852776 - RNA, 19 nt, Human
ucaaguaauccaccugccu

SEQ ID NO: 1852777 - RNA, 22 nt, Human
ucaagugauucucaugccucag

SEQ ID NO: 1852778 - RNA, 21 nt, Human
ucaagugauucucaugccuca

SEQ ID NO: 1852779 - RNA, 16 nt, Human
ucaagugauucuccug

SEQ ID NO: 1852780 - RNA, 19 nt, Human
ucaauaggaaaaacugauu

SEQ ID NO: 1852781 - RNA, 18 nt, Human
ucaauaggaaaaacugau

SEQ ID NO: 1852782 - RNA, 17 nt, Human
ucaagugauucuccugc

SEQ ID NO: 1852783 - RNA, 17 nt, Human
ucaauaggaaaaacuga

SEQ ID NO: 1852784 - RNA, 22 nt, Human
ucaauaggaaaaacugauuuuu

SEQ ID NO: 1852785 - RNA, 17 nt, Human
ucaagcaagauuucaga

SEQ ID NO: 1852786 - RNA, 21 nt, Human
ucaagagggcacugguggccc

SEQ ID NO: 1852787 - RNA, 20 nt, Human
ucaagagggcacugguggcc

SEQ ID NO: 1852788 - RNA, 17 nt, Human
ucaagagggucugagga

SEQ ID NO: 1852789 - RNA, 17 nt, Human
ucaggguuggccccugc

SEQ ID NO: 1852790 - RNA, 23 nt, Human
ucaggggugugcggccuuuggcu

SEQ ID NO: 1852791 - RNA, 19 nt, Human
ucaggggugugcggccuuu

SEQ ID NO: 1852792 - RNA, 12 nt, Human
ucaggggugugc

SEQ ID NO: 1852793 - RNA, 18 nt, Human
ucaggccaggcccucugc

SEQ ID NO: 1852794 - RNA, 17 nt, Human
ucaggccaggcccucug

SEQ ID NO: 1852795 - RNA, 19 nt, Human
ucaggccaggcccucugcc

SEQ ID NO: 1852796 - RNA, 19 nt, Human
acccgcuaagagggaggga

SEQ ID NO: 1852797 - RNA, 21 nt, Human
ucagguaaucgaccugccucg

SEQ ID NO: 1852798 - RNA, 20 nt, Human
ucagguaaucgaccugccuc

SEQ ID NO: 1852799 - RNA, 19 nt, Human
ucagguaaucgaccugccu

SEQ ID NO: 1852800 - RNA, 18 nt, Human
ucagguaaucgaccugcc

SEQ ID NO: 1852801 - RNA, 23 nt, Human
ucaggguuggccccugcccggcu

SEQ ID NO: 1852802 - RNA, 18 nt, Human
ucaggguuggccccugcc

SEQ ID NO: 1852803 - RNA, 19 nt, Human
ucaggguuggccccugccc

SEQ ID NO: 1852804 - RNA, 16 nt, Human
ucaggccaggcccucu

SEQ ID NO: 1852805 - RNA, 15 nt, Human
ucaggccaggcccuc

SEQ ID NO: 1852806 - RNA, 14 nt, Human
ucaggccaggcccu

SEQ ID NO: 1852807 - RNA, 13 nt, Human
ucaggccaggccc

SEQ ID NO: 1852808 - RNA, 14 nt, Human
ucaggccagcugcu

SEQ ID NO: 1852809 - RNA, 13 nt, Human
ucaggccagcugc

SEQ ID NO: 1852810 - RNA, 13 nt, Human
ucaggccacuuga

SEQ ID NO: 1852811 - RNA, 18 nt, Human
ucaggcaggugggaugga

SEQ ID NO: 1852812 - RNA, 17 nt, Human
ucaggcaggugggaugg

SEQ ID NO: 1852813 - RNA, 12 nt, Human
acccccagccug

SEQ ID NO: 1852814 - RNA, 13 nt, Human
acccccagccugc

SEQ ID NO: 1852815 - RNA, 23 nt, Human
acccugaggcccagagggccugc

SEQ ID NO: 1852816 - RNA, 21 nt, Human
acccugaggcccagagggccu

SEQ ID NO: 1852817 - RNA, 19 nt, Human
acccugaggcccagagggc

SEQ ID NO: 1852818 - RNA, 13 nt, Human
acccugaggccca

SEQ ID NO: 1852819 - RNA, 11 nt, Human
acccugaggcc

SEQ ID NO: 1852820 - RNA, 18 nt, Human
acccucgaggcggaucuu

SEQ ID NO: 1852821 - RNA, 14 nt, Human
acccucgaggcgga

SEQ ID NO: 1852822 - RNA, 20 nt, Human
acccgggaagggggcuggga

SEQ ID NO: 1852823 - RNA, 19 nt, Human
acccgggaagggggcuggg

SEQ ID NO: 1852824 - RNA, 15 nt, Human
acccggaggggccug

SEQ ID NO: 1852825 - RNA, 22 nt, Human
acccgggaagggggcugggaca

SEQ ID NO: 1852826 - RNA, 14 nt, Human
acccucauguucuu

SEQ ID NO: 1852827 - RNA, 15 nt, Human
acccucauguucuua

SEQ ID NO: 1852828 - RNA, 17 nt, Human
acccucauguucuuaau

SEQ ID NO: 1852829 - RNA, 15 nt, Human
acccgggaggcagag

SEQ ID NO: 1852830 - RNA, 21 nt, Human
acccuccuuucaccacaugug

SEQ ID NO: 1852831 - RNA, 22 nt, Human
accgaaaacguggcugcuucaa

SEQ ID NO: 1852832 - RNA, 21 nt, Human
accgaaaacguggcugcuuca

SEQ ID NO: 1852833 - RNA, 22 nt, Human
ucagguggggucacucuggcag

SEQ ID NO: 1852834 - RNA, 23 nt, Human
ucagguggggucacucuggcagc

SEQ ID NO: 1852835 - RNA, 15 nt, Human
ucaggugucccugca

SEQ ID NO: 1852836 - RNA, 17 nt, Human
ucaggugucccugcacu

SEQ ID NO: 1852837 - RNA, 18 nt, Human
ucaggugucccugcacuu

SEQ ID NO: 1852838 - RNA, 20 nt, Human
acccuugccgucuaccugag

SEQ ID NO: 1852839 - RNA, 15 nt, Human
acccuugugguccca

SEQ ID NO: 1852840 - RNA, 20 nt, Human
accgaaaacguggcugcuuc

SEQ ID NO: 1852841 - RNA, 13 nt, Human
ucaguaagccgug

SEQ ID NO: 1852842 - RNA, 13 nt, Human
ucaguaauaacuc

SEQ ID NO: 1852843 - RNA, 22 nt, Human
ucagguugucugaagucacugc

SEQ ID NO: 1852844 - RNA, 22 nt, Human
ucaggugucccugcacuugcag

SEQ ID NO: 1852845 - RNA, 19 nt, Human
ucaguuguuagugugucuu

SEQ ID NO: 1852846 - RNA, 18 nt, Human
ucauaaauaaaguuuguu

SEQ ID NO: 1852847 - RNA, 13 nt, Human
ucauaacuagaac

SEQ ID NO: 1852848 - RNA, 24 nt, Human
ucauaaagcaggcagaacucaucu

SEQ ID NO: 1852849 - RNA, 15 nt, Human
ucauaacuagaacug

SEQ ID NO: 1852850 - RNA, 23 nt, Human
ucagugccuuauggaacacucug

SEQ ID NO: 1852851 - RNA, 22 nt, Human
ucagugccuuauggaacacucu

SEQ ID NO: 1852852 - RNA, 20 nt, Human
ucagugccuuauggaacacu

SEQ ID NO: 1852853 - RNA, 19 nt, Human
ucagugccuuauggaacac

SEQ ID NO: 1852854 - RNA, 14 nt, Human
ucaguggcagcugc

SEQ ID NO: 1852855 - RNA, 15 nt, Human
ucaguggcagcugcu

SEQ ID NO: 1852856 - RNA, 16 nt, Human
ucaguggcagcugcuu

SEQ ID NO: 1852857 - RNA, 15 nt, Human
ucagugcuucgcaga

SEQ ID NO: 1852858 - RNA, 12 nt, Human
ucagaauucuca

SEQ ID NO: 1852859 - RNA, 10 nt, Human
ucagaauucu

SEQ ID NO: 1852860 - RNA, 20 nt, Human
ucagaauucucagaaucuca

SEQ ID NO: 1852861 - RNA, 22 nt, Human
ucagagacuccugcaggcagcc

SEQ ID NO: 1852862 - RNA, 16 nt, Human
ucagaauagaaauuag

SEQ ID NO: 1852863 - RNA, 23 nt, Human
ucagaaguuucugccgcagcccu

SEQ ID NO: 1852864 - RNA, 15 nt, Human
acccagcccacuucu

SEQ ID NO: 1852865 - RNA, 23 nt, Human
ucagagacuccugcaggcagcca

SEQ ID NO: 1852866 - RNA, 16 nt, Human
ucagagacuccugcag

SEQ ID NO: 1852867 - RNA, 21 nt, Human
ucagagccaccccuaaagaga

SEQ ID NO: 1852868 - RNA, 21 nt, Human
ucagaugcugugcaaauguua

SEQ ID NO: 1852869 - RNA, 16 nt, Human
ucagaucucuaacuuc

SEQ ID NO: 1852870 - RNA, 13 nt, Human
accccagguuucu

SEQ ID NO: 1852871 - RNA, 22 nt, Human
accccagcuggggccaggcugg

SEQ ID NO: 1852872 - RNA, 19 nt, Human
accccagcuggggccaggc

SEQ ID NO: 1852873 - RNA, 23 nt, Human
acccaggugcuaggaacacuccu

SEQ ID NO: 1852874 - RNA, 11 nt, Human
acccaggugcu

SEQ ID NO: 1852875 - RNA, 13 nt, Human
acccaggagcccc

SEQ ID NO: 1852876 - RNA, 15 nt, Human
acccaggagccccga

SEQ ID NO: 1852877 - RNA, 13 nt, Human
acccagcgagccc

SEQ ID NO: 1852878 - RNA, 16 nt, Human
acccagcgagcccugg

SEQ ID NO: 1852879 - RNA, 17 nt, Human
acccagcgagcccuggu

SEQ ID NO: 1852880 - RNA, 21 nt, Human
accauucuccaccugccaggg

SEQ ID NO: 1852881 - RNA, 20 nt, Human
accauucuccaccugccagg

SEQ ID NO: 1852882 - RNA, 19 nt, Human
accauucuccaccugccag

SEQ ID NO: 1852883 - RNA, 18 nt, Human
accauguuggccaggcug

SEQ ID NO: 1852884 - RNA, 22 nt, Human
accauuuugcugucccuuuucc

SEQ ID NO: 1852885 - RNA, 23 nt, Human
accauuuugcugucccuuuuccu

SEQ ID NO: 1852886 - RNA, 21 nt, Human
accauuuugggguacccacug

SEQ ID NO: 1852887 - RNA, 21 nt, Human
acccagauaaagguucaugca

SEQ ID NO: 1852888 - RNA, 21 nt, Human
acccacuggacucaccucccc

SEQ ID NO: 1852889 - RNA, 17 nt, Human
acccacuggacucaccu

SEQ ID NO: 1852890 - RNA, 14 nt, Human
acccacuggacuca

SEQ ID NO: 1852891 - RNA, 20 nt, Human
acccacugcuuuuggucugu

SEQ ID NO: 1852892 - RNA, 16 nt, Human
acccaaauguucauca

SEQ ID NO: 1852893 - RNA, 20 nt, Human
acccaaauguucaucaauga

SEQ ID NO: 1852894 - RNA, 22 nt, Human
accauuuugggguacccacugc

SEQ ID NO: 1852895 - RNA, 15 nt, Human
ucacuguugcccagg

SEQ ID NO: 1852896 - RNA, 15 nt, Human
ucacugcacagugca

SEQ ID NO: 1852897 - RNA, 17 nt, Human
ucacugcaacuucugcc

SEQ ID NO: 1852898 - RNA, 18 nt, Human
ucacugcaacuucugccu

SEQ ID NO: 1852899 - RNA, 14 nt, Human
ucacuguugcccag

SEQ ID NO: 1852900 - RNA, 21 nt, Human
ucacugcaaccuucgccaccu

SEQ ID NO: 1852901 - RNA, 18 nt, Human
ucacugcaaccuccgccu

SEQ ID NO: 1852902 - RNA, 23 nt, Human
ucacugagacagcccgggcucug

SEQ ID NO: 1852903 - RNA, 22 nt, Human
ucaccagccccagugcccacag

SEQ ID NO: 1852904 - RNA, 21 nt, Human
ucacuauguugcccaggcagg

SEQ ID NO: 1852905 - RNA, 16 nt, Human
ucucaaaaaaagaaaa

SEQ ID NO: 1852906 - RNA, 16 nt, Human
ucuauuguuucuuuca

SEQ ID NO: 1852907 - RNA, 13 nt, Human
ucucacuccuacc

SEQ ID NO: 1852908 - RNA, 18 nt, Human
ucucacuccuaccuggua

SEQ ID NO: 1852909 - RNA, 17 nt, Human
ucucacuccuaccuggu

SEQ ID NO: 1852910 - RNA, 16 nt, Human
ucucacuccuaccugg

SEQ ID NO: 1852911 - RNA, 20 nt, Human
acuucgggaggucgaggcag

SEQ ID NO: 1852912 - RNA, 17 nt, Human
acuucgggaggucgagg

SEQ ID NO: 1852913 - RNA, 22 nt, Human
acuucgggaggucgaggcagga

SEQ ID NO: 1852914 - RNA, 18 nt, Human
acuucuccacccugcucu

SEQ ID NO: 1852915 - RNA, 14 nt, Human
acuugucuuuggac

SEQ ID NO: 1852916 - RNA, 15 nt, Human
acuuguauuaugugu

SEQ ID NO: 1852917 - RNA, 14 nt, Human
acuuguauuaugug

SEQ ID NO: 1852918 - RNA, 13 nt, Human
acuuguauuaugu

SEQ ID NO: 1852919 - RNA, 14 nt, Human
acuuguaugaaaga

SEQ ID NO: 1852920 - RNA, 14 nt, Human
acuuggaagcuccg

SEQ ID NO: 1852921 - RNA, 23 nt, Human
acuugaacccgggaggcagaggu

SEQ ID NO: 1852922 - RNA, 18 nt, Human
acuugaaaauuaacauga

SEQ ID NO: 1852923 - RNA, 17 nt, Human
acuugaaaauuaacaug

SEQ ID NO: 1852924 - RNA, 19 nt, Human
acuugagaauuacccuuuu

SEQ ID NO: 1852925 - RNA, 24 nt, Human
ucuagauacuguaucaugacaaag

SEQ ID NO: 1852926 - RNA, 23 nt, Human
ucuaguuugauuaaauucuugca

SEQ ID NO: 1852927 - RNA, 13 nt, Human
ucuauaauuuaaa

SEQ ID NO: 1852928 - RNA, 17 nt, Human
acuuccacugccauccu

SEQ ID NO: 1852929 - RNA, 18 nt, Human
acuuccaauuuacauacu

SEQ ID NO: 1852930 - RNA, 17 nt, Human
acuuccauaaucuggac

SEQ ID NO: 1852931 - RNA, 20 nt, Human
acuucaggcucuucuccuuu

SEQ ID NO: 1852932 - RNA, 18 nt, Human
acuucaggcucuucuccu

SEQ ID NO: 1852933 - RNA, 17 nt, Human
acuucaggcucuucucc

SEQ ID NO: 1852934 - RNA, 13 nt, Human
acuuacuguacau

SEQ ID NO: 1852935 - RNA, 14 nt, Human
acuuacuguacaug

SEQ ID NO: 1852936 - RNA, 20 nt, Human
acuuagagguggggagcaga

SEQ ID NO: 1852937 - RNA, 15 nt, Human
acuuacuguacauga

SEQ ID NO: 1852938 - RNA, 19 nt, Human
ucuaccugaggggccucuu

SEQ ID NO: 1852939 - RNA, 12 nt, Human
ucuaccugaggg

SEQ ID NO: 1852940 - RNA, 16 nt, Human
acuucaggcucuucuc

SEQ ID NO: 1852941 - RNA, 18 nt, Human
ucgcccuggacugugugc

SEQ ID NO: 1852942 - RNA, 14 nt, Human
ucgcuccugugucu

SEQ ID NO: 1852943 - RNA, 15 nt, Human
acuggguacuugugg

SEQ ID NO: 1852944 - RNA, 22 nt, Human
acugggcuuggggaccagagcu

SEQ ID NO: 1852945 - RNA, 21 nt, Human
acugggcuuggggaccagagc

SEQ ID NO: 1852946 - RNA, 21 nt, Human
ucgcucuguugcccaggcugg

SEQ ID NO: 1852947 - RNA, 23 nt, Human
ucgcugugucagcauagaaguaa

SEQ ID NO: 1852948 - RNA, 20 nt, Human
acuguacaugaaaacacauu

SEQ ID NO: 1852949 - RNA, 21 nt, Human
acuguacaugaaaacacauuu

SEQ ID NO: 1852950 - RNA, 15 nt, Human
acuguacuugcucuu

SEQ ID NO: 1852951 - RNA, 20 nt, Human
acuguacuccucccaggcgc

SEQ ID NO: 1852952 - RNA, 14 nt, Human
acuguaucaugaca

SEQ ID NO: 1852953 - RNA, 23 nt, Human
acuguacuugcucuugaugccug

SEQ ID NO: 1852954 - RNA, 19 nt, Human
acuguacaugaaaacacau

SEQ ID NO: 1852955 - RNA, 16 nt, Human
acuguacaugaaaaca

SEQ ID NO: 1852956 - RNA, 18 nt, Human
acuguacagacagaaaaa

SEQ ID NO: 1852957 - RNA, 22 nt, Human
acuguacaaaguagaagucuua

SEQ ID NO: 1852958 - RNA, 16 nt, Human
acuguacaaaguagaa

SEQ ID NO: 1852959 - RNA, 17 nt, Human
acuggguacuuguggac

SEQ ID NO: 1852960 - RNA, 18 nt, Human
acuggguacuuguggaca

SEQ ID NO: 1852961 - RNA, 16 nt, Human
acuguaucaugacaaa

SEQ ID NO: 1852962 - RNA, 20 nt, Human
acuguaucaugacaaagacu

SEQ ID NO: 1852963 - RNA, 13 nt, Human
ucuaaaggcuacc

SEQ ID NO: 1852964 - RNA, 16 nt, Human
ucuaaaggcuaccuuu

SEQ ID NO: 1852965 - RNA, 17 nt, Human
ucuaaagcugccagccg

SEQ ID NO: 1852966 - RNA, 23 nt, Human
ucuaaacugcccccucugcccug

SEQ ID NO: 1852967 - RNA, 22 nt, Human
ucuaaacugcccccucugcccu

SEQ ID NO: 1852968 - RNA, 16 nt, Human
ucuaaacugcccccuc

SEQ ID NO: 1852969 - RNA, 13 nt, Human
ucuaaacugcccc

SEQ ID NO: 1852970 - RNA, 21 nt, Human
ucuacccucuuagaaaaacca

SEQ ID NO: 1852971 - RNA, 17 nt, Human
acuguuaauaguucagg

SEQ ID NO: 1852972 - RNA, 21 nt, Human
acuguuaauaguucagguaac

SEQ ID NO: 1852973 - RNA, 19 nt, Human
ucggggagaggcugaggac

SEQ ID NO: 1852974 - RNA, 13 nt, Human
ucguucucugccu

SEQ ID NO: 1852975 - RNA, 23 nt, Human
ucgucacugcuuaacuucacaua

SEQ ID NO: 1852976 - RNA, 21 nt, Human
ucucucaggccaaacucaccu

SEQ ID NO: 1852977 - RNA, 14 nt, Human
ucucuccauucccg

SEQ ID NO: 1852978 - RNA, 12 nt, Human
ucucucaggcca

SEQ ID NO: 1852979 - RNA, 15 nt, Human
ucucggcucacugca

SEQ ID NO: 1852980 - RNA, 17 nt, Human
ucucgaacuccugaccu

SEQ ID NO: 1852981 - RNA, 20 nt, Human
ucucgcuauugucaccaggg

SEQ ID NO: 1852982 - RNA, 17 nt, Human
ucucgcucuguugccca

SEQ ID NO: 1852983 - RNA, 23 nt, Human
ucuccuuggugucgggcaugaca

SEQ ID NO: 1852984 - RNA, 21 nt, Human
ucuccuuggugucgggcauga

SEQ ID NO: 1852985 - RNA, 15 nt, Human
ucuccuuagaagugg

SEQ ID NO: 1852986 - RNA, 21 nt, Human
ucuccuuagaaguggaaguag

SEQ ID NO: 1852987 - RNA, 20 nt, Human
ucuccuuaaagaguguggca

SEQ ID NO: 1852988 - RNA, 18 nt, Human
acuuuguguucaccuugu

SEQ ID NO: 1852989 - RNA, 16 nt, Human
acuuuguguucaccuu

SEQ ID NO: 1852990 - RNA, 23 nt, Human
acuuugaggguguauauuuucug

SEQ ID NO: 1852991 - RNA, 14 nt, Human
acuuuggaaagagu

SEQ ID NO: 1852992 - RNA, 13 nt, Human
acuuuggaaagag

SEQ ID NO: 1852993 - RNA, 12 nt, Human
acuuuggaaaga

SEQ ID NO: 1852994 - RNA, 23 nt, Human
acuuuggaaagaguaggaagacu

SEQ ID NO: 1852995 - RNA, 19 nt, Human
acuuuguauaaaagggacu

SEQ ID NO: 1852996 - RNA, 13 nt, Human
acuuuagggaagu

SEQ ID NO: 1852997 - RNA, 16 nt, Human
acuuguuuucugggaa

SEQ ID NO: 1852998 - RNA, 15 nt, Human
acuuguggacacagc

SEQ ID NO: 1852999 - RNA, 16 nt, Human
acuuuaaaaggagcca

SEQ ID NO: 1853000 - RNA, 14 nt, Human
acuuguggacacag

SEQ ID NO: 1853001 - RNA, 22 nt, Human
agaaagacuaucuaaauguuga

SEQ ID NO: 1853002 - RNA, 20 nt, Human
agaaagacuaucuaaauguu

SEQ ID NO: 1853003 - RNA, 17 nt, Human
agaaagcagaacaguga

SEQ ID NO: 1853004 - RNA, 18 nt, Human
agaaagcagaacagugau

SEQ ID NO: 1853005 - RNA, 20 nt, Human
agaaagcagaacagugauua

SEQ ID NO: 1853006 - RNA, 18 nt, Human
ucugaaggcuggguucug

SEQ ID NO: 1853007 - RNA, 15 nt, Human
agaaaugccuuaccc

SEQ ID NO: 1853008 - RNA, 20 nt, Human
agaaaugcugguuuuucagu

SEQ ID NO: 1853009 - RNA, 21 nt, Human
agaaaugcugguuuuucaguu

SEQ ID NO: 1853010 - RNA, 16 nt, Human
agaaaugaaaaaauau

SEQ ID NO: 1853011 - RNA, 13 nt, Human
agaaaugaaaaaa

SEQ ID NO: 1853012 - RNA, 12 nt, Human
agaaaugaaaaa

SEQ ID NO: 1853013 - RNA, 18 nt, Human
agaaaaaugagccuggca

SEQ ID NO: 1853014 - RNA, 23 nt, Human
agaaaaaauauuuuccugccagg

SEQ ID NO: 1853015 - RNA, 17 nt, Human
agaaaaaauauuuuccu

SEQ ID NO: 1853016 - RNA, 19 nt, Human
agaaaaaauauuuucccua

SEQ ID NO: 1853017 - RNA, 18 nt, Human
ucucuugguccugcugca

SEQ ID NO: 1853018 - RNA, 17 nt, Human
ucucuugguccugcugc

SEQ ID NO: 1853019 - RNA, 16 nt, Human
ucucuugguccugcug

SEQ ID NO: 1853020 - RNA, 22 nt, Human
ucucugcaggucccuaauaaag

SEQ ID NO: 1853021 - RNA, 21 nt, Human
ucucugcaggucccuaauaaa

SEQ ID NO: 1853022 - RNA, 20 nt, Human
ucucugcaggucccuaauaa

SEQ ID NO: 1853023 - RNA, 19 nt, Human
ucucugcaggucccuaaua

SEQ ID NO: 1853024 - RNA, 23 nt, Human
agaagcucccugaaguaagcaaa

SEQ ID NO: 1853025 - RNA, 22 nt, Human
agaaguuugagaucagccuggg

SEQ ID NO: 1853026 - RNA, 23 nt, Human
ucugcuuuuuaaagaaugcucuu

SEQ ID NO: 1853027 - RNA, 22 nt, Human
ucugcuuugggguuuaucagaa

SEQ ID NO: 1853028 - RNA, 14 nt, Human
ucugccugucuccc

SEQ ID NO: 1853029 - RNA, 12 nt, Human
ucugccugucuc

SEQ ID NO: 1853030 - RNA, 23 nt, Human
ucuggcagaguugaagacagagc

SEQ ID NO: 1853031 - RNA, 20 nt, Human
ucuggcagaguugaagacag

SEQ ID NO: 1853032 - RNA, 17 nt, Human
ucuggcagcucagagag

SEQ ID NO: 1853033 - RNA, 21 nt, Human
ucuggcagcucagagagggug

SEQ ID NO: 1853034 - RNA, 18 nt, Human
ucuggcagcucagagagg

SEQ ID NO: 1853035 - RNA, 10 nt, Human
ucuggccuuc

SEQ ID NO: 1853036 - RNA, 13 nt, Human
agaagcagcucuu

SEQ ID NO: 1853037 - RNA, 12 nt, Human
agaagcagcucu

SEQ ID NO: 1853038 - RNA, 16 nt, Human
agaagcagaggaagga

SEQ ID NO: 1853039 - RNA, 19 nt, Human
agaagcaacccaaauguuc

SEQ ID NO: 1853040 - RNA, 23 nt, Human
agaagcccaggaaaggcuccagg

SEQ ID NO: 1853041 - RNA, 20 nt, Human
ucugcccauccugccccuga

SEQ ID NO: 1853042 - RNA, 23 nt, Human
ucugcccacucccugcaaccuga

SEQ ID NO: 1853043 - RNA, 23 nt, Human
ucugcccuugguuaggcauugug

SEQ ID NO: 1853044 - RNA, 12 nt, Human
ucugcccuuggu

SEQ ID NO: 1853045 - RNA, 22 nt, Human
ucugcccugcgggucacaggag

SEQ ID NO: 1853046 - RNA, 23 nt, Human
agaaccuuuugagugccuuacac

SEQ ID NO: 1853047 - RNA, 19 nt, Human
agaaccuuuugagugccuu

SEQ ID NO: 1853048 - RNA, 17 nt, Human
agaacucccuuucaaca

SEQ ID NO: 1853049 - RNA, 16 nt, Human
agaacucccuuucaac

SEQ ID NO: 1853050 - RNA, 21 nt, Human
agaacugaauuuugucuuuau

SEQ ID NO: 1853051 - RNA, 12 nt, Human
agaaauuaugug

SEQ ID NO: 1853052 - RNA, 23 nt, Human
ucugcaggucccuaauaaagcug

SEQ ID NO: 1853053 - RNA, 22 nt, Human
ucugcaggucccuaauaaagcu

SEQ ID NO: 1853054 - RNA, 19 nt, Human
ucugcaggucccuaauaaa

SEQ ID NO: 1853055 - RNA, 21 nt, Human
ucugcaggucccuaauaaagc

SEQ ID NO: 1853056 - RNA, 22 nt, Human
agagccuuccaggggugggaca

SEQ ID NO: 1853057 - RNA, 17 nt, Human
agagccuuccaggggug

SEQ ID NO: 1853058 - RNA, 15 nt, Human
agagccuuccagggg

SEQ ID NO: 1853059 - RNA, 13 nt, Human
agagccuuccagg

SEQ ID NO: 1853060 - RNA, 20 nt, Human
agagcuagcagcagggaggg

SEQ ID NO: 1853061 - RNA, 14 nt, Human
agagcugccaccug

SEQ ID NO: 1853062 - RNA, 23 nt, Human
agagcaccuuagacagucccugc

SEQ ID NO: 1853063 - RNA, 21 nt, Human
agagcaccuuagacagucccu

SEQ ID NO: 1853064 - RNA, 22 nt, Human
agagcaccuuagacagucccug

SEQ ID NO: 1853065 - RNA, 22 nt, Human
agagacuccugcaggcagccag

SEQ ID NO: 1853066 - RNA, 21 nt, Human
agagacuccugcaggcagcca

SEQ ID NO: 1853067 - RNA, 20 nt, Human
agagacuccugcaggcagcc

SEQ ID NO: 1853068 - RNA, 19 nt, Human
agagacuccugcaggcagc

SEQ ID NO: 1853069 - RNA, 18 nt, Human
agagacuccugcaggcag

SEQ ID NO: 1853070 - RNA, 17 nt, Human
agagacuccugcaggca

SEQ ID NO: 1853071 - RNA, 11 nt, Human
agagacuccug

SEQ ID NO: 1853072 - RNA, 16 nt, Human
agagacuccagcuggg

SEQ ID NO: 1853073 - RNA, 15 nt, Human
ugaaagacuguacaa

SEQ ID NO: 1853074 - RNA, 13 nt, Human
ugaaagacuguac

SEQ ID NO: 1853075 - RNA, 23 nt, Human
agagcaagacgcugugcugcccu

SEQ ID NO: 1853076 - RNA, 19 nt, Human
agagcaagacgcugugcug

SEQ ID NO: 1853077 - RNA, 23 nt, Human
agagacuccugcaggcagccagg

SEQ ID NO: 1853078 - RNA, 22 nt, Human
agagaucaaccccuucgcuccu

SEQ ID NO: 1853079 - RNA, 22 nt, Human
ucuuuggucuacacugugcuga

SEQ ID NO: 1853080 - RNA, 16 nt, Human
ucuuuggugaacauug

SEQ ID NO: 1853081 - RNA, 22 nt, Human
ucuuuggugaacauugcaauag

SEQ ID NO: 1853082 - RNA, 20 nt, Human
ucuuucuggcuaugcauuug

SEQ ID NO: 1853083 - RNA, 21 nt, Human
ucuuucuggcuaugcauuuga

SEQ ID NO: 1853084 - RNA, 21 nt, Human
ucuuucugcagaaacagaaag

SEQ ID NO: 1853085 - RNA, 16 nt, Human
ugaaaaaggaggaaga

SEQ ID NO: 1853086 - RNA, 23 nt, Human
ugaaaaaauauauaucaaauaua

SEQ ID NO: 1853087 - RNA, 22 nt, Human
ugaaaaaguucugcagauaaac

SEQ ID NO: 1853088 - RNA, 22 nt, Human
ugaaaaaguauccugcuucuga

SEQ ID NO: 1853089 - RNA, 22 nt, Human
ugaaaaaggaggaagagaaaaa

SEQ ID NO: 1853090 - RNA, 20 nt, Human
ugaaaaaggaggaagagaaa

SEQ ID NO: 1853091 - RNA, 16 nt, Human
ugaaaaucgugacaac

SEQ ID NO: 1853092 - RNA, 16 nt, Human
ugaaacgcaaccacca

SEQ ID NO: 1853093 - RNA, 17 nt, Human
ugaaaauguauguguaa

SEQ ID NO: 1853094 - RNA, 19 nt, Human
ugaaaaucgugacaacacu

SEQ ID NO: 1853095 - RNA, 20 nt, Human
ugaaaaucuuauaauuuaaa

SEQ ID NO: 1853096 - RNA, 23 nt, Human
agaccuucuccuucaccuuuguc

SEQ ID NO: 1853097 - RNA, 21 nt, Human
agaccuucuccuucaccuuug

SEQ ID NO: 1853098 - RNA, 18 nt, Human
agaccuucuccuucaccu

SEQ ID NO: 1853099 - RNA, 15 nt, Human
agaccuucuccuuca

SEQ ID NO: 1853100 - RNA, 11 nt, Human
agaccuucucc

SEQ ID NO: 1853101 - RNA, 21 nt, Human
ucuugaugccuggcggggugg

SEQ ID NO: 1853102 - RNA, 13 nt, Human
ucuugauucauaa

SEQ ID NO: 1853103 - RNA, 16 nt, Human
ucuugagccugggagg

SEQ ID NO: 1853104 - RNA, 13 nt, Human
ucuugagccuggg

SEQ ID NO: 1853105 - RNA, 16 nt, Human
ucuugagccuugaacu

SEQ ID NO: 1853106 - RNA, 19 nt, Human
ucuugguccugcugcaguu

SEQ ID NO: 1853107 - RNA, 16 nt, Human
ucuuuaaaugcugcuu

SEQ ID NO: 1853108 - RNA, 17 nt, Human
ucuugguccugcugcag

SEQ ID NO: 1853109 - RNA, 15 nt, Human
ucuugguccugcugc

SEQ ID NO: 1853110 - RNA, 17 nt, Human
ucuuuccugaggcuggg

SEQ ID NO: 1853111 - RNA, 19 nt, Human
ucuuucuaaugugugaauc

SEQ ID NO: 1853112 - RNA, 18 nt, Human
ucuuucuaaugugugaau

SEQ ID NO: 1853113 - RNA, 16 nt, Human
ucuuuaugauuuuuaa

SEQ ID NO: 1853114 - RNA, 17 nt, Human
ucuuuauuaaauguaga

SEQ ID NO: 1853115 - RNA, 21 nt, Human
ucuuuauuaaauguagaaagu

SEQ ID NO: 1853116 - RNA, 14 nt, Human
ucuugguccugcug

SEQ ID NO: 1853117 - RNA, 17 nt, Human
ucuuggucagauuugaa

SEQ ID NO: 1853118 - RNA, 19 nt, Human
ucuugcaauggcagccuug

SEQ ID NO: 1853119 - RNA, 18 nt, Human
ucuugcaauggcagccuu

SEQ ID NO: 1853120 - RNA, 22 nt, Human
ucuugcaauggcagccuuggca

SEQ ID NO: 1853121 - RNA, 21 nt, Human
ucuucugaacuuggcgcugcc

SEQ ID NO: 1853122 - RNA, 12 nt, Human
ucuucugcuuca

SEQ ID NO: 1853123 - RNA, 19 nt, Human
ucuucugcuucagccuccc

SEQ ID NO: 1853124 - RNA, 20 nt, Human
ucuucuguggguuucuaaag

SEQ ID NO: 1853125 - RNA, 18 nt, Human
ucuucuggguuccuuccu

SEQ ID NO: 1853126 - RNA, 15 nt, Human
ucuucuguacgucug

SEQ ID NO: 1853127 - RNA, 20 nt, Human
ucuucuguacgucugacagg

SEQ ID NO: 1853128 - RNA, 21 nt, Human
agacauagaauuaacacauga

SEQ ID NO: 1853129 - RNA, 19 nt, Human
agacauacuaaccagcaga

SEQ ID NO: 1853130 - RNA, 17 nt, Human
agacaucaacagauaaa

SEQ ID NO: 1853131 - RNA, 18 nt, Human
agacaucaacagauaaau

SEQ ID NO: 1853132 - RNA, 22 nt, Human
ucuucccuacaguugaaaaaca

SEQ ID NO: 1853133 - RNA, 19 nt, Human
ucuucccuacaguugaaaa

SEQ ID NO: 1853134 - RNA, 14 nt, Human
ucuuccucccuccc

SEQ ID NO: 1853135 - RNA, 15 nt, Human
ucuuccucccucccu

SEQ ID NO: 1853136 - RNA, 14 nt, Human
ucuuccucugcuga

SEQ ID NO: 1853137 - RNA, 12 nt, Human
ucuuccucugcu

SEQ ID NO: 1853138 - RNA, 11 nt, Human
ucuuccucugc

SEQ ID NO: 1853139 - RNA, 14 nt, Human
agaaucacuugaac

SEQ ID NO: 1853140 - RNA, 15 nt, Human
ucuucaacucccugc

SEQ ID NO: 1853141 - RNA, 19 nt, Human
ucuucaacugaccagccuc

SEQ ID NO: 1853142 - RNA, 16 nt, Human
ucuucaacugaccagc

SEQ ID NO: 1853143 - RNA, 12 nt, Human
ucuucagagacu

SEQ ID NO: 1853144 - RNA, 18 nt, Human
ucuucagagacuccugca

SEQ ID NO: 1853145 - RNA, 17 nt, Human
ucuucagagacuccugc

SEQ ID NO: 1853146 - RNA, 20 nt, Human
ucuuccaggcugggagagcc

SEQ ID NO: 1853147 - RNA, 17 nt, Human
ucuuccaggcugggaga

SEQ ID NO: 1853148 - RNA, 15 nt, Human
ucuuccaggcuggga

SEQ ID NO: 1853149 - RNA, 20 nt, Human
ucuucagagacuccugcagg

SEQ ID NO: 1853150 - RNA, 21 nt, Human
ucuuccaggcugggagagccu

SEQ ID NO: 1853151 - RNA, 16 nt, Human
agagggagggagggcu

SEQ ID NO: 1853152 - RNA, 20 nt, Human
agagggagggagggcuccag

SEQ ID NO: 1853153 - RNA, 12 nt, Human
ugaagccuuugu

SEQ ID NO: 1853154 - RNA, 20 nt, Human
ugaagcuaucguaaaauuaa

SEQ ID NO: 1853155 - RNA, 16 nt, Human
agagguggggagcaga

SEQ ID NO: 1853156 - RNA, 15 nt, Human
agagguuaagguggg

SEQ ID NO: 1853157 - RNA, 15 nt, Human
ugaauacuuuauaaa

SEQ ID NO: 1853158 - RNA, 16 nt, Human
ugaauaaagacaccua

SEQ ID NO: 1853159 - RNA, 21 nt, Human
ugaagucacugcacagugcau

SEQ ID NO: 1853160 - RNA, 16 nt, Human
ugaagucacugcacag

SEQ ID NO: 1853161 - RNA, 15 nt, Human
ugaagucacugcaca

SEQ ID NO: 1853162 - RNA, 14 nt, Human
ugaagucacugcac

SEQ ID NO: 1853163 - RNA, 14 nt, Human
ugaagucacacagu

SEQ ID NO: 1853164 - RNA, 20 nt, Human
agauauuuugcuuugugauu

SEQ ID NO: 1853165 - RNA, 21 nt, Human
agauauuuugcuuugugauuu

SEQ ID NO: 1853166 - RNA, 18 nt, Human
agaucaaaagguuaauaa

SEQ ID NO: 1853167 - RNA, 15 nt, Human
agauacuguaucaug

SEQ ID NO: 1853168 - RNA, 16 nt, Human
agauacuguaucauga

SEQ ID NO: 1853169 - RNA, 22 nt, Human
agauaauauuaaggaagacaau

SEQ ID NO: 1853170 - RNA, 18 nt, Human
agauaauauuaaggaaga

SEQ ID NO: 1853171 - RNA, 13 nt, Human
agauacaguuacu

SEQ ID NO: 1853172 - RNA, 20 nt, Human
agauacaggaaaagcugcug

SEQ ID NO: 1853173 - RNA, 11 nt, Human
agauacuguau

SEQ ID NO: 1853174 - RNA, 22 nt, Human
agauacaguuacucagaauucu

SEQ ID NO: 1853175 - RNA, 15 nt, Human
agagucacuggaaca

SEQ ID NO: 1853176 - RNA, 22 nt, Human
agagucagaaguuucugccgca

SEQ ID NO: 1853177 - RNA, 17 nt, Human
agaguuguuacauuuuu

SEQ ID NO: 1853178 - RNA, 19 nt, Human
agaguuguuacauuuuuaa

SEQ ID NO: 1853179 - RNA, 20 nt, Human
agaguuguuacauuuuuaag

SEQ ID NO: 1853180 - RNA, 17 nt, Human
agauaaggguaucuggu

SEQ ID NO: 1853181 - RNA, 18 nt, Human
agauaauacaccacuaca

SEQ ID NO: 1853182 - RNA, 22 nt, Human
ugacacagucuuggcucacugc

SEQ ID NO: 1853183 - RNA, 23 nt, Human
ugacacagucuuggcucacugca

SEQ ID NO: 1853184 - RNA, 19 nt, Human
ugacacacagcucuguccu

SEQ ID NO: 1853185 - RNA, 20 nt, Human
ugacacacagcucuguccug

SEQ ID NO: 1853186 - RNA, 19 nt, Human
ugacaaagacugaguacgu

SEQ ID NO: 1853187 - RNA, 16 nt, Human
ugacacacagcucugu

SEQ ID NO: 1853188 - RNA, 18 nt, Human
ugacacacagcucugucc

SEQ ID NO: 1853189 - RNA, 12 nt, Human
ugacacaugcaa

SEQ ID NO: 1853190 - RNA, 20 nt, Human
ugacacaugcaaggucauuu

SEQ ID NO: 1853191 - RNA, 21 nt, Human
ugaauuugugaagguggaaau

SEQ ID NO: 1853192 - RNA, 13 nt, Human
ugaauuugugaag

SEQ ID NO: 1853193 - RNA, 23 nt, Human
ugaauuucuuuugccguuauuaa

SEQ ID NO: 1853194 - RNA, 23 nt, Human
ugaauuugugaagguggaaauaa

SEQ ID NO: 1853195 - RNA, 22 nt, Human
agcaagacgcugugcugcccug

SEQ ID NO: 1853196 - RNA, 21 nt, Human
agcaagacgcugugcugcccu

SEQ ID NO: 1853197 - RNA, 20 nt, Human
agcaagacgcugugcugccc

SEQ ID NO: 1853198 - RNA, 17 nt, Human
agcaagacgcugugcug

SEQ ID NO: 1853199 - RNA, 23 nt, Human
agcaagacgcugugcugcccugc

SEQ ID NO: 1853200 - RNA, 14 nt, Human
agcaagauuucaga

SEQ ID NO: 1853201 - RNA, 20 nt, Human
ugagaagcagaggaaggaga

SEQ ID NO: 1853202 - RNA, 16 nt, Human
agcaagacgcugugcu

SEQ ID NO: 1853203 - RNA, 13 nt, Human
agcaagacgcugu

SEQ ID NO: 1853204 - RNA, 13 nt, Human
agauuggaaggaa

SEQ ID NO: 1853205 - RNA, 19 nt, Human
agauuccagagaguggcuc

SEQ ID NO: 1853206 - RNA, 19 nt, Human
ugacuuacuguacaugaaa

SEQ ID NO: 1853207 - RNA, 22 nt, Human
agauucauauuuacuucuuaua

SEQ ID NO: 1853208 - RNA, 18 nt, Human
agauuccagagaguggcu

SEQ ID NO: 1853209 - RNA, 20 nt, Human
agauuucucauuugccaaua

SEQ ID NO: 1853210 - RNA, 17 nt, Human
agauuugaacucuucaa

SEQ ID NO: 1853211 - RNA, 21 nt, Human
agauuuugaaauuuuuauuaa

SEQ ID NO: 1853212 - RNA, 17 nt, Human
ugacacuuaaaaauggu

SEQ ID NO: 1853213 - RNA, 16 nt, Human
ugacacuuaaaaaugg

SEQ ID NO: 1853214 - RNA, 23 nt, Human
agaugcugacuguacuccuccca

SEQ ID NO: 1853215 - RNA, 20 nt, Human
agaugcugacuguacuccuc

SEQ ID NO: 1853216 - RNA, 16 nt, Human
agaugccgcauuugga

SEQ ID NO: 1853217 - RNA, 16 nt, Human
ugacccaugcugcccu

SEQ ID NO: 1853218 - RNA, 12 nt, Human
ugacccaugcug

SEQ ID NO: 1853219 - RNA, 21 nt, Human
ugacccaugcugcccugugag

SEQ ID NO: 1853220 - RNA, 15 nt, Human
ugacccaugcugccc

SEQ ID NO: 1853221 - RNA, 14 nt, Human
ugacccaugcugcc

SEQ ID NO: 1853222 - RNA, 13 nt, Human
ugacuuacuguac

SEQ ID NO: 1853223 - RNA, 15 nt, Human
ugacuuacuguacau

SEQ ID NO: 1853224 - RNA, 16 nt, Human
ugacuuacuguacaug

SEQ ID NO: 1853225 - RNA, 19 nt, Human
ugaccugaggcccuucucu

SEQ ID NO: 1853226 - RNA, 18 nt, Human
ugaccugaggcccuucuc

SEQ ID NO: 1853227 - RNA, 23 nt, Human
ugaccccucauagcccucacccu

SEQ ID NO: 1853228 - RNA, 23 nt, Human
ugauauuuucaacgcagcccugc

SEQ ID NO: 1853229 - RNA, 22 nt, Human
ugauauuuucaacgcagcccug

SEQ ID NO: 1853230 - RNA, 21 nt, Human
ugauauuuucaacgcagcccu

SEQ ID NO: 1853231 - RNA, 19 nt, Human
ugauauuuucaacgcagcc

SEQ ID NO: 1853232 - RNA, 19 nt, Human
ugauauguugguagauucu

SEQ ID NO: 1853233 - RNA, 22 nt, Human
agcauauucaggaagcucaggg

SEQ ID NO: 1853234 - RNA, 20 nt, Human
ugaucacggcucacugcagc

SEQ ID NO: 1853235 - RNA, 21 nt, Human
ugaucacggcucacugcagcc

SEQ ID NO: 1853236 - RNA, 13 nt, Human
agcaucaggccag

SEQ ID NO: 1853237 - RNA, 20 nt, Human
agcaucacaugaacuuguaa

SEQ ID NO: 1853238 - RNA, 19 nt, Human
ugaucacggcucacugcag

SEQ ID NO: 1853239 - RNA, 20 nt, Human
agcaucaggccaggcccucu

SEQ ID NO: 1853240 - RNA, 19 nt, Human
agcaucaggccaggcccuc

SEQ ID NO: 1853241 - RNA, 18 nt, Human
agcaucaggccaggcccu

SEQ ID NO: 1853242 - RNA, 17 nt, Human
agcaucaggccaggccc

SEQ ID NO: 1853243 - RNA, 16 nt, Human
agcaucaggccaggcc

SEQ ID NO: 1853244 - RNA, 14 nt, Human
agcaucaggccagg

SEQ ID NO: 1853245 - RNA, 12 nt, Human
agcauggcugcc

SEQ ID NO: 1853246 - RNA, 20 nt, Human
agcaugucgucaaagcugaa

SEQ ID NO: 1853247 - RNA, 17 nt, Human
agcaugucgucaaagcu

SEQ ID NO: 1853248 - RNA, 14 nt, Human
ugagucaccaagcc

SEQ ID NO: 1853249 - RNA, 20 nt, Human
ugagugccuuacacaauggu

SEQ ID NO: 1853250 - RNA, 17 nt, Human
ugagugccuuacacaau

SEQ ID NO: 1853251 - RNA, 16 nt, Human
ugagucaccaagccca

SEQ ID NO: 1853252 - RNA, 17 nt, Human
ugagucaccaagcccag

SEQ ID NO: 1853253 - RNA, 21 nt, Human
ugagugggugaauaauacagu

SEQ ID NO: 1853254 - RNA, 23 nt, Human
ugagugggggaucacagccucug

SEQ ID NO: 1853255 - RNA, 14 nt, Human
ugauacuacaguuu

SEQ ID NO: 1853256 - RNA, 17 nt, Human
ugauacuacaguuuguu

SEQ ID NO: 1853257 - RNA, 20 nt, Human
ugauacaaugcugugcccua

SEQ ID NO: 1853258 - RNA, 21 nt, Human
ugauacaaugcugugcccuaa

SEQ ID NO: 1853259 - RNA, 20 nt, Human
ugauaagaaccuuuugagug

SEQ ID NO: 1853260 - RNA, 17 nt, Human
ugaguucauacccuguu

SEQ ID NO: 1853261 - RNA, 16 nt, Human
agcauacguacacauu

SEQ ID NO: 1853262 - RNA, 17 nt, Human
agcauacguacacauuu

SEQ ID NO: 1853263 - RNA, 18 nt, Human
agcauacguacacauuuu

SEQ ID NO: 1853264 - RNA, 19 nt, Human
agcauacguacacauuuua

SEQ ID NO: 1853265 - RNA, 20 nt, Human
agcauacguacacauuuuau

SEQ ID NO: 1853266 - RNA, 21 nt, Human
agcauacguacacauuuuauu

SEQ ID NO: 1853267 - RNA, 15 nt, Human
agcauacguacacau

SEQ ID NO: 1853268 - RNA, 21 nt, Human
agcauaauacuugcuuuggaa

SEQ ID NO: 1853269 - RNA, 12 nt, Human
ugagaauuaccc

SEQ ID NO: 1853270 - RNA, 23 nt, Human
ugaguacuacaguccucccaucu

SEQ ID NO: 1853271 - RNA, 22 nt, Human
ugaguacuacaguccucccauc

SEQ ID NO: 1853272 - RNA, 21 nt, Human
ugaguacuacaguccucccau

SEQ ID NO: 1853273 - RNA, 17 nt, Human
ugaguacuacaguccuc

SEQ ID NO: 1853274 - RNA, 13 nt, Human
ugaguagcuggga

SEQ ID NO: 1853275 - RNA, 13 nt, Human
ugaguagcuggau

SEQ ID NO: 1853276 - RNA, 14 nt, Human
agcauauucaggaa

SEQ ID NO: 1853277 - RNA, 15 nt, Human
ugaguacuacagucc

SEQ ID NO: 1853278 - RNA, 22 nt, Human
ugaguaacugauuuguaacaag

SEQ ID NO: 1853279 - RNA, 18 nt, Human
agccaccgugccuggcca

SEQ ID NO: 1853280 - RNA, 14 nt, Human
agccacggccaggc

SEQ ID NO: 1853281 - RNA, 23 nt, Human
agccaccaacauacucccaucug

SEQ ID NO: 1853282 - RNA, 20 nt, Human
agccaccaacauacucccau

SEQ ID NO: 1853283 - RNA, 19 nt, Human
agccaccaacauacuccca

SEQ ID NO: 1853284 - RNA, 18 nt, Human
agccacauuccugaugcu

SEQ ID NO: 1853285 - RNA, 14 nt, Human
agccacauuccuga

SEQ ID NO: 1853286 - RNA, 14 nt, Human
ugaugaagaggagu

SEQ ID NO: 1853287 - RNA, 13 nt, Human
ugaugaagaggag

SEQ ID NO: 1853288 - RNA, 18 nt, Human
ugauccuuuuggagucag

SEQ ID NO: 1853289 - RNA, 15 nt, Human
agccacggccaggcc

SEQ ID NO: 1853290 - RNA, 14 nt, Human
ugauuaccagggac

SEQ ID NO: 1853291 - RNA, 12 nt, Human
ugauuaaaccaa

SEQ ID NO: 1853292 - RNA, 15 nt, Human
ugauuaauuaaaaca

SEQ ID NO: 1853293 - RNA, 13 nt, Human
agccacugcaccg

SEQ ID NO: 1853294 - RNA, 21 nt, Human
agccacugcaccgggccacag

SEQ ID NO: 1853295 - RNA, 22 nt, Human
agccacugcaccgggccacaga

SEQ ID NO: 1853296 - RNA, 16 nt, Human
ugauggugcaaugacc

SEQ ID NO: 1853297 - RNA, 23 nt, Human
ugauggugcaaugaccuuucaau

SEQ ID NO: 1853298 - RNA, 17 nt, Human
ugauggugcaaugaccu

SEQ ID NO: 1853299 - RNA, 20 nt, Human
ugaugauccuaggcauuugc

SEQ ID NO: 1853300 - RNA, 14 nt, Human
ugaugauccuaggc

SEQ ID NO: 1853301 - RNA, 17 nt, Human
ugauguuuuaaggaugc

SEQ ID NO: 1853302 - RNA, 18 nt, Human
ugauguuuuaaggaugcu

SEQ ID NO: 1853303 - RNA, 19 nt, Human
ugauucccaagcucugcuc

SEQ ID NO: 1853304 - RNA, 21 nt, Human
ugauucccaagcucugcuccu

SEQ ID NO: 1853305 - RNA, 15 nt, Human
ugauucccaagcucu

SEQ ID NO: 1853306 - RNA, 16 nt, Human
ugauucccaagcucug

SEQ ID NO: 1853307 - RNA, 18 nt, Human
ugauucccaagcucugcu

SEQ ID NO: 1853308 - RNA, 23 nt, Human
agcccaggaaaggcuccaggagc

SEQ ID NO: 1853309 - RNA, 22 nt, Human
agcccaggaaaggcuccaggag

SEQ ID NO: 1853310 - RNA, 24 nt, Human
agcccaggaaaggcuccaggagca

SEQ ID NO: 1853311 - RNA, 14 nt, Human
ugauucagcucugc

SEQ ID NO: 1853312 - RNA, 13 nt, Human
ugauucagcucug

SEQ ID NO: 1853313 - RNA, 15 nt, Human
ugauucauaaugacu

SEQ ID NO: 1853314 - RNA, 21 nt, Human
agcccaggaaaggcuccagga

SEQ ID NO: 1853315 - RNA, 20 nt, Human
agcccaggaaaggcuccagg

SEQ ID NO: 1853316 - RNA, 19 nt, Human
agcccaggaaaggcuccag

SEQ ID NO: 1853317 - RNA, 22 nt, Human
agcccacuucugccauauucug

SEQ ID NO: 1853318 - RNA, 14 nt, Human
agccaggccacaag

SEQ ID NO: 1853319 - RNA, 12 nt, Human
agccaggccaca

SEQ ID NO: 1853320 - RNA, 22 nt, Human
agccaggccacaagacccuugu

SEQ ID NO: 1853321 - RNA, 21 nt, Human
agccaggccacaagacccuug

SEQ ID NO: 1853322 - RNA, 12 nt, Human
agccagggucuc

SEQ ID NO: 1853323 - RNA, 23 nt, Human
agccaguaaaugggggugcauuu

SEQ ID NO: 1853324 - RNA, 16 nt, Human
agcggagaaaggaagg

SEQ ID NO: 1853325 - RNA, 20 nt, Human
ugcauuaucuagauacugua

SEQ ID NO: 1853326 - RNA, 20 nt, Human
agcggagaaaggaagggcug

SEQ ID NO: 1853327 - RNA, 18 nt, Human
agcggagacggaguccca

SEQ ID NO: 1853328 - RNA, 17 nt, Human
agccuuccagggguggg

SEQ ID NO: 1853329 - RNA, 16 nt, Human
agccuuccaggggugg

SEQ ID NO: 1853330 - RNA, 14 nt, Human
agccuuccaggggu

SEQ ID NO: 1853331 - RNA, 11 nt, Human
agccuuccagg

SEQ ID NO: 1853332 - RNA, 22 nt, Human
ugccaauaauaauaccucccuu

SEQ ID NO: 1853333 - RNA, 21 nt, Human
ugccaauaauaauaccucccu

SEQ ID NO: 1853334 - RNA, 16 nt, Human
ugccacacuucaggcu

SEQ ID NO: 1853335 - RNA, 15 nt, Human
ugccacacuucaggc

SEQ ID NO: 1853336 - RNA, 14 nt, Human
ugccacacuucagg

SEQ ID NO: 1853337 - RNA, 13 nt, Human
ugccacacuucag

SEQ ID NO: 1853338 - RNA, 21 nt, Human
ugcauuaucuagauacuguau

SEQ ID NO: 1853339 - RNA, 22 nt, Human
ugcauuaucuagauacuguauc

SEQ ID NO: 1853340 - RNA, 21 nt, Human
agccugugccucugggacugg

SEQ ID NO: 1853341 - RNA, 13 nt, Human
agccuguuuaaga

SEQ ID NO: 1853342 - RNA, 23 nt, Human
agccugugucuuuaaaugcugcu

SEQ ID NO: 1853343 - RNA, 16 nt, Human
agccugugucuuuaaa

SEQ ID NO: 1853344 - RNA, 22 nt, Human
agccugcuccagcuguucagcu

SEQ ID NO: 1853345 - RNA, 19 nt, Human
agccugcuccagcuguuca

SEQ ID NO: 1853346 - RNA, 22 nt, Human
agccugggugacagagcaagug

SEQ ID NO: 1853347 - RNA, 17 nt, Human
agccugcuccagcuguu

SEQ ID NO: 1853348 - RNA, 16 nt, Human
agccugcuccagcugu

SEQ ID NO: 1853349 - RNA, 15 nt, Human
agccugcuccagcug

SEQ ID NO: 1853350 - RNA, 14 nt, Human
ugcauaccacuuuu

SEQ ID NO: 1853351 - RNA, 12 nt, Human
ugcauaccacuu

SEQ ID NO: 1853352 - RNA, 17 nt, Human
agcuacuugggaggcug

SEQ ID NO: 1853353 - RNA, 18 nt, Human
agcuacuugggaggcuga

SEQ ID NO: 1853354 - RNA, 11 nt, Human
agcuagaaaug

SEQ ID NO: 1853355 - RNA, 12 nt, Human
agcuagaaauga

SEQ ID NO: 1853356 - RNA, 18 nt, Human
agcuagacgagcaggcuu

SEQ ID NO: 1853357 - RNA, 23 nt, Human
ugccacacuucaggcucuucucc

SEQ ID NO: 1853358 - RNA, 22 nt, Human
ugccacacuucaggcucuucuc

SEQ ID NO: 1853359 - RNA, 19 nt, Human
agcgugagccacugcaccg

SEQ ID NO: 1853360 - RNA, 15 nt, Human
agcgugcauaaguua

SEQ ID NO: 1853361 - RNA, 22 nt, Human
agcgugagccacugcaccgggc

SEQ ID NO: 1853362 - RNA, 19 nt, Human
agcuacuaauuuuaaaaug

SEQ ID NO: 1853363 - RNA, 18 nt, Human
agcuaggaauuguguuua

SEQ ID NO: 1853364 - RNA, 12 nt, Human
agcuaggccugg

SEQ ID NO: 1853365 - RNA, 16 nt, Human
agcuaggccuggccag

SEQ ID NO: 1853366 - RNA, 14 nt, Human
agcuaggccuggcc

SEQ ID NO: 1853367 - RNA, 15 nt, Human
agcuaggccuggcca

SEQ ID NO: 1853368 - RNA, 18 nt, Human
agcucaggugucccugca

SEQ ID NO: 1853369 - RNA, 22 nt, Human
agcucaggugucccugcacuug

SEQ ID NO: 1853370 - RNA, 20 nt, Human
agcucaggugucccugcacu

SEQ ID NO: 1853371 - RNA, 21 nt, Human
agcucaggugucccugcacuu

SEQ ID NO: 1853372 - RNA, 20 nt, Human
agcucauucuccuuguguua

SEQ ID NO: 1853373 - RNA, 21 nt, Human
agcucauucuccuuguguuac

SEQ ID NO: 1853374 - RNA, 21 nt, Human
ugcccaagaauagaugcugac

SEQ ID NO: 1853375 - RNA, 23 nt, Human
ugcccaagaauagaugcugacug

SEQ ID NO: 1853376 - RNA, 22 nt, Human
ugcccaagaauagaugcugacu

SEQ ID NO: 1853377 - RNA, 20 nt, Human
ugcccagccccuucugaccc

SEQ ID NO: 1853378 - RNA, 21 nt, Human
ugcccagccccuucugaccca

SEQ ID NO: 1853379 - RNA, 20 nt, Human
ugcccacaggaucagucuga

SEQ ID NO: 1853380 - RNA, 19 nt, Human
ugcccacaggaucagucug

SEQ ID NO: 1853381 - RNA, 16 nt, Human
ugcccacaggaucagu

SEQ ID NO: 1853382 - RNA, 10 nt, Human
ugcacacauu

SEQ ID NO: 1853383 - RNA, 20 nt, Human
ugcacacauuuuuuaaaugc

SEQ ID NO: 1853384 - RNA, 17 nt, Human
ugcacccucaggcaggu

SEQ ID NO: 1853385 - RNA, 16 nt, Human
ugcacccucaggcagg

SEQ ID NO: 1853386 - RNA, 14 nt, Human
ugcacgugugugca

SEQ ID NO: 1853387 - RNA, 15 nt, Human
ugcacgugugugcac

SEQ ID NO: 1853388 - RNA, 24 nt, Human
agccccuucugacccaugcugccc

SEQ ID NO: 1853389 - RNA, 20 nt, Human
agccccuucugacccaugcu

SEQ ID NO: 1853390 - RNA, 21 nt, Human
agcccugcuuugggcugcccu

SEQ ID NO: 1853391 - RNA, 23 nt, Human
agcccugcuuugggcugcccugg

SEQ ID NO: 1853392 - RNA, 22 nt, Human
agcccugcuuugggcugcccug

SEQ ID NO: 1853393 - RNA, 21 nt, Human
agcccugguggcagugggagc

SEQ ID NO: 1853394 - RNA, 21 nt, Human
ugcacaagcugcacccucagg

SEQ ID NO: 1853395 - RNA, 18 nt, Human
ugcacaagcugcacccuc

SEQ ID NO: 1853396 - RNA, 24 nt, Human
ugcacacagcacgggggccaagga

SEQ ID NO: 1853397 - RNA, 12 nt, Human
ugcacacagcac

SEQ ID NO: 1853398 - RNA, 15 nt, Human
ugcacaagcugcacc

SEQ ID NO: 1853399 - RNA, 22 nt, Human
agcccugguggcagugggagcu

SEQ ID NO: 1853400 - RNA, 23 nt, Human
agcccugguggcagugggagcug

SEQ ID NO: 1853401 - RNA, 15 nt, Human
ugauucuccugccuc

SEQ ID NO: 1853402 - RNA, 19 nt, Human
ugauucuccugccucagcc

SEQ ID NO: 1853403 - RNA, 20 nt, Human
ugauucuccugccucagccu

SEQ ID NO: 1853404 - RNA, 18 nt, Human
agcccauggcacucuaug

SEQ ID NO: 1853405 - RNA, 20 nt, Human
agccccaaaacucuccucug

SEQ ID NO: 1853406 - RNA, 22 nt, Human
agccccaaaacucuccucugcu

SEQ ID NO: 1853407 - RNA, 21 nt, Human
agccccaaaacucuccucugc

SEQ ID NO: 1853408 - RNA, 24 nt, Human
agccccaaaacucuccucugcugc

SEQ ID NO: 1853409 - RNA, 17 nt, Human
agccccgaggccuucuc

SEQ ID NO: 1853410 - RNA, 22 nt, Human
agccccgaggccuucucugaag

SEQ ID NO: 1853411 - RNA, 16 nt, Human
agccccgaggccuucu

SEQ ID NO: 1853412 - RNA, 18 nt, Human
agccccuggaugcagccu

SEQ ID NO: 1853413 - RNA, 17 nt, Human
agccccuggaugcagcc

SEQ ID NO: 1853414 - RNA, 19 nt, Human
agccccuggaugcagccuc

SEQ ID NO: 1853415 - RNA, 22 nt, Human
agccccuggaugcagccucaca

SEQ ID NO: 1853416 - RNA, 16 nt, Human
ugcaggucccuaauaa

SEQ ID NO: 1853417 - RNA, 15 nt, Human
ugcaggucccuaaua

SEQ ID NO: 1853418 - RNA, 14 nt, Human
ugcaggucccuaau

SEQ ID NO: 1853419 - RNA, 12 nt, Human
ugcaggucccua

SEQ ID NO: 1853420 - RNA, 18 nt, Human
ugcaguacuuuaccuccu

SEQ ID NO: 1853421 - RNA, 17 nt, Human
ugcauaaguuaacuucc

SEQ ID NO: 1853422 - RNA, 14 nt, Human
ugcauaaguuaacu

SEQ ID NO: 1853423 - RNA, 23 nt, Human
ugcauaacguauaaaagccuguu

SEQ ID NO: 1853424 - RNA, 22 nt, Human
ugcauaacguauaaaagccugu

SEQ ID NO: 1853425 - RNA, 15 nt, Human
ugcagccucacaguc

SEQ ID NO: 1853426 - RNA, 13 nt, Human
ugcagccucacag

SEQ ID NO: 1853427 - RNA, 16 nt, Human
ugcagccucacagucc

SEQ ID NO: 1853428 - RNA, 22 nt, Human
agccugaaagaggaaugaagua

SEQ ID NO: 1853429 - RNA, 17 nt, Human
agccucccaaagugcug

SEQ ID NO: 1853430 - RNA, 17 nt, Human
agccucagcauccuggc

SEQ ID NO: 1853431 - RNA, 19 nt, Human
agccucagcauccuggcac

SEQ ID NO: 1853432 - RNA, 20 nt, Human
agccucagcauccuggcacc

SEQ ID NO: 1853433 - RNA, 21 nt, Human
agccucagcauccuggcaccc

SEQ ID NO: 1853434 - RNA, 15 nt, Human
agccucauguccacu

SEQ ID NO: 1853435 - RNA, 12 nt, Human
agccucaucucu

SEQ ID NO: 1853436 - RNA, 22 nt, Human
agccucagcauccuggcacccg

SEQ ID NO: 1853437 - RNA, 23 nt, Human
agccucagcauccuggcacccgg

SEQ ID NO: 1853438 - RNA, 20 nt, Human
agccucauguccacugguuc

SEQ ID NO: 1853439 - RNA, 20 nt, Human
agccuccaugcugccuccag

SEQ ID NO: 1853440 - RNA, 18 nt, Human
agccuccaugcugccucc

SEQ ID NO: 1853441 - RNA, 16 nt, Human
agccucccaaagugcu

SEQ ID NO: 1853442 - RNA, 13 nt, Human
agccguggcuucc

SEQ ID NO: 1853443 - RNA, 21 nt, Human
agccguggcuucccgcucagc

SEQ ID NO: 1853444 - RNA, 14 nt, Human
agccguggcuuccc

SEQ ID NO: 1853445 - RNA, 23 nt, Human
agccguggcuucccgcucagccc

SEQ ID NO: 1853446 - RNA, 22 nt, Human
agccguggcuucccgcucagcc

SEQ ID NO: 1853447 - RNA, 19 nt, Human
agccguuuguuccccaaga

SEQ ID NO: 1853448 - RNA, 23 nt, Human
agcccuucuaccuuccugcaaca

SEQ ID NO: 1853449 - RNA, 23 nt, Human
ugcacuauagccuaggugacaga

SEQ ID NO: 1853450 - RNA, 14 nt, Human
ugcuuguacauaau

SEQ ID NO: 1853451 - RNA, 16 nt, Human
ugcuuguacauaaugc

SEQ ID NO: 1853452 - RNA, 22 nt, Human
ugcuuguacauaaugcgugcau

SEQ ID NO: 1853453 - RNA, 12 nt, Human
ugcuuugugauu

SEQ ID NO: 1853454 - RNA, 14 nt, Human
ugcuuugugauuuu

SEQ ID NO: 1853455 - RNA, 16 nt, Human
ugcuuugugauuuuug

SEQ ID NO: 1853456 - RNA, 14 nt, Human
ugcuuuuggucugu

SEQ ID NO: 1853457 - RNA, 17 nt, Human
ugcuuuuggucugugug

SEQ ID NO: 1853458 - RNA, 12 nt, Human
ugcuuguacaua

SEQ ID NO: 1853459 - RNA, 13 nt, Human
ugcuuguacauaa

SEQ ID NO: 1853460 - RNA, 16 nt, Human
ugcuuggaggaaggaa

SEQ ID NO: 1853461 - RNA, 15 nt, Human
ugcuuggaggaagga

SEQ ID NO: 1853462 - RNA, 14 nt, Human
ugcuuggaggaagg

SEQ ID NO: 1853463 - RNA, 21 nt, Human
ugcuugaggcaacucaucuua

SEQ ID NO: 1853464 - RNA, 14 nt, Human
aggauccugagcca

SEQ ID NO: 1853465 - RNA, 13 nt, Human
aggauccugagcc

SEQ ID NO: 1853466 - RNA, 18 nt, Human
uggaaguacuauaauuua

SEQ ID NO: 1853467 - RNA, 23 nt, Human
uggaaggggacacgugacagccg

SEQ ID NO: 1853468 - RNA, 18 nt, Human
uggaaaugggcagagcag

SEQ ID NO: 1853469 - RNA, 17 nt, Human
uggaaaugggcagagca

SEQ ID NO: 1853470 - RNA, 16 nt, Human
uggaagcacagcuuca

SEQ ID NO: 1853471 - RNA, 14 nt, Human
uggagaacuagaga

SEQ ID NO: 1853472 - RNA, 15 nt, Human
uggacugugugcuca

SEQ ID NO: 1853473 - RNA, 22 nt, Human
uggagaagcggcuggcagccca

SEQ ID NO: 1853474 - RNA, 13 nt, Human
uggagaagcggcu

SEQ ID NO: 1853475 - RNA, 20 nt, Human
aggcaccuaccaccacgccc

SEQ ID NO: 1853476 - RNA, 14 nt, Human
aggcaaugcuggcu

SEQ ID NO: 1853477 - RNA, 20 nt, Human
aggcacccaccaucaugucu

SEQ ID NO: 1853478 - RNA, 21 nt, Human
aggcacccaccaucaugucug

SEQ ID NO: 1853479 - RNA, 22 nt, Human
aggcacccaccaucaugucugg

SEQ ID NO: 1853480 - RNA, 13 nt, Human
aggcaaucauggu

SEQ ID NO: 1853481 - RNA, 23 nt, Human
uggacccuguggaugauaaaaca

SEQ ID NO: 1853482 - RNA, 21 nt, Human
uggacccugaggcccagaggg

SEQ ID NO: 1853483 - RNA, 20 nt, Human
uggacccugaggcccagagg

SEQ ID NO: 1853484 - RNA, 19 nt, Human
uggacccugaggcccagag

SEQ ID NO: 1853485 - RNA, 18 nt, Human
uggacccugaggcccaga

SEQ ID NO: 1853486 - RNA, 16 nt, Human
uggacccugaggccca

SEQ ID NO: 1853487 - RNA, 23 nt, Human
uggacacagcucuucuccaggcu

SEQ ID NO: 1853488 - RNA, 20 nt, Human
uggaccuugaacuggguacu

SEQ ID NO: 1853489 - RNA, 15 nt, Human
uggacccugaggccc

SEQ ID NO: 1853490 - RNA, 22 nt, Human
uggacacagcucuucuccaggc

SEQ ID NO: 1853491 - RNA, 13 nt, Human
uggacacagcucu

SEQ ID NO: 1853492 - RNA, 14 nt, Human
uggacacagcucuu

SEQ ID NO: 1853493 - RNA, 18 nt, Human
aggaucucuugagccugg

SEQ ID NO: 1853494 - RNA, 17 nt, Human
aggaucucuugagccug

SEQ ID NO: 1853495 - RNA, 19 nt, Human
aggaucucuugagccuggg

SEQ ID NO: 1853496 - RNA, 13 nt, Human
uggauuguccccg

SEQ ID NO: 1853497 - RNA, 21 nt, Human
uggauuguccccgacccuugc

SEQ ID NO: 1853498 - RNA, 13 nt, Human
uggauuggauuug

SEQ ID NO: 1853499 - RNA, 17 nt, Human
uggauuauauuaugaag

SEQ ID NO: 1853500 - RNA, 14 nt, Human
uggaguauauguca

SEQ ID NO: 1853501 - RNA, 15 nt, Human
uggauggaaggggcu

SEQ ID NO: 1853502 - RNA, 20 nt, Human
uggagguacgaaaagagggg

SEQ ID NO: 1853503 - RNA, 16 nt, Human
aggccaaggugggagg

SEQ ID NO: 1853504 - RNA, 20 nt, Human
aggccaaaggaagcacaugc

SEQ ID NO: 1853505 - RNA, 19 nt, Human
aggccaaaggaagcacaug

SEQ ID NO: 1853506 - RNA, 18 nt, Human
aggccaaaggaagcacau

SEQ ID NO: 1853507 - RNA, 16 nt, Human
aggccaaaggaagcac

SEQ ID NO: 1853508 - RNA, 16 nt, Human
aggcagccccauucug

SEQ ID NO: 1853509 - RNA, 17 nt, Human
aggcagccccauucugc

SEQ ID NO: 1853510 - RNA, 16 nt, Human
aggccccgcccaggcu

SEQ ID NO: 1853511 - RNA, 21 nt, Human
aggcccagagggccugcaagg

SEQ ID NO: 1853512 - RNA, 20 nt, Human
aggccagagggagugacaga

SEQ ID NO: 1853513 - RNA, 19 nt, Human
uggcagcucaccucucccu

SEQ ID NO: 1853514 - RNA, 16 nt, Human
aggccacaagacccuu

SEQ ID NO: 1853515 - RNA, 15 nt, Human
uggcagcucaccucu

SEQ ID NO: 1853516 - RNA, 17 nt, Human
uggcagccuuggcaaac

SEQ ID NO: 1853517 - RNA, 18 nt, Human
aggccacaagacccuugu

SEQ ID NO: 1853518 - RNA, 17 nt, Human
aggccacaagacccuug

SEQ ID NO: 1853519 - RNA, 19 nt, Human
aggccacaagacccuugug

SEQ ID NO: 1853520 - RNA, 14 nt, Human
aggccagagggagu

SEQ ID NO: 1853521 - RNA, 18 nt, Human
uggcacagggcaguggga

SEQ ID NO: 1853522 - RNA, 13 nt, Human
uggcccacgcacu

SEQ ID NO: 1853523 - RNA, 14 nt, Human
uggcccugcccugg

SEQ ID NO: 1853524 - RNA, 23 nt, Human
uggccgggcgcgguggcucacgc

SEQ ID NO: 1853525 - RNA, 13 nt, Human
uggccucuucaga

SEQ ID NO: 1853526 - RNA, 18 nt, Human
uggccugagcugggauga

SEQ ID NO: 1853527 - RNA, 21 nt, Human
uggccuggccccucagggucc

SEQ ID NO: 1853528 - RNA, 18 nt, Human
uggccuggccccucaggg

SEQ ID NO: 1853529 - RNA, 18 nt, Human
aggccugggggcugggca

SEQ ID NO: 1853530 - RNA, 12 nt, Human
aggccuggggac

SEQ ID NO: 1853531 - RNA, 20 nt, Human
aggccugggggcugggcaga

SEQ ID NO: 1853532 - RNA, 14 nt, Human
uggccuucggccuc

SEQ ID NO: 1853533 - RNA, 15 nt, Human
uggccagguggccac

SEQ ID NO: 1853534 - RNA, 11 nt, Human
uggccaggugg

SEQ ID NO: 1853535 - RNA, 21 nt, Human
uggccaaagccaaagcuaggc

SEQ ID NO: 1853536 - RNA, 23 nt, Human
uggccaaagccaaagcuaggccu

SEQ ID NO: 1853537 - RNA, 19 nt, Human
uggccagguggccacucca

SEQ ID NO: 1853538 - RNA, 17 nt, Human
uggccagguggccacuc

SEQ ID NO: 1853539 - RNA, 16 nt, Human
uggccagguggccacu

SEQ ID NO: 1853540 - RNA, 23 nt, Human
uggccagugugacaaggauugcu

SEQ ID NO: 1853541 - RNA, 17 nt, Human
aggccccgcccaggcuu

SEQ ID NO: 1853542 - RNA, 12 nt, Human
aggccccugcca

SEQ ID NO: 1853543 - RNA, 13 nt, Human
ugcuucaaaaaca

SEQ ID NO: 1853544 - RNA, 21 nt, Human
ugcuucaaaaacauucuuaca

SEQ ID NO: 1853545 - RNA, 17 nt, Human
ugcugucccuuuuccuu

SEQ ID NO: 1853546 - RNA, 13 nt, Human
ugcugugcaaaug

SEQ ID NO: 1853547 - RNA, 15 nt, Human
ugcugucccuuuucc

SEQ ID NO: 1853548 - RNA, 19 nt, Human
ugcugucccuuacgugagu

SEQ ID NO: 1853549 - RNA, 17 nt, Human
ugcugucccuuacguga

SEQ ID NO: 1853550 - RNA, 23 nt, Human
ugcuucaaggauccugagccaga

SEQ ID NO: 1853551 - RNA, 21 nt, Human
ugcuucaaggauccugagcca

SEQ ID NO: 1853552 - RNA, 20 nt, Human
ugcuucaaggauccugagcc

SEQ ID NO: 1853553 - RNA, 16 nt, Human
ugcuuccagugaggcu

SEQ ID NO: 1853554 - RNA, 18 nt, Human
aggacacuaaccacgcug

SEQ ID NO: 1853555 - RNA, 17 nt, Human
aggacagccccuccucc

SEQ ID NO: 1853556 - RNA, 13 nt, Human
ugcuggcugccuu

SEQ ID NO: 1853557 - RNA, 19 nt, Human
ugcugggauuacaagcgug

SEQ ID NO: 1853558 - RNA, 19 nt, Human
ugcuggcuguuggcugggg

SEQ ID NO: 1853559 - RNA, 21 nt, Human
ugcuggcuguuggcugggggc

SEQ ID NO: 1853560 - RNA, 21 nt, Human
ugcugggauuacaagcgugag

SEQ ID NO: 1853561 - RNA, 17 nt, Human
ugcugggauuacaggug

SEQ ID NO: 1853562 - RNA, 21 nt, Human
ugcugcccugcccaccuggcc

SEQ ID NO: 1853563 - RNA, 19 nt, Human
ugcugcccugcccaccugg

SEQ ID NO: 1853564 - RNA, 11 nt, Human
ugcugcccugu

SEQ ID NO: 1853565 - RNA, 18 nt, Human
ugcugcccugcccaccug

SEQ ID NO: 1853566 - RNA, 17 nt, Human
ugcugcccugcccaccu

SEQ ID NO: 1853567 - RNA, 16 nt, Human
ugcugcccugcccacc

SEQ ID NO: 1853568 - RNA, 13 nt, Human
ugcugcccugccc

SEQ ID NO: 1853569 - RNA, 19 nt, Human
ugcuaucucccccagcccc

SEQ ID NO: 1853570 - RNA, 20 nt, Human
ugcuaucucccccagcccca

SEQ ID NO: 1853571 - RNA, 19 nt, Human
ugcugacuguacuccuccc

SEQ ID NO: 1853572 - RNA, 16 nt, Human
ugcugacuguacuccu

SEQ ID NO: 1853573 - RNA, 15 nt, Human
ugcucuggacaggca

SEQ ID NO: 1853574 - RNA, 16 nt, Human
ugcucuggacaggcau

SEQ ID NO: 1853575 - RNA, 14 nt, Human
ugcucuggacaggc

SEQ ID NO: 1853576 - RNA, 19 nt, Human
aggaaaucaccgaaaacgu

SEQ ID NO: 1853577 - RNA, 15 nt, Human
aggaaaucaccgaaa

SEQ ID NO: 1853578 - RNA, 17 nt, Human
aggaagcacaugccucu

SEQ ID NO: 1853579 - RNA, 16 nt, Human
aggaagcacaugccuc

SEQ ID NO: 1853580 - RNA, 11 nt, Human
aggaagcacau

SEQ ID NO: 1853581 - RNA, 14 nt, Human
aggaaauccagggu

SEQ ID NO: 1853582 - RNA, 16 nt, Human
aggaaaggcuccagga

SEQ ID NO: 1853583 - RNA, 15 nt, Human
aggaaaggcuccagg

SEQ ID NO: 1853584 - RNA, 14 nt, Human
aggaaaggcuccag

SEQ ID NO: 1853585 - RNA, 13 nt, Human
aggaaaggcucca

SEQ ID NO: 1853586 - RNA, 16 nt, Human
ugcugacuguuuucuc

SEQ ID NO: 1853587 - RNA, 22 nt, Human
ugcugacuguacuccucccagg

SEQ ID NO: 1853588 - RNA, 21 nt, Human
ugcugacuguacuccucccag

SEQ ID NO: 1853589 - RNA, 23 nt, Human
aggaagccagcaggcucucaggc

SEQ ID NO: 1853590 - RNA, 22 nt, Human
aggaagccagcaggcucucagg

SEQ ID NO: 1853591 - RNA, 21 nt, Human
aggaagccagcaggcucucag

SEQ ID NO: 1853592 - RNA, 22 nt, Human
aggaagcacaugccucucucag

SEQ ID NO: 1853593 - RNA, 20 nt, Human
aggaagccgcuggggccagu

SEQ ID NO: 1853594 - RNA, 19 nt, Human
aggaagccgcuggggccag

SEQ ID NO: 1853595 - RNA, 18 nt, Human
aggaagccgcuggggcca

SEQ ID NO: 1853596 - RNA, 22 nt, Human
aggaaggaaacccagcucuggu

SEQ ID NO: 1853597 - RNA, 20 nt, Human
aggaaggaaacccagcucug

SEQ ID NO: 1853598 - RNA, 23 nt, Human
aggaaggaaacccagcucugguc

SEQ ID NO: 1853599 - RNA, 12 nt, Human
aggaagcucagg

SEQ ID NO: 1853600 - RNA, 16 nt, Human
agcuguguggcagucu

SEQ ID NO: 1853601 - RNA, 14 nt, Human
agcuguguggcagu

SEQ ID NO: 1853602 - RNA, 21 nt, Human
agcugugcucuggacaggcau

SEQ ID NO: 1853603 - RNA, 23 nt, Human
agcugugcucuggacaggcaugu

SEQ ID NO: 1853604 - RNA, 20 nt, Human
agcugugcucuggacaggca

SEQ ID NO: 1853605 - RNA, 15 nt, Human
agcugggacuacagg

SEQ ID NO: 1853606 - RNA, 20 nt, Human
ugccuguugggccaggagcc

SEQ ID NO: 1853607 - RNA, 19 nt, Human
ugccuguugggccaggagc

SEQ ID NO: 1853608 - RNA, 21 nt, Human
ugccuguucagcuccagcuca

SEQ ID NO: 1853609 - RNA, 16 nt, Human
ugccuuauggaacacu

SEQ ID NO: 1853610 - RNA, 15 nt, Human
ugccuuauggaacac

SEQ ID NO: 1853611 - RNA, 14 nt, Human
agcuguuacugucu

SEQ ID NO: 1853612 - RNA, 14 nt, Human
agcuguucagcugg

SEQ ID NO: 1853613 - RNA, 13 nt, Human
agcuguucagcug

SEQ ID NO: 1853614 - RNA, 18 nt, Human
ugccuguucagcuccagc

SEQ ID NO: 1853615 - RNA, 20 nt, Human
ugccuguucagcuccagcuc

SEQ ID NO: 1853616 - RNA, 15 nt, Human
ugccugcccuauucu

SEQ ID NO: 1853617 - RNA, 14 nt, Human
ugccugcccaggcc

SEQ ID NO: 1853618 - RNA, 15 nt, Human
ugccugcccaggccc

SEQ ID NO: 1853619 - RNA, 16 nt, Human
ugccugcccaggcccc

SEQ ID NO: 1853620 - RNA, 12 nt, Human
ugcccaggcagg

SEQ ID NO: 1853621 - RNA, 13 nt, Human
ugcccaggcaggu

SEQ ID NO: 1853622 - RNA, 14 nt, Human
ugcccaggcagguc

SEQ ID NO: 1853623 - RNA, 13 nt, Human
ugccucugccucu

SEQ ID NO: 1853624 - RNA, 14 nt, Human
ugccucugccucug

SEQ ID NO: 1853625 - RNA, 15 nt, Human
ugccucugccucuga

SEQ ID NO: 1853626 - RNA, 22 nt, Human
agcuggaucuccauucucucag

SEQ ID NO: 1853627 - RNA, 21 nt, Human
agcugcuuuugucuaugggac

SEQ ID NO: 1853628 - RNA, 21 nt, Human
agcugcuugggcuucauccuc

SEQ ID NO: 1853629 - RNA, 21 nt, Human
agcugccuguucagcuccagc

SEQ ID NO: 1853630 - RNA, 22 nt, Human
agcugccuguucagcuccagcu

SEQ ID NO: 1853631 - RNA, 15 nt, Human
ugccuggauggggcu

SEQ ID NO: 1853632 - RNA, 14 nt, Human
ugccuggauggggc

SEQ ID NO: 1853633 - RNA, 20 nt, Human
agcugccuguucagcuccag

SEQ ID NO: 1853634 - RNA, 14 nt, Human
agcuugaggguugg

SEQ ID NO: 1853635 - RNA, 18 nt, Human
agcuugaggguugggcug

SEQ ID NO: 1853636 - RNA, 22 nt, Human
agcuugaggguugggcuggugu

SEQ ID NO: 1853637 - RNA, 18 nt, Human
agcuuguaaauagcucag

SEQ ID NO: 1853638 - RNA, 19 nt, Human
agcuugaccgugaggccag

SEQ ID NO: 1853639 - RNA, 11 nt, Human
ugcuacacacu

SEQ ID NO: 1853640 - RNA, 20 nt, Human
ugcgggcuuccuccuggugu

SEQ ID NO: 1853641 - RNA, 19 nt, Human
ugcggccuuuggcuucacg

SEQ ID NO: 1853642 - RNA, 17 nt, Human
ugcggccuuuggcuuca

SEQ ID NO: 1853643 - RNA, 16 nt, Human
ugcgggucacaggagg

SEQ ID NO: 1853644 - RNA, 14 nt, Human
ugcgggucacagga

SEQ ID NO: 1853645 - RNA, 17 nt, Human
ugcgggucacaggaggg

SEQ ID NO: 1853646 - RNA, 17 nt, Human
ugcgguccacccaggag

SEQ ID NO: 1853647 - RNA, 21 nt, Human
ugcggugcuaucucccccagc

SEQ ID NO: 1853648 - RNA, 17 nt, Human
ugcggugcuaucucccc

SEQ ID NO: 1853649 - RNA, 18 nt, Human
ugcgguccacccaggagc

SEQ ID NO: 1853650 - RNA, 23 nt, Human
ugcggacagccacggccaggcca

SEQ ID NO: 1853651 - RNA, 22 nt, Human
ugcggacagccacggccaggcc

SEQ ID NO: 1853652 - RNA, 14 nt, Human
uggggcccugccuc

SEQ ID NO: 1853653 - RNA, 23 nt, Human
uggggaccucaggccugggggcu

SEQ ID NO: 1853654 - RNA, 12 nt, Human
uggggagaaagu

SEQ ID NO: 1853655 - RNA, 15 nt, Human
uggggaggggcugug

SEQ ID NO: 1853656 - RNA, 16 nt, Human
uggggcccugccuccu

SEQ ID NO: 1853657 - RNA, 15 nt, Human
uggggcccugccucc

SEQ ID NO: 1853658 - RNA, 23 nt, Human
uggggcuaggaaauccagggugg

SEQ ID NO: 1853659 - RNA, 18 nt, Human
uggggcggugagagggga

SEQ ID NO: 1853660 - RNA, 15 nt, Human
ugggguaugggagag

SEQ ID NO: 1853661 - RNA, 18 nt, Human
uggggucacucuggcagc

SEQ ID NO: 1853662 - RNA, 17 nt, Human
uggggucacucuggcag

SEQ ID NO: 1853663 - RNA, 15 nt, Human
ugggguacccacugc

SEQ ID NO: 1853664 - RNA, 16 nt, Human
ugggguacccacugcu

SEQ ID NO: 1853665 - RNA, 20 nt, Human
ugggguacccacugcucugg

SEQ ID NO: 1853666 - RNA, 20 nt, Human
uggggcugcaccggcuggcc

SEQ ID NO: 1853667 - RNA, 14 nt, Human
ugggguacccacug

SEQ ID NO: 1853668 - RNA, 15 nt, Human
uggggaccagagcug

SEQ ID NO: 1853669 - RNA, 14 nt, Human
uggggaccagagcu

SEQ ID NO: 1853670 - RNA, 17 nt, Human
uggggacagagcagaac

SEQ ID NO: 1853671 - RNA, 18 nt, Human
uggggaccagagcugcca

SEQ ID NO: 1853672 - RNA, 17 nt, Human
uggggaccagagcugcc

SEQ ID NO: 1853673 - RNA, 13 nt, Human
uggggaccucagg

SEQ ID NO: 1853674 - RNA, 19 nt, Human
ugggcuggguucuacccag

SEQ ID NO: 1853675 - RNA, 18 nt, Human
ugggcuggguucuaccca

SEQ ID NO: 1853676 - RNA, 21 nt, Human
ugggcucccuucccaccucuc

SEQ ID NO: 1853677 - RNA, 20 nt, Human
ugggcucccuucccaccucu

SEQ ID NO: 1853678 - RNA, 21 nt, Human
ugggcugcccuggugcugcca

SEQ ID NO: 1853679 - RNA, 20 nt, Human
ugggcugcccuggugcugcc

SEQ ID NO: 1853680 - RNA, 19 nt, Human
ugggcugcccuggugcugc

SEQ ID NO: 1853681 - RNA, 17 nt, Human
ugggcugcccuggugcu

SEQ ID NO: 1853682 - RNA, 19 nt, Human
ugggcucccuucccaccuc

SEQ ID NO: 1853683 - RNA, 18 nt, Human
ugggcucccuucccaccu

SEQ ID NO: 1853684 - RNA, 23 nt, Human
agggcuucugccauuucugagau

SEQ ID NO: 1853685 - RNA, 17 nt, Human
agggaggugaccccagg

SEQ ID NO: 1853686 - RNA, 17 nt, Human
agggagugacagaggca

SEQ ID NO: 1853687 - RNA, 18 nt, Human
agggagugacagaggcag

SEQ ID NO: 1853688 - RNA, 19 nt, Human
agggagugacagaggcagc

SEQ ID NO: 1853689 - RNA, 15 nt, Human
agggagggcuucugc

SEQ ID NO: 1853690 - RNA, 23 nt, Human
agggcccagagaggguggugacc

SEQ ID NO: 1853691 - RNA, 16 nt, Human
ugggccaggagccucc

SEQ ID NO: 1853692 - RNA, 14 nt, Human
ugggccaggagccu

SEQ ID NO: 1853693 - RNA, 20 nt, Human
ugggcccaaugcacuuuguu

SEQ ID NO: 1853694 - RNA, 13 nt, Human
ugggccaggagcc

SEQ ID NO: 1853695 - RNA, 18 nt, Human
ugggccagaauuucaaac

SEQ ID NO: 1853696 - RNA, 17 nt, Human
ugggccagaauuucaaa

SEQ ID NO: 1853697 - RNA, 17 nt, Human
ugggcaacccccagccu

SEQ ID NO: 1853698 - RNA, 20 nt, Human
ugggcaacccccagccugcu

SEQ ID NO: 1853699 - RNA, 21 nt, Human
ugggcaacccccagccugcua

SEQ ID NO: 1853700 - RNA, 17 nt, Human
ugggaggucaaggcugc

SEQ ID NO: 1853701 - RNA, 23 nt, Human
ugggaggucaaggcugcagugag

SEQ ID NO: 1853702 - RNA, 20 nt, Human
ugggaggucaaggcugcagu

SEQ ID NO: 1853703 - RNA, 19 nt, Human
ugggaggucaaggcugcag

SEQ ID NO: 1853704 - RNA, 18 nt, Human
ugggaggucaaggcugca

SEQ ID NO: 1853705 - RNA, 16 nt, Human
ugggcaacccccagcc

SEQ ID NO: 1853706 - RNA, 23 nt, Human
aggggagcaaaaucgaugcagug

SEQ ID NO: 1853707 - RNA, 15 nt, Human
aggggccuggcagcc

SEQ ID NO: 1853708 - RNA, 23 nt, Human
aggggccuggcagccgugccuuc

SEQ ID NO: 1853709 - RNA, 18 nt, Human
aggggccuggcagccgug

SEQ ID NO: 1853710 - RNA, 19 nt, Human
uggggucacucuggcagcu

SEQ ID NO: 1853711 - RNA, 20 nt, Human
uggggucacucuggcagcuc

SEQ ID NO: 1853712 - RNA, 18 nt, Human
aggggguggccucccaac

SEQ ID NO: 1853713 - RNA, 17 nt, Human
aggggguggccucccaa

SEQ ID NO: 1853714 - RNA, 15 nt, Human
aggggguggccuccc

SEQ ID NO: 1853715 - RNA, 22 nt, Human
aggggugggacacccugugaug

SEQ ID NO: 1853716 - RNA, 20 nt, Human
aggggugggacacccuguga

SEQ ID NO: 1853717 - RNA, 24 nt, Human
agggguucccuuuuuuggcugcug

SEQ ID NO: 1853718 - RNA, 21 nt, Human
agggucucacuauguugccca

SEQ ID NO: 1853719 - RNA, 22 nt, Human
agggucucacuauguugcccag

SEQ ID NO: 1853720 - RNA, 23 nt, Human
agggucucacuauguugcccagg

SEQ ID NO: 1853721 - RNA, 16 nt, Human
ugguacuaacuuuccu

SEQ ID NO: 1853722 - RNA, 17 nt, Human
ugguacucauuaaaaaa

SEQ ID NO: 1853723 - RNA, 20 nt, Human
ugguagcuuuucccuucuuu

SEQ ID NO: 1853724 - RNA, 21 nt, Human
ugguagcuuuucccuucuuuu

SEQ ID NO: 1853725 - RNA, 17 nt, Human
ugguagcuuuucccuuc

SEQ ID NO: 1853726 - RNA, 20 nt, Human
uggucacaggacucugccuc

SEQ ID NO: 1853727 - RNA, 23 nt, Human
uggucacaggacucugccuccuc

SEQ ID NO: 1853728 - RNA, 22 nt, Human
uggucacaggacucugccuccu

SEQ ID NO: 1853729 - RNA, 19 nt, Human
ugggugcuuggaggaagga

SEQ ID NO: 1853730 - RNA, 15 nt, Human
ugggugcuuggagga

SEQ ID NO: 1853731 - RNA, 22 nt, Human
ugggugcuuggaggaaggaaac

SEQ ID NO: 1853732 - RNA, 15 nt, Human
agggugggagugggc

SEQ ID NO: 1853733 - RNA, 21 nt, Human
ugggucgcccuggacugugug

SEQ ID NO: 1853734 - RNA, 22 nt, Human
agggucucacucugucgcccag

SEQ ID NO: 1853735 - RNA, 21 nt, Human
agggucucacucugucgccca

SEQ ID NO: 1853736 - RNA, 18 nt, Human
uggucucaaacuccugac

SEQ ID NO: 1853737 - RNA, 17 nt, Human
uggucucaaacucuuga

SEQ ID NO: 1853738 - RNA, 23 nt, Human
uggucucaaacucuugaccucag

SEQ ID NO: 1853739 - RNA, 19 nt, Human
uggucuaucuuugagcgcc

SEQ ID NO: 1853740 - RNA, 16 nt, Human
uggucucaaacucuug

SEQ ID NO: 1853741 - RNA, 16 nt, Human
uggucccaccccacac

SEQ ID NO: 1853742 - RNA, 13 nt, Human
uggucccacucag

SEQ ID NO: 1853743 - RNA, 20 nt, Human
uggucaccaaaucagcugcu

SEQ ID NO: 1853744 - RNA, 22 nt, Human
uggucagauuugaacucuucaa

SEQ ID NO: 1853745 - RNA, 18 nt, Human
uggucaccaaaucagcug

SEQ ID NO: 1853746 - RNA, 15 nt, Human
uggucccaccccaca

SEQ ID NO: 1853747 - RNA, 14 nt, Human
uggucccaccccac

SEQ ID NO: 1853748 - RNA, 16 nt, Human
uggucugacccacugc

SEQ ID NO: 1853749 - RNA, 17 nt, Human
uggucugacccacugcu

SEQ ID NO: 1853750 - RNA, 22 nt, Human
aggguguccggucccuguccca

SEQ ID NO: 1853751 - RNA, 13 nt, Human
aggguuauaauaa

SEQ ID NO: 1853752 - RNA, 18 nt, Human
aggucaccuuuauucugg

SEQ ID NO: 1853753 - RNA, 19 nt, Human
aggucaccuuuauucuggc

SEQ ID NO: 1853754 - RNA, 17 nt, Human
aggucauuuuuuuuaag

SEQ ID NO: 1853755 - RNA, 20 nt, Human
aggucauuuuuuuuaagaaa

SEQ ID NO: 1853756 - RNA, 12 nt, Human
aggucagagccu

SEQ ID NO: 1853757 - RNA, 21 nt, Human
agguaugcaaucaaaucugcu

SEQ ID NO: 1853758 - RNA, 23 nt, Human
agguauaauucacauuguauuca

SEQ ID NO: 1853759 - RNA, 20 nt, Human
agguauaaguggugugugua

SEQ ID NO: 1853760 - RNA, 19 nt, Human
agguauaaguggugugugu

SEQ ID NO: 1853761 - RNA, 23 nt, Human
agguagaaauaucugaaaaugua

SEQ ID NO: 1853762 - RNA, 19 nt, Human
agguagaaauaucugaaaa

SEQ ID NO: 1853763 - RNA, 17 nt, Human
agguagaaauaucugaa

SEQ ID NO: 1853764 - RNA, 18 nt, Human
aggguuggccccugcccg

SEQ ID NO: 1853765 - RNA, 23 nt, Human
aggguuggccccugcccggcugc

SEQ ID NO: 1853766 - RNA, 13 nt, Human
aggguugggcugg

SEQ ID NO: 1853767 - RNA, 18 nt, Human
uguagaggagaaacugga

SEQ ID NO: 1853768 - RNA, 14 nt, Human
uguagagugggagc

SEQ ID NO: 1853769 - RNA, 13 nt, Human
uguagagugggag

SEQ ID NO: 1853770 - RNA, 14 nt, Human
uguaauuugugaua

SEQ ID NO: 1853771 - RNA, 11 nt, Human
agguuuuccug

SEQ ID NO: 1853772 - RNA, 20 nt, Human
aguaagccgugauuuucauu

SEQ ID NO: 1853773 - RNA, 15 nt, Human
aguaaaaauaaaauu

SEQ ID NO: 1853774 - RNA, 12 nt, Human
aguaaaaauaaa

SEQ ID NO: 1853775 - RNA, 18 nt, Human
aguaauaugcacacauuu

SEQ ID NO: 1853776 - RNA, 19 nt, Human
aguaauaugcacacauuuu

SEQ ID NO: 1853777 - RNA, 17 nt, Human
aguaauaugcacacauu

SEQ ID NO: 1853778 - RNA, 20 nt, Human
aguaauaugcacacauuuuu

SEQ ID NO: 1853779 - RNA, 23 nt, Human
aguaaggaauuuuauuuuuuucu

SEQ ID NO: 1853780 - RNA, 21 nt, Human
aguaauccaagcaaaugugaa

SEQ ID NO: 1853781 - RNA, 14 nt, Human
aguaauccaccugc

SEQ ID NO: 1853782 - RNA, 15 nt, Human
aguaauccaagcaaa

SEQ ID NO: 1853783 - RNA, 19 nt, Human
aguacuuuuggcauuuuac

SEQ ID NO: 1853784 - RNA, 16 nt, Human
aguacacuguuucaaa

SEQ ID NO: 1853785 - RNA, 20 nt, Human
aguacacuguuucaaacuuu

SEQ ID NO: 1853786 - RNA, 14 nt, Human
aguacacuguuuca

SEQ ID NO: 1853787 - RNA, 20 nt, Human
uguaggaagguuaauguuca

SEQ ID NO: 1853788 - RNA, 18 nt, Human
uguaggaagguuaauguu

SEQ ID NO: 1853789 - RNA, 17 nt, Human
aguagaagucuuagaug

SEQ ID NO: 1853790 - RNA, 12 nt, Human
aguagagacagg

SEQ ID NO: 1853791 - RNA, 20 nt, Human
aggugggauccuccaggugc

SEQ ID NO: 1853792 - RNA, 14 nt, Human
agguggccacucca

SEQ ID NO: 1853793 - RNA, 17 nt, Human
agguggccacuccagac

SEQ ID NO: 1853794 - RNA, 21 nt, Human
aggugcacaagcuccaagcuc

SEQ ID NO: 1853795 - RNA, 15 nt, Human
aggugcacaagcucc

SEQ ID NO: 1853796 - RNA, 20 nt, Human
aggugcacaagcuccaagcu

SEQ ID NO: 1853797 - RNA, 18 nt, Human
aggugcacaagcuccaag

SEQ ID NO: 1853798 - RNA, 17 nt, Human
aggugcacaagcuccaa

SEQ ID NO: 1853799 - RNA, 16 nt, Human
aggugcacaagcucca

SEQ ID NO: 1853800 - RNA, 10 nt, Human
aggucccuaa

SEQ ID NO: 1853801 - RNA, 23 nt, Human
aggucuugaacuccuggccucaa

SEQ ID NO: 1853802 - RNA, 23 nt, Human
uguaauuaaguacuauguaucaa

SEQ ID NO: 1853803 - RNA, 19 nt, Human
uguaagaucguucucugcc

SEQ ID NO: 1853804 - RNA, 20 nt, Human
uguaagaucguucucugccu

SEQ ID NO: 1853805 - RNA, 14 nt, Human
agguuggugggggc

SEQ ID NO: 1853806 - RNA, 17 nt, Human
uguaacuuucugaaaua

SEQ ID NO: 1853807 - RNA, 17 nt, Human
aggugguuauggagagg

SEQ ID NO: 1853808 - RNA, 22 nt, Human
aguccaggcuuuuuuaucaugu

SEQ ID NO: 1853809 - RNA, 12 nt, Human
agucccugccaa

SEQ ID NO: 1853810 - RNA, 16 nt, Human
agucucacuguugccc

SEQ ID NO: 1853811 - RNA, 17 nt, Human
agucucacuguugccca

SEQ ID NO: 1853812 - RNA, 23 nt, Human
aguccgaaagggacuuggaagcu

SEQ ID NO: 1853813 - RNA, 14 nt, Human
uguccgagcuuuga

SEQ ID NO: 1853814 - RNA, 13 nt, Human
uguccgagcuuug

SEQ ID NO: 1853815 - RNA, 16 nt, Human
ugucgcccaggcugga

SEQ ID NO: 1853816 - RNA, 15 nt, Human
ugucgcccaggcugg

SEQ ID NO: 1853817 - RNA, 16 nt, Human
uguccuacccacccuc

SEQ ID NO: 1853818 - RNA, 15 nt, Human
ugucgggcaugacac

SEQ ID NO: 1853819 - RNA, 14 nt, Human
ugucgggcaugaca

SEQ ID NO: 1853820 - RNA, 12 nt, Human
ugucgggcauga

SEQ ID NO: 1853821 - RNA, 13 nt, Human
ugucgccucugca

SEQ ID NO: 1853822 - RNA, 14 nt, Human
ugucgcccagucug

SEQ ID NO: 1853823 - RNA, 15 nt, Human
ugucgcccagucugg

SEQ ID NO: 1853824 - RNA, 16 nt, Human
agucagacagaugugg

SEQ ID NO: 1853825 - RNA, 13 nt, Human
agucaccaagccc

SEQ ID NO: 1853826 - RNA, 14 nt, Human
agucaccaagccca

SEQ ID NO: 1853827 - RNA, 16 nt, Human
ugucagcugaaccugg

SEQ ID NO: 1853828 - RNA, 13 nt, Human
agucacugcacag

SEQ ID NO: 1853829 - RNA, 18 nt, Human
agucacugagacagcccg

SEQ ID NO: 1853830 - RNA, 19 nt, Human
agucacugagacagcccgg

SEQ ID NO: 1853831 - RNA, 19 nt, Human
ugucagcugaaccugggua

SEQ ID NO: 1853832 - RNA, 16 nt, Human
ugucagguggggcagc

SEQ ID NO: 1853833 - RNA, 23 nt, Human
ugucauuugcuggagcucugccc

SEQ ID NO: 1853834 - RNA, 16 nt, Human
aguaggaagacuuugg

SEQ ID NO: 1853835 - RNA, 22 nt, Human
aguaggaagacuuuggaaagac

SEQ ID NO: 1853836 - RNA, 19 nt, Human
aguaggaagacuuuggaaa

SEQ ID NO: 1853837 - RNA, 18 nt, Human
aguaggaagacuuuggaa

SEQ ID NO: 1853838 - RNA, 17 nt, Human
aguaggaagacuuugga

SEQ ID NO: 1853839 - RNA, 14 nt, Human
uguauuuuuuuacu

SEQ ID NO: 1853840 - RNA, 16 nt, Human
uguauuuuuuuacuaa

SEQ ID NO: 1853841 - RNA, 15 nt, Human
ugucaagccauaauu

SEQ ID NO: 1853842 - RNA, 19 nt, Human
ugucaagagggucugagga

SEQ ID NO: 1853843 - RNA, 15 nt, Human
ugugcugcccugccc

SEQ ID NO: 1853844 - RNA, 14 nt, Human
ugugcugcccugcc

SEQ ID NO: 1853845 - RNA, 13 nt, Human
ugugcugcccugc

SEQ ID NO: 1853846 - RNA, 16 nt, Human
ugugcucuggacaggc

SEQ ID NO: 1853847 - RNA, 18 nt, Human
ugugcucuggacaggcau

SEQ ID NO: 1853848 - RNA, 19 nt, Human
ugugcucuggacaggcaug

SEQ ID NO: 1853849 - RNA, 20 nt, Human
ugugcccuaaaguguauuuu

SEQ ID NO: 1853850 - RNA, 21 nt, Human
ugugcccuaaaguguauuuuu

SEQ ID NO: 1853851 - RNA, 21 nt, Human
agucucacuguugcccaggcu

SEQ ID NO: 1853852 - RNA, 20 nt, Human
agucucacuguugcccaggc

SEQ ID NO: 1853853 - RNA, 18 nt, Human
agucucacuguugcccag

SEQ ID NO: 1853854 - RNA, 19 nt, Human
agucucacuguugcccagg

SEQ ID NO: 1853855 - RNA, 13 nt, Human
ugugccucugccu

SEQ ID NO: 1853856 - RNA, 12 nt, Human
ugugccucugcc

SEQ ID NO: 1853857 - RNA, 22 nt, Human
ugugcucugaucauccacugug

SEQ ID NO: 1853858 - RNA, 12 nt, Human
ugugcucugauc

SEQ ID NO: 1853859 - RNA, 23 nt, Human
ugugcucugaucauccacugugc

SEQ ID NO: 1853860 - RNA, 15 nt, Human
ugugcucuggacagg

SEQ ID NO: 1853861 - RNA, 17 nt, Human
agugcaucucagcccac

SEQ ID NO: 1853862 - RNA, 16 nt, Human
agugcaucucagccca

SEQ ID NO: 1853863 - RNA, 14 nt, Human
agugcaucucagcc

SEQ ID NO: 1853864 - RNA, 15 nt, Human
agugcaucucagccc

SEQ ID NO: 1853865 - RNA, 16 nt, Human
agugccaaaaacaaca

SEQ ID NO: 1853866 - RNA, 14 nt, Human
agugcccacaggau

SEQ ID NO: 1853867 - RNA, 16 nt, Human
agugagucgaggacag

SEQ ID NO: 1853868 - RNA, 22 nt, Human
agugauucuccugccucagccu

SEQ ID NO: 1853869 - RNA, 24 nt, Human
agugauucuccugccucagccucc

SEQ ID NO: 1853870 - RNA, 16 nt, Human
agugcaaugacacagu

SEQ ID NO: 1853871 - RNA, 18 nt, Human
agugcaaugacacagucu

SEQ ID NO: 1853872 - RNA, 14 nt, Human
uguguuaugaagca

SEQ ID NO: 1853873 - RNA, 16 nt, Human
ugugucucuugguccu

SEQ ID NO: 1853874 - RNA, 20 nt, Human
ugugucuaggcaggaccugu

SEQ ID NO: 1853875 - RNA, 11 nt, Human
ugugugugugc

SEQ ID NO: 1853876 - RNA, 13 nt, Human
ugugucucuuggu

SEQ ID NO: 1853877 - RNA, 19 nt, Human
ugugucuaggcaggaccug

SEQ ID NO: 1853878 - RNA, 20 nt, Human
ugugucagguggggcagcuu

SEQ ID NO: 1853879 - RNA, 17 nt, Human
ugugucagguggggcag

SEQ ID NO: 1853880 - RNA, 19 nt, Human
ugugucagguggggcagcu

SEQ ID NO: 1853881 - RNA, 19 nt, Human
aguggaaaaauagccugcc

SEQ ID NO: 1853882 - RNA, 18 nt, Human
aguggaaaaauagccugc

SEQ ID NO: 1853883 - RNA, 11 nt, Human
aguggaaaaau

SEQ ID NO: 1853884 - RNA, 19 nt, Human
uguuaaugauagcuacugu

SEQ ID NO: 1853885 - RNA, 21 nt, Human
uguuaacauggacaugaucuu

SEQ ID NO: 1853886 - RNA, 12 nt, Human
ugugguuucauu

SEQ ID NO: 1853887 - RNA, 19 nt, Human
ugugucagcauagaaguaa

SEQ ID NO: 1853888 - RNA, 16 nt, Human
agugcuuccaaggaug

SEQ ID NO: 1853889 - RNA, 21 nt, Human
agugccuguaaucacagcuac

SEQ ID NO: 1853890 - RNA, 15 nt, Human
agugccuuacacaau

SEQ ID NO: 1853891 - RNA, 17 nt, Human
agugccuuacacaaugg

SEQ ID NO: 1853892 - RNA, 20 nt, Human
agugcugcauuuaaaagaua

SEQ ID NO: 1853893 - RNA, 22 nt, Human
agugcugcauuuaaaagauaca

SEQ ID NO: 1853894 - RNA, 20 nt, Human
agugcugggauuacaagcgu

SEQ ID NO: 1853895 - RNA, 20 nt, Human
agugcugggauuacaggcgu

SEQ ID NO: 1853896 - RNA, 17 nt, Human
agugcugggauuacagg

SEQ ID NO: 1853897 - RNA, 19 nt, Human
agugcugggauuacaggug

SEQ ID NO: 1853898 - RNA, 14 nt, Human
uguuuauugucaaa

SEQ ID NO: 1853899 - RNA, 17 nt, Human
uguuuaguaaucauauu

SEQ ID NO: 1853900 - RNA, 14 nt, Human
uguuuaguaaucau

SEQ ID NO: 1853901 - RNA, 13 nt, Human
uguuuaguaauca

SEQ ID NO: 1853902 - RNA, 20 nt, Human
uguuuagauaauacaccacu

SEQ ID NO: 1853903 - RNA, 23 nt, Human
aguuccucauuagcauuuugcua

SEQ ID NO: 1853904 - RNA, 15 nt, Human
aguucccuacuuccu

SEQ ID NO: 1853905 - RNA, 16 nt, Human
aguucaauucucauuu

SEQ ID NO: 1853906 - RNA, 19 nt, Human
aguucggugagcuacaaau

SEQ ID NO: 1853907 - RNA, 20 nt, Human
aguucggugagcuacaaaug

SEQ ID NO: 1853908 - RNA, 21 nt, Human
aguguucauaaauaaaguuug

SEQ ID NO: 1853909 - RNA, 19 nt, Human
aguguguguuuuucauaaa

SEQ ID NO: 1853910 - RNA, 22 nt, Human
uguucuugguuuguaaauuaac

SEQ ID NO: 1853911 - RNA, 20 nt, Human
uguucuugguuuguaaauua

SEQ ID NO: 1853912 - RNA, 19 nt, Human
uguucuuucacccuuuucu

SEQ ID NO: 1853913 - RNA, 13 nt, Human
uguugcccaggcu

SEQ ID NO: 1853914 - RNA, 14 nt, Human
uguugcccaggcug

SEQ ID NO: 1853915 - RNA, 21 nt, Human
uguugcccaggcuggagugca

SEQ ID NO: 1853916 - RNA, 15 nt, Human
uguugcccaggcugg

SEQ ID NO: 1853917 - RNA, 21 nt, Human
aguuacucuucaguuaagccu

SEQ ID NO: 1853918 - RNA, 18 nt, Human
uguucuuaguuugcaguu

SEQ ID NO: 1853919 - RNA, 18 nt, Human
uguucuagcauggcugcc

SEQ ID NO: 1853920 - RNA, 16 nt, Human
aguggaaccagcccag

SEQ ID NO: 1853921 - RNA, 21 nt, Human
uuaagaaaaaggaugcacaga

SEQ ID NO: 1853922 - RNA, 20 nt, Human
uuaagaaaaaggaugcacag

SEQ ID NO: 1853923 - RNA, 18 nt, Human
auaaaagccuguuuaaga

SEQ ID NO: 1853924 - RNA, 15 nt, Human
aguuuuuauugcuug

SEQ ID NO: 1853925 - RNA, 20 nt, Human
aguuuuuauugcuuguugga

SEQ ID NO: 1853926 - RNA, 13 nt, Human
auaaaagccuguu

SEQ ID NO: 1853927 - RNA, 23 nt, Human
aguuuuuauggcuuuugugcauu

SEQ ID NO: 1853928 - RNA, 12 nt, Human
aguuuuguaaau

SEQ ID NO: 1853929 - RNA, 15 nt, Human
aguuuuguaaauuuc

SEQ ID NO: 1853930 - RNA, 18 nt, Human
uuaaugaaagacuguaca

SEQ ID NO: 1853931 - RNA, 22 nt, Human
uuaaucugguuuauuuuuguuc

SEQ ID NO: 1853932 - RNA, 21 nt, Human
uuaauugacuuauuuauauaa

SEQ ID NO: 1853933 - RNA, 19 nt, Human
uuaaugaaagacuguacaa

SEQ ID NO: 1853934 - RNA, 22 nt, Human
uuaaucauuaggugugacugaa

SEQ ID NO: 1853935 - RNA, 23 nt, Human
uuaaucauuaggugugacugaau

SEQ ID NO: 1853936 - RNA, 21 nt, Human
uuaaucugggccagaauuuca

SEQ ID NO: 1853937 - RNA, 22 nt, Human
uuaauauuuauaggucacuuug

SEQ ID NO: 1853938 - RNA, 13 nt, Human
uuaaucauuaggu

SEQ ID NO: 1853939 - RNA, 9 nt, Human
uuaaggugg

SEQ ID NO: 1853940 - RNA, 22 nt, Human
uuaagaaagacuaucuaaaugu

SEQ ID NO: 1853941 - RNA, 15 nt, Human
uuaagugcugcauuu

SEQ ID NO: 1853942 - RNA, 16 nt, Human
uuaagugcugcauuua

SEQ ID NO: 1853943 - RNA, 19 nt, Human
uuaagugcugcauuuaaaa

SEQ ID NO: 1853944 - RNA, 14 nt, Human
uuaagugcugcauu

SEQ ID NO: 1853945 - RNA, 23 nt, Human
aguugccagucaccccggccacc

SEQ ID NO: 1853946 - RNA, 17 nt, Human
aguuggguggaugccug

SEQ ID NO: 1853947 - RNA, 19 nt, Human
aguugggcuuccucauagu

SEQ ID NO: 1853948 - RNA, 13 nt, Human
aguugggcuuccu

SEQ ID NO: 1853949 - RNA, 14 nt, Human
aguuuaauugacuu

SEQ ID NO: 1853950 - RNA, 15 nt, Human
aguuuaauugacuua

SEQ ID NO: 1853951 - RNA, 18 nt, Human
aguuuaauugacuuauuu

SEQ ID NO: 1853952 - RNA, 13 nt, Human
uuaaaaaaaaucc

SEQ ID NO: 1853953 - RNA, 13 nt, Human
aguuggucccccu

SEQ ID NO: 1853954 - RNA, 11 nt, Human
aguuggucccc

SEQ ID NO: 1853955 - RNA, 17 nt, Human
aguuggucccccuucca

SEQ ID NO: 1853956 - RNA, 14 nt, Human
aguuuaaauuguaa

SEQ ID NO: 1853957 - RNA, 19 nt, Human
uuaacagaaauguacagca

SEQ ID NO: 1853958 - RNA, 20 nt, Human
uuaacagaaauguacagcaa

SEQ ID NO: 1853959 - RNA, 16 nt, Human
uuaaauaaugugaaac

SEQ ID NO: 1853960 - RNA, 18 nt, Human
uuaaauaaugugaaacug

SEQ ID NO: 1853961 - RNA, 15 nt, Human
uuaaauaaugugaaa

SEQ ID NO: 1853962 - RNA, 14 nt, Human
uuaaaaaucucaaa

SEQ ID NO: 1853963 - RNA, 15 nt, Human
uuaaaaaucucaaau

SEQ ID NO: 1853964 - RNA, 16 nt, Human
uuaaaaaucucaaauu

SEQ ID NO: 1853965 - RNA, 17 nt, Human
uuaaaaaucucaaauuu

SEQ ID NO: 1853966 - RNA, 15 nt, Human
auaaauaguuuauga

SEQ ID NO: 1853967 - RNA, 14 nt, Human
auaaauaaaaauaa

SEQ ID NO: 1853968 - RNA, 15 nt, Human
auaaagguucaugca

SEQ ID NO: 1853969 - RNA, 17 nt, Human
auaaagguucaugcaaa

SEQ ID NO: 1853970 - RNA, 13 nt, Human
auaaauaaaaaua

SEQ ID NO: 1853971 - RNA, 14 nt, Human
auaacguauaaaag

SEQ ID NO: 1853972 - RNA, 22 nt, Human
auaacgauaaaagacagugaaa

SEQ ID NO: 1853973 - RNA, 11 nt, Human
auaaauuauuu

SEQ ID NO: 1853974 - RNA, 23 nt, Human
uuacucuucaguuaagccuuugg

SEQ ID NO: 1853975 - RNA, 17 nt, Human
uuagaaauugcauuucc

SEQ ID NO: 1853976 - RNA, 13 nt, Human
uuagacagagucu

SEQ ID NO: 1853977 - RNA, 13 nt, Human
uuagacagucccu

SEQ ID NO: 1853978 - RNA, 20 nt, Human
uuagacagagucucacuguu

SEQ ID NO: 1853979 - RNA, 20 nt, Human
uuaccuuugacaaagguaaa

SEQ ID NO: 1853980 - RNA, 13 nt, Human
uuaccuuugacaa

SEQ ID NO: 1853981 - RNA, 24 nt, Human
uuacaggcgugagccaccgugccu

SEQ ID NO: 1853982 - RNA, 18 nt, Human
uuacaggcuccugccacc

SEQ ID NO: 1853983 - RNA, 16 nt, Human
uuacaggcuccugcca

SEQ ID NO: 1853984 - RNA, 19 nt, Human
uuacccucauguucuuaau

SEQ ID NO: 1853985 - RNA, 12 nt, Human
auaauacaccac

SEQ ID NO: 1853986 - RNA, 18 nt, Human
auaauacaccacuacauu

SEQ ID NO: 1853987 - RNA, 20 nt, Human
auaauacaccacuacauucu

SEQ ID NO: 1853988 - RNA, 19 nt, Human
auaauacuugcuuuggaaa

SEQ ID NO: 1853989 - RNA, 14 nt, Human
uuagacagucccug

SEQ ID NO: 1853990 - RNA, 22 nt, Human
auaauugacaggauuauuggaa

SEQ ID NO: 1853991 - RNA, 15 nt, Human
auaaugaaugaaaca

SEQ ID NO: 1853992 - RNA, 15 nt, Human
auaaugcgugcauac

SEQ ID NO: 1853993 - RNA, 20 nt, Human
auaaucuggacuccucuguc

SEQ ID NO: 1853994 - RNA, 19 nt, Human
auaaucuggacuccucugu

SEQ ID NO: 1853995 - RNA, 18 nt, Human
auaaucuggacuccucug

SEQ ID NO: 1853996 - RNA, 18 nt, Human
auaaucucuccauucccg

SEQ ID NO: 1853997 - RNA, 18 nt, Human
auaauccuaaacauauga

SEQ ID NO: 1853998 - RNA, 22 nt, Human
uuaguuugcaguuacacuaaaa

SEQ ID NO: 1853999 - RNA, 15 nt, Human
uuaguuucuccaagc

SEQ ID NO: 1854000 - RNA, 21 nt, Human
uuaggugugacugaauuucuu

SEQ ID NO: 1854001 - RNA, 16 nt, Human
uuaggugaggaagcaa

SEQ ID NO: 1854002 - RNA, 16 nt, Human
uuaggugugacugaau

SEQ ID NO: 1854003 - RNA, 20 nt, Human
uuagggaaggauacaaaagc

SEQ ID NO: 1854004 - RNA, 18 nt, Human
uuagcaaauucuguuuuu

SEQ ID NO: 1854005 - RNA, 12 nt, Human
uuagcaccaggg

SEQ ID NO: 1854006 - RNA, 18 nt, Human
auaauuuaccugaagucu

SEQ ID NO: 1854007 - RNA, 18 nt, Human
uuagccaagugugguaga

SEQ ID NO: 1854008 - RNA, 14 nt, Human
uuagcggagacgga

SEQ ID NO: 1854009 - RNA, 15 nt, Human
uuuuaagugcugcau

SEQ ID NO: 1854010 - RNA, 16 nt, Human
uuuuaaguaaggaauu

SEQ ID NO: 1854011 - RNA, 23 nt, Human
uuuuaaggguuuguggaaaauga

SEQ ID NO: 1854012 - RNA, 20 nt, Human
uuuuaaggguuuguggaaaa

SEQ ID NO: 1854013 - RNA, 16 nt, Human
uuuuaagaggcagggu

SEQ ID NO: 1854014 - RNA, 15 nt, Human
uuuuaagaggcaggg

SEQ ID NO: 1854015 - RNA, 18 nt, Human
uuuguuugaacugauaaa

SEQ ID NO: 1854016 - RNA, 16 nt, Human
uuuuaaaacacuucca

SEQ ID NO: 1854017 - RNA, 22 nt, Human
uuuuaaaacacuuccauaaucu

SEQ ID NO: 1854018 - RNA, 13 nt, Human
uuuguaaauuguc

SEQ ID NO: 1854019 - RNA, 13 nt, Human
uuuguagagccag

SEQ ID NO: 1854020 - RNA, 19 nt, Human
uuugugaggaagccgcugg

SEQ ID NO: 1854021 - RNA, 18 nt, Human
uuugugaggaagccgcug

SEQ ID NO: 1854022 - RNA, 12 nt, Human
uuuguuugaacu

SEQ ID NO: 1854023 - RNA, 13 nt, Human
uuuguuugaacug

SEQ ID NO: 1854024 - RNA, 14 nt, Human
uuuguuugaacuga

SEQ ID NO: 1854025 - RNA, 16 nt, Human
uuugugagcaggcugu

SEQ ID NO: 1854026 - RNA, 23 nt, Human
auguccaagaagcccaggaaagg

SEQ ID NO: 1854027 - RNA, 18 nt, Human
auguccaagaagcccagg

SEQ ID NO: 1854028 - RNA, 19 nt, Human
auguccaagaagcccagga

SEQ ID NO: 1854029 - RNA, 16 nt, Human
augucagugugacuga

SEQ ID NO: 1854030 - RNA, 15 nt, Human
augucagugugacug

SEQ ID NO: 1854031 - RNA, 21 nt, Human
augucagugugacugaucucu

SEQ ID NO: 1854032 - RNA, 20 nt, Human
augucccaacuuguaaaaau

SEQ ID NO: 1854033 - RNA, 16 nt, Human
auguccacugguucuu

SEQ ID NO: 1854034 - RNA, 24 nt, Human
augucccuaccgagucucuucucc

SEQ ID NO: 1854035 - RNA, 12 nt, Human
auguauguguaa

SEQ ID NO: 1854036 - RNA, 15 nt, Human
auguaucugagcagg

SEQ ID NO: 1854037 - RNA, 15 nt, Human
auguaucaaugagua

SEQ ID NO: 1854038 - RNA, 22 nt, Human
uuugggggaaaauuuagaaaua

SEQ ID NO: 1854039 - RNA, 22 nt, Human
uuugccauguuggccaggcugg

SEQ ID NO: 1854040 - RNA, 22 nt, Human
uuugggaggccaaggugggagg

SEQ ID NO: 1854041 - RNA, 14 nt, Human
uuuggggauauuuu

SEQ ID NO: 1854042 - RNA, 15 nt, Human
uuugcuucaaaaaca

SEQ ID NO: 1854043 - RNA, 21 nt, Human
uuugcuguagaagauggcacu

SEQ ID NO: 1854044 - RNA, 17 nt, Human
auguuuuucuucucccu

SEQ ID NO: 1854045 - RNA, 18 nt, Human
auguuuuucuucucccuc

SEQ ID NO: 1854046 - RNA, 14 nt, Human
auguuuuccaugag

SEQ ID NO: 1854047 - RNA, 14 nt, Human
auuaagaaagacua

SEQ ID NO: 1854048 - RNA, 13 nt, Human
auuaagaaagacu

SEQ ID NO: 1854049 - RNA, 23 nt, Human
auuaacuuuuauaaacuuuaccu

SEQ ID NO: 1854050 - RNA, 16 nt, Human
auuaacuuuuauaaac

SEQ ID NO: 1854051 - RNA, 17 nt, Human
auuaacuuuuauaaacu

SEQ ID NO: 1854052 - RNA, 19 nt, Human
auuaacuuuuauaaacuuu

SEQ ID NO: 1854053 - RNA, 20 nt, Human
auuaacuuuuauaaacuuua

SEQ ID NO: 1854054 - RNA, 12 nt, Human
auuaacuuuuau

SEQ ID NO: 1854055 - RNA, 17 nt, Human
auuaaacuuaaucuaaa

SEQ ID NO: 1854056 - RNA, 16 nt, Human
auuaaacuuaaucuaa

SEQ ID NO: 1854057 - RNA, 19 nt, Human
auuaaacuuaaucuaaaug

SEQ ID NO: 1854058 - RNA, 21 nt, Human
auuaaacuuaaucuaaaugga

SEQ ID NO: 1854059 - RNA, 17 nt, Human
auuaaccacuucagcug

SEQ ID NO: 1854060 - RNA, 20 nt, Human
auuaaccacuucagcugacu

SEQ ID NO: 1854061 - RNA, 18 nt, Human
auuaaccacuucagcuga

SEQ ID NO: 1854062 - RNA, 21 nt, Human
uuuuauucagcucauggacuu

SEQ ID NO: 1854063 - RNA, 17 nt, Human
uuuucagauauaaaaga

SEQ ID NO: 1854064 - RNA, 22 nt, Human
uuuucagauauaaaagacugac

SEQ ID NO: 1854065 - RNA, 19 nt, Human
uuuucagauauaaaagacu

SEQ ID NO: 1854066 - RNA, 21 nt, Human
uuuucagauauaaaagacuga

SEQ ID NO: 1854067 - RNA, 19 nt, Human
uuuuccagguuuaagcugu

SEQ ID NO: 1854068 - RNA, 18 nt, Human
uuuuaugugaaacauguu

SEQ ID NO: 1854069 - RNA, 19 nt, Human
uuuuaugugaaacauguuu

SEQ ID NO: 1854070 - RNA, 22 nt, Human
uuuuauguugcauagaauaaaa

SEQ ID NO: 1854071 - RNA, 19 nt, Human
uuuuauaaacuuuaccuuu

SEQ ID NO: 1854072 - RNA, 14 nt, Human
uuuuauaaacuuua

SEQ ID NO: 1854073 - RNA, 17 nt, Human
uuuuauaaacuuuaccu

SEQ ID NO: 1854074 - RNA, 13 nt, Human
auguuggccaggc

SEQ ID NO: 1854075 - RNA, 14 nt, Human
auguuggccaggcu

SEQ ID NO: 1854076 - RNA, 16 nt, Human
auguuggccaggcugc

SEQ ID NO: 1854077 - RNA, 16 nt, Human
auguuggccaggcugg

SEQ ID NO: 1854078 - RNA, 12 nt, Human
uuuuauaaacuu

SEQ ID NO: 1854079 - RNA, 13 nt, Human
uuuuauaaacuuu

SEQ ID NO: 1854080 - RNA, 19 nt, Human
uuuuaguugcaacuuugua

SEQ ID NO: 1854081 - RNA, 23 nt, Human
uuuuagaguugauacuacaguuu

SEQ ID NO: 1854082 - RNA, 15 nt, Human
auguugaagccuuug

SEQ ID NO: 1854083 - RNA, 16 nt, Human
auguugaagccuuugu

SEQ ID NO: 1854084 - RNA, 19 nt, Human
auguucaucaaugaaugaa

SEQ ID NO: 1854085 - RNA, 21 nt, Human
auguucaucauccuaagcuau

SEQ ID NO: 1854086 - RNA, 16 nt, Human
uuuuaagugcugcauu

SEQ ID NO: 1854087 - RNA, 17 nt, Human
uuuuaagugcugcauuu

SEQ ID NO: 1854088 - RNA, 21 nt, Human
uuuuaagugcugcauuuaaaa

SEQ ID NO: 1854089 - RNA, 21 nt, Human
uuuuaaguuacacauuuuuca

SEQ ID NO: 1854090 - RNA, 22 nt, Human
uuuuaaguuacacauuuuucag

SEQ ID NO: 1854091 - RNA, 20 nt, Human
auuccacuuauaggaauuga

SEQ ID NO: 1854092 - RNA, 13 nt, Human
auuccacagcugc

SEQ ID NO: 1854093 - RNA, 16 nt, Human
auuccccaggaggcca

SEQ ID NO: 1854094 - RNA, 20 nt, Human
auuccccagauugcaacagg

SEQ ID NO: 1854095 - RNA, 22 nt, Human
auuccccacccugaaagcccug

SEQ ID NO: 1854096 - RNA, 19 nt, Human
auuccccaggaggccagcc

SEQ ID NO: 1854097 - RNA, 22 nt, Human
auucaggaagcucagggccugg

SEQ ID NO: 1854098 - RNA, 21 nt, Human
auucaggaagcucagggccug

SEQ ID NO: 1854099 - RNA, 18 nt, Human
auucagcucugcaagaau

SEQ ID NO: 1854100 - RNA, 14 nt, Human
auucagcucugcaa

SEQ ID NO: 1854101 - RNA, 16 nt, Human
auucaguuguuagugu

SEQ ID NO: 1854102 - RNA, 23 nt, Human
auucaggaagcucagggccuggc

SEQ ID NO: 1854103 - RNA, 21 nt, Human
auucaguuguuagugugucuu

SEQ ID NO: 1854104 - RNA, 14 nt, Human
auucagcucaugga

SEQ ID NO: 1854105 - RNA, 16 nt, Human
auucaaaaugauguau

SEQ ID NO: 1854106 - RNA, 18 nt, Human
auuauuuuauguugcaua

SEQ ID NO: 1854107 - RNA, 16 nt, Human
auuauuuuauguugca

SEQ ID NO: 1854108 - RNA, 23 nt, Human
auuauuuauuaaaugcccagccc

SEQ ID NO: 1854109 - RNA, 17 nt, Human
auuauauuuacaaaugg

SEQ ID NO: 1854110 - RNA, 16 nt, Human
auuauauuuacaaaug

SEQ ID NO: 1854111 - RNA, 12 nt, Human
auuaccagggac

SEQ ID NO: 1854112 - RNA, 22 nt, Human
auuaccugaauuuuggcugugu

SEQ ID NO: 1854113 - RNA, 19 nt, Human
auuaccacagacauacuaa

SEQ ID NO: 1854114 - RNA, 22 nt, Human
uuuuuguuccacaaguuaaaua

SEQ ID NO: 1854115 - RNA, 23 nt, Human
auuucuuuugccguuauuaaaaa

SEQ ID NO: 1854116 - RNA, 20 nt, Human
auuuuacuguacagacagaa

SEQ ID NO: 1854117 - RNA, 22 nt, Human
auuuuacuguacagacagaaaa

SEQ ID NO: 1854118 - RNA, 17 nt, Human
auuuuauuaugcaugaa

SEQ ID NO: 1854119 - RNA, 14 nt, Human
auuuuauuaugcau

SEQ ID NO: 1854120 - RNA, 15 nt, Human
auuuuauuaugcaug

SEQ ID NO: 1854121 - RNA, 13 nt, Human
auuuuauuaugca

SEQ ID NO: 1854122 - RNA, 14 nt, Human
auuuuauguugcau

SEQ ID NO: 1854123 - RNA, 21 nt, Human
auuuuauguugcauagaauaa

SEQ ID NO: 1854124 - RNA, 18 nt, Human
auuuuauguugcauagaa

SEQ ID NO: 1854125 - RNA, 21 nt, Human
auuuuacuuuaaaaggagcca

SEQ ID NO: 1854126 - RNA, 21 nt, Human
auuucuaaaucuccaaaauaa

SEQ ID NO: 1854127 - RNA, 12 nt, Human
auuucuaaaucu

SEQ ID NO: 1854128 - RNA, 13 nt, Human
auuucuaaaucuc

SEQ ID NO: 1854129 - RNA, 16 nt, Human
auuuauuauggcacau

SEQ ID NO: 1854130 - RNA, 14 nt, Human
auuuccugugucuu

SEQ ID NO: 1854131 - RNA, 20 nt, Human
auuuauuaaaugcccagccc

SEQ ID NO: 1854132 - RNA, 22 nt, Human
auuuauuaaaugcccagccccu

SEQ ID NO: 1854133 - RNA, 13 nt, Human
auuuauuauggca

SEQ ID NO: 1854134 - RNA, 17 nt, Human
auuuggugguuucagaa

SEQ ID NO: 1854135 - RNA, 18 nt, Human
auuuggugguuucagaaa

SEQ ID NO: 1854136 - RNA, 20 nt, Human
auuuggugguuucagaaaug

SEQ ID NO: 1854137 - RNA, 20 nt, Human
auuucuuuugccguuauuaa

SEQ ID NO: 1854138 - RNA, 15 nt, Human
auuugaggucuguuc

SEQ ID NO: 1854139 - RNA, 23 nt, Human
auuugaggucuguucuuuccaaa

SEQ ID NO: 1854140 - RNA, 17 nt, Human
auuugagcagggcucag

SEQ ID NO: 1854141 - RNA, 22 nt, Human
auuugaggucuguucuuuccaa

SEQ ID NO: 1854142 - RNA, 23 nt, Human
auuggcuuuggguugcaggaccu

SEQ ID NO: 1854143 - RNA, 13 nt, Human
auugugccccugc

SEQ ID NO: 1854144 - RNA, 15 nt, Human
auugugaaauuauuc

SEQ ID NO: 1854145 - RNA, 15 nt, Human
auuguauuacaaauc

SEQ ID NO: 1854146 - RNA, 14 nt, Human
auuguauuacaaau

SEQ ID NO: 1854147 - RNA, 19 nt, Human
auuuaauuuuuuugagaca

SEQ ID NO: 1854148 - RNA, 23 nt, Human
auuuaauuuuuuugagacagagu

SEQ ID NO: 1854149 - RNA, 16 nt, Human
auuuacaaaugggaaa

SEQ ID NO: 1854150 - RNA, 19 nt, Human
auuuacccuucuuuucuga

SEQ ID NO: 1854151 - RNA, 22 nt, Human
auuuacaacugggggaggguga

SEQ ID NO: 1854152 - RNA, 20 nt, Human
auuuaacagaaauguacagc

SEQ ID NO: 1854153 - RNA, 17 nt, Human
auuuaacagaaauguac

SEQ ID NO: 1854154 - RNA, 19 nt, Human
auuuaacagaaauguacag

SEQ ID NO: 1854155 - RNA, 15 nt, Human
auuuaacagaaaugu

SEQ ID NO: 1854156 - RNA, 16 nt, Human
auuuaacagaaaugua

SEQ ID NO: 1854157 - RNA, 14 nt, Human
auugcuacuguccu

SEQ ID NO: 1854158 - RNA, 18 nt, Human
auucuccaccugccaggg

SEQ ID NO: 1854159 - RNA, 20 nt, Human
auugacacuuaaaaaugguu

SEQ ID NO: 1854160 - RNA, 17 nt, Human
auucuccaccugccagg

SEQ ID NO: 1854161 - RNA, 16 nt, Human
auucuccaccugccag

SEQ ID NO: 1854162 - RNA, 13 nt, Human
auucuccaccugc

SEQ ID NO: 1854163 - RNA, 20 nt, Human
auucucagaaucucaaauaa

SEQ ID NO: 1854164 - RNA, 18 nt, Human
auucucagaaucucaaau

SEQ ID NO: 1854165 - RNA, 16 nt, Human
auucuacuuugagugc

SEQ ID NO: 1854166 - RNA, 13 nt, Human
auucuacuuugag

SEQ ID NO: 1854167 - RNA, 14 nt, Human
auucucagaaucuc

SEQ ID NO: 1854168 - RNA, 16 nt, Human
auugcggacagccacg

SEQ ID NO: 1854169 - RNA, 18 nt, Human
auugcggacagccacggc

SEQ ID NO: 1854170 - RNA, 19 nt, Human
auugcggacagccacggcc

SEQ ID NO: 1854171 - RNA, 17 nt, Human
auugcccacgcuggagu

SEQ ID NO: 1854172 - RNA, 21 nt, Human
auugcccacgcuggagugcag

SEQ ID NO: 1854173 - RNA, 17 nt, Human
auugcauuuccugacag

SEQ ID NO: 1854174 - RNA, 16 nt, Human
auugcauuuccugaca

SEQ ID NO: 1854175 - RNA, 23 nt, Human
auugccauuucuuccacaagagc

SEQ ID NO: 1854176 - RNA, 12 nt, Human
auugcaauagaa

SEQ ID NO: 1854177 - RNA, 16 nt, Human
auugcaacaggcuggg

SEQ ID NO: 1854178 - RNA, 21 nt, Human
auugcaacaggcugggcuuca

SEQ ID NO: 1854179 - RNA, 21 nt, Human
auugacccacaagaaaugaaa

SEQ ID NO: 1854180 - RNA, 18 nt, Human
auugacaggauuauugga

SEQ ID NO: 1854181 - RNA, 13 nt, Human
auugaccugaggc

SEQ ID NO: 1854182 - RNA, 15 nt, Human
auugcaacaggcugg

SEQ ID NO: 1854183 - RNA, 11 nt, Human
uucagaaaugu

SEQ ID NO: 1854184 - RNA, 13 nt, Human
uucagaaaugugu

SEQ ID NO: 1854185 - RNA, 13 nt, Human
uucagugccuuau

SEQ ID NO: 1854186 - RNA, 12 nt, Human
uucagugccuua

SEQ ID NO: 1854187 - RNA, 16 nt, Human
uucagugccaaaaaca

SEQ ID NO: 1854188 - RNA, 18 nt, Human
uucagugccuuauggaac

SEQ ID NO: 1854189 - RNA, 19 nt, Human
uucauaauuauuauuuggc

SEQ ID NO: 1854190 - RNA, 17 nt, Human
uucaucccucuggggcu

SEQ ID NO: 1854191 - RNA, 21 nt, Human
uucaucccucuggggcuguuc

SEQ ID NO: 1854192 - RNA, 13 nt, Human
auauauuuuaaga

SEQ ID NO: 1854193 - RNA, 12 nt, Human
auauauuuuaag

SEQ ID NO: 1854194 - RNA, 14 nt, Human
auauauuuuaagac

SEQ ID NO: 1854195 - RNA, 20 nt, Human
auaucugaaaauguaugugu

SEQ ID NO: 1854196 - RNA, 17 nt, Human
auaucugaaaauguaug

SEQ ID NO: 1854197 - RNA, 16 nt, Human
auaucugaaaauguau

SEQ ID NO: 1854198 - RNA, 17 nt, Human
auauguaacaagccacc

SEQ ID NO: 1854199 - RNA, 16 nt, Human
auauguaacaagccac

SEQ ID NO: 1854200 - RNA, 14 nt, Human
auaugcacacauuu

SEQ ID NO: 1854201 - RNA, 15 nt, Human
auaugcacacauuuu

SEQ ID NO: 1854202 - RNA, 16 nt, Human
auaugcacacauuuuu

SEQ ID NO: 1854203 - RNA, 22 nt, Human
auaugcacacauuuuuuaaaug

SEQ ID NO: 1854204 - RNA, 17 nt, Human
uuccaaggguacuaagg

SEQ ID NO: 1854205 - RNA, 15 nt, Human
uuccaaggguacuaa

SEQ ID NO: 1854206 - RNA, 18 nt, Human
uucauuuaggugaggaag

SEQ ID NO: 1854207 - RNA, 15 nt, Human
auauguggaguucau

SEQ ID NO: 1854208 - RNA, 16 nt, Human
auauguggaguucauc

SEQ ID NO: 1854209 - RNA, 17 nt, Human
uuccaggggugggacac

SEQ ID NO: 1854210 - RNA, 19 nt, Human
uuccaccaucaagccacca

SEQ ID NO: 1854211 - RNA, 22 nt, Human
uuccacaagagcccaggccucc

SEQ ID NO: 1854212 - RNA, 22 nt, Human
uucccaccucucucacuccuug

SEQ ID NO: 1854213 - RNA, 12 nt, Human
uucccaccucuc

SEQ ID NO: 1854214 - RNA, 18 nt, Human
uucccaagcucugcuccu

SEQ ID NO: 1854215 - RNA, 13 nt, Human
uucccaagcucug

SEQ ID NO: 1854216 - RNA, 14 nt, Human
uucccaagcucugc

SEQ ID NO: 1854217 - RNA, 15 nt, Human
uucccaagcucugcu

SEQ ID NO: 1854218 - RNA, 16 nt, Human
uucccaagcucugcuc

SEQ ID NO: 1854219 - RNA, 22 nt, Human
uuccagugaggcucugcccuug

SEQ ID NO: 1854220 - RNA, 21 nt, Human
uuccagugaggcucugcccuu

SEQ ID NO: 1854221 - RNA, 20 nt, Human
uuccagugaggcucugcccu

SEQ ID NO: 1854222 - RNA, 19 nt, Human
uuccagugaggcucugccc

SEQ ID NO: 1854223 - RNA, 17 nt, Human
uuccagugaggcucugc

SEQ ID NO: 1854224 - RNA, 21 nt, Human
uuccaggggugggacacccug

SEQ ID NO: 1854225 - RNA, 23 nt, Human
uuccauaaucuggacuccucugu

SEQ ID NO: 1854226 - RNA, 22 nt, Human
uuccauaaucuggacuccucug

SEQ ID NO: 1854227 - RNA, 19 nt, Human
uuccauaaucuggacuccu

SEQ ID NO: 1854228 - RNA, 23 nt, Human
uucccaaagcagugcaugcuguc

SEQ ID NO: 1854229 - RNA, 22 nt, Human
auaguuaagcgugcauaaguua

SEQ ID NO: 1854230 - RNA, 20 nt, Human
auaguuguaccgcaauguga

SEQ ID NO: 1854231 - RNA, 22 nt, Human
auaguuggcuaggaccccucca

SEQ ID NO: 1854232 - RNA, 21 nt, Human
auagugaggcaucgcaaugua

SEQ ID NO: 1854233 - RNA, 15 nt, Human
auaguggugugauuu

SEQ ID NO: 1854234 - RNA, 17 nt, Human
auaguggcuuaaaacaa

SEQ ID NO: 1854235 - RNA, 16 nt, Human
auauaaaagacugacc

SEQ ID NO: 1854236 - RNA, 13 nt, Human
auauauaaccagu

SEQ ID NO: 1854237 - RNA, 12 nt, Human
auauauaaccag

SEQ ID NO: 1854238 - RNA, 15 nt, Human
uucacuuacagcacc

SEQ ID NO: 1854239 - RNA, 17 nt, Human
auaggaaaaacugauuu

SEQ ID NO: 1854240 - RNA, 16 nt, Human
auaggaaaaacugauu

SEQ ID NO: 1854241 - RNA, 14 nt, Human
auaggaaaaacuga

SEQ ID NO: 1854242 - RNA, 12 nt, Human
auaggaaaaacu

SEQ ID NO: 1854243 - RNA, 22 nt, Human
auagcuuuucccuuuuuuuaag

SEQ ID NO: 1854244 - RNA, 17 nt, Human
auaggcguaacuaauuu

SEQ ID NO: 1854245 - RNA, 20 nt, Human
uucacaguucucuccuucuu

SEQ ID NO: 1854246 - RNA, 15 nt, Human
uucacaguucucucc

SEQ ID NO: 1854247 - RNA, 20 nt, Human
uucacagaugggugcuugga

SEQ ID NO: 1854248 - RNA, 23 nt, Human
uucacaagacccaaaaggcagaa

SEQ ID NO: 1854249 - RNA, 17 nt, Human
uucaagugauucucaug

SEQ ID NO: 1854250 - RNA, 17 nt, Human
uucaaaauaaaaaugag

SEQ ID NO: 1854251 - RNA, 21 nt, Human
uucaaaauuguuacaaauugu

SEQ ID NO: 1854252 - RNA, 21 nt, Human
uucaagcgauucuucugcuuc

SEQ ID NO: 1854253 - RNA, 18 nt, Human
uuauuuuuagacagaguc

SEQ ID NO: 1854254 - RNA, 17 nt, Human
uuauuuuuagacagagu

SEQ ID NO: 1854255 - RNA, 13 nt, Human
uuauuuuuuucug

SEQ ID NO: 1854256 - RNA, 17 nt, Human
uuauuuuuuucugaauu

SEQ ID NO: 1854257 - RNA, 15 nt, Human
aucccaccaacccuc

SEQ ID NO: 1854258 - RNA, 15 nt, Human
uucuggcucuuccag

SEQ ID NO: 1854259 - RNA, 15 nt, Human
uucugccgcagcccu

SEQ ID NO: 1854260 - RNA, 14 nt, Human
uucugccgcagccc

SEQ ID NO: 1854261 - RNA, 18 nt, Human
uucuggcuaugcauuuga

SEQ ID NO: 1854262 - RNA, 20 nt, Human
uucuggcuaugcauuugaaa

SEQ ID NO: 1854263 - RNA, 22 nt, Human
uucugguugaugccugugaacu

SEQ ID NO: 1854264 - RNA, 23 nt, Human
aucaggccaggcccucugcccac

SEQ ID NO: 1854265 - RNA, 22 nt, Human
aucaggccaggcccucugccca

SEQ ID NO: 1854266 - RNA, 21 nt, Human
aucaggccaggcccucugccc

SEQ ID NO: 1854267 - RNA, 21 nt, Human
aucauugaaaucuuuuugcuu

SEQ ID NO: 1854268 - RNA, 13 nt, Human
uucuccugccuca

SEQ ID NO: 1854269 - RNA, 12 nt, Human
uucuccugccuc

SEQ ID NO: 1854270 - RNA, 14 nt, Human
uucuccugccucag

SEQ ID NO: 1854271 - RNA, 13 nt, Human
uucugccgcagcc

SEQ ID NO: 1854272 - RNA, 19 nt, Human
uucugcagccacuauuguu

SEQ ID NO: 1854273 - RNA, 14 nt, Human
uucugacccaugcu

SEQ ID NO: 1854274 - RNA, 15 nt, Human
uucugcacacagcac

SEQ ID NO: 1854275 - RNA, 16 nt, Human
uucucuuuucaaaaca

SEQ ID NO: 1854276 - RNA, 17 nt, Human
uucucuacucuagggaa

SEQ ID NO: 1854277 - RNA, 16 nt, Human
uugaaaguuuacagga

SEQ ID NO: 1854278 - RNA, 20 nt, Human
uugaaauauaggaacuuaaa

SEQ ID NO: 1854279 - RNA, 11 nt, Human
uugaaaucuuu

SEQ ID NO: 1854280 - RNA, 21 nt, Human
uugaaauuuuuauuaaauuau

SEQ ID NO: 1854281 - RNA, 18 nt, Human
uugaacccgggaggcaga

SEQ ID NO: 1854282 - RNA, 19 nt, Human
auccuaaugaaugcauaaa

SEQ ID NO: 1854283 - RNA, 14 nt, Human
auccuacaagacac

SEQ ID NO: 1854284 - RNA, 13 nt, Human
auccuaaugaaug

SEQ ID NO: 1854285 - RNA, 12 nt, Human
auccuaaugaau

SEQ ID NO: 1854286 - RNA, 13 nt, Human
auccuaguuccac

SEQ ID NO: 1854287 - RNA, 21 nt, Human
auccuaggcauuugcugaaua

SEQ ID NO: 1854288 - RNA, 13 nt, Human
uucuuaauucuua

SEQ ID NO: 1854289 - RNA, 23 nt, Human
uucuuccucccucccucuuuccc

SEQ ID NO: 1854290 - RNA, 13 nt, Human
uucuuccucugcu

SEQ ID NO: 1854291 - RNA, 12 nt, Human
uucuuccucugc

SEQ ID NO: 1854292 - RNA, 11 nt, Human
uucuuccucug

SEQ ID NO: 1854293 - RNA, 18 nt, Human
uucuguucuuucuggcua

SEQ ID NO: 1854294 - RNA, 16 nt, Human
uucuguugcugccuca

SEQ ID NO: 1854295 - RNA, 15 nt, Human
uucuguugcugccuc

SEQ ID NO: 1854296 - RNA, 20 nt, Human
uucuguuuuucuaggccugg

SEQ ID NO: 1854297 - RNA, 17 nt, Human
uucuguugcugccucau

SEQ ID NO: 1854298 - RNA, 21 nt, Human
uucuguuggccagugugacaa

SEQ ID NO: 1854299 - RNA, 22 nt, Human
uucuuucuggcuaugcauuuga

SEQ ID NO: 1854300 - RNA, 15 nt, Human
uucuuucuuccucug

SEQ ID NO: 1854301 - RNA, 13 nt, Human
uucuuucuuccuc

SEQ ID NO: 1854302 - RNA, 13 nt, Human
uucuugcaaagua

SEQ ID NO: 1854303 - RNA, 12 nt, Human
uucuugcaaagu

SEQ ID NO: 1854304 - RNA, 15 nt, Human
uucuaaaguaaaaac

SEQ ID NO: 1854305 - RNA, 13 nt, Human
uucgcuccugugu

SEQ ID NO: 1854306 - RNA, 19 nt, Human
uucuaaaucuccaaaauaa

SEQ ID NO: 1854307 - RNA, 21 nt, Human
uucgcaggauucuuccucccu

SEQ ID NO: 1854308 - RNA, 20 nt, Human
uucgauacaccgggccugga

SEQ ID NO: 1854309 - RNA, 13 nt, Human
uucucagaaucuc

SEQ ID NO: 1854310 - RNA, 13 nt, Human
uucucagcuccca

SEQ ID NO: 1854311 - RNA, 19 nt, Human
aucagacuaugaaguuuuu

SEQ ID NO: 1854312 - RNA, 14 nt, Human
aucaggccaggccc

SEQ ID NO: 1854313 - RNA, 13 nt, Human
aucaggccaggcc

SEQ ID NO: 1854314 - RNA, 21 nt, Human
uucucacugccaugccagcuu

SEQ ID NO: 1854315 - RNA, 14 nt, Human
uucuauaauuuaaa

SEQ ID NO: 1854316 - RNA, 13 nt, Human
uucuauaauuuaa

SEQ ID NO: 1854317 - RNA, 12 nt, Human
uuccucuccacu

SEQ ID NO: 1854318 - RNA, 15 nt, Human
uuccucuccacugcc

SEQ ID NO: 1854319 - RNA, 14 nt, Human
uuccucuccacugc

SEQ ID NO: 1854320 - RNA, 13 nt, Human
uuccucuccacug

SEQ ID NO: 1854321 - RNA, 20 nt, Human
uuccuucaaagcaaaugucu

SEQ ID NO: 1854322 - RNA, 23 nt, Human
aucaaguuggcuucuaaucaaag

SEQ ID NO: 1854323 - RNA, 22 nt, Human
aucaaguuggcuucuaaucaaa

SEQ ID NO: 1854324 - RNA, 19 nt, Human
aucaaccccuucgcuccug

SEQ ID NO: 1854325 - RNA, 20 nt, Human
aucaaccccuucgcuccugu

SEQ ID NO: 1854326 - RNA, 22 nt, Human
aucaaccccuucgcuccugugu

SEQ ID NO: 1854327 - RNA, 20 nt, Human
uucccuuuuuuggcugcuga

SEQ ID NO: 1854328 - RNA, 19 nt, Human
uucccuuuuuuggcugcug

SEQ ID NO: 1854329 - RNA, 18 nt, Human
uucccuuuuuuggcugcu

SEQ ID NO: 1854330 - RNA, 16 nt, Human
uucccuacuuccugug

SEQ ID NO: 1854331 - RNA, 14 nt, Human
uucccuacuuccug

SEQ ID NO: 1854332 - RNA, 17 nt, Human
uucccuacuuccuguga

SEQ ID NO: 1854333 - RNA, 22 nt, Human
uuccccuuccuaauuccacagc

SEQ ID NO: 1854334 - RNA, 14 nt, Human
uuccccuguucacu

SEQ ID NO: 1854335 - RNA, 17 nt, Human
uuccccuguucacucua

SEQ ID NO: 1854336 - RNA, 19 nt, Human
uugugauacaaugcugugc

SEQ ID NO: 1854337 - RNA, 18 nt, Human
uugugauacaaugcugug

SEQ ID NO: 1854338 - RNA, 21 nt, Human
uugugaggaagccgcuggggc

SEQ ID NO: 1854339 - RNA, 19 nt, Human
uuguucuggcucuuccagg

SEQ ID NO: 1854340 - RNA, 17 nt, Human
uuguguguuuauuguca

SEQ ID NO: 1854341 - RNA, 22 nt, Human
uuguucuggcucuuccaggcug

SEQ ID NO: 1854342 - RNA, 20 nt, Human
uuguucuggcucuuccaggc

SEQ ID NO: 1854343 - RNA, 13 nt, Human
uugugguuaaucu

SEQ ID NO: 1854344 - RNA, 19 nt, Human
augauuucagcucacugca

SEQ ID NO: 1854345 - RNA, 14 nt, Human
augauuuuuaaaga

SEQ ID NO: 1854346 - RNA, 16 nt, Human
augauuuuuaaagaaa

SEQ ID NO: 1854347 - RNA, 13 nt, Human
augcaccagcccu

SEQ ID NO: 1854348 - RNA, 12 nt, Human
augcacuuuguu

SEQ ID NO: 1854349 - RNA, 14 nt, Human
augcaccagcccuu

SEQ ID NO: 1854350 - RNA, 19 nt, Human
augauuaaccacuucagcu

SEQ ID NO: 1854351 - RNA, 21 nt, Human
augauuaaccacuucagcuga

SEQ ID NO: 1854352 - RNA, 20 nt, Human
augauuaaccacuucagcug

SEQ ID NO: 1854353 - RNA, 17 nt, Human
augauuucagcucacug

SEQ ID NO: 1854354 - RNA, 21 nt, Human
augauucaacagguuuuccug

SEQ ID NO: 1854355 - RNA, 17 nt, Human
uuuaagugcugcauuua

SEQ ID NO: 1854356 - RNA, 19 nt, Human
uuuaagugcugcauuuaaa

SEQ ID NO: 1854357 - RNA, 15 nt, Human
uuuaagugcugcauu

SEQ ID NO: 1854358 - RNA, 16 nt, Human
uuuaagugcugcauuu

SEQ ID NO: 1854359 - RNA, 12 nt, Human
uuuaauuuuaca

SEQ ID NO: 1854360 - RNA, 15 nt, Human
uuguuuuacugucuu

SEQ ID NO: 1854361 - RNA, 14 nt, Human
uuuaaauguuuuuu

SEQ ID NO: 1854362 - RNA, 16 nt, Human
uuguuuucaguguaca

SEQ ID NO: 1854363 - RNA, 13 nt, Human
uuguuuucagugu

SEQ ID NO: 1854364 - RNA, 15 nt, Human
augcacuuuguucug

SEQ ID NO: 1854365 - RNA, 16 nt, Human
augcacuuuguucugg

SEQ ID NO: 1854366 - RNA, 15 nt, Human
augccacuaaauuga

SEQ ID NO: 1854367 - RNA, 17 nt, Human
augccacuaaauugaca

SEQ ID NO: 1854368 - RNA, 15 nt, Human
augcaguuuuccuua

SEQ ID NO: 1854369 - RNA, 13 nt, Human
augcagccucaca

SEQ ID NO: 1854370 - RNA, 15 nt, Human
augcagccucacagu

SEQ ID NO: 1854371 - RNA, 14 nt, Human
augcagccucacag

SEQ ID NO: 1854372 - RNA, 17 nt, Human
augcagccucacagucc

SEQ ID NO: 1854373 - RNA, 23 nt, Human
auggacguguuaugacuccagaa

SEQ ID NO: 1854374 - RNA, 18 nt, Human
auggauuuccagccaaag

SEQ ID NO: 1854375 - RNA, 20 nt, Human
auggacguguuaugacucca

SEQ ID NO: 1854376 - RNA, 19 nt, Human
auggacguguuaugacucc

SEQ ID NO: 1854377 - RNA, 22 nt, Human
auggcacaaucucggcucacug

SEQ ID NO: 1854378 - RNA, 19 nt, Human
auggcaaggacugcaggga

SEQ ID NO: 1854379 - RNA, 17 nt, Human
auggcacaucagcacga

SEQ ID NO: 1854380 - RNA, 23 nt, Human
auggcacaucagcacgauuucug

SEQ ID NO: 1854381 - RNA, 21 nt, Human
auggccgggcgcgguggcuca

SEQ ID NO: 1854382 - RNA, 16 nt, Human
auggccagguggccac

SEQ ID NO: 1854383 - RNA, 22 nt, Human
auggccagguggccacuccaga

SEQ ID NO: 1854384 - RNA, 20 nt, Human
auggcuaguaucaaaagaaa

SEQ ID NO: 1854385 - RNA, 20 nt, Human
auggccuuugcuugaaagaa

SEQ ID NO: 1854386 - RNA, 16 nt, Human
auggaagacagcucuu

SEQ ID NO: 1854387 - RNA, 14 nt, Human
uuucacugcuggcu

SEQ ID NO: 1854388 - RNA, 18 nt, Human
uuucacugcuggcugccu

SEQ ID NO: 1854389 - RNA, 17 nt, Human
uuucacugcuggcugcc

SEQ ID NO: 1854390 - RNA, 22 nt, Human
uuucacugcuggcugccuuaga

SEQ ID NO: 1854391 - RNA, 20 nt, Human
uuucacugcuggcugccuua

SEQ ID NO: 1854392 - RNA, 13 nt, Human
uuucagaaaugug

SEQ ID NO: 1854393 - RNA, 14 nt, Human
auggacaugaucuu

SEQ ID NO: 1854394 - RNA, 19 nt, Human
auggacaugaucuucuuua

SEQ ID NO: 1854395 - RNA, 23 nt, Human
augcugucccuuacgugaguccu

SEQ ID NO: 1854396 - RNA, 19 nt, Human
augcugucccuuacgugag

SEQ ID NO: 1854397 - RNA, 15 nt, Human
auggaacacucugag

SEQ ID NO: 1854398 - RNA, 14 nt, Human
auggaacacucuga

SEQ ID NO: 1854399 - RNA, 11 nt, Human
auggaacacuc

SEQ ID NO: 1854400 - RNA, 16 nt, Human
auggaacacucugaga

SEQ ID NO: 1854401 - RNA, 15 nt, Human
auggaagacagcucu

SEQ ID NO: 1854402 - RNA, 22 nt, Human
augcuguaacuuucugaaauaa

SEQ ID NO: 1854403 - RNA, 13 nt, Human
augcugguuuuuc

SEQ ID NO: 1854404 - RNA, 15 nt, Human
augcucugcauguua

SEQ ID NO: 1854405 - RNA, 15 nt, Human
augcuagaacucccu

SEQ ID NO: 1854406 - RNA, 16 nt, Human
augcuagaacucccuu

SEQ ID NO: 1854407 - RNA, 19 nt, Human
augcuagaacucccuuuca

SEQ ID NO: 1854408 - RNA, 15 nt, Human
uuuaguagagacagg

SEQ ID NO: 1854409 - RNA, 16 nt, Human
uuuaguaucuuuuuau

SEQ ID NO: 1854410 - RNA, 24 nt, Human
uuuauggcuuuugugcauuaucua

SEQ ID NO: 1854411 - RNA, 22 nt, Human
uuuaugggucagaguuccgacu

SEQ ID NO: 1854412 - RNA, 20 nt, Human
uuuauggcuuuugugcauua

SEQ ID NO: 1854413 - RNA, 18 nt, Human
aucuugaauuguaaggaa

SEQ ID NO: 1854414 - RNA, 17 nt, Human
aucuugcucugcugaca

SEQ ID NO: 1854415 - RNA, 19 nt, Human
aucuugcucugcugacaga

SEQ ID NO: 1854416 - RNA, 17 nt, Human
aucuggguucacugcaa

SEQ ID NO: 1854417 - RNA, 19 nt, Human
aucuggguucacugcaacc

SEQ ID NO: 1854418 - RNA, 18 nt, Human
uugccgucuaccugaggg

SEQ ID NO: 1854419 - RNA, 15 nt, Human
uugccgucuaccuga

SEQ ID NO: 1854420 - RNA, 19 nt, Human
uugccgucuaccugagggg

SEQ ID NO: 1854421 - RNA, 14 nt, Human
uugccguuauuaaa

SEQ ID NO: 1854422 - RNA, 13 nt, Human
uugccgucuaccu

SEQ ID NO: 1854423 - RNA, 18 nt, Human
aucugaugcaagcaagaa

SEQ ID NO: 1854424 - RNA, 16 nt, Human
uugaugugugucuagg

SEQ ID NO: 1854425 - RNA, 14 nt, Human
uugauucagacagc

SEQ ID NO: 1854426 - RNA, 23 nt, Human
uugauggugaugaaauguaaaua

SEQ ID NO: 1854427 - RNA, 15 nt, Human
uugaugggauuuggu

SEQ ID NO: 1854428 - RNA, 12 nt, Human
uugaugccuggc

SEQ ID NO: 1854429 - RNA, 19 nt, Human
aucucuucuggguuccuuc

SEQ ID NO: 1854430 - RNA, 14 nt, Human
uugcaucugaaaau

SEQ ID NO: 1854431 - RNA, 12 nt, Human
uugcaugaggcu

SEQ ID NO: 1854432 - RNA, 16 nt, Human
uugauucagacagcug

SEQ ID NO: 1854433 - RNA, 15 nt, Human
uugauucagacagcu

SEQ ID NO: 1854434 - RNA, 19 nt, Human
uugcacaaaccaauuaaac

SEQ ID NO: 1854435 - RNA, 13 nt, Human
aucucccccagcc

SEQ ID NO: 1854436 - RNA, 12 nt, Human
aucucccccagc

SEQ ID NO: 1854437 - RNA, 14 nt, Human
aucucccccagccc

SEQ ID NO: 1854438 - RNA, 16 nt, Human
aucuccccaucauugg

SEQ ID NO: 1854439 - RNA, 15 nt, Human
aucuccacuccagau

SEQ ID NO: 1854440 - RNA, 13 nt, Human
aucuccaaaauaa

SEQ ID NO: 1854441 - RNA, 15 nt, Human
aucucacacaugagc

SEQ ID NO: 1854442 - RNA, 16 nt, Human
aucucacacaugagca

SEQ ID NO: 1854443 - RNA, 17 nt, Human
aucucaccuccugcugg

SEQ ID NO: 1854444 - RNA, 19 nt, Human
auccuaguuccaccaucaa

SEQ ID NO: 1854445 - RNA, 15 nt, Human
auccuaguuccacca

SEQ ID NO: 1854446 - RNA, 11 nt, Human
aucucagccca

SEQ ID NO: 1854447 - RNA, 21 nt, Human
aucucaccuccugcugggcag

SEQ ID NO: 1854448 - RNA, 20 nt, Human
aucucaccuccugcugggca

SEQ ID NO: 1854449 - RNA, 14 nt, Human
aucucagggccugg

SEQ ID NO: 1854450 - RNA, 14 nt, Human
augacacaugcaag

SEQ ID NO: 1854451 - RNA, 22 nt, Human
augacacaugcaaggucauuuu

SEQ ID NO: 1854452 - RNA, 23 nt, Human
augagaaaucuaaaaaacgaaaa

SEQ ID NO: 1854453 - RNA, 18 nt, Human
augagaaaucuaaaaaac

SEQ ID NO: 1854454 - RNA, 15 nt, Human
augagaaaucuaaaa

SEQ ID NO: 1854455 - RNA, 21 nt, Human
augagaaagguugaagcacca

SEQ ID NO: 1854456 - RNA, 22 nt, Human
augagaaagguugaagcaccaa

SEQ ID NO: 1854457 - RNA, 17 nt, Human
augagaaaaugucuuua

SEQ ID NO: 1854458 - RNA, 16 nt, Human
augacuuacuguacau

SEQ ID NO: 1854459 - RNA, 17 nt, Human
augacuuacuguacaug

SEQ ID NO: 1854460 - RNA, 18 nt, Human
augacacgaauauugcug

SEQ ID NO: 1854461 - RNA, 22 nt, Human
augacuuaagcacacuugacau

SEQ ID NO: 1854462 - RNA, 14 nt, Human
augacuuacuguac

SEQ ID NO: 1854463 - RNA, 22 nt, Human
aucuuuggacagaagcagcucu

SEQ ID NO: 1854464 - RNA, 18 nt, Human
aucuuugcagacaggcaa

SEQ ID NO: 1854465 - RNA, 21 nt, Human
aucuuuaauuuuacauuuccu

SEQ ID NO: 1854466 - RNA, 16 nt, Human
aucuuuaauuuuacau

SEQ ID NO: 1854467 - RNA, 22 nt, Human
aucuuuaauuuuacauuuccua

SEQ ID NO: 1854468 - RNA, 13 nt, Human
uuggcugcaggga

SEQ ID NO: 1854469 - RNA, 13 nt, Human
aucuuuuuauuca

SEQ ID NO: 1854470 - RNA, 23 nt, Human
aucuuuggacagaagcagcucuu

SEQ ID NO: 1854471 - RNA, 15 nt, Human
augaaagcagggacu

SEQ ID NO: 1854472 - RNA, 23 nt, Human
uuggcgcugccccuggcagcccc

SEQ ID NO: 1854473 - RNA, 18 nt, Human
uuggcuagagguucaaag

SEQ ID NO: 1854474 - RNA, 14 nt, Human
uuggggauauuuuu

SEQ ID NO: 1854475 - RNA, 18 nt, Human
uugggccccagaggcugg

SEQ ID NO: 1854476 - RNA, 22 nt, Human
uuggggggcugaggugggagga

SEQ ID NO: 1854477 - RNA, 15 nt, Human
augaaagggcccaga

SEQ ID NO: 1854478 - RNA, 18 nt, Human
augaagauguagaggaga

SEQ ID NO: 1854479 - RNA, 13 nt, Human
augaaugaauggc

SEQ ID NO: 1854480 - RNA, 20 nt, Human
augaaugucagugugacuga

SEQ ID NO: 1854481 - RNA, 12 nt, Human
cacagcugcuca

SEQ ID NO: 1854482 - RNA, 22 nt, Human
cacagcugcucaauaaaguaca

SEQ ID NO: 1854483 - RNA, 13 nt, Human
cacaggaaaccag

SEQ ID NO: 1854484 - RNA, 19 nt, Human
cacaggcccuuccucucca

SEQ ID NO: 1854485 - RNA, 18 nt, Human
cacaggcccuuccucucc

SEQ ID NO: 1854486 - RNA, 17 nt, Human
cacaggcccuuccucuc

SEQ ID NO: 1854487 - RNA, 16 nt, Human
cacaggcccuuccucu

SEQ ID NO: 1854488 - RNA, 19 nt, Human
cacagugcaucucagccca

SEQ ID NO: 1854489 - RNA, 18 nt, Human
cacagugcaucucagccc

SEQ ID NO: 1854490 - RNA, 17 nt, Human
cacagugcaucucagcc

SEQ ID NO: 1854491 - RNA, 21 nt, Human
cacaggcccuuccucuccacu

SEQ ID NO: 1854492 - RNA, 13 nt, Human
cacaguggaacca

SEQ ID NO: 1854493 - RNA, 19 nt, Human
cacaguggaaccagcccag

SEQ ID NO: 1854494 - RNA, 17 nt, Human
cacaguucaauucucau

SEQ ID NO: 1854495 - RNA, 15 nt, Human
caagacgcugugcug

SEQ ID NO: 1854496 - RNA, 13 nt, Human
caagacgcugugc

SEQ ID NO: 1854497 - RNA, 23 nt, Human
caagaccuucuccuucaccuuug

SEQ ID NO: 1854498 - RNA, 21 nt, Human
caagaccuucuccuucaccuu

SEQ ID NO: 1854499 - RNA, 13 nt, Human
caagagcccaggc

SEQ ID NO: 1854500 - RNA, 17 nt, Human
caagagcuuaacagugu

SEQ ID NO: 1854501 - RNA, 16 nt, Human
caacuuguaaaugugg

SEQ ID NO: 1854502 - RNA, 12 nt, Human
caacuugggaac

SEQ ID NO: 1854503 - RNA, 13 nt, Human
caagaagcccagg

SEQ ID NO: 1854504 - RNA, 14 nt, Human
caagaagcccagga

SEQ ID NO: 1854505 - RNA, 17 nt, Human
caagaaaugaaagcagg

SEQ ID NO: 1854506 - RNA, 19 nt, Human
caagaaaugaaagcaggga

SEQ ID NO: 1854507 - RNA, 18 nt, Human
caaagugcugggauuaca

SEQ ID NO: 1854508 - RNA, 23 nt, Human
caaagugcugggauuacaagcgu

SEQ ID NO: 1854509 - RNA, 20 nt, Human
caaaguucccuacuuccugu

SEQ ID NO: 1854510 - RNA, 13 nt, Human
caaagugcuggga

SEQ ID NO: 1854511 - RNA, 19 nt, Human
caaagugcugggauuacaa

SEQ ID NO: 1854512 - RNA, 18 nt, Human
caaauguucaucaaugaa

SEQ ID NO: 1854513 - RNA, 14 nt, Human
caaauguucaucaa

SEQ ID NO: 1854514 - RNA, 23 nt, Human
caaauggaaaugggcagagcaga

SEQ ID NO: 1854515 - RNA, 23 nt, Human
caaauauauucagccuggcuuca

SEQ ID NO: 1854516 - RNA, 15 nt, Human
caaauuucuaaaucu

SEQ ID NO: 1854517 - RNA, 22 nt, Human
caaauuucuaaaucuccaaaau

SEQ ID NO: 1854518 - RNA, 16 nt, Human
caaccuucuguggcuc

SEQ ID NO: 1854519 - RNA, 16 nt, Human
caaccuggucacagga

SEQ ID NO: 1854520 - RNA, 20 nt, Human
caaccuucuguggcucacag

SEQ ID NO: 1854521 - RNA, 19 nt, Human
caaccuucuguggcucaca

SEQ ID NO: 1854522 - RNA, 17 nt, Human
caaccuucuguggcuca

SEQ ID NO: 1854523 - RNA, 18 nt, Human
caaccugcucuccucuug

SEQ ID NO: 1854524 - RNA, 23 nt, Human
caaccugcucuccucuugccacu

SEQ ID NO: 1854525 - RNA, 21 nt, Human
caaccugcucuccucuugcca

SEQ ID NO: 1854526 - RNA, 20 nt, Human
caacauacucccaucuguga

SEQ ID NO: 1854527 - RNA, 19 nt, Human
caacauacucccaucugug

SEQ ID NO: 1854528 - RNA, 17 nt, Human
caacauacucccaucug

SEQ ID NO: 1854529 - RNA, 12 nt, Human
caacaggcuggg

SEQ ID NO: 1854530 - RNA, 13 nt, Human
caacaggcugggc

SEQ ID NO: 1854531 - RNA, 17 nt, Human
caaacucuugaccucag

SEQ ID NO: 1854532 - RNA, 19 nt, Human
caaacucuugaccucaggu

SEQ ID NO: 1854533 - RNA, 20 nt, Human
caaacucuugaccucaggug

SEQ ID NO: 1854534 - RNA, 12 nt, Human
caaagaaauuuc

SEQ ID NO: 1854535 - RNA, 18 nt, Human
caaagaaauuuccacuca

SEQ ID NO: 1854536 - RNA, 19 nt, Human
caaagaaauuuccacucag

SEQ ID NO: 1854537 - RNA, 21 nt, Human
caaacucuugaccucagguga

SEQ ID NO: 1854538 - RNA, 22 nt, Human
caaaaugaaacgcaaccaccac

SEQ ID NO: 1854539 - RNA, 11 nt, Human
caaaaugaaac

SEQ ID NO: 1854540 - RNA, 21 nt, Human
caaaaugagcccuguccugcc

SEQ ID NO: 1854541 - RNA, 15 nt, Human
caaacagaggccgcc

SEQ ID NO: 1854542 - RNA, 13 nt, Human
caaacagaggccg

SEQ ID NO: 1854543 - RNA, 21 nt, Human
caaaacgguuuuacugcagcu

SEQ ID NO: 1854544 - RNA, 15 nt, Human
caaaacgguuuuacu

SEQ ID NO: 1854545 - RNA, 18 nt, Human
auuuuauuuuauuaugca

SEQ ID NO: 1854546 - RNA, 16 nt, Human
caaaacucuccucugc

SEQ ID NO: 1854547 - RNA, 15 nt, Human
caaaacucuccucug

SEQ ID NO: 1854548 - RNA, 19 nt, Human
caaaacucuccucugcugc

SEQ ID NO: 1854549 - RNA, 14 nt, Human
caaaaguuucucuu

SEQ ID NO: 1854550 - RNA, 16 nt, Human
caaaauaaaacuuuuu

SEQ ID NO: 1854551 - RNA, 20 nt, Human
caaaauaaaacuuuuuaaaa

SEQ ID NO: 1854552 - RNA, 21 nt, Human
caaaaucgaugcagugcuucc

SEQ ID NO: 1854553 - RNA, 22 nt, Human
cacagauuugagcucagcccug

SEQ ID NO: 1854554 - RNA, 18 nt, Human
cacagauuugagcucagc

SEQ ID NO: 1854555 - RNA, 17 nt, Human
cacagauuugagcucag

SEQ ID NO: 1854556 - RNA, 16 nt, Human
cacagauuugagcuca

SEQ ID NO: 1854557 - RNA, 13 nt, Human
cacagaggcugcc

SEQ ID NO: 1854558 - RNA, 22 nt, Human
cacagaguuguuacauuuuuaa

SEQ ID NO: 1854559 - RNA, 21 nt, Human
cacagaguuguuacauuuuua

SEQ ID NO: 1854560 - RNA, 23 nt, Human
cacagaugggugcuuggaggaag

SEQ ID NO: 1854561 - RNA, 19 nt, Human
cacagagaaaguacuucuc

SEQ ID NO: 1854562 - RNA, 20 nt, Human
cacagagaaaguacuucucc

SEQ ID NO: 1854563 - RNA, 21 nt, Human
cacagagaaaguacuucucca

SEQ ID NO: 1854564 - RNA, 14 nt, Human
cacacuccagcugg

SEQ ID NO: 1854565 - RNA, 17 nt, Human
cacacacgcgugcacac

SEQ ID NO: 1854566 - RNA, 20 nt, Human
cacaagaaaugaaagcaggg

SEQ ID NO: 1854567 - RNA, 21 nt, Human
cacaagaaaugaaagcaggga

SEQ ID NO: 1854568 - RNA, 13 nt, Human
cacaaaggagagc

SEQ ID NO: 1854569 - RNA, 18 nt, Human
cacaagaaaugaaagcag

SEQ ID NO: 1854570 - RNA, 22 nt, Human
caaugugacuuaaugccacuaa

SEQ ID NO: 1854571 - RNA, 22 nt, Human
caaugugaaaagaaaaaugagc

SEQ ID NO: 1854572 - RNA, 21 nt, Human
caauaucuuuuuuuuaauaaa

SEQ ID NO: 1854573 - RNA, 17 nt, Human
caauuacaggaaguacu

SEQ ID NO: 1854574 - RNA, 14 nt, Human
cacaaacagaggcc

SEQ ID NO: 1854575 - RNA, 15 nt, Human
cacaaacagaggccg

SEQ ID NO: 1854576 - RNA, 18 nt, Human
cacaaagcccuuccaugu

SEQ ID NO: 1854577 - RNA, 13 nt, Human
cacaaacagaggc

SEQ ID NO: 1854578 - RNA, 18 nt, Human
caauuacaggaaguacug

SEQ ID NO: 1854579 - RNA, 18 nt, Human
caauaggaaaaacugauu

SEQ ID NO: 1854580 - RNA, 22 nt, Human
caagcugcacccucaggcaggu

SEQ ID NO: 1854581 - RNA, 21 nt, Human
caagcuggucccacucagucc

SEQ ID NO: 1854582 - RNA, 15 nt, Human
caagcgauucuucug

SEQ ID NO: 1854583 - RNA, 17 nt, Human
caagcgauucuucugcu

SEQ ID NO: 1854584 - RNA, 21 nt, Human
caagcugcacccucaggcagg

SEQ ID NO: 1854585 - RNA, 18 nt, Human
caagcgauucuucugcuu

SEQ ID NO: 1854586 - RNA, 22 nt, Human
caaggcugcagugagccgagau

SEQ ID NO: 1854587 - RNA, 17 nt, Human
caaggcugcagugagcc

SEQ ID NO: 1854588 - RNA, 20 nt, Human
caaggauccugagccagauu

SEQ ID NO: 1854589 - RNA, 22 nt, Human
caaggauccugagccagauuuc

SEQ ID NO: 1854590 - RNA, 19 nt, Human
caaggauccugagccagau

SEQ ID NO: 1854591 - RNA, 18 nt, Human
caaggauccugagccaga

SEQ ID NO: 1854592 - RNA, 16 nt, Human
caaggagauuuacaac

SEQ ID NO: 1854593 - RNA, 20 nt, Human
caaggaaaaaauaacaauga

SEQ ID NO: 1854594 - RNA, 22 nt, Human
caagcuggucccacucagucca

SEQ ID NO: 1854595 - RNA, 23 nt, Human
caagcuggucccacucaguccau

SEQ ID NO: 1854596 - RNA, 18 nt, Human
caaggaaaaaauaacaau

SEQ ID NO: 1854597 - RNA, 18 nt, Human
caaggcugggggaagaag

SEQ ID NO: 1854598 - RNA, 19 nt, Human
caaggguagggugggccuu

SEQ ID NO: 1854599 - RNA, 19 nt, Human
caauagauauuuaccuuuu

SEQ ID NO: 1854600 - RNA, 18 nt, Human
caauaauaauaccucccu

SEQ ID NO: 1854601 - RNA, 17 nt, Human
caauaggaaaaacugau

SEQ ID NO: 1854602 - RNA, 16 nt, Human
caauaggaaaaacuga

SEQ ID NO: 1854603 - RNA, 15 nt, Human
caauaggaaaaacug

SEQ ID NO: 1854604 - RNA, 17 nt, Human
cauauuuauaaaaauaa

SEQ ID NO: 1854605 - RNA, 17 nt, Human
cauauuuacuucuuaua

SEQ ID NO: 1854606 - RNA, 16 nt, Human
cauauuuacuucuuau

SEQ ID NO: 1854607 - RNA, 20 nt, Human
cauauuuacuucuuauacau

SEQ ID NO: 1854608 - RNA, 12 nt, Human
cauauuuauaaa

SEQ ID NO: 1854609 - RNA, 14 nt, Human
cauauuuacuucuu

SEQ ID NO: 1854610 - RNA, 13 nt, Human
cauaugccugggc

SEQ ID NO: 1854611 - RNA, 18 nt, Human
caucaaugaaugaaugaa

SEQ ID NO: 1854612 - RNA, 14 nt, Human
caucaagaugugac

SEQ ID NO: 1854613 - RNA, 22 nt, Human
caucaagucuuucacauuuaaa

SEQ ID NO: 1854614 - RNA, 23 nt, Human
cauagagagcaagacgcugugcu

SEQ ID NO: 1854615 - RNA, 21 nt, Human
cauagagagcaagacgcugug

SEQ ID NO: 1854616 - RNA, 19 nt, Human
cauagagagcaagacgcug

SEQ ID NO: 1854617 - RNA, 20 nt, Human
cauagaauaaaauuuuuaau

SEQ ID NO: 1854618 - RNA, 14 nt, Human
cauagaauaaaauu

SEQ ID NO: 1854619 - RNA, 20 nt, Human
cauacucccaucugugaaag

SEQ ID NO: 1854620 - RNA, 18 nt, Human
cauacucccaucugugaa

SEQ ID NO: 1854621 - RNA, 15 nt, Human
cauacucccaucugu

SEQ ID NO: 1854622 - RNA, 16 nt, Human
cauacucccaucugug

SEQ ID NO: 1854623 - RNA, 11 nt, Human
cauacucugcu

SEQ ID NO: 1854624 - RNA, 21 nt, Human
cauaugauguacauguacuga

SEQ ID NO: 1854625 - RNA, 17 nt, Human
cauaugauguacaugua

SEQ ID NO: 1854626 - RNA, 15 nt, Human
cauaugauguacaug

SEQ ID NO: 1854627 - RNA, 23 nt, Human
cauauauauguuuuaagaggcag

SEQ ID NO: 1854628 - RNA, 22 nt, Human
cauauauauguuuuaagaggca

SEQ ID NO: 1854629 - RNA, 18 nt, Human
cauaguaugguggcuggg

SEQ ID NO: 1854630 - RNA, 19 nt, Human
cauaguaugguggcugggu

SEQ ID NO: 1854631 - RNA, 22 nt, Human
cauagugaugguuccccuguuc

SEQ ID NO: 1854632 - RNA, 20 nt, Human
cauaguaugguggcuggguu

SEQ ID NO: 1854633 - RNA, 22 nt, Human
cauaguggcuuaaaacaacacu

SEQ ID NO: 1854634 - RNA, 21 nt, Human
caucccugaaggccccgccca

SEQ ID NO: 1854635 - RNA, 19 nt, Human
caucccugaaggccccgcc

SEQ ID NO: 1854636 - RNA, 18 nt, Human
caucccugaaggccccgc

SEQ ID NO: 1854637 - RNA, 17 nt, Human
caucccugaaggccccg

SEQ ID NO: 1854638 - RNA, 21 nt, Human
cauccuaacuccaugucucug

SEQ ID NO: 1854639 - RNA, 14 nt, Human
cauccuaacuccau

SEQ ID NO: 1854640 - RNA, 22 nt, Human
caucccugaaggccccgcccag

SEQ ID NO: 1854641 - RNA, 21 nt, Human
caucauugaaaucuuuuugcu

SEQ ID NO: 1854642 - RNA, 20 nt, Human
caucauugaaaucuuuuugc

SEQ ID NO: 1854643 - RNA, 15 nt, Human
caucauugaaaucuu

SEQ ID NO: 1854644 - RNA, 14 nt, Human
caucauugaaaucu

SEQ ID NO: 1854645 - RNA, 15 nt, Human
caucaccaacgucug

SEQ ID NO: 1854646 - RNA, 13 nt, Human
caucauugaaauc

SEQ ID NO: 1854647 - RNA, 19 nt, Human
caucccucuggggcuguuc

SEQ ID NO: 1854648 - RNA, 13 nt, Human
caucccugaaggc

SEQ ID NO: 1854649 - RNA, 11 nt, Human
caucccugaag

SEQ ID NO: 1854650 - RNA, 15 nt, Human
cauccagguucagcu

SEQ ID NO: 1854651 - RNA, 22 nt, Human
caucuuccaaggguacuaagga

SEQ ID NO: 1854652 - RNA, 16 nt, Human
caucucuuguuuaaau

SEQ ID NO: 1854653 - RNA, 14 nt, Human
caucuccacuccag

SEQ ID NO: 1854654 - RNA, 22 nt, Human
caucucuucuggguuccuuccu

SEQ ID NO: 1854655 - RNA, 13 nt, Human
caucuugcucugc

SEQ ID NO: 1854656 - RNA, 15 nt, Human
caucuugcucugcug

SEQ ID NO: 1854657 - RNA, 14 nt, Human
caucuugcucugcu

SEQ ID NO: 1854658 - RNA, 20 nt, Human
caucuugcucugcugacaga

SEQ ID NO: 1854659 - RNA, 16 nt, Human
cauccucauacccacc

SEQ ID NO: 1854660 - RNA, 15 nt, Human
cauccucauacccac

SEQ ID NO: 1854661 - RNA, 16 nt, Human
cauccuacaagacaca

SEQ ID NO: 1854662 - RNA, 19 nt, Human
cauccuccucagaucuucu

SEQ ID NO: 1854663 - RNA, 18 nt, Human
cauccuccucagaucuuc

SEQ ID NO: 1854664 - RNA, 16 nt, Human
cauccuccucagaucu

SEQ ID NO: 1854665 - RNA, 15 nt, Human
cauccuccucagauc

SEQ ID NO: 1854666 - RNA, 12 nt, Human
cauccuccucag

SEQ ID NO: 1854667 - RNA, 11 nt, Human
cauccuccuca

SEQ ID NO: 1854668 - RNA, 20 nt, Human
cauccuccgccucccggguu

SEQ ID NO: 1854669 - RNA, 22 nt, Human
cauccucauacccacccccacc

SEQ ID NO: 1854670 - RNA, 21 nt, Human
cauccucauacccacccccac

SEQ ID NO: 1854671 - RNA, 18 nt, Human
cauccucauacccacccc

SEQ ID NO: 1854672 - RNA, 17 nt, Human
cauccucauacccaccc

SEQ ID NO: 1854673 - RNA, 13 nt, Human
cauccucccaagg

SEQ ID NO: 1854674 - RNA, 18 nt, Human
cauccucuguacagagcc

SEQ ID NO: 1854675 - RNA, 15 nt, Human
cauccucuguacaga

SEQ ID NO: 1854676 - RNA, 19 nt, Human
cauccucuguacagagccc

SEQ ID NO: 1854677 - RNA, 21 nt, Human
cauccucuguacagagcccac

SEQ ID NO: 1854678 - RNA, 18 nt, Human
caucuagguaaauuacag

SEQ ID NO: 1854679 - RNA, 17 nt, Human
caucuagguaaauuaca

SEQ ID NO: 1854680 - RNA, 12 nt, Human
caucuaggauuu

SEQ ID NO: 1854681 - RNA, 15 nt, Human
caucuacccuccgau

SEQ ID NO: 1854682 - RNA, 17 nt, Human
caucucacacaugagca

SEQ ID NO: 1854683 - RNA, 16 nt, Human
caucucacacaugagc

SEQ ID NO: 1854684 - RNA, 20 nt, Human
caucucacacaugagcauca

SEQ ID NO: 1854685 - RNA, 18 nt, Human
caucucaccuccugcugg

SEQ ID NO: 1854686 - RNA, 17 nt, Human
caucucaccuccugcug

SEQ ID NO: 1854687 - RNA, 16 nt, Human
caucucaccuccugcu

SEQ ID NO: 1854688 - RNA, 13 nt, Human
caucucagcccac

SEQ ID NO: 1854689 - RNA, 20 nt, Human
cauacuaauuauacccccug

SEQ ID NO: 1854690 - RNA, 21 nt, Human
cauacccacccccacccaagg

SEQ ID NO: 1854691 - RNA, 18 nt, Human
cauacccacccccaccca

SEQ ID NO: 1854692 - RNA, 17 nt, Human
cauacccacccccaccc

SEQ ID NO: 1854693 - RNA, 14 nt, Human
cauacccaccccca

SEQ ID NO: 1854694 - RNA, 17 nt, Human
cauacguacacauuuua

SEQ ID NO: 1854695 - RNA, 18 nt, Human
cauacguacacauuuuau

SEQ ID NO: 1854696 - RNA, 14 nt, Human
cauacuaaccagca

SEQ ID NO: 1854697 - RNA, 21 nt, Human
cauacuaaccagcagaaaugc

SEQ ID NO: 1854698 - RNA, 15 nt, Human
cauacguacacauuu

SEQ ID NO: 1854699 - RNA, 16 nt, Human
cauacguacacauuuu

SEQ ID NO: 1854700 - RNA, 13 nt, Human
cauacguacacau

SEQ ID NO: 1854701 - RNA, 21 nt, Human
cauaaaaauuagccaagugug

SEQ ID NO: 1854702 - RNA, 22 nt, Human
cauaaacaagaccacguuucua

SEQ ID NO: 1854703 - RNA, 20 nt, Human
cauaaacaagaccacguuuc

SEQ ID NO: 1854704 - RNA, 21 nt, Human
cauaaacaagaccacguuucu

SEQ ID NO: 1854705 - RNA, 16 nt, Human
cauaaagcaggcagaa

SEQ ID NO: 1854706 - RNA, 14 nt, Human
cauaaagcaggcag

SEQ ID NO: 1854707 - RNA, 16 nt, Human
cauaaccuagccuuag

SEQ ID NO: 1854708 - RNA, 14 nt, Human
cauaagauaaaugu

SEQ ID NO: 1854709 - RNA, 13 nt, Human
cauaacuagaacu

SEQ ID NO: 1854710 - RNA, 15 nt, Human
cauaauacuugcuuu

SEQ ID NO: 1854711 - RNA, 13 nt, Human
cauaccacuuuug

SEQ ID NO: 1854712 - RNA, 14 nt, Human
cauaccacuuuugu

SEQ ID NO: 1854713 - RNA, 15 nt, Human
cauaccacuuuuguu

SEQ ID NO: 1854714 - RNA, 18 nt, Human
cauaccacuuuuguucuu

SEQ ID NO: 1854715 - RNA, 12 nt, Human
cauacccacccc

SEQ ID NO: 1854716 - RNA, 11 nt, Human
cauacccaccc

SEQ ID NO: 1854717 - RNA, 19 nt, Human
cauaccacuuuuguucuug

SEQ ID NO: 1854718 - RNA, 15 nt, Human
caguuuuuauugcuu

SEQ ID NO: 1854719 - RNA, 17 nt, Human
caguuguuagugugucu

SEQ ID NO: 1854720 - RNA, 22 nt, Human
caguuggucccccuuccaugga

SEQ ID NO: 1854721 - RNA, 21 nt, Human
caguuggucccccuuccaugg

SEQ ID NO: 1854722 - RNA, 20 nt, Human
caguuggucccccuuccaug

SEQ ID NO: 1854723 - RNA, 19 nt, Human
caguuggucccccuuccau

SEQ ID NO: 1854724 - RNA, 18 nt, Human
caguuggucccccuucca

SEQ ID NO: 1854725 - RNA, 18 nt, Human
caguuggguggaugccug

SEQ ID NO: 1854726 - RNA, 19 nt, Human
caguuggguggaugccugg

SEQ ID NO: 1854727 - RNA, 16 nt, Human
caguuggguggaugcc

SEQ ID NO: 1854728 - RNA, 23 nt, Human
caguugccagucaccccggccac

SEQ ID NO: 1854729 - RNA, 16 nt, Human
caguggaaccagccca

SEQ ID NO: 1854730 - RNA, 12 nt, Human
caguggcagcug

SEQ ID NO: 1854731 - RNA, 13 nt, Human
caguggcagcugc

SEQ ID NO: 1854732 - RNA, 14 nt, Human
caguggcagcugcu

SEQ ID NO: 1854733 - RNA, 15 nt, Human
caguggcagcugcuu

SEQ ID NO: 1854734 - RNA, 16 nt, Human
caguggcagcugcuuu

SEQ ID NO: 1854735 - RNA, 22 nt, Human
cagugguuccuaauccucuagg

SEQ ID NO: 1854736 - RNA, 11 nt, Human
cagugggaacu

SEQ ID NO: 1854737 - RNA, 12 nt, Human
cagugugacuga

SEQ ID NO: 1854738 - RNA, 14 nt, Human
cagugugacaagga

SEQ ID NO: 1854739 - RNA, 14 nt, Human
cagugucaaugcag

SEQ ID NO: 1854740 - RNA, 23 nt, Human
caguguacauggaauaacaugua

SEQ ID NO: 1854741 - RNA, 20 nt, Human
caguguacauggaauaacau

SEQ ID NO: 1854742 - RNA, 16 nt, Human
caguguacauggaaua

SEQ ID NO: 1854743 - RNA, 17 nt, Human
caguguacagucuugua

SEQ ID NO: 1854744 - RNA, 18 nt, Human
caguguacagucuuguau

SEQ ID NO: 1854745 - RNA, 12 nt, Human
caguguacaguc

SEQ ID NO: 1854746 - RNA, 15 nt, Human
caguguacagucuug

SEQ ID NO: 1854747 - RNA, 14 nt, Human
caguuacucagaau

SEQ ID NO: 1854748 - RNA, 14 nt, Human
caguuaagagaaau

SEQ ID NO: 1854749 - RNA, 13 nt, Human
caguuaagagaaa

SEQ ID NO: 1854750 - RNA, 17 nt, Human
caguuaagccuuuggaa

SEQ ID NO: 1854751 - RNA, 15 nt, Human
caguuaagccuuugg

SEQ ID NO: 1854752 - RNA, 14 nt, Human
caguuaagccuuug

SEQ ID NO: 1854753 - RNA, 20 nt, Human
caguuaagccuuuggaaaca

SEQ ID NO: 1854754 - RNA, 19 nt, Human
caguguuguggauuuaaca

SEQ ID NO: 1854755 - RNA, 20 nt, Human
caguguuguggauuuaacag

SEQ ID NO: 1854756 - RNA, 22 nt, Human
caguguuguggauuuaacagaa

SEQ ID NO: 1854757 - RNA, 22 nt, Human
caguucucuccuucuucccccc

SEQ ID NO: 1854758 - RNA, 15 nt, Human
caguucucuccuucu

SEQ ID NO: 1854759 - RNA, 14 nt, Human
caguucucuccuuc

SEQ ID NO: 1854760 - RNA, 13 nt, Human
caguucucuccuu

SEQ ID NO: 1854761 - RNA, 22 nt, Human
caguucggugagcuacaaaugc

SEQ ID NO: 1854762 - RNA, 19 nt, Human
caguugaaaaacagcugag

SEQ ID NO: 1854763 - RNA, 18 nt, Human
caguugaaaaacagcuga

SEQ ID NO: 1854764 - RNA, 12 nt, Human
caguugaaaaac

SEQ ID NO: 1854765 - RNA, 13 nt, Human
caugccccugaac

SEQ ID NO: 1854766 - RNA, 20 nt, Human
caugccagcuuaucucaggg

SEQ ID NO: 1854767 - RNA, 19 nt, Human
caugccagcuuaucucagg

SEQ ID NO: 1854768 - RNA, 13 nt, Human
caugccuggaugg

SEQ ID NO: 1854769 - RNA, 19 nt, Human
caugccucucucaggccaa

SEQ ID NO: 1854770 - RNA, 18 nt, Human
caugccucucucaggcca

SEQ ID NO: 1854771 - RNA, 17 nt, Human
caugccucucucaggcc

SEQ ID NO: 1854772 - RNA, 16 nt, Human
caugccucucucaggc

SEQ ID NO: 1854773 - RNA, 15 nt, Human
caugccucucucagg

SEQ ID NO: 1854774 - RNA, 14 nt, Human
caugccucucucag

SEQ ID NO: 1854775 - RNA, 17 nt, Human
cauggagguuugaagau

SEQ ID NO: 1854776 - RNA, 13 nt, Human
cauggacuuuguu

SEQ ID NO: 1854777 - RNA, 11 nt, Human
cauggacuuug

SEQ ID NO: 1854778 - RNA, 16 nt, Human
cauggaguauauguca

SEQ ID NO: 1854779 - RNA, 18 nt, Human
caugggaaugaaugucag

SEQ ID NO: 1854780 - RNA, 16 nt, Human
caugggccuccugugu

SEQ ID NO: 1854781 - RNA, 17 nt, Human
caugggccuccugugug

SEQ ID NO: 1854782 - RNA, 17 nt, Human
caugggacagggaggac

SEQ ID NO: 1854783 - RNA, 22 nt, Human
caugggaaugaaugucagugug

SEQ ID NO: 1854784 - RNA, 15 nt, Human
caugggccuccugug

SEQ ID NO: 1854785 - RNA, 22 nt, Human
caugcugucccuuacgugaguc

SEQ ID NO: 1854786 - RNA, 21 nt, Human
caugccuggauggggcugcac

SEQ ID NO: 1854787 - RNA, 18 nt, Human
caugccuggauggggcug

SEQ ID NO: 1854788 - RNA, 23 nt, Human
caugccuggauggggcugcaccg

SEQ ID NO: 1854789 - RNA, 22 nt, Human
cauggaaguacuauaauuuacc

SEQ ID NO: 1854790 - RNA, 20 nt, Human
cauggaaguacuauaauuua

SEQ ID NO: 1854791 - RNA, 18 nt, Human
cauggacaugaucuucuu

SEQ ID NO: 1854792 - RNA, 16 nt, Human
cauggaauaacaugua

SEQ ID NO: 1854793 - RNA, 21 nt, Human
cauguaauuaaguacuaugua

SEQ ID NO: 1854794 - RNA, 18 nt, Human
cauguaauuaaguacuau

SEQ ID NO: 1854795 - RNA, 15 nt, Human
caugucgccucugca

SEQ ID NO: 1854796 - RNA, 14 nt, Human
caugucgccucugc

SEQ ID NO: 1854797 - RNA, 20 nt, Human
caugucgccucugcauucag

SEQ ID NO: 1854798 - RNA, 18 nt, Human
caugucgccucugcauuc

SEQ ID NO: 1854799 - RNA, 23 nt, Human
caugucuuuucuugcaugaggcu

SEQ ID NO: 1854800 - RNA, 21 nt, Human
caugucuuuucuugcaugagg

SEQ ID NO: 1854801 - RNA, 19 nt, Human
caugucuuuucuugcauga

SEQ ID NO: 1854802 - RNA, 14 nt, Human
caugucuuuucuug

SEQ ID NO: 1854803 - RNA, 17 nt, Human
caugugaaaucauucau

SEQ ID NO: 1854804 - RNA, 16 nt, Human
caugugaaaucauuca

SEQ ID NO: 1854805 - RNA, 15 nt, Human
caugugaaaucauuc

SEQ ID NO: 1854806 - RNA, 16 nt, Human
cauggucggaaaacau

SEQ ID NO: 1854807 - RNA, 15 nt, Human
caugugcacaugcac

SEQ ID NO: 1854808 - RNA, 21 nt, Human
caugugccagguuuuuggucu

SEQ ID NO: 1854809 - RNA, 22 nt, Human
caugugccagguuuuuggucug

SEQ ID NO: 1854810 - RNA, 23 nt, Human
cauguuugauguaucugagcagg

SEQ ID NO: 1854811 - RNA, 22 nt, Human
cauguuucuuuguaaugaaaac

SEQ ID NO: 1854812 - RNA, 15 nt, Human
cauguuugugauuga

SEQ ID NO: 1854813 - RNA, 21 nt, Human
cauguuucuuuguaaugaaaa

SEQ ID NO: 1854814 - RNA, 20 nt, Human
cauguuucuuuguaaugaaa

SEQ ID NO: 1854815 - RNA, 18 nt, Human
cauguuuuucuucucccu

SEQ ID NO: 1854816 - RNA, 15 nt, Human
cauguuuuguuuacg

SEQ ID NO: 1854817 - RNA, 21 nt, Human
cauuaaagccugaguuugcuu

SEQ ID NO: 1854818 - RNA, 18 nt, Human
cauuagcaguuugcuuug

SEQ ID NO: 1854819 - RNA, 17 nt, Human
cauuagcaguuugcuuu

SEQ ID NO: 1854820 - RNA, 23 nt, Human
cauuucuuccacaagagcccagg

SEQ ID NO: 1854821 - RNA, 18 nt, Human
cauuugaggucuguucuu

SEQ ID NO: 1854822 - RNA, 19 nt, Human
cauuugaggucuguucuuu

SEQ ID NO: 1854823 - RNA, 17 nt, Human
cauuugaggucuguucu

SEQ ID NO: 1854824 - RNA, 16 nt, Human
cauuugagcagggcuc

SEQ ID NO: 1854825 - RNA, 14 nt, Human
cauuugagcagggc

SEQ ID NO: 1854826 - RNA, 18 nt, Human
ccaaaauaaaacuuuuua

SEQ ID NO: 1854827 - RNA, 21 nt, Human
ccaaaauaaaacuuuuuaaaa

SEQ ID NO: 1854828 - RNA, 20 nt, Human
cauuuuuaguagagacaggg

SEQ ID NO: 1854829 - RNA, 19 nt, Human
cauuuuauuuuauuaugca

SEQ ID NO: 1854830 - RNA, 21 nt, Human
cauuuuauuuuauuaugcaug

SEQ ID NO: 1854831 - RNA, 22 nt, Human
cauuugaggucuguucuuucca

SEQ ID NO: 1854832 - RNA, 23 nt, Human
cauuuugggguacccacugcucu

SEQ ID NO: 1854833 - RNA, 15 nt, Human
cauuuuuaagugcug

SEQ ID NO: 1854834 - RNA, 20 nt, Human
cauuuuuaagugcugcauuu

SEQ ID NO: 1854835 - RNA, 19 nt, Human
cauuuuuaguagagacagg

SEQ ID NO: 1854836 - RNA, 18 nt, Human
cauuuuuaguagagacag

SEQ ID NO: 1854837 - RNA, 24 nt, Human
cauuuugcuaaaugugaaugauga

SEQ ID NO: 1854838 - RNA, 21 nt, Human
cauuuugcuaaaugugaauga

SEQ ID NO: 1854839 - RNA, 18 nt, Human
cauuuugcuaaaugugaa

SEQ ID NO: 1854840 - RNA, 20 nt, Human
cauuuugggguacccacugc

SEQ ID NO: 1854841 - RNA, 21 nt, Human
cauuuugggguacccacugcu

SEQ ID NO: 1854842 - RNA, 22 nt, Human
cauuuugggguacccacugcuc

SEQ ID NO: 1854843 - RNA, 19 nt, Human
cauugaaaucuuuuugcuu

SEQ ID NO: 1854844 - RNA, 22 nt, Human
cauugaccugaggcccuucucu

SEQ ID NO: 1854845 - RNA, 13 nt, Human
cauugaccugagg

SEQ ID NO: 1854846 - RNA, 21 nt, Human
cauuucuuccacaagagccca

SEQ ID NO: 1854847 - RNA, 21 nt, Human
cauuuaaaagauacaguuacu

SEQ ID NO: 1854848 - RNA, 14 nt, Human
cauugcaauagaaa

SEQ ID NO: 1854849 - RNA, 13 nt, Human
cauugcaauagaa

SEQ ID NO: 1854850 - RNA, 15 nt, Human
cauugcaauagaaau

SEQ ID NO: 1854851 - RNA, 17 nt, Human
cauuuacuuuguguuca

SEQ ID NO: 1854852 - RNA, 21 nt, Human
cauuuacuuuguguucaccuu

SEQ ID NO: 1854853 - RNA, 19 nt, Human
ccacaagagcccaggccuc

SEQ ID NO: 1854854 - RNA, 18 nt, Human
ccacaagagcccaggccu

SEQ ID NO: 1854855 - RNA, 17 nt, Human
ccacaagagcccaggcc

SEQ ID NO: 1854856 - RNA, 16 nt, Human
ccacaagagcccaggc

SEQ ID NO: 1854857 - RNA, 21 nt, Human
ccacaagagcccaggccuccu

SEQ ID NO: 1854858 - RNA, 20 nt, Human
ccacaagagcccaggccucc

SEQ ID NO: 1854859 - RNA, 20 nt, Human
ccacaaguuaaauaaaucau

SEQ ID NO: 1854860 - RNA, 15 nt, Human
ccacaaguuaaauaa

SEQ ID NO: 1854861 - RNA, 20 nt, Human
ccaauauucauagcagcuua

SEQ ID NO: 1854862 - RNA, 16 nt, Human
ccaaguggcucccaca

SEQ ID NO: 1854863 - RNA, 13 nt, Human
ccaaguggcuccc

SEQ ID NO: 1854864 - RNA, 19 nt, Human
ccaaggcugauuaaaccaa

SEQ ID NO: 1854865 - RNA, 16 nt, Human
ccaaggcucugagcaa

SEQ ID NO: 1854866 - RNA, 14 nt, Human
ccaaggcuggggga

SEQ ID NO: 1854867 - RNA, 14 nt, Human
ccaauauuguacag

SEQ ID NO: 1854868 - RNA, 15 nt, Human
ccaauauuguacagu

SEQ ID NO: 1854869 - RNA, 16 nt, Human
ccaauauuguacaguu

SEQ ID NO: 1854870 - RNA, 18 nt, Human
ccaauauuguacaguuuu

SEQ ID NO: 1854871 - RNA, 16 nt, Human
ccacaagaaaugaaag

SEQ ID NO: 1854872 - RNA, 22 nt, Human
ccacaagaaaugaaagcaggga

SEQ ID NO: 1854873 - RNA, 13 nt, Human
ccacaagagccca

SEQ ID NO: 1854874 - RNA, 16 nt, Human
ccacaagacccuugug

SEQ ID NO: 1854875 - RNA, 13 nt, Human
ccacaacacacag

SEQ ID NO: 1854876 - RNA, 18 nt, Human
ccacaaaggagagcuagc

SEQ ID NO: 1854877 - RNA, 18 nt, Human
ccaaggcuagaaccaccu

SEQ ID NO: 1854878 - RNA, 14 nt, Human
ccaagcuccaucuc

SEQ ID NO: 1854879 - RNA, 13 nt, Human
ccaagcucccagg

SEQ ID NO: 1854880 - RNA, 12 nt, Human
ccaagcucccag

SEQ ID NO: 1854881 - RNA, 23 nt, Human
ccaagccguggcuucccgcucag

SEQ ID NO: 1854882 - RNA, 21 nt, Human
ccaagccguggcuucccgcuc

SEQ ID NO: 1854883 - RNA, 17 nt, Human
ccaagccguggcuuccc

SEQ ID NO: 1854884 - RNA, 16 nt, Human
ccaagccguggcuucc

SEQ ID NO: 1854885 - RNA, 15 nt, Human
ccaagccguggcuuc

SEQ ID NO: 1854886 - RNA, 14 nt, Human
ccaagcaggacaug

SEQ ID NO: 1854887 - RNA, 14 nt, Human
ccaagccguggcuu

SEQ ID NO: 1854888 - RNA, 23 nt, Human
ccaagcagagguugggaggccau

SEQ ID NO: 1854889 - RNA, 14 nt, Human
ccaaagaugcagcc

SEQ ID NO: 1854890 - RNA, 13 nt, Human
ccaaagaugcagc

SEQ ID NO: 1854891 - RNA, 22 nt, Human
ccaaauucuuucaguggcuacc

SEQ ID NO: 1854892 - RNA, 15 nt, Human
ccaaauucuuucagu

SEQ ID NO: 1854893 - RNA, 14 nt, Human
ccaacauacuccca

SEQ ID NO: 1854894 - RNA, 16 nt, Human
ccaacaucaacaucuu

SEQ ID NO: 1854895 - RNA, 15 nt, Human
ccaacccucaucacc

SEQ ID NO: 1854896 - RNA, 13 nt, Human
ccaacccucauca

SEQ ID NO: 1854897 - RNA, 18 nt, Human
ccaacccuggcacccagg

SEQ ID NO: 1854898 - RNA, 15 nt, Human
ccaagaccuucuccu

SEQ ID NO: 1854899 - RNA, 13 nt, Human
ccaggagcagcca

SEQ ID NO: 1854900 - RNA, 12 nt, Human
ccaggagcagcc

SEQ ID NO: 1854901 - RNA, 19 nt, Human
ccaggaagccagcaggcuc

SEQ ID NO: 1854902 - RNA, 17 nt, Human
ccaggaagccagcaggc

SEQ ID NO: 1854903 - RNA, 15 nt, Human
ccaggaagccagcag

SEQ ID NO: 1854904 - RNA, 22 nt, Human
ccagcugugcucuggacaggca

SEQ ID NO: 1854905 - RNA, 23 nt, Human
ccagcugugcucuggacaggcau

SEQ ID NO: 1854906 - RNA, 14 nt, Human
ccaggagcagccac

SEQ ID NO: 1854907 - RNA, 14 nt, Human
ccaggccagaggga

SEQ ID NO: 1854908 - RNA, 21 nt, Human
ccaggccagagggagugacag

SEQ ID NO: 1854909 - RNA, 21 nt, Human
ccaggccccugccacccuggg

SEQ ID NO: 1854910 - RNA, 23 nt, Human
ccaggccccugccacccugggga

SEQ ID NO: 1854911 - RNA, 19 nt, Human
ccaggccccugccacccug

SEQ ID NO: 1854912 - RNA, 19 nt, Human
ccaggccuccuacagcuug

SEQ ID NO: 1854913 - RNA, 18 nt, Human
ccaggccuccuacagcuu

SEQ ID NO: 1854914 - RNA, 13 nt, Human
ccaggccuccuac

SEQ ID NO: 1854915 - RNA, 19 nt, Human
ccaggcccucugcccacuc

SEQ ID NO: 1854916 - RNA, 18 nt, Human
ccaggcccucugcccacu

SEQ ID NO: 1854917 - RNA, 17 nt, Human
ccaggcccucugcccac

SEQ ID NO: 1854918 - RNA, 15 nt, Human
ccagcugcuugggcu

SEQ ID NO: 1854919 - RNA, 13 nt, Human
ccagcugcuuggg

SEQ ID NO: 1854920 - RNA, 18 nt, Human
ccagcugcuugggcuuca

SEQ ID NO: 1854921 - RNA, 16 nt, Human
ccagcugcuugggcuu

SEQ ID NO: 1854922 - RNA, 12 nt, Human
ccagcuggccgg

SEQ ID NO: 1854923 - RNA, 20 nt, Human
ccagcuggccgggagccuga

SEQ ID NO: 1854924 - RNA, 14 nt, Human
ccagcuggccggga

SEQ ID NO: 1854925 - RNA, 17 nt, Human
ccagcuggguuggaaaa

SEQ ID NO: 1854926 - RNA, 16 nt, Human
ccagcuggguuggaaa

SEQ ID NO: 1854927 - RNA, 18 nt, Human
ccagcugugcucuggaca

SEQ ID NO: 1854928 - RNA, 20 nt, Human
ccagcugugcucuggacagg

SEQ ID NO: 1854929 - RNA, 21 nt, Human
ccagcugugcucuggacaggc

SEQ ID NO: 1854930 - RNA, 23 nt, Human
ccauguuggccaggcuggucuca

SEQ ID NO: 1854931 - RNA, 12 nt, Human
ccaggccugccu

SEQ ID NO: 1854932 - RNA, 23 nt, Human
ccagggacagaggggguggccuc

SEQ ID NO: 1854933 - RNA, 12 nt, Human
ccaucacccgcu

SEQ ID NO: 1854934 - RNA, 23 nt, Human
ccauagagagcaagacgcugugc

SEQ ID NO: 1854935 - RNA, 15 nt, Human
ccauauucuguuggc

SEQ ID NO: 1854936 - RNA, 18 nt, Human
ccauauucuguuggccag

SEQ ID NO: 1854937 - RNA, 19 nt, Human
ccauauucuguuggccagu

SEQ ID NO: 1854938 - RNA, 16 nt, Human
ccaucgcugucaucuc

SEQ ID NO: 1854939 - RNA, 18 nt, Human
ccaucucaccuccugcug

SEQ ID NO: 1854940 - RNA, 21 nt, Human
ccaucucaccuccugcugggc

SEQ ID NO: 1854941 - RNA, 19 nt, Human
ccaucucaccuccugcugg

SEQ ID NO: 1854942 - RNA, 23 nt, Human
ccaucucaccuccugcugggcag

SEQ ID NO: 1854943 - RNA, 16 nt, Human
ccauccugaggcucca

SEQ ID NO: 1854944 - RNA, 15 nt, Human
ccauccugaggcucc

SEQ ID NO: 1854945 - RNA, 21 nt, Human
ccauccucuguacagagccca

SEQ ID NO: 1854946 - RNA, 14 nt, Human
ccaucaugucuggc

SEQ ID NO: 1854947 - RNA, 16 nt, Human
ccaucaugucuggcua

SEQ ID NO: 1854948 - RNA, 22 nt, Human
cccaugagccucagcauccugg

SEQ ID NO: 1854949 - RNA, 13 nt, Human
cccagguuucuau

SEQ ID NO: 1854950 - RNA, 18 nt, Human
cccaggcauuccccagga

SEQ ID NO: 1854951 - RNA, 17 nt, Human
cccaggcauuccccagg

SEQ ID NO: 1854952 - RNA, 19 nt, Human
cccagggugggaagggcua

SEQ ID NO: 1854953 - RNA, 16 nt, Human
cccaggaggccagccu

SEQ ID NO: 1854954 - RNA, 15 nt, Human
cccaggaggccagcc

SEQ ID NO: 1854955 - RNA, 15 nt, Human
cccaggcauucccca

SEQ ID NO: 1854956 - RNA, 23 nt, Human
cccaggcaggucuugaacuccug

SEQ ID NO: 1854957 - RNA, 14 nt, Human
cccaguuagcucuc

SEQ ID NO: 1854958 - RNA, 20 nt, Human
cccagugguuccuaauccuc

SEQ ID NO: 1854959 - RNA, 15 nt, Human
cccagugccgagaag

SEQ ID NO: 1854960 - RNA, 21 nt, Human
cccagugcccacaggaucagu

SEQ ID NO: 1854961 - RNA, 10 nt, Human
cccagucugg

SEQ ID NO: 1854962 - RNA, 18 nt, Human
cccagucuggaaugcagu

SEQ ID NO: 1854963 - RNA, 19 nt, Human
cccagucuggaaugcagug

SEQ ID NO: 1854964 - RNA, 13 nt, Human
cccaucucacaca

SEQ ID NO: 1854965 - RNA, 18 nt, Human
cccaucucacacaugagc

SEQ ID NO: 1854966 - RNA, 20 nt, Human
cccaucugugaaaggaaaga

SEQ ID NO: 1854967 - RNA, 13 nt, Human
cccaugcugcccu

SEQ ID NO: 1854968 - RNA, 12 nt, Human
cccaugcugccc

SEQ ID NO: 1854969 - RNA, 14 nt, Human
cccaugcugcccug

SEQ ID NO: 1854970 - RNA, 15 nt, Human
cccaugagccucagc

SEQ ID NO: 1854971 - RNA, 16 nt, Human
cccaugagccucagca

SEQ ID NO: 1854972 - RNA, 20 nt, Human
cccaugagccucagcauccu

SEQ ID NO: 1854973 - RNA, 17 nt, Human
cccaugucucgacucau

SEQ ID NO: 1854974 - RNA, 16 nt, Human
cccaugucucgacuca

SEQ ID NO: 1854975 - RNA, 21 nt, Human
ccccaaauggaaaugggcaga

SEQ ID NO: 1854976 - RNA, 18 nt, Human
cccaggaggccagccuug

SEQ ID NO: 1854977 - RNA, 16 nt, Human
cccagaggcuggguga

SEQ ID NO: 1854978 - RNA, 12 nt, Human
cccagccccauc

SEQ ID NO: 1854979 - RNA, 11 nt, Human
cccagccccau

SEQ ID NO: 1854980 - RNA, 17 nt, Human
cccagccccaaugaaca

SEQ ID NO: 1854981 - RNA, 13 nt, Human
cccagccccaaug

SEQ ID NO: 1854982 - RNA, 15 nt, Human
cccagccccauccuc

SEQ ID NO: 1854983 - RNA, 14 nt, Human
cccagccccauccu

SEQ ID NO: 1854984 - RNA, 14 nt, Human
cccagccccauccc

SEQ ID NO: 1854985 - RNA, 13 nt, Human
cccagccccaucc

SEQ ID NO: 1854986 - RNA, 19 nt, Human
cccagccccauccucugua

SEQ ID NO: 1854987 - RNA, 18 nt, Human
cccagccccauccucugu

SEQ ID NO: 1854988 - RNA, 20 nt, Human
cccagccuccaagcuccauc

SEQ ID NO: 1854989 - RNA, 18 nt, Human
cccagccuccaagcucca

SEQ ID NO: 1854990 - RNA, 23 nt, Human
cccagcccuccuuaucaaaggac

SEQ ID NO: 1854991 - RNA, 13 nt, Human
cccaggagccccg

SEQ ID NO: 1854992 - RNA, 14 nt, Human
cccaggagccccga

SEQ ID NO: 1854993 - RNA, 14 nt, Human
cccaggaggccagc

SEQ ID NO: 1854994 - RNA, 14 nt, Human
cccagcgagcccug

SEQ ID NO: 1854995 - RNA, 18 nt, Human
cccagcucugguccauag

SEQ ID NO: 1854996 - RNA, 16 nt, Human
cccagcucugguccau

SEQ ID NO: 1854997 - RNA, 15 nt, Human
cccagcucuggucca

SEQ ID NO: 1854998 - RNA, 14 nt, Human
cccagcucuggucc

SEQ ID NO: 1854999 - RNA, 13 nt, Human
cccagcucugguc

SEQ ID NO: 1855000 - RNA, 12 nt, Human
cccagcucuggu

SEQ ID NO: 1855001 - RNA, 18 nt, Human
ccauguuggccaggcugg

SEQ ID NO: 1855002 - RNA, 15 nt, Human
ccauguuggccaggc

SEQ ID NO: 1855003 - RNA, 19 nt, Human
ccauguuggccaggcuggu

SEQ ID NO: 1855004 - RNA, 21 nt, Human
ccauguuggccaggcuggucu

SEQ ID NO: 1855005 - RNA, 15 nt, Human
cccaccuggccucug

SEQ ID NO: 1855006 - RNA, 12 nt, Human
cccaccuggccu

SEQ ID NO: 1855007 - RNA, 17 nt, Human
cccaccuuggcugcagg

SEQ ID NO: 1855008 - RNA, 19 nt, Human
cccaccuuggcugcaggga

SEQ ID NO: 1855009 - RNA, 20 nt, Human
cccaccuuggcugcagggag

SEQ ID NO: 1855010 - RNA, 14 nt, Human
cccacgcccccacu

SEQ ID NO: 1855011 - RNA, 13 nt, Human
cccacgcccccac

SEQ ID NO: 1855012 - RNA, 15 nt, Human
cccacgcccccacug

SEQ ID NO: 1855013 - RNA, 18 nt, Human
ccaugcuccuggcccacu

SEQ ID NO: 1855014 - RNA, 15 nt, Human
ccaugcuccuggccc

SEQ ID NO: 1855015 - RNA, 15 nt, Human
ccaugcugcccugug

SEQ ID NO: 1855016 - RNA, 17 nt, Human
ccaugcugcccugugag

SEQ ID NO: 1855017 - RNA, 16 nt, Human
ccaugcugcccuguga

SEQ ID NO: 1855018 - RNA, 14 nt, Human
ccaugcugccucca

SEQ ID NO: 1855019 - RNA, 13 nt, Human
ccaugcuccuggc

SEQ ID NO: 1855020 - RNA, 13 nt, Human
ccauguuggccag

SEQ ID NO: 1855021 - RNA, 14 nt, Human
ccauguuggccagg

SEQ ID NO: 1855022 - RNA, 23 nt, Human
ccauggcacucuauguucuaaga

SEQ ID NO: 1855023 - RNA, 13 nt, Human
ccaugugccaggu

SEQ ID NO: 1855024 - RNA, 14 nt, Human
cccugguggcagcu

SEQ ID NO: 1855025 - RNA, 22 nt, Human
cccugccucucugcaggucccu

SEQ ID NO: 1855026 - RNA, 21 nt, Human
cccugccucucugcagguccc

SEQ ID NO: 1855027 - RNA, 16 nt, Human
cccugccucucugcag

SEQ ID NO: 1855028 - RNA, 13 nt, Human
cccugcugguuca

SEQ ID NO: 1855029 - RNA, 23 nt, Human
cccugcuuugggcugcccuggug

SEQ ID NO: 1855030 - RNA, 19 nt, Human
cccugcugguucaggguug

SEQ ID NO: 1855031 - RNA, 20 nt, Human
cccugcugguucaggguugg

SEQ ID NO: 1855032 - RNA, 21 nt, Human
cccuggacugugugcucagga

SEQ ID NO: 1855033 - RNA, 18 nt, Human
cccugggaggcucuggag

SEQ ID NO: 1855034 - RNA, 17 nt, Human
cccugggaggcucugga

SEQ ID NO: 1855035 - RNA, 16 nt, Human
cccugggaggcucugg

SEQ ID NO: 1855036 - RNA, 15 nt, Human
cccugggaggcucug

SEQ ID NO: 1855037 - RNA, 21 nt, Human
cccuggugcugccacacuuca

SEQ ID NO: 1855038 - RNA, 17 nt, Human
cccuggugcugccacac

SEQ ID NO: 1855039 - RNA, 22 nt, Human
cccugguggcagugggagcugc

SEQ ID NO: 1855040 - RNA, 23 nt, Human
cccugccuccuuugugaggaagc

SEQ ID NO: 1855041 - RNA, 16 nt, Human
cccugccuccuuugug

SEQ ID NO: 1855042 - RNA, 18 nt, Human
cccugccucucugcaggu

SEQ ID NO: 1855043 - RNA, 11 nt, Human
cccugccucuc

SEQ ID NO: 1855044 - RNA, 14 nt, Human
cccugccuccuuug

SEQ ID NO: 1855045 - RNA, 17 nt, Human
cccugccacccugggga

SEQ ID NO: 1855046 - RNA, 18 nt, Human
cccugccacccuggggag

SEQ ID NO: 1855047 - RNA, 12 nt, Human
cccugccacccu

SEQ ID NO: 1855048 - RNA, 14 nt, Human
cccugccacccugg

SEQ ID NO: 1855049 - RNA, 15 nt, Human
cccugccacccuggg

SEQ ID NO: 1855050 - RNA, 18 nt, Human
cccugcagagggcacaga

SEQ ID NO: 1855051 - RNA, 20 nt, Human
cccugcagagggcacagaaa

SEQ ID NO: 1855052 - RNA, 12 nt, Human
cccugcagaggg

SEQ ID NO: 1855053 - RNA, 16 nt, Human
cccugcaaccugauug

SEQ ID NO: 1855054 - RNA, 22 nt, Human
cccugcaaccugauugugucuc

SEQ ID NO: 1855055 - RNA, 19 nt, Human
cccucagggucccuggugg

SEQ ID NO: 1855056 - RNA, 18 nt, Human
cccucagggucccuggug

SEQ ID NO: 1855057 - RNA, 17 nt, Human
cccucagggucccuggu

SEQ ID NO: 1855058 - RNA, 16 nt, Human
cccucagggucccugg

SEQ ID NO: 1855059 - RNA, 15 nt, Human
cccucagggucccug

SEQ ID NO: 1855060 - RNA, 14 nt, Human
cccuaauaaagcug

SEQ ID NO: 1855061 - RNA, 13 nt, Human
cccuaauaaagcu

SEQ ID NO: 1855062 - RNA, 12 nt, Human
cccuaauaaagc

SEQ ID NO: 1855063 - RNA, 18 nt, Human
cccuaauaaagcugugug

SEQ ID NO: 1855064 - RNA, 15 nt, Human
cccuaauaaagcugu

SEQ ID NO: 1855065 - RNA, 17 nt, Human
cccuaaaguguauuuuu

SEQ ID NO: 1855066 - RNA, 22 nt, Human
cccuaaaguguauuuuuuuacu

SEQ ID NO: 1855067 - RNA, 16 nt, Human
cccggcaggguccuag

SEQ ID NO: 1855068 - RNA, 18 nt, Human
cccggaggggccuggcag

SEQ ID NO: 1855069 - RNA, 17 nt, Human
cccggaggggccuggca

SEQ ID NO: 1855070 - RNA, 22 nt, Human
cccucauccucauacccacccc

SEQ ID NO: 1855071 - RNA, 21 nt, Human
cccuccaagaccuucuccuuc

SEQ ID NO: 1855072 - RNA, 22 nt, Human
cccucauuccaccuucccaugc

SEQ ID NO: 1855073 - RNA, 20 nt, Human
cccucagucuggcccuuccu

SEQ ID NO: 1855074 - RNA, 21 nt, Human
cccucagggucccugguggca

SEQ ID NO: 1855075 - RNA, 15 nt, Human
cccucauagcccuca

SEQ ID NO: 1855076 - RNA, 13 nt, Human
cccucauagcccu

SEQ ID NO: 1855077 - RNA, 20 nt, Human
cccucauccucauacccacc

SEQ ID NO: 1855078 - RNA, 17 nt, Human
cccucauccucauaccc

SEQ ID NO: 1855079 - RNA, 22 nt, Human
cccucaucaccaacgucugugc

SEQ ID NO: 1855080 - RNA, 19 nt, Human
cccucauagcccucacccu

SEQ ID NO: 1855081 - RNA, 13 nt, Human
cccucccucuuuc

SEQ ID NO: 1855082 - RNA, 14 nt, Human
cccucccuucaacc

SEQ ID NO: 1855083 - RNA, 19 nt, Human
cccuccaucuaaacugccc

SEQ ID NO: 1855084 - RNA, 17 nt, Human
cccuccaugugggcuag

SEQ ID NO: 1855085 - RNA, 22 nt, Human
ccccagcuggggccaggcuggg

SEQ ID NO: 1855086 - RNA, 21 nt, Human
ccccagcuggggccaggcugg

SEQ ID NO: 1855087 - RNA, 13 nt, Human
ccccagccugcua

SEQ ID NO: 1855088 - RNA, 16 nt, Human
ccccagccccauccca

SEQ ID NO: 1855089 - RNA, 15 nt, Human
ccccagccccauccu

SEQ ID NO: 1855090 - RNA, 19 nt, Human
ccccagcccuccuuaucaa

SEQ ID NO: 1855091 - RNA, 22 nt, Human
ccccaggugguuauggagaggg

SEQ ID NO: 1855092 - RNA, 14 nt, Human
ccccuggcagcccc

SEQ ID NO: 1855093 - RNA, 12 nt, Human
ccccuggcagcc

SEQ ID NO: 1855094 - RNA, 15 nt, Human
ccccuggcagccccu

SEQ ID NO: 1855095 - RNA, 12 nt, Human
ccccaggaggcc

SEQ ID NO: 1855096 - RNA, 14 nt, Human
ccccuuaccacugc

SEQ ID NO: 1855097 - RNA, 20 nt, Human
ccccuguucuggcagaguug

SEQ ID NO: 1855098 - RNA, 12 nt, Human
ccccuucccccu

SEQ ID NO: 1855099 - RNA, 22 nt, Human
ccccuuccuaauuccacagcug

SEQ ID NO: 1855100 - RNA, 21 nt, Human
ccccuuccuaauuccacagcu

SEQ ID NO: 1855101 - RNA, 20 nt, Human
ccccuuccuaauuccacagc

SEQ ID NO: 1855102 - RNA, 22 nt, Human
ccccuguccccgcacugggcuu

SEQ ID NO: 1855103 - RNA, 23 nt, Human
ccccuggcuuuucacugcuggcu

SEQ ID NO: 1855104 - RNA, 20 nt, Human
cccgaggccuucucugaagg

SEQ ID NO: 1855105 - RNA, 15 nt, Human
cccgaggccuucucu

SEQ ID NO: 1855106 - RNA, 23 nt, Human
cccgcucagcccucccugccccu

SEQ ID NO: 1855107 - RNA, 22 nt, Human
cccgcuaagagggagggagggc

SEQ ID NO: 1855108 - RNA, 19 nt, Human
cccgcucagcccucccugc

SEQ ID NO: 1855109 - RNA, 15 nt, Human
ccuccucucugcccu

SEQ ID NO: 1855110 - RNA, 13 nt, Human
ccuccucucugcc

SEQ ID NO: 1855111 - RNA, 16 nt, Human
ccuccucucugcccua

SEQ ID NO: 1855112 - RNA, 21 nt, Human
ccuccuccagccgccaugcuc

SEQ ID NO: 1855113 - RNA, 22 nt, Human
ccucucccuuggauuguccccg

SEQ ID NO: 1855114 - RNA, 13 nt, Human
ccucucccuugga

SEQ ID NO: 1855115 - RNA, 20 nt, Human
ccucuccccagcaagugaga

SEQ ID NO: 1855116 - RNA, 15 nt, Human
ccucuccccagcaag

SEQ ID NO: 1855117 - RNA, 17 nt, Human
ccucugcacuccccugc

SEQ ID NO: 1855118 - RNA, 16 nt, Human
ccucugcacuccccug

SEQ ID NO: 1855119 - RNA, 12 nt, Human
ccucugagccuu

SEQ ID NO: 1855120 - RNA, 11 nt, Human
ccucugagccu

SEQ ID NO: 1855121 - RNA, 13 nt, Human
ccucugaggcuga

SEQ ID NO: 1855122 - RNA, 18 nt, Human
ccucugcacuccccugcu

SEQ ID NO: 1855123 - RNA, 23 nt, Human
ccucugcacuccccugcugggug

SEQ ID NO: 1855124 - RNA, 14 nt, Human
ccucugcagcaaua

SEQ ID NO: 1855125 - RNA, 18 nt, Human
ccucugcagcaauaaagc

SEQ ID NO: 1855126 - RNA, 16 nt, Human
ccucugcccacucccu

SEQ ID NO: 1855127 - RNA, 13 nt, Human
ccucugcccacuc

SEQ ID NO: 1855128 - RNA, 19 nt, Human
ccucugcagcaauaaagca

SEQ ID NO: 1855129 - RNA, 21 nt, Human
ccucugacacacagcucuguc

SEQ ID NO: 1855130 - RNA, 13 nt, Human
ccucugacacaca

SEQ ID NO: 1855131 - RNA, 15 nt, Human
ccucugacacacagc

SEQ ID NO: 1855132 - RNA, 14 nt, Human
ccucugacacacag

SEQ ID NO: 1855133 - RNA, 19 nt, Human
ccucugacacacagcucug

SEQ ID NO: 1855134 - RNA, 20 nt, Human
ccucugacacacagcucugu

SEQ ID NO: 1855135 - RNA, 12 nt, Human
ccuccuccagcc

SEQ ID NO: 1855136 - RNA, 11 nt, Human
ccuccucagau

SEQ ID NO: 1855137 - RNA, 13 nt, Human
ccucccucuuucc

SEQ ID NO: 1855138 - RNA, 19 nt, Human
ccucccgaguagcugggac

SEQ ID NO: 1855139 - RNA, 17 nt, Human
ccucccgaguagcuggg

SEQ ID NO: 1855140 - RNA, 18 nt, Human
ccucccgaguagcuggga

SEQ ID NO: 1855141 - RNA, 21 nt, Human
ccucccgaauagcugggacua

SEQ ID NO: 1855142 - RNA, 19 nt, Human
ccucccgaauagcugggac

SEQ ID NO: 1855143 - RNA, 20 nt, Human
ccucccgaauagcugggacu

SEQ ID NO: 1855144 - RNA, 15 nt, Human
ccucccaacucaccc

SEQ ID NO: 1855145 - RNA, 23 nt, Human
ccucccaaagugcugggauuaca

SEQ ID NO: 1855146 - RNA, 15 nt, Human
ccuccccuccuccug

SEQ ID NO: 1855147 - RNA, 18 nt, Human
ccucccgaauagcuggga

SEQ ID NO: 1855148 - RNA, 20 nt, Human
ccucaggugagaagcagagg

SEQ ID NO: 1855149 - RNA, 18 nt, Human
ccucaggugagaagcaga

SEQ ID NO: 1855150 - RNA, 17 nt, Human
ccucaggugagaagcag

SEQ ID NO: 1855151 - RNA, 12 nt, Human
ccucauacccac

SEQ ID NO: 1855152 - RNA, 12 nt, Human
ccuccaggugca

SEQ ID NO: 1855153 - RNA, 11 nt, Human
ccuccaggugc

SEQ ID NO: 1855154 - RNA, 17 nt, Human
ccuccaggugcacaagc

SEQ ID NO: 1855155 - RNA, 12 nt, Human
ccuccauguggg

SEQ ID NO: 1855156 - RNA, 15 nt, Human
ccuccaugugggcua

SEQ ID NO: 1855157 - RNA, 14 nt, Human
ccucccaacucacc

SEQ ID NO: 1855158 - RNA, 17 nt, Human
ccucccaaagugcuggg

SEQ ID NO: 1855159 - RNA, 12 nt, Human
ccuccauccuga

SEQ ID NO: 1855160 - RNA, 13 nt, Human
ccuccauccugag

SEQ ID NO: 1855161 - RNA, 16 nt, Human
ccuccaugcugccucc

SEQ ID NO: 1855162 - RNA, 19 nt, Human
ccuccaugcugccuccaga

SEQ ID NO: 1855163 - RNA, 22 nt, Human
ccucaggugagaagcagaggaa

SEQ ID NO: 1855164 - RNA, 22 nt, Human
ccucagggucccugguggcagc

SEQ ID NO: 1855165 - RNA, 20 nt, Human
ccucagggucccugguggca

SEQ ID NO: 1855166 - RNA, 17 nt, Human
ccucagggucccuggug

SEQ ID NO: 1855167 - RNA, 16 nt, Human
ccucagggucccuggu

SEQ ID NO: 1855168 - RNA, 16 nt, Human
ccucagaucuucugug

SEQ ID NO: 1855169 - RNA, 14 nt, Human
ccucacccuggggc

SEQ ID NO: 1855170 - RNA, 16 nt, Human
ccucagagccaccccu

SEQ ID NO: 1855171 - RNA, 17 nt, Human
ccuauuagagaagagau

SEQ ID NO: 1855172 - RNA, 16 nt, Human
ccuauuagagaagaga

SEQ ID NO: 1855173 - RNA, 23 nt, Human
ccucacaguccuuaccagcagag

SEQ ID NO: 1855174 - RNA, 24 nt, Human
ccucacaguccuuaccagcagagc

SEQ ID NO: 1855175 - RNA, 15 nt, Human
ccuaggugacagagu

SEQ ID NO: 1855176 - RNA, 13 nt, Human
cccuguucacucu

SEQ ID NO: 1855177 - RNA, 22 nt, Human
cccuguucacucuacuuagcau

SEQ ID NO: 1855178 - RNA, 14 nt, Human
cccuguucacucua

SEQ ID NO: 1855179 - RNA, 20 nt, Human
cccuuccuaauuccacagcu

SEQ ID NO: 1855180 - RNA, 19 nt, Human
cccuuccuaauuccacagc

SEQ ID NO: 1855181 - RNA, 14 nt, Human
cccuuccuaauucc

SEQ ID NO: 1855182 - RNA, 13 nt, Human
cccuuccuaauuc

SEQ ID NO: 1855183 - RNA, 12 nt, Human
cccuucccaccu

SEQ ID NO: 1855184 - RNA, 11 nt, Human
cccuucauuug

SEQ ID NO: 1855185 - RNA, 13 nt, Human
cccuucccaccuc

SEQ ID NO: 1855186 - RNA, 17 nt, Human
cccuuggauuguccccg

SEQ ID NO: 1855187 - RNA, 19 nt, Human
cccuucuuuuucuucuuuu

SEQ ID NO: 1855188 - RNA, 11 nt, Human
cccuucuuuuu

SEQ ID NO: 1855189 - RNA, 21 nt, Human
cccuuccuaauuccacagcug

SEQ ID NO: 1855190 - RNA, 23 nt, Human
cccuugguuaggcauugugggaa

SEQ ID NO: 1855191 - RNA, 22 nt, Human
cccuugguuaggcauuguggga

SEQ ID NO: 1855192 - RNA, 22 nt, Human
cccuuguggucccaccccacac

SEQ ID NO: 1855193 - RNA, 21 nt, Human
ccggaggggccuggcagccgu

SEQ ID NO: 1855194 - RNA, 17 nt, Human
ccggaggggccuggcag

SEQ ID NO: 1855195 - RNA, 17 nt, Human
ccgggaagggggcuggg

SEQ ID NO: 1855196 - RNA, 23 nt, Human
ccgggagccugaucaccugcccu

SEQ ID NO: 1855197 - RNA, 16 nt, Human
ccgggagccugaucac

SEQ ID NO: 1855198 - RNA, 12 nt, Human
ccguuauuaaaa

SEQ ID NO: 1855199 - RNA, 22 nt, Human
ccuagguauaauucacauugua

SEQ ID NO: 1855200 - RNA, 13 nt, Human
ccuaggugacaga

SEQ ID NO: 1855201 - RNA, 13 nt, Human
ccuacuuccccuu

SEQ ID NO: 1855202 - RNA, 16 nt, Human
ccuacuuccccuuccu

SEQ ID NO: 1855203 - RNA, 21 nt, Human
ccuagaaauuccccacccuga

SEQ ID NO: 1855204 - RNA, 19 nt, Human
ccuacuguaauuugugaua

SEQ ID NO: 1855205 - RNA, 18 nt, Human
ccuacccacccuccuuuc

SEQ ID NO: 1855206 - RNA, 13 nt, Human
ccuacccacccuc

SEQ ID NO: 1855207 - RNA, 19 nt, Human
ccuacagcuugaccgugag

SEQ ID NO: 1855208 - RNA, 22 nt, Human
ccuacaguugaaaaacagcuga

SEQ ID NO: 1855209 - RNA, 13 nt, Human
ccuaaacauauga

SEQ ID NO: 1855210 - RNA, 16 nt, Human
ccuaaaauucagugga

SEQ ID NO: 1855211 - RNA, 21 nt, Human
cuacuguaauuugugauacaa

SEQ ID NO: 1855212 - RNA, 17 nt, Human
cuagcacuuugggaggc

SEQ ID NO: 1855213 - RNA, 15 nt, Human
cuagagguucaaaga

SEQ ID NO: 1855214 - RNA, 21 nt, Human
cuagagugaacuugggccacu

SEQ ID NO: 1855215 - RNA, 17 nt, Human
cuagagugaacuugggc

SEQ ID NO: 1855216 - RNA, 21 nt, Human
cuagacgagcaggcuucuucc

SEQ ID NO: 1855217 - RNA, 20 nt, Human
cuagacgagcaggcuucuuc

SEQ ID NO: 1855218 - RNA, 18 nt, Human
cuagacucccaagcugga

SEQ ID NO: 1855219 - RNA, 15 nt, Human
cuacuugggaggcug

SEQ ID NO: 1855220 - RNA, 18 nt, Human
cuacuugggaggcugaga

SEQ ID NO: 1855221 - RNA, 19 nt, Human
cuacuugggaggcugagau

SEQ ID NO: 1855222 - RNA, 20 nt, Human
cuacuuccccuuccuaauuc

SEQ ID NO: 1855223 - RNA, 15 nt, Human
cuacuuccccuuccu

SEQ ID NO: 1855224 - RNA, 14 nt, Human
cuacuuccccuucc

SEQ ID NO: 1855225 - RNA, 20 nt, Human
cuacuuccugugacuucagc

SEQ ID NO: 1855226 - RNA, 14 nt, Human
cuacugaggugcua

SEQ ID NO: 1855227 - RNA, 17 nt, Human
cuacuguaauuugugau

SEQ ID NO: 1855228 - RNA, 16 nt, Human
cuacuguaauuuguga

SEQ ID NO: 1855229 - RNA, 21 nt, Human
cuacuguaaggcaaucauggu

SEQ ID NO: 1855230 - RNA, 21 nt, Human
cuacccgggaagggggcuggg

SEQ ID NO: 1855231 - RNA, 20 nt, Human
cuacccgggaagggggcugg

SEQ ID NO: 1855232 - RNA, 15 nt, Human
cuacccgggaagggg

SEQ ID NO: 1855233 - RNA, 14 nt, Human
cuacccgggaaggg

SEQ ID NO: 1855234 - RNA, 16 nt, Human
cuacucugugucaggu

SEQ ID NO: 1855235 - RNA, 21 nt, Human
cuacucugugucagguggggc

SEQ ID NO: 1855236 - RNA, 14 nt, Human
cuaaggcugaacuu

SEQ ID NO: 1855237 - RNA, 15 nt, Human
cuaaggugugcucug

SEQ ID NO: 1855238 - RNA, 21 nt, Human
cuaagcuauucaguaauaacu

SEQ ID NO: 1855239 - RNA, 19 nt, Human
cuaagcuauucaguaauaa

SEQ ID NO: 1855240 - RNA, 15 nt, Human
cuaagcaaaauguga

SEQ ID NO: 1855241 - RNA, 18 nt, Human
cuaagcaaaaugugauau

SEQ ID NO: 1855242 - RNA, 20 nt, Human
cuaagcacgggccauaugaa

SEQ ID NO: 1855243 - RNA, 23 nt, Human
cuaagcacgggccauaugaauaa

SEQ ID NO: 1855244 - RNA, 14 nt, Human
cuaagcaaaaugug

SEQ ID NO: 1855245 - RNA, 17 nt, Human
cuaaccagcagaaaugc

SEQ ID NO: 1855246 - RNA, 16 nt, Human
cuaaccagcagaaaug

SEQ ID NO: 1855247 - RNA, 17 nt, Human
cuaaccacgcuggaccu

SEQ ID NO: 1855248 - RNA, 17 nt, Human
cuacagaggccaugggc

SEQ ID NO: 1855249 - RNA, 17 nt, Human
cuacccacccuccuuuc

SEQ ID NO: 1855250 - RNA, 22 nt, Human
cuacccacccuccuuucaccac

SEQ ID NO: 1855251 - RNA, 12 nt, Human
cuacccaggugc

SEQ ID NO: 1855252 - RNA, 20 nt, Human
cuacccagcgagcccuggug

SEQ ID NO: 1855253 - RNA, 19 nt, Human
cuacccagcgagcccuggu

SEQ ID NO: 1855254 - RNA, 16 nt, Human
cuacacuccagugaga

SEQ ID NO: 1855255 - RNA, 21 nt, Human
cuacacacugcauguuuguga

SEQ ID NO: 1855256 - RNA, 17 nt, Human
cuacacuccagugagac

SEQ ID NO: 1855257 - RNA, 18 nt, Human
cuacacugugcugagucu

SEQ ID NO: 1855258 - RNA, 13 nt, Human
cuacacacugcau

SEQ ID NO: 1855259 - RNA, 15 nt, Human
cuacacacugcaugu

SEQ ID NO: 1855260 - RNA, 15 nt, Human
cuacagaggccaugg

SEQ ID NO: 1855261 - RNA, 16 nt, Human
cuaauccucuuuuucu

SEQ ID NO: 1855262 - RNA, 19 nt, Human
cuaaucagcauucucacuc

SEQ ID NO: 1855263 - RNA, 17 nt, Human
cuaaucagcauucucac

SEQ ID NO: 1855264 - RNA, 13 nt, Human
cuaauaaagcugu

SEQ ID NO: 1855265 - RNA, 21 nt, Human
cuaauaaaauuuaaaagucuu

SEQ ID NO: 1855266 - RNA, 12 nt, Human
cuaauaaagcug

SEQ ID NO: 1855267 - RNA, 16 nt, Human
cuaaggugugcucuga

SEQ ID NO: 1855268 - RNA, 14 nt, Human
cuaauguacugcau

SEQ ID NO: 1855269 - RNA, 16 nt, Human
cuaauguacugcauau

SEQ ID NO: 1855270 - RNA, 22 nt, Human
cuaaugaaugcauaaaauguua

SEQ ID NO: 1855271 - RNA, 19 nt, Human
cuaaugaaugcauaaaaug

SEQ ID NO: 1855272 - RNA, 15 nt, Human
cuacaagacacagug

SEQ ID NO: 1855273 - RNA, 14 nt, Human
cuaguuccaccauc

SEQ ID NO: 1855274 - RNA, 14 nt, Human
cuaugacacaugca

SEQ ID NO: 1855275 - RNA, 20 nt, Human
cuaucaaguauuauaccuuu

SEQ ID NO: 1855276 - RNA, 22 nt, Human
cuauauuuuuuguuaaaugauu

SEQ ID NO: 1855277 - RNA, 22 nt, Human
cuauauuguuuucaguguacau

SEQ ID NO: 1855278 - RNA, 20 nt, Human
cuauauuuuuuguuaaauga

SEQ ID NO: 1855279 - RNA, 23 nt, Human
cuauauuguuuucaguguacaug

SEQ ID NO: 1855280 - RNA, 12 nt, Human
cuagcagcaggg

SEQ ID NO: 1855281 - RNA, 15 nt, Human
cuaggaacacuccuu

SEQ ID NO: 1855282 - RNA, 13 nt, Human
cuaggaacacucc

SEQ ID NO: 1855283 - RNA, 21 nt, Human
cuaggaagacuuuggaaagag

SEQ ID NO: 1855284 - RNA, 17 nt, Human
cuaggaaauccagggug

SEQ ID NO: 1855285 - RNA, 16 nt, Human
cuaggaaauccagggu

SEQ ID NO: 1855286 - RNA, 17 nt, Human
cuaggaggucucuaaga

SEQ ID NO: 1855287 - RNA, 22 nt, Human
cuaggaccccuccaugugggcu

SEQ ID NO: 1855288 - RNA, 15 nt, Human
cuaguaucaaaagaa

SEQ ID NO: 1855289 - RNA, 17 nt, Human
cuaguaucaaaagaaag

SEQ ID NO: 1855290 - RNA, 23 nt, Human
cuaguaucaaaagaaagaaaauc

SEQ ID NO: 1855291 - RNA, 21 nt, Human
cuaggcauuugcugaauacag

SEQ ID NO: 1855292 - RNA, 15 nt, Human
cuaggcaggaccugu

SEQ ID NO: 1855293 - RNA, 16 nt, Human
cuaggcaggaccugug

SEQ ID NO: 1855294 - RNA, 23 nt, Human
cuagugugguguuuccuggcacu

SEQ ID NO: 1855295 - RNA, 22 nt, Human
cuagugugguguuuccuggcac

SEQ ID NO: 1855296 - RNA, 21 nt, Human
cuagugugguguuuccuggca

SEQ ID NO: 1855297 - RNA, 19 nt, Human
cuagugugguguuuccugg

SEQ ID NO: 1855298 - RNA, 11 nt, Human
cuaugcauuug

SEQ ID NO: 1855299 - RNA, 12 nt, Human
cuaugcauuuga

SEQ ID NO: 1855300 - RNA, 21 nt, Human
cuaugcauuugaaaauuuuga

SEQ ID NO: 1855301 - RNA, 14 nt, Human
cuaugcauuugaaa

SEQ ID NO: 1855302 - RNA, 22 nt, Human
cuauuuuaauaaacacucuuga

SEQ ID NO: 1855303 - RNA, 18 nt, Human
cuauuuuaauaaacacuc

SEQ ID NO: 1855304 - RNA, 21 nt, Human
cucaacucuccuccagaguca

SEQ ID NO: 1855305 - RNA, 20 nt, Human
cucaacucuccuccagaguc

SEQ ID NO: 1855306 - RNA, 13 nt, Human
cucaaauuucuaa

SEQ ID NO: 1855307 - RNA, 17 nt, Human
cucaagagggcacuggu

SEQ ID NO: 1855308 - RNA, 21 nt, Human
cucaagagggcacugguggcc

SEQ ID NO: 1855309 - RNA, 19 nt, Human
cucaagagggcacuggugg

SEQ ID NO: 1855310 - RNA, 19 nt, Human
cucaacucuccuccagagu

SEQ ID NO: 1855311 - RNA, 13 nt, Human
cucaccccagccc

SEQ ID NO: 1855312 - RNA, 12 nt, Human
cucaccccagcc

SEQ ID NO: 1855313 - RNA, 14 nt, Human
cucaccccagcccc

SEQ ID NO: 1855314 - RNA, 17 nt, Human
cucaccccuugccauaa

SEQ ID NO: 1855315 - RNA, 16 nt, Human
cucacuaggcuucugg

SEQ ID NO: 1855316 - RNA, 13 nt, Human
cucacuaggcuuc

SEQ ID NO: 1855317 - RNA, 21 nt, Human
cucacuaucccggcugcccuu

SEQ ID NO: 1855318 - RNA, 20 nt, Human
cucacuaucccggcugcccu

SEQ ID NO: 1855319 - RNA, 20 nt, Human
cucacuaggcuucugguuga

SEQ ID NO: 1855320 - RNA, 16 nt, Human
cucacuauguugccca

SEQ ID NO: 1855321 - RNA, 17 nt, Human
cucacuauguugcccag

SEQ ID NO: 1855322 - RNA, 18 nt, Human
cucaagugauucuccugc

SEQ ID NO: 1855323 - RNA, 19 nt, Human
cucaagugauucuccugcc

SEQ ID NO: 1855324 - RNA, 20 nt, Human
cucaagugauucuccugccu

SEQ ID NO: 1855325 - RNA, 20 nt, Human
cucaccagccccagugccca

SEQ ID NO: 1855326 - RNA, 21 nt, Human
cucaccagccccagugcccac

SEQ ID NO: 1855327 - RNA, 20 nt, Human
cucacauagcuuacaagcca

SEQ ID NO: 1855328 - RNA, 19 nt, Human
cucaccagccccagugccc

SEQ ID NO: 1855329 - RNA, 13 nt, Human
cucacauuuauau

SEQ ID NO: 1855330 - RNA, 22 nt, Human
cggugcuaucucccccagcccc

SEQ ID NO: 1855331 - RNA, 21 nt, Human
cggugcuaucucccccagccc

SEQ ID NO: 1855332 - RNA, 20 nt, Human
cggugcuaucucccccagcc

SEQ ID NO: 1855333 - RNA, 18 nt, Human
cggugcuaucucccccag

SEQ ID NO: 1855334 - RNA, 16 nt, Human
cgucuaccugaggggc

SEQ ID NO: 1855335 - RNA, 16 nt, Human
cgucucauacucaccu

SEQ ID NO: 1855336 - RNA, 16 nt, Human
cgucgacguagaaccu

SEQ ID NO: 1855337 - RNA, 16 nt, Human
cgugcacacaccagag

SEQ ID NO: 1855338 - RNA, 20 nt, Human
cgucugacaggcaaugcugg

SEQ ID NO: 1855339 - RNA, 21 nt, Human
cgucugacaggcaaugcuggc

SEQ ID NO: 1855340 - RNA, 22 nt, Human
cgucugacaggcaaugcuggcu

SEQ ID NO: 1855341 - RNA, 23 nt, Human
cgugcauaccacuuuuguucuug

SEQ ID NO: 1855342 - RNA, 21 nt, Human
cgugcaguggugcgaucuggg

SEQ ID NO: 1855343 - RNA, 22 nt, Human
cgugcaguggugcgaucugggu

SEQ ID NO: 1855344 - RNA, 18 nt, Human
cgugcacacaccagagcc

SEQ ID NO: 1855345 - RNA, 19 nt, Human
cgugcacacaccagagccc

SEQ ID NO: 1855346 - RNA, 15 nt, Human
cguggaacguuuuuc

SEQ ID NO: 1855347 - RNA, 20 nt, Human
cguggaacguuuuuccuguu

SEQ ID NO: 1855348 - RNA, 19 nt, Human
cguggcuucccgcucagcc

SEQ ID NO: 1855349 - RNA, 18 nt, Human
cguggcuucccgcucagc

SEQ ID NO: 1855350 - RNA, 21 nt, Human
cguggcuucccgcucagcccu

SEQ ID NO: 1855351 - RNA, 20 nt, Human
cguggcuucccgcucagccc

SEQ ID NO: 1855352 - RNA, 20 nt, Human
cuaaauauauuuuaagacga

SEQ ID NO: 1855353 - RNA, 18 nt, Human
cuaaauauauuuuaagac

SEQ ID NO: 1855354 - RNA, 18 nt, Human
cuaaauggaaccacucua

SEQ ID NO: 1855355 - RNA, 16 nt, Human
cuaaauggaaccacuc

SEQ ID NO: 1855356 - RNA, 17 nt, Human
cuaaauggaaccacucu

SEQ ID NO: 1855357 - RNA, 15 nt, Human
cuaaauggaaccacu

SEQ ID NO: 1855358 - RNA, 20 nt, Human
cuaaaucuccaaaauaaaac

SEQ ID NO: 1855359 - RNA, 16 nt, Human
cuaaauguugaaagau

SEQ ID NO: 1855360 - RNA, 23 nt, Human
cuaaauugacacuuaaaaauggu

SEQ ID NO: 1855361 - RNA, 15 nt, Human
cuaacaugauuuggg

SEQ ID NO: 1855362 - RNA, 17 nt, Human
cuaacauggaaguacua

SEQ ID NO: 1855363 - RNA, 15 nt, Human
cuaacauggaaguac

SEQ ID NO: 1855364 - RNA, 16 nt, Human
cgcccuggacugugug

SEQ ID NO: 1855365 - RNA, 21 nt, Human
cgccccucccacagcgcuggc

SEQ ID NO: 1855366 - RNA, 19 nt, Human
cgccccucccacagcgcug

SEQ ID NO: 1855367 - RNA, 12 nt, Human
cgcccagucugg

SEQ ID NO: 1855368 - RNA, 22 nt, Human
cgcccaggcuuagucacugaga

SEQ ID NO: 1855369 - RNA, 20 nt, Human
ccucugcccacucccugcaa

SEQ ID NO: 1855370 - RNA, 19 nt, Human
ccucugcccacucccugca

SEQ ID NO: 1855371 - RNA, 17 nt, Human
ccucugcccacucccug

SEQ ID NO: 1855372 - RNA, 22 nt, Human
cgccagauucuuuccugaggcu

SEQ ID NO: 1855373 - RNA, 16 nt, Human
cgccaucccagcccca

SEQ ID NO: 1855374 - RNA, 14 nt, Human
cgccaucccagccc

SEQ ID NO: 1855375 - RNA, 23 nt, Human
cgccaggggaaaaucagccugcu

SEQ ID NO: 1855376 - RNA, 17 nt, Human
cgccaucccagccccaa

SEQ ID NO: 1855377 - RNA, 18 nt, Human
cgcucucuggccuucggc

SEQ ID NO: 1855378 - RNA, 22 nt, Human
cgcugucagccauuccuguucc

SEQ ID NO: 1855379 - RNA, 17 nt, Human
cgcugugcugcccugcc

SEQ ID NO: 1855380 - RNA, 16 nt, Human
cgcugugcugcccugc

SEQ ID NO: 1855381 - RNA, 15 nt, Human
cgcugugcugcccug

SEQ ID NO: 1855382 - RNA, 18 nt, Human
cgcugugcugcccugccc

SEQ ID NO: 1855383 - RNA, 15 nt, Human
cggaaaacaugcuac

SEQ ID NO: 1855384 - RNA, 20 nt, Human
cggaaaacaugcuacacacu

SEQ ID NO: 1855385 - RNA, 14 nt, Human
cgcucucuggccuu

SEQ ID NO: 1855386 - RNA, 15 nt, Human
cgcucucuggccuuc

SEQ ID NO: 1855387 - RNA, 17 nt, Human
cgcuacccgggaagggg

SEQ ID NO: 1855388 - RNA, 12 nt, Human
cgcucagcccuc

SEQ ID NO: 1855389 - RNA, 21 nt, Human
cgcucagcccucccugccccu

SEQ ID NO: 1855390 - RNA, 16 nt, Human
cgcucagcccucccug

SEQ ID NO: 1855391 - RNA, 16 nt, Human
cgcuacccgggaaggg

SEQ ID NO: 1855392 - RNA, 22 nt, Human
cgcuaagagggagggagggcuc

SEQ ID NO: 1855393 - RNA, 13 nt, Human
cggaagagccuug

SEQ ID NO: 1855394 - RNA, 14 nt, Human
cggaauaguuggcu

SEQ ID NO: 1855395 - RNA, 17 nt, Human
cggccaccugcggugcu

SEQ ID NO: 1855396 - RNA, 16 nt, Human
cggccaccugcggugc

SEQ ID NO: 1855397 - RNA, 15 nt, Human
cggccaccugcggug

SEQ ID NO: 1855398 - RNA, 11 nt, Human
cggccaccugc

SEQ ID NO: 1855399 - RNA, 13 nt, Human
cggccccugcugg

SEQ ID NO: 1855400 - RNA, 18 nt, Human
cggccccugcugguucag

SEQ ID NO: 1855401 - RNA, 19 nt, Human
cggccccugcugguucagg

SEQ ID NO: 1855402 - RNA, 24 nt, Human
cggccaggccagagggagugacag

SEQ ID NO: 1855403 - RNA, 12 nt, Human
cggcugcccuuu

SEQ ID NO: 1855404 - RNA, 11 nt, Human
cggcugcccuu

SEQ ID NO: 1855405 - RNA, 12 nt, Human
cggccuccaucc

SEQ ID NO: 1855406 - RNA, 14 nt, Human
cggccuccauccug

SEQ ID NO: 1855407 - RNA, 23 nt, Human
cggggacagcuccuucuguccua

SEQ ID NO: 1855408 - RNA, 16 nt, Human
cgggguggauuggauu

SEQ ID NO: 1855409 - RNA, 15 nt, Human
cgggggcagagaggg

SEQ ID NO: 1855410 - RNA, 22 nt, Human
cggcuggccuggccccucaggg

SEQ ID NO: 1855411 - RNA, 23 nt, Human
cggcuggccuggccccucagggu

SEQ ID NO: 1855412 - RNA, 20 nt, Human
cgggaggucgaggcaggagg

SEQ ID NO: 1855413 - RNA, 18 nt, Human
cgggaggucgaggcagga

SEQ ID NO: 1855414 - RNA, 17 nt, Human
cgggauuaguacacacu

SEQ ID NO: 1855415 - RNA, 22 nt, Human
cggggacagcuccuucuguccu

SEQ ID NO: 1855416 - RNA, 14 nt, Human
cgggcacucagaag

SEQ ID NO: 1855417 - RNA, 22 nt, Human
cgggcacucagaagacacugau

SEQ ID NO: 1855418 - RNA, 11 nt, Human
cgggucacagg

SEQ ID NO: 1855419 - RNA, 19 nt, Human
cgggucacaggagggaggg

SEQ ID NO: 1855420 - RNA, 14 nt, Human
cgguccacccagga

SEQ ID NO: 1855421 - RNA, 15 nt, Human
cgguccacccaggag

SEQ ID NO: 1855422 - RNA, 16 nt, Human
cgguccacccaggagc

SEQ ID NO: 1855423 - RNA, 20 nt, Human
cgguccacccaggagccccg

SEQ ID NO: 1855424 - RNA, 20 nt, Human
cggugagaggggaacagacu

SEQ ID NO: 1855425 - RNA, 21 nt, Human
cggugagaggggaacagacug

SEQ ID NO: 1855426 - RNA, 17 nt, Human
cggugagcuacaaaugc

SEQ ID NO: 1855427 - RNA, 18 nt, Human
cucuccagccccuggaug

SEQ ID NO: 1855428 - RNA, 17 nt, Human
cucuccagccccuggau

SEQ ID NO: 1855429 - RNA, 16 nt, Human
cucuccagccccugga

SEQ ID NO: 1855430 - RNA, 15 nt, Human
cucuccagccccugg

SEQ ID NO: 1855431 - RNA, 14 nt, Human
cucuccagccccug

SEQ ID NO: 1855432 - RNA, 14 nt, Human
cucuccacugccuu

SEQ ID NO: 1855433 - RNA, 12 nt, Human
cucuccacugcc

SEQ ID NO: 1855434 - RNA, 11 nt, Human
cucuccacugc

SEQ ID NO: 1855435 - RNA, 21 nt, Human
cucucaggccagcugcuuggg

SEQ ID NO: 1855436 - RNA, 19 nt, Human
cucucaggccagcugcuug

SEQ ID NO: 1855437 - RNA, 18 nt, Human
cucucaggccagcugcuu

SEQ ID NO: 1855438 - RNA, 17 nt, Human
cucucaggccagcugcu

SEQ ID NO: 1855439 - RNA, 15 nt, Human
cucucaggccagcug

SEQ ID NO: 1855440 - RNA, 13 nt, Human
cucucaggccagc

SEQ ID NO: 1855441 - RNA, 23 nt, Human
cucucaggccaaacucaccugcc

SEQ ID NO: 1855442 - RNA, 22 nt, Human
cucucaggccaaacucaccugc

SEQ ID NO: 1855443 - RNA, 21 nt, Human
cucucaggccaaacucaccug

SEQ ID NO: 1855444 - RNA, 20 nt, Human
cucucaggccaaacucaccu

SEQ ID NO: 1855445 - RNA, 12 nt, Human
cucucaggccaa

SEQ ID NO: 1855446 - RNA, 15 nt, Human
cucuaguuugauuaa

SEQ ID NO: 1855447 - RNA, 19 nt, Human
cucuaguuugauuaaauuc

SEQ ID NO: 1855448 - RNA, 20 nt, Human
cucuaguuugauuaaauucu

SEQ ID NO: 1855449 - RNA, 21 nt, Human
cucuaguuugauuaaauucuu

SEQ ID NO: 1855450 - RNA, 12 nt, Human
cucucucacucc

SEQ ID NO: 1855451 - RNA, 13 nt, Human
cucucucaggcca

SEQ ID NO: 1855452 - RNA, 22 nt, Human
cucuccucuugccacugccucu

SEQ ID NO: 1855453 - RNA, 19 nt, Human
cucuccucuugccacugcc

SEQ ID NO: 1855454 - RNA, 17 nt, Human
cucuccucuugccacug

SEQ ID NO: 1855455 - RNA, 16 nt, Human
cucuccucuugccacu

SEQ ID NO: 1855456 - RNA, 15 nt, Human
cucuccucuugccac

SEQ ID NO: 1855457 - RNA, 14 nt, Human
cucuccucuugcca

SEQ ID NO: 1855458 - RNA, 18 nt, Human
cucuccucugcugcuggc

SEQ ID NO: 1855459 - RNA, 15 nt, Human
cucuccucugcugcu

SEQ ID NO: 1855460 - RNA, 14 nt, Human
cucuccucugcugc

SEQ ID NO: 1855461 - RNA, 13 nt, Human
cucuccucugcug

SEQ ID NO: 1855462 - RNA, 19 nt, Human
cucuccagccccuggaugc

SEQ ID NO: 1855463 - RNA, 15 nt, Human
cucuccacugccuuc

SEQ ID NO: 1855464 - RNA, 14 nt, Human
cucuccccagcaag

SEQ ID NO: 1855465 - RNA, 22 nt, Human
cucuccccagcaagugagagcu

SEQ ID NO: 1855466 - RNA, 12 nt, Human
cucuccucugcu

SEQ ID NO: 1855467 - RNA, 24 nt, Human
cucuccccagcaagugagagcugg

SEQ ID NO: 1855468 - RNA, 13 nt, Human
cucuacaaaaagc

SEQ ID NO: 1855469 - RNA, 13 nt, Human
cucuacagaggcc

SEQ ID NO: 1855470 - RNA, 21 nt, Human
cucuacagcuaaucagcauuc

SEQ ID NO: 1855471 - RNA, 19 nt, Human
cucuacagaggccaugggc

SEQ ID NO: 1855472 - RNA, 14 nt, Human
cucuacagaggcca

SEQ ID NO: 1855473 - RNA, 16 nt, Human
cucuacagaggccaug

SEQ ID NO: 1855474 - RNA, 14 nt, Human
cucggcucacugca

SEQ ID NO: 1855475 - RNA, 18 nt, Human
cucggcucacugcauccu

SEQ ID NO: 1855476 - RNA, 17 nt, Human
cucggcucacugcaucc

SEQ ID NO: 1855477 - RNA, 19 nt, Human
cuccuucacagaugggugc

SEQ ID NO: 1855478 - RNA, 13 nt, Human
cuccuucaccuuu

SEQ ID NO: 1855479 - RNA, 17 nt, Human
cuccuucacagaugggu

SEQ ID NO: 1855480 - RNA, 16 nt, Human
cuccuucacagauggg

SEQ ID NO: 1855481 - RNA, 20 nt, Human
cuccugugugugcgccuaca

SEQ ID NO: 1855482 - RNA, 16 nt, Human
cucuacuuagcauguc

SEQ ID NO: 1855483 - RNA, 20 nt, Human
cucuacuuagcaugucccua

SEQ ID NO: 1855484 - RNA, 19 nt, Human
cucuacuuagcaugucccu

SEQ ID NO: 1855485 - RNA, 17 nt, Human
cucuacuuagcaugucc

SEQ ID NO: 1855486 - RNA, 20 nt, Human
cucuaccauccccuguagag

SEQ ID NO: 1855487 - RNA, 13 nt, Human
cucuacccuggca

SEQ ID NO: 1855488 - RNA, 23 nt, Human
cucuagggaaaaaccagcgugug

SEQ ID NO: 1855489 - RNA, 15 nt, Human
cuccugccucagccu

SEQ ID NO: 1855490 - RNA, 16 nt, Human
cuccugugugugcgcc

SEQ ID NO: 1855491 - RNA, 19 nt, Human
cuccugugugugcgccuac

SEQ ID NO: 1855492 - RNA, 17 nt, Human
cuccugcaggcagccag

SEQ ID NO: 1855493 - RNA, 16 nt, Human
cuccugcaggcagcca

SEQ ID NO: 1855494 - RNA, 11 nt, Human
cuccugcaggc

SEQ ID NO: 1855495 - RNA, 20 nt, Human
cuccugcaggcagccaggcc

SEQ ID NO: 1855496 - RNA, 18 nt, Human
cuccugcaggcagccagg

SEQ ID NO: 1855497 - RNA, 11 nt, Human
cuccugcccuu

SEQ ID NO: 1855498 - RNA, 13 nt, Human
cuccugccucagc

SEQ ID NO: 1855499 - RNA, 14 nt, Human
cuccugccucagcc

SEQ ID NO: 1855500 - RNA, 17 nt, Human
cuccucccggugcccaa

SEQ ID NO: 1855501 - RNA, 15 nt, Human
cuccucccggugccc

SEQ ID NO: 1855502 - RNA, 14 nt, Human
cuccucccggugcc

SEQ ID NO: 1855503 - RNA, 22 nt, Human
cuccucuccccagcaagugaga

SEQ ID NO: 1855504 - RNA, 22 nt, Human
cuccuccagccgccaugcuccu

SEQ ID NO: 1855505 - RNA, 13 nt, Human
cucccucauucca

SEQ ID NO: 1855506 - RNA, 15 nt, Human
cuccgaccagacacc

SEQ ID NO: 1855507 - RNA, 20 nt, Human
cucccuuuuaauccuggcug

SEQ ID NO: 1855508 - RNA, 19 nt, Human
cucccuuuuaauccuggcu

SEQ ID NO: 1855509 - RNA, 22 nt, Human
cucccaacucaccccagcccca

SEQ ID NO: 1855510 - RNA, 17 nt, Human
cucccaacucaccccag

SEQ ID NO: 1855511 - RNA, 22 nt, Human
cucccaaagugcugggauuaca

SEQ ID NO: 1855512 - RNA, 18 nt, Human
cucccaaagugcugggau

SEQ ID NO: 1855513 - RNA, 23 nt, Human
cucccaucugugaaaggaaagag

SEQ ID NO: 1855514 - RNA, 18 nt, Human
cucccaucugugaaagga

SEQ ID NO: 1855515 - RNA, 15 nt, Human
cucccaucugugaaa

SEQ ID NO: 1855516 - RNA, 14 nt, Human
cucccaucugugaa

SEQ ID NO: 1855517 - RNA, 11 nt, Human
cucccaucugu

SEQ ID NO: 1855518 - RNA, 16 nt, Human
cuccaucuccacucca

SEQ ID NO: 1855519 - RNA, 22 nt, Human
cuccaugucucugagcauuaga

SEQ ID NO: 1855520 - RNA, 13 nt, Human
cuccaugucucug

SEQ ID NO: 1855521 - RNA, 17 nt, Human
cucccaaagugcuggga

SEQ ID NO: 1855522 - RNA, 13 nt, Human
cuccaugugggcu

SEQ ID NO: 1855523 - RNA, 11 nt, Human
cuccauccuga

SEQ ID NO: 1855524 - RNA, 16 nt, Human
cuccauccugaggcuc

SEQ ID NO: 1855525 - RNA, 18 nt, Human
cuccauccugaggcucca

SEQ ID NO: 1855526 - RNA, 14 nt, Human
cuccaucuccacuc

SEQ ID NO: 1855527 - RNA, 18 nt, Human
cucacuauguugcccagg

SEQ ID NO: 1855528 - RNA, 12 nt, Human
cuccccagcaag

SEQ ID NO: 1855529 - RNA, 20 nt, Human
cuccccagcaagugagagcu

SEQ ID NO: 1855530 - RNA, 21 nt, Human
cuccccagcaagugagagcug

SEQ ID NO: 1855531 - RNA, 12 nt, Human
cuccccugcugg

SEQ ID NO: 1855532 - RNA, 14 nt, Human
cuccccugcugggu

SEQ ID NO: 1855533 - RNA, 13 nt, Human
cuccccugcuggg

SEQ ID NO: 1855534 - RNA, 17 nt, Human
cucccgaauagcuggga

SEQ ID NO: 1855535 - RNA, 16 nt, Human
cucccgaauagcuggg

SEQ ID NO: 1855536 - RNA, 15 nt, Human
cucccgaguagcugg

SEQ ID NO: 1855537 - RNA, 18 nt, Human
cucccgaauagcugggac

SEQ ID NO: 1855538 - RNA, 16 nt, Human
cucccgaguagcuggg

SEQ ID NO: 1855539 - RNA, 17 nt, Human
cucccgaguagcuggga

SEQ ID NO: 1855540 - RNA, 19 nt, Human
cucccgaauagcugggacu

SEQ ID NO: 1855541 - RNA, 18 nt, Human
cucccgaguagcugggac

SEQ ID NO: 1855542 - RNA, 20 nt, Human
cucccggcuaugggggcacu

SEQ ID NO: 1855543 - RNA, 15 nt, Human
cugagacagcccggg

SEQ ID NO: 1855544 - RNA, 14 nt, Human
cugagacagcccgg

SEQ ID NO: 1855545 - RNA, 14 nt, Human
cugagaaauuuaua

SEQ ID NO: 1855546 - RNA, 11 nt, Human
cugagaaauuu

SEQ ID NO: 1855547 - RNA, 18 nt, Human
cugacuguuuucucuuga

SEQ ID NO: 1855548 - RNA, 16 nt, Human
cugacuguuuucucuu

SEQ ID NO: 1855549 - RNA, 15 nt, Human
cugacccaugcugcc

SEQ ID NO: 1855550 - RNA, 14 nt, Human
cugacccaugcugc

SEQ ID NO: 1855551 - RNA, 16 nt, Human
cugacccaugcugccc

SEQ ID NO: 1855552 - RNA, 13 nt, Human
cugacccaugcug

SEQ ID NO: 1855553 - RNA, 13 nt, Human
cugacccacugcu

SEQ ID NO: 1855554 - RNA, 14 nt, Human
cugacccacugcuu

SEQ ID NO: 1855555 - RNA, 19 nt, Human
cugaccaauauuguacagu

SEQ ID NO: 1855556 - RNA, 20 nt, Human
cugaccaauauuguacaguu

SEQ ID NO: 1855557 - RNA, 21 nt, Human
cugaccaauauuguacaguuu

SEQ ID NO: 1855558 - RNA, 12 nt, Human
cugacccacugc

SEQ ID NO: 1855559 - RNA, 15 nt, Human
cugaccaauauugua

SEQ ID NO: 1855560 - RNA, 18 nt, Human
cugaccaauauuguacag

SEQ ID NO: 1855561 - RNA, 22 nt, Human
cugacauuguuggccaaagcca

SEQ ID NO: 1855562 - RNA, 19 nt, Human
cugaagacucauucuucug

SEQ ID NO: 1855563 - RNA, 21 nt, Human
cugacaggcaaugcuggcugu

SEQ ID NO: 1855564 - RNA, 20 nt, Human
cugaggcccuucucuccagc

SEQ ID NO: 1855565 - RNA, 19 nt, Human
cugaggcccuucucuccag

SEQ ID NO: 1855566 - RNA, 18 nt, Human
cugaggcccuucucucca

SEQ ID NO: 1855567 - RNA, 15 nt, Human
cugaggcccuucucu

SEQ ID NO: 1855568 - RNA, 14 nt, Human
cugaggcccuucuc

SEQ ID NO: 1855569 - RNA, 23 nt, Human
cugaggcccagagggccugcaag

SEQ ID NO: 1855570 - RNA, 21 nt, Human
cugaggcccagagggccugca

SEQ ID NO: 1855571 - RNA, 19 nt, Human
cugaggcccagagggccug

SEQ ID NO: 1855572 - RNA, 18 nt, Human
cugaggcccagagggccu

SEQ ID NO: 1855573 - RNA, 17 nt, Human
cugaggcccagagggcc

SEQ ID NO: 1855574 - RNA, 16 nt, Human
cugaggcccagagggc

SEQ ID NO: 1855575 - RNA, 15 nt, Human
cugaggcccagaggg

SEQ ID NO: 1855576 - RNA, 14 nt, Human
cugaggcccagagg

SEQ ID NO: 1855577 - RNA, 13 nt, Human
cugaggcccagag

SEQ ID NO: 1855578 - RNA, 12 nt, Human
cugaggcccaga

SEQ ID NO: 1855579 - RNA, 17 nt, Human
cugaggaucagaguaau

SEQ ID NO: 1855580 - RNA, 19 nt, Human
cugaggaucagaguaaucc

SEQ ID NO: 1855581 - RNA, 21 nt, Human
cugagccagauuucacucucc

SEQ ID NO: 1855582 - RNA, 20 nt, Human
cugagccagauuucacucuc

SEQ ID NO: 1855583 - RNA, 19 nt, Human
cugagccagauuucacucu

SEQ ID NO: 1855584 - RNA, 18 nt, Human
cugagccagauuucacuc

SEQ ID NO: 1855585 - RNA, 17 nt, Human
cugagccagauuucacu

SEQ ID NO: 1855586 - RNA, 18 nt, Human
cugagacagcccgggcuc

SEQ ID NO: 1855587 - RNA, 17 nt, Human
cugagacagcccgggcu

SEQ ID NO: 1855588 - RNA, 16 nt, Human
cugagacagcccgggc

SEQ ID NO: 1855589 - RNA, 21 nt, Human
cugagccucagucucccuccc

SEQ ID NO: 1855590 - RNA, 16 nt, Human
cugagccucagucucc

SEQ ID NO: 1855591 - RNA, 16 nt, Human
cugagcgacagugaga

SEQ ID NO: 1855592 - RNA, 20 nt, Human
cugagcgacagugagacucu

SEQ ID NO: 1855593 - RNA, 22 nt, Human
cugagccucagucucccucccu

SEQ ID NO: 1855594 - RNA, 13 nt, Human
cucucuccucccu

SEQ ID NO: 1855595 - RNA, 21 nt, Human
cucugccugaagucacacagu

SEQ ID NO: 1855596 - RNA, 22 nt, Human
cucugccugaagucacacagug

SEQ ID NO: 1855597 - RNA, 15 nt, Human
cucuggacaggcaug

SEQ ID NO: 1855598 - RNA, 12 nt, Human
cucuggccuucg

SEQ ID NO: 1855599 - RNA, 16 nt, Human
cucuggcagcucagag

SEQ ID NO: 1855600 - RNA, 15 nt, Human
cucuggcagcucaga

SEQ ID NO: 1855601 - RNA, 19 nt, Human
cucuggccuucggccucca

SEQ ID NO: 1855602 - RNA, 16 nt, Human
cucuggcuccagcugg

SEQ ID NO: 1855603 - RNA, 15 nt, Human
cucuggcuccagcug

SEQ ID NO: 1855604 - RNA, 19 nt, Human
cucuggagcccacuguacu

SEQ ID NO: 1855605 - RNA, 16 nt, Human
cucuggacaggcaugu

SEQ ID NO: 1855606 - RNA, 22 nt, Human
cucuggacaggcauguucucug

SEQ ID NO: 1855607 - RNA, 14 nt, Human
cucuggcagcucag

SEQ ID NO: 1855608 - RNA, 12 nt, Human
cucuggcagcuc

SEQ ID NO: 1855609 - RNA, 19 nt, Human
cucugugucagguggggca

SEQ ID NO: 1855610 - RNA, 15 nt, Human
cucugugucaggugg

SEQ ID NO: 1855611 - RNA, 15 nt, Human
cucuuagaaaaacca

SEQ ID NO: 1855612 - RNA, 13 nt, Human
cucuuagaaaaac

SEQ ID NO: 1855613 - RNA, 15 nt, Human
cucuuccaggcuggg

SEQ ID NO: 1855614 - RNA, 14 nt, Human
cucuuccaggcugg

SEQ ID NO: 1855615 - RNA, 13 nt, Human
cucuuccaggcug

SEQ ID NO: 1855616 - RNA, 22 nt, Human
cucuggcuccagcuggccggga

SEQ ID NO: 1855617 - RNA, 19 nt, Human
cugaaagcccugagcuuuc

SEQ ID NO: 1855618 - RNA, 18 nt, Human
cugaaagcccugagcuuu

SEQ ID NO: 1855619 - RNA, 17 nt, Human
cugaaagcccugagcuu

SEQ ID NO: 1855620 - RNA, 16 nt, Human
cugaaagcccugagcu

SEQ ID NO: 1855621 - RNA, 23 nt, Human
cugaaagcccugagcuuucugcu

SEQ ID NO: 1855622 - RNA, 22 nt, Human
cugaaauagacccacaagaggc

SEQ ID NO: 1855623 - RNA, 17 nt, Human
cucuuucuauuguuucu

SEQ ID NO: 1855624 - RNA, 15 nt, Human
cugaaagcccugagc

SEQ ID NO: 1855625 - RNA, 19 nt, Human
cugaagaauugaaaaacca

SEQ ID NO: 1855626 - RNA, 17 nt, Human
cugaacucugacaacag

SEQ ID NO: 1855627 - RNA, 16 nt, Human
cugaacucugacaaca

SEQ ID NO: 1855628 - RNA, 17 nt, Human
cucuugguccugcugca

SEQ ID NO: 1855629 - RNA, 16 nt, Human
cucuugguccugcugc

SEQ ID NO: 1855630 - RNA, 15 nt, Human
cucuugguccugcug

SEQ ID NO: 1855631 - RNA, 13 nt, Human
cucuugguccugc

SEQ ID NO: 1855632 - RNA, 18 nt, Human
cucuuuaaugucacaggc

SEQ ID NO: 1855633 - RNA, 17 nt, Human
cucuuucccucccuucc

SEQ ID NO: 1855634 - RNA, 13 nt, Human
cucuuucccuccc

SEQ ID NO: 1855635 - RNA, 20 nt, Human
cucuuuaaugucacaggcag

SEQ ID NO: 1855636 - RNA, 21 nt, Human
cucuuuaaugucacaggcagg

SEQ ID NO: 1855637 - RNA, 22 nt, Human
cucuuuaaugucacaggcaggu

SEQ ID NO: 1855638 - RNA, 23 nt, Human
cucuuuaaugucacaggcagguc

SEQ ID NO: 1855639 - RNA, 22 nt, Human
cucuugaaauauaggaacuuaa

SEQ ID NO: 1855640 - RNA, 19 nt, Human
cucuuggguucaagugauu

SEQ ID NO: 1855641 - RNA, 21 nt, Human
cucuuggguucaagcgauucu

SEQ ID NO: 1855642 - RNA, 15 nt, Human
cucuugaacuccuga

SEQ ID NO: 1855643 - RNA, 19 nt, Human
cucuuggguucaagcgauu

SEQ ID NO: 1855644 - RNA, 14 nt, Human
cuggcaagaaugug

SEQ ID NO: 1855645 - RNA, 18 nt, Human
cuggaauauauaaccagu

SEQ ID NO: 1855646 - RNA, 20 nt, Human
cuggaagugcuaauuuugaa

SEQ ID NO: 1855647 - RNA, 16 nt, Human
cuggcacagggcagug

SEQ ID NO: 1855648 - RNA, 15 nt, Human
cuggcacagggcagu

SEQ ID NO: 1855649 - RNA, 16 nt, Human
cuggcacccggccccu

SEQ ID NO: 1855650 - RNA, 17 nt, Human
cuggcacccggccccug

SEQ ID NO: 1855651 - RNA, 18 nt, Human
cuggcacccggccccugc

SEQ ID NO: 1855652 - RNA, 24 nt, Human
cuggcaugggaaugaaugucagug

SEQ ID NO: 1855653 - RNA, 22 nt, Human
cuggcaugggaaugaaugucag

SEQ ID NO: 1855654 - RNA, 19 nt, Human
cuggcaugggaaugaaugu

SEQ ID NO: 1855655 - RNA, 18 nt, Human
cuggcaugggaaugaaug

SEQ ID NO: 1855656 - RNA, 16 nt, Human
cuggcaugggaaugaa

SEQ ID NO: 1855657 - RNA, 16 nt, Human
cuggcacuauaaugua

SEQ ID NO: 1855658 - RNA, 15 nt, Human
cuggcacuauaaugu

SEQ ID NO: 1855659 - RNA, 22 nt, Human
cuggcacuauaauguaagcucu

SEQ ID NO: 1855660 - RNA, 16 nt, Human
cuggccuucggccucc

SEQ ID NO: 1855661 - RNA, 17 nt, Human
cuggccuucggccucca

SEQ ID NO: 1855662 - RNA, 18 nt, Human
cuggccuucggccuccau

SEQ ID NO: 1855663 - RNA, 21 nt, Human
cuggccuucggccuccauccu

SEQ ID NO: 1855664 - RNA, 15 nt, Human
cuggccuucggccuc

SEQ ID NO: 1855665 - RNA, 19 nt, Human
cuggccuggccccucaggg

SEQ ID NO: 1855666 - RNA, 17 nt, Human
cuggccuggccccucag

SEQ ID NO: 1855667 - RNA, 16 nt, Human
cuggccuggccccuca

SEQ ID NO: 1855668 - RNA, 16 nt, Human
cuggccugagcuggga

SEQ ID NO: 1855669 - RNA, 16 nt, Human
cuggccucugcacucc

SEQ ID NO: 1855670 - RNA, 14 nt, Human
cuggccucugcacu

SEQ ID NO: 1855671 - RNA, 13 nt, Human
cuggccucugcac

SEQ ID NO: 1855672 - RNA, 18 nt, Human
cuggccugagcugggaug

SEQ ID NO: 1855673 - RNA, 15 nt, Human
cuggccugagcuggg

SEQ ID NO: 1855674 - RNA, 14 nt, Human
cuggccuggccccu

SEQ ID NO: 1855675 - RNA, 12 nt, Human
cuggccucugca

SEQ ID NO: 1855676 - RNA, 23 nt, Human
cuggccucaagugauucuccugc

SEQ ID NO: 1855677 - RNA, 21 nt, Human
cugggaggucaaggcugcagu

SEQ ID NO: 1855678 - RNA, 19 nt, Human
cugggaggucaaggcugca

SEQ ID NO: 1855679 - RNA, 22 nt, Human
cugggaggcucuggagcccacu

SEQ ID NO: 1855680 - RNA, 17 nt, Human
cugggaggcucuggagc

SEQ ID NO: 1855681 - RNA, 21 nt, Human
cugggaggcucuggagcccac

SEQ ID NO: 1855682 - RNA, 20 nt, Human
cugggaggcucuggagccca

SEQ ID NO: 1855683 - RNA, 18 nt, Human
cugggaggcucuggagcc

SEQ ID NO: 1855684 - RNA, 19 nt, Human
cugggccccaguuguauuu

SEQ ID NO: 1855685 - RNA, 15 nt, Human
cugggccccaguugu

SEQ ID NO: 1855686 - RNA, 18 nt, Human
cugggaugauuggagggg

SEQ ID NO: 1855687 - RNA, 20 nt, Human
cugggaucacauguggacuu

SEQ ID NO: 1855688 - RNA, 20 nt, Human
cugggaucccucauccucau

SEQ ID NO: 1855689 - RNA, 18 nt, Human
cugggauuacagguguga

SEQ ID NO: 1855690 - RNA, 16 nt, Human
cugggauuacaggugu

SEQ ID NO: 1855691 - RNA, 20 nt, Human
cugggauuacaggugugaac

SEQ ID NO: 1855692 - RNA, 17 nt, Human
cugggauuacaggugug

SEQ ID NO: 1855693 - RNA, 20 nt, Human
cugggagagccuuccagggg

SEQ ID NO: 1855694 - RNA, 19 nt, Human
cugggagagccuuccaggg

SEQ ID NO: 1855695 - RNA, 21 nt, Human
cugggagagccuuccaggggu

SEQ ID NO: 1855696 - RNA, 18 nt, Human
cugggagagccuuccagg

SEQ ID NO: 1855697 - RNA, 17 nt, Human
cugggagagccuuccag

SEQ ID NO: 1855698 - RNA, 23 nt, Human
cuggcuuuucacugcuggcugcc

SEQ ID NO: 1855699 - RNA, 18 nt, Human
cuggcuguuggcuggggg

SEQ ID NO: 1855700 - RNA, 20 nt, Human
cuggcugguuagagguuccc

SEQ ID NO: 1855701 - RNA, 16 nt, Human
cuggcuguuggcuggg

SEQ ID NO: 1855702 - RNA, 17 nt, Human
cuggcuguuggcugggg

SEQ ID NO: 1855703 - RNA, 13 nt, Human
cuggcugucgaga

SEQ ID NO: 1855704 - RNA, 18 nt, Human
cuguaaggcaaucauggu

SEQ ID NO: 1855705 - RNA, 23 nt, Human
cugguuaauauuuauaggucacu

SEQ ID NO: 1855706 - RNA, 20 nt, Human
cugguucaggguuggccccu

SEQ ID NO: 1855707 - RNA, 16 nt, Human
cuggucucgaacuccu

SEQ ID NO: 1855708 - RNA, 12 nt, Human
cugguggcagcu

SEQ ID NO: 1855709 - RNA, 14 nt, Human
cugguggcagcuca

SEQ ID NO: 1855710 - RNA, 13 nt, Human
cugguggcagcuc

SEQ ID NO: 1855711 - RNA, 16 nt, Human
cugguggcagcucacc

SEQ ID NO: 1855712 - RNA, 23 nt, Human
cuguacagagcccacgcccccac

SEQ ID NO: 1855713 - RNA, 21 nt, Human
cuguaauuugugauacaaugc

SEQ ID NO: 1855714 - RNA, 22 nt, Human
cuguaauuugugauacaaugcu

SEQ ID NO: 1855715 - RNA, 18 nt, Human
cuguaauuugugauacaa

SEQ ID NO: 1855716 - RNA, 17 nt, Human
cuguaauuugugauaca

SEQ ID NO: 1855717 - RNA, 21 nt, Human
cuguaccucuugagccuugaa

SEQ ID NO: 1855718 - RNA, 22 nt, Human
cuguacaugaaaacacauuuuu

SEQ ID NO: 1855719 - RNA, 23 nt, Human
cuguacaugaaaacacauuuuuc

SEQ ID NO: 1855720 - RNA, 22 nt, Human
cugggucgcccuggacugugug

SEQ ID NO: 1855721 - RNA, 18 nt, Human
cugggucgcccuggacug

SEQ ID NO: 1855722 - RNA, 17 nt, Human
cugggucgcccuggacu

SEQ ID NO: 1855723 - RNA, 15 nt, Human
cuggguuggagggug

SEQ ID NO: 1855724 - RNA, 22 nt, Human
cugggcucccuucccaccucuc

SEQ ID NO: 1855725 - RNA, 21 nt, Human
cugggcucccuucccaccucu

SEQ ID NO: 1855726 - RNA, 20 nt, Human
cugggcucccuucccaccuc

SEQ ID NO: 1855727 - RNA, 19 nt, Human
cuggguacuuguggacaca

SEQ ID NO: 1855728 - RNA, 18 nt, Human
cuggguacuuguggacac

SEQ ID NO: 1855729 - RNA, 16 nt, Human
cuggguacuuguggac

SEQ ID NO: 1855730 - RNA, 14 nt, Human
cuggguacuugugg

SEQ ID NO: 1855731 - RNA, 23 nt, Human
cuggucacaggacucugccuccu

SEQ ID NO: 1855732 - RNA, 22 nt, Human
cuggucacaggacucugccucc

SEQ ID NO: 1855733 - RNA, 21 nt, Human
cuggucacaggacucugccuc

SEQ ID NO: 1855734 - RNA, 20 nt, Human
cuggucacaggacucugccu

SEQ ID NO: 1855735 - RNA, 19 nt, Human
cuggucacaggacucugcc

SEQ ID NO: 1855736 - RNA, 23 nt, Human
cuggucucaaacucuugaccuca

SEQ ID NO: 1855737 - RNA, 14 nt, Human
cuggucccacucag

SEQ ID NO: 1855738 - RNA, 13 nt, Human
cuggucccacuca

SEQ ID NO: 1855739 - RNA, 14 nt, Human
cugucccccugaca

SEQ ID NO: 1855740 - RNA, 13 nt, Human
cugucccccugac

SEQ ID NO: 1855741 - RNA, 16 nt, Human
cuguccuacucugugu

SEQ ID NO: 1855742 - RNA, 17 nt, Human
cuguccuacucuguguc

SEQ ID NO: 1855743 - RNA, 18 nt, Human
cuguccuacucuguguca

SEQ ID NO: 1855744 - RNA, 20 nt, Human
cuguccuacucugugucagg

SEQ ID NO: 1855745 - RNA, 21 nt, Human
cugucucaagagggcacuggu

SEQ ID NO: 1855746 - RNA, 20 nt, Human
cugucucaagagggcacugg

SEQ ID NO: 1855747 - RNA, 19 nt, Human
cugucucaagagggcacug

SEQ ID NO: 1855748 - RNA, 18 nt, Human
cugucucaagagggcacu

SEQ ID NO: 1855749 - RNA, 22 nt, Human
cugucucaaaaaaagaaaaaga

SEQ ID NO: 1855750 - RNA, 21 nt, Human
cuguccuacucugugucaggu

SEQ ID NO: 1855751 - RNA, 18 nt, Human
cugucucuacuaaaaaua

SEQ ID NO: 1855752 - RNA, 19 nt, Human
cuguccaggcacugcugcc

SEQ ID NO: 1855753 - RNA, 18 nt, Human
cuguccaggcacugcugc

SEQ ID NO: 1855754 - RNA, 22 nt, Human
cuguccaggcacugcugcccag

SEQ ID NO: 1855755 - RNA, 21 nt, Human
cuguccaggcacugcugccca

SEQ ID NO: 1855756 - RNA, 20 nt, Human
cuguccaggcacugcugccc

SEQ ID NO: 1855757 - RNA, 22 nt, Human
cugucccagugccgagaaggaa

SEQ ID NO: 1855758 - RNA, 22 nt, Human
cuguaccucuugagccuugaac

SEQ ID NO: 1855759 - RNA, 14 nt, Human
cuguaucccaugag

SEQ ID NO: 1855760 - RNA, 15 nt, Human
cuguaucccaugagc

SEQ ID NO: 1855761 - RNA, 20 nt, Human
cuguaugucucgugguagga

SEQ ID NO: 1855762 - RNA, 19 nt, Human
cuguaucccaugagccuca

SEQ ID NO: 1855763 - RNA, 18 nt, Human
cuguaucccaugagccuc

SEQ ID NO: 1855764 - RNA, 13 nt, Human
cugcugcaguugc

SEQ ID NO: 1855765 - RNA, 10 nt, Human
cugcugcagu

SEQ ID NO: 1855766 - RNA, 14 nt, Human
cugcugcaguugcc

SEQ ID NO: 1855767 - RNA, 15 nt, Human
cugcugcaguugcca

SEQ ID NO: 1855768 - RNA, 23 nt, Human
cugcugccugcuuuuuauggccu

SEQ ID NO: 1855769 - RNA, 14 nt, Human
cugcugccugcuuu

SEQ ID NO: 1855770 - RNA, 19 nt, Human
cugcucuugaacuccugac

SEQ ID NO: 1855771 - RNA, 18 nt, Human
cugcucuugaacuccuga

SEQ ID NO: 1855772 - RNA, 16 nt, Human
cugcucuugaacuccu

SEQ ID NO: 1855773 - RNA, 12 nt, Human
cugcucugguua

SEQ ID NO: 1855774 - RNA, 20 nt, Human
cugcucugaugaagaggagu

SEQ ID NO: 1855775 - RNA, 23 nt, Human
cugcggugcuaucucccccagcc

SEQ ID NO: 1855776 - RNA, 22 nt, Human
cugcggugcuaucucccccagc

SEQ ID NO: 1855777 - RNA, 21 nt, Human
cugcggugcuaucucccccag

SEQ ID NO: 1855778 - RNA, 20 nt, Human
cugcggugcuaucuccccca

SEQ ID NO: 1855779 - RNA, 23 nt, Human
cugcuccucuccccagcaaguga

SEQ ID NO: 1855780 - RNA, 19 nt, Human
cugcuccucuccccagcaa

SEQ ID NO: 1855781 - RNA, 20 nt, Human
cugcuccucuccccagcaag

SEQ ID NO: 1855782 - RNA, 15 nt, Human
cugcucuccgaccag

SEQ ID NO: 1855783 - RNA, 22 nt, Human
cugccugcuuuuuauggccugu

SEQ ID NO: 1855784 - RNA, 21 nt, Human
cugcgggucacaggagggagg

SEQ ID NO: 1855785 - RNA, 15 nt, Human
cugcgggucacagga

SEQ ID NO: 1855786 - RNA, 19 nt, Human
cugcggugcuaucuccccc

SEQ ID NO: 1855787 - RNA, 18 nt, Human
cugcggugcuaucucccc

SEQ ID NO: 1855788 - RNA, 23 nt, Human
cugcgggucacaggagggagggg

SEQ ID NO: 1855789 - RNA, 22 nt, Human
cugcgggucacaggagggaggg

SEQ ID NO: 1855790 - RNA, 23 nt, Human
cugcgguccacccaggagccccg

SEQ ID NO: 1855791 - RNA, 21 nt, Human
cugccugcaguacuuuaccuc

SEQ ID NO: 1855792 - RNA, 20 nt, Human
cugccugcaguacuuuaccu

SEQ ID NO: 1855793 - RNA, 23 nt, Human
cugccugaagucacacagugagu

SEQ ID NO: 1855794 - RNA, 19 nt, Human
cugccugaagucacacagu

SEQ ID NO: 1855795 - RNA, 17 nt, Human
cugcccugcccaccugg

SEQ ID NO: 1855796 - RNA, 20 nt, Human
cugcccugcccaccuggccu

SEQ ID NO: 1855797 - RNA, 21 nt, Human
cugcccugcccaccuggccuc

SEQ ID NO: 1855798 - RNA, 18 nt, Human
cugccugaagucacacag

SEQ ID NO: 1855799 - RNA, 16 nt, Human
cugccugaagucacac

SEQ ID NO: 1855800 - RNA, 20 nt, Human
cugcuugcuugcuuuuuaau

SEQ ID NO: 1855801 - RNA, 22 nt, Human
cugcuugaggcaacucaucuua

SEQ ID NO: 1855802 - RNA, 18 nt, Human
cugcuugggcuucauccu

SEQ ID NO: 1855803 - RNA, 17 nt, Human
cugcuugggcuucaucc

SEQ ID NO: 1855804 - RNA, 15 nt, Human
cugcuugggcuucau

SEQ ID NO: 1855805 - RNA, 13 nt, Human
cugcuugggcuuc

SEQ ID NO: 1855806 - RNA, 19 nt, Human
cugcuugugaaaggaaaga

SEQ ID NO: 1855807 - RNA, 19 nt, Human
cugcuugggcuucauccuc

SEQ ID NO: 1855808 - RNA, 19 nt, Human
cugcuuuugucuaugggac

SEQ ID NO: 1855809 - RNA, 17 nt, Human
cugcuuuuggucugugu

SEQ ID NO: 1855810 - RNA, 13 nt, Human
cugcuuuggaaau

SEQ ID NO: 1855811 - RNA, 16 nt, Human
cugcuuugggcugccc

SEQ ID NO: 1855812 - RNA, 17 nt, Human
cugcuuugggcugcccu

SEQ ID NO: 1855813 - RNA, 15 nt, Human
cugcuuuuggucugu

SEQ ID NO: 1855814 - RNA, 17 nt, Human
cugcuggguguggcgca

SEQ ID NO: 1855815 - RNA, 15 nt, Human
cugcuggguguggcg

SEQ ID NO: 1855816 - RNA, 14 nt, Human
cugcuggguguggc

SEQ ID NO: 1855817 - RNA, 14 nt, Human
cugcugcuggcugg

SEQ ID NO: 1855818 - RNA, 13 nt, Human
cugcuggcugccu

SEQ ID NO: 1855819 - RNA, 15 nt, Human
cugcuggcugccuua

SEQ ID NO: 1855820 - RNA, 14 nt, Human
cugcuggcugccuu

SEQ ID NO: 1855821 - RNA, 13 nt, Human
cugcugcuggcug

SEQ ID NO: 1855822 - RNA, 12 nt, Human
cugcugcuggcu

SEQ ID NO: 1855823 - RNA, 21 nt, Human
cugcuugaggcaacucaucuu

SEQ ID NO: 1855824 - RNA, 20 nt, Human
cugcuugaggcaacucaucu

SEQ ID NO: 1855825 - RNA, 13 nt, Human
cugcuugaggcaa

SEQ ID NO: 1855826 - RNA, 21 nt, Human
cugcccuaaugcgcaggcugg

SEQ ID NO: 1855827 - RNA, 20 nt, Human
cugcccuaaugcgcaggcug

SEQ ID NO: 1855828 - RNA, 22 nt, Human
cugcccuaaugcgcaggcuggc

SEQ ID NO: 1855829 - RNA, 20 nt, Human
cugcccggcaggguccuaga

SEQ ID NO: 1855830 - RNA, 13 nt, Human
cugcccggcaggg

SEQ ID NO: 1855831 - RNA, 19 nt, Human
cugccccuggcagccccug

SEQ ID NO: 1855832 - RNA, 18 nt, Human
cugccccuggcagccccu

SEQ ID NO: 1855833 - RNA, 15 nt, Human
cugccauuucugaga

SEQ ID NO: 1855834 - RNA, 12 nt, Human
cugcccaccugg

SEQ ID NO: 1855835 - RNA, 14 nt, Human
cugcccaggccccu

SEQ ID NO: 1855836 - RNA, 15 nt, Human
cugcccaggccccug

SEQ ID NO: 1855837 - RNA, 17 nt, Human
cugcccaggccugccug

SEQ ID NO: 1855838 - RNA, 16 nt, Human
cugcccaggccccugc

SEQ ID NO: 1855839 - RNA, 18 nt, Human
cugcccaggccccugcca

SEQ ID NO: 1855840 - RNA, 19 nt, Human
cugcccaggccccugccac

SEQ ID NO: 1855841 - RNA, 20 nt, Human
cugcccaggccccugccacc

SEQ ID NO: 1855842 - RNA, 22 nt, Human
cugccaggaagccagcaggcuc

SEQ ID NO: 1855843 - RNA, 15 nt, Human
cugccauccucccaa

SEQ ID NO: 1855844 - RNA, 21 nt, Human
cugccauccagguucagcuug

SEQ ID NO: 1855845 - RNA, 20 nt, Human
cugccaucucaccuccugcu

SEQ ID NO: 1855846 - RNA, 21 nt, Human
cugccaggaagccagcaggcu

SEQ ID NO: 1855847 - RNA, 20 nt, Human
cugccaggaagccagcaggc

SEQ ID NO: 1855848 - RNA, 14 nt, Human
cugccaggaagcca

SEQ ID NO: 1855849 - RNA, 13 nt, Human
cugccaggaagcc

SEQ ID NO: 1855850 - RNA, 21 nt, Human
cugccacccuggggagaaagu

SEQ ID NO: 1855851 - RNA, 12 nt, Human
cugccacccugg

SEQ ID NO: 1855852 - RNA, 14 nt, Human
cugccacccugggg

SEQ ID NO: 1855853 - RNA, 15 nt, Human
cugcauaugaaagga

SEQ ID NO: 1855854 - RNA, 20 nt, Human
cugcaucaagaugugacaug

SEQ ID NO: 1855855 - RNA, 17 nt, Human
cugcagcaauaaagcag

SEQ ID NO: 1855856 - RNA, 18 nt, Human
cugcaggucccuaauaaa

SEQ ID NO: 1855857 - RNA, 17 nt, Human
cugcaggucccuaauaa

SEQ ID NO: 1855858 - RNA, 16 nt, Human
cugcaggucccuaaua

SEQ ID NO: 1855859 - RNA, 15 nt, Human
cugcaggucccuaau

SEQ ID NO: 1855860 - RNA, 14 nt, Human
cugcaggucccuaa

SEQ ID NO: 1855861 - RNA, 13 nt, Human
cugcaggucccua

SEQ ID NO: 1855862 - RNA, 12 nt, Human
cugcaggucccu

SEQ ID NO: 1855863 - RNA, 11 nt, Human
cugcagguccc

SEQ ID NO: 1855864 - RNA, 23 nt, Human
cugcaggucccuaauaaagcugu

SEQ ID NO: 1855865 - RNA, 22 nt, Human
cugcaggucccuaauaaagcug

SEQ ID NO: 1855866 - RNA, 21 nt, Human
cugcaggucccuaauaaagcu

SEQ ID NO: 1855867 - RNA, 20 nt, Human
cugcaggucccuaauaaagc

SEQ ID NO: 1855868 - RNA, 19 nt, Human
cugcaggucccuaauaaag

SEQ ID NO: 1855869 - RNA, 16 nt, Human
cugcaguugccaguca

SEQ ID NO: 1855870 - RNA, 13 nt, Human
cugcaguugccag

SEQ ID NO: 1855871 - RNA, 21 nt, Human
cugcacuccccugcugggugu

SEQ ID NO: 1855872 - RNA, 13 nt, Human
cugcagagggcac

SEQ ID NO: 1855873 - RNA, 15 nt, Human
cugcagcaauaaagc

SEQ ID NO: 1855874 - RNA, 16 nt, Human
cugcagcaauaaagca

SEQ ID NO: 1855875 - RNA, 10 nt, Human
cugcagaggg

SEQ ID NO: 1855876 - RNA, 20 nt, Human
cugcacuccccugcugggug

SEQ ID NO: 1855877 - RNA, 19 nt, Human
cugcacuccccugcugggu

SEQ ID NO: 1855878 - RNA, 13 nt, Human
cugcacuccccug

SEQ ID NO: 1855879 - RNA, 14 nt, Human
cugcacuccccugc

SEQ ID NO: 1855880 - RNA, 20 nt, Human
cugcacuccagccuggguga

SEQ ID NO: 1855881 - RNA, 18 nt, Human
cugcaccgggccacagag

SEQ ID NO: 1855882 - RNA, 20 nt, Human
cugcaccgggccacagagaa

SEQ ID NO: 1855883 - RNA, 14 nt, Human
cugcaccggcuggc

SEQ ID NO: 1855884 - RNA, 23 nt, Human
cugaggcccuucucuccagcccc

SEQ ID NO: 1855885 - RNA, 22 nt, Human
cugaggcccuucucuccagccc

SEQ ID NO: 1855886 - RNA, 16 nt, Human
cugcaccggcuggccu

SEQ ID NO: 1855887 - RNA, 15 nt, Human
cugcaccggcuggcc

SEQ ID NO: 1855888 - RNA, 14 nt, Human
cugcaccgggccac

SEQ ID NO: 1855889 - RNA, 15 nt, Human
cugcaccgggccaca

SEQ ID NO: 1855890 - RNA, 21 nt, Human
cuuuccugaggcugggcuccc

SEQ ID NO: 1855891 - RNA, 20 nt, Human
cuuuccugaggcugggcucc

SEQ ID NO: 1855892 - RNA, 16 nt, Human
cuuuccugaggcuggg

SEQ ID NO: 1855893 - RNA, 17 nt, Human
cuuuccugaggcugggc

SEQ ID NO: 1855894 - RNA, 23 nt, Human
cuuuggaaagaguaggaagacuu

SEQ ID NO: 1855895 - RNA, 19 nt, Human
cuuuggaaagaguaggaag

SEQ ID NO: 1855896 - RNA, 14 nt, Human
cuuugcagacaggc

SEQ ID NO: 1855897 - RNA, 15 nt, Human
cuuugcagacaggca

SEQ ID NO: 1855898 - RNA, 19 nt, Human
cuuuauuuuguguuuagga

SEQ ID NO: 1855899 - RNA, 21 nt, Human
cuuguggacacagcucuucuc

SEQ ID NO: 1855900 - RNA, 21 nt, Human
cuuuccgguguuuaagacauu

SEQ ID NO: 1855901 - RNA, 21 nt, Human
cuuuccccaugucucgacuca

SEQ ID NO: 1855902 - RNA, 20 nt, Human
cuuuccccaugucucgacuc

SEQ ID NO: 1855903 - RNA, 15 nt, Human
cuuuccccaugucuc

SEQ ID NO: 1855904 - RNA, 16 nt, Human
cuuuccaaaguacacu

SEQ ID NO: 1855905 - RNA, 16 nt, Human
cuuuccaaaugcccag

SEQ ID NO: 1855906 - RNA, 22 nt, Human
cuuuccaaaguacacuguuuca

SEQ ID NO: 1855907 - RNA, 14 nt, Human
cuuuccaggaaggc

SEQ ID NO: 1855908 - RNA, 16 nt, Human
cuuuuuuauacauaaa

SEQ ID NO: 1855909 - RNA, 17 nt, Human
cuuuuuuauacauaaac

SEQ ID NO: 1855910 - RNA, 15 nt, Human
cuuuuuuauacauaa

SEQ ID NO: 1855911 - RNA, 16 nt, Human
gaaaaagaaaaaauau

SEQ ID NO: 1855912 - RNA, 11 nt, Human
gaaaaagaaaa

SEQ ID NO: 1855913 - RNA, 19 nt, Human
cuuuuuuaucaugugaaau

SEQ ID NO: 1855914 - RNA, 18 nt, Human
cuuuuuuauacauaaaca

SEQ ID NO: 1855915 - RNA, 22 nt, Human
cuuuuuaauauugauaugcuua

SEQ ID NO: 1855916 - RNA, 13 nt, Human
cuuuucuuuucuu

SEQ ID NO: 1855917 - RNA, 17 nt, Human
cuuuucuuucagccaag

SEQ ID NO: 1855918 - RNA, 18 nt, Human
cuuuuaaaacacuuccau

SEQ ID NO: 1855919 - RNA, 15 nt, Human
cuuuuaauccuggcu

SEQ ID NO: 1855920 - RNA, 23 nt, Human
cuuuuccaacccucaucaccaac

SEQ ID NO: 1855921 - RNA, 13 nt, Human
cuuuuccaacccu

SEQ ID NO: 1855922 - RNA, 22 nt, Human
cuuuucauuuaggugaggaagc

SEQ ID NO: 1855923 - RNA, 12 nt, Human
cuuuucacugcu

SEQ ID NO: 1855924 - RNA, 21 nt, Human
cuuuucgcaggauucuuccuc

SEQ ID NO: 1855925 - RNA, 20 nt, Human
cuuuucgcaggauucuuccu

SEQ ID NO: 1855926 - RNA, 16 nt, Human
cuuuucacugcuggcu

SEQ ID NO: 1855927 - RNA, 14 nt, Human
cuuuucccuucuuu

SEQ ID NO: 1855928 - RNA, 19 nt, Human
cuugaaauauaggaacuua

SEQ ID NO: 1855929 - RNA, 17 nt, Human
cuucuuuuuuugugaug

SEQ ID NO: 1855930 - RNA, 19 nt, Human
cuugaacuccuggccucaa

SEQ ID NO: 1855931 - RNA, 16 nt, Human
cuugaacuggguacuu

SEQ ID NO: 1855932 - RNA, 15 nt, Human
cuugaacuuugaccu

SEQ ID NO: 1855933 - RNA, 18 nt, Human
cuugaacuggguacuugu

SEQ ID NO: 1855934 - RNA, 20 nt, Human
cuugaacuggguacuugugg

SEQ ID NO: 1855935 - RNA, 14 nt, Human
cuugaacccgggag

SEQ ID NO: 1855936 - RNA, 19 nt, Human
cuugaacccgggaggcaga

SEQ ID NO: 1855937 - RNA, 20 nt, Human
cuugaacccgggaggcagag

SEQ ID NO: 1855938 - RNA, 14 nt, Human
cuugaacuccuggc

SEQ ID NO: 1855939 - RNA, 15 nt, Human
cuugaacuccuggcc

SEQ ID NO: 1855940 - RNA, 17 nt, Human
cuugaacuccuggccuc

SEQ ID NO: 1855941 - RNA, 18 nt, Human
cuugaacuccuggccuca

SEQ ID NO: 1855942 - RNA, 21 nt, Human
cuugaccauucuccaccugcc

SEQ ID NO: 1855943 - RNA, 14 nt, Human
cuugagagggugga

SEQ ID NO: 1855944 - RNA, 20 nt, Human
cuugaccauucuccaccugc

SEQ ID NO: 1855945 - RNA, 17 nt, Human
cuugaccauucuccacc

SEQ ID NO: 1855946 - RNA, 19 nt, Human
cuugagccuugaacuuuga

SEQ ID NO: 1855947 - RNA, 20 nt, Human
cuugagccuugaacuuugac

SEQ ID NO: 1855948 - RNA, 22 nt, Human
cuugagccuugaacuuugaccu

SEQ ID NO: 1855949 - RNA, 13 nt, Human
cuugagcucagga

SEQ ID NO: 1855950 - RNA, 22 nt, Human
cuugcaaaguaucccuacugua

SEQ ID NO: 1855951 - RNA, 19 nt, Human
cuugcacguauuuuaauag

SEQ ID NO: 1855952 - RNA, 14 nt, Human
cuugcaauggcagc

SEQ ID NO: 1855953 - RNA, 21 nt, Human
cuugcaugguuuagaaagcuu

SEQ ID NO: 1855954 - RNA, 21 nt, Human
cuugcaugaggcuaguguggu

SEQ ID NO: 1855955 - RNA, 18 nt, Human
cuugcagacucuacagag

SEQ ID NO: 1855956 - RNA, 13 nt, Human
cuuguauuaaguu

SEQ ID NO: 1855957 - RNA, 17 nt, Human
cuuguauuaaguuguua

SEQ ID NO: 1855958 - RNA, 13 nt, Human
cuuguauuaugug

SEQ ID NO: 1855959 - RNA, 22 nt, Human
cuuguauuaaguuguuaauaaa

SEQ ID NO: 1855960 - RNA, 23 nt, Human
cuuguauuaaguuguuaauaaaa

SEQ ID NO: 1855961 - RNA, 21 nt, Human
cuuguaugaaagauggcugug

SEQ ID NO: 1855962 - RNA, 18 nt, Human
cuuguauuauguguguuu

SEQ ID NO: 1855963 - RNA, 17 nt, Human
cuuguggacacagcucu

SEQ ID NO: 1855964 - RNA, 18 nt, Human
cuuguggacacagcucuu

SEQ ID NO: 1855965 - RNA, 14 nt, Human
cuuggcugcaggga

SEQ ID NO: 1855966 - RNA, 19 nt, Human
cuuggggaccagagcugcc

SEQ ID NO: 1855967 - RNA, 18 nt, Human
cuuggggaccagagcugc

SEQ ID NO: 1855968 - RNA, 17 nt, Human
cuuggggaccagagcug

SEQ ID NO: 1855969 - RNA, 16 nt, Human
cuuggggaccagagcu

SEQ ID NO: 1855970 - RNA, 18 nt, Human
cuuguaaaaauuaaaagu

SEQ ID NO: 1855971 - RNA, 18 nt, Human
cuuguaaaggaauuuaaa

SEQ ID NO: 1855972 - RNA, 14 nt, Human
cuuggauugucccc

SEQ ID NO: 1855973 - RNA, 13 nt, Human
cuuggauuguccc

SEQ ID NO: 1855974 - RNA, 24 nt, Human
cuuggcucacugcaacuucugccu

SEQ ID NO: 1855975 - RNA, 23 nt, Human
cuuggcucaaguccucuuuucug

SEQ ID NO: 1855976 - RNA, 12 nt, Human
cuuggcugcagg

SEQ ID NO: 1855977 - RNA, 13 nt, Human
cuuggcugcaggg

SEQ ID NO: 1855978 - RNA, 15 nt, Human
cuugcuuuuaaaauc

SEQ ID NO: 1855979 - RNA, 13 nt, Human
cuugcuugcuuuu

SEQ ID NO: 1855980 - RNA, 17 nt, Human
cuugccaaauauaaaua

SEQ ID NO: 1855981 - RNA, 17 nt, Human
gaacuuggcgcugcccc

SEQ ID NO: 1855982 - RNA, 14 nt, Human
gaacuuaaauaaug

SEQ ID NO: 1855983 - RNA, 17 nt, Human
gaacuuaaauaauguga

SEQ ID NO: 1855984 - RNA, 16 nt, Human
gaacucccuuucaaca

SEQ ID NO: 1855985 - RNA, 15 nt, Human
gaacuccuaaaucaa

SEQ ID NO: 1855986 - RNA, 13 nt, Human
gaacuccugaccu

SEQ ID NO: 1855987 - RNA, 16 nt, Human
gaacuccuaaaucaag

SEQ ID NO: 1855988 - RNA, 20 nt, Human
gaaccacaucuugcucugcu

SEQ ID NO: 1855989 - RNA, 18 nt, Human
gaaccacaucuugcucug

SEQ ID NO: 1855990 - RNA, 16 nt, Human
gaacuuugaccucugc

SEQ ID NO: 1855991 - RNA, 22 nt, Human
gaacuuugaccucugcagcaau

SEQ ID NO: 1855992 - RNA, 15 nt, Human
gaacuuguuuucugg

SEQ ID NO: 1855993 - RNA, 12 nt, Human
gaacuugguucc

SEQ ID NO: 1855994 - RNA, 17 nt, Human
gaacuuuccaggaaggc

SEQ ID NO: 1855995 - RNA, 17 nt, Human
gaacuugggccacugug

SEQ ID NO: 1855996 - RNA, 18 nt, Human
gaacuuggcgcugccccu

SEQ ID NO: 1855997 - RNA, 22 nt, Human
gaacuuguaaaggaauuuaaaa

SEQ ID NO: 1855998 - RNA, 19 nt, Human
gaagacuucaucccucugg

SEQ ID NO: 1855999 - RNA, 17 nt, Human
gaagacuucaucccucu

SEQ ID NO: 1856000 - RNA, 12 nt, Human
gaagagccuugc

SEQ ID NO: 1856001 - RNA, 16 nt, Human
gaagacuucaucccuc

SEQ ID NO: 1856002 - RNA, 15 nt, Human
gaagacuucaucccu

SEQ ID NO: 1856003 - RNA, 17 nt, Human
gaagauguagaggagaa

SEQ ID NO: 1856004 - RNA, 22 nt, Human
gaagauugagauguguucacaa

SEQ ID NO: 1856005 - RNA, 17 nt, Human
gaagauugagauguguu

SEQ ID NO: 1856006 - RNA, 23 nt, Human
gaagauuuugaaauuuuuauuaa

SEQ ID NO: 1856007 - RNA, 15 nt, Human
gaaggaacguccccu

SEQ ID NO: 1856008 - RNA, 22 nt, Human
gaaggaaacccagcucuggucc

SEQ ID NO: 1856009 - RNA, 21 nt, Human
gaaggaaacccagcucugguc

SEQ ID NO: 1856010 - RNA, 19 nt, Human
gaaggaagacuucaucccu

SEQ ID NO: 1856011 - RNA, 22 nt, Human
gaaggacccggaggggccuggc

SEQ ID NO: 1856012 - RNA, 22 nt, Human
gaaggaauaaauugcuccuuga

SEQ ID NO: 1856013 - RNA, 19 nt, Human
gaaggacauugcggacagc

SEQ ID NO: 1856014 - RNA, 20 nt, Human
gaaggacauugcggacagcc

SEQ ID NO: 1856015 - RNA, 21 nt, Human
gaaggacauugcggacagcca

SEQ ID NO: 1856016 - RNA, 20 nt, Human
gaaggaaacccagcucuggu

SEQ ID NO: 1856017 - RNA, 19 nt, Human
gaaggaaacccagcucugg

SEQ ID NO: 1856018 - RNA, 14 nt, Human
gaagccgcuggggc

SEQ ID NO: 1856019 - RNA, 20 nt, Human
gaagccgcuggggccaguug

SEQ ID NO: 1856020 - RNA, 18 nt, Human
gaagccgcuggggccagu

SEQ ID NO: 1856021 - RNA, 21 nt, Human
gaagccgcuggggccaguugg

SEQ ID NO: 1856022 - RNA, 15 nt, Human
gaagucacugcacag

SEQ ID NO: 1856023 - RNA, 21 nt, Human
gaaggugaggagcuugaaacc

SEQ ID NO: 1856024 - RNA, 19 nt, Human
gaaguaauaugcacacauu

SEQ ID NO: 1856025 - RNA, 20 nt, Human
gaaguaauaugcacacauuu

SEQ ID NO: 1856026 - RNA, 21 nt, Human
gaaguaauaugcacacauuuu

SEQ ID NO: 1856027 - RNA, 13 nt, Human
gaagucacacagu

SEQ ID NO: 1856028 - RNA, 18 nt, Human
gaaggcagggagggccug

SEQ ID NO: 1856029 - RNA, 23 nt, Human
gaaggcagggagggccugggccc

SEQ ID NO: 1856030 - RNA, 22 nt, Human
gaaggcagggagggccugggcc

SEQ ID NO: 1856031 - RNA, 20 nt, Human
gaaggcagggagggccuggg

SEQ ID NO: 1856032 - RNA, 15 nt, Human
gaagggggcugggac

SEQ ID NO: 1856033 - RNA, 13 nt, Human
gaagggggcuggg

SEQ ID NO: 1856034 - RNA, 19 nt, Human
gaaaugggcagagcagaga

SEQ ID NO: 1856035 - RNA, 17 nt, Human
gaaaugggcagagcaga

SEQ ID NO: 1856036 - RNA, 17 nt, Human
gaaauguacagcaagga

SEQ ID NO: 1856037 - RNA, 11 nt, Human
gaaaugagcug

SEQ ID NO: 1856038 - RNA, 18 nt, Human
gaaaugaggucagagccu

SEQ ID NO: 1856039 - RNA, 15 nt, Human
gaaaugggcagagca

SEQ ID NO: 1856040 - RNA, 16 nt, Human
gaaaugggcagagcag

SEQ ID NO: 1856041 - RNA, 17 nt, Human
gaaauauaggaacuuaa

SEQ ID NO: 1856042 - RNA, 19 nt, Human
gaaauaucugaaaauguau

SEQ ID NO: 1856043 - RNA, 18 nt, Human
gaaauaucugaaaaugua

SEQ ID NO: 1856044 - RNA, 20 nt, Human
gaaauaucugaaaauguaug

SEQ ID NO: 1856045 - RNA, 22 nt, Human
gaacagacuggaagcacagcuu

SEQ ID NO: 1856046 - RNA, 23 nt, Human
gaaauuaguacuccccuccuuga

SEQ ID NO: 1856047 - RNA, 20 nt, Human
gaaauuuccacucaggucug

SEQ ID NO: 1856048 - RNA, 19 nt, Human
gaaauuuccacucaggucu

SEQ ID NO: 1856049 - RNA, 16 nt, Human
gaacacuccuucacag

SEQ ID NO: 1856050 - RNA, 15 nt, Human
gaacacuccuucaca

SEQ ID NO: 1856051 - RNA, 17 nt, Human
gaacacuccuucacaga

SEQ ID NO: 1856052 - RNA, 20 nt, Human
gaacagacuggaagcacagc

SEQ ID NO: 1856053 - RNA, 19 nt, Human
gaacagacuggaagcacag

SEQ ID NO: 1856054 - RNA, 13 nt, Human
gaaagcagaacag

SEQ ID NO: 1856055 - RNA, 14 nt, Human
gaaagcagaacagu

SEQ ID NO: 1856056 - RNA, 23 nt, Human
gaaagauggcugugccucugccu

SEQ ID NO: 1856057 - RNA, 16 nt, Human
gaaagaucaaaagguu

SEQ ID NO: 1856058 - RNA, 22 nt, Human
gaaagauggcugugccucugcc

SEQ ID NO: 1856059 - RNA, 17 nt, Human
gaaagacuguacaaagu

SEQ ID NO: 1856060 - RNA, 16 nt, Human
gaaaaaugagccuggc

SEQ ID NO: 1856061 - RNA, 20 nt, Human
gaaacuaggugcauauuuau

SEQ ID NO: 1856062 - RNA, 16 nt, Human
gaaaguuuacaggaaa

SEQ ID NO: 1856063 - RNA, 14 nt, Human
gaaaguuuacagga

SEQ ID NO: 1856064 - RNA, 13 nt, Human
gaaaguucaugcu

SEQ ID NO: 1856065 - RNA, 21 nt, Human
gaaagcuugcccuggugccuc

SEQ ID NO: 1856066 - RNA, 16 nt, Human
gaaaggaaagaggcuc

SEQ ID NO: 1856067 - RNA, 11 nt, Human
gaaaggaaaga

SEQ ID NO: 1856068 - RNA, 13 nt, Human
gagcccaccuugg

SEQ ID NO: 1856069 - RNA, 15 nt, Human
gagcccaccuuggcu

SEQ ID NO: 1856070 - RNA, 17 nt, Human
gagcccaccuuggcuca

SEQ ID NO: 1856071 - RNA, 18 nt, Human
gagccacugcaccgggcc

SEQ ID NO: 1856072 - RNA, 19 nt, Human
gagccacugcaccgggcca

SEQ ID NO: 1856073 - RNA, 19 nt, Human
gagccagauuucacucucc

SEQ ID NO: 1856074 - RNA, 18 nt, Human
gagccagauuucacucuc

SEQ ID NO: 1856075 - RNA, 15 nt, Human
gagccagauuucacu

SEQ ID NO: 1856076 - RNA, 20 nt, Human
gagccacugcaccgggccac

SEQ ID NO: 1856077 - RNA, 21 nt, Human
gagcagagaccaucccugaag

SEQ ID NO: 1856078 - RNA, 19 nt, Human
gagcagagaccaucccuga

SEQ ID NO: 1856079 - RNA, 23 nt, Human
gagcagagaccaucccugaaggc

SEQ ID NO: 1856080 - RNA, 21 nt, Human
gagcagccacauuccugaugc

SEQ ID NO: 1856081 - RNA, 22 nt, Human
gagcagccacauuccugaugcu

SEQ ID NO: 1856082 - RNA, 16 nt, Human
gagcagagaccauccc

SEQ ID NO: 1856083 - RNA, 18 nt, Human
gagcagagaccaucccug

SEQ ID NO: 1856084 - RNA, 17 nt, Human
gagcagagaccaucccu

SEQ ID NO: 1856085 - RNA, 21 nt, Human
gagauagccaaggccaaagga

SEQ ID NO: 1856086 - RNA, 20 nt, Human
gagauagccaaggccaaagg

SEQ ID NO: 1856087 - RNA, 13 nt, Human
gagccuccugccc

SEQ ID NO: 1856088 - RNA, 12 nt, Human
gagccugcaguu

SEQ ID NO: 1856089 - RNA, 13 nt, Human
gagccucagcauc

SEQ ID NO: 1856090 - RNA, 19 nt, Human
gagccucagucucccuccc

SEQ ID NO: 1856091 - RNA, 17 nt, Human
gagccucagcauccugg

SEQ ID NO: 1856092 - RNA, 14 nt, Human
gagccucagcaucc

SEQ ID NO: 1856093 - RNA, 15 nt, Human
gagccucagcauccu

SEQ ID NO: 1856094 - RNA, 21 nt, Human
gagccgagaucacgccacugc

SEQ ID NO: 1856095 - RNA, 22 nt, Human
gagccgagaucacgccacugca

SEQ ID NO: 1856096 - RNA, 18 nt, Human
gagcccacgcccccacug

SEQ ID NO: 1856097 - RNA, 21 nt, Human
gagcccacuguacuugcucuu

SEQ ID NO: 1856098 - RNA, 18 nt, Human
gagcccacuguacuugcu

SEQ ID NO: 1856099 - RNA, 19 nt, Human
gagccgagaucacgccacu

SEQ ID NO: 1856100 - RNA, 20 nt, Human
gagccgagaucacgccacug

SEQ ID NO: 1856101 - RNA, 15 nt, Human
gagccugcaguuauu

SEQ ID NO: 1856102 - RNA, 17 nt, Human
gagcuagcagcagggag

SEQ ID NO: 1856103 - RNA, 15 nt, Human
gagcuagcagcaggg

SEQ ID NO: 1856104 - RNA, 15 nt, Human
gagcugaguggggga

SEQ ID NO: 1856105 - RNA, 22 nt, Human
gagcuugaaacccguggcgcuu

SEQ ID NO: 1856106 - RNA, 22 nt, Human
gagcuuucugcuaucaaagagg

SEQ ID NO: 1856107 - RNA, 20 nt, Human
gagcuuugaaaauucagugg

SEQ ID NO: 1856108 - RNA, 23 nt, Human
gaggaaaaccaagccguggcuuc

SEQ ID NO: 1856109 - RNA, 21 nt, Human
gaggaaaaccaagccguggcu

SEQ ID NO: 1856110 - RNA, 20 nt, Human
gaggaaaaccaagccguggc

SEQ ID NO: 1856111 - RNA, 17 nt, Human
gaggaaagcaaaggaga

SEQ ID NO: 1856112 - RNA, 16 nt, Human
gaggaaagcaaaggag

SEQ ID NO: 1856113 - RNA, 18 nt, Human
gaggaagccgcuggggcc

SEQ ID NO: 1856114 - RNA, 17 nt, Human
gaggaagccgcuggggc

SEQ ID NO: 1856115 - RNA, 14 nt, Human
gaggaagccgcugg

SEQ ID NO: 1856116 - RNA, 13 nt, Human
gaggaagccgcug

SEQ ID NO: 1856117 - RNA, 17 nt, Human
gaggaagagaaaaaaua

SEQ ID NO: 1856118 - RNA, 16 nt, Human
gaggaacaaggcaagg

SEQ ID NO: 1856119 - RNA, 14 nt, Human
gaggaacaaggcaa

SEQ ID NO: 1856120 - RNA, 21 nt, Human
gagaaugcacaaacagaggcc

SEQ ID NO: 1856121 - RNA, 20 nt, Human
gagaaugcacaaacagaggc

SEQ ID NO: 1856122 - RNA, 22 nt, Human
gagaaugcacaaacagaggccg

SEQ ID NO: 1856123 - RNA, 17 nt, Human
gagacacaagccuucgg

SEQ ID NO: 1856124 - RNA, 15 nt, Human
gagacacaagccuuc

SEQ ID NO: 1856125 - RNA, 12 nt, Human
gagacagcccgg

SEQ ID NO: 1856126 - RNA, 16 nt, Human
gagacagccaacuaug

SEQ ID NO: 1856127 - RNA, 19 nt, Human
gagacagaguuuucacucu

SEQ ID NO: 1856128 - RNA, 14 nt, Human
gagaaauuuauaaa

SEQ ID NO: 1856129 - RNA, 12 nt, Human
gagaaaugaaaa

SEQ ID NO: 1856130 - RNA, 23 nt, Human
gagaaaguacuucuccacccugc

SEQ ID NO: 1856131 - RNA, 16 nt, Human
gagaaacagccugugu

SEQ ID NO: 1856132 - RNA, 18 nt, Human
gacucgcgacaaugcaaa

SEQ ID NO: 1856133 - RNA, 17 nt, Human
gacuccugcaggcagcc

SEQ ID NO: 1856134 - RNA, 19 nt, Human
gacucgcgacaaugcaaac

SEQ ID NO: 1856135 - RNA, 14 nt, Human
gacuuggaagcucc

SEQ ID NO: 1856136 - RNA, 15 nt, Human
gacuuggaagcuccg

SEQ ID NO: 1856137 - RNA, 16 nt, Human
gacuuggaagcuccgc

SEQ ID NO: 1856138 - RNA, 21 nt, Human
gagaaaauggacguguuauga

SEQ ID NO: 1856139 - RNA, 19 nt, Human
gacuugugacgguguaccu

SEQ ID NO: 1856140 - RNA, 15 nt, Human
gagacagcucugcau

SEQ ID NO: 1856141 - RNA, 18 nt, Human
gagacagcucugcauacu

SEQ ID NO: 1856142 - RNA, 13 nt, Human
gagacagcucugc

SEQ ID NO: 1856143 - RNA, 24 nt, Human
gagacagcccgggcucugccuccc

SEQ ID NO: 1856144 - RNA, 23 nt, Human
gagacagcccgggcucugccucc

SEQ ID NO: 1856145 - RNA, 22 nt, Human
gagacagcccgggcucugccuc

SEQ ID NO: 1856146 - RNA, 21 nt, Human
gagacagcccgggcucugccu

SEQ ID NO: 1856147 - RNA, 20 nt, Human
gagacagcccgggcucugcc

SEQ ID NO: 1856148 - RNA, 19 nt, Human
gagacagcccgggcucugc

SEQ ID NO: 1856149 - RNA, 18 nt, Human
gagacagcccgggcucug

SEQ ID NO: 1856150 - RNA, 17 nt, Human
gagacagcccgggcucu

SEQ ID NO: 1856151 - RNA, 14 nt, Human
gagacagcccgggc

SEQ ID NO: 1856152 - RNA, 22 nt, Human
gagacuccugcaggcagccagg

SEQ ID NO: 1856153 - RNA, 18 nt, Human
gagacucgcgacaaugca

SEQ ID NO: 1856154 - RNA, 16 nt, Human
gagacucgcgacaaug

SEQ ID NO: 1856155 - RNA, 12 nt, Human
gagaccaucccu

SEQ ID NO: 1856156 - RNA, 13 nt, Human
gagacuuguauga

SEQ ID NO: 1856157 - RNA, 23 nt, Human
gagacugucucaagagggcacug

SEQ ID NO: 1856158 - RNA, 22 nt, Human
gagacugucucaagagggcacu

SEQ ID NO: 1856159 - RNA, 14 nt, Human
gagacucugucuca

SEQ ID NO: 1856160 - RNA, 17 nt, Human
gagagaagagaaugcac

SEQ ID NO: 1856161 - RNA, 14 nt, Human
gagagccuuccagg

SEQ ID NO: 1856162 - RNA, 13 nt, Human
gagagccuuccag

SEQ ID NO: 1856163 - RNA, 21 nt, Human
gagagggugggagugggccca

SEQ ID NO: 1856164 - RNA, 13 nt, Human
gagaggggaacag

SEQ ID NO: 1856165 - RNA, 18 nt, Human
gagaggggaacagacugg

SEQ ID NO: 1856166 - RNA, 15 nt, Human
gagagugaacaaauu

SEQ ID NO: 1856167 - RNA, 19 nt, Human
gagagugaacaaauuuaca

SEQ ID NO: 1856168 - RNA, 17 nt, Human
gagauacagaauuuuau

SEQ ID NO: 1856169 - RNA, 23 nt, Human
gacacccugugauggggcccugc

SEQ ID NO: 1856170 - RNA, 22 nt, Human
gacacccugugauggggcccug

SEQ ID NO: 1856171 - RNA, 17 nt, Human
gacaccuacugaguggc

SEQ ID NO: 1856172 - RNA, 13 nt, Human
gacacccugugau

SEQ ID NO: 1856173 - RNA, 12 nt, Human
gacacccuguga

SEQ ID NO: 1856174 - RNA, 17 nt, Human
gacacagugaccauacu

SEQ ID NO: 1856175 - RNA, 18 nt, Human
gacacaggcccggcucca

SEQ ID NO: 1856176 - RNA, 15 nt, Human
gacacgaauauugcu

SEQ ID NO: 1856177 - RNA, 18 nt, Human
gacaccuugacagggcac

SEQ ID NO: 1856178 - RNA, 20 nt, Human
gacaccuugacagggcacac

SEQ ID NO: 1856179 - RNA, 15 nt, Human
gacaccuugacaggg

SEQ ID NO: 1856180 - RNA, 17 nt, Human
gacaccuugacagggca

SEQ ID NO: 1856181 - RNA, 18 nt, Human
gacacgaauauugcugau

SEQ ID NO: 1856182 - RNA, 17 nt, Human
gacacgaauauugcuga

SEQ ID NO: 1856183 - RNA, 19 nt, Human
gacacgaauauugcugaug

SEQ ID NO: 1856184 - RNA, 15 nt, Human
gacacuaaccacgcu

SEQ ID NO: 1856185 - RNA, 16 nt, Human
gacacuaaccacgcug

SEQ ID NO: 1856186 - RNA, 17 nt, Human
gacacuaaccacgcugg

SEQ ID NO: 1856187 - RNA, 18 nt, Human
gacacuaaccacgcugga

SEQ ID NO: 1856188 - RNA, 17 nt, Human
gacaaugacuuacugua

SEQ ID NO: 1856189 - RNA, 20 nt, Human
gacaaugacuuacuguacau

SEQ ID NO: 1856190 - RNA, 12 nt, Human
gacaaugcaaac

SEQ ID NO: 1856191 - RNA, 21 nt, Human
gacaaugacuuacuguacaug

SEQ ID NO: 1856192 - RNA, 18 nt, Human
gacaaugcaaaccaucau

SEQ ID NO: 1856193 - RNA, 16 nt, Human
gacaaugcaaaccauc

SEQ ID NO: 1856194 - RNA, 12 nt, Human
gacaauuuauua

SEQ ID NO: 1856195 - RNA, 13 nt, Human
gacaauuuauuau

SEQ ID NO: 1856196 - RNA, 19 nt, Human
gacaauuuauuauggcaca

SEQ ID NO: 1856197 - RNA, 13 nt, Human
gacacacagcucu

SEQ ID NO: 1856198 - RNA, 15 nt, Human
gacacaggcccggcu

SEQ ID NO: 1856199 - RNA, 17 nt, Human
gacacaggcccggcucc

SEQ ID NO: 1856200 - RNA, 16 nt, Human
gacaaugacccagugg

SEQ ID NO: 1856201 - RNA, 16 nt, Human
gaagucuuuguacaga

SEQ ID NO: 1856202 - RNA, 14 nt, Human
gaagucuuuguaca

SEQ ID NO: 1856203 - RNA, 22 nt, Human
gacaaggauugcuacuguccua

SEQ ID NO: 1856204 - RNA, 14 nt, Human
gacaggcaaugcug

SEQ ID NO: 1856205 - RNA, 16 nt, Human
gacaggcaaugcuggc

SEQ ID NO: 1856206 - RNA, 17 nt, Human
gacaggcaaugcuggcu

SEQ ID NO: 1856207 - RNA, 18 nt, Human
gacaggcauguucucuga

SEQ ID NO: 1856208 - RNA, 19 nt, Human
gacaggcauguucucugag

SEQ ID NO: 1856209 - RNA, 15 nt, Human
gacagcugccuggga

SEQ ID NO: 1856210 - RNA, 14 nt, Human
gacagcugccuggg

SEQ ID NO: 1856211 - RNA, 19 nt, Human
gacagccaacuauggccug

SEQ ID NO: 1856212 - RNA, 13 nt, Human
gacagcugccugg

SEQ ID NO: 1856213 - RNA, 12 nt, Human
gacagcugccug

SEQ ID NO: 1856214 - RNA, 22 nt, Human
gacagccaacuauggccugugg

SEQ ID NO: 1856215 - RNA, 13 nt, Human
gacagccacggcc

SEQ ID NO: 1856216 - RNA, 14 nt, Human
gacagacacaggcc

SEQ ID NO: 1856217 - RNA, 20 nt, Human
gacacuaaccacgcuggacc

SEQ ID NO: 1856218 - RNA, 21 nt, Human
gacacuaaccacgcuggaccu

SEQ ID NO: 1856219 - RNA, 23 nt, Human
gacagaucucugcuuuggaaauc

SEQ ID NO: 1856220 - RNA, 21 nt, Human
gacagaucucugcuuuggaaa

SEQ ID NO: 1856221 - RNA, 19 nt, Human
gacagaucucugcuuugga

SEQ ID NO: 1856222 - RNA, 15 nt, Human
gacagacacaggccc

SEQ ID NO: 1856223 - RNA, 16 nt, Human
gacagacacaggcccg

SEQ ID NO: 1856224 - RNA, 17 nt, Human
gacaugucuuuucuugc

SEQ ID NO: 1856225 - RNA, 21 nt, Human
gacaugucuuuucuugcauga

SEQ ID NO: 1856226 - RNA, 15 nt, Human
gacauacuaaccagc

SEQ ID NO: 1856227 - RNA, 16 nt, Human
gacauacuaaccagca

SEQ ID NO: 1856228 - RNA, 14 nt, Human
gacaucaacagaua

SEQ ID NO: 1856229 - RNA, 23 nt, Human
gacauacuaaccagcagaaaugc

SEQ ID NO: 1856230 - RNA, 23 nt, Human
gacccugucucaaaaaaagaaaa

SEQ ID NO: 1856231 - RNA, 16 nt, Human
gacccugcccuguggg

SEQ ID NO: 1856232 - RNA, 15 nt, Human
gacccugcccugugg

SEQ ID NO: 1856233 - RNA, 13 nt, Human
gacccugcccugu

SEQ ID NO: 1856234 - RNA, 21 nt, Human
gacccugaggcccagagggcc

SEQ ID NO: 1856235 - RNA, 12 nt, Human
gacccugcccug

SEQ ID NO: 1856236 - RNA, 20 nt, Human
gacccugaggcccagagggc

SEQ ID NO: 1856237 - RNA, 19 nt, Human
gacccugaggcccagaggg

SEQ ID NO: 1856238 - RNA, 22 nt, Human
gaccccucauagcccucacccu

SEQ ID NO: 1856239 - RNA, 20 nt, Human
gaccccgagccuggcuccaa

SEQ ID NO: 1856240 - RNA, 23 nt, Human
gaccccucauagcccucacccug

SEQ ID NO: 1856241 - RNA, 13 nt, Human
gaccccuccaugu

SEQ ID NO: 1856242 - RNA, 11 nt, Human
gacccacugcu

SEQ ID NO: 1856243 - RNA, 12 nt, Human
gacccacugcuu

SEQ ID NO: 1856244 - RNA, 17 nt, Human
gacccaugcugcccugu

SEQ ID NO: 1856245 - RNA, 16 nt, Human
gacccaugcugcccug

SEQ ID NO: 1856246 - RNA, 15 nt, Human
gacccaugcugcccu

SEQ ID NO: 1856247 - RNA, 14 nt, Human
gacccaugcugccc

SEQ ID NO: 1856248 - RNA, 15 nt, Human
gaccgugaggccaga

SEQ ID NO: 1856249 - RNA, 14 nt, Human
gaccgugaggccag

SEQ ID NO: 1856250 - RNA, 15 nt, Human
gaccugaggcccuuc

SEQ ID NO: 1856251 - RNA, 13 nt, Human
gaccucaggccug

SEQ ID NO: 1856252 - RNA, 12 nt, Human
gaccucaggccu

SEQ ID NO: 1856253 - RNA, 11 nt, Human
gaccucaggcc

SEQ ID NO: 1856254 - RNA, 21 nt, Human
gaccugaggcccuucucucca

SEQ ID NO: 1856255 - RNA, 18 nt, Human
gaccugaggcccuucucu

SEQ ID NO: 1856256 - RNA, 15 nt, Human
gaccugccucggccu

SEQ ID NO: 1856257 - RNA, 21 nt, Human
gaccugccccuccucucugcc

SEQ ID NO: 1856258 - RNA, 23 nt, Human
gaccugauuucugagcauuuaau

SEQ ID NO: 1856259 - RNA, 22 nt, Human
gacguguuaugacuccagaauu

SEQ ID NO: 1856260 - RNA, 17 nt, Human
gacuacucccccaggug

SEQ ID NO: 1856261 - RNA, 12 nt, Human
gacuacaggcac

SEQ ID NO: 1856262 - RNA, 16 nt, Human
gacuccugcaggcagc

SEQ ID NO: 1856263 - RNA, 15 nt, Human
gacuccugcaggcag

SEQ ID NO: 1856264 - RNA, 14 nt, Human
gacuccugcaggca

SEQ ID NO: 1856265 - RNA, 15 nt, Human
gacucagguugucug

SEQ ID NO: 1856266 - RNA, 15 nt, Human
gacucaguggggagg

SEQ ID NO: 1856267 - RNA, 20 nt, Human
gacguguuaugacuccagaa

SEQ ID NO: 1856268 - RNA, 17 nt, Human
gacguguuaugacucca

SEQ ID NO: 1856269 - RNA, 17 nt, Human
gacgggguuucaccaug

SEQ ID NO: 1856270 - RNA, 23 nt, Human
gacggagucccaccuuggcugca

SEQ ID NO: 1856271 - RNA, 21 nt, Human
gacggagucccaccuuggcug

SEQ ID NO: 1856272 - RNA, 14 nt, Human
gacggagucccacc

SEQ ID NO: 1856273 - RNA, 18 nt, Human
gacggagucccaccuugg

SEQ ID NO: 1856274 - RNA, 19 nt, Human
gaccugccucggccuccca

SEQ ID NO: 1856275 - RNA, 23 nt, Human
gaccuugaacuggguacuugugg

SEQ ID NO: 1856276 - RNA, 21 nt, Human
gaccuuucaauaggaaaaacu

SEQ ID NO: 1856277 - RNA, 20 nt, Human
gcagaguugaagacagagcu

SEQ ID NO: 1856278 - RNA, 18 nt, Human
gcagauaaacaguaguga

SEQ ID NO: 1856279 - RNA, 21 nt, Human
gcagaguugaagacagagcua

SEQ ID NO: 1856280 - RNA, 17 nt, Human
gcagacaguuaagagaa

SEQ ID NO: 1856281 - RNA, 22 nt, Human
gcagauacaggaaaagcugcug

SEQ ID NO: 1856282 - RNA, 20 nt, Human
gcagccccgugggguuccuc

SEQ ID NO: 1856283 - RNA, 21 nt, Human
gcagccccuguucuggcagag

SEQ ID NO: 1856284 - RNA, 20 nt, Human
gcagccccuguucuggcaga

SEQ ID NO: 1856285 - RNA, 13 nt, Human
gcagcccugcaga

SEQ ID NO: 1856286 - RNA, 16 nt, Human
gcagcaauaaagcagc

SEQ ID NO: 1856287 - RNA, 23 nt, Human
gcagcaauaaagcagcguuucua

SEQ ID NO: 1856288 - RNA, 17 nt, Human
gcagccccauucugccu

SEQ ID NO: 1856289 - RNA, 18 nt, Human
gcagccccauucugccug

SEQ ID NO: 1856290 - RNA, 19 nt, Human
gcagccccauucugccugc

SEQ ID NO: 1856291 - RNA, 21 nt, Human
gcagccccauucugccugccc

SEQ ID NO: 1856292 - RNA, 24 nt, Human
gcagccccauucugccugcccagg

SEQ ID NO: 1856293 - RNA, 17 nt, Human
gcagcccugcagagggc

SEQ ID NO: 1856294 - RNA, 16 nt, Human
gcagcccugcagaggg

SEQ ID NO: 1856295 - RNA, 15 nt, Human
gcagcccugcagagg

SEQ ID NO: 1856296 - RNA, 14 nt, Human
gcagcccugcagag

SEQ ID NO: 1856297 - RNA, 13 nt, Human
gcagcccugcuuu

SEQ ID NO: 1856298 - RNA, 15 nt, Human
gcagcucaccucucc

SEQ ID NO: 1856299 - RNA, 14 nt, Human
gcagcucaccucuc

SEQ ID NO: 1856300 - RNA, 15 nt, Human
gcagccuuggcaaac

SEQ ID NO: 1856301 - RNA, 14 nt, Human
gcaggcagccaggc

SEQ ID NO: 1856302 - RNA, 13 nt, Human
gcaggcagccagg

SEQ ID NO: 1856303 - RNA, 12 nt, Human
gcaggcagccag

SEQ ID NO: 1856304 - RNA, 20 nt, Human
gcaggaaggcugagaggaga

SEQ ID NO: 1856305 - RNA, 20 nt, Human
gcaggaggaucacuugaguc

SEQ ID NO: 1856306 - RNA, 23 nt, Human
gcaggaggaucacuugaguccag

SEQ ID NO: 1856307 - RNA, 16 nt, Human
gcaccagcagccugga

SEQ ID NO: 1856308 - RNA, 22 nt, Human
gcacccaccaucaugucuggcu

SEQ ID NO: 1856309 - RNA, 19 nt, Human
gcacccggccccugcuggu

SEQ ID NO: 1856310 - RNA, 22 nt, Human
gcaccacugcacuccagccugg

SEQ ID NO: 1856311 - RNA, 21 nt, Human
gcaccacugcacuccagccug

SEQ ID NO: 1856312 - RNA, 15 nt, Human
gcaccagcagccugg

SEQ ID NO: 1856313 - RNA, 12 nt, Human
gcaauggcagcc

SEQ ID NO: 1856314 - RNA, 13 nt, Human
gcaauggcagccu

SEQ ID NO: 1856315 - RNA, 20 nt, Human
gcaccacugcacuccagccu

SEQ ID NO: 1856316 - RNA, 14 nt, Human
gcaauggcagccuu

SEQ ID NO: 1856317 - RNA, 17 nt, Human
gcaccuuagacaguccc

SEQ ID NO: 1856318 - RNA, 14 nt, Human
gcaccuuagacagu

SEQ ID NO: 1856319 - RNA, 22 nt, Human
gcaccuggaauauauaaccagu

SEQ ID NO: 1856320 - RNA, 18 nt, Human
gcaccuggaauauauaac

SEQ ID NO: 1856321 - RNA, 21 nt, Human
gcaccuggaauauauaaccag

SEQ ID NO: 1856322 - RNA, 15 nt, Human
gcacccucaggcagg

SEQ ID NO: 1856323 - RNA, 18 nt, Human
gcaccuuagacagucccu

SEQ ID NO: 1856324 - RNA, 19 nt, Human
gcaccuuagacagucccug

SEQ ID NO: 1856325 - RNA, 12 nt, Human
gcacgauuucug

SEQ ID NO: 1856326 - RNA, 14 nt, Human
gcacguauuuuaau

SEQ ID NO: 1856327 - RNA, 15 nt, Human
gcacguauuuuaaua

SEQ ID NO: 1856328 - RNA, 20 nt, Human
gcacugcuuccagugaggcu

SEQ ID NO: 1856329 - RNA, 22 nt, Human
gcacugcuuccagugaggcucu

SEQ ID NO: 1856330 - RNA, 12 nt, Human
gcacugcugccc

SEQ ID NO: 1856331 - RNA, 24 nt, Human
gcacugguggcccgacagccuggc

SEQ ID NO: 1856332 - RNA, 23 nt, Human
gcacugguggcccgacagccugg

SEQ ID NO: 1856333 - RNA, 22 nt, Human
gcacugguggcccgacagccug

SEQ ID NO: 1856334 - RNA, 18 nt, Human
gcacugcuuccagugagg

SEQ ID NO: 1856335 - RNA, 16 nt, Human
gcacugcuuccaguga

SEQ ID NO: 1856336 - RNA, 15 nt, Human
gcagacaggaccagg

SEQ ID NO: 1856337 - RNA, 13 nt, Human
gcagacaggacca

SEQ ID NO: 1856338 - RNA, 12 nt, Human
gcagacaggacc

SEQ ID NO: 1856339 - RNA, 23 nt, Human
gcagacaggcaagcaccuccugc

SEQ ID NO: 1856340 - RNA, 18 nt, Human
gcagacaggaccagggau

SEQ ID NO: 1856341 - RNA, 19 nt, Human
gcagacaggcaagcaccuc

SEQ ID NO: 1856342 - RNA, 16 nt, Human
gcagugcaugcugucc

SEQ ID NO: 1856343 - RNA, 15 nt, Human
gcagugcaugcuguc

SEQ ID NO: 1856344 - RNA, 22 nt, Human
gcagguccaggguuugaguuca

SEQ ID NO: 1856345 - RNA, 19 nt, Human
gcaggucuugaacuccugg

SEQ ID NO: 1856346 - RNA, 20 nt, Human
gcaggucuugaacuccuggc

SEQ ID NO: 1856347 - RNA, 22 nt, Human
gcagggcucagcggggacagcu

SEQ ID NO: 1856348 - RNA, 17 nt, Human
gcagggucucacucugu

SEQ ID NO: 1856349 - RNA, 18 nt, Human
gcagggucucacucuguc

SEQ ID NO: 1856350 - RNA, 16 nt, Human
gcaggcagccaggcca

SEQ ID NO: 1856351 - RNA, 15 nt, Human
gcaggcagccaggcc

SEQ ID NO: 1856352 - RNA, 19 nt, Human
gcagggcucagcggggaca

SEQ ID NO: 1856353 - RNA, 21 nt, Human
gcagggcucagcggggacagc

SEQ ID NO: 1856354 - RNA, 17 nt, Human
gcauagguuuaauaauu

SEQ ID NO: 1856355 - RNA, 22 nt, Human
gcaguggugguuuucuguucuu

SEQ ID NO: 1856356 - RNA, 23 nt, Human
gcaguggugguuuucuguucuuu

SEQ ID NO: 1856357 - RNA, 13 nt, Human
gcagugggagcug

SEQ ID NO: 1856358 - RNA, 14 nt, Human
gcagugggagcugc

SEQ ID NO: 1856359 - RNA, 15 nt, Human
gcagugggagcugcc

SEQ ID NO: 1856360 - RNA, 13 nt, Human
gcauagaaguaaa

SEQ ID NO: 1856361 - RNA, 17 nt, Human
gcaguuauuaacacuaa

SEQ ID NO: 1856362 - RNA, 16 nt, Human
gcaucugaaaauugau

SEQ ID NO: 1856363 - RNA, 18 nt, Human
gcaugaaguaauaugcac

SEQ ID NO: 1856364 - RNA, 18 nt, Human
gcaugcgggcuuccuccu

SEQ ID NO: 1856365 - RNA, 20 nt, Human
gcauggcaaggacugcaggg

SEQ ID NO: 1856366 - RNA, 15 nt, Human
gcauguucucugagg

SEQ ID NO: 1856367 - RNA, 21 nt, Human
gcauguucucugaggacacua

SEQ ID NO: 1856368 - RNA, 22 nt, Human
gcauguucucugaggacacuaa

SEQ ID NO: 1856369 - RNA, 18 nt, Human
gcauuuguuugaacugau

SEQ ID NO: 1856370 - RNA, 16 nt, Human
gccaaacucaccugcc

SEQ ID NO: 1856371 - RNA, 14 nt, Human
gccaaacucaccug

SEQ ID NO: 1856372 - RNA, 19 nt, Human
gccaaagccuccuccagcc

SEQ ID NO: 1856373 - RNA, 16 nt, Human
gccaaagccuccucca

SEQ ID NO: 1856374 - RNA, 13 nt, Human
gccaaagccaaag

SEQ ID NO: 1856375 - RNA, 20 nt, Human
gccaaagccaaagcuaggcc

SEQ ID NO: 1856376 - RNA, 16 nt, Human
gccaaagcuaggccug

SEQ ID NO: 1856377 - RNA, 22 nt, Human
gccaaagcuaggccuggccaga

SEQ ID NO: 1856378 - RNA, 12 nt, Human
gccaaaggaagc

SEQ ID NO: 1856379 - RNA, 17 nt, Human
gcauuugcugaauacag

SEQ ID NO: 1856380 - RNA, 14 nt, Human
gcauuugcugaaua

SEQ ID NO: 1856381 - RNA, 16 nt, Human
gcauuuguuugaacug

SEQ ID NO: 1856382 - RNA, 13 nt, Human
gcauuugcugaau

SEQ ID NO: 1856383 - RNA, 21 nt, Human
gcauuugaggucuguucuuuc

SEQ ID NO: 1856384 - RNA, 17 nt, Human
gcauuaucuagauacug

SEQ ID NO: 1856385 - RNA, 13 nt, Human
gaucuuuggacag

SEQ ID NO: 1856386 - RNA, 21 nt, Human
gaucuuuggacagaagcagcu

SEQ ID NO: 1856387 - RNA, 18 nt, Human
gaucuuugcagacaggca

SEQ ID NO: 1856388 - RNA, 17 nt, Human
gaucuuugcagacaggc

SEQ ID NO: 1856389 - RNA, 22 nt, Human
gauccugagccagauuucacuc

SEQ ID NO: 1856390 - RNA, 21 nt, Human
gauccugagccagauuucacu

SEQ ID NO: 1856391 - RNA, 16 nt, Human
gaucccucauccucau

SEQ ID NO: 1856392 - RNA, 15 nt, Human
gaucccucauccuca

SEQ ID NO: 1856393 - RNA, 14 nt, Human
gauccccagcuguu

SEQ ID NO: 1856394 - RNA, 21 nt, Human
gauggcuaguaucaaaagaaa

SEQ ID NO: 1856395 - RNA, 19 nt, Human
gauggcugugccucugccu

SEQ ID NO: 1856396 - RNA, 18 nt, Human
gauggcugugccucugcc

SEQ ID NO: 1856397 - RNA, 17 nt, Human
gauggcugugccucugc

SEQ ID NO: 1856398 - RNA, 13 nt, Human
gauggcugugccu

SEQ ID NO: 1856399 - RNA, 22 nt, Human
gauggggcccugccuccuuugu

SEQ ID NO: 1856400 - RNA, 14 nt, Human
gauggggcccugcc

SEQ ID NO: 1856401 - RNA, 13 nt, Human
gauggggcccugc

SEQ ID NO: 1856402 - RNA, 20 nt, Human
gauggcugugccucugccug

SEQ ID NO: 1856403 - RNA, 22 nt, Human
gauggauuuccagccaaagccu

SEQ ID NO: 1856404 - RNA, 20 nt, Human
gaugccugguggcagcugcg

SEQ ID NO: 1856405 - RNA, 18 nt, Human
gaugccugguggcagcug

SEQ ID NO: 1856406 - RNA, 19 nt, Human
gaugccugguggcagcugc

SEQ ID NO: 1856407 - RNA, 12 nt, Human
gaugcagccuca

SEQ ID NO: 1856408 - RNA, 14 nt, Human
gaugcagccucaca

SEQ ID NO: 1856409 - RNA, 19 nt, Human
gaugcagccucacaguccu

SEQ ID NO: 1856410 - RNA, 21 nt, Human
gaugcacagaguuguuacauu

SEQ ID NO: 1856411 - RNA, 22 nt, Human
gaugcacagaguuguuacauuu

SEQ ID NO: 1856412 - RNA, 13 nt, Human
gaugcaccagccc

SEQ ID NO: 1856413 - RNA, 20 nt, Human
gauccccaagccuggcaagg

SEQ ID NO: 1856414 - RNA, 20 nt, Human
gaucauugugaaauuauuca

SEQ ID NO: 1856415 - RNA, 14 nt, Human
gaucauugugaaau

SEQ ID NO: 1856416 - RNA, 17 nt, Human
gaucauccacugugcca

SEQ ID NO: 1856417 - RNA, 19 nt, Human
gaucauccacugugccaug

SEQ ID NO: 1856418 - RNA, 21 nt, Human
gaucauccacugugccaugug

SEQ ID NO: 1856419 - RNA, 12 nt, Human
gaucacggcuca

SEQ ID NO: 1856420 - RNA, 15 nt, Human
gaucagccugggcaa

SEQ ID NO: 1856421 - RNA, 12 nt, Human
gaucagccuggg

SEQ ID NO: 1856422 - RNA, 22 nt, Human
gaucagucugauucccaagcuc

SEQ ID NO: 1856423 - RNA, 16 nt, Human
gaucacgccacugcac

SEQ ID NO: 1856424 - RNA, 18 nt, Human
gaucacgccacugcacua

SEQ ID NO: 1856425 - RNA, 21 nt, Human
gaggaaggaaacccagcucug

SEQ ID NO: 1856426 - RNA, 20 nt, Human
gaggaaggaaacccagcucu

SEQ ID NO: 1856427 - RNA, 19 nt, Human
gaggaaggaaacccagcuc

SEQ ID NO: 1856428 - RNA, 13 nt, Human
gaggaaggaaacc

SEQ ID NO: 1856429 - RNA, 19 nt, Human
gauaaaguugguaaaccuu

SEQ ID NO: 1856430 - RNA, 22 nt, Human
gauaaauaguuuaugauuccac

SEQ ID NO: 1856431 - RNA, 16 nt, Human
gauaaauaacuuuuuu

SEQ ID NO: 1856432 - RNA, 21 nt, Human
gauaaauaacuuuuuuuuaag

SEQ ID NO: 1856433 - RNA, 22 nt, Human
gauagcacagacccugcccugu

SEQ ID NO: 1856434 - RNA, 21 nt, Human
gauagcacagacccugcccug

SEQ ID NO: 1856435 - RNA, 18 nt, Human
gauacaggaaaagcugcu

SEQ ID NO: 1856436 - RNA, 19 nt, Human
gauacaggaaaagcugcug

SEQ ID NO: 1856437 - RNA, 14 nt, Human
gauaauacaccacu

SEQ ID NO: 1856438 - RNA, 18 nt, Human
gauaauacaccacuacau

SEQ ID NO: 1856439 - RNA, 21 nt, Human
gauaauacaccacuacauucu

SEQ ID NO: 1856440 - RNA, 22 nt, Human
gauaauacaccacuacauucug

SEQ ID NO: 1856441 - RNA, 19 nt, Human
gauacaccgggccuggaga

SEQ ID NO: 1856442 - RNA, 23 nt, Human
gauagauaggucagugcaaauac

SEQ ID NO: 1856443 - RNA, 19 nt, Human
gauucauauuuacuucuua

SEQ ID NO: 1856444 - RNA, 18 nt, Human
gauucauauuuacuucuu

SEQ ID NO: 1856445 - RNA, 17 nt, Human
gauucauauuuacuucu

SEQ ID NO: 1856446 - RNA, 22 nt, Human
gauuccagagaguggcuccucc

SEQ ID NO: 1856447 - RNA, 20 nt, Human
gauuccagagaguggcuccu

SEQ ID NO: 1856448 - RNA, 19 nt, Human
gauuccagagaguggcucc

SEQ ID NO: 1856449 - RNA, 15 nt, Human
gauucagcucugcaa

SEQ ID NO: 1856450 - RNA, 13 nt, Human
gauucagcucugc

SEQ ID NO: 1856451 - RNA, 19 nt, Human
gauucagacagcugccugg

SEQ ID NO: 1856452 - RNA, 23 nt, Human
gauggggcugcaccggcuggccu

SEQ ID NO: 1856453 - RNA, 12 nt, Human
gauucuuuccug

SEQ ID NO: 1856454 - RNA, 21 nt, Human
gauucccaagcucugcuccuc

SEQ ID NO: 1856455 - RNA, 19 nt, Human
gauucccaagcucugcucc

SEQ ID NO: 1856456 - RNA, 20 nt, Human
gauucccaagcucugcuccu

SEQ ID NO: 1856457 - RNA, 23 nt, Human
gauugcaccacugcacuccagcc

SEQ ID NO: 1856458 - RNA, 16 nt, Human
gauugcaccacugcac

SEQ ID NO: 1856459 - RNA, 21 nt, Human
gauugcaacaggcugggcuuc

SEQ ID NO: 1856460 - RNA, 17 nt, Human
gauucuuuccugaggcu

SEQ ID NO: 1856461 - RNA, 16 nt, Human
gauucuuuccugaggc

SEQ ID NO: 1856462 - RNA, 18 nt, Human
gauucuuuccugaggcug

SEQ ID NO: 1856463 - RNA, 20 nt, Human
gauugcaacaggcugggcuu

SEQ ID NO: 1856464 - RNA, 15 nt, Human
gauuuccguuaaaau

SEQ ID NO: 1856465 - RNA, 18 nt, Human
gauuuccguuaaaauacc

SEQ ID NO: 1856466 - RNA, 22 nt, Human
gauuuggucaacacuaacauga

SEQ ID NO: 1856467 - RNA, 11 nt, Human
gauuucuguuu

SEQ ID NO: 1856468 - RNA, 19 nt, Human
gauuucuguuuagauaaua

SEQ ID NO: 1856469 - RNA, 20 nt, Human
gauuugucuuuggugaacau

SEQ ID NO: 1856470 - RNA, 22 nt, Human
gauuugucuuuggugaacauug

SEQ ID NO: 1856471 - RNA, 19 nt, Human
gauuuguuaaugauagcua

SEQ ID NO: 1856472 - RNA, 22 nt, Human
gcaaugaccuuucaauaggaaa

SEQ ID NO: 1856473 - RNA, 20 nt, Human
gcaaugaccuuucaauagga

SEQ ID NO: 1856474 - RNA, 17 nt, Human
gcaaugaccuuucaaua

SEQ ID NO: 1856475 - RNA, 15 nt, Human
gcaaugaccuuucaa

SEQ ID NO: 1856476 - RNA, 17 nt, Human
gcaaucaaaucugcuuu

SEQ ID NO: 1856477 - RNA, 15 nt, Human
gcaaucaaaucugcu

SEQ ID NO: 1856478 - RNA, 14 nt, Human
gcaaggucauuuuu

SEQ ID NO: 1856479 - RNA, 23 nt, Human
gcaaugaccuuucaauaggaaaa

SEQ ID NO: 1856480 - RNA, 13 nt, Human
gcaaugcuggcug

SEQ ID NO: 1856481 - RNA, 14 nt, Human
gcaaugcuggcugu

SEQ ID NO: 1856482 - RNA, 22 nt, Human
gcaaugcuggcuguuggcuggg

SEQ ID NO: 1856483 - RNA, 23 nt, Human
gcaaugcuggcuguuggcugggg

SEQ ID NO: 1856484 - RNA, 11 nt, Human
gcaaggcuguc

SEQ ID NO: 1856485 - RNA, 13 nt, Human
gcaaggcugucaa

SEQ ID NO: 1856486 - RNA, 18 nt, Human
gcaaggagauuuacaacu

SEQ ID NO: 1856487 - RNA, 13 nt, Human
gcaaagcccagcu

SEQ ID NO: 1856488 - RNA, 21 nt, Human
gcaaagcccagcuugaaaccu

SEQ ID NO: 1856489 - RNA, 15 nt, Human
gauuuuugucuugug

SEQ ID NO: 1856490 - RNA, 16 nt, Human
gcaaaguaucccuacu

SEQ ID NO: 1856491 - RNA, 22 nt, Human
gcaagacgcugugcugcccugc

SEQ ID NO: 1856492 - RNA, 21 nt, Human
gcaagacgcugugcugcccug

SEQ ID NO: 1856493 - RNA, 20 nt, Human
gcaagacgcugugcugcccu

SEQ ID NO: 1856494 - RNA, 14 nt, Human
gcaagacgcugugc

SEQ ID NO: 1856495 - RNA, 23 nt, Human
gcaagacgcugugcugcccugcc

SEQ ID NO: 1856496 - RNA, 17 nt, Human
gcaagaauugaagcagg

SEQ ID NO: 1856497 - RNA, 14 nt, Human
gccucucucaggcc

SEQ ID NO: 1856498 - RNA, 13 nt, Human
gccucucucaggc

SEQ ID NO: 1856499 - RNA, 16 nt, Human
gccucucucaggccaa

SEQ ID NO: 1856500 - RNA, 17 nt, Human
gccucugacacacagcu

SEQ ID NO: 1856501 - RNA, 18 nt, Human
gccucugacacacagcuc

SEQ ID NO: 1856502 - RNA, 14 nt, Human
gccucugcacuccc

SEQ ID NO: 1856503 - RNA, 19 nt, Human
gccucugacacacagcucu

SEQ ID NO: 1856504 - RNA, 20 nt, Human
gccucugacacacagcucug

SEQ ID NO: 1856505 - RNA, 21 nt, Human
gccucugacacacagcucugu

SEQ ID NO: 1856506 - RNA, 18 nt, Human
gccucugccucugacaca

SEQ ID NO: 1856507 - RNA, 15 nt, Human
gccucugcacucccc

SEQ ID NO: 1856508 - RNA, 12 nt, Human
gccucugccucu

SEQ ID NO: 1856509 - RNA, 13 nt, Human
gccucugccucug

SEQ ID NO: 1856510 - RNA, 15 nt, Human
gccugcaagggagug

SEQ ID NO: 1856511 - RNA, 13 nt, Human
gccugcaagggag

SEQ ID NO: 1856512 - RNA, 18 nt, Human
gccucacaguccuuacca

SEQ ID NO: 1856513 - RNA, 21 nt, Human
gccucacaguccuuaccagca

SEQ ID NO: 1856514 - RNA, 15 nt, Human
gccucagcauccugg

SEQ ID NO: 1856515 - RNA, 16 nt, Human
gccucagcauccuggc

SEQ ID NO: 1856516 - RNA, 18 nt, Human
gccucccaaagugcuggg

SEQ ID NO: 1856517 - RNA, 13 nt, Human
gccucccaacuca

SEQ ID NO: 1856518 - RNA, 19 nt, Human
gccucccaaagugcuggga

SEQ ID NO: 1856519 - RNA, 19 nt, Human
gccucccaacucaccccag

SEQ ID NO: 1856520 - RNA, 18 nt, Human
gccucccaacucacccca

SEQ ID NO: 1856521 - RNA, 17 nt, Human
gccucccaacucacccc

SEQ ID NO: 1856522 - RNA, 16 nt, Human
gccucccaacucaccc

SEQ ID NO: 1856523 - RNA, 16 nt, Human
gccucccaucacccgc

SEQ ID NO: 1856524 - RNA, 14 nt, Human
gccucccaucaccc

SEQ ID NO: 1856525 - RNA, 17 nt, Human
gccucccaucacccgcu

SEQ ID NO: 1856526 - RNA, 20 nt, Human
gccucccgaguagcugggac

SEQ ID NO: 1856527 - RNA, 18 nt, Human
gccucccgaguagcuggg

SEQ ID NO: 1856528 - RNA, 19 nt, Human
gccucccgaguagcuggga

SEQ ID NO: 1856529 - RNA, 17 nt, Human
gccgucuaccugagggg

SEQ ID NO: 1856530 - RNA, 16 nt, Human
gccgucuaccugaggg

SEQ ID NO: 1856531 - RNA, 15 nt, Human
gccgucuaccugagg

SEQ ID NO: 1856532 - RNA, 20 nt, Human
gccguguaaccauggaccca

SEQ ID NO: 1856533 - RNA, 22 nt, Human
gccguggcuucccgcucagccc

SEQ ID NO: 1856534 - RNA, 21 nt, Human
gccguggcuucccgcucagcc

SEQ ID NO: 1856535 - RNA, 19 nt, Human
gccgugccuucagcucuac

SEQ ID NO: 1856536 - RNA, 17 nt, Human
gccgugccuucagcucu

SEQ ID NO: 1856537 - RNA, 15 nt, Human
gccgugccuucagcu

SEQ ID NO: 1856538 - RNA, 14 nt, Human
gccgugccuucagc

SEQ ID NO: 1856539 - RNA, 19 nt, Human
gccguggcuucccgcucag

SEQ ID NO: 1856540 - RNA, 22 nt, Human
gccuaugugcaugcagcaucua

SEQ ID NO: 1856541 - RNA, 18 nt, Human
gccucaaccuccugggcu

SEQ ID NO: 1856542 - RNA, 19 nt, Human
gccucaaccuccugggcua

SEQ ID NO: 1856543 - RNA, 17 nt, Human
gccucacaguccuuacc

SEQ ID NO: 1856544 - RNA, 13 nt, Human
gccucacaguccu

SEQ ID NO: 1856545 - RNA, 13 nt, Human
gccgcagcccugc

SEQ ID NO: 1856546 - RNA, 12 nt, Human
gccgcagcccug

SEQ ID NO: 1856547 - RNA, 11 nt, Human
gccgcagcccu

SEQ ID NO: 1856548 - RNA, 22 nt, Human
gccgagaucacgccacugcacu

SEQ ID NO: 1856549 - RNA, 20 nt, Human
gccgagaucacgccacugca

SEQ ID NO: 1856550 - RNA, 21 nt, Human
gccgagaucacgccacugcac

SEQ ID NO: 1856551 - RNA, 18 nt, Human
gccgggaccccgagccug

SEQ ID NO: 1856552 - RNA, 23 nt, Human
gccgggaccccgagccuggcucc

SEQ ID NO: 1856553 - RNA, 19 nt, Human
gccgggaccccgagccugg

SEQ ID NO: 1856554 - RNA, 21 nt, Human
gccgggcgcgguggcucacgc

SEQ ID NO: 1856555 - RNA, 20 nt, Human
gccgggcgugguggugagug

SEQ ID NO: 1856556 - RNA, 18 nt, Human
gcccugcuuugggcugcc

SEQ ID NO: 1856557 - RNA, 16 nt, Human
gcccugcuuugggcug

SEQ ID NO: 1856558 - RNA, 18 nt, Human
gcccuucucuccagcccc

SEQ ID NO: 1856559 - RNA, 17 nt, Human
gcccuucucuccagccc

SEQ ID NO: 1856560 - RNA, 16 nt, Human
gcccuucucuccagcc

SEQ ID NO: 1856561 - RNA, 14 nt, Human
gcccuucucuccag

SEQ ID NO: 1856562 - RNA, 15 nt, Human
gcgggucacaggagg

SEQ ID NO: 1856563 - RNA, 13 nt, Human
gcgggucacagga

SEQ ID NO: 1856564 - RNA, 15 nt, Human
gcggacagccacggc

SEQ ID NO: 1856565 - RNA, 20 nt, Human
gcgggucacaggagggaggg

SEQ ID NO: 1856566 - RNA, 19 nt, Human
gcgggucacaggagggagg

SEQ ID NO: 1856567 - RNA, 19 nt, Human
gcgucucauacucaccuca

SEQ ID NO: 1856568 - RNA, 11 nt, Human
gcggacagcca

SEQ ID NO: 1856569 - RNA, 13 nt, Human
gcggacagccacg

SEQ ID NO: 1856570 - RNA, 15 nt, Human
gcgccuacaggagug

SEQ ID NO: 1856571 - RNA, 22 nt, Human
gcgacagugagacucugucuca

SEQ ID NO: 1856572 - RNA, 12 nt, Human
gcgacagugaga

SEQ ID NO: 1856573 - RNA, 19 nt, Human
gcuagaacucccuuucaac

SEQ ID NO: 1856574 - RNA, 16 nt, Human
gcuaccuuuguauucu

SEQ ID NO: 1856575 - RNA, 20 nt, Human
gcuaccuuuguauucucucc

SEQ ID NO: 1856576 - RNA, 16 nt, Human
gcuaggaacacuccuu

SEQ ID NO: 1856577 - RNA, 22 nt, Human
gcuaggaaauccaggguggugg

SEQ ID NO: 1856578 - RNA, 15 nt, Human
gcuaggaacacuccu

SEQ ID NO: 1856579 - RNA, 19 nt, Human
gcuaggaaauccagggugg

SEQ ID NO: 1856580 - RNA, 14 nt, Human
gcuacacaggggaa

SEQ ID NO: 1856581 - RNA, 13 nt, Human
gcuacacacugca

SEQ ID NO: 1856582 - RNA, 20 nt, Human
gcuacacacugcauguuugu

SEQ ID NO: 1856583 - RNA, 20 nt, Human
gcuaagagggagggagggcu

SEQ ID NO: 1856584 - RNA, 13 nt, Human
gcuaagagggagg

SEQ ID NO: 1856585 - RNA, 20 nt, Human
gccuuacacaaugguuuucu

SEQ ID NO: 1856586 - RNA, 21 nt, Human
gccuuacacaaugguuuucuu

SEQ ID NO: 1856587 - RNA, 18 nt, Human
gccuuacccucauguucu

SEQ ID NO: 1856588 - RNA, 13 nt, Human
gccuguuuaagag

SEQ ID NO: 1856589 - RNA, 12 nt, Human
gccuguuuaaga

SEQ ID NO: 1856590 - RNA, 19 nt, Human
gccuuagaagucacacagu

SEQ ID NO: 1856591 - RNA, 17 nt, Human
gccuuagaagucacaca

SEQ ID NO: 1856592 - RNA, 18 nt, Human
gccuuagaagucacacag

SEQ ID NO: 1856593 - RNA, 14 nt, Human
gccuuauggaacac

SEQ ID NO: 1856594 - RNA, 10 nt, Human
gccuuaugga

SEQ ID NO: 1856595 - RNA, 13 nt, Human
gccugguggcagc

SEQ ID NO: 1856596 - RNA, 14 nt, Human
gccugguggcagcu

SEQ ID NO: 1856597 - RNA, 18 nt, Human
gccugguggcagcugcgg

SEQ ID NO: 1856598 - RNA, 19 nt, Human
gccugguggcagcugcggu

SEQ ID NO: 1856599 - RNA, 21 nt, Human
gccugguggcagcugcggucc

SEQ ID NO: 1856600 - RNA, 22 nt, Human
gccugggggcugggcagaggaa

SEQ ID NO: 1856601 - RNA, 13 nt, Human
gccuuuggcuuca

SEQ ID NO: 1856602 - RNA, 23 nt, Human
gcgacaaugcaaaccaucauuga

SEQ ID NO: 1856603 - RNA, 22 nt, Human
gccuuuggaaacagcucgacuu

SEQ ID NO: 1856604 - RNA, 20 nt, Human
gccuuauggaacacucugag

SEQ ID NO: 1856605 - RNA, 19 nt, Human
gccuuauggaacacucuga

SEQ ID NO: 1856606 - RNA, 18 nt, Human
gccuuauggaacacucug

SEQ ID NO: 1856607 - RNA, 16 nt, Human
gccuuauggaacacuc

SEQ ID NO: 1856608 - RNA, 12 nt, Human
gccuuccagggg

SEQ ID NO: 1856609 - RNA, 13 nt, Human
gccuucaucuccc

SEQ ID NO: 1856610 - RNA, 21 nt, Human
gccuucagggagugagggauu

SEQ ID NO: 1856611 - RNA, 13 nt, Human
gccuucagggagu

SEQ ID NO: 1856612 - RNA, 22 nt, Human
gccuucgauacaccgggccugg

SEQ ID NO: 1856613 - RNA, 18 nt, Human
gccuucgauacaccgggc

SEQ ID NO: 1856614 - RNA, 23 nt, Human
gccuucgauacaccgggccugga

SEQ ID NO: 1856615 - RNA, 16 nt, Human
gccuuccagggguggg

SEQ ID NO: 1856616 - RNA, 15 nt, Human
gccuuccaggggugg

SEQ ID NO: 1856617 - RNA, 21 nt, Human
gccuuccaggggugggacacc

SEQ ID NO: 1856618 - RNA, 17 nt, Human
gccccuguucuggcaga

SEQ ID NO: 1856619 - RNA, 15 nt, Human
gcccgacagccuggc

SEQ ID NO: 1856620 - RNA, 14 nt, Human
gcccgacagccugg

SEQ ID NO: 1856621 - RNA, 12 nt, Human
gcccgacagccu

SEQ ID NO: 1856622 - RNA, 18 nt, Human
gccccucagggucccugg

SEQ ID NO: 1856623 - RNA, 16 nt, Human
gccccucagggucccu

SEQ ID NO: 1856624 - RNA, 15 nt, Human
gccccgaggccuucu

SEQ ID NO: 1856625 - RNA, 14 nt, Human
gccccucagggucc

SEQ ID NO: 1856626 - RNA, 18 nt, Human
gccccgaggccuucucug

SEQ ID NO: 1856627 - RNA, 22 nt, Human
gccccgaggccuucucugaagg

SEQ ID NO: 1856628 - RNA, 14 nt, Human
gcccugcagagggc

SEQ ID NO: 1856629 - RNA, 13 nt, Human
gcccugcagaggg

SEQ ID NO: 1856630 - RNA, 15 nt, Human
gcccugcagagggca

SEQ ID NO: 1856631 - RNA, 16 nt, Human
gcccugcagagggcac

SEQ ID NO: 1856632 - RNA, 14 nt, Human
gcccugagcuuucu

SEQ ID NO: 1856633 - RNA, 19 nt, Human
gcccucugcccacucccug

SEQ ID NO: 1856634 - RNA, 18 nt, Human
gcccucugcccacucccu

SEQ ID NO: 1856635 - RNA, 16 nt, Human
gcccucugcccacucc

SEQ ID NO: 1856636 - RNA, 13 nt, Human
gcccucugcccac

SEQ ID NO: 1856637 - RNA, 21 nt, Human
gcccucccugccccucccuuc

SEQ ID NO: 1856638 - RNA, 23 nt, Human
gcccuccaagaccuucuccuuca

SEQ ID NO: 1856639 - RNA, 22 nt, Human
gcccuccaagaccuucuccuuc

SEQ ID NO: 1856640 - RNA, 21 nt, Human
gcccuccaucuaaacugcccc

SEQ ID NO: 1856641 - RNA, 20 nt, Human
gcccuccaucuaaacugccc

SEQ ID NO: 1856642 - RNA, 21 nt, Human
gcccuccaagaccuucuccuu

SEQ ID NO: 1856643 - RNA, 19 nt, Human
gcccuccaagaccuucucc

SEQ ID NO: 1856644 - RNA, 22 nt, Human
gccccauccucuguacagagcc

SEQ ID NO: 1856645 - RNA, 14 nt, Human
gccccauccucugu

SEQ ID NO: 1856646 - RNA, 13 nt, Human
gccccauccucug

SEQ ID NO: 1856647 - RNA, 15 nt, Human
gccccauucugccug

SEQ ID NO: 1856648 - RNA, 14 nt, Human
gccccauucugccu

SEQ ID NO: 1856649 - RNA, 15 nt, Human
gccccagugcccaca

SEQ ID NO: 1856650 - RNA, 13 nt, Human
gccccagugccca

SEQ ID NO: 1856651 - RNA, 14 nt, Human
gccccagugcccac

SEQ ID NO: 1856652 - RNA, 21 nt, Human
gccccauaauuuuuuuuuucc

SEQ ID NO: 1856653 - RNA, 19 nt, Human
gccccaguuguauuuauuu

SEQ ID NO: 1856654 - RNA, 18 nt, Human
gccccaucccaaacccuu

SEQ ID NO: 1856655 - RNA, 12 nt, Human
gccccagugccc

SEQ ID NO: 1856656 - RNA, 13 nt, Human
gcccaggccuccu

SEQ ID NO: 1856657 - RNA, 20 nt, Human
gcccaggcuggagugcaaug

SEQ ID NO: 1856658 - RNA, 15 nt, Human
gcccaggcuggagug

SEQ ID NO: 1856659 - RNA, 21 nt, Human
gcccagagaggguggugaccu

SEQ ID NO: 1856660 - RNA, 23 nt, Human
gcccaggccccugccacccuggg

SEQ ID NO: 1856661 - RNA, 12 nt, Human
gcccaggcuggc

SEQ ID NO: 1856662 - RNA, 16 nt, Human
gccaggagccuccugc

SEQ ID NO: 1856663 - RNA, 14 nt, Human
gccaggagccuccu

SEQ ID NO: 1856664 - RNA, 20 nt, Human
gccaggagccuccugcccuu

SEQ ID NO: 1856665 - RNA, 19 nt, Human
gccaggagccuccugcccu

SEQ ID NO: 1856666 - RNA, 15 nt, Human
gccaggaagccagca

SEQ ID NO: 1856667 - RNA, 13 nt, Human
gccagcuggagaa

SEQ ID NO: 1856668 - RNA, 14 nt, Human
gccaggaagccagc

SEQ ID NO: 1856669 - RNA, 13 nt, Human
gccaggaagccag

SEQ ID NO: 1856670 - RNA, 12 nt, Human
gccaggaagcca

SEQ ID NO: 1856671 - RNA, 20 nt, Human
gccagcugcuugggcuucau

SEQ ID NO: 1856672 - RNA, 18 nt, Human
gccagcugcuugggcuuc

SEQ ID NO: 1856673 - RNA, 17 nt, Human
gccagcugcuugggcuu

SEQ ID NO: 1856674 - RNA, 14 nt, Human
gccagaugcaccag

SEQ ID NO: 1856675 - RNA, 17 nt, Human
gccagagggagugacag

SEQ ID NO: 1856676 - RNA, 22 nt, Human
gccagccgagauagccaaggcc

SEQ ID NO: 1856677 - RNA, 13 nt, Human
gccagauuucacu

SEQ ID NO: 1856678 - RNA, 24 nt, Human
gccagauucuuuccugaggcuggg

SEQ ID NO: 1856679 - RNA, 20 nt, Human
gccagauucuuuccugaggc

SEQ ID NO: 1856680 - RNA, 15 nt, Human
gccagaugcaccagc

SEQ ID NO: 1856681 - RNA, 24 nt, Human
gccaaggccaaaggaagcacaugc

SEQ ID NO: 1856682 - RNA, 20 nt, Human
gccacuccagaccccuggcu

SEQ ID NO: 1856683 - RNA, 21 nt, Human
gccacuccagaccccuggcuu

SEQ ID NO: 1856684 - RNA, 20 nt, Human
gccaaggccaaaggaagcac

SEQ ID NO: 1856685 - RNA, 22 nt, Human
gccacuccagaccccuggcuuu

SEQ ID NO: 1856686 - RNA, 20 nt, Human
gccacugcaccgggccacag

SEQ ID NO: 1856687 - RNA, 21 nt, Human
gccacugcaccgggccacaga

SEQ ID NO: 1856688 - RNA, 22 nt, Human
gccagagacacaagccuucggc

SEQ ID NO: 1856689 - RNA, 21 nt, Human
gccagagacacaagccuucgg

SEQ ID NO: 1856690 - RNA, 22 nt, Human
gccacugcaccgggccacagag

SEQ ID NO: 1856691 - RNA, 24 nt, Human
gcccaccuggccucugcacucccc

SEQ ID NO: 1856692 - RNA, 21 nt, Human
gcccaccuggccucugcacuc

SEQ ID NO: 1856693 - RNA, 20 nt, Human
gcccaccuggccucugcacu

SEQ ID NO: 1856694 - RNA, 17 nt, Human
gcccaccuggccucugc

SEQ ID NO: 1856695 - RNA, 16 nt, Human
gcccaccuggccucug

SEQ ID NO: 1856696 - RNA, 15 nt, Human
gcccaccuggccucu

SEQ ID NO: 1856697 - RNA, 14 nt, Human
gcccacuucugcca

SEQ ID NO: 1856698 - RNA, 13 nt, Human
gcccaccuuggcu

SEQ ID NO: 1856699 - RNA, 15 nt, Human
gcccaccuuggcuca

SEQ ID NO: 1856700 - RNA, 16 nt, Human
gcccaccuuggcucaa

SEQ ID NO: 1856701 - RNA, 17 nt, Human
gcccaccuuggcucaag

SEQ ID NO: 1856702 - RNA, 20 nt, Human
gcccacauagugaugguucc

SEQ ID NO: 1856703 - RNA, 24 nt, Human
gcccaaccugcucuccucuugcca

SEQ ID NO: 1856704 - RNA, 22 nt, Human
gcccaagaauagaugcugacug

SEQ ID NO: 1856705 - RNA, 21 nt, Human
gcccaagaauagaugcugacu

SEQ ID NO: 1856706 - RNA, 24 nt, Human
gccaugcuccuggcccacugcauc

SEQ ID NO: 1856707 - RNA, 15 nt, Human
gccaugggccuccug

SEQ ID NO: 1856708 - RNA, 16 nt, Human
gccaugggccuccugu

SEQ ID NO: 1856709 - RNA, 14 nt, Human
gccaugcuccuggc

SEQ ID NO: 1856710 - RNA, 14 nt, Human
gccauccagguuca

SEQ ID NO: 1856711 - RNA, 17 nt, Human
gccaggcugggucgccc

SEQ ID NO: 1856712 - RNA, 23 nt, Human
gccaggcugggucgcccuggacu

SEQ ID NO: 1856713 - RNA, 13 nt, Human
gccaggcuggucu

SEQ ID NO: 1856714 - RNA, 23 nt, Human
gccaguaaaugggggugcauuug

SEQ ID NO: 1856715 - RNA, 15 nt, Human
gccaggcuggucuca

SEQ ID NO: 1856716 - RNA, 21 nt, Human
gccagucaccccggccaccug

SEQ ID NO: 1856717 - RNA, 18 nt, Human
uuuuuaaagacuuuuaug

SEQ ID NO: 1856718 - RNA, 13 nt, Human
uuuuuaaagacuu

SEQ ID NO: 1856719 - RNA, 12 nt, Human
uuuuuaaagacu

SEQ ID NO: 1856720 - RNA, 12 nt, Human
uuuuuaaagaaa

SEQ ID NO: 1856721 - RNA, 20 nt, Human
uuuuuaaagaaaaguuuugu

SEQ ID NO: 1856722 - RNA, 17 nt, Human
uuuuuaaagacagaguc

SEQ ID NO: 1856723 - RNA, 13 nt, Human
uuuugucuugugu

SEQ ID NO: 1856724 - RNA, 16 nt, Human
uuuugucauauaagau

SEQ ID NO: 1856725 - RNA, 19 nt, Human
uuuuguagagccagggucu

SEQ ID NO: 1856726 - RNA, 18 nt, Human
uuuucuaaaguaaaaaca

SEQ ID NO: 1856727 - RNA, 14 nt, Human
uuuuggcugcugaa

SEQ ID NO: 1856728 - RNA, 15 nt, Human
uuuuggucuguguga

SEQ ID NO: 1856729 - RNA, 20 nt, Human
uuuugacaaggggcaguggu

SEQ ID NO: 1856730 - RNA, 12 nt, Human
uuuuuuguuuca

SEQ ID NO: 1856731 - RNA, 13 nt, Human
uuuuuuguuucau

SEQ ID NO: 1856732 - RNA, 19 nt, Human
uuuuuccuucagugccuua

SEQ ID NO: 1856733 - RNA, 11 nt, Human
uuuuuccuuuu

SEQ ID NO: 1856734 - RNA, 11 nt, Human
uuuuuaaaugc

SEQ ID NO: 1856735 - RNA, 11 nt, Human
uuuuuccuuca

SEQ ID NO: 1856736 - RNA, 11 nt, Human
uuuuaaaugca

SEQ ID NO: 1856737 - RNA, 12 nt, Human
uuuuaaaugcac

SEQ ID NO: 1856738 - RNA, 21 nt, Human
uuuuaaaugcaccuggaauau

SEQ ID NO: 1856739 - RNA, 17 nt, Human
uuuuaaagaaugcucuu

SEQ ID NO: 1856740 - RNA, 14 nt, Human
uuuuaaagaaaagu

SEQ ID NO: 1856741 - RNA, 18 nt, Human
uuuuaaagacuuuuauga

SEQ ID NO: 1856742 - RNA, 15 nt, Human
uuuuaaagaaaaguu

SEQ ID NO: 1856743 - RNA, 21 nt, Human
uuuguucuggcucuuccaggc

SEQ ID NO: 1856744 - RNA, 14 nt, Human
uuuggaauuuugug

SEQ ID NO: 1856745 - RNA, 15 nt, Human
uuugcuuugugauuu

SEQ ID NO: 1856746 - RNA, 16 nt, Human
uuugcuuugugauuuu

SEQ ID NO: 1856747 - RNA, 15 nt, Human
uuugcaucugaaaau

SEQ ID NO: 1856748 - RNA, 23 nt, Human
uuuggugaacauugcaauagaaa

SEQ ID NO: 1856749 - RNA, 22 nt, Human
uuuggugaacauugcaauagaa

SEQ ID NO: 1856750 - RNA, 21 nt, Human
uuuggaauuuugugcccccau

SEQ ID NO: 1856751 - RNA, 20 nt, Human
uuuggagucagacagaugug

SEQ ID NO: 1856752 - RNA, 18 nt, Human
uuucuuagggaaggauac

SEQ ID NO: 1856753 - RNA, 23 nt, Human
uuucuuagggaaggauacaaaag

SEQ ID NO: 1856754 - RNA, 12 nt, Human
uuucuucucccu

SEQ ID NO: 1856755 - RNA, 16 nt, Human
uuucuuccucugcuga

SEQ ID NO: 1856756 - RNA, 14 nt, Human
uuucuuccucugcu

SEQ ID NO: 1856757 - RNA, 13 nt, Human
uuucuucucccuc

SEQ ID NO: 1856758 - RNA, 13 nt, Human
uuucuuccucugc

SEQ ID NO: 1856759 - RNA, 11 nt, Human
uuucuuccucu

SEQ ID NO: 1856760 - RNA, 14 nt, Human
uuugaacucuucaa

SEQ ID NO: 1856761 - RNA, 15 nt, Human
uuugaacugauaaag

SEQ ID NO: 1856762 - RNA, 17 nt, Human
uuugaacugauaaagau

SEQ ID NO: 1856763 - RNA, 19 nt, Human
uuugaacugauaaagauga

SEQ ID NO: 1856764 - RNA, 22 nt, Human
uuugaagaugccgcauuuggau

SEQ ID NO: 1856765 - RNA, 18 nt, Human
uuugaaucaucaagucuu

SEQ ID NO: 1856766 - RNA, 20 nt, Human
uuucuguucuuucuggcuau

SEQ ID NO: 1856767 - RNA, 20 nt, Human
uuucuaaaggcuaccuuugu

SEQ ID NO: 1856768 - RNA, 21 nt, Human
uuucuaaaggcuaccuuugua

SEQ ID NO: 1856769 - RNA, 14 nt, Human
uuucuaaaguaaaa

SEQ ID NO: 1856770 - RNA, 12 nt, Human
uuucuaaaguaa

SEQ ID NO: 1856771 - RNA, 23 nt, Human
uuucuacucgaguuacagacaaa

SEQ ID NO: 1856772 - RNA, 16 nt, Human
uuuccugaggcugggc

SEQ ID NO: 1856773 - RNA, 13 nt, Human
uuuccugcccugg

SEQ ID NO: 1856774 - RNA, 12 nt, Human
uuuccugcccug

SEQ ID NO: 1856775 - RNA, 14 nt, Human
uuaccacagacaua

SEQ ID NO: 1856776 - RNA, 17 nt, Human
uuaccacagacauacua

SEQ ID NO: 1856777 - RNA, 23 nt, Human
guagggcgggaggauguucuggg

SEQ ID NO: 1856778 - RNA, 21 nt, Human
guagggcgggaggauguucug

SEQ ID NO: 1856779 - RNA, 22 nt, Human
guagggcgggaggauguucugg

SEQ ID NO: 1856780 - RNA, 16 nt, Human
guagggcgggaggaug

SEQ ID NO: 1856781 - RNA, 15 nt, Human
guagagugugccuga

SEQ ID NO: 1856782 - RNA, 17 nt, Human
guauaauucacauugua

SEQ ID NO: 1856783 - RNA, 14 nt, Human
guagucaggugccu

SEQ ID NO: 1856784 - RNA, 14 nt, Human
guagggugggccuu

SEQ ID NO: 1856785 - RNA, 16 nt, Human
guaggguuauaauaau

SEQ ID NO: 1856786 - RNA, 22 nt, Human
guagggugggccuucagggagu

SEQ ID NO: 1856787 - RNA, 17 nt, Human
guagggugggccuucag

SEQ ID NO: 1856788 - RNA, 17 nt, Human
guauguugaagccuuug

SEQ ID NO: 1856789 - RNA, 21 nt, Human
guaugaucacggcucacugca

SEQ ID NO: 1856790 - RNA, 17 nt, Human
guaugaggcauuuguuu

SEQ ID NO: 1856791 - RNA, 20 nt, Human
guaugaggcauuuguuugaa

SEQ ID NO: 1856792 - RNA, 20 nt, Human
guaugaucacggcucacugc

SEQ ID NO: 1856793 - RNA, 23 nt, Human
guaugaaagauggcugugccucu

SEQ ID NO: 1856794 - RNA, 22 nt, Human
guaugaaagauggcugugccuc

SEQ ID NO: 1856795 - RNA, 19 nt, Human
guaucuggugacuuuccuc

SEQ ID NO: 1856796 - RNA, 12 nt, Human
guaucuggugac

SEQ ID NO: 1856797 - RNA, 12 nt, Human
guaucugagcag

SEQ ID NO: 1856798 - RNA, 19 nt, Human
guaugaauaaagacaccua

SEQ ID NO: 1856799 - RNA, 18 nt, Human
guaugaauaaagacaccu

SEQ ID NO: 1856800 - RNA, 13 nt, Human
guaugaggcauuu

SEQ ID NO: 1856801 - RNA, 15 nt, Human
guaugaggcauuugu

SEQ ID NO: 1856802 - RNA, 15 nt, Human
guauagaaaugcugg

SEQ ID NO: 1856803 - RNA, 22 nt, Human
guauagaaaugcugguuuuuca

SEQ ID NO: 1856804 - RNA, 14 nt, Human
guauagaaaugcug

SEQ ID NO: 1856805 - RNA, 23 nt, Human
guauagaaaugcugguuuuucag

SEQ ID NO: 1856806 - RNA, 22 nt, Human
guauaugucaagccauaauugu

SEQ ID NO: 1856807 - RNA, 16 nt, Human
guauauguugggugca

SEQ ID NO: 1856808 - RNA, 21 nt, Human
guauaugucucaggucccugc

SEQ ID NO: 1856809 - RNA, 15 nt, Human
guauaugucucaggu

SEQ ID NO: 1856810 - RNA, 13 nt, Human
guauaugucucag

SEQ ID NO: 1856811 - RNA, 20 nt, Human
gucccuaauaaagcugugug

SEQ ID NO: 1856812 - RNA, 18 nt, Human
gucccuaauaaagcugug

SEQ ID NO: 1856813 - RNA, 23 nt, Human
gucccuaccgagucucuucucca

SEQ ID NO: 1856814 - RNA, 22 nt, Human
gucccuaccgagucucuucucc

SEQ ID NO: 1856815 - RNA, 21 nt, Human
gucccuaccgagucucuucuc

SEQ ID NO: 1856816 - RNA, 16 nt, Human
gucccugcacuugcag

SEQ ID NO: 1856817 - RNA, 19 nt, Human
gucccugcacuugcagacu

SEQ ID NO: 1856818 - RNA, 21 nt, Human
gucccugcacuugcagacucu

SEQ ID NO: 1856819 - RNA, 17 nt, Human
guccccaccgcagacag

SEQ ID NO: 1856820 - RNA, 17 nt, Human
gucccuaauaaagcugu

SEQ ID NO: 1856821 - RNA, 16 nt, Human
gucccuaauaaagcug

SEQ ID NO: 1856822 - RNA, 19 nt, Human
gucccaggcugagccucag

SEQ ID NO: 1856823 - RNA, 18 nt, Human
gucccaggcugagccuca

SEQ ID NO: 1856824 - RNA, 21 nt, Human
gucccaggcugagccucaguc

SEQ ID NO: 1856825 - RNA, 17 nt, Human
gucccaggcugagccuc

SEQ ID NO: 1856826 - RNA, 16 nt, Human
gucccaggcugagccu

SEQ ID NO: 1856827 - RNA, 15 nt, Human
gucccaggcugagcc

SEQ ID NO: 1856828 - RNA, 23 nt, Human
gucccaccuuggcugcagggagu

SEQ ID NO: 1856829 - RNA, 13 nt, Human
guccacccaggag

SEQ ID NO: 1856830 - RNA, 12 nt, Human
guccacccagga

SEQ ID NO: 1856831 - RNA, 23 nt, Human
guccacccaggagccccgaggcc

SEQ ID NO: 1856832 - RNA, 21 nt, Human
gucccaccuuggcugcaggga

SEQ ID NO: 1856833 - RNA, 16 nt, Human
guccacaguggaacca

SEQ ID NO: 1856834 - RNA, 19 nt, Human
guccacaguggaaccagcc

SEQ ID NO: 1856835 - RNA, 21 nt, Human
guccacaguggaaccagccca

SEQ ID NO: 1856836 - RNA, 19 nt, Human
guauuuuguuuuugucuua

SEQ ID NO: 1856837 - RNA, 15 nt, Human
gucaagugaaaaagg

SEQ ID NO: 1856838 - RNA, 15 nt, Human
gucaaugcagccccc

SEQ ID NO: 1856839 - RNA, 14 nt, Human
guauuuuacuaaua

SEQ ID NO: 1856840 - RNA, 22 nt, Human
guauuaaguuguuaauaaaagu

SEQ ID NO: 1856841 - RNA, 13 nt, Human
guauuuuaaucac

SEQ ID NO: 1856842 - RNA, 18 nt, Human
gucaccccggccaccugc

SEQ ID NO: 1856843 - RNA, 17 nt, Human
gucaccccggccaccug

SEQ ID NO: 1856844 - RNA, 22 nt, Human
gucaccccggccaccugcggug

SEQ ID NO: 1856845 - RNA, 16 nt, Human
gucacucuggcagcuc

SEQ ID NO: 1856846 - RNA, 14 nt, Human
gucacucuggcagc

SEQ ID NO: 1856847 - RNA, 13 nt, Human
gucacucuggcag

SEQ ID NO: 1856848 - RNA, 12 nt, Human
gucacucuggca

SEQ ID NO: 1856849 - RNA, 19 nt, Human
gucacucuggcagcucaga

SEQ ID NO: 1856850 - RNA, 17 nt, Human
gucacucuggcagcuca

SEQ ID NO: 1856851 - RNA, 22 nt, Human
gucacucuggcagcucagagag

SEQ ID NO: 1856852 - RNA, 15 nt, Human
gucagagccugcagu

SEQ ID NO: 1856853 - RNA, 16 nt, Human
gucagagccugcaguu

SEQ ID NO: 1856854 - RNA, 14 nt, Human
gucagagccugcag

SEQ ID NO: 1856855 - RNA, 22 nt, Human
gucagaugcugugcaaauguua

SEQ ID NO: 1856856 - RNA, 17 nt, Human
gucucugguuccucccc

SEQ ID NO: 1856857 - RNA, 16 nt, Human
gucucugguuccuccc

SEQ ID NO: 1856858 - RNA, 18 nt, Human
gucucuucuccacuggau

SEQ ID NO: 1856859 - RNA, 21 nt, Human
gucucuggauuauauuaugaa

SEQ ID NO: 1856860 - RNA, 13 nt, Human
gucucugagcauu

SEQ ID NO: 1856861 - RNA, 17 nt, Human
gucucuggaauuugaaa

SEQ ID NO: 1856862 - RNA, 19 nt, Human
gucucgugguaggacugua

SEQ ID NO: 1856863 - RNA, 15 nt, Human
gucucacucugucgc

SEQ ID NO: 1856864 - RNA, 16 nt, Human
gucucacucugucgcc

SEQ ID NO: 1856865 - RNA, 18 nt, Human
gucucacucugucgccca

SEQ ID NO: 1856866 - RNA, 19 nt, Human
gucucacucugucgcccag

SEQ ID NO: 1856867 - RNA, 22 nt, Human
gucucacucugucgcccagucu

SEQ ID NO: 1856868 - RNA, 16 nt, Human
gucgggcaugacacga

SEQ ID NO: 1856869 - RNA, 21 nt, Human
gucggaaaacaugcuacacac

SEQ ID NO: 1856870 - RNA, 19 nt, Human
guccuuaccagcagagcac

SEQ ID NO: 1856871 - RNA, 18 nt, Human
guccuuaccagcagagca

SEQ ID NO: 1856872 - RNA, 21 nt, Human
guccuuaccagcagagcaccu

SEQ ID NO: 1856873 - RNA, 14 nt, Human
gucccugccaaugg

SEQ ID NO: 1856874 - RNA, 11 nt, Human
gucccugccaa

SEQ ID NO: 1856875 - RNA, 15 nt, Human
gucccugccaaugga

SEQ ID NO: 1856876 - RNA, 18 nt, Human
gucucacuauguugccca

SEQ ID NO: 1856877 - RNA, 11 nt, Human
gucucacucug

SEQ ID NO: 1856878 - RNA, 19 nt, Human
gucucacuauguugcccag

SEQ ID NO: 1856879 - RNA, 18 nt, Human
gucgucaaagcugaaaug

SEQ ID NO: 1856880 - RNA, 21 nt, Human
gucuugaacuccuggccucaa

SEQ ID NO: 1856881 - RNA, 18 nt, Human
gucuugaacuccuggccu

SEQ ID NO: 1856882 - RNA, 20 nt, Human
gucuugaacuccuggccuca

SEQ ID NO: 1856883 - RNA, 16 nt, Human
gucuugcaauggcagc

SEQ ID NO: 1856884 - RNA, 17 nt, Human
gucuugcaauggcagcc

SEQ ID NO: 1856885 - RNA, 18 nt, Human
gucuugcaauggcagccu

SEQ ID NO: 1856886 - RNA, 19 nt, Human
gucuugcaauggcagccuu

SEQ ID NO: 1856887 - RNA, 21 nt, Human
gucuuaaaaaguggaaaaaua

SEQ ID NO: 1856888 - RNA, 16 nt, Human
gucuugaacuccuggc

SEQ ID NO: 1856889 - RNA, 17 nt, Human
gucuugaacuccuggcc

SEQ ID NO: 1856890 - RNA, 16 nt, Human
gucuuuuuucacuaca

SEQ ID NO: 1856891 - RNA, 23 nt, Human
gucuugcaauggcagccuuggca

SEQ ID NO: 1856892 - RNA, 20 nt, Human
gucuugcaauggcagccuug

SEQ ID NO: 1856893 - RNA, 21 nt, Human
gucuugcaauggcagccuugg

SEQ ID NO: 1856894 - RNA, 22 nt, Human
gucugugagaugcuagaacucc

SEQ ID NO: 1856895 - RNA, 23 nt, Human
gucugugagaugcuagaacuccc

SEQ ID NO: 1856896 - RNA, 18 nt, Human
gucugugccauuuuguau

SEQ ID NO: 1856897 - RNA, 15 nt, Human
gucugugagaugcua

SEQ ID NO: 1856898 - RNA, 16 nt, Human
gucugugagaugcuag

SEQ ID NO: 1856899 - RNA, 17 nt, Human
gucugugagaugcuaga

SEQ ID NO: 1856900 - RNA, 21 nt, Human
gucugugagaugcuagaacuc

SEQ ID NO: 1856901 - RNA, 14 nt, Human
gucuguucuuucca

SEQ ID NO: 1856902 - RNA, 17 nt, Human
gucuguucuuuccaaag

SEQ ID NO: 1856903 - RNA, 12 nt, Human
gugacagaggca

SEQ ID NO: 1856904 - RNA, 13 nt, Human
gugacagaggcag

SEQ ID NO: 1856905 - RNA, 14 nt, Human
gugacagaggcagc

SEQ ID NO: 1856906 - RNA, 12 nt, Human
gugaccucugcc

SEQ ID NO: 1856907 - RNA, 15 nt, Human
gugacagaggcagcc

SEQ ID NO: 1856908 - RNA, 13 nt, Human
gugaccucugccu

SEQ ID NO: 1856909 - RNA, 14 nt, Human
gugaccucugccug

SEQ ID NO: 1856910 - RNA, 15 nt, Human
gugaccucugccuga

SEQ ID NO: 1856911 - RNA, 21 nt, Human
gugaaugaugauccuaggcau

SEQ ID NO: 1856912 - RNA, 20 nt, Human
gugacaaggauugcuacugu

SEQ ID NO: 1856913 - RNA, 21 nt, Human
gugaacaaauuuacagagaca

SEQ ID NO: 1856914 - RNA, 22 nt, Human
gugauccacccaccucagccuc

SEQ ID NO: 1856915 - RNA, 19 nt, Human
gugauauaaguguguguuu

SEQ ID NO: 1856916 - RNA, 17 nt, Human
gugaguugauagcacag

SEQ ID NO: 1856917 - RNA, 15 nt, Human
gugauacaaugcugu

SEQ ID NO: 1856918 - RNA, 17 nt, Human
gugauacaaugcugugc

SEQ ID NO: 1856919 - RNA, 15 nt, Human
gugagccacugcacc

SEQ ID NO: 1856920 - RNA, 20 nt, Human
gugagccacugcaccgggcc

SEQ ID NO: 1856921 - RNA, 17 nt, Human
gugaggaugaaaaaaua

SEQ ID NO: 1856922 - RNA, 18 nt, Human
gugaggagcuugaaaccc

SEQ ID NO: 1856923 - RNA, 19 nt, Human
gugagccgagaucacgcca

SEQ ID NO: 1856924 - RNA, 20 nt, Human
gugcccaagaauagaugcug

SEQ ID NO: 1856925 - RNA, 14 nt, Human
gugccaugugccag

SEQ ID NO: 1856926 - RNA, 16 nt, Human
gugccaugugccaggu

SEQ ID NO: 1856927 - RNA, 15 nt, Human
gugccuucagcucua

SEQ ID NO: 1856928 - RNA, 21 nt, Human
gugcgaucuggguucacugca

SEQ ID NO: 1856929 - RNA, 14 nt, Human
gugcggccuuuggc

SEQ ID NO: 1856930 - RNA, 14 nt, Human
gugcgccuacagga

SEQ ID NO: 1856931 - RNA, 20 nt, Human
gugcaguggugcgaucuggg

SEQ ID NO: 1856932 - RNA, 23 nt, Human
gugcaguggugcgaucuggguuc

SEQ ID NO: 1856933 - RNA, 22 nt, Human
gugcauaccacuuuuguucuug

SEQ ID NO: 1856934 - RNA, 13 nt, Human
gugcaucucagcc

SEQ ID NO: 1856935 - RNA, 23 nt, Human
gugauccacccaccucagccucc

SEQ ID NO: 1856936 - RNA, 24 nt, Human
gugauccacccaccucagccuccc

SEQ ID NO: 1856937 - RNA, 13 nt, Human
gugauuuuuguaa

SEQ ID NO: 1856938 - RNA, 18 nt, Human
gugauuuuuguaauuuuu

SEQ ID NO: 1856939 - RNA, 12 nt, Human
gugauuuucauu

SEQ ID NO: 1856940 - RNA, 13 nt, Human
guguggagaagcg

SEQ ID NO: 1856941 - RNA, 21 nt, Human
guguggagaagcggcuggcag

SEQ ID NO: 1856942 - RNA, 12 nt, Human
guguguuuuaaa

SEQ ID NO: 1856943 - RNA, 15 nt, Human
guguguuucugaucu

SEQ ID NO: 1856944 - RNA, 17 nt, Human
gugugcucaggagcccu

SEQ ID NO: 1856945 - RNA, 16 nt, Human
gugugcucaggagccc

SEQ ID NO: 1856946 - RNA, 19 nt, Human
gugugcucaggagcccugg

SEQ ID NO: 1856947 - RNA, 18 nt, Human
gugugcucaggagcccug

SEQ ID NO: 1856948 - RNA, 12 nt, Human
gugugcucugau

SEQ ID NO: 1856949 - RNA, 15 nt, Human
gugugcucugaucau

SEQ ID NO: 1856950 - RNA, 22 nt, Human
gugugcucugaucauccacugu

SEQ ID NO: 1856951 - RNA, 21 nt, Human
gugucucuugguccugcugca

SEQ ID NO: 1856952 - RNA, 20 nt, Human
gugucucuugguccugcugc

SEQ ID NO: 1856953 - RNA, 19 nt, Human
gugucucuugguccugcug

SEQ ID NO: 1856954 - RNA, 18 nt, Human
gugucucuugguccugcu

SEQ ID NO: 1856955 - RNA, 22 nt, Human
gugucucuugguccugcugcag

SEQ ID NO: 1856956 - RNA, 20 nt, Human
gugugagucaccaagcccag

SEQ ID NO: 1856957 - RNA, 14 nt, Human
gugucucuuggucc

SEQ ID NO: 1856958 - RNA, 17 nt, Human
gugucucccuucauccu

SEQ ID NO: 1856959 - RNA, 19 nt, Human
gugucuaggcaggaccugu

SEQ ID NO: 1856960 - RNA, 15 nt, Human
gugucgggcaugaca

SEQ ID NO: 1856961 - RNA, 14 nt, Human
guguccggucccug

SEQ ID NO: 1856962 - RNA, 23 nt, Human
gugucccugcacuugcagacucu

SEQ ID NO: 1856963 - RNA, 13 nt, Human
guguucugugaua

SEQ ID NO: 1856964 - RNA, 18 nt, Human
guguuuuucauaaagcag

SEQ ID NO: 1856965 - RNA, 19 nt, Human
guguguuuuaaaaugagaa

SEQ ID NO: 1856966 - RNA, 16 nt, Human
guguguuuuaaaauga

SEQ ID NO: 1856967 - RNA, 13 nt, Human
guguguuuuaaaa

SEQ ID NO: 1856968 - RNA, 14 nt, Human
guguguuuuucaua

SEQ ID NO: 1856969 - RNA, 18 nt, Human
guguuaugacuccagaau

SEQ ID NO: 1856970 - RNA, 12 nt, Human
guguuacuaagu

SEQ ID NO: 1856971 - RNA, 14 nt, Human
guguuacuaaguuu

SEQ ID NO: 1856972 - RNA, 13 nt, Human
guuacagacaaag

SEQ ID NO: 1856973 - RNA, 17 nt, Human
guuacacauuuuucaga

SEQ ID NO: 1856974 - RNA, 16 nt, Human
guuacacuaaaaggug

SEQ ID NO: 1856975 - RNA, 15 nt, Human
guuacacuaaaaggu

SEQ ID NO: 1856976 - RNA, 16 nt, Human
guuacacauuuuucag

SEQ ID NO: 1856977 - RNA, 18 nt, Human
guuaacugagugccuuuu

SEQ ID NO: 1856978 - RNA, 22 nt, Human
guuaaaauaccagccaguaaau

SEQ ID NO: 1856979 - RNA, 19 nt, Human
guuaaacuuacuuaguguu

SEQ ID NO: 1856980 - RNA, 21 nt, Human
guguaaguauucuuauuuaau

SEQ ID NO: 1856981 - RNA, 19 nt, Human
guggugcgaucuggguuca

SEQ ID NO: 1856982 - RNA, 21 nt, Human
guggugagaggcauccaguau

SEQ ID NO: 1856983 - RNA, 14 nt, Human
guggugaccucugc

SEQ ID NO: 1856984 - RNA, 17 nt, Human
guggugaccucugccug

SEQ ID NO: 1856985 - RNA, 18 nt, Human
gugguccuaaucuucuga

SEQ ID NO: 1856986 - RNA, 17 nt, Human
guggucccaccccacac

SEQ ID NO: 1856987 - RNA, 16 nt, Human
guggucccaccccaca

SEQ ID NO: 1856988 - RNA, 15 nt, Human
guggucccaccccac

SEQ ID NO: 1856989 - RNA, 14 nt, Human
guggucccacccca

SEQ ID NO: 1856990 - RNA, 17 nt, Human
gugguagagugugccug

SEQ ID NO: 1856991 - RNA, 19 nt, Human
gugguaugaucacggcuca

SEQ ID NO: 1856992 - RNA, 14 nt, Human
gugguauagaaaug

SEQ ID NO: 1856993 - RNA, 22 nt, Human
guguacauggaauaacauguaa

SEQ ID NO: 1856994 - RNA, 17 nt, Human
guguacauggaauaaca

SEQ ID NO: 1856995 - RNA, 13 nt, Human
guguacagucuug

SEQ ID NO: 1856996 - RNA, 16 nt, Human
guguacagucuuguau

SEQ ID NO: 1856997 - RNA, 22 nt, Human
guguacagucuuguauuaaguu

SEQ ID NO: 1856998 - RNA, 13 nt, Human
gugucccugcacu

SEQ ID NO: 1856999 - RNA, 16 nt, Human
gugucccugcacuugc

SEQ ID NO: 1857000 - RNA, 18 nt, Human
gugucccugcacuugcag

SEQ ID NO: 1857001 - RNA, 14 nt, Human
guggcucacgccug

SEQ ID NO: 1857002 - RNA, 15 nt, Human
gugcuaauuuugaaa

SEQ ID NO: 1857003 - RNA, 13 nt, Human
gugcuaauuuuga

SEQ ID NO: 1857004 - RNA, 14 nt, Human
guggcugcuucaag

SEQ ID NO: 1857005 - RNA, 12 nt, Human
guggcugcuuca

SEQ ID NO: 1857006 - RNA, 20 nt, Human
guggcuccucccggugccca

SEQ ID NO: 1857007 - RNA, 13 nt, Human
guggcuccucccg

SEQ ID NO: 1857008 - RNA, 22 nt, Human
guggcugcuucaaggauccuga

SEQ ID NO: 1857009 - RNA, 19 nt, Human
guggcugcuucaaggaucc

SEQ ID NO: 1857010 - RNA, 16 nt, Human
guggcugcuucaagga

SEQ ID NO: 1857011 - RNA, 15 nt, Human
guggcugcuucaagg

SEQ ID NO: 1857012 - RNA, 23 nt, Human
guggcugcuucaaggauccugag

SEQ ID NO: 1857013 - RNA, 19 nt, Human
guggcuggguuggagggug

SEQ ID NO: 1857014 - RNA, 20 nt, Human
guggcuucccgcucagcccu

SEQ ID NO: 1857015 - RNA, 19 nt, Human
guggcuucccgcucagccc

SEQ ID NO: 1857016 - RNA, 18 nt, Human
guggcuucccgcucagcc

SEQ ID NO: 1857017 - RNA, 22 nt, Human
guggcuuaaaacaacacucaca

SEQ ID NO: 1857018 - RNA, 17 nt, Human
gugggcccaaugcacuu

SEQ ID NO: 1857019 - RNA, 19 nt, Human
gugggccuucagggaguga

SEQ ID NO: 1857020 - RNA, 22 nt, Human
gugggcgugagaccugccccuc

SEQ ID NO: 1857021 - RNA, 21 nt, Human
gugggcgugagaccugccccu

SEQ ID NO: 1857022 - RNA, 18 nt, Human
gugggcgugagaccugcc

SEQ ID NO: 1857023 - RNA, 12 nt, Human
gugggcuaagca

SEQ ID NO: 1857024 - RNA, 15 nt, Human
gugggcuaguugggc

SEQ ID NO: 1857025 - RNA, 13 nt, Human
guggggaggggcu

SEQ ID NO: 1857026 - RNA, 18 nt, Human
guggggaccucaggccug

SEQ ID NO: 1857027 - RNA, 15 nt, Human
guggggaccucaggc

SEQ ID NO: 1857028 - RNA, 13 nt, Human
guggggcagcuug

SEQ ID NO: 1857029 - RNA, 17 nt, Human
guggggcagcuugaggg

SEQ ID NO: 1857030 - RNA, 23 nt, Human
guggguuucuaaagcugccagcc

SEQ ID NO: 1857031 - RNA, 21 nt, Human
guuaugacuccagaauuuccc

SEQ ID NO: 1857032 - RNA, 23 nt, Human
guucaauucucauuugucacaca

SEQ ID NO: 1857033 - RNA, 16 nt, Human
guucaauucucauuug

SEQ ID NO: 1857034 - RNA, 20 nt, Human
guucaagcgauucuucugcu

SEQ ID NO: 1857035 - RNA, 23 nt, Human
guucaagugauucucaugccuca

SEQ ID NO: 1857036 - RNA, 19 nt, Human
guuauuaaaaaucucaaau

SEQ ID NO: 1857037 - RNA, 19 nt, Human
guucaagcgauucuucugc

SEQ ID NO: 1857038 - RNA, 17 nt, Human
guuauuauauuuacaaa

SEQ ID NO: 1857039 - RNA, 19 nt, Human
guuacauaagauaaaugug

SEQ ID NO: 1857040 - RNA, 18 nt, Human
guuacauaagauaaaugu

SEQ ID NO: 1857041 - RNA, 17 nt, Human
guuacagacaaagcgug

SEQ ID NO: 1857042 - RNA, 15 nt, Human
guuacagacaaagcg

SEQ ID NO: 1857043 - RNA, 21 nt, Human
guuacauuuuuaagugcugca

SEQ ID NO: 1857044 - RNA, 23 nt, Human
guuaccauuuugggguacccacu

SEQ ID NO: 1857045 - RNA, 19 nt, Human
guuaguuucuccaagcagg

SEQ ID NO: 1857046 - RNA, 16 nt, Human
guuaguuucuccaagc

SEQ ID NO: 1857047 - RNA, 22 nt, Human
guuaguuucuccaagcaggaca

SEQ ID NO: 1857048 - RNA, 22 nt, Human
guuacuaaguuuuuauggcuuu

SEQ ID NO: 1857049 - RNA, 15 nt, Human
guuacucagaauucu

SEQ ID NO: 1857050 - RNA, 24 nt, Human
guucacucuacuuagcaugucccu

SEQ ID NO: 1857051 - RNA, 19 nt, Human
guucacugcaaccuccgcc

SEQ ID NO: 1857052 - RNA, 13 nt, Human
guucaucuugaau

SEQ ID NO: 1857053 - RNA, 12 nt, Human
guucaucuugaa

SEQ ID NO: 1857054 - RNA, 18 nt, Human
guucaucuugaauuguaa

SEQ ID NO: 1857055 - RNA, 16 nt, Human
guucaucaaugaauga

SEQ ID NO: 1857056 - RNA, 17 nt, Human
guucaucauccuaagcu

SEQ ID NO: 1857057 - RNA, 20 nt, Human
guuccaccaucaagccacca

SEQ ID NO: 1857058 - RNA, 17 nt, Human
guuccaccaucaagcca

SEQ ID NO: 1857059 - RNA, 21 nt, Human
guuccagcaauucuccugccu

SEQ ID NO: 1857060 - RNA, 20 nt, Human
guuccagcaauucuccugcc

SEQ ID NO: 1857061 - RNA, 23 nt, Human
guuccagcaauucuccugccuca

SEQ ID NO: 1857062 - RNA, 22 nt, Human
guuccucauuagcauuuugcua

SEQ ID NO: 1857063 - RNA, 14 nt, Human
guuccuaauccucu

SEQ ID NO: 1857064 - RNA, 23 nt, Human
guuccuccccuccuccuggacuc

SEQ ID NO: 1857065 - RNA, 17 nt, Human
guugaaaaacagcugag

SEQ ID NO: 1857066 - RNA, 13 nt, Human
guucuuuccaaag

SEQ ID NO: 1857067 - RNA, 14 nt, Human
guucuuuccaaagu

SEQ ID NO: 1857068 - RNA, 18 nt, Human
guucuuuccaaaguacac

SEQ ID NO: 1857069 - RNA, 20 nt, Human
guucuuuccaaaguacacug

SEQ ID NO: 1857070 - RNA, 15 nt, Human
guucuuucuuccucu

SEQ ID NO: 1857071 - RNA, 14 nt, Human
guucuuucuuccuc

SEQ ID NO: 1857072 - RNA, 19 nt, Human
guucuuucuuccucugcug

SEQ ID NO: 1857073 - RNA, 18 nt, Human
guucuuucuuccucugcu

SEQ ID NO: 1857074 - RNA, 17 nt, Human
guucuuucuuccucugc

SEQ ID NO: 1857075 - RNA, 16 nt, Human
guucuuucuuccucug

SEQ ID NO: 1857076 - RNA, 20 nt, Human
guucuggcucuuccaggcug

SEQ ID NO: 1857077 - RNA, 16 nt, Human
guucuggcucuuccag

SEQ ID NO: 1857078 - RNA, 12 nt, Human
guucuggcucuu

SEQ ID NO: 1857079 - RNA, 23 nt, Human
guucuggcagaguugaagacaga

SEQ ID NO: 1857080 - RNA, 11 nt, Human
guucugggaca

SEQ ID NO: 1857081 - RNA, 12 nt, Human
guucugggacac

SEQ ID NO: 1857082 - RNA, 14 nt, Human
guucugggacacag

SEQ ID NO: 1857083 - RNA, 15 nt, Human
guucugggacacagu

SEQ ID NO: 1857084 - RNA, 16 nt, Human
guucugggacacaguu

SEQ ID NO: 1857085 - RNA, 18 nt, Human
guucuuucacccuuuucu

SEQ ID NO: 1857086 - RNA, 23 nt, Human
guucugggacacaguucaauucu

SEQ ID NO: 1857087 - RNA, 14 nt, Human
guucuaaagaugga

SEQ ID NO: 1857088 - RNA, 17 nt, Human
guucuaaagauggaaaa

SEQ ID NO: 1857089 - RNA, 20 nt, Human
guucuaaagauggaaaaacc

SEQ ID NO: 1857090 - RNA, 23 nt, Human
guucuaaagauggaaaaaccacc

SEQ ID NO: 1857091 - RNA, 17 nt, Human
guuccuuccucugagcc

SEQ ID NO: 1857092 - RNA, 19 nt, Human
guuccuuccucugagccuu

SEQ ID NO: 1857093 - RNA, 18 nt, Human
guuccuuccucugagccu

SEQ ID NO: 1857094 - RNA, 19 nt, Human
guucugauccuaguuccac

SEQ ID NO: 1857095 - RNA, 16 nt, Human
guucugcacacagcac

SEQ ID NO: 1857096 - RNA, 15 nt, Human
guucugcacacagca

SEQ ID NO: 1857097 - RNA, 23 nt, Human
guugccagucaccccggccaccu

SEQ ID NO: 1857098 - RNA, 18 nt, Human
guugccagucaccccggc

SEQ ID NO: 1857099 - RNA, 17 nt, Human
guugccagucaccccgg

SEQ ID NO: 1857100 - RNA, 16 nt, Human
guugccagucaccccg

SEQ ID NO: 1857101 - RNA, 14 nt, Human
guugccagucaccc

SEQ ID NO: 1857102 - RNA, 13 nt, Human
guugccagucacc

SEQ ID NO: 1857103 - RNA, 12 nt, Human
guugcccaggca

SEQ ID NO: 1857104 - RNA, 15 nt, Human
guugcccaggcaggu

SEQ ID NO: 1857105 - RNA, 14 nt, Human
guugcccaggcagg

SEQ ID NO: 1857106 - RNA, 14 nt, Human
guuggccaggcugc

SEQ ID NO: 1857107 - RNA, 13 nt, Human
guuggccaggcug

SEQ ID NO: 1857108 - RNA, 15 nt, Human
guuggccaggcuggu

SEQ ID NO: 1857109 - RNA, 14 nt, Human
guuggccaggcugg

SEQ ID NO: 1857110 - RNA, 18 nt, Human
guuggccaggcuggucuc

SEQ ID NO: 1857111 - RNA, 19 nt, Human
guuggccaggcugcucuug

SEQ ID NO: 1857112 - RNA, 17 nt, Human
guuggccaggcuggucu

SEQ ID NO: 1857113 - RNA, 19 nt, Human
guuggccaggcuggucuca

SEQ ID NO: 1857114 - RNA, 14 nt, Human
guuggccaguguga

SEQ ID NO: 1857115 - RNA, 23 nt, Human
guuggccaaagccaaagcuaggc

SEQ ID NO: 1857116 - RNA, 18 nt, Human
guuggcaaaaaggcagga

SEQ ID NO: 1857117 - RNA, 20 nt, Human
guuggauuuuugucuugugu

SEQ ID NO: 1857118 - RNA, 14 nt, Human
guuggcaaaaaggc

SEQ ID NO: 1857119 - RNA, 14 nt, Human
guuggauuuuuguc

SEQ ID NO: 1857120 - RNA, 14 nt, Human
guugaagccuuugu

SEQ ID NO: 1857121 - RNA, 13 nt, Human
guugaagccuuug

SEQ ID NO: 1857122 - RNA, 16 nt, Human
guugaagacagagcua

SEQ ID NO: 1857123 - RNA, 15 nt, Human
guugcaggaccucag

SEQ ID NO: 1857124 - RNA, 14 nt, Human
guugcaacuuugua

SEQ ID NO: 1857125 - RNA, 23 nt, Human
guugauuucagcaccuacagugu

SEQ ID NO: 1857126 - RNA, 16 nt, Human
guugcaacuuuguaua

SEQ ID NO: 1857127 - RNA, 19 nt, Human
guuuaggaacuacugagga

SEQ ID NO: 1857128 - RNA, 14 nt, Human
guuguuacauuuuu

SEQ ID NO: 1857129 - RNA, 15 nt, Human
guuguuacauuuuua

SEQ ID NO: 1857130 - RNA, 20 nt, Human
guuguuugauucagacagcu

SEQ ID NO: 1857131 - RNA, 14 nt, Human
guuuagauaauaca

SEQ ID NO: 1857132 - RNA, 15 nt, Human
guuuagauaauacac

SEQ ID NO: 1857133 - RNA, 22 nt, Human
guugucugaagucacugcacag

SEQ ID NO: 1857134 - RNA, 19 nt, Human
guugucugaagucacugca

SEQ ID NO: 1857135 - RNA, 14 nt, Human
guugugguuaaucu

SEQ ID NO: 1857136 - RNA, 22 nt, Human
guuguggauuuaacagaaaugu

SEQ ID NO: 1857137 - RNA, 15 nt, Human
guuguuaauaaaagu

SEQ ID NO: 1857138 - RNA, 12 nt, Human
guugucagcuga

SEQ ID NO: 1857139 - RNA, 23 nt, Human
guuggcugggggccucagugcca

SEQ ID NO: 1857140 - RNA, 19 nt, Human
guuggcugggggccucagu

SEQ ID NO: 1857141 - RNA, 20 nt, Human
guuggccccugcccggcugc

SEQ ID NO: 1857142 - RNA, 13 nt, Human
guuggccccugcc

SEQ ID NO: 1857143 - RNA, 14 nt, Human
guuggccccugccc

SEQ ID NO: 1857144 - RNA, 12 nt, Human
guuggcuggggg

SEQ ID NO: 1857145 - RNA, 18 nt, Human
guuucuuuguaaugaaaa

SEQ ID NO: 1857146 - RNA, 16 nt, Human
guuucuuuaguuuuug

SEQ ID NO: 1857147 - RNA, 19 nt, Human
guuucuuuguaaugaaaac

SEQ ID NO: 1857148 - RNA, 18 nt, Human
guuugagaucagccuggg

SEQ ID NO: 1857149 - RNA, 23 nt, Human
guuugauuaaauucuugcaaagu

SEQ ID NO: 1857150 - RNA, 17 nt, Human
guuugagaucagccugg

SEQ ID NO: 1857151 - RNA, 21 nt, Human
guuugauucagacagcugccu

SEQ ID NO: 1857152 - RNA, 20 nt, Human
guuugauucagacagcugcc

SEQ ID NO: 1857153 - RNA, 16 nt, Human
guuugauucagacagc

SEQ ID NO: 1857154 - RNA, 20 nt, Human
guuuguaaauuaacuuuuau

SEQ ID NO: 1857155 - RNA, 18 nt, Human
guuuguuucugaaaggga

SEQ ID NO: 1857156 - RNA, 20 nt, Human
guuuuccaugaguccccugu

SEQ ID NO: 1857157 - RNA, 19 nt, Human
guuuuccaugaguccccug

SEQ ID NO: 1857158 - RNA, 20 nt, Human
guuuuccagguuuaagcugu

SEQ ID NO: 1857159 - RNA, 13 nt, Human
guuuuccugaaga

SEQ ID NO: 1857160 - RNA, 12 nt, Human
guuuuguaaauu

SEQ ID NO: 1857161 - RNA, 14 nt, Human
guuuuguaaauuuc

SEQ ID NO: 1857162 - RNA, 16 nt, Human
guuuuaaaaugagaaa

SEQ ID NO: 1857163 - RNA, 15 nt, Human
guuuuaaaaugagaa

SEQ ID NO: 1857164 - RNA, 20 nt, Human
guuuguuucugaaagggacg

SEQ ID NO: 1857165 - RNA, 17 nt, Human
guuuucaaaauaaaaau

SEQ ID NO: 1857166 - RNA, 20 nt, Human
guuuucaaaauuguuacaaa

SEQ ID NO: 1857167 - RNA, 17 nt, Human
guuuuaaaaugagaaau

SEQ ID NO: 1857168 - RNA, 24 nt, Human
guuuucaggaguggguugauuuca

SEQ ID NO: 1857169 - RNA, 11 nt, Human
guuuucacucu

SEQ ID NO: 1857170 - RNA, 12 nt, Human
guuuucacucuu

SEQ ID NO: 1857171 - RNA, 12 nt, Human
uaaaaggugacc

SEQ ID NO: 1857172 - RNA, 19 nt, Human
uaaaaggugaccaaugaug

SEQ ID NO: 1857173 - RNA, 12 nt, Human
uaaaaggagcca

SEQ ID NO: 1857174 - RNA, 21 nt, Human
uaaaagguaugcaaucaaauc

SEQ ID NO: 1857175 - RNA, 14 nt, Human
uaaaagauacaguu

SEQ ID NO: 1857176 - RNA, 17 nt, Human
uaaaagauacaguuacu

SEQ ID NO: 1857177 - RNA, 20 nt, Human
uaaaagauacaguuacucag

SEQ ID NO: 1857178 - RNA, 21 nt, Human
uaaaagauacaguuacucaga

SEQ ID NO: 1857179 - RNA, 17 nt, Human
uaaaaacaaagaaauua

SEQ ID NO: 1857180 - RNA, 21 nt, Human
uaaaaacaaagaaauuaugug

SEQ ID NO: 1857181 - RNA, 21 nt, Human
guuuuuaaggguuuguggaaa

SEQ ID NO: 1857182 - RNA, 17 nt, Human
guuuuuaauaaagacag

SEQ ID NO: 1857183 - RNA, 18 nt, Human
uaaaaaugguuuaaaugg

SEQ ID NO: 1857184 - RNA, 19 nt, Human
uaaaaaugguuuaaauggu

SEQ ID NO: 1857185 - RNA, 19 nt, Human
uaaaacacuuccauaaucu

SEQ ID NO: 1857186 - RNA, 23 nt, Human
uaaaacacaacaucuuuuucuac

SEQ ID NO: 1857187 - RNA, 22 nt, Human
uaaaacacaacaucuuuuucua

SEQ ID NO: 1857188 - RNA, 17 nt, Human
uaaaacacaacaucuuu

SEQ ID NO: 1857189 - RNA, 22 nt, Human
uaaaacaagcacuaaacaaaga

SEQ ID NO: 1857190 - RNA, 15 nt, Human
uaaaacaacacucac

SEQ ID NO: 1857191 - RNA, 16 nt, Human
uaaagaaaaguuuugu

SEQ ID NO: 1857192 - RNA, 22 nt, Human
uaaagaaaaguuuuguaaauuu

SEQ ID NO: 1857193 - RNA, 12 nt, Human
uaaagaaaacug

SEQ ID NO: 1857194 - RNA, 16 nt, Human
uaaagcagcguuucua

SEQ ID NO: 1857195 - RNA, 17 nt, Human
uaaagcagcguuucuau

SEQ ID NO: 1857196 - RNA, 19 nt, Human
uaaagcagcguuucuauga

SEQ ID NO: 1857197 - RNA, 18 nt, Human
uaaagcaggcagaacuca

SEQ ID NO: 1857198 - RNA, 15 nt, Human
uaaaggcuaccuuug

SEQ ID NO: 1857199 - RNA, 20 nt, Human
uaaagccugaguuugcuuuc

SEQ ID NO: 1857200 - RNA, 14 nt, Human
uaaagcugaaaacu

SEQ ID NO: 1857201 - RNA, 17 nt, Human
uaaaggcuaccuuugua

SEQ ID NO: 1857202 - RNA, 14 nt, Human
uaaaguguuugaaa

SEQ ID NO: 1857203 - RNA, 22 nt, Human
uaaacuugguuuuuaaaaaacu

SEQ ID NO: 1857204 - RNA, 21 nt, Human
uaaacaagaccacguuucuaa

SEQ ID NO: 1857205 - RNA, 22 nt, Human
uaaacaagaccacguuucuaaa

SEQ ID NO: 1857206 - RNA, 20 nt, Human
uaaacaagaccacguuucua

SEQ ID NO: 1857207 - RNA, 16 nt, Human
uaaaaucuugaaaaug

SEQ ID NO: 1857208 - RNA, 17 nt, Human
uaaacacucuugaaaaa

SEQ ID NO: 1857209 - RNA, 15 nt, Human
uaaacacucuugaaa

SEQ ID NO: 1857210 - RNA, 18 nt, Human
uaaacacucuugaaaaau

SEQ ID NO: 1857211 - RNA, 17 nt, Human
uaaaugcccagccccuu

SEQ ID NO: 1857212 - RNA, 16 nt, Human
uaaaugcccagccccu

SEQ ID NO: 1857213 - RNA, 15 nt, Human
uaaaugcccagcccc

SEQ ID NO: 1857214 - RNA, 14 nt, Human
uaaaugcccagccc

SEQ ID NO: 1857215 - RNA, 16 nt, Human
uaaauggaaccacucu

SEQ ID NO: 1857216 - RNA, 11 nt, Human
uaaaugcugcu

SEQ ID NO: 1857217 - RNA, 17 nt, Human
uaaaugcugcuuuuucu

SEQ ID NO: 1857218 - RNA, 13 nt, Human
uaaaugcccagcc

SEQ ID NO: 1857219 - RNA, 16 nt, Human
uaaaguugguaaaccu

SEQ ID NO: 1857220 - RNA, 17 nt, Human
uaaaguugguaaaccuu

SEQ ID NO: 1857221 - RNA, 18 nt, Human
uaaaugggggugcauuug

SEQ ID NO: 1857222 - RNA, 19 nt, Human
uaaaugggggugcauuuga

SEQ ID NO: 1857223 - RNA, 14 nt, Human
uaaaugggggugca

SEQ ID NO: 1857224 - RNA, 17 nt, Human
uaaaugggggugcauuu

SEQ ID NO: 1857225 - RNA, 15 nt, Human
uaaauguagaaagug

SEQ ID NO: 1857226 - RNA, 20 nt, Human
uaaaugucuaguuguaacac

SEQ ID NO: 1857227 - RNA, 22 nt, Human
uaaaugucucuuuaaugucaca

SEQ ID NO: 1857228 - RNA, 18 nt, Human
uaacaccaugauuaacca

SEQ ID NO: 1857229 - RNA, 20 nt, Human
uaaauugacacuuaaaaaug

SEQ ID NO: 1857230 - RNA, 23 nt, Human
uaaauugacacuuaaaaaugguu

SEQ ID NO: 1857231 - RNA, 17 nt, Human
uaaauucuugcaaagua

SEQ ID NO: 1857232 - RNA, 18 nt, Human
uaaauucuugcaaaguau

SEQ ID NO: 1857233 - RNA, 22 nt, Human
uaaauucuugcaaaguaucccu

SEQ ID NO: 1857234 - RNA, 16 nt, Human
uaaauucuugcaaagu

SEQ ID NO: 1857235 - RNA, 11 nt, Human
uaaauuauuuu

SEQ ID NO: 1857236 - RNA, 24 nt, Human
uaagaaagacuaucuaaauguuga

SEQ ID NO: 1857237 - RNA, 19 nt, Human
uaagaaccuuuugagugcc

SEQ ID NO: 1857238 - RNA, 16 nt, Human
uaagaaaaaggaugca

SEQ ID NO: 1857239 - RNA, 18 nt, Human
uaagaaaaaggaugcaca

SEQ ID NO: 1857240 - RNA, 19 nt, Human
uaagaaaaaggaugcacag

SEQ ID NO: 1857241 - RNA, 23 nt, Human
uaagaaaaaggaugcacagaguu

SEQ ID NO: 1857242 - RNA, 23 nt, Human
uaaccaguguuguggauuuaaca

SEQ ID NO: 1857243 - RNA, 16 nt, Human
uaaccacuucagcuga

SEQ ID NO: 1857244 - RNA, 13 nt, Human
uaaccagaucauu

SEQ ID NO: 1857245 - RNA, 12 nt, Human
uaacagaaaugu

SEQ ID NO: 1857246 - RNA, 11 nt, Human
uaacagaaaug

SEQ ID NO: 1857247 - RNA, 16 nt, Human
uaacuauguugauaaa

SEQ ID NO: 1857248 - RNA, 14 nt, Human
uaagugcugcauuu

SEQ ID NO: 1857249 - RNA, 23 nt, Human
uaagugaggaugaaaaaauaaca

SEQ ID NO: 1857250 - RNA, 12 nt, Human
uaagugagagag

SEQ ID NO: 1857251 - RNA, 22 nt, Human
uaagugauugcugguuuuaguu

SEQ ID NO: 1857252 - RNA, 13 nt, Human
uaagugaaauaag

SEQ ID NO: 1857253 - RNA, 15 nt, Human
uaagugcugcauuua

SEQ ID NO: 1857254 - RNA, 16 nt, Human
uaagugcugcauuuaa

SEQ ID NO: 1857255 - RNA, 18 nt, Human
uaagugcugcauuuaaaa

SEQ ID NO: 1857256 - RNA, 22 nt, Human
uaagugcugcauuuaaaagaua

SEQ ID NO: 1857257 - RNA, 15 nt, Human
uaaguggugugugua

SEQ ID NO: 1857258 - RNA, 16 nt, Human
uaagugguguguguau

SEQ ID NO: 1857259 - RNA, 12 nt, Human
uaauaaagcugu

SEQ ID NO: 1857260 - RNA, 15 nt, Human
uaagccaugggagac

SEQ ID NO: 1857261 - RNA, 12 nt, Human
uaagaggcaggg

SEQ ID NO: 1857262 - RNA, 15 nt, Human
uaagaggcagggucu

SEQ ID NO: 1857263 - RNA, 14 nt, Human
uaaggcaaucaugg

SEQ ID NO: 1857264 - RNA, 16 nt, Human
uaaggauguucuagca

SEQ ID NO: 1857265 - RNA, 14 nt, Human
uaagcuauucagua

SEQ ID NO: 1857266 - RNA, 17 nt, Human
uaaggguaucuggugac

SEQ ID NO: 1857267 - RNA, 20 nt, Human
uaagguggguacgggagggu

SEQ ID NO: 1857268 - RNA, 15 nt, Human
uaaggugugcucuga

SEQ ID NO: 1857269 - RNA, 23 nt, Human
uaaucugggccagaauuucaaac

SEQ ID NO: 1857270 - RNA, 18 nt, Human
uaaucugggccagaauuu

SEQ ID NO: 1857271 - RNA, 22 nt, Human
uaaucuggacuccucuguccag

SEQ ID NO: 1857272 - RNA, 21 nt, Human
uaaucuggacuccucugucca

SEQ ID NO: 1857273 - RNA, 20 nt, Human
uaaucuggacuccucugucc

SEQ ID NO: 1857274 - RNA, 19 nt, Human
uaaucuggacuccucuguc

SEQ ID NO: 1857275 - RNA, 15 nt, Human
uaaucuggacuccuc

SEQ ID NO: 1857276 - RNA, 18 nt, Human
uaaucuggacuccucugu

SEQ ID NO: 1857277 - RNA, 17 nt, Human
uaaucuggacuccucug

SEQ ID NO: 1857278 - RNA, 20 nt, Human
uaauccucuaggaggucucu

SEQ ID NO: 1857279 - RNA, 12 nt, Human
uaaucuaaaugg

SEQ ID NO: 1857280 - RNA, 13 nt, Human
uaaucuaaaugga

SEQ ID NO: 1857281 - RNA, 20 nt, Human
uaauauuaaggaagacaaug

SEQ ID NO: 1857282 - RNA, 15 nt, Human
uaauaugcacacauu

SEQ ID NO: 1857283 - RNA, 16 nt, Human
uaauaugcacacauuu

SEQ ID NO: 1857284 - RNA, 17 nt, Human
uaauaugcacacauuuu

SEQ ID NO: 1857285 - RNA, 18 nt, Human
uaauaugcacacauuuuu

SEQ ID NO: 1857286 - RNA, 19 nt, Human
uaauaugcacacauuuuuu

SEQ ID NO: 1857287 - RNA, 15 nt, Human
uaaugcgugcauacc

SEQ ID NO: 1857288 - RNA, 19 nt, Human
uaaugcgugcauaccacuu

SEQ ID NO: 1857289 - RNA, 22 nt, Human
uaaugcgugcauaccacuuuug

SEQ ID NO: 1857290 - RNA, 23 nt, Human
uaaugcgugcauaccacuuuugu

SEQ ID NO: 1857291 - RNA, 15 nt, Human
uaauggggcggugag

SEQ ID NO: 1857292 - RNA, 20 nt, Human
uaauuaaguacuauguauca

SEQ ID NO: 1857293 - RNA, 17 nt, Human
uaauuaaguacuaugua

SEQ ID NO: 1857294 - RNA, 14 nt, Human
uaauuaaguacuau

SEQ ID NO: 1857295 - RNA, 11 nt, Human
uaauguuuccu

SEQ ID NO: 1857296 - RNA, 11 nt, Human
uauagaaaugc

SEQ ID NO: 1857297 - RNA, 20 nt, Human
uaucaggugcugccauccag

SEQ ID NO: 1857298 - RNA, 14 nt, Human
uaucaaaagaaaga

SEQ ID NO: 1857299 - RNA, 19 nt, Human
uaucaggugcugccaucca

SEQ ID NO: 1857300 - RNA, 17 nt, Human
uaucaugacaaagacug

SEQ ID NO: 1857301 - RNA, 21 nt, Human
uauauuuuuuguuaaaugauu

SEQ ID NO: 1857302 - RNA, 15 nt, Human
uauaaacuuuaccuu

SEQ ID NO: 1857303 - RNA, 16 nt, Human
uauaaacuuuaccuuu

SEQ ID NO: 1857304 - RNA, 17 nt, Human
uauaaacuuuaccuuuu

SEQ ID NO: 1857305 - RNA, 18 nt, Human
uauaaacuuuaccuuuuu

SEQ ID NO: 1857306 - RNA, 13 nt, Human
uauaaacuuuacc

SEQ ID NO: 1857307 - RNA, 14 nt, Human
uauaaacuuuaccu

SEQ ID NO: 1857308 - RNA, 11 nt, Human
uauaaacuuua

SEQ ID NO: 1857309 - RNA, 16 nt, Human
uaguuugauuaaauuc

SEQ ID NO: 1857310 - RNA, 21 nt, Human
uaguuugauuaaauucuugca

SEQ ID NO: 1857311 - RNA, 15 nt, Human
uaguuugauuaaauu

SEQ ID NO: 1857312 - RNA, 20 nt, Human
uaguuguuugauucagacag

SEQ ID NO: 1857313 - RNA, 22 nt, Human
uaguuguuugauucagacagcu

SEQ ID NO: 1857314 - RNA, 21 nt, Human
uaguuguuugauucagacagc

SEQ ID NO: 1857315 - RNA, 15 nt, Human
uaguaugaggcauuu

SEQ ID NO: 1857316 - RNA, 16 nt, Human
uaguaugguggcuggg

SEQ ID NO: 1857317 - RNA, 20 nt, Human
uaguggcuuaaaacaacacu

SEQ ID NO: 1857318 - RNA, 22 nt, Human
uagcuggucuuauuuguaaagc

SEQ ID NO: 1857319 - RNA, 11 nt, Human
uagggaaaaac

SEQ ID NO: 1857320 - RNA, 11 nt, Human
uaggugacaga

SEQ ID NO: 1857321 - RNA, 16 nt, Human
uaggugacagagugag

SEQ ID NO: 1857322 - RNA, 17 nt, Human
uaggugugggggaagca

SEQ ID NO: 1857323 - RNA, 13 nt, Human
uagguguggggga

SEQ ID NO: 1857324 - RNA, 19 nt, Human
uaggugugacugaauuucu

SEQ ID NO: 1857325 - RNA, 21 nt, Human
uaggugugacugaauuucuuu

SEQ ID NO: 1857326 - RNA, 23 nt, Human
uaggugugacugaauuucuuuug

SEQ ID NO: 1857327 - RNA, 17 nt, Human
uaguaugaggcauuugu

SEQ ID NO: 1857328 - RNA, 18 nt, Human
uaguaugaggcauuuguu

SEQ ID NO: 1857329 - RNA, 16 nt, Human
uagcauacguacacau

SEQ ID NO: 1857330 - RNA, 17 nt, Human
uagcauacguacacauu

SEQ ID NO: 1857331 - RNA, 18 nt, Human
uagcauacguacacauuu

SEQ ID NO: 1857332 - RNA, 19 nt, Human
uagcauacguacacauuuu

SEQ ID NO: 1857333 - RNA, 11 nt, Human
uagcagggaaa

SEQ ID NO: 1857334 - RNA, 16 nt, Human
uagauacuguaucaug

SEQ ID NO: 1857335 - RNA, 16 nt, Human
uagccccucuccugga

SEQ ID NO: 1857336 - RNA, 16 nt, Human
uagccuaggugacaga

SEQ ID NO: 1857337 - RNA, 20 nt, Human
uagccugugccucugggacu

SEQ ID NO: 1857338 - RNA, 18 nt, Human
uagccugugccucuggga

SEQ ID NO: 1857339 - RNA, 12 nt, Human
uagcucauucuc

SEQ ID NO: 1857340 - RNA, 20 nt, Human
uagcucaggugucccugcac

SEQ ID NO: 1857341 - RNA, 21 nt, Human
uagcucaggugucccugcacu

SEQ ID NO: 1857342 - RNA, 15 nt, Human
uagcugggacuacag

SEQ ID NO: 1857343 - RNA, 17 nt, Human
uagcugggacuacaggc

SEQ ID NO: 1857344 - RNA, 19 nt, Human
uagcugggacuacaggcac

SEQ ID NO: 1857345 - RNA, 13 nt, Human
uagagaaggaccc

SEQ ID NO: 1857346 - RNA, 22 nt, Human
uagagaaggacccggaggggcc

SEQ ID NO: 1857347 - RNA, 11 nt, Human
uagagacaggg

SEQ ID NO: 1857348 - RNA, 14 nt, Human
uagagguucaaaga

SEQ ID NO: 1857349 - RNA, 15 nt, Human
uagagguucaaagau

SEQ ID NO: 1857350 - RNA, 12 nt, Human
uagagugggagc

SEQ ID NO: 1857351 - RNA, 14 nt, Human
uagaguugauacua

SEQ ID NO: 1857352 - RNA, 17 nt, Human
uagaguugauacuacag

SEQ ID NO: 1857353 - RNA, 20 nt, Human
uagacccacuggacucaccu

SEQ ID NO: 1857354 - RNA, 15 nt, Human
uagaauuaacacaug

SEQ ID NO: 1857355 - RNA, 16 nt, Human
uagaauuaacacauga

SEQ ID NO: 1857356 - RNA, 18 nt, Human
uagaauuaacacaugauc

SEQ ID NO: 1857357 - RNA, 23 nt, Human
uagaauuaguggcacuugcuuuu

SEQ ID NO: 1857358 - RNA, 14 nt, Human
uacuuguggacaca

SEQ ID NO: 1857359 - RNA, 23 nt, Human
uacauuuuuaagugcugcauuua

SEQ ID NO: 1857360 - RNA, 15 nt, Human
uacccacugcucugg

SEQ ID NO: 1857361 - RNA, 22 nt, Human
uaccuaacgaaguauccuucag

SEQ ID NO: 1857362 - RNA, 22 nt, Human
uaccgagucucuucuccacugg

SEQ ID NO: 1857363 - RNA, 21 nt, Human
uaccgagucucuucuccacug

SEQ ID NO: 1857364 - RNA, 18 nt, Human
uaccgagucucuucucca

SEQ ID NO: 1857365 - RNA, 17 nt, Human
uaccgagucucuucucc

SEQ ID NO: 1857366 - RNA, 15 nt, Human
uaccuacauacaauu

SEQ ID NO: 1857367 - RNA, 21 nt, Human
uacgaaaagaggggaagagac

SEQ ID NO: 1857368 - RNA, 18 nt, Human
uacgaaaagaggggaaga

SEQ ID NO: 1857369 - RNA, 13 nt, Human
uaccuuuuuuaua

SEQ ID NO: 1857370 - RNA, 16 nt, Human
uaccuuuuuuauacau

SEQ ID NO: 1857371 - RNA, 17 nt, Human
uaccuuuuuuauacaua

SEQ ID NO: 1857372 - RNA, 20 nt, Human
uacuaauagacaauuuauua

SEQ ID NO: 1857373 - RNA, 21 nt, Human
uacuaauagacaauuuauuau

SEQ ID NO: 1857374 - RNA, 14 nt, Human
uacuaaggaaucuu

SEQ ID NO: 1857375 - RNA, 13 nt, Human
uaccuuuuuuaga

SEQ ID NO: 1857376 - RNA, 19 nt, Human
uaccuuuuuuagaguugau

SEQ ID NO: 1857377 - RNA, 22 nt, Human
uaccuuuuuuagaguugauacu

SEQ ID NO: 1857378 - RNA, 21 nt, Human
uaccucuugagccuugaacuu

SEQ ID NO: 1857379 - RNA, 18 nt, Human
uaccucggugccuuccuc

SEQ ID NO: 1857380 - RNA, 21 nt, Human
uacugucuucaguaagccgug

SEQ ID NO: 1857381 - RNA, 16 nt, Human
uacuguccuacccacc

SEQ ID NO: 1857382 - RNA, 19 nt, Human
uacuugcucuugaugccug

SEQ ID NO: 1857383 - RNA, 18 nt, Human
uacuugcucuugaugccu

SEQ ID NO: 1857384 - RNA, 14 nt, Human
uacuugcucuugau

SEQ ID NO: 1857385 - RNA, 13 nt, Human
uacuugcucuuga

SEQ ID NO: 1857386 - RNA, 20 nt, Human
uacuugcucuugaugccugg

SEQ ID NO: 1857387 - RNA, 13 nt, Human
uacuuguggacac

SEQ ID NO: 1857388 - RNA, 22 nt, Human
uacuacaguccucccaucucac

SEQ ID NO: 1857389 - RNA, 13 nt, Human
uacuacaguuugu

SEQ ID NO: 1857390 - RNA, 14 nt, Human
uacuacaguuuguu

SEQ ID NO: 1857391 - RNA, 18 nt, Human
uacucgaguuacagacaa

SEQ ID NO: 1857392 - RNA, 22 nt, Human
uacucgaguuacagacaaagcg

SEQ ID NO: 1857393 - RNA, 12 nt, Human
uacuccucccag

SEQ ID NO: 1857394 - RNA, 15 nt, Human
uacuccccuccuuga

SEQ ID NO: 1857395 - RNA, 22 nt, Human
uacugcccaggccugccuguuc

SEQ ID NO: 1857396 - RNA, 21 nt, Human
uacugcccaggccugccuguu

SEQ ID NO: 1857397 - RNA, 20 nt, Human
uacugcccaggccugccugu

SEQ ID NO: 1857398 - RNA, 19 nt, Human
uacugcccaggccugccug

SEQ ID NO: 1857399 - RNA, 14 nt, Human
uacugccuauuuua

SEQ ID NO: 1857400 - RNA, 21 nt, Human
uacugccuauuuuaauaaaca

SEQ ID NO: 1857401 - RNA, 16 nt, Human
uacucuacccucuuag

SEQ ID NO: 1857402 - RNA, 15 nt, Human
uacacacugcauguu

SEQ ID NO: 1857403 - RNA, 21 nt, Human
uacacugugcugagucugaag

SEQ ID NO: 1857404 - RNA, 11 nt, Human
uacacacacac

SEQ ID NO: 1857405 - RNA, 18 nt, Human
uacaaaguagaagucuua

SEQ ID NO: 1857406 - RNA, 14 nt, Human
uacaaaguagaagu

SEQ ID NO: 1857407 - RNA, 22 nt, Human
uacauggaauaacauguaauua

SEQ ID NO: 1857408 - RNA, 19 nt, Human
uacauggaauaacauguaa

SEQ ID NO: 1857409 - RNA, 18 nt, Human
uacauggaauaacaugua

SEQ ID NO: 1857410 - RNA, 14 nt, Human
uacauggaauaaca

SEQ ID NO: 1857411 - RNA, 19 nt, Human
uacauuuuuaagugcugca

SEQ ID NO: 1857412 - RNA, 22 nt, Human
uacauuuuuaagugcugcauuu

SEQ ID NO: 1857413 - RNA, 14 nt, Human
uacauuuuuaagug

SEQ ID NO: 1857414 - RNA, 17 nt, Human
uacauaagauaaaugug

SEQ ID NO: 1857415 - RNA, 16 nt, Human
uacauaagauaaaugu

SEQ ID NO: 1857416 - RNA, 16 nt, Human
uacaugaaaacacauu

SEQ ID NO: 1857417 - RNA, 17 nt, Human
uacaugaaaacacauuu

SEQ ID NO: 1857418 - RNA, 18 nt, Human
uacaugaaaacacauuuu

SEQ ID NO: 1857419 - RNA, 19 nt, Human
uacaugaaaacacauuuuu

SEQ ID NO: 1857420 - RNA, 23 nt, Human
uacaugaaaacacauuuuucuua

SEQ ID NO: 1857421 - RNA, 19 nt, Human
uacaguuuguuaguaugag

SEQ ID NO: 1857422 - RNA, 21 nt, Human
uacaguuuguuaguaugaggc

SEQ ID NO: 1857423 - RNA, 16 nt, Human
uacauaaacaaguccu

SEQ ID NO: 1857424 - RNA, 13 nt, Human
uacagcugccugc

SEQ ID NO: 1857425 - RNA, 14 nt, Human
uacagcugccugca

SEQ ID NO: 1857426 - RNA, 13 nt, Human
uacaggaaguacu

SEQ ID NO: 1857427 - RNA, 18 nt, Human
uacaggaagguagaaaua

SEQ ID NO: 1857428 - RNA, 20 nt, Human
uacagcuugaccgugaggcc

SEQ ID NO: 1857429 - RNA, 23 nt, Human
uacacugugcugagucugaaggc

SEQ ID NO: 1857430 - RNA, 22 nt, Human
uacacugugcugagucugaagg

SEQ ID NO: 1857431 - RNA, 20 nt, Human
uacacuguuucaaacuuuac

SEQ ID NO: 1857432 - RNA, 16 nt, Human
uacacuuacacuuuau

SEQ ID NO: 1857433 - RNA, 22 nt, Human
uacacuguuucaaacuuuacua

SEQ ID NO: 1857434 - RNA, 18 nt, Human
uacagcuaaucagcauuc

SEQ ID NO: 1857435 - RNA, 16 nt, Human
uacagcuaaucagcau

SEQ ID NO: 1857436 - RNA, 19 nt, Human
uacaguugaaaaacagcug

SEQ ID NO: 1857437 - RNA, 17 nt, Human
uacaguugaaaaacagc

SEQ ID NO: 1857438 - RNA, 21 nt, Human
uacagcuugaccgugaggcca

SEQ ID NO: 1857439 - RNA, 20 nt, Human
uacaguugaaaaacagcuga

SEQ ID NO: 1857440 - RNA, 18 nt, Human
uacaguuuguuaguauga

SEQ ID NO: 1857441 - RNA, 15 nt, Human
uacaggaaguacugg

SEQ ID NO: 1857442 - RNA, 14 nt, Human
uacaggaaguacug

SEQ ID NO: 1857443 - RNA, 22 nt, Human
uacaggaaguacuggagaaaau

SEQ ID NO: 1857444 - RNA, 15 nt, Human
uacaggagugagcac

SEQ ID NO: 1857445 - RNA, 20 nt, Human
uacaggaugaugacuaugga

SEQ ID NO: 1857446 - RNA, 23 nt, Human
uacaguucggugagcuacaaaug

SEQ ID NO: 1857447 - RNA, 14 nt, Human
ugacacacagcucu

SEQ ID NO: 1857448 - RNA, 15 nt, Human
ugacacacagcucug

SEQ ID NO: 1857449 - RNA, 14 nt, Human
ugacagacacaggc

SEQ ID NO: 1857450 - RNA, 16 nt, Human
ugacagacacaggccc

SEQ ID NO: 1857451 - RNA, 13 nt, Human
ugacagacacagg

SEQ ID NO: 1857452 - RNA, 23 nt, Human
ugacaaggauugcuacuguccua

SEQ ID NO: 1857453 - RNA, 23 nt, Human
ugacaacacucauugaccugagg

SEQ ID NO: 1857454 - RNA, 15 nt, Human
ugacaacagacuucu

SEQ ID NO: 1857455 - RNA, 19 nt, Human
ugacaacagacuucugaaa

SEQ ID NO: 1857456 - RNA, 18 nt, Human
ugacaacagacuucugaa

SEQ ID NO: 1857457 - RNA, 13 nt, Human
ugacaacacucau

SEQ ID NO: 1857458 - RNA, 20 nt, Human
ugacaaagguaaaucagacu

SEQ ID NO: 1857459 - RNA, 13 nt, Human
ugaauuguaagga

SEQ ID NO: 1857460 - RNA, 21 nt, Human
ugaauuguaaggaaugauuaa

SEQ ID NO: 1857461 - RNA, 16 nt, Human
ugaccacugcagaaga

SEQ ID NO: 1857462 - RNA, 17 nt, Human
ugaccacugcagaagac

SEQ ID NO: 1857463 - RNA, 18 nt, Human
ugaccacugcagaagaca

SEQ ID NO: 1857464 - RNA, 13 nt, Human
ugacauguuuuau

SEQ ID NO: 1857465 - RNA, 23 nt, Human
ugaccagccuccaugcugccucc

SEQ ID NO: 1857466 - RNA, 22 nt, Human
ugaccagccuccaugcugccuc

SEQ ID NO: 1857467 - RNA, 21 nt, Human
ugaccagccuccaugcugccu

SEQ ID NO: 1857468 - RNA, 19 nt, Human
ugacauguguuggcagccu

SEQ ID NO: 1857469 - RNA, 15 nt, Human
ugacauauuuuugcu

SEQ ID NO: 1857470 - RNA, 23 nt, Human
ugacaucaacugcaucaagaugu

SEQ ID NO: 1857471 - RNA, 22 nt, Human
ugacagagcaagugagacccug

SEQ ID NO: 1857472 - RNA, 17 nt, Human
ugacagacacaggcccg

SEQ ID NO: 1857473 - RNA, 18 nt, Human
ugacagacacaggcccgg

SEQ ID NO: 1857474 - RNA, 17 nt, Human
ugaaucacguaaagcua

SEQ ID NO: 1857475 - RNA, 23 nt, Human
ugaaucacguaaagcuagaaaug

SEQ ID NO: 1857476 - RNA, 21 nt, Human
ugaaggcuggguucugauccu

SEQ ID NO: 1857477 - RNA, 20 nt, Human
ugaaggcuggguucugaucc

SEQ ID NO: 1857478 - RNA, 16 nt, Human
ugaaucuuggugucua

SEQ ID NO: 1857479 - RNA, 14 nt, Human
ugaaugcauaaaau

SEQ ID NO: 1857480 - RNA, 15 nt, Human
ugaaugaauggcuaa

SEQ ID NO: 1857481 - RNA, 20 nt, Human
ugaaugaauggcuaagcaaa

SEQ ID NO: 1857482 - RNA, 18 nt, Human
ugaaggccccgcccaggc

SEQ ID NO: 1857483 - RNA, 16 nt, Human
ugaagcuuuuauguga

SEQ ID NO: 1857484 - RNA, 21 nt, Human
ugaagcuuuuaugugaaacau

SEQ ID NO: 1857485 - RNA, 20 nt, Human
ugaaggccccgcccaggcuu

SEQ ID NO: 1857486 - RNA, 19 nt, Human
ugaaggccccgcccaggcu

SEQ ID NO: 1857487 - RNA, 16 nt, Human
ugaaacacuuugcaua

SEQ ID NO: 1857488 - RNA, 13 nt, Human
ugaaacauguuuc

SEQ ID NO: 1857489 - RNA, 19 nt, Human
ugaagacucauucuucugu

SEQ ID NO: 1857490 - RNA, 20 nt, Human
ugaagacucauucuucugua

SEQ ID NO: 1857491 - RNA, 16 nt, Human
ugaggcugggcucccu

SEQ ID NO: 1857492 - RNA, 15 nt, Human
ugaggcugggcuccc

SEQ ID NO: 1857493 - RNA, 18 nt, Human
ugaggcucugcccuuggu

SEQ ID NO: 1857494 - RNA, 15 nt, Human
ugaggcucugcccuu

SEQ ID NO: 1857495 - RNA, 16 nt, Human
ugaggcucugcccuug

SEQ ID NO: 1857496 - RNA, 21 nt, Human
ugagucccaggcugagccuca

SEQ ID NO: 1857497 - RNA, 20 nt, Human
ugagucccaggcugagccuc

SEQ ID NO: 1857498 - RNA, 21 nt, Human
ugaggcugggcucccuuccca

SEQ ID NO: 1857499 - RNA, 18 nt, Human
ugaggucagagccugcag

SEQ ID NO: 1857500 - RNA, 19 nt, Human
ugaggucagagccugcagu

SEQ ID NO: 1857501 - RNA, 23 nt, Human
ugagcuuaagaauuuugagcagg

SEQ ID NO: 1857502 - RNA, 22 nt, Human
ugaggaugaaaaaauaacacug

SEQ ID NO: 1857503 - RNA, 19 nt, Human
ugaggaucagaguaaucca

SEQ ID NO: 1857504 - RNA, 17 nt, Human
ugaggaucagaguaauc

SEQ ID NO: 1857505 - RNA, 13 nt, Human
ugaggaucagagu

SEQ ID NO: 1857506 - RNA, 23 nt, Human
ugagccgagaucacgccacugca

SEQ ID NO: 1857507 - RNA, 20 nt, Human
ugagcagggcucagcgggga

SEQ ID NO: 1857508 - RNA, 22 nt, Human
ugagcagggcucagcggggaca

SEQ ID NO: 1857509 - RNA, 23 nt, Human
ugagcagggcucagcggggacag

SEQ ID NO: 1857510 - RNA, 22 nt, Human
ugagccgagaucacgccacugc

SEQ ID NO: 1857511 - RNA, 19 nt, Human
ugagcucaggaguuugaga

SEQ ID NO: 1857512 - RNA, 11 nt, Human
ugagcucagga

SEQ ID NO: 1857513 - RNA, 12 nt, Human
ugagcucagccc

SEQ ID NO: 1857514 - RNA, 11 nt, Human
ugagcucagcc

SEQ ID NO: 1857515 - RNA, 20 nt, Human
ugagcucagcccuggugggc

SEQ ID NO: 1857516 - RNA, 16 nt, Human
ugacuuuccucuuugg

SEQ ID NO: 1857517 - RNA, 21 nt, Human
ugacucuuucuauuguuucuu

SEQ ID NO: 1857518 - RNA, 19 nt, Human
ugacucuuggcacagcaug

SEQ ID NO: 1857519 - RNA, 14 nt, Human
ugacucuuggcaca

SEQ ID NO: 1857520 - RNA, 13 nt, Human
ugaccauucucca

SEQ ID NO: 1857521 - RNA, 14 nt, Human
ugaccauucuccac

SEQ ID NO: 1857522 - RNA, 14 nt, Human
ugagaccaaccugg

SEQ ID NO: 1857523 - RNA, 12 nt, Human
ugagaccugccc

SEQ ID NO: 1857524 - RNA, 22 nt, Human
ugagaccugccccuccucucug

SEQ ID NO: 1857525 - RNA, 15 nt, Human
ugagaccugccccuc

SEQ ID NO: 1857526 - RNA, 14 nt, Human
ugagaccugccccu

SEQ ID NO: 1857527 - RNA, 13 nt, Human
ugagaccugcccc

SEQ ID NO: 1857528 - RNA, 19 nt, Human
ugagaggggaacagacugg

SEQ ID NO: 1857529 - RNA, 18 nt, Human
ugagaggggaacagacug

SEQ ID NO: 1857530 - RNA, 14 nt, Human
ugagaggggaacag

SEQ ID NO: 1857531 - RNA, 15 nt, Human
ugagaaauaaaguuu

SEQ ID NO: 1857532 - RNA, 22 nt, Human
ugacuuuucuguccgagcuuug

SEQ ID NO: 1857533 - RNA, 15 nt, Human
ucuugcucugcugac

SEQ ID NO: 1857534 - RNA, 23 nt, Human
ucuugcucugcugacagacacag

SEQ ID NO: 1857535 - RNA, 17 nt, Human
ucuugccacugccucuu

SEQ ID NO: 1857536 - RNA, 16 nt, Human
ucuugccacugccucu

SEQ ID NO: 1857537 - RNA, 14 nt, Human
ucuugcucugcuga

SEQ ID NO: 1857538 - RNA, 23 nt, Human
ucuugcauggcaaggacugcagg

SEQ ID NO: 1857539 - RNA, 19 nt, Human
ucuugccaaauauaaauaa

SEQ ID NO: 1857540 - RNA, 20 nt, Human
ucuugaaauauaggaacuua

SEQ ID NO: 1857541 - RNA, 21 nt, Human
ucuugaaauauaggaacuuaa

SEQ ID NO: 1857542 - RNA, 22 nt, Human
ucuugaagacuuuucuuucagc

SEQ ID NO: 1857543 - RNA, 13 nt, Human
ucuugaagacuuu

SEQ ID NO: 1857544 - RNA, 16 nt, Human
ucuucuuggucucagu

SEQ ID NO: 1857545 - RNA, 15 nt, Human
ucuuagauguauaua

SEQ ID NO: 1857546 - RNA, 22 nt, Human
ucugugucagguggggcagcuu

SEQ ID NO: 1857547 - RNA, 17 nt, Human
ucugugucagguggggc

SEQ ID NO: 1857548 - RNA, 20 nt, Human
ucugugucagguggggcagc

SEQ ID NO: 1857549 - RNA, 23 nt, Human
ucuuagguuggcaaaaaggcagg

SEQ ID NO: 1857550 - RNA, 20 nt, Human
ucuuagguuggcaaaaaggc

SEQ ID NO: 1857551 - RNA, 14 nt, Human
ucuuauaauuuaaa

SEQ ID NO: 1857552 - RNA, 13 nt, Human
ucuuauaauuuaa

SEQ ID NO: 1857553 - RNA, 22 nt, Human
ucuuauccaacaucaacaucuu

SEQ ID NO: 1857554 - RNA, 21 nt, Human
ucuucagagacuccugcaggc

SEQ ID NO: 1857555 - RNA, 14 nt, Human
ucuucagaucucua

SEQ ID NO: 1857556 - RNA, 22 nt, Human
ucuucaguuaagccuuuggaaa

SEQ ID NO: 1857557 - RNA, 20 nt, Human
ucuucaguuaagccuuugga

SEQ ID NO: 1857558 - RNA, 19 nt, Human
ucuucaguuaagccuuugg

SEQ ID NO: 1857559 - RNA, 15 nt, Human
ucuucagaucucuaa

SEQ ID NO: 1857560 - RNA, 14 nt, Human
ucuuugcagacagg

SEQ ID NO: 1857561 - RNA, 17 nt, Human
ucuuugcagacaggcaa

SEQ ID NO: 1857562 - RNA, 23 nt, Human
ucuuugagugaagcugggagaac

SEQ ID NO: 1857563 - RNA, 13 nt, Human
ucuuugcagacag

SEQ ID NO: 1857564 - RNA, 15 nt, Human
ucuuuggacccugag

SEQ ID NO: 1857565 - RNA, 14 nt, Human
ucuuuggacccuga

SEQ ID NO: 1857566 - RNA, 16 nt, Human
ucuuuggacccugagg

SEQ ID NO: 1857567 - RNA, 13 nt, Human
ucuuuggacccug

SEQ ID NO: 1857568 - RNA, 23 nt, Human
ucuuucccucccuuccucuuucc

SEQ ID NO: 1857569 - RNA, 13 nt, Human
ucuuucccucccu

SEQ ID NO: 1857570 - RNA, 12 nt, Human
ucuuucccuccc

SEQ ID NO: 1857571 - RNA, 13 nt, Human
ucuuguguguuua

SEQ ID NO: 1857572 - RNA, 23 nt, Human
ucuuuccaaaguacacuguuuca

SEQ ID NO: 1857573 - RNA, 15 nt, Human
ugaaacacuuugcau

SEQ ID NO: 1857574 - RNA, 12 nt, Human
ugaaaauuuuga

SEQ ID NO: 1857575 - RNA, 14 nt, Human
ugaaaauucagugg

SEQ ID NO: 1857576 - RNA, 20 nt, Human
ugaaaauuaggauuucauga

SEQ ID NO: 1857577 - RNA, 22 nt, Human
ugaaaagaaaaaugagccuggc

SEQ ID NO: 1857578 - RNA, 20 nt, Human
ugaaaagaaaaaugagccug

SEQ ID NO: 1857579 - RNA, 19 nt, Human
ugaaaagaaaaaugagccu

SEQ ID NO: 1857580 - RNA, 18 nt, Human
ugaaaaccacauuggaga

SEQ ID NO: 1857581 - RNA, 23 nt, Human
ugaaaacacuguucucugcccuc

SEQ ID NO: 1857582 - RNA, 22 nt, Human
ugaaaacacuguucucugcccu

SEQ ID NO: 1857583 - RNA, 21 nt, Human
ugaaaacacuguucucugccc

SEQ ID NO: 1857584 - RNA, 20 nt, Human
ugaaaacacuguucucugcc

SEQ ID NO: 1857585 - RNA, 17 nt, Human
ugaaaacacuguucucu

SEQ ID NO: 1857586 - RNA, 16 nt, Human
ucuuuuuauacuauua

SEQ ID NO: 1857587 - RNA, 21 nt, Human
ugaaaacacauuuuucuuagg

SEQ ID NO: 1857588 - RNA, 15 nt, Human
ucugcugcuggcugg

SEQ ID NO: 1857589 - RNA, 14 nt, Human
ucugcugcuggcug

SEQ ID NO: 1857590 - RNA, 17 nt, Human
ucugcugcuggcugguu

SEQ ID NO: 1857591 - RNA, 14 nt, Human
ucuggaauuugaaa

SEQ ID NO: 1857592 - RNA, 18 nt, Human
ucuggacuccucugucca

SEQ ID NO: 1857593 - RNA, 16 nt, Human
ucuggacuccucuguc

SEQ ID NO: 1857594 - RNA, 15 nt, Human
ucuggacuccucugu

SEQ ID NO: 1857595 - RNA, 22 nt, Human
ucuggacuccucuguccaggca

SEQ ID NO: 1857596 - RNA, 13 nt, Human
ucugcugcuggcu

SEQ ID NO: 1857597 - RNA, 11 nt, Human
ucugcugcugg

SEQ ID NO: 1857598 - RNA, 13 nt, Human
ucugcugaaggaa

SEQ ID NO: 1857599 - RNA, 17 nt, Human
ucugccugcccaggccc

SEQ ID NO: 1857600 - RNA, 18 nt, Human
ucugccugcccaggcccc

SEQ ID NO: 1857601 - RNA, 20 nt, Human
ucugccugcccaggccccug

SEQ ID NO: 1857602 - RNA, 22 nt, Human
ucuggagcccacuguacuugcu

SEQ ID NO: 1857603 - RNA, 16 nt, Human
ucuggagcccacugua

SEQ ID NO: 1857604 - RNA, 12 nt, Human
ucuggagcccac

SEQ ID NO: 1857605 - RNA, 16 nt, Human
ucuggugacuuuccuc

SEQ ID NO: 1857606 - RNA, 15 nt, Human
ucuguacagagccca

SEQ ID NO: 1857607 - RNA, 14 nt, Human
ucuguacagagccc

SEQ ID NO: 1857608 - RNA, 12 nt, Human
ucuguccuggga

SEQ ID NO: 1857609 - RNA, 17 nt, Human
ucugucgcccagucugg

SEQ ID NO: 1857610 - RNA, 13 nt, Human
ucugucuaggaau

SEQ ID NO: 1857611 - RNA, 14 nt, Human
ucugucucagucca

SEQ ID NO: 1857612 - RNA, 24 nt, Human
ucugagaucaaaacgguuuuacug

SEQ ID NO: 1857613 - RNA, 18 nt, Human
ucugagaggacuuuucuu

SEQ ID NO: 1857614 - RNA, 23 nt, Human
ucugacccaugcugcccugugag

SEQ ID NO: 1857615 - RNA, 22 nt, Human
ucugacccaugcugcccuguga

SEQ ID NO: 1857616 - RNA, 20 nt, Human
ucugacccaugcugcccugu

SEQ ID NO: 1857617 - RNA, 19 nt, Human
ucugacccaugcugcccug

SEQ ID NO: 1857618 - RNA, 13 nt, Human
ucugcacuccccu

SEQ ID NO: 1857619 - RNA, 22 nt, Human
ucugaggaauccagacccggcu

SEQ ID NO: 1857620 - RNA, 18 nt, Human
ucugaggaauccagaccc

SEQ ID NO: 1857621 - RNA, 21 nt, Human
ucugaggaauccagacccggc

SEQ ID NO: 1857622 - RNA, 16 nt, Human
ucugcccacucccugc

SEQ ID NO: 1857623 - RNA, 14 nt, Human
ucugcccacucccu

SEQ ID NO: 1857624 - RNA, 13 nt, Human
ucugcccacuccc

SEQ ID NO: 1857625 - RNA, 12 nt, Human
ucugccucccau

SEQ ID NO: 1857626 - RNA, 15 nt, Human
ucugccucccaucac

SEQ ID NO: 1857627 - RNA, 13 nt, Human
ucugccucccauc

SEQ ID NO: 1857628 - RNA, 12 nt, Human
ucugcccacucc

SEQ ID NO: 1857629 - RNA, 22 nt, Human
ucugccauauucuguuggccag

SEQ ID NO: 1857630 - RNA, 23 nt, Human
ucugccauauucuguuggccagu

SEQ ID NO: 1857631 - RNA, 18 nt, Human
ucugccauauucuguugg

SEQ ID NO: 1857632 - RNA, 23 nt, Human
ucugccucugacacacagcucug

SEQ ID NO: 1857633 - RNA, 21 nt, Human
ucugccucugacacacagcuc

SEQ ID NO: 1857634 - RNA, 22 nt, Human
ucugccucugacacacagcucu

SEQ ID NO: 1857635 - RNA, 19 nt, Human
ucugccugaagucacacag

SEQ ID NO: 1857636 - RNA, 20 nt, Human
ucugccugaagucacacagu

SEQ ID NO: 1857637 - RNA, 21 nt, Human
ucugccucccaucacccgcua

SEQ ID NO: 1857638 - RNA, 20 nt, Human
ucugccucccaucacccgcu

SEQ ID NO: 1857639 - RNA, 17 nt, Human
ucugccucccaucaccc

SEQ ID NO: 1857640 - RNA, 16 nt, Human
ucugccucccaucacc

SEQ ID NO: 1857641 - RNA, 15 nt, Human
ucugccucugacaca

SEQ ID NO: 1857642 - RNA, 18 nt, Human
ucugccucugacacacag

SEQ ID NO: 1857643 - RNA, 20 nt, Human
ucugccucacauagcuuaca

SEQ ID NO: 1857644 - RNA, 15 nt, Human
ucugccuccucuuca

SEQ ID NO: 1857645 - RNA, 17 nt, Human
ucaguuaagccuuugga

SEQ ID NO: 1857646 - RNA, 16 nt, Human
ucaguuaagccuuugg

SEQ ID NO: 1857647 - RNA, 18 nt, Human
ucagugugacugaucucu

SEQ ID NO: 1857648 - RNA, 17 nt, Human
ucagucugauucccaag

SEQ ID NO: 1857649 - RNA, 19 nt, Human
ucagucugauucccaagcu

SEQ ID NO: 1857650 - RNA, 14 nt, Human
ucagguggggcagc

SEQ ID NO: 1857651 - RNA, 18 nt, Human
ucaggugcugccauccag

SEQ ID NO: 1857652 - RNA, 20 nt, Human
ucaggugcugccauccaggu

SEQ ID NO: 1857653 - RNA, 15 nt, Human
ucagguggggcagcu

SEQ ID NO: 1857654 - RNA, 16 nt, Human
ucagguggggcagcuu

SEQ ID NO: 1857655 - RNA, 21 nt, Human
ucagguggggcagcuugaggg

SEQ ID NO: 1857656 - RNA, 17 nt, Human
ucagguggggcagcuug

SEQ ID NO: 1857657 - RNA, 20 nt, Human
ucagguggggucacucuggc

SEQ ID NO: 1857658 - RNA, 17 nt, Human
ucagguggggucacucu

SEQ ID NO: 1857659 - RNA, 21 nt, Human
ucagguggggucacucuggca

SEQ ID NO: 1857660 - RNA, 18 nt, Human
ucaguccccgugaaggag

SEQ ID NO: 1857661 - RNA, 18 nt, Human
ucaguccaugaagaugua

SEQ ID NO: 1857662 - RNA, 15 nt, Human
ucaguccauagcaga

SEQ ID NO: 1857663 - RNA, 24 nt, Human
ucauggacuucugccagcauaaua

SEQ ID NO: 1857664 - RNA, 16 nt, Human
ucagccugcuccagcu

SEQ ID NO: 1857665 - RNA, 22 nt, Human
ucagccucccaaagugcuggga

SEQ ID NO: 1857666 - RNA, 12 nt, Human
ucagccucccga

SEQ ID NO: 1857667 - RNA, 20 nt, Human
ucagccucccgaauagcugg

SEQ ID NO: 1857668 - RNA, 18 nt, Human
ucagcuccagcucaccag

SEQ ID NO: 1857669 - RNA, 21 nt, Human
ucagcuccagcucaccagccc

SEQ ID NO: 1857670 - RNA, 22 nt, Human
ucagcuccagcucaccagcccc

SEQ ID NO: 1857671 - RNA, 15 nt, Human
ucagcugcuacuacu

SEQ ID NO: 1857672 - RNA, 15 nt, Human
ucagcacgauuucug

SEQ ID NO: 1857673 - RNA, 16 nt, Human
ucagcacgauuucugu

SEQ ID NO: 1857674 - RNA, 20 nt, Human
ucagcaccuacaguguacag

SEQ ID NO: 1857675 - RNA, 21 nt, Human
ucagcaccuacaguguacagu

SEQ ID NO: 1857676 - RNA, 22 nt, Human
ucagcaccuacaguguacaguc

SEQ ID NO: 1857677 - RNA, 17 nt, Human
ucagcacgauuucuguu

SEQ ID NO: 1857678 - RNA, 12 nt, Human
ucagccucccaa

SEQ ID NO: 1857679 - RNA, 13 nt, Human
ucagccucccaaa

SEQ ID NO: 1857680 - RNA, 15 nt, Human
ucagcauccuggcac

SEQ ID NO: 1857681 - RNA, 16 nt, Human
ucagcauccuggcacc

SEQ ID NO: 1857682 - RNA, 17 nt, Human
ucagcauccuggcaccc

SEQ ID NO: 1857683 - RNA, 18 nt, Human
ucagcauccuggcacccg

SEQ ID NO: 1857684 - RNA, 15 nt, Human
ucagaucucuaacuu

SEQ ID NO: 1857685 - RNA, 16 nt, Human
ucccaggauguacaag

SEQ ID NO: 1857686 - RNA, 18 nt, Human
ucccaggcauuccccagg

SEQ ID NO: 1857687 - RNA, 17 nt, Human
ucccaggcauuccccag

SEQ ID NO: 1857688 - RNA, 19 nt, Human
ucccaggcauuccccagga

SEQ ID NO: 1857689 - RNA, 19 nt, Human
ucccaggcugagccucagu

SEQ ID NO: 1857690 - RNA, 15 nt, Human
ucccaugagccucag

SEQ ID NO: 1857691 - RNA, 16 nt, Human
ucccaugagccucagc

SEQ ID NO: 1857692 - RNA, 18 nt, Human
ucccaccucucucacucc

SEQ ID NO: 1857693 - RNA, 17 nt, Human
ucccaccucucucacuc

SEQ ID NO: 1857694 - RNA, 14 nt, Human
ucccaccucucuca

SEQ ID NO: 1857695 - RNA, 16 nt, Human
ucccaccucagccucc

SEQ ID NO: 1857696 - RNA, 18 nt, Human
ucccaccucagccucccg

SEQ ID NO: 1857697 - RNA, 20 nt, Human
ucccaccucucucacuccuu

SEQ ID NO: 1857698 - RNA, 19 nt, Human
ucccaccuuggcugcaggg

SEQ ID NO: 1857699 - RNA, 21 nt, Human
ucccaccuuggcugcagggag

SEQ ID NO: 1857700 - RNA, 14 nt, Human
ucccacucagucca

SEQ ID NO: 1857701 - RNA, 17 nt, Human
uccauagagagcaagac

SEQ ID NO: 1857702 - RNA, 23 nt, Human
uccauaaucuggacuccucuguc

SEQ ID NO: 1857703 - RNA, 20 nt, Human
uccauagagagcaagacgcu

SEQ ID NO: 1857704 - RNA, 18 nt, Human
ucccaacucaccccagcc

SEQ ID NO: 1857705 - RNA, 17 nt, Human
ucccaacucaccccagc

SEQ ID NO: 1857706 - RNA, 21 nt, Human
ucccaacucaccccagcccca

SEQ ID NO: 1857707 - RNA, 19 nt, Human
ucccaacucaccccagccc

SEQ ID NO: 1857708 - RNA, 14 nt, Human
ucccaacuuguaaa

SEQ ID NO: 1857709 - RNA, 18 nt, Human
uccaugucgccucugcau

SEQ ID NO: 1857710 - RNA, 17 nt, Human
uccaugucgccucugca

SEQ ID NO: 1857711 - RNA, 19 nt, Human
uccaugucgccucugcauu

SEQ ID NO: 1857712 - RNA, 16 nt, Human
uccaugucgccucugc

SEQ ID NO: 1857713 - RNA, 14 nt, Human
uccacuuucuagcc

SEQ ID NO: 1857714 - RNA, 17 nt, Human
uccacuuuaucuugaau

SEQ ID NO: 1857715 - RNA, 19 nt, Human
uccagagaguggcuccucc

SEQ ID NO: 1857716 - RNA, 22 nt, Human
uccagagaguggcuccucccgg

SEQ ID NO: 1857717 - RNA, 15 nt, Human
uccacuuuaucuuga

SEQ ID NO: 1857718 - RNA, 23 nt, Human
uccacuuagaaauugcauuuccu

SEQ ID NO: 1857719 - RNA, 21 nt, Human
uccacuuagaaauugcauuuc

SEQ ID NO: 1857720 - RNA, 22 nt, Human
uccacugugccaugugccaggu

SEQ ID NO: 1857721 - RNA, 21 nt, Human
uccacccugcucuccgaccag

SEQ ID NO: 1857722 - RNA, 13 nt, Human
uccacccugcucu

SEQ ID NO: 1857723 - RNA, 14 nt, Human
uccacccugcucuc

SEQ ID NO: 1857724 - RNA, 18 nt, Human
uccagcaauucuccugcc

SEQ ID NO: 1857725 - RNA, 21 nt, Human
uccagcaauucuccugccuca

SEQ ID NO: 1857726 - RNA, 20 nt, Human
uccagcaauucuccugccuc

SEQ ID NO: 1857727 - RNA, 19 nt, Human
uccagcaauucuccugccu

SEQ ID NO: 1857728 - RNA, 22 nt, Human
uccagauuuuuuacagcugccu

SEQ ID NO: 1857729 - RNA, 22 nt, Human
uccagcuggccgggagccugau

SEQ ID NO: 1857730 - RNA, 21 nt, Human
uccagcuggccgggagccuga

SEQ ID NO: 1857731 - RNA, 15 nt, Human
uccagcuggccggga

SEQ ID NO: 1857732 - RNA, 19 nt, Human
uccagcuggguuggaaaac

SEQ ID NO: 1857733 - RNA, 16 nt, Human
uccaagaagcccagga

SEQ ID NO: 1857734 - RNA, 15 nt, Human
uccaagaagcccagg

SEQ ID NO: 1857735 - RNA, 14 nt, Human
uccaagaagcccag

SEQ ID NO: 1857736 - RNA, 20 nt, Human
uccaagaccuucuccuucac

SEQ ID NO: 1857737 - RNA, 19 nt, Human
uccaagaagcccaggaaag

SEQ ID NO: 1857738 - RNA, 22 nt, Human
uccaagcaggacauggacaagg

SEQ ID NO: 1857739 - RNA, 14 nt, Human
uccaagcaggacau

SEQ ID NO: 1857740 - RNA, 17 nt, Human
uccaagcaaaugugaau

SEQ ID NO: 1857741 - RNA, 15 nt, Human
uccaagcaaauguga

SEQ ID NO: 1857742 - RNA, 19 nt, Human
uccacaagagcccaggccu

SEQ ID NO: 1857743 - RNA, 20 nt, Human
uccacaagagcccaggccuc

SEQ ID NO: 1857744 - RNA, 21 nt, Human
uccacaagagcccaggccucc

SEQ ID NO: 1857745 - RNA, 12 nt, Human
ucuacuaaaaau

SEQ ID NO: 1857746 - RNA, 15 nt, Human
ucuacuaaaaauaca

SEQ ID NO: 1857747 - RNA, 19 nt, Human
ucuacuaaaaauacaaaaa

SEQ ID NO: 1857748 - RNA, 14 nt, Human
ucuacuauuuaugu

SEQ ID NO: 1857749 - RNA, 21 nt, Human
ucuacucgaguuacagacaaa

SEQ ID NO: 1857750 - RNA, 20 nt, Human
ucuacucgaguuacagacaa

SEQ ID NO: 1857751 - RNA, 18 nt, Human
ucuacucuagggaaaaac

SEQ ID NO: 1857752 - RNA, 18 nt, Human
ucuaggaggucucuaaga

SEQ ID NO: 1857753 - RNA, 15 nt, Human
ucuagguaaauuaca

SEQ ID NO: 1857754 - RNA, 12 nt, Human
ucuagggaaaaa

SEQ ID NO: 1857755 - RNA, 19 nt, Human
ucuagggaaaaaccagcgu

SEQ ID NO: 1857756 - RNA, 17 nt, Human
ucucacuguugcccagg

SEQ ID NO: 1857757 - RNA, 14 nt, Human
ucucacuguugccc

SEQ ID NO: 1857758 - RNA, 15 nt, Human
ucucacuguugccca

SEQ ID NO: 1857759 - RNA, 13 nt, Human
ucucaaauuucua

SEQ ID NO: 1857760 - RNA, 22 nt, Human
ucuaucuuugagcgcccacuag

SEQ ID NO: 1857761 - RNA, 14 nt, Human
ucucaaauuucuaa

SEQ ID NO: 1857762 - RNA, 16 nt, Human
ucucaaauuucuaaau

SEQ ID NO: 1857763 - RNA, 18 nt, Human
ucucaaauuucuaaaucu

SEQ ID NO: 1857764 - RNA, 16 nt, Human
ucucacacaugagcau

SEQ ID NO: 1857765 - RNA, 23 nt, Human
ucucacacaugagcaucaggcca

SEQ ID NO: 1857766 - RNA, 20 nt, Human
ucucacugccaugccagcuu

SEQ ID NO: 1857767 - RNA, 21 nt, Human
ucucacacaugagcaucaggc

SEQ ID NO: 1857768 - RNA, 23 nt, Human
ucucacucugucgcccagucugg

SEQ ID NO: 1857769 - RNA, 15 nt, Human
ucggaaaacaugcua

SEQ ID NO: 1857770 - RNA, 18 nt, Human
ucggaaaacaugcuacac

SEQ ID NO: 1857771 - RNA, 14 nt, Human
ucgcccagucugga

SEQ ID NO: 1857772 - RNA, 19 nt, Human
ucgcccagucuggaaugca

SEQ ID NO: 1857773 - RNA, 23 nt, Human
ucgcccagucuggaaugcagugg

SEQ ID NO: 1857774 - RNA, 15 nt, Human
ucggccuccauccug

SEQ ID NO: 1857775 - RNA, 16 nt, Human
ucggccuccauccuga

SEQ ID NO: 1857776 - RNA, 17 nt, Human
ucggccuccauccugag

SEQ ID NO: 1857777 - RNA, 23 nt, Human
ucgcaggauucuuccucccuccc

SEQ ID NO: 1857778 - RNA, 21 nt, Human
ucgcaggauucuuccucccuc

SEQ ID NO: 1857779 - RNA, 17 nt, Human
ucgcaggauucuuccuc

SEQ ID NO: 1857780 - RNA, 22 nt, Human
uccuuuucgcaggauucuuccu

SEQ ID NO: 1857781 - RNA, 23 nt, Human
uccuugaaaacacuguucucugc

SEQ ID NO: 1857782 - RNA, 22 nt, Human
uccuugaaaacacuguucucug

SEQ ID NO: 1857783 - RNA, 17 nt, Human
uccuuaucaaaggacac

SEQ ID NO: 1857784 - RNA, 15 nt, Human
uccuuaucaaaggac

SEQ ID NO: 1857785 - RNA, 14 nt, Human
uccuuaucaaagga

SEQ ID NO: 1857786 - RNA, 21 nt, Human
uccuuaccagcagagcaccuu

SEQ ID NO: 1857787 - RNA, 22 nt, Human
uccuuugugaggaagccgcugg

SEQ ID NO: 1857788 - RNA, 18 nt, Human
uccuuugugaggaagccg

SEQ ID NO: 1857789 - RNA, 17 nt, Human
uccuuugugaggaagcc

SEQ ID NO: 1857790 - RNA, 22 nt, Human
uccuuggugucgggcaugacac

SEQ ID NO: 1857791 - RNA, 21 nt, Human
uccuuggugucgggcaugaca

SEQ ID NO: 1857792 - RNA, 18 nt, Human
uccuuggugucgggcaug

SEQ ID NO: 1857793 - RNA, 15 nt, Human
uccugaggcuccacu

SEQ ID NO: 1857794 - RNA, 21 nt, Human
uccugagccagauuucacucu

SEQ ID NO: 1857795 - RNA, 22 nt, Human
uccucuguccaggcacugcugc

SEQ ID NO: 1857796 - RNA, 19 nt, Human
uccugagccagauuucacu

SEQ ID NO: 1857797 - RNA, 18 nt, Human
uccugagccagauuucac

SEQ ID NO: 1857798 - RNA, 23 nt, Human
uccucuguacagagcccacgccc

SEQ ID NO: 1857799 - RNA, 17 nt, Human
uccugagccagauuuca

SEQ ID NO: 1857800 - RNA, 17 nt, Human
uccucuguccaggcacu

SEQ ID NO: 1857801 - RNA, 16 nt, Human
uccugaggcuccacuu

SEQ ID NO: 1857802 - RNA, 17 nt, Human
uccugaggcuccacuug

SEQ ID NO: 1857803 - RNA, 12 nt, Human
uccugaggcugg

SEQ ID NO: 1857804 - RNA, 19 nt, Human
uccugaggcugggcucccu

SEQ ID NO: 1857805 - RNA, 17 nt, Human
uccugaggcugggcucc

SEQ ID NO: 1857806 - RNA, 16 nt, Human
uccugaggcugggcuc

SEQ ID NO: 1857807 - RNA, 15 nt, Human
uccugaggcugggcu

SEQ ID NO: 1857808 - RNA, 15 nt, Human
uccucuggccugugu

SEQ ID NO: 1857809 - RNA, 13 nt, Human
uccucuguacaga

SEQ ID NO: 1857810 - RNA, 15 nt, Human
uccucuguacagagc

SEQ ID NO: 1857811 - RNA, 21 nt, Human
uccucuaggaggucucuaaga

SEQ ID NO: 1857812 - RNA, 17 nt, Human
uccucuaggaggucucu

SEQ ID NO: 1857813 - RNA, 13 nt, Human
uccuccuggacuc

SEQ ID NO: 1857814 - RNA, 21 nt, Human
uccuccuuuucacaguucucu

SEQ ID NO: 1857815 - RNA, 20 nt, Human
uccucaaaacuucagacaua

SEQ ID NO: 1857816 - RNA, 13 nt, Human
uccuccaggugca

SEQ ID NO: 1857817 - RNA, 12 nt, Human
uccuccaggugc

SEQ ID NO: 1857818 - RNA, 22 nt, Human
uccuccaggugcacaagcucca

SEQ ID NO: 1857819 - RNA, 20 nt, Human
uccuccaggugcacaagcuc

SEQ ID NO: 1857820 - RNA, 18 nt, Human
uccuccaggugcacaagc

SEQ ID NO: 1857821 - RNA, 14 nt, Human
uccuccaggugcac

SEQ ID NO: 1857822 - RNA, 12 nt, Human
uccuccucagau

SEQ ID NO: 1857823 - RNA, 17 nt, Human
uccuaguuccaccauca

SEQ ID NO: 1857824 - RNA, 14 nt, Human
uccuaguuccacca

SEQ ID NO: 1857825 - RNA, 18 nt, Human
uccuaagcuauucaguaa

SEQ ID NO: 1857826 - RNA, 16 nt, Human
uccuaagcuauucagu

SEQ ID NO: 1857827 - RNA, 21 nt, Human
uccuaguuccaccaucaagcc

SEQ ID NO: 1857828 - RNA, 22 nt, Human
uccuaguuccaccaucaagcca

SEQ ID NO: 1857829 - RNA, 22 nt, Human
uccgaaagggacuuggaagcuc

SEQ ID NO: 1857830 - RNA, 17 nt, Human
ucccuucuuuuucuucu

SEQ ID NO: 1857831 - RNA, 21 nt, Human
uccgaaagggacuuggaagcu

SEQ ID NO: 1857832 - RNA, 21 nt, Human
uccgcuuucuacccagcgagc

SEQ ID NO: 1857833 - RNA, 16 nt, Human
ucccuucccaccucuc

SEQ ID NO: 1857834 - RNA, 21 nt, Human
ucccuucccacuggaggcaug

SEQ ID NO: 1857835 - RNA, 17 nt, Human
ucccuucccaccucucu

SEQ ID NO: 1857836 - RNA, 18 nt, Human
ucccugccccucccuuca

SEQ ID NO: 1857837 - RNA, 14 nt, Human
ucccugccccuccc

SEQ ID NO: 1857838 - RNA, 16 nt, Human
ucccugccccccagcc

SEQ ID NO: 1857839 - RNA, 16 nt, Human
ucccugccaauggacu

SEQ ID NO: 1857840 - RNA, 14 nt, Human
ucccugccaaugga

SEQ ID NO: 1857841 - RNA, 13 nt, Human
ucccucuggggcu

SEQ ID NO: 1857842 - RNA, 17 nt, Human
ucccucuggggcuguuc

SEQ ID NO: 1857843 - RNA, 20 nt, Human
ucccugcacuugcagacucu

SEQ ID NO: 1857844 - RNA, 14 nt, Human
ucccucccuugggg

SEQ ID NO: 1857845 - RNA, 13 nt, Human
ucccucccuuggg

SEQ ID NO: 1857846 - RNA, 18 nt, Human
ucccucccuuccucuuuc

SEQ ID NO: 1857847 - RNA, 17 nt, Human
ucccuacuuccugugac

SEQ ID NO: 1857848 - RNA, 17 nt, Human
ucccaugagccucagca

SEQ ID NO: 1857849 - RNA, 22 nt, Human
ucccaugagccucagcauccug

SEQ ID NO: 1857850 - RNA, 23 nt, Human
ucccuaccgagucucuucuccac

SEQ ID NO: 1857851 - RNA, 22 nt, Human
ucccuaccgagucucuucucca

SEQ ID NO: 1857852 - RNA, 21 nt, Human
ucccuaccgagucucuucucc

SEQ ID NO: 1857853 - RNA, 19 nt, Human
ucccuaccgagucucuucu

SEQ ID NO: 1857854 - RNA, 16 nt, Human
uggacagaagcagcuc

SEQ ID NO: 1857855 - RNA, 15 nt, Human
uggacagaagcagcu

SEQ ID NO: 1857856 - RNA, 18 nt, Human
uggacagaagcagcucuu

SEQ ID NO: 1857857 - RNA, 17 nt, Human
uggacagaagcagcucu

SEQ ID NO: 1857858 - RNA, 20 nt, Human
uggacucaccucccccaucu

SEQ ID NO: 1857859 - RNA, 18 nt, Human
uggacucaccucccccau

SEQ ID NO: 1857860 - RNA, 19 nt, Human
uggacaugcacagcuaaca

SEQ ID NO: 1857861 - RNA, 13 nt, Human
uggacaugcacag

SEQ ID NO: 1857862 - RNA, 19 nt, Human
uggaauaacauguaauuaa

SEQ ID NO: 1857863 - RNA, 15 nt, Human
uggaauaacauguaa

SEQ ID NO: 1857864 - RNA, 14 nt, Human
uggaauaacaugua

SEQ ID NO: 1857865 - RNA, 21 nt, Human
uggaacguuuuuccuguucuu

SEQ ID NO: 1857866 - RNA, 15 nt, Human
uggaauauauaacca

SEQ ID NO: 1857867 - RNA, 16 nt, Human
uggaauauauaaccag

SEQ ID NO: 1857868 - RNA, 17 nt, Human
uggaauaaggagaauga

SEQ ID NO: 1857869 - RNA, 22 nt, Human
uggaauaauccuaaacauauga

SEQ ID NO: 1857870 - RNA, 20 nt, Human
uggaaaaauagccugccucu

SEQ ID NO: 1857871 - RNA, 17 nt, Human
uggaaaaauagccugcc

SEQ ID NO: 1857872 - RNA, 20 nt, Human
uggaaagaguaggaagacuu

SEQ ID NO: 1857873 - RNA, 14 nt, Human
uggaaagaguacuc

SEQ ID NO: 1857874 - RNA, 21 nt, Human
uggaaagacuuuuccaacccu

SEQ ID NO: 1857875 - RNA, 22 nt, Human
uggaaacagcucgacuuuaaaa

SEQ ID NO: 1857876 - RNA, 17 nt, Human
uggaaacagcucgacuu

SEQ ID NO: 1857877 - RNA, 13 nt, Human
uggcagugggagc

SEQ ID NO: 1857878 - RNA, 19 nt, Human
uggcaggaguuggaagugu

SEQ ID NO: 1857879 - RNA, 13 nt, Human
uggcagcugcuuu

SEQ ID NO: 1857880 - RNA, 21 nt, Human
uggcacccggccccugcuggu

SEQ ID NO: 1857881 - RNA, 20 nt, Human
uggccacuccagaccccugg

SEQ ID NO: 1857882 - RNA, 17 nt, Human
uggccacuccagacccc

SEQ ID NO: 1857883 - RNA, 20 nt, Human
uggccagaugcaccagcccu

SEQ ID NO: 1857884 - RNA, 21 nt, Human
uggccagaugcaccagcccuu

SEQ ID NO: 1857885 - RNA, 15 nt, Human
uggacuccugcacac

SEQ ID NO: 1857886 - RNA, 15 nt, Human
uggacuccucugucc

SEQ ID NO: 1857887 - RNA, 18 nt, Human
uggaggaaggaaacccag

SEQ ID NO: 1857888 - RNA, 12 nt, Human
uggaggaaggaa

SEQ ID NO: 1857889 - RNA, 20 nt, Human
uggaggaaggaaacccagcu

SEQ ID NO: 1857890 - RNA, 20 nt, Human
uggauuuaacagaaauguac

SEQ ID NO: 1857891 - RNA, 24 nt, Human
uggauuuaacagaaauguacagca

SEQ ID NO: 1857892 - RNA, 16 nt, Human
uggguucuacccaggu

SEQ ID NO: 1857893 - RNA, 15 nt, Human
uggguucuacccagg

SEQ ID NO: 1857894 - RNA, 22 nt, Human
uggguucuacccaggugcuagg

SEQ ID NO: 1857895 - RNA, 14 nt, Human
uggguuaguggaug

SEQ ID NO: 1857896 - RNA, 19 nt, Human
ugggguuuaucagaauucu

SEQ ID NO: 1857897 - RNA, 16 nt, Human
uggguaacuagggaag

SEQ ID NO: 1857898 - RNA, 18 nt, Human
uggguuucuaaagcugcc

SEQ ID NO: 1857899 - RNA, 17 nt, Human
uggguuucuaaagcugc

SEQ ID NO: 1857900 - RNA, 21 nt, Human
uggguuucuaaagcugccagc

SEQ ID NO: 1857901 - RNA, 22 nt, Human
ugguauagaaaugcugguuuuu

SEQ ID NO: 1857902 - RNA, 14 nt, Human
ugguauagaaaugc

SEQ ID NO: 1857903 - RNA, 16 nt, Human
ugguauagaaaugcug

SEQ ID NO: 1857904 - RNA, 13 nt, Human
ugguauagaaaug

SEQ ID NO: 1857905 - RNA, 23 nt, Human
ugguauuggcuagagguucaaag

SEQ ID NO: 1857906 - RNA, 18 nt, Human
ugguaugaucacggcuca

SEQ ID NO: 1857907 - RNA, 20 nt, Human
ugggggaucacagccucuga

SEQ ID NO: 1857908 - RNA, 21 nt, Human
ugggggaucacagccucugaa

SEQ ID NO: 1857909 - RNA, 18 nt, Human
ugggggcugggcagagga

SEQ ID NO: 1857910 - RNA, 17 nt, Human
ugggggcugggcagagg

SEQ ID NO: 1857911 - RNA, 19 nt, Human
ugggggcugggcagaggaa

SEQ ID NO: 1857912 - RNA, 12 nt, Human
ugggggugcauu

SEQ ID NO: 1857913 - RNA, 15 nt, Human
ugggggugcauuuga

SEQ ID NO: 1857914 - RNA, 16 nt, Human
ugggcagaggaaagca

SEQ ID NO: 1857915 - RNA, 20 nt, Human
ugggcgugagaccugccccu

SEQ ID NO: 1857916 - RNA, 22 nt, Human
ugggcuaagugauccucccacc

SEQ ID NO: 1857917 - RNA, 16 nt, Human
ugggcuaguugggcuu

SEQ ID NO: 1857918 - RNA, 23 nt, Human
ugggcuggguucuacccaggugc

SEQ ID NO: 1857919 - RNA, 17 nt, Human
ugggcuggugucaccug

SEQ ID NO: 1857920 - RNA, 15 nt, Human
ugggcuucaguggca

SEQ ID NO: 1857921 - RNA, 17 nt, Human
ugggcuucaguggcagc

SEQ ID NO: 1857922 - RNA, 14 nt, Human
uggcuuuugugcau

SEQ ID NO: 1857923 - RNA, 21 nt, Human
uggcuugaguuuaaauuguaa

SEQ ID NO: 1857924 - RNA, 21 nt, Human
uggcugcuucaaggauccuga

SEQ ID NO: 1857925 - RNA, 21 nt, Human
uggcugggggccucagugcca

SEQ ID NO: 1857926 - RNA, 15 nt, Human
ugggauccuccaggu

SEQ ID NO: 1857927 - RNA, 15 nt, Human
ugggagugagcuggu

SEQ ID NO: 1857928 - RNA, 17 nt, Human
ugggagcugccuguuca

SEQ ID NO: 1857929 - RNA, 21 nt, Human
ugggagcugccuguucagcuc

SEQ ID NO: 1857930 - RNA, 14 nt, Human
ugggaguacaaaag

SEQ ID NO: 1857931 - RNA, 22 nt, Human
ugggagcugccuguucagcucc

SEQ ID NO: 1857932 - RNA, 15 nt, Human
ugggcagaggaaagc

SEQ ID NO: 1857933 - RNA, 17 nt, Human
ugggauuacagguguga

SEQ ID NO: 1857934 - RNA, 21 nt, Human
ugggauuacagggaugagcca

SEQ ID NO: 1857935 - RNA, 13 nt, Human
ugggauccuggag

SEQ ID NO: 1857936 - RNA, 18 nt, Human
ugggauccuccaggugca

SEQ ID NO: 1857937 - RNA, 18 nt, Human
ugggauuacaggcuccug

SEQ ID NO: 1857938 - RNA, 16 nt, Human
ugggauuacaggugug

SEQ ID NO: 1857939 - RNA, 12 nt, Human
ugggacacccug

SEQ ID NO: 1857940 - RNA, 13 nt, Human
ugggacacccugu

SEQ ID NO: 1857941 - RNA, 13 nt, Human
ugggagcaaaaga

SEQ ID NO: 1857942 - RNA, 12 nt, Human
ugggagcugccu

SEQ ID NO: 1857943 - RNA, 13 nt, Human
ugggagcugccug

SEQ ID NO: 1857944 - RNA, 14 nt, Human
ugggagcugccugu

SEQ ID NO: 1857945 - RNA, 14 nt, Human
ugcacuuuguucug

SEQ ID NO: 1857946 - RNA, 12 nt, Human
ugcacuuuguuc

SEQ ID NO: 1857947 - RNA, 20 nt, Human
ugcagcaauaaagcagcguu

SEQ ID NO: 1857948 - RNA, 23 nt, Human
ugcagcaauaaagcagcguuucu

SEQ ID NO: 1857949 - RNA, 21 nt, Human
ugcagagcaggaaacaugacu

SEQ ID NO: 1857950 - RNA, 20 nt, Human
ugaguccccuguuuguuucu

SEQ ID NO: 1857951 - RNA, 17 nt, Human
ugcaccgggccacagag

SEQ ID NO: 1857952 - RNA, 22 nt, Human
ugcaccgggccacagagaaagu

SEQ ID NO: 1857953 - RNA, 23 nt, Human
ugcaccggcuggccuggccccuc

SEQ ID NO: 1857954 - RNA, 19 nt, Human
ugaguccccuguuuguuuc

SEQ ID NO: 1857955 - RNA, 14 nt, Human
ugcaccgggccaca

SEQ ID NO: 1857956 - RNA, 15 nt, Human
ugcaccgggccacag

SEQ ID NO: 1857957 - RNA, 14 nt, Human
ugcaggcagccagg

SEQ ID NO: 1857958 - RNA, 13 nt, Human
ugcaggcagccag

SEQ ID NO: 1857959 - RNA, 15 nt, Human
ugcaggcagccaggc

SEQ ID NO: 1857960 - RNA, 16 nt, Human
ugcagugcuuccaagg

SEQ ID NO: 1857961 - RNA, 22 nt, Human
ugcagugguaugaucacggcuc

SEQ ID NO: 1857962 - RNA, 20 nt, Human
ugcaguggugcgaucugggu

SEQ ID NO: 1857963 - RNA, 14 nt, Human
ugcaguugccaguc

SEQ ID NO: 1857964 - RNA, 13 nt, Human
ugcaguugccagu

SEQ ID NO: 1857965 - RNA, 15 nt, Human
ugcaguugccaguca

SEQ ID NO: 1857966 - RNA, 17 nt, Human
ugccccuggcagccccu

SEQ ID NO: 1857967 - RNA, 13 nt, Human
ugccccucccuuc

SEQ ID NO: 1857968 - RNA, 15 nt, Human
ugccccagggcuccc

SEQ ID NO: 1857969 - RNA, 23 nt, Human
ugccccucaacucuccuccagag

SEQ ID NO: 1857970 - RNA, 15 nt, Human
ugcccacucccugca

SEQ ID NO: 1857971 - RNA, 14 nt, Human
ugcccacucccugc

SEQ ID NO: 1857972 - RNA, 16 nt, Human
ugcccacucccugcaa

SEQ ID NO: 1857973 - RNA, 11 nt, Human
ugcccaggcug

SEQ ID NO: 1857974 - RNA, 21 nt, Human
ugcccacucccugcaaccuga

SEQ ID NO: 1857975 - RNA, 13 nt, Human
ugcccaggcugga

SEQ ID NO: 1857976 - RNA, 18 nt, Human
ugcccaggcuggagugca

SEQ ID NO: 1857977 - RNA, 20 nt, Human
ugcccaggcuggagugcaau

SEQ ID NO: 1857978 - RNA, 13 nt, Human
ugcccaggcuggc

SEQ ID NO: 1857979 - RNA, 14 nt, Human
ugcccaccuggccu

SEQ ID NO: 1857980 - RNA, 13 nt, Human
ugcccaccuggcc

SEQ ID NO: 1857981 - RNA, 21 nt, Human
ugccauccagguucagcuugu

SEQ ID NO: 1857982 - RNA, 20 nt, Human
ugccauccagguucagcuug

SEQ ID NO: 1857983 - RNA, 10 nt, Human
ugccaggcau

SEQ ID NO: 1857984 - RNA, 18 nt, Human
ugccagguuuuuggucug

SEQ ID NO: 1857985 - RNA, 19 nt, Human
ugccagguuuuuggucuga

SEQ ID NO: 1857986 - RNA, 22 nt, Human
ugccagguuuuuggucugaccc

SEQ ID NO: 1857987 - RNA, 20 nt, Human
ugccacuaaauugacacuua

SEQ ID NO: 1857988 - RNA, 19 nt, Human
ugccacccuggggagaaag

SEQ ID NO: 1857989 - RNA, 22 nt, Human
ugccacuacggaauaguuggcu

SEQ ID NO: 1857990 - RNA, 20 nt, Human
ugccacccuggggagaaagu

SEQ ID NO: 1857991 - RNA, 21 nt, Human
ugcauauuuauaaaaauaaaa

SEQ ID NO: 1857992 - RNA, 20 nt, Human
ugcauauuuauaaaaauaaa

SEQ ID NO: 1857993 - RNA, 18 nt, Human
ugccaaauauaaauaaaa

SEQ ID NO: 1857994 - RNA, 17 nt, Human
ugccaaauauaaauaaa

SEQ ID NO: 1857995 - RNA, 14 nt, Human
ugcaucaagaugug

SEQ ID NO: 1857996 - RNA, 19 nt, Human
ugcaucaagaugugacaug

SEQ ID NO: 1857997 - RNA, 22 nt, Human
ugccaaauauaaauaaaaauaa

SEQ ID NO: 1857998 - RNA, 19 nt, Human
ugccaaauauaaauaaaaa

SEQ ID NO: 1857999 - RNA, 15 nt, Human
ugcuaaaugugaaug

SEQ ID NO: 1858000 - RNA, 14 nt, Human
ugcgccuacaggag

SEQ ID NO: 1858001 - RNA, 16 nt, Human
ugcgccuacaggagug

SEQ ID NO: 1858002 - RNA, 22 nt, Human
ugcgccuacaggagugagcacu

SEQ ID NO: 1858003 - RNA, 21 nt, Human
ugccugugaacugaacucuga

SEQ ID NO: 1858004 - RNA, 18 nt, Human
ugccugugaacugaacuc

SEQ ID NO: 1858005 - RNA, 17 nt, Human
ugccugugaacugaacu

SEQ ID NO: 1858006 - RNA, 14 nt, Human
ugcgaucuggguuc

SEQ ID NO: 1858007 - RNA, 15 nt, Human
ugcgaucuggguuca

SEQ ID NO: 1858008 - RNA, 19 nt, Human
ugcgaucuggguucacugc

SEQ ID NO: 1858009 - RNA, 20 nt, Human
ugcgaucuggguucacugca

SEQ ID NO: 1858010 - RNA, 21 nt, Human
ugcgaucuggguucacugcaa

SEQ ID NO: 1858011 - RNA, 9 nt, Human
ugccucucu

SEQ ID NO: 1858012 - RNA, 18 nt, Human
ugccccuggcagccccug

SEQ ID NO: 1858013 - RNA, 20 nt, Human
ugccucgaacuggcugcaaa

SEQ ID NO: 1858014 - RNA, 18 nt, Human
ugccucgaacuggcugca

SEQ ID NO: 1858015 - RNA, 19 nt, Human
ugccucgaacuggcugcaa

SEQ ID NO: 1858016 - RNA, 18 nt, Human
ugccugggcagaaggaag

SEQ ID NO: 1858017 - RNA, 21 nt, Human
ugccugggaucccucauccuc

SEQ ID NO: 1858018 - RNA, 15 nt, Human
ugccuggcggggugg

SEQ ID NO: 1858019 - RNA, 14 nt, Human
ugccugugaacuga

SEQ ID NO: 1858020 - RNA, 14 nt, Human
ugccugguggcagc

SEQ ID NO: 1858021 - RNA, 15 nt, Human
ugccugguggcagcu

SEQ ID NO: 1858022 - RNA, 18 nt, Human
ugccuguaaucacagcua

SEQ ID NO: 1858023 - RNA, 16 nt, Human
ugccugguggcagcug

SEQ ID NO: 1858024 - RNA, 13 nt, Human
ugcugcuggcugg

SEQ ID NO: 1858025 - RNA, 18 nt, Human
ugcugcaguugccaguca

SEQ ID NO: 1858026 - RNA, 23 nt, Human
ugcugcaguugccagucaccccg

SEQ ID NO: 1858027 - RNA, 17 nt, Human
ugcugauggugcaauga

SEQ ID NO: 1858028 - RNA, 15 nt, Human
ugcugauggugcaau

SEQ ID NO: 1858029 - RNA, 13 nt, Human
ugcugauggugca

SEQ ID NO: 1858030 - RNA, 18 nt, Human
ugcugauggugcaaugac

SEQ ID NO: 1858031 - RNA, 12 nt, Human
ugcugaaggcuc

SEQ ID NO: 1858032 - RNA, 23 nt, Human
ugcugaaggaauaaauugcuccu

SEQ ID NO: 1858033 - RNA, 21 nt, Human
ugcugaaggcucgagcaugcc

SEQ ID NO: 1858034 - RNA, 13 nt, Human
ugcugaaggcucg

SEQ ID NO: 1858035 - RNA, 22 nt, Human
ugcugacagacacaggcccggc

SEQ ID NO: 1858036 - RNA, 23 nt, Human
ugcugacagacacaggcccggcu

SEQ ID NO: 1858037 - RNA, 14 nt, Human
ugcuccucucccca

SEQ ID NO: 1858038 - RNA, 17 nt, Human
ugcucagagcaguguuu

SEQ ID NO: 1858039 - RNA, 15 nt, Human
ugcucacauaucugu

SEQ ID NO: 1858040 - RNA, 16 nt, Human
ugcucacauaucuguc

SEQ ID NO: 1858041 - RNA, 22 nt, Human
ugcucuccucuugccacugccu

SEQ ID NO: 1858042 - RNA, 21 nt, Human
ugcucuccucuugccacugcc

SEQ ID NO: 1858043 - RNA, 18 nt, Human
ugcucuccucuugccacu

SEQ ID NO: 1858044 - RNA, 16 nt, Human
ugcucuccucuugcca

SEQ ID NO: 1858045 - RNA, 18 nt, Human
ugcuccuuucuuguuuua

SEQ ID NO: 1858046 - RNA, 17 nt, Human
ugcuccucuccccagca

SEQ ID NO: 1858047 - RNA, 18 nt, Human
ugcuccucuccccagcaa

SEQ ID NO: 1858048 - RNA, 21 nt, Human
ugucuuuucuugcaugaggcu

SEQ ID NO: 1858049 - RNA, 16 nt, Human
ugucuuuggacccuga

SEQ ID NO: 1858050 - RNA, 14 nt, Human
ugucuuuggacccu

SEQ ID NO: 1858051 - RNA, 23 nt, Human
ugucuuuucuugcaugaggcuag

SEQ ID NO: 1858052 - RNA, 23 nt, Human
ugugaaaagaaaaaugagccugg

SEQ ID NO: 1858053 - RNA, 17 nt, Human
ugugaaaaugugugugu

SEQ ID NO: 1858054 - RNA, 16 nt, Human
ugugaaaaugugugug

SEQ ID NO: 1858055 - RNA, 16 nt, Human
ugucugaagucacugc

SEQ ID NO: 1858056 - RNA, 18 nt, Human
ugucugaagucacugcac

SEQ ID NO: 1858057 - RNA, 17 nt, Human
ugucugaagucacugca

SEQ ID NO: 1858058 - RNA, 19 nt, Human
ugucugaagucacugcaca

SEQ ID NO: 1858059 - RNA, 16 nt, Human
ugugauauaagugugu

SEQ ID NO: 1858060 - RNA, 15 nt, Human
ugugagucaccaagc

SEQ ID NO: 1858061 - RNA, 17 nt, Human
ugugagucaccaagccc

SEQ ID NO: 1858062 - RNA, 19 nt, Human
ugugagucaccaagcccag

SEQ ID NO: 1858063 - RNA, 21 nt, Human
ugugagucaccaagcccaguu

SEQ ID NO: 1858064 - RNA, 18 nt, Human
ugugaggaagccgcuggg

SEQ ID NO: 1858065 - RNA, 13 nt, Human
ugugaggaagccg

SEQ ID NO: 1858066 - RNA, 20 nt, Human
ugugaggaagccgcuggggc

SEQ ID NO: 1858067 - RNA, 12 nt, Human
ugugaggaagcc

SEQ ID NO: 1858068 - RNA, 18 nt, Human
uguggacacagcucuucu

SEQ ID NO: 1858069 - RNA, 19 nt, Human
uguggacacagcucuucuc

SEQ ID NO: 1858070 - RNA, 10 nt, Human
uguggcucac

SEQ ID NO: 1858071 - RNA, 23 nt, Human
uguggcgcagcauauucaggaag

SEQ ID NO: 1858072 - RNA, 21 nt, Human
ugugggcgugagaccugcccc

SEQ ID NO: 1858073 - RNA, 20 nt, Human
ugugggcgugagaccugccc

SEQ ID NO: 1858074 - RNA, 22 nt, Human
ugugggcgugagaccugccccu

SEQ ID NO: 1858075 - RNA, 22 nt, Human
ugugggcuaguugggcuuccuc

SEQ ID NO: 1858076 - RNA, 16 nt, Human
uguguagggcgggagg

SEQ ID NO: 1858077 - RNA, 12 nt, Human
uguguagggcgg

SEQ ID NO: 1858078 - RNA, 20 nt, Human
ugugcauuaucuagauacug

SEQ ID NO: 1858079 - RNA, 21 nt, Human
ugugcauuaucuagauacugu

SEQ ID NO: 1858080 - RNA, 23 nt, Human
ugugcauuaucuagauacuguau

SEQ ID NO: 1858081 - RNA, 23 nt, Human
ugugcauuuggugguuucagaaa

SEQ ID NO: 1858082 - RNA, 14 nt, Human
ugugcauuaucuag

SEQ ID NO: 1858083 - RNA, 16 nt, Human
ugugcauuaucuagau

SEQ ID NO: 1858084 - RNA, 19 nt, Human
ugugcauuaucuagauacu

SEQ ID NO: 1858085 - RNA, 14 nt, Human
ugugcacguacaca

SEQ ID NO: 1858086 - RNA, 16 nt, Human
ugugcucaggagcccu

SEQ ID NO: 1858087 - RNA, 15 nt, Human
ugugcucaggagccc

SEQ ID NO: 1858088 - RNA, 17 nt, Human
ugugcucaggagcccug

SEQ ID NO: 1858089 - RNA, 20 nt, Human
ugugcucaggagcccuggga

SEQ ID NO: 1858090 - RNA, 14 nt, Human
ugugcuuguuaacu

SEQ ID NO: 1858091 - RNA, 14 nt, Human
ugugcgccuacagg

SEQ ID NO: 1858092 - RNA, 19 nt, Human
ugugcgccuacaggaguga

SEQ ID NO: 1858093 - RNA, 19 nt, Human
uguacugcauaugaaagga

SEQ ID NO: 1858094 - RNA, 15 nt, Human
uguacgucugacagg

SEQ ID NO: 1858095 - RNA, 18 nt, Human
uguagccccucuccugga

SEQ ID NO: 1858096 - RNA, 16 nt, Human
uguaccgcaaugugac

SEQ ID NO: 1858097 - RNA, 21 nt, Human
uguacagucuuguauuaaguu

SEQ ID NO: 1858098 - RNA, 18 nt, Human
uguacagagcccacgccc

SEQ ID NO: 1858099 - RNA, 17 nt, Human
uguacagagcccacgcc

SEQ ID NO: 1858100 - RNA, 16 nt, Human
uguacagagcccacgc

SEQ ID NO: 1858101 - RNA, 17 nt, Human
uguaauuaaguacuaug

SEQ ID NO: 1858102 - RNA, 23 nt, Human
uguacaaggacagccccuccucc

SEQ ID NO: 1858103 - RNA, 20 nt, Human
uguacaaggacagccccucc

SEQ ID NO: 1858104 - RNA, 16 nt, Human
uguacaaggacagccc

SEQ ID NO: 1858105 - RNA, 17 nt, Human
uggucacaggaaguaga

SEQ ID NO: 1858106 - RNA, 14 nt, Human
uguaaucacagcua

SEQ ID NO: 1858107 - RNA, 15 nt, Human
uguauuuaaaugaaa

SEQ ID NO: 1858108 - RNA, 20 nt, Human
uguauuuauuuaguauuuau

SEQ ID NO: 1858109 - RNA, 13 nt, Human
ugucacaggcagg

SEQ ID NO: 1858110 - RNA, 12 nt, Human
ugucacaggcag

SEQ ID NO: 1858111 - RNA, 17 nt, Human
ugucacacacuuuggcu

SEQ ID NO: 1858112 - RNA, 22 nt, Human
uguauaaaagggacugagaaau

SEQ ID NO: 1858113 - RNA, 22 nt, Human
uguauucucuccuguaccucuu

SEQ ID NO: 1858114 - RNA, 12 nt, Human
uguccuacucug

SEQ ID NO: 1858115 - RNA, 17 nt, Human
uguccuacucuguguca

SEQ ID NO: 1858116 - RNA, 16 nt, Human
uguccccgacccuugc

SEQ ID NO: 1858117 - RNA, 17 nt, Human
uguccccgacccuugcc

SEQ ID NO: 1858118 - RNA, 20 nt, Human
uguccuacccacccuccuuu

SEQ ID NO: 1858119 - RNA, 22 nt, Human
uguccccaccgcagacaggacc

SEQ ID NO: 1858120 - RNA, 19 nt, Human
uguccccaccgcagacagg

SEQ ID NO: 1858121 - RNA, 18 nt, Human
uguccccaccgcagacag

SEQ ID NO: 1858122 - RNA, 13 nt, Human
ugucaccugaaga

SEQ ID NO: 1858123 - RNA, 16 nt, Human
ugucccaacuuguaaa

SEQ ID NO: 1858124 - RNA, 19 nt, Human
ugucauuugagcagggcuc

SEQ ID NO: 1858125 - RNA, 16 nt, Human
ugucauuugagcaggg

SEQ ID NO: 1858126 - RNA, 18 nt, Human
uuaaagaaaaguuuugua

SEQ ID NO: 1858127 - RNA, 16 nt, Human
uuaaaugcccagcccc

SEQ ID NO: 1858128 - RNA, 15 nt, Human
uuaaaugcccagccc

SEQ ID NO: 1858129 - RNA, 14 nt, Human
uuaaaugcccagcc

SEQ ID NO: 1858130 - RNA, 11 nt, Human
uuaaaugcacc

SEQ ID NO: 1858131 - RNA, 14 nt, Human
uuaaaacccaagug

SEQ ID NO: 1858132 - RNA, 22 nt, Human
uuaaaaaaaaaccugagcccca

SEQ ID NO: 1858133 - RNA, 22 nt, Human
uguuuuaaggaugcuuguacau

SEQ ID NO: 1858134 - RNA, 23 nt, Human
uguuuuaaggaugcuuguacaua

SEQ ID NO: 1858135 - RNA, 17 nt, Human
uguuuuaagaggcaggg

SEQ ID NO: 1858136 - RNA, 16 nt, Human
uguuuuaagaggcagg

SEQ ID NO: 1858137 - RNA, 15 nt, Human
uguuuccuggcacug

SEQ ID NO: 1858138 - RNA, 14 nt, Human
uuaacuuuuauaaa

SEQ ID NO: 1858139 - RNA, 12 nt, Human
uuaagaguaaaa

SEQ ID NO: 1858140 - RNA, 15 nt, Human
uuaaauguagaaagu

SEQ ID NO: 1858141 - RNA, 12 nt, Human
uuaacuuuuaua

SEQ ID NO: 1858142 - RNA, 13 nt, Human
uuaacuuuuauaa

SEQ ID NO: 1858143 - RNA, 20 nt, Human
uuaauagcgucauaacuaga

SEQ ID NO: 1858144 - RNA, 20 nt, Human
uuacacuuuaugcacaaaau

SEQ ID NO: 1858145 - RNA, 13 nt, Human
uuacacuuuaugc

SEQ ID NO: 1858146 - RNA, 17 nt, Human
uuacacauuuuucagau

SEQ ID NO: 1858147 - RNA, 23 nt, Human
uuacacauuuuucagauauaaaa

SEQ ID NO: 1858148 - RNA, 12 nt, Human
uuacauuuuuaa

SEQ ID NO: 1858149 - RNA, 17 nt, Human
uuacauuuuuaagugcu

SEQ ID NO: 1858150 - RNA, 15 nt, Human
uuacacauuuuucag

SEQ ID NO: 1858151 - RNA, 22 nt, Human
uuaauuaaaacacaacaucuuu

SEQ ID NO: 1858152 - RNA, 12 nt, Human
uguuuaagagac

SEQ ID NO: 1858153 - RNA, 17 nt, Human
uguuggcugggggccuc

SEQ ID NO: 1858154 - RNA, 19 nt, Human
uguuggcugggggccucag

SEQ ID NO: 1858155 - RNA, 14 nt, Human
uguuggcagccucu

SEQ ID NO: 1858156 - RNA, 15 nt, Human
uguuggccaaagcca

SEQ ID NO: 1858157 - RNA, 15 nt, Human
uguuggccaggcugg

SEQ ID NO: 1858158 - RNA, 16 nt, Human
uguuggccaggcuggu

SEQ ID NO: 1858159 - RNA, 23 nt, Human
uguucuuucuggcuaugcauuug

SEQ ID NO: 1858160 - RNA, 20 nt, Human
uguucuggcucuuccaggcu

SEQ ID NO: 1858161 - RNA, 17 nt, Human
uguucuggcucuuccag

SEQ ID NO: 1858162 - RNA, 21 nt, Human
uguucuggcucuuccaggcug

SEQ ID NO: 1858163 - RNA, 15 nt, Human
uguucugcuuuccuc

SEQ ID NO: 1858164 - RNA, 12 nt, Human
uguucugggaca

SEQ ID NO: 1858165 - RNA, 15 nt, Human
uguugaagccuuugu

SEQ ID NO: 1858166 - RNA, 16 nt, Human
uguucucugcccucca

SEQ ID NO: 1858167 - RNA, 15 nt, Human
uguucucugcccucc

SEQ ID NO: 1858168 - RNA, 14 nt, Human
uguucucugcccuc

SEQ ID NO: 1858169 - RNA, 13 nt, Human
uguucucugcccu

SEQ ID NO: 1858170 - RNA, 16 nt, Human
uguucuggcucuucca

SEQ ID NO: 1858171 - RNA, 13 nt, Human
uguucuggcucuu

SEQ ID NO: 1858172 - RNA, 12 nt, Human
uguucuggcucu

SEQ ID NO: 1858173 - RNA, 13 nt, Human
uguucucugagga

SEQ ID NO: 1858174 - RNA, 19 nt, Human
uguucaucauccuaagcua

SEQ ID NO: 1858175 - RNA, 16 nt, Human
uguucucucuucucca

SEQ ID NO: 1858176 - RNA, 15 nt, Human
uguucucucuucucc

SEQ ID NO: 1858177 - RNA, 18 nt, Human
uguguuuuucauaaagca

SEQ ID NO: 1858178 - RNA, 20 nt, Human
uguguuuuuaauaaagacag

SEQ ID NO: 1858179 - RNA, 15 nt, Human
uguguuuuucauaaa

SEQ ID NO: 1858180 - RNA, 15 nt, Human
uguguuuuuaauaaa

SEQ ID NO: 1858181 - RNA, 16 nt, Human
uguguuuauugucaaa

SEQ ID NO: 1858182 - RNA, 19 nt, Human
ugugugugcuuauguauga

SEQ ID NO: 1858183 - RNA, 20 nt, Human
ugugugugcuuauguaugag

SEQ ID NO: 1858184 - RNA, 22 nt, Human
ugugugucuaggcaggaccugu

SEQ ID NO: 1858185 - RNA, 17 nt, Human
ugugugugaaaaugugu

SEQ ID NO: 1858186 - RNA, 18 nt, Human
uguguaugcgugugugug

SEQ ID NO: 1858187 - RNA, 15 nt, Human
ugugugcuuauguau

SEQ ID NO: 1858188 - RNA, 19 nt, Human
ugugugcacguacacacac

SEQ ID NO: 1858189 - RNA, 17 nt, Human
uguuagccccauaauuu

SEQ ID NO: 1858190 - RNA, 14 nt, Human
uguuacuaaguuuu

SEQ ID NO: 1858191 - RNA, 17 nt, Human
uguucauaaauaaaguu

SEQ ID NO: 1858192 - RNA, 20 nt, Human
uguucagcuccagcucacca

SEQ ID NO: 1858193 - RNA, 21 nt, Human
uguucagcuccagcucaccag

SEQ ID NO: 1858194 - RNA, 22 nt, Human
uguucagcuccagcucaccagc

SEQ ID NO: 1858195 - RNA, 17 nt, Human
uguuaguaugaggcauu

SEQ ID NO: 1858196 - RNA, 19 nt, Human
uguuaguaugaggcauuug

SEQ ID NO: 1858197 - RNA, 20 nt, Human
uguuaguaugaggcauuugu

SEQ ID NO: 1858198 - RNA, 17 nt, Human
aaaacacauuuuucuua

SEQ ID NO: 1858199 - RNA, 19 nt, Human
aaaacacuguucucugccc

SEQ ID NO: 1858200 - RNA, 11 nt, Human
aaaagaaaaag

SEQ ID NO: 1858201 - RNA, 17 nt, Human
aaaagaaagaaaaucag

SEQ ID NO: 1858202 - RNA, 16 nt, Human
aaaagaaaagucaagg

SEQ ID NO: 1858203 - RNA, 20 nt, Human
aaaagacaaggaaaaaauaa

SEQ ID NO: 1858204 - RNA, 14 nt, Human
aaaauaaaacuuuu

SEQ ID NO: 1858205 - RNA, 21 nt, Human
aaaaucagccugcuccagcug

SEQ ID NO: 1858206 - RNA, 17 nt, Human
aaaaucagccugcucca

SEQ ID NO: 1858207 - RNA, 13 nt, Human
aaaaucagccugc

SEQ ID NO: 1858208 - RNA, 16 nt, Human
aaaauaaaacuuuuua

SEQ ID NO: 1858209 - RNA, 15 nt, Human
aaagcccaaaguggu

SEQ ID NO: 1858210 - RNA, 15 nt, Human
aaaaucucaaauuuc

SEQ ID NO: 1858211 - RNA, 16 nt, Human
aaaaucucaaauuucu

SEQ ID NO: 1858212 - RNA, 18 nt, Human
aaaaucucaaauuucuaa

SEQ ID NO: 1858213 - RNA, 23 nt, Human
aaacugauuuuuuuuuccuucag

SEQ ID NO: 1858214 - RNA, 22 nt, Human
aaacugauuuuuuuuuccuuca

SEQ ID NO: 1858215 - RNA, 23 nt, Human
aaacucuuaaaacccaagugccu

SEQ ID NO: 1858216 - RNA, 12 nt, Human
aaacucuuaaaa

SEQ ID NO: 1858217 - RNA, 16 nt, Human
aaaccgccaaggcugg

SEQ ID NO: 1858218 - RNA, 15 nt, Human
aaaccgccaaggcug

SEQ ID NO: 1858219 - RNA, 16 nt, Human
aaacccagcucugguc

SEQ ID NO: 1858220 - RNA, 12 nt, Human
aaacccagcucu

SEQ ID NO: 1858221 - RNA, 18 nt, Human
aaacccagcucuggucca

SEQ ID NO: 1858222 - RNA, 17 nt, Human
aaauguucaucaaugaa

SEQ ID NO: 1858223 - RNA, 13 nt, Human
aaauguucaucaa

SEQ ID NO: 1858224 - RNA, 14 nt, Human
aaaggaugcacaga

SEQ ID NO: 1858225 - RNA, 20 nt, Human
aaaggaugcccaaagaugca

SEQ ID NO: 1858226 - RNA, 14 nt, Human
aaaucuuuuugcuu

SEQ ID NO: 1858227 - RNA, 13 nt, Human
aaaucuuuuugcu

SEQ ID NO: 1858228 - RNA, 19 nt, Human
aaaucuccaaaauaaaacu

SEQ ID NO: 1858229 - RNA, 19 nt, Human
aaaugcuguaacuuucuga

SEQ ID NO: 1858230 - RNA, 22 nt, Human
aaaugcugguuuuucaguuuuc

SEQ ID NO: 1858231 - RNA, 14 nt, Human
aaaugaaaaaauau

SEQ ID NO: 1858232 - RNA, 23 nt, Human
aaaugcugcuuuuucucaaaaug

SEQ ID NO: 1858233 - RNA, 10 nt, Human
aaaugcugcu

SEQ ID NO: 1858234 - RNA, 23 nt, Human
aaccuuuugagugccuuacacaa

SEQ ID NO: 1858235 - RNA, 16 nt, Human
aaccuuuugagugccu

SEQ ID NO: 1858236 - RNA, 18 nt, Human
aaccuuuguuugcaucug

SEQ ID NO: 1858237 - RNA, 23 nt, Human
aacauggccuuugcuugaaagaa

SEQ ID NO: 1858238 - RNA, 12 nt, Human
aacccucagagc

SEQ ID NO: 1858239 - RNA, 19 nt, Human
aacccucagagccaccccu

SEQ ID NO: 1858240 - RNA, 23 nt, Human
aaauucuucuccacuuucuagcc

SEQ ID NO: 1858241 - RNA, 15 nt, Human
aaauucuugcaaagu

SEQ ID NO: 1858242 - RNA, 18 nt, Human
aaauucuugcaaaguauc

SEQ ID NO: 1858243 - RNA, 11 nt, Human
aacaggcagau

SEQ ID NO: 1858244 - RNA, 15 nt, Human
aacagccugugucuu

SEQ ID NO: 1858245 - RNA, 12 nt, Human
aacagccugugu

SEQ ID NO: 1858246 - RNA, 22 nt, Human
aacauggccuuugcuugaaaga

SEQ ID NO: 1858247 - RNA, 16 nt, Human
aauaaacacucuugaa

SEQ ID NO: 1858248 - RNA, 11 nt, Human
aauaaacacuc

SEQ ID NO: 1858249 - RNA, 19 nt, Human
aauaaacacucuugaaaaa

SEQ ID NO: 1858250 - RNA, 22 nt, Human
aaguuguaggcauaaagucagg

SEQ ID NO: 1858251 - RNA, 22 nt, Human
aagugcugcauuuaaaagauac

SEQ ID NO: 1858252 - RNA, 12 nt, Human
aagugcugggau

SEQ ID NO: 1858253 - RNA, 19 nt, Human
aauaauguuaacauggaca

SEQ ID NO: 1858254 - RNA, 14 nt, Human
aauaaagcagcguu

SEQ ID NO: 1858255 - RNA, 17 nt, Human
aauaaugugaaacugga

SEQ ID NO: 1858256 - RNA, 22 nt, Human
aauaaugugaaacuggauuaaa

SEQ ID NO: 1858257 - RNA, 11 nt, Human
aauaaagacag

SEQ ID NO: 1858258 - RNA, 12 nt, Human
aauaaagacagg

SEQ ID NO: 1858259 - RNA, 21 nt, Human
aaucaccgaaaacguggcugc

SEQ ID NO: 1858260 - RNA, 22 nt, Human
aaucaaugcuauaacuauguug

SEQ ID NO: 1858261 - RNA, 23 nt, Human
aaucaccgaaaacguggcugcuu

SEQ ID NO: 1858262 - RNA, 15 nt, Human
aaucacguaaagcua

SEQ ID NO: 1858263 - RNA, 23 nt, Human
aaucaaguuggcuucuaaucaaa

SEQ ID NO: 1858264 - RNA, 13 nt, Human
aauauuaagaaag

SEQ ID NO: 1858265 - RNA, 23 nt, Human
aauauguggaguucaucuugaau

SEQ ID NO: 1858266 - RNA, 20 nt, Human
aaugaaagacuguacaaagu

SEQ ID NO: 1858267 - RNA, 18 nt, Human
aaugaaagacuguacaaa

SEQ ID NO: 1858268 - RNA, 21 nt, Human
aaugaaagacuguacaaagua

SEQ ID NO: 1858269 - RNA, 14 nt, Human
aaugaagcaaugcu

SEQ ID NO: 1858270 - RNA, 20 nt, Human
aaugaugccaugaggaacaa

SEQ ID NO: 1858271 - RNA, 20 nt, Human
aaugauguauguugaagccu

SEQ ID NO: 1858272 - RNA, 20 nt, Human
aaugaauacuuuauaaagga

SEQ ID NO: 1858273 - RNA, 10 nt, Human
aagccuuugu

SEQ ID NO: 1858274 - RNA, 14 nt, Human
aagcggcuggcagc

SEQ ID NO: 1858275 - RNA, 13 nt, Human
aagcuagaaauga

SEQ ID NO: 1858276 - RNA, 16 nt, Human
aagcgugagccacugc

SEQ ID NO: 1858277 - RNA, 15 nt, Human
aagcgugagccacug

SEQ ID NO: 1858278 - RNA, 21 nt, Human
aagauaauauuaaggaagaca

SEQ ID NO: 1858279 - RNA, 19 nt, Human
aagauaauauuaaggaaga

SEQ ID NO: 1858280 - RNA, 17 nt, Human
aagauacaguuacucag

SEQ ID NO: 1858281 - RNA, 23 nt, Human
aagauacaguuacucagaauucu

SEQ ID NO: 1858282 - RNA, 19 nt, Human
aagcugcacccucaggcag

SEQ ID NO: 1858283 - RNA, 13 nt, Human
aagcugcacccuc

SEQ ID NO: 1858284 - RNA, 22 nt, Human
aagcuagacgagcaggcuucuu

SEQ ID NO: 1858285 - RNA, 15 nt, Human
aaggcaaggcuguca

SEQ ID NO: 1858286 - RNA, 16 nt, Human
aaggcaaggcugucaa

SEQ ID NO: 1858287 - RNA, 22 nt, Human
aaggcagggagggccugggccc

SEQ ID NO: 1858288 - RNA, 19 nt, Human
aaggcagggagggccuggg

SEQ ID NO: 1858289 - RNA, 13 nt, Human
aaggcaaggcugu

SEQ ID NO: 1858290 - RNA, 13 nt, Human
aagagaaaaaaua

SEQ ID NO: 1858291 - RNA, 19 nt, Human
aagacuuuucuuucagcca

SEQ ID NO: 1858292 - RNA, 12 nt, Human
aagacuuuucuu

SEQ ID NO: 1858293 - RNA, 21 nt, Human
aagacuuuuccaacccucauc

SEQ ID NO: 1858294 - RNA, 15 nt, Human
aagaccacguuucua

SEQ ID NO: 1858295 - RNA, 17 nt, Human
aagaccacguuucuaaa

SEQ ID NO: 1858296 - RNA, 23 nt, Human
aagacagauacuccuccaagguu

SEQ ID NO: 1858297 - RNA, 12 nt, Human
aagacagagucu

SEQ ID NO: 1858298 - RNA, 17 nt, Human
aagacuuuuccaacccu

SEQ ID NO: 1858299 - RNA, 16 nt, Human
aacgcagcccugcuuu

SEQ ID NO: 1858300 - RNA, 12 nt, Human
aacgcagcccug

SEQ ID NO: 1858301 - RNA, 14 nt, Human
aagaacuagcauaa

SEQ ID NO: 1858302 - RNA, 20 nt, Human
aagacaaugugaaaagaaaa

SEQ ID NO: 1858303 - RNA, 19 nt, Human
aagacaaugugaaaagaaa

SEQ ID NO: 1858304 - RNA, 22 nt, Human
aagacaaugacuuacuguacau

SEQ ID NO: 1858305 - RNA, 21 nt, Human
aagacaaggaaaaaauaacaa

SEQ ID NO: 1858306 - RNA, 12 nt, Human
aagaguguggca

SEQ ID NO: 1858307 - RNA, 22 nt, Human
acucccaucugugaaaggaaag

SEQ ID NO: 1858308 - RNA, 15 nt, Human
acucccaagcuggac

SEQ ID NO: 1858309 - RNA, 18 nt, Human
acucccugccccccagcc

SEQ ID NO: 1858310 - RNA, 14 nt, Human
acucccuuucaaca

SEQ ID NO: 1858311 - RNA, 15 nt, Human
acucuacagaggcca

SEQ ID NO: 1858312 - RNA, 16 nt, Human
acugauuuuuuuuucc

SEQ ID NO: 1858313 - RNA, 20 nt, Human
acugauuuuuuuuuccuuca

SEQ ID NO: 1858314 - RNA, 19 nt, Human
acugauuuuuuuuuccuuc

SEQ ID NO: 1858315 - RNA, 18 nt, Human
acugauuuuuuuuuccuu

SEQ ID NO: 1858316 - RNA, 17 nt, Human
acugauuuuuuuuuccu

SEQ ID NO: 1858317 - RNA, 14 nt, Human
acugauuacugccu

SEQ ID NO: 1858318 - RNA, 20 nt, Human
acugauguaugaggaauuuc

SEQ ID NO: 1858319 - RNA, 23 nt, Human
acugaugggcaacccccagccug

SEQ ID NO: 1858320 - RNA, 12 nt, Human
acugaauuucuu

SEQ ID NO: 1858321 - RNA, 23 nt, Human
acugaauuucuuuugccguuauu

SEQ ID NO: 1858322 - RNA, 17 nt, Human
acugacauuguuggcca

SEQ ID NO: 1858323 - RNA, 18 nt, Human
acugacauuguuggccaa

SEQ ID NO: 1858324 - RNA, 16 nt, Human
acugucuuuuuucuaa

SEQ ID NO: 1858325 - RNA, 16 nt, Human
acugugaagagaacca

SEQ ID NO: 1858326 - RNA, 23 nt, Human
acugucuuuuuucuaaaguaaaa

SEQ ID NO: 1858327 - RNA, 22 nt, Human
acugucuuuuuucuaaaguaaa

SEQ ID NO: 1858328 - RNA, 17 nt, Human
acugugccaugugccag

SEQ ID NO: 1858329 - RNA, 18 nt, Human
acugugccaugugccagg

SEQ ID NO: 1858330 - RNA, 19 nt, Human
acugcccaggccugccugu

SEQ ID NO: 1858331 - RNA, 14 nt, Human
acugccaugccagc

SEQ ID NO: 1858332 - RNA, 12 nt, Human
acuggaacucuc

SEQ ID NO: 1858333 - RNA, 15 nt, Human
acugccuauuuuaau

SEQ ID NO: 1858334 - RNA, 12 nt, Human
acugguggcccg

SEQ ID NO: 1858335 - RNA, 17 nt, Human
acuguaaaauaauaacu

SEQ ID NO: 1858336 - RNA, 13 nt, Human
acuuggucuguga

SEQ ID NO: 1858337 - RNA, 23 nt, Human
acuuggggggcugaggugggagg

SEQ ID NO: 1858338 - RNA, 16 nt, Human
acuugaaaauuaacau

SEQ ID NO: 1858339 - RNA, 14 nt, Human
acuugaaaauuaac

SEQ ID NO: 1858340 - RNA, 12 nt, Human
acuugaaaauua

SEQ ID NO: 1858341 - RNA, 21 nt, Human
acuucagacauagaauuaaca

SEQ ID NO: 1858342 - RNA, 22 nt, Human
acuuaaaaaugguuuaaauggu

SEQ ID NO: 1858343 - RNA, 15 nt, Human
acuguuucaaacuuu

SEQ ID NO: 1858344 - RNA, 18 nt, Human
acuguuucaaacuuuacu

SEQ ID NO: 1858345 - RNA, 19 nt, Human
acuguuucaaacuuuacua

SEQ ID NO: 1858346 - RNA, 18 nt, Human
accgugaggccagagaca

SEQ ID NO: 1858347 - RNA, 23 nt, Human
accgggcugggagcucugcagag

SEQ ID NO: 1858348 - RNA, 21 nt, Human
accgggcugggagcucugcag

SEQ ID NO: 1858349 - RNA, 23 nt, Human
accgugaggccagagacacaagc

SEQ ID NO: 1858350 - RNA, 19 nt, Human
accgugccuggccacgccc

SEQ ID NO: 1858351 - RNA, 12 nt, Human
accucagccucc

SEQ ID NO: 1858352 - RNA, 11 nt, Human
accucagccuc

SEQ ID NO: 1858353 - RNA, 21 nt, Human
acccugugauggggcccugcc

SEQ ID NO: 1858354 - RNA, 20 nt, Human
acccugugauggggcccugc

SEQ ID NO: 1858355 - RNA, 19 nt, Human
acccugugauggggcccug

SEQ ID NO: 1858356 - RNA, 17 nt, Human
acccugugauggggccc

SEQ ID NO: 1858357 - RNA, 12 nt, Human
accgggcacuca

SEQ ID NO: 1858358 - RNA, 14 nt, Human
accgggcacucaga

SEQ ID NO: 1858359 - RNA, 16 nt, Human
accgggcacucagaag

SEQ ID NO: 1858360 - RNA, 11 nt, Human
accucaggccu

SEQ ID NO: 1858361 - RNA, 20 nt, Human
accucaggugauccacccac

SEQ ID NO: 1858362 - RNA, 21 nt, Human
accucaggugauccacccacc

SEQ ID NO: 1858363 - RNA, 13 nt, Human
acccuauugcugc

SEQ ID NO: 1858364 - RNA, 19 nt, Human
acccuauugcugcuugagg

SEQ ID NO: 1858365 - RNA, 14 nt, Human
acccuauugcugcu

SEQ ID NO: 1858366 - RNA, 11 nt, Human
acccucagagc

SEQ ID NO: 1858367 - RNA, 16 nt, Human
acccucaggcaggugg

SEQ ID NO: 1858368 - RNA, 15 nt, Human
acccucaggcaggug

SEQ ID NO: 1858369 - RNA, 13 nt, Human
acccucaucacca

SEQ ID NO: 1858370 - RNA, 14 nt, Human
acccucaggcaggu

SEQ ID NO: 1858371 - RNA, 13 nt, Human
acccucaggcagg

SEQ ID NO: 1858372 - RNA, 18 nt, Human
acccucagagccaccccu

SEQ ID NO: 1858373 - RNA, 23 nt, Human
acccuggcacuauaauguaagcu

SEQ ID NO: 1858374 - RNA, 18 nt, Human
acccuggcacccagggug

SEQ ID NO: 1858375 - RNA, 23 nt, Human
acccucaucaccaacgucugugc

SEQ ID NO: 1858376 - RNA, 21 nt, Human
acccugucucuacuaaaaaua

SEQ ID NO: 1858377 - RNA, 16 nt, Human
acccugugauggggcc

SEQ ID NO: 1858378 - RNA, 16 nt, Human
acccuggggagaaagu

SEQ ID NO: 1858379 - RNA, 20 nt, Human
accugccccucaacucuccu

SEQ ID NO: 1858380 - RNA, 15 nt, Human
accugccccucaacu

SEQ ID NO: 1858381 - RNA, 12 nt, Human
accugccccuca

SEQ ID NO: 1858382 - RNA, 23 nt, Human
accugccaggaagccagcaggcu

SEQ ID NO: 1858383 - RNA, 22 nt, Human
accugccaggaagccagcaggc

SEQ ID NO: 1858384 - RNA, 21 nt, Human
accugccaggaagccagcagg

SEQ ID NO: 1858385 - RNA, 17 nt, Human
accuguggccaaguucu

SEQ ID NO: 1858386 - RNA, 12 nt, Human
accucugccuga

SEQ ID NO: 1858387 - RNA, 20 nt, Human
accucugccugaagucacac

SEQ ID NO: 1858388 - RNA, 23 nt, Human
accucugccugaagucacacagu

SEQ ID NO: 1858389 - RNA, 18 nt, Human
acuaauggggcggugaga

SEQ ID NO: 1858390 - RNA, 20 nt, Human
acgauuucuguuuagauaau

SEQ ID NO: 1858391 - RNA, 23 nt, Human
acgauuucuguuuagauaauaca

SEQ ID NO: 1858392 - RNA, 19 nt, Human
acgauuucuguuuagauaa

SEQ ID NO: 1858393 - RNA, 19 nt, Human
acgcugugcugcccugccc

SEQ ID NO: 1858394 - RNA, 22 nt, Human
acgcugugcugcccugcccacc

SEQ ID NO: 1858395 - RNA, 23 nt, Human
acgcagcccugcuuugggcugcc

SEQ ID NO: 1858396 - RNA, 22 nt, Human
acgcagcccugcuuugggcugc

SEQ ID NO: 1858397 - RNA, 12 nt, Human
acgcagcccugc

SEQ ID NO: 1858398 - RNA, 13 nt, Human
acgucugugccau

SEQ ID NO: 1858399 - RNA, 12 nt, Human
acgucugugcca

SEQ ID NO: 1858400 - RNA, 19 nt, Human
acggacacucaaaagcugg

SEQ ID NO: 1858401 - RNA, 17 nt, Human
acggacacucaaaagcu

SEQ ID NO: 1858402 - RNA, 19 nt, Human
acggaauaguuggcuagga

SEQ ID NO: 1858403 - RNA, 19 nt, Human
acagcucuucuccaggcug

SEQ ID NO: 1858404 - RNA, 20 nt, Human
acagcucuucuccaggcugu

SEQ ID NO: 1858405 - RNA, 14 nt, Human
acaggauuauugga

SEQ ID NO: 1858406 - RNA, 15 nt, Human
acaggcaaugcuggc

SEQ ID NO: 1858407 - RNA, 16 nt, Human
acaggcaaugcuggcu

SEQ ID NO: 1858408 - RNA, 14 nt, Human
acaggcacccacca

SEQ ID NO: 1858409 - RNA, 17 nt, Human
acaggcaaugcuggcug

SEQ ID NO: 1858410 - RNA, 18 nt, Human
acaguggaaccagcccag

SEQ ID NO: 1858411 - RNA, 19 nt, Human
acagugauuaccagggacu

SEQ ID NO: 1858412 - RNA, 13 nt, Human
acagugcaucuca

SEQ ID NO: 1858413 - RNA, 18 nt, Human
acagugcaucucagccca

SEQ ID NO: 1858414 - RNA, 17 nt, Human
acagugcaucucagccc

SEQ ID NO: 1858415 - RNA, 15 nt, Human
acagugcaucucagc

SEQ ID NO: 1858416 - RNA, 23 nt, Human
acaggcacccaccaucaugucug

SEQ ID NO: 1858417 - RNA, 16 nt, Human
accagagcugccaccu

SEQ ID NO: 1858418 - RNA, 14 nt, Human
accagagcugccac

SEQ ID NO: 1858419 - RNA, 12 nt, Human
accagagcugcc

SEQ ID NO: 1858420 - RNA, 13 nt, Human
accagagcugcca

SEQ ID NO: 1858421 - RNA, 21 nt, Human
accaacgucugugccauuuug

SEQ ID NO: 1858422 - RNA, 14 nt, Human
accaagccguggcu

SEQ ID NO: 1858423 - RNA, 18 nt, Human
accaagccguggcuuccc

SEQ ID NO: 1858424 - RNA, 17 nt, Human
accaagccguggcuucc

SEQ ID NO: 1858425 - RNA, 16 nt, Human
accaagccguggcuuc

SEQ ID NO: 1858426 - RNA, 15 nt, Human
accaagccguggcuu

SEQ ID NO: 1858427 - RNA, 13 nt, Human
accacguuucuaa

SEQ ID NO: 1858428 - RNA, 14 nt, Human
accacguuucuaaa

SEQ ID NO: 1858429 - RNA, 18 nt, Human
accacgcuggaccuugaa

SEQ ID NO: 1858430 - RNA, 14 nt, Human
accacgcuggaccu

SEQ ID NO: 1858431 - RNA, 16 nt, Human
accacgcuggaccuug

SEQ ID NO: 1858432 - RNA, 17 nt, Human
accaacgucugugccau

SEQ ID NO: 1858433 - RNA, 14 nt, Human
accaacgucugugc

SEQ ID NO: 1858434 - RNA, 13 nt, Human
acaugcacgugug

SEQ ID NO: 1858435 - RNA, 20 nt, Human
acaugccucucucaggccaa

SEQ ID NO: 1858436 - RNA, 15 nt, Human
acauaagauaaaugu

SEQ ID NO: 1858437 - RNA, 20 nt, Human
acauaaguauuuaauucaug

SEQ ID NO: 1858438 - RNA, 20 nt, Human
acauacaggaagguagaaau

SEQ ID NO: 1858439 - RNA, 16 nt, Human
acauacaauuccaaac

SEQ ID NO: 1858440 - RNA, 19 nt, Human
acauguuuuucuucucccu

SEQ ID NO: 1858441 - RNA, 17 nt, Human
acauguuaaacuuacuu

SEQ ID NO: 1858442 - RNA, 17 nt, Human
acauguguuggcagccu

SEQ ID NO: 1858443 - RNA, 19 nt, Human
aauucucagaaucucaaau

SEQ ID NO: 1858444 - RNA, 14 nt, Human
aauucuacuuugag

SEQ ID NO: 1858445 - RNA, 22 nt, Human
aauucuagcuuugagcuuaaga

SEQ ID NO: 1858446 - RNA, 15 nt, Human
aauucucuuauccaa

SEQ ID NO: 1858447 - RNA, 15 nt, Human
aauucucuaguuuga

SEQ ID NO: 1858448 - RNA, 17 nt, Human
aauucucuaguuugauu

SEQ ID NO: 1858449 - RNA, 16 nt, Human
aauucuccugccucag

SEQ ID NO: 1858450 - RNA, 15 nt, Human
aauucuccugccuca

SEQ ID NO: 1858451 - RNA, 14 nt, Human
aauucuccugccuc

SEQ ID NO: 1858452 - RNA, 21 nt, Human
aauucucauuugucacacacu

SEQ ID NO: 1858453 - RNA, 22 nt, Human
aauuguaaggaaugauuaauua

SEQ ID NO: 1858454 - RNA, 13 nt, Human
aauucuuaaauau

SEQ ID NO: 1858455 - RNA, 22 nt, Human
aauuggauacgacaacuugcac

SEQ ID NO: 1858456 - RNA, 18 nt, Human
aauucuguuuuucuaggc

SEQ ID NO: 1858457 - RNA, 14 nt, Human
aauucuguuuuucu

SEQ ID NO: 1858458 - RNA, 19 nt, Human
aauuaugaguuauuuuuau

SEQ ID NO: 1858459 - RNA, 19 nt, Human
aauuauacccccugcaaag

SEQ ID NO: 1858460 - RNA, 17 nt, Human
aauuucccaaagcagug

SEQ ID NO: 1858461 - RNA, 15 nt, Human
aauuucccaaagcag

SEQ ID NO: 1858462 - RNA, 21 nt, Human
aauuuccacucaggucuguuu

SEQ ID NO: 1858463 - RNA, 11 nt, Human
aauuguaauag

SEQ ID NO: 1858464 - RNA, 14 nt, Human
acacagcucuucuc

SEQ ID NO: 1858465 - RNA, 16 nt, Human
acacagcucuucucca

SEQ ID NO: 1858466 - RNA, 18 nt, Human
acacagcucuucuccagg

SEQ ID NO: 1858467 - RNA, 18 nt, Human
acaccagagcccaccuug

SEQ ID NO: 1858468 - RNA, 23 nt, Human
acaccagagcccaccuuggcuca

SEQ ID NO: 1858469 - RNA, 15 nt, Human
acaccaauauucaua

SEQ ID NO: 1858470 - RNA, 13 nt, Human
acaccagagccca

SEQ ID NO: 1858471 - RNA, 20 nt, Human
acaaggcaaggcugucaauu

SEQ ID NO: 1858472 - RNA, 19 nt, Human
acaaggcaaggcugucaau

SEQ ID NO: 1858473 - RNA, 17 nt, Human
acaaggcaaggcuguca

SEQ ID NO: 1858474 - RNA, 16 nt, Human
acaaggcaaggcuguc

SEQ ID NO: 1858475 - RNA, 15 nt, Human
acaaguuaaauaaau

SEQ ID NO: 1858476 - RNA, 14 nt, Human
aucaaaagaaagaa

SEQ ID NO: 1858477 - RNA, 18 nt, Human
auauuuuuuucuuuucuu

SEQ ID NO: 1858478 - RNA, 12 nt, Human
aucaaaggacac

SEQ ID NO: 1858479 - RNA, 19 nt, Human
aucaaagagguuuuaaaaa

SEQ ID NO: 1858480 - RNA, 20 nt, Human
aucaaaagguuaauaaagua

SEQ ID NO: 1858481 - RNA, 24 nt, Human
aucaaaagguuaauaaaguaauua

SEQ ID NO: 1858482 - RNA, 14 nt, Human
auagcacagacccu

SEQ ID NO: 1858483 - RNA, 19 nt, Human
aucauggagguuugaagau

SEQ ID NO: 1858484 - RNA, 20 nt, Human
aucaugacaaagacugagua

SEQ ID NO: 1858485 - RNA, 15 nt, Human
aucauccuaagcuau

SEQ ID NO: 1858486 - RNA, 23 nt, Human
auccacuuuaucuugaauaaugu

SEQ ID NO: 1858487 - RNA, 21 nt, Human
auccacugugccaugugccag

SEQ ID NO: 1858488 - RNA, 22 nt, Human
aucuaggaagacuuuggaaaga

SEQ ID NO: 1858489 - RNA, 14 nt, Human
aucgaccugccucg

SEQ ID NO: 1858490 - RNA, 15 nt, Human
augggacagggagga

SEQ ID NO: 1858491 - RNA, 19 nt, Human
augcucugcauguuacaua

SEQ ID NO: 1858492 - RNA, 18 nt, Human
augcucugcauguuacau

SEQ ID NO: 1858493 - RNA, 22 nt, Human
augcuucuucagagacuccugc

SEQ ID NO: 1858494 - RNA, 21 nt, Human
augcuuuaggauguacaguua

SEQ ID NO: 1858495 - RNA, 20 nt, Human
augcuucuucagagacuccu

SEQ ID NO: 1858496 - RNA, 17 nt, Human
augcuucuucagagacu

SEQ ID NO: 1858497 - RNA, 14 nt, Human
augcuucuucagag

SEQ ID NO: 1858498 - RNA, 16 nt, Human
augcuuugaucccuuc

SEQ ID NO: 1858499 - RNA, 11 nt, Human
augccuggugg

SEQ ID NO: 1858500 - RNA, 12 nt, Human
augccugguggc

SEQ ID NO: 1858501 - RNA, 13 nt, Human
augccugguggca

SEQ ID NO: 1858502 - RNA, 14 nt, Human
augccugguggcag

SEQ ID NO: 1858503 - RNA, 19 nt, Human
augccugguggcagcugcg

SEQ ID NO: 1858504 - RNA, 18 nt, Human
augccugguggcagcugc

SEQ ID NO: 1858505 - RNA, 21 nt, Human
augccugguggcagcugcggu

SEQ ID NO: 1858506 - RNA, 24 nt, Human
augcauauuauuuuauguugcaua

SEQ ID NO: 1858507 - RNA, 23 nt, Human
aucuaggaagacuuuggaaagag

SEQ ID NO: 1858508 - RNA, 11 nt, Human
aucuaggauuu

SEQ ID NO: 1858509 - RNA, 19 nt, Human
aucuaggauuuuaagggaa

SEQ ID NO: 1858510 - RNA, 18 nt, Human
augaccuuucaauaggaa

SEQ ID NO: 1858511 - RNA, 15 nt, Human
augaccuuucaauag

SEQ ID NO: 1858512 - RNA, 13 nt, Human
augaccuuucaau

SEQ ID NO: 1858513 - RNA, 12 nt, Human
augagccuggca

SEQ ID NO: 1858514 - RNA, 11 nt, Human
augagccuggc

SEQ ID NO: 1858515 - RNA, 21 nt, Human
augagccucagcauccuggca

SEQ ID NO: 1858516 - RNA, 19 nt, Human
augagccucagcauccugg

SEQ ID NO: 1858517 - RNA, 12 nt, Human
augaaagacugu

SEQ ID NO: 1858518 - RNA, 23 nt, Human
augaagcauuuacuuuguguuca

SEQ ID NO: 1858519 - RNA, 13 nt, Human
augaaguacucau

SEQ ID NO: 1858520 - RNA, 23 nt, Human
augaaguaauaugcacacauuuu

SEQ ID NO: 1858521 - RNA, 14 nt, Human
augaaguaauaugc

SEQ ID NO: 1858522 - RNA, 21 nt, Human
augaaguaauaugcacacauu

SEQ ID NO: 1858523 - RNA, 17 nt, Human
augaauaaagacaccua

SEQ ID NO: 1858524 - RNA, 23 nt, Human
augaaguuuuuuuuauacaggau

SEQ ID NO: 1858525 - RNA, 18 nt, Human
aguccuuaccagcagagc

SEQ ID NO: 1858526 - RNA, 16 nt, Human
aguccuuaccagcaga

SEQ ID NO: 1858527 - RNA, 14 nt, Human
aguccucuuuucug

SEQ ID NO: 1858528 - RNA, 21 nt, Human
agucugauucccaagcucugc

SEQ ID NO: 1858529 - RNA, 22 nt, Human
agucugauucccaagcucugcu

SEQ ID NO: 1858530 - RNA, 16 nt, Human
agucgaggacagggag

SEQ ID NO: 1858531 - RNA, 18 nt, Human
agucuggcccuuccuuuu

SEQ ID NO: 1858532 - RNA, 16 nt, Human
agugacagaggcagcc

SEQ ID NO: 1858533 - RNA, 19 nt, Human
agugacagaggcagcccca

SEQ ID NO: 1858534 - RNA, 14 nt, Human
agugacagaggcag

SEQ ID NO: 1858535 - RNA, 19 nt, Human
agugauccucccaccucag

SEQ ID NO: 1858536 - RNA, 20 nt, Human
agugauccucccaccucagc

SEQ ID NO: 1858537 - RNA, 22 nt, Human
agugauccucccaccucagccu

SEQ ID NO: 1858538 - RNA, 23 nt, Human
agugauccucccaccucagccuc

SEQ ID NO: 1858539 - RNA, 13 nt, Human
agugauuaccagg

SEQ ID NO: 1858540 - RNA, 22 nt, Human
agugccuuauggaacacucuga

SEQ ID NO: 1858541 - RNA, 21 nt, Human
agugccuuauggaacacucug

SEQ ID NO: 1858542 - RNA, 20 nt, Human
agugccuuauggaacacucu

SEQ ID NO: 1858543 - RNA, 19 nt, Human
agugccuuauggaacacuc

SEQ ID NO: 1858544 - RNA, 18 nt, Human
agugauucuccugccuca

SEQ ID NO: 1858545 - RNA, 19 nt, Human
agugauucuccugccucag

SEQ ID NO: 1858546 - RNA, 20 nt, Human
agugauucuccugccucagc

SEQ ID NO: 1858547 - RNA, 21 nt, Human
aguaaaugggggugcauuuga

SEQ ID NO: 1858548 - RNA, 19 nt, Human
aguaaaugggggugcauuu

SEQ ID NO: 1858549 - RNA, 20 nt, Human
aguaaaugggggugcauuug

SEQ ID NO: 1858550 - RNA, 17 nt, Human
aguaacuuacuuaggug

SEQ ID NO: 1858551 - RNA, 15 nt, Human
aguacuggagaaaau

SEQ ID NO: 1858552 - RNA, 22 nt, Human
aguauauugauccagaaagaaa

SEQ ID NO: 1858553 - RNA, 20 nt, Human
aguacuucuccacccugcuc

SEQ ID NO: 1858554 - RNA, 19 nt, Human
aguacuucuccacccugcu

SEQ ID NO: 1858555 - RNA, 21 nt, Human
aguacuucuccacccugcucu

SEQ ID NO: 1858556 - RNA, 22 nt, Human
aguacuucuccacccugcucuc

SEQ ID NO: 1858557 - RNA, 17 nt, Human
auacaccacuacauucu

SEQ ID NO: 1858558 - RNA, 14 nt, Human
auacaccgggccug

SEQ ID NO: 1858559 - RNA, 18 nt, Human
auacaccgggccuggaga

SEQ ID NO: 1858560 - RNA, 19 nt, Human
auacuugaaaauuaacaug

SEQ ID NO: 1858561 - RNA, 21 nt, Human
auaaagaugagugagcaugcc

SEQ ID NO: 1858562 - RNA, 15 nt, Human
auacaccacuacauu

SEQ ID NO: 1858563 - RNA, 12 nt, Human
auaauguuaaca

SEQ ID NO: 1858564 - RNA, 23 nt, Human
auacaaugcugugcccuaaagug

SEQ ID NO: 1858565 - RNA, 11 nt, Human
aguuugcaguu

SEQ ID NO: 1858566 - RNA, 14 nt, Human
aguuugauuaaauu

SEQ ID NO: 1858567 - RNA, 15 nt, Human
auaaaagacagugaa

SEQ ID NO: 1858568 - RNA, 16 nt, Human
auaaaagacagugaaa

SEQ ID NO: 1858569 - RNA, 22 nt, Human
aguuguuagugugucuuagugu

SEQ ID NO: 1858570 - RNA, 17 nt, Human
aguuguuagugugucuu

SEQ ID NO: 1858571 - RNA, 18 nt, Human
aguugaaaaacagcugag

SEQ ID NO: 1858572 - RNA, 17 nt, Human
aguugaagacagagcua

SEQ ID NO: 1858573 - RNA, 16 nt, Human
aguugaagacagagcu

SEQ ID NO: 1858574 - RNA, 17 nt, Human
aguugaaaaacagcuga

SEQ ID NO: 1858575 - RNA, 21 nt, Human
aguuccaccaucaagccacca

SEQ ID NO: 1858576 - RNA, 18 nt, Human
aguuccaccaucaagcca

SEQ ID NO: 1858577 - RNA, 13 nt, Human
aguuacacauuuu

SEQ ID NO: 1858578 - RNA, 16 nt, Human
aguuacacauuuuuca

SEQ ID NO: 1858579 - RNA, 19 nt, Human
aguuacacauuuuucagau

SEQ ID NO: 1858580 - RNA, 14 nt, Human
aguucauacccugu

SEQ ID NO: 1858581 - RNA, 18 nt, Human
aguuacacuaaaagguga

SEQ ID NO: 1858582 - RNA, 12 nt, Human
agugcuccagcc

SEQ ID NO: 1858583 - RNA, 23 nt, Human
agaucucugcuuuggaaaucaca

SEQ ID NO: 1858584 - RNA, 18 nt, Human
agaucucugcuuuggaaa

SEQ ID NO: 1858585 - RNA, 22 nt, Human
agaugggugcuuggaggaagga

SEQ ID NO: 1858586 - RNA, 20 nt, Human
agaugggugcuuggaggaag

SEQ ID NO: 1858587 - RNA, 14 nt, Human
agauucuuuccuga

SEQ ID NO: 1858588 - RNA, 18 nt, Human
agaugacaucugucuagg

SEQ ID NO: 1858589 - RNA, 20 nt, Human
agauggcugugccucugccu

SEQ ID NO: 1858590 - RNA, 19 nt, Human
agauggcugugccucugcc

SEQ ID NO: 1858591 - RNA, 18 nt, Human
agauggcugugccucugc

SEQ ID NO: 1858592 - RNA, 17 nt, Human
agauggcugugccucug

SEQ ID NO: 1858593 - RNA, 22 nt, Human
agauggcugugccucugccugu

SEQ ID NO: 1858594 - RNA, 21 nt, Human
agauggcugugccucugccug

SEQ ID NO: 1858595 - RNA, 16 nt, Human
agauucuuuccugagg

SEQ ID NO: 1858596 - RNA, 15 nt, Human
agauucuuuccugag

SEQ ID NO: 1858597 - RNA, 18 nt, Human
agauucuuuccugaggcu

SEQ ID NO: 1858598 - RNA, 17 nt, Human
agauugagauguguuca

SEQ ID NO: 1858599 - RNA, 16 nt, Human
agauugcaacaggcug

SEQ ID NO: 1858600 - RNA, 16 nt, Human
agauugcaccacugca

SEQ ID NO: 1858601 - RNA, 17 nt, Human
agauugcaacaggcugg

SEQ ID NO: 1858602 - RNA, 19 nt, Human
agauugcaacaggcugggc

SEQ ID NO: 1858603 - RNA, 19 nt, Human
agcaaauucuguuuuucua

SEQ ID NO: 1858604 - RNA, 15 nt, Human
agaguggcuccuccc

SEQ ID NO: 1858605 - RNA, 14 nt, Human
agaguggcuccucc

SEQ ID NO: 1858606 - RNA, 13 nt, Human
agaguggcuccuc

SEQ ID NO: 1858607 - RNA, 12 nt, Human
agaguggcuccu

SEQ ID NO: 1858608 - RNA, 20 nt, Human
agagggucugaggaauccag

SEQ ID NO: 1858609 - RNA, 23 nt, Human
agaggggguggccucccaacuca

SEQ ID NO: 1858610 - RNA, 13 nt, Human
agaguugaagaca

SEQ ID NO: 1858611 - RNA, 15 nt, Human
agaguugaagacaga

SEQ ID NO: 1858612 - RNA, 14 nt, Human
agaguugaagacag

SEQ ID NO: 1858613 - RNA, 15 nt, Human
agauauaaaagacug

SEQ ID NO: 1858614 - RNA, 20 nt, Human
agauagccaaggccaaagga

SEQ ID NO: 1858615 - RNA, 20 nt, Human
agauagauaggucagugcaa

SEQ ID NO: 1858616 - RNA, 15 nt, Human
agcaauucuccugcc

SEQ ID NO: 1858617 - RNA, 20 nt, Human
agcaauucuccugccucagc

SEQ ID NO: 1858618 - RNA, 19 nt, Human
agcaauucuccugccucag

SEQ ID NO: 1858619 - RNA, 18 nt, Human
agcaauucuccugccuca

SEQ ID NO: 1858620 - RNA, 17 nt, Human
agcaauucuccugccuc

SEQ ID NO: 1858621 - RNA, 21 nt, Human
agcacagacccugcccugugg

SEQ ID NO: 1858622 - RNA, 17 nt, Human
agcagugcaugcugucc

SEQ ID NO: 1858623 - RNA, 19 nt, Human
agcagcguuucuaugacac

SEQ ID NO: 1858624 - RNA, 18 nt, Human
agcagcguuucuaugaca

SEQ ID NO: 1858625 - RNA, 20 nt, Human
agcagccuggacccugugga

SEQ ID NO: 1858626 - RNA, 16 nt, Human
agcagugcaugcuguc

SEQ ID NO: 1858627 - RNA, 13 nt, Human
agcagugcaugcu

SEQ ID NO: 1858628 - RNA, 16 nt, Human
agcagccuggacccug

SEQ ID NO: 1858629 - RNA, 22 nt, Human
agccagauuucacucuccuugg

SEQ ID NO: 1858630 - RNA, 20 nt, Human
agccagauuucacucuccuu

SEQ ID NO: 1858631 - RNA, 17 nt, Human
agccagauuucacucuc

SEQ ID NO: 1858632 - RNA, 14 nt, Human
agccagauuucacu

SEQ ID NO: 1858633 - RNA, 17 nt, Human
agccaacuauggccugu

SEQ ID NO: 1858634 - RNA, 20 nt, Human
agcccacgcccccacuggug

SEQ ID NO: 1858635 - RNA, 19 nt, Human
agcccacgcccccacuggu

SEQ ID NO: 1858636 - RNA, 18 nt, Human
agcccacgcccccacugg

SEQ ID NO: 1858637 - RNA, 17 nt, Human
agcccacgcccccacug

SEQ ID NO: 1858638 - RNA, 23 nt, Human
agcccaccccucaacaccucugc

SEQ ID NO: 1858639 - RNA, 13 nt, Human
agcccaccuuggc

SEQ ID NO: 1858640 - RNA, 23 nt, Human
agccagcaggcucucaggccagc

SEQ ID NO: 1858641 - RNA, 21 nt, Human
agccagcaggcucucaggcca

SEQ ID NO: 1858642 - RNA, 22 nt, Human
agccagcaggcucucaggccag

SEQ ID NO: 1858643 - RNA, 16 nt, Human
agcaucuaugugagac

SEQ ID NO: 1858644 - RNA, 18 nt, Human
agaagaugaaugagcaaa

SEQ ID NO: 1858645 - RNA, 19 nt, Human
agaagauggcacuuauaac

SEQ ID NO: 1858646 - RNA, 19 nt, Human
agaagucuuagauguauau

SEQ ID NO: 1858647 - RNA, 17 nt, Human
agaagucuuagauguau

SEQ ID NO: 1858648 - RNA, 14 nt, Human
agaagucacacagu

SEQ ID NO: 1858649 - RNA, 23 nt, Human
agaagagaaugcacaaacagagg

SEQ ID NO: 1858650 - RNA, 15 nt, Human
agaagagaaugcaca

SEQ ID NO: 1858651 - RNA, 21 nt, Human
agaaccaaaaagaggcuaugu

SEQ ID NO: 1858652 - RNA, 17 nt, Human
agaaccaggcaacuugg

SEQ ID NO: 1858653 - RNA, 20 nt, Human
agaaccaggcaacuugggaa

SEQ ID NO: 1858654 - RNA, 16 nt, Human
agaaugaaagggccca

SEQ ID NO: 1858655 - RNA, 17 nt, Human
agaaucucaaauaacua

SEQ ID NO: 1858656 - RNA, 23 nt, Human
agaaugcacaaacagaggccgcc

SEQ ID NO: 1858657 - RNA, 18 nt, Human
agaaugcucuuuacuuca

SEQ ID NO: 1858658 - RNA, 18 nt, Human
agaaccaaaaagaggcua

SEQ ID NO: 1858659 - RNA, 17 nt, Human
agaaccaaaaagaggcu

SEQ ID NO: 1858660 - RNA, 17 nt, Human
agaacaucccuccuggg

SEQ ID NO: 1858661 - RNA, 13 nt, Human
agaacaucccucc

SEQ ID NO: 1858662 - RNA, 22 nt, Human
agaacagugauuaccagggacu

SEQ ID NO: 1858663 - RNA, 16 nt, Human
agacucuuuggacacu

SEQ ID NO: 1858664 - RNA, 21 nt, Human
agacugaccaauauuguacag

SEQ ID NO: 1858665 - RNA, 12 nt, Human
agacugaccaau

SEQ ID NO: 1858666 - RNA, 23 nt, Human
agagagcaagacgcugugcugcc

SEQ ID NO: 1858667 - RNA, 19 nt, Human
agagagcaagacgcugugc

SEQ ID NO: 1858668 - RNA, 11 nt, Human
agagagcaaga

SEQ ID NO: 1858669 - RNA, 18 nt, Human
agagcccacgcccccacu

SEQ ID NO: 1858670 - RNA, 15 nt, Human
agaauuuugagcagg

SEQ ID NO: 1858671 - RNA, 20 nt, Human
agacaaugugaaaagaaaaa

SEQ ID NO: 1858672 - RNA, 19 nt, Human
agacaaggaaaaaauaaca

SEQ ID NO: 1858673 - RNA, 20 nt, Human
agacgcugugcugcccugcc

SEQ ID NO: 1858674 - RNA, 19 nt, Human
agacgcugugcugcccugc

SEQ ID NO: 1858675 - RNA, 18 nt, Human
agacgcugugcugcccug

SEQ ID NO: 1858676 - RNA, 17 nt, Human
agacgcugugcugcccu

SEQ ID NO: 1858677 - RNA, 15 nt, Human
agacuaucuaaaugu

SEQ ID NO: 1858678 - RNA, 23 nt, Human
agacagcccgggcucugccuccc

SEQ ID NO: 1858679 - RNA, 22 nt, Human
agacagcccgggcucugccucc

SEQ ID NO: 1858680 - RNA, 14 nt, Human
agacaauuuauuau

SEQ ID NO: 1858681 - RNA, 21 nt, Human
agacagcccgggcucugccuc

SEQ ID NO: 1858682 - RNA, 13 nt, Human
agacagcccucca

SEQ ID NO: 1858683 - RNA, 23 nt, Human
agaccaucccugaaggccccgcc

SEQ ID NO: 1858684 - RNA, 14 nt, Human
agaccacguuucua

SEQ ID NO: 1858685 - RNA, 17 nt, Human
agacccaaaaggcagaa

SEQ ID NO: 1858686 - RNA, 18 nt, Human
agacgaaacauuuguucu

SEQ ID NO: 1858687 - RNA, 22 nt, Human
agcucaccagccccagugccca

SEQ ID NO: 1858688 - RNA, 23 nt, Human
agcucaccagccccagugcccac

SEQ ID NO: 1858689 - RNA, 21 nt, Human
agcugacuuuucuguccgagc

SEQ ID NO: 1858690 - RNA, 15 nt, Human
agcugacuuuucugu

SEQ ID NO: 1858691 - RNA, 16 nt, Human
agcugguugagguuuc

SEQ ID NO: 1858692 - RNA, 14 nt, Human
agcuggguuggaaa

SEQ ID NO: 1858693 - RNA, 16 nt, Human
agcuggguuggaaaac

SEQ ID NO: 1858694 - RNA, 20 nt, Human
agcuggguuggaaaacagua

SEQ ID NO: 1858695 - RNA, 15 nt, Human
agcuggucccacuca

SEQ ID NO: 1858696 - RNA, 14 nt, Human
aggaagguagaaau

SEQ ID NO: 1858697 - RNA, 15 nt, Human
aggaaguacuggaga

SEQ ID NO: 1858698 - RNA, 11 nt, Human
aggaaguacug

SEQ ID NO: 1858699 - RNA, 12 nt, Human
aggaacacuccu

SEQ ID NO: 1858700 - RNA, 23 nt, Human
aggaaaaccaagccguggcuucc

SEQ ID NO: 1858701 - RNA, 22 nt, Human
aggaaaaccaagccguggcuuc

SEQ ID NO: 1858702 - RNA, 21 nt, Human
aggaaaaccaagccguggcuu

SEQ ID NO: 1858703 - RNA, 20 nt, Human
aggaaaaccaagccguggcu

SEQ ID NO: 1858704 - RNA, 15 nt, Human
aggaacacuccuuca

SEQ ID NO: 1858705 - RNA, 19 nt, Human
aggaaaaccaagccguggc

SEQ ID NO: 1858706 - RNA, 18 nt, Human
aggaaaaaauaacaauga

SEQ ID NO: 1858707 - RNA, 21 nt, Human
agcuuuguuuguugucagcug

SEQ ID NO: 1858708 - RNA, 22 nt, Human
agcuuuguuuguugucagcuga

SEQ ID NO: 1858709 - RNA, 14 nt, Human
agccuggacccugu

SEQ ID NO: 1858710 - RNA, 18 nt, Human
agccuggcacagggcagu

SEQ ID NO: 1858711 - RNA, 17 nt, Human
agccuggcacagggcag

SEQ ID NO: 1858712 - RNA, 20 nt, Human
agccuggcacagggcagugg

SEQ ID NO: 1858713 - RNA, 17 nt, Human
agccugcugccugcuuu

SEQ ID NO: 1858714 - RNA, 18 nt, Human
agccugggcaaugugaua

SEQ ID NO: 1858715 - RNA, 20 nt, Human
agcuaacauggaaguacuau

SEQ ID NO: 1858716 - RNA, 19 nt, Human
agcuaacauggaaguacua

SEQ ID NO: 1858717 - RNA, 13 nt, Human
agcgacagugaga

SEQ ID NO: 1858718 - RNA, 15 nt, Human
agcgacagugagacu

SEQ ID NO: 1858719 - RNA, 17 nt, Human
agcgauucuucugcuuc

SEQ ID NO: 1858720 - RNA, 19 nt, Human
agcgauucuucugcuucag

SEQ ID NO: 1858721 - RNA, 17 nt, Human
agcgacagugagacucu

SEQ ID NO: 1858722 - RNA, 15 nt, Human
agcgauucuucugcu

SEQ ID NO: 1858723 - RNA, 13 nt, Human
agcucaccagccc

SEQ ID NO: 1858724 - RNA, 14 nt, Human
agcucaccagcccc

SEQ ID NO: 1858725 - RNA, 15 nt, Human
agcucaccagcccca

SEQ ID NO: 1858726 - RNA, 21 nt, Human
agcucaccagccccagugccc

SEQ ID NO: 1858727 - RNA, 13 nt, Human
agcuacaaaugca

SEQ ID NO: 1858728 - RNA, 13 nt, Human
agcuaaugggaca

SEQ ID NO: 1858729 - RNA, 14 nt, Human
agcuaaugggacac

SEQ ID NO: 1858730 - RNA, 15 nt, Human
agcuaaugggacacu

SEQ ID NO: 1858731 - RNA, 12 nt, Human
agcuacaaaugc

SEQ ID NO: 1858732 - RNA, 16 nt, Human
aggcagccaggccaca

SEQ ID NO: 1858733 - RNA, 15 nt, Human
aggcagccaggccac

SEQ ID NO: 1858734 - RNA, 14 nt, Human
aggcagccaggcca

SEQ ID NO: 1858735 - RNA, 22 nt, Human
aggcagaacucaucuagguaaa

SEQ ID NO: 1858736 - RNA, 20 nt, Human
aggcagagguugcagugagc

SEQ ID NO: 1858737 - RNA, 13 nt, Human
aggcagauacagg

SEQ ID NO: 1858738 - RNA, 18 nt, Human
aggcagccaggccacaag

SEQ ID NO: 1858739 - RNA, 17 nt, Human
aggcaucgcaauguaag

SEQ ID NO: 1858740 - RNA, 24 nt, Human
aggcaugugaugagaggaaaucac

SEQ ID NO: 1858741 - RNA, 23 nt, Human
aggcaugugaugagaggaaauca

SEQ ID NO: 1858742 - RNA, 22 nt, Human
aggcaugugccacccacccaac

SEQ ID NO: 1858743 - RNA, 12 nt, Human
aggcauguucuc

SEQ ID NO: 1858744 - RNA, 23 nt, Human
aggcauuccccaggaggccagcc

SEQ ID NO: 1858745 - RNA, 22 nt, Human
aggcauuccccaggaggccagc

SEQ ID NO: 1858746 - RNA, 21 nt, Human
aggcauuccccaggaggccag

SEQ ID NO: 1858747 - RNA, 20 nt, Human
aggcauguucucugaggaca

SEQ ID NO: 1858748 - RNA, 22 nt, Human
aggcauguucucugaggacacu

SEQ ID NO: 1858749 - RNA, 23 nt, Human
aggccaggcccucugcccacucc

SEQ ID NO: 1858750 - RNA, 19 nt, Human
aggccaggcccucugccca

SEQ ID NO: 1858751 - RNA, 18 nt, Human
aggccaggcccucugccc

SEQ ID NO: 1858752 - RNA, 17 nt, Human
aggccaggcccucugcc

SEQ ID NO: 1858753 - RNA, 16 nt, Human
aggccaggcccucugc

SEQ ID NO: 1858754 - RNA, 16 nt, Human
aggccagcugcuuggg

SEQ ID NO: 1858755 - RNA, 14 nt, Human
aggccagcugcuug

SEQ ID NO: 1858756 - RNA, 13 nt, Human
aggccagcugcuu

SEQ ID NO: 1858757 - RNA, 14 nt, Human
aggccaugggccuc

SEQ ID NO: 1858758 - RNA, 16 nt, Human
aggccaugggccuccu

SEQ ID NO: 1858759 - RNA, 17 nt, Human
aggcccucugcccacuc

SEQ ID NO: 1858760 - RNA, 17 nt, Human
aggccaugggccuccug

SEQ ID NO: 1858761 - RNA, 23 nt, Human
aggccagcugcuugggcuucauc

SEQ ID NO: 1858762 - RNA, 18 nt, Human
aggaguuucguuuucaaa

SEQ ID NO: 1858763 - RNA, 14 nt, Human
aggagugagcacua

SEQ ID NO: 1858764 - RNA, 15 nt, Human
aggaggucucuaaga

SEQ ID NO: 1858765 - RNA, 12 nt, Human
aggagugagcac

SEQ ID NO: 1858766 - RNA, 14 nt, Human
aggaggucucuaag

SEQ ID NO: 1858767 - RNA, 16 nt, Human
aggagagcccuucauu

SEQ ID NO: 1858768 - RNA, 13 nt, Human
aggaaguagagga

SEQ ID NO: 1858769 - RNA, 19 nt, Human
aggaaguacuggagaaaau

SEQ ID NO: 1858770 - RNA, 14 nt, Human
agggacugagaaau

SEQ ID NO: 1858771 - RNA, 13 nt, Human
agggacugagaaa

SEQ ID NO: 1858772 - RNA, 15 nt, Human
agggacugagaaauu

SEQ ID NO: 1858773 - RNA, 17 nt, Human
agggacugagaaauuua

SEQ ID NO: 1858774 - RNA, 18 nt, Human
agggccuggcucaggugg

SEQ ID NO: 1858775 - RNA, 14 nt, Human
agggccuggcucag

SEQ ID NO: 1858776 - RNA, 13 nt, Human
agggccuggcuca

SEQ ID NO: 1858777 - RNA, 20 nt, Human
aggcccucugcccacucccu

SEQ ID NO: 1858778 - RNA, 19 nt, Human
aggcccucugcccacuccc

SEQ ID NO: 1858779 - RNA, 21 nt, Human
aggcccucugcccacucccug

SEQ ID NO: 1858780 - RNA, 22 nt, Human
aggcucuggagcccacuguacu

SEQ ID NO: 1858781 - RNA, 13 nt, Human
aggcugaggacuu

SEQ ID NO: 1858782 - RNA, 11 nt, Human
aggcugaggac

SEQ ID NO: 1858783 - RNA, 13 nt, Human
aggcugagccuca

SEQ ID NO: 1858784 - RNA, 11 nt, Human
aggcugagccu

SEQ ID NO: 1858785 - RNA, 13 nt, Human
aggcucuucuccu

SEQ ID NO: 1858786 - RNA, 12 nt, Human
aggcugucaauu

SEQ ID NO: 1858787 - RNA, 19 nt, Human
aggcugucaauuacaggaa

SEQ ID NO: 1858788 - RNA, 24 nt, Human
aggcuguaucccaugagccucagc

SEQ ID NO: 1858789 - RNA, 19 nt, Human
aggcugcagugagccgaga

SEQ ID NO: 1858790 - RNA, 17 nt, Human
aggcugcagugagccga

SEQ ID NO: 1858791 - RNA, 23 nt, Human
aggcuguaucccaugagccucag

SEQ ID NO: 1858792 - RNA, 13 nt, Human
cuccuaccuggua

SEQ ID NO: 1858793 - RNA, 14 nt, Human
cuccuuguguuacu

SEQ ID NO: 1858794 - RNA, 13 nt, Human
cuccuuucacaac

SEQ ID NO: 1858795 - RNA, 17 nt, Human
cuccuuucacaaccuuc

SEQ ID NO: 1858796 - RNA, 16 nt, Human
cuccuuucacaaccuu

SEQ ID NO: 1858797 - RNA, 15 nt, Human
cuccuuucaccacau

SEQ ID NO: 1858798 - RNA, 14 nt, Human
cuccuggggguucu

SEQ ID NO: 1858799 - RNA, 16 nt, Human
cuccuguaccucuuga

SEQ ID NO: 1858800 - RNA, 14 nt, Human
cuccucugcugcug

SEQ ID NO: 1858801 - RNA, 13 nt, Human
cuccucugcugcu

SEQ ID NO: 1858802 - RNA, 15 nt, Human
cuccucugcugcugg

SEQ ID NO: 1858803 - RNA, 15 nt, Human
cuccucuguccaggc

SEQ ID NO: 1858804 - RNA, 12 nt, Human
cuccucugucca

SEQ ID NO: 1858805 - RNA, 16 nt, Human
cuccucuugccacugc

SEQ ID NO: 1858806 - RNA, 15 nt, Human
cuccucuugccacug

SEQ ID NO: 1858807 - RNA, 12 nt, Human
cuccucuugcca

SEQ ID NO: 1858808 - RNA, 19 nt, Human
cuccuggcccacugcaucg

SEQ ID NO: 1858809 - RNA, 18 nt, Human
cuccucuugccacugccu

SEQ ID NO: 1858810 - RNA, 19 nt, Human
cuccuggccucaagugauu

SEQ ID NO: 1858811 - RNA, 18 nt, Human
cuccugggcuaagugauc

SEQ ID NO: 1858812 - RNA, 21 nt, Human
cucccacaggcccuuccucuc

SEQ ID NO: 1858813 - RNA, 20 nt, Human
cucccacaggcccuuccucu

SEQ ID NO: 1858814 - RNA, 16 nt, Human
cucccacaggcccuuc

SEQ ID NO: 1858815 - RNA, 14 nt, Human
cucccacaggcccu

SEQ ID NO: 1858816 - RNA, 15 nt, Human
cucccacaggcccuu

SEQ ID NO: 1858817 - RNA, 23 nt, Human
cuccaggugcacaagcuccaagc

SEQ ID NO: 1858818 - RNA, 15 nt, Human
cuccaggcuccuuua

SEQ ID NO: 1858819 - RNA, 23 nt, Human
cuccaggcuccuuuagcgcccag

SEQ ID NO: 1858820 - RNA, 20 nt, Human
cuccaggcuguaucccauga

SEQ ID NO: 1858821 - RNA, 22 nt, Human
cuccaggcuguaucccaugagc

SEQ ID NO: 1858822 - RNA, 20 nt, Human
cucccucuuucccucccuuc

SEQ ID NO: 1858823 - RNA, 20 nt, Human
cucccugaaguaagcaaaga

SEQ ID NO: 1858824 - RNA, 16 nt, Human
cucugcacuccccugc

SEQ ID NO: 1858825 - RNA, 15 nt, Human
cucugcacuccccug

SEQ ID NO: 1858826 - RNA, 21 nt, Human
cucugcacaagcugcacccuc

SEQ ID NO: 1858827 - RNA, 20 nt, Human
cucugcacaagcugcacccu

SEQ ID NO: 1858828 - RNA, 17 nt, Human
cucugcacuccccugcu

SEQ ID NO: 1858829 - RNA, 13 nt, Human
cucugcagguccc

SEQ ID NO: 1858830 - RNA, 21 nt, Human
cucugcuccucuccccagcaa

SEQ ID NO: 1858831 - RNA, 21 nt, Human
cucugcugacagacacaggcc

SEQ ID NO: 1858832 - RNA, 22 nt, Human
cucugcugacagacacaggccc

SEQ ID NO: 1858833 - RNA, 20 nt, Human
cucugcugacagacacaggc

SEQ ID NO: 1858834 - RNA, 13 nt, Human
cucugcugcuggc

SEQ ID NO: 1858835 - RNA, 23 nt, Human
cucugcugacagacacaggcccg

SEQ ID NO: 1858836 - RNA, 13 nt, Human
cucuguacagagc

SEQ ID NO: 1858837 - RNA, 15 nt, Human
cucuguacagagccc

SEQ ID NO: 1858838 - RNA, 14 nt, Human
cucuguacagagcc

SEQ ID NO: 1858839 - RNA, 15 nt, Human
cucugcugcuggcug

SEQ ID NO: 1858840 - RNA, 14 nt, Human
cucugcugcuggcu

SEQ ID NO: 1858841 - RNA, 16 nt, Human
cucugcugcuggcugg

SEQ ID NO: 1858842 - RNA, 16 nt, Human
cucuguacagagccca

SEQ ID NO: 1858843 - RNA, 13 nt, Human
cucuguccuggga

SEQ ID NO: 1858844 - RNA, 23 nt, Human
cuccuuugugaggaagccgcugg

SEQ ID NO: 1858845 - RNA, 18 nt, Human
cuccuuugugaggaagcc

SEQ ID NO: 1858846 - RNA, 17 nt, Human
cuccuuugugaggaagc

SEQ ID NO: 1858847 - RNA, 20 nt, Human
cuccuuucacaaccuucugu

SEQ ID NO: 1858848 - RNA, 16 nt, Human
cucgguguggagaagc

SEQ ID NO: 1858849 - RNA, 23 nt, Human
cucgguguggagaagcggcuggc

SEQ ID NO: 1858850 - RNA, 17 nt, Human
cucgguguggagaagcg

SEQ ID NO: 1858851 - RNA, 14 nt, Human
cucucuggccuucg

SEQ ID NO: 1858852 - RNA, 16 nt, Human
cucucuggccuucggc

SEQ ID NO: 1858853 - RNA, 13 nt, Human
cucucuggccuuc

SEQ ID NO: 1858854 - RNA, 16 nt, Human
cucuccuccagaguca

SEQ ID NO: 1858855 - RNA, 12 nt, Human
cucuccuccaga

SEQ ID NO: 1858856 - RNA, 15 nt, Human
cucuccuccagaguc

SEQ ID NO: 1858857 - RNA, 13 nt, Human
cucuccuccagag

SEQ ID NO: 1858858 - RNA, 19 nt, Human
cucuauguucuaagaagug

SEQ ID NO: 1858859 - RNA, 23 nt, Human
cucaauuauuuugcauuuuuucu

SEQ ID NO: 1858860 - RNA, 21 nt, Human
cucaagugauucuccugccuc

SEQ ID NO: 1858861 - RNA, 17 nt, Human
cuauccuacuuccccuu

SEQ ID NO: 1858862 - RNA, 14 nt, Human
cuaucucccccagc

SEQ ID NO: 1858863 - RNA, 13 nt, Human
cuaucucccccag

SEQ ID NO: 1858864 - RNA, 14 nt, Human
cuaugugagaccau

SEQ ID NO: 1858865 - RNA, 18 nt, Human
cuauguugcccaggcagg

SEQ ID NO: 1858866 - RNA, 19 nt, Human
cuauguugcccaggcaggu

SEQ ID NO: 1858867 - RNA, 21 nt, Human
cuauguugcccaggcaggucu

SEQ ID NO: 1858868 - RNA, 22 nt, Human
cuauguugcccaggcaggucuu

SEQ ID NO: 1858869 - RNA, 17 nt, Human
cuaugugagcacaaagg

SEQ ID NO: 1858870 - RNA, 18 nt, Human
cuauguucuaagaaguga

SEQ ID NO: 1858871 - RNA, 14 nt, Human
cuauguugcccagg

SEQ ID NO: 1858872 - RNA, 22 nt, Human
cucagguugucugaagucacug

SEQ ID NO: 1858873 - RNA, 23 nt, Human
cucaggugucccugcacuugcag

SEQ ID NO: 1858874 - RNA, 22 nt, Human
cucagucuggcccuuccuuuuc

SEQ ID NO: 1858875 - RNA, 20 nt, Human
cucagucuggcccuuccuuu

SEQ ID NO: 1858876 - RNA, 16 nt, Human
cucaguccaugaagau

SEQ ID NO: 1858877 - RNA, 14 nt, Human
cucagguugucuga

SEQ ID NO: 1858878 - RNA, 15 nt, Human
cucaguccauagcag

SEQ ID NO: 1858879 - RNA, 17 nt, Human
cucaguccauagcagag

SEQ ID NO: 1858880 - RNA, 20 nt, Human
cucaggccaaacucaccugc

SEQ ID NO: 1858881 - RNA, 19 nt, Human
cucaggccaaacucaccug

SEQ ID NO: 1858882 - RNA, 21 nt, Human
cucaggccaaacucaccugcc

SEQ ID NO: 1858883 - RNA, 20 nt, Human
cucaggccagcugcuugggc

SEQ ID NO: 1858884 - RNA, 18 nt, Human
cucaggccagcugcuugg

SEQ ID NO: 1858885 - RNA, 17 nt, Human
cucaggccagcugcuug

SEQ ID NO: 1858886 - RNA, 16 nt, Human
cucaggccagcugcuu

SEQ ID NO: 1858887 - RNA, 11 nt, Human
cucaggccugg

SEQ ID NO: 1858888 - RNA, 22 nt, Human
cucaggccugggggcugggcag

SEQ ID NO: 1858889 - RNA, 17 nt, Human
cucaccuuucccaucuu

SEQ ID NO: 1858890 - RNA, 13 nt, Human
cucagaagacacu

SEQ ID NO: 1858891 - RNA, 15 nt, Human
cucagaagacacuga

SEQ ID NO: 1858892 - RNA, 17 nt, Human
cucagaagacacugaug

SEQ ID NO: 1858893 - RNA, 20 nt, Human
cucagaagacacugaugggc

SEQ ID NO: 1858894 - RNA, 22 nt, Human
cucagaagacacugaugggcaa

SEQ ID NO: 1858895 - RNA, 19 nt, Human
cucagccucccgaauagcu

SEQ ID NO: 1858896 - RNA, 21 nt, Human
cucagccucccgaauagcugg

SEQ ID NO: 1858897 - RNA, 22 nt, Human
cucagccucccgaauagcuggg

SEQ ID NO: 1858898 - RNA, 23 nt, Human
cucagaagacacugaugggcaac

SEQ ID NO: 1858899 - RNA, 17 nt, Human
cguaaagcuagaaauga

SEQ ID NO: 1858900 - RNA, 20 nt, Human
cgguggcucacgccuguaau

SEQ ID NO: 1858901 - RNA, 22 nt, Human
cguacacauuuuauuuuauuau

SEQ ID NO: 1858902 - RNA, 13 nt, Human
cgggcucugccuc

SEQ ID NO: 1858903 - RNA, 12 nt, Human
cgggcucugccu

SEQ ID NO: 1858904 - RNA, 20 nt, Human
cgggcugggagcucugcaga

SEQ ID NO: 1858905 - RNA, 16 nt, Human
cgggcugggagcucug

SEQ ID NO: 1858906 - RNA, 19 nt, Human
cgggcucagcaaaagaugc

SEQ ID NO: 1858907 - RNA, 20 nt, Human
cgggccuggagaacuagaga

SEQ ID NO: 1858908 - RNA, 16 nt, Human
cgggccuggagaacua

SEQ ID NO: 1858909 - RNA, 18 nt, Human
cgggccagugcuccagcc

SEQ ID NO: 1858910 - RNA, 14 nt, Human
cgggccagugcucc

SEQ ID NO: 1858911 - RNA, 20 nt, Human
cggagacggagucccaccuu

SEQ ID NO: 1858912 - RNA, 17 nt, Human
cggagacggagucccac

SEQ ID NO: 1858913 - RNA, 21 nt, Human
cggagucccaccuuggcugca

SEQ ID NO: 1858914 - RNA, 22 nt, Human
cggagucccaccuuggcugcag

SEQ ID NO: 1858915 - RNA, 15 nt, Human
cggaggggccuggca

SEQ ID NO: 1858916 - RNA, 23 nt, Human
cggagucccaccuuggcugcagg

SEQ ID NO: 1858917 - RNA, 18 nt, Human
cggcuaauuuuuguauuu

SEQ ID NO: 1858918 - RNA, 16 nt, Human
cgagucucuucuccac

SEQ ID NO: 1858919 - RNA, 18 nt, Human
cgagucucuucuccacug

SEQ ID NO: 1858920 - RNA, 17 nt, Human
cgagucucuucuccacu

SEQ ID NO: 1858921 - RNA, 22 nt, Human
cgcaggcuggcccugcccuggu

SEQ ID NO: 1858922 - RNA, 21 nt, Human
cgcaggcuggcccugcccugg

SEQ ID NO: 1858923 - RNA, 21 nt, Human
cgagucucuucuccacuggau

SEQ ID NO: 1858924 - RNA, 20 nt, Human
cgagucucuucuccacugga

SEQ ID NO: 1858925 - RNA, 20 nt, Human
ccuuuucgcaggauucuucc

SEQ ID NO: 1858926 - RNA, 17 nt, Human
cgcuggagugcagugag

SEQ ID NO: 1858927 - RNA, 18 nt, Human
cgcuggagugcagugagc

SEQ ID NO: 1858928 - RNA, 21 nt, Human
cgcucuuggcagguacucagc

SEQ ID NO: 1858929 - RNA, 22 nt, Human
cgcucuguugcccaggcuggag

SEQ ID NO: 1858930 - RNA, 20 nt, Human
cgcucugucgcccaggcugg

SEQ ID NO: 1858931 - RNA, 19 nt, Human
cgcucuguugcccaggcug

SEQ ID NO: 1858932 - RNA, 20 nt, Human
cgcugccccuggcagccccu

SEQ ID NO: 1858933 - RNA, 19 nt, Human
cgcugccccuggcagcccc

SEQ ID NO: 1858934 - RNA, 22 nt, Human
cgugagccacugcaccgggcca

SEQ ID NO: 1858935 - RNA, 14 nt, Human
cgugaggccagaga

SEQ ID NO: 1858936 - RNA, 14 nt, Human
cgugagccacugca

SEQ ID NO: 1858937 - RNA, 15 nt, Human
cgugagccacugcac

SEQ ID NO: 1858938 - RNA, 20 nt, Human
cgugagccacugcaccgggc

SEQ ID NO: 1858939 - RNA, 14 nt, Human
cgugacaacacuug

SEQ ID NO: 1858940 - RNA, 15 nt, Human
cgugacaacacuugu

SEQ ID NO: 1858941 - RNA, 22 nt, Human
cuaacuugucuuuggacccuga

SEQ ID NO: 1858942 - RNA, 14 nt, Human
cuaacuugucuuug

SEQ ID NO: 1858943 - RNA, 16 nt, Human
cuaacuuuccuucauu

SEQ ID NO: 1858944 - RNA, 22 nt, Human
cuaagaaagcccuuaggaagaa

SEQ ID NO: 1858945 - RNA, 20 nt, Human
cuaacgaaguauccuucagc

SEQ ID NO: 1858946 - RNA, 19 nt, Human
cuaaaguguauuuuuuuac

SEQ ID NO: 1858947 - RNA, 23 nt, Human
cuaaaguaaaaacaaagaaauua

SEQ ID NO: 1858948 - RNA, 19 nt, Human
cguguuaugacuccagaau

SEQ ID NO: 1858949 - RNA, 15 nt, Human
cguguuaugacucca

SEQ ID NO: 1858950 - RNA, 18 nt, Human
cgugaguccuggcauggg

SEQ ID NO: 1858951 - RNA, 19 nt, Human
cgugaguccuggcauggga

SEQ ID NO: 1858952 - RNA, 16 nt, Human
cgugaggccagagaca

SEQ ID NO: 1858953 - RNA, 11 nt, Human
cuaaagcugcc

SEQ ID NO: 1858954 - RNA, 14 nt, Human
cuaaguuuuuaugg

SEQ ID NO: 1858955 - RNA, 20 nt, Human
cuaauaaaauuuaaaagucu

SEQ ID NO: 1858956 - RNA, 19 nt, Human
cuacaaaaagcauaaaaau

SEQ ID NO: 1858957 - RNA, 14 nt, Human
ccuugcauaauggu

SEQ ID NO: 1858958 - RNA, 17 nt, Human
ccuuucaauaggaaaaa

SEQ ID NO: 1858959 - RNA, 18 nt, Human
ccuuucaauaggaaaaac

SEQ ID NO: 1858960 - RNA, 14 nt, Human
ccuuuauucuggca

SEQ ID NO: 1858961 - RNA, 15 nt, Human
ccuuucaauaggaaa

SEQ ID NO: 1858962 - RNA, 19 nt, Human
ccuucccccuccaauccca

SEQ ID NO: 1858963 - RNA, 18 nt, Human
ccuuccuaauuccacagc

SEQ ID NO: 1858964 - RNA, 20 nt, Human
ccuuccuaauuccacagcug

SEQ ID NO: 1858965 - RNA, 19 nt, Human
ccuuccuaauuccacagcu

SEQ ID NO: 1858966 - RNA, 21 nt, Human
ccuuccuaauuccacagcugc

SEQ ID NO: 1858967 - RNA, 20 nt, Human
ccuucucuccagccccugga

SEQ ID NO: 1858968 - RNA, 17 nt, Human
ccuuccucuccacugcc

SEQ ID NO: 1858969 - RNA, 16 nt, Human
ccuuccucuccacugc

SEQ ID NO: 1858970 - RNA, 15 nt, Human
ccuuccucuccacug

SEQ ID NO: 1858971 - RNA, 14 nt, Human
ccuuccucuccacu

SEQ ID NO: 1858972 - RNA, 23 nt, Human
ccuucucuccagccccuggaugc

SEQ ID NO: 1858973 - RNA, 21 nt, Human
ccuucucuccagccccuggau

SEQ ID NO: 1858974 - RNA, 20 nt, Human
ccuuccucuccacugccuuc

SEQ ID NO: 1858975 - RNA, 14 nt, Human
ccuucucugaagga

SEQ ID NO: 1858976 - RNA, 16 nt, Human
ccuucucugaaggaca

SEQ ID NO: 1858977 - RNA, 22 nt, Human
ccuucuguccuacucuguguca

SEQ ID NO: 1858978 - RNA, 17 nt, Human
ccuucucuucacaguca

SEQ ID NO: 1858979 - RNA, 20 nt, Human
ccuucuguccuacucugugu

SEQ ID NO: 1858980 - RNA, 21 nt, Human
ccuucuguccuacucuguguc

SEQ ID NO: 1858981 - RNA, 21 nt, Human
ccuguucacucuacuuagcau

SEQ ID NO: 1858982 - RNA, 13 nt, Human
ccuguucagcucc

SEQ ID NO: 1858983 - RNA, 16 nt, Human
ccuuagcaaauucugu

SEQ ID NO: 1858984 - RNA, 19 nt, Human
ccuuagcagggaaacagcu

SEQ ID NO: 1858985 - RNA, 20 nt, Human
ccuuagcagggaaacagcua

SEQ ID NO: 1858986 - RNA, 20 nt, Human
ccuguugggccaggagccuc

SEQ ID NO: 1858987 - RNA, 19 nt, Human
ccuguugggccaggagccu

SEQ ID NO: 1858988 - RNA, 18 nt, Human
ccuguugggccaggagcc

SEQ ID NO: 1858989 - RNA, 17 nt, Human
ccuguugggccaggagc

SEQ ID NO: 1858990 - RNA, 16 nt, Human
ccuguugggccaggag

SEQ ID NO: 1858991 - RNA, 18 nt, Human
ccuguucccaugagauga

SEQ ID NO: 1858992 - RNA, 12 nt, Human
ccuguucccauu

SEQ ID NO: 1858993 - RNA, 17 nt, Human
ccuguucuggcagaguu

SEQ ID NO: 1858994 - RNA, 12 nt, Human
ccuguucuggca

SEQ ID NO: 1858995 - RNA, 16 nt, Human
ccuguucugcuuuccu

SEQ ID NO: 1858996 - RNA, 23 nt, Human
ccuguucagcuccagcucaccag

SEQ ID NO: 1858997 - RNA, 20 nt, Human
ccuguucagcuccagcucac

SEQ ID NO: 1858998 - RNA, 21 nt, Human
ccuguucagcuccagcucacc

SEQ ID NO: 1858999 - RNA, 14 nt, Human
ccuguucagcucca

SEQ ID NO: 1859000 - RNA, 15 nt, Human
ccuguucagcuccag

SEQ ID NO: 1859001 - RNA, 16 nt, Human
ccuguucagcuccagc

SEQ ID NO: 1859002 - RNA, 19 nt, Human
ccuguucagcuccagcuca

SEQ ID NO: 1859003 - RNA, 19 nt, Human
ccuucccaccucucucacu

SEQ ID NO: 1859004 - RNA, 14 nt, Human
ccuucccaccucuc

SEQ ID NO: 1859005 - RNA, 12 nt, Human
ccuucccaccuc

SEQ ID NO: 1859006 - RNA, 15 nt, Human
ccuucccaugcccug

SEQ ID NO: 1859007 - RNA, 18 nt, Human
ccuuauggaacacucuga

SEQ ID NO: 1859008 - RNA, 17 nt, Human
ccuuauggaacacucug

SEQ ID NO: 1859009 - RNA, 16 nt, Human
ccuuauggaacacucu

SEQ ID NO: 1859010 - RNA, 14 nt, Human
ccuuauggaacacu

SEQ ID NO: 1859011 - RNA, 20 nt, Human
ccuuauggaacacucugaga

SEQ ID NO: 1859012 - RNA, 19 nt, Human
ccuuauggaacacucugag

SEQ ID NO: 1859013 - RNA, 22 nt, Human
ccuuauggaacacucugagacu

SEQ ID NO: 1859014 - RNA, 18 nt, Human
ccuuaucaaaggacacca

SEQ ID NO: 1859015 - RNA, 14 nt, Human
ccuuaucaaaggac

SEQ ID NO: 1859016 - RNA, 12 nt, Human
ccuuauggaaca

SEQ ID NO: 1859017 - RNA, 13 nt, Human
ccuuaucaaagga

SEQ ID NO: 1859018 - RNA, 20 nt, Human
ccuuaggugauccacucgcc

SEQ ID NO: 1859019 - RNA, 20 nt, Human
ccugccuccuuugugaggaa

SEQ ID NO: 1859020 - RNA, 19 nt, Human
ccugccuccuuugugagga

SEQ ID NO: 1859021 - RNA, 15 nt, Human
ccugccuccuuugug

SEQ ID NO: 1859022 - RNA, 13 nt, Human
ccugccuccuuug

SEQ ID NO: 1859023 - RNA, 22 nt, Human
ccugccuccuuugugaggaagc

SEQ ID NO: 1859024 - RNA, 21 nt, Human
ccugccuccuuugugaggaag

SEQ ID NO: 1859025 - RNA, 23 nt, Human
ccugccuccuuugugaggaagcc

SEQ ID NO: 1859026 - RNA, 17 nt, Human
ccugccucucugcaggu

SEQ ID NO: 1859027 - RNA, 15 nt, Human
ccugccucuucucua

SEQ ID NO: 1859028 - RNA, 21 nt, Human
ccugccucucugcaggucccu

SEQ ID NO: 1859029 - RNA, 20 nt, Human
ccugccucucugcagguccc

SEQ ID NO: 1859030 - RNA, 16 nt, Human
ccugcugcaguugcca

SEQ ID NO: 1859031 - RNA, 12 nt, Human
ccugcugcaguu

SEQ ID NO: 1859032 - RNA, 11 nt, Human
ccugcugcagu

SEQ ID NO: 1859033 - RNA, 22 nt, Human
ccugcugcaguugccagucacc

SEQ ID NO: 1859034 - RNA, 19 nt, Human
ccucuuuggucuacacugu

SEQ ID NO: 1859035 - RNA, 16 nt, Human
ccucuuugagugaagc

SEQ ID NO: 1859036 - RNA, 19 nt, Human
ccucugccugucuccccca

SEQ ID NO: 1859037 - RNA, 15 nt, Human
ccucugccugucucc

SEQ ID NO: 1859038 - RNA, 21 nt, Human
ccucugccugaagucacacag

SEQ ID NO: 1859039 - RNA, 21 nt, Human
ccugcaggcagccaggccaca

SEQ ID NO: 1859040 - RNA, 20 nt, Human
ccugcaggcagccaggccac

SEQ ID NO: 1859041 - RNA, 19 nt, Human
ccugcaggcagccaggcca

SEQ ID NO: 1859042 - RNA, 18 nt, Human
ccugcaggcagccaggcc

SEQ ID NO: 1859043 - RNA, 23 nt, Human
ccugcaggcagccaggccacaag

SEQ ID NO: 1859044 - RNA, 14 nt, Human
ccugcagagggcac

SEQ ID NO: 1859045 - RNA, 17 nt, Human
ccugcaggcagccaggc

SEQ ID NO: 1859046 - RNA, 16 nt, Human
ccugcaggcagccagg

SEQ ID NO: 1859047 - RNA, 12 nt, Human
ccugcagagggc

SEQ ID NO: 1859048 - RNA, 15 nt, Human
ccugcaggcagccag

SEQ ID NO: 1859049 - RNA, 16 nt, Human
ccugaggggccucuua

SEQ ID NO: 1859050 - RNA, 12 nt, Human
ccugaggggccu

SEQ ID NO: 1859051 - RNA, 21 nt, Human
ccugaggcugggcucccuucc

SEQ ID NO: 1859052 - RNA, 19 nt, Human
ccugaggcugggcucccuu

SEQ ID NO: 1859053 - RNA, 17 nt, Human
ccugaggcugggcuccc

SEQ ID NO: 1859054 - RNA, 23 nt, Human
ccucccaacucaccccagcccca

SEQ ID NO: 1859055 - RNA, 21 nt, Human
ccucccaacucaccccagccc

SEQ ID NO: 1859056 - RNA, 20 nt, Human
ccucccaacucaccccagcc

SEQ ID NO: 1859057 - RNA, 17 nt, Human
ccucccaacucacccca

SEQ ID NO: 1859058 - RNA, 11 nt, Human
ccucaggcagg

SEQ ID NO: 1859059 - RNA, 18 nt, Human
ccucagccuccugaguag

SEQ ID NO: 1859060 - RNA, 15 nt, Human
ccucagccuccugag

SEQ ID NO: 1859061 - RNA, 20 nt, Human
ccuccuuugugaggaagccg

SEQ ID NO: 1859062 - RNA, 19 nt, Human
ccuccuuugugaggaagcc

SEQ ID NO: 1859063 - RNA, 18 nt, Human
ccuccuuugugaggaagc

SEQ ID NO: 1859064 - RNA, 16 nt, Human
ccucgagguuucucaa

SEQ ID NO: 1859065 - RNA, 16 nt, Human
ccucgaacuggcugca

SEQ ID NO: 1859066 - RNA, 15 nt, Human
ccucgaacuggcugc

SEQ ID NO: 1859067 - RNA, 16 nt, Human
ccuccgccucccgggu

SEQ ID NO: 1859068 - RNA, 13 nt, Human
ccuccgccucccg

SEQ ID NO: 1859069 - RNA, 12 nt, Human
ccucucucacuc

SEQ ID NO: 1859070 - RNA, 19 nt, Human
ccucucugcaggucccuaa

SEQ ID NO: 1859071 - RNA, 18 nt, Human
ccucucugcaggucccua

SEQ ID NO: 1859072 - RNA, 17 nt, Human
ccucucugcaggucccu

SEQ ID NO: 1859073 - RNA, 16 nt, Human
ccucucugcagguccc

SEQ ID NO: 1859074 - RNA, 14 nt, Human
ccucugcccugcgg

SEQ ID NO: 1859075 - RNA, 13 nt, Human
ccucugcccugcg

SEQ ID NO: 1859076 - RNA, 12 nt, Human
ccucugcccugc

SEQ ID NO: 1859077 - RNA, 11 nt, Human
ccucugcccug

SEQ ID NO: 1859078 - RNA, 20 nt, Human
ccucugccucugacacacag

SEQ ID NO: 1859079 - RNA, 21 nt, Human
ccucugccucugacacacagc

SEQ ID NO: 1859080 - RNA, 23 nt, Human
ccucugccucugacacacagcuc

SEQ ID NO: 1859081 - RNA, 11 nt, Human
ccucugccuga

SEQ ID NO: 1859082 - RNA, 20 nt, Human
ccucugccugaagucacaca

SEQ ID NO: 1859083 - RNA, 22 nt, Human
cccugacaacacucauugaccu

SEQ ID NO: 1859084 - RNA, 16 nt, Human
cccugacaacacucau

SEQ ID NO: 1859085 - RNA, 22 nt, Human
cccugaaggccccgcccaggcu

SEQ ID NO: 1859086 - RNA, 20 nt, Human
cccugaaggccccgcccagg

SEQ ID NO: 1859087 - RNA, 14 nt, Human
cccugacaacacuc

SEQ ID NO: 1859088 - RNA, 19 nt, Human
cccugaaggccccgcccag

SEQ ID NO: 1859089 - RNA, 16 nt, Human
cccugaaggccccgcc

SEQ ID NO: 1859090 - RNA, 14 nt, Human
cccugaaggccccg

SEQ ID NO: 1859091 - RNA, 13 nt, Human
cccugaaggcccc

SEQ ID NO: 1859092 - RNA, 12 nt, Human
cccugaaggccc

SEQ ID NO: 1859093 - RNA, 14 nt, Human
cccuccucucugcc

SEQ ID NO: 1859094 - RNA, 23 nt, Human
cccucgaggcggaucuuuggaca

SEQ ID NO: 1859095 - RNA, 22 nt, Human
cccucgaggcggaucuuuggac

SEQ ID NO: 1859096 - RNA, 18 nt, Human
cccuccuccuggacuccu

SEQ ID NO: 1859097 - RNA, 16 nt, Human
cccuccuccuggacuc

SEQ ID NO: 1859098 - RNA, 11 nt, Human
cccuccuccug

SEQ ID NO: 1859099 - RNA, 18 nt, Human
cccugaaagcccugagcu

SEQ ID NO: 1859100 - RNA, 19 nt, Human
cccuggauccaucaggcca

SEQ ID NO: 1859101 - RNA, 21 nt, Human
cccuggaugcagccucacagu

SEQ ID NO: 1859102 - RNA, 17 nt, Human
cccuggaugcagccuca

SEQ ID NO: 1859103 - RNA, 13 nt, Human
cccuggaugcagc

SEQ ID NO: 1859104 - RNA, 23 nt, Human
cccugcccugguuuccugcccug

SEQ ID NO: 1859105 - RNA, 22 nt, Human
cccugcccugguuuccugcccu

SEQ ID NO: 1859106 - RNA, 12 nt, Human
cccugcccuggu

SEQ ID NO: 1859107 - RNA, 11 nt, Human
cccugcccugg

SEQ ID NO: 1859108 - RNA, 20 nt, Human
cccuggcucccacaggcccu

SEQ ID NO: 1859109 - RNA, 14 nt, Human
cccugccccccagc

SEQ ID NO: 1859110 - RNA, 15 nt, Human
cccugccccccagcc

SEQ ID NO: 1859111 - RNA, 20 nt, Human
cccugccccccagcccuccu

SEQ ID NO: 1859112 - RNA, 22 nt, Human
cccugcccaccuggccucugca

SEQ ID NO: 1859113 - RNA, 17 nt, Human
cccugccccucccuuca

SEQ ID NO: 1859114 - RNA, 23 nt, Human
cccugccccucccuucaaccauu

SEQ ID NO: 1859115 - RNA, 19 nt, Human
cccugccccucccuucaac

SEQ ID NO: 1859116 - RNA, 18 nt, Human
cccugccccucccuucaa

SEQ ID NO: 1859117 - RNA, 14 nt, Human
cccugcccggcugc

SEQ ID NO: 1859118 - RNA, 17 nt, Human
cccugcccggcugcgga

SEQ ID NO: 1859119 - RNA, 16 nt, Human
cccugagcuuucugcu

SEQ ID NO: 1859120 - RNA, 20 nt, Human
cccugcccaccuggccucug

SEQ ID NO: 1859121 - RNA, 23 nt, Human
ccgaaggugaggagcuugaaacc

SEQ ID NO: 1859122 - RNA, 16 nt, Human
ccgaauagcugggacu

SEQ ID NO: 1859123 - RNA, 17 nt, Human
ccgaauagcugggacua

SEQ ID NO: 1859124 - RNA, 15 nt, Human
ccgaccaccugccca

SEQ ID NO: 1859125 - RNA, 18 nt, Human
ccgaccagacaccuugac

SEQ ID NO: 1859126 - RNA, 13 nt, Human
ccgaccagacacc

SEQ ID NO: 1859127 - RNA, 17 nt, Human
ccgaccagacaccuuga

SEQ ID NO: 1859128 - RNA, 17 nt, Human
ccgaaaacguggcugcu

SEQ ID NO: 1859129 - RNA, 16 nt, Human
ccgaaaacguggcugc

SEQ ID NO: 1859130 - RNA, 19 nt, Human
ccgaaagggacuuggaagc

SEQ ID NO: 1859131 - RNA, 15 nt, Human
cccuuccucuuucca

SEQ ID NO: 1859132 - RNA, 17 nt, Human
ccgcagacaggaccagg

SEQ ID NO: 1859133 - RNA, 16 nt, Human
ccgcagacaggaccag

SEQ ID NO: 1859134 - RNA, 12 nt, Human
ccgcccaggcuu

SEQ ID NO: 1859135 - RNA, 22 nt, Human
cccugugauggggcccugccuc

SEQ ID NO: 1859136 - RNA, 21 nt, Human
cccugugauggggcccugccu

SEQ ID NO: 1859137 - RNA, 21 nt, Human
cccuuccucuccacugccuuc

SEQ ID NO: 1859138 - RNA, 23 nt, Human
cccugugauggggcccugccucc

SEQ ID NO: 1859139 - RNA, 13 nt, Human
cccugucuaauga

SEQ ID NO: 1859140 - RNA, 18 nt, Human
ccggcaggguccuagaaa

SEQ ID NO: 1859141 - RNA, 16 nt, Human
ccggccaccugcggug

SEQ ID NO: 1859142 - RNA, 15 nt, Human
ccggccccugcuggu

SEQ ID NO: 1859143 - RNA, 20 nt, Human
ccuaacgaaguauccuucag

SEQ ID NO: 1859144 - RNA, 16 nt, Human
ccgugaggccagagac

SEQ ID NO: 1859145 - RNA, 14 nt, Human
ccgugaggccagag

SEQ ID NO: 1859146 - RNA, 13 nt, Human
ccgugaggccaga

SEQ ID NO: 1859147 - RNA, 12 nt, Human
ccgugaggccag

SEQ ID NO: 1859148 - RNA, 17 nt, Human
ccgucuaccugaggggc

SEQ ID NO: 1859149 - RNA, 15 nt, Human
ccgucuaccugaggg

SEQ ID NO: 1859150 - RNA, 14 nt, Human
ccgucuaccugagg

SEQ ID NO: 1859151 - RNA, 15 nt, Human
ccggcuccaggcucc

SEQ ID NO: 1859152 - RNA, 12 nt, Human
ccggcuccaggc

SEQ ID NO: 1859153 - RNA, 13 nt, Human
ccggcuccaggcu

SEQ ID NO: 1859154 - RNA, 14 nt, Human
ccggcuccaggcuc

SEQ ID NO: 1859155 - RNA, 19 nt, Human
ccuagcauacguacacauu

SEQ ID NO: 1859156 - RNA, 20 nt, Human
ccuaaugcgcaggcuggccc

SEQ ID NO: 1859157 - RNA, 17 nt, Human
ccuagcacuuugggagg

SEQ ID NO: 1859158 - RNA, 21 nt, Human
ccuagcauacguacacauuuu

SEQ ID NO: 1859159 - RNA, 20 nt, Human
ccuagccugugccucuggga

SEQ ID NO: 1859160 - RNA, 14 nt, Human
ccuaaucuucugaa

SEQ ID NO: 1859161 - RNA, 12 nt, Human
ccagcagccugg

SEQ ID NO: 1859162 - RNA, 11 nt, Human
ccagcagccug

SEQ ID NO: 1859163 - RNA, 16 nt, Human
ccagcagaaaugccuu

SEQ ID NO: 1859164 - RNA, 17 nt, Human
ccagcagaaaugccuua

SEQ ID NO: 1859165 - RNA, 22 nt, Human
ccagcagaaaugccuuacccuc

SEQ ID NO: 1859166 - RNA, 15 nt, Human
ccagccccuggaugc

SEQ ID NO: 1859167 - RNA, 14 nt, Human
ccagccccuggaug

SEQ ID NO: 1859168 - RNA, 13 nt, Human
ccagccccuggau

SEQ ID NO: 1859169 - RNA, 23 nt, Human
ccagccccauccucuguacagag

SEQ ID NO: 1859170 - RNA, 13 nt, Human
ccagcagccugga

SEQ ID NO: 1859171 - RNA, 17 nt, Human
ccagccccuucugaccc

SEQ ID NO: 1859172 - RNA, 16 nt, Human
ccagccccuucugacc

SEQ ID NO: 1859173 - RNA, 15 nt, Human
ccagccccuucugac

SEQ ID NO: 1859174 - RNA, 18 nt, Human
ccagccccuggaugcagc

SEQ ID NO: 1859175 - RNA, 18 nt, Human
ccagccccuucugaccca

SEQ ID NO: 1859176 - RNA, 21 nt, Human
ccagcgagcccugguggcagu

SEQ ID NO: 1859177 - RNA, 19 nt, Human
ccaggaaaggcuccaggag

SEQ ID NO: 1859178 - RNA, 18 nt, Human
ccaggaaaggcuccagga

SEQ ID NO: 1859179 - RNA, 17 nt, Human
ccaggaaaggcuccagg

SEQ ID NO: 1859180 - RNA, 20 nt, Human
ccaggaaaggcuccaggagc

SEQ ID NO: 1859181 - RNA, 20 nt, Human
ccagcuugaaaccuucacuu

SEQ ID NO: 1859182 - RNA, 16 nt, Human
ccagucaccccggcca

SEQ ID NO: 1859183 - RNA, 22 nt, Human
ccaguaucuugaagacuuuucu

SEQ ID NO: 1859184 - RNA, 19 nt, Human
ccaguaucuugaagacuuu

SEQ ID NO: 1859185 - RNA, 13 nt, Human
ccaguaucuugaa

SEQ ID NO: 1859186 - RNA, 22 nt, Human
ccaggggugggacacccuguga

SEQ ID NO: 1859187 - RNA, 21 nt, Human
ccaggggugggacacccugug

SEQ ID NO: 1859188 - RNA, 20 nt, Human
ccaggggugggacacccugu

SEQ ID NO: 1859189 - RNA, 13 nt, Human
ccaggcugagccu

SEQ ID NO: 1859190 - RNA, 16 nt, Human
ccaggcugagccucag

SEQ ID NO: 1859191 - RNA, 14 nt, Human
ccaggcugagccuc

SEQ ID NO: 1859192 - RNA, 22 nt, Human
ccaggcugagccucagucuccc

SEQ ID NO: 1859193 - RNA, 19 nt, Human
ccaggcugagccucagucu

SEQ ID NO: 1859194 - RNA, 17 nt, Human
ccaggcugagccucagu

SEQ ID NO: 1859195 - RNA, 18 nt, Human
ccagucaccccggccacc

SEQ ID NO: 1859196 - RNA, 17 nt, Human
ccagucaccccggccac

SEQ ID NO: 1859197 - RNA, 19 nt, Human
ccagucaccccggccaccu

SEQ ID NO: 1859198 - RNA, 18 nt, Human
ccagagacacaagccuuc

SEQ ID NO: 1859199 - RNA, 16 nt, Human
ccagagacacaagccu

SEQ ID NO: 1859200 - RNA, 13 nt, Human
ccagagagggugg

SEQ ID NO: 1859201 - RNA, 13 nt, Human
ccagaugcaccag

SEQ ID NO: 1859202 - RNA, 14 nt, Human
ccagaugcaccagc

SEQ ID NO: 1859203 - RNA, 13 nt, Human
ccacuuucuagcc

SEQ ID NO: 1859204 - RNA, 19 nt, Human
ccacuuucuagccagagga

SEQ ID NO: 1859205 - RNA, 18 nt, Human
ccacuuucuagccagagg

SEQ ID NO: 1859206 - RNA, 20 nt, Human
ccacuuucuagccagaggag

SEQ ID NO: 1859207 - RNA, 20 nt, Human
ccacuuggucugugagaugc

SEQ ID NO: 1859208 - RNA, 22 nt, Human
ccacuuggucugugagaugcua

SEQ ID NO: 1859209 - RNA, 15 nt, Human
ccacuuggucuguga

SEQ ID NO: 1859210 - RNA, 16 nt, Human
ccacuuggucugugag

SEQ ID NO: 1859211 - RNA, 17 nt, Human
ccacuuggucugugaga

SEQ ID NO: 1859212 - RNA, 19 nt, Human
ccacuuggucugugagaug

SEQ ID NO: 1859213 - RNA, 14 nt, Human
ccacuuuuguucuu

SEQ ID NO: 1859214 - RNA, 15 nt, Human
ccacuuuuguucuug

SEQ ID NO: 1859215 - RNA, 21 nt, Human
ccacuuuuguucuugguuugu

SEQ ID NO: 1859216 - RNA, 22 nt, Human
ccacuuuuguucuugguuugua

SEQ ID NO: 1859217 - RNA, 17 nt, Human
ccagacccggcugcgug

SEQ ID NO: 1859218 - RNA, 12 nt, Human
ccacuuggucug

SEQ ID NO: 1859219 - RNA, 18 nt, Human
ccacugcacuccagccug

SEQ ID NO: 1859220 - RNA, 19 nt, Human
ccacugcacuauagccuag

SEQ ID NO: 1859221 - RNA, 20 nt, Human
ccacugcacuauagccuagg

SEQ ID NO: 1859222 - RNA, 13 nt, Human
ccacugcaccggg

SEQ ID NO: 1859223 - RNA, 14 nt, Human
ccacugcaccgggc

SEQ ID NO: 1859224 - RNA, 17 nt, Human
ccacugcaccgggccac

SEQ ID NO: 1859225 - RNA, 19 nt, Human
ccacugcaccgggccacag

SEQ ID NO: 1859226 - RNA, 19 nt, Human
cccauccucuguacagagc

SEQ ID NO: 1859227 - RNA, 15 nt, Human
cccauccucuguaca

SEQ ID NO: 1859228 - RNA, 20 nt, Human
cccauccucuguacagagcc

SEQ ID NO: 1859229 - RNA, 23 nt, Human
cccagcuggggccaggcuggguc

SEQ ID NO: 1859230 - RNA, 22 nt, Human
cccagcuggggccaggcugggu

SEQ ID NO: 1859231 - RNA, 18 nt, Human
cccaggcuggcgugcagu

SEQ ID NO: 1859232 - RNA, 19 nt, Human
cccaggcuggcgugcagug

SEQ ID NO: 1859233 - RNA, 20 nt, Human
cccaggcuggcgugcagugg

SEQ ID NO: 1859234 - RNA, 14 nt, Human
cccauccucuguac

SEQ ID NO: 1859235 - RNA, 20 nt, Human
cccagcuggggccaggcugg

SEQ ID NO: 1859236 - RNA, 23 nt, Human
cccagccccaaaacucuccucug

SEQ ID NO: 1859237 - RNA, 21 nt, Human
cccagccccaaaacucuccuc

SEQ ID NO: 1859238 - RNA, 19 nt, Human
cccagcccacuucugccau

SEQ ID NO: 1859239 - RNA, 15 nt, Human
ccccauuguggucac

SEQ ID NO: 1859240 - RNA, 14 nt, Human
cccccuuccaugga

SEQ ID NO: 1859241 - RNA, 12 nt, Human
ccccgcccaggc

SEQ ID NO: 1859242 - RNA, 14 nt, Human
ccccgcccaggcuu

SEQ ID NO: 1859243 - RNA, 13 nt, Human
ccccggccaccug

SEQ ID NO: 1859244 - RNA, 18 nt, Human
ccccggccaccugcggug

SEQ ID NO: 1859245 - RNA, 14 nt, Human
ccccggccaccugc

SEQ ID NO: 1859246 - RNA, 12 nt, Human
ccccagccccaa

SEQ ID NO: 1859247 - RNA, 10 nt, Human
ccccagcccc

SEQ ID NO: 1859248 - RNA, 14 nt, Human
ccccagccccaaaa

SEQ ID NO: 1859249 - RNA, 14 nt, Human
ccccagccccaucc

SEQ ID NO: 1859250 - RNA, 21 nt, Human
ccccauucugccugcccaggc

SEQ ID NO: 1859251 - RNA, 18 nt, Human
ccccaaaacucuccucug

SEQ ID NO: 1859252 - RNA, 20 nt, Human
ccccaaaacucuccucugcu

SEQ ID NO: 1859253 - RNA, 21 nt, Human
ccccaaaacucuccucugcug

SEQ ID NO: 1859254 - RNA, 15 nt, Human
ccaugucucgacuca

SEQ ID NO: 1859255 - RNA, 14 nt, Human
ccaugucucgacuc

SEQ ID NO: 1859256 - RNA, 20 nt, Human
ccaugucucugagcauuaga

SEQ ID NO: 1859257 - RNA, 18 nt, Human
ccaugaggaacaaggcaa

SEQ ID NO: 1859258 - RNA, 17 nt, Human
ccaugaggaacaaggca

SEQ ID NO: 1859259 - RNA, 16 nt, Human
ccaugaggaacaaggc

SEQ ID NO: 1859260 - RNA, 13 nt, Human
ccaugagccucag

SEQ ID NO: 1859261 - RNA, 18 nt, Human
cccaccgcagacaggacc

SEQ ID NO: 1859262 - RNA, 15 nt, Human
cccaccgcagacagg

SEQ ID NO: 1859263 - RNA, 23 nt, Human
cccacuguacuugcucuugaugc

SEQ ID NO: 1859264 - RNA, 19 nt, Human
cccacuguacuugcucuug

SEQ ID NO: 1859265 - RNA, 18 nt, Human
cccacuguacuugcucuu

SEQ ID NO: 1859266 - RNA, 15 nt, Human
cccacccaagggccu

SEQ ID NO: 1859267 - RNA, 18 nt, Human
cccacccaagggccuggc

SEQ ID NO: 1859268 - RNA, 23 nt, Human
cccaagccuacuuuugccauuga

SEQ ID NO: 1859269 - RNA, 16 nt, Human
cccaagccuggcaagg

SEQ ID NO: 1859270 - RNA, 21 nt, Human
cccaagaauagaugcugacug

SEQ ID NO: 1859271 - RNA, 20 nt, Human
cccaagaauagaugcugacu

SEQ ID NO: 1859272 - RNA, 17 nt, Human
cccaagcucugcuccuc

SEQ ID NO: 1859273 - RNA, 21 nt, Human
cccaaccugcucuccucuugc

SEQ ID NO: 1859274 - RNA, 14 nt, Human
cccaaccugcucuc

SEQ ID NO: 1859275 - RNA, 13 nt, Human
cccaaccugcucu

SEQ ID NO: 1859276 - RNA, 23 nt, Human
cccaaccugcucuccucuugcca

SEQ ID NO: 1859277 - RNA, 22 nt, Human
ccauuguggucacaggaaguag

SEQ ID NO: 1859278 - RNA, 23 nt, Human
cacaucuugcucugcugacagac

SEQ ID NO: 1859279 - RNA, 17 nt, Human
cacauuuauucugcuca

SEQ ID NO: 1859280 - RNA, 18 nt, Human
cacauuuauucugcucac

SEQ ID NO: 1859281 - RNA, 17 nt, Human
caccagccccagugccc

SEQ ID NO: 1859282 - RNA, 19 nt, Human
caccagcccuuagcaggga

SEQ ID NO: 1859283 - RNA, 18 nt, Human
caccagccccagugccca

SEQ ID NO: 1859284 - RNA, 21 nt, Human
caccagccccagugcccacag

SEQ ID NO: 1859285 - RNA, 22 nt, Human
caccagccccagugcccacagg

SEQ ID NO: 1859286 - RNA, 12 nt, Human
cacccagcccac

SEQ ID NO: 1859287 - RNA, 13 nt, Human
cacaucuugcucu

SEQ ID NO: 1859288 - RNA, 14 nt, Human
cacaucuugcucug

SEQ ID NO: 1859289 - RNA, 15 nt, Human
cacaucuugcucugc

SEQ ID NO: 1859290 - RNA, 20 nt, Human
cacaucuugcucugcugaca

SEQ ID NO: 1859291 - RNA, 21 nt, Human
cacaucuugcucugcugacag

SEQ ID NO: 1859292 - RNA, 22 nt, Human
cacaucuugcucugcugacaga

SEQ ID NO: 1859293 - RNA, 16 nt, Human
cacuccagugagacag

SEQ ID NO: 1859294 - RNA, 21 nt, Human
cacuccagugagacagcucug

SEQ ID NO: 1859295 - RNA, 17 nt, Human
cacuccagaccccuggc

SEQ ID NO: 1859296 - RNA, 21 nt, Human
cacgcuggagugcagugagcc

SEQ ID NO: 1859297 - RNA, 16 nt, Human
cacgcuggagugcagu

SEQ ID NO: 1859298 - RNA, 17 nt, Human
cacgcuggagugcagug

SEQ ID NO: 1859299 - RNA, 18 nt, Human
cacgcuggagugcaguga

SEQ ID NO: 1859300 - RNA, 20 nt, Human
cacgcuggagugcagugagc

SEQ ID NO: 1859301 - RNA, 15 nt, Human
cacgcuggagugcag

SEQ ID NO: 1859302 - RNA, 16 nt, Human
cacuccagaccccugg

SEQ ID NO: 1859303 - RNA, 14 nt, Human
cacuccagaccccu

SEQ ID NO: 1859304 - RNA, 15 nt, Human
cacuacauucuguua

SEQ ID NO: 1859305 - RNA, 16 nt, Human
cacuagacccacugga

SEQ ID NO: 1859306 - RNA, 22 nt, Human
cacggaagagccuugcggaagg

SEQ ID NO: 1859307 - RNA, 16 nt, Human
cacggaagagccuugc

SEQ ID NO: 1859308 - RNA, 13 nt, Human
cacuacauucugu

SEQ ID NO: 1859309 - RNA, 14 nt, Human
cacuacauucuguu

SEQ ID NO: 1859310 - RNA, 20 nt, Human
caccugcggugcuaucuccc

SEQ ID NO: 1859311 - RNA, 19 nt, Human
caccugcggugcuaucucc

SEQ ID NO: 1859312 - RNA, 17 nt, Human
caccugcggugcuaucu

SEQ ID NO: 1859313 - RNA, 16 nt, Human
caccugcggugcuauc

SEQ ID NO: 1859314 - RNA, 12 nt, Human
caccugccaggg

SEQ ID NO: 1859315 - RNA, 11 nt, Human
caccugccagg

SEQ ID NO: 1859316 - RNA, 21 nt, Human
caccugccccucaacucuccu

SEQ ID NO: 1859317 - RNA, 18 nt, Human
caccugccccucaacucu

SEQ ID NO: 1859318 - RNA, 13 nt, Human
caccugccaggga

SEQ ID NO: 1859319 - RNA, 12 nt, Human
cacccuccuuuc

SEQ ID NO: 1859320 - RNA, 12 nt, Human
cacccugcucuc

SEQ ID NO: 1859321 - RNA, 17 nt, Human
caaguauuauaccuuuu

SEQ ID NO: 1859322 - RNA, 22 nt, Human
caaguauuauaccuuuuuuaga

SEQ ID NO: 1859323 - RNA, 14 nt, Human
caaggcaaggcugu

SEQ ID NO: 1859324 - RNA, 20 nt, Human
caaggauugcuacuguccua

SEQ ID NO: 1859325 - RNA, 18 nt, Human
caagcuccaagcucccag

SEQ ID NO: 1859326 - RNA, 17 nt, Human
caagcuccaagcuccca

SEQ ID NO: 1859327 - RNA, 21 nt, Human
caagcuccaagcucccaggca

SEQ ID NO: 1859328 - RNA, 19 nt, Human
caagcuccaagcucccagg

SEQ ID NO: 1859329 - RNA, 17 nt, Human
caagcuccaucuccacu

SEQ ID NO: 1859330 - RNA, 21 nt, Human
caagcuccaucuccacuccag

SEQ ID NO: 1859331 - RNA, 17 nt, Human
caagcucccaggcauuc

SEQ ID NO: 1859332 - RNA, 15 nt, Human
caagcucccaggcau

SEQ ID NO: 1859333 - RNA, 14 nt, Human
caagcucccaggca

SEQ ID NO: 1859334 - RNA, 12 nt, Human
caagcucccagg

SEQ ID NO: 1859335 - RNA, 15 nt, Human
caagcucugcuccuc

SEQ ID NO: 1859336 - RNA, 16 nt, Human
caagcucugcuccucu

SEQ ID NO: 1859337 - RNA, 20 nt, Human
caauuuauuauggcacauca

SEQ ID NO: 1859338 - RNA, 17 nt, Human
caauauuguacaguuuu

SEQ ID NO: 1859339 - RNA, 18 nt, Human
caauauuguacaguuuuu

SEQ ID NO: 1859340 - RNA, 16 nt, Human
caauauuguacaguuu

SEQ ID NO: 1859341 - RNA, 20 nt, Human
caauuggauacgacaacuug

SEQ ID NO: 1859342 - RNA, 12 nt, Human
caaugcuggcug

SEQ ID NO: 1859343 - RNA, 16 nt, Human
caauggcagccuuggc

SEQ ID NO: 1859344 - RNA, 13 nt, Human
caauggcagccuu

SEQ ID NO: 1859345 - RNA, 14 nt, Human
caauggcagccuug

SEQ ID NO: 1859346 - RNA, 15 nt, Human
caauggcagccuugg

SEQ ID NO: 1859347 - RNA, 14 nt, Human
caaucaaaucugcu

SEQ ID NO: 1859348 - RNA, 17 nt, Human
caagaaggaugauucaa

SEQ ID NO: 1859349 - RNA, 18 nt, Human
caagaagcccaggaaagg

SEQ ID NO: 1859350 - RNA, 18 nt, Human
caagaauagaugcugacu

SEQ ID NO: 1859351 - RNA, 20 nt, Human
caacucccugccccccagcc

SEQ ID NO: 1859352 - RNA, 19 nt, Human
caacucccugccccccagc

SEQ ID NO: 1859353 - RNA, 15 nt, Human
caagaagcccaggaa

SEQ ID NO: 1859354 - RNA, 21 nt, Human
caacucccugccccccagccc

SEQ ID NO: 1859355 - RNA, 14 nt, Human
caacuauggccugu

SEQ ID NO: 1859356 - RNA, 14 nt, Human
caacccccagccug

SEQ ID NO: 1859357 - RNA, 13 nt, Human
caacuauggccug

SEQ ID NO: 1859358 - RNA, 17 nt, Human
caaccccuucgcuccug

SEQ ID NO: 1859359 - RNA, 14 nt, Human
caaccccuucgcuc

SEQ ID NO: 1859360 - RNA, 16 nt, Human
caaccccuucgcuccu

SEQ ID NO: 1859361 - RNA, 18 nt, Human
caagcaccuagccucgcu

SEQ ID NO: 1859362 - RNA, 14 nt, Human
caagcaccuccugc

SEQ ID NO: 1859363 - RNA, 13 nt, Human
caagcaccuccug

SEQ ID NO: 1859364 - RNA, 19 nt, Human
caagcaaaugugaaucauu

SEQ ID NO: 1859365 - RNA, 17 nt, Human
caagcaaaugugaauca

SEQ ID NO: 1859366 - RNA, 15 nt, Human
caagcaaaugugaau

SEQ ID NO: 1859367 - RNA, 13 nt, Human
caagcaagaaaca

SEQ ID NO: 1859368 - RNA, 18 nt, Human
caagcaagaaacacuggg

SEQ ID NO: 1859369 - RNA, 14 nt, Human
caagaccacguuuc

SEQ ID NO: 1859370 - RNA, 16 nt, Human
caagaccacguuucua

SEQ ID NO: 1859371 - RNA, 20 nt, Human
auuucuguuuagauaauaca

SEQ ID NO: 1859372 - RNA, 19 nt, Human
auuucuguuuagauaauac

SEQ ID NO: 1859373 - RNA, 21 nt, Human
auuucuguuuagauaauacac

SEQ ID NO: 1859374 - RNA, 14 nt, Human
auuucacucuccuu

SEQ ID NO: 1859375 - RNA, 12 nt, Human
auuucacucucc

SEQ ID NO: 1859376 - RNA, 15 nt, Human
auuuauauaaauuuu

SEQ ID NO: 1859377 - RNA, 16 nt, Human
caaaccaucauugaaa

SEQ ID NO: 1859378 - RNA, 14 nt, Human
caaaccaucauuga

SEQ ID NO: 1859379 - RNA, 17 nt, Human
caaaccaucauugaaau

SEQ ID NO: 1859380 - RNA, 22 nt, Human
auuuuguuuuugucuuaaaaag

SEQ ID NO: 1859381 - RNA, 15 nt, Human
auuuuuuucugaauu

SEQ ID NO: 1859382 - RNA, 16 nt, Human
auuuuuauuaaauuau

SEQ ID NO: 1859383 - RNA, 15 nt, Human
auuuuuuuuguuuca

SEQ ID NO: 1859384 - RNA, 21 nt, Human
caaaagguauuuuaaucacca

SEQ ID NO: 1859385 - RNA, 19 nt, Human
caaaagcaucuaugugaga

SEQ ID NO: 1859386 - RNA, 13 nt, Human
caaaagcauguga

SEQ ID NO: 1859387 - RNA, 20 nt, Human
caaaagguuaauaaaguaau

SEQ ID NO: 1859388 - RNA, 15 nt, Human
auuuugaaaaacugc

SEQ ID NO: 1859389 - RNA, 13 nt, Human
auuuugaaaaacu

SEQ ID NO: 1859390 - RNA, 19 nt, Human
auuuucuauaauuuaaaua

SEQ ID NO: 1859391 - RNA, 18 nt, Human
auuuucuauaauuuaaau

SEQ ID NO: 1859392 - RNA, 17 nt, Human
auuuucuauaauuuaaa

SEQ ID NO: 1859393 - RNA, 14 nt, Human
auuuguuauaauga

SEQ ID NO: 1859394 - RNA, 19 nt, Human
auuuguucuauagcuuuuc

SEQ ID NO: 1859395 - RNA, 21 nt, Human
auuaacaugaauauuuagugu

SEQ ID NO: 1859396 - RNA, 16 nt, Human
auuacaggcuccugcc

SEQ ID NO: 1859397 - RNA, 15 nt, Human
auuacaggcuccugc

SEQ ID NO: 1859398 - RNA, 13 nt, Human
auuacagguguga

SEQ ID NO: 1859399 - RNA, 19 nt, Human
auuacaggcuccugccacc

SEQ ID NO: 1859400 - RNA, 17 nt, Human
auuacaggcuccugcca

SEQ ID NO: 1859401 - RNA, 22 nt, Human
auuacaagcgugagccacugca

SEQ ID NO: 1859402 - RNA, 15 nt, Human
auuaauggaaauguu

SEQ ID NO: 1859403 - RNA, 15 nt, Human
auucucuuauccaac

SEQ ID NO: 1859404 - RNA, 16 nt, Human
auucucuccuguaccu

SEQ ID NO: 1859405 - RNA, 14 nt, Human
auucucuuauccaa

SEQ ID NO: 1859406 - RNA, 12 nt, Human
auucucuuaucc

SEQ ID NO: 1859407 - RNA, 23 nt, Human
auucucuaguuugauuaaauucu

SEQ ID NO: 1859408 - RNA, 20 nt, Human
auucucuaguuugauuaaau

SEQ ID NO: 1859409 - RNA, 23 nt, Human
auuaugugccagauuuaugcaua

SEQ ID NO: 1859410 - RNA, 21 nt, Human
auuaugugccagauuuaugca

SEQ ID NO: 1859411 - RNA, 13 nt, Human
auuaugugccaga

SEQ ID NO: 1859412 - RNA, 14 nt, Human
auucauauuuacuu

SEQ ID NO: 1859413 - RNA, 12 nt, Human
caggccaggccc

SEQ ID NO: 1859414 - RNA, 11 nt, Human
caggccaggcc

SEQ ID NO: 1859415 - RNA, 23 nt, Human
caggaccucaggugagaagcaga

SEQ ID NO: 1859416 - RNA, 16 nt, Human
caggaccucaggugag

SEQ ID NO: 1859417 - RNA, 14 nt, Human
caggcaaugcuggc

SEQ ID NO: 1859418 - RNA, 15 nt, Human
caggcaaugcuggcu

SEQ ID NO: 1859419 - RNA, 16 nt, Human
caggcaaugcuggcug

SEQ ID NO: 1859420 - RNA, 17 nt, Human
caggcaaugcuggcugu

SEQ ID NO: 1859421 - RNA, 19 nt, Human
caggaggaucacuugaguc

SEQ ID NO: 1859422 - RNA, 19 nt, Human
caggaggccagccuugacc

SEQ ID NO: 1859423 - RNA, 18 nt, Human
caggaggccagccuugac

SEQ ID NO: 1859424 - RNA, 22 nt, Human
caggaggccagccuugaccauu

SEQ ID NO: 1859425 - RNA, 21 nt, Human
caggcugggagagccuuccag

SEQ ID NO: 1859426 - RNA, 21 nt, Human
caggcgugagccaccgugccu

SEQ ID NO: 1859427 - RNA, 14 nt, Human
caggccuccuacag

SEQ ID NO: 1859428 - RNA, 12 nt, Human
caggccuccuac

SEQ ID NO: 1859429 - RNA, 16 nt, Human
caggggaaaagaggag

SEQ ID NO: 1859430 - RNA, 14 nt, Human
caggggaaaagagg

SEQ ID NO: 1859431 - RNA, 17 nt, Human
caggggaaaaucagccu

SEQ ID NO: 1859432 - RNA, 23 nt, Human
caggcugggagagccuuccaggg

SEQ ID NO: 1859433 - RNA, 22 nt, Human
caggcugggagagccuuccagg

SEQ ID NO: 1859434 - RNA, 20 nt, Human
cagcgcuggccgggaccccg

SEQ ID NO: 1859435 - RNA, 21 nt, Human
cagcggaaagcccugugcucc

SEQ ID NO: 1859436 - RNA, 15 nt, Human
cagcuaacauggaag

SEQ ID NO: 1859437 - RNA, 16 nt, Human
cagccugcuccagcug

SEQ ID NO: 1859438 - RNA, 19 nt, Human
cagccugcuccagcuguuc

SEQ ID NO: 1859439 - RNA, 17 nt, Human
cagccugcuccagcugu

SEQ ID NO: 1859440 - RNA, 21 nt, Human
cagcugacuuuucuguccgag

SEQ ID NO: 1859441 - RNA, 17 nt, Human
caggaaaggcuccagga

SEQ ID NO: 1859442 - RNA, 16 nt, Human
caggaaaggcuccagg

SEQ ID NO: 1859443 - RNA, 20 nt, Human
caggaaaggcuccaggagca

SEQ ID NO: 1859444 - RNA, 19 nt, Human
caggaaaggcuccaggagc

SEQ ID NO: 1859445 - RNA, 14 nt, Human
cagacagcugccug

SEQ ID NO: 1859446 - RNA, 13 nt, Human
cagacagcugccu

SEQ ID NO: 1859447 - RNA, 14 nt, Human
cagacagcccucca

SEQ ID NO: 1859448 - RNA, 18 nt, Human
cagacagcugccugggau

SEQ ID NO: 1859449 - RNA, 17 nt, Human
cagacagcugccuggga

SEQ ID NO: 1859450 - RNA, 16 nt, Human
cagacagcugccuggg

SEQ ID NO: 1859451 - RNA, 15 nt, Human
cagacagcugccugg

SEQ ID NO: 1859452 - RNA, 16 nt, Human
cagacaggaccaggga

SEQ ID NO: 1859453 - RNA, 15 nt, Human
cagacaggaccaggg

SEQ ID NO: 1859454 - RNA, 13 nt, Human
cagacaggaccag

SEQ ID NO: 1859455 - RNA, 24 nt, Human
cagacaggaccagggauuuccaug

SEQ ID NO: 1859456 - RNA, 17 nt, Human
cagacaggaccagggau

SEQ ID NO: 1859457 - RNA, 11 nt, Human
cagacaggcaa

SEQ ID NO: 1859458 - RNA, 13 nt, Human
cagacaggcaagc

SEQ ID NO: 1859459 - RNA, 18 nt, Human
cagacaggcaagcaccuc

SEQ ID NO: 1859460 - RNA, 20 nt, Human
cagacaggcaagcaccuccu

SEQ ID NO: 1859461 - RNA, 21 nt, Human
cagacaggcaagcaccuccug

SEQ ID NO: 1859462 - RNA, 23 nt, Human
cagacucuacagaggccaugggc

SEQ ID NO: 1859463 - RNA, 18 nt, Human
cagacucuacagaggcca

SEQ ID NO: 1859464 - RNA, 19 nt, Human
cagacucuacagaggccau

SEQ ID NO: 1859465 - RNA, 20 nt, Human
cagacucuacagaggccaug

SEQ ID NO: 1859466 - RNA, 21 nt, Human
cagacucuacagaggccaugg

SEQ ID NO: 1859467 - RNA, 17 nt, Human
cagacucuacagaggcc

SEQ ID NO: 1859468 - RNA, 22 nt, Human
cagacaggcaagcaccuccugc

SEQ ID NO: 1859469 - RNA, 23 nt, Human
cagacaggcaagcaccuccugcc

SEQ ID NO: 1859470 - RNA, 13 nt, Human
cagacuggaagca

SEQ ID NO: 1859471 - RNA, 14 nt, Human
cagacuggaagcac

SEQ ID NO: 1859472 - RNA, 16 nt, Human
cagacuggaagcacag

SEQ ID NO: 1859473 - RNA, 17 nt, Human
cagacuggaagcacagc

SEQ ID NO: 1859474 - RNA, 18 nt, Human
cagacuggaagcacagcu

SEQ ID NO: 1859475 - RNA, 20 nt, Human
cagacuggaagcacagcuuc

SEQ ID NO: 1859476 - RNA, 21 nt, Human
cagacuggaagcacagcuuca

SEQ ID NO: 1859477 - RNA, 19 nt, Human
cagcaccaucucuccuccu

SEQ ID NO: 1859478 - RNA, 19 nt, Human
cagauuucacucuccuugg

SEQ ID NO: 1859479 - RNA, 17 nt, Human
cagcaccaucucuccuc

SEQ ID NO: 1859480 - RNA, 19 nt, Human
cagauuugaacucuucaau

SEQ ID NO: 1859481 - RNA, 20 nt, Human
cagauuucacucuccuuggu

SEQ ID NO: 1859482 - RNA, 13 nt, Human
cagauuucacucu

SEQ ID NO: 1859483 - RNA, 13 nt, Human
cagauuuaugcau

SEQ ID NO: 1859484 - RNA, 19 nt, Human
cagauugcaacaggcuggg

SEQ ID NO: 1859485 - RNA, 20 nt, Human
cagauugcaacaggcugggc

SEQ ID NO: 1859486 - RNA, 18 nt, Human
cagauugcaacaggcugg

SEQ ID NO: 1859487 - RNA, 14 nt, Human
cagcacgauuucug

SEQ ID NO: 1859488 - RNA, 15 nt, Human
cagcacgauuucugu

SEQ ID NO: 1859489 - RNA, 18 nt, Human
cagcacgggggccaagga

SEQ ID NO: 1859490 - RNA, 12 nt, Human
cagagagggugg

SEQ ID NO: 1859491 - RNA, 13 nt, Human
cagagaggguggg

SEQ ID NO: 1859492 - RNA, 17 nt, Human
cagagaggguggugacc

SEQ ID NO: 1859493 - RNA, 20 nt, Human
cagagaggguggugaccucu

SEQ ID NO: 1859494 - RNA, 22 nt, Human
cagagaggguggugaccucugc

SEQ ID NO: 1859495 - RNA, 13 nt, Human
cagagcugccacc

SEQ ID NO: 1859496 - RNA, 20 nt, Human
cagagagguuaaggugggua

SEQ ID NO: 1859497 - RNA, 23 nt, Human
cagagagggugggagugggccca

SEQ ID NO: 1859498 - RNA, 23 nt, Human
cagagaggguggugaccucugcc

SEQ ID NO: 1859499 - RNA, 19 nt, Human
cagaggaaagcaaaggaga

SEQ ID NO: 1859500 - RNA, 17 nt, Human
cagaggaaagcaaagga

SEQ ID NO: 1859501 - RNA, 13 nt, Human
cagaggggguggc

SEQ ID NO: 1859502 - RNA, 20 nt, Human
cagaggaaagcaaaggagau

SEQ ID NO: 1859503 - RNA, 19 nt, Human
cagauacuuggggggcuga

SEQ ID NO: 1859504 - RNA, 16 nt, Human
cagaggggguggccuc

SEQ ID NO: 1859505 - RNA, 14 nt, Human
cagaggggguggcc

SEQ ID NO: 1859506 - RNA, 19 nt, Human
cagauagauauaugcucug

SEQ ID NO: 1859507 - RNA, 22 nt, Human
cagauauaaaagacugaccaau

SEQ ID NO: 1859508 - RNA, 14 nt, Human
cagauccccaagcc

SEQ ID NO: 1859509 - RNA, 22 nt, Human
caguuguuagugugucuuagug

SEQ ID NO: 1859510 - RNA, 18 nt, Human
caguuguuagugugucuu

SEQ ID NO: 1859511 - RNA, 21 nt, Human
caguuuguuaguaugaggcau

SEQ ID NO: 1859512 - RNA, 23 nt, Human
caguuuguuaguaugaggcauuu

SEQ ID NO: 1859513 - RNA, 23 nt, Human
cauaaugcgugcauaccacuuuu

SEQ ID NO: 1859514 - RNA, 11 nt, Human
caguuuuccuu

SEQ ID NO: 1859515 - RNA, 16 nt, Human
cauacaguuugcacuu

SEQ ID NO: 1859516 - RNA, 23 nt, Human
cauacaggaagguagaaauaucu

SEQ ID NO: 1859517 - RNA, 18 nt, Human
cauaauuauuauuuggcc

SEQ ID NO: 1859518 - RNA, 21 nt, Human
cauauuauuuuauguugcaua

SEQ ID NO: 1859519 - RNA, 22 nt, Human
cauauuaccacagacauacuaa

SEQ ID NO: 1859520 - RNA, 20 nt, Human
cauagcagcuuauucacaag

SEQ ID NO: 1859521 - RNA, 19 nt, Human
cauagcagcuuauucacaa

SEQ ID NO: 1859522 - RNA, 23 nt, Human
cauagcagagaaugaaagggccc

SEQ ID NO: 1859523 - RNA, 16 nt, Human
cauagguuuaauaauu

SEQ ID NO: 1859524 - RNA, 18 nt, Human
cauccugaggcuccacuu

SEQ ID NO: 1859525 - RNA, 19 nt, Human
cauccugaggcuccacuug

SEQ ID NO: 1859526 - RNA, 21 nt, Human
caucuaaacugcccccucugc

SEQ ID NO: 1859527 - RNA, 15 nt, Human
caucuaaacugcccc

SEQ ID NO: 1859528 - RNA, 22 nt, Human
cauccucuguacagagcccacg

SEQ ID NO: 1859529 - RNA, 12 nt, Human
caucccagcccc

SEQ ID NO: 1859530 - RNA, 11 nt, Human
caucccagccc

SEQ ID NO: 1859531 - RNA, 20 nt, Human
caucccaaacccuucagugc

SEQ ID NO: 1859532 - RNA, 21 nt, Human
caucagcacgauuucuguuua

SEQ ID NO: 1859533 - RNA, 19 nt, Human
caucccaaacccuucagug

SEQ ID NO: 1859534 - RNA, 22 nt, Human
caguuauuauauuuacaaaugg

SEQ ID NO: 1859535 - RNA, 21 nt, Human
cagucugauucccaagcucug

SEQ ID NO: 1859536 - RNA, 22 nt, Human
cagucugauucccaagcucugc

SEQ ID NO: 1859537 - RNA, 20 nt, Human
cagugguaugaucacggcuc

SEQ ID NO: 1859538 - RNA, 16 nt, Human
cagugggagcugccug

SEQ ID NO: 1859539 - RNA, 17 nt, Human
cagugggagcugccugu

SEQ ID NO: 1859540 - RNA, 18 nt, Human
cagugggagcugccuguu

SEQ ID NO: 1859541 - RNA, 21 nt, Human
cagugcccacaggaucagucu

SEQ ID NO: 1859542 - RNA, 22 nt, Human
cagugcccacaggaucagucug

SEQ ID NO: 1859543 - RNA, 22 nt, Human
cagugauuaccagggacugagg

SEQ ID NO: 1859544 - RNA, 23 nt, Human
cagucugauucccaagcucugcu

SEQ ID NO: 1859545 - RNA, 20 nt, Human
caguuacucagaauucucua

SEQ ID NO: 1859546 - RNA, 21 nt, Human
cagugguaugaucacggcuca

SEQ ID NO: 1859547 - RNA, 19 nt, Human
caguggugcgaucuggguu

SEQ ID NO: 1859548 - RNA, 20 nt, Human
caguggugcgaucuggguuc

SEQ ID NO: 1859549 - RNA, 21 nt, Human
caguuauuauauuuacaaaug

SEQ ID NO: 1859550 - RNA, 17 nt, Human
caguuauuauauuuaca

SEQ ID NO: 1859551 - RNA, 12 nt, Human
caugcaagguca

SEQ ID NO: 1859552 - RNA, 15 nt, Human
caugcaaggucauuu

SEQ ID NO: 1859553 - RNA, 14 nt, Human
caugaugcgggcca

SEQ ID NO: 1859554 - RNA, 20 nt, Human
caugaugcgggccagugcuc

SEQ ID NO: 1859555 - RNA, 15 nt, Human
caugaugcgggccag

SEQ ID NO: 1859556 - RNA, 13 nt, Human
caugacaaagacu

SEQ ID NO: 1859557 - RNA, 16 nt, Human
caugaauuugugaagg

SEQ ID NO: 1859558 - RNA, 21 nt, Human
caugaauauuuaguguucaua

SEQ ID NO: 1859559 - RNA, 18 nt, Human
caugggaaaggggaaguu

SEQ ID NO: 1859560 - RNA, 20 nt, Human
caugggaaaugucaacaagu

SEQ ID NO: 1859561 - RNA, 21 nt, Human
cauggccucuucagaucucua

SEQ ID NO: 1859562 - RNA, 14 nt, Human
cauggccgugaacu

SEQ ID NO: 1859563 - RNA, 22 nt, Human
cauggccucuucagaucucuaa

SEQ ID NO: 1859564 - RNA, 16 nt, Human
caugcuccuggcccac

SEQ ID NO: 1859565 - RNA, 14 nt, Human
caugcuccuggccc

SEQ ID NO: 1859566 - RNA, 17 nt, Human
caugcuccuggcccacu

SEQ ID NO: 1859567 - RNA, 20 nt, Human
caugcuccuggcccacugca

SEQ ID NO: 1859568 - RNA, 15 nt, Human
cauggccagguggcc

SEQ ID NO: 1859569 - RNA, 17 nt, Human
cauguuacauaagauaa

SEQ ID NO: 1859570 - RNA, 16 nt, Human
cauguuacauaagaua

SEQ ID NO: 1859571 - RNA, 16 nt, Human
cauguccaagaagccc

SEQ ID NO: 1859572 - RNA, 15 nt, Human
cauguccaagaagcc

SEQ ID NO: 1859573 - RNA, 13 nt, Human
cauguucuuaauu

SEQ ID NO: 1859574 - RNA, 16 nt, Human
cauguucuuaauucuu

SEQ ID NO: 1859575 - RNA, 21 nt, Human
cauguuacauaagauaaaugu

SEQ ID NO: 1859576 - RNA, 18 nt, Human
cauguucuuaauucuuag

SEQ ID NO: 1859577 - RNA, 18 nt, Human
cauguuggccaggcuggu

SEQ ID NO: 1859578 - RNA, 17 nt, Human
cauguuggccaggcugg

SEQ ID NO: 1859579 - RNA, 20 nt, Human
cauguuggccaggcugcucu

SEQ ID NO: 1859580 - RNA, 19 nt, Human
cauguuggccaggcugguc

SEQ ID NO: 1859581 - RNA, 21 nt, Human
cauucuccaccugccagggac

SEQ ID NO: 1859582 - RNA, 19 nt, Human
cauucuccaccugccaggg

SEQ ID NO: 1859583 - RNA, 18 nt, Human
cauucuccaccugccagg

SEQ ID NO: 1859584 - RNA, 17 nt, Human
cauucuccaccugccag

SEQ ID NO: 1859585 - RNA, 20 nt, Human
cauucuccuuguguuacuaa

SEQ ID NO: 1859586 - RNA, 22 nt, Human
ccaaaguacacuguuucaaacu

SEQ ID NO: 1859587 - RNA, 14 nt, Human
ccaaagugcuggga

SEQ ID NO: 1859588 - RNA, 14 nt, Human
ccaaugggagcuca

SEQ ID NO: 1859589 - RNA, 23 nt, Human
ccaauggacuaacuugucuuugg

SEQ ID NO: 1859590 - RNA, 21 nt, Human
ccaauggagacugucucaaga

SEQ ID NO: 1859591 - RNA, 13 nt, Human
ccaacucacccca

SEQ ID NO: 1859592 - RNA, 16 nt, Human
ccaacuauggccugug

SEQ ID NO: 1859593 - RNA, 15 nt, Human
ccaacuauggccugu

SEQ ID NO: 1859594 - RNA, 14 nt, Human
ccaacuauggccug

SEQ ID NO: 1859595 - RNA, 15 nt, Human
ccaaaucagcugcua

SEQ ID NO: 1859596 - RNA, 23 nt, Human
ccaaaucagcugcuacuacuccu

SEQ ID NO: 1859597 - RNA, 16 nt, Human
ccaaaucauaguggcu

SEQ ID NO: 1859598 - RNA, 16 nt, Human
ccaagcucugcuccuc

SEQ ID NO: 1859599 - RNA, 14 nt, Human
ccaagcucugcucc

SEQ ID NO: 1859600 - RNA, 15 nt, Human
ccaagcucugcuccu

SEQ ID NO: 1859601 - RNA, 21 nt, Human
ccaacucaccccagccccaaa

SEQ ID NO: 1859602 - RNA, 16 nt, Human
cauuggagauguuuag

SEQ ID NO: 1859603 - RNA, 16 nt, Human
cauuuaggugaggaag

SEQ ID NO: 1859604 - RNA, 18 nt, Human
cauuuaggugaggaagca

SEQ ID NO: 1859605 - RNA, 14 nt, Human
ccaaaaggcagaag

SEQ ID NO: 1859606 - RNA, 23 nt, Human
cauuuuuuuuaagaaaaaggaug

SEQ ID NO: 1859607 - RNA, 21 nt, Human
cauuuggugguuucagaaaug

SEQ ID NO: 1859608 - RNA, 22 nt, Human
gcccugccuccuuugugaggaa

SEQ ID NO: 1859609 - RNA, 16 nt, Human
gcccugccuccuuugu

SEQ ID NO: 1859610 - RNA, 16 nt, Human
gcccugcugaguccca

SEQ ID NO: 1859611 - RNA, 22 nt, Human
gcccugcugagucccaggcuga

SEQ ID NO: 1859612 - RNA, 21 nt, Human
gcccugcugagucccaggcug

SEQ ID NO: 1859613 - RNA, 23 nt, Human
gcccugcugagucccaggcugag

SEQ ID NO: 1859614 - RNA, 15 nt, Human
gccgccaugcuccug

SEQ ID NO: 1859615 - RNA, 20 nt, Human
gcccuuaccugccaggaagc

SEQ ID NO: 1859616 - RNA, 16 nt, Human
gcccuuaccugccagg

SEQ ID NO: 1859617 - RNA, 16 nt, Human
gccgccaugcuccugg

SEQ ID NO: 1859618 - RNA, 13 nt, Human
gcccacucccugc

SEQ ID NO: 1859619 - RNA, 23 nt, Human
gcccacuagacccacuggacuca

SEQ ID NO: 1859620 - RNA, 17 nt, Human
gcccacuagacccacug

SEQ ID NO: 1859621 - RNA, 15 nt, Human
gcccacucccugcaa

SEQ ID NO: 1859622 - RNA, 14 nt, Human
gcccacucccugca

SEQ ID NO: 1859623 - RNA, 19 nt, Human
gcccacucccugcaaccug

SEQ ID NO: 1859624 - RNA, 22 nt, Human
gcccuaaaguguauuuuuuuac

SEQ ID NO: 1859625 - RNA, 22 nt, Human
gccccuggaugcagccucacag

SEQ ID NO: 1859626 - RNA, 18 nt, Human
gccccuggaugcagccuc

SEQ ID NO: 1859627 - RNA, 16 nt, Human
gccccuggaugcagcc

SEQ ID NO: 1859628 - RNA, 15 nt, Human
gccccugcccggcug

SEQ ID NO: 1859629 - RNA, 14 nt, Human
gcccccucugcccu

SEQ ID NO: 1859630 - RNA, 13 nt, Human
gccccugcccggc

SEQ ID NO: 1859631 - RNA, 14 nt, Human
gccccugcccggcu

SEQ ID NO: 1859632 - RNA, 19 nt, Human
gccccaaaacucuccucug

SEQ ID NO: 1859633 - RNA, 18 nt, Human
gccccaaaacucuccucu

SEQ ID NO: 1859634 - RNA, 13 nt, Human
gccuccuccagcc

SEQ ID NO: 1859635 - RNA, 12 nt, Human
gccucugggacu

SEQ ID NO: 1859636 - RNA, 14 nt, Human
gccucugggacugg

SEQ ID NO: 1859637 - RNA, 13 nt, Human
gccuccugugugu

SEQ ID NO: 1859638 - RNA, 12 nt, Human
gccucuuccucc

SEQ ID NO: 1859639 - RNA, 22 nt, Human
gccucuuccucccucauuccac

SEQ ID NO: 1859640 - RNA, 23 nt, Human
gccucuucucuacucuagggaaa

SEQ ID NO: 1859641 - RNA, 12 nt, Human
gccucuucucua

SEQ ID NO: 1859642 - RNA, 17 nt, Human
gccugcccaggccccug

SEQ ID NO: 1859643 - RNA, 18 nt, Human
gccugcccaggccccugc

SEQ ID NO: 1859644 - RNA, 19 nt, Human
gccugcccaggccccugcc

SEQ ID NO: 1859645 - RNA, 20 nt, Human
gccugcccaggccccugcca

SEQ ID NO: 1859646 - RNA, 16 nt, Human
gccugccucuucucua

SEQ ID NO: 1859647 - RNA, 17 nt, Human
gccugccuguucccauu

SEQ ID NO: 1859648 - RNA, 17 nt, Human
gccuggccccucagggu

SEQ ID NO: 1859649 - RNA, 16 nt, Human
gccuggccccucaggg

SEQ ID NO: 1859650 - RNA, 15 nt, Human
gccuggccccucagg

SEQ ID NO: 1859651 - RNA, 10 nt, Human
gccuggccug

SEQ ID NO: 1859652 - RNA, 22 nt, Human
gccuggccccucagggucccug

SEQ ID NO: 1859653 - RNA, 20 nt, Human
gccuggccccucaggguccc

SEQ ID NO: 1859654 - RNA, 18 nt, Human
gccugggaucccucaucc

SEQ ID NO: 1859655 - RNA, 21 nt, Human
gccugggaucccucauccuca

SEQ ID NO: 1859656 - RNA, 22 nt, Human
gccugugucuuuaaaugcugcu

SEQ ID NO: 1859657 - RNA, 13 nt, Human
gccugugucuuua

SEQ ID NO: 1859658 - RNA, 14 nt, Human
gccugggaucccuc

SEQ ID NO: 1859659 - RNA, 22 nt, Human
gccugggaggucaaggcugcag

SEQ ID NO: 1859660 - RNA, 21 nt, Human
gccugggaggucaaggcugca

SEQ ID NO: 1859661 - RNA, 20 nt, Human
gccacauuccugaugcuucu

SEQ ID NO: 1859662 - RNA, 16 nt, Human
gccacauuccugaugc

SEQ ID NO: 1859663 - RNA, 21 nt, Human
gccaccaacauacucccaucu

SEQ ID NO: 1859664 - RNA, 20 nt, Human
gccaccaacauacucccauc

SEQ ID NO: 1859665 - RNA, 19 nt, Human
gccaccaacauacucccau

SEQ ID NO: 1859666 - RNA, 14 nt, Human
gccaccacgcccgg

SEQ ID NO: 1859667 - RNA, 13 nt, Human
gccaccacgcccg

SEQ ID NO: 1859668 - RNA, 22 nt, Human
gccaccaacauacucccaucug

SEQ ID NO: 1859669 - RNA, 21 nt, Human
gccacugcacuauagccuagg

SEQ ID NO: 1859670 - RNA, 13 nt, Human
gccacccugggga

SEQ ID NO: 1859671 - RNA, 19 nt, Human
gccacccuggggagaaagu

SEQ ID NO: 1859672 - RNA, 23 nt, Human
gccacugcaccgggccacagaga

SEQ ID NO: 1859673 - RNA, 19 nt, Human
gccacugugaagagaacca

SEQ ID NO: 1859674 - RNA, 18 nt, Human
gccacugugaagagaacc

SEQ ID NO: 1859675 - RNA, 17 nt, Human
gccacugccucuuccuc

SEQ ID NO: 1859676 - RNA, 16 nt, Human
gccacugccucuuccu

SEQ ID NO: 1859677 - RNA, 13 nt, Human
gccacugccucuu

SEQ ID NO: 1859678 - RNA, 12 nt, Human
gccacugccucu

SEQ ID NO: 1859679 - RNA, 21 nt, Human
gccacuugaugacccccaacc

SEQ ID NO: 1859680 - RNA, 18 nt, Human
gcacuuggagacuuguau

SEQ ID NO: 1859681 - RNA, 19 nt, Human
gccauauucuguuggccag

SEQ ID NO: 1859682 - RNA, 20 nt, Human
gccauauucuguuggccagu

SEQ ID NO: 1859683 - RNA, 15 nt, Human
gccauguuggccagg

SEQ ID NO: 1859684 - RNA, 16 nt, Human
gccauguuggccaggc

SEQ ID NO: 1859685 - RNA, 17 nt, Human
gccauguuggccaggcu

SEQ ID NO: 1859686 - RNA, 18 nt, Human
gccauguuggccaggcug

SEQ ID NO: 1859687 - RNA, 14 nt, Human
gccauguuggccag

SEQ ID NO: 1859688 - RNA, 14 nt, Human
gcccacgcccccac

SEQ ID NO: 1859689 - RNA, 13 nt, Human
gcccacgccccca

SEQ ID NO: 1859690 - RNA, 18 nt, Human
gcccaccuuggcucaagu

SEQ ID NO: 1859691 - RNA, 15 nt, Human
gcccacgcuggagug

SEQ ID NO: 1859692 - RNA, 16 nt, Human
gcccacgcuggagugc

SEQ ID NO: 1859693 - RNA, 17 nt, Human
gcccacgcuggagugca

SEQ ID NO: 1859694 - RNA, 18 nt, Human
gccauuccccgucucugg

SEQ ID NO: 1859695 - RNA, 17 nt, Human
gccauuccccgucucug

SEQ ID NO: 1859696 - RNA, 19 nt, Human
gccauguuggccaggcugg

SEQ ID NO: 1859697 - RNA, 20 nt, Human
gccauguuggccaggcuggu

SEQ ID NO: 1859698 - RNA, 22 nt, Human
gccauguuggccaggcuggucu

SEQ ID NO: 1859699 - RNA, 24 nt, Human
gccauguuggccaggcuggucuca

SEQ ID NO: 1859700 - RNA, 23 nt, Human
gccaggccacaagacccuugugg

SEQ ID NO: 1859701 - RNA, 12 nt, Human
gccaggccagag

SEQ ID NO: 1859702 - RNA, 20 nt, Human
gccaggcccucugcccacuc

SEQ ID NO: 1859703 - RNA, 19 nt, Human
gccaggcccucugcccacu

SEQ ID NO: 1859704 - RNA, 21 nt, Human
gccaggcccucugcccacucc

SEQ ID NO: 1859705 - RNA, 17 nt, Human
gccaggcccucugccca

SEQ ID NO: 1859706 - RNA, 16 nt, Human
gccaggcccucugccc

SEQ ID NO: 1859707 - RNA, 13 nt, Human
gccaggccagagg

SEQ ID NO: 1859708 - RNA, 15 nt, Human
gccaggcccucugcc

SEQ ID NO: 1859709 - RNA, 22 nt, Human
gccagacaucaacagauaaaua

SEQ ID NO: 1859710 - RNA, 15 nt, Human
gccagaauuucaaac

SEQ ID NO: 1859711 - RNA, 23 nt, Human
gccagcaggcucucaggccagcu

SEQ ID NO: 1859712 - RNA, 21 nt, Human
gccagcaggcucucaggccag

SEQ ID NO: 1859713 - RNA, 20 nt, Human
gccagcaggcucucaggcca

SEQ ID NO: 1859714 - RNA, 19 nt, Human
gccagcaggcucucaggcc

SEQ ID NO: 1859715 - RNA, 18 nt, Human
gccagcaggcucucaggc

SEQ ID NO: 1859716 - RNA, 17 nt, Human
gccagcaggcucucagg

SEQ ID NO: 1859717 - RNA, 16 nt, Human
gccagcaggcucucag

SEQ ID NO: 1859718 - RNA, 13 nt, Human
gccagcaggcucu

SEQ ID NO: 1859719 - RNA, 22 nt, Human
gcucagguggggucacucuggc

SEQ ID NO: 1859720 - RNA, 21 nt, Human
gcucagguggggucacucugg

SEQ ID NO: 1859721 - RNA, 15 nt, Human
gcucagagagggugg

SEQ ID NO: 1859722 - RNA, 20 nt, Human
gcucagagagggugggagug

SEQ ID NO: 1859723 - RNA, 18 nt, Human
gcucagagagggugggag

SEQ ID NO: 1859724 - RNA, 22 nt, Human
gcucagagagggugggaguggg

SEQ ID NO: 1859725 - RNA, 14 nt, Human
gcucaggagcccug

SEQ ID NO: 1859726 - RNA, 18 nt, Human
gcucaggagcccugggag

SEQ ID NO: 1859727 - RNA, 15 nt, Human
gcucaggagcccugg

SEQ ID NO: 1859728 - RNA, 12 nt, Human
gcucagggccug

SEQ ID NO: 1859729 - RNA, 21 nt, Human
gcucaggagcccugggaggcu

SEQ ID NO: 1859730 - RNA, 16 nt, Human
gcucagggccuggcuc

SEQ ID NO: 1859731 - RNA, 13 nt, Human
gcucagggccugg

SEQ ID NO: 1859732 - RNA, 17 nt, Human
gcucagggccuggcuca

SEQ ID NO: 1859733 - RNA, 14 nt, Human
gccuguucagcucc

SEQ ID NO: 1859734 - RNA, 20 nt, Human
gccuguucagcuccagcuca

SEQ ID NO: 1859735 - RNA, 19 nt, Human
gccuguucagcuccagcuc

SEQ ID NO: 1859736 - RNA, 14 nt, Human
gccugugucuuuaa

SEQ ID NO: 1859737 - RNA, 21 nt, Human
gcuaggaacacuccuucacag

SEQ ID NO: 1859738 - RNA, 19 nt, Human
gcuaggaacacuccuucac

SEQ ID NO: 1859739 - RNA, 18 nt, Human
gcuaggaacacuccuuca

SEQ ID NO: 1859740 - RNA, 21 nt, Human
gcuauugucaccagggcugga

SEQ ID NO: 1859741 - RNA, 20 nt, Human
gcuauugucaccagggcugg

SEQ ID NO: 1859742 - RNA, 16 nt, Human
gcuauugucaccaggg

SEQ ID NO: 1859743 - RNA, 16 nt, Human
gcuaguaucaaaagaa

SEQ ID NO: 1859744 - RNA, 14 nt, Human
gcuaggccuggcca

SEQ ID NO: 1859745 - RNA, 15 nt, Human
gcuaggccuggccag

SEQ ID NO: 1859746 - RNA, 23 nt, Human
gcucuggagcccacuguacuugc

SEQ ID NO: 1859747 - RNA, 21 nt, Human
gcucugagcaaauguggcucc

SEQ ID NO: 1859748 - RNA, 20 nt, Human
gcucugagcaaauguggcuc

SEQ ID NO: 1859749 - RNA, 22 nt, Human
gcugaauacagaggcaacugca

SEQ ID NO: 1859750 - RNA, 17 nt, Human
gcugaaugguuuucaaa

SEQ ID NO: 1859751 - RNA, 20 nt, Human
gcugaaggcucgagcaugcc

SEQ ID NO: 1859752 - RNA, 12 nt, Human
gcugaaggcucg

SEQ ID NO: 1859753 - RNA, 16 nt, Human
gcugacagacacaggc

SEQ ID NO: 1859754 - RNA, 14 nt, Human
gcugacagacacag

SEQ ID NO: 1859755 - RNA, 15 nt, Human
gcugacagacacagg

SEQ ID NO: 1859756 - RNA, 19 nt, Human
gcucugucgcccaggcugg

SEQ ID NO: 1859757 - RNA, 16 nt, Human
gcucuguccugggagu

SEQ ID NO: 1859758 - RNA, 15 nt, Human
gcucuggccuccaag

SEQ ID NO: 1859759 - RNA, 17 nt, Human
gcucuggccuccaaguc

SEQ ID NO: 1859760 - RNA, 15 nt, Human
gcucuguccugggag

SEQ ID NO: 1859761 - RNA, 14 nt, Human
gcucuguccuggga

SEQ ID NO: 1859762 - RNA, 16 nt, Human
gcucuuccaggcuggg

SEQ ID NO: 1859763 - RNA, 15 nt, Human
gcucuuccaggcugg

SEQ ID NO: 1859764 - RNA, 12 nt, Human
gcucuuccaggc

SEQ ID NO: 1859765 - RNA, 21 nt, Human
gcucccaggcauuccccagga

SEQ ID NO: 1859766 - RNA, 20 nt, Human
gcucccaggcauuccccagg

SEQ ID NO: 1859767 - RNA, 14 nt, Human
gcuccccagcccca

SEQ ID NO: 1859768 - RNA, 22 nt, Human
gcucccaggcauuccccaggag

SEQ ID NO: 1859769 - RNA, 23 nt, Human
gcucccaggcauuccccaggagg

SEQ ID NO: 1859770 - RNA, 22 nt, Human
gcuccugccaccacgcccggcu

SEQ ID NO: 1859771 - RNA, 16 nt, Human
gcucucaggccagcug

SEQ ID NO: 1859772 - RNA, 15 nt, Human
gcucucaggccagcu

SEQ ID NO: 1859773 - RNA, 14 nt, Human
gcucucaggccagc

SEQ ID NO: 1859774 - RNA, 13 nt, Human
gcucucaggccag

SEQ ID NO: 1859775 - RNA, 22 nt, Human
gcucuacagcuaaucagcauuc

SEQ ID NO: 1859776 - RNA, 20 nt, Human
gcucuacagcuaaucagcau

SEQ ID NO: 1859777 - RNA, 14 nt, Human
gcugcaccggcugg

SEQ ID NO: 1859778 - RNA, 17 nt, Human
gcugcaccggcuggccu

SEQ ID NO: 1859779 - RNA, 16 nt, Human
gcugcaccggcuggcc

SEQ ID NO: 1859780 - RNA, 22 nt, Human
gcugcaccggcuggccuggccc

SEQ ID NO: 1859781 - RNA, 19 nt, Human
gcugcaccggcuggccugg

SEQ ID NO: 1859782 - RNA, 18 nt, Human
gcugcaccggcuggccug

SEQ ID NO: 1859783 - RNA, 21 nt, Human
gcugccagccgagauagccaa

SEQ ID NO: 1859784 - RNA, 19 nt, Human
gcugccagccgagauagcc

SEQ ID NO: 1859785 - RNA, 21 nt, Human
gcugccauccagguucagcuu

SEQ ID NO: 1859786 - RNA, 23 nt, Human
gcugccauccagguucagcuugu

SEQ ID NO: 1859787 - RNA, 22 nt, Human
gcugccaucucaccuccugcug

SEQ ID NO: 1859788 - RNA, 23 nt, Human
gcugccaucucaccuccugcugg

SEQ ID NO: 1859789 - RNA, 18 nt, Human
gcugagggugagugggug

SEQ ID NO: 1859790 - RNA, 18 nt, Human
gcugccugggaucccuca

SEQ ID NO: 1859791 - RNA, 16 nt, Human
gcugccugggaucccu

SEQ ID NO: 1859792 - RNA, 19 nt, Human
gcugccugggaucccucau

SEQ ID NO: 1859793 - RNA, 13 nt, Human
gcugccugggauc

SEQ ID NO: 1859794 - RNA, 17 nt, Human
gcuggagcucugcccau

SEQ ID NO: 1859795 - RNA, 12 nt, Human
gcuggagugcag

SEQ ID NO: 1859796 - RNA, 14 nt, Human
gcuggagcucugcc

SEQ ID NO: 1859797 - RNA, 20 nt, Human
gcugggcucccuucccaccu

SEQ ID NO: 1859798 - RNA, 17 nt, Human
gcugggcucccuuccca

SEQ ID NO: 1859799 - RNA, 16 nt, Human
gcugggcucccuuccc

SEQ ID NO: 1859800 - RNA, 12 nt, Human
gcugggcucccu

SEQ ID NO: 1859801 - RNA, 19 nt, Human
gcugggcagaggaaagcaa

SEQ ID NO: 1859802 - RNA, 17 nt, Human
gcugggcagaggaaagc

SEQ ID NO: 1859803 - RNA, 16 nt, Human
gcugggcagaggaaag

SEQ ID NO: 1859804 - RNA, 14 nt, Human
gcugggcagguugg

SEQ ID NO: 1859805 - RNA, 16 nt, Human
gcugggucgcccugga

SEQ ID NO: 1859806 - RNA, 18 nt, Human
gcugggucgcccuggacu

SEQ ID NO: 1859807 - RNA, 17 nt, Human
gcugggucgcccuggac

SEQ ID NO: 1859808 - RNA, 15 nt, Human
gcuggguguggcgca

SEQ ID NO: 1859809 - RNA, 19 nt, Human
gcugggucgcccuggacug

SEQ ID NO: 1859810 - RNA, 17 nt, Human
gcuggccuggccccuca

SEQ ID NO: 1859811 - RNA, 16 nt, Human
gcuggccuggccccuc

SEQ ID NO: 1859812 - RNA, 14 nt, Human
gcuggagugcagug

SEQ ID NO: 1859813 - RNA, 15 nt, Human
gcuggagugcaguga

SEQ ID NO: 1859814 - RNA, 19 nt, Human
gcuggccuggccccucagg

SEQ ID NO: 1859815 - RNA, 18 nt, Human
gcuggccuggccccucag

SEQ ID NO: 1859816 - RNA, 23 nt, Human
gcugggauuacaggcuccugcca

SEQ ID NO: 1859817 - RNA, 22 nt, Human
gcugggauuacaggcuccugcc

SEQ ID NO: 1859818 - RNA, 16 nt, Human
gcugggauuacaggug

SEQ ID NO: 1859819 - RNA, 15 nt, Human
gcugggcagaggaaa

SEQ ID NO: 1859820 - RNA, 14 nt, Human
gcugggcagaggaa

SEQ ID NO: 1859821 - RNA, 13 nt, Human
gcugggcagagga

SEQ ID NO: 1859822 - RNA, 17 nt, Human
gcugggauuacaggugu

SEQ ID NO: 1859823 - RNA, 17 nt, Human
gcugggauuacagggau

SEQ ID NO: 1859824 - RNA, 18 nt, Human
gcugggauuacaggugug

SEQ ID NO: 1859825 - RNA, 19 nt, Human
gcugggauuacagguguga

SEQ ID NO: 1859826 - RNA, 18 nt, Human
gcuucccgcucagcccuc

SEQ ID NO: 1859827 - RNA, 17 nt, Human
gcuucccgcucagcccu

SEQ ID NO: 1859828 - RNA, 16 nt, Human
gcuucccgcucagccc

SEQ ID NO: 1859829 - RNA, 15 nt, Human
gcuucccgcucagcc

SEQ ID NO: 1859830 - RNA, 23 nt, Human
gcuucccgcucagcccucccugc

SEQ ID NO: 1859831 - RNA, 14 nt, Human
gcuuguacauaaug

SEQ ID NO: 1859832 - RNA, 16 nt, Human
gcuuguacauaaugcg

SEQ ID NO: 1859833 - RNA, 19 nt, Human
gcuugggcuucauccuccu

SEQ ID NO: 1859834 - RNA, 19 nt, Human
gcuugaaacccguggcgcu

SEQ ID NO: 1859835 - RNA, 15 nt, Human
gcuggguucugaucc

SEQ ID NO: 1859836 - RNA, 15 nt, Human
gcuggguucuaccca

SEQ ID NO: 1859837 - RNA, 14 nt, Human
gcuggguuggaggg

SEQ ID NO: 1859838 - RNA, 21 nt, Human
gcuggguuggaggguguccca

SEQ ID NO: 1859839 - RNA, 14 nt, Human
gcugguuuuucagu

SEQ ID NO: 1859840 - RNA, 15 nt, Human
gcugguuuuucaguu

SEQ ID NO: 1859841 - RNA, 20 nt, Human
gcuguaucccaugagccuca

SEQ ID NO: 1859842 - RNA, 23 nt, Human
gcuguaucccaugagccucagca

SEQ ID NO: 1859843 - RNA, 20 nt, Human
gcuucacggaagagccuugc

SEQ ID NO: 1859844 - RNA, 14 nt, Human
gcuuaacuucacau

SEQ ID NO: 1859845 - RNA, 22 nt, Human
gcuucaaggauccugagccaga

SEQ ID NO: 1859846 - RNA, 21 nt, Human
gcuguuggcugggggccucag

SEQ ID NO: 1859847 - RNA, 22 nt, Human
gcuguuggcugggggccucagu

SEQ ID NO: 1859848 - RNA, 22 nt, Human
gcugugcugcccugcccaccug

SEQ ID NO: 1859849 - RNA, 19 nt, Human
gcugugcugcccugcccac

SEQ ID NO: 1859850 - RNA, 13 nt, Human
gcugugcugcccu

SEQ ID NO: 1859851 - RNA, 12 nt, Human
gcugugcugccc

SEQ ID NO: 1859852 - RNA, 21 nt, Human
gcugugcucuggacaggcaug

SEQ ID NO: 1859853 - RNA, 21 nt, Human
ggaccccgagccuggcuccaa

SEQ ID NO: 1859854 - RNA, 18 nt, Human
ggacccugaggcccagag

SEQ ID NO: 1859855 - RNA, 15 nt, Human
ggacccugaggccca

SEQ ID NO: 1859856 - RNA, 14 nt, Human
ggacccugaggccc

SEQ ID NO: 1859857 - RNA, 21 nt, Human
ggacccggaggggccuggcag

SEQ ID NO: 1859858 - RNA, 20 nt, Human
ggacccggaggggccuggca

SEQ ID NO: 1859859 - RNA, 19 nt, Human
ggacccugaggcccagagg

SEQ ID NO: 1859860 - RNA, 19 nt, Human
gcuuguacauaaugcgugc

SEQ ID NO: 1859861 - RNA, 15 nt, Human
ggagagcuagcagca

SEQ ID NO: 1859862 - RNA, 18 nt, Human
ggagagccuuccaggggu

SEQ ID NO: 1859863 - RNA, 17 nt, Human
ggagagccuuccagggg

SEQ ID NO: 1859864 - RNA, 22 nt, Human
ggagagccuuccagggguggga

SEQ ID NO: 1859865 - RNA, 16 nt, Human
ggagagccuuccaggg

SEQ ID NO: 1859866 - RNA, 13 nt, Human
ggagagccuucca

SEQ ID NO: 1859867 - RNA, 14 nt, Human
ggagagagacucca

SEQ ID NO: 1859868 - RNA, 23 nt, Human
ggacugugugcucaggagcccug

SEQ ID NO: 1859869 - RNA, 22 nt, Human
ggacugugugcucaggagcccu

SEQ ID NO: 1859870 - RNA, 17 nt, Human
ggacuuagcugggagaa

SEQ ID NO: 1859871 - RNA, 12 nt, Human
ggaccucaggcc

SEQ ID NO: 1859872 - RNA, 20 nt, Human
ggacuacaggugugagucac

SEQ ID NO: 1859873 - RNA, 16 nt, Human
ggacuaggguccuggg

SEQ ID NO: 1859874 - RNA, 22 nt, Human
ggacucaaugcacugacauugu

SEQ ID NO: 1859875 - RNA, 16 nt, Human
ggagacugucucaaga

SEQ ID NO: 1859876 - RNA, 13 nt, Human
ggagaacuagaga

SEQ ID NO: 1859877 - RNA, 22 nt, Human
ggagaaccaaaaagaggcuaug

SEQ ID NO: 1859878 - RNA, 18 nt, Human
ggagaaaugaaaaaauau

SEQ ID NO: 1859879 - RNA, 18 nt, Human
ggacuuuuauuuccagug

SEQ ID NO: 1859880 - RNA, 19 nt, Human
ggagaaaauggacguguua

SEQ ID NO: 1859881 - RNA, 15 nt, Human
ggacuuggaagcucc

SEQ ID NO: 1859882 - RNA, 17 nt, Human
ggacuuggaagcuccgc

SEQ ID NO: 1859883 - RNA, 15 nt, Human
ggagcccacuguacu

SEQ ID NO: 1859884 - RNA, 21 nt, Human
ggagcagccacauuccugaug

SEQ ID NO: 1859885 - RNA, 13 nt, Human
ggagcagccacau

SEQ ID NO: 1859886 - RNA, 18 nt, Human
ggaggucgaggcaggagg

SEQ ID NO: 1859887 - RNA, 15 nt, Human
ggaggcugagauggg

SEQ ID NO: 1859888 - RNA, 19 nt, Human
ggaggcugagaugggagaa

SEQ ID NO: 1859889 - RNA, 21 nt, Human
ggaggcucuggagcccacugu

SEQ ID NO: 1859890 - RNA, 16 nt, Human
ggaggucgaggcagga

SEQ ID NO: 1859891 - RNA, 15 nt, Human
ggaggucgaggcagg

SEQ ID NO: 1859892 - RNA, 22 nt, Human
ggagcccacuguacuugcucuu

SEQ ID NO: 1859893 - RNA, 18 nt, Human
ggagcccacuguacuugc

SEQ ID NO: 1859894 - RNA, 16 nt, Human
ggagcugaguggggga

SEQ ID NO: 1859895 - RNA, 22 nt, Human
ggagcugccuguucagcuccag

SEQ ID NO: 1859896 - RNA, 20 nt, Human
ggaggcucuggagcccacug

SEQ ID NO: 1859897 - RNA, 17 nt, Human
ggaggcucuggagccca

SEQ ID NO: 1859898 - RNA, 20 nt, Human
ggaggccaaggugggaggau

SEQ ID NO: 1859899 - RNA, 18 nt, Human
ggaggccaaggugggagg

SEQ ID NO: 1859900 - RNA, 13 nt, Human
ggaggccagccuu

SEQ ID NO: 1859901 - RNA, 21 nt, Human
ggaggcaugugaugagaggaa

SEQ ID NO: 1859902 - RNA, 20 nt, Human
ggaggaaaaccaagccgugg

SEQ ID NO: 1859903 - RNA, 22 nt, Human
ggaggaaaaccaagccguggcu

SEQ ID NO: 1859904 - RNA, 21 nt, Human
ggaggaaaaccaagccguggc

SEQ ID NO: 1859905 - RNA, 12 nt, Human
ggaggaagagaa

SEQ ID NO: 1859906 - RNA, 12 nt, Human
ggcauuguggga

SEQ ID NO: 1859907 - RNA, 21 nt, Human
ggccaaaggaagcacaugccu

SEQ ID NO: 1859908 - RNA, 13 nt, Human
ggccaaaggaagc

SEQ ID NO: 1859909 - RNA, 12 nt, Human
ggccaaaggaag

SEQ ID NO: 1859910 - RNA, 15 nt, Human
ggccaaagccaaagc

SEQ ID NO: 1859911 - RNA, 13 nt, Human
ggccaagguggga

SEQ ID NO: 1859912 - RNA, 21 nt, Human
ggccaaggaugccccgucccc

SEQ ID NO: 1859913 - RNA, 23 nt, Human
ggccagagggagugacagaggca

SEQ ID NO: 1859914 - RNA, 19 nt, Human
ggccagaugcaccagcccu

SEQ ID NO: 1859915 - RNA, 20 nt, Human
ggccagaugcaccagcccuu

SEQ ID NO: 1859916 - RNA, 19 nt, Human
ggccagguggccacuccag

SEQ ID NO: 1859917 - RNA, 17 nt, Human
ggcccgacagccuggca

SEQ ID NO: 1859918 - RNA, 16 nt, Human
ggcccgacagccuggc

SEQ ID NO: 1859919 - RNA, 15 nt, Human
ggcccgacagccugg

SEQ ID NO: 1859920 - RNA, 14 nt, Human
ggccucccaacuca

SEQ ID NO: 1859921 - RNA, 13 nt, Human
ggccucccaacuc

SEQ ID NO: 1859922 - RNA, 14 nt, Human
ggcccuuccuuuuc

SEQ ID NO: 1859923 - RNA, 13 nt, Human
ggccucccaaagu

SEQ ID NO: 1859924 - RNA, 22 nt, Human
ggcccuuccucuccacugccuu

SEQ ID NO: 1859925 - RNA, 19 nt, Human
ggcccuuccucuccacugc

SEQ ID NO: 1859926 - RNA, 18 nt, Human
ggcccuuccucuccacug

SEQ ID NO: 1859927 - RNA, 23 nt, Human
ggcccuuccucuccacugccuuc

SEQ ID NO: 1859928 - RNA, 12 nt, Human
ggcagaaggaag

SEQ ID NO: 1859929 - RNA, 17 nt, Human
ggcagccaggccacaag

SEQ ID NO: 1859930 - RNA, 15 nt, Human
ggcagccaggccaca

SEQ ID NO: 1859931 - RNA, 12 nt, Human
ggcagagcagag

SEQ ID NO: 1859932 - RNA, 10 nt, Human
ggcagagcag

SEQ ID NO: 1859933 - RNA, 18 nt, Human
ggcagccgugccuucagc

SEQ ID NO: 1859934 - RNA, 21 nt, Human
ggcagccgugccuucagcucu

SEQ ID NO: 1859935 - RNA, 19 nt, Human
ggcagccgugccuucagcu

SEQ ID NO: 1859936 - RNA, 22 nt, Human
ggcagccgugccuucagcucua

SEQ ID NO: 1859937 - RNA, 21 nt, Human
ggaugaauuccaaauucugcu

SEQ ID NO: 1859938 - RNA, 12 nt, Human
ggaugagaaagg

SEQ ID NO: 1859939 - RNA, 22 nt, Human
ggaugagaaagguugaagcacc

SEQ ID NO: 1859940 - RNA, 13 nt, Human
ggauguucuggga

SEQ ID NO: 1859941 - RNA, 21 nt, Human
ggauuuugauccaagcugguc

SEQ ID NO: 1859942 - RNA, 11 nt, Human
ggcaaaauaau

SEQ ID NO: 1859943 - RNA, 23 nt, Human
ggauuaaacuuaaucuaaaugga

SEQ ID NO: 1859944 - RNA, 20 nt, Human
aaaaagcuccaaaugcagcu

SEQ ID NO: 1859945 - RNA, 13 nt, Human
aaaaaaacacaaa

SEQ ID NO: 1859946 - RNA, 19 nt, Human
ggcuguaucccaugagccu

SEQ ID NO: 1859947 - RNA, 16 nt, Human
ggcuggugucaccuga

SEQ ID NO: 1859948 - RNA, 15 nt, Human
ggcuucaguggcagc

SEQ ID NO: 1859949 - RNA, 20 nt, Human
ggcuguaucccaugagccuc

SEQ ID NO: 1859950 - RNA, 22 nt, Human
ggcuguaucccaugagccucag

SEQ ID NO: 1859951 - RNA, 15 nt, Human
ggcugucaauuacag

SEQ ID NO: 1859952 - RNA, 23 nt, Human
ggcuguaucccaugagccucagc

SEQ ID NO: 1859953 - RNA, 16 nt, Human
ggcuucaguggcagcu

SEQ ID NO: 1859954 - RNA, 13 nt, Human
gggaaaaucagcc

SEQ ID NO: 1859955 - RNA, 23 nt, Human
gggaaaaucagccugcuccagcu

SEQ ID NO: 1859956 - RNA, 13 nt, Human
ggcugggagagcc

SEQ ID NO: 1859957 - RNA, 22 nt, Human
ggcuggccuggccccucagggu

SEQ ID NO: 1859958 - RNA, 17 nt, Human
ggcuggccuggccccuc

SEQ ID NO: 1859959 - RNA, 15 nt, Human
ggcuggcccugcccu

SEQ ID NO: 1859960 - RNA, 14 nt, Human
ggcuggcccugccc

SEQ ID NO: 1859961 - RNA, 13 nt, Human
ggcuggcccugcc

SEQ ID NO: 1859962 - RNA, 16 nt, Human
ggcuggcccugcccug

SEQ ID NO: 1859963 - RNA, 14 nt, Human
ggcuggcgugcagu

SEQ ID NO: 1859964 - RNA, 16 nt, Human
ggcuggcgugcagugg

SEQ ID NO: 1859965 - RNA, 20 nt, Human
ggcuggcgugcaguggugcg

SEQ ID NO: 1859966 - RNA, 22 nt, Human
ggcugccaucucaccuccugcu

SEQ ID NO: 1859967 - RNA, 21 nt, Human
ggcugccaucucaccuccugc

SEQ ID NO: 1859968 - RNA, 23 nt, Human
ggcugccaucucaccuccugcug

SEQ ID NO: 1859969 - RNA, 16 nt, Human
ggcucccuucccaccu

SEQ ID NO: 1859970 - RNA, 18 nt, Human
ggcucccuucccaccucu

SEQ ID NO: 1859971 - RNA, 17 nt, Human
ggcucccuucccaccuc

SEQ ID NO: 1859972 - RNA, 22 nt, Human
ggcucccuucccaccucucuca

SEQ ID NO: 1859973 - RNA, 20 nt, Human
ggcucccuucccaccucucu

SEQ ID NO: 1859974 - RNA, 17 nt, Human
ggcuccucccggugccc

SEQ ID NO: 1859975 - RNA, 13 nt, Human
ggcuccugccacc

SEQ ID NO: 1859976 - RNA, 12 nt, Human
ggcuccugccac

SEQ ID NO: 1859977 - RNA, 20 nt, Human
ggcucuuccaggcugggaga

SEQ ID NO: 1859978 - RNA, 24 nt, Human
ggcucuuccaggcugggagagccu

SEQ ID NO: 1859979 - RNA, 23 nt, Human
ggcucuuccaggcugggagagcc

SEQ ID NO: 1859980 - RNA, 18 nt, Human
ggcucgagcaugccugga

SEQ ID NO: 1859981 - RNA, 20 nt, Human
ggcugcaugcgggcuuccuc

SEQ ID NO: 1859982 - RNA, 22 nt, Human
ggcugcaugcgggcuuccuccu

SEQ ID NO: 1859983 - RNA, 17 nt, Human
ggcugcagggaguccga

SEQ ID NO: 1859984 - RNA, 12 nt, Human
aaaauagccugc

SEQ ID NO: 1859985 - RNA, 18 nt, Human
aaaauaguggugugauuu

SEQ ID NO: 1859986 - RNA, 18 nt, Human
aaaauauauaucaaauau

SEQ ID NO: 1859987 - RNA, 12 nt, Human
aaaauaaauuau

SEQ ID NO: 1859988 - RNA, 14 nt, Human
aaaauaccagccag

SEQ ID NO: 1859989 - RNA, 14 nt, Human
aaaauaccaaggaa

SEQ ID NO: 1859990 - RNA, 15 nt, Human
aaaauaccagccagu

SEQ ID NO: 1859991 - RNA, 16 nt, Human
aaaagggacugagaaa

SEQ ID NO: 1859992 - RNA, 18 nt, Human
aaaagggaacugaacauu

SEQ ID NO: 1859993 - RNA, 15 nt, Human
gggauuuccaugaug

SEQ ID NO: 1859994 - RNA, 20 nt, Human
gggaggcagagguugcagug

SEQ ID NO: 1859995 - RNA, 19 nt, Human
gggaggccaaggugggagg

SEQ ID NO: 1859996 - RNA, 13 nt, Human
gggagggcuccag

SEQ ID NO: 1859997 - RNA, 11 nt, Human
gggagggcucc

SEQ ID NO: 1859998 - RNA, 13 nt, Human
gggagggccuggg

SEQ ID NO: 1859999 - RNA, 11 nt, Human
gggaggcagag

SEQ ID NO: 1860000 - RNA, 21 nt, Human
aaaacuuuaugcuaagugaaa

SEQ ID NO: 1860001 - RNA, 18 nt, Human
aaaagccuguuuaagaga

SEQ ID NO: 1860002 - RNA, 16 nt, Human
aaaagccuguuuaaga

SEQ ID NO: 1860003 - RNA, 14 nt, Human
aaaagcugggcagg

SEQ ID NO: 1860004 - RNA, 22 nt, Human
aaaagcuccauuuuuagugaaa

SEQ ID NO: 1860005 - RNA, 15 nt, Human
aaaaccaauguucuc

SEQ ID NO: 1860006 - RNA, 18 nt, Human
aaaacguggcugcuucaa

SEQ ID NO: 1860007 - RNA, 17 nt, Human
aaaacguggcugcuuca

SEQ ID NO: 1860008 - RNA, 16 nt, Human
aaaacguggcugcuuc

SEQ ID NO: 1860009 - RNA, 14 nt, Human
aaaacguggcugcu

SEQ ID NO: 1860010 - RNA, 21 nt, Human
aaaacguggcugcuucaagga

SEQ ID NO: 1860011 - RNA, 19 nt, Human
aaaaccaagccguggcuuc

SEQ ID NO: 1860012 - RNA, 22 nt, Human
aaaacugauuuuuuuuuccuuc

SEQ ID NO: 1860013 - RNA, 18 nt, Human
aaaacugauuuuuuuuuc

SEQ ID NO: 1860014 - RNA, 20 nt, Human
aaaacugcugacuguuuucu

SEQ ID NO: 1860015 - RNA, 19 nt, Human
aaaacugcucauaugaugu

SEQ ID NO: 1860016 - RNA, 14 nt, Human
gggaacagacugga

SEQ ID NO: 1860017 - RNA, 19 nt, Human
aaaaaucucaaauuucuaa

SEQ ID NO: 1860018 - RNA, 20 nt, Human
aaaaaucucaaauuucuaaa

SEQ ID NO: 1860019 - RNA, 22 nt, Human
gggaacagacuggaagcacagc

SEQ ID NO: 1860020 - RNA, 20 nt, Human
ggguaucaggugcugccauc

SEQ ID NO: 1860021 - RNA, 14 nt, Human
aaaccaagccgugg

SEQ ID NO: 1860022 - RNA, 23 nt, Human
aaacauguuucuuuguaaugaaa

SEQ ID NO: 1860023 - RNA, 22 nt, Human
aaacauguuucuuuguaaugaa

SEQ ID NO: 1860024 - RNA, 19 nt, Human
aaacauguuucuuuguaau

SEQ ID NO: 1860025 - RNA, 22 nt, Human
gggucucacuauguugcccagg

SEQ ID NO: 1860026 - RNA, 12 nt, Human
gggucucacucu

SEQ ID NO: 1860027 - RNA, 23 nt, Human
gggucucacuauguugcccaggc

SEQ ID NO: 1860028 - RNA, 16 nt, Human
aaacuggauuaaacuu

SEQ ID NO: 1860029 - RNA, 21 nt, Human
aaacugcccccucugcccugc

SEQ ID NO: 1860030 - RNA, 20 nt, Human
aaacugcccccucugcccug

SEQ ID NO: 1860031 - RNA, 19 nt, Human
aaacugcccccucugcccu

SEQ ID NO: 1860032 - RNA, 17 nt, Human
aaacugcccccucugcc

SEQ ID NO: 1860033 - RNA, 13 nt, Human
aaacugcccccuc

SEQ ID NO: 1860034 - RNA, 11 nt, Human
aaacugccccc

SEQ ID NO: 1860035 - RNA, 12 nt, Human
aaacugcccccu

SEQ ID NO: 1860036 - RNA, 11 nt, Human
aaacuccugac

SEQ ID NO: 1860037 - RNA, 20 nt, Human
aaacguggcugcuucaagga

SEQ ID NO: 1860038 - RNA, 17 nt, Human
aaacguggcugcuucaa

SEQ ID NO: 1860039 - RNA, 16 nt, Human
aaacguggcugcuuca

SEQ ID NO: 1860040 - RNA, 12 nt, Human
aaacgugaaaau

SEQ ID NO: 1860041 - RNA, 21 nt, Human
aaaccacauuggagauguuua

SEQ ID NO: 1860042 - RNA, 23 nt, Human
aaacggccucacuaggcuucugg

SEQ ID NO: 1860043 - RNA, 23 nt, Human
ggggcccugccuccuuugugagg

SEQ ID NO: 1860044 - RNA, 19 nt, Human
ggggcccugccuccuuugu

SEQ ID NO: 1860045 - RNA, 16 nt, Human
ggggcccugccuccuu

SEQ ID NO: 1860046 - RNA, 19 nt, Human
ggggccaguuggucccccu

SEQ ID NO: 1860047 - RNA, 17 nt, Human
ggggccaguuggucccc

SEQ ID NO: 1860048 - RNA, 16 nt, Human
ggggccaggcuggguc

SEQ ID NO: 1860049 - RNA, 14 nt, Human
ggggccaggcuggg

SEQ ID NO: 1860050 - RNA, 13 nt, Human
ggggccaggcugg

SEQ ID NO: 1860051 - RNA, 17 nt, Human
ggggaccucaggccugg

SEQ ID NO: 1860052 - RNA, 16 nt, Human
ggggaccucaggccug

SEQ ID NO: 1860053 - RNA, 15 nt, Human
ggggaccucaggccu

SEQ ID NO: 1860054 - RNA, 13 nt, Human
ggggaccucaggc

SEQ ID NO: 1860055 - RNA, 16 nt, Human
aaacaugcuacacacu

SEQ ID NO: 1860056 - RNA, 22 nt, Human
aaacaugcuacacacugcaugu

SEQ ID NO: 1860057 - RNA, 13 nt, Human
aaacaaagaaauu

SEQ ID NO: 1860058 - RNA, 18 nt, Human
aaacaagaccacguuucu

SEQ ID NO: 1860059 - RNA, 19 nt, Human
aaaauuuuuaaucuuuaau

SEQ ID NO: 1860060 - RNA, 16 nt, Human
aaaauuuuuaaucuuu

SEQ ID NO: 1860061 - RNA, 15 nt, Human
aaaauuuuuaaucuu

SEQ ID NO: 1860062 - RNA, 21 nt, Human
aaaauggacguguuaugacuc

SEQ ID NO: 1860063 - RNA, 21 nt, Human
aaaauguaggguuauaauaau

SEQ ID NO: 1860064 - RNA, 18 nt, Human
gguauaaguggugugugu

SEQ ID NO: 1860065 - RNA, 19 nt, Human
gguccacccaggagccccg

SEQ ID NO: 1860066 - RNA, 23 nt, Human
gguauuggcuagagguucaaaga

SEQ ID NO: 1860067 - RNA, 14 nt, Human
aaacuuuaccuuuu

SEQ ID NO: 1860068 - RNA, 12 nt, Human
ggucccacccca

SEQ ID NO: 1860069 - RNA, 20 nt, Human
gguccacccaggagccccga

SEQ ID NO: 1860070 - RNA, 22 nt, Human
gguccacccaggagccccgagg

SEQ ID NO: 1860071 - RNA, 18 nt, Human
aaagaggcuaugugagca

SEQ ID NO: 1860072 - RNA, 13 nt, Human
aaagaggcuaugu

SEQ ID NO: 1860073 - RNA, 15 nt, Human
aaagaugagugagca

SEQ ID NO: 1860074 - RNA, 19 nt, Human
aaagacuuuuccaacccuc

SEQ ID NO: 1860075 - RNA, 15 nt, Human
aaagacuguacaaag

SEQ ID NO: 1860076 - RNA, 17 nt, Human
aaagaauggaaggugga

SEQ ID NO: 1860077 - RNA, 21 nt, Human
ggugauccacucgccuucauc

SEQ ID NO: 1860078 - RNA, 22 nt, Human
ggugcacaagcuccaagcuccc

SEQ ID NO: 1860079 - RNA, 16 nt, Human
ggugcacaagcuccaa

SEQ ID NO: 1860080 - RNA, 14 nt, Human
ggucugugagaugc

SEQ ID NO: 1860081 - RNA, 24 nt, Human
ggucugugagaugcuagaacuccc

SEQ ID NO: 1860082 - RNA, 12 nt, Human
ggucuguucuuu

SEQ ID NO: 1860083 - RNA, 17 nt, Human
ggucuguucuuuccaaa

SEQ ID NO: 1860084 - RNA, 19 nt, Human
ggucuguucuuuccaaagu

SEQ ID NO: 1860085 - RNA, 21 nt, Human
ggucuugaacuccuggccuca

SEQ ID NO: 1860086 - RNA, 22 nt, Human
ggucuugaacuccuggccucaa

SEQ ID NO: 1860087 - RNA, 22 nt, Human
aaagcagugcaugcugucccuu

SEQ ID NO: 1860088 - RNA, 21 nt, Human
aaagcagugcaugcugucccu

SEQ ID NO: 1860089 - RNA, 13 nt, Human
aaagcuagaaaug

SEQ ID NO: 1860090 - RNA, 18 nt, Human
aaagcuaggccuggccag

SEQ ID NO: 1860091 - RNA, 17 nt, Human
aaagcagugcaugcugu

SEQ ID NO: 1860092 - RNA, 11 nt, Human
aaaggaaagag

SEQ ID NO: 1860093 - RNA, 13 nt, Human
aaaggaauuuaaa

SEQ ID NO: 1860094 - RNA, 16 nt, Human
gacgcucucuggccuu

SEQ ID NO: 1860095 - RNA, 17 nt, Human
gacgcucucuggccuuc

SEQ ID NO: 1860096 - RNA, 15 nt, Human
gacgcucucuggccu

SEQ ID NO: 1860097 - RNA, 19 nt, Human
gacgcuacccgggaagggg

SEQ ID NO: 1860098 - RNA, 18 nt, Human
gacgcuacccgggaaggg

SEQ ID NO: 1860099 - RNA, 16 nt, Human
gacgcuacccgggaag

SEQ ID NO: 1860100 - RNA, 18 nt, Human
gacgccaucccagcccca

SEQ ID NO: 1860101 - RNA, 17 nt, Human
gacgccaucccagcccc

SEQ ID NO: 1860102 - RNA, 19 nt, Human
gacgccaucccagccccaa

SEQ ID NO: 1860103 - RNA, 16 nt, Human
gacgccaucccagccc

SEQ ID NO: 1860104 - RNA, 14 nt, Human
gaccugaggcccuu

SEQ ID NO: 1860105 - RNA, 13 nt, Human
gaccugaggcccu

SEQ ID NO: 1860106 - RNA, 11 nt, Human
gaccugaggcc

SEQ ID NO: 1860107 - RNA, 14 nt, Human
gaccucugcagcaa

SEQ ID NO: 1860108 - RNA, 20 nt, Human
gaccaucccugaaggccccg

SEQ ID NO: 1860109 - RNA, 22 nt, Human
gacucaccucccccaucucuuc

SEQ ID NO: 1860110 - RNA, 15 nt, Human
gacucaccuccccca

SEQ ID NO: 1860111 - RNA, 16 nt, Human
gacucugccuccucuu

SEQ ID NO: 1860112 - RNA, 12 nt, Human
gacucugccucc

SEQ ID NO: 1860113 - RNA, 19 nt, Human
gacucugucucaaaaaaac

SEQ ID NO: 1860114 - RNA, 14 nt, Human
gacugaauuucuuu

SEQ ID NO: 1860115 - RNA, 23 nt, Human
gacuguacuccucccaggcgccc

SEQ ID NO: 1860116 - RNA, 18 nt, Human
gacuguacuccucccagg

SEQ ID NO: 1860117 - RNA, 11 nt, Human
gacuguagaaa

SEQ ID NO: 1860118 - RNA, 22 nt, Human
gacugugugcucaggagcccug

SEQ ID NO: 1860119 - RNA, 14 nt, Human
gacacagcucuucu

SEQ ID NO: 1860120 - RNA, 16 nt, Human
gacacagcucuucucc

SEQ ID NO: 1860121 - RNA, 13 nt, Human
gacacagcucuuc

SEQ ID NO: 1860122 - RNA, 17 nt, Human
gacacagcucuucucca

SEQ ID NO: 1860123 - RNA, 22 nt, Human
gacacagcucuucuccaggcug

SEQ ID NO: 1860124 - RNA, 23 nt, Human
gacacagcucuucuccaggcugu

SEQ ID NO: 1860125 - RNA, 12 nt, Human
gacacaggcccg

SEQ ID NO: 1860126 - RNA, 21 nt, Human
gacagaaagcagaacagugau

SEQ ID NO: 1860127 - RNA, 17 nt, Human
gacagcccgggcucugc

SEQ ID NO: 1860128 - RNA, 15 nt, Human
gacagaagcagcucu

SEQ ID NO: 1860129 - RNA, 19 nt, Human
gacauuguuggccaaagcc

SEQ ID NO: 1860130 - RNA, 19 nt, Human
gacagcccgggcucugccu

SEQ ID NO: 1860131 - RNA, 18 nt, Human
gacagcccgggcucugcc

SEQ ID NO: 1860132 - RNA, 20 nt, Human
gacagcccgggcucugccuc

SEQ ID NO: 1860133 - RNA, 16 nt, Human
gacagaagcagcucuu

SEQ ID NO: 1860134 - RNA, 21 nt, Human
gacagugagacucugucucag

SEQ ID NO: 1860135 - RNA, 14 nt, Human
gacauugcggacag

SEQ ID NO: 1860136 - RNA, 15 nt, Human
gacauugcggacagc

SEQ ID NO: 1860137 - RNA, 18 nt, Human
gaccagggauuuccauga

SEQ ID NO: 1860138 - RNA, 19 nt, Human
gaccaucccugaaggcccc

SEQ ID NO: 1860139 - RNA, 18 nt, Human
gaccaucccugaaggccc

SEQ ID NO: 1860140 - RNA, 13 nt, Human
gaccaucccugaa

SEQ ID NO: 1860141 - RNA, 12 nt, Human
gaccaucccuga

SEQ ID NO: 1860142 - RNA, 20 nt, Human
gaccagggauuuccaugaug

SEQ ID NO: 1860143 - RNA, 13 nt, Human
gaccauacuaauu

SEQ ID NO: 1860144 - RNA, 20 nt, Human
gaauauugcugauggugcaa

SEQ ID NO: 1860145 - RNA, 19 nt, Human
gaauauugcugauggugca

SEQ ID NO: 1860146 - RNA, 20 nt, Human
gaauauuagugaccucagcu

SEQ ID NO: 1860147 - RNA, 15 nt, Human
gaauauugcugaugg

SEQ ID NO: 1860148 - RNA, 14 nt, Human
gaauauugcugaug

SEQ ID NO: 1860149 - RNA, 18 nt, Human
gaaguuuaauugacuuau

SEQ ID NO: 1860150 - RNA, 22 nt, Human
gaaggggagauaaggguaucug

SEQ ID NO: 1860151 - RNA, 20 nt, Human
gaagcuaucguaaaauuaag

SEQ ID NO: 1860152 - RNA, 19 nt, Human
gaagcuccgcuuucuaccc

SEQ ID NO: 1860153 - RNA, 17 nt, Human
gaaggccccgcccaggc

SEQ ID NO: 1860154 - RNA, 22 nt, Human
gaagcuccgcuuucuacccagc

SEQ ID NO: 1860155 - RNA, 21 nt, Human
gaagggcuuggacucaagcaa

SEQ ID NO: 1860156 - RNA, 22 nt, Human
gaaggcuggguucugauccuag

SEQ ID NO: 1860157 - RNA, 20 nt, Human
gaaggcuggguucugauccu

SEQ ID NO: 1860158 - RNA, 19 nt, Human
gaaggccccgcccaggcuu

SEQ ID NO: 1860159 - RNA, 18 nt, Human
gaaggccccgcccaggcu

SEQ ID NO: 1860160 - RNA, 21 nt, Human
gaaggcucgagcaugccugga

SEQ ID NO: 1860161 - RNA, 19 nt, Human
gaaggcuggguucugaucc

SEQ ID NO: 1860162 - RNA, 15 nt, Human
gaaggcuggguucug

SEQ ID NO: 1860163 - RNA, 20 nt, Human
gaacucugacaacagacuuc

SEQ ID NO: 1860164 - RNA, 11 nt, Human
gaacuggcugc

SEQ ID NO: 1860165 - RNA, 12 nt, Human
gaacuggcugca

SEQ ID NO: 1860166 - RNA, 15 nt, Human
gaagcagaggaagga

SEQ ID NO: 1860167 - RNA, 21 nt, Human
gaagcacaugccucucucagg

SEQ ID NO: 1860168 - RNA, 16 nt, Human
gaagacaaugacuuac

SEQ ID NO: 1860169 - RNA, 23 nt, Human
gaagacaaugugaaaagaaaaau

SEQ ID NO: 1860170 - RNA, 22 nt, Human
gaagacaaugacuuacuguaca

SEQ ID NO: 1860171 - RNA, 23 nt, Human
gaagcaacccaaauguucaucaa

SEQ ID NO: 1860172 - RNA, 20 nt, Human
gaagcaaugcuucaucccuu

SEQ ID NO: 1860173 - RNA, 20 nt, Human
gaagcacaugccucucucag

SEQ ID NO: 1860174 - RNA, 17 nt, Human
gaagcacaugccucucu

SEQ ID NO: 1860175 - RNA, 15 nt, Human
gaagcacaugccucu

SEQ ID NO: 1860176 - RNA, 12 nt, Human
gaggggccucuu

SEQ ID NO: 1860177 - RNA, 19 nt, Human
gaggcuccacuuggucugu

SEQ ID NO: 1860178 - RNA, 18 nt, Human
gaggcuccacuuggucug

SEQ ID NO: 1860179 - RNA, 18 nt, Human
gaggcuacuguaaggcaa

SEQ ID NO: 1860180 - RNA, 12 nt, Human
gaggcuccacuu

SEQ ID NO: 1860181 - RNA, 23 nt, Human
gaggcuccacuuggucugugaga

SEQ ID NO: 1860182 - RNA, 22 nt, Human
gaggcuagugugguguuuccug

SEQ ID NO: 1860183 - RNA, 19 nt, Human
gaggccagagacacaagcc

SEQ ID NO: 1860184 - RNA, 14 nt, Human
gaggccagagacac

SEQ ID NO: 1860185 - RNA, 13 nt, Human
gaggccagagaca

SEQ ID NO: 1860186 - RNA, 17 nt, Human
gaggcaucgcaauguaa

SEQ ID NO: 1860187 - RNA, 15 nt, Human
gaggacgcucucugg

SEQ ID NO: 1860188 - RNA, 14 nt, Human
gaggcagggucuca

SEQ ID NO: 1860189 - RNA, 22 nt, Human
gaggccaaggugggaggauugc

SEQ ID NO: 1860190 - RNA, 17 nt, Human
gaggccaaggugggagg

SEQ ID NO: 1860191 - RNA, 15 nt, Human
gaggcagggucucac

SEQ ID NO: 1860192 - RNA, 20 nt, Human
gagccuuccaggggugggac

SEQ ID NO: 1860193 - RNA, 23 nt, Human
gagccuuccaggggugggacacc

SEQ ID NO: 1860194 - RNA, 13 nt, Human
gagccuugaacuu

SEQ ID NO: 1860195 - RNA, 21 nt, Human
gagcgcccacuagacccacug

SEQ ID NO: 1860196 - RNA, 15 nt, Human
gaggucgaggcagga

SEQ ID NO: 1860197 - RNA, 23 nt, Human
gaggugaccccagguuucuaugu

SEQ ID NO: 1860198 - RNA, 17 nt, Human
gagucaccaagcccagu

SEQ ID NO: 1860199 - RNA, 16 nt, Human
gagucaccaagcccag

SEQ ID NO: 1860200 - RNA, 22 nt, Human
gagucagaaguuucugccgcag

SEQ ID NO: 1860201 - RNA, 12 nt, Human
gagucccaccuu

SEQ ID NO: 1860202 - RNA, 13 nt, Human
gagucccaccuug

SEQ ID NO: 1860203 - RNA, 18 nt, Human
gagugacagaggcagccc

SEQ ID NO: 1860204 - RNA, 17 nt, Human
gaguugauucagcucug

SEQ ID NO: 1860205 - RNA, 16 nt, Human
gaguugauucagcucu

SEQ ID NO: 1860206 - RNA, 15 nt, Human
gaguugauucagcuc

SEQ ID NO: 1860207 - RNA, 19 nt, Human
gagugcaaugacacagucu

SEQ ID NO: 1860208 - RNA, 20 nt, Human
gagugacagaggcagcccca

SEQ ID NO: 1860209 - RNA, 16 nt, Human
gaguuuaaauuguaau

SEQ ID NO: 1860210 - RNA, 22 nt, Human
gaguuguuacauuuuuaagugc

SEQ ID NO: 1860211 - RNA, 18 nt, Human
gaguugauucagcucugc

SEQ ID NO: 1860212 - RNA, 16 nt, Human
gaugagugagcaugcc

SEQ ID NO: 1860213 - RNA, 21 nt, Human
gaugaucuaggaagacuuugg

SEQ ID NO: 1860214 - RNA, 15 nt, Human
gaugaucuaggaaga

SEQ ID NO: 1860215 - RNA, 17 nt, Human
gauguagaggagaaacu

SEQ ID NO: 1860216 - RNA, 18 nt, Human
gauguagaggagaaacug

SEQ ID NO: 1860217 - RNA, 18 nt, Human
gauguaaaagacuuuuuu

SEQ ID NO: 1860218 - RNA, 12 nt, Human
gauuauuggaaa

SEQ ID NO: 1860219 - RNA, 20 nt, Human
gauuauaggcaccuaccacc

SEQ ID NO: 1860220 - RNA, 14 nt, Human
gauuauauuaugaa

SEQ ID NO: 1860221 - RNA, 20 nt, Human
gauguauguugaagccuuug

SEQ ID NO: 1860222 - RNA, 21 nt, Human
gauguauguugaagccuuugu

SEQ ID NO: 1860223 - RNA, 18 nt, Human
gauucuccugccucagcc

SEQ ID NO: 1860224 - RNA, 15 nt, Human
gauucuccugccuca

SEQ ID NO: 1860225 - RNA, 17 nt, Human
gauucuccugccucagc

SEQ ID NO: 1860226 - RNA, 20 nt, Human
gauuuuuuacagcugccugc

SEQ ID NO: 1860227 - RNA, 18 nt, Human
gauucuuccucccucccu

SEQ ID NO: 1860228 - RNA, 17 nt, Human
gauucuuccucccuccc

SEQ ID NO: 1860229 - RNA, 22 nt, Human
gcacuccccugcuggguguggc

SEQ ID NO: 1860230 - RNA, 13 nt, Human
gcacucagaagac

SEQ ID NO: 1860231 - RNA, 16 nt, Human
gcacucagaagacacu

SEQ ID NO: 1860232 - RNA, 17 nt, Human
gcacuccccugcugggu

SEQ ID NO: 1860233 - RNA, 17 nt, Human
gcacucagaagacacug

SEQ ID NO: 1860234 - RNA, 21 nt, Human
gcaccuaccaccacgcccggc

SEQ ID NO: 1860235 - RNA, 22 nt, Human
gcaccuaccaccacgcccggcu

SEQ ID NO: 1860236 - RNA, 23 nt, Human
gcaccgggccacagagaaaguac

SEQ ID NO: 1860237 - RNA, 22 nt, Human
gcacaucagcacgauuucuguu

SEQ ID NO: 1860238 - RNA, 23 nt, Human
gcacaucagcacgauuucuguuu

SEQ ID NO: 1860239 - RNA, 14 nt, Human
gcaccgggccacag

SEQ ID NO: 1860240 - RNA, 18 nt, Human
gcaagucagaauagaaau

SEQ ID NO: 1860241 - RNA, 21 nt, Human
gcacagugcaucucagcccac

SEQ ID NO: 1860242 - RNA, 20 nt, Human
gcacagugcaucucagccca

SEQ ID NO: 1860243 - RNA, 19 nt, Human
gcacagugcaucucagccc

SEQ ID NO: 1860244 - RNA, 20 nt, Human
gcacaccgggcacucagaag

SEQ ID NO: 1860245 - RNA, 22 nt, Human
gcacaagcugcacccucaggca

SEQ ID NO: 1860246 - RNA, 14 nt, Human
gcacacauuuuuua

SEQ ID NO: 1860247 - RNA, 14 nt, Human
gcacaccgggcacu

SEQ ID NO: 1860248 - RNA, 13 nt, Human
cuugcucugcuga

SEQ ID NO: 1860249 - RNA, 12 nt, Human
cuugcucugcug

SEQ ID NO: 1860250 - RNA, 23 nt, Human
cuugaaugaugccaugaggaaca

SEQ ID NO: 1860251 - RNA, 23 nt, Human
cuugccgucuaccugaggggccu

SEQ ID NO: 1860252 - RNA, 20 nt, Human
cuugccgucuaccugagggg

SEQ ID NO: 1860253 - RNA, 12 nt, Human
cuugacagggca

SEQ ID NO: 1860254 - RNA, 20 nt, Human
cuugaaugaugccaugagga

SEQ ID NO: 1860255 - RNA, 21 nt, Human
cuucuucagagacuccugcag

SEQ ID NO: 1860256 - RNA, 20 nt, Human
cuucuucagagacuccugca

SEQ ID NO: 1860257 - RNA, 22 nt, Human
cuucuucagagacuccugcagg

SEQ ID NO: 1860258 - RNA, 22 nt, Human
cuuucggggagaggcugaggac

SEQ ID NO: 1860259 - RNA, 17 nt, Human
cuuucuaaugugugaau

SEQ ID NO: 1860260 - RNA, 22 nt, Human
cuuugacgccaucccagcccca

SEQ ID NO: 1860261 - RNA, 21 nt, Human
cuuugacgccaucccagcccc

SEQ ID NO: 1860262 - RNA, 19 nt, Human
cuuugacgccaucccagcc

SEQ ID NO: 1860263 - RNA, 18 nt, Human
cuuugacgccaucccagc

SEQ ID NO: 1860264 - RNA, 16 nt, Human
cuuugagcuuaagaau

SEQ ID NO: 1860265 - RNA, 15 nt, Human
cuuuucaaaacauuu

SEQ ID NO: 1860266 - RNA, 19 nt, Human
cuuuuauuuagcaccaggg

SEQ ID NO: 1860267 - RNA, 19 nt, Human
cuuuuauaaacuuuaccuu

SEQ ID NO: 1860268 - RNA, 16 nt, Human
cuuuuauaaacuuuac

SEQ ID NO: 1860269 - RNA, 18 nt, Human
cuuuuauaaacuuuaccu

SEQ ID NO: 1860270 - RNA, 15 nt, Human
cuuuuauaaacuuua

SEQ ID NO: 1860271 - RNA, 18 nt, Human
cuuuuaggccaaaaaaau

SEQ ID NO: 1860272 - RNA, 16 nt, Human
cuuuuaggccaaaaaa

SEQ ID NO: 1860273 - RNA, 16 nt, Human
cuuuggucuacacugu

SEQ ID NO: 1860274 - RNA, 20 nt, Human
cuuuggucuacacugugcug

SEQ ID NO: 1860275 - RNA, 15 nt, Human
cuuuggugaacauug

SEQ ID NO: 1860276 - RNA, 16 nt, Human
cuuguggacacagcuc

SEQ ID NO: 1860277 - RNA, 15 nt, Human
cuuuaaaugcugcuu

SEQ ID NO: 1860278 - RNA, 14 nt, Human
cuuuaaaugcugcu

SEQ ID NO: 1860279 - RNA, 14 nt, Human
cuuguggacacagc

SEQ ID NO: 1860280 - RNA, 15 nt, Human
cuuguggacacagcu

SEQ ID NO: 1860281 - RNA, 13 nt, Human
cuuguggacacag

SEQ ID NO: 1860282 - RNA, 22 nt, Human
cuuucaauaggaaaaacugauu

SEQ ID NO: 1860283 - RNA, 21 nt, Human
cuuucaauaggaaaaacugau

SEQ ID NO: 1860284 - RNA, 20 nt, Human
cuuucaauaggaaaaacuga

SEQ ID NO: 1860285 - RNA, 17 nt, Human
cugugacuucagcucug

SEQ ID NO: 1860286 - RNA, 22 nt, Human
cugugacuucagcucuguuuua

SEQ ID NO: 1860287 - RNA, 22 nt, Human
cugugcugagucugaaggcugg

SEQ ID NO: 1860288 - RNA, 20 nt, Human
cugugcugagucugaaggcu

SEQ ID NO: 1860289 - RNA, 11 nt, Human
cugugcugccc

SEQ ID NO: 1860290 - RNA, 21 nt, Human
cugugucagguggggcagcuu

SEQ ID NO: 1860291 - RNA, 20 nt, Human
cugugucagcauagaaguaa

SEQ ID NO: 1860292 - RNA, 19 nt, Human
cugugucagguggggcagc

SEQ ID NO: 1860293 - RNA, 19 nt, Human
cugugucucccuucauccu

SEQ ID NO: 1860294 - RNA, 14 nt, Human
cugugucucccuuc

SEQ ID NO: 1860295 - RNA, 14 nt, Human
cugugucuugcaau

SEQ ID NO: 1860296 - RNA, 13 nt, Human
cuguucagcucca

SEQ ID NO: 1860297 - RNA, 14 nt, Human
cuguucagcuccag

SEQ ID NO: 1860298 - RNA, 15 nt, Human
cuguucacucuacuu

SEQ ID NO: 1860299 - RNA, 20 nt, Human
cugugucuugcaauggcagc

SEQ ID NO: 1860300 - RNA, 16 nt, Human
cugugucuugcaaugg

SEQ ID NO: 1860301 - RNA, 19 nt, Human
cugugucuugcaauggcag

SEQ ID NO: 1860302 - RNA, 14 nt, Human
cuguugcugccuca

SEQ ID NO: 1860303 - RNA, 17 nt, Human
cuguugcugccucaugc

SEQ ID NO: 1860304 - RNA, 16 nt, Human
cuguugcugccucaug

SEQ ID NO: 1860305 - RNA, 15 nt, Human
cuguugcugccucau

SEQ ID NO: 1860306 - RNA, 20 nt, Human
cuguugggccaggagccucc

SEQ ID NO: 1860307 - RNA, 17 nt, Human
cuguugggccaggagcc

SEQ ID NO: 1860308 - RNA, 16 nt, Human
cuguugggccaggagc

SEQ ID NO: 1860309 - RNA, 20 nt, Human
cuuaaaauauuccugcauuu

SEQ ID NO: 1860310 - RNA, 18 nt, Human
cuuaaaauauuccugcau

SEQ ID NO: 1860311 - RNA, 13 nt, Human
cuuacacaauggu

SEQ ID NO: 1860312 - RNA, 15 nt, Human
cuuaaagaguguggc

SEQ ID NO: 1860313 - RNA, 21 nt, Human
cuuaaagaguguggcaaaaua

SEQ ID NO: 1860314 - RNA, 17 nt, Human
cuuacccucauguucuu

SEQ ID NO: 1860315 - RNA, 18 nt, Human
cuuacccucauguucuua

SEQ ID NO: 1860316 - RNA, 19 nt, Human
cuuacccucauguucuuaa

SEQ ID NO: 1860317 - RNA, 13 nt, Human
cuuaccucggugc

SEQ ID NO: 1860318 - RNA, 13 nt, Human
cuuaccugccagg

SEQ ID NO: 1860319 - RNA, 21 nt, Human
cuuaccucggugccuuccucu

SEQ ID NO: 1860320 - RNA, 19 nt, Human
cuuaccucggugccuuccu

SEQ ID NO: 1860321 - RNA, 18 nt, Human
cuuagcagggaaacagcu

SEQ ID NO: 1860322 - RNA, 21 nt, Human
cuuagcagggaaacagcuaau

SEQ ID NO: 1860323 - RNA, 21 nt, Human
cuuaugggcuggguucuaccc

SEQ ID NO: 1860324 - RNA, 14 nt, Human
cuuaugggcugggu

SEQ ID NO: 1860325 - RNA, 23 nt, Human
cuuaugggcuggguucuacccag

SEQ ID NO: 1860326 - RNA, 22 nt, Human
cuuaugggcuggguucuaccca

SEQ ID NO: 1860327 - RNA, 12 nt, Human
cuuauugcccac

SEQ ID NO: 1860328 - RNA, 13 nt, Human
cuuauugcccacg

SEQ ID NO: 1860329 - RNA, 20 nt, Human
cuuccaugucgccucugcau

SEQ ID NO: 1860330 - RNA, 19 nt, Human
cuuccaugucgccucugca

SEQ ID NO: 1860331 - RNA, 18 nt, Human
cuuccaugucgccucugc

SEQ ID NO: 1860332 - RNA, 17 nt, Human
cuuccaugucgccucug

SEQ ID NO: 1860333 - RNA, 20 nt, Human
cuuccagugaggcucugccc

SEQ ID NO: 1860334 - RNA, 19 nt, Human
cuuccagugaggcucugcc

SEQ ID NO: 1860335 - RNA, 17 nt, Human
cuuccagugaggcucug

SEQ ID NO: 1860336 - RNA, 18 nt, Human
cuuccagugaggcucugc

SEQ ID NO: 1860337 - RNA, 17 nt, Human
cuuccauggacuuuguu

SEQ ID NO: 1860338 - RNA, 16 nt, Human
cuuccauggacuuugu

SEQ ID NO: 1860339 - RNA, 16 nt, Human
cuuccaugucgccucu

SEQ ID NO: 1860340 - RNA, 15 nt, Human
cuuccaugucgccuc

SEQ ID NO: 1860341 - RNA, 15 nt, Human
cuucauccuccucag

SEQ ID NO: 1860342 - RNA, 13 nt, Human
cuucaucccucug

SEQ ID NO: 1860343 - RNA, 18 nt, Human
cuucaguuaagccuuugg

SEQ ID NO: 1860344 - RNA, 24 nt, Human
cuucagagacuccugcaggcagcc

SEQ ID NO: 1860345 - RNA, 23 nt, Human
cuucagagacuccugcaggcagc

SEQ ID NO: 1860346 - RNA, 17 nt, Human
cuucaguuaagccuuug

SEQ ID NO: 1860347 - RNA, 18 nt, Human
cuucaguggcagcugcuu

SEQ ID NO: 1860348 - RNA, 16 nt, Human
cuucauccuccucaga

SEQ ID NO: 1860349 - RNA, 22 nt, Human
cuucaucucccaaagugcuggg

SEQ ID NO: 1860350 - RNA, 11 nt, Human
cuucagacaua

SEQ ID NO: 1860351 - RNA, 22 nt, Human
cuucagagacuccugcaggcag

SEQ ID NO: 1860352 - RNA, 21 nt, Human
cuucagagacuccugcaggca

SEQ ID NO: 1860353 - RNA, 16 nt, Human
cuucagagacuccugc

SEQ ID NO: 1860354 - RNA, 14 nt, Human
cuucaccuuugucc

SEQ ID NO: 1860355 - RNA, 18 nt, Human
cuuauugcccacgcugga

SEQ ID NO: 1860356 - RNA, 20 nt, Human
cuucaccuuuguccccaccg

SEQ ID NO: 1860357 - RNA, 17 nt, Human
cuucaccuuugucccca

SEQ ID NO: 1860358 - RNA, 12 nt, Human
cugcugaaggcu

SEQ ID NO: 1860359 - RNA, 16 nt, Human
cugcucacauaucugu

SEQ ID NO: 1860360 - RNA, 19 nt, Human
cugcucacauaucugucau

SEQ ID NO: 1860361 - RNA, 14 nt, Human
cugcucacauaucu

SEQ ID NO: 1860362 - RNA, 23 nt, Human
cugcugagucccaggcugagccu

SEQ ID NO: 1860363 - RNA, 19 nt, Human
cugcugagucccaggcuga

SEQ ID NO: 1860364 - RNA, 13 nt, Human
cugcugacagugu

SEQ ID NO: 1860365 - RNA, 15 nt, Human
cugcugacaguguug

SEQ ID NO: 1860366 - RNA, 14 nt, Human
cugcugaaggcucg

SEQ ID NO: 1860367 - RNA, 13 nt, Human
cugcugaaggcuc

SEQ ID NO: 1860368 - RNA, 15 nt, Human
cugcugaaggcucga

SEQ ID NO: 1860369 - RNA, 12 nt, Human
cugcugacagug

SEQ ID NO: 1860370 - RNA, 20 nt, Human
cugcuuaacuucacauauug

SEQ ID NO: 1860371 - RNA, 22 nt, Human
cuggaugcagccucacaguccu

SEQ ID NO: 1860372 - RNA, 15 nt, Human
cuggaugcagccuca

SEQ ID NO: 1860373 - RNA, 15 nt, Human
cuggaguucugguuc

SEQ ID NO: 1860374 - RNA, 17 nt, Human
cuggaguucugguuccu

SEQ ID NO: 1860375 - RNA, 16 nt, Human
cuggaguucugguucc

SEQ ID NO: 1860376 - RNA, 23 nt, Human
cuggacugugugcucaggagccc

SEQ ID NO: 1860377 - RNA, 22 nt, Human
cuggacugugugcucaggagcc

SEQ ID NO: 1860378 - RNA, 19 nt, Human
cuggacugugugcucagga

SEQ ID NO: 1860379 - RNA, 12 nt, Human
cuggcccuuccu

SEQ ID NO: 1860380 - RNA, 22 nt, Human
cuggcuaugcauuugaaaauuu

SEQ ID NO: 1860381 - RNA, 15 nt, Human
cuggcuaugcauuug

SEQ ID NO: 1860382 - RNA, 16 nt, Human
cuggcuaugcauuuga

SEQ ID NO: 1860383 - RNA, 13 nt, Human
cuggcuaugcauu

SEQ ID NO: 1860384 - RNA, 14 nt, Human
cuggcuaugcauuu

SEQ ID NO: 1860385 - RNA, 22 nt, Human
cugggacaugggaaaggggaag

SEQ ID NO: 1860386 - RNA, 18 nt, Human
cugggacaugggaaaggg

SEQ ID NO: 1860387 - RNA, 14 nt, Human
cugggacaugggaa

SEQ ID NO: 1860388 - RNA, 22 nt, Human
cugggagaaccaaaaagaggcu

SEQ ID NO: 1860389 - RNA, 17 nt, Human
cugggagaaaugaaaaa

SEQ ID NO: 1860390 - RNA, 16 nt, Human
cugggagaaaugaaaa

SEQ ID NO: 1860391 - RNA, 13 nt, Human
cugggacuacagg

SEQ ID NO: 1860392 - RNA, 15 nt, Human
cugggacuacaggca

SEQ ID NO: 1860393 - RNA, 16 nt, Human
cugggacuacaggcac

SEQ ID NO: 1860394 - RNA, 21 nt, Human
cuggugccucaccccuugcca

SEQ ID NO: 1860395 - RNA, 21 nt, Human
cuggguggcaccagcagccug

SEQ ID NO: 1860396 - RNA, 14 nt, Human
cuggguguggcgca

SEQ ID NO: 1860397 - RNA, 15 nt, Human
cuggguguggcgcag

SEQ ID NO: 1860398 - RNA, 20 nt, Human
cugggcagaggaaagcaaag

SEQ ID NO: 1860399 - RNA, 16 nt, Human
cugggcagaggaaagc

SEQ ID NO: 1860400 - RNA, 13 nt, Human
cugggcagaggaa

SEQ ID NO: 1860401 - RNA, 12 nt, Human
cugggcagagga

SEQ ID NO: 1860402 - RNA, 20 nt, Human
cugggcagguuggugggggc

SEQ ID NO: 1860403 - RNA, 20 nt, Human
cuggguggcaccagcagccu

SEQ ID NO: 1860404 - RNA, 18 nt, Human
cuggguggcaccagcagc

SEQ ID NO: 1860405 - RNA, 13 nt, Human
cuggggagaaagu

SEQ ID NO: 1860406 - RNA, 14 nt, Human
cuggggagaaagua

SEQ ID NO: 1860407 - RNA, 19 nt, Human
cugcccugugggcccccaa

SEQ ID NO: 1860408 - RNA, 18 nt, Human
cugccccuccucucugcc

SEQ ID NO: 1860409 - RNA, 17 nt, Human
cugccccuccucucugc

SEQ ID NO: 1860410 - RNA, 17 nt, Human
cugccccucccuucaac

SEQ ID NO: 1860411 - RNA, 14 nt, Human
cugccccucccuuc

SEQ ID NO: 1860412 - RNA, 13 nt, Human
cugccccucccuu

SEQ ID NO: 1860413 - RNA, 17 nt, Human
cugcccuuaccugccag

SEQ ID NO: 1860414 - RNA, 16 nt, Human
cugcccuuaccugcca

SEQ ID NO: 1860415 - RNA, 12 nt, Human
cugcccuuaccu

SEQ ID NO: 1860416 - RNA, 19 nt, Human
cugccccuccucucugccc

SEQ ID NO: 1860417 - RNA, 16 nt, Human
cugccauauucuguug

SEQ ID NO: 1860418 - RNA, 16 nt, Human
cugccauccagguuca

SEQ ID NO: 1860419 - RNA, 18 nt, Human
cugccauccagguucagc

SEQ ID NO: 1860420 - RNA, 19 nt, Human
cugccauccagguucagcu

SEQ ID NO: 1860421 - RNA, 13 nt, Human
cugccccccagcc

SEQ ID NO: 1860422 - RNA, 17 nt, Human
cugccagucccccugcc

SEQ ID NO: 1860423 - RNA, 21 nt, Human
cugccagucccccugccccag

SEQ ID NO: 1860424 - RNA, 20 nt, Human
cugccagucccccugcccca

SEQ ID NO: 1860425 - RNA, 22 nt, Human
cugccagucccccugccccagg

SEQ ID NO: 1860426 - RNA, 22 nt, Human
cugccagggacagagggggugg

SEQ ID NO: 1860427 - RNA, 20 nt, Human
cugccagggacagagggggu

SEQ ID NO: 1860428 - RNA, 17 nt, Human
cugcauuuaaaagauac

SEQ ID NO: 1860429 - RNA, 18 nt, Human
cugcauuuaaaagauaca

SEQ ID NO: 1860430 - RNA, 23 nt, Human
cugccagggacagaggggguggc

SEQ ID NO: 1860431 - RNA, 13 nt, Human
cugcauuggcuuu

SEQ ID NO: 1860432 - RNA, 14 nt, Human
cugcauuuaaaaga

SEQ ID NO: 1860433 - RNA, 20 nt, Human
cugcaggcagccaggccaca

SEQ ID NO: 1860434 - RNA, 19 nt, Human
cugcaggcagccaggccac

SEQ ID NO: 1860435 - RNA, 18 nt, Human
cugcaggcagccaggcca

SEQ ID NO: 1860436 - RNA, 17 nt, Human
cugcaggcagccaggcc

SEQ ID NO: 1860437 - RNA, 16 nt, Human
cugcaggcagccaggc

SEQ ID NO: 1860438 - RNA, 15 nt, Human
cugcaggcagccagg

SEQ ID NO: 1860439 - RNA, 14 nt, Human
cugcaggcagccag

SEQ ID NO: 1860440 - RNA, 13 nt, Human
cugcaggcagcca

SEQ ID NO: 1860441 - RNA, 12 nt, Human
cugcagcuuugu

SEQ ID NO: 1860442 - RNA, 17 nt, Human
cugcacuccagccuggg

SEQ ID NO: 1860443 - RNA, 16 nt, Human
cugcacuccagccugg

SEQ ID NO: 1860444 - RNA, 18 nt, Human
cugcacuccagccugggu

SEQ ID NO: 1860445 - RNA, 24 nt, Human
cugcagccucaaccuccugggcua

SEQ ID NO: 1860446 - RNA, 19 nt, Human
cugcacuccagccugggug

SEQ ID NO: 1860447 - RNA, 23 nt, Human
cugcagccucaaccuccugggcu

SEQ ID NO: 1860448 - RNA, 16 nt, Human
cugcacuauagccuag

SEQ ID NO: 1860449 - RNA, 17 nt, Human
cugcacuauagccuagg

SEQ ID NO: 1860450 - RNA, 18 nt, Human
cugcacuauagccuaggu

SEQ ID NO: 1860451 - RNA, 20 nt, Human
cugcacuauagccuagguga

SEQ ID NO: 1860452 - RNA, 17 nt, Human
cugcacuccagccugag

SEQ ID NO: 1860453 - RNA, 20 nt, Human
cugcacuccagccugagcga

SEQ ID NO: 1860454 - RNA, 16 nt, Human
cugcacuccagccuga

SEQ ID NO: 1860455 - RNA, 15 nt, Human
cugcacuccagccug

SEQ ID NO: 1860456 - RNA, 13 nt, Human
cugcacuccagcc

SEQ ID NO: 1860457 - RNA, 22 nt, Human
cugcacuauagccuaggugaca

SEQ ID NO: 1860458 - RNA, 23 nt, Human
cugcacuauagccuaggugacag

SEQ ID NO: 1860459 - RNA, 18 nt, Human
cugcaagaauugaagcag

SEQ ID NO: 1860460 - RNA, 19 nt, Human
cugcaacuuguaaaugugg

SEQ ID NO: 1860461 - RNA, 18 nt, Human
cugcaacuuguaaaugug

SEQ ID NO: 1860462 - RNA, 15 nt, Human
cugcaacuucugccu

SEQ ID NO: 1860463 - RNA, 14 nt, Human
cugcaacuucugcc

SEQ ID NO: 1860464 - RNA, 22 nt, Human
cugcaaccugauugugucucuu

SEQ ID NO: 1860465 - RNA, 22 nt, Human
cugcaaccuucgccaccugggu

SEQ ID NO: 1860466 - RNA, 20 nt, Human
cugcaaccuucgccaccugg

SEQ ID NO: 1860467 - RNA, 19 nt, Human
cugcaaccuucgccaccug

SEQ ID NO: 1860468 - RNA, 17 nt, Human
cugcaaccuucgccacc

SEQ ID NO: 1860469 - RNA, 20 nt, Human
cugcaaccuccgccucuugg

SEQ ID NO: 1860470 - RNA, 21 nt, Human
cugcaaccugauugugucucu

SEQ ID NO: 1860471 - RNA, 19 nt, Human
cugcaaccugauugugucu

SEQ ID NO: 1860472 - RNA, 14 nt, Human
cugcaaccugauug

SEQ ID NO: 1860473 - RNA, 22 nt, Human
cugcaaccuccgccucuugggu

SEQ ID NO: 1860474 - RNA, 20 nt, Human
cugcaagaauugaagcagga

SEQ ID NO: 1860475 - RNA, 12 nt, Human
cugcaagggagu

SEQ ID NO: 1860476 - RNA, 23 nt, Human
cugcaccgggccacagagaaagu

SEQ ID NO: 1860477 - RNA, 17 nt, Human
cugaugcuucuucagag

SEQ ID NO: 1860478 - RNA, 16 nt, Human
cugaugcuucuucaga

SEQ ID NO: 1860479 - RNA, 15 nt, Human
cucuuaugggcuggg

SEQ ID NO: 1860480 - RNA, 14 nt, Human
cucuuaugggcugg

SEQ ID NO: 1860481 - RNA, 20 nt, Human
cugaugcuucuucagagacu

SEQ ID NO: 1860482 - RNA, 19 nt, Human
cugaugcuucuucagagac

SEQ ID NO: 1860483 - RNA, 18 nt, Human
cugaugcuucuucagaga

SEQ ID NO: 1860484 - RNA, 18 nt, Human
cugaugggcaacccccag

SEQ ID NO: 1860485 - RNA, 21 nt, Human
cugaugggcaacccccagccu

SEQ ID NO: 1860486 - RNA, 24 nt, Human
cugaugggcaacccccagccugcu

SEQ ID NO: 1860487 - RNA, 22 nt, Human
cugaugggcaacccccagccug

SEQ ID NO: 1860488 - RNA, 23 nt, Human
cugaugggcaacccccagccugc

SEQ ID NO: 1860489 - RNA, 18 nt, Human
cugcaaagcccagcuuga

SEQ ID NO: 1860490 - RNA, 17 nt, Human
cugcaaagcccagcuug

SEQ ID NO: 1860491 - RNA, 21 nt, Human
cugcaaaggguaucaggugcu

SEQ ID NO: 1860492 - RNA, 22 nt, Human
cugcaaaggguaucaggugcug

SEQ ID NO: 1860493 - RNA, 14 nt, Human
aaauucaugcugcu

SEQ ID NO: 1860494 - RNA, 21 nt, Human
aaauuaacuuuuauaaacuuu

SEQ ID NO: 1860495 - RNA, 19 nt, Human
aaauuaacuuuuauaaacu

SEQ ID NO: 1860496 - RNA, 20 nt, Human
aaauguuaaguugaugguga

SEQ ID NO: 1860497 - RNA, 22 nt, Human
aaauuaacuuuuauaaacuuua

SEQ ID NO: 1860498 - RNA, 23 nt, Human
aaauuaacuuuuauaaacuuuac

SEQ ID NO: 1860499 - RNA, 16 nt, Human
guauuuaauucauguu

SEQ ID NO: 1860500 - RNA, 22 nt, Human
guauuggcuagagguucaaaga

SEQ ID NO: 1860501 - RNA, 18 nt, Human
gucaaaguggugagaggc

SEQ ID NO: 1860502 - RNA, 19 nt, Human
gucaaaguggugagaggca

SEQ ID NO: 1860503 - RNA, 17 nt, Human
guauuuuuuuacuaaua

SEQ ID NO: 1860504 - RNA, 21 nt, Human
guauuuuuuuacuaauagaca

SEQ ID NO: 1860505 - RNA, 16 nt, Human
gucacacacuuuggcu

SEQ ID NO: 1860506 - RNA, 20 nt, Human
gucacacaguauuacuucug

SEQ ID NO: 1860507 - RNA, 14 nt, Human
guauuuuuuuacua

SEQ ID NO: 1860508 - RNA, 15 nt, Human
guauuuuuuuacuaa

SEQ ID NO: 1860509 - RNA, 22 nt, Human
aaauuuccacucaggucuguuu

SEQ ID NO: 1860510 - RNA, 14 nt, Human
aaauuuccacucag

SEQ ID NO: 1860511 - RNA, 18 nt, Human
aaauuucagcagcugcag

SEQ ID NO: 1860512 - RNA, 17 nt, Human
aaauuucagcagcugca

SEQ ID NO: 1860513 - RNA, 14 nt, Human
guaugggagagaag

SEQ ID NO: 1860514 - RNA, 22 nt, Human
guaugaucacggcucacugcag

SEQ ID NO: 1860515 - RNA, 15 nt, Human
guaucccuacuguaa

SEQ ID NO: 1860516 - RNA, 15 nt, Human
guaugggagagaaga

SEQ ID NO: 1860517 - RNA, 16 nt, Human
guaugggacuggccuc

SEQ ID NO: 1860518 - RNA, 13 nt, Human
guaugguggcugg

SEQ ID NO: 1860519 - RNA, 15 nt, Human
guauucuuauuuaau

SEQ ID NO: 1860520 - RNA, 21 nt, Human
guauaaaagccuguuuaagag

SEQ ID NO: 1860521 - RNA, 18 nt, Human
guauaaaagccuguuuaa

SEQ ID NO: 1860522 - RNA, 18 nt, Human
guauaaaagggacugaga

SEQ ID NO: 1860523 - RNA, 22 nt, Human
guauauugauccagaaagaaaa

SEQ ID NO: 1860524 - RNA, 19 nt, Human
aaaugggggugcauuugag

SEQ ID NO: 1860525 - RNA, 17 nt, Human
aaaugggggugcauuug

SEQ ID NO: 1860526 - RNA, 18 nt, Human
aaaugggggugcauuuga

SEQ ID NO: 1860527 - RNA, 15 nt, Human
aaaugggggugcauu

SEQ ID NO: 1860528 - RNA, 16 nt, Human
aaaugggggugcauuu

SEQ ID NO: 1860529 - RNA, 17 nt, Human
guauaaaagccuguuua

SEQ ID NO: 1860530 - RNA, 19 nt, Human
aaaucuacacuccagugag

SEQ ID NO: 1860531 - RNA, 15 nt, Human
aaaucucaaauuucu

SEQ ID NO: 1860532 - RNA, 16 nt, Human
aaaucucaaauuucua

SEQ ID NO: 1860533 - RNA, 17 nt, Human
aaaucucaaauuucuaa

SEQ ID NO: 1860534 - RNA, 19 nt, Human
aaaucucaaauuucuaaau

SEQ ID NO: 1860535 - RNA, 11 nt, Human
aaaugaaaauu

SEQ ID NO: 1860536 - RNA, 17 nt, Human
aaaugaaaaucgugaca

SEQ ID NO: 1860537 - RNA, 18 nt, Human
aaaucccuuaccucggug

SEQ ID NO: 1860538 - RNA, 15 nt, Human
aaaucccauuuaaaa

SEQ ID NO: 1860539 - RNA, 13 nt, Human
aaaucgaugcagu

SEQ ID NO: 1860540 - RNA, 17 nt, Human
aaaggagagcuagcagc

SEQ ID NO: 1860541 - RNA, 17 nt, Human
guagcuggauuacaggc

SEQ ID NO: 1860542 - RNA, 12 nt, Human
guagcugggacu

SEQ ID NO: 1860543 - RNA, 18 nt, Human
guagcugggacuacaggc

SEQ ID NO: 1860544 - RNA, 19 nt, Human
guagcugggacuacaggca

SEQ ID NO: 1860545 - RNA, 18 nt, Human
guagcugggauuacaggc

SEQ ID NO: 1860546 - RNA, 21 nt, Human
guagcugggacuacaggcacc

SEQ ID NO: 1860547 - RNA, 15 nt, Human
guaggaagacuuugg

SEQ ID NO: 1860548 - RNA, 15 nt, Human
guaggacuguagaaa

SEQ ID NO: 1860549 - RNA, 18 nt, Human
guaggaagguuaauguuc

SEQ ID NO: 1860550 - RNA, 19 nt, Human
aaaugagccuggcaagaau

SEQ ID NO: 1860551 - RNA, 13 nt, Human
aaaugagccuggc

SEQ ID NO: 1860552 - RNA, 16 nt, Human
aaaugagaaaucuaaa

SEQ ID NO: 1860553 - RNA, 14 nt, Human
aaaugagaaaucua

SEQ ID NO: 1860554 - RNA, 13 nt, Human
aaaugagaaaucu

SEQ ID NO: 1860555 - RNA, 23 nt, Human
aaaugauccccagcuguuuaugc

SEQ ID NO: 1860556 - RNA, 23 nt, Human
aaaugagguacucuccuggaaau

SEQ ID NO: 1860557 - RNA, 16 nt, Human
aaaugagguacucucc

SEQ ID NO: 1860558 - RNA, 17 nt, Human
aaaugaggucagagccu

SEQ ID NO: 1860559 - RNA, 19 nt, Human
aaaugaggucagagccugc

SEQ ID NO: 1860560 - RNA, 11 nt, Human
aaaugagaaau

SEQ ID NO: 1860561 - RNA, 21 nt, Human
aaaugaaagcagggacuugaa

SEQ ID NO: 1860562 - RNA, 22 nt, Human
aaaugaaagcagggacuugaac

SEQ ID NO: 1860563 - RNA, 14 nt, Human
aaaugaaagugaga

SEQ ID NO: 1860564 - RNA, 13 nt, Human
aaaugcauguugc

SEQ ID NO: 1860565 - RNA, 18 nt, Human
aaaugcaccuggaauaua

SEQ ID NO: 1860566 - RNA, 22 nt, Human
aaaugcaccuggaauauauaac

SEQ ID NO: 1860567 - RNA, 14 nt, Human
aaaugcaccuggaa

SEQ ID NO: 1860568 - RNA, 23 nt, Human
aaaugccuuacccucauguucuu

SEQ ID NO: 1860569 - RNA, 20 nt, Human
aaaugggcagagcagagacc

SEQ ID NO: 1860570 - RNA, 18 nt, Human
aaaugggcagagcagaga

SEQ ID NO: 1860571 - RNA, 15 nt, Human
aaaugggcagagcag

SEQ ID NO: 1860572 - RNA, 13 nt, Human
aaaugcccagcuu

SEQ ID NO: 1860573 - RNA, 18 nt, Human
aaaugcccagccccuucu

SEQ ID NO: 1860574 - RNA, 15 nt, Human
aaaugcccagccccu

SEQ ID NO: 1860575 - RNA, 14 nt, Human
aaaugcccagcccc

SEQ ID NO: 1860576 - RNA, 13 nt, Human
aaaugcccagccc

SEQ ID NO: 1860577 - RNA, 14 nt, Human
aaaugcauuucuaa

SEQ ID NO: 1860578 - RNA, 16 nt, Human
gucucccucccuuggg

SEQ ID NO: 1860579 - RNA, 21 nt, Human
aaccaucauugaaaucuuuuu

SEQ ID NO: 1860580 - RNA, 23 nt, Human
aaccaucauugaaaucuuuuugc

SEQ ID NO: 1860581 - RNA, 20 nt, Human
aaccaucauugaaaucuuuu

SEQ ID NO: 1860582 - RNA, 19 nt, Human
aaccaucauugaaaucuuu

SEQ ID NO: 1860583 - RNA, 20 nt, Human
aaccacaucuugcucugcug

SEQ ID NO: 1860584 - RNA, 22 nt, Human
aaccacaucuugcucugcugac

SEQ ID NO: 1860585 - RNA, 18 nt, Human
aaccacaucuugcucugc

SEQ ID NO: 1860586 - RNA, 17 nt, Human
aaccuccgccucuuggg

SEQ ID NO: 1860587 - RNA, 14 nt, Human
aaccuccugggcua

SEQ ID NO: 1860588 - RNA, 13 nt, Human
aacccccagccug

SEQ ID NO: 1860589 - RNA, 14 nt, Human
aacccccagccugc

SEQ ID NO: 1860590 - RNA, 15 nt, Human
aacccccagccugcu

SEQ ID NO: 1860591 - RNA, 17 nt, Human
aacccagcucuggucca

SEQ ID NO: 1860592 - RNA, 20 nt, Human
aacccauauuuguacaccaa

SEQ ID NO: 1860593 - RNA, 18 nt, Human
aacccaaauguucaucaa

SEQ ID NO: 1860594 - RNA, 11 nt, Human
aacccagcucu

SEQ ID NO: 1860595 - RNA, 14 nt, Human
aacccagcucuggu

SEQ ID NO: 1860596 - RNA, 13 nt, Human
aacccagcucugg

SEQ ID NO: 1860597 - RNA, 13 nt, Human
aacccaaauguuc

SEQ ID NO: 1860598 - RNA, 13 nt, Human
aacucccuuucaa

SEQ ID NO: 1860599 - RNA, 14 nt, Human
aacucccuuucaac

SEQ ID NO: 1860600 - RNA, 19 nt, Human
gugaaccaccacacccagc

SEQ ID NO: 1860601 - RNA, 19 nt, Human
aacucccugccccccagcc

SEQ ID NO: 1860602 - RNA, 13 nt, Human
aacucccugcccc

SEQ ID NO: 1860603 - RNA, 19 nt, Human
aacguggcugcuucaagga

SEQ ID NO: 1860604 - RNA, 16 nt, Human
aacguggcugcuucaa

SEQ ID NO: 1860605 - RNA, 22 nt, Human
aacguggcugcuucaaggaucc

SEQ ID NO: 1860606 - RNA, 15 nt, Human
aacguggcugcuuca

SEQ ID NO: 1860607 - RNA, 20 nt, Human
aaccugcucuccucuugcca

SEQ ID NO: 1860608 - RNA, 15 nt, Human
aaccugcucuccucu

SEQ ID NO: 1860609 - RNA, 11 nt, Human
aaccugcucuc

SEQ ID NO: 1860610 - RNA, 15 nt, Human
gucuggcuucacaga

SEQ ID NO: 1860611 - RNA, 15 nt, Human
gucuuuggacccuga

SEQ ID NO: 1860612 - RNA, 14 nt, Human
gucuuuggacccug

SEQ ID NO: 1860613 - RNA, 17 nt, Human
gucuuuggacccugagg

SEQ ID NO: 1860614 - RNA, 18 nt, Human
gucuuuggacccugaggc

SEQ ID NO: 1860615 - RNA, 19 nt, Human
gucuuuucuugcaugaggc

SEQ ID NO: 1860616 - RNA, 14 nt, Human
gucuuuucuugcau

SEQ ID NO: 1860617 - RNA, 24 nt, Human
gucuuuucuugcaugaggcuagug

SEQ ID NO: 1860618 - RNA, 15 nt, Human
gucuuagauguauau

SEQ ID NO: 1860619 - RNA, 21 nt, Human
aacacuguucucugcccucca

SEQ ID NO: 1860620 - RNA, 11 nt, Human
aacacuuccau

SEQ ID NO: 1860621 - RNA, 21 nt, Human
gucauuugagcagggcucagc

SEQ ID NO: 1860622 - RNA, 22 nt, Human
gucauuugagcagggcucagcg

SEQ ID NO: 1860623 - RNA, 15 nt, Human
guccacaacacacag

SEQ ID NO: 1860624 - RNA, 21 nt, Human
aacacucauugaccugaggcc

SEQ ID NO: 1860625 - RNA, 11 nt, Human
aacacucugag

SEQ ID NO: 1860626 - RNA, 12 nt, Human
aacacuccuuca

SEQ ID NO: 1860627 - RNA, 13 nt, Human
aacacucugagac

SEQ ID NO: 1860628 - RNA, 12 nt, Human
aacacucugaga

SEQ ID NO: 1860629 - RNA, 14 nt, Human
aacacucugagacu

SEQ ID NO: 1860630 - RNA, 20 nt, Human
aacacuguucucugcccucc

SEQ ID NO: 1860631 - RNA, 15 nt, Human
aacacuguucucugc

SEQ ID NO: 1860632 - RNA, 23 nt, Human
aaauuuuuaaucuuuaauuuuac

SEQ ID NO: 1860633 - RNA, 16 nt, Human
gucacaggcaggucca

SEQ ID NO: 1860634 - RNA, 13 nt, Human
gucacaggcaggu

SEQ ID NO: 1860635 - RNA, 15 nt, Human
gucacaggcaggucc

SEQ ID NO: 1860636 - RNA, 16 nt, Human
aacaagaccacguuuc

SEQ ID NO: 1860637 - RNA, 17 nt, Human
aacaagaccacguuucu

SEQ ID NO: 1860638 - RNA, 19 nt, Human
aacaagaccacguuucuaa

SEQ ID NO: 1860639 - RNA, 20 nt, Human
aacaagaccacguuucuaaa

SEQ ID NO: 1860640 - RNA, 21 nt, Human
aacaagccuccuuuuaaagua

SEQ ID NO: 1860641 - RNA, 23 nt, Human
aacaaggcaaggcugucaauuac

SEQ ID NO: 1860642 - RNA, 10 nt, Human
aacagaaaug

SEQ ID NO: 1860643 - RNA, 11 nt, Human
aacagaaaugu

SEQ ID NO: 1860644 - RNA, 21 nt, Human
aacagaaauguacagcaagga

SEQ ID NO: 1860645 - RNA, 13 nt, Human
guccgagcuuuga

SEQ ID NO: 1860646 - RNA, 15 nt, Human
gucccaacuuguaaa

SEQ ID NO: 1860647 - RNA, 21 nt, Human
guccggucccugucccagugc

SEQ ID NO: 1860648 - RNA, 19 nt, Human
aacagacuggaagcacagc

SEQ ID NO: 1860649 - RNA, 22 nt, Human
aacaggcugggcuucaguggca

SEQ ID NO: 1860650 - RNA, 13 nt, Human
aacaggcugggcu

SEQ ID NO: 1860651 - RNA, 23 nt, Human
aacaggcugggcuucaguggcag

SEQ ID NO: 1860652 - RNA, 22 nt, Human
aacaguagugauaguuguaccg

SEQ ID NO: 1860653 - RNA, 15 nt, Human
aacauacucccaucu

SEQ ID NO: 1860654 - RNA, 14 nt, Human
aacauacucccauc

SEQ ID NO: 1860655 - RNA, 14 nt, Human
aacauugcaauaga

SEQ ID NO: 1860656 - RNA, 15 nt, Human
aacauugcaauagaa

SEQ ID NO: 1860657 - RNA, 16 nt, Human
aacauugcaauagaaa

SEQ ID NO: 1860658 - RNA, 20 nt, Human
aacauuuguucuauagcuuu

SEQ ID NO: 1860659 - RNA, 17 nt, Human
aacauugcaauagaaau

SEQ ID NO: 1860660 - RNA, 21 nt, Human
aagcucuacugaggugcuaug

SEQ ID NO: 1860661 - RNA, 22 nt, Human
aagcuauucaguaauaacucua

SEQ ID NO: 1860662 - RNA, 17 nt, Human
aagcuaucguaaaauua

SEQ ID NO: 1860663 - RNA, 20 nt, Human
guucccuacuuccugugacu

SEQ ID NO: 1860664 - RNA, 16 nt, Human
guucccauuugcuccu

SEQ ID NO: 1860665 - RNA, 20 nt, Human
guucccauuugcuccuuucu

SEQ ID NO: 1860666 - RNA, 20 nt, Human
guuccauggccucuucagau

SEQ ID NO: 1860667 - RNA, 14 nt, Human
guucuucaucuaag

SEQ ID NO: 1860668 - RNA, 21 nt, Human
guucuugguuuguaaauuaac

SEQ ID NO: 1860669 - RNA, 19 nt, Human
guucuuaguugcuguaugu

SEQ ID NO: 1860670 - RNA, 17 nt, Human
guucuuaguuugcaguu

SEQ ID NO: 1860671 - RNA, 22 nt, Human
guugaugaucuuugcagacagg

SEQ ID NO: 1860672 - RNA, 16 nt, Human
guucuacccaggugcu

SEQ ID NO: 1860673 - RNA, 22 nt, Human
guucccuuugacgccaucccag

SEQ ID NO: 1860674 - RNA, 21 nt, Human
guucccuuugacgccauccca

SEQ ID NO: 1860675 - RNA, 20 nt, Human
guucccuuugacgccauccc

SEQ ID NO: 1860676 - RNA, 13 nt, Human
guucucuccuucu

SEQ ID NO: 1860677 - RNA, 19 nt, Human
aagccuccuccagccgcca

SEQ ID NO: 1860678 - RNA, 17 nt, Human
aagcuaggccuggccag

SEQ ID NO: 1860679 - RNA, 18 nt, Human
aagcuaggccuggccaga

SEQ ID NO: 1860680 - RNA, 22 nt, Human
aagcuaggccuggccagaugca

SEQ ID NO: 1860681 - RNA, 17 nt, Human
guucaggguuggccccu

SEQ ID NO: 1860682 - RNA, 18 nt, Human
guucaggguuggccccug

SEQ ID NO: 1860683 - RNA, 19 nt, Human
guucaggguuggccccugc

SEQ ID NO: 1860684 - RNA, 18 nt, Human
guucagcuccagcucacc

SEQ ID NO: 1860685 - RNA, 16 nt, Human
guucagcuccagcuca

SEQ ID NO: 1860686 - RNA, 17 nt, Human
guucagcuccagcucac

SEQ ID NO: 1860687 - RNA, 16 nt, Human
guuaagccuuuggaaa

SEQ ID NO: 1860688 - RNA, 13 nt, Human
guuaagccuuugg

SEQ ID NO: 1860689 - RNA, 12 nt, Human
guuaagccuuug

SEQ ID NO: 1860690 - RNA, 18 nt, Human
guguuuuaaaaugagaaa

SEQ ID NO: 1860691 - RNA, 12 nt, Human
guuaauaaaagu

SEQ ID NO: 1860692 - RNA, 18 nt, Human
guuaaugauagcuacugu

SEQ ID NO: 1860693 - RNA, 22 nt, Human
guuaaguugauggugaugaaau

SEQ ID NO: 1860694 - RNA, 17 nt, Human
guuaguaugaggcauuu

SEQ ID NO: 1860695 - RNA, 20 nt, Human
guuaguaugaggcauuuguu

SEQ ID NO: 1860696 - RNA, 18 nt, Human
aaggaugcacagaguugu

SEQ ID NO: 1860697 - RNA, 15 nt, Human
aaggaugcuuguaca

SEQ ID NO: 1860698 - RNA, 16 nt, Human
aaggaugcuuguacau

SEQ ID NO: 1860699 - RNA, 17 nt, Human
aaggaugcuuguacaua

SEQ ID NO: 1860700 - RNA, 19 nt, Human
aaggaugcuuguacauaau

SEQ ID NO: 1860701 - RNA, 19 nt, Human
aaggaugccccgucccccu

SEQ ID NO: 1860702 - RNA, 23 nt, Human
aaggaugaucuaggaagacuuug

SEQ ID NO: 1860703 - RNA, 18 nt, Human
aaggaugaucuaggaaga

SEQ ID NO: 1860704 - RNA, 17 nt, Human
aaggauccugagccaga

SEQ ID NO: 1860705 - RNA, 15 nt, Human
aaggauccugagcca

SEQ ID NO: 1860706 - RNA, 14 nt, Human
aaggauccugagcc

SEQ ID NO: 1860707 - RNA, 21 nt, Human
guugaugccugugaacugaac

SEQ ID NO: 1860708 - RNA, 23 nt, Human
guugaugaucuuugcagacaggc

SEQ ID NO: 1860709 - RNA, 19 nt, Human
aaggcuaccuuuguauucu

SEQ ID NO: 1860710 - RNA, 18 nt, Human
aaggccaaaggaagcaca

SEQ ID NO: 1860711 - RNA, 14 nt, Human
aaggcuccaggagc

SEQ ID NO: 1860712 - RNA, 17 nt, Human
guugcccaggcaggucu

SEQ ID NO: 1860713 - RNA, 18 nt, Human
guugcccaggcaggucuu

SEQ ID NO: 1860714 - RNA, 19 nt, Human
guugcccaggcaggucuug

SEQ ID NO: 1860715 - RNA, 21 nt, Human
guugcccaggcuggcgugcag

SEQ ID NO: 1860716 - RNA, 20 nt, Human
guuuaagacauuuuuggaag

SEQ ID NO: 1860717 - RNA, 18 nt, Human
guuguaccgcaaugugac

SEQ ID NO: 1860718 - RNA, 18 nt, Human
guuggucccccuuccaug

SEQ ID NO: 1860719 - RNA, 13 nt, Human
guuggguggaugc

SEQ ID NO: 1860720 - RNA, 11 nt, Human
guuuucuguuc

SEQ ID NO: 1860721 - RNA, 12 nt, Human
guuuucuguucu

SEQ ID NO: 1860722 - RNA, 20 nt, Human
guuuucuuaaccagaucauu

SEQ ID NO: 1860723 - RNA, 15 nt, Human
guuuuacugcagcuu

SEQ ID NO: 1860724 - RNA, 23 nt, Human
guuuuacaauaaaaucuugaaaa

SEQ ID NO: 1860725 - RNA, 20 nt, Human
guuugggccccagaggcugg

SEQ ID NO: 1860726 - RNA, 18 nt, Human
guuuggggaugagaaagg

SEQ ID NO: 1860727 - RNA, 22 nt, Human
guuucuaaaggcuaccuuugua

SEQ ID NO: 1860728 - RNA, 23 nt, Human
guuucuaaaggcuaccuuuguau

SEQ ID NO: 1860729 - RNA, 22 nt, Human
guuugauucagacagcugccug

SEQ ID NO: 1860730 - RNA, 13 nt, Human
guuugccucugcc

SEQ ID NO: 1860731 - RNA, 16 nt, Human
guuugccucugccucu

SEQ ID NO: 1860732 - RNA, 17 nt, Human
aagggccuggccugagc

SEQ ID NO: 1860733 - RNA, 14 nt, Human
aagggccuggccug

SEQ ID NO: 1860734 - RNA, 19 nt, Human
aagggccuggccugagcug

SEQ ID NO: 1860735 - RNA, 22 nt, Human
aaggggaauguuugccucugcc

SEQ ID NO: 1860736 - RNA, 23 nt, Human
aaggggaauguuugccucugccu

SEQ ID NO: 1860737 - RNA, 13 nt, Human
aagggccuggccu

SEQ ID NO: 1860738 - RNA, 15 nt, Human
aaguaauaugcacac

SEQ ID NO: 1860739 - RNA, 16 nt, Human
aaguaauaugcacaca

SEQ ID NO: 1860740 - RNA, 19 nt, Human
guuucuaaaggcuaccuuu

SEQ ID NO: 1860741 - RNA, 12 nt, Human
aaguaauaugca

SEQ ID NO: 1860742 - RNA, 22 nt, Human
aaguaaaaacaaagaaauuaug

SEQ ID NO: 1860743 - RNA, 20 nt, Human
aaguaaaaacaaagaaauua

SEQ ID NO: 1860744 - RNA, 13 nt, Human
aaguaaaaacaaa

SEQ ID NO: 1860745 - RNA, 17 nt, Human
aaggguaucaggugcug

SEQ ID NO: 1860746 - RNA, 16 nt, Human
aaggguaucaggugcu

SEQ ID NO: 1860747 - RNA, 16 nt, Human
aagagcuuaacagugu

SEQ ID NO: 1860748 - RNA, 19 nt, Human
guggcccgacagccuggca

SEQ ID NO: 1860749 - RNA, 18 nt, Human
guggcccgacagccuggc

SEQ ID NO: 1860750 - RNA, 18 nt, Human
aagacuaucuaaauguug

SEQ ID NO: 1860751 - RNA, 17 nt, Human
aagacugaguacguugu

SEQ ID NO: 1860752 - RNA, 17 nt, Human
aagacuguacaaaguag

SEQ ID NO: 1860753 - RNA, 21 nt, Human
aagacugaguacguugugcau

SEQ ID NO: 1860754 - RNA, 22 nt, Human
aagacugaguacguugugcauu

SEQ ID NO: 1860755 - RNA, 21 nt, Human
aagacccuuguggucccaccc

SEQ ID NO: 1860756 - RNA, 18 nt, Human
aagacccuugugguccca

SEQ ID NO: 1860757 - RNA, 22 nt, Human
aagacccuuguggucccacccc

SEQ ID NO: 1860758 - RNA, 17 nt, Human
aagacuaucuaaauguu

SEQ ID NO: 1860759 - RNA, 16 nt, Human
aagacuaucuaaaugu

SEQ ID NO: 1860760 - RNA, 22 nt, Human
gugggacacccugugauggggc

SEQ ID NO: 1860761 - RNA, 23 nt, Human
guggcgcagcauauucaggaagc

SEQ ID NO: 1860762 - RNA, 13 nt, Human
gugggauccucca

SEQ ID NO: 1860763 - RNA, 14 nt, Human
gugggagugggccc

SEQ ID NO: 1860764 - RNA, 13 nt, Human
gugggagugggcc

SEQ ID NO: 1860765 - RNA, 16 nt, Human
gugguuucagaaaugu

SEQ ID NO: 1860766 - RNA, 14 nt, Human
guggugguuuucug

SEQ ID NO: 1860767 - RNA, 20 nt, Human
gugggggaucacagccucug

SEQ ID NO: 1860768 - RNA, 14 nt, Human
guggguacgggagg

SEQ ID NO: 1860769 - RNA, 18 nt, Human
aagaugugacauguuuua

SEQ ID NO: 1860770 - RNA, 14 nt, Human
aagaugugacaugu

SEQ ID NO: 1860771 - RNA, 22 nt, Human
aagcaaagacuuuccucuuagu

SEQ ID NO: 1860772 - RNA, 15 nt, Human
aagcaagauuucaga

SEQ ID NO: 1860773 - RNA, 13 nt, Human
aagcaaaggagau

SEQ ID NO: 1860774 - RNA, 12 nt, Human
aagcaaaggaga

SEQ ID NO: 1860775 - RNA, 12 nt, Human
aagaugcagccg

SEQ ID NO: 1860776 - RNA, 20 nt, Human
guggugguuuucuguucuuu

SEQ ID NO: 1860777 - RNA, 17 nt, Human
gugguuuucuguucuuu

SEQ ID NO: 1860778 - RNA, 18 nt, Human
aagagguuuuaaaaaaau

SEQ ID NO: 1860779 - RNA, 17 nt, Human
gugucuugcaauggcag

SEQ ID NO: 1860780 - RNA, 18 nt, Human
gugucuugcaauggcagc

SEQ ID NO: 1860781 - RNA, 17 nt, Human
gugugacuacuccccca

SEQ ID NO: 1860782 - RNA, 17 nt, Human
gugugaaaaugugugug

SEQ ID NO: 1860783 - RNA, 18 nt, Human
gugucuuuuuucacuaca

SEQ ID NO: 1860784 - RNA, 23 nt, Human
guguuuccuggcacugcuuccag

SEQ ID NO: 1860785 - RNA, 18 nt, Human
guguguaugcgugugugu

SEQ ID NO: 1860786 - RNA, 16 nt, Human
aagaauugaagcagga

SEQ ID NO: 1860787 - RNA, 16 nt, Human
guggcagcucaccucu

SEQ ID NO: 1860788 - RNA, 14 nt, Human
guggcagcucaccu

SEQ ID NO: 1860789 - RNA, 20 nt, Human
guggcagcucaccucucccu

SEQ ID NO: 1860790 - RNA, 19 nt, Human
guggcaccagcagccugga

SEQ ID NO: 1860791 - RNA, 20 nt, Human
guggauuuaacagaaaugua

SEQ ID NO: 1860792 - RNA, 18 nt, Human
guggauuuaacagaaaug

SEQ ID NO: 1860793 - RNA, 19 nt, Human
guggauuuaacagaaaugu

SEQ ID NO: 1860794 - RNA, 22 nt, Human
gugcuaucucccccagccccau

SEQ ID NO: 1860795 - RNA, 12 nt, Human
gugcuauguucu

SEQ ID NO: 1860796 - RNA, 15 nt, Human
gugcucaggagcccu

SEQ ID NO: 1860797 - RNA, 21 nt, Human
gugcugggauuacaagcguga

SEQ ID NO: 1860798 - RNA, 22 nt, Human
gugcugggauuacaagcgugag

SEQ ID NO: 1860799 - RNA, 20 nt, Human
gugcugggauuacaggcgug

SEQ ID NO: 1860800 - RNA, 19 nt, Human
guggaaguaguggagcccc

SEQ ID NO: 1860801 - RNA, 20 nt, Human
gugcugggauuacaggugug

SEQ ID NO: 1860802 - RNA, 23 nt, Human
guggacacagcucuucuccaggc

SEQ ID NO: 1860803 - RNA, 18 nt, Human
guggacacagcucuucuc

SEQ ID NO: 1860804 - RNA, 22 nt, Human
guggacacagcucuucuccagg

SEQ ID NO: 1860805 - RNA, 21 nt, Human
guggauggaaggggcugacag

SEQ ID NO: 1860806 - RNA, 21 nt, Human
guggaugccugguggcagcug

SEQ ID NO: 1860807 - RNA, 15 nt, Human
aagaaaaaggaugca

SEQ ID NO: 1860808 - RNA, 17 nt, Human
aagaaaaaggaugcaca

SEQ ID NO: 1860809 - RNA, 18 nt, Human
aagaaaaaggaugcacag

SEQ ID NO: 1860810 - RNA, 22 nt, Human
aagaaagacuaucuaaauguug

SEQ ID NO: 1860811 - RNA, 20 nt, Human
aagaaagacuaucuaaaugu

SEQ ID NO: 1860812 - RNA, 13 nt, Human
aagaaauauaccu

SEQ ID NO: 1860813 - RNA, 16 nt, Human
aagaagugaaaaucua

SEQ ID NO: 1860814 - RNA, 22 nt, Human
aagaagugaaaaucuacacucc

SEQ ID NO: 1860815 - RNA, 21 nt, Human
gugcuaucucccccagcccca

SEQ ID NO: 1860816 - RNA, 22 nt, Human
gugcuaggaacacuccuucaca

SEQ ID NO: 1860817 - RNA, 18 nt, Human
gugcuaggaacacuccuu

SEQ ID NO: 1860818 - RNA, 18 nt, Human
aacuugucuuuggacccu

SEQ ID NO: 1860819 - RNA, 22 nt, Human
aacuugucuuuggacccugagg

SEQ ID NO: 1860820 - RNA, 16 nt, Human
aacuuguauuaugugu

SEQ ID NO: 1860821 - RNA, 15 nt, Human
aacuuguauuaugug

SEQ ID NO: 1860822 - RNA, 11 nt, Human
gugccuuaugg

SEQ ID NO: 1860823 - RNA, 12 nt, Human
aacuugggaacu

SEQ ID NO: 1860824 - RNA, 13 nt, Human
aacuuuaccuuuu

SEQ ID NO: 1860825 - RNA, 23 nt, Human
gugccuuauggaacacucugaga

SEQ ID NO: 1860826 - RNA, 21 nt, Human
gugccuuauggaacacucuga

SEQ ID NO: 1860827 - RNA, 14 nt, Human
gugccuuauggaac

SEQ ID NO: 1860828 - RNA, 14 nt, Human
gugccucugggacu

SEQ ID NO: 1860829 - RNA, 15 nt, Human
gugccucugccuguc

SEQ ID NO: 1860830 - RNA, 13 nt, Human
gugccucugggac

SEQ ID NO: 1860831 - RNA, 12 nt, Human
gugccucuggga

SEQ ID NO: 1860832 - RNA, 13 nt, Human
gugccucugccug

SEQ ID NO: 1860833 - RNA, 21 nt, Human
gugaaccaccacacccagccc

SEQ ID NO: 1860834 - RNA, 15 nt, Human
gugccucaagagaag

SEQ ID NO: 1860835 - RNA, 20 nt, Human
uacaaaaagcauaaaaauua

SEQ ID NO: 1860836 - RNA, 15 nt, Human
uacaaaagcauguga

SEQ ID NO: 1860837 - RNA, 13 nt, Human
uaauuccacagcu

SEQ ID NO: 1860838 - RNA, 17 nt, Human
uaauuccacagcugcuc

SEQ ID NO: 1860839 - RNA, 14 nt, Human
uaauuccacagcug

SEQ ID NO: 1860840 - RNA, 16 nt, Human
aauggacguguuauga

SEQ ID NO: 1860841 - RNA, 24 nt, Human
aaugcccagccccuucugacccau

SEQ ID NO: 1860842 - RNA, 23 nt, Human
aaugcccagccccuucugaccca

SEQ ID NO: 1860843 - RNA, 22 nt, Human
aaugcccagccccuucugaccc

SEQ ID NO: 1860844 - RNA, 20 nt, Human
aaugcccagccccuucugac

SEQ ID NO: 1860845 - RNA, 20 nt, Human
aaugcugugcccuaaagugu

SEQ ID NO: 1860846 - RNA, 21 nt, Human
aaugcugugcccuaaagugua

SEQ ID NO: 1860847 - RNA, 13 nt, Human
aaugcugugcccu

SEQ ID NO: 1860848 - RNA, 14 nt, Human
uacaaggacagccc

SEQ ID NO: 1860849 - RNA, 13 nt, Human
aaugcauaaaaug

SEQ ID NO: 1860850 - RNA, 16 nt, Human
aaugcauaaaauguua

SEQ ID NO: 1860851 - RNA, 15 nt, Human
aaugcccagccccuu

SEQ ID NO: 1860852 - RNA, 14 nt, Human
aaugcccagccccu

SEQ ID NO: 1860853 - RNA, 19 nt, Human
uacauauaagugauugcug

SEQ ID NO: 1860854 - RNA, 12 nt, Human
aauguacugcau

SEQ ID NO: 1860855 - RNA, 21 nt, Human
uacauaaugcgugcauaccac

SEQ ID NO: 1860856 - RNA, 19 nt, Human
uacauaaugcgugcauacc

SEQ ID NO: 1860857 - RNA, 20 nt, Human
uacauaaugcgugcauacca

SEQ ID NO: 1860858 - RNA, 15 nt, Human
uacaguaucucaggg

SEQ ID NO: 1860859 - RNA, 17 nt, Human
uacauaaugcgugcaua

SEQ ID NO: 1860860 - RNA, 14 nt, Human
aauguauguguaag

SEQ ID NO: 1860861 - RNA, 12 nt, Human
aauguaugugua

SEQ ID NO: 1860862 - RNA, 18 nt, Human
aauguacugcauaugaaa

SEQ ID NO: 1860863 - RNA, 14 nt, Human
aauguacugcauau

SEQ ID NO: 1860864 - RNA, 14 nt, Human
aaugugacucaaga

SEQ ID NO: 1860865 - RNA, 14 nt, Human
aauguggcuccugg

SEQ ID NO: 1860866 - RNA, 11 nt, Human
aaugugauaug

SEQ ID NO: 1860867 - RNA, 14 nt, Human
uacacuccagugag

SEQ ID NO: 1860868 - RNA, 15 nt, Human
uacaggcauagaguu

SEQ ID NO: 1860869 - RNA, 18 nt, Human
uacagaggccaugggccu

SEQ ID NO: 1860870 - RNA, 22 nt, Human
uacaggcgugagccaccgugcc

SEQ ID NO: 1860871 - RNA, 15 nt, Human
uacaggcuccugcca

SEQ ID NO: 1860872 - RNA, 14 nt, Human
uacaggcuccugcc

SEQ ID NO: 1860873 - RNA, 17 nt, Human
uacaggcuccugccacc

SEQ ID NO: 1860874 - RNA, 19 nt, Human
uacaccacuacauucuguu

SEQ ID NO: 1860875 - RNA, 20 nt, Human
uacaccacuacauucuguua

SEQ ID NO: 1860876 - RNA, 15 nt, Human
uacaccacuacauuc

SEQ ID NO: 1860877 - RNA, 16 nt, Human
uacaccacuacauucu

SEQ ID NO: 1860878 - RNA, 17 nt, Human
uacaccacuacauucug

SEQ ID NO: 1860879 - RNA, 18 nt, Human
uacaccacuacauucugu

SEQ ID NO: 1860880 - RNA, 15 nt, Human
uacacauuuuucaga

SEQ ID NO: 1860881 - RNA, 17 nt, Human
uacacauuuuucagaua

SEQ ID NO: 1860882 - RNA, 21 nt, Human
uacacauuuuucagauauaaa

SEQ ID NO: 1860883 - RNA, 19 nt, Human
uacacauuuuucagauaua

SEQ ID NO: 1860884 - RNA, 21 nt, Human
aauggacguguuaugacucca

SEQ ID NO: 1860885 - RNA, 19 nt, Human
aauggacuuuuguacauag

SEQ ID NO: 1860886 - RNA, 15 nt, Human
aaugagccuggcaag

SEQ ID NO: 1860887 - RNA, 18 nt, Human
aaugacuuacuguacaug

SEQ ID NO: 1860888 - RNA, 14 nt, Human
aaugacuuacugua

SEQ ID NO: 1860889 - RNA, 17 nt, Human
aaugacuuacuguacau

SEQ ID NO: 1860890 - RNA, 15 nt, Human
aaugaaaaccacauu

SEQ ID NO: 1860891 - RNA, 13 nt, Human
uaaugaggaaacu

SEQ ID NO: 1860892 - RNA, 20 nt, Human
aaucuucugaacuuggcgcu

SEQ ID NO: 1860893 - RNA, 13 nt, Human
aaucuucugaacu

SEQ ID NO: 1860894 - RNA, 21 nt, Human
uaauagcgucauaacuagaac

SEQ ID NO: 1860895 - RNA, 19 nt, Human
uaaugaaagacuguacaaa

SEQ ID NO: 1860896 - RNA, 18 nt, Human
uaaugaaagacuguacaa

SEQ ID NO: 1860897 - RNA, 17 nt, Human
uaaugaaagacuguaca

SEQ ID NO: 1860898 - RNA, 14 nt, Human
uaaugaaagacugu

SEQ ID NO: 1860899 - RNA, 21 nt, Human
uaaugacuuaagcacacuuga

SEQ ID NO: 1860900 - RNA, 15 nt, Human
uaaugacuuaagcac

SEQ ID NO: 1860901 - RNA, 23 nt, Human
uaaugaaagacuguacaaaguag

SEQ ID NO: 1860902 - RNA, 22 nt, Human
uaaugaaagacuguacaaagua

SEQ ID NO: 1860903 - RNA, 20 nt, Human
uaaguuuuuauggcuuuugu

SEQ ID NO: 1860904 - RNA, 12 nt, Human
aaucagcauucu

SEQ ID NO: 1860905 - RNA, 17 nt, Human
aaucagacuaugaaguu

SEQ ID NO: 1860906 - RNA, 14 nt, Human
aaucagacuaugaa

SEQ ID NO: 1860907 - RNA, 17 nt, Human
aaucauggugcucagag

SEQ ID NO: 1860908 - RNA, 17 nt, Human
uaauaaaaguacauguu

SEQ ID NO: 1860909 - RNA, 15 nt, Human
aaucaucaagucuuu

SEQ ID NO: 1860910 - RNA, 15 nt, Human
aaucucaaauaacua

SEQ ID NO: 1860911 - RNA, 12 nt, Human
aaucucaaauuu

SEQ ID NO: 1860912 - RNA, 14 nt, Human
aaucucaaauuucu

SEQ ID NO: 1860913 - RNA, 16 nt, Human
aaucuuauaauuuaaa

SEQ ID NO: 1860914 - RNA, 14 nt, Human
aaucuuauaauuua

SEQ ID NO: 1860915 - RNA, 12 nt, Human
aaucuaaaugga

SEQ ID NO: 1860916 - RNA, 18 nt, Human
aaucuaaauggaaccacu

SEQ ID NO: 1860917 - RNA, 13 nt, Human
aaucuaaauggaa

SEQ ID NO: 1860918 - RNA, 15 nt, Human
aaucuaaauggaacc

SEQ ID NO: 1860919 - RNA, 14 nt, Human
uaacaugauuuggg

SEQ ID NO: 1860920 - RNA, 14 nt, Human
uaacauggaaguac

SEQ ID NO: 1860921 - RNA, 15 nt, Human
uaacauggaaguacu

SEQ ID NO: 1860922 - RNA, 16 nt, Human
uaacauggaaguacua

SEQ ID NO: 1860923 - RNA, 15 nt, Human
uaacuaaaagguaug

SEQ ID NO: 1860924 - RNA, 14 nt, Human
uaacuaaaagguau

SEQ ID NO: 1860925 - RNA, 16 nt, Human
aauagaugcugacugu

SEQ ID NO: 1860926 - RNA, 20 nt, Human
aauagccugccucuucucua

SEQ ID NO: 1860927 - RNA, 13 nt, Human
aauagcugggacu

SEQ ID NO: 1860928 - RNA, 14 nt, Human
aauagcugggacua

SEQ ID NO: 1860929 - RNA, 18 nt, Human
aauagacaauuuauuaug

SEQ ID NO: 1860930 - RNA, 23 nt, Human
aauagacaauuuauuauggcaca

SEQ ID NO: 1860931 - RNA, 18 nt, Human
aauagacccacaagaggc

SEQ ID NO: 1860932 - RNA, 16 nt, Human
aauaggaaaaacugau

SEQ ID NO: 1860933 - RNA, 15 nt, Human
aauaggaaaaacuga

SEQ ID NO: 1860934 - RNA, 18 nt, Human
aauaggaaaaacugauuu

SEQ ID NO: 1860935 - RNA, 17 nt, Human
aauaggaaaaacugauu

SEQ ID NO: 1860936 - RNA, 19 nt, Human
aauaggaaaaacugauuuu

SEQ ID NO: 1860937 - RNA, 18 nt, Human
aauaggcguaacuaauuu

SEQ ID NO: 1860938 - RNA, 15 nt, Human
uaacuuuuauaaacu

SEQ ID NO: 1860939 - RNA, 17 nt, Human
uaacuuuuauaaacuuu

SEQ ID NO: 1860940 - RNA, 18 nt, Human
uaacuuuuauaaacuuua

SEQ ID NO: 1860941 - RNA, 19 nt, Human
uaacuuuuauaaacuuuac

SEQ ID NO: 1860942 - RNA, 17 nt, Human
uaagacauuuuuggaag

SEQ ID NO: 1860943 - RNA, 19 nt, Human
aauaucuuuuuuuuaauaa

SEQ ID NO: 1860944 - RNA, 20 nt, Human
aauaucugaaaauguaugug

SEQ ID NO: 1860945 - RNA, 19 nt, Human
aauaucugaaaauguaugu

SEQ ID NO: 1860946 - RNA, 18 nt, Human
aauaucugaaaauguaug

SEQ ID NO: 1860947 - RNA, 17 nt, Human
aauaucugaaaauguau

SEQ ID NO: 1860948 - RNA, 16 nt, Human
aauaucugaaaaugua

SEQ ID NO: 1860949 - RNA, 15 nt, Human
aauaugcacacauuu

SEQ ID NO: 1860950 - RNA, 18 nt, Human
aauauugauaugcuuaua

SEQ ID NO: 1860951 - RNA, 22 nt, Human
aauauugcugauggugcaauga

SEQ ID NO: 1860952 - RNA, 21 nt, Human
aauauugcugauggugcaaug

SEQ ID NO: 1860953 - RNA, 18 nt, Human
aauauugcugauggugca

SEQ ID NO: 1860954 - RNA, 15 nt, Human
aauauugcugauggu

SEQ ID NO: 1860955 - RNA, 13 nt, Human
aauauugcugaug

SEQ ID NO: 1860956 - RNA, 12 nt, Human
aauauugcugau

SEQ ID NO: 1860957 - RNA, 11 nt, Human
aauauugcuga

SEQ ID NO: 1860958 - RNA, 13 nt, Human
aauauuguacagu

SEQ ID NO: 1860959 - RNA, 14 nt, Human
aauauuguacaguu

SEQ ID NO: 1860960 - RNA, 12 nt, Human
aauaacuuuuuu

SEQ ID NO: 1860961 - RNA, 19 nt, Human
uaaauaaugugaaacugga

SEQ ID NO: 1860962 - RNA, 21 nt, Human
uaaauaaaguuuguugaaaca

SEQ ID NO: 1860963 - RNA, 12 nt, Human
uaaauaaaguuu

SEQ ID NO: 1860964 - RNA, 18 nt, Human
uaaauuaacuuuuauaaa

SEQ ID NO: 1860965 - RNA, 17 nt, Human
uaaauuaacuuuuauaa

SEQ ID NO: 1860966 - RNA, 15 nt, Human
uaaauuaacuuuuau

SEQ ID NO: 1860967 - RNA, 16 nt, Human
uaaauuaacuuuuaua

SEQ ID NO: 1860968 - RNA, 12 nt, Human
uaaauuaacuuu

SEQ ID NO: 1860969 - RNA, 14 nt, Human
uaaauuaacuuuua

SEQ ID NO: 1860970 - RNA, 24 nt, Human
uaaauguuuuuuuuuaaagacuuu

SEQ ID NO: 1860971 - RNA, 20 nt, Human
uaaauguugaaagaucaaaa

SEQ ID NO: 1860972 - RNA, 23 nt, Human
uaaauguuuuuuuuuaaagacuu

SEQ ID NO: 1860973 - RNA, 15 nt, Human
uaaauguugaaagau

SEQ ID NO: 1860974 - RNA, 23 nt, Human
uaaaugcaccuggaauauauaac

SEQ ID NO: 1860975 - RNA, 14 nt, Human
uaaaucuccaaaau

SEQ ID NO: 1860976 - RNA, 15 nt, Human
uaaaucuccaaaaua

SEQ ID NO: 1860977 - RNA, 18 nt, Human
uaaaucuccaaaauaaaa

SEQ ID NO: 1860978 - RNA, 22 nt, Human
uaaaguaaaaacaaagaaauua

SEQ ID NO: 1860979 - RNA, 21 nt, Human
uaaaguaaaaacaaagaaauu

SEQ ID NO: 1860980 - RNA, 19 nt, Human
uaaaguaaaaacaaagaaa

SEQ ID NO: 1860981 - RNA, 22 nt, Human
uaaagguucaugcaaacuuuau

SEQ ID NO: 1860982 - RNA, 20 nt, Human
aaguuuuuauggcuuuugug

SEQ ID NO: 1860983 - RNA, 15 nt, Human
aaguuuuguaaauuu

SEQ ID NO: 1860984 - RNA, 16 nt, Human
aauaaaucauaaaacu

SEQ ID NO: 1860985 - RNA, 12 nt, Human
aauaaaacuuuu

SEQ ID NO: 1860986 - RNA, 14 nt, Human
aauaaaacuuuuua

SEQ ID NO: 1860987 - RNA, 15 nt, Human
aauaaaacuuuuuaa

SEQ ID NO: 1860988 - RNA, 18 nt, Human
aauaaaacuuuuuaaaau

SEQ ID NO: 1860989 - RNA, 20 nt, Human
aauaaauugcuccuugacau

SEQ ID NO: 1860990 - RNA, 16 nt, Human
aauaaauugcuccuug

SEQ ID NO: 1860991 - RNA, 21 nt, Human
aauaacaaugaaaguugauaa

SEQ ID NO: 1860992 - RNA, 15 nt, Human
aauaacgauaaaaga

SEQ ID NO: 1860993 - RNA, 17 nt, Human
acaacaucuuuuucuac

SEQ ID NO: 1860994 - RNA, 13 nt, Human
acaagacacagug

SEQ ID NO: 1860995 - RNA, 17 nt, Human
acaaauuuacagagaca

SEQ ID NO: 1860996 - RNA, 21 nt, Human
acaaauucugucucuggauua

SEQ ID NO: 1860997 - RNA, 22 nt, Human
acaagagcccaggccuccuaca

SEQ ID NO: 1860998 - RNA, 19 nt, Human
acaagagcuuaacagugug

SEQ ID NO: 1860999 - RNA, 18 nt, Human
acaagagcuuaacagugu

SEQ ID NO: 1861000 - RNA, 16 nt, Human
acaagaccacguuucu

SEQ ID NO: 1861001 - RNA, 14 nt, Human
acaagacacaguga

SEQ ID NO: 1861002 - RNA, 17 nt, Human
acaagaccacguuucua

SEQ ID NO: 1861003 - RNA, 13 nt, Human
acaagcuccaagc

SEQ ID NO: 1861004 - RNA, 17 nt, Human
acaagcgugagccacug

SEQ ID NO: 1861005 - RNA, 16 nt, Human
uagcucaggugucccu

SEQ ID NO: 1861006 - RNA, 16 nt, Human
uagcuacuaauuuuaa

SEQ ID NO: 1861007 - RNA, 19 nt, Human
acaagcuccaagcucccag

SEQ ID NO: 1861008 - RNA, 17 nt, Human
acaagcuccaagcuccc

SEQ ID NO: 1861009 - RNA, 16 nt, Human
acaagcuccaagcucc

SEQ ID NO: 1861010 - RNA, 15 nt, Human
acaagcuccaagcuc

SEQ ID NO: 1861011 - RNA, 22 nt, Human
acaagcuccaagcucccaggca

SEQ ID NO: 1861012 - RNA, 18 nt, Human
acaagcgugagccacugc

SEQ ID NO: 1861013 - RNA, 20 nt, Human
acaaucucggcucacugcau

SEQ ID NO: 1861014 - RNA, 18 nt, Human
acaaucucggcucacugc

SEQ ID NO: 1861015 - RNA, 13 nt, Human
uacuuuuuccugg

SEQ ID NO: 1861016 - RNA, 16 nt, Human
aauuuguuauaaugaa

SEQ ID NO: 1861017 - RNA, 22 nt, Human
aauuuuuuuaucgucacugcuu

SEQ ID NO: 1861018 - RNA, 22 nt, Human
aauuuuuaaucuuuaauuuuac

SEQ ID NO: 1861019 - RNA, 22 nt, Human
uagauaggucagugcaaauacu

SEQ ID NO: 1861020 - RNA, 21 nt, Human
acaaagcgugguggacaugca

SEQ ID NO: 1861021 - RNA, 18 nt, Human
acaaagcccuuccauguc

SEQ ID NO: 1861022 - RNA, 14 nt, Human
acaaaacuuuucua

SEQ ID NO: 1861023 - RNA, 17 nt, Human
uacugagagugaacaaa

SEQ ID NO: 1861024 - RNA, 19 nt, Human
uacugagagugaacaaauu

SEQ ID NO: 1861025 - RNA, 16 nt, Human
uacuguaauuugugau

SEQ ID NO: 1861026 - RNA, 17 nt, Human
uacuguaauuugugaua

SEQ ID NO: 1861027 - RNA, 15 nt, Human
uacuguaauuuguga

SEQ ID NO: 1861028 - RNA, 21 nt, Human
aauugacuuauuuauauaaau

SEQ ID NO: 1861029 - RNA, 18 nt, Human
uacuguacaugaaaacac

SEQ ID NO: 1861030 - RNA, 23 nt, Human
uacuguacagacagaaaaaacug

SEQ ID NO: 1861031 - RNA, 19 nt, Human
uacuguacagacagaaaaa

SEQ ID NO: 1861032 - RNA, 24 nt, Human
uacgcuccaucgcugucaucucag

SEQ ID NO: 1861033 - RNA, 15 nt, Human
uacgucugacaggca

SEQ ID NO: 1861034 - RNA, 22 nt, Human
uacucuacccucuuagaaaaac

SEQ ID NO: 1861035 - RNA, 18 nt, Human
uacuagggaaaugccuuu

SEQ ID NO: 1861036 - RNA, 18 nt, Human
uacuaaaaauacaaaaaa

SEQ ID NO: 1861037 - RNA, 14 nt, Human
uacuaaaaauacaa

SEQ ID NO: 1861038 - RNA, 13 nt, Human
uacgugaguccug

SEQ ID NO: 1861039 - RNA, 16 nt, Human
uacgucugacaggcaa

SEQ ID NO: 1861040 - RNA, 15 nt, Human
uacuugaaaauuaac

SEQ ID NO: 1861041 - RNA, 23 nt, Human
uacuuugauauuuucaacgcagc

SEQ ID NO: 1861042 - RNA, 15 nt, Human
uacuucuuauacauu

SEQ ID NO: 1861043 - RNA, 14 nt, Human
uacuucuuauacau

SEQ ID NO: 1861044 - RNA, 16 nt, Human
uacuucuuauacauuu

SEQ ID NO: 1861045 - RNA, 20 nt, Human
uacuucuccacccugcucuc

SEQ ID NO: 1861046 - RNA, 15 nt, Human
uacuucugcuacaua

SEQ ID NO: 1861047 - RNA, 20 nt, Human
uacuuccccuuccuaauucc

SEQ ID NO: 1861048 - RNA, 18 nt, Human
uacuuccccuuccuaauu

SEQ ID NO: 1861049 - RNA, 15 nt, Human
uacuuccccuuccua

SEQ ID NO: 1861050 - RNA, 14 nt, Human
uacuuccccuuccu

SEQ ID NO: 1861051 - RNA, 23 nt, Human
uacuuccugugacuucagcucug

SEQ ID NO: 1861052 - RNA, 13 nt, Human
uacuucuccaccc

SEQ ID NO: 1861053 - RNA, 18 nt, Human
uacuucuccacccugcuc

SEQ ID NO: 1861054 - RNA, 15 nt, Human
aauuugaaacacuuu

SEQ ID NO: 1861055 - RNA, 17 nt, Human
aauuuacagagacagaa

SEQ ID NO: 1861056 - RNA, 18 nt, Human
aauuuacagagacagaaa

SEQ ID NO: 1861057 - RNA, 17 nt, Human
aauuuaccugaagucuu

SEQ ID NO: 1861058 - RNA, 15 nt, Human
aauuuacauacucug

SEQ ID NO: 1861059 - RNA, 13 nt, Human
aauuuauuauggc

SEQ ID NO: 1861060 - RNA, 14 nt, Human
aauuuauuauggca

SEQ ID NO: 1861061 - RNA, 17 nt, Human
aauuuauuauggcacau

SEQ ID NO: 1861062 - RNA, 22 nt, Human
aauuuauaaacuuuuuucuuac

SEQ ID NO: 1861063 - RNA, 15 nt, Human
acacuguucucugcc

SEQ ID NO: 1861064 - RNA, 14 nt, Human
acacuguucucugc

SEQ ID NO: 1861065 - RNA, 20 nt, Human
acacuguucucugcccucca

SEQ ID NO: 1861066 - RNA, 18 nt, Human
acacuguucucugcccuc

SEQ ID NO: 1861067 - RNA, 17 nt, Human
acacuguucucugcccu

SEQ ID NO: 1861068 - RNA, 16 nt, Human
acacuguucucugccc

SEQ ID NO: 1861069 - RNA, 23 nt, Human
acacuguucucugcccuccaaga

SEQ ID NO: 1861070 - RNA, 22 nt, Human
acacuguucucugcccuccaag

SEQ ID NO: 1861071 - RNA, 14 nt, Human
acacuccagugaga

SEQ ID NO: 1861072 - RNA, 13 nt, Human
acacuccuucaca

SEQ ID NO: 1861073 - RNA, 13 nt, Human
acacucugagacu

SEQ ID NO: 1861074 - RNA, 11 nt, Human
acacucugaga

SEQ ID NO: 1861075 - RNA, 23 nt, Human
acacuuguugauuaauggaaaug

SEQ ID NO: 1861076 - RNA, 20 nt, Human
acacuuguugauuaauggaa

SEQ ID NO: 1861077 - RNA, 13 nt, Human
acacuuaaaaaug

SEQ ID NO: 1861078 - RNA, 15 nt, Human
acacuuaaaaauggu

SEQ ID NO: 1861079 - RNA, 16 nt, Human
acacuguuucaaacuu

SEQ ID NO: 1861080 - RNA, 15 nt, Human
acacuguuucaaacu

SEQ ID NO: 1861081 - RNA, 23 nt, Human
acacuguuucaaacuuuacuaug

SEQ ID NO: 1861082 - RNA, 17 nt, Human
acagacuggaagcacag

SEQ ID NO: 1861083 - RNA, 19 nt, Human
acagacuggaagcacagcu

SEQ ID NO: 1861084 - RNA, 21 nt, Human
acagacuggaagcacagcuuc

SEQ ID NO: 1861085 - RNA, 22 nt, Human
acagacuggaagcacagcuuca

SEQ ID NO: 1861086 - RNA, 18 nt, Human
acagacacaggcccggcu

SEQ ID NO: 1861087 - RNA, 22 nt, Human
acagacacaggcccggcuccag

SEQ ID NO: 1861088 - RNA, 19 nt, Human
acagaaagcagaacaguga

SEQ ID NO: 1861089 - RNA, 17 nt, Human
acagacacaggcccggc

SEQ ID NO: 1861090 - RNA, 12 nt, Human
uauauuuacaaa

SEQ ID NO: 1861091 - RNA, 19 nt, Human
uaucccuacuguaauuugu

SEQ ID NO: 1861092 - RNA, 20 nt, Human
uaucccuacuguaauuugug

SEQ ID NO: 1861093 - RNA, 16 nt, Human
uaucccggcugcccuu

SEQ ID NO: 1861094 - RNA, 15 nt, Human
uaucucagggccugg

SEQ ID NO: 1861095 - RNA, 13 nt, Human
uaucucagggccu

SEQ ID NO: 1861096 - RNA, 17 nt, Human
uauccuacuuccccuuc

SEQ ID NO: 1861097 - RNA, 14 nt, Human
uauccuacuucccc

SEQ ID NO: 1861098 - RNA, 21 nt, Human
acagagcaagugagacccugu

SEQ ID NO: 1861099 - RNA, 17 nt, Human
acagaguuguuacauuu

SEQ ID NO: 1861100 - RNA, 18 nt, Human
acagaguuguuacauuuu

SEQ ID NO: 1861101 - RNA, 19 nt, Human
acagaguuguuacauuuuu

SEQ ID NO: 1861102 - RNA, 20 nt, Human
acagaguuguuacauuuuua

SEQ ID NO: 1861103 - RNA, 16 nt, Human
acagaguuguuacauu

SEQ ID NO: 1861104 - RNA, 23 nt, Human
acagcccgggcucugccucccau

SEQ ID NO: 1861105 - RNA, 22 nt, Human
acagcccgggcucugccuccca

SEQ ID NO: 1861106 - RNA, 21 nt, Human
acagcccgggcucugccuccc

SEQ ID NO: 1861107 - RNA, 16 nt, Human
acagcaaggagauuua

SEQ ID NO: 1861108 - RNA, 23 nt, Human
uaugaaagauggcugugccucug

SEQ ID NO: 1861109 - RNA, 22 nt, Human
uaugaaagauggcugugccucu

SEQ ID NO: 1861110 - RNA, 20 nt, Human
uaugaaagauggcugugccu

SEQ ID NO: 1861111 - RNA, 21 nt, Human
acagaguuguuacauuuuuaa

SEQ ID NO: 1861112 - RNA, 22 nt, Human
acagaguuguuacauuuuuaag

SEQ ID NO: 1861113 - RNA, 20 nt, Human
acagauagauauaugcucug

SEQ ID NO: 1861114 - RNA, 20 nt, Human
acagauacuccuccaagguu

SEQ ID NO: 1861115 - RNA, 23 nt, Human
acagaugggugcuuggaggaagg

SEQ ID NO: 1861116 - RNA, 20 nt, Human
acagauguaaaagacuuuuu

SEQ ID NO: 1861117 - RNA, 13 nt, Human
uaguagagacagg

SEQ ID NO: 1861118 - RNA, 19 nt, Human
acacagucuuggcucacug

SEQ ID NO: 1861119 - RNA, 11 nt, Human
acacagugagu

SEQ ID NO: 1861120 - RNA, 21 nt, Human
uagguuggcaaaaaggcagga

SEQ ID NO: 1861121 - RNA, 17 nt, Human
acacagugaccauacua

SEQ ID NO: 1861122 - RNA, 13 nt, Human
acacagugagucg

SEQ ID NO: 1861123 - RNA, 11 nt, Human
acacacagcuc

SEQ ID NO: 1861124 - RNA, 12 nt, Human
acacacagcucu

SEQ ID NO: 1861125 - RNA, 14 nt, Human
acacacacauacac

SEQ ID NO: 1861126 - RNA, 21 nt, Human
acaaugguuuucuuguguguu

SEQ ID NO: 1861127 - RNA, 15 nt, Human
acaaugguuuucuug

SEQ ID NO: 1861128 - RNA, 22 nt, Human
uauaaccaguguuguggauuua

SEQ ID NO: 1861129 - RNA, 19 nt, Human
uauaacuauguugauaaaa

SEQ ID NO: 1861130 - RNA, 16 nt, Human
acacuaaccacgcugg

SEQ ID NO: 1861131 - RNA, 17 nt, Human
acacuaaccacgcugga

SEQ ID NO: 1861132 - RNA, 19 nt, Human
acacuaaccacgcuggacc

SEQ ID NO: 1861133 - RNA, 19 nt, Human
acaccucugcacaagcugc

SEQ ID NO: 1861134 - RNA, 14 nt, Human
acaccuugacaggg

SEQ ID NO: 1861135 - RNA, 15 nt, Human
acaccuugacagggc

SEQ ID NO: 1861136 - RNA, 16 nt, Human
acaccuugacagggca

SEQ ID NO: 1861137 - RNA, 18 nt, Human
acaccucugcacaagcug

SEQ ID NO: 1861138 - RNA, 19 nt, Human
acacauguccaagaagccc

SEQ ID NO: 1861139 - RNA, 18 nt, Human
acacauguccaagaagcc

SEQ ID NO: 1861140 - RNA, 13 nt, Human
acacauguccaag

SEQ ID NO: 1861141 - RNA, 22 nt, Human
acacauguccaagaagcccagg

SEQ ID NO: 1861142 - RNA, 21 nt, Human
acacauguccaagaagcccag

SEQ ID NO: 1861143 - RNA, 13 nt, Human
acacauuuuauuu

SEQ ID NO: 1861144 - RNA, 12 nt, Human
acacccagccca

SEQ ID NO: 1861145 - RNA, 13 nt, Human
acacccagcccac

SEQ ID NO: 1861146 - RNA, 14 nt, Human
uauaaaagacugac

SEQ ID NO: 1861147 - RNA, 21 nt, Human
uauaaaaauaaaaaacacugg

SEQ ID NO: 1861148 - RNA, 20 nt, Human
uauaaaaauaaaaaacacug

SEQ ID NO: 1861149 - RNA, 10 nt, Human
uaguuuuugu

SEQ ID NO: 1861150 - RNA, 18 nt, Human
uaguucagguaacaggca

SEQ ID NO: 1861151 - RNA, 20 nt, Human
ucaccccagccccaaaacuc

SEQ ID NO: 1861152 - RNA, 14 nt, Human
ucaccccagcccca

SEQ ID NO: 1861153 - RNA, 13 nt, Human
ucaccccagcccc

SEQ ID NO: 1861154 - RNA, 15 nt, Human
ucaccccggccaccu

SEQ ID NO: 1861155 - RNA, 16 nt, Human
ucacaacaaccugguc

SEQ ID NO: 1861156 - RNA, 22 nt, Human
ucacacgucuggcuucacagau

SEQ ID NO: 1861157 - RNA, 12 nt, Human
ucacauaucugu

SEQ ID NO: 1861158 - RNA, 15 nt, Human
ucacauaucugucau

SEQ ID NO: 1861159 - RNA, 15 nt, Human
ucacaguucucuccu

SEQ ID NO: 1861160 - RNA, 15 nt, Human
accaauguucucucu

SEQ ID NO: 1861161 - RNA, 18 nt, Human
accaauauuguacaguuu

SEQ ID NO: 1861162 - RNA, 19 nt, Human
accaauauuguacaguuuu

SEQ ID NO: 1861163 - RNA, 15 nt, Human
accaauauuguacag

SEQ ID NO: 1861164 - RNA, 14 nt, Human
accaauauuguaca

SEQ ID NO: 1861165 - RNA, 16 nt, Human
accaauauuguacagu

SEQ ID NO: 1861166 - RNA, 17 nt, Human
accaauauuguacaguu

SEQ ID NO: 1861167 - RNA, 22 nt, Human
accaacauacucccaucuguga

SEQ ID NO: 1861168 - RNA, 21 nt, Human
accaacauacucccaucugug

SEQ ID NO: 1861169 - RNA, 19 nt, Human
accaacauacucccaucug

SEQ ID NO: 1861170 - RNA, 20 nt, Human
ucaagugauucucaugccuc

SEQ ID NO: 1861171 - RNA, 23 nt, Human
ucaagugaaaaaggaggaagaga

SEQ ID NO: 1861172 - RNA, 17 nt, Human
ucaagugauucucaugc

SEQ ID NO: 1861173 - RNA, 15 nt, Human
ucaagugaaaaagga

SEQ ID NO: 1861174 - RNA, 14 nt, Human
accacacuccagcu

SEQ ID NO: 1861175 - RNA, 15 nt, Human
ucaauucuugccaaa

SEQ ID NO: 1861176 - RNA, 15 nt, Human
accacuuuuguucuu

SEQ ID NO: 1861177 - RNA, 16 nt, Human
accacuuuuguucuug

SEQ ID NO: 1861178 - RNA, 21 nt, Human
accacuuuuguucuugguuug

SEQ ID NO: 1861179 - RNA, 22 nt, Human
ucaccccggccaccugcggugc

SEQ ID NO: 1861180 - RNA, 21 nt, Human
accacugcacuccagccuggg

SEQ ID NO: 1861181 - RNA, 23 nt, Human
accacugcucugaugaagaggag

SEQ ID NO: 1861182 - RNA, 17 nt, Human
accacugcucugaugaa

SEQ ID NO: 1861183 - RNA, 15 nt, Human
accacugcucugaug

SEQ ID NO: 1861184 - RNA, 20 nt, Human
accacugcacuccagccugg

SEQ ID NO: 1861185 - RNA, 17 nt, Human
accacugcacuccagcc

SEQ ID NO: 1861186 - RNA, 18 nt, Human
ucaccccggccaccugcg

SEQ ID NO: 1861187 - RNA, 17 nt, Human
ucaccccggccaccugc

SEQ ID NO: 1861188 - RNA, 22 nt, Human
accacuuuuguucuugguuugu

SEQ ID NO: 1861189 - RNA, 12 nt, Human
accagagcccac

SEQ ID NO: 1861190 - RNA, 14 nt, Human
accagagcccaccu

SEQ ID NO: 1861191 - RNA, 16 nt, Human
accagagcccaccuug

SEQ ID NO: 1861192 - RNA, 14 nt, Human
accagacaccuuga

SEQ ID NO: 1861193 - RNA, 11 nt, Human
accagacaggu

SEQ ID NO: 1861194 - RNA, 13 nt, Human
ucaccugccccuc

SEQ ID NO: 1861195 - RNA, 15 nt, Human
ucaccugccccucaa

SEQ ID NO: 1861196 - RNA, 15 nt, Human
ucaccucucccuugg

SEQ ID NO: 1861197 - RNA, 16 nt, Human
ucaccugaagacucau

SEQ ID NO: 1861198 - RNA, 14 nt, Human
accagggacugagg

SEQ ID NO: 1861199 - RNA, 21 nt, Human
accagccuccaugcugccucc

SEQ ID NO: 1861200 - RNA, 20 nt, Human
accagccuccaugcugccuc

SEQ ID NO: 1861201 - RNA, 19 nt, Human
accagccuccaugcugccu

SEQ ID NO: 1861202 - RNA, 14 nt, Human
accagccuccaugc

SEQ ID NO: 1861203 - RNA, 17 nt, Human
accagagcccaccuugg

SEQ ID NO: 1861204 - RNA, 18 nt, Human
ucacuauguugcccaggc

SEQ ID NO: 1861205 - RNA, 17 nt, Human
ucacuauguugcccagg

SEQ ID NO: 1861206 - RNA, 19 nt, Human
ucacuauguugcccaggca

SEQ ID NO: 1861207 - RNA, 20 nt, Human
ucacuauguugcccaggcag

SEQ ID NO: 1861208 - RNA, 12 nt, Human
acccccacccaa

SEQ ID NO: 1861209 - RNA, 16 nt, Human
accccuucgcuccugu

SEQ ID NO: 1861210 - RNA, 14 nt, Human
accccuucgcuccu

SEQ ID NO: 1861211 - RNA, 15 nt, Human
accccuucgcuccug

SEQ ID NO: 1861212 - RNA, 12 nt, Human
ucagcucaugga

SEQ ID NO: 1861213 - RNA, 20 nt, Human
ucagcuuguaaauagcucag

SEQ ID NO: 1861214 - RNA, 16 nt, Human
ucagcucacugcaacc

SEQ ID NO: 1861215 - RNA, 13 nt, Human
ucagcucacugca

SEQ ID NO: 1861216 - RNA, 14 nt, Human
ucagcggggacagc

SEQ ID NO: 1861217 - RNA, 23 nt, Human
ucagccguguaaccauggaccca

SEQ ID NO: 1861218 - RNA, 19 nt, Human
acccagcgagcccuggugg

SEQ ID NO: 1861219 - RNA, 23 nt, Human
acccagcgagcccugguggcagu

SEQ ID NO: 1861220 - RNA, 22 nt, Human
ucagccaagaauucuuaaauau

SEQ ID NO: 1861221 - RNA, 24 nt, Human
acccagcgagcccugguggcagug

SEQ ID NO: 1861222 - RNA, 23 nt, Human
accccagcuggggccaggcuggg

SEQ ID NO: 1861223 - RNA, 16 nt, Human
acccccaaauuuucuu

SEQ ID NO: 1861224 - RNA, 20 nt, Human
ucagagacuccugcaggcag

SEQ ID NO: 1861225 - RNA, 17 nt, Human
ucagagacuccugcagg

SEQ ID NO: 1861226 - RNA, 21 nt, Human
ucagagacuccugcaggcagc

SEQ ID NO: 1861227 - RNA, 19 nt, Human
ucagaaucucaaauaacua

SEQ ID NO: 1861228 - RNA, 18 nt, Human
ucagaaucucaaauaacu

SEQ ID NO: 1861229 - RNA, 17 nt, Human
ucagaaucucucuucuu

SEQ ID NO: 1861230 - RNA, 21 nt, Human
ucagagagggugggagugggc

SEQ ID NO: 1861231 - RNA, 16 nt, Human
ucagagagggugggag

SEQ ID NO: 1861232 - RNA, 23 nt, Human
ucagagagggugggagugggccc

SEQ ID NO: 1861233 - RNA, 12 nt, Human
ucagagccugca

SEQ ID NO: 1861234 - RNA, 13 nt, Human
ucagagccugcag

SEQ ID NO: 1861235 - RNA, 14 nt, Human
ucagagccugcagu

SEQ ID NO: 1861236 - RNA, 15 nt, Human
ucagagccugcaguu

SEQ ID NO: 1861237 - RNA, 18 nt, Human
ucagagccugcaguuauu

SEQ ID NO: 1861238 - RNA, 14 nt, Human
ucagaagacacuga

SEQ ID NO: 1861239 - RNA, 22 nt, Human
ucagaaguuucugccgcagccc

SEQ ID NO: 1861240 - RNA, 19 nt, Human
ucagaaguuucugccgcag

SEQ ID NO: 1861241 - RNA, 19 nt, Human
ucagaaguuucucagcucc

SEQ ID NO: 1861242 - RNA, 15 nt, Human
ucacuccuaccuggu

SEQ ID NO: 1861243 - RNA, 21 nt, Human
ucacucuuauugcccacgcug

SEQ ID NO: 1861244 - RNA, 23 nt, Human
ucacucuuauugcccacgcugga

SEQ ID NO: 1861245 - RNA, 22 nt, Human
accauggucggaaaacaugcua

SEQ ID NO: 1861246 - RNA, 13 nt, Human
acccacugcucug

SEQ ID NO: 1861247 - RNA, 14 nt, Human
acccacugcucugg

SEQ ID NO: 1861248 - RNA, 15 nt, Human
acccacugcucuggu

SEQ ID NO: 1861249 - RNA, 11 nt, Human
acccacugcuu

SEQ ID NO: 1861250 - RNA, 10 nt, Human
acccacugcu

SEQ ID NO: 1861251 - RNA, 11 nt, Human
acccacugcuc

SEQ ID NO: 1861252 - RNA, 23 nt, Human
accauuucuugagguaaaagcau

SEQ ID NO: 1861253 - RNA, 18 nt, Human
ucaaaagaaagaaaauca

SEQ ID NO: 1861254 - RNA, 19 nt, Human
ucaaaauuguuacaaauug

SEQ ID NO: 1861255 - RNA, 16 nt, Human
ucaaaauuguuacaaa

SEQ ID NO: 1861256 - RNA, 14 nt, Human
ucaaagcugaaaug

SEQ ID NO: 1861257 - RNA, 19 nt, Human
acaugauccugcaauucca

SEQ ID NO: 1861258 - RNA, 19 nt, Human
acaugagcaucaggccagg

SEQ ID NO: 1861259 - RNA, 18 nt, Human
acaugagcaucaggccag

SEQ ID NO: 1861260 - RNA, 17 nt, Human
acaugagcaucaggcca

SEQ ID NO: 1861261 - RNA, 17 nt, Human
acaugaucuucuuuaua

SEQ ID NO: 1861262 - RNA, 15 nt, Human
acaugaucuucuuua

SEQ ID NO: 1861263 - RNA, 22 nt, Human
acaugcuacacacugcauguuu

SEQ ID NO: 1861264 - RNA, 20 nt, Human
acaugagcaucaggccaggc

SEQ ID NO: 1861265 - RNA, 18 nt, Human
ucaaauaacuaaaaggua

SEQ ID NO: 1861266 - RNA, 22 nt, Human
acauuagcaguuugcuuuguau

SEQ ID NO: 1861267 - RNA, 18 nt, Human
acauuagcaguuugcuuu

SEQ ID NO: 1861268 - RNA, 21 nt, Human
acauguccaagaagcccagga

SEQ ID NO: 1861269 - RNA, 15 nt, Human
acauucuguuaauca

SEQ ID NO: 1861270 - RNA, 15 nt, Human
ucaaauuucuaaauc

SEQ ID NO: 1861271 - RNA, 16 nt, Human
ucaaauuucuaaaucu

SEQ ID NO: 1861272 - RNA, 12 nt, Human
acauucuguuaa

SEQ ID NO: 1861273 - RNA, 17 nt, Human
ucaaauuucuaaaucuc

SEQ ID NO: 1861274 - RNA, 16 nt, Human
ucaacagguuuuccug

SEQ ID NO: 1861275 - RNA, 15 nt, Human
ucaagacuuccagag

SEQ ID NO: 1861276 - RNA, 23 nt, Human
ucaaguauuauaccuuuuuuaga

SEQ ID NO: 1861277 - RNA, 16 nt, Human
ucaaguauuauaccuu

SEQ ID NO: 1861278 - RNA, 21 nt, Human
ucaaguauuauaccuuuuuua

SEQ ID NO: 1861279 - RNA, 15 nt, Human
ucaaguauuauaccu

SEQ ID NO: 1861280 - RNA, 11 nt, Human
ucaaguauuau

SEQ ID NO: 1861281 - RNA, 18 nt, Human
acaugaaaacacauuuuu

SEQ ID NO: 1861282 - RNA, 19 nt, Human
acaugaaaacacauuuuuc

SEQ ID NO: 1861283 - RNA, 17 nt, Human
acaugaaaacacauuuu

SEQ ID NO: 1861284 - RNA, 21 nt, Human
acaucuugcucugcugacaga

SEQ ID NO: 1861285 - RNA, 18 nt, Human
acaucuugcucugcugac

SEQ ID NO: 1861286 - RNA, 19 nt, Human
acaucuugcucugcugaca

SEQ ID NO: 1861287 - RNA, 13 nt, Human
acaucuugcucug

SEQ ID NO: 1861288 - RNA, 14 nt, Human
acaucuugcucugc

SEQ ID NO: 1861289 - RNA, 13 nt, Human
acaucaacagaua

SEQ ID NO: 1861290 - RNA, 18 nt, Human
acaucaacaucuugguca

SEQ ID NO: 1861291 - RNA, 16 nt, Human
acaucaacaucuuggu

SEQ ID NO: 1861292 - RNA, 18 nt, Human
acauauugauuuccguua

SEQ ID NO: 1861293 - RNA, 22 nt, Human
acauauugauuuccguuaaaau

SEQ ID NO: 1861294 - RNA, 23 nt, Human
acauauugauuuccguuaaaaua

SEQ ID NO: 1861295 - RNA, 14 nt, Human
acauauugauuucc

SEQ ID NO: 1861296 - RNA, 16 nt, Human
acauauugauuuccgu

SEQ ID NO: 1861297 - RNA, 14 nt, Human
acauagaauuaaca

SEQ ID NO: 1861298 - RNA, 18 nt, Human
acauagaauuaacacaug

SEQ ID NO: 1861299 - RNA, 21 nt, Human
acauagcuuacaagccagcug

SEQ ID NO: 1861300 - RNA, 21 nt, Human
acauagugaugguuccccugu

SEQ ID NO: 1861301 - RNA, 16 nt, Human
acauagugaugguucc

SEQ ID NO: 1861302 - RNA, 15 nt, Human
acaguuuuuauugcu

SEQ ID NO: 1861303 - RNA, 16 nt, Human
acaguuuguuaguaug

SEQ ID NO: 1861304 - RNA, 20 nt, Human
acaguuuguuaguaugaggc

SEQ ID NO: 1861305 - RNA, 14 nt, Human
acauacucugcuua

SEQ ID NO: 1861306 - RNA, 17 nt, Human
acauacucccaucugug

SEQ ID NO: 1861307 - RNA, 21 nt, Human
acauacuaaccagcagaaaug

SEQ ID NO: 1861308 - RNA, 22 nt, Human
acauacuaaccagcagaaaugc

SEQ ID NO: 1861309 - RNA, 13 nt, Human
acauacucccauc

SEQ ID NO: 1861310 - RNA, 13 nt, Human
acauacuaaccag

SEQ ID NO: 1861311 - RNA, 16 nt, Human
acaguugaaaaacagc

SEQ ID NO: 1861312 - RNA, 15 nt, Human
acaguugaaaaacag

SEQ ID NO: 1861313 - RNA, 20 nt, Human
acaguugaaaaacagcugag

SEQ ID NO: 1861314 - RNA, 22 nt, Human
uauuucccucaccuuucccauc

SEQ ID NO: 1861315 - RNA, 23 nt, Human
uauuuccuauauuguuuucagug

SEQ ID NO: 1861316 - RNA, 14 nt, Human
accugaggcccuuc

SEQ ID NO: 1861317 - RNA, 21 nt, Human
accugaggcccuucucuccag

SEQ ID NO: 1861318 - RNA, 20 nt, Human
accugaggcccuucucucca

SEQ ID NO: 1861319 - RNA, 16 nt, Human
accugaggcccuucuc

SEQ ID NO: 1861320 - RNA, 15 nt, Human
accugaggcccuucu

SEQ ID NO: 1861321 - RNA, 22 nt, Human
accugaggcccuucucuccagc

SEQ ID NO: 1861322 - RNA, 18 nt, Human
accugauugugucucuug

SEQ ID NO: 1861323 - RNA, 17 nt, Human
accugauugugucucuu

SEQ ID NO: 1861324 - RNA, 15 nt, Human
accugauugugucuc

SEQ ID NO: 1861325 - RNA, 15 nt, Human
ucauugaccugaggc

SEQ ID NO: 1861326 - RNA, 14 nt, Human
ucauugaccugagg

SEQ ID NO: 1861327 - RNA, 12 nt, Human
ucauugaccuga

SEQ ID NO: 1861328 - RNA, 22 nt, Human
ucauugaaaucuuuuugcuuug

SEQ ID NO: 1861329 - RNA, 19 nt, Human
accucggugccuuccucuu

SEQ ID NO: 1861330 - RNA, 13 nt, Human
accuccugggcua

SEQ ID NO: 1861331 - RNA, 13 nt, Human
accuccugcuggg

SEQ ID NO: 1861332 - RNA, 16 nt, Human
accuccugcugggcag

SEQ ID NO: 1861333 - RNA, 14 nt, Human
accuccugcugggc

SEQ ID NO: 1861334 - RNA, 13 nt, Human
ucauugaaaucuu

SEQ ID NO: 1861335 - RNA, 12 nt, Human
ucauugaaaucu

SEQ ID NO: 1861336 - RNA, 12 nt, Human
ucauucuucugu

SEQ ID NO: 1861337 - RNA, 22 nt, Human
ucauccuucuggaauaaggaga

SEQ ID NO: 1861338 - RNA, 14 nt, Human
ucaucuaggauuuu

SEQ ID NO: 1861339 - RNA, 18 nt, Human
ucaucuagguaaauuaca

SEQ ID NO: 1861340 - RNA, 19 nt, Human
ucauccuccucagaucuuc

SEQ ID NO: 1861341 - RNA, 13 nt, Human
ucauccuccucag

SEQ ID NO: 1861342 - RNA, 18 nt, Human
ucauccucauacccaccc

SEQ ID NO: 1861343 - RNA, 14 nt, Human
ucauccuucuggaa

SEQ ID NO: 1861344 - RNA, 15 nt, Human
ucauccuaagcuauu

SEQ ID NO: 1861345 - RNA, 23 nt, Human
accuccugccucgaacuggcugc

SEQ ID NO: 1861346 - RNA, 12 nt, Human
accuccugcugg

SEQ ID NO: 1861347 - RNA, 11 nt, Human
accuccugcug

SEQ ID NO: 1861348 - RNA, 13 nt, Human
accuccugccucg

SEQ ID NO: 1861349 - RNA, 12 nt, Human
accuccugccuc

SEQ ID NO: 1861350 - RNA, 15 nt, Human
ucaggaagcucaggg

SEQ ID NO: 1861351 - RNA, 14 nt, Human
ucaggaagcucagg

SEQ ID NO: 1861352 - RNA, 13 nt, Human
ucaggaagcucag

SEQ ID NO: 1861353 - RNA, 12 nt, Human
ucaggaagcuca

SEQ ID NO: 1861354 - RNA, 20 nt, Human
accuaccaccacgcccggcu

SEQ ID NO: 1861355 - RNA, 16 nt, Human
accuaccaccacgccc

SEQ ID NO: 1861356 - RNA, 15 nt, Human
accuacaguguacag

SEQ ID NO: 1861357 - RNA, 16 nt, Human
accuacaguguacagu

SEQ ID NO: 1861358 - RNA, 17 nt, Human
accuacaguguacaguc

SEQ ID NO: 1861359 - RNA, 18 nt, Human
accuacaguguacagucu

SEQ ID NO: 1861360 - RNA, 20 nt, Human
accuacaguguacagucuug

SEQ ID NO: 1861361 - RNA, 14 nt, Human
uccaacccucauca

SEQ ID NO: 1861362 - RNA, 17 nt, Human
uccaacccucaucacca

SEQ ID NO: 1861363 - RNA, 16 nt, Human
uccaacccucaucacc

SEQ ID NO: 1861364 - RNA, 23 nt, Human
uccaacccucaucaccaacgucu

SEQ ID NO: 1861365 - RNA, 15 nt, Human
accugccaggaagcc

SEQ ID NO: 1861366 - RNA, 14 nt, Human
accugccaggaagc

SEQ ID NO: 1861367 - RNA, 12 nt, Human
accugccaggaa

SEQ ID NO: 1861368 - RNA, 12 nt, Human
uccaagaagccc

SEQ ID NO: 1861369 - RNA, 16 nt, Human
uccaagcuggucccac

SEQ ID NO: 1861370 - RNA, 20 nt, Human
uccaagcuggucccacucag

SEQ ID NO: 1861371 - RNA, 18 nt, Human
uccaaucccaccaacccu

SEQ ID NO: 1861372 - RNA, 19 nt, Human
uccaaguccacaguggaac

SEQ ID NO: 1861373 - RNA, 21 nt, Human
uccaagcuggucccacucagu

SEQ ID NO: 1861374 - RNA, 20 nt, Human
accuuagacagucccugcca

SEQ ID NO: 1861375 - RNA, 19 nt, Human
accuuagacagucccugcc

SEQ ID NO: 1861376 - RNA, 18 nt, Human
accuuagacagucccugc

SEQ ID NO: 1861377 - RNA, 19 nt, Human
accuguuucugcagccacu

SEQ ID NO: 1861378 - RNA, 21 nt, Human
accuggucacaggacucugcc

SEQ ID NO: 1861379 - RNA, 20 nt, Human
accuggccucugcacucccc

SEQ ID NO: 1861380 - RNA, 18 nt, Human
accuggccucugcacucc

SEQ ID NO: 1861381 - RNA, 23 nt, Human
accuggccucugcacuccccugc

SEQ ID NO: 1861382 - RNA, 17 nt, Human
accuggccucugcacuc

SEQ ID NO: 1861383 - RNA, 16 nt, Human
accuggccucugcacu

SEQ ID NO: 1861384 - RNA, 14 nt, Human
accuggccucugca

SEQ ID NO: 1861385 - RNA, 17 nt, Human
uccacccaccucagccu

SEQ ID NO: 1861386 - RNA, 18 nt, Human
uccacccaccucagccuc

SEQ ID NO: 1861387 - RNA, 19 nt, Human
uccacccaccucagccucc

SEQ ID NO: 1861388 - RNA, 12 nt, Human
uccacccaggag

SEQ ID NO: 1861389 - RNA, 14 nt, Human
uccacccaggagcc

SEQ ID NO: 1861390 - RNA, 15 nt, Human
uccacccaggagccc

SEQ ID NO: 1861391 - RNA, 13 nt, Human
uccagacacaugu

SEQ ID NO: 1861392 - RNA, 22 nt, Human
uccagaauuucccaaagcagug

SEQ ID NO: 1861393 - RNA, 20 nt, Human
uccagaauuucccaaagcag

SEQ ID NO: 1861394 - RNA, 22 nt, Human
uccacugccuucgauacaccgg

SEQ ID NO: 1861395 - RNA, 15 nt, Human
uccacugccuucgau

SEQ ID NO: 1861396 - RNA, 13 nt, Human
uccacugccuucg

SEQ ID NO: 1861397 - RNA, 16 nt, Human
uccagaauuucccaaa

SEQ ID NO: 1861398 - RNA, 14 nt, Human
uccagagacuggga

SEQ ID NO: 1861399 - RNA, 19 nt, Human
uccagacccggcugcgugg

SEQ ID NO: 1861400 - RNA, 15 nt, Human
uccagacccggcugc

SEQ ID NO: 1861401 - RNA, 18 nt, Human
uccagacccggcugcgug

SEQ ID NO: 1861402 - RNA, 17 nt, Human
uccacucaggucuguuu

SEQ ID NO: 1861403 - RNA, 18 nt, Human
uccaccuucccaugcccu

SEQ ID NO: 1861404 - RNA, 16 nt, Human
uccaccuucccaugcc

SEQ ID NO: 1861405 - RNA, 19 nt, Human
uccaccuucccaugcccug

SEQ ID NO: 1861406 - RNA, 20 nt, Human
accuuuugagugccuuacac

SEQ ID NO: 1861407 - RNA, 17 nt, Human
accuuuugagugccuua

SEQ ID NO: 1861408 - RNA, 14 nt, Human
accuuuugagugcc

SEQ ID NO: 1861409 - RNA, 14 nt, Human
uccaggcuguaucc

SEQ ID NO: 1861410 - RNA, 12 nt, Human
uccagccccugg

SEQ ID NO: 1861411 - RNA, 15 nt, Human
uccagagaguggcuc

SEQ ID NO: 1861412 - RNA, 17 nt, Human
uccagagaguggcuccu

SEQ ID NO: 1861413 - RNA, 16 nt, Human
uccagagaguggcucc

SEQ ID NO: 1861414 - RNA, 13 nt, Human
uccagccccugga

SEQ ID NO: 1861415 - RNA, 14 nt, Human
uccagccccuggau

SEQ ID NO: 1861416 - RNA, 19 nt, Human
accuuuuuuauacauaaac

SEQ ID NO: 1861417 - RNA, 20 nt, Human
accuuuuuuauacauaaaca

SEQ ID NO: 1861418 - RNA, 21 nt, Human
uccaggcuguaucccaugagc

SEQ ID NO: 1861419 - RNA, 21 nt, Human
accuuuuuuauacauaaacaa

SEQ ID NO: 1861420 - RNA, 22 nt, Human
accuuuuuuauacauaaacaag

SEQ ID NO: 1861421 - RNA, 14 nt, Human
acgagaaaacaaua

SEQ ID NO: 1861422 - RNA, 17 nt, Human
acgccagauucuuuccu

SEQ ID NO: 1861423 - RNA, 19 nt, Human
acgccagauucuuuccuga

SEQ ID NO: 1861424 - RNA, 16 nt, Human
acgagcaggcuucuuc

SEQ ID NO: 1861425 - RNA, 13 nt, Human
acuacaguuuguu

SEQ ID NO: 1861426 - RNA, 14 nt, Human
acuacaguuuguua

SEQ ID NO: 1861427 - RNA, 15 nt, Human
acuacaggcacccac

SEQ ID NO: 1861428 - RNA, 11 nt, Human
acuacaggcac

SEQ ID NO: 1861429 - RNA, 12 nt, Human
acuaaccacgcu

SEQ ID NO: 1861430 - RNA, 15 nt, Human
acuacaguuuguuag

SEQ ID NO: 1861431 - RNA, 11 nt, Human
acuacauucug

SEQ ID NO: 1861432 - RNA, 12 nt, Human
acuacauucugu

SEQ ID NO: 1861433 - RNA, 13 nt, Human
acuacauucuguu

SEQ ID NO: 1861434 - RNA, 14 nt, Human
acuacauucuguua

SEQ ID NO: 1861435 - RNA, 12 nt, Human
ucccagccccaa

SEQ ID NO: 1861436 - RNA, 17 nt, Human
ucccagcugugcucugg

SEQ ID NO: 1861437 - RNA, 21 nt, Human
uccccaccgcagacaggacca

SEQ ID NO: 1861438 - RNA, 18 nt, Human
uccccaccgcagacagga

SEQ ID NO: 1861439 - RNA, 17 nt, Human
uccccaccgcagacagg

SEQ ID NO: 1861440 - RNA, 22 nt, Human
uccccaccgcagacaggaccag

SEQ ID NO: 1861441 - RNA, 17 nt, Human
uccccaugucucgacuc

SEQ ID NO: 1861442 - RNA, 15 nt, Human
acuacauucuguuaa

SEQ ID NO: 1861443 - RNA, 22 nt, Human
ucccauaugccugggcagaagg

SEQ ID NO: 1861444 - RNA, 15 nt, Human
ucccaucacccgcua

SEQ ID NO: 1861445 - RNA, 20 nt, Human
acgggaggguaaggcugugg

SEQ ID NO: 1861446 - RNA, 13 nt, Human
ucccacagcgcug

SEQ ID NO: 1861447 - RNA, 20 nt, Human
ucccaccccacacacgccag

SEQ ID NO: 1861448 - RNA, 15 nt, Human
ucccaccccacacac

SEQ ID NO: 1861449 - RNA, 16 nt, Human
ucccacaaaggagagc

SEQ ID NO: 1861450 - RNA, 23 nt, Human
acguggcugcuucaaggauccug

SEQ ID NO: 1861451 - RNA, 17 nt, Human
acgguuuuacugcagcu

SEQ ID NO: 1861452 - RNA, 15 nt, Human
acgguuuuacugcag

SEQ ID NO: 1861453 - RNA, 22 nt, Human
acguauaaaagccuguuuaaga

SEQ ID NO: 1861454 - RNA, 13 nt, Human
uccaugaagaugu

SEQ ID NO: 1861455 - RNA, 21 nt, Human
uccaugaagauguagaggaga

SEQ ID NO: 1861456 - RNA, 20 nt, Human
uccauccugaggcuccacuu

SEQ ID NO: 1861457 - RNA, 21 nt, Human
uccauccugaggcuccacuug

SEQ ID NO: 1861458 - RNA, 23 nt, Human
acgccagauucuuuccugaggcu

SEQ ID NO: 1861459 - RNA, 22 nt, Human
acgccagauucuuuccugaggc

SEQ ID NO: 1861460 - RNA, 16 nt, Human
uccaucuaaacugccc

SEQ ID NO: 1861461 - RNA, 18 nt, Human
uccaucuaaacugccccc

SEQ ID NO: 1861462 - RNA, 18 nt, Human
ucccaaagcagugcaugc

SEQ ID NO: 1861463 - RNA, 17 nt, Human
ucccaaagcagugcaug

SEQ ID NO: 1861464 - RNA, 21 nt, Human
ucccaaagcagugcaugcugu

SEQ ID NO: 1861465 - RNA, 13 nt, Human
ucccaaagugcug

SEQ ID NO: 1861466 - RNA, 14 nt, Human
ucccaaagugcugg

SEQ ID NO: 1861467 - RNA, 18 nt, Human
ucccaaacccuucagugc

SEQ ID NO: 1861468 - RNA, 16 nt, Human
ucccaaagcagugcau

SEQ ID NO: 1861469 - RNA, 13 nt, Human
acuccagccuggg

SEQ ID NO: 1861470 - RNA, 12 nt, Human
acuccagccugg

SEQ ID NO: 1861471 - RNA, 23 nt, Human
acuccagaauuucccaaagcagu

SEQ ID NO: 1861472 - RNA, 17 nt, Human
acuccugcaggcagcca

SEQ ID NO: 1861473 - RNA, 15 nt, Human
acuccugaccucaag

SEQ ID NO: 1861474 - RNA, 19 nt, Human
acuccugcaggcagccagg

SEQ ID NO: 1861475 - RNA, 18 nt, Human
acuccugcaggcagccag

SEQ ID NO: 1861476 - RNA, 13 nt, Human
acuccucugucca

SEQ ID NO: 1861477 - RNA, 14 nt, Human
acuccucuguccag

SEQ ID NO: 1861478 - RNA, 17 nt, Human
acuccagaauuucccaa

SEQ ID NO: 1861479 - RNA, 15 nt, Human
acuccagaauuuccc

SEQ ID NO: 1861480 - RNA, 15 nt, Human
acucauugaccugag

SEQ ID NO: 1861481 - RNA, 14 nt, Human
acucauugaccuga

SEQ ID NO: 1861482 - RNA, 15 nt, Human
acucauucuucugua

SEQ ID NO: 1861483 - RNA, 17 nt, Human
ucccuuacgugaguccu

SEQ ID NO: 1861484 - RNA, 21 nt, Human
acuccugcaggcagccaggcc

SEQ ID NO: 1861485 - RNA, 12 nt, Human
ucccugucccag

SEQ ID NO: 1861486 - RNA, 15 nt, Human
ucccugguggcagcu

SEQ ID NO: 1861487 - RNA, 16 nt, Human
uccuagaaauucccca

SEQ ID NO: 1861488 - RNA, 14 nt, Human
uccuacuuccccuu

SEQ ID NO: 1861489 - RNA, 19 nt, Human
uccuaaauauauuuuaaga

SEQ ID NO: 1861490 - RNA, 17 nt, Human
uccggucccugucccag

SEQ ID NO: 1861491 - RNA, 12 nt, Human
ucccuuuuccuu

SEQ ID NO: 1861492 - RNA, 19 nt, Human
ucccuuuuaauccuggcug

SEQ ID NO: 1861493 - RNA, 14 nt, Human
ucccucuuucccuc

SEQ ID NO: 1861494 - RNA, 20 nt, Human
ucccucuuucccucccuucc

SEQ ID NO: 1861495 - RNA, 18 nt, Human
ucccucuuucccucccuu

SEQ ID NO: 1861496 - RNA, 21 nt, Human
ucccucuuucccucccuuccu

SEQ ID NO: 1861497 - RNA, 15 nt, Human
ucccugaaggccccg

SEQ ID NO: 1861498 - RNA, 11 nt, Human
ucccugaaggc

SEQ ID NO: 1861499 - RNA, 22 nt, Human
ucccggcugcccuuucugggca

SEQ ID NO: 1861500 - RNA, 18 nt, Human
ucccggcugcccuuucug

SEQ ID NO: 1861501 - RNA, 15 nt, Human
ucccggcugcccuuu

SEQ ID NO: 1861502 - RNA, 14 nt, Human
ucccggcugcccuu

SEQ ID NO: 1861503 - RNA, 13 nt, Human
ucccggcugcccu

SEQ ID NO: 1861504 - RNA, 16 nt, Human
ucccugaaggccccgc

SEQ ID NO: 1861505 - RNA, 17 nt, Human
ucccugaaggccccgcc

SEQ ID NO: 1861506 - RNA, 20 nt, Human
ucccgaauagcugggacuac

SEQ ID NO: 1861507 - RNA, 15 nt, Human
ucccgaguagcuggg

SEQ ID NO: 1861508 - RNA, 20 nt, Human
ucccgaguagcugagauuau

SEQ ID NO: 1861509 - RNA, 18 nt, Human
ucccgaguagcugggacu

SEQ ID NO: 1861510 - RNA, 16 nt, Human
ucccgaguagcuggga

SEQ ID NO: 1861511 - RNA, 17 nt, Human
ucccgaguagcugggac

SEQ ID NO: 1861512 - RNA, 17 nt, Human
acuacucccccaggugg

SEQ ID NO: 1861513 - RNA, 21 nt, Human
acuacuagggaaaugccuuug

SEQ ID NO: 1861514 - RNA, 12 nt, Human
acucaccccagc

SEQ ID NO: 1861515 - RNA, 14 nt, Human
acuguucucugccc

SEQ ID NO: 1861516 - RNA, 20 nt, Human
acuguucucugcccuccaag

SEQ ID NO: 1861517 - RNA, 15 nt, Human
acuguucucugcccu

SEQ ID NO: 1861518 - RNA, 21 nt, Human
acuguucucugcccuccaaga

SEQ ID NO: 1861519 - RNA, 15 nt, Human
ucuaaagcugccagc

SEQ ID NO: 1861520 - RNA, 16 nt, Human
ucuaaagcugccagcc

SEQ ID NO: 1861521 - RNA, 14 nt, Human
ucuaaagcugccag

SEQ ID NO: 1861522 - RNA, 13 nt, Human
ucuaaagcugcca

SEQ ID NO: 1861523 - RNA, 20 nt, Human
ucuaaagccauuguaguccu

SEQ ID NO: 1861524 - RNA, 17 nt, Human
acuuaaauaaugugaaa

SEQ ID NO: 1861525 - RNA, 18 nt, Human
acuuaaauaaugugaaac

SEQ ID NO: 1861526 - RNA, 16 nt, Human
acuuaaauaaugugaa

SEQ ID NO: 1861527 - RNA, 15 nt, Human
acuuaaauaauguga

SEQ ID NO: 1861528 - RNA, 12 nt, Human
acuguugcccag

SEQ ID NO: 1861529 - RNA, 13 nt, Human
acuguugcccagg

SEQ ID NO: 1861530 - RNA, 14 nt, Human
acuguugcccaggc

SEQ ID NO: 1861531 - RNA, 17 nt, Human
acuguugcccaggcugg

SEQ ID NO: 1861532 - RNA, 18 nt, Human
acuguugcccaggcuggc

SEQ ID NO: 1861533 - RNA, 13 nt, Human
acuuaaucuaaau

SEQ ID NO: 1861534 - RNA, 15 nt, Human
acuuaaucuaaaugg

SEQ ID NO: 1861535 - RNA, 16 nt, Human
acuuaaucuaaaugga

SEQ ID NO: 1861536 - RNA, 16 nt, Human
acuuagaaauugcauu

SEQ ID NO: 1861537 - RNA, 14 nt, Human
acuucagcucuguu

SEQ ID NO: 1861538 - RNA, 12 nt, Human
acugugugcuca

SEQ ID NO: 1861539 - RNA, 21 nt, Human
acugugugcucaggagcccug

SEQ ID NO: 1861540 - RNA, 20 nt, Human
acugugugcucaggagcccu

SEQ ID NO: 1861541 - RNA, 19 nt, Human
acugugugcucaggagccc

SEQ ID NO: 1861542 - RNA, 15 nt, Human
acugugugcucagga

SEQ ID NO: 1861543 - RNA, 16 nt, Human
acugggagaaaugaaa

SEQ ID NO: 1861544 - RNA, 18 nt, Human
acuguccuacccacccuc

SEQ ID NO: 1861545 - RNA, 23 nt, Human
acuguccuacccacccuccuuuc

SEQ ID NO: 1861546 - RNA, 17 nt, Human
acuguccuacccacccu

SEQ ID NO: 1861547 - RNA, 16 nt, Human
ucguaaaauuaagaaa

SEQ ID NO: 1861548 - RNA, 22 nt, Human
ucguuuucaaaauuguuacaaa

SEQ ID NO: 1861549 - RNA, 17 nt, Human
ucguuugaaucacagua

SEQ ID NO: 1861550 - RNA, 13 nt, Human
ucguaaaauuaag

SEQ ID NO: 1861551 - RNA, 18 nt, Human
ucggcucacugcauccuc

SEQ ID NO: 1861552 - RNA, 21 nt, Human
ucgggaggucgaggcaggagg

SEQ ID NO: 1861553 - RNA, 19 nt, Human
ucgggaggucgaggcagga

SEQ ID NO: 1861554 - RNA, 17 nt, Human
ucgggaggucgaggcag

SEQ ID NO: 1861555 - RNA, 12 nt, Human
ucgggcaugaca

SEQ ID NO: 1861556 - RNA, 11 nt, Human
ucgggcaugac

SEQ ID NO: 1861557 - RNA, 15 nt, Human
acugcuggcugccuu

SEQ ID NO: 1861558 - RNA, 14 nt, Human
acugcuggcugccu

SEQ ID NO: 1861559 - RNA, 18 nt, Human
acugcuuaacuucacaua

SEQ ID NO: 1861560 - RNA, 15 nt, Human
acuggauuaaacuua

SEQ ID NO: 1861561 - RNA, 20 nt, Human
acugcuuaacuucacauauu

SEQ ID NO: 1861562 - RNA, 17 nt, Human
acugcuuccagugaggc

SEQ ID NO: 1861563 - RNA, 21 nt, Human
acugcuugugaaaggaaagag

SEQ ID NO: 1861564 - RNA, 14 nt, Human
acugcuuuuggucu

SEQ ID NO: 1861565 - RNA, 15 nt, Human
acugcauguuuguga

SEQ ID NO: 1861566 - RNA, 16 nt, Human
acugcauguuugugau

SEQ ID NO: 1861567 - RNA, 23 nt, Human
acugcauccuccgccucccgggu

SEQ ID NO: 1861568 - RNA, 22 nt, Human
acugcaucaagaugugacaugu

SEQ ID NO: 1861569 - RNA, 20 nt, Human
acugcaucaagaugugacau

SEQ ID NO: 1861570 - RNA, 20 nt, Human
acugcauccuccgccucccg

SEQ ID NO: 1861571 - RNA, 17 nt, Human
acugcauccuccgccuc

SEQ ID NO: 1861572 - RNA, 16 nt, Human
acugcauaugaaagga

SEQ ID NO: 1861573 - RNA, 22 nt, Human
uccuagaaauuccccacccuga

SEQ ID NO: 1861574 - RNA, 21 nt, Human
uccuagaaauuccccacccug

SEQ ID NO: 1861575 - RNA, 21 nt, Human
acugccuauuuuaauaaacac

SEQ ID NO: 1861576 - RNA, 16 nt, Human
acugccuauuuuaaua

SEQ ID NO: 1861577 - RNA, 15 nt, Human
acugccucuuccucc

SEQ ID NO: 1861578 - RNA, 14 nt, Human
acugccucuuccuc

SEQ ID NO: 1861579 - RNA, 15 nt, Human
uccuucagugccuua

SEQ ID NO: 1861580 - RNA, 14 nt, Human
uccuucagugccuu

SEQ ID NO: 1861581 - RNA, 14 nt, Human
acuggccucugcug

SEQ ID NO: 1861582 - RNA, 17 nt, Human
uccuucagugccuuaug

SEQ ID NO: 1861583 - RNA, 16 nt, Human
uccuucagugccuuau

SEQ ID NO: 1861584 - RNA, 14 nt, Human
uccuuguguuacua

SEQ ID NO: 1861585 - RNA, 23 nt, Human
uccuuguguuacuaaguuuuuau

SEQ ID NO: 1861586 - RNA, 21 nt, Human
uccuuuaauuuuuuacuauuu

SEQ ID NO: 1861587 - RNA, 15 nt, Human
uccuuuagcgcccag

SEQ ID NO: 1861588 - RNA, 19 nt, Human
uccuuuagcgcccaguugg

SEQ ID NO: 1861589 - RNA, 18 nt, Human
ucgcuauugucaccaggg

SEQ ID NO: 1861590 - RNA, 18 nt, Human
ucgagcaugccuggaugg

SEQ ID NO: 1861591 - RNA, 16 nt, Human
ucgagcaugccuggau

SEQ ID NO: 1861592 - RNA, 19 nt, Human
ucgcgacaaugcaaaccau

SEQ ID NO: 1861593 - RNA, 16 nt, Human
ucgcgacaaugcaaac

SEQ ID NO: 1861594 - RNA, 13 nt, Human
ucgaggacaggga

SEQ ID NO: 1861595 - RNA, 22 nt, Human
uccuuuagcgcccaguugggug

SEQ ID NO: 1861596 - RNA, 23 nt, Human
uccuuuagcgcccaguugggugg

SEQ ID NO: 1861597 - RNA, 18 nt, Human
ucgagaaacagccugugu

SEQ ID NO: 1861598 - RNA, 19 nt, Human
agaaaacuuguauuaugug

SEQ ID NO: 1861599 - RNA, 18 nt, Human
agaaaaaggaugcacaga

SEQ ID NO: 1861600 - RNA, 21 nt, Human
agaaaacuuguauuaugugug

SEQ ID NO: 1861601 - RNA, 17 nt, Human
agaaaaaggaugcacag

SEQ ID NO: 1861602 - RNA, 21 nt, Human
ucucuggccuucggccuccau

SEQ ID NO: 1861603 - RNA, 22 nt, Human
ucucuggccuucggccuccauc

SEQ ID NO: 1861604 - RNA, 23 nt, Human
ucucuggccuucggccuccaucc

SEQ ID NO: 1861605 - RNA, 17 nt, Human
ucucuugagccugggag

SEQ ID NO: 1861606 - RNA, 18 nt, Human
ucucuugagccugggagg

SEQ ID NO: 1861607 - RNA, 16 nt, Human
ucucuugauucauaau

SEQ ID NO: 1861608 - RNA, 14 nt, Human
ucucuugauucaua

SEQ ID NO: 1861609 - RNA, 13 nt, Human
agaaaaagaaaaa

SEQ ID NO: 1861610 - RNA, 20 nt, Human
ucucuuuaaugucacaggca

SEQ ID NO: 1861611 - RNA, 21 nt, Human
ucucuuuaaugucacaggcag

SEQ ID NO: 1861612 - RNA, 19 nt, Human
ucucuccagccccuggaug

SEQ ID NO: 1861613 - RNA, 18 nt, Human
ucucuccagccccuggau

SEQ ID NO: 1861614 - RNA, 16 nt, Human
ucucuccagccccugg

SEQ ID NO: 1861615 - RNA, 17 nt, Human
ucucuccagccccugga

SEQ ID NO: 1861616 - RNA, 15 nt, Human
acuuugaccucugca

SEQ ID NO: 1861617 - RNA, 16 nt, Human
acuuugaccucugcag

SEQ ID NO: 1861618 - RNA, 18 nt, Human
acuuugaccucugcagca

SEQ ID NO: 1861619 - RNA, 15 nt, Human
ucucucacuccuuga

SEQ ID NO: 1861620 - RNA, 13 nt, Human
ucucucacuccuu

SEQ ID NO: 1861621 - RNA, 17 nt, Human
ucucugcccuccaagac

SEQ ID NO: 1861622 - RNA, 16 nt, Human
ucucugcccuccaaga

SEQ ID NO: 1861623 - RNA, 15 nt, Human
ucucugcccuccaag

SEQ ID NO: 1861624 - RNA, 11 nt, Human
ucucugcccuc

SEQ ID NO: 1861625 - RNA, 14 nt, Human
ucucuccuguaccu

SEQ ID NO: 1861626 - RNA, 16 nt, Human
ucucuccuguaccucu

SEQ ID NO: 1861627 - RNA, 17 nt, Human
ucucuccuguaccucuu

SEQ ID NO: 1861628 - RNA, 12 nt, Human
ucucuggccuuc

SEQ ID NO: 1861629 - RNA, 19 nt, Human
ucucuggaauuugaaacac

SEQ ID NO: 1861630 - RNA, 15 nt, Human
ucucuggaauuugaa

SEQ ID NO: 1861631 - RNA, 22 nt, Human
ucugcacuccccugcugggugu

SEQ ID NO: 1861632 - RNA, 18 nt, Human
ucugcagcaauaaagcag

SEQ ID NO: 1861633 - RNA, 20 nt, Human
ucugcacuccccugcugggu

SEQ ID NO: 1861634 - RNA, 17 nt, Human
ucugcaggucccuaaua

SEQ ID NO: 1861635 - RNA, 16 nt, Human
ucugcaggucccuaau

SEQ ID NO: 1861636 - RNA, 15 nt, Human
ucugcaggucccuaa

SEQ ID NO: 1861637 - RNA, 17 nt, Human
agaaauuuauaaacuuu

SEQ ID NO: 1861638 - RNA, 16 nt, Human
agaaauuuauaaacuu

SEQ ID NO: 1861639 - RNA, 22 nt, Human
agaaauuaugugccagauuuau

SEQ ID NO: 1861640 - RNA, 21 nt, Human
agaaauuaugugccagauuua

SEQ ID NO: 1861641 - RNA, 13 nt, Human
agaaauuaugugc

SEQ ID NO: 1861642 - RNA, 18 nt, Human
ucugcaggucccuaauaa

SEQ ID NO: 1861643 - RNA, 14 nt, Human
ucugcaggucccua

SEQ ID NO: 1861644 - RNA, 23 nt, Human
ucugagacucgcgacaaugcaaa

SEQ ID NO: 1861645 - RNA, 23 nt, Human
ucugaugcaagcaagaaacacug

SEQ ID NO: 1861646 - RNA, 19 nt, Human
ucugcacuccccugcuggg

SEQ ID NO: 1861647 - RNA, 18 nt, Human
ucugcacuccccugcugg

SEQ ID NO: 1861648 - RNA, 18 nt, Human
ucugauucccaagcucug

SEQ ID NO: 1861649 - RNA, 20 nt, Human
agaaauaucugaaaauguau

SEQ ID NO: 1861650 - RNA, 19 nt, Human
agaaauaucugaaaaugua

SEQ ID NO: 1861651 - RNA, 14 nt, Human
agaaauauaauuga

SEQ ID NO: 1861652 - RNA, 17 nt, Human
agaaaugaaaaaauaua

SEQ ID NO: 1861653 - RNA, 15 nt, Human
agaaaucuaaaaaac

SEQ ID NO: 1861654 - RNA, 12 nt, Human
agaaaucuaaaa

SEQ ID NO: 1861655 - RNA, 14 nt, Human
agaaagaaaaucag

SEQ ID NO: 1861656 - RNA, 14 nt, Human
agaaaugaaagcag

SEQ ID NO: 1861657 - RNA, 23 nt, Human
agaaaugaaaaaauauauaucaa

SEQ ID NO: 1861658 - RNA, 18 nt, Human
agaaaugaaaaaauauau

SEQ ID NO: 1861659 - RNA, 15 nt, Human
ucugacaacagacuu

SEQ ID NO: 1861660 - RNA, 16 nt, Human
ucugacaacagacuuc

SEQ ID NO: 1861661 - RNA, 12 nt, Human
ucugacacacag

SEQ ID NO: 1861662 - RNA, 18 nt, Human
ucugaagucacugcacag

SEQ ID NO: 1861663 - RNA, 16 nt, Human
ucugaagucacugcac

SEQ ID NO: 1861664 - RNA, 15 nt, Human
ucugaagucacugca

SEQ ID NO: 1861665 - RNA, 14 nt, Human
acuugcucuugaug

SEQ ID NO: 1861666 - RNA, 16 nt, Human
acuuguggacacagcu

SEQ ID NO: 1861667 - RNA, 17 nt, Human
acuuguggacacagcuc

SEQ ID NO: 1861668 - RNA, 18 nt, Human
acuuguggacacagcucu

SEQ ID NO: 1861669 - RNA, 21 nt, Human
acuugaacccgggaggcagag

SEQ ID NO: 1861670 - RNA, 19 nt, Human
acuugagcccagagugaac

SEQ ID NO: 1861671 - RNA, 21 nt, Human
acuugaacccauauuuguaca

SEQ ID NO: 1861672 - RNA, 19 nt, Human
acuugaacccgggaggcag

SEQ ID NO: 1861673 - RNA, 20 nt, Human
acuugaacccgggaggcaga

SEQ ID NO: 1861674 - RNA, 15 nt, Human
acuucuccacccugc

SEQ ID NO: 1861675 - RNA, 16 nt, Human
acuucuccacccugcu

SEQ ID NO: 1861676 - RNA, 15 nt, Human
acuuccugugacuuc

SEQ ID NO: 1861677 - RNA, 13 nt, Human
ucucacuccuuga

SEQ ID NO: 1861678 - RNA, 16 nt, Human
ucucacuauguugccc

SEQ ID NO: 1861679 - RNA, 16 nt, Human
ucucacucugucgccc

SEQ ID NO: 1861680 - RNA, 12 nt, Human
ucucacucuguc

SEQ ID NO: 1861681 - RNA, 14 nt, Human
acuucuccacccug

SEQ ID NO: 1861682 - RNA, 11 nt, Human
ucucacuccuu

SEQ ID NO: 1861683 - RNA, 14 nt, Human
acuucaggcucuuc

SEQ ID NO: 1861684 - RNA, 16 nt, Human
acuucagcugacuuuu

SEQ ID NO: 1861685 - RNA, 11 nt, Human
acuucagcuga

SEQ ID NO: 1861686 - RNA, 16 nt, Human
ucuccauguuugaugu

SEQ ID NO: 1861687 - RNA, 17 nt, Human
acuuucuagccagagga

SEQ ID NO: 1861688 - RNA, 16 nt, Human
acuuucuagccagagg

SEQ ID NO: 1861689 - RNA, 14 nt, Human
acuuugaccucugc

SEQ ID NO: 1861690 - RNA, 21 nt, Human
ucuccuccuuuucacaguucu

SEQ ID NO: 1861691 - RNA, 17 nt, Human
ucuccaaaauaaaacuu

SEQ ID NO: 1861692 - RNA, 19 nt, Human
ucuccaaaauaaaacuuuu

SEQ ID NO: 1861693 - RNA, 22 nt, Human
ucuccaaaauaaaacuuuuuaa

SEQ ID NO: 1861694 - RNA, 16 nt, Human
ucuccaggcuguaucc

SEQ ID NO: 1861695 - RNA, 13 nt, Human
ucucagggccugg

SEQ ID NO: 1861696 - RNA, 12 nt, Human
ucucagggccug

SEQ ID NO: 1861697 - RNA, 15 nt, Human
ucucagggccugguc

SEQ ID NO: 1861698 - RNA, 14 nt, Human
ucucagggccuggu

SEQ ID NO: 1861699 - RNA, 19 nt, Human
ucucagggccuggucguuu

SEQ ID NO: 1861700 - RNA, 23 nt, Human
agaaccccaggguccuguagccc

SEQ ID NO: 1861701 - RNA, 16 nt, Human
agaaauuuccacucag

SEQ ID NO: 1861702 - RNA, 22 nt, Human
agaaauuuccacucaggucugu

SEQ ID NO: 1861703 - RNA, 21 nt, Human
agaauguguuuaaacuugguu

SEQ ID NO: 1861704 - RNA, 19 nt, Human
agaauuaguggcacuugcu

SEQ ID NO: 1861705 - RNA, 22 nt, Human
ucuggguuccuuccucugagcc

SEQ ID NO: 1861706 - RNA, 23 nt, Human
ucuggguuccuuccucugagccu

SEQ ID NO: 1861707 - RNA, 14 nt, Human
agaauucucuaguu

SEQ ID NO: 1861708 - RNA, 20 nt, Human
agaauucucagaaucucaaa

SEQ ID NO: 1861709 - RNA, 20 nt, Human
agaauuauaauuaguuccuc

SEQ ID NO: 1861710 - RNA, 23 nt, Human
ucuguuuagauaauacaccacua

SEQ ID NO: 1861711 - RNA, 16 nt, Human
ucuguuuagauaauac

SEQ ID NO: 1861712 - RNA, 19 nt, Human
ucuguuuagauaauacacc

SEQ ID NO: 1861713 - RNA, 19 nt, Human
ucuguucugcacacagcac

SEQ ID NO: 1861714 - RNA, 18 nt, Human
ucuguucugcacacagca

SEQ ID NO: 1861715 - RNA, 17 nt, Human
ucuguucugcacacagc

SEQ ID NO: 1861716 - RNA, 18 nt, Human
ucuguacgucugacaggc

SEQ ID NO: 1861717 - RNA, 12 nt, Human
agacagaaaaaa

SEQ ID NO: 1861718 - RNA, 14 nt, Human
agacagcugccugg

SEQ ID NO: 1861719 - RNA, 13 nt, Human
agacagcugccug

SEQ ID NO: 1861720 - RNA, 22 nt, Human
agacacauguccaagaagccca

SEQ ID NO: 1861721 - RNA, 21 nt, Human
agacacauguccaagaagccc

SEQ ID NO: 1861722 - RNA, 23 nt, Human
agacacaggcccggcuccaggcu

SEQ ID NO: 1861723 - RNA, 19 nt, Human
agacaccuugacagggcac

SEQ ID NO: 1861724 - RNA, 24 nt, Human
agacacauguccaagaagcccagg

SEQ ID NO: 1861725 - RNA, 22 nt, Human
agacaccuugacagggcacacc

SEQ ID NO: 1861726 - RNA, 17 nt, Human
agaauucucuuauccaa

SEQ ID NO: 1861727 - RNA, 18 nt, Human
agaauucucuaguuugau

SEQ ID NO: 1861728 - RNA, 19 nt, Human
agaauucucuaguuugauu

SEQ ID NO: 1861729 - RNA, 13 nt, Human
agacacaagccuu

SEQ ID NO: 1861730 - RNA, 14 nt, Human
agacacaagccuuc

SEQ ID NO: 1861731 - RNA, 19 nt, Human
agacacaggcccggcucca

SEQ ID NO: 1861732 - RNA, 20 nt, Human
agacacaggcccggcuccag

SEQ ID NO: 1861733 - RNA, 21 nt, Human
agacacaggcccggcuccagg

SEQ ID NO: 1861734 - RNA, 22 nt, Human
agacacaggcccggcuccaggc

SEQ ID NO: 1861735 - RNA, 17 nt, Human
agacacaggcccggcuc

SEQ ID NO: 1861736 - RNA, 12 nt, Human
ucuuagauguau

SEQ ID NO: 1861737 - RNA, 14 nt, Human
ucuuagauguauau

SEQ ID NO: 1861738 - RNA, 19 nt, Human
ucuuacugucuuuuuucua

SEQ ID NO: 1861739 - RNA, 12 nt, Human
agacagucccug

SEQ ID NO: 1861740 - RNA, 16 nt, Human
agacagcugccuggga

SEQ ID NO: 1861741 - RNA, 15 nt, Human
agacagcugccuggg

SEQ ID NO: 1861742 - RNA, 14 nt, Human
agacagucccugcc

SEQ ID NO: 1861743 - RNA, 13 nt, Human
agacagucccugc

SEQ ID NO: 1861744 - RNA, 15 nt, Human
ucuuuaguuuuugug

SEQ ID NO: 1861745 - RNA, 14 nt, Human
ucuuuaauuuuaca

SEQ ID NO: 1861746 - RNA, 22 nt, Human
ucuuuaaugucacaggcagguc

SEQ ID NO: 1861747 - RNA, 16 nt, Human
ucuugguuuguaaauu

SEQ ID NO: 1861748 - RNA, 20 nt, Human
ucuuuaaugucacaggcagg

SEQ ID NO: 1861749 - RNA, 14 nt, Human
ucuugguuuguaaa

SEQ ID NO: 1861750 - RNA, 13 nt, Human
ucuuucugcuuug

SEQ ID NO: 1861751 - RNA, 20 nt, Human
ucuuuauaauucuacuuuga

SEQ ID NO: 1861752 - RNA, 18 nt, Human
ucuuucuggcuaugcauu

SEQ ID NO: 1861753 - RNA, 22 nt, Human
ucuuucugcagaaacagaaagg

SEQ ID NO: 1861754 - RNA, 14 nt, Human
ucuuucuuccucug

SEQ ID NO: 1861755 - RNA, 19 nt, Human
ucuuucuggcuaugcauuu

SEQ ID NO: 1861756 - RNA, 19 nt, Human
agacucgcgacaaugcaaa

SEQ ID NO: 1861757 - RNA, 18 nt, Human
agacucgcgacaaugcaa

SEQ ID NO: 1861758 - RNA, 17 nt, Human
agacucgcgacaaugca

SEQ ID NO: 1861759 - RNA, 15 nt, Human
agacucgcgacaaug

SEQ ID NO: 1861760 - RNA, 16 nt, Human
ucuuucuuccucugcu

SEQ ID NO: 1861761 - RNA, 15 nt, Human
ucuuucuuccucugc

SEQ ID NO: 1861762 - RNA, 17 nt, Human
ucuuucuuccucugcug

SEQ ID NO: 1861763 - RNA, 14 nt, Human
agacugucucaaga

SEQ ID NO: 1861764 - RNA, 15 nt, Human
agacuuccagagccu

SEQ ID NO: 1861765 - RNA, 16 nt, Human
agacuguacaaaguag

SEQ ID NO: 1861766 - RNA, 15 nt, Human
agacuguacaaagua

SEQ ID NO: 1861767 - RNA, 20 nt, Human
agacucgcgacaaugcaaac

SEQ ID NO: 1861768 - RNA, 22 nt, Human
agagaaaaaauauuuuccugcc

SEQ ID NO: 1861769 - RNA, 19 nt, Human
agacuuuuuuuaaauagua

SEQ ID NO: 1861770 - RNA, 18 nt, Human
agacuuguaugaaagaug

SEQ ID NO: 1861771 - RNA, 24 nt, Human
agagacagaaagcagaacagugau

SEQ ID NO: 1861772 - RNA, 15 nt, Human
agagacacaagccuu

SEQ ID NO: 1861773 - RNA, 17 nt, Human
ucuuauuuaaugaaaga

SEQ ID NO: 1861774 - RNA, 21 nt, Human
ucuucuguacgucugacaggc

SEQ ID NO: 1861775 - RNA, 22 nt, Human
ucuucuguacgucugacaggca

SEQ ID NO: 1861776 - RNA, 22 nt, Human
ucuucugcuucagccucccgag

SEQ ID NO: 1861777 - RNA, 14 nt, Human
agacauagaauuaa

SEQ ID NO: 1861778 - RNA, 23 nt, Human
agacauacuaaccagcagaaaug

SEQ ID NO: 1861779 - RNA, 23 nt, Human
ucuucuguacgucugacaggcaa

SEQ ID NO: 1861780 - RNA, 14 nt, Human
agaccccuggcuuu

SEQ ID NO: 1861781 - RNA, 15 nt, Human
agaccccuggcuuuu

SEQ ID NO: 1861782 - RNA, 21 nt, Human
agaccccuggcuuuucacugc

SEQ ID NO: 1861783 - RNA, 14 nt, Human
agacccggcugcgu

SEQ ID NO: 1861784 - RNA, 13 nt, Human
agaccugccccuc

SEQ ID NO: 1861785 - RNA, 16 nt, Human
agaccugccccuccuc

SEQ ID NO: 1861786 - RNA, 23 nt, Human
agaccugccccuccucucugccc

SEQ ID NO: 1861787 - RNA, 22 nt, Human
agaccugccccuccucucugcc

SEQ ID NO: 1861788 - RNA, 20 nt, Human
ucuugagccuugaacuuuga

SEQ ID NO: 1861789 - RNA, 18 nt, Human
ucuugagccuugaacuuu

SEQ ID NO: 1861790 - RNA, 19 nt, Human
ucuugagccuugaacuuug

SEQ ID NO: 1861791 - RNA, 21 nt, Human
agacucaguggggaggggcug

SEQ ID NO: 1861792 - RNA, 17 nt, Human
ucuugagccuugaacuu

SEQ ID NO: 1861793 - RNA, 15 nt, Human
agacucauucuucug

SEQ ID NO: 1861794 - RNA, 20 nt, Human
ugacaggcaaugcuggcugu

SEQ ID NO: 1861795 - RNA, 21 nt, Human
ugacacacagcucuguccugg

SEQ ID NO: 1861796 - RNA, 11 nt, Human
ugacagggcac

SEQ ID NO: 1861797 - RNA, 16 nt, Human
ugacagggcacaccgg

SEQ ID NO: 1861798 - RNA, 21 nt, Human
ugacagggcacaccgggcacu

SEQ ID NO: 1861799 - RNA, 20 nt, Human
ugacagggcacaccgggcac

SEQ ID NO: 1861800 - RNA, 12 nt, Human
agaucauuguga

SEQ ID NO: 1861801 - RNA, 15 nt, Human
agaucagccugggca

SEQ ID NO: 1861802 - RNA, 13 nt, Human
agaucagccuggg

SEQ ID NO: 1861803 - RNA, 18 nt, Human
ugaccaaugauggucacc

SEQ ID NO: 1861804 - RNA, 19 nt, Human
ugaccaauauuguacaguu

SEQ ID NO: 1861805 - RNA, 21 nt, Human
ugaccaauauuguacaguuuu

SEQ ID NO: 1861806 - RNA, 17 nt, Human
ugaccaauauuguacag

SEQ ID NO: 1861807 - RNA, 18 nt, Human
ugaccaauauuguacagu

SEQ ID NO: 1861808 - RNA, 22 nt, Human
ugacauuguagagcuucuggca

SEQ ID NO: 1861809 - RNA, 20 nt, Human
ugacauuguuggccaaagcc

SEQ ID NO: 1861810 - RNA, 21 nt, Human
ugacauuguuggccaaagcca

SEQ ID NO: 1861811 - RNA, 15 nt, Human
agaugcuucucacug

SEQ ID NO: 1861812 - RNA, 12 nt, Human
ugacccacugcu

SEQ ID NO: 1861813 - RNA, 13 nt, Human
ugacccacugcuu

SEQ ID NO: 1861814 - RNA, 17 nt, Human
ugacccacaagaaauga

SEQ ID NO: 1861815 - RNA, 23 nt, Human
ugaccauucuccaccugccaggg

SEQ ID NO: 1861816 - RNA, 14 nt, Human
agaugcuagaacuc

SEQ ID NO: 1861817 - RNA, 15 nt, Human
agaugcuagaacucc

SEQ ID NO: 1861818 - RNA, 14 nt, Human
agaugcaccagccc

SEQ ID NO: 1861819 - RNA, 15 nt, Human
agaugcaccagcccu

SEQ ID NO: 1861820 - RNA, 20 nt, Human
ugaaugguuuucaaaauaaa

SEQ ID NO: 1861821 - RNA, 19 nt, Human
ugaaugucagugugacuga

SEQ ID NO: 1861822 - RNA, 21 nt, Human
agaguuguuacauuuuuaagu

SEQ ID NO: 1861823 - RNA, 16 nt, Human
agaguuguuacauuuu

SEQ ID NO: 1861824 - RNA, 12 nt, Human
agaguuguuaca

SEQ ID NO: 1861825 - RNA, 20 nt, Human
agaguugaugguuguacaua

SEQ ID NO: 1861826 - RNA, 17 nt, Human
agaguugauacuacagu

SEQ ID NO: 1861827 - RNA, 20 nt, Human
agaguugauacuacaguuug

SEQ ID NO: 1861828 - RNA, 22 nt, Human
agaguugauacuacaguuuguu

SEQ ID NO: 1861829 - RNA, 12 nt, Human
agauaaaugugc

SEQ ID NO: 1861830 - RNA, 17 nt, Human
agauaaagguucaugca

SEQ ID NO: 1861831 - RNA, 14 nt, Human
agaucacgccacug

SEQ ID NO: 1861832 - RNA, 15 nt, Human
agaucacgccacugc

SEQ ID NO: 1861833 - RNA, 16 nt, Human
agaucacgccacugca

SEQ ID NO: 1861834 - RNA, 15 nt, Human
ugaauuucuuuugcc

SEQ ID NO: 1861835 - RNA, 17 nt, Human
agaucacgccacugcac

SEQ ID NO: 1861836 - RNA, 18 nt, Human
agaucacgccacugcacu

SEQ ID NO: 1861837 - RNA, 19 nt, Human
ugaacuuugaccucugcag

SEQ ID NO: 1861838 - RNA, 20 nt, Human
ugaacuuugaccucugcagc

SEQ ID NO: 1861839 - RNA, 22 nt, Human
ugaacuuugaccucugcagcaa

SEQ ID NO: 1861840 - RNA, 15 nt, Human
agagcuuaacagugu

SEQ ID NO: 1861841 - RNA, 22 nt, Human
agagcuucuguugcugccucau

SEQ ID NO: 1861842 - RNA, 19 nt, Human
ugaacaaauuuacagagac

SEQ ID NO: 1861843 - RNA, 20 nt, Human
ugaacaaauuuacagagaca

SEQ ID NO: 1861844 - RNA, 15 nt, Human
ugaaauuuuuauuaa

SEQ ID NO: 1861845 - RNA, 22 nt, Human
ugaaccgaugagaaauaaaguu

SEQ ID NO: 1861846 - RNA, 21 nt, Human
ugaacuaggauuguaguccca

SEQ ID NO: 1861847 - RNA, 12 nt, Human
ugaacuccuggc

SEQ ID NO: 1861848 - RNA, 14 nt, Human
ugaacuccuggccu

SEQ ID NO: 1861849 - RNA, 15 nt, Human
ugaacuccuggccuc

SEQ ID NO: 1861850 - RNA, 15 nt, Human
agagguugcagugag

SEQ ID NO: 1861851 - RNA, 19 nt, Human
agagguccacaacacacag

SEQ ID NO: 1861852 - RNA, 13 nt, Human
agaggcugaggac

SEQ ID NO: 1861853 - RNA, 17 nt, Human
agaggcuaugugagcac

SEQ ID NO: 1861854 - RNA, 19 nt, Human
agaggccaugggccuccug

SEQ ID NO: 1861855 - RNA, 10 nt, Human
agaggcaggg

SEQ ID NO: 1861856 - RNA, 13 nt, Human
agaggcagggucu

SEQ ID NO: 1861857 - RNA, 13 nt, Human
agaggcagcccca

SEQ ID NO: 1861858 - RNA, 19 nt, Human
agaggcagccccauucugc

SEQ ID NO: 1861859 - RNA, 24 nt, Human
agaggcagccccauucugccugcc

SEQ ID NO: 1861860 - RNA, 18 nt, Human
agagcagagaccaucccu

SEQ ID NO: 1861861 - RNA, 17 nt, Human
agagcagagaccauccc

SEQ ID NO: 1861862 - RNA, 20 nt, Human
agagcagagaccaucccuga

SEQ ID NO: 1861863 - RNA, 21 nt, Human
agagccuugcggaagguucua

SEQ ID NO: 1861864 - RNA, 11 nt, Human
agagccuugcg

SEQ ID NO: 1861865 - RNA, 12 nt, Human
agagcagagacc

SEQ ID NO: 1861866 - RNA, 21 nt, Human
ucuuuggacccugaggcccag

SEQ ID NO: 1861867 - RNA, 17 nt, Human
ucuuuggacccugaggc

SEQ ID NO: 1861868 - RNA, 17 nt, Human
ugaaauaagccagacau

SEQ ID NO: 1861869 - RNA, 18 nt, Human
ugaaauaagccagacauc

SEQ ID NO: 1861870 - RNA, 20 nt, Human
ugaaauaagccagacaucaa

SEQ ID NO: 1861871 - RNA, 23 nt, Human
ugaaauaagccagacaucaacag

SEQ ID NO: 1861872 - RNA, 18 nt, Human
agagcugccaccugccug

SEQ ID NO: 1861873 - RNA, 15 nt, Human
ugaaauuguauuaca

SEQ ID NO: 1861874 - RNA, 19 nt, Human
agcaggcucucaggccagc

SEQ ID NO: 1861875 - RNA, 18 nt, Human
agcaggcucucaggccag

SEQ ID NO: 1861876 - RNA, 17 nt, Human
agcaggcucucaggcca

SEQ ID NO: 1861877 - RNA, 16 nt, Human
agcaggcucucaggcc

SEQ ID NO: 1861878 - RNA, 15 nt, Human
agcaggcucucaggc

SEQ ID NO: 1861879 - RNA, 14 nt, Human
agcaggcucucagg

SEQ ID NO: 1861880 - RNA, 13 nt, Human
agcaggcucucag

SEQ ID NO: 1861881 - RNA, 17 nt, Human
agcaggcucgggcuccc

SEQ ID NO: 1861882 - RNA, 23 nt, Human
agcaggcucucaggccagcugcu

SEQ ID NO: 1861883 - RNA, 22 nt, Human
agcaggcucucaggccagcugc

SEQ ID NO: 1861884 - RNA, 21 nt, Human
agcaggcucucaggccagcug

SEQ ID NO: 1861885 - RNA, 15 nt, Human
agcaggcugugaguu

SEQ ID NO: 1861886 - RNA, 13 nt, Human
agcagggaaacag

SEQ ID NO: 1861887 - RNA, 14 nt, Human
agcagggaaacagc

SEQ ID NO: 1861888 - RNA, 15 nt, Human
agcagggaaacagcu

SEQ ID NO: 1861889 - RNA, 22 nt, Human
agcagggcucagcggggacagc

SEQ ID NO: 1861890 - RNA, 20 nt, Human
agcagggagggcuucugcca

SEQ ID NO: 1861891 - RNA, 13 nt, Human
agcagggcucagc

SEQ ID NO: 1861892 - RNA, 14 nt, Human
agcagggcucagcg

SEQ ID NO: 1861893 - RNA, 15 nt, Human
agcagggcucagcgg

SEQ ID NO: 1861894 - RNA, 19 nt, Human
ugacccaugcugcccugug

SEQ ID NO: 1861895 - RNA, 18 nt, Human
ugacccaugcugcccugu

SEQ ID NO: 1861896 - RNA, 17 nt, Human
ugacccaugcugcccug

SEQ ID NO: 1861897 - RNA, 20 nt, Human
ugacccaugcugcccuguga

SEQ ID NO: 1861898 - RNA, 11 nt, Human
agcagccacau

SEQ ID NO: 1861899 - RNA, 15 nt, Human
agcagccacauuccu

SEQ ID NO: 1861900 - RNA, 13 nt, Human
agcaggacaugga

SEQ ID NO: 1861901 - RNA, 16 nt, Human
agcagcagggagggcu

SEQ ID NO: 1861902 - RNA, 14 nt, Human
ugaguacuacaguc

SEQ ID NO: 1861903 - RNA, 20 nt, Human
ugaguacguugugcauuugg

SEQ ID NO: 1861904 - RNA, 18 nt, Human
ugagucaccaagcccagu

SEQ ID NO: 1861905 - RNA, 14 nt, Human
ugagugccuuacac

SEQ ID NO: 1861906 - RNA, 13 nt, Human
ugagugccuuaca

SEQ ID NO: 1861907 - RNA, 17 nt, Human
ugagugcagcucuggag

SEQ ID NO: 1861908 - RNA, 16 nt, Human
ugagugccuuacacaa

SEQ ID NO: 1861909 - RNA, 14 nt, Human
ugauacaaugcugu

SEQ ID NO: 1861910 - RNA, 15 nt, Human
ugauacaaugcugug

SEQ ID NO: 1861911 - RNA, 21 nt, Human
ugagugggggaucacagccuc

SEQ ID NO: 1861912 - RNA, 18 nt, Human
ugaguucauacccuguua

SEQ ID NO: 1861913 - RNA, 23 nt, Human
agcauaaaaauuagccaagugug

SEQ ID NO: 1861914 - RNA, 16 nt, Human
ugaguacguugugcau

SEQ ID NO: 1861915 - RNA, 17 nt, Human
ugaguacguugugcauu

SEQ ID NO: 1861916 - RNA, 18 nt, Human
ugaguacguugugcauuu

SEQ ID NO: 1861917 - RNA, 19 nt, Human
ugaguacguugugcauuug

SEQ ID NO: 1861918 - RNA, 19 nt, Human
agcauaaaaauuagccaag

SEQ ID NO: 1861919 - RNA, 14 nt, Human
agcaguuugcuuug

SEQ ID NO: 1861920 - RNA, 15 nt, Human
ugaucuaggaagacu

SEQ ID NO: 1861921 - RNA, 14 nt, Human
ugaucuaggaagac

SEQ ID NO: 1861922 - RNA, 22 nt, Human
ugaugaaaugaggucagagccu

SEQ ID NO: 1861923 - RNA, 18 nt, Human
ugaugaaauguaaauacu

SEQ ID NO: 1861924 - RNA, 23 nt, Human
ugaugaaaugaggucagagccug

SEQ ID NO: 1861925 - RNA, 19 nt, Human
ugaugaucuuugcagacag

SEQ ID NO: 1861926 - RNA, 20 nt, Human
ugaugaucuuugcagacagg

SEQ ID NO: 1861927 - RNA, 21 nt, Human
ugaugaucuuugcagacaggc

SEQ ID NO: 1861928 - RNA, 21 nt, Human
ugaugggcaacccccagccug

SEQ ID NO: 1861929 - RNA, 13 nt, Human
ugauggggcccug

SEQ ID NO: 1861930 - RNA, 22 nt, Human
ugaugggcaacccccagccugc

SEQ ID NO: 1861931 - RNA, 22 nt, Human
ugauggggcccugccuccuuug

SEQ ID NO: 1861932 - RNA, 23 nt, Human
ugauggguuaguggauggaaggg

SEQ ID NO: 1861933 - RNA, 19 nt, Human
ugauggguuaguggaugga

SEQ ID NO: 1861934 - RNA, 17 nt, Human
ugauguuuuccaugagu

SEQ ID NO: 1861935 - RNA, 21 nt, Human
ugauguuuuaaggaugcuugu

SEQ ID NO: 1861936 - RNA, 19 nt, Human
ugauguuuuccaugagucc

SEQ ID NO: 1861937 - RNA, 23 nt, Human
ugauguuuuccaugaguccccug

SEQ ID NO: 1861938 - RNA, 17 nt, Human
ugauuaaauucuugcaa

SEQ ID NO: 1861939 - RNA, 13 nt, Human
ugauuaaauucuu

SEQ ID NO: 1861940 - RNA, 16 nt, Human
ugauuaaauucuugca

SEQ ID NO: 1861941 - RNA, 16 nt, Human
agccacggccaggcca

SEQ ID NO: 1861942 - RNA, 13 nt, Human
agccaccacgccc

SEQ ID NO: 1861943 - RNA, 18 nt, Human
ugauccucccaccucagc

SEQ ID NO: 1861944 - RNA, 13 nt, Human
ugaucuaggaaga

SEQ ID NO: 1861945 - RNA, 19 nt, Human
ugauccucccaccucagcc

SEQ ID NO: 1861946 - RNA, 20 nt, Human
ugauccucccaccucagccu

SEQ ID NO: 1861947 - RNA, 13 nt, Human
ugauccagaaaga

SEQ ID NO: 1861948 - RNA, 14 nt, Human
ugauccacucgccu

SEQ ID NO: 1861949 - RNA, 18 nt, Human
ugauccacucgccuucau

SEQ ID NO: 1861950 - RNA, 23 nt, Human
ugauccagaaagaaaacuuguau

SEQ ID NO: 1861951 - RNA, 16 nt, Human
agcauauucaggaagc

SEQ ID NO: 1861952 - RNA, 12 nt, Human
agcaucaggcca

SEQ ID NO: 1861953 - RNA, 21 nt, Human
agcaucaggccaggcccucug

SEQ ID NO: 1861954 - RNA, 22 nt, Human
agcaucaggccaggcccucugc

SEQ ID NO: 1861955 - RNA, 23 nt, Human
agcaucaggccaggcccucugcc

SEQ ID NO: 1861956 - RNA, 13 nt, Human
agcauggcugcca

SEQ ID NO: 1861957 - RNA, 18 nt, Human
ugauacaaugcugugccc

SEQ ID NO: 1861958 - RNA, 21 nt, Human
agcauauucaggaagcucagg

SEQ ID NO: 1861959 - RNA, 19 nt, Human
agcauauucaggaagcuca

SEQ ID NO: 1861960 - RNA, 17 nt, Human
agcauauucaggaagcu

SEQ ID NO: 1861961 - RNA, 14 nt, Human
ugaucaccugcccu

SEQ ID NO: 1861962 - RNA, 18 nt, Human
ugaucacggcucacugca

SEQ ID NO: 1861963 - RNA, 15 nt, Human
ugaucacggcucacu

SEQ ID NO: 1861964 - RNA, 13 nt, Human
ugaucacggcuca

SEQ ID NO: 1861965 - RNA, 14 nt, Human
ugaucacggcucac

SEQ ID NO: 1861966 - RNA, 17 nt, Human
agcauuagauuucucau

SEQ ID NO: 1861967 - RNA, 19 nt, Human
agcauggcugccaauggga

SEQ ID NO: 1861968 - RNA, 20 nt, Human
agcauucucacuccuaccug

SEQ ID NO: 1861969 - RNA, 18 nt, Human
agcauucucacuccuacc

SEQ ID NO: 1861970 - RNA, 22 nt, Human
agcauucucacuccuaccuggu

SEQ ID NO: 1861971 - RNA, 22 nt, Human
agcauuuugcuaaaugugaaug

SEQ ID NO: 1861972 - RNA, 15 nt, Human
agcauuuugcuaaau

SEQ ID NO: 1861973 - RNA, 18 nt, Human
agccaaacauccuacaag

SEQ ID NO: 1861974 - RNA, 16 nt, Human
agcauuugucaacaaa

SEQ ID NO: 1861975 - RNA, 15 nt, Human
agcccgggcucugcc

SEQ ID NO: 1861976 - RNA, 14 nt, Human
agcccgggcucugc

SEQ ID NO: 1861977 - RNA, 13 nt, Human
agcccgggcucug

SEQ ID NO: 1861978 - RNA, 19 nt, Human
agccccuucugacccaugc

SEQ ID NO: 1861979 - RNA, 16 nt, Human
agccccuucugaccca

SEQ ID NO: 1861980 - RNA, 15 nt, Human
agccccuucugaccc

SEQ ID NO: 1861981 - RNA, 14 nt, Human
agccccuucugacc

SEQ ID NO: 1861982 - RNA, 19 nt, Human
agcccugcagagggcacag

SEQ ID NO: 1861983 - RNA, 16 nt, Human
agcccugcagagggca

SEQ ID NO: 1861984 - RNA, 15 nt, Human
agcccugcagagggc

SEQ ID NO: 1861985 - RNA, 14 nt, Human
agcccugcagaggg

SEQ ID NO: 1861986 - RNA, 16 nt, Human
agcccgggcucugccu

SEQ ID NO: 1861987 - RNA, 21 nt, Human
agcccaggccuccuacagcuu

SEQ ID NO: 1861988 - RNA, 19 nt, Human
agcccaggccuccuacagc

SEQ ID NO: 1861989 - RNA, 14 nt, Human
agcccaggccuccu

SEQ ID NO: 1861990 - RNA, 14 nt, Human
agccccgaggccuu

SEQ ID NO: 1861991 - RNA, 18 nt, Human
agccccgugggguuccuc

SEQ ID NO: 1861992 - RNA, 20 nt, Human
agcccugggaggcucuggag

SEQ ID NO: 1861993 - RNA, 18 nt, Human
agcccugggaggcucugg

SEQ ID NO: 1861994 - RNA, 17 nt, Human
agcccugggaggcucug

SEQ ID NO: 1861995 - RNA, 21 nt, Human
ugcaccacugcacuccagccu

SEQ ID NO: 1861996 - RNA, 13 nt, Human
ugcaccagcccuu

SEQ ID NO: 1861997 - RNA, 15 nt, Human
ugcacuccagccuga

SEQ ID NO: 1861998 - RNA, 14 nt, Human
ugcacuccagccug

SEQ ID NO: 1861999 - RNA, 16 nt, Human
ugcaccggcuggccug

SEQ ID NO: 1862000 - RNA, 15 nt, Human
ugcaccggcuggccu

SEQ ID NO: 1862001 - RNA, 14 nt, Human
ugcaccggcuggcc

SEQ ID NO: 1862002 - RNA, 17 nt, Human
ugcacuccagccugagc

SEQ ID NO: 1862003 - RNA, 15 nt, Human
ugcacuccagccugg

SEQ ID NO: 1862004 - RNA, 16 nt, Human
ugcacuccagccuggg

SEQ ID NO: 1862005 - RNA, 22 nt, Human
ugcagaagacaguauggcagcu

SEQ ID NO: 1862006 - RNA, 12 nt, Human
agcccaggccuc

SEQ ID NO: 1862007 - RNA, 15 nt, Human
ugcaaggucauuuuu

SEQ ID NO: 1862008 - RNA, 13 nt, Human
ugcaacaggcugg

SEQ ID NO: 1862009 - RNA, 17 nt, Human
agccacggccaggccag

SEQ ID NO: 1862010 - RNA, 18 nt, Human
agccacggccaggccaga

SEQ ID NO: 1862011 - RNA, 13 nt, Human
ugauuucauucaa

SEQ ID NO: 1862012 - RNA, 20 nt, Human
ugauuucagcaccuacagug

SEQ ID NO: 1862013 - RNA, 13 nt, Human
ugcaaaccaucau

SEQ ID NO: 1862014 - RNA, 12 nt, Human
ugcaaaccauca

SEQ ID NO: 1862015 - RNA, 12 nt, Human
ugauuuggaaaa

SEQ ID NO: 1862016 - RNA, 18 nt, Human
ugauuuccguuaaaauac

SEQ ID NO: 1862017 - RNA, 20 nt, Human
ugcaaaccaucauugaaauc

SEQ ID NO: 1862018 - RNA, 18 nt, Human
ugcaaaccaucauugaaa

SEQ ID NO: 1862019 - RNA, 17 nt, Human
ugcaaagcccagcuuga

SEQ ID NO: 1862020 - RNA, 15 nt, Human
ugcaaagcccagcuu

SEQ ID NO: 1862021 - RNA, 14 nt, Human
ugcaaagcccagcu

SEQ ID NO: 1862022 - RNA, 21 nt, Human
ugcaaaggguaucaggugcug

SEQ ID NO: 1862023 - RNA, 20 nt, Human
ugcaaaguaucccuacugua

SEQ ID NO: 1862024 - RNA, 23 nt, Human
ugcaaaguucccuacuuccugug

SEQ ID NO: 1862025 - RNA, 19 nt, Human
agccugugccucugggacu

SEQ ID NO: 1862026 - RNA, 18 nt, Human
agccugugccucugggac

SEQ ID NO: 1862027 - RNA, 17 nt, Human
agccugugccucuggga

SEQ ID NO: 1862028 - RNA, 19 nt, Human
agccuugcggaagguucua

SEQ ID NO: 1862029 - RNA, 21 nt, Human
agccuugaccauucuccaccu

SEQ ID NO: 1862030 - RNA, 19 nt, Human
agccuugaccauucuccac

SEQ ID NO: 1862031 - RNA, 18 nt, Human
agccuugaccauucucca

SEQ ID NO: 1862032 - RNA, 16 nt, Human
agccuugggaccccug

SEQ ID NO: 1862033 - RNA, 13 nt, Human
agccuugaacuuu

SEQ ID NO: 1862034 - RNA, 15 nt, Human
agccuguuuaagaga

SEQ ID NO: 1862035 - RNA, 22 nt, Human
agccuuagaagucacacaguau

SEQ ID NO: 1862036 - RNA, 20 nt, Human
agccuuagaagucacacagu

SEQ ID NO: 1862037 - RNA, 14 nt, Human
ugccaaugggagcu

SEQ ID NO: 1862038 - RNA, 13 nt, Human
ugccaauggacua

SEQ ID NO: 1862039 - RNA, 18 nt, Human
ugccaaugggagcucaug

SEQ ID NO: 1862040 - RNA, 16 nt, Human
ugcauuuaaaagauac

SEQ ID NO: 1862041 - RNA, 22 nt, Human
ugccagccgagauagccaaggc

SEQ ID NO: 1862042 - RNA, 17 nt, Human
ugccagccgagauagcc

SEQ ID NO: 1862043 - RNA, 13 nt, Human
ugccauaauuacu

SEQ ID NO: 1862044 - RNA, 18 nt, Human
agccuccugcccuuaccu

SEQ ID NO: 1862045 - RNA, 14 nt, Human
agccuccugcccuu

SEQ ID NO: 1862046 - RNA, 13 nt, Human
agccuccugcccu

SEQ ID NO: 1862047 - RNA, 12 nt, Human
ugcagacaggca

SEQ ID NO: 1862048 - RNA, 13 nt, Human
ugcagacaggcaa

SEQ ID NO: 1862049 - RNA, 21 nt, Human
ugcagacaggcaagcaccucc

SEQ ID NO: 1862050 - RNA, 22 nt, Human
ugcaggucccuaauaaagcugu

SEQ ID NO: 1862051 - RNA, 11 nt, Human
ugcaggucccu

SEQ ID NO: 1862052 - RNA, 21 nt, Human
ugcagccucacaguccuuacc

SEQ ID NO: 1862053 - RNA, 17 nt, Human
ugcagccucacaguccu

SEQ ID NO: 1862054 - RNA, 18 nt, Human
ugcagccucacaguccuu

SEQ ID NO: 1862055 - RNA, 21 nt, Human
ugcaugcugucccuuacguga

SEQ ID NO: 1862056 - RNA, 19 nt, Human
ugcaugcugucccuuacgu

SEQ ID NO: 1862057 - RNA, 18 nt, Human
ugcaugcugucccuuacg

SEQ ID NO: 1862058 - RNA, 15 nt, Human
ugcaucucagcccac

SEQ ID NO: 1862059 - RNA, 14 nt, Human
ugcaucucagccca

SEQ ID NO: 1862060 - RNA, 13 nt, Human
ugcaucucagccc

SEQ ID NO: 1862061 - RNA, 13 nt, Human
ugcauacucauua

SEQ ID NO: 1862062 - RNA, 19 nt, Human
ugcauacucauuaggaugg

SEQ ID NO: 1862063 - RNA, 17 nt, Human
ugcauagaauaaaauuu

SEQ ID NO: 1862064 - RNA, 16 nt, Human
ugcauaccacuuuugu

SEQ ID NO: 1862065 - RNA, 18 nt, Human
ugcauaccacuuuuguuc

SEQ ID NO: 1862066 - RNA, 20 nt, Human
ugcauaccacuuuuguucuu

SEQ ID NO: 1862067 - RNA, 13 nt, Human
aggaucagucuga

SEQ ID NO: 1862068 - RNA, 19 nt, Human
aggauucuuccucccuccc

SEQ ID NO: 1862069 - RNA, 17 nt, Human
aggauucuuccucccuc

SEQ ID NO: 1862070 - RNA, 23 nt, Human
aggaugaucuaggaagacuuugg

SEQ ID NO: 1862071 - RNA, 22 nt, Human
aggaugaucuaggaagacuuug

SEQ ID NO: 1862072 - RNA, 22 nt, Human
aggaugcacagaguuguuacau

SEQ ID NO: 1862073 - RNA, 16 nt, Human
ugcuuuuuauggccug

SEQ ID NO: 1862074 - RNA, 17 nt, Human
ugcuuuuucucaaaaug

SEQ ID NO: 1862075 - RNA, 23 nt, Human
uggaaauuuguuauaaugaauga

SEQ ID NO: 1862076 - RNA, 21 nt, Human
uggaaauuuguuauaaugaau

SEQ ID NO: 1862077 - RNA, 16 nt, Human
uggaagacagcucuua

SEQ ID NO: 1862078 - RNA, 15 nt, Human
ugcuuugggcugccc

SEQ ID NO: 1862079 - RNA, 14 nt, Human
ugcuuugggcugcc

SEQ ID NO: 1862080 - RNA, 15 nt, Human
ugcuugagcucagga

SEQ ID NO: 1862081 - RNA, 17 nt, Human
aggagccuccugcccuu

SEQ ID NO: 1862082 - RNA, 17 nt, Human
ugcuuugugauuuuugu

SEQ ID NO: 1862083 - RNA, 22 nt, Human
ugcuuugugauuuuuguaauuu

SEQ ID NO: 1862084 - RNA, 17 nt, Human
ugcuuugggcugcccug

SEQ ID NO: 1862085 - RNA, 16 nt, Human
ugcuuugggcugcccu

SEQ ID NO: 1862086 - RNA, 23 nt, Human
ugcuuuuuaauauugauaugcuu

SEQ ID NO: 1862087 - RNA, 20 nt, Human
ugcuuuugucuaugggacuc

SEQ ID NO: 1862088 - RNA, 18 nt, Human
ugcuuuuggucuguguga

SEQ ID NO: 1862089 - RNA, 15 nt, Human
aggacuaggguccug

SEQ ID NO: 1862090 - RNA, 18 nt, Human
aggacuaggguccugggg

SEQ ID NO: 1862091 - RNA, 16 nt, Human
aggacuaggguccugg

SEQ ID NO: 1862092 - RNA, 19 nt, Human
aggacuaggguccugggga

SEQ ID NO: 1862093 - RNA, 16 nt, Human
aggacgcucucuggcc

SEQ ID NO: 1862094 - RNA, 17 nt, Human
aggacgcucucuggccu

SEQ ID NO: 1862095 - RNA, 19 nt, Human
aggacgcucucuggccuuc

SEQ ID NO: 1862096 - RNA, 20 nt, Human
aggacgcucucuggccuucg

SEQ ID NO: 1862097 - RNA, 13 nt, Human
aggacgcucucug

SEQ ID NO: 1862098 - RNA, 14 nt, Human
aggacgcucucugg

SEQ ID NO: 1862099 - RNA, 16 nt, Human
aggagccuccugcccu

SEQ ID NO: 1862100 - RNA, 23 nt, Human
aggagcccugggaggcucuggag

SEQ ID NO: 1862101 - RNA, 17 nt, Human
aggagccccgaggccuu

SEQ ID NO: 1862102 - RNA, 13 nt, Human
aggagcagccaca

SEQ ID NO: 1862103 - RNA, 12 nt, Human
aggagcagccac

SEQ ID NO: 1862104 - RNA, 18 nt, Human
aggacucugccuccucuu

SEQ ID NO: 1862105 - RNA, 17 nt, Human
aggacucugccuccucu

SEQ ID NO: 1862106 - RNA, 16 nt, Human
aggacucugccuccuc

SEQ ID NO: 1862107 - RNA, 14 nt, Human
aggacucugccucc

SEQ ID NO: 1862108 - RNA, 13 nt, Human
aggacucugccuc

SEQ ID NO: 1862109 - RNA, 12 nt, Human
aggacucugccu

SEQ ID NO: 1862110 - RNA, 18 nt, Human
aggagaaacuggaacucu

SEQ ID NO: 1862111 - RNA, 19 nt, Human
aggagaaacuggaacucuc

SEQ ID NO: 1862112 - RNA, 22 nt, Human
aggacuuuucuuuguggcuucc

SEQ ID NO: 1862113 - RNA, 17 nt, Human
aggacuuuucuuugugg

SEQ ID NO: 1862114 - RNA, 19 nt, Human
aggacuuuucuuuguggcu

SEQ ID NO: 1862115 - RNA, 17 nt, Human
aggcaggugggauggau

SEQ ID NO: 1862116 - RNA, 15 nt, Human
aggcauaaagucagg

SEQ ID NO: 1862117 - RNA, 12 nt, Human
aggcagggucuc

SEQ ID NO: 1862118 - RNA, 22 nt, Human
aggcaggucuugaacuccuggc

SEQ ID NO: 1862119 - RNA, 20 nt, Human
aggcauuuaggccaugggac

SEQ ID NO: 1862120 - RNA, 18 nt, Human
aggcauugugggaagggg

SEQ ID NO: 1862121 - RNA, 22 nt, Human
aggcauaaagucagggguuccc

SEQ ID NO: 1862122 - RNA, 14 nt, Human
uggagaaaauggac

SEQ ID NO: 1862123 - RNA, 18 nt, Human
aggauugcuacuguccua

SEQ ID NO: 1862124 - RNA, 15 nt, Human
aggauugcuacuguc

SEQ ID NO: 1862125 - RNA, 17 nt, Human
aggauugcuacuguccu

SEQ ID NO: 1862126 - RNA, 16 nt, Human
aggcaaggcugucaau

SEQ ID NO: 1862127 - RNA, 17 nt, Human
aggcaaggcugucaauu

SEQ ID NO: 1862128 - RNA, 20 nt, Human
aggcaagcaccuccugccuc

SEQ ID NO: 1862129 - RNA, 18 nt, Human
aggcaagcaccuccugcc

SEQ ID NO: 1862130 - RNA, 19 nt, Human
aggcaagcaccuccugccu

SEQ ID NO: 1862131 - RNA, 17 nt, Human
uggagccaauggagacu

SEQ ID NO: 1862132 - RNA, 17 nt, Human
aggcaagcaccuccugc

SEQ ID NO: 1862133 - RNA, 15 nt, Human
aggccagccuugacc

SEQ ID NO: 1862134 - RNA, 12 nt, Human
aggccagcugcu

SEQ ID NO: 1862135 - RNA, 13 nt, Human
aggccagccuuga

SEQ ID NO: 1862136 - RNA, 22 nt, Human
uggcagcucaccucucccuugg

SEQ ID NO: 1862137 - RNA, 21 nt, Human
uggcagcucaccucucccuug

SEQ ID NO: 1862138 - RNA, 23 nt, Human
uggcagcucaccucucccuugga

SEQ ID NO: 1862139 - RNA, 13 nt, Human
uggcagcucagag

SEQ ID NO: 1862140 - RNA, 18 nt, Human
uggcacccggccccugcu

SEQ ID NO: 1862141 - RNA, 19 nt, Human
uggcacccggccccugcug

SEQ ID NO: 1862142 - RNA, 20 nt, Human
uggcacccggccccugcugg

SEQ ID NO: 1862143 - RNA, 13 nt, Human
aggcccagagggc

SEQ ID NO: 1862144 - RNA, 14 nt, Human
aggccccgcccagg

SEQ ID NO: 1862145 - RNA, 14 nt, Human
aggcccggccucuc

SEQ ID NO: 1862146 - RNA, 13 nt, Human
aggcccggccucu

SEQ ID NO: 1862147 - RNA, 15 nt, Human
aggcccggccucuca

SEQ ID NO: 1862148 - RNA, 13 nt, Human
aggcccggcucca

SEQ ID NO: 1862149 - RNA, 20 nt, Human
aggcauuugcugaauacaga

SEQ ID NO: 1862150 - RNA, 16 nt, Human
aggcauuugcugaaua

SEQ ID NO: 1862151 - RNA, 17 nt, Human
uggagugcaaugacaca

SEQ ID NO: 1862152 - RNA, 14 nt, Human
uggagugcagugag

SEQ ID NO: 1862153 - RNA, 14 nt, Human
uggaguugaaaauc

SEQ ID NO: 1862154 - RNA, 21 nt, Human
uggaugccugguggcagcugc

SEQ ID NO: 1862155 - RNA, 23 nt, Human
uggaugccugguggcagcugcgg

SEQ ID NO: 1862156 - RNA, 13 nt, Human
uggauggaagggg

SEQ ID NO: 1862157 - RNA, 23 nt, Human
uggcacaucagcacgauuucugu

SEQ ID NO: 1862158 - RNA, 21 nt, Human
ugccugcuuuuuauggccugu

SEQ ID NO: 1862159 - RNA, 20 nt, Human
ugccugcuuuuuauggccug

SEQ ID NO: 1862160 - RNA, 22 nt, Human
ugccugcuuuuuauggccugug

SEQ ID NO: 1862161 - RNA, 24 nt, Human
ugccugcccaggccccugccaccc

SEQ ID NO: 1862162 - RNA, 12 nt, Human
ugccucugccug

SEQ ID NO: 1862163 - RNA, 20 nt, Human
ugccugcccaggccccugcc

SEQ ID NO: 1862164 - RNA, 22 nt, Human
ugccugcccaggccccugccac

SEQ ID NO: 1862165 - RNA, 23 nt, Human
ugccugcccaggccccugccacc

SEQ ID NO: 1862166 - RNA, 14 nt, Human
ugccucagccuccc

SEQ ID NO: 1862167 - RNA, 18 nt, Human
ugccucugccucugacac

SEQ ID NO: 1862168 - RNA, 20 nt, Human
ugccucugccucugacacac

SEQ ID NO: 1862169 - RNA, 17 nt, Human
ugccucugccucugaca

SEQ ID NO: 1862170 - RNA, 19 nt, Human
agcuggccgggagccugau

SEQ ID NO: 1862171 - RNA, 18 nt, Human
agcuggccgggagccuga

SEQ ID NO: 1862172 - RNA, 16 nt, Human
agcugcuugggcuuca

SEQ ID NO: 1862173 - RNA, 20 nt, Human
agcugcuugggcuucauccu

SEQ ID NO: 1862174 - RNA, 21 nt, Human
ugccuggauggggcugcaccg

SEQ ID NO: 1862175 - RNA, 20 nt, Human
ugccuggauggggcugcacc

SEQ ID NO: 1862176 - RNA, 17 nt, Human
ugccuggauggggcugc

SEQ ID NO: 1862177 - RNA, 16 nt, Human
ugccuggauggggcug

SEQ ID NO: 1862178 - RNA, 19 nt, Human
agcugccuguucagcucca

SEQ ID NO: 1862179 - RNA, 18 nt, Human
agcugccuguucagcucc

SEQ ID NO: 1862180 - RNA, 14 nt, Human
agcugccuguucag

SEQ ID NO: 1862181 - RNA, 16 nt, Human
agcugccuguucagcu

SEQ ID NO: 1862182 - RNA, 18 nt, Human
agcuguuacugucuucag

SEQ ID NO: 1862183 - RNA, 19 nt, Human
agcugugcucuggacaggc

SEQ ID NO: 1862184 - RNA, 17 nt, Human
agcugugcucuggacag

SEQ ID NO: 1862185 - RNA, 18 nt, Human
agcugugcucuggacagg

SEQ ID NO: 1862186 - RNA, 23 nt, Human
agcugggguggggaccucaggcc

SEQ ID NO: 1862187 - RNA, 22 nt, Human
agcugggguggggaccucaggc

SEQ ID NO: 1862188 - RNA, 20 nt, Human
agcugggacuacaggcaccc

SEQ ID NO: 1862189 - RNA, 23 nt, Human
agcugggacuacaggcacccacc

SEQ ID NO: 1862190 - RNA, 20 nt, Human
agcugggguggggaccucag

SEQ ID NO: 1862191 - RNA, 16 nt, Human
agcugggacuacaggu

SEQ ID NO: 1862192 - RNA, 17 nt, Human
ugccuguugggccagga

SEQ ID NO: 1862193 - RNA, 16 nt, Human
ugccuguugggccagg

SEQ ID NO: 1862194 - RNA, 20 nt, Human
ugccuuacccucauguucuu

SEQ ID NO: 1862195 - RNA, 16 nt, Human
ugccuuggggacaaga

SEQ ID NO: 1862196 - RNA, 21 nt, Human
ugccuuacccucauguucuua

SEQ ID NO: 1862197 - RNA, 14 nt, Human
ugccuguucccauu

SEQ ID NO: 1862198 - RNA, 19 nt, Human
agcuguuacugucuucagu

SEQ ID NO: 1862199 - RNA, 20 nt, Human
agcugccagccgagauagcc

SEQ ID NO: 1862200 - RNA, 16 nt, Human
agcucuguccugggag

SEQ ID NO: 1862201 - RNA, 21 nt, Human
agcucuguccugggagugagc

SEQ ID NO: 1862202 - RNA, 23 nt, Human
agcucuguccugggagugagcug

SEQ ID NO: 1862203 - RNA, 14 nt, Human
ugccgcagcccugc

SEQ ID NO: 1862204 - RNA, 12 nt, Human
ugccgcagcccu

SEQ ID NO: 1862205 - RNA, 12 nt, Human
ugccucagccuc

SEQ ID NO: 1862206 - RNA, 13 nt, Human
ugccucagccucc

SEQ ID NO: 1862207 - RNA, 18 nt, Human
ugcccuuaccugccagga

SEQ ID NO: 1862208 - RNA, 17 nt, Human
agcucugguccauagag

SEQ ID NO: 1862209 - RNA, 12 nt, Human
agcucuggucca

SEQ ID NO: 1862210 - RNA, 16 nt, Human
agcuccuucuguccua

SEQ ID NO: 1862211 - RNA, 21 nt, Human
agcuccuucuguccuacucug

SEQ ID NO: 1862212 - RNA, 15 nt, Human
agcuccaucuccacu

SEQ ID NO: 1862213 - RNA, 13 nt, Human
agcuccaucucca

SEQ ID NO: 1862214 - RNA, 13 nt, Human
agcucccaggcau

SEQ ID NO: 1862215 - RNA, 16 nt, Human
agcuccaucuccacuc

SEQ ID NO: 1862216 - RNA, 23 nt, Human
agcucccaggcauuccccaggag

SEQ ID NO: 1862217 - RNA, 15 nt, Human
agcuccuucuguccu

SEQ ID NO: 1862218 - RNA, 16 nt, Human
aggaagcucagggccu

SEQ ID NO: 1862219 - RNA, 15 nt, Human
aggaagcucagggcc

SEQ ID NO: 1862220 - RNA, 15 nt, Human
aggaaggcugagagg

SEQ ID NO: 1862221 - RNA, 14 nt, Human
aggaagcucagggc

SEQ ID NO: 1862222 - RNA, 13 nt, Human
aggaagcucaggg

SEQ ID NO: 1862223 - RNA, 13 nt, Human
aggaagccagcag

SEQ ID NO: 1862224 - RNA, 18 nt, Human
aggaagcagcuuucccca

SEQ ID NO: 1862225 - RNA, 18 nt, Human
ugcuaucucccccagccc

SEQ ID NO: 1862226 - RNA, 17 nt, Human
ugcuaucucccccagcc

SEQ ID NO: 1862227 - RNA, 14 nt, Human
ugcuaucuccccca

SEQ ID NO: 1862228 - RNA, 13 nt, Human
ugcuaucuccccc

SEQ ID NO: 1862229 - RNA, 16 nt, Human
aggaaaagcugcugac

SEQ ID NO: 1862230 - RNA, 21 nt, Human
ugcuccagcuguucagcuggu

SEQ ID NO: 1862231 - RNA, 15 nt, Human
ugcucuugaacuccu

SEQ ID NO: 1862232 - RNA, 22 nt, Human
ugcucuugaacuccugaccuca

SEQ ID NO: 1862233 - RNA, 20 nt, Human
ugcucuugaacuccugaccu

SEQ ID NO: 1862234 - RNA, 14 nt, Human
ugcucugcugacag

SEQ ID NO: 1862235 - RNA, 15 nt, Human
ugcucugcugacaga

SEQ ID NO: 1862236 - RNA, 16 nt, Human
ugcucugcugacagac

SEQ ID NO: 1862237 - RNA, 20 nt, Human
ugcuaauuuugaaaaacugc

SEQ ID NO: 1862238 - RNA, 19 nt, Human
ugcuaauuuugaaaaacug

SEQ ID NO: 1862239 - RNA, 18 nt, Human
ugcuaauuuugaaaaacu

SEQ ID NO: 1862240 - RNA, 16 nt, Human
ugcuaauuuugaaaaa

SEQ ID NO: 1862241 - RNA, 13 nt, Human
agcuuaacagugu

SEQ ID NO: 1862242 - RNA, 13 nt, Human
agcuguuuaugca

SEQ ID NO: 1862243 - RNA, 14 nt, Human
ugcgguccacccag

SEQ ID NO: 1862244 - RNA, 15 nt, Human
ugcgguccacccagg

SEQ ID NO: 1862245 - RNA, 20 nt, Human
agcuugcccuggugccucac

SEQ ID NO: 1862246 - RNA, 23 nt, Human
agcuugaccgugaggccagagac

SEQ ID NO: 1862247 - RNA, 22 nt, Human
agcuugaccgugaggccagaga

SEQ ID NO: 1862248 - RNA, 20 nt, Human
agcuugaccgugaggccaga

SEQ ID NO: 1862249 - RNA, 15 nt, Human
agcuuacaagccagc

SEQ ID NO: 1862250 - RNA, 17 nt, Human
agcuuacaagccagcug

SEQ ID NO: 1862251 - RNA, 19 nt, Human
agcuuacaagccagcugga

SEQ ID NO: 1862252 - RNA, 22 nt, Human
agcuuuccccaugucucgacuc

SEQ ID NO: 1862253 - RNA, 14 nt, Human
aggaaaagcugcug

SEQ ID NO: 1862254 - RNA, 18 nt, Human
aggugccucaagagaagg

SEQ ID NO: 1862255 - RNA, 15 nt, Human
aggugggauccucca

SEQ ID NO: 1862256 - RNA, 17 nt, Human
aggugggauccuccagg

SEQ ID NO: 1862257 - RNA, 16 nt, Human
aggugggauccuccag

SEQ ID NO: 1862258 - RNA, 18 nt, Human
aggugggauccuccaggu

SEQ ID NO: 1862259 - RNA, 23 nt, Human
agguggggcagcuugaggguugg

SEQ ID NO: 1862260 - RNA, 14 nt, Human
aggugauccaccca

SEQ ID NO: 1862261 - RNA, 20 nt, Human
aggugauccacccaccucag

SEQ ID NO: 1862262 - RNA, 20 nt, Human
aggugcauauuuauaaaaau

SEQ ID NO: 1862263 - RNA, 14 nt, Human
agguuuaagcuguu

SEQ ID NO: 1862264 - RNA, 19 nt, Human
agguggggucacucuggca

SEQ ID NO: 1862265 - RNA, 17 nt, Human
aggugugaaccaccaca

SEQ ID NO: 1862266 - RNA, 15 nt, Human
aggugugcucugauc

SEQ ID NO: 1862267 - RNA, 20 nt, Human
aggugugcucugaucaucca

SEQ ID NO: 1862268 - RNA, 17 nt, Human
ugguuuucaaaauaaaa

SEQ ID NO: 1862269 - RNA, 15 nt, Human
ugguuuucaaaauaa

SEQ ID NO: 1862270 - RNA, 14 nt, Human
ugguuuucaaaaua

SEQ ID NO: 1862271 - RNA, 15 nt, Human
ugguuuguaaauuaa

SEQ ID NO: 1862272 - RNA, 13 nt, Human
ugguuuccugccc

SEQ ID NO: 1862273 - RNA, 12 nt, Human
ugguuuccugcc

SEQ ID NO: 1862274 - RNA, 20 nt, Human
ugguuuccugcccugggagg

SEQ ID NO: 1862275 - RNA, 15 nt, Human
ugguuuccugcccug

SEQ ID NO: 1862276 - RNA, 14 nt, Human
ugguuuccugcccu

SEQ ID NO: 1862277 - RNA, 14 nt, Human
ugguuauggagagg

SEQ ID NO: 1862278 - RNA, 15 nt, Human
uguaaauagcucagg

SEQ ID NO: 1862279 - RNA, 16 nt, Human
uguaaauagcucaggu

SEQ ID NO: 1862280 - RNA, 21 nt, Human
uguaaauacuguuuuuaacaa

SEQ ID NO: 1862281 - RNA, 19 nt, Human
uguaaauaaagaacuagca

SEQ ID NO: 1862282 - RNA, 16 nt, Human
aggugagaagcagagg

SEQ ID NO: 1862283 - RNA, 23 nt, Human
aggugagaagcagaggaaggaga

SEQ ID NO: 1862284 - RNA, 21 nt, Human
aggugagaagcagaggaagga

SEQ ID NO: 1862285 - RNA, 22 nt, Human
aggugacagagugagacucugu

SEQ ID NO: 1862286 - RNA, 13 nt, Human
aggugaccccagg

SEQ ID NO: 1862287 - RNA, 18 nt, Human
aggucuugaacuccuggc

SEQ ID NO: 1862288 - RNA, 17 nt, Human
aggucuugaacuccugg

SEQ ID NO: 1862289 - RNA, 13 nt, Human
aggugacagagug

SEQ ID NO: 1862290 - RNA, 15 nt, Human
aggugacagagugag

SEQ ID NO: 1862291 - RNA, 19 nt, Human
agguccacaacacacagau

SEQ ID NO: 1862292 - RNA, 16 nt, Human
aggucuugaacuccug

SEQ ID NO: 1862293 - RNA, 15 nt, Human
uggucagauuugaac

SEQ ID NO: 1862294 - RNA, 16 nt, Human
uggucagauuugaacu

SEQ ID NO: 1862295 - RNA, 13 nt, Human
aggucagagccug

SEQ ID NO: 1862296 - RNA, 14 nt, Human
aggucagagccugc

SEQ ID NO: 1862297 - RNA, 15 nt, Human
aggucagagccugca

SEQ ID NO: 1862298 - RNA, 17 nt, Human
aggucagagccugcagu

SEQ ID NO: 1862299 - RNA, 18 nt, Human
aggucagagccugcaguu

SEQ ID NO: 1862300 - RNA, 23 nt, Human
uggugugaccacugcagaagaca

SEQ ID NO: 1862301 - RNA, 20 nt, Human
ugguuaggcauugugggaag

SEQ ID NO: 1862302 - RNA, 18 nt, Human
ugguuaggcauuguggga

SEQ ID NO: 1862303 - RNA, 21 nt, Human
ugguggagaggcccggccucu

SEQ ID NO: 1862304 - RNA, 14 nt, Human
ugguggcagcugcg

SEQ ID NO: 1862305 - RNA, 13 nt, Human
ugguggcagcugc

SEQ ID NO: 1862306 - RNA, 15 nt, Human
ugguggcagcugcgg

SEQ ID NO: 1862307 - RNA, 12 nt, Human
ugguggcagugg

SEQ ID NO: 1862308 - RNA, 18 nt, Human
uggugcugccacacuuca

SEQ ID NO: 1862309 - RNA, 13 nt, Human
uggugcugccaca

SEQ ID NO: 1862310 - RNA, 16 nt, Human
uggugcgaucuggguu

SEQ ID NO: 1862311 - RNA, 17 nt, Human
uggugcgaucuggguuc

SEQ ID NO: 1862312 - RNA, 23 nt, Human
agucacacaguauuacuucugcu

SEQ ID NO: 1862313 - RNA, 19 nt, Human
agucaccccggccaccugc

SEQ ID NO: 1862314 - RNA, 15 nt, Human
agucacacagugagu

SEQ ID NO: 1862315 - RNA, 23 nt, Human
agucacacagugagucgaggaca

SEQ ID NO: 1862316 - RNA, 15 nt, Human
ugucaauuacaggaa

SEQ ID NO: 1862317 - RNA, 14 nt, Human
ugucaauuacagga

SEQ ID NO: 1862318 - RNA, 17 nt, Human
ugucaauuacaggaagu

SEQ ID NO: 1862319 - RNA, 19 nt, Human
ugucaauuacaggaaguac

SEQ ID NO: 1862320 - RNA, 15 nt, Human
aguaugguggcuggg

SEQ ID NO: 1862321 - RNA, 16 nt, Human
aguaugguggcugggu

SEQ ID NO: 1862322 - RNA, 15 nt, Human
aguauuacuucugcu

SEQ ID NO: 1862323 - RNA, 17 nt, Human
aguaugguggcuggguu

SEQ ID NO: 1862324 - RNA, 18 nt, Human
aguauuacuucugcuaca

SEQ ID NO: 1862325 - RNA, 17 nt, Human
uguaucaaugaguaaca

SEQ ID NO: 1862326 - RNA, 18 nt, Human
uguaugucucgugguagg

SEQ ID NO: 1862327 - RNA, 13 nt, Human
uguauuacaaauc

SEQ ID NO: 1862328 - RNA, 22 nt, Human
uguauuacaaauccaaugaaau

SEQ ID NO: 1862329 - RNA, 19 nt, Human
uguauucucuccuguaccu

SEQ ID NO: 1862330 - RNA, 20 nt, Human
uguauucucuccuguaccuc

SEQ ID NO: 1862331 - RNA, 20 nt, Human
aguagaagucuuagauguau

SEQ ID NO: 1862332 - RNA, 19 nt, Human
aguagaagucuuagaugua

SEQ ID NO: 1862333 - RNA, 21 nt, Human
aguagaagucuuagauguaua

SEQ ID NO: 1862334 - RNA, 14 nt, Human
aguacauguuaaac

SEQ ID NO: 1862335 - RNA, 11 nt, Human
aguagagacag

SEQ ID NO: 1862336 - RNA, 20 nt, Human
uguaggcauaaagucagggg

SEQ ID NO: 1862337 - RNA, 17 nt, Human
uguaggcauaaagucag

SEQ ID NO: 1862338 - RNA, 14 nt, Human
aguaauaugcacac

SEQ ID NO: 1862339 - RNA, 15 nt, Human
aguaauaugcacaca

SEQ ID NO: 1862340 - RNA, 13 nt, Human
aguaaaauccaca

SEQ ID NO: 1862341 - RNA, 18 nt, Human
uguagaaaagggaacuga

SEQ ID NO: 1862342 - RNA, 19 nt, Human
uguagaaaagggaacugaa

SEQ ID NO: 1862343 - RNA, 20 nt, Human
uguagaaaagggaacugaac

SEQ ID NO: 1862344 - RNA, 21 nt, Human
uguagaaaagggaacugaaca

SEQ ID NO: 1862345 - RNA, 23 nt, Human
uguacuugcucuugaugccuggc

SEQ ID NO: 1862346 - RNA, 22 nt, Human
uguacuugcucuugaugccugg

SEQ ID NO: 1862347 - RNA, 16 nt, Human
uguagaggagaaacug

SEQ ID NO: 1862348 - RNA, 14 nt, Human
uguagagcuucugg

SEQ ID NO: 1862349 - RNA, 23 nt, Human
uguagaaaagggaacugaacauu

SEQ ID NO: 1862350 - RNA, 16 nt, Human
uguagagccagggucu

SEQ ID NO: 1862351 - RNA, 18 nt, Human
uguagagccagggucuca

SEQ ID NO: 1862352 - RNA, 16 nt, Human
ugggagagccuuccag

SEQ ID NO: 1862353 - RNA, 18 nt, Human
ugggaggaucucuugagc

SEQ ID NO: 1862354 - RNA, 18 nt, Human
ugggagacugcugaguca

SEQ ID NO: 1862355 - RNA, 21 nt, Human
ugggagagaagagaaugcaca

SEQ ID NO: 1862356 - RNA, 19 nt, Human
ugggagagaagagaaugca

SEQ ID NO: 1862357 - RNA, 20 nt, Human
ugggacucaaugcacugaca

SEQ ID NO: 1862358 - RNA, 23 nt, Human
agggaggacgcucucuggccuuc

SEQ ID NO: 1862359 - RNA, 21 nt, Human
agggaggacgcucucuggccu

SEQ ID NO: 1862360 - RNA, 22 nt, Human
agggaggacgcucucuggccuu

SEQ ID NO: 1862361 - RNA, 14 nt, Human
ugggacuacaggca

SEQ ID NO: 1862362 - RNA, 15 nt, Human
ugggacuacaggcac

SEQ ID NO: 1862363 - RNA, 16 nt, Human
ugggacuacaggcacc

SEQ ID NO: 1862364 - RNA, 21 nt, Human
aggcccggcuccaggcuccuu

SEQ ID NO: 1862365 - RNA, 18 nt, Human
aggcccggcuccaggcuc

SEQ ID NO: 1862366 - RNA, 20 nt, Human
aggcccggcuccaggcuccu

SEQ ID NO: 1862367 - RNA, 13 nt, Human
agggaaauuucag

SEQ ID NO: 1862368 - RNA, 21 nt, Human
agggaauuucuucaacucccu

SEQ ID NO: 1862369 - RNA, 22 nt, Human
agggaaggauacaaaagcaugu

SEQ ID NO: 1862370 - RNA, 22 nt, Human
agggaaggggacaaggacuagg

SEQ ID NO: 1862371 - RNA, 13 nt, Human
agggaaggggaca

SEQ ID NO: 1862372 - RNA, 20 nt, Human
ugggaggccaaggugggagg

SEQ ID NO: 1862373 - RNA, 19 nt, Human
ugggaggccaaggugggag

SEQ ID NO: 1862374 - RNA, 22 nt, Human
ugggaggaucucuugagccugg

SEQ ID NO: 1862375 - RNA, 21 nt, Human
ugggaggaucucuugagccug

SEQ ID NO: 1862376 - RNA, 20 nt, Human
ugggaggaucucuugagccu

SEQ ID NO: 1862377 - RNA, 13 nt, Human
ugggcagagcaga

SEQ ID NO: 1862378 - RNA, 18 nt, Human
ugggccaggagccuccug

SEQ ID NO: 1862379 - RNA, 12 nt, Human
ugggcagagcag

SEQ ID NO: 1862380 - RNA, 11 nt, Human
ugggcagagca

SEQ ID NO: 1862381 - RNA, 12 nt, Human
ugggcagaagga

SEQ ID NO: 1862382 - RNA, 21 nt, Human
ugggcccccaaauggaaaugg

SEQ ID NO: 1862383 - RNA, 16 nt, Human
ugggcccccaaaugga

SEQ ID NO: 1862384 - RNA, 22 nt, Human
ugggccccaguuguauuuauuu

SEQ ID NO: 1862385 - RNA, 18 nt, Human
ugggccccaguuguauuu

SEQ ID NO: 1862386 - RNA, 17 nt, Human
agggagggagggcucca

SEQ ID NO: 1862387 - RNA, 15 nt, Human
agggagggagggcuc

SEQ ID NO: 1862388 - RNA, 19 nt, Human
ugggccccugccucucugc

SEQ ID NO: 1862389 - RNA, 15 nt, Human
ugggccccugccucu

SEQ ID NO: 1862390 - RNA, 20 nt, Human
ugggccccugccucucugca

SEQ ID NO: 1862391 - RNA, 19 nt, Human
agggcucagcggggacagc

SEQ ID NO: 1862392 - RNA, 20 nt, Human
agggcucagcggggacagcu

SEQ ID NO: 1862393 - RNA, 22 nt, Human
agggcucagcggggacagcucc

SEQ ID NO: 1862394 - RNA, 23 nt, Human
agggcucagcggggacagcuccu

SEQ ID NO: 1862395 - RNA, 15 nt, Human
agggagggcuccaga

SEQ ID NO: 1862396 - RNA, 14 nt, Human
agggagggcuccag

SEQ ID NO: 1862397 - RNA, 16 nt, Human
agggagggcuccagac

SEQ ID NO: 1862398 - RNA, 14 nt, Human
agggcacugguggc

SEQ ID NO: 1862399 - RNA, 16 nt, Human
agggcacugguggccc

SEQ ID NO: 1862400 - RNA, 21 nt, Human
aggggaauaaacuguugaguc

SEQ ID NO: 1862401 - RNA, 13 nt, Human
aggggaauguuug

SEQ ID NO: 1862402 - RNA, 22 nt, Human
aggggaaaaucagccugcucca

SEQ ID NO: 1862403 - RNA, 18 nt, Human
aggggaaaaucagccugc

SEQ ID NO: 1862404 - RNA, 14 nt, Human
aggggaacagacug

SEQ ID NO: 1862405 - RNA, 13 nt, Human
aggggaaaagagg

SEQ ID NO: 1862406 - RNA, 22 nt, Human
uggggucacucuggcagcucag

SEQ ID NO: 1862407 - RNA, 16 nt, Human
uggggucacucuggca

SEQ ID NO: 1862408 - RNA, 17 nt, Human
ugggguacccacugcuc

SEQ ID NO: 1862409 - RNA, 18 nt, Human
ugggguacccacugcucu

SEQ ID NO: 1862410 - RNA, 14 nt, Human
uggggucacucugg

SEQ ID NO: 1862411 - RNA, 13 nt, Human
uggggucacucug

SEQ ID NO: 1862412 - RNA, 19 nt, Human
ugggguacccacugcucug

SEQ ID NO: 1862413 - RNA, 17 nt, Human
uggggaccucaggccug

SEQ ID NO: 1862414 - RNA, 16 nt, Human
uggggaccucaggccu

SEQ ID NO: 1862415 - RNA, 15 nt, Human
uggggaccucaggcc

SEQ ID NO: 1862416 - RNA, 14 nt, Human
uggggaccucaggc

SEQ ID NO: 1862417 - RNA, 15 nt, Human
agggcuccagacaca

SEQ ID NO: 1862418 - RNA, 12 nt, Human
agggcuccagac

SEQ ID NO: 1862419 - RNA, 23 nt, Human
uggggcugcaccggcuggccugg

SEQ ID NO: 1862420 - RNA, 22 nt, Human
uggggcugcaccggcuggccug

SEQ ID NO: 1862421 - RNA, 21 nt, Human
uggggccaguuggucccccuu

SEQ ID NO: 1862422 - RNA, 12 nt, Human
uggggcccugcc

SEQ ID NO: 1862423 - RNA, 22 nt, Human
uggguggcaccagcagccugga

SEQ ID NO: 1862424 - RNA, 21 nt, Human
uggguggcaccagcagccugg

SEQ ID NO: 1862425 - RNA, 20 nt, Human
uggguggcaccagcagccug

SEQ ID NO: 1862426 - RNA, 17 nt, Human
uggguggcaccagcagc

SEQ ID NO: 1862427 - RNA, 20 nt, Human
ugguagagugugccugaagu

SEQ ID NO: 1862428 - RNA, 18 nt, Human
ugggucgcccuggacugu

SEQ ID NO: 1862429 - RNA, 16 nt, Human
ugggucgcccuggacu

SEQ ID NO: 1862430 - RNA, 16 nt, Human
aggguggugaccucug

SEQ ID NO: 1862431 - RNA, 18 nt, Human
aggggagcaugggaagug

SEQ ID NO: 1862432 - RNA, 19 nt, Human
aggggaauguuugccucug

SEQ ID NO: 1862433 - RNA, 20 nt, Human
aggggaauguuugccucugc

SEQ ID NO: 1862434 - RNA, 21 nt, Human
aggggaauguuugccucugcc

SEQ ID NO: 1862435 - RNA, 18 nt, Human
aggggugggacacccugu

SEQ ID NO: 1862436 - RNA, 20 nt, Human
aggggguggccucccaacuc

SEQ ID NO: 1862437 - RNA, 15 nt, Human
aggguaaggcugugg

SEQ ID NO: 1862438 - RNA, 14 nt, Human
agggucucacucug

SEQ ID NO: 1862439 - RNA, 15 nt, Human
agggucucacucugu

SEQ ID NO: 1862440 - RNA, 16 nt, Human
agggucucacucuguc

SEQ ID NO: 1862441 - RNA, 15 nt, Human
auaaaaguacauguu

SEQ ID NO: 1862442 - RNA, 21 nt, Human
auaaaaguacauguuaaacuu

SEQ ID NO: 1862443 - RNA, 17 nt, Human
uuaaguacuauguauca

SEQ ID NO: 1862444 - RNA, 22 nt, Human
uuaaguuacacauuuuucagau

SEQ ID NO: 1862445 - RNA, 22 nt, Human
uuaagugcugcauuuaaaagau

SEQ ID NO: 1862446 - RNA, 18 nt, Human
uuaaguaaggaauuuuau

SEQ ID NO: 1862447 - RNA, 15 nt, Human
uuaagaggcaggguc

SEQ ID NO: 1862448 - RNA, 16 nt, Human
uuaagaggcagggucu

SEQ ID NO: 1862449 - RNA, 13 nt, Human
uuaagaggcaggg

SEQ ID NO: 1862450 - RNA, 20 nt, Human
uuaaugaaagacuguacaaa

SEQ ID NO: 1862451 - RNA, 23 nt, Human
uuaaugaaagacuguacaaagua

SEQ ID NO: 1862452 - RNA, 13 nt, Human
uuaauaaagacag

SEQ ID NO: 1862453 - RNA, 14 nt, Human
uuaauaaagacagg

SEQ ID NO: 1862454 - RNA, 17 nt, Human
uuaauaaacacucuuga

SEQ ID NO: 1862455 - RNA, 13 nt, Human
uuaauaaacacuc

SEQ ID NO: 1862456 - RNA, 15 nt, Human
uuaauucuuagcuca

SEQ ID NO: 1862457 - RNA, 16 nt, Human
auaaaauuaaagcuga

SEQ ID NO: 1862458 - RNA, 19 nt, Human
uuaauuuuuuugagacaga

SEQ ID NO: 1862459 - RNA, 23 nt, Human
auaaacaagaccacguuucuaaa

SEQ ID NO: 1862460 - RNA, 15 nt, Human
auaaacaagaccacg

SEQ ID NO: 1862461 - RNA, 22 nt, Human
auaaacaagaccacguuucuaa

SEQ ID NO: 1862462 - RNA, 20 nt, Human
auaaaauuuuuaaucuuuaa

SEQ ID NO: 1862463 - RNA, 18 nt, Human
uuacucagaauucucuag

SEQ ID NO: 1862464 - RNA, 23 nt, Human
uuacucagaauucucuaguuuga

SEQ ID NO: 1862465 - RNA, 20 nt, Human
uuacauaagauaaaugugcu

SEQ ID NO: 1862466 - RNA, 14 nt, Human
uuagaaauauaauu

SEQ ID NO: 1862467 - RNA, 12 nt, Human
uuagaaauauaa

SEQ ID NO: 1862468 - RNA, 11 nt, Human
uuagaaauaua

SEQ ID NO: 1862469 - RNA, 13 nt, Human
uuagaaccuuucu

SEQ ID NO: 1862470 - RNA, 11 nt, Human
uuagacagagu

SEQ ID NO: 1862471 - RNA, 14 nt, Human
uuacaggaaguacu

SEQ ID NO: 1862472 - RNA, 14 nt, Human
uuacagcugccugc

SEQ ID NO: 1862473 - RNA, 13 nt, Human
uuacagcugccug

SEQ ID NO: 1862474 - RNA, 19 nt, Human
auaacuagaacugaauuuu

SEQ ID NO: 1862475 - RNA, 16 nt, Human
auaacuaaaagguaug

SEQ ID NO: 1862476 - RNA, 18 nt, Human
auaaacacucuugaaaaa

SEQ ID NO: 1862477 - RNA, 14 nt, Human
auaaauaacuuuuu

SEQ ID NO: 1862478 - RNA, 21 nt, Human
aguucugcagauaaacaguag

SEQ ID NO: 1862479 - RNA, 16 nt, Human
aguucugcagauaaac

SEQ ID NO: 1862480 - RNA, 16 nt, Human
aguucuuaguugcugu

SEQ ID NO: 1862481 - RNA, 14 nt, Human
aguucugguuccua

SEQ ID NO: 1862482 - RNA, 20 nt, Human
uguuuuccaugaguccccug

SEQ ID NO: 1862483 - RNA, 13 nt, Human
uguuuggagacag

SEQ ID NO: 1862484 - RNA, 21 nt, Human
uguuuuauuuuaauucaguug

SEQ ID NO: 1862485 - RNA, 19 nt, Human
uguugccuugcauaauggu

SEQ ID NO: 1862486 - RNA, 19 nt, Human
uguugcccaggcaggucuu

SEQ ID NO: 1862487 - RNA, 19 nt, Human
uguuuauugucaaaguggu

SEQ ID NO: 1862488 - RNA, 17 nt, Human
uguuuauugucaaagug

SEQ ID NO: 1862489 - RNA, 22 nt, Human
uguuugauucagacagcugccu

SEQ ID NO: 1862490 - RNA, 17 nt, Human
uguuugauucagacagc

SEQ ID NO: 1862491 - RNA, 19 nt, Human
uguuucuuuguaaugaaaa

SEQ ID NO: 1862492 - RNA, 18 nt, Human
uguuucuuuguaaugaaa

SEQ ID NO: 1862493 - RNA, 23 nt, Human
aguuguuugauucagacagcugc

SEQ ID NO: 1862494 - RNA, 21 nt, Human
aguuguuugauucagacagcu

SEQ ID NO: 1862495 - RNA, 18 nt, Human
aguuggucccccuuccau

SEQ ID NO: 1862496 - RNA, 20 nt, Human
aguucuuaguugcuguaugu

SEQ ID NO: 1862497 - RNA, 21 nt, Human
aguucuuaguugcuguauguc

SEQ ID NO: 1862498 - RNA, 16 nt, Human
aguuggcuaggacccc

SEQ ID NO: 1862499 - RNA, 13 nt, Human
aguuggcuucuaa

SEQ ID NO: 1862500 - RNA, 21 nt, Human
aguuggguggaugccuggugg

SEQ ID NO: 1862501 - RNA, 13 nt, Human
uuaaauaauguga

SEQ ID NO: 1862502 - RNA, 20 nt, Human
uuaaauucuugcaaaguauc

SEQ ID NO: 1862503 - RNA, 15 nt, Human
uuaaauuucuaccgc

SEQ ID NO: 1862504 - RNA, 14 nt, Human
uguuacaaauugua

SEQ ID NO: 1862505 - RNA, 17 nt, Human
aguggaaguaguggagc

SEQ ID NO: 1862506 - RNA, 17 nt, Human
aguggugcgaucugggu

SEQ ID NO: 1862507 - RNA, 19 nt, Human
aguggugguuuucuguucu

SEQ ID NO: 1862508 - RNA, 20 nt, Human
aguggugguuuucuguucuu

SEQ ID NO: 1862509 - RNA, 21 nt, Human
aguggugguuuucuguucuuu

SEQ ID NO: 1862510 - RNA, 23 nt, Human
aguggugguuuucuguucuuucu

SEQ ID NO: 1862511 - RNA, 17 nt, Human
aguggugguuuucuguu

SEQ ID NO: 1862512 - RNA, 18 nt, Human
aguggugguuuucuguuc

SEQ ID NO: 1862513 - RNA, 21 nt, Human
agugguggugaacagaacaaa

SEQ ID NO: 1862514 - RNA, 20 nt, Human
agugugguguuuccuggcac

SEQ ID NO: 1862515 - RNA, 19 nt, Human
agugugguguuuccuggca

SEQ ID NO: 1862516 - RNA, 17 nt, Human
agugugguguuuccugg

SEQ ID NO: 1862517 - RNA, 20 nt, Human
agugugccugaagucccaga

SEQ ID NO: 1862518 - RNA, 16 nt, Human
agugugguguuuccug

SEQ ID NO: 1862519 - RNA, 18 nt, Human
uguucugugauauaagug

SEQ ID NO: 1862520 - RNA, 15 nt, Human
uguucugugauauaa

SEQ ID NO: 1862521 - RNA, 13 nt, Human
uguugcccaggca

SEQ ID NO: 1862522 - RNA, 12 nt, Human
uguugcccaggc

SEQ ID NO: 1862523 - RNA, 15 nt, Human
uguugcccaggcagg

SEQ ID NO: 1862524 - RNA, 16 nt, Human
uguugcccaggcaggu

SEQ ID NO: 1862525 - RNA, 17 nt, Human
uguugcccaggcagguc

SEQ ID NO: 1862526 - RNA, 18 nt, Human
uguugcccaggcaggucu

SEQ ID NO: 1862527 - RNA, 16 nt, Human
uguucugggacacagu

SEQ ID NO: 1862528 - RNA, 20 nt, Human
agugugucuuagugugugca

SEQ ID NO: 1862529 - RNA, 20 nt, Human
uguuccacaaguuaaauaaa

SEQ ID NO: 1862530 - RNA, 20 nt, Human
ugugucucuugguccugcug

SEQ ID NO: 1862531 - RNA, 17 nt, Human
ugugucucuugguccug

SEQ ID NO: 1862532 - RNA, 22 nt, Human
ugugucucuugguccugcugca

SEQ ID NO: 1862533 - RNA, 21 nt, Human
ugugucucuugguccugcugc

SEQ ID NO: 1862534 - RNA, 21 nt, Human
ugugucuugcaauggcagccu

SEQ ID NO: 1862535 - RNA, 19 nt, Human
ugugucuuuaaaugcugcu

SEQ ID NO: 1862536 - RNA, 23 nt, Human
uguguguuuauugucaaaguggu

SEQ ID NO: 1862537 - RNA, 19 nt, Human
uguguguuuauugucaaag

SEQ ID NO: 1862538 - RNA, 16 nt, Human
agugcugcauuuaaaa

SEQ ID NO: 1862539 - RNA, 17 nt, Human
agugcugcauuuaaaag

SEQ ID NO: 1862540 - RNA, 19 nt, Human
agugcugcauuuaaaagau

SEQ ID NO: 1862541 - RNA, 20 nt, Human
agugcugggauuacaggugu

SEQ ID NO: 1862542 - RNA, 21 nt, Human
agugcugggauuacaggugug

SEQ ID NO: 1862543 - RNA, 23 nt, Human
agugaguugauagcacagacccu

SEQ ID NO: 1862544 - RNA, 22 nt, Human
agugaguugauagcacagaccc

SEQ ID NO: 1862545 - RNA, 12 nt, Human
agugcugcauuu

SEQ ID NO: 1862546 - RNA, 13 nt, Human
agugcugcauuua

SEQ ID NO: 1862547 - RNA, 20 nt, Human
uguggucacaggaaguagag

SEQ ID NO: 1862548 - RNA, 23 nt, Human
uguggguuucuaaagcugccagc

SEQ ID NO: 1862549 - RNA, 21 nt, Human
uguggguuucuaaagcugcca

SEQ ID NO: 1862550 - RNA, 16 nt, Human
ugugguguuuccuggc

SEQ ID NO: 1862551 - RNA, 14 nt, Human
ugugguguuuccug

SEQ ID NO: 1862552 - RNA, 20 nt, Human
ugugguguuuccuggcacug

SEQ ID NO: 1862553 - RNA, 15 nt, Human
uguggucccacccca

SEQ ID NO: 1862554 - RNA, 13 nt, Human
uguggucccaccc

SEQ ID NO: 1862555 - RNA, 16 nt, Human
uguggucccaccccac

SEQ ID NO: 1862556 - RNA, 15 nt, Human
ugugagaugcuagaa

SEQ ID NO: 1862557 - RNA, 19 nt, Human
ugugagaugcuagaacucc

SEQ ID NO: 1862558 - RNA, 16 nt, Human
ugugacugaauuucuu

SEQ ID NO: 1862559 - RNA, 15 nt, Human
ugugacugaauuucu

SEQ ID NO: 1862560 - RNA, 14 nt, Human
agucucuucuccac

SEQ ID NO: 1862561 - RNA, 13 nt, Human
agucucuucucca

SEQ ID NO: 1862562 - RNA, 14 nt, Human
agucuuuguacaga

SEQ ID NO: 1862563 - RNA, 22 nt, Human
agucuuguauuaaguuguuaau

SEQ ID NO: 1862564 - RNA, 15 nt, Human
agucuuggcucacug

SEQ ID NO: 1862565 - RNA, 16 nt, Human
agucuuguauuaaguu

SEQ ID NO: 1862566 - RNA, 18 nt, Human
agucuuguauuaaguugu

SEQ ID NO: 1862567 - RNA, 17 nt, Human
agucucuucuccacugg

SEQ ID NO: 1862568 - RNA, 18 nt, Human
agucucuucuccacugga

SEQ ID NO: 1862569 - RNA, 16 nt, Human
agucucuucuccacug

SEQ ID NO: 1862570 - RNA, 15 nt, Human
agucucuucuccacu

SEQ ID NO: 1862571 - RNA, 21 nt, Human
ugugaaaggaaagagggaggu

SEQ ID NO: 1862572 - RNA, 18 nt, Human
ugugaaaggaaagaggcu

SEQ ID NO: 1862573 - RNA, 15 nt, Human
ugugaaaggaaagag

SEQ ID NO: 1862574 - RNA, 12 nt, Human
ugugaaauuauu

SEQ ID NO: 1862575 - RNA, 18 nt, Human
ugucuuguguuucuuuag

SEQ ID NO: 1862576 - RNA, 15 nt, Human
ugucuuguguuucuu

SEQ ID NO: 1862577 - RNA, 14 nt, Human
ugugaagagaacca

SEQ ID NO: 1862578 - RNA, 19 nt, Human
ugugaaccaccacacccag

SEQ ID NO: 1862579 - RNA, 20 nt, Human
ugugaaccaccacacccagc

SEQ ID NO: 1862580 - RNA, 21 nt, Human
ugugaaccaccacacccagcc

SEQ ID NO: 1862581 - RNA, 17 nt, Human
agugaggcucugcccuu

SEQ ID NO: 1862582 - RNA, 16 nt, Human
agugaggcucugcccu

SEQ ID NO: 1862583 - RNA, 14 nt, Human
agugaggcucugcc

SEQ ID NO: 1862584 - RNA, 15 nt, Human
agugaggcucugccc

SEQ ID NO: 1862585 - RNA, 18 nt, Human
uguggccaaguucuuagu

SEQ ID NO: 1862586 - RNA, 20 nt, Human
agugaggcucugcccuuggu

SEQ ID NO: 1862587 - RNA, 19 nt, Human
agugaggcucugcccuugg

SEQ ID NO: 1862588 - RNA, 21 nt, Human
agugaggcucugcccuugguu

SEQ ID NO: 1862589 - RNA, 14 nt, Human
agugagggauuauc

SEQ ID NO: 1862590 - RNA, 21 nt, Human
agugaguugauagcacagacc

SEQ ID NO: 1862591 - RNA, 15 nt, Human
agugagucgaggaca

SEQ ID NO: 1862592 - RNA, 21 nt, Human
ugugcccccauguaagcaccc

SEQ ID NO: 1862593 - RNA, 21 nt, Human
uguggaguucaucuugaauug

SEQ ID NO: 1862594 - RNA, 17 nt, Human
uguggaguucaucuuga

SEQ ID NO: 1862595 - RNA, 20 nt, Human
ugugccagauuuaugcauau

SEQ ID NO: 1862596 - RNA, 20 nt, Human
ugugccagguuuuuggucug

SEQ ID NO: 1862597 - RNA, 12 nt, Human
ugugccaugugc

SEQ ID NO: 1862598 - RNA, 16 nt, Human
ugugccaugugccagg

SEQ ID NO: 1862599 - RNA, 18 nt, Human
ugugccagauuuaugcau

SEQ ID NO: 1862600 - RNA, 20 nt, Human
ugugauggggcccugccucc

SEQ ID NO: 1862601 - RNA, 19 nt, Human
ugugauggggcccugccuc

SEQ ID NO: 1862602 - RNA, 18 nt, Human
ugugaugagaggaaauca

SEQ ID NO: 1862603 - RNA, 16 nt, Human
agugaacaaauuuaca

SEQ ID NO: 1862604 - RNA, 20 nt, Human
agugaacaaauuuacagaga

SEQ ID NO: 1862605 - RNA, 15 nt, Human
agugaaagaaaauaa

SEQ ID NO: 1862606 - RNA, 14 nt, Human
uuccuucagugccu

SEQ ID NO: 1862607 - RNA, 11 nt, Human
uuccuucagug

SEQ ID NO: 1862608 - RNA, 20 nt, Human
uuccuguucuuaagacguga

SEQ ID NO: 1862609 - RNA, 15 nt, Human
uuccuucagugccuu

SEQ ID NO: 1862610 - RNA, 20 nt, Human
auauuuucaacgcagcccug

SEQ ID NO: 1862611 - RNA, 19 nt, Human
auauuuucaacgcagcccu

SEQ ID NO: 1862612 - RNA, 11 nt, Human
uuccucuuucc

SEQ ID NO: 1862613 - RNA, 17 nt, Human
uuccuguucccaugaga

SEQ ID NO: 1862614 - RNA, 15 nt, Human
uuccuaauccucuag

SEQ ID NO: 1862615 - RNA, 13 nt, Human
uuccuaauccucu

SEQ ID NO: 1862616 - RNA, 14 nt, Human
auauuuuaagacga

SEQ ID NO: 1862617 - RNA, 20 nt, Human
uuccuuuuaaaacacuucca

SEQ ID NO: 1862618 - RNA, 22 nt, Human
uuccuuuuaaaacacuuccaua

SEQ ID NO: 1862619 - RNA, 21 nt, Human
uuccuuuuaaaacacuuccau

SEQ ID NO: 1862620 - RNA, 14 nt, Human
aucacguaaagcua

SEQ ID NO: 1862621 - RNA, 21 nt, Human
aucacguaaagcuagaaauga

SEQ ID NO: 1862622 - RNA, 22 nt, Human
aucacggcucacugcagccuca

SEQ ID NO: 1862623 - RNA, 21 nt, Human
aucaagaugugacauguuuua

SEQ ID NO: 1862624 - RNA, 13 nt, Human
aucaaguauuaua

SEQ ID NO: 1862625 - RNA, 14 nt, Human
aucaaguauuauac

SEQ ID NO: 1862626 - RNA, 18 nt, Human
aucaaguauuauaccuuu

SEQ ID NO: 1862627 - RNA, 16 nt, Human
auauucuguuggccag

SEQ ID NO: 1862628 - RNA, 19 nt, Human
auauugauuuccguuaaaa

SEQ ID NO: 1862629 - RNA, 13 nt, Human
auauugaugugug

SEQ ID NO: 1862630 - RNA, 21 nt, Human
auauugauuuccguuaaaaua

SEQ ID NO: 1862631 - RNA, 22 nt, Human
auauugauuuccguuaaaauac

SEQ ID NO: 1862632 - RNA, 22 nt, Human
auauugauccagaaagaaaacu

SEQ ID NO: 1862633 - RNA, 15 nt, Human
auauugauccagaaa

SEQ ID NO: 1862634 - RNA, 20 nt, Human
auauguuuuaagaggcaggg

SEQ ID NO: 1862635 - RNA, 18 nt, Human
auauguuuuaagaggcag

SEQ ID NO: 1862636 - RNA, 22 nt, Human
auauuaaggaagacaaugugaa

SEQ ID NO: 1862637 - RNA, 24 nt, Human
auauuaagaaagacuaucuaaaug

SEQ ID NO: 1862638 - RNA, 20 nt, Human
auauuuguauuuaaaugaaa

SEQ ID NO: 1862639 - RNA, 20 nt, Human
auauuguuuucaguguacau

SEQ ID NO: 1862640 - RNA, 21 nt, Human
auauugcugauggugcaauga

SEQ ID NO: 1862641 - RNA, 17 nt, Human
auauugcugauggugca

SEQ ID NO: 1862642 - RNA, 22 nt, Human
uucucagaaucucaaauaacua

SEQ ID NO: 1862643 - RNA, 19 nt, Human
uucucagaaucucaaauaa

SEQ ID NO: 1862644 - RNA, 23 nt, Human
uucucagaaucucaaauaacuaa

SEQ ID NO: 1862645 - RNA, 13 nt, Human
uucuaggccuggg

SEQ ID NO: 1862646 - RNA, 17 nt, Human
aucagcacgauuucugu

SEQ ID NO: 1862647 - RNA, 18 nt, Human
aucagcacgauuucuguu

SEQ ID NO: 1862648 - RNA, 15 nt, Human
aucagcacgauuucu

SEQ ID NO: 1862649 - RNA, 16 nt, Human
aucagcacgauuucug

SEQ ID NO: 1862650 - RNA, 14 nt, Human
aucauucauuuucu

SEQ ID NO: 1862651 - RNA, 22 nt, Human
aucauuaaagccugaguuugcu

SEQ ID NO: 1862652 - RNA, 15 nt, Human
aucauugaaaucuuu

SEQ ID NO: 1862653 - RNA, 14 nt, Human
aucauugaaaucuu

SEQ ID NO: 1862654 - RNA, 23 nt, Human
aucauaguggcuuaaaacaacac

SEQ ID NO: 1862655 - RNA, 23 nt, Human
uucugccgcagcccugcagaggg

SEQ ID NO: 1862656 - RNA, 16 nt, Human
uucugccgcagcccug

SEQ ID NO: 1862657 - RNA, 10 nt, Human
uucugggaca

SEQ ID NO: 1862658 - RNA, 11 nt, Human
uucugggacac

SEQ ID NO: 1862659 - RNA, 22 nt, Human
uucugggacacaguucaauucu

SEQ ID NO: 1862660 - RNA, 15 nt, Human
uucugaaagggacgc

SEQ ID NO: 1862661 - RNA, 19 nt, Human
aucauugaaaucuuuuugc

SEQ ID NO: 1862662 - RNA, 20 nt, Human
aucauugaaaucuuuuugcu

SEQ ID NO: 1862663 - RNA, 17 nt, Human
aucccaggauguacaag

SEQ ID NO: 1862664 - RNA, 17 nt, Human
auccaggguggugguga

SEQ ID NO: 1862665 - RNA, 15 nt, Human
auccagguucagcuu

SEQ ID NO: 1862666 - RNA, 16 nt, Human
auccagguucagcuug

SEQ ID NO: 1862667 - RNA, 17 nt, Human
aucccauaugccugggc

SEQ ID NO: 1862668 - RNA, 16 nt, Human
aucccauaugccuggg

SEQ ID NO: 1862669 - RNA, 14 nt, Human
uuauuuaaauuuua

SEQ ID NO: 1862670 - RNA, 22 nt, Human
uuauuuaaugaaagacuguaca

SEQ ID NO: 1862671 - RNA, 18 nt, Human
uuauuuaaugaaagacug

SEQ ID NO: 1862672 - RNA, 23 nt, Human
auagcuggucuuauuuguaaagc

SEQ ID NO: 1862673 - RNA, 22 nt, Human
auagcuggucuuauuuguaaag

SEQ ID NO: 1862674 - RNA, 17 nt, Human
auagcugggacuacagg

SEQ ID NO: 1862675 - RNA, 15 nt, Human
uuauuuaguauuuau

SEQ ID NO: 1862676 - RNA, 16 nt, Human
uuauuuaguuccuuga

SEQ ID NO: 1862677 - RNA, 17 nt, Human
uuauuuagcaccaggga

SEQ ID NO: 1862678 - RNA, 19 nt, Human
auagcucaggugucccugc

SEQ ID NO: 1862679 - RNA, 18 nt, Human
auagcuacuaauuuuaaa

SEQ ID NO: 1862680 - RNA, 22 nt, Human
auagcucaggugucccugcacu

SEQ ID NO: 1862681 - RNA, 20 nt, Human
auagcucaggugucccugca

SEQ ID NO: 1862682 - RNA, 21 nt, Human
auagcucaggugucccugcac

SEQ ID NO: 1862683 - RNA, 12 nt, Human
auagcugggacu

SEQ ID NO: 1862684 - RNA, 17 nt, Human
auaagauaaaugugcug

SEQ ID NO: 1862685 - RNA, 13 nt, Human
auaagauaaaugu

SEQ ID NO: 1862686 - RNA, 18 nt, Human
auagccugccucuucucu

SEQ ID NO: 1862687 - RNA, 20 nt, Human
auagcgucauaacuagaacu

SEQ ID NO: 1862688 - RNA, 18 nt, Human
auagcgucauaacuagaa

SEQ ID NO: 1862689 - RNA, 17 nt, Human
auagcuacuaauuuuaa

SEQ ID NO: 1862690 - RNA, 14 nt, Human
auagcuacuaauuu

SEQ ID NO: 1862691 - RNA, 13 nt, Human
uucacaguucucu

SEQ ID NO: 1862692 - RNA, 17 nt, Human
uucacauauugauuucc

SEQ ID NO: 1862693 - RNA, 19 nt, Human
uucacauuguauucagagu

SEQ ID NO: 1862694 - RNA, 22 nt, Human
uucaccacaugugcacaugcac

SEQ ID NO: 1862695 - RNA, 22 nt, Human
auaggaauugacccacaagaaa

SEQ ID NO: 1862696 - RNA, 17 nt, Human
auaggcacaggaaacca

SEQ ID NO: 1862697 - RNA, 22 nt, Human
auaggcaccuaccaccacgccc

SEQ ID NO: 1862698 - RNA, 21 nt, Human
auaggaauugacccacaagaa

SEQ ID NO: 1862699 - RNA, 19 nt, Human
auaggaacuuaaauaaugu

SEQ ID NO: 1862700 - RNA, 22 nt, Human
auagcuuacaagccagcuggag

SEQ ID NO: 1862701 - RNA, 22 nt, Human
uucaccauguuggccaggcugg

SEQ ID NO: 1862702 - RNA, 22 nt, Human
uucaccauguuggccaggcugc

SEQ ID NO: 1862703 - RNA, 22 nt, Human
uucaagugauucucaugccuca

SEQ ID NO: 1862704 - RNA, 20 nt, Human
uucaagugauucucaugccu

SEQ ID NO: 1862705 - RNA, 20 nt, Human
uucaagugauucuccugccu

SEQ ID NO: 1862706 - RNA, 21 nt, Human
uucaaggauccugagccagau

SEQ ID NO: 1862707 - RNA, 19 nt, Human
uucaaggauccugagccag

SEQ ID NO: 1862708 - RNA, 18 nt, Human
uucaaggauccugagcca

SEQ ID NO: 1862709 - RNA, 16 nt, Human
uucaaggauccugagc

SEQ ID NO: 1862710 - RNA, 15 nt, Human
uucaaggauccugag

SEQ ID NO: 1862711 - RNA, 16 nt, Human
uucaaaauuguuacaa

SEQ ID NO: 1862712 - RNA, 17 nt, Human
auauaaauuuuuuuugu

SEQ ID NO: 1862713 - RNA, 22 nt, Human
auauaaauuuuuuuuguuucau

SEQ ID NO: 1862714 - RNA, 19 nt, Human
uucacugcuggcugccuua

SEQ ID NO: 1862715 - RNA, 18 nt, Human
uucacugcuggcugccuu

SEQ ID NO: 1862716 - RNA, 17 nt, Human
uucacugcuggcugccu

SEQ ID NO: 1862717 - RNA, 16 nt, Human
uucacugcuggcugcc

SEQ ID NO: 1862718 - RNA, 15 nt, Human
uucacugcuggcugc

SEQ ID NO: 1862719 - RNA, 13 nt, Human
uucacugcuggcu

SEQ ID NO: 1862720 - RNA, 15 nt, Human
uucagaaagaagugg

SEQ ID NO: 1862721 - RNA, 19 nt, Human
uucagccaagaauucuuaa

SEQ ID NO: 1862722 - RNA, 22 nt, Human
uucagcaccuacaguguacagu

SEQ ID NO: 1862723 - RNA, 23 nt, Human
uucagcaccuacaguguacaguc

SEQ ID NO: 1862724 - RNA, 17 nt, Human
uucagaucucuaacuuc

SEQ ID NO: 1862725 - RNA, 13 nt, Human
auaugcacacauu

SEQ ID NO: 1862726 - RNA, 14 nt, Human
auaugucaagccau

SEQ ID NO: 1862727 - RNA, 20 nt, Human
auaugauuuaaaucagccgu

SEQ ID NO: 1862728 - RNA, 22 nt, Human
auaucugaaaauguauguguaa

SEQ ID NO: 1862729 - RNA, 21 nt, Human
uucauauuuacuucuuauaca

SEQ ID NO: 1862730 - RNA, 16 nt, Human
uucauauuuacuucuu

SEQ ID NO: 1862731 - RNA, 14 nt, Human
uucaguaauaacuc

SEQ ID NO: 1862732 - RNA, 14 nt, Human
uucagccugccuuc

SEQ ID NO: 1862733 - RNA, 21 nt, Human
uucaucauccuaagcuauuca

SEQ ID NO: 1862734 - RNA, 18 nt, Human
uucaucauccuaagcuau

SEQ ID NO: 1862735 - RNA, 18 nt, Human
auauauucagccuggcuu

SEQ ID NO: 1862736 - RNA, 21 nt, Human
aucucaaauaacuaaaaggua

SEQ ID NO: 1862737 - RNA, 14 nt, Human
aucucaaauaacua

SEQ ID NO: 1862738 - RNA, 23 nt, Human
aucucaaauaacuaaaagguaug

SEQ ID NO: 1862739 - RNA, 14 nt, Human
aucucaaauuucua

SEQ ID NO: 1862740 - RNA, 19 nt, Human
aucuaggaagacuuuggaa

SEQ ID NO: 1862741 - RNA, 18 nt, Human
aucuaggaagacuuugga

SEQ ID NO: 1862742 - RNA, 17 nt, Human
aucuaggaagacuuugg

SEQ ID NO: 1862743 - RNA, 19 nt, Human
aucuagauacuguaucaug

SEQ ID NO: 1862744 - RNA, 18 nt, Human
aucuagauacuguaucau

SEQ ID NO: 1862745 - RNA, 23 nt, Human
aucuaauauguaacaagccaccc

SEQ ID NO: 1862746 - RNA, 17 nt, Human
uugauacuacaguuugu

SEQ ID NO: 1862747 - RNA, 18 nt, Human
uugauagcacagacccug

SEQ ID NO: 1862748 - RNA, 21 nt, Human
uugagugcugucuccauguuu

SEQ ID NO: 1862749 - RNA, 11 nt, Human
uugagugccuu

SEQ ID NO: 1862750 - RNA, 17 nt, Human
uugaccauucuccaccu

SEQ ID NO: 1862751 - RNA, 16 nt, Human
uugagcagggcucagc

SEQ ID NO: 1862752 - RNA, 12 nt, Human
uugagcagggcu

SEQ ID NO: 1862753 - RNA, 10 nt, Human
uugagacaga

SEQ ID NO: 1862754 - RNA, 11 nt, Human
uugagacagag

SEQ ID NO: 1862755 - RNA, 19 nt, Human
uugacaggauuauuggaaa

SEQ ID NO: 1862756 - RNA, 10 nt, Human
uugacagggc

SEQ ID NO: 1862757 - RNA, 12 nt, Human
uugacagggcac

SEQ ID NO: 1862758 - RNA, 16 nt, Human
uugacaucaacugcau

SEQ ID NO: 1862759 - RNA, 14 nt, Human
uugcaugaggcuag

SEQ ID NO: 1862760 - RNA, 21 nt, Human
uugcaccacugcacuccagcc

SEQ ID NO: 1862761 - RNA, 15 nt, Human
uugcaauagaaaucc

SEQ ID NO: 1862762 - RNA, 22 nt, Human
uugcaauagaaauccaauugga

SEQ ID NO: 1862763 - RNA, 14 nt, Human
uugcaauggcagcc

SEQ ID NO: 1862764 - RNA, 13 nt, Human
uugcccaggcagg

SEQ ID NO: 1862765 - RNA, 14 nt, Human
uugcccaggcaggu

SEQ ID NO: 1862766 - RNA, 16 nt, Human
uugcccaggcaggucu

SEQ ID NO: 1862767 - RNA, 18 nt, Human
uugcccaggcaggucuug

SEQ ID NO: 1862768 - RNA, 11 nt, Human
uugcccaggcu

SEQ ID NO: 1862769 - RNA, 12 nt, Human
uugcccaggcug

SEQ ID NO: 1862770 - RNA, 14 nt, Human
uugcccaggcuggc

SEQ ID NO: 1862771 - RNA, 23 nt, Human
uugcccaggcuggcgugcagugg

SEQ ID NO: 1862772 - RNA, 23 nt, Human
uugauguucuuucacccuuuucu

SEQ ID NO: 1862773 - RNA, 18 nt, Human
uugcaacuuuguauaaaa

SEQ ID NO: 1862774 - RNA, 17 nt, Human
uugcaacuuuguauaaa

SEQ ID NO: 1862775 - RNA, 16 nt, Human
uugcaacuuuguauaa

SEQ ID NO: 1862776 - RNA, 15 nt, Human
uugauuaaauucuug

SEQ ID NO: 1862777 - RNA, 16 nt, Human
uugauuaaauucuugc

SEQ ID NO: 1862778 - RNA, 20 nt, Human
uugauuaaauucuugcaaag

SEQ ID NO: 1862779 - RNA, 21 nt, Human
uugauuaaauucuugcaaagu

SEQ ID NO: 1862780 - RNA, 23 nt, Human
aucucacacaugagcaucaggcc

SEQ ID NO: 1862781 - RNA, 16 nt, Human
aucucaaauuucuaaa

SEQ ID NO: 1862782 - RNA, 17 nt, Human
aucucaaauuucuaaau

SEQ ID NO: 1862783 - RNA, 16 nt, Human
aucucaccuccugcug

SEQ ID NO: 1862784 - RNA, 15 nt, Human
aucucaccuccugcu

SEQ ID NO: 1862785 - RNA, 16 nt, Human
aucucuuguuuaaauu

SEQ ID NO: 1862786 - RNA, 22 nt, Human
aucucuuuguucuaaagaugga

SEQ ID NO: 1862787 - RNA, 12 nt, Human
aucugaaaaugu

SEQ ID NO: 1862788 - RNA, 12 nt, Human
uuguaaugaaaa

SEQ ID NO: 1862789 - RNA, 13 nt, Human
uuguaaauuguca

SEQ ID NO: 1862790 - RNA, 14 nt, Human
uuguaaauuucucu

SEQ ID NO: 1862791 - RNA, 19 nt, Human
uuggugucgggcaugacac

SEQ ID NO: 1862792 - RNA, 18 nt, Human
uuggugucgggcaugaca

SEQ ID NO: 1862793 - RNA, 17 nt, Human
uuggugucgggcaugac

SEQ ID NO: 1862794 - RNA, 14 nt, Human
uugguuuguaaauu

SEQ ID NO: 1862795 - RNA, 18 nt, Human
uuggugguuucagaaaug

SEQ ID NO: 1862796 - RNA, 19 nt, Human
uuggugguuucagaaaugu

SEQ ID NO: 1862797 - RNA, 18 nt, Human
augaaugucagugugacu

SEQ ID NO: 1862798 - RNA, 16 nt, Human
augaaugucaguguga

SEQ ID NO: 1862799 - RNA, 17 nt, Human
augaaugaaacauuuug

SEQ ID NO: 1862800 - RNA, 15 nt, Human
augaagcaaugcuuc

SEQ ID NO: 1862801 - RNA, 14 nt, Human
augaagcaaugcuu

SEQ ID NO: 1862802 - RNA, 16 nt, Human
augaaagugagacuuu

SEQ ID NO: 1862803 - RNA, 23 nt, Human
augaaccacaucuugcucugcug

SEQ ID NO: 1862804 - RNA, 22 nt, Human
augaaccacaucuugcucugcu

SEQ ID NO: 1862805 - RNA, 15 nt, Human
uugcuuugugauuuu

SEQ ID NO: 1862806 - RNA, 13 nt, Human
uugcuuuguaugc

SEQ ID NO: 1862807 - RNA, 18 nt, Human
uugcucuugaugccuggc

SEQ ID NO: 1862808 - RNA, 17 nt, Human
uugcucuugaugccugg

SEQ ID NO: 1862809 - RNA, 14 nt, Human
uugcucuugaugcc

SEQ ID NO: 1862810 - RNA, 20 nt, Human
uugcuuugugauuuuuguaa

SEQ ID NO: 1862811 - RNA, 16 nt, Human
uugcuuuguaugcacu

SEQ ID NO: 1862812 - RNA, 17 nt, Human
uuggaaaauaaauuauu

SEQ ID NO: 1862813 - RNA, 15 nt, Human
uuggaaaauaaauca

SEQ ID NO: 1862814 - RNA, 12 nt, Human
uuggaaaauaaa

SEQ ID NO: 1862815 - RNA, 12 nt, Human
aucugucauuug

SEQ ID NO: 1862816 - RNA, 17 nt, Human
aucugucauuugagcag

SEQ ID NO: 1862817 - RNA, 22 nt, Human
aucugucauuugagcagggcuc

SEQ ID NO: 1862818 - RNA, 15 nt, Human
aucuugcucugcuga

SEQ ID NO: 1862819 - RNA, 16 nt, Human
aucuugcucugcugac

SEQ ID NO: 1862820 - RNA, 15 nt, Human
aucuuauaauuuaaa

SEQ ID NO: 1862821 - RNA, 14 nt, Human
aucuugcucugcug

SEQ ID NO: 1862822 - RNA, 16 nt, Human
aucuuauaauuuaaaa

SEQ ID NO: 1862823 - RNA, 18 nt, Human
uuuaccugaagucuuugu

SEQ ID NO: 1862824 - RNA, 22 nt, Human
uuuaccugaagucuuuguacag

SEQ ID NO: 1862825 - RNA, 20 nt, Human
uuuacccuucuuuucugacu

SEQ ID NO: 1862826 - RNA, 16 nt, Human
augcgugugugugugu

SEQ ID NO: 1862827 - RNA, 16 nt, Human
uuuacugcagcuuugu

SEQ ID NO: 1862828 - RNA, 11 nt, Human
uuuacuuaaac

SEQ ID NO: 1862829 - RNA, 15 nt, Human
uuuacuucuuauaca

SEQ ID NO: 1862830 - RNA, 14 nt, Human
uuuacuucuuauac

SEQ ID NO: 1862831 - RNA, 13 nt, Human
uuuacuucuuaua

SEQ ID NO: 1862832 - RNA, 23 nt, Human
uuuaaugaaagacuguacaaagu

SEQ ID NO: 1862833 - RNA, 21 nt, Human
uuuaaugaaagacuguacaaa

SEQ ID NO: 1862834 - RNA, 17 nt, Human
augcccagccccuucug

SEQ ID NO: 1862835 - RNA, 18 nt, Human
augccccgucccccucug

SEQ ID NO: 1862836 - RNA, 21 nt, Human
augccccgucccccucuggcu

SEQ ID NO: 1862837 - RNA, 16 nt, Human
augcccagccccuucu

SEQ ID NO: 1862838 - RNA, 15 nt, Human
augcccagccccuuc

SEQ ID NO: 1862839 - RNA, 21 nt, Human
augccaugaggaacaaggcaa

SEQ ID NO: 1862840 - RNA, 15 nt, Human
augccucucucaggc

SEQ ID NO: 1862841 - RNA, 14 nt, Human
augccucucucagg

SEQ ID NO: 1862842 - RNA, 13 nt, Human
augccucucucag

SEQ ID NO: 1862843 - RNA, 13 nt, Human
augcgcaggcugg

SEQ ID NO: 1862844 - RNA, 22 nt, Human
augcgcaggcuggcccugcccu

SEQ ID NO: 1862845 - RNA, 20 nt, Human
augcgcaggcuggcccugcc

SEQ ID NO: 1862846 - RNA, 18 nt, Human
augcgcaggcuggcccug

SEQ ID NO: 1862847 - RNA, 14 nt, Human
augcgcaggcuggc

SEQ ID NO: 1862848 - RNA, 22 nt, Human
augcgugcauaccacuuuuguu

SEQ ID NO: 1862849 - RNA, 12 nt, Human
augcgugugugu

SEQ ID NO: 1862850 - RNA, 20 nt, Human
augcgugcauaccacuuuug

SEQ ID NO: 1862851 - RNA, 18 nt, Human
augcuacaggauuugaaa

SEQ ID NO: 1862852 - RNA, 14 nt, Human
uuuaucagaauucu

SEQ ID NO: 1862853 - RNA, 19 nt, Human
augcuccuggcccacugca

SEQ ID NO: 1862854 - RNA, 14 nt, Human
augcuccuggccca

SEQ ID NO: 1862855 - RNA, 18 nt, Human
augcuggcuguuggcugg

SEQ ID NO: 1862856 - RNA, 19 nt, Human
augcuggcuguuggcuggg

SEQ ID NO: 1862857 - RNA, 20 nt, Human
augcuggcuguuggcugggg

SEQ ID NO: 1862858 - RNA, 20 nt, Human
augcuucucacugccaugcc

SEQ ID NO: 1862859 - RNA, 16 nt, Human
augcuucucacugcca

SEQ ID NO: 1862860 - RNA, 18 nt, Human
auggaagacagcucuuau

SEQ ID NO: 1862861 - RNA, 17 nt, Human
auggaagacagcucuua

SEQ ID NO: 1862862 - RNA, 14 nt, Human
auggaaggggcuga

SEQ ID NO: 1862863 - RNA, 21 nt, Human
uuucagaaagaaguggggaca

SEQ ID NO: 1862864 - RNA, 12 nt, Human
uuucaaacuuua

SEQ ID NO: 1862865 - RNA, 15 nt, Human
uuucaaacuuuacua

SEQ ID NO: 1862866 - RNA, 11 nt, Human
uuucagaaaug

SEQ ID NO: 1862867 - RNA, 12 nt, Human
uuucagaaaugu

SEQ ID NO: 1862868 - RNA, 16 nt, Human
uuucccuauuagagaa

SEQ ID NO: 1862869 - RNA, 13 nt, Human
uugugaggaagcc

SEQ ID NO: 1862870 - RNA, 18 nt, Human
uugugaggaagccgcugg

SEQ ID NO: 1862871 - RNA, 17 nt, Human
uugugaggaagccgcug

SEQ ID NO: 1862872 - RNA, 20 nt, Human
uugugauacaaugcugugcc

SEQ ID NO: 1862873 - RNA, 16 nt, Human
uuguccccgacccuug

SEQ ID NO: 1862874 - RNA, 15 nt, Human
uuguccccgacccuu

SEQ ID NO: 1862875 - RNA, 20 nt, Human
uuguccccaccgcagacagg

SEQ ID NO: 1862876 - RNA, 18 nt, Human
uuguccccaccgcagaca

SEQ ID NO: 1862877 - RNA, 22 nt, Human
uugugaugucccaacuuguaaa

SEQ ID NO: 1862878 - RNA, 18 nt, Human
uugugaugucccaacuug

SEQ ID NO: 1862879 - RNA, 17 nt, Human
augagguacugagagug

SEQ ID NO: 1862880 - RNA, 18 nt, Human
augagguacugagaguga

SEQ ID NO: 1862881 - RNA, 15 nt, Human
augagguacugagag

SEQ ID NO: 1862882 - RNA, 22 nt, Human
augaggucagagccugcaguua

SEQ ID NO: 1862883 - RNA, 19 nt, Human
augaggucagagccugcag

SEQ ID NO: 1862884 - RNA, 20 nt, Human
augaggucagagccugcagu

SEQ ID NO: 1862885 - RNA, 21 nt, Human
augagguacaaccuguucugc

SEQ ID NO: 1862886 - RNA, 15 nt, Human
augaggucagagccu

SEQ ID NO: 1862887 - RNA, 16 nt, Human
augaggucagagccug

SEQ ID NO: 1862888 - RNA, 18 nt, Human
augaggucagagccugca

SEQ ID NO: 1862889 - RNA, 17 nt, Human
uugucacacacuuuggc

SEQ ID NO: 1862890 - RNA, 21 nt, Human
uugucauauaagauucauauu

SEQ ID NO: 1862891 - RNA, 23 nt, Human
augaguccccuguuuguuucuga

SEQ ID NO: 1862892 - RNA, 13 nt, Human
augaguccccugu

SEQ ID NO: 1862893 - RNA, 16 nt, Human
uuuaaugaaagacugu

SEQ ID NO: 1862894 - RNA, 22 nt, Human
uuuaaggguuuguggaaaauga

SEQ ID NO: 1862895 - RNA, 20 nt, Human
uuuaaggguuuguggaaaau

SEQ ID NO: 1862896 - RNA, 17 nt, Human
uuuaaggguuuguggaa

SEQ ID NO: 1862897 - RNA, 20 nt, Human
uuuaaggaugcuuguacaua

SEQ ID NO: 1862898 - RNA, 21 nt, Human
uuuaaggaugcuuguacauaa

SEQ ID NO: 1862899 - RNA, 22 nt, Human
uuuaaggaugcuuguacauaau

SEQ ID NO: 1862900 - RNA, 21 nt, Human
uuuaagcuguuacugucuuca

SEQ ID NO: 1862901 - RNA, 19 nt, Human
uuuaaggaugcuuguacau

SEQ ID NO: 1862902 - RNA, 12 nt, Human
uuuaagagaaau

SEQ ID NO: 1862903 - RNA, 14 nt, Human
uuuaagagacagcc

SEQ ID NO: 1862904 - RNA, 14 nt, Human
uuuaagaggcaggg

SEQ ID NO: 1862905 - RNA, 21 nt, Human
uuuaaaaaauuaaucugggcc

SEQ ID NO: 1862906 - RNA, 23 nt, Human
uuuaaaaauacagauagauauau

SEQ ID NO: 1862907 - RNA, 11 nt, Human
uuuaaaugcac

SEQ ID NO: 1862908 - RNA, 14 nt, Human
uuuaaaugcugcuu

SEQ ID NO: 1862909 - RNA, 13 nt, Human
uuuaaaugaaagu

SEQ ID NO: 1862910 - RNA, 21 nt, Human
uuuaaaugaaagugagacuuu

SEQ ID NO: 1862911 - RNA, 21 nt, Human
uuuaaauauaugcuaagucuu

SEQ ID NO: 1862912 - RNA, 17 nt, Human
uuguucuugguuuguaa

SEQ ID NO: 1862913 - RNA, 19 nt, Human
uuguucuugguuuguaaau

SEQ ID NO: 1862914 - RNA, 20 nt, Human
uuguucuugguuuguaaauu

SEQ ID NO: 1862915 - RNA, 13 nt, Human
augauuucauuca

SEQ ID NO: 1862916 - RNA, 21 nt, Human
augcacuuuguucuggcucuu

SEQ ID NO: 1862917 - RNA, 18 nt, Human
augcagagguccacaaca

SEQ ID NO: 1862918 - RNA, 17 nt, Human
augcagagguccacaac

SEQ ID NO: 1862919 - RNA, 18 nt, Human
uuuaaaaaaauuccaagu

SEQ ID NO: 1862920 - RNA, 23 nt, Human
augcacuuuguucuggcucuucc

SEQ ID NO: 1862921 - RNA, 16 nt, Human
auuucuuccacaagag

SEQ ID NO: 1862922 - RNA, 17 nt, Human
auuugaggucuguucuu

SEQ ID NO: 1862923 - RNA, 18 nt, Human
auuugaggucuguucuuu

SEQ ID NO: 1862924 - RNA, 15 nt, Human
auuugagcagggcuc

SEQ ID NO: 1862925 - RNA, 16 nt, Human
auuugagcagggcuca

SEQ ID NO: 1862926 - RNA, 21 nt, Human
auuugaggucuguucuuucca

SEQ ID NO: 1862927 - RNA, 21 nt, Human
auuuggugguuucagaaaugu

SEQ ID NO: 1862928 - RNA, 16 nt, Human
auuucccaaagcagug

SEQ ID NO: 1862929 - RNA, 14 nt, Human
auuucccaaagcag

SEQ ID NO: 1862930 - RNA, 17 nt, Human
auuuccguuaaaauacc

SEQ ID NO: 1862931 - RNA, 14 nt, Human
auuuccuaaauaua

SEQ ID NO: 1862932 - RNA, 21 nt, Human
auuuccuaaauauauuuuaag

SEQ ID NO: 1862933 - RNA, 14 nt, Human
auuuaaaaaaaauc

SEQ ID NO: 1862934 - RNA, 19 nt, Human
auuguuuucaguguacaug

SEQ ID NO: 1862935 - RNA, 18 nt, Human
auuguuuucaguguacau

SEQ ID NO: 1862936 - RNA, 17 nt, Human
auuuaaaaaaaaaccug

SEQ ID NO: 1862937 - RNA, 17 nt, Human
auuguuuucaguguaca

SEQ ID NO: 1862938 - RNA, 16 nt, Human
auuguaguccuguaau

SEQ ID NO: 1862939 - RNA, 15 nt, Human
auuuauaaacuuuuu

SEQ ID NO: 1862940 - RNA, 23 nt, Human
auuuauaaaaauaaaaaacacug

SEQ ID NO: 1862941 - RNA, 17 nt, Human
auuuaguguucauaaau

SEQ ID NO: 1862942 - RNA, 20 nt, Human
auuuacuucuuauacauuug

SEQ ID NO: 1862943 - RNA, 19 nt, Human
auuuacuucuuauacauuu

SEQ ID NO: 1862944 - RNA, 16 nt, Human
auuuaguguucauaaa

SEQ ID NO: 1862945 - RNA, 23 nt, Human
auuggcuagagguucaaagauau

SEQ ID NO: 1862946 - RNA, 19 nt, Human
auuggcuagagguucaaag

SEQ ID NO: 1862947 - RNA, 20 nt, Human
auuggcuagagguucaaaga

SEQ ID NO: 1862948 - RNA, 22 nt, Human
auuggcuagagguucaaagaua

SEQ ID NO: 1862949 - RNA, 17 nt, Human
auugcaacaggcugggc

SEQ ID NO: 1862950 - RNA, 18 nt, Human
auugcaacaggcugggcu

SEQ ID NO: 1862951 - RNA, 12 nt, Human
auugcaccacug

SEQ ID NO: 1862952 - RNA, 19 nt, Human
auugcaacaggcugggcuu

SEQ ID NO: 1862953 - RNA, 13 nt, Human
auuaaguuguuaa

SEQ ID NO: 1862954 - RNA, 13 nt, Human
auuagagaagaga

SEQ ID NO: 1862955 - RNA, 14 nt, Human
auuacuucugcuac

SEQ ID NO: 1862956 - RNA, 12 nt, Human
auuacuucugcu

SEQ ID NO: 1862957 - RNA, 13 nt, Human
auuacuucugcua

SEQ ID NO: 1862958 - RNA, 19 nt, Human
auuaaguacuauguaucaa

SEQ ID NO: 1862959 - RNA, 18 nt, Human
auuaaguacuauguauca

SEQ ID NO: 1862960 - RNA, 13 nt, Human
auuaaggaagaca

SEQ ID NO: 1862961 - RNA, 11 nt, Human
uuuuuguauuu

SEQ ID NO: 1862962 - RNA, 22 nt, Human
uuuuugggaaaagaaaagucaa

SEQ ID NO: 1862963 - RNA, 15 nt, Human
uuuuugaagcuguau

SEQ ID NO: 1862964 - RNA, 16 nt, Human
uuuuguuuuugucuua

SEQ ID NO: 1862965 - RNA, 21 nt, Human
uuuugugaaguuuaauugacu

SEQ ID NO: 1862966 - RNA, 15 nt, Human
auucagccuggcuuc

SEQ ID NO: 1862967 - RNA, 14 nt, Human
auucagccuggcuu

SEQ ID NO: 1862968 - RNA, 22 nt, Human
auuccccaggaggccagccuug

SEQ ID NO: 1862969 - RNA, 20 nt, Human
auuccccaggaggccagccu

SEQ ID NO: 1862970 - RNA, 18 nt, Human
auucccaagcucugcucc

SEQ ID NO: 1862971 - RNA, 19 nt, Human
auucccaagcucugcuccu

SEQ ID NO: 1862972 - RNA, 18 nt, Human
auuccagagaguggcucc

SEQ ID NO: 1862973 - RNA, 17 nt, Human
auucccaagcucugcuc

SEQ ID NO: 1862974 - RNA, 12 nt, Human
auuccacagcug

SEQ ID NO: 1862975 - RNA, 17 nt, Human
auuccaagugauugaaa

SEQ ID NO: 1862976 - RNA, 20 nt, Human
auuauauggcuugaguuuaa

SEQ ID NO: 1862977 - RNA, 23 nt, Human
uuucccucccuuccucuuuccau

SEQ ID NO: 1862978 - RNA, 19 nt, Human
uuugaccucugcagcaaua

SEQ ID NO: 1862979 - RNA, 21 nt, Human
uuugaccucugcagcaauaaa

SEQ ID NO: 1862980 - RNA, 14 nt, Human
uuugacaaggggca

SEQ ID NO: 1862981 - RNA, 18 nt, Human
uuugacaaagguaaauca

SEQ ID NO: 1862982 - RNA, 15 nt, Human
uuugauucagacagc

SEQ ID NO: 1862983 - RNA, 15 nt, Human
uuugauccaagcugg

SEQ ID NO: 1862984 - RNA, 13 nt, Human
uuugagacagagu

SEQ ID NO: 1862985 - RNA, 18 nt, Human
uuugaccucugcagcaau

SEQ ID NO: 1862986 - RNA, 22 nt, Human
uuuggauuggaugaauuccaaa

SEQ ID NO: 1862987 - RNA, 13 nt, Human
uuugcuguagaag

SEQ ID NO: 1862988 - RNA, 20 nt, Human
uuugcuggagcucugcccau

SEQ ID NO: 1862989 - RNA, 19 nt, Human
uuugcuggggccgaaagaa

SEQ ID NO: 1862990 - RNA, 22 nt, Human
uuugcuggggccgaaagaacag

SEQ ID NO: 1862991 - RNA, 18 nt, Human
uuugauucagacagcugc

SEQ ID NO: 1862992 - RNA, 13 nt, Human
uuuggcugcugaa

SEQ ID NO: 1862993 - RNA, 12 nt, Human
uuuggcugcuga

SEQ ID NO: 1862994 - RNA, 14 nt, Human
uuugggcugcccug

SEQ ID NO: 1862995 - RNA, 13 nt, Human
uuuggggaagaac

SEQ ID NO: 1862996 - RNA, 21 nt, Human
uuugggguacccacugcucug

SEQ ID NO: 1862997 - RNA, 22 nt, Human
uuugggguacccacugcucugg

SEQ ID NO: 1862998 - RNA, 14 nt, Human
uuugucuuaaaaag

SEQ ID NO: 1862999 - RNA, 13 nt, Human
uuugucuuaaaaa

SEQ ID NO: 1863000 - RNA, 23 nt, Human
uuugucuuaaaaaguggaaaaau

SEQ ID NO: 1863001 - RNA, 16 nt, Human
uuugugauacaaugcu

SEQ ID NO: 1863002 - RNA, 22 nt, Human
uuugugauacaaugcugugccc

SEQ ID NO: 1863003 - RNA, 15 nt, Human
uuugugauacaaugc

SEQ ID NO: 1863004 - RNA, 19 nt, Human
uuugugcauuaucuagaua

SEQ ID NO: 1863005 - RNA, 22 nt, Human
uuugugcauuaucuagauacug

SEQ ID NO: 1863006 - RNA, 13 nt, Human
uuuguuucauauu

SEQ ID NO: 1863007 - RNA, 16 nt, Human
uuuguuucugaaaggg

SEQ ID NO: 1863008 - RNA, 14 nt, Human
uuuguuucugaaag

SEQ ID NO: 1863009 - RNA, 14 nt, Human
uuuguacagacaac

SEQ ID NO: 1863010 - RNA, 16 nt, Human
uuuguaauuuuuuuau

SEQ ID NO: 1863011 - RNA, 18 nt, Human
augugauccuuuuggagu

SEQ ID NO: 1863012 - RNA, 15 nt, Human
augugaugagaggaa

SEQ ID NO: 1863013 - RNA, 19 nt, Human
auguauauuuuauaucaau

SEQ ID NO: 1863014 - RNA, 12 nt, Human
auguaucaauga

SEQ ID NO: 1863015 - RNA, 17 nt, Human
auguccaagaagcccag

SEQ ID NO: 1863016 - RNA, 16 nt, Human
auguccaagaagccca

SEQ ID NO: 1863017 - RNA, 13 nt, Human
augugagaccauu

SEQ ID NO: 1863018 - RNA, 14 nt, Human
augugagacugguu

SEQ ID NO: 1863019 - RNA, 23 nt, Human
augucgucaaagcugaaauggac

SEQ ID NO: 1863020 - RNA, 15 nt, Human
auguuuuuuuuuaaa

SEQ ID NO: 1863021 - RNA, 23 nt, Human
auuaaaaaucucaaauuucuaaa

SEQ ID NO: 1863022 - RNA, 19 nt, Human
auuaaaacacaacaucuuu

SEQ ID NO: 1863023 - RNA, 13 nt, Human
uuuucuguucuuu

SEQ ID NO: 1863024 - RNA, 21 nt, Human
uuuucuuaaccagaucauugu

SEQ ID NO: 1863025 - RNA, 17 nt, Human
auguuggccaggcuggu

SEQ ID NO: 1863026 - RNA, 12 nt, Human
uuuuauuaaauu

SEQ ID NO: 1863027 - RNA, 21 nt, Human
uuuuauggcuuuugugcauua

SEQ ID NO: 1863028 - RNA, 18 nt, Human
uuuuauggcuuuugugca

SEQ ID NO: 1863029 - RNA, 19 nt, Human
uuuuauggcuuuugugcau

SEQ ID NO: 1863030 - RNA, 15 nt, Human
uuuuaguagagacag

SEQ ID NO: 1863031 - RNA, 14 nt, Human
uuuucaguguacau

SEQ ID NO: 1863032 - RNA, 16 nt, Human
uuuucuauaauuuaaa

SEQ ID NO: 1863033 - RNA, 18 nt, Human
uuuuaaaaaacugcugac

SEQ ID NO: 1863034 - RNA, 21 nt, Human
uuuuaaaaaacugcugacugu

SEQ ID NO: 1863035 - RNA, 21 nt, Human
augugccagguuuuuggucug

SEQ ID NO: 1863036 - RNA, 15 nt, Human
auguguguuuuaaaa

SEQ ID NO: 1863037 - RNA, 12 nt, Human
auguugaaagau

SEQ ID NO: 1863038 - RNA, 18 nt, Human
auguugaaagaucaaaag

SEQ ID NO: 1863039 - RNA, 13 nt, Human
auguugcccaggc

SEQ ID NO: 1863040 - RNA, 14 nt, Human
auguugcccaggca

SEQ ID NO: 1863041 - RNA, 15 nt, Human
auguugcccaggcag

SEQ ID NO: 1863042 - RNA, 16 nt, Human
auguugcccaggcagg

SEQ ID NO: 1863043 - RNA, 21 nt, Human
uuuuagacccuauugcugcuu

SEQ ID NO: 1863044 - RNA, 17 nt, Human
uuuuagaguugauacua

SEQ ID NO: 1863045 - RNA, 19 nt, Human
auguuacauaagauaaaug

SEQ ID NO: 1863046 - RNA, 20 nt, Human
auguuacauaagauaaaugu

SEQ ID NO: 1863047 - RNA, 13 nt, Human
cacccaagggccu

SEQ ID NO: 1863048 - RNA, 22 nt, Human
cacacggacacucaaaagcugg

SEQ ID NO: 1863049 - RNA, 18 nt, Human
cacagcucuucuccaggc

SEQ ID NO: 1863050 - RNA, 23 nt, Human
cacaguccuuaccagcagagcac

SEQ ID NO: 1863051 - RNA, 14 nt, Human
cacaggcccggcuc

SEQ ID NO: 1863052 - RNA, 17 nt, Human
cacaggaucagucugau

SEQ ID NO: 1863053 - RNA, 16 nt, Human
cacaggacucugccuc

SEQ ID NO: 1863054 - RNA, 15 nt, Human
cacaggacucugccu

SEQ ID NO: 1863055 - RNA, 21 nt, Human
cacagcucuucuccaggcugu

SEQ ID NO: 1863056 - RNA, 19 nt, Human
cacagcucuucuccaggcu

SEQ ID NO: 1863057 - RNA, 20 nt, Human
cacagcucuucuccaggcug

SEQ ID NO: 1863058 - RNA, 17 nt, Human
cacaugagcaucaggcc

SEQ ID NO: 1863059 - RNA, 13 nt, Human
cacaugagcauca

SEQ ID NO: 1863060 - RNA, 21 nt, Human
cacaugagcaucaggccaggc

SEQ ID NO: 1863061 - RNA, 20 nt, Human
cacaugagcaucaggccagg

SEQ ID NO: 1863062 - RNA, 19 nt, Human
cacaugagcaucaggccag

SEQ ID NO: 1863063 - RNA, 18 nt, Human
cacaugagcaucaggcca

SEQ ID NO: 1863064 - RNA, 17 nt, Human
cacaugcaaggucauuu

SEQ ID NO: 1863065 - RNA, 19 nt, Human
cacaugcaaggucauuuuu

SEQ ID NO: 1863066 - RNA, 20 nt, Human
cacaugcaaggucauuuuuu

SEQ ID NO: 1863067 - RNA, 18 nt, Human
cacaugcacgugugugca

SEQ ID NO: 1863068 - RNA, 17 nt, Human
cacauguccaagaagcc

SEQ ID NO: 1863069 - RNA, 16 nt, Human
cacauguccaagaagc

SEQ ID NO: 1863070 - RNA, 20 nt, Human
cacaugccucucucaggcca

SEQ ID NO: 1863071 - RNA, 21 nt, Human
cacaugccucucucaggccaa

SEQ ID NO: 1863072 - RNA, 13 nt, Human
caccaagcccagu

SEQ ID NO: 1863073 - RNA, 12 nt, Human
caccaagcccag

SEQ ID NO: 1863074 - RNA, 22 nt, Human
cacauguccaagaagcccagga

SEQ ID NO: 1863075 - RNA, 21 nt, Human
cacauguccaagaagcccagg

SEQ ID NO: 1863076 - RNA, 19 nt, Human
cacauguccaagaagccca

SEQ ID NO: 1863077 - RNA, 18 nt, Human
cacauguccaagaagccc

SEQ ID NO: 1863078 - RNA, 17 nt, Human
caccaacgucugugcca

SEQ ID NO: 1863079 - RNA, 23 nt, Human
cacauguccaagaagcccaggaa

SEQ ID NO: 1863080 - RNA, 14 nt, Human
caccacgcccggcu

SEQ ID NO: 1863081 - RNA, 15 nt, Human
caccacgcccggcua

SEQ ID NO: 1863082 - RNA, 19 nt, Human
caccacacccagcccacuu

SEQ ID NO: 1863083 - RNA, 17 nt, Human
caccagagcccaccuug

SEQ ID NO: 1863084 - RNA, 18 nt, Human
caccagagcccaccuugg

SEQ ID NO: 1863085 - RNA, 20 nt, Human
caccagagcccaccuuggcu

SEQ ID NO: 1863086 - RNA, 22 nt, Human
caccagagcccaccuuggcuca

SEQ ID NO: 1863087 - RNA, 15 nt, Human
caccagagcccaccu

SEQ ID NO: 1863088 - RNA, 20 nt, Human
caccauguuggccaggcugg

SEQ ID NO: 1863089 - RNA, 20 nt, Human
caccauguuggccaggcugc

SEQ ID NO: 1863090 - RNA, 19 nt, Human
caccauguuggccaggcug

SEQ ID NO: 1863091 - RNA, 24 nt, Human
caccaucaagccaccaacauacuc

SEQ ID NO: 1863092 - RNA, 19 nt, Human
caccaucaagccaccaaca

SEQ ID NO: 1863093 - RNA, 17 nt, Human
caccaucaagccaccaa

SEQ ID NO: 1863094 - RNA, 16 nt, Human
caccaucaagccacca

SEQ ID NO: 1863095 - RNA, 15 nt, Human
caccaucaugucugg

SEQ ID NO: 1863096 - RNA, 17 nt, Human
caccaucaugucuggcu

SEQ ID NO: 1863097 - RNA, 18 nt, Human
caccaucaugucuggcua

SEQ ID NO: 1863098 - RNA, 21 nt, Human
caccauauuaccacagacaua

SEQ ID NO: 1863099 - RNA, 18 nt, Human
caccauaggucaccuuua

SEQ ID NO: 1863100 - RNA, 15 nt, Human
caccaucaagccacc

SEQ ID NO: 1863101 - RNA, 14 nt, Human
caccaucaagccac

SEQ ID NO: 1863102 - RNA, 13 nt, Human
caccaucaagcca

SEQ ID NO: 1863103 - RNA, 14 nt, Human
cacacccagcccac

SEQ ID NO: 1863104 - RNA, 20 nt, Human
cacacccagcccacuucugc

SEQ ID NO: 1863105 - RNA, 16 nt, Human
cacacagcucuguccu

SEQ ID NO: 1863106 - RNA, 21 nt, Human
cacaccagagcccaccuuggc

SEQ ID NO: 1863107 - RNA, 22 nt, Human
cacaccagagcccaccuuggcu

SEQ ID NO: 1863108 - RNA, 22 nt, Human
cacacagauuugagcucagccc

SEQ ID NO: 1863109 - RNA, 13 nt, Human
cacacagcucugu

SEQ ID NO: 1863110 - RNA, 14 nt, Human
cacacagcucuguc

SEQ ID NO: 1863111 - RNA, 15 nt, Human
cacacagcucugucc

SEQ ID NO: 1863112 - RNA, 24 nt, Human
cacaaucucggcucacugcauccu

SEQ ID NO: 1863113 - RNA, 23 nt, Human
cacaaucucggcucacugcaucc

SEQ ID NO: 1863114 - RNA, 22 nt, Human
cacaaucucggcucacugcauc

SEQ ID NO: 1863115 - RNA, 20 nt, Human
cacaaucucggcucacugca

SEQ ID NO: 1863116 - RNA, 15 nt, Human
cacacaccagagccc

SEQ ID NO: 1863117 - RNA, 16 nt, Human
cacacaccagagccca

SEQ ID NO: 1863118 - RNA, 20 nt, Human
cacacaccagagcccaccuu

SEQ ID NO: 1863119 - RNA, 21 nt, Human
cacacagaggcugccucuccc

SEQ ID NO: 1863120 - RNA, 20 nt, Human
cacacagauuugagcucagc

SEQ ID NO: 1863121 - RNA, 18 nt, Human
cacacagauuugagcuca

SEQ ID NO: 1863122 - RNA, 14 nt, Human
cacacacuuuggcu

SEQ ID NO: 1863123 - RNA, 23 nt, Human
cacaagaaaugaaagcagggacu

SEQ ID NO: 1863124 - RNA, 23 nt, Human
cacaagacccaaaaggcagaagc

SEQ ID NO: 1863125 - RNA, 19 nt, Human
cacaaucucggcucacugc

SEQ ID NO: 1863126 - RNA, 17 nt, Human
cacaaagguagcuuuuc

SEQ ID NO: 1863127 - RNA, 13 nt, Human
cacaagaaaugaa

SEQ ID NO: 1863128 - RNA, 15 nt, Human
cacaagaaaugaaag

SEQ ID NO: 1863129 - RNA, 17 nt, Human
cacaaacgggcucagca

SEQ ID NO: 1863130 - RNA, 18 nt, Human
caaugguuuucuugugug

SEQ ID NO: 1863131 - RNA, 14 nt, Human
caaugcacuuuguu

SEQ ID NO: 1863132 - RNA, 16 nt, Human
caaugaccuuucaaua

SEQ ID NO: 1863133 - RNA, 15 nt, Human
caaugaccuuucaau

SEQ ID NO: 1863134 - RNA, 13 nt, Human
caaugauggucac

SEQ ID NO: 1863135 - RNA, 14 nt, Human
caaugaccuuucaa

SEQ ID NO: 1863136 - RNA, 22 nt, Human
caaugcaaaccaucauugaaau

SEQ ID NO: 1863137 - RNA, 21 nt, Human
caaugcaaaccaucauugaaa

SEQ ID NO: 1863138 - RNA, 14 nt, Human
caaugcaaaccauc

SEQ ID NO: 1863139 - RNA, 14 nt, Human
caaugauggucacc

SEQ ID NO: 1863140 - RNA, 23 nt, Human
caaugcaaaccaucauugaaauc

SEQ ID NO: 1863141 - RNA, 13 nt, Human
caaugcacuuugu

SEQ ID NO: 1863142 - RNA, 14 nt, Human
caaugcacugacau

SEQ ID NO: 1863143 - RNA, 18 nt, Human
caaucucggcucacugca

SEQ ID NO: 1863144 - RNA, 20 nt, Human
caacaggcugggcuucagug

SEQ ID NO: 1863145 - RNA, 21 nt, Human
caaagagguuuuaaaaaaauc

SEQ ID NO: 1863146 - RNA, 14 nt, Human
caaagagguuuuaa

SEQ ID NO: 1863147 - RNA, 13 nt, Human
caaagcccagcuu

SEQ ID NO: 1863148 - RNA, 19 nt, Human
caaagcccaaagugguaua

SEQ ID NO: 1863149 - RNA, 17 nt, Human
caaagcccaaaguggua

SEQ ID NO: 1863150 - RNA, 12 nt, Human
caaagaaauuau

SEQ ID NO: 1863151 - RNA, 15 nt, Human
caaagaaauuaugug

SEQ ID NO: 1863152 - RNA, 13 nt, Human
caaagaaauuaug

SEQ ID NO: 1863153 - RNA, 20 nt, Human
caaaggguaucaggugcugc

SEQ ID NO: 1863154 - RNA, 21 nt, Human
caaaggguaucaggugcugcc

SEQ ID NO: 1863155 - RNA, 17 nt, Human
caaaguggugagaggca

SEQ ID NO: 1863156 - RNA, 16 nt, Human
caaaguggugagaggc

SEQ ID NO: 1863157 - RNA, 18 nt, Human
caaagugguauagaaaug

SEQ ID NO: 1863158 - RNA, 19 nt, Human
caaagugguauagaaaugc

SEQ ID NO: 1863159 - RNA, 23 nt, Human
caaaggguaucaggugcugccau

SEQ ID NO: 1863160 - RNA, 14 nt, Human
caaaggagauugga

SEQ ID NO: 1863161 - RNA, 18 nt, Human
caaagcccuuccaugucg

SEQ ID NO: 1863162 - RNA, 20 nt, Human
caaaggagauuggaaggaac

SEQ ID NO: 1863163 - RNA, 19 nt, Human
caaaguggugagaggcauc

SEQ ID NO: 1863164 - RNA, 21 nt, Human
caaaguucccuacuuccugug

SEQ ID NO: 1863165 - RNA, 22 nt, Human
caaaguucccuacuuccuguga

SEQ ID NO: 1863166 - RNA, 17 nt, Human
caaauauuccagagacu

SEQ ID NO: 1863167 - RNA, 13 nt, Human
caaauauuccaga

SEQ ID NO: 1863168 - RNA, 17 nt, Human
caaauuguaagcaugca

SEQ ID NO: 1863169 - RNA, 21 nt, Human
caaccugauugugucucuugg

SEQ ID NO: 1863170 - RNA, 19 nt, Human
caaccugauugugucucuu

SEQ ID NO: 1863171 - RNA, 17 nt, Human
caaccugauugugucuc

SEQ ID NO: 1863172 - RNA, 23 nt, Human
caacugcaucaagaugugacaug

SEQ ID NO: 1863173 - RNA, 20 nt, Human
caacugcaucaagaugugac

SEQ ID NO: 1863174 - RNA, 17 nt, Human
caacugcaucaagaugu

SEQ ID NO: 1863175 - RNA, 15 nt, Human
caacauacucccauc

SEQ ID NO: 1863176 - RNA, 14 nt, Human
caacauacucccau

SEQ ID NO: 1863177 - RNA, 16 nt, Human
caacauacucccaucu

SEQ ID NO: 1863178 - RNA, 17 nt, Human
caacaggcugggcuuca

SEQ ID NO: 1863179 - RNA, 16 nt, Human
caaauuuacagagaca

SEQ ID NO: 1863180 - RNA, 17 nt, Human
caaauuuacagagacag

SEQ ID NO: 1863181 - RNA, 23 nt, Human
caaauuuacagagacagaaagca

SEQ ID NO: 1863182 - RNA, 14 nt, Human
caacaggcugggcu

SEQ ID NO: 1863183 - RNA, 14 nt, Human
caaggauccugagc

SEQ ID NO: 1863184 - RNA, 21 nt, Human
caaggacuaggguccugggga

SEQ ID NO: 1863185 - RNA, 20 nt, Human
caaggacuaggguccugggg

SEQ ID NO: 1863186 - RNA, 19 nt, Human
caaggacuaggguccuggg

SEQ ID NO: 1863187 - RNA, 18 nt, Human
caaggacuaggguccugg

SEQ ID NO: 1863188 - RNA, 16 nt, Human
caaggacuaggguccu

SEQ ID NO: 1863189 - RNA, 21 nt, Human
caaggcugucaauuacaggaa

SEQ ID NO: 1863190 - RNA, 23 nt, Human
caagggaauuucuucaacucccu

SEQ ID NO: 1863191 - RNA, 14 nt, Human
caaggcugucaauu

SEQ ID NO: 1863192 - RNA, 13 nt, Human
caaggcugucaau

SEQ ID NO: 1863193 - RNA, 21 nt, Human
caaggcugggggaagaagcuc

SEQ ID NO: 1863194 - RNA, 16 nt, Human
caaggauccugagcca

SEQ ID NO: 1863195 - RNA, 15 nt, Human
caaggauccugagcc

SEQ ID NO: 1863196 - RNA, 17 nt, Human
caaggauccugagccag

SEQ ID NO: 1863197 - RNA, 20 nt, Human
caagagggcacugguggccc

SEQ ID NO: 1863198 - RNA, 19 nt, Human
caagagggcacugguggcc

SEQ ID NO: 1863199 - RNA, 18 nt, Human
caagagggcacugguggc

SEQ ID NO: 1863200 - RNA, 17 nt, Human
caagagggcacuggugg

SEQ ID NO: 1863201 - RNA, 17 nt, Human
caagagcccaggccucc

SEQ ID NO: 1863202 - RNA, 12 nt, Human
caagagggucug

SEQ ID NO: 1863203 - RNA, 16 nt, Human
caagagggucugagga

SEQ ID NO: 1863204 - RNA, 17 nt, Human
caagagggucugaggaa

SEQ ID NO: 1863205 - RNA, 23 nt, Human
caagacccuuguggucccacccc

SEQ ID NO: 1863206 - RNA, 15 nt, Human
caagaaaugaaagca

SEQ ID NO: 1863207 - RNA, 13 nt, Human
caagaaaugaaag

SEQ ID NO: 1863208 - RNA, 22 nt, Human
caagacgcugugcugcccugcc

SEQ ID NO: 1863209 - RNA, 21 nt, Human
caagacgcugugcugcccugc

SEQ ID NO: 1863210 - RNA, 20 nt, Human
caagacgcugugcugcccug

SEQ ID NO: 1863211 - RNA, 13 nt, Human
caagaccuucucc

SEQ ID NO: 1863212 - RNA, 16 nt, Human
caagggccuggccuga

SEQ ID NO: 1863213 - RNA, 14 nt, Human
caagugagacccug

SEQ ID NO: 1863214 - RNA, 23 nt, Human
caagugaaaaaggaggaagagaa

SEQ ID NO: 1863215 - RNA, 22 nt, Human
caagugaaaaaggaggaagaga

SEQ ID NO: 1863216 - RNA, 20 nt, Human
caagugauucuccugccuca

SEQ ID NO: 1863217 - RNA, 19 nt, Human
caagugagacccugucuca

SEQ ID NO: 1863218 - RNA, 15 nt, Human
caagugagacccugu

SEQ ID NO: 1863219 - RNA, 19 nt, Human
caagugauucuccugccuc

SEQ ID NO: 1863220 - RNA, 18 nt, Human
caagugauucuccugccu

SEQ ID NO: 1863221 - RNA, 23 nt, Human
caaggggaauguuugccucugcc

SEQ ID NO: 1863222 - RNA, 13 nt, Human
caaggucauuuuu

SEQ ID NO: 1863223 - RNA, 14 nt, Human
caagggccuggccu

SEQ ID NO: 1863224 - RNA, 13 nt, Human
caagggccuggcc

SEQ ID NO: 1863225 - RNA, 15 nt, Human
caagggccuggccug

SEQ ID NO: 1863226 - RNA, 21 nt, Human
caaggggaauguuugccucug

SEQ ID NO: 1863227 - RNA, 13 nt, Human
uuuuuucuuacug

SEQ ID NO: 1863228 - RNA, 22 nt, Human
cauuugaaaauuuugauguuuu

SEQ ID NO: 1863229 - RNA, 20 nt, Human
cauuugaaaauuuugauguu

SEQ ID NO: 1863230 - RNA, 14 nt, Human
cauuugcuccuuuc

SEQ ID NO: 1863231 - RNA, 13 nt, Human
cauuugcuccuuu

SEQ ID NO: 1863232 - RNA, 17 nt, Human
cauuuguuugaacugau

SEQ ID NO: 1863233 - RNA, 13 nt, Human
cauuugcugaaua

SEQ ID NO: 1863234 - RNA, 20 nt, Human
cauuuguuugaacugauaaa

SEQ ID NO: 1863235 - RNA, 22 nt, Human
cauuuguuugaacugauaaaga

SEQ ID NO: 1863236 - RNA, 20 nt, Human
cauuugagcagggcucagcg

SEQ ID NO: 1863237 - RNA, 17 nt, Human
cauuugagcagggcuca

SEQ ID NO: 1863238 - RNA, 18 nt, Human
cauuugagcagggcucag

SEQ ID NO: 1863239 - RNA, 17 nt, Human
ccaaacucaccugcccc

SEQ ID NO: 1863240 - RNA, 20 nt, Human
ccaaacauccuacaagacac

SEQ ID NO: 1863241 - RNA, 19 nt, Human
ccaaacauccuacaagaca

SEQ ID NO: 1863242 - RNA, 23 nt, Human
cauuuuucuuagggaaggauaca

SEQ ID NO: 1863243 - RNA, 20 nt, Human
cauuuuucagauauaaaaga

SEQ ID NO: 1863244 - RNA, 18 nt, Human
cauuuuucagauauaaaa

SEQ ID NO: 1863245 - RNA, 17 nt, Human
cauuuaggccaugggac

SEQ ID NO: 1863246 - RNA, 20 nt, Human
cauuuccugacagaaggacu

SEQ ID NO: 1863247 - RNA, 13 nt, Human
cauuuccugacag

SEQ ID NO: 1863248 - RNA, 15 nt, Human
cauuuccuaaauaua

SEQ ID NO: 1863249 - RNA, 12 nt, Human
cauuuaaaagau

SEQ ID NO: 1863250 - RNA, 15 nt, Human
cauuuaaaagauaca

SEQ ID NO: 1863251 - RNA, 16 nt, Human
cauuuaaaagauacag

SEQ ID NO: 1863252 - RNA, 12 nt, Human
cauuuccugugu

SEQ ID NO: 1863253 - RNA, 13 nt, Human
cauuuccuguguc

SEQ ID NO: 1863254 - RNA, 21 nt, Human
cauuguagagcuucuggcacu

SEQ ID NO: 1863255 - RNA, 19 nt, Human
cauuguagagcuucuggca

SEQ ID NO: 1863256 - RNA, 17 nt, Human
cauuguagagcuucugg

SEQ ID NO: 1863257 - RNA, 16 nt, Human
cauuguagagcuucug

SEQ ID NO: 1863258 - RNA, 15 nt, Human
cauuguagagcuucu

SEQ ID NO: 1863259 - RNA, 15 nt, Human
cacccaagggccugg

SEQ ID NO: 1863260 - RNA, 14 nt, Human
cacccaagggccug

SEQ ID NO: 1863261 - RNA, 23 nt, Human
cauuguauucagaguugaugguu

SEQ ID NO: 1863262 - RNA, 18 nt, Human
cauuguuggccaaagcca

SEQ ID NO: 1863263 - RNA, 17 nt, Human
cauuguuggccaaagcc

SEQ ID NO: 1863264 - RNA, 22 nt, Human
ccaauaguuguugauuggcagg

SEQ ID NO: 1863265 - RNA, 23 nt, Human
ccaagguuuggggaagaacgaag

SEQ ID NO: 1863266 - RNA, 13 nt, Human
ccaaggugggagg

SEQ ID NO: 1863267 - RNA, 18 nt, Human
ccaaggugggaggauugc

SEQ ID NO: 1863268 - RNA, 20 nt, Human
ccaagucaagugaaaaagga

SEQ ID NO: 1863269 - RNA, 21 nt, Human
ccaaggccaaaggaagcacau

SEQ ID NO: 1863270 - RNA, 18 nt, Human
ccaaggccaaaggaagca

SEQ ID NO: 1863271 - RNA, 15 nt, Human
ccaagggccuggccu

SEQ ID NO: 1863272 - RNA, 18 nt, Human
ccaagggccuggccugag

SEQ ID NO: 1863273 - RNA, 16 nt, Human
ccaagggccuggccug

SEQ ID NO: 1863274 - RNA, 19 nt, Human
ccaagggccuggccugagc

SEQ ID NO: 1863275 - RNA, 22 nt, Human
ccaaggggaauguuugccucug

SEQ ID NO: 1863276 - RNA, 17 nt, Human
ccaaggccaaaggaagc

SEQ ID NO: 1863277 - RNA, 22 nt, Human
ccaagcucccaggcauucccca

SEQ ID NO: 1863278 - RNA, 16 nt, Human
ccaagcucccaggcau

SEQ ID NO: 1863279 - RNA, 15 nt, Human
ccaagcucccaggca

SEQ ID NO: 1863280 - RNA, 14 nt, Human
ccaagcucccaggc

SEQ ID NO: 1863281 - RNA, 15 nt, Human
ccaagccuggcaagg

SEQ ID NO: 1863282 - RNA, 22 nt, Human
ccaagccuacuuuugccauuga

SEQ ID NO: 1863283 - RNA, 13 nt, Human
ccaagccguggcu

SEQ ID NO: 1863284 - RNA, 20 nt, Human
ccaagaagcccaggaaaggc

SEQ ID NO: 1863285 - RNA, 19 nt, Human
ccaagaagcccaggaaagg

SEQ ID NO: 1863286 - RNA, 19 nt, Human
ccaagaauagaugcugacu

SEQ ID NO: 1863287 - RNA, 20 nt, Human
ccaagaauagaugcugacug

SEQ ID NO: 1863288 - RNA, 12 nt, Human
ccaacccucauc

SEQ ID NO: 1863289 - RNA, 15 nt, Human
ccaagaagcccagga

SEQ ID NO: 1863290 - RNA, 15 nt, Human
ccaacccucagagcc

SEQ ID NO: 1863291 - RNA, 14 nt, Human
ccaacccucagagc

SEQ ID NO: 1863292 - RNA, 16 nt, Human
ccaacauacucccauc

SEQ ID NO: 1863293 - RNA, 20 nt, Human
ccaacauacucccaucugug

SEQ ID NO: 1863294 - RNA, 19 nt, Human
ccaacauacucccaucugu

SEQ ID NO: 1863295 - RNA, 18 nt, Human
ccaacauacucccaucug

SEQ ID NO: 1863296 - RNA, 17 nt, Human
ccaacauacucccaucu

SEQ ID NO: 1863297 - RNA, 22 nt, Human
ccaacauacucccaucugugaa

SEQ ID NO: 1863298 - RNA, 21 nt, Human
ccaacauacucccaucuguga

SEQ ID NO: 1863299 - RNA, 13 nt, Human
ccaacaucaacau

SEQ ID NO: 1863300 - RNA, 20 nt, Human
ccaaccaaguggcucccaca

SEQ ID NO: 1863301 - RNA, 20 nt, Human
ccaaaguacacuguuucaaa

SEQ ID NO: 1863302 - RNA, 17 nt, Human
ccaaauuuucuuuuuau

SEQ ID NO: 1863303 - RNA, 15 nt, Human
ccaaaguacacuguu

SEQ ID NO: 1863304 - RNA, 18 nt, Human
ccaaaguacacuguuuca

SEQ ID NO: 1863305 - RNA, 23 nt, Human
ccaaaggaagcacaugccucucu

SEQ ID NO: 1863306 - RNA, 15 nt, Human
ccaaaggaagcacau

SEQ ID NO: 1863307 - RNA, 21 nt, Human
ccaaagcuaggccuggccaga

SEQ ID NO: 1863308 - RNA, 16 nt, Human
ccaaagcuaggccugg

SEQ ID NO: 1863309 - RNA, 17 nt, Human
ccaaagcuaggccuggc

SEQ ID NO: 1863310 - RNA, 15 nt, Human
ccaaagcuaggccug

SEQ ID NO: 1863311 - RNA, 20 nt, Human
ccaaacucaccugccccuca

SEQ ID NO: 1863312 - RNA, 22 nt, Human
ccaaagccuccuccagccgcca

SEQ ID NO: 1863313 - RNA, 17 nt, Human
ccaaagccuccuccagc

SEQ ID NO: 1863314 - RNA, 19 nt, Human
ccaaagcagugcaugcugu

SEQ ID NO: 1863315 - RNA, 23 nt, Human
ccaaagcagugcaugcugucccu

SEQ ID NO: 1863316 - RNA, 19 nt, Human
ccaaagccaaagcuaggcc

SEQ ID NO: 1863317 - RNA, 15 nt, Human
ccaccccacacacgc

SEQ ID NO: 1863318 - RNA, 14 nt, Human
ccacgguguucugu

SEQ ID NO: 1863319 - RNA, 23 nt, Human
ccacggccaggccagagggagug

SEQ ID NO: 1863320 - RNA, 18 nt, Human
ccacgcuggagugcagug

SEQ ID NO: 1863321 - RNA, 19 nt, Human
ccacgcuggagugcaguga

SEQ ID NO: 1863322 - RNA, 16 nt, Human
ccacggccaggccaga

SEQ ID NO: 1863323 - RNA, 18 nt, Human
ccacggccaggccagagg

SEQ ID NO: 1863324 - RNA, 15 nt, Human
ccacccccacccaag

SEQ ID NO: 1863325 - RNA, 16 nt, Human
ccacgcuggagugcag

SEQ ID NO: 1863326 - RNA, 16 nt, Human
ccacuacauucuguua

SEQ ID NO: 1863327 - RNA, 17 nt, Human
ccacuacauucuguuaa

SEQ ID NO: 1863328 - RNA, 17 nt, Human
ccacuagacccacugga

SEQ ID NO: 1863329 - RNA, 15 nt, Human
ccacuagacccacug

SEQ ID NO: 1863330 - RNA, 11 nt, Human
ccacuacauuc

SEQ ID NO: 1863331 - RNA, 15 nt, Human
ccacuacauucuguu

SEQ ID NO: 1863332 - RNA, 14 nt, Human
ccacuacauucugu

SEQ ID NO: 1863333 - RNA, 11 nt, Human
ccacucagguc

SEQ ID NO: 1863334 - RNA, 16 nt, Human
ccacucaggucuguuu

SEQ ID NO: 1863335 - RNA, 22 nt, Human
ccacuccagaccccuggcuuuu

SEQ ID NO: 1863336 - RNA, 21 nt, Human
ccacuccagaccccuggcuuu

SEQ ID NO: 1863337 - RNA, 20 nt, Human
ccacuccagaccccuggcuu

SEQ ID NO: 1863338 - RNA, 18 nt, Human
ccacucaguccauagcag

SEQ ID NO: 1863339 - RNA, 14 nt, Human
ccagaccccuggcu

SEQ ID NO: 1863340 - RNA, 17 nt, Human
ccagaccccuggcuuuu

SEQ ID NO: 1863341 - RNA, 16 nt, Human
ccagaccccuggcuuu

SEQ ID NO: 1863342 - RNA, 15 nt, Human
ccagaccccuggcuu

SEQ ID NO: 1863343 - RNA, 19 nt, Human
ccagaauuucccaaagcag

SEQ ID NO: 1863344 - RNA, 12 nt, Human
ccagaauuuccc

SEQ ID NO: 1863345 - RNA, 13 nt, Human
ccagaauuucaaa

SEQ ID NO: 1863346 - RNA, 23 nt, Human
ccagaauggucuuucuaaugugu

SEQ ID NO: 1863347 - RNA, 16 nt, Human
ccagaaugcuuuagga

SEQ ID NO: 1863348 - RNA, 21 nt, Human
ccagaauuucccaaagcagug

SEQ ID NO: 1863349 - RNA, 21 nt, Human
ccagacaccuugacagggcac

SEQ ID NO: 1863350 - RNA, 18 nt, Human
ccagaauuucccaaagca

SEQ ID NO: 1863351 - RNA, 22 nt, Human
ccagaaguuugagaucagccug

SEQ ID NO: 1863352 - RNA, 23 nt, Human
ccagaaguuugagaucagccugg

SEQ ID NO: 1863353 - RNA, 14 nt, Human
ccacuucagcugac

SEQ ID NO: 1863354 - RNA, 13 nt, Human
ccacuucagcuga

SEQ ID NO: 1863355 - RNA, 21 nt, Human
ccacuuagaaauugcauuucc

SEQ ID NO: 1863356 - RNA, 13 nt, Human
ccacugcagaaga

SEQ ID NO: 1863357 - RNA, 18 nt, Human
ccacugcagaagacagua

SEQ ID NO: 1863358 - RNA, 19 nt, Human
ccacuuagaaauugcauuu

SEQ ID NO: 1863359 - RNA, 17 nt, Human
ccacccccacccaaggg

SEQ ID NO: 1863360 - RNA, 23 nt, Human
ccacccaggagccccgaggccuu

SEQ ID NO: 1863361 - RNA, 21 nt, Human
ccacccaggagccccgaggcc

SEQ ID NO: 1863362 - RNA, 16 nt, Human
ccaauauucauagcag

SEQ ID NO: 1863363 - RNA, 20 nt, Human
ccacaguggaaccagcccag

SEQ ID NO: 1863364 - RNA, 20 nt, Human
ccacaucuugcucugcugac

SEQ ID NO: 1863365 - RNA, 19 nt, Human
ccacaucuugcucugcuga

SEQ ID NO: 1863366 - RNA, 18 nt, Human
ccacaucuugcucugcug

SEQ ID NO: 1863367 - RNA, 17 nt, Human
ccacaucuugcucugcu

SEQ ID NO: 1863368 - RNA, 16 nt, Human
ccacauuccugaugcu

SEQ ID NO: 1863369 - RNA, 16 nt, Human
ccacaugugcacaugc

SEQ ID NO: 1863370 - RNA, 21 nt, Human
ccaccaacauacucccaucug

SEQ ID NO: 1863371 - RNA, 15 nt, Human
ccaccaacccucaga

SEQ ID NO: 1863372 - RNA, 20 nt, Human
ccacacccagcccacuucug

SEQ ID NO: 1863373 - RNA, 15 nt, Human
ccacacccagcccac

SEQ ID NO: 1863374 - RNA, 21 nt, Human
ccacacccagcccacuucugc

SEQ ID NO: 1863375 - RNA, 22 nt, Human
ccacacccagcccacuucugcc

SEQ ID NO: 1863376 - RNA, 12 nt, Human
ccacacuccagc

SEQ ID NO: 1863377 - RNA, 23 nt, Human
ccacaggcccuuccucuccacug

SEQ ID NO: 1863378 - RNA, 22 nt, Human
ccacaggcccuuccucuccacu

SEQ ID NO: 1863379 - RNA, 19 nt, Human
ccacaggcccuuccucucc

SEQ ID NO: 1863380 - RNA, 18 nt, Human
ccacaggcccuuccucuc

SEQ ID NO: 1863381 - RNA, 17 nt, Human
ccacaggcccuuccucu

SEQ ID NO: 1863382 - RNA, 16 nt, Human
ccacaggcccuuccuc

SEQ ID NO: 1863383 - RNA, 15 nt, Human
ccacaggcccuuccu

SEQ ID NO: 1863384 - RNA, 16 nt, Human
ccacaggaucagucug

SEQ ID NO: 1863385 - RNA, 22 nt, Human
ccccucagggucccugguggca

SEQ ID NO: 1863386 - RNA, 17 nt, Human
ccccaggaggccagccu

SEQ ID NO: 1863387 - RNA, 18 nt, Human
cccaugcugcccugugag

SEQ ID NO: 1863388 - RNA, 17 nt, Human
cccaugcugcccuguga

SEQ ID NO: 1863389 - RNA, 16 nt, Human
cccaugcugcccugug

SEQ ID NO: 1863390 - RNA, 15 nt, Human
cccaugcugcccugu

SEQ ID NO: 1863391 - RNA, 17 nt, Human
cccagugccgagaagga

SEQ ID NO: 1863392 - RNA, 18 nt, Human
cccagugccgagaaggaa

SEQ ID NO: 1863393 - RNA, 15 nt, Human
cccagugcccacagg

SEQ ID NO: 1863394 - RNA, 20 nt, Human
cccagugcccacaggaucag

SEQ ID NO: 1863395 - RNA, 22 nt, Human
ccccaaauggaaaugggcagag

SEQ ID NO: 1863396 - RNA, 13 nt, Human
cccauucugccug

SEQ ID NO: 1863397 - RNA, 20 nt, Human
ccccacccaagggccuggcc

SEQ ID NO: 1863398 - RNA, 14 nt, Human
ccccacccaagggc

SEQ ID NO: 1863399 - RNA, 14 nt, Human
ccccaagccuggca

SEQ ID NO: 1863400 - RNA, 13 nt, Human
ccccaagccuggc

SEQ ID NO: 1863401 - RNA, 19 nt, Human
cccaagggccuggccugag

SEQ ID NO: 1863402 - RNA, 18 nt, Human
cccaagggccuggccuga

SEQ ID NO: 1863403 - RNA, 23 nt, Human
cccaagggccuggccugagcugg

SEQ ID NO: 1863404 - RNA, 23 nt, Human
cccaaugcacuuuguucuggcuc

SEQ ID NO: 1863405 - RNA, 18 nt, Human
cccagagggccugcaagg

SEQ ID NO: 1863406 - RNA, 20 nt, Human
cccagagggccugcaaggga

SEQ ID NO: 1863407 - RNA, 20 nt, Human
cccagauugcaacaggcugg

SEQ ID NO: 1863408 - RNA, 21 nt, Human
cccagauugcaacaggcuggg

SEQ ID NO: 1863409 - RNA, 22 nt, Human
cccagauugcaacaggcugggc

SEQ ID NO: 1863410 - RNA, 16 nt, Human
cccagcaagugagagc

SEQ ID NO: 1863411 - RNA, 18 nt, Human
cccagcaagugagagcug

SEQ ID NO: 1863412 - RNA, 18 nt, Human
cccagccccuucugaccc

SEQ ID NO: 1863413 - RNA, 12 nt, Human
cccagccugcua

SEQ ID NO: 1863414 - RNA, 19 nt, Human
cccagcaagugagagcugg

SEQ ID NO: 1863415 - RNA, 20 nt, Human
cccagcaagugagagcuggg

SEQ ID NO: 1863416 - RNA, 21 nt, Human
cccagcaagugagagcugggu

SEQ ID NO: 1863417 - RNA, 22 nt, Human
cccagcaagugagagcugggug

SEQ ID NO: 1863418 - RNA, 23 nt, Human
cccagcaagugagagcugggugu

SEQ ID NO: 1863419 - RNA, 23 nt, Human
cccagauugcaacaggcugggcu

SEQ ID NO: 1863420 - RNA, 11 nt, Human
cccagccccuu

SEQ ID NO: 1863421 - RNA, 19 nt, Human
cccagcgagcccugguggc

SEQ ID NO: 1863422 - RNA, 23 nt, Human
cccagcgagcccugguggcagug

SEQ ID NO: 1863423 - RNA, 17 nt, Human
cccagcgagcccuggug

SEQ ID NO: 1863424 - RNA, 18 nt, Human
cccagcgagcccuggugg

SEQ ID NO: 1863425 - RNA, 15 nt, Human
cccagcgagcccugg

SEQ ID NO: 1863426 - RNA, 23 nt, Human
cccaggcauuccccaggaggcca

SEQ ID NO: 1863427 - RNA, 22 nt, Human
cccaggcauuccccaggaggcc

SEQ ID NO: 1863428 - RNA, 21 nt, Human
cccaggcauuccccaggaggc

SEQ ID NO: 1863429 - RNA, 20 nt, Human
cccaggcauuccccaggagg

SEQ ID NO: 1863430 - RNA, 17 nt, Human
cccaggcaggucuugaa

SEQ ID NO: 1863431 - RNA, 11 nt, Human
cccaggccccu

SEQ ID NO: 1863432 - RNA, 16 nt, Human
cccaggccccugccac

SEQ ID NO: 1863433 - RNA, 18 nt, Human
cccaggccccugccaccc

SEQ ID NO: 1863434 - RNA, 21 nt, Human
cccaggccccugccacccugg

SEQ ID NO: 1863435 - RNA, 22 nt, Human
cccaggccccugccacccuggg

SEQ ID NO: 1863436 - RNA, 11 nt, Human
cccaggcaggu

SEQ ID NO: 1863437 - RNA, 13 nt, Human
cccaggcaggucu

SEQ ID NO: 1863438 - RNA, 22 nt, Human
cccaggaggccagccuugacca

SEQ ID NO: 1863439 - RNA, 13 nt, Human
cccaggaggccag

SEQ ID NO: 1863440 - RNA, 21 nt, Human
cccaggagccccgaggccuuc

SEQ ID NO: 1863441 - RNA, 18 nt, Human
cccaggagccccgaggcc

SEQ ID NO: 1863442 - RNA, 14 nt, Human
cccaggcugagccu

SEQ ID NO: 1863443 - RNA, 18 nt, Human
cccaggcgccccuucccc

SEQ ID NO: 1863444 - RNA, 16 nt, Human
cccaggccugccuguu

SEQ ID NO: 1863445 - RNA, 15 nt, Human
cccaggccugccugu

SEQ ID NO: 1863446 - RNA, 18 nt, Human
cccaggccuccuacagcu

SEQ ID NO: 1863447 - RNA, 17 nt, Human
cccaggccuccuacagc

SEQ ID NO: 1863448 - RNA, 13 nt, Human
cccagugcccaca

SEQ ID NO: 1863449 - RNA, 20 nt, Human
cccagucuggaaugcagugg

SEQ ID NO: 1863450 - RNA, 23 nt, Human
cccaggugcuaggaacacuccuu

SEQ ID NO: 1863451 - RNA, 22 nt, Human
cccaggugcuaggaacacuccu

SEQ ID NO: 1863452 - RNA, 22 nt, Human
ccagcucugguccauagagagc

SEQ ID NO: 1863453 - RNA, 21 nt, Human
ccagcucugguccauagagag

SEQ ID NO: 1863454 - RNA, 17 nt, Human
ccagcucugguccauag

SEQ ID NO: 1863455 - RNA, 14 nt, Human
ccagcucuggucca

SEQ ID NO: 1863456 - RNA, 24 nt, Human
ccagcuggagaaauaugguacuca

SEQ ID NO: 1863457 - RNA, 23 nt, Human
ccagcugcuugggcuucauccuc

SEQ ID NO: 1863458 - RNA, 20 nt, Human
ccagcugcuugggcuucauc

SEQ ID NO: 1863459 - RNA, 20 nt, Human
ccagccuugaccauucucca

SEQ ID NO: 1863460 - RNA, 19 nt, Human
ccagccuugaccauucucc

SEQ ID NO: 1863461 - RNA, 22 nt, Human
ccagagcccaccuuggcucaag

SEQ ID NO: 1863462 - RNA, 16 nt, Human
ccagagcccaccuugg

SEQ ID NO: 1863463 - RNA, 13 nt, Human
ccagcucuggucc

SEQ ID NO: 1863464 - RNA, 12 nt, Human
ccagcucugguc

SEQ ID NO: 1863465 - RNA, 11 nt, Human
ccagcucuggu

SEQ ID NO: 1863466 - RNA, 22 nt, Human
ccagccuugaccauucuccacc

SEQ ID NO: 1863467 - RNA, 14 nt, Human
ccagcgagcccugg

SEQ ID NO: 1863468 - RNA, 15 nt, Human
ccagcgagcccuggu

SEQ ID NO: 1863469 - RNA, 16 nt, Human
ccagcgagcccuggug

SEQ ID NO: 1863470 - RNA, 20 nt, Human
ccaggaagccagcaggcucu

SEQ ID NO: 1863471 - RNA, 22 nt, Human
ccaggaagccagcaggcucuca

SEQ ID NO: 1863472 - RNA, 23 nt, Human
ccagcuggggccaggcugggucg

SEQ ID NO: 1863473 - RNA, 22 nt, Human
ccagcuggggccaggcuggguc

SEQ ID NO: 1863474 - RNA, 21 nt, Human
ccagcuggggccaggcugggu

SEQ ID NO: 1863475 - RNA, 20 nt, Human
ccagcuggggccaggcuggg

SEQ ID NO: 1863476 - RNA, 19 nt, Human
ccagcuggggccaggcugg

SEQ ID NO: 1863477 - RNA, 18 nt, Human
ccagcuggggccaggcug

SEQ ID NO: 1863478 - RNA, 17 nt, Human
ccagcuggggccaggcu

SEQ ID NO: 1863479 - RNA, 14 nt, Human
ccaggcauucccca

SEQ ID NO: 1863480 - RNA, 17 nt, Human
ccaggcauuccccagga

SEQ ID NO: 1863481 - RNA, 13 nt, Human
ccaggcauggugg

SEQ ID NO: 1863482 - RNA, 22 nt, Human
ccaggcauuccccaggaggcca

SEQ ID NO: 1863483 - RNA, 23 nt, Human
ccaggcauuccccaggaggccag

SEQ ID NO: 1863484 - RNA, 24 nt, Human
ccaggcauuccccaggaggccagc

SEQ ID NO: 1863485 - RNA, 21 nt, Human
ccaggccacaagacccuugug

SEQ ID NO: 1863486 - RNA, 13 nt, Human
ccaggaggccagc

SEQ ID NO: 1863487 - RNA, 14 nt, Human
ccaggaggccagcc

SEQ ID NO: 1863488 - RNA, 12 nt, Human
ccaggaggccag

SEQ ID NO: 1863489 - RNA, 14 nt, Human
ccaggagccuccug

SEQ ID NO: 1863490 - RNA, 13 nt, Human
ccaggagccuccu

SEQ ID NO: 1863491 - RNA, 18 nt, Human
ccaggagccuccugcccu

SEQ ID NO: 1863492 - RNA, 19 nt, Human
ccaggagccuccugcccuu

SEQ ID NO: 1863493 - RNA, 16 nt, Human
ccaggagcagccacau

SEQ ID NO: 1863494 - RNA, 15 nt, Human
ccaggagcagccaca

SEQ ID NO: 1863495 - RNA, 15 nt, Human
ccaggagccccgagg

SEQ ID NO: 1863496 - RNA, 19 nt, Human
ccaggcuuuuuuaucaugu

SEQ ID NO: 1863497 - RNA, 12 nt, Human
ccagggaagggg

SEQ ID NO: 1863498 - RNA, 20 nt, Human
ccaggcuguaucccaugagc

SEQ ID NO: 1863499 - RNA, 21 nt, Human
ccaggcuggucucgaacuccu

SEQ ID NO: 1863500 - RNA, 19 nt, Human
ccaggcuggucucaaacuc

SEQ ID NO: 1863501 - RNA, 13 nt, Human
ccaggccccugcc

SEQ ID NO: 1863502 - RNA, 19 nt, Human
ccaggugcuaggaacacuc

SEQ ID NO: 1863503 - RNA, 20 nt, Human
ccagugaaaucaguuacucu

SEQ ID NO: 1863504 - RNA, 14 nt, Human
ccagguucagcuug

SEQ ID NO: 1863505 - RNA, 15 nt, Human
ccagguucagcuugu

SEQ ID NO: 1863506 - RNA, 20 nt, Human
ccauccucuguacagagccc

SEQ ID NO: 1863507 - RNA, 19 nt, Human
ccagugaggcucugcccuu

SEQ ID NO: 1863508 - RNA, 18 nt, Human
ccagugaggcucugcccu

SEQ ID NO: 1863509 - RNA, 20 nt, Human
ccagugaggcucugcccuug

SEQ ID NO: 1863510 - RNA, 23 nt, Human
ccauacuaauuauacccccugca

SEQ ID NO: 1863511 - RNA, 13 nt, Human
ccauacuaauuau

SEQ ID NO: 1863512 - RNA, 12 nt, Human
ccauacuaauua

SEQ ID NO: 1863513 - RNA, 13 nt, Human
ccaucaccagaca

SEQ ID NO: 1863514 - RNA, 19 nt, Human
ccauccucuguacagagcc

SEQ ID NO: 1863515 - RNA, 12 nt, Human
ccauccucugua

SEQ ID NO: 1863516 - RNA, 22 nt, Human
ccaucauugaaaucuuuuugcu

SEQ ID NO: 1863517 - RNA, 13 nt, Human
ccaugcugcccug

SEQ ID NO: 1863518 - RNA, 11 nt, Human
ccaugcugccc

SEQ ID NO: 1863519 - RNA, 14 nt, Human
ccaugcugcccugu

SEQ ID NO: 1863520 - RNA, 18 nt, Human
ccaugauguuuuccauga

SEQ ID NO: 1863521 - RNA, 21 nt, Human
ccaugauuaaccacuucagcu

SEQ ID NO: 1863522 - RNA, 19 nt, Human
ccaugauuaaccacuucag

SEQ ID NO: 1863523 - RNA, 14 nt, Human
ccaugaagauguag

SEQ ID NO: 1863524 - RNA, 21 nt, Human
cccacaaaggagagcuagcag

SEQ ID NO: 1863525 - RNA, 16 nt, Human
ccauucuccaccugcc

SEQ ID NO: 1863526 - RNA, 15 nt, Human
ccauucuccaccugc

SEQ ID NO: 1863527 - RNA, 14 nt, Human
ccauggacuuuguu

SEQ ID NO: 1863528 - RNA, 13 nt, Human
ccauggacuuugu

SEQ ID NO: 1863529 - RNA, 21 nt, Human
ccauucugccugcccaggccc

SEQ ID NO: 1863530 - RNA, 19 nt, Human
ccauucugccugcccaggc

SEQ ID NO: 1863531 - RNA, 20 nt, Human
ccauucugccugcccaggcc

SEQ ID NO: 1863532 - RNA, 16 nt, Human
ccauucugccugccca

SEQ ID NO: 1863533 - RNA, 17 nt, Human
ccauucuccaccugcca

SEQ ID NO: 1863534 - RNA, 17 nt, Human
ccauucugccugcccag

SEQ ID NO: 1863535 - RNA, 18 nt, Human
ccauucugccugcccagg

SEQ ID NO: 1863536 - RNA, 15 nt, Human
cccaaagaugcagcc

SEQ ID NO: 1863537 - RNA, 12 nt, Human
cccaaagaugca

SEQ ID NO: 1863538 - RNA, 16 nt, Human
cccaaagcagugcaug

SEQ ID NO: 1863539 - RNA, 22 nt, Human
ccauuuugggguacccacugcu

SEQ ID NO: 1863540 - RNA, 23 nt, Human
ccauuuuggauucuuauggacaa

SEQ ID NO: 1863541 - RNA, 20 nt, Human
ccauuuugggguacccacug

SEQ ID NO: 1863542 - RNA, 13 nt, Human
cccaaaaggcaga

SEQ ID NO: 1863543 - RNA, 18 nt, Human
cccaaaaggcagaagcaa

SEQ ID NO: 1863544 - RNA, 14 nt, Human
cgcagacaggacca

SEQ ID NO: 1863545 - RNA, 13 nt, Human
cgcagacaggacc

SEQ ID NO: 1863546 - RNA, 20 nt, Human
cgcccaggcuggagugcaau

SEQ ID NO: 1863547 - RNA, 19 nt, Human
cgcccaggcuggagugcaa

SEQ ID NO: 1863548 - RNA, 12 nt, Human
cgcccaggcugg

SEQ ID NO: 1863549 - RNA, 15 nt, Human
cgcccccacugguga

SEQ ID NO: 1863550 - RNA, 17 nt, Human
cgcgacaaugcaaacca

SEQ ID NO: 1863551 - RNA, 16 nt, Human
cgcgacaaugcaaacc

SEQ ID NO: 1863552 - RNA, 14 nt, Human
cgcuaagagggagg

SEQ ID NO: 1863553 - RNA, 16 nt, Human
cgcuaagagggaggga

SEQ ID NO: 1863554 - RNA, 15 nt, Human
cgcuaagagggaggg

SEQ ID NO: 1863555 - RNA, 21 nt, Human
cgcuaagagggagggagggcu

SEQ ID NO: 1863556 - RNA, 16 nt, Human
cgcgugcacacaccag

SEQ ID NO: 1863557 - RNA, 19 nt, Human
cgcgugcacacaccagagc

SEQ ID NO: 1863558 - RNA, 20 nt, Human
cgcgugcacacaccagagcc

SEQ ID NO: 1863559 - RNA, 15 nt, Human
ccuuuguauucucuc

SEQ ID NO: 1863560 - RNA, 18 nt, Human
ccuuuguauucucuccug

SEQ ID NO: 1863561 - RNA, 20 nt, Human
ccuuuguauucucuccugua

SEQ ID NO: 1863562 - RNA, 14 nt, Human
cgaggacagggagg

SEQ ID NO: 1863563 - RNA, 13 nt, Human
cgaggacagggag

SEQ ID NO: 1863564 - RNA, 12 nt, Human
cgaggacaggga

SEQ ID NO: 1863565 - RNA, 18 nt, Human
cgaggccuucucugaagg

SEQ ID NO: 1863566 - RNA, 19 nt, Human
cgaggccuucucugaagga

SEQ ID NO: 1863567 - RNA, 19 nt, Human
cgaucuggguucacugcaa

SEQ ID NO: 1863568 - RNA, 21 nt, Human
cgauucuucugcuucagccuc

SEQ ID NO: 1863569 - RNA, 13 nt, Human
cgauucuucugcu

SEQ ID NO: 1863570 - RNA, 19 nt, Human
cgauucuucugcuucagcc

SEQ ID NO: 1863571 - RNA, 12 nt, Human
cgauuucuguuu

SEQ ID NO: 1863572 - RNA, 11 nt, Human
cgcaaugugac

SEQ ID NO: 1863573 - RNA, 14 nt, Human
ccuuugacaaaggu

SEQ ID NO: 1863574 - RNA, 23 nt, Human
ccuuugacgccaucccagcccca

SEQ ID NO: 1863575 - RNA, 16 nt, Human
ccuuugcuugaaagaa

SEQ ID NO: 1863576 - RNA, 12 nt, Human
ccuuggcugcag

SEQ ID NO: 1863577 - RNA, 13 nt, Human
ccuuggcugcagg

SEQ ID NO: 1863578 - RNA, 19 nt, Human
ccuuguggucccaccccac

SEQ ID NO: 1863579 - RNA, 16 nt, Human
ccuuguggucccaccc

SEQ ID NO: 1863580 - RNA, 20 nt, Human
ccuuguggucccaccccaca

SEQ ID NO: 1863581 - RNA, 14 nt, Human
ccuuggcugcaggg

SEQ ID NO: 1863582 - RNA, 13 nt, Human
ccuuuaagagaaa

SEQ ID NO: 1863583 - RNA, 14 nt, Human
ccuuuaagagaaau

SEQ ID NO: 1863584 - RNA, 12 nt, Human
cgggcaugacac

SEQ ID NO: 1863585 - RNA, 15 nt, Human
cgggcaugacacgaa

SEQ ID NO: 1863586 - RNA, 17 nt, Human
cgggaggucgaggcagg

SEQ ID NO: 1863587 - RNA, 16 nt, Human
cgggaggucgaggcag

SEQ ID NO: 1863588 - RNA, 21 nt, Human
cgggaggauguucugggacac

SEQ ID NO: 1863589 - RNA, 21 nt, Human
cgggagccugaucaccugccc

SEQ ID NO: 1863590 - RNA, 22 nt, Human
cgggagccugaucaccugcccu

SEQ ID NO: 1863591 - RNA, 20 nt, Human
cgggaggauguucugggaca

SEQ ID NO: 1863592 - RNA, 19 nt, Human
cggcuggccuggccccuca

SEQ ID NO: 1863593 - RNA, 18 nt, Human
cggcuggccuggccccuc

SEQ ID NO: 1863594 - RNA, 16 nt, Human
cggcuggccuggcccc

SEQ ID NO: 1863595 - RNA, 15 nt, Human
cggcuggccuggccc

SEQ ID NO: 1863596 - RNA, 15 nt, Human
cggccuuuggcuuca

SEQ ID NO: 1863597 - RNA, 14 nt, Human
cggccucccaaagu

SEQ ID NO: 1863598 - RNA, 16 nt, Human
cggccuccauccugag

SEQ ID NO: 1863599 - RNA, 17 nt, Human
cggccuccauccugagg

SEQ ID NO: 1863600 - RNA, 20 nt, Human
cggaaugaaccacaucuugc

SEQ ID NO: 1863601 - RNA, 15 nt, Human
cggacagccacggcc

SEQ ID NO: 1863602 - RNA, 16 nt, Human
cggacagccacggcca

SEQ ID NO: 1863603 - RNA, 18 nt, Human
cggacagccacggccagg

SEQ ID NO: 1863604 - RNA, 17 nt, Human
cgcuauugucaccaggg

SEQ ID NO: 1863605 - RNA, 13 nt, Human
cgcuccugugucu

SEQ ID NO: 1863606 - RNA, 17 nt, Human
cggaaagcccugugcuc

SEQ ID NO: 1863607 - RNA, 20 nt, Human
cggacagccacggccaggcc

SEQ ID NO: 1863608 - RNA, 19 nt, Human
cggaucuuuggacagaagc

SEQ ID NO: 1863609 - RNA, 16 nt, Human
cggaucuuuggacaga

SEQ ID NO: 1863610 - RNA, 14 nt, Human
cgucauaacuagaa

SEQ ID NO: 1863611 - RNA, 16 nt, Human
cgucauaacuagaacu

SEQ ID NO: 1863612 - RNA, 17 nt, Human
cgucauaacuagaacug

SEQ ID NO: 1863613 - RNA, 21 nt, Human
cgucccccucuggcuccagcu

SEQ ID NO: 1863614 - RNA, 14 nt, Human
cgucccccucuggc

SEQ ID NO: 1863615 - RNA, 22 nt, Human
cguauaugucucaggucccugc

SEQ ID NO: 1863616 - RNA, 22 nt, Human
cguauaaaagccuguuuaagag

SEQ ID NO: 1863617 - RNA, 21 nt, Human
cguauaaaagccuguuuaaga

SEQ ID NO: 1863618 - RNA, 17 nt, Human
cguauaaaagccuguuu

SEQ ID NO: 1863619 - RNA, 16 nt, Human
cguauaaaagccuguu

SEQ ID NO: 1863620 - RNA, 23 nt, Human
cggugcuaucucccccagcccca

SEQ ID NO: 1863621 - RNA, 12 nt, Human
cgugacaacacu

SEQ ID NO: 1863622 - RNA, 20 nt, Human
cgugcacacaccagagccca

SEQ ID NO: 1863623 - RNA, 21 nt, Human
cgugcacacaccagagcccac

SEQ ID NO: 1863624 - RNA, 19 nt, Human
cgugcauaccacuuuuguu

SEQ ID NO: 1863625 - RNA, 14 nt, Human
cgugcauaccacuu

SEQ ID NO: 1863626 - RNA, 18 nt, Human
cgugcauaccacuuuugu

SEQ ID NO: 1863627 - RNA, 22 nt, Human
cgugcacacaccagagcccacc

SEQ ID NO: 1863628 - RNA, 14 nt, Human
cguccccugucccc

SEQ ID NO: 1863629 - RNA, 11 nt, Human
cguccccuguc

SEQ ID NO: 1863630 - RNA, 22 nt, Human
cgucccccucuggcuccagcug

SEQ ID NO: 1863631 - RNA, 14 nt, Human
cgucuaccugaggg

SEQ ID NO: 1863632 - RNA, 13 nt, Human
cgucugacaggca

SEQ ID NO: 1863633 - RNA, 14 nt, Human
cgucugacaggcaa

SEQ ID NO: 1863634 - RNA, 17 nt, Human
cguggcugcuucaagga

SEQ ID NO: 1863635 - RNA, 15 nt, Human
cguggcugcuucaag

SEQ ID NO: 1863636 - RNA, 14 nt, Human
cguggcugcuucaa

SEQ ID NO: 1863637 - RNA, 12 nt, Human
cguggcugcuuc

SEQ ID NO: 1863638 - RNA, 16 nt, Human
cgugccuggccacgcc

SEQ ID NO: 1863639 - RNA, 12 nt, Human
cgugccuggcca

SEQ ID NO: 1863640 - RNA, 18 nt, Human
cgugccuucagcucuaca

SEQ ID NO: 1863641 - RNA, 16 nt, Human
cgugccuucagcucua

SEQ ID NO: 1863642 - RNA, 15 nt, Human
cgugccuucagcucu

SEQ ID NO: 1863643 - RNA, 13 nt, Human
cgugccuucagcu

SEQ ID NO: 1863644 - RNA, 20 nt, Human
cguuucuaugacacaugcaa

SEQ ID NO: 1863645 - RNA, 19 nt, Human
cguuucuaaaggcuaccuu

SEQ ID NO: 1863646 - RNA, 21 nt, Human
cguuucuaaaggcuaccuuug

SEQ ID NO: 1863647 - RNA, 12 nt, Human
cguucucugccu

SEQ ID NO: 1863648 - RNA, 22 nt, Human
cguuccuucaaagcaaaugucu

SEQ ID NO: 1863649 - RNA, 19 nt, Human
ccuucagugccuuauggaa

SEQ ID NO: 1863650 - RNA, 15 nt, Human
ccuucagugccuuau

SEQ ID NO: 1863651 - RNA, 20 nt, Human
ccuucagugccuuauggaac

SEQ ID NO: 1863652 - RNA, 14 nt, Human
ccuucagugccuua

SEQ ID NO: 1863653 - RNA, 13 nt, Human
ccuucagugccuu

SEQ ID NO: 1863654 - RNA, 10 nt, Human
ccuucagugc

SEQ ID NO: 1863655 - RNA, 22 nt, Human
ccuuccaggggugggacacccu

SEQ ID NO: 1863656 - RNA, 18 nt, Human
ccuuccaggggugggaca

SEQ ID NO: 1863657 - RNA, 23 nt, Human
ccuuccaugucgccucugcauuc

SEQ ID NO: 1863658 - RNA, 21 nt, Human
ccuuccaugucgccucugcau

SEQ ID NO: 1863659 - RNA, 20 nt, Human
ccuuccaugucgccucugca

SEQ ID NO: 1863660 - RNA, 19 nt, Human
ccuuccaugucgccucugc

SEQ ID NO: 1863661 - RNA, 16 nt, Human
ccuuccagggguggga

SEQ ID NO: 1863662 - RNA, 15 nt, Human
ccuuccagggguggg

SEQ ID NO: 1863663 - RNA, 13 nt, Human
ccuucgccaccug

SEQ ID NO: 1863664 - RNA, 23 nt, Human
ccuucgauacaccgggccuggag

SEQ ID NO: 1863665 - RNA, 22 nt, Human
ccuucgauacaccgggccugga

SEQ ID NO: 1863666 - RNA, 20 nt, Human
ccuucgauacaccgggccug

SEQ ID NO: 1863667 - RNA, 15 nt, Human
ccuucgauacaccgg

SEQ ID NO: 1863668 - RNA, 14 nt, Human
ccuuccucuuucca

SEQ ID NO: 1863669 - RNA, 14 nt, Human
ccuuccucugaggc

SEQ ID NO: 1863670 - RNA, 17 nt, Human
ccuuagacagucccugc

SEQ ID NO: 1863671 - RNA, 16 nt, Human
ccuuagacagucccug

SEQ ID NO: 1863672 - RNA, 18 nt, Human
ccuuagaaccuuucuuac

SEQ ID NO: 1863673 - RNA, 16 nt, Human
ccuuagaaccuuucuu

SEQ ID NO: 1863674 - RNA, 15 nt, Human
ccuuagaaccuuucu

SEQ ID NO: 1863675 - RNA, 14 nt, Human
ccuuagaaccuuuc

SEQ ID NO: 1863676 - RNA, 19 nt, Human
ccuuagacagucccugcca

SEQ ID NO: 1863677 - RNA, 18 nt, Human
ccuuagacagucccugcc

SEQ ID NO: 1863678 - RNA, 21 nt, Human
ccuuagacagucccugccaau

SEQ ID NO: 1863679 - RNA, 14 nt, Human
ccuucaaccauucc

SEQ ID NO: 1863680 - RNA, 19 nt, Human
ccuucaaagcaaaugucuu

SEQ ID NO: 1863681 - RNA, 15 nt, Human
ccuucaaagcaaaug

SEQ ID NO: 1863682 - RNA, 14 nt, Human
ccuuaccugccagg

SEQ ID NO: 1863683 - RNA, 20 nt, Human
ccuuaccucggugccuuccu

SEQ ID NO: 1863684 - RNA, 16 nt, Human
ccuuaccagcagagca

SEQ ID NO: 1863685 - RNA, 15 nt, Human
ccuuaccagcagagc

SEQ ID NO: 1863686 - RNA, 17 nt, Human
ccuuaccagcagagcac

SEQ ID NO: 1863687 - RNA, 14 nt, Human
ccuuaccagcagag

SEQ ID NO: 1863688 - RNA, 20 nt, Human
ccuguggccaaguucuuagu

SEQ ID NO: 1863689 - RNA, 11 nt, Human
ccuuuggcuuc

SEQ ID NO: 1863690 - RNA, 13 nt, Human
ccuugacagggca

SEQ ID NO: 1863691 - RNA, 23 nt, Human
ccuugaguugauucagcucugca

SEQ ID NO: 1863692 - RNA, 22 nt, Human
ccuugaguugauucagcucugc

SEQ ID NO: 1863693 - RNA, 21 nt, Human
ccuugaccauucuccaccugc

SEQ ID NO: 1863694 - RNA, 22 nt, Human
ccuugaccauucuccaccugcc

SEQ ID NO: 1863695 - RNA, 14 nt, Human
ccuugacagggcac

SEQ ID NO: 1863696 - RNA, 20 nt, Human
ccuugaccauucuccaccug

SEQ ID NO: 1863697 - RNA, 19 nt, Human
ccuugaccauucuccaccu

SEQ ID NO: 1863698 - RNA, 15 nt, Human
ccuugacagggcaca

SEQ ID NO: 1863699 - RNA, 17 nt, Human
ccuugacagggcacacc

SEQ ID NO: 1863700 - RNA, 15 nt, Human
ccuugaaaacacugu

SEQ ID NO: 1863701 - RNA, 16 nt, Human
ccuucuuuuucuucuu

SEQ ID NO: 1863702 - RNA, 14 nt, Human
ccuucuuuuucuuc

SEQ ID NO: 1863703 - RNA, 13 nt, Human
ccuucgcuccugu

SEQ ID NO: 1863704 - RNA, 14 nt, Human
ccuucgcuccugug

SEQ ID NO: 1863705 - RNA, 15 nt, Human
ccuucgcuccugugu

SEQ ID NO: 1863706 - RNA, 18 nt, Human
ccuucgcuccugugucuu

SEQ ID NO: 1863707 - RNA, 21 nt, Human
ccuugaaaacacuguucucug

SEQ ID NO: 1863708 - RNA, 19 nt, Human
ccuugaaaacacuguucuc

SEQ ID NO: 1863709 - RNA, 22 nt, Human
ccuugaaaacacuguucucugc

SEQ ID NO: 1863710 - RNA, 14 nt, Human
ccuugaacugggua

SEQ ID NO: 1863711 - RNA, 19 nt, Human
ccuugaacuuugaccucug

SEQ ID NO: 1863712 - RNA, 17 nt, Human
ccuugaaugaugccaug

SEQ ID NO: 1863713 - RNA, 17 nt, Human
ccuugaacuuugaccuc

SEQ ID NO: 1863714 - RNA, 16 nt, Human
ccuugaacuggguacu

SEQ ID NO: 1863715 - RNA, 23 nt, Human
ccugcgucucauacucaccucac

SEQ ID NO: 1863716 - RNA, 16 nt, Human
ccugcaaccugauugu

SEQ ID NO: 1863717 - RNA, 19 nt, Human
ccugcaacaccuuguuucc

SEQ ID NO: 1863718 - RNA, 19 nt, Human
ccugcaaagcccagcuuga

SEQ ID NO: 1863719 - RNA, 18 nt, Human
ccugcaacaccuuguuuc

SEQ ID NO: 1863720 - RNA, 22 nt, Human
ccugcuccagcuguucagcugg

SEQ ID NO: 1863721 - RNA, 14 nt, Human
ccugcuccagcugu

SEQ ID NO: 1863722 - RNA, 13 nt, Human
ccugcuccagcug

SEQ ID NO: 1863723 - RNA, 12 nt, Human
ccugcuccagcu

SEQ ID NO: 1863724 - RNA, 17 nt, Human
ccugcuaauuccccaga

SEQ ID NO: 1863725 - RNA, 17 nt, Human
ccugcuuugggcugccc

SEQ ID NO: 1863726 - RNA, 18 nt, Human
ccugcuuugggcugcccu

SEQ ID NO: 1863727 - RNA, 20 nt, Human
ccugcuuuuuauggccugug

SEQ ID NO: 1863728 - RNA, 13 nt, Human
ccugcugguucag

SEQ ID NO: 1863729 - RNA, 19 nt, Human
ccugcugguucaggguugg

SEQ ID NO: 1863730 - RNA, 14 nt, Human
ccuggacccugugg

SEQ ID NO: 1863731 - RNA, 13 nt, Human
ccuggacccugug

SEQ ID NO: 1863732 - RNA, 20 nt, Human
ccuggacugugugcucagga

SEQ ID NO: 1863733 - RNA, 17 nt, Human
ccuggacugugugcuca

SEQ ID NO: 1863734 - RNA, 14 nt, Human
ccuggacuccugca

SEQ ID NO: 1863735 - RNA, 17 nt, Human
ccuggcacugcuuccag

SEQ ID NO: 1863736 - RNA, 20 nt, Human
ccuggcacugcuuccaguga

SEQ ID NO: 1863737 - RNA, 17 nt, Human
ccuggcaugggaaugaa

SEQ ID NO: 1863738 - RNA, 16 nt, Human
ccuggcaugggaauga

SEQ ID NO: 1863739 - RNA, 19 nt, Human
ccuggcagccgugccuuca

SEQ ID NO: 1863740 - RNA, 18 nt, Human
ccuggcagccgugccuuc

SEQ ID NO: 1863741 - RNA, 12 nt, Human
ccuggcagccgu

SEQ ID NO: 1863742 - RNA, 16 nt, Human
ccuggcagccccuguu

SEQ ID NO: 1863743 - RNA, 21 nt, Human
ccuggcacugcuuccagugag

SEQ ID NO: 1863744 - RNA, 20 nt, Human
ccugggaucccucauccuca

SEQ ID NO: 1863745 - RNA, 16 nt, Human
ccugggaucccucauc

SEQ ID NO: 1863746 - RNA, 20 nt, Human
ccugggaggucaaggcugca

SEQ ID NO: 1863747 - RNA, 21 nt, Human
ccugggaggcucuggagccca

SEQ ID NO: 1863748 - RNA, 13 nt, Human
ccugggaggcucu

SEQ ID NO: 1863749 - RNA, 13 nt, Human
ccugggaggcagu

SEQ ID NO: 1863750 - RNA, 14 nt, Human
ccugggcagaagga

SEQ ID NO: 1863751 - RNA, 12 nt, Human
ccugggcagaag

SEQ ID NO: 1863752 - RNA, 16 nt, Human
ccuggccccucagggu

SEQ ID NO: 1863753 - RNA, 14 nt, Human
ccuggccccucagg

SEQ ID NO: 1863754 - RNA, 12 nt, Human
ccuggcggggug

SEQ ID NO: 1863755 - RNA, 20 nt, Human
ccuggcuccaaacccucgag

SEQ ID NO: 1863756 - RNA, 23 nt, Human
ccuggcaugggaaugaaugucag

SEQ ID NO: 1863757 - RNA, 18 nt, Human
ccuggcaugggaaugaau

SEQ ID NO: 1863758 - RNA, 23 nt, Human
ccuguagagugggagcugagugg

SEQ ID NO: 1863759 - RNA, 19 nt, Human
ccuguagagugggagcuga

SEQ ID NO: 1863760 - RNA, 21 nt, Human
ccuguagagugggagcugagu

SEQ ID NO: 1863761 - RNA, 20 nt, Human
ccuguaauccuagcacuuug

SEQ ID NO: 1863762 - RNA, 18 nt, Human
ccugguggcagcucaccu

SEQ ID NO: 1863763 - RNA, 17 nt, Human
ccugguggcagcucacc

SEQ ID NO: 1863764 - RNA, 16 nt, Human
ccugguggcagcucac

SEQ ID NO: 1863765 - RNA, 14 nt, Human
ccugguggcagcuc

SEQ ID NO: 1863766 - RNA, 12 nt, Human
ccugguggcagc

SEQ ID NO: 1863767 - RNA, 13 nt, Human
ccugguggcagcu

SEQ ID NO: 1863768 - RNA, 15 nt, Human
ccuggugcugccaca

SEQ ID NO: 1863769 - RNA, 21 nt, Human
ccuggugcugccacacuucag

SEQ ID NO: 1863770 - RNA, 18 nt, Human
ccuggugcugccacacuu

SEQ ID NO: 1863771 - RNA, 18 nt, Human
ccuguccccgcacugggc

SEQ ID NO: 1863772 - RNA, 17 nt, Human
ccugucccccugacaac

SEQ ID NO: 1863773 - RNA, 16 nt, Human
ccugucccccugacaa

SEQ ID NO: 1863774 - RNA, 20 nt, Human
ccugugaguacuacaguccu

SEQ ID NO: 1863775 - RNA, 22 nt, Human
ccugugagcuaggaauuguguu

SEQ ID NO: 1863776 - RNA, 19 nt, Human
ccugugauggggcccugcc

SEQ ID NO: 1863777 - RNA, 18 nt, Human
ccugugauggggcccugc

SEQ ID NO: 1863778 - RNA, 17 nt, Human
ccugugauggggcccug

SEQ ID NO: 1863779 - RNA, 21 nt, Human
ccugugauggggcccugccuc

SEQ ID NO: 1863780 - RNA, 20 nt, Human
ccugugauggggcccugccu

SEQ ID NO: 1863781 - RNA, 22 nt, Human
ccugugauggggcccugccucc

SEQ ID NO: 1863782 - RNA, 17 nt, Human
ccugugccucugggacu

SEQ ID NO: 1863783 - RNA, 15 nt, Human
ccugugccucuggga

SEQ ID NO: 1863784 - RNA, 19 nt, Human
ccugugccucugggacugg

SEQ ID NO: 1863785 - RNA, 21 nt, Human
ccucugcacuccccugcuggg

SEQ ID NO: 1863786 - RNA, 20 nt, Human
ccucugcacuccccugcugg

SEQ ID NO: 1863787 - RNA, 15 nt, Human
ccucugcacuccccu

SEQ ID NO: 1863788 - RNA, 19 nt, Human
ccucugcacuccccugcug

SEQ ID NO: 1863789 - RNA, 14 nt, Human
ccucugcacucccc

SEQ ID NO: 1863790 - RNA, 22 nt, Human
ccucugcacuccccugcugggu

SEQ ID NO: 1863791 - RNA, 19 nt, Human
ccucugcacaagcugcacc

SEQ ID NO: 1863792 - RNA, 17 nt, Human
ccucugcacaagcugca

SEQ ID NO: 1863793 - RNA, 20 nt, Human
ccucugcacaagcugcaccc

SEQ ID NO: 1863794 - RNA, 15 nt, Human
ccucugcacaagcug

SEQ ID NO: 1863795 - RNA, 11 nt, Human
ccucugcacaa

SEQ ID NO: 1863796 - RNA, 17 nt, Human
ccucugacacacagcuc

SEQ ID NO: 1863797 - RNA, 18 nt, Human
ccucugacacacagcucu

SEQ ID NO: 1863798 - RNA, 17 nt, Human
ccucuggcuccagcugg

SEQ ID NO: 1863799 - RNA, 16 nt, Human
ccucuggcuccagcug

SEQ ID NO: 1863800 - RNA, 12 nt, Human
ccucugggacug

SEQ ID NO: 1863801 - RNA, 20 nt, Human
ccuccuuaucaaaggacacc

SEQ ID NO: 1863802 - RNA, 18 nt, Human
ccuccuuaucaaaggaca

SEQ ID NO: 1863803 - RNA, 23 nt, Human
ccuccugugugugcgccuacagg

SEQ ID NO: 1863804 - RNA, 12 nt, Human
ccucucccauca

SEQ ID NO: 1863805 - RNA, 16 nt, Human
ccucuccacugccuuc

SEQ ID NO: 1863806 - RNA, 14 nt, Human
ccucuccacugccu

SEQ ID NO: 1863807 - RNA, 13 nt, Human
ccucuccacugcc

SEQ ID NO: 1863808 - RNA, 12 nt, Human
ccucuccacugc

SEQ ID NO: 1863809 - RNA, 19 nt, Human
ccucuccacugccuucgau

SEQ ID NO: 1863810 - RNA, 23 nt, Human
ccucugaaaaccaauguucucuc

SEQ ID NO: 1863811 - RNA, 16 nt, Human
ccucugacacacagcu

SEQ ID NO: 1863812 - RNA, 13 nt, Human
ccucucugcccua

SEQ ID NO: 1863813 - RNA, 17 nt, Human
ccuccugggaaugaagc

SEQ ID NO: 1863814 - RNA, 13 nt, Human
ccuccuggacucc

SEQ ID NO: 1863815 - RNA, 13 nt, Human
ccuccugggcuaa

SEQ ID NO: 1863816 - RNA, 13 nt, Human
ccuccugugugug

SEQ ID NO: 1863817 - RNA, 15 nt, Human
ccuccugugugugcg

SEQ ID NO: 1863818 - RNA, 22 nt, Human
ccuccugugugugcgccuacag

SEQ ID NO: 1863819 - RNA, 14 nt, Human
ccuccuccuggacu

SEQ ID NO: 1863820 - RNA, 13 nt, Human
ccuccugccucga

SEQ ID NO: 1863821 - RNA, 16 nt, Human
ccucccucccucuuuc

SEQ ID NO: 1863822 - RNA, 15 nt, Human
ccucccucccucuuu

SEQ ID NO: 1863823 - RNA, 13 nt, Human
ccucccucccucu

SEQ ID NO: 1863824 - RNA, 16 nt, Human
ccucccggugcccaag

SEQ ID NO: 1863825 - RNA, 13 nt, Human
ccucccggugccc

SEQ ID NO: 1863826 - RNA, 14 nt, Human
ccucagucucccuc

SEQ ID NO: 1863827 - RNA, 15 nt, Human
ccucagucuggcccu

SEQ ID NO: 1863828 - RNA, 15 nt, Human
ccucagggucccugg

SEQ ID NO: 1863829 - RNA, 21 nt, Human
ccucagguaaucgaccugccu

SEQ ID NO: 1863830 - RNA, 16 nt, Human
ccucaggugagaagca

SEQ ID NO: 1863831 - RNA, 23 nt, Human
ccucagguaaucgaccugccucg

SEQ ID NO: 1863832 - RNA, 22 nt, Human
ccucagguaaucgaccugccuc

SEQ ID NO: 1863833 - RNA, 22 nt, Human
ccucaggugauccacccaccuc

SEQ ID NO: 1863834 - RNA, 17 nt, Human
ccucaggugauccaccc

SEQ ID NO: 1863835 - RNA, 19 nt, Human
ccucaggugauccacccac

SEQ ID NO: 1863836 - RNA, 21 nt, Human
ccucaggccugggggcugggc

SEQ ID NO: 1863837 - RNA, 14 nt, Human
ccucaggccugggg

SEQ ID NO: 1863838 - RNA, 11 nt, Human
ccucaggccug

SEQ ID NO: 1863839 - RNA, 14 nt, Human
ccucagggucccug

SEQ ID NO: 1863840 - RNA, 23 nt, Human
ccucaggccugggggcugggcag

SEQ ID NO: 1863841 - RNA, 16 nt, Human
ccucagcauccuggca

SEQ ID NO: 1863842 - RNA, 17 nt, Human
ccucagcauccuggcac

SEQ ID NO: 1863843 - RNA, 14 nt, Human
ccucagcauccugg

SEQ ID NO: 1863844 - RNA, 21 nt, Human
ccucacuaucccggcugcccu

SEQ ID NO: 1863845 - RNA, 21 nt, Human
ccucacuaggcuucugguuga

SEQ ID NO: 1863846 - RNA, 22 nt, Human
ccucacuaucccggcugcccuu

SEQ ID NO: 1863847 - RNA, 20 nt, Human
ccugaggcccuucucuccag

SEQ ID NO: 1863848 - RNA, 19 nt, Human
ccugaggcccuucucucca

SEQ ID NO: 1863849 - RNA, 17 nt, Human
ccugaggcccuucucuc

SEQ ID NO: 1863850 - RNA, 16 nt, Human
ccugaggcccuucucu

SEQ ID NO: 1863851 - RNA, 22 nt, Human
ccugaggcccuucucuccagcc

SEQ ID NO: 1863852 - RNA, 21 nt, Human
ccugaggcccuucucuccagc

SEQ ID NO: 1863853 - RNA, 23 nt, Human
ccugaggcccuucucuccagccc

SEQ ID NO: 1863854 - RNA, 16 nt, Human
ccugacaacacucauu

SEQ ID NO: 1863855 - RNA, 15 nt, Human
ccugacaacacucau

SEQ ID NO: 1863856 - RNA, 14 nt, Human
ccugacaacacuca

SEQ ID NO: 1863857 - RNA, 12 nt, Human
ccugacaacacu

SEQ ID NO: 1863858 - RNA, 14 nt, Human
ccugaggcccagag

SEQ ID NO: 1863859 - RNA, 13 nt, Human
ccugaggcccaga

SEQ ID NO: 1863860 - RNA, 12 nt, Human
ccugaggcccag

SEQ ID NO: 1863861 - RNA, 18 nt, Human
ccugaggcuccacuuggu

SEQ ID NO: 1863862 - RNA, 20 nt, Human
ccugaggcuccacuuggucu

SEQ ID NO: 1863863 - RNA, 14 nt, Human
ccugaugcuucuuc

SEQ ID NO: 1863864 - RNA, 18 nt, Human
ccugaugcuucuucagag

SEQ ID NO: 1863865 - RNA, 17 nt, Human
ccugaugcuucuucaga

SEQ ID NO: 1863866 - RNA, 23 nt, Human
ccugauugugucucuugguccug

SEQ ID NO: 1863867 - RNA, 23 nt, Human
ccucuguacagagcccacgcccc

SEQ ID NO: 1863868 - RNA, 18 nt, Human
ccucuguacagagcccac

SEQ ID NO: 1863869 - RNA, 17 nt, Human
ccucuguacagagccca

SEQ ID NO: 1863870 - RNA, 16 nt, Human
ccucuguacagagccc

SEQ ID NO: 1863871 - RNA, 15 nt, Human
ccucuguacagagcc

SEQ ID NO: 1863872 - RNA, 14 nt, Human
ccucuguacagagc

SEQ ID NO: 1863873 - RNA, 17 nt, Human
ccucuguccaggcacug

SEQ ID NO: 1863874 - RNA, 14 nt, Human
ccucuuaugggcug

SEQ ID NO: 1863875 - RNA, 16 nt, Human
ccucuuaugggcuggg

SEQ ID NO: 1863876 - RNA, 15 nt, Human
ccucuuaugggcugg

SEQ ID NO: 1863877 - RNA, 14 nt, Human
ccucuuagaaaaac

SEQ ID NO: 1863878 - RNA, 21 nt, Human
ccucuguucugcacacagcac

SEQ ID NO: 1863879 - RNA, 17 nt, Human
ccucuuaugggcugggu

SEQ ID NO: 1863880 - RNA, 19 nt, Human
ccucuuccucccucauucc

SEQ ID NO: 1863881 - RNA, 16 nt, Human
ccucuuccucccucau

SEQ ID NO: 1863882 - RNA, 15 nt, Human
ccucuuccucccuca

SEQ ID NO: 1863883 - RNA, 22 nt, Human
ccucuuuggucuacacugugcu

SEQ ID NO: 1863884 - RNA, 23 nt, Human
ccugaaagaggaaugaaguacuc

SEQ ID NO: 1863885 - RNA, 18 nt, Human
ccugaaagaggaaugaag

SEQ ID NO: 1863886 - RNA, 23 nt, Human
ccugaagcuaucguaaaauuaag

SEQ ID NO: 1863887 - RNA, 22 nt, Human
ccugaagcuaucguaaaauuaa

SEQ ID NO: 1863888 - RNA, 20 nt, Human
ccugaagcuaucguaaaauu

SEQ ID NO: 1863889 - RNA, 21 nt, Human
ccugaagacucauucuucugu

SEQ ID NO: 1863890 - RNA, 13 nt, Human
ccugaaggccccg

SEQ ID NO: 1863891 - RNA, 15 nt, Human
ccugaagucacacag

SEQ ID NO: 1863892 - RNA, 16 nt, Human
ccugaagucacacagu

SEQ ID NO: 1863893 - RNA, 17 nt, Human
ccugaagucacacagug

SEQ ID NO: 1863894 - RNA, 20 nt, Human
ccccucagggucccuggugg

SEQ ID NO: 1863895 - RNA, 18 nt, Human
ccccucagggucccuggu

SEQ ID NO: 1863896 - RNA, 17 nt, Human
ccccucagggucccugg

SEQ ID NO: 1863897 - RNA, 21 nt, Human
cccugguuuccugcccuggga

SEQ ID NO: 1863898 - RNA, 21 nt, Human
cccugguggcagugggagcug

SEQ ID NO: 1863899 - RNA, 16 nt, Human
cccugguggcaguggg

SEQ ID NO: 1863900 - RNA, 19 nt, Human
cccugguggcagugggagc

SEQ ID NO: 1863901 - RNA, 16 nt, Human
cccugugggcccccaa

SEQ ID NO: 1863902 - RNA, 21 nt, Human
cccuguagagugggagcugag

SEQ ID NO: 1863903 - RNA, 23 nt, Human
cccugguuuccugcccugggagg

SEQ ID NO: 1863904 - RNA, 22 nt, Human
cccugguuuccugcccugggag

SEQ ID NO: 1863905 - RNA, 18 nt, Human
cccugugggcccccaaau

SEQ ID NO: 1863906 - RNA, 15 nt, Human
cccuguuuguuucug

SEQ ID NO: 1863907 - RNA, 16 nt, Human
cccuguuuguuucuga

SEQ ID NO: 1863908 - RNA, 21 nt, Human
cccccgcugucagccauuccu

SEQ ID NO: 1863909 - RNA, 16 nt, Human
cccccucugcccugcg

SEQ ID NO: 1863910 - RNA, 14 nt, Human
cccccucugcccug

SEQ ID NO: 1863911 - RNA, 13 nt, Human
cccccucugcccu

SEQ ID NO: 1863912 - RNA, 21 nt, Human
ccccgucucugguuccucccc

SEQ ID NO: 1863913 - RNA, 20 nt, Human
ccccgucccccucuggcucc

SEQ ID NO: 1863914 - RNA, 16 nt, Human
ccccgucccccucugg

SEQ ID NO: 1863915 - RNA, 16 nt, Human
cccccaucucuucugg

SEQ ID NO: 1863916 - RNA, 12 nt, Human
cccccagcccca

SEQ ID NO: 1863917 - RNA, 14 nt, Human
ccccacuggugaca

SEQ ID NO: 1863918 - RNA, 13 nt, Human
ccccacuggugac

SEQ ID NO: 1863919 - RNA, 12 nt, Human
ccccacugguga

SEQ ID NO: 1863920 - RNA, 23 nt, Human
cccccaaccaaguggcucccaca

SEQ ID NO: 1863921 - RNA, 22 nt, Human
ccccaggaggccagccuugacc

SEQ ID NO: 1863922 - RNA, 21 nt, Human
ccccaggaggccagccuugac

SEQ ID NO: 1863923 - RNA, 15 nt, Human
ccccaggaggccagc

SEQ ID NO: 1863924 - RNA, 14 nt, Human
ccccaggaggccag

SEQ ID NO: 1863925 - RNA, 13 nt, Human
ccccaggaggcca

SEQ ID NO: 1863926 - RNA, 13 nt, Human
cccuuuucuguuu

SEQ ID NO: 1863927 - RNA, 11 nt, Human
cccuuuuccuu

SEQ ID NO: 1863928 - RNA, 18 nt, Human
cccuuuuuuggcugcuga

SEQ ID NO: 1863929 - RNA, 17 nt, Human
cccuuuuuuggcugcug

SEQ ID NO: 1863930 - RNA, 22 nt, Human
ccgagauagccaaggccaaagg

SEQ ID NO: 1863931 - RNA, 19 nt, Human
ccgagauagccaaggccaa

SEQ ID NO: 1863932 - RNA, 17 nt, Human
ccgagaaggaagccucc

SEQ ID NO: 1863933 - RNA, 19 nt, Human
cccuuuuuuggcugcugaa

SEQ ID NO: 1863934 - RNA, 22 nt, Human
ccgagucucuucuccacuggau

SEQ ID NO: 1863935 - RNA, 19 nt, Human
ccgagccuggcuccaaacc

SEQ ID NO: 1863936 - RNA, 16 nt, Human
ccgagccuggcuccaa

SEQ ID NO: 1863937 - RNA, 18 nt, Human
ccgagaucacgccacugc

SEQ ID NO: 1863938 - RNA, 16 nt, Human
cccuuguggucccacc

SEQ ID NO: 1863939 - RNA, 14 nt, Human
cccuugugguccca

SEQ ID NO: 1863940 - RNA, 18 nt, Human
cccuuggggagcaggcuc

SEQ ID NO: 1863941 - RNA, 18 nt, Human
cccuuguggucccacccc

SEQ ID NO: 1863942 - RNA, 20 nt, Human
cccuuguggucccaccccac

SEQ ID NO: 1863943 - RNA, 20 nt, Human
cccuuugacgccaucccagc

SEQ ID NO: 1863944 - RNA, 22 nt, Human
cccuuucugggcaccggggccu

SEQ ID NO: 1863945 - RNA, 18 nt, Human
cccuugccgucuaccuga

SEQ ID NO: 1863946 - RNA, 17 nt, Human
cccuugccgucuaccug

SEQ ID NO: 1863947 - RNA, 22 nt, Human
cccuugccgucuaccugagggg

SEQ ID NO: 1863948 - RNA, 20 nt, Human
cccuuccucuccacugccuu

SEQ ID NO: 1863949 - RNA, 17 nt, Human
cccuuccucuccacugc

SEQ ID NO: 1863950 - RNA, 16 nt, Human
cccuuccucuccacug

SEQ ID NO: 1863951 - RNA, 19 nt, Human
cccuuaccucggugccuuc

SEQ ID NO: 1863952 - RNA, 21 nt, Human
cccuuaccacugcucugauga

SEQ ID NO: 1863953 - RNA, 17 nt, Human
cccuuaccacugcucug

SEQ ID NO: 1863954 - RNA, 13 nt, Human
cccuuccucucca

SEQ ID NO: 1863955 - RNA, 12 nt, Human
ccuaccugguaa

SEQ ID NO: 1863956 - RNA, 17 nt, Human
ccuaauuccacagcugc

SEQ ID NO: 1863957 - RNA, 16 nt, Human
ccuaauuccacagcug

SEQ ID NO: 1863958 - RNA, 15 nt, Human
ccuaauuccacagcu

SEQ ID NO: 1863959 - RNA, 14 nt, Human
ccuaauuccacagc

SEQ ID NO: 1863960 - RNA, 13 nt, Human
ccuaauuccacag

SEQ ID NO: 1863961 - RNA, 14 nt, Human
ccuaaaguguauuu

SEQ ID NO: 1863962 - RNA, 12 nt, Human
ccuaaagagaua

SEQ ID NO: 1863963 - RNA, 23 nt, Human
ccguggcuucccgcucagcccuc

SEQ ID NO: 1863964 - RNA, 21 nt, Human
ccguggcuucccgcucagccc

SEQ ID NO: 1863965 - RNA, 15 nt, Human
ccguggcuucccgcu

SEQ ID NO: 1863966 - RNA, 17 nt, Human
ccgugccuucagcucua

SEQ ID NO: 1863967 - RNA, 16 nt, Human
ccgugccuucagcucu

SEQ ID NO: 1863968 - RNA, 15 nt, Human
ccgugccuucagcuc

SEQ ID NO: 1863969 - RNA, 14 nt, Human
ccgugccuucagcu

SEQ ID NO: 1863970 - RNA, 19 nt, Human
ccgggccuggagaacuaga

SEQ ID NO: 1863971 - RNA, 20 nt, Human
ccgggcacucagaagacacu

SEQ ID NO: 1863972 - RNA, 12 nt, Human
ccggcuggccug

SEQ ID NO: 1863973 - RNA, 12 nt, Human
ccggcugcccuu

SEQ ID NO: 1863974 - RNA, 22 nt, Human
ccgggaggcagagguugcagug

SEQ ID NO: 1863975 - RNA, 13 nt, Human
ccggcuggccugg

SEQ ID NO: 1863976 - RNA, 15 nt, Human
ccgggcacucagaag

SEQ ID NO: 1863977 - RNA, 23 nt, Human
ccgcuuucuacccagcgagcccu

SEQ ID NO: 1863978 - RNA, 17 nt, Human
ccucaccuuucccaucu

SEQ ID NO: 1863979 - RNA, 12 nt, Human
ccucaccccacu

SEQ ID NO: 1863980 - RNA, 22 nt, Human
ccucacaguccuuaccagcaga

SEQ ID NO: 1863981 - RNA, 20 nt, Human
ccucacaguccuuaccagca

SEQ ID NO: 1863982 - RNA, 15 nt, Human
ccucaccccacugug

SEQ ID NO: 1863983 - RNA, 17 nt, Human
ccuaucagaaguuucuc

SEQ ID NO: 1863984 - RNA, 17 nt, Human
ccucacaguccuuacca

SEQ ID NO: 1863985 - RNA, 16 nt, Human
cugcccugcccaccug

SEQ ID NO: 1863986 - RNA, 15 nt, Human
cugcccugcccaccu

SEQ ID NO: 1863987 - RNA, 14 nt, Human
cugcccugcccacc

SEQ ID NO: 1863988 - RNA, 13 nt, Human
cugcccugcccac

SEQ ID NO: 1863989 - RNA, 11 nt, Human
cugcccggcug

SEQ ID NO: 1863990 - RNA, 19 nt, Human
cugcccuccaagaccuucu

SEQ ID NO: 1863991 - RNA, 15 nt, Human
cugcccggcugcgga

SEQ ID NO: 1863992 - RNA, 17 nt, Human
cugccccuggcagcccc

SEQ ID NO: 1863993 - RNA, 16 nt, Human
cugccccuggcagccc

SEQ ID NO: 1863994 - RNA, 15 nt, Human
cugccccuggcagcc

SEQ ID NO: 1863995 - RNA, 14 nt, Human
cugccccuggcagc

SEQ ID NO: 1863996 - RNA, 18 nt, Human
cugcccaggccugccugu

SEQ ID NO: 1863997 - RNA, 19 nt, Human
cugcccaggccugccuguu

SEQ ID NO: 1863998 - RNA, 19 nt, Human
cugcccaaccugcucuccu

SEQ ID NO: 1863999 - RNA, 13 nt, Human
cugcccaggcccc

SEQ ID NO: 1864000 - RNA, 17 nt, Human
cugcccaaccugcucuc

SEQ ID NO: 1864001 - RNA, 16 nt, Human
cugccauuucugagau

SEQ ID NO: 1864002 - RNA, 19 nt, Human
cugccaggaagccagcagg

SEQ ID NO: 1864003 - RNA, 18 nt, Human
cugccaggaagccagcag

SEQ ID NO: 1864004 - RNA, 16 nt, Human
cugccaggaagccagc

SEQ ID NO: 1864005 - RNA, 15 nt, Human
cugccaggaagccag

SEQ ID NO: 1864006 - RNA, 19 nt, Human
cugccagccgagauagcca

SEQ ID NO: 1864007 - RNA, 19 nt, Human
cugccaugccagcuuaucu

SEQ ID NO: 1864008 - RNA, 17 nt, Human
cugccaugccagcuuau

SEQ ID NO: 1864009 - RNA, 22 nt, Human
cugccacacuucaggcucuucu

SEQ ID NO: 1864010 - RNA, 17 nt, Human
cugccacacuucaggcu

SEQ ID NO: 1864011 - RNA, 13 nt, Human
cugccacacuuca

SEQ ID NO: 1864012 - RNA, 19 nt, Human
cugccaccacgcccggcua

SEQ ID NO: 1864013 - RNA, 15 nt, Human
cugccacccugggga

SEQ ID NO: 1864014 - RNA, 16 nt, Human
cugccacccuggggag

SEQ ID NO: 1864015 - RNA, 20 nt, Human
cugccacccuggggagaaag

SEQ ID NO: 1864016 - RNA, 20 nt, Human
cugcggaaugaaccacaucu

SEQ ID NO: 1864017 - RNA, 15 nt, Human
cugcgguccacccag

SEQ ID NO: 1864018 - RNA, 21 nt, Human
cugcggaaugaaccacaucuu

SEQ ID NO: 1864019 - RNA, 17 nt, Human
cugcgguccacccagga

SEQ ID NO: 1864020 - RNA, 16 nt, Human
cugcgguccacccagg

SEQ ID NO: 1864021 - RNA, 14 nt, Human
cugcuccagcuguu

SEQ ID NO: 1864022 - RNA, 15 nt, Human
cugcuccagcuguuc

SEQ ID NO: 1864023 - RNA, 16 nt, Human
cugcuccucuccccag

SEQ ID NO: 1864024 - RNA, 17 nt, Human
cugcuccucuccccagc

SEQ ID NO: 1864025 - RNA, 18 nt, Human
cugcuccucuccccagca

SEQ ID NO: 1864026 - RNA, 14 nt, Human
cugccucuucucua

SEQ ID NO: 1864027 - RNA, 13 nt, Human
cugccucuucucu

SEQ ID NO: 1864028 - RNA, 12 nt, Human
cugccucuuccu

SEQ ID NO: 1864029 - RNA, 14 nt, Human
cugccucucugcag

SEQ ID NO: 1864030 - RNA, 13 nt, Human
cugccucucugca

SEQ ID NO: 1864031 - RNA, 12 nt, Human
cugccucucugc

SEQ ID NO: 1864032 - RNA, 13 nt, Human
cugccugcccagg

SEQ ID NO: 1864033 - RNA, 14 nt, Human
cugccugcccaggc

SEQ ID NO: 1864034 - RNA, 15 nt, Human
cugccugcccaggcc

SEQ ID NO: 1864035 - RNA, 15 nt, Human
cugccuaagugcagc

SEQ ID NO: 1864036 - RNA, 13 nt, Human
cugccuauuuuaa

SEQ ID NO: 1864037 - RNA, 22 nt, Human
cugcccugggaggcagugaugg

SEQ ID NO: 1864038 - RNA, 15 nt, Human
cugcccugggaggca

SEQ ID NO: 1864039 - RNA, 11 nt, Human
cugcccuggga

SEQ ID NO: 1864040 - RNA, 13 nt, Human
cugcccugggagg

SEQ ID NO: 1864041 - RNA, 12 nt, Human
cugcccugggag

SEQ ID NO: 1864042 - RNA, 14 nt, Human
cugccucagccucc

SEQ ID NO: 1864043 - RNA, 13 nt, Human
cugccucagccuc

SEQ ID NO: 1864044 - RNA, 17 nt, Human
cugcagggacugccagu

SEQ ID NO: 1864045 - RNA, 15 nt, Human
cugcagggacugcca

SEQ ID NO: 1864046 - RNA, 16 nt, Human
cugcagggccaagcac

SEQ ID NO: 1864047 - RNA, 22 nt, Human
cugcagggaguccgaaagggac

SEQ ID NO: 1864048 - RNA, 22 nt, Human
cugcagccucaaccuccugggc

SEQ ID NO: 1864049 - RNA, 19 nt, Human
cugcagccucaaccuccug

SEQ ID NO: 1864050 - RNA, 20 nt, Human
cugcagccucaaccuccugg

SEQ ID NO: 1864051 - RNA, 11 nt, Human
cugcagccuca

SEQ ID NO: 1864052 - RNA, 20 nt, Human
cugcaccggcuggccuggcc

SEQ ID NO: 1864053 - RNA, 19 nt, Human
cugcaccggcuggccuggc

SEQ ID NO: 1864054 - RNA, 18 nt, Human
cugcaccggcuggccugg

SEQ ID NO: 1864055 - RNA, 17 nt, Human
cugcaccggcuggccug

SEQ ID NO: 1864056 - RNA, 14 nt, Human
cugcacuugcagac

SEQ ID NO: 1864057 - RNA, 16 nt, Human
cugcacuugcagacuc

SEQ ID NO: 1864058 - RNA, 17 nt, Human
cugcacuugcagacucu

SEQ ID NO: 1864059 - RNA, 20 nt, Human
cugcagagcaggaaacauga

SEQ ID NO: 1864060 - RNA, 13 nt, Human
cugcagaagacag

SEQ ID NO: 1864061 - RNA, 23 nt, Human
cugcagaagacaguauggcagcu

SEQ ID NO: 1864062 - RNA, 22 nt, Human
cugcacagugcaucucagccca

SEQ ID NO: 1864063 - RNA, 21 nt, Human
cugcacagugcaucucagccc

SEQ ID NO: 1864064 - RNA, 18 nt, Human
cugcacccucaggcaggu

SEQ ID NO: 1864065 - RNA, 17 nt, Human
cugcacccucaggcagg

SEQ ID NO: 1864066 - RNA, 16 nt, Human
cugcacaagcugcacc

SEQ ID NO: 1864067 - RNA, 15 nt, Human
cugcacaagcugcac

SEQ ID NO: 1864068 - RNA, 14 nt, Human
cugcacaagcugca

SEQ ID NO: 1864069 - RNA, 13 nt, Human
cugcacaagcugc

SEQ ID NO: 1864070 - RNA, 18 nt, Human
cugcacaagcugcacccu

SEQ ID NO: 1864071 - RNA, 18 nt, Human
cugcacagugcaucucag

SEQ ID NO: 1864072 - RNA, 13 nt, Human
cugcacaaagccc

SEQ ID NO: 1864073 - RNA, 20 nt, Human
cugcacaaagcccuuccaug

SEQ ID NO: 1864074 - RNA, 18 nt, Human
cugcacaaagcccuucca

SEQ ID NO: 1864075 - RNA, 21 nt, Human
cugcacaaagcccuuccaugu

SEQ ID NO: 1864076 - RNA, 16 nt, Human
cugagucugaaggcug

SEQ ID NO: 1864077 - RNA, 15 nt, Human
cugagucugaaggcu

SEQ ID NO: 1864078 - RNA, 14 nt, Human
cugagucugaaggc

SEQ ID NO: 1864079 - RNA, 13 nt, Human
cugagucugaagg

SEQ ID NO: 1864080 - RNA, 17 nt, Human
cugagucugaaggcugg

SEQ ID NO: 1864081 - RNA, 14 nt, Human
cugagugccuuuug

SEQ ID NO: 1864082 - RNA, 16 nt, Human
cugagugccuuuuggu

SEQ ID NO: 1864083 - RNA, 15 nt, Human
cugagugccuuuugg

SEQ ID NO: 1864084 - RNA, 22 nt, Human
cugagugggggaucacagccuc

SEQ ID NO: 1864085 - RNA, 13 nt, Human
cugauaaagauga

SEQ ID NO: 1864086 - RNA, 21 nt, Human
cugauaaagaugagugagcau

SEQ ID NO: 1864087 - RNA, 14 nt, Human
cugaucucucguga

SEQ ID NO: 1864088 - RNA, 22 nt, Human
cugauucccaagcucugcuccu

SEQ ID NO: 1864089 - RNA, 19 nt, Human
cugauucccaagcucugcu

SEQ ID NO: 1864090 - RNA, 20 nt, Human
cugauucccaagcucugcuc

SEQ ID NO: 1864091 - RNA, 17 nt, Human
cugauucccaagcucug

SEQ ID NO: 1864092 - RNA, 18 nt, Human
cugauucccaagcucugc

SEQ ID NO: 1864093 - RNA, 15 nt, Human
cugauucccaagcuc

SEQ ID NO: 1864094 - RNA, 22 nt, Human
cuggcuuuucacugcuggcugc

SEQ ID NO: 1864095 - RNA, 20 nt, Human
cuggcuuuucacugcuggcu

SEQ ID NO: 1864096 - RNA, 19 nt, Human
cuggcuuuucacugcuggc

SEQ ID NO: 1864097 - RNA, 17 nt, Human
cuggcuuuucacugcug

SEQ ID NO: 1864098 - RNA, 19 nt, Human
cugggaacaccauagguca

SEQ ID NO: 1864099 - RNA, 16 nt, Human
cuggcuuuucacugcu

SEQ ID NO: 1864100 - RNA, 15 nt, Human
cuggcuuuucacugc

SEQ ID NO: 1864101 - RNA, 14 nt, Human
cuggcuucacagau

SEQ ID NO: 1864102 - RNA, 20 nt, Human
cuggcuguuggcugggggcc

SEQ ID NO: 1864103 - RNA, 21 nt, Human
cuggcuggguggcaccagcag

SEQ ID NO: 1864104 - RNA, 22 nt, Human
cuggcuggguggcaccagcagc

SEQ ID NO: 1864105 - RNA, 19 nt, Human
cuggcuguuggcugggggc

SEQ ID NO: 1864106 - RNA, 19 nt, Human
cuggcugccuuagaaccuu

SEQ ID NO: 1864107 - RNA, 14 nt, Human
cuggcugccuuaga

SEQ ID NO: 1864108 - RNA, 19 nt, Human
cuggcucuuccaggcuggg

SEQ ID NO: 1864109 - RNA, 18 nt, Human
cuggcucuuccaggcugg

SEQ ID NO: 1864110 - RNA, 20 nt, Human
cuggcucuuccaggcuggga

SEQ ID NO: 1864111 - RNA, 13 nt, Human
cuggccugagcug

SEQ ID NO: 1864112 - RNA, 17 nt, Human
cuggcucuuccaggcug

SEQ ID NO: 1864113 - RNA, 20 nt, Human
cugggcaaugugauaaaacc

SEQ ID NO: 1864114 - RNA, 10 nt, Human
cugggccccu

SEQ ID NO: 1864115 - RNA, 17 nt, Human
cugggccccugccucuc

SEQ ID NO: 1864116 - RNA, 16 nt, Human
cugggccccugccucu

SEQ ID NO: 1864117 - RNA, 12 nt, Human
cugggccccugc

SEQ ID NO: 1864118 - RNA, 23 nt, Human
cugggauuacaggcuccugccac

SEQ ID NO: 1864119 - RNA, 22 nt, Human
cugggauuacaggcuccugcca

SEQ ID NO: 1864120 - RNA, 21 nt, Human
cugggauuacaggcuccugcc

SEQ ID NO: 1864121 - RNA, 21 nt, Human
cugggauuacaggcgugagcc

SEQ ID NO: 1864122 - RNA, 20 nt, Human
cugggauuacaggcuccugc

SEQ ID NO: 1864123 - RNA, 19 nt, Human
cugggauuacaggcuccug

SEQ ID NO: 1864124 - RNA, 16 nt, Human
cugggagugagcuggu

SEQ ID NO: 1864125 - RNA, 13 nt, Human
cugggagugagcu

SEQ ID NO: 1864126 - RNA, 12 nt, Human
cugggagugagc

SEQ ID NO: 1864127 - RNA, 15 nt, Human
cugggagcucugcag

SEQ ID NO: 1864128 - RNA, 14 nt, Human
cugggagcucugca

SEQ ID NO: 1864129 - RNA, 13 nt, Human
cugggagcucugc

SEQ ID NO: 1864130 - RNA, 16 nt, Human
cugggaggcucuggag

SEQ ID NO: 1864131 - RNA, 15 nt, Human
cugggaggcucugga

SEQ ID NO: 1864132 - RNA, 16 nt, Human
cugggaggcagugaug

SEQ ID NO: 1864133 - RNA, 14 nt, Human
cugggaggcaguga

SEQ ID NO: 1864134 - RNA, 18 nt, Human
cugggaggucaaggcugc

SEQ ID NO: 1864135 - RNA, 21 nt, Human
cuggguacuuguggacacagc

SEQ ID NO: 1864136 - RNA, 23 nt, Human
cuggguacuuguggacacagcuc

SEQ ID NO: 1864137 - RNA, 22 nt, Human
cugggguggggaccucaggccu

SEQ ID NO: 1864138 - RNA, 21 nt, Human
cugggguggggaccucaggcc

SEQ ID NO: 1864139 - RNA, 23 nt, Human
cugggguggggaccucaggccug

SEQ ID NO: 1864140 - RNA, 20 nt, Human
cuggguacuuguggacacag

SEQ ID NO: 1864141 - RNA, 19 nt, Human
cugggguggggaccucagg

SEQ ID NO: 1864142 - RNA, 18 nt, Human
cugggguggggaccucag

SEQ ID NO: 1864143 - RNA, 17 nt, Human
cugggguggggaccuca

SEQ ID NO: 1864144 - RNA, 13 nt, Human
cugggggccucag

SEQ ID NO: 1864145 - RNA, 17 nt, Human
cugggggccucagugcc

SEQ ID NO: 1864146 - RNA, 18 nt, Human
cugggggccucagugcca

SEQ ID NO: 1864147 - RNA, 18 nt, Human
cugggcuucaguggcagc

SEQ ID NO: 1864148 - RNA, 17 nt, Human
cugggcuucaguggcag

SEQ ID NO: 1864149 - RNA, 19 nt, Human
cugggcuucaguggcagcu

SEQ ID NO: 1864150 - RNA, 20 nt, Human
cugggcuucaguggcagcug

SEQ ID NO: 1864151 - RNA, 21 nt, Human
cugggcuucaguggcagcugc

SEQ ID NO: 1864152 - RNA, 22 nt, Human
cugggcuucaguggcagcugcu

SEQ ID NO: 1864153 - RNA, 13 nt, Human
cugggcuugggga

SEQ ID NO: 1864154 - RNA, 23 nt, Human
cugggcuucaguggcagcugcuu

SEQ ID NO: 1864155 - RNA, 20 nt, Human
cugggcuuggggaccagagc

SEQ ID NO: 1864156 - RNA, 17 nt, Human
cugggcuuggggaccag

SEQ ID NO: 1864157 - RNA, 21 nt, Human
cugggcuuggggaccagagcu

SEQ ID NO: 1864158 - RNA, 19 nt, Human
cugggcucccuucccaccu

SEQ ID NO: 1864159 - RNA, 18 nt, Human
cuggucucaaacuccuga

SEQ ID NO: 1864160 - RNA, 19 nt, Human
cugguggcagugggagcug

SEQ ID NO: 1864161 - RNA, 23 nt, Human
cugguggcagugggagcugccug

SEQ ID NO: 1864162 - RNA, 17 nt, Human
cugguccauagagagca

SEQ ID NO: 1864163 - RNA, 15 nt, Human
cugguccauagagag

SEQ ID NO: 1864164 - RNA, 18 nt, Human
cuggguuggaaaacagua

SEQ ID NO: 1864165 - RNA, 13 nt, Human
cuggguuggaaaa

SEQ ID NO: 1864166 - RNA, 13 nt, Human
cuggguuggaggg

SEQ ID NO: 1864167 - RNA, 19 nt, Human
cuggguucuacccaggugc

SEQ ID NO: 1864168 - RNA, 21 nt, Human
cugguccauagagagcaagac

SEQ ID NO: 1864169 - RNA, 18 nt, Human
cugguccauagagagcaa

SEQ ID NO: 1864170 - RNA, 15 nt, Human
cuggucccacucagu

SEQ ID NO: 1864171 - RNA, 18 nt, Human
cuggucccacucagucca

SEQ ID NO: 1864172 - RNA, 17 nt, Human
cuggccuagcauacgua

SEQ ID NO: 1864173 - RNA, 13 nt, Human
cuggcccacugca

SEQ ID NO: 1864174 - RNA, 12 nt, Human
cuggcccacugc

SEQ ID NO: 1864175 - RNA, 23 nt, Human
cuggccuagcauacguacacauu

SEQ ID NO: 1864176 - RNA, 22 nt, Human
cuggccucaagugauucuccug

SEQ ID NO: 1864177 - RNA, 22 nt, Human
cuggccagaugcaccagcccuu

SEQ ID NO: 1864178 - RNA, 21 nt, Human
cuggccagaugcaccagcccu

SEQ ID NO: 1864179 - RNA, 17 nt, Human
cuggccagaugcaccag

SEQ ID NO: 1864180 - RNA, 18 nt, Human
cuggccagaugcaccagc

SEQ ID NO: 1864181 - RNA, 19 nt, Human
cuggccagaugcaccagcc

SEQ ID NO: 1864182 - RNA, 20 nt, Human
cuggccagaugcaccagccc

SEQ ID NO: 1864183 - RNA, 18 nt, Human
cuggcacugcuuccagug

SEQ ID NO: 1864184 - RNA, 17 nt, Human
cuggcacugcuuccagu

SEQ ID NO: 1864185 - RNA, 16 nt, Human
cuggcacugcuuccag

SEQ ID NO: 1864186 - RNA, 15 nt, Human
cuggcacugcuucca

SEQ ID NO: 1864187 - RNA, 16 nt, Human
cuggccaacgggguga

SEQ ID NO: 1864188 - RNA, 16 nt, Human
cuggccagaugcacca

SEQ ID NO: 1864189 - RNA, 23 nt, Human
cuggcacuauaauguaagcucua

SEQ ID NO: 1864190 - RNA, 14 nt, Human
cuggcacugcuucc

SEQ ID NO: 1864191 - RNA, 13 nt, Human
cuggcacugcuuc

SEQ ID NO: 1864192 - RNA, 17 nt, Human
cuggcacagggcagugg

SEQ ID NO: 1864193 - RNA, 17 nt, Human
cuggauuauauuaugaa

SEQ ID NO: 1864194 - RNA, 23 nt, Human
cuggauuauucaaaaugauguau

SEQ ID NO: 1864195 - RNA, 13 nt, Human
cuggauuaaacuu

SEQ ID NO: 1864196 - RNA, 23 nt, Human
cuggauuaaacuuaaucuaaaug

SEQ ID NO: 1864197 - RNA, 16 nt, Human
cuggauggggcugcac

SEQ ID NO: 1864198 - RNA, 15 nt, Human
cuggauggggcugca

SEQ ID NO: 1864199 - RNA, 21 nt, Human
cuggauggaggaaaaccaagc

SEQ ID NO: 1864200 - RNA, 16 nt, Human
cuggacucaccucccc

SEQ ID NO: 1864201 - RNA, 20 nt, Human
cuggagcccacuguacuugc

SEQ ID NO: 1864202 - RNA, 17 nt, Human
cuggagcccacuguacu

SEQ ID NO: 1864203 - RNA, 16 nt, Human
cuggagcccacuguac

SEQ ID NO: 1864204 - RNA, 15 nt, Human
cuggagcccacugua

SEQ ID NO: 1864205 - RNA, 13 nt, Human
cuggagcccacug

SEQ ID NO: 1864206 - RNA, 21 nt, Human
cuggagcccacuguacuugcu

SEQ ID NO: 1864207 - RNA, 12 nt, Human
cugcucugauga

SEQ ID NO: 1864208 - RNA, 18 nt, Human
cugcuuugggcugcccug

SEQ ID NO: 1864209 - RNA, 20 nt, Human
cugcuuugggcugcccuggu

SEQ ID NO: 1864210 - RNA, 19 nt, Human
cugcuuugggcugcccugg

SEQ ID NO: 1864211 - RNA, 23 nt, Human
cugcuuugggcugcccuggugcu

SEQ ID NO: 1864212 - RNA, 22 nt, Human
cugcuuugggcugcccuggugc

SEQ ID NO: 1864213 - RNA, 21 nt, Human
cugcuuugggcugcccuggug

SEQ ID NO: 1864214 - RNA, 14 nt, Human
cuggaaugcagugg

SEQ ID NO: 1864215 - RNA, 15 nt, Human
cuggaaugcaguggu

SEQ ID NO: 1864216 - RNA, 15 nt, Human
cuggaagcacagcuu

SEQ ID NO: 1864217 - RNA, 18 nt, Human
cuggaagcacagcuucau

SEQ ID NO: 1864218 - RNA, 21 nt, Human
cuggaagugcuaauuuugaaa

SEQ ID NO: 1864219 - RNA, 23 nt, Human
cuggaauaauccuaaacauauga

SEQ ID NO: 1864220 - RNA, 18 nt, Human
cucccaucucacacauga

SEQ ID NO: 1864221 - RNA, 15 nt, Human
cucccaucucacaca

SEQ ID NO: 1864222 - RNA, 21 nt, Human
cucccaucucacacaugagca

SEQ ID NO: 1864223 - RNA, 14 nt, Human
cucccaucucacac

SEQ ID NO: 1864224 - RNA, 14 nt, Human
cucccaucacccgc

SEQ ID NO: 1864225 - RNA, 23 nt, Human
cucccuucccaccucucucacuc

SEQ ID NO: 1864226 - RNA, 10 nt, Human
cucccuuccu

SEQ ID NO: 1864227 - RNA, 20 nt, Human
cucccuucaaccauucccca

SEQ ID NO: 1864228 - RNA, 19 nt, Human
cucccuucaaccauucccc

SEQ ID NO: 1864229 - RNA, 18 nt, Human
cucccuucaaccauuccc

SEQ ID NO: 1864230 - RNA, 12 nt, Human
cucccuucaacc

SEQ ID NO: 1864231 - RNA, 13 nt, Human
cucccuuucaaca

SEQ ID NO: 1864232 - RNA, 20 nt, Human
cucccuuggauuguccccga

SEQ ID NO: 1864233 - RNA, 17 nt, Human
cucccuuggauuguccc

SEQ ID NO: 1864234 - RNA, 17 nt, Human
cucccuuucuucccuac

SEQ ID NO: 1864235 - RNA, 13 nt, Human
cucccuuccucuu

SEQ ID NO: 1864236 - RNA, 14 nt, Human
cucccuuccucuuu

SEQ ID NO: 1864237 - RNA, 16 nt, Human
cucccuucucuucaca

SEQ ID NO: 1864238 - RNA, 14 nt, Human
cuccugcaggcagc

SEQ ID NO: 1864239 - RNA, 13 nt, Human
cuccugcaggcag

SEQ ID NO: 1864240 - RNA, 22 nt, Human
cuccugaguagcugggauuaca

SEQ ID NO: 1864241 - RNA, 12 nt, Human
cuccugcaggca

SEQ ID NO: 1864242 - RNA, 17 nt, Human
cuccugaguagcuggga

SEQ ID NO: 1864243 - RNA, 21 nt, Human
cuccugaguagcuggauuaca

SEQ ID NO: 1864244 - RNA, 14 nt, Human
cuccugaccuuagg

SEQ ID NO: 1864245 - RNA, 14 nt, Human
cuccugaccucagg

SEQ ID NO: 1864246 - RNA, 19 nt, Human
cuccucuugccacugccuc

SEQ ID NO: 1864247 - RNA, 14 nt, Human
cuccucagaucuuc

SEQ ID NO: 1864248 - RNA, 12 nt, Human
cuccucagaucu

SEQ ID NO: 1864249 - RNA, 22 nt, Human
cuccuaucagaaguuucucagc

SEQ ID NO: 1864250 - RNA, 21 nt, Human
cuccuucaccuuuguccccac

SEQ ID NO: 1864251 - RNA, 19 nt, Human
cuccuucaccuuugucccc

SEQ ID NO: 1864252 - RNA, 16 nt, Human
cuccuucaccuuuguc

SEQ ID NO: 1864253 - RNA, 14 nt, Human
cuccuucaccuuug

SEQ ID NO: 1864254 - RNA, 14 nt, Human
cuccugugugugcg

SEQ ID NO: 1864255 - RNA, 21 nt, Human
cuccugcaggcagccaggcca

SEQ ID NO: 1864256 - RNA, 15 nt, Human
cuccugcaggcagcc

SEQ ID NO: 1864257 - RNA, 22 nt, Human
cuccugcaggcagccaggccac

SEQ ID NO: 1864258 - RNA, 11 nt, Human
cuccugccacc

SEQ ID NO: 1864259 - RNA, 15 nt, Human
cuccugugucuugca

SEQ ID NO: 1864260 - RNA, 23 nt, Human
cuccugugucuugcaauggcagc

SEQ ID NO: 1864261 - RNA, 11 nt, Human
cuccugugugu

SEQ ID NO: 1864262 - RNA, 21 nt, Human
cuccuugaaaacacuguucuc

SEQ ID NO: 1864263 - RNA, 11 nt, Human
cuccuucuucc

SEQ ID NO: 1864264 - RNA, 16 nt, Human
cucgaacuggcugcaa

SEQ ID NO: 1864265 - RNA, 14 nt, Human
cuccuucuguccua

SEQ ID NO: 1864266 - RNA, 15 nt, Human
cuccuucuguccuac

SEQ ID NO: 1864267 - RNA, 20 nt, Human
cuccuucuguccuacucugu

SEQ ID NO: 1864268 - RNA, 19 nt, Human
cucggacuuagcugggaga

SEQ ID NO: 1864269 - RNA, 18 nt, Human
cucggacuuagcugggag

SEQ ID NO: 1864270 - RNA, 21 nt, Human
cucgcuauugucaccagggcu

SEQ ID NO: 1864271 - RNA, 22 nt, Human
cucgcuauugucaccagggcug

SEQ ID NO: 1864272 - RNA, 22 nt, Human
cucggccucccaaagugcuggg

SEQ ID NO: 1864273 - RNA, 23 nt, Human
cucggccucccaaagugcuggga

SEQ ID NO: 1864274 - RNA, 15 nt, Human
cucgcgacaaugcaa

SEQ ID NO: 1864275 - RNA, 19 nt, Human
cucgcuauugucaccaggg

SEQ ID NO: 1864276 - RNA, 13 nt, Human
cucgcgacaaugc

SEQ ID NO: 1864277 - RNA, 17 nt, Human
cucgagguuucucaaag

SEQ ID NO: 1864278 - RNA, 16 nt, Human
cucgaguuacagacaa

SEQ ID NO: 1864279 - RNA, 20 nt, Human
cucgaguuacagacaaagcg

SEQ ID NO: 1864280 - RNA, 20 nt, Human
cuccagaccccuggcuuuuc

SEQ ID NO: 1864281 - RNA, 19 nt, Human
cuccagaccccuggcuuuu

SEQ ID NO: 1864282 - RNA, 18 nt, Human
cuccagaccccuggcuuu

SEQ ID NO: 1864283 - RNA, 17 nt, Human
cuccagaccccuggcuu

SEQ ID NO: 1864284 - RNA, 15 nt, Human
cuccagaccccuggc

SEQ ID NO: 1864285 - RNA, 14 nt, Human
cuccagaccccugg

SEQ ID NO: 1864286 - RNA, 11 nt, Human
cuccacugccu

SEQ ID NO: 1864287 - RNA, 19 nt, Human
cuccagcucaccagcccca

SEQ ID NO: 1864288 - RNA, 20 nt, Human
cuccagcucaccagccccag

SEQ ID NO: 1864289 - RNA, 11 nt, Human
cuccacccugc

SEQ ID NO: 1864290 - RNA, 15 nt, Human
cuccaccugccaggg

SEQ ID NO: 1864291 - RNA, 17 nt, Human
cuccaccugccagggac

SEQ ID NO: 1864292 - RNA, 21 nt, Human
cuccaccugccagggacagag

SEQ ID NO: 1864293 - RNA, 18 nt, Human
cuccaccugccagggaca

SEQ ID NO: 1864294 - RNA, 12 nt, Human
cuccacccugcu

SEQ ID NO: 1864295 - RNA, 14 nt, Human
cucccaggcgcccc

SEQ ID NO: 1864296 - RNA, 22 nt, Human
cucccaggcauuccccaggagg

SEQ ID NO: 1864297 - RNA, 21 nt, Human
cucccaggcauuccccaggag

SEQ ID NO: 1864298 - RNA, 20 nt, Human
cucccaggcauuccccagga

SEQ ID NO: 1864299 - RNA, 19 nt, Human
cucccaggcauuccccagg

SEQ ID NO: 1864300 - RNA, 17 nt, Human
cucccaggcauucccca

SEQ ID NO: 1864301 - RNA, 24 nt, Human
cuccauucccguggaacguuuuuc

SEQ ID NO: 1864302 - RNA, 14 nt, Human
cuccaugugggcua

SEQ ID NO: 1864303 - RNA, 22 nt, Human
cucccaaggggcccaaauucuu

SEQ ID NO: 1864304 - RNA, 21 nt, Human
cucccaaggggcccaaauucu

SEQ ID NO: 1864305 - RNA, 15 nt, Human
cucccaggcauuccc

SEQ ID NO: 1864306 - RNA, 13 nt, Human
cuccagcuguuca

SEQ ID NO: 1864307 - RNA, 19 nt, Human
cuccagcuggguuggaaaa

SEQ ID NO: 1864308 - RNA, 19 nt, Human
cuccagcuguucagcuggu

SEQ ID NO: 1864309 - RNA, 18 nt, Human
cuccagcuguucagcugg

SEQ ID NO: 1864310 - RNA, 23 nt, Human
cuccauccugaggcuccacuugg

SEQ ID NO: 1864311 - RNA, 17 nt, Human
cuccaucuaaacugccc

SEQ ID NO: 1864312 - RNA, 20 nt, Human
cuccaucgcugucaucucag

SEQ ID NO: 1864313 - RNA, 13 nt, Human
cuccaucuccacu

SEQ ID NO: 1864314 - RNA, 18 nt, Human
cuccaucuaaacugcccc

SEQ ID NO: 1864315 - RNA, 21 nt, Human
cuccauccugaggcuccacuu

SEQ ID NO: 1864316 - RNA, 20 nt, Human
cuccauccugaggcuccacu

SEQ ID NO: 1864317 - RNA, 11 nt, Human
cuccaggcucc

SEQ ID NO: 1864318 - RNA, 12 nt, Human
cucagggucccu

SEQ ID NO: 1864319 - RNA, 23 nt, Human
cuaaaagguaugcaaucaaaucu

SEQ ID NO: 1864320 - RNA, 14 nt, Human
cucagggucccugg

SEQ ID NO: 1864321 - RNA, 18 nt, Human
cucaggucccugcagggc

SEQ ID NO: 1864322 - RNA, 17 nt, Human
cucaggucccugcaggg

SEQ ID NO: 1864323 - RNA, 15 nt, Human
cucaggucuguuuuc

SEQ ID NO: 1864324 - RNA, 23 nt, Human
cucagguggggucacucuggcag

SEQ ID NO: 1864325 - RNA, 22 nt, Human
cucagguggggucacucuggca

SEQ ID NO: 1864326 - RNA, 15 nt, Human
cucaggugucccugc

SEQ ID NO: 1864327 - RNA, 16 nt, Human
cucaggugucccugca

SEQ ID NO: 1864328 - RNA, 17 nt, Human
cucaggugucccugcac

SEQ ID NO: 1864329 - RNA, 18 nt, Human
cucaggugucccugcacu

SEQ ID NO: 1864330 - RNA, 14 nt, Human
cucaggugagaagc

SEQ ID NO: 1864331 - RNA, 19 nt, Human
cucaggugucccugcacuu

SEQ ID NO: 1864332 - RNA, 20 nt, Human
cucauaguaugguggcuggg

SEQ ID NO: 1864333 - RNA, 18 nt, Human
cucauaguaugguggcug

SEQ ID NO: 1864334 - RNA, 19 nt, Human
cucauaguaugguggcugg

SEQ ID NO: 1864335 - RNA, 17 nt, Human
cucauuaggauggcuag

SEQ ID NO: 1864336 - RNA, 18 nt, Human
cucauuaggauggcuagu

SEQ ID NO: 1864337 - RNA, 21 nt, Human
cucauuagcauuuugcuaaau

SEQ ID NO: 1864338 - RNA, 17 nt, Human
cucaucuccccaucauu

SEQ ID NO: 1864339 - RNA, 21 nt, Human
cucaucuagguaaauuacagu

SEQ ID NO: 1864340 - RNA, 16 nt, Human
cucauugaccugaggc

SEQ ID NO: 1864341 - RNA, 15 nt, Human
cucauugaccugagg

SEQ ID NO: 1864342 - RNA, 13 nt, Human
cucauugaccuga

SEQ ID NO: 1864343 - RNA, 23 nt, Human
cucauucuucuguacgucugaca

SEQ ID NO: 1864344 - RNA, 18 nt, Human
cucauuccaccuucccau

SEQ ID NO: 1864345 - RNA, 21 nt, Human
cucauuccaccuucccaugcc

SEQ ID NO: 1864346 - RNA, 13 nt, Human
cucauucuucugu

SEQ ID NO: 1864347 - RNA, 14 nt, Human
cucauucuucugua

SEQ ID NO: 1864348 - RNA, 12 nt, Human
cucuggagccca

SEQ ID NO: 1864349 - RNA, 14 nt, Human
cucuggacaggcau

SEQ ID NO: 1864350 - RNA, 14 nt, Human
cucuggaauuugaa

SEQ ID NO: 1864351 - RNA, 15 nt, Human
cucugcuuuggaaau

SEQ ID NO: 1864352 - RNA, 16 nt, Human
cucugccuccucuuca

SEQ ID NO: 1864353 - RNA, 15 nt, Human
cucugccuccucuuc

SEQ ID NO: 1864354 - RNA, 14 nt, Human
cucugccucugaca

SEQ ID NO: 1864355 - RNA, 16 nt, Human
cucugccucugacaca

SEQ ID NO: 1864356 - RNA, 23 nt, Human
cucugcccuccaagaccuucucc

SEQ ID NO: 1864357 - RNA, 16 nt, Human
cucugcccuccaagac

SEQ ID NO: 1864358 - RNA, 15 nt, Human
cucugcccuccaaga

SEQ ID NO: 1864359 - RNA, 14 nt, Human
cucugcccuccaag

SEQ ID NO: 1864360 - RNA, 11 nt, Human
cucugcccugc

SEQ ID NO: 1864361 - RNA, 23 nt, Human
cucugcccuaaugcgcaggcugg

SEQ ID NO: 1864362 - RNA, 12 nt, Human
cucugcccuugg

SEQ ID NO: 1864363 - RNA, 12 nt, Human
cucugcccugcg

SEQ ID NO: 1864364 - RNA, 14 nt, Human
cucugccuccucuu

SEQ ID NO: 1864365 - RNA, 15 nt, Human
cucugagccuuggga

SEQ ID NO: 1864366 - RNA, 16 nt, Human
cucugagcaaaugugg

SEQ ID NO: 1864367 - RNA, 21 nt, Human
cucucugcccuaaugcgcagg

SEQ ID NO: 1864368 - RNA, 13 nt, Human
cucucugcccuaa

SEQ ID NO: 1864369 - RNA, 12 nt, Human
cucucugcccua

SEQ ID NO: 1864370 - RNA, 20 nt, Human
cucugagacucgcgacaaug

SEQ ID NO: 1864371 - RNA, 22 nt, Human
cucugcaagaauugaagcagga

SEQ ID NO: 1864372 - RNA, 17 nt, Human
cucugaugaagaggagu

SEQ ID NO: 1864373 - RNA, 10 nt, Human
cucugcacaa

SEQ ID NO: 1864374 - RNA, 23 nt, Human
cucugcaggucccuaauaaagcu

SEQ ID NO: 1864375 - RNA, 23 nt, Human
cucugcauacucauuaggauggc

SEQ ID NO: 1864376 - RNA, 12 nt, Human
cucucucaggcc

SEQ ID NO: 1864377 - RNA, 16 nt, Human
cucucucacuccuuga

SEQ ID NO: 1864378 - RNA, 15 nt, Human
cucucucacuccuug

SEQ ID NO: 1864379 - RNA, 14 nt, Human
cucucucacuccuu

SEQ ID NO: 1864380 - RNA, 22 nt, Human
cucucugcaggucccuaauaaa

SEQ ID NO: 1864381 - RNA, 19 nt, Human
cucucugcaggucccuaau

SEQ ID NO: 1864382 - RNA, 17 nt, Human
cucucugcaggucccua

SEQ ID NO: 1864383 - RNA, 16 nt, Human
cucucugcaggucccu

SEQ ID NO: 1864384 - RNA, 14 nt, Human
cucucugcaggucc

SEQ ID NO: 1864385 - RNA, 13 nt, Human
cucucugcagguc

SEQ ID NO: 1864386 - RNA, 12 nt, Human
cucucugcaggu

SEQ ID NO: 1864387 - RNA, 22 nt, Human
cucuccuguaccucuugagccu

SEQ ID NO: 1864388 - RNA, 17 nt, Human
cucuccuguaccucuug

SEQ ID NO: 1864389 - RNA, 18 nt, Human
cucuccuguaccucuuga

SEQ ID NO: 1864390 - RNA, 13 nt, Human
cucuccuguaccu

SEQ ID NO: 1864391 - RNA, 14 nt, Human
cucuccuguaccuc

SEQ ID NO: 1864392 - RNA, 15 nt, Human
cucuccuguaccucu

SEQ ID NO: 1864393 - RNA, 13 nt, Human
cucuccccagcaa

SEQ ID NO: 1864394 - RNA, 18 nt, Human
cucucccaucacuucccu

SEQ ID NO: 1864395 - RNA, 14 nt, Human
cucucccaucacuu

SEQ ID NO: 1864396 - RNA, 20 nt, Human
cucucccaucacuucccuac

SEQ ID NO: 1864397 - RNA, 13 nt, Human
cucucccaucacu

SEQ ID NO: 1864398 - RNA, 13 nt, Human
cucuccagccccu

SEQ ID NO: 1864399 - RNA, 12 nt, Human
cucuccagcccc

SEQ ID NO: 1864400 - RNA, 21 nt, Human
cucuccauucccguggaacgu

SEQ ID NO: 1864401 - RNA, 16 nt, Human
cucuccacugccuucg

SEQ ID NO: 1864402 - RNA, 23 nt, Human
cucucaggccagcugcuugggcu

SEQ ID NO: 1864403 - RNA, 22 nt, Human
cucucaggccagcugcuugggc

SEQ ID NO: 1864404 - RNA, 19 nt, Human
cucuugguccugcugcagu

SEQ ID NO: 1864405 - RNA, 18 nt, Human
cucuugguccugcugcag

SEQ ID NO: 1864406 - RNA, 18 nt, Human
cucuucuggguuccuucc

SEQ ID NO: 1864407 - RNA, 18 nt, Human
cucuugaacuccugaccu

SEQ ID NO: 1864408 - RNA, 16 nt, Human
cucuugaccucaggug

SEQ ID NO: 1864409 - RNA, 13 nt, Human
cucuugaccucag

SEQ ID NO: 1864410 - RNA, 15 nt, Human
cucuugaccucaggu

SEQ ID NO: 1864411 - RNA, 17 nt, Human
cucuuuccaucuacccu

SEQ ID NO: 1864412 - RNA, 18 nt, Human
cucuuuggacacucacac

SEQ ID NO: 1864413 - RNA, 15 nt, Human
cucuuuggacacuca

SEQ ID NO: 1864414 - RNA, 23 nt, Human
cucuucaguuaagccuuuggaaa

SEQ ID NO: 1864415 - RNA, 20 nt, Human
cucuucaguuaagccuuugg

SEQ ID NO: 1864416 - RNA, 19 nt, Human
cucuucaguuaagccuuug

SEQ ID NO: 1864417 - RNA, 24 nt, Human
cucuuaaaacccaagugccuuagc

SEQ ID NO: 1864418 - RNA, 13 nt, Human
cucuuaaaaccca

SEQ ID NO: 1864419 - RNA, 19 nt, Human
cucuggcagcucagagagg

SEQ ID NO: 1864420 - RNA, 20 nt, Human
cucuggcagcucagagaggg

SEQ ID NO: 1864421 - RNA, 19 nt, Human
cucuguucugcacacagca

SEQ ID NO: 1864422 - RNA, 21 nt, Human
cucuguucugcacacagcacg

SEQ ID NO: 1864423 - RNA, 20 nt, Human
cucuguucugcacacagcac

SEQ ID NO: 1864424 - RNA, 18 nt, Human
cucuggcagcucagagag

SEQ ID NO: 1864425 - RNA, 17 nt, Human
cucuggcagcucagaga

SEQ ID NO: 1864426 - RNA, 15 nt, Human
cucuggagcccacug

SEQ ID NO: 1864427 - RNA, 16 nt, Human
cucuucuccuuucaca

SEQ ID NO: 1864428 - RNA, 15 nt, Human
cucuucuccuuucac

SEQ ID NO: 1864429 - RNA, 13 nt, Human
cucuucuccuuuc

SEQ ID NO: 1864430 - RNA, 21 nt, Human
cucuuccaggcugggagagcc

SEQ ID NO: 1864431 - RNA, 22 nt, Human
cucuuccaggcugggagagccu

SEQ ID NO: 1864432 - RNA, 23 nt, Human
cucuuccaggcugggagagccuu

SEQ ID NO: 1864433 - RNA, 14 nt, Human
cucuucuccacugg

SEQ ID NO: 1864434 - RNA, 17 nt, Human
cucuucuccacuggaug

SEQ ID NO: 1864435 - RNA, 15 nt, Human
cucuucuccacugga

SEQ ID NO: 1864436 - RNA, 19 nt, Human
cucuucuccacuggaugga

SEQ ID NO: 1864437 - RNA, 12 nt, Human
cucuucuccagg

SEQ ID NO: 1864438 - RNA, 21 nt, Human
cucuuuggucuacacugugcu

SEQ ID NO: 1864439 - RNA, 19 nt, Human
cucuuuggucuacacugug

SEQ ID NO: 1864440 - RNA, 18 nt, Human
cucuuugggccuggcucc

SEQ ID NO: 1864441 - RNA, 21 nt, Human
cugaaccuggguaacuaggga

SEQ ID NO: 1864442 - RNA, 21 nt, Human
cugaacuuggcgcugccccug

SEQ ID NO: 1864443 - RNA, 16 nt, Human
cugaacuuggcgcugc

SEQ ID NO: 1864444 - RNA, 15 nt, Human
cugaacuuggcgcug

SEQ ID NO: 1864445 - RNA, 21 nt, Human
cugaagacucauucuucugua

SEQ ID NO: 1864446 - RNA, 16 nt, Human
cugaauacagaggcaa

SEQ ID NO: 1864447 - RNA, 24 nt, Human
cugaagucuuuguacagacaacaa

SEQ ID NO: 1864448 - RNA, 22 nt, Human
cugaagucacugcacagugcau

SEQ ID NO: 1864449 - RNA, 16 nt, Human
cugaagucacugcaca

SEQ ID NO: 1864450 - RNA, 17 nt, Human
cugaagucacugcacag

SEQ ID NO: 1864451 - RNA, 14 nt, Human
cugaagucacacag

SEQ ID NO: 1864452 - RNA, 15 nt, Human
cugaagucacacagu

SEQ ID NO: 1864453 - RNA, 16 nt, Human
cugaagucacacagug

SEQ ID NO: 1864454 - RNA, 19 nt, Human
cugacagacacaggcccgg

SEQ ID NO: 1864455 - RNA, 11 nt, Human
cugacaggcaa

SEQ ID NO: 1864456 - RNA, 19 nt, Human
cugacagacagcccuccau

SEQ ID NO: 1864457 - RNA, 17 nt, Human
cugacagacagcccucc

SEQ ID NO: 1864458 - RNA, 21 nt, Human
cugacagacacaggcccggcu

SEQ ID NO: 1864459 - RNA, 17 nt, Human
cugacauuguuggccaa

SEQ ID NO: 1864460 - RNA, 20 nt, Human
cugacaggcaaugcuggcug

SEQ ID NO: 1864461 - RNA, 16 nt, Human
cugacaggcaaugcug

SEQ ID NO: 1864462 - RNA, 17 nt, Human
cugacaggcaaugcugg

SEQ ID NO: 1864463 - RNA, 18 nt, Human
cugacaggcaaugcuggc

SEQ ID NO: 1864464 - RNA, 19 nt, Human
cugacaggcaaugcuggcu

SEQ ID NO: 1864465 - RNA, 11 nt, Human
cugacccacug

SEQ ID NO: 1864466 - RNA, 21 nt, Human
cugacauuguuggccaaagcc

SEQ ID NO: 1864467 - RNA, 12 nt, Human
cuuaacuucaca

SEQ ID NO: 1864468 - RNA, 14 nt, Human
cuuaacuucacaua

SEQ ID NO: 1864469 - RNA, 15 nt, Human
cuuaacuucacauau

SEQ ID NO: 1864470 - RNA, 16 nt, Human
cuuaacuucacauauu

SEQ ID NO: 1864471 - RNA, 17 nt, Human
cuuaacuucacauauug

SEQ ID NO: 1864472 - RNA, 22 nt, Human
cuuaacuucacauauugauuuc

SEQ ID NO: 1864473 - RNA, 18 nt, Human
cuuaaugccacuaaauug

SEQ ID NO: 1864474 - RNA, 14 nt, Human
cuuaaucuaaaugg

SEQ ID NO: 1864475 - RNA, 16 nt, Human
cuuaaucuaaauggaa

SEQ ID NO: 1864476 - RNA, 16 nt, Human
cuuaaguuuauacucu

SEQ ID NO: 1864477 - RNA, 23 nt, Human
cuguuuguuucugaaagggacgc

SEQ ID NO: 1864478 - RNA, 21 nt, Human
cuguuuguuucugaaagggac

SEQ ID NO: 1864479 - RNA, 21 nt, Human
cuguuuuauuuuaauucaguu

SEQ ID NO: 1864480 - RNA, 14 nt, Human
cuguuuucucuuga

SEQ ID NO: 1864481 - RNA, 13 nt, Human
cuguuuucucuug

SEQ ID NO: 1864482 - RNA, 17 nt, Human
cuguuuucucuugagag

SEQ ID NO: 1864483 - RNA, 18 nt, Human
cuguuuguuucugaaagg

SEQ ID NO: 1864484 - RNA, 17 nt, Human
cugguugaugccuguga

SEQ ID NO: 1864485 - RNA, 12 nt, Human
cuguuuagauaa

SEQ ID NO: 1864486 - RNA, 18 nt, Human
cuuagacagucccugcca

SEQ ID NO: 1864487 - RNA, 17 nt, Human
cuuagacagucccugcc

SEQ ID NO: 1864488 - RNA, 19 nt, Human
cuuagacagucccugccaa

SEQ ID NO: 1864489 - RNA, 11 nt, Human
cuuagacaguc

SEQ ID NO: 1864490 - RNA, 15 nt, Human
cuuagaaccuuucuu

SEQ ID NO: 1864491 - RNA, 17 nt, Human
cuuagaaauugcauuuc

SEQ ID NO: 1864492 - RNA, 16 nt, Human
cuuagacagucccugc

SEQ ID NO: 1864493 - RNA, 15 nt, Human
cuuagacagucccug

SEQ ID NO: 1864494 - RNA, 14 nt, Human
cuuagacagucccu

SEQ ID NO: 1864495 - RNA, 15 nt, Human
cuuagaagucacaca

SEQ ID NO: 1864496 - RNA, 14 nt, Human
cuuacuuaguguua

SEQ ID NO: 1864497 - RNA, 16 nt, Human
cuuacuguacaugaaa

SEQ ID NO: 1864498 - RNA, 19 nt, Human
cuuacuaguuucccuugca

SEQ ID NO: 1864499 - RNA, 15 nt, Human
cuuacgugaguccug

SEQ ID NO: 1864500 - RNA, 19 nt, Human
cuuauaggaauugacccac

SEQ ID NO: 1864501 - RNA, 15 nt, Human
cuuauacauuugaua

SEQ ID NO: 1864502 - RNA, 14 nt, Human
cuuauaauuuaaaa

SEQ ID NO: 1864503 - RNA, 17 nt, Human
cuuagguuggcaaaaag

SEQ ID NO: 1864504 - RNA, 20 nt, Human
cuuaggugauccacucgccu

SEQ ID NO: 1864505 - RNA, 13 nt, Human
cuuauaauuuaaa

SEQ ID NO: 1864506 - RNA, 15 nt, Human
cuuauuuaaugaaag

SEQ ID NO: 1864507 - RNA, 14 nt, Human
cuuaucaaaggaca

SEQ ID NO: 1864508 - RNA, 16 nt, Human
cuuaucaaaggacacc

SEQ ID NO: 1864509 - RNA, 18 nt, Human
cuucccgcucagcccucc

SEQ ID NO: 1864510 - RNA, 17 nt, Human
cuucccgcucagcccuc

SEQ ID NO: 1864511 - RNA, 16 nt, Human
cuucccgcucagcccu

SEQ ID NO: 1864512 - RNA, 15 nt, Human
cuucccgcucagccc

SEQ ID NO: 1864513 - RNA, 15 nt, Human
cuuccagugaggcuc

SEQ ID NO: 1864514 - RNA, 14 nt, Human
cuuccagugaggcu

SEQ ID NO: 1864515 - RNA, 24 nt, Human
cuuccaggggugggacacccugug

SEQ ID NO: 1864516 - RNA, 22 nt, Human
cuuccaggggugggacacccug

SEQ ID NO: 1864517 - RNA, 11 nt, Human
cuucagcugac

SEQ ID NO: 1864518 - RNA, 14 nt, Human
cuucaggcucuucu

SEQ ID NO: 1864519 - RNA, 18 nt, Human
cuucaggcucuucuccuu

SEQ ID NO: 1864520 - RNA, 17 nt, Human
cuucaggcucuucuccu

SEQ ID NO: 1864521 - RNA, 16 nt, Human
cuucaggcucuucucc

SEQ ID NO: 1864522 - RNA, 15 nt, Human
cuucaggcucuucuc

SEQ ID NO: 1864523 - RNA, 22 nt, Human
cuuccacaagagcccaggccuc

SEQ ID NO: 1864524 - RNA, 23 nt, Human
cuuccacaagagcccaggccucc

SEQ ID NO: 1864525 - RNA, 14 nt, Human
cuucauuuggagau

SEQ ID NO: 1864526 - RNA, 13 nt, Human
cuucauuuggaga

SEQ ID NO: 1864527 - RNA, 12 nt, Human
cuucagugccuu

SEQ ID NO: 1864528 - RNA, 11 nt, Human
cuucagugccu

SEQ ID NO: 1864529 - RNA, 14 nt, Human
cuucagugccuuau

SEQ ID NO: 1864530 - RNA, 13 nt, Human
cuucagugccuua

SEQ ID NO: 1864531 - RNA, 18 nt, Human
cuucauuuccugugucuu

SEQ ID NO: 1864532 - RNA, 17 nt, Human
cuucuccaggcuguauc

SEQ ID NO: 1864533 - RNA, 16 nt, Human
cuucuccacccugcuc

SEQ ID NO: 1864534 - RNA, 14 nt, Human
cuucuccaggcugu

SEQ ID NO: 1864535 - RNA, 14 nt, Human
cuucuccacccugc

SEQ ID NO: 1864536 - RNA, 15 nt, Human
cuucuccacccugcu

SEQ ID NO: 1864537 - RNA, 17 nt, Human
cuucuccuuucacaacc

SEQ ID NO: 1864538 - RNA, 14 nt, Human
cuucuccuuucaca

SEQ ID NO: 1864539 - RNA, 22 nt, Human
cuucuccuuucacaaccuucug

SEQ ID NO: 1864540 - RNA, 20 nt, Human
cuucuccuuucacaaccuuc

SEQ ID NO: 1864541 - RNA, 22 nt, Human
cuucuccuucaccuuugucccc

SEQ ID NO: 1864542 - RNA, 18 nt, Human
cuucugcuucagccuccc

SEQ ID NO: 1864543 - RNA, 16 nt, Human
cuucugcuucagccuc

SEQ ID NO: 1864544 - RNA, 17 nt, Human
cuucugcuucagccucc

SEQ ID NO: 1864545 - RNA, 20 nt, Human
cuucugccauuucugagauc

SEQ ID NO: 1864546 - RNA, 21 nt, Human
cuucugccauauucuguuggc

SEQ ID NO: 1864547 - RNA, 15 nt, Human
cuucugccauauucu

SEQ ID NO: 1864548 - RNA, 17 nt, Human
cuucugccauauucugu

SEQ ID NO: 1864549 - RNA, 21 nt, Human
cuucgggaggucgaggcagga

SEQ ID NO: 1864550 - RNA, 20 nt, Human
cuucgggaggucgaggcagg

SEQ ID NO: 1864551 - RNA, 18 nt, Human
cuucggccuccauccuga

SEQ ID NO: 1864552 - RNA, 19 nt, Human
cuucggccuccauccugag

SEQ ID NO: 1864553 - RNA, 17 nt, Human
cuucggccuccauccug

SEQ ID NO: 1864554 - RNA, 16 nt, Human
cuucgcuccugugucu

SEQ ID NO: 1864555 - RNA, 14 nt, Human
cuucgcuccugugu

SEQ ID NO: 1864556 - RNA, 15 nt, Human
cuucgcuccuguguc

SEQ ID NO: 1864557 - RNA, 13 nt, Human
cuucgcuccugug

SEQ ID NO: 1864558 - RNA, 17 nt, Human
cuuugacaaagguaaau

SEQ ID NO: 1864559 - RNA, 19 nt, Human
cuuucuuuuuuuuuuuuga

SEQ ID NO: 1864560 - RNA, 16 nt, Human
cuuucuuccucugcug

SEQ ID NO: 1864561 - RNA, 15 nt, Human
cuuucugcagaaaca

SEQ ID NO: 1864562 - RNA, 16 nt, Human
cuuuccucuuuggucu

SEQ ID NO: 1864563 - RNA, 13 nt, Human
cuuucugaaauaa

SEQ ID NO: 1864564 - RNA, 19 nt, Human
cuuuccucaaaacuucaga

SEQ ID NO: 1864565 - RNA, 23 nt, Human
cuuugugaggaagccgcuggggc

SEQ ID NO: 1864566 - RNA, 17 nt, Human
cuuugggccuggcuccc

SEQ ID NO: 1864567 - RNA, 23 nt, Human
cuuugggaggccaaggugggagg

SEQ ID NO: 1864568 - RNA, 21 nt, Human
cuuuguucuggcucuuccagg

SEQ ID NO: 1864569 - RNA, 16 nt, Human
cuuuguucuggcucuu

SEQ ID NO: 1864570 - RNA, 19 nt, Human
cuuugugaggaagccgcug

SEQ ID NO: 1864571 - RNA, 12 nt, Human
cuuugugauuuu

SEQ ID NO: 1864572 - RNA, 13 nt, Human
cuuuguggcuucc

SEQ ID NO: 1864573 - RNA, 19 nt, Human
cuuugacaaagguaaauca

SEQ ID NO: 1864574 - RNA, 14 nt, Human
cuuugcuugaaaga

SEQ ID NO: 1864575 - RNA, 23 nt, Human
cuuuggaaagacuuuuccaaccc

SEQ ID NO: 1864576 - RNA, 12 nt, Human
cuuuggaaagac

SEQ ID NO: 1864577 - RNA, 22 nt, Human
cuuuuguucuugguuuguaaau

SEQ ID NO: 1864578 - RNA, 15 nt, Human
cuuuucuguuugcua

SEQ ID NO: 1864579 - RNA, 21 nt, Human
cuuuguuuguugucagcugaa

SEQ ID NO: 1864580 - RNA, 17 nt, Human
cuuuguuuuacugucuu

SEQ ID NO: 1864581 - RNA, 16 nt, Human
cuuuuuuagaguugau

SEQ ID NO: 1864582 - RNA, 21 nt, Human
gaaaacacuguucucugcccu

SEQ ID NO: 1864583 - RNA, 20 nt, Human
gaaaacacuguucucugccc

SEQ ID NO: 1864584 - RNA, 16 nt, Human
gaaaacaugcuacaca

SEQ ID NO: 1864585 - RNA, 18 nt, Human
gaaaacaugcuacacacu

SEQ ID NO: 1864586 - RNA, 19 nt, Human
gaaaacacuguucucugcc

SEQ ID NO: 1864587 - RNA, 14 nt, Human
gaaaacguggcugc

SEQ ID NO: 1864588 - RNA, 19 nt, Human
gaaaacaugcuacacacug

SEQ ID NO: 1864589 - RNA, 22 nt, Human
gaaaagucaaggguaggguggg

SEQ ID NO: 1864590 - RNA, 19 nt, Human
gaaaauaacaauaaaagac

SEQ ID NO: 1864591 - RNA, 20 nt, Human
cuugggccacugugaagaga

SEQ ID NO: 1864592 - RNA, 18 nt, Human
cuugggccacugugaaga

SEQ ID NO: 1864593 - RNA, 22 nt, Human
cuuggagccaauggagacuguc

SEQ ID NO: 1864594 - RNA, 20 nt, Human
cuugguuuguaaauuaacuu

SEQ ID NO: 1864595 - RNA, 14 nt, Human
cuugguuuguaaau

SEQ ID NO: 1864596 - RNA, 15 nt, Human
cuugguuuguaaauu

SEQ ID NO: 1864597 - RNA, 15 nt, Human
cuuggggccuaugca

SEQ ID NO: 1864598 - RNA, 15 nt, Human
cuuguggucccaccc

SEQ ID NO: 1864599 - RNA, 19 nt, Human
cuuguggucccaccccaca

SEQ ID NO: 1864600 - RNA, 16 nt, Human
cuuguggucccacccc

SEQ ID NO: 1864601 - RNA, 16 nt, Human
cuuguuaagauaguua

SEQ ID NO: 1864602 - RNA, 19 nt, Human
cuuuaccuuuuuuauacau

SEQ ID NO: 1864603 - RNA, 20 nt, Human
cuuuaccuuuuuuauacaua

SEQ ID NO: 1864604 - RNA, 17 nt, Human
cuuuaccuuuuuuauac

SEQ ID NO: 1864605 - RNA, 21 nt, Human
cuuuaaaaagcuccaaaugca

SEQ ID NO: 1864606 - RNA, 22 nt, Human
cuuuaaaaaauuaaucugggcc

SEQ ID NO: 1864607 - RNA, 19 nt, Human
cuugaguugauucagcucu

SEQ ID NO: 1864608 - RNA, 18 nt, Human
cuugaguugauucagcuc

SEQ ID NO: 1864609 - RNA, 20 nt, Human
cuugaguugauucagcucug

SEQ ID NO: 1864610 - RNA, 21 nt, Human
cuugaguugauucagcucugc

SEQ ID NO: 1864611 - RNA, 15 nt, Human
cuugcaauggcagcc

SEQ ID NO: 1864612 - RNA, 16 nt, Human
cuugcaauggcagccu

SEQ ID NO: 1864613 - RNA, 17 nt, Human
cuugcaauggcagccuu

SEQ ID NO: 1864614 - RNA, 18 nt, Human
cuugcaauggcagccuug

SEQ ID NO: 1864615 - RNA, 21 nt, Human
cuugcagacucuacagaggcc

SEQ ID NO: 1864616 - RNA, 20 nt, Human
cuugcagacucuacagaggc

SEQ ID NO: 1864617 - RNA, 17 nt, Human
cuucuggcacuuggaga

SEQ ID NO: 1864618 - RNA, 15 nt, Human
cuugagccugggagg

SEQ ID NO: 1864619 - RNA, 12 nt, Human
cuugagccuggg

SEQ ID NO: 1864620 - RNA, 15 nt, Human
cuugaggguugggcu

SEQ ID NO: 1864621 - RNA, 17 nt, Human
cuugaggguugggcugg

SEQ ID NO: 1864622 - RNA, 18 nt, Human
cuugcccuggugccucac

SEQ ID NO: 1864623 - RNA, 14 nt, Human
cuugcaugaggcua

SEQ ID NO: 1864624 - RNA, 13 nt, Human
cuugcaugaggcu

SEQ ID NO: 1864625 - RNA, 17 nt, Human
cuugcaugaggcuagug

SEQ ID NO: 1864626 - RNA, 18 nt, Human
cuugcucuugaugccugg

SEQ ID NO: 1864627 - RNA, 17 nt, Human
cuugcucuugaugccug

SEQ ID NO: 1864628 - RNA, 19 nt, Human
cuugcucuugaugccuggc

SEQ ID NO: 1864629 - RNA, 22 nt, Human
cuugcucugcugacagacacag

SEQ ID NO: 1864630 - RNA, 20 nt, Human
cuuggaagcuccgcuuucua

SEQ ID NO: 1864631 - RNA, 14 nt, Human
cuuggaagcuccgc

SEQ ID NO: 1864632 - RNA, 20 nt, Human
cuugcuugauuguauggugg

SEQ ID NO: 1864633 - RNA, 18 nt, Human
gaauuucccaaagcagug

SEQ ID NO: 1864634 - RNA, 16 nt, Human
gaauuucccaaagcag

SEQ ID NO: 1864635 - RNA, 22 nt, Human
gaauuucccaaagcagugcaug

SEQ ID NO: 1864636 - RNA, 22 nt, Human
gacacgaauauugcugauggug

SEQ ID NO: 1864637 - RNA, 16 nt, Human
gacacuagaagauuuu

SEQ ID NO: 1864638 - RNA, 17 nt, Human
gacagacacaggcccgg

SEQ ID NO: 1864639 - RNA, 20 nt, Human
gacagacacaggcccggcuc

SEQ ID NO: 1864640 - RNA, 22 nt, Human
gacagacacaggcccggcucca

SEQ ID NO: 1864641 - RNA, 16 nt, Human
gacagacagcccucca

SEQ ID NO: 1864642 - RNA, 20 nt, Human
gacagagcuacacaggggaa

SEQ ID NO: 1864643 - RNA, 12 nt, Human
gacagaggcagc

SEQ ID NO: 1864644 - RNA, 13 nt, Human
gacagagggggug

SEQ ID NO: 1864645 - RNA, 23 nt, Human
gacagaggcagccccauucugcc

SEQ ID NO: 1864646 - RNA, 19 nt, Human
gacagagugagacucuguc

SEQ ID NO: 1864647 - RNA, 21 nt, Human
gacagagucucacuguugccc

SEQ ID NO: 1864648 - RNA, 16 nt, Human
gacagagugagacucu

SEQ ID NO: 1864649 - RNA, 16 nt, Human
gacaucaacugcauca

SEQ ID NO: 1864650 - RNA, 23 nt, Human
gacaucaacugcaucaagaugug

SEQ ID NO: 1864651 - RNA, 22 nt, Human
gacagggcauggccagguggcc

SEQ ID NO: 1864652 - RNA, 20 nt, Human
gacagggcauggccaggugg

SEQ ID NO: 1864653 - RNA, 15 nt, Human
gacagggcauggcca

SEQ ID NO: 1864654 - RNA, 14 nt, Human
gacagggcauggcc

SEQ ID NO: 1864655 - RNA, 22 nt, Human
gacaggcauguucucugaggac

SEQ ID NO: 1864656 - RNA, 24 nt, Human
gacaggcaaugcuggcuguuggcu

SEQ ID NO: 1864657 - RNA, 23 nt, Human
gacaggcaaugcuggcuguuggc

SEQ ID NO: 1864658 - RNA, 20 nt, Human
gacaggcauguucucugagg

SEQ ID NO: 1864659 - RNA, 21 nt, Human
gacaggcauguucucugagga

SEQ ID NO: 1864660 - RNA, 20 nt, Human
gacaggcaagcaccuccugc

SEQ ID NO: 1864661 - RNA, 21 nt, Human
gacaggcaagcaccuccugcc

SEQ ID NO: 1864662 - RNA, 18 nt, Human
gacaggcaaugcuggcug

SEQ ID NO: 1864663 - RNA, 19 nt, Human
gacaggcaaugcuggcugu

SEQ ID NO: 1864664 - RNA, 13 nt, Human
gacaggcaagcac

SEQ ID NO: 1864665 - RNA, 17 nt, Human
gacaggcaagcaccucc

SEQ ID NO: 1864666 - RNA, 18 nt, Human
gacaggcaagcaccuccu

SEQ ID NO: 1864667 - RNA, 18 nt, Human
gaccacaaaacuuuucua

SEQ ID NO: 1864668 - RNA, 17 nt, Human
gaccaauauuguacagu

SEQ ID NO: 1864669 - RNA, 18 nt, Human
gaccaauauuguacaguu

SEQ ID NO: 1864670 - RNA, 19 nt, Human
gaccaauauuguacaguuu

SEQ ID NO: 1864671 - RNA, 21 nt, Human
gaccaauauuguacaguuuuu

SEQ ID NO: 1864672 - RNA, 22 nt, Human
gaccacacuccagcugggauca

SEQ ID NO: 1864673 - RNA, 16 nt, Human
gaccacacuccagcug

SEQ ID NO: 1864674 - RNA, 14 nt, Human
gaccacacuccagc

SEQ ID NO: 1864675 - RNA, 21 nt, Human
gaccagcaccaucucuccucc

SEQ ID NO: 1864676 - RNA, 20 nt, Human
gaccagcaccaucucuccuc

SEQ ID NO: 1864677 - RNA, 21 nt, Human
gaccagagcugccaccugccu

SEQ ID NO: 1864678 - RNA, 23 nt, Human
gaccagacaccuugacagggcac

SEQ ID NO: 1864679 - RNA, 24 nt, Human
gaccagacaccuugacagggcaca

SEQ ID NO: 1864680 - RNA, 16 nt, Human
gaccacugcagaagac

SEQ ID NO: 1864681 - RNA, 18 nt, Human
gaccacugcagaagacag

SEQ ID NO: 1864682 - RNA, 22 nt, Human
gaccagacaccuugacagggca

SEQ ID NO: 1864683 - RNA, 21 nt, Human
gaccagacaccuugacagggc

SEQ ID NO: 1864684 - RNA, 16 nt, Human
gaccacguuucuaaag

SEQ ID NO: 1864685 - RNA, 22 nt, Human
gacccugcccugugggccccca

SEQ ID NO: 1864686 - RNA, 20 nt, Human
gacccugcccugugggcccc

SEQ ID NO: 1864687 - RNA, 17 nt, Human
gacccugcccugugggc

SEQ ID NO: 1864688 - RNA, 18 nt, Human
gacccugaggcccagagg

SEQ ID NO: 1864689 - RNA, 16 nt, Human
gacccugaggcccaga

SEQ ID NO: 1864690 - RNA, 12 nt, Human
gacccugaggcc

SEQ ID NO: 1864691 - RNA, 11 nt, Human
gacccugaggc

SEQ ID NO: 1864692 - RNA, 20 nt, Human
gacccaugcugcccugugag

SEQ ID NO: 1864693 - RNA, 19 nt, Human
gacccaugcugcccuguga

SEQ ID NO: 1864694 - RNA, 18 nt, Human
gacccaugcugcccugug

SEQ ID NO: 1864695 - RNA, 13 nt, Human
gacccaugcugcc

SEQ ID NO: 1864696 - RNA, 20 nt, Human
gacccaaaaggcagaagcaa

SEQ ID NO: 1864697 - RNA, 19 nt, Human
gacccacuggacucaccuc

SEQ ID NO: 1864698 - RNA, 18 nt, Human
gacccaaaaggcagaagc

SEQ ID NO: 1864699 - RNA, 19 nt, Human
gacccaaaaggcagaagca

SEQ ID NO: 1864700 - RNA, 21 nt, Human
gacugaccaauauuguacagu

SEQ ID NO: 1864701 - RNA, 22 nt, Human
gacugaccaauauuguacaguu

SEQ ID NO: 1864702 - RNA, 11 nt, Human
gacugagaaau

SEQ ID NO: 1864703 - RNA, 21 nt, Human
gacucuacagaggccaugggc

SEQ ID NO: 1864704 - RNA, 16 nt, Human
gacugaauuucuuuug

SEQ ID NO: 1864705 - RNA, 15 nt, Human
gacucuacagaggcc

SEQ ID NO: 1864706 - RNA, 21 nt, Human
gacuccugcaggcagccaggc

SEQ ID NO: 1864707 - RNA, 20 nt, Human
gacuccugcaggcagccagg

SEQ ID NO: 1864708 - RNA, 19 nt, Human
gacuccugcaggcagccag

SEQ ID NO: 1864709 - RNA, 18 nt, Human
gacuccugcaggcagcca

SEQ ID NO: 1864710 - RNA, 18 nt, Human
gacuacaggcacccacca

SEQ ID NO: 1864711 - RNA, 13 nt, Human
gacuacaggcacc

SEQ ID NO: 1864712 - RNA, 15 nt, Human
gacuacaggcaccca

SEQ ID NO: 1864713 - RNA, 16 nt, Human
gacugaggggagggga

SEQ ID NO: 1864714 - RNA, 18 nt, Human
gacugaguacguugugca

SEQ ID NO: 1864715 - RNA, 13 nt, Human
gacugagaaauuu

SEQ ID NO: 1864716 - RNA, 20 nt, Human
gacugccagucccccugccc

SEQ ID NO: 1864717 - RNA, 15 nt, Human
gacuuacuguacaug

SEQ ID NO: 1864718 - RNA, 16 nt, Human
gacuuacuguacauga

SEQ ID NO: 1864719 - RNA, 12 nt, Human
gacuuacuguac

SEQ ID NO: 1864720 - RNA, 18 nt, Human
gacuuacuguacaugaaa

SEQ ID NO: 1864721 - RNA, 23 nt, Human
gacuuacuguacaugaaaacaca

SEQ ID NO: 1864722 - RNA, 15 nt, Human
gacuuagcugggaga

SEQ ID NO: 1864723 - RNA, 16 nt, Human
gacuuauuuauauaaa

SEQ ID NO: 1864724 - RNA, 20 nt, Human
gacuucaucccucuggggcu

SEQ ID NO: 1864725 - RNA, 12 nt, Human
gacuucaucccu

SEQ ID NO: 1864726 - RNA, 14 nt, Human
gacuucagcucugu

SEQ ID NO: 1864727 - RNA, 23 nt, Human
gacuggccaagguuuggggaaga

SEQ ID NO: 1864728 - RNA, 15 nt, Human
gacccuugugguccc

SEQ ID NO: 1864729 - RNA, 23 nt, Human
gacccuugccgucuaccugaggg

SEQ ID NO: 1864730 - RNA, 20 nt, Human
gacccuugccgucuaccuga

SEQ ID NO: 1864731 - RNA, 19 nt, Human
gacccuugccgucuaccug

SEQ ID NO: 1864732 - RNA, 19 nt, Human
gaccuguggccaaguucuu

SEQ ID NO: 1864733 - RNA, 16 nt, Human
gaccuucuccuucacc

SEQ ID NO: 1864734 - RNA, 15 nt, Human
gaccuucuccuucac

SEQ ID NO: 1864735 - RNA, 14 nt, Human
gaccuucuccuuca

SEQ ID NO: 1864736 - RNA, 21 nt, Human
gaccuucuccuucaccuuugu

SEQ ID NO: 1864737 - RNA, 20 nt, Human
gaccuucuccuucaccuuug

SEQ ID NO: 1864738 - RNA, 14 nt, Human
gaccuugaacuggg

SEQ ID NO: 1864739 - RNA, 16 nt, Human
gacgugauuuugcugu

SEQ ID NO: 1864740 - RNA, 17 nt, Human
gacgugauuuugcugua

SEQ ID NO: 1864741 - RNA, 20 nt, Human
gaccuuucaauaggaaaaac

SEQ ID NO: 1864742 - RNA, 19 nt, Human
gaccuuucaauaggaaaaa

SEQ ID NO: 1864743 - RNA, 11 nt, Human
gaccuuucaau

SEQ ID NO: 1864744 - RNA, 22 nt, Human
gaccuuuaagagaaaugagcug

SEQ ID NO: 1864745 - RNA, 22 nt, Human
gacgcugugcugcccugcccac

SEQ ID NO: 1864746 - RNA, 21 nt, Human
gacgcugugcugcccugccca

SEQ ID NO: 1864747 - RNA, 13 nt, Human
gacggagucccac

SEQ ID NO: 1864748 - RNA, 23 nt, Human
gacuaacuugucuuuggacccug

SEQ ID NO: 1864749 - RNA, 16 nt, Human
gacuaacuugucuuug

SEQ ID NO: 1864750 - RNA, 15 nt, Human
gacguguuaugacuc

SEQ ID NO: 1864751 - RNA, 14 nt, Human
gacguguuaugacu

SEQ ID NO: 1864752 - RNA, 11 nt, Human
gacguguuaug

SEQ ID NO: 1864753 - RNA, 16 nt, Human
gaacagugauuaccag

SEQ ID NO: 1864754 - RNA, 20 nt, Human
gaacagugauuaccagggac

SEQ ID NO: 1864755 - RNA, 15 nt, Human
gaacacucugagacu

SEQ ID NO: 1864756 - RNA, 14 nt, Human
gaacacucugagac

SEQ ID NO: 1864757 - RNA, 13 nt, Human
gaacacucugaga

SEQ ID NO: 1864758 - RNA, 17 nt, Human
gaaauuuauaaacuuuu

SEQ ID NO: 1864759 - RNA, 16 nt, Human
gaaauuuauaaacuuu

SEQ ID NO: 1864760 - RNA, 18 nt, Human
gaaauuguauuacaaauc

SEQ ID NO: 1864761 - RNA, 23 nt, Human
gaaaauaaaucaaugcuauaacu

SEQ ID NO: 1864762 - RNA, 16 nt, Human
gaaauuguauuacaaa

SEQ ID NO: 1864763 - RNA, 14 nt, Human
gaacaucccuccug

SEQ ID NO: 1864764 - RNA, 13 nt, Human
gaacauugcaaua

SEQ ID NO: 1864765 - RNA, 15 nt, Human
gaacauugcaauaga

SEQ ID NO: 1864766 - RNA, 17 nt, Human
gaacauugcaauagaaa

SEQ ID NO: 1864767 - RNA, 21 nt, Human
gaaccuuuugagugccuuaca

SEQ ID NO: 1864768 - RNA, 19 nt, Human
gaaccuuuugagugccuua

SEQ ID NO: 1864769 - RNA, 18 nt, Human
gaaccuuuugagugccuu

SEQ ID NO: 1864770 - RNA, 14 nt, Human
gaacuacugaggau

SEQ ID NO: 1864771 - RNA, 12 nt, Human
gaacguuuuucc

SEQ ID NO: 1864772 - RNA, 15 nt, Human
gaacguuuuuccugu

SEQ ID NO: 1864773 - RNA, 22 nt, Human
gaaccuuuugagugccuuacac

SEQ ID NO: 1864774 - RNA, 13 nt, Human
gaagacuuuggaa

SEQ ID NO: 1864775 - RNA, 11 nt, Human
gaagacuuugg

SEQ ID NO: 1864776 - RNA, 23 nt, Human
gaacuuugaccucugcagcaaua

SEQ ID NO: 1864777 - RNA, 21 nt, Human
gaacucaucuagguaaauuac

SEQ ID NO: 1864778 - RNA, 20 nt, Human
gaacucaucuagguaaauua

SEQ ID NO: 1864779 - RNA, 22 nt, Human
gaacucaucuagguaaauuaca

SEQ ID NO: 1864780 - RNA, 19 nt, Human
gaagagaaugcacaaacag

SEQ ID NO: 1864781 - RNA, 20 nt, Human
gaagacuuuucuuucagcca

SEQ ID NO: 1864782 - RNA, 17 nt, Human
gaagacuuuggaaagag

SEQ ID NO: 1864783 - RNA, 14 nt, Human
gaagacuuuggaaa

SEQ ID NO: 1864784 - RNA, 23 nt, Human
gaagcccuucuaccuuccugcaa

SEQ ID NO: 1864785 - RNA, 19 nt, Human
gaagcccaggaaaggcucc

SEQ ID NO: 1864786 - RNA, 16 nt, Human
gaagcccaggaaaggc

SEQ ID NO: 1864787 - RNA, 15 nt, Human
gaagcccaggaaagg

SEQ ID NO: 1864788 - RNA, 13 nt, Human
gaagcccaggaaa

SEQ ID NO: 1864789 - RNA, 22 nt, Human
gaagccagcaggcucucaggcc

SEQ ID NO: 1864790 - RNA, 21 nt, Human
gaagccagcaggcucucaggc

SEQ ID NO: 1864791 - RNA, 20 nt, Human
gaagccagcaggcucucagg

SEQ ID NO: 1864792 - RNA, 17 nt, Human
gaagcauuuacuuugug

SEQ ID NO: 1864793 - RNA, 18 nt, Human
gaagcauuuacuuugugu

SEQ ID NO: 1864794 - RNA, 20 nt, Human
gaagauaauauuaaggaaga

SEQ ID NO: 1864795 - RNA, 18 nt, Human
gaagauguagaggagaaa

SEQ ID NO: 1864796 - RNA, 19 nt, Human
gaagggggcugggacaugg

SEQ ID NO: 1864797 - RNA, 16 nt, Human
gaagggggcugggaca

SEQ ID NO: 1864798 - RNA, 22 nt, Human
gaaguaauaugcacacauuuuu

SEQ ID NO: 1864799 - RNA, 18 nt, Human
gaaguacuauaauuuacc

SEQ ID NO: 1864800 - RNA, 15 nt, Human
gaaguacuggagaaa

SEQ ID NO: 1864801 - RNA, 20 nt, Human
gaaguuucugccgcagcccu

SEQ ID NO: 1864802 - RNA, 15 nt, Human
gaagucuuagaugua

SEQ ID NO: 1864803 - RNA, 21 nt, Human
gaaguuucugccgcagcccug

SEQ ID NO: 1864804 - RNA, 18 nt, Human
gaagucuuagauguauau

SEQ ID NO: 1864805 - RNA, 16 nt, Human
gaaguauccuucagcc

SEQ ID NO: 1864806 - RNA, 14 nt, Human
gaaguauccuucag

SEQ ID NO: 1864807 - RNA, 23 nt, Human
gaaguaguggagccccugcucug

SEQ ID NO: 1864808 - RNA, 19 nt, Human
gaauaacauguaauuaagu

SEQ ID NO: 1864809 - RNA, 18 nt, Human
gaauaacauguaauuaag

SEQ ID NO: 1864810 - RNA, 20 nt, Human
gaaguuugagaucagccugg

SEQ ID NO: 1864811 - RNA, 17 nt, Human
gaauaauacaguaucuc

SEQ ID NO: 1864812 - RNA, 21 nt, Human
gaauacagaggcaacugcauu

SEQ ID NO: 1864813 - RNA, 15 nt, Human
gaauaccuguccccc

SEQ ID NO: 1864814 - RNA, 13 nt, Human
gaauaccuguccc

SEQ ID NO: 1864815 - RNA, 23 nt, Human
gaauagcugggacuacaggugug

SEQ ID NO: 1864816 - RNA, 22 nt, Human
gaauagcugggacuacaggugu

SEQ ID NO: 1864817 - RNA, 23 nt, Human
gaauuguguuuauaauuuuaaau

SEQ ID NO: 1864818 - RNA, 15 nt, Human
gaauuguguuuauaa

SEQ ID NO: 1864819 - RNA, 22 nt, Human
gaauuguaaggaaugauuaauu

SEQ ID NO: 1864820 - RNA, 15 nt, Human
gaauuucccaaagca

SEQ ID NO: 1864821 - RNA, 14 nt, Human
gaauugaagcagga

SEQ ID NO: 1864822 - RNA, 14 nt, Human
gaauugaaaaacca

SEQ ID NO: 1864823 - RNA, 19 nt, Human
gaauucucuaguuugauua

SEQ ID NO: 1864824 - RNA, 21 nt, Human
gaaugucagugugacugaucu

SEQ ID NO: 1864825 - RNA, 20 nt, Human
gaaugucagugugacugauc

SEQ ID NO: 1864826 - RNA, 17 nt, Human
gaauucucagaaucuca

SEQ ID NO: 1864827 - RNA, 17 nt, Human
gaauucucuaguuugau

SEQ ID NO: 1864828 - RNA, 22 nt, Human
gaaugguuuucaaaauaaaaau

SEQ ID NO: 1864829 - RNA, 14 nt, Human
gaaugucaguguga

SEQ ID NO: 1864830 - RNA, 13 nt, Human
gaaugcuuuagga

SEQ ID NO: 1864831 - RNA, 14 nt, Human
gaaugcauaaaaug

SEQ ID NO: 1864832 - RNA, 11 nt, Human
gaaugcagugg

SEQ ID NO: 1864833 - RNA, 22 nt, Human
gaaugaaccacaucuugcucug

SEQ ID NO: 1864834 - RNA, 18 nt, Human
gaaugaaccacaucuugc

SEQ ID NO: 1864835 - RNA, 23 nt, Human
gaaugaaccacaucuugcucugc

SEQ ID NO: 1864836 - RNA, 12 nt, Human
gauaauacacca

SEQ ID NO: 1864837 - RNA, 23 nt, Human
gauaauacaccacuacauucugu

SEQ ID NO: 1864838 - RNA, 24 nt, Human
gauaauacaccacuacauucuguu

SEQ ID NO: 1864839 - RNA, 13 nt, Human
gaguucugguucc

SEQ ID NO: 1864840 - RNA, 13 nt, Human
gauaaacaguagu

SEQ ID NO: 1864841 - RNA, 16 nt, Human
gaucacauguggacuu

SEQ ID NO: 1864842 - RNA, 14 nt, Human
gaucacagccucug

SEQ ID NO: 1864843 - RNA, 23 nt, Human
gaucacggcucacugcagccuca

SEQ ID NO: 1864844 - RNA, 20 nt, Human
gaucacggcucacugcagcc

SEQ ID NO: 1864845 - RNA, 20 nt, Human
gauagugucccacggugccu

SEQ ID NO: 1864846 - RNA, 18 nt, Human
gauauaaaagacugacca

SEQ ID NO: 1864847 - RNA, 18 nt, Human
gauauaugcucugcaugu

SEQ ID NO: 1864848 - RNA, 18 nt, Human
gauaauucuagcuuugag

SEQ ID NO: 1864849 - RNA, 17 nt, Human
gauacaaaagcauguga

SEQ ID NO: 1864850 - RNA, 16 nt, Human
gauacaaaagcaugug

SEQ ID NO: 1864851 - RNA, 17 nt, Human
gauaggucagugcaaau

SEQ ID NO: 1864852 - RNA, 18 nt, Human
gauccuaggcauuugcug

SEQ ID NO: 1864853 - RNA, 23 nt, Human
gauccuaaugaaugcauaaaaug

SEQ ID NO: 1864854 - RNA, 14 nt, Human
gauccuccaggugc

SEQ ID NO: 1864855 - RNA, 16 nt, Human
gauccucccaccucag

SEQ ID NO: 1864856 - RNA, 17 nt, Human
gauccucccaccucagc

SEQ ID NO: 1864857 - RNA, 18 nt, Human
gauccucccaccucagcc

SEQ ID NO: 1864858 - RNA, 13 nt, Human
gaucauccacugu

SEQ ID NO: 1864859 - RNA, 16 nt, Human
gaucauccacugugcc

SEQ ID NO: 1864860 - RNA, 20 nt, Human
gaucuaggaagacuuuggaa

SEQ ID NO: 1864861 - RNA, 18 nt, Human
gaucuaggaagacuuugg

SEQ ID NO: 1864862 - RNA, 14 nt, Human
gaucuaggaagacu

SEQ ID NO: 1864863 - RNA, 13 nt, Human
gaucuaggaagac

SEQ ID NO: 1864864 - RNA, 12 nt, Human
gauccugagcca

SEQ ID NO: 1864865 - RNA, 16 nt, Human
gauccucccaggcuuc

SEQ ID NO: 1864866 - RNA, 16 nt, Human
gaugagaggaaaucac

SEQ ID NO: 1864867 - RNA, 14 nt, Human
gaugcagugcuucc

SEQ ID NO: 1864868 - RNA, 14 nt, Human
gaugccugguggca

SEQ ID NO: 1864869 - RNA, 15 nt, Human
gaugccugguggcag

SEQ ID NO: 1864870 - RNA, 16 nt, Human
gaugccugguggcagc

SEQ ID NO: 1864871 - RNA, 20 nt, Human
gaugaccuugaaugaugcca

SEQ ID NO: 1864872 - RNA, 23 nt, Human
gaugagaaauaaaguuucuguug

SEQ ID NO: 1864873 - RNA, 18 nt, Human
gaugaccuugaaugaugc

SEQ ID NO: 1864874 - RNA, 14 nt, Human
gaugagaggaaauc

SEQ ID NO: 1864875 - RNA, 14 nt, Human
gaugcaccagcccu

SEQ ID NO: 1864876 - RNA, 15 nt, Human
gaugcaccagcccuu

SEQ ID NO: 1864877 - RNA, 23 nt, Human
gaugcaccagcccuuagcaggga

SEQ ID NO: 1864878 - RNA, 22 nt, Human
gaucuucuguggguuucuaaag

SEQ ID NO: 1864879 - RNA, 19 nt, Human
gaucuucuuuauaauucua

SEQ ID NO: 1864880 - RNA, 15 nt, Human
gaugaaaugagguca

SEQ ID NO: 1864881 - RNA, 21 nt, Human
gaugaaaugaggucagagccu

SEQ ID NO: 1864882 - RNA, 16 nt, Human
gaugaaauguaaauac

SEQ ID NO: 1864883 - RNA, 21 nt, Human
gcaaaccaucauugaaaucuu

SEQ ID NO: 1864884 - RNA, 20 nt, Human
gcaaaccaucauugaaaucu

SEQ ID NO: 1864885 - RNA, 19 nt, Human
gcaaaccaucauugaaauc

SEQ ID NO: 1864886 - RNA, 17 nt, Human
gcaaaccaucauugaaa

SEQ ID NO: 1864887 - RNA, 16 nt, Human
gcaaaccaucauugaa

SEQ ID NO: 1864888 - RNA, 18 nt, Human
gcaaacuuuauuuugugu

SEQ ID NO: 1864889 - RNA, 12 nt, Human
gcaaaugugaau

SEQ ID NO: 1864890 - RNA, 18 nt, Human
gcaacugcauuggcuuug

SEQ ID NO: 1864891 - RNA, 20 nt, Human
gcaaacuuuauuuuguguuu

SEQ ID NO: 1864892 - RNA, 23 nt, Human
gcaaaguucccuacuuccuguga

SEQ ID NO: 1864893 - RNA, 22 nt, Human
gcaacuuuguauaaaagggacu

SEQ ID NO: 1864894 - RNA, 18 nt, Human
gcaagcaagaaacacugg

SEQ ID NO: 1864895 - RNA, 15 nt, Human
gcaagcaccuccugc

SEQ ID NO: 1864896 - RNA, 16 nt, Human
gcaagcaccuccugcc

SEQ ID NO: 1864897 - RNA, 18 nt, Human
gcaagcaccuccugccuc

SEQ ID NO: 1864898 - RNA, 20 nt, Human
gcaagcaccuccugccucga

SEQ ID NO: 1864899 - RNA, 18 nt, Human
gcaaggcugucaauuaca

SEQ ID NO: 1864900 - RNA, 14 nt, Human
gcaaggcugucaau

SEQ ID NO: 1864901 - RNA, 21 nt, Human
gcaagggaauuucuucaacuc

SEQ ID NO: 1864902 - RNA, 17 nt, Human
gcaauccugcaagaaca

SEQ ID NO: 1864903 - RNA, 15 nt, Human
gauucccaagcucug

SEQ ID NO: 1864904 - RNA, 18 nt, Human
gauucagacagcugccug

SEQ ID NO: 1864905 - RNA, 17 nt, Human
gauucagacagcugccu

SEQ ID NO: 1864906 - RNA, 14 nt, Human
gauucagacagcug

SEQ ID NO: 1864907 - RNA, 13 nt, Human
gauucagacagcu

SEQ ID NO: 1864908 - RNA, 13 nt, Human
gauuacaagcgug

SEQ ID NO: 1864909 - RNA, 21 nt, Human
gauuacaagcgugagccacug

SEQ ID NO: 1864910 - RNA, 21 nt, Human
gauguuuuaaggaugcuugua

SEQ ID NO: 1864911 - RNA, 14 nt, Human
gauguucugggaca

SEQ ID NO: 1864912 - RNA, 18 nt, Human
gauguucuagcauggcug

SEQ ID NO: 1864913 - RNA, 22 nt, Human
gaugcgggccagugcuccagcc

SEQ ID NO: 1864914 - RNA, 16 nt, Human
gaugcuagaacucccu

SEQ ID NO: 1864915 - RNA, 20 nt, Human
gaugcgggccagugcuccag

SEQ ID NO: 1864916 - RNA, 17 nt, Human
gaugccugguggcagcu

SEQ ID NO: 1864917 - RNA, 20 nt, Human
gaugccugugaacugaacuc

SEQ ID NO: 1864918 - RNA, 17 nt, Human
gauugcaacaggcuggg

SEQ ID NO: 1864919 - RNA, 18 nt, Human
gauugcaacaggcugggc

SEQ ID NO: 1864920 - RNA, 18 nt, Human
gauugcuugagcucagga

SEQ ID NO: 1864921 - RNA, 16 nt, Human
gauucccaagcucugc

SEQ ID NO: 1864922 - RNA, 17 nt, Human
gauucccaagcucugcu

SEQ ID NO: 1864923 - RNA, 19 nt, Human
gauucuuuccugaggcugg

SEQ ID NO: 1864924 - RNA, 18 nt, Human
gauucccaagcucugcuc

SEQ ID NO: 1864925 - RNA, 22 nt, Human
gauucuuuccugaggcugggcu

SEQ ID NO: 1864926 - RNA, 20 nt, Human
gauucuuuccugaggcuggg

SEQ ID NO: 1864927 - RNA, 16 nt, Human
gauugcaacaggcugg

SEQ ID NO: 1864928 - RNA, 16 nt, Human
gauugggaauccgccc

SEQ ID NO: 1864929 - RNA, 22 nt, Human
gauuucuguuuagauaauacac

SEQ ID NO: 1864930 - RNA, 21 nt, Human
gauuucuguuuagauaauaca

SEQ ID NO: 1864931 - RNA, 14 nt, Human
gcagccgugccuuc

SEQ ID NO: 1864932 - RNA, 17 nt, Human
gcagccgugccuucagc

SEQ ID NO: 1864933 - RNA, 15 nt, Human
gcagccgugccuuca

SEQ ID NO: 1864934 - RNA, 19 nt, Human
gcagccucaaccuccuggg

SEQ ID NO: 1864935 - RNA, 20 nt, Human
gcagccucaaccuccugggc

SEQ ID NO: 1864936 - RNA, 14 nt, Human
gcagccuggacccu

SEQ ID NO: 1864937 - RNA, 18 nt, Human
gcagccgugccuucagcu

SEQ ID NO: 1864938 - RNA, 21 nt, Human
gcagccucaaccuccugggcu

SEQ ID NO: 1864939 - RNA, 22 nt, Human
gcagccucaaccuccugggcua

SEQ ID NO: 1864940 - RNA, 21 nt, Human
gcaggaguuucguuuucaaaa

SEQ ID NO: 1864941 - RNA, 20 nt, Human
gcaggaguuucguuuucaaa

SEQ ID NO: 1864942 - RNA, 18 nt, Human
gcagaaggaagacuucau

SEQ ID NO: 1864943 - RNA, 19 nt, Human
gcagagaaugaaagggccc

SEQ ID NO: 1864944 - RNA, 20 nt, Human
gcagagaaugaaagggccca

SEQ ID NO: 1864945 - RNA, 21 nt, Human
gcagagaaugaaagggcccag

SEQ ID NO: 1864946 - RNA, 21 nt, Human
gcagagaauucucuuauccaa

SEQ ID NO: 1864947 - RNA, 22 nt, Human
gcagagaaugaaagggcccaga

SEQ ID NO: 1864948 - RNA, 23 nt, Human
gcagagaaugaaagggcccagag

SEQ ID NO: 1864949 - RNA, 19 nt, Human
gcagagaccaucccugaag

SEQ ID NO: 1864950 - RNA, 17 nt, Human
gcagagaccaucccuga

SEQ ID NO: 1864951 - RNA, 15 nt, Human
gcagagaccaucccu

SEQ ID NO: 1864952 - RNA, 14 nt, Human
gcagagaccauccc

SEQ ID NO: 1864953 - RNA, 15 nt, Human
gcagaguugaagaca

SEQ ID NO: 1864954 - RNA, 17 nt, Human
gcagaguugaagacaga

SEQ ID NO: 1864955 - RNA, 16 nt, Human
gcagaguugaagacag

SEQ ID NO: 1864956 - RNA, 19 nt, Human
gcagaguugaagacagagc

SEQ ID NO: 1864957 - RNA, 12 nt, Human
gcagcaauaaag

SEQ ID NO: 1864958 - RNA, 14 nt, Human
gcacccggccccug

SEQ ID NO: 1864959 - RNA, 15 nt, Human
gcacccggccccugc

SEQ ID NO: 1864960 - RNA, 17 nt, Human
gcacccggccccugcug

SEQ ID NO: 1864961 - RNA, 14 nt, Human
gcaccuccugccuc

SEQ ID NO: 1864962 - RNA, 15 nt, Human
gcaccuccugccucg

SEQ ID NO: 1864963 - RNA, 19 nt, Human
gcaccacugcacuccagcc

SEQ ID NO: 1864964 - RNA, 14 nt, Human
gcaaugaccuuuca

SEQ ID NO: 1864965 - RNA, 13 nt, Human
gcaaugaccuuuc

SEQ ID NO: 1864966 - RNA, 19 nt, Human
gcacagcuaacauggaagu

SEQ ID NO: 1864967 - RNA, 16 nt, Human
gcacagcuucauuucc

SEQ ID NO: 1864968 - RNA, 14 nt, Human
gcagaagacaguau

SEQ ID NO: 1864969 - RNA, 14 nt, Human
gcagaaggaagacu

SEQ ID NO: 1864970 - RNA, 13 nt, Human
gcagaaggaagac

SEQ ID NO: 1864971 - RNA, 12 nt, Human
gcagaaggaaga

SEQ ID NO: 1864972 - RNA, 23 nt, Human
gcacugggcuuggggaccagagc

SEQ ID NO: 1864973 - RNA, 22 nt, Human
gcacugggcuuggggaccagag

SEQ ID NO: 1864974 - RNA, 17 nt, Human
gcacugaggaccagcca

SEQ ID NO: 1864975 - RNA, 19 nt, Human
gcacuaaggugugcucuga

SEQ ID NO: 1864976 - RNA, 18 nt, Human
gcacuaaggugugcucug

SEQ ID NO: 1864977 - RNA, 17 nt, Human
gcacuaaggugugcucu

SEQ ID NO: 1864978 - RNA, 18 nt, Human
gcacccggccccugcugg

SEQ ID NO: 1864979 - RNA, 11 nt, Human
gcaggucccua

SEQ ID NO: 1864980 - RNA, 10 nt, Human
gcaggucccu

SEQ ID NO: 1864981 - RNA, 13 nt, Human
gcaggucccuaau

SEQ ID NO: 1864982 - RNA, 12 nt, Human
gcaggucccuaa

SEQ ID NO: 1864983 - RNA, 23 nt, Human
gcagugcuuccaaggauggacca

SEQ ID NO: 1864984 - RNA, 16 nt, Human
gcagugggagcugccu

SEQ ID NO: 1864985 - RNA, 17 nt, Human
gcagggagggccugggc

SEQ ID NO: 1864986 - RNA, 14 nt, Human
gcagggagggccug

SEQ ID NO: 1864987 - RNA, 20 nt, Human
gcaggauucuuccucccucc

SEQ ID NO: 1864988 - RNA, 16 nt, Human
gcagggagggcuucug

SEQ ID NO: 1864989 - RNA, 22 nt, Human
gcagggagggccugggccccag

SEQ ID NO: 1864990 - RNA, 18 nt, Human
gcagggagggccugggcc

SEQ ID NO: 1864991 - RNA, 14 nt, Human
gcagggcucagcgg

SEQ ID NO: 1864992 - RNA, 12 nt, Human
gcagggcucagc

SEQ ID NO: 1864993 - RNA, 15 nt, Human
gcauauucaggaagc

SEQ ID NO: 1864994 - RNA, 23 nt, Human
gcauauuauuuuauguugcauag

SEQ ID NO: 1864995 - RNA, 18 nt, Human
gcauauuauuuuauguug

SEQ ID NO: 1864996 - RNA, 20 nt, Human
gcauauucaggaagcucagg

SEQ ID NO: 1864997 - RNA, 18 nt, Human
gcauauucaggaagcuca

SEQ ID NO: 1864998 - RNA, 17 nt, Human
gcauauucaggaagcuc

SEQ ID NO: 1864999 - RNA, 21 nt, Human
gcaucaagaugugacauguuu

SEQ ID NO: 1865000 - RNA, 19 nt, Human
gcauauuuauaaaaauaaa

SEQ ID NO: 1865001 - RNA, 17 nt, Human
gcagugggagcugccug

SEQ ID NO: 1865002 - RNA, 18 nt, Human
gcagugggagcugccugu

SEQ ID NO: 1865003 - RNA, 20 nt, Human
gcauuagauuucucauuugc

SEQ ID NO: 1865004 - RNA, 15 nt, Human
gcaugcugucccuua

SEQ ID NO: 1865005 - RNA, 17 nt, Human
gcauguuugugauugac

SEQ ID NO: 1865006 - RNA, 22 nt, Human
gcaugccuggauggggcugcac

SEQ ID NO: 1865007 - RNA, 17 nt, Human
gcaugccuggauggggc

SEQ ID NO: 1865008 - RNA, 17 nt, Human
gcaugaauuugugaagg

SEQ ID NO: 1865009 - RNA, 20 nt, Human
gcaugacacgaauauugcug

SEQ ID NO: 1865010 - RNA, 15 nt, Human
gcaugaauuugugaa

SEQ ID NO: 1865011 - RNA, 17 nt, Human
gcaucaggccaggcccu

SEQ ID NO: 1865012 - RNA, 16 nt, Human
gcaucaggccaggccc

SEQ ID NO: 1865013 - RNA, 15 nt, Human
gcaucaggccaggcc

SEQ ID NO: 1865014 - RNA, 13 nt, Human
gcaucaggccagg

SEQ ID NO: 1865015 - RNA, 17 nt, Human
gcauuuuacuguacaga

SEQ ID NO: 1865016 - RNA, 16 nt, Human
gcauuuuacuguacag

SEQ ID NO: 1865017 - RNA, 21 nt, Human
gcauuuggugguuucagaaau

SEQ ID NO: 1865018 - RNA, 23 nt, Human
gcauuugcugaauacagaggcaa

SEQ ID NO: 1865019 - RNA, 12 nt, Human
gcauuccccacu

SEQ ID NO: 1865020 - RNA, 12 nt, Human
gcauuccccagg

SEQ ID NO: 1865021 - RNA, 15 nt, Human
gcauucucacuccua

SEQ ID NO: 1865022 - RNA, 13 nt, Human
gcauucucacucc

SEQ ID NO: 1865023 - RNA, 18 nt, Human
gcauucucacuccuaccu

SEQ ID NO: 1865024 - RNA, 20 nt, Human
gccaaaggaagcacaugccu

SEQ ID NO: 1865025 - RNA, 16 nt, Human
gccaaaggaagcacau

SEQ ID NO: 1865026 - RNA, 14 nt, Human
gccaaaggaagcac

SEQ ID NO: 1865027 - RNA, 19 nt, Human
gccaaacucaccugccccu

SEQ ID NO: 1865028 - RNA, 21 nt, Human
gccaaacucaccugccccuca

SEQ ID NO: 1865029 - RNA, 22 nt, Human
gcauuuugcuaaaugugaauga

SEQ ID NO: 1865030 - RNA, 12 nt, Human
gccagccuugac

SEQ ID NO: 1865031 - RNA, 20 nt, Human
gccagccgagauagccaagg

SEQ ID NO: 1865032 - RNA, 21 nt, Human
gccagccgagauagccaaggc

SEQ ID NO: 1865033 - RNA, 19 nt, Human
gccagauucuuuccugagg

SEQ ID NO: 1865034 - RNA, 17 nt, Human
gccagauucuuuccuga

SEQ ID NO: 1865035 - RNA, 16 nt, Human
gccagauucuuuccug

SEQ ID NO: 1865036 - RNA, 19 nt, Human
gccagagggagugacagag

SEQ ID NO: 1865037 - RNA, 20 nt, Human
gccagagggagugacagagg

SEQ ID NO: 1865038 - RNA, 22 nt, Human
gccagccuugaccauucuccac

SEQ ID NO: 1865039 - RNA, 21 nt, Human
gccagccuugaccauucucca

SEQ ID NO: 1865040 - RNA, 20 nt, Human
gccagccuugaccauucucc

SEQ ID NO: 1865041 - RNA, 14 nt, Human
gccagccuugacca

SEQ ID NO: 1865042 - RNA, 15 nt, Human
gccagcugcuugggc

SEQ ID NO: 1865043 - RNA, 16 nt, Human
gccagcugcuugggcu

SEQ ID NO: 1865044 - RNA, 14 nt, Human
gccagcugcuuggg

SEQ ID NO: 1865045 - RNA, 15 nt, Human
gccagagacacaagc

SEQ ID NO: 1865046 - RNA, 12 nt, Human
gccagagacaca

SEQ ID NO: 1865047 - RNA, 18 nt, Human
gccagagggagugacaga

SEQ ID NO: 1865048 - RNA, 19 nt, Human
gccacuccagaccccuggc

SEQ ID NO: 1865049 - RNA, 18 nt, Human
gccacuccagaccccugg

SEQ ID NO: 1865050 - RNA, 16 nt, Human
gccacuccagaccccu

SEQ ID NO: 1865051 - RNA, 19 nt, Human
gccacugcaccgggccaca

SEQ ID NO: 1865052 - RNA, 17 nt, Human
gccacugcaccgggcca

SEQ ID NO: 1865053 - RNA, 18 nt, Human
gccacugcaccgggccac

SEQ ID NO: 1865054 - RNA, 14 nt, Human
gccacggccaggcc

SEQ ID NO: 1865055 - RNA, 15 nt, Human
gccacggccaggcca

SEQ ID NO: 1865056 - RNA, 21 nt, Human
gccacuauuguuagucucuug

SEQ ID NO: 1865057 - RNA, 16 nt, Human
gccacggccaggccag

SEQ ID NO: 1865058 - RNA, 22 nt, Human
gccacguucuuacuaguuuccc

SEQ ID NO: 1865059 - RNA, 18 nt, Human
gccaggaagccagcaggc

SEQ ID NO: 1865060 - RNA, 17 nt, Human
gccaggaagccagcagg

SEQ ID NO: 1865061 - RNA, 11 nt, Human
gccaggaagcc

SEQ ID NO: 1865062 - RNA, 19 nt, Human
gccaggaagccagcaggcu

SEQ ID NO: 1865063 - RNA, 20 nt, Human
gccaggaagccagcaggcuc

SEQ ID NO: 1865064 - RNA, 23 nt, Human
gccaggggaaaaucagccugcuc

SEQ ID NO: 1865065 - RNA, 22 nt, Human
gccaggggaaaaucagccugcu

SEQ ID NO: 1865066 - RNA, 21 nt, Human
gccaggggaaaaucagccugc

SEQ ID NO: 1865067 - RNA, 17 nt, Human
gccaggggaaaaucagc

SEQ ID NO: 1865068 - RNA, 17 nt, Human
gccaucccagccccaau

SEQ ID NO: 1865069 - RNA, 16 nt, Human
gccaucccagccccaa

SEQ ID NO: 1865070 - RNA, 15 nt, Human
gccaucccagcccca

SEQ ID NO: 1865071 - RNA, 14 nt, Human
gccaucccagcccc

SEQ ID NO: 1865072 - RNA, 13 nt, Human
gccaucccagccc

SEQ ID NO: 1865073 - RNA, 19 nt, Human
gccauccagguucagcuug

SEQ ID NO: 1865074 - RNA, 20 nt, Human
gccauccagguucagcuugu

SEQ ID NO: 1865075 - RNA, 14 nt, Human
gccaugggacaggg

SEQ ID NO: 1865076 - RNA, 19 nt, Human
gccaugggacagggaggac

SEQ ID NO: 1865077 - RNA, 22 nt, Human
gccauuucuuccacaagagccc

SEQ ID NO: 1865078 - RNA, 20 nt, Human
gccauuucuuccacaagagc

SEQ ID NO: 1865079 - RNA, 17 nt, Human
gccauuucuuccacaag

SEQ ID NO: 1865080 - RNA, 15 nt, Human
gcccaccccucaaca

SEQ ID NO: 1865081 - RNA, 19 nt, Human
gcccacaggaucagucuga

SEQ ID NO: 1865082 - RNA, 13 nt, Human
gcccacaggauca

SEQ ID NO: 1865083 - RNA, 18 nt, Human
gcccacaggaucagucug

SEQ ID NO: 1865084 - RNA, 16 nt, Human
gcccaaagaugcagcc

SEQ ID NO: 1865085 - RNA, 15 nt, Human
gcccaaagaugcagc

SEQ ID NO: 1865086 - RNA, 16 nt, Human
gccauuuguguuuaua

SEQ ID NO: 1865087 - RNA, 19 nt, Human
gcccaaagugguauagaaa

SEQ ID NO: 1865088 - RNA, 22 nt, Human
gcccaucugggggccucuucug

SEQ ID NO: 1865089 - RNA, 16 nt, Human
gccccagugcccacag

SEQ ID NO: 1865090 - RNA, 17 nt, Human
gccccagugcccacagg

SEQ ID NO: 1865091 - RNA, 21 nt, Human
gccccagugcccacaggauca

SEQ ID NO: 1865092 - RNA, 23 nt, Human
gccccauccucuguacagagccc

SEQ ID NO: 1865093 - RNA, 17 nt, Human
gccccauucugccugcc

SEQ ID NO: 1865094 - RNA, 18 nt, Human
gccccauucugccugccc

SEQ ID NO: 1865095 - RNA, 20 nt, Human
gccccauucugccugcccag

SEQ ID NO: 1865096 - RNA, 21 nt, Human
gccccauucugccugcccagg

SEQ ID NO: 1865097 - RNA, 22 nt, Human
gcccagucuggaaugcaguggu

SEQ ID NO: 1865098 - RNA, 16 nt, Human
gcccaggcuggcgugc

SEQ ID NO: 1865099 - RNA, 14 nt, Human
gcccaggcuggcgu

SEQ ID NO: 1865100 - RNA, 15 nt, Human
gcccaggcuggcgug

SEQ ID NO: 1865101 - RNA, 18 nt, Human
gcccaggccuccuacagc

SEQ ID NO: 1865102 - RNA, 16 nt, Human
gcccaggaaaggcucc

SEQ ID NO: 1865103 - RNA, 15 nt, Human
gcccaggaaaggcuc

SEQ ID NO: 1865104 - RNA, 12 nt, Human
gcccaggaaagg

SEQ ID NO: 1865105 - RNA, 17 nt, Human
gcccaggccugccuguu

SEQ ID NO: 1865106 - RNA, 11 nt, Human
gcccaggcugg

SEQ ID NO: 1865107 - RNA, 12 nt, Human
gcccggcuccag

SEQ ID NO: 1865108 - RNA, 19 nt, Human
gccccuucugacccaugcu

SEQ ID NO: 1865109 - RNA, 20 nt, Human
gccccuucugacccaugcug

SEQ ID NO: 1865110 - RNA, 18 nt, Human
gcccgggcucugccuccc

SEQ ID NO: 1865111 - RNA, 15 nt, Human
gcccgggcucugccu

SEQ ID NO: 1865112 - RNA, 14 nt, Human
gcccgggcucugcc

SEQ ID NO: 1865113 - RNA, 13 nt, Human
gcccgggcucugc

SEQ ID NO: 1865114 - RNA, 13 nt, Human
gcccggcuccagg

SEQ ID NO: 1865115 - RNA, 14 nt, Human
gcccggcuccaggc

SEQ ID NO: 1865116 - RNA, 12 nt, Human
gcccgggcucug

SEQ ID NO: 1865117 - RNA, 15 nt, Human
gcccggcuccaggcu

SEQ ID NO: 1865118 - RNA, 22 nt, Human
gcccucugcccacucccugcaa

SEQ ID NO: 1865119 - RNA, 20 nt, Human
gcccgggcucugccucccau

SEQ ID NO: 1865120 - RNA, 19 nt, Human
gcccgggcucugccuccca

SEQ ID NO: 1865121 - RNA, 21 nt, Human
gcccgggcucugccucccauc

SEQ ID NO: 1865122 - RNA, 15 nt, Human
gcccucccugccccu

SEQ ID NO: 1865123 - RNA, 19 nt, Human
gccccugcacuccagccug

SEQ ID NO: 1865124 - RNA, 23 nt, Human
gccccuggcagccccuguucugg

SEQ ID NO: 1865125 - RNA, 13 nt, Human
gccccugcacaaa

SEQ ID NO: 1865126 - RNA, 18 nt, Human
gccccucccacagcgcug

SEQ ID NO: 1865127 - RNA, 17 nt, Human
gccccuucccccuccaa

SEQ ID NO: 1865128 - RNA, 23 nt, Human
gccccucaacucuccuccagagu

SEQ ID NO: 1865129 - RNA, 21 nt, Human
gccccucagggucccuggugg

SEQ ID NO: 1865130 - RNA, 19 nt, Human
gccccucagggucccuggu

SEQ ID NO: 1865131 - RNA, 14 nt, Human
gccccgcccaggcu

SEQ ID NO: 1865132 - RNA, 22 nt, Human
gccccauucugccugcccaggc

SEQ ID NO: 1865133 - RNA, 23 nt, Human
gccccauucugccugcccaggcc

SEQ ID NO: 1865134 - RNA, 23 nt, Human
gccccgaggccuucucugaagga

SEQ ID NO: 1865135 - RNA, 17 nt, Human
gccccgugggguuccuc

SEQ ID NO: 1865136 - RNA, 21 nt, Human
gccccgucccccucuggcucc

SEQ ID NO: 1865137 - RNA, 17 nt, Human
gccccgucccccucugg

SEQ ID NO: 1865138 - RNA, 13 nt, Human
gcccuucucucca

SEQ ID NO: 1865139 - RNA, 22 nt, Human
gcccuuccucuccacugccuuc

SEQ ID NO: 1865140 - RNA, 16 nt, Human
gccgagauagccaagg

SEQ ID NO: 1865141 - RNA, 19 nt, Human
gccgagauagccaaggcca

SEQ ID NO: 1865142 - RNA, 17 nt, Human
gccgagauagccaaggc

SEQ ID NO: 1865143 - RNA, 17 nt, Human
gccgcagcccugcagag

SEQ ID NO: 1865144 - RNA, 16 nt, Human
gccgcagcccugcaga

SEQ ID NO: 1865145 - RNA, 15 nt, Human
gccgcagcccugcag

SEQ ID NO: 1865146 - RNA, 19 nt, Human
gccgcagcccugcagaggg

SEQ ID NO: 1865147 - RNA, 12 nt, Human
gccgggguggau

SEQ ID NO: 1865148 - RNA, 22 nt, Human
gccucaagugauucuccugccu

SEQ ID NO: 1865149 - RNA, 24 nt, Human
gccucaagugauucuccugccuca

SEQ ID NO: 1865150 - RNA, 18 nt, Human
gccucagcauccuggcac

SEQ ID NO: 1865151 - RNA, 17 nt, Human
gccucagcauccuggca

SEQ ID NO: 1865152 - RNA, 21 nt, Human
gccucagcauccuggcacccg

SEQ ID NO: 1865153 - RNA, 14 nt, Human
gccuaaggcugaac

SEQ ID NO: 1865154 - RNA, 17 nt, Human
gccuauuuuaauaaaca

SEQ ID NO: 1865155 - RNA, 23 nt, Human
gccgucuaccugaggggccucuu

SEQ ID NO: 1865156 - RNA, 22 nt, Human
gccgucuaccugaggggccucu

SEQ ID NO: 1865157 - RNA, 20 nt, Human
gccgucuaccugaggggccu

SEQ ID NO: 1865158 - RNA, 18 nt, Human
gccgucuaccugaggggc

SEQ ID NO: 1865159 - RNA, 15 nt, Human
gccguggcuucccgc

SEQ ID NO: 1865160 - RNA, 13 nt, Human
gccguggcuuccc

SEQ ID NO: 1865161 - RNA, 12 nt, Human
gccguggcuucc

SEQ ID NO: 1865162 - RNA, 11 nt, Human
gccguggcuuc

SEQ ID NO: 1865163 - RNA, 15 nt, Human
gccucucccaucacu

SEQ ID NO: 1865164 - RNA, 17 nt, Human
gccucucugcagguccc

SEQ ID NO: 1865165 - RNA, 16 nt, Human
gccucucugcaggucc

SEQ ID NO: 1865166 - RNA, 14 nt, Human
gccucucugcaggu

SEQ ID NO: 1865167 - RNA, 10 nt, Human
gccucucugc

SEQ ID NO: 1865168 - RNA, 12 nt, Human
gccucagccucc

SEQ ID NO: 1865169 - RNA, 14 nt, Human
gccucagccuccca

SEQ ID NO: 1865170 - RNA, 22 nt, Human
gccucagccucccaaagugcug

SEQ ID NO: 1865171 - RNA, 18 nt, Human
gccucccgaauagcuggg

SEQ ID NO: 1865172 - RNA, 19 nt, Human
gccucccgaauagcuggga

SEQ ID NO: 1865173 - RNA, 21 nt, Human
gccucccgaguagcugggacu

SEQ ID NO: 1865174 - RNA, 23 nt, Human
gccucccgaguagcugggacuac

SEQ ID NO: 1865175 - RNA, 20 nt, Human
gccucccgaauagcugggac

SEQ ID NO: 1865176 - RNA, 14 nt, Human
gccuggacccugug

SEQ ID NO: 1865177 - RNA, 11 nt, Human
gccugcccagg

SEQ ID NO: 1865178 - RNA, 12 nt, Human
gccugcccaggc

SEQ ID NO: 1865179 - RNA, 21 nt, Human
gccucugcacuccccugcugg

SEQ ID NO: 1865180 - RNA, 12 nt, Human
gccucugcauuc

SEQ ID NO: 1865181 - RNA, 15 nt, Human
gccucugcauucagg

SEQ ID NO: 1865182 - RNA, 15 nt, Human
gccugaagucacaca

SEQ ID NO: 1865183 - RNA, 20 nt, Human
gccucugcacuccccugcug

SEQ ID NO: 1865184 - RNA, 19 nt, Human
gccucugcacuccccugcu

SEQ ID NO: 1865185 - RNA, 18 nt, Human
gccucugcacuccccugc

SEQ ID NO: 1865186 - RNA, 17 nt, Human
gccucugcacuccccug

SEQ ID NO: 1865187 - RNA, 16 nt, Human
gccucugcacuccccu

SEQ ID NO: 1865188 - RNA, 16 nt, Human
gccucugacacacagc

SEQ ID NO: 1865189 - RNA, 15 nt, Human
gccucugacacacag

SEQ ID NO: 1865190 - RNA, 20 nt, Human
gcgccuacaggagugagcac

SEQ ID NO: 1865191 - RNA, 21 nt, Human
gcgccuacaggagugagcacu

SEQ ID NO: 1865192 - RNA, 14 nt, Human
gcgcugccccuggc

SEQ ID NO: 1865193 - RNA, 19 nt, Human
gcgcuggccgggaccccga

SEQ ID NO: 1865194 - RNA, 17 nt, Human
gcgcugccccuggcagc

SEQ ID NO: 1865195 - RNA, 18 nt, Human
gcgccuacaggagugagc

SEQ ID NO: 1865196 - RNA, 19 nt, Human
gcggaaugaaccacaucuu

SEQ ID NO: 1865197 - RNA, 16 nt, Human
gcggacagccacggcc

SEQ ID NO: 1865198 - RNA, 19 nt, Human
gcggacagccacggccagg

SEQ ID NO: 1865199 - RNA, 23 nt, Human
gcggacagccacggccaggccag

SEQ ID NO: 1865200 - RNA, 19 nt, Human
gcggggacagcuccuucug

SEQ ID NO: 1865201 - RNA, 23 nt, Human
gcggggacagcuccuucuguccu

SEQ ID NO: 1865202 - RNA, 20 nt, Human
gcgguccacccaggagcccc

SEQ ID NO: 1865203 - RNA, 23 nt, Human
gcgguccacccaggagccccgag

SEQ ID NO: 1865204 - RNA, 22 nt, Human
gcuacacaggggaaaagaggag

SEQ ID NO: 1865205 - RNA, 14 nt, Human
gcuaacauggaagu

SEQ ID NO: 1865206 - RNA, 18 nt, Human
gcuaacauggaaguacua

SEQ ID NO: 1865207 - RNA, 17 nt, Human
gcuaacauggaaguacu

SEQ ID NO: 1865208 - RNA, 14 nt, Human
gcgugagccacugc

SEQ ID NO: 1865209 - RNA, 16 nt, Human
gcgugagaccugcccc

SEQ ID NO: 1865210 - RNA, 16 nt, Human
gcgugagccacugcac

SEQ ID NO: 1865211 - RNA, 15 nt, Human
gcgugagccacugca

SEQ ID NO: 1865212 - RNA, 22 nt, Human
gcuagacgagcaggcuucuucc

SEQ ID NO: 1865213 - RNA, 21 nt, Human
gcuagacgagcaggcuucuuc

SEQ ID NO: 1865214 - RNA, 19 nt, Human
gccuuacccucauguucuu

SEQ ID NO: 1865215 - RNA, 16 nt, Human
gccuuagaaccuuucu

SEQ ID NO: 1865216 - RNA, 17 nt, Human
gccuuagaaccuuucuu

SEQ ID NO: 1865217 - RNA, 20 nt, Human
gccuuagaagucacacagua

SEQ ID NO: 1865218 - RNA, 23 nt, Human
gccuuauggaacacucugagacu

SEQ ID NO: 1865219 - RNA, 22 nt, Human
gccuuauggaacacucugagac

SEQ ID NO: 1865220 - RNA, 21 nt, Human
gccuuauggaacacucugaga

SEQ ID NO: 1865221 - RNA, 15 nt, Human
gccugguggcagcug

SEQ ID NO: 1865222 - RNA, 18 nt, Human
gccuguaaucacagcuac

SEQ ID NO: 1865223 - RNA, 16 nt, Human
gccugguggcagcugc

SEQ ID NO: 1865224 - RNA, 17 nt, Human
gccugguggcagcugcg

SEQ ID NO: 1865225 - RNA, 18 nt, Human
gccuucggccuccauccu

SEQ ID NO: 1865226 - RNA, 16 nt, Human
gccuucagcucuacag

SEQ ID NO: 1865227 - RNA, 13 nt, Human
gccuucagcucua

SEQ ID NO: 1865228 - RNA, 19 nt, Human
gccuucggccuccauccug

SEQ ID NO: 1865229 - RNA, 14 nt, Human
ggucccaccccaca

SEQ ID NO: 1865230 - RNA, 17 nt, Human
ggucccaccccacacac

SEQ ID NO: 1865231 - RNA, 17 nt, Human
ggucucaaacuccugac

SEQ ID NO: 1865232 - RNA, 21 nt, Human
ggucucacuauguugcccagg

SEQ ID NO: 1865233 - RNA, 22 nt, Human
ggucucacucugucgcccaguc

SEQ ID NO: 1865234 - RNA, 23 nt, Human
ggucucacucugucgcccagucu

SEQ ID NO: 1865235 - RNA, 14 nt, Human
ggucugacccacug

SEQ ID NO: 1865236 - RNA, 22 nt, Human
ggugaccagcaccaucucuccu

SEQ ID NO: 1865237 - RNA, 22 nt, Human
gguggccucccaacucacccca

SEQ ID NO: 1865238 - RNA, 23 nt, Human
gguggccacuccagaccccuggc

SEQ ID NO: 1865239 - RNA, 22 nt, Human
gguggccacuccagaccccugg

SEQ ID NO: 1865240 - RNA, 21 nt, Human
gguggccacuccagaccccug

SEQ ID NO: 1865241 - RNA, 20 nt, Human
gguggccacuccagaccccu

SEQ ID NO: 1865242 - RNA, 23 nt, Human
gguggccucccaacucaccccag

SEQ ID NO: 1865243 - RNA, 21 nt, Human
ggugcuaucucccccagcccc

SEQ ID NO: 1865244 - RNA, 15 nt, Human
ggugcugccauccag

SEQ ID NO: 1865245 - RNA, 21 nt, Human
ggugcugccauccagguucag

SEQ ID NO: 1865246 - RNA, 19 nt, Human
gguggcagugggagcugcc

SEQ ID NO: 1865247 - RNA, 22 nt, Human
gguggcagugggagcugccugu

SEQ ID NO: 1865248 - RNA, 20 nt, Human
ggugcuaucucccccagccc

SEQ ID NO: 1865249 - RNA, 19 nt, Human
ggugcuaucucccccagcc

SEQ ID NO: 1865250 - RNA, 17 nt, Human
ggugcuaucucccccag

SEQ ID NO: 1865251 - RNA, 16 nt, Human
ggugcuaucuccccca

SEQ ID NO: 1865252 - RNA, 15 nt, Human
ggugagaagcagagg

SEQ ID NO: 1865253 - RNA, 16 nt, Human
ggugagaggggaacag

SEQ ID NO: 1865254 - RNA, 16 nt, Human
gguggugaccucugcc

SEQ ID NO: 1865255 - RNA, 14 nt, Human
gguggugaccucug

SEQ ID NO: 1865256 - RNA, 15 nt, Human
gguggugaccucugc

SEQ ID NO: 1865257 - RNA, 15 nt, Human
ggugguuuucuguuc

SEQ ID NO: 1865258 - RNA, 18 nt, Human
ggugguuuucuguucuuu

SEQ ID NO: 1865259 - RNA, 21 nt, Human
ggugguuauggagaggguguc

SEQ ID NO: 1865260 - RNA, 17 nt, Human
ggugguuucagaaaugu

SEQ ID NO: 1865261 - RNA, 18 nt, Human
ggugguuucagaaaugug

SEQ ID NO: 1865262 - RNA, 19 nt, Human
ggugucaccugaagacuca

SEQ ID NO: 1865263 - RNA, 19 nt, Human
ggugucaagagggucugag

SEQ ID NO: 1865264 - RNA, 17 nt, Human
ggugucaagagggucug

SEQ ID NO: 1865265 - RNA, 13 nt, Human
gguuauggagagg

SEQ ID NO: 1865266 - RNA, 22 nt, Human
gguuaguggauggaaggggcug

SEQ ID NO: 1865267 - RNA, 21 nt, Human
gguuaguggauggaaggggcu

SEQ ID NO: 1865268 - RNA, 17 nt, Human
gguuaggcauuguggga

SEQ ID NO: 1865269 - RNA, 21 nt, Human
gguuacccaguuagcucucaa

SEQ ID NO: 1865270 - RNA, 13 nt, Human
gguucaaagauau

SEQ ID NO: 1865271 - RNA, 21 nt, Human
gguucaaagauauuuugcuuu

SEQ ID NO: 1865272 - RNA, 16 nt, Human
gguucuuucuuccucu

SEQ ID NO: 1865273 - RNA, 14 nt, Human
gguucuuucuuccu

SEQ ID NO: 1865274 - RNA, 13 nt, Human
gguugagguuuca

SEQ ID NO: 1865275 - RNA, 22 nt, Human
gguagaagcccuucuaccuucc

SEQ ID NO: 1865276 - RNA, 23 nt, Human
gguagaaauaucugaaaauguau

SEQ ID NO: 1865277 - RNA, 11 nt, Human
gguacccacug

SEQ ID NO: 1865278 - RNA, 16 nt, Human
gguacccacugcucug

SEQ ID NO: 1865279 - RNA, 13 nt, Human
gguacccacugcu

SEQ ID NO: 1865280 - RNA, 22 nt, Human
gguagaaauaucugaaaaugua

SEQ ID NO: 1865281 - RNA, 20 nt, Human
gguacuuguggacacagcuc

SEQ ID NO: 1865282 - RNA, 16 nt, Human
gguacuuguggacaca

SEQ ID NO: 1865283 - RNA, 17 nt, Human
gguacuuguggacacag

SEQ ID NO: 1865284 - RNA, 12 nt, Human
ggucacucuggc

SEQ ID NO: 1865285 - RNA, 18 nt, Human
ggucacaggacucugccu

SEQ ID NO: 1865286 - RNA, 16 nt, Human
ggucacaggacucugc

SEQ ID NO: 1865287 - RNA, 16 nt, Human
ggucccaccccacaca

SEQ ID NO: 1865288 - RNA, 15 nt, Human
ggucccaccccacac

SEQ ID NO: 1865289 - RNA, 11 nt, Human
ggucagagccu

SEQ ID NO: 1865290 - RNA, 19 nt, Human
gggugacagagcaagugag

SEQ ID NO: 1865291 - RNA, 17 nt, Human
gggugaagugaagacaa

SEQ ID NO: 1865292 - RNA, 17 nt, Human
gggugcugggccccugc

SEQ ID NO: 1865293 - RNA, 18 nt, Human
gggugcugggccccugcc

SEQ ID NO: 1865294 - RNA, 22 nt, Human
ggguucaagcgauucuucugcu

SEQ ID NO: 1865295 - RNA, 23 nt, Human
ggguucaagcgauucuucugcuu

SEQ ID NO: 1865296 - RNA, 19 nt, Human
ggguuccuuccucugagcc

SEQ ID NO: 1865297 - RNA, 12 nt, Human
ggguucuaccca

SEQ ID NO: 1865298 - RNA, 21 nt, Human
ggguuccuuccucugagccuu

SEQ ID NO: 1865299 - RNA, 20 nt, Human
ggguuccuuccucugagccu

SEQ ID NO: 1865300 - RNA, 16 nt, Human
ggguucuuucuuccuc

SEQ ID NO: 1865301 - RNA, 17 nt, Human
ggguucuuucuuccucu

SEQ ID NO: 1865302 - RNA, 19 nt, Human
ggguucuuucuuccucugc

SEQ ID NO: 1865303 - RNA, 16 nt, Human
ggggcaacccugguga

SEQ ID NO: 1865304 - RNA, 17 nt, Human
ggggcugaggugggagg

SEQ ID NO: 1865305 - RNA, 19 nt, Human
ggggaaaaucagccugcuc

SEQ ID NO: 1865306 - RNA, 17 nt, Human
ggggaaaaucagccugc

SEQ ID NO: 1865307 - RNA, 16 nt, Human
ggggaaaaucagccug

SEQ ID NO: 1865308 - RNA, 11 nt, Human
gggccugggcc

SEQ ID NO: 1865309 - RNA, 22 nt, Human
gggcuuggggaccagagcugcc

SEQ ID NO: 1865310 - RNA, 24 nt, Human
ggggaaaaucagccugcuccagcu

SEQ ID NO: 1865311 - RNA, 21 nt, Human
ggggaaaaucagccugcucca

SEQ ID NO: 1865312 - RNA, 18 nt, Human
ggggaggggcugugggcg

SEQ ID NO: 1865313 - RNA, 22 nt, Human
ggggcugcaccggcuggccugg

SEQ ID NO: 1865314 - RNA, 21 nt, Human
ggggcugcaccggcuggccug

SEQ ID NO: 1865315 - RNA, 12 nt, Human
ggggcugcaccg

SEQ ID NO: 1865316 - RNA, 19 nt, Human
ggggcugaggugggaggau

SEQ ID NO: 1865317 - RNA, 23 nt, Human
ggggcugcaccggcuggccuggc

SEQ ID NO: 1865318 - RNA, 22 nt, Human
gggggaggugggauccuccagg

SEQ ID NO: 1865319 - RNA, 17 nt, Human
gggguggggaccucagg

SEQ ID NO: 1865320 - RNA, 20 nt, Human
gggguggggggggugcuggg

SEQ ID NO: 1865321 - RNA, 18 nt, Human
ggggugcugggccccugc

SEQ ID NO: 1865322 - RNA, 12 nt, Human
gggguggccucc

SEQ ID NO: 1865323 - RNA, 12 nt, Human
gggucugaggaa

SEQ ID NO: 1865324 - RNA, 21 nt, Human
gggucugaggaauccagaccc

SEQ ID NO: 1865325 - RNA, 17 nt, Human
ggguaagugagagaggg

SEQ ID NO: 1865326 - RNA, 14 nt, Human
gggucucacucugu

SEQ ID NO: 1865327 - RNA, 21 nt, Human
gggccccugccucucugcagg

SEQ ID NO: 1865328 - RNA, 19 nt, Human
gggccccugccucucugca

SEQ ID NO: 1865329 - RNA, 18 nt, Human
gggccccugccucucugc

SEQ ID NO: 1865330 - RNA, 17 nt, Human
gggccccugccucucug

SEQ ID NO: 1865331 - RNA, 15 nt, Human
gggccccugccucuc

SEQ ID NO: 1865332 - RNA, 13 nt, Human
gggccccugccuc

SEQ ID NO: 1865333 - RNA, 14 nt, Human
gggccccagaggcu

SEQ ID NO: 1865334 - RNA, 13 nt, Human
gggccuggccuga

SEQ ID NO: 1865335 - RNA, 13 nt, Human
gggcccugccucc

SEQ ID NO: 1865336 - RNA, 22 nt, Human
gggccccugccucucugcaggu

SEQ ID NO: 1865337 - RNA, 13 nt, Human
gggccuggcuccc

SEQ ID NO: 1865338 - RNA, 17 nt, Human
gggccuggcucaggugg

SEQ ID NO: 1865339 - RNA, 18 nt, Human
gggccuggccugagcugg

SEQ ID NO: 1865340 - RNA, 14 nt, Human
gggccuggccugag

SEQ ID NO: 1865341 - RNA, 19 nt, Human
gggccuggccugagcuggg

SEQ ID NO: 1865342 - RNA, 20 nt, Human
gggcauggccagguggccac

SEQ ID NO: 1865343 - RNA, 17 nt, Human
gggcauggccagguggc

SEQ ID NO: 1865344 - RNA, 15 nt, Human
gggcauggccaggug

SEQ ID NO: 1865345 - RNA, 12 nt, Human
gggcaugacacg

SEQ ID NO: 1865346 - RNA, 23 nt, Human
gggccacagagaaaguacuucuc

SEQ ID NO: 1865347 - RNA, 16 nt, Human
gggccacagagaaagu

SEQ ID NO: 1865348 - RNA, 17 nt, Human
gggcccagagagggugg

SEQ ID NO: 1865349 - RNA, 20 nt, Human
gggcaacccccagccugcua

SEQ ID NO: 1865350 - RNA, 18 nt, Human
gggcaacccuggugacca

SEQ ID NO: 1865351 - RNA, 23 nt, Human
gggauccuggaguucugguuccu

SEQ ID NO: 1865352 - RNA, 16 nt, Human
gggauccuccaggugc

SEQ ID NO: 1865353 - RNA, 15 nt, Human
gggauccuccaggug

SEQ ID NO: 1865354 - RNA, 21 nt, Human
gggauaugauuuaaaucagcc

SEQ ID NO: 1865355 - RNA, 13 nt, Human
gggauagagagag

SEQ ID NO: 1865356 - RNA, 13 nt, Human
gggacugagaaau

SEQ ID NO: 1865357 - RNA, 17 nt, Human
gggaggugggauccucc

SEQ ID NO: 1865358 - RNA, 16 nt, Human
gggaggugaccccagg

SEQ ID NO: 1865359 - RNA, 18 nt, Human
gggagugacagaggcagc

SEQ ID NO: 1865360 - RNA, 11 nt, Human
gggagugagcu

SEQ ID NO: 1865361 - RNA, 14 nt, Human
gggagugagcuggu

SEQ ID NO: 1865362 - RNA, 17 nt, Human
gggcagguugguggggg

SEQ ID NO: 1865363 - RNA, 12 nt, Human
gggcagagcaga

SEQ ID NO: 1865364 - RNA, 11 nt, Human
gggcagagcag

SEQ ID NO: 1865365 - RNA, 18 nt, Human
gggcagaaggaagacuuc

SEQ ID NO: 1865366 - RNA, 14 nt, Human
gggcagaaggaaga

SEQ ID NO: 1865367 - RNA, 16 nt, Human
gggcacugguggcccg

SEQ ID NO: 1865368 - RNA, 13 nt, Human
gggcacugguggc

SEQ ID NO: 1865369 - RNA, 20 nt, Human
gggcacucagaagacacuga

SEQ ID NO: 1865370 - RNA, 16 nt, Human
gggcacagggucucua

SEQ ID NO: 1865371 - RNA, 13 nt, Human
gggcacagggucu

SEQ ID NO: 1865372 - RNA, 14 nt, Human
gggcaccggggccu

SEQ ID NO: 1865373 - RNA, 16 nt, Human
gggcacucagaagaca

SEQ ID NO: 1865374 - RNA, 19 nt, Human
gggcacucagaagacacug

SEQ ID NO: 1865375 - RNA, 21 nt, Human
gggcacagaaaauggaagaca

SEQ ID NO: 1865376 - RNA, 20 nt, Human
gggcacagaaaauggaagac

SEQ ID NO: 1865377 - RNA, 18 nt, Human
gggcacagaaaauggaag

SEQ ID NO: 1865378 - RNA, 23 nt, Human
gggcacaccgggcacucagaaga

SEQ ID NO: 1865379 - RNA, 23 nt, Human
ggcugcuucaaggauccugagcc

SEQ ID NO: 1865380 - RNA, 19 nt, Human
ggcugggagagccuuccag

SEQ ID NO: 1865381 - RNA, 23 nt, Human
ggcugggagagccuuccaggggu

SEQ ID NO: 1865382 - RNA, 20 nt, Human
ggcugggagagccuuccagg

SEQ ID NO: 1865383 - RNA, 14 nt, Human
ggcugggcagagga

SEQ ID NO: 1865384 - RNA, 13 nt, Human
ggcugggcagagg

SEQ ID NO: 1865385 - RNA, 19 nt, Human
ggcugggcagaggaaagca

SEQ ID NO: 1865386 - RNA, 15 nt, Human
ggcugggcagaggaa

SEQ ID NO: 1865387 - RNA, 18 nt, Human
ggcugggagagccuucca

SEQ ID NO: 1865388 - RNA, 22 nt, Human
ggcugcuucaaggauccugagc

SEQ ID NO: 1865389 - RNA, 14 nt, Human
ggcugcuucaagga

SEQ ID NO: 1865390 - RNA, 12 nt, Human
ggcugcuucaag

SEQ ID NO: 1865391 - RNA, 11 nt, Human
ggcugcuucaa

SEQ ID NO: 1865392 - RNA, 17 nt, Human
ggcugcugaaggcucga

SEQ ID NO: 1865393 - RNA, 15 nt, Human
ggcugcugaaggcuc

SEQ ID NO: 1865394 - RNA, 18 nt, Human
ggcugcugaaggcucgag

SEQ ID NO: 1865395 - RNA, 12 nt, Human
ggcugcagggag

SEQ ID NO: 1865396 - RNA, 14 nt, Human
ggcugcugaaggcu

SEQ ID NO: 1865397 - RNA, 13 nt, Human
ggcugcagggagu

SEQ ID NO: 1865398 - RNA, 14 nt, Human
ggcucuggagccca

SEQ ID NO: 1865399 - RNA, 13 nt, Human
ggcucuggagccc

SEQ ID NO: 1865400 - RNA, 17 nt, Human
ggcucugccucccauca

SEQ ID NO: 1865401 - RNA, 20 nt, Human
ggccccugcccggcugcgga

SEQ ID NO: 1865402 - RNA, 16 nt, Human
ggccccugcccggcug

SEQ ID NO: 1865403 - RNA, 17 nt, Human
ggccccugcccggcugc

SEQ ID NO: 1865404 - RNA, 15 nt, Human
ggcugaggugggagg

SEQ ID NO: 1865405 - RNA, 13 nt, Human
ggcugagguggga

SEQ ID NO: 1865406 - RNA, 19 nt, Human
ggcugcaccggcuggccug

SEQ ID NO: 1865407 - RNA, 18 nt, Human
ggcugcaccggcuggccu

SEQ ID NO: 1865408 - RNA, 17 nt, Human
ggcugcaccggcuggcc

SEQ ID NO: 1865409 - RNA, 24 nt, Human
ggcugcaaaggguaucaggugcug

SEQ ID NO: 1865410 - RNA, 22 nt, Human
ggcugcaaaggguaucaggugc

SEQ ID NO: 1865411 - RNA, 23 nt, Human
ggcugcaaaggguaucaggugcu

SEQ ID NO: 1865412 - RNA, 18 nt, Human
ggcugcaaaggguaucag

SEQ ID NO: 1865413 - RNA, 21 nt, Human
ggcuuagucacugagacagcc

SEQ ID NO: 1865414 - RNA, 18 nt, Human
ggcugggcuucaguggca

SEQ ID NO: 1865415 - RNA, 13 nt, Human
ggcugggcuucag

SEQ ID NO: 1865416 - RNA, 17 nt, Human
ggcugggcuucaguggc

SEQ ID NO: 1865417 - RNA, 17 nt, Human
ggcugggcucccuuccc

SEQ ID NO: 1865418 - RNA, 18 nt, Human
ggcugggcucccuuccca

SEQ ID NO: 1865419 - RNA, 12 nt, Human
ggcugggcuuca

SEQ ID NO: 1865420 - RNA, 17 nt, Human
ggcuuuucacugcuggc

SEQ ID NO: 1865421 - RNA, 15 nt, Human
ggcuuuucacugcug

SEQ ID NO: 1865422 - RNA, 14 nt, Human
ggcuuuucacugcu

SEQ ID NO: 1865423 - RNA, 10 nt, Human
ggcuuuugug

SEQ ID NO: 1865424 - RNA, 22 nt, Human
ggcuuuucacugcuggcugccu

SEQ ID NO: 1865425 - RNA, 19 nt, Human
ggcuuuucacugcuggcug

SEQ ID NO: 1865426 - RNA, 21 nt, Human
ggcuuggggaccagagcugcc

SEQ ID NO: 1865427 - RNA, 22 nt, Human
ggcuugaguuuaaauuguaaua

SEQ ID NO: 1865428 - RNA, 16 nt, Human
gggaagggggcuggga

SEQ ID NO: 1865429 - RNA, 14 nt, Human
gggaagggggcugg

SEQ ID NO: 1865430 - RNA, 17 nt, Human
gggaagggggcugggac

SEQ ID NO: 1865431 - RNA, 14 nt, Human
ggcuuuugugcauu

SEQ ID NO: 1865432 - RNA, 21 nt, Human
gggaaggauacaaaagcaugu

SEQ ID NO: 1865433 - RNA, 23 nt, Human
gggaaggauacaaaagcauguga

SEQ ID NO: 1865434 - RNA, 22 nt, Human
gggaaggcagggagggccuggg

SEQ ID NO: 1865435 - RNA, 14 nt, Human
gggaccccugagcu

SEQ ID NO: 1865436 - RNA, 20 nt, Human
gggaccccgagccuggcucc

SEQ ID NO: 1865437 - RNA, 18 nt, Human
gggaccccgagccuggcu

SEQ ID NO: 1865438 - RNA, 17 nt, Human
gggaauuucuucaacuc

SEQ ID NO: 1865439 - RNA, 23 nt, Human
gggacaaggacuaggguccuggg

SEQ ID NO: 1865440 - RNA, 15 nt, Human
gggaccucaggccug

SEQ ID NO: 1865441 - RNA, 13 nt, Human
gggaccucaggcc

SEQ ID NO: 1865442 - RNA, 12 nt, Human
gggaccucaggc

SEQ ID NO: 1865443 - RNA, 17 nt, Human
gggacuacaggcaccca

SEQ ID NO: 1865444 - RNA, 16 nt, Human
gggacucaaugcacug

SEQ ID NO: 1865445 - RNA, 20 nt, Human
gcugggacaugggaaagggg

SEQ ID NO: 1865446 - RNA, 17 nt, Human
gcuggccgggagccuga

SEQ ID NO: 1865447 - RNA, 13 nt, Human
gcuggcccugccc

SEQ ID NO: 1865448 - RNA, 13 nt, Human
gcuggccgggacc

SEQ ID NO: 1865449 - RNA, 12 nt, Human
gcuggcccugcc

SEQ ID NO: 1865450 - RNA, 19 nt, Human
gcugggacuacagguguga

SEQ ID NO: 1865451 - RNA, 13 nt, Human
gcugggacuacag

SEQ ID NO: 1865452 - RNA, 18 nt, Human
gcugggacuacaggcacc

SEQ ID NO: 1865453 - RNA, 19 nt, Human
gcugggacuacaggcaccc

SEQ ID NO: 1865454 - RNA, 20 nt, Human
gcugggacuacaggcaccca

SEQ ID NO: 1865455 - RNA, 16 nt, Human
gcuggauuacaggcau

SEQ ID NO: 1865456 - RNA, 22 nt, Human
gcugcuugggcuucauccuccu

SEQ ID NO: 1865457 - RNA, 17 nt, Human
gcugcuugggcuucauc

SEQ ID NO: 1865458 - RNA, 18 nt, Human
gcuggaccuugaacuggg

SEQ ID NO: 1865459 - RNA, 21 nt, Human
gcuggaccuugaacuggguac

SEQ ID NO: 1865460 - RNA, 22 nt, Human
gcuggaccuugaacuggguacu

SEQ ID NO: 1865461 - RNA, 16 nt, Human
gcugcuugggcuucau

SEQ ID NO: 1865462 - RNA, 22 nt, Human
gcugcuucaaggauccugagcc

SEQ ID NO: 1865463 - RNA, 21 nt, Human
gcugcuucaaggauccugagc

SEQ ID NO: 1865464 - RNA, 23 nt, Human
gcugcuucaaggauccugagcca

SEQ ID NO: 1865465 - RNA, 13 nt, Human
gcugcuucaagga

SEQ ID NO: 1865466 - RNA, 19 nt, Human
gcugcgguccacccaggag

SEQ ID NO: 1865467 - RNA, 17 nt, Human
gcugcgguccacccagg

SEQ ID NO: 1865468 - RNA, 18 nt, Human
gcugcgguccacccagga

SEQ ID NO: 1865469 - RNA, 22 nt, Human
gcuagcagcagggagggcuucu

SEQ ID NO: 1865470 - RNA, 19 nt, Human
gcugcccuggugcugccac

SEQ ID NO: 1865471 - RNA, 18 nt, Human
gcugcccuggugcugcca

SEQ ID NO: 1865472 - RNA, 11 nt, Human
gcugcccugug

SEQ ID NO: 1865473 - RNA, 22 nt, Human
gcugcccuggugcugccacacu

SEQ ID NO: 1865474 - RNA, 20 nt, Human
gcugcccuggugcugccaca

SEQ ID NO: 1865475 - RNA, 14 nt, Human
gcugcccugugagu

SEQ ID NO: 1865476 - RNA, 12 nt, Human
gcugcccuguga

SEQ ID NO: 1865477 - RNA, 23 nt, Human
gcugcccuggugcugccacacuu

SEQ ID NO: 1865478 - RNA, 17 nt, Human
gcugcccuuucugggca

SEQ ID NO: 1865479 - RNA, 23 nt, Human
gcugggggaagaagcucucuccu

SEQ ID NO: 1865480 - RNA, 12 nt, Human
gcuggggccagu

SEQ ID NO: 1865481 - RNA, 19 nt, Human
gcuggggccaggcuggguc

SEQ ID NO: 1865482 - RNA, 16 nt, Human
gcuggggccaggcugg

SEQ ID NO: 1865483 - RNA, 18 nt, Human
gcugggcuucaguggcag

SEQ ID NO: 1865484 - RNA, 19 nt, Human
gcugggcuucaguggcagc

SEQ ID NO: 1865485 - RNA, 13 nt, Human
gcugggggccuca

SEQ ID NO: 1865486 - RNA, 15 nt, Human
gcuggucccacucag

SEQ ID NO: 1865487 - RNA, 19 nt, Human
gcuggucccacucagucca

SEQ ID NO: 1865488 - RNA, 19 nt, Human
gcugggggccucagugcca

SEQ ID NO: 1865489 - RNA, 20 nt, Human
gcugggggccucagugccac

SEQ ID NO: 1865490 - RNA, 18 nt, Human
gcugggagagccuuccag

SEQ ID NO: 1865491 - RNA, 17 nt, Human
gcugggagagccuucca

SEQ ID NO: 1865492 - RNA, 13 nt, Human
gcugggagagccu

SEQ ID NO: 1865493 - RNA, 12 nt, Human
gcugggagagcc

SEQ ID NO: 1865494 - RNA, 22 nt, Human
gcugggagagccuuccaggggu

SEQ ID NO: 1865495 - RNA, 19 nt, Human
gcugggagagccuuccagg

SEQ ID NO: 1865496 - RNA, 21 nt, Human
gcugggaugauuggagggggg

SEQ ID NO: 1865497 - RNA, 15 nt, Human
gcugggagcucugca

SEQ ID NO: 1865498 - RNA, 16 nt, Human
gcugggagcucugcag

SEQ ID NO: 1865499 - RNA, 20 nt, Human
gcugggauuacaggcuccug

SEQ ID NO: 1865500 - RNA, 19 nt, Human
gcugggauuacaggcuccu

SEQ ID NO: 1865501 - RNA, 18 nt, Human
gcugggauuacaggcgug

SEQ ID NO: 1865502 - RNA, 17 nt, Human
gcugggauuacaggcgu

SEQ ID NO: 1865503 - RNA, 21 nt, Human
gcugggauuacaggcuccugc

SEQ ID NO: 1865504 - RNA, 17 nt, Human
gcugggcuucaguggca

SEQ ID NO: 1865505 - RNA, 23 nt, Human
gcugucaauuacaggaaguacug

SEQ ID NO: 1865506 - RNA, 22 nt, Human
gcugucaauuacaggaaguacu

SEQ ID NO: 1865507 - RNA, 19 nt, Human
gcugucaauuacaggaagu

SEQ ID NO: 1865508 - RNA, 17 nt, Human
gcugucaauuacaggaa

SEQ ID NO: 1865509 - RNA, 21 nt, Human
gcugucccuuacgugaguccu

SEQ ID NO: 1865510 - RNA, 22 nt, Human
gcugucccuuacgugaguccug

SEQ ID NO: 1865511 - RNA, 19 nt, Human
gcugucccuuacgugaguc

SEQ ID NO: 1865512 - RNA, 17 nt, Human
gcugucuccauguuuga

SEQ ID NO: 1865513 - RNA, 21 nt, Human
gcugguuagagguucccuuug

SEQ ID NO: 1865514 - RNA, 15 nt, Human
gcugguucaggguug

SEQ ID NO: 1865515 - RNA, 16 nt, Human
gcugucaauuacagga

SEQ ID NO: 1865516 - RNA, 22 nt, Human
gcugguucaggguuggccccug

SEQ ID NO: 1865517 - RNA, 16 nt, Human
gcuggugucaccugaa

SEQ ID NO: 1865518 - RNA, 18 nt, Human
gcuggugucaccugaaga

SEQ ID NO: 1865519 - RNA, 20 nt, Human
gcuggucccacucaguccau

SEQ ID NO: 1865520 - RNA, 13 nt, Human
gcuguucagcugg

SEQ ID NO: 1865521 - RNA, 20 nt, Human
gcuuccagugaggcucugcc

SEQ ID NO: 1865522 - RNA, 19 nt, Human
gcuuccagugaggcucugc

SEQ ID NO: 1865523 - RNA, 21 nt, Human
gcuuccagugaggcucugccc

SEQ ID NO: 1865524 - RNA, 17 nt, Human
gcuucucacugccaugc

SEQ ID NO: 1865525 - RNA, 17 nt, Human
gcuugcccuggugccuc

SEQ ID NO: 1865526 - RNA, 19 nt, Human
gcuugcccuggugccucac

SEQ ID NO: 1865527 - RNA, 13 nt, Human
gcuuggaggaagg

SEQ ID NO: 1865528 - RNA, 15 nt, Human
gcuuggaggaaggaa

SEQ ID NO: 1865529 - RNA, 14 nt, Human
gcuuggaggaagga

SEQ ID NO: 1865530 - RNA, 16 nt, Human
gcuucuguugcugccu

SEQ ID NO: 1865531 - RNA, 22 nt, Human
gcuugcagagaugaggccgcca

SEQ ID NO: 1865532 - RNA, 14 nt, Human
gcuuugggcugccc

SEQ ID NO: 1865533 - RNA, 14 nt, Human
ggaaaaacugauuu

SEQ ID NO: 1865534 - RNA, 19 nt, Human
ggaaaaaccacccccaaau

SEQ ID NO: 1865535 - RNA, 13 nt, Human
ggaaaaauagccu

SEQ ID NO: 1865536 - RNA, 15 nt, Human
ggaaaaauagccugc

SEQ ID NO: 1865537 - RNA, 22 nt, Human
ggaaaaccaagccguggcuucc

SEQ ID NO: 1865538 - RNA, 16 nt, Human
gcuuugggcugcccug

SEQ ID NO: 1865539 - RNA, 15 nt, Human
gcuuugggcugcccu

SEQ ID NO: 1865540 - RNA, 14 nt, Human
gcuuuuacuuaaac

SEQ ID NO: 1865541 - RNA, 20 nt, Human
ggaaaaaauaacaaugaaag

SEQ ID NO: 1865542 - RNA, 14 nt, Human
ggaagccagcaggc

SEQ ID NO: 1865543 - RNA, 13 nt, Human
ggaagccagcagg

SEQ ID NO: 1865544 - RNA, 18 nt, Human
ggaagccagcaggcucuc

SEQ ID NO: 1865545 - RNA, 17 nt, Human
ggaagccagcaggcucu

SEQ ID NO: 1865546 - RNA, 16 nt, Human
ggaagccagcaggcuc

SEQ ID NO: 1865547 - RNA, 15 nt, Human
ggaagccagcaggcu

SEQ ID NO: 1865548 - RNA, 22 nt, Human
ggaagcacaugccucucucagg

SEQ ID NO: 1865549 - RNA, 21 nt, Human
ggaagcacaugccucucucag

SEQ ID NO: 1865550 - RNA, 23 nt, Human
ggaagcacaugccucucucaggc

SEQ ID NO: 1865551 - RNA, 13 nt, Human
ggaagcagcuuuc

SEQ ID NO: 1865552 - RNA, 13 nt, Human
ggaagagccuugc

SEQ ID NO: 1865553 - RNA, 17 nt, Human
ggaagcacaugccucuc

SEQ ID NO: 1865554 - RNA, 15 nt, Human
ggaagcacaugccuc

SEQ ID NO: 1865555 - RNA, 14 nt, Human
ggaagcacaugccu

SEQ ID NO: 1865556 - RNA, 13 nt, Human
ggaagcacaugcc

SEQ ID NO: 1865557 - RNA, 17 nt, Human
ggaagcacagcuucauu

SEQ ID NO: 1865558 - RNA, 17 nt, Human
ggaacagacuggaagca

SEQ ID NO: 1865559 - RNA, 14 nt, Human
ggaaaauaaauuau

SEQ ID NO: 1865560 - RNA, 15 nt, Human
ggaaaaucagccugc

SEQ ID NO: 1865561 - RNA, 19 nt, Human
ggaacagacuggaagcaca

SEQ ID NO: 1865562 - RNA, 20 nt, Human
ggaacagacuggaagcacag

SEQ ID NO: 1865563 - RNA, 23 nt, Human
ggaacuagacucccaagcuggac

SEQ ID NO: 1865564 - RNA, 20 nt, Human
ggagcaaaaucgaugcagug

SEQ ID NO: 1865565 - RNA, 12 nt, Human
ggagcccuggga

SEQ ID NO: 1865566 - RNA, 13 nt, Human
ggagcccugggag

SEQ ID NO: 1865567 - RNA, 20 nt, Human
ggagauuuacaacuggggga

SEQ ID NO: 1865568 - RNA, 15 nt, Human
ggagaggggcacagg

SEQ ID NO: 1865569 - RNA, 21 nt, Human
ggacugccagucccccugccc

SEQ ID NO: 1865570 - RNA, 21 nt, Human
ggagaccccuuggggagcagg

SEQ ID NO: 1865571 - RNA, 21 nt, Human
ggagagcuagcagcagggagg

SEQ ID NO: 1865572 - RNA, 17 nt, Human
ggagagcuagcagcagg

SEQ ID NO: 1865573 - RNA, 11 nt, Human
ggacucugccu

SEQ ID NO: 1865574 - RNA, 12 nt, Human
ggacuccucugu

SEQ ID NO: 1865575 - RNA, 14 nt, Human
ggacuccucugucc

SEQ ID NO: 1865576 - RNA, 15 nt, Human
ggacuccucugucca

SEQ ID NO: 1865577 - RNA, 20 nt, Human
ggaagccagcaggcucucag

SEQ ID NO: 1865578 - RNA, 11 nt, Human
ggagugacaga

SEQ ID NO: 1865579 - RNA, 16 nt, Human
ggagugacagaggcag

SEQ ID NO: 1865580 - RNA, 20 nt, Human
ggagucccaccuuggcugca

SEQ ID NO: 1865581 - RNA, 21 nt, Human
ggagucccaccuuggcugcag

SEQ ID NO: 1865582 - RNA, 15 nt, Human
ggagggcuccagaca

SEQ ID NO: 1865583 - RNA, 14 nt, Human
ggagggcuccagac

SEQ ID NO: 1865584 - RNA, 17 nt, Human
ggagggcuccagacaca

SEQ ID NO: 1865585 - RNA, 23 nt, Human
ggagugaguugauagcacagacc

SEQ ID NO: 1865586 - RNA, 16 nt, Human
ggaucacagccucuga

SEQ ID NO: 1865587 - RNA, 17 nt, Human
ggagugacagaggcagc

SEQ ID NO: 1865588 - RNA, 18 nt, Human
ggagugacagaggcagcc

SEQ ID NO: 1865589 - RNA, 19 nt, Human
ggagugacagaggcagccc

SEQ ID NO: 1865590 - RNA, 21 nt, Human
ggagugacagaggcagcccca

SEQ ID NO: 1865591 - RNA, 12 nt, Human
ggagugagcugg

SEQ ID NO: 1865592 - RNA, 21 nt, Human
ggagugaguugauagcacaga

SEQ ID NO: 1865593 - RNA, 14 nt, Human
ggagugagcugguu

SEQ ID NO: 1865594 - RNA, 20 nt, Human
ggaggacgcucucuggccuu

SEQ ID NO: 1865595 - RNA, 21 nt, Human
ggaggacgcucucuggccuuc

SEQ ID NO: 1865596 - RNA, 19 nt, Human
ggaggacgcucucuggccu

SEQ ID NO: 1865597 - RNA, 12 nt, Human
ggagggagggcu

SEQ ID NO: 1865598 - RNA, 13 nt, Human
ggagggcuccaga

SEQ ID NO: 1865599 - RNA, 12 nt, Human
ggagggcuccag

SEQ ID NO: 1865600 - RNA, 21 nt, Human
ggaggaucucuugagccuggg

SEQ ID NO: 1865601 - RNA, 17 nt, Human
ggaggaucucuugagcc

SEQ ID NO: 1865602 - RNA, 23 nt, Human
ggaggaucacuugaguccagaag

SEQ ID NO: 1865603 - RNA, 15 nt, Human
ggaggauguucuggg

SEQ ID NO: 1865604 - RNA, 21 nt, Human
ggccccucagggucccuggug

SEQ ID NO: 1865605 - RNA, 20 nt, Human
ggccccucagggucccuggu

SEQ ID NO: 1865606 - RNA, 19 nt, Human
ggccccucagggucccugg

SEQ ID NO: 1865607 - RNA, 16 nt, Human
ggccccucaggguccc

SEQ ID NO: 1865608 - RNA, 17 nt, Human
ggccccugccacccugg

SEQ ID NO: 1865609 - RNA, 18 nt, Human
ggccccugccacccuggg

SEQ ID NO: 1865610 - RNA, 13 nt, Human
ggccccugcccgg

SEQ ID NO: 1865611 - RNA, 13 nt, Human
ggccccugccacc

SEQ ID NO: 1865612 - RNA, 16 nt, Human
ggccccugccacccug

SEQ ID NO: 1865613 - RNA, 12 nt, Human
ggccccugccac

SEQ ID NO: 1865614 - RNA, 12 nt, Human
ggccaggcuggu

SEQ ID NO: 1865615 - RNA, 22 nt, Human
ggccaugggacagggaggacgc

SEQ ID NO: 1865616 - RNA, 13 nt, Human
ggccaugggccuc

SEQ ID NO: 1865617 - RNA, 11 nt, Human
ggccacuguga

SEQ ID NO: 1865618 - RNA, 14 nt, Human
ggccaggagccucc

SEQ ID NO: 1865619 - RNA, 16 nt, Human
ggccacugugaagaga

SEQ ID NO: 1865620 - RNA, 16 nt, Human
ggccaggagccuccug

SEQ ID NO: 1865621 - RNA, 14 nt, Human
ggccaggccagagg

SEQ ID NO: 1865622 - RNA, 16 nt, Human
ggccaggccagaggga

SEQ ID NO: 1865623 - RNA, 22 nt, Human
ggccaggcugggucgcccugga

SEQ ID NO: 1865624 - RNA, 18 nt, Human
ggccaggcugggucgccc

SEQ ID NO: 1865625 - RNA, 11 nt, Human
ggccaggcugg

SEQ ID NO: 1865626 - RNA, 17 nt, Human
ggccacaagacccuugu

SEQ ID NO: 1865627 - RNA, 16 nt, Human
ggccacaagacccuug

SEQ ID NO: 1865628 - RNA, 15 nt, Human
ggcauuccccaggag

SEQ ID NO: 1865629 - RNA, 12 nt, Human
ggccaaguucuu

SEQ ID NO: 1865630 - RNA, 22 nt, Human
ggccaccugcggugcuaucucc

SEQ ID NO: 1865631 - RNA, 16 nt, Human
ggccaccugcggugcu

SEQ ID NO: 1865632 - RNA, 15 nt, Human
ggcagguuggugggg

SEQ ID NO: 1865633 - RNA, 23 nt, Human
ggcauguucucugaggacacuaa

SEQ ID NO: 1865634 - RNA, 21 nt, Human
ggcagcucaccucucccuugg

SEQ ID NO: 1865635 - RNA, 18 nt, Human
ggcagcucaccucucccu

SEQ ID NO: 1865636 - RNA, 22 nt, Human
ggcagcucaccucucccuugga

SEQ ID NO: 1865637 - RNA, 21 nt, Human
ggcagcuugaggguugggcug

SEQ ID NO: 1865638 - RNA, 19 nt, Human
ggcagcugcgguccaccca

SEQ ID NO: 1865639 - RNA, 23 nt, Human
ggcaggucuugaacuccuggccu

SEQ ID NO: 1865640 - RNA, 14 nt, Human
ggcaggaaggcuga

SEQ ID NO: 1865641 - RNA, 13 nt, Human
ggcagguccaggg

SEQ ID NO: 1865642 - RNA, 17 nt, Human
ggcagaggaaagcaaag

SEQ ID NO: 1865643 - RNA, 23 nt, Human
ggcagaguugaagacagagcuac

SEQ ID NO: 1865644 - RNA, 23 nt, Human
ggcagauacaggaaaagcugcug

SEQ ID NO: 1865645 - RNA, 16 nt, Human
ggcaaggcugucaauu

SEQ ID NO: 1865646 - RNA, 17 nt, Human
ggcacccggccccugcu

SEQ ID NO: 1865647 - RNA, 15 nt, Human
ggcacccggccccug

SEQ ID NO: 1865648 - RNA, 16 nt, Human
ggcacccggccccugc

SEQ ID NO: 1865649 - RNA, 16 nt, Human
ggcagagcagagacca

SEQ ID NO: 1865650 - RNA, 15 nt, Human
ggcagagcagagacc

SEQ ID NO: 1865651 - RNA, 20 nt, Human
ggcagagcagagaccauccc

SEQ ID NO: 1865652 - RNA, 19 nt, Human
ggcaacugcauuggcuuug

SEQ ID NO: 1865653 - RNA, 15 nt, Human
ggcaaggcugucaau

SEQ ID NO: 1865654 - RNA, 23 nt, Human
ggcaacuugggaacuagacuccc

SEQ ID NO: 1865655 - RNA, 18 nt, Human
ggcaacuugggaacuaga

SEQ ID NO: 1865656 - RNA, 18 nt, Human
ggcaacugcauuggcuuu

SEQ ID NO: 1865657 - RNA, 21 nt, Human
ggaucagucugauucccaagc

SEQ ID NO: 1865658 - RNA, 19 nt, Human
ggcaacccccagccugcua

SEQ ID NO: 1865659 - RNA, 17 nt, Human
uauaaauuuuuuuuguu

SEQ ID NO: 1865660 - RNA, 21 nt, Human
uauaaauuuuuuuuguuucau

SEQ ID NO: 1865661 - RNA, 18 nt, Human
uauaaugaaugaaacauu

SEQ ID NO: 1865662 - RNA, 20 nt, Human
uauaaugaaugaaacauuuu

SEQ ID NO: 1865663 - RNA, 17 nt, Human
uauaauucuacuuugag

SEQ ID NO: 1865664 - RNA, 20 nt, Human
uauaauucacauuguauuca

SEQ ID NO: 1865665 - RNA, 20 nt, Human
uauaauguaagcucuacuga

SEQ ID NO: 1865666 - RNA, 19 nt, Human
uauaauguaagcucuacug

SEQ ID NO: 1865667 - RNA, 14 nt, Human
uauaauguaagcuc

SEQ ID NO: 1865668 - RNA, 17 nt, Human
uauacccccugcaaagc

SEQ ID NO: 1865669 - RNA, 20 nt, Human
uauacucuuauagacaacau

SEQ ID NO: 1865670 - RNA, 18 nt, Human
uagugaugguuccccugu

SEQ ID NO: 1865671 - RNA, 14 nt, Human
uagugaugguuccc

SEQ ID NO: 1865672 - RNA, 13 nt, Human
uagugaugguucc

SEQ ID NO: 1865673 - RNA, 21 nt, Human
uaguuguaccgcaaugugacu

SEQ ID NO: 1865674 - RNA, 12 nt, Human
uaguuugcaguu

SEQ ID NO: 1865675 - RNA, 23 nt, Human
uaguuugauuaaauucuugcaaa

SEQ ID NO: 1865676 - RNA, 13 nt, Human
uaguuucuccaag

SEQ ID NO: 1865677 - RNA, 15 nt, Human
uaguggauguucuga

SEQ ID NO: 1865678 - RNA, 15 nt, Human
uaguggauggaaggg

SEQ ID NO: 1865679 - RNA, 18 nt, Human
uaguggauggaaggggcu

SEQ ID NO: 1865680 - RNA, 19 nt, Human
uauauuuuuuguuaaauga

SEQ ID NO: 1865681 - RNA, 17 nt, Human
uaucaggugcugccauc

SEQ ID NO: 1865682 - RNA, 16 nt, Human
uaucaugucaaacgug

SEQ ID NO: 1865683 - RNA, 16 nt, Human
uaucaugacaaagacu

SEQ ID NO: 1865684 - RNA, 22 nt, Human
uauccugcuucugauaugcagu

SEQ ID NO: 1865685 - RNA, 22 nt, Human
uaucaugugaaaucauucauuu

SEQ ID NO: 1865686 - RNA, 17 nt, Human
uaucaugugaaaucauu

SEQ ID NO: 1865687 - RNA, 21 nt, Human
uaucaugucaaacgugaaaau

SEQ ID NO: 1865688 - RNA, 15 nt, Human
uaucuaaauguugaa

SEQ ID NO: 1865689 - RNA, 19 nt, Human
uaucgucacugcuuaacuu

SEQ ID NO: 1865690 - RNA, 14 nt, Human
uauauuuuaagacg

SEQ ID NO: 1865691 - RNA, 13 nt, Human
uauauuuuaagac

SEQ ID NO: 1865692 - RNA, 20 nt, Human
uauaugcucugcauguuaca

SEQ ID NO: 1865693 - RNA, 16 nt, Human
uagcacuuugggaggc

SEQ ID NO: 1865694 - RNA, 19 nt, Human
uagcagagaaugaaagggc

SEQ ID NO: 1865695 - RNA, 23 nt, Human
uagcagagaaugaaagggcccag

SEQ ID NO: 1865696 - RNA, 12 nt, Human
uagauguauaua

SEQ ID NO: 1865697 - RNA, 18 nt, Human
uagauaauacaccacuac

SEQ ID NO: 1865698 - RNA, 19 nt, Human
uagagguucaaagauauuu

SEQ ID NO: 1865699 - RNA, 16 nt, Human
uagagguucaaagaua

SEQ ID NO: 1865700 - RNA, 21 nt, Human
uagagguucaaagauauuuug

SEQ ID NO: 1865701 - RNA, 16 nt, Human
uagagagagaccacuu

SEQ ID NO: 1865702 - RNA, 23 nt, Human
uagaaccaggcaacuugggaacu

SEQ ID NO: 1865703 - RNA, 12 nt, Human
uagaaccaggca

SEQ ID NO: 1865704 - RNA, 21 nt, Human
uagaaccucgagguuucucaa

SEQ ID NO: 1865705 - RNA, 17 nt, Human
uaggaagacuuuggaaa

SEQ ID NO: 1865706 - RNA, 16 nt, Human
uaggaagacuuuggaa

SEQ ID NO: 1865707 - RNA, 15 nt, Human
uaggaagacuuugga

SEQ ID NO: 1865708 - RNA, 14 nt, Human
uaggaagacuuugg

SEQ ID NO: 1865709 - RNA, 13 nt, Human
uaggaagacuuug

SEQ ID NO: 1865710 - RNA, 14 nt, Human
uaggaacacuccuu

SEQ ID NO: 1865711 - RNA, 13 nt, Human
uaggaacacuccu

SEQ ID NO: 1865712 - RNA, 21 nt, Human
uaggaacuuaaauaaugugaa

SEQ ID NO: 1865713 - RNA, 17 nt, Human
uaggaacacuccuucac

SEQ ID NO: 1865714 - RNA, 13 nt, Human
uaggccaugggac

SEQ ID NO: 1865715 - RNA, 17 nt, Human
uaggccguuccuucaaa

SEQ ID NO: 1865716 - RNA, 14 nt, Human
uaggccuggccaga

SEQ ID NO: 1865717 - RNA, 13 nt, Human
uaggccuggccag

SEQ ID NO: 1865718 - RNA, 23 nt, Human
uaggaauugacccacaagaaaug

SEQ ID NO: 1865719 - RNA, 20 nt, Human
uaggaauugacccacaagaa

SEQ ID NO: 1865720 - RNA, 14 nt, Human
uaggaauuguguuu

SEQ ID NO: 1865721 - RNA, 15 nt, Human
uaggaagguuaaugu

SEQ ID NO: 1865722 - RNA, 13 nt, Human
uagccccauaauu

SEQ ID NO: 1865723 - RNA, 18 nt, Human
uagcccucacccuggggc

SEQ ID NO: 1865724 - RNA, 14 nt, Human
uagcccaaaaccaa

SEQ ID NO: 1865725 - RNA, 21 nt, Human
uagcucuaggagggcuggcaa

SEQ ID NO: 1865726 - RNA, 17 nt, Human
uagccugccucuucucu

SEQ ID NO: 1865727 - RNA, 22 nt, Human
uagcucauucuccuuguguuac

SEQ ID NO: 1865728 - RNA, 11 nt, Human
uagcugggacu

SEQ ID NO: 1865729 - RNA, 22 nt, Human
uagcugggagaaagagagagcu

SEQ ID NO: 1865730 - RNA, 18 nt, Human
uagcugggacuacaggug

SEQ ID NO: 1865731 - RNA, 12 nt, Human
uagcugggacua

SEQ ID NO: 1865732 - RNA, 20 nt, Human
uagcugggacuacaggcacc

SEQ ID NO: 1865733 - RNA, 23 nt, Human
uacacaaugguuuucuugugugu

SEQ ID NO: 1865734 - RNA, 21 nt, Human
uacacaaugguuuucuugugu

SEQ ID NO: 1865735 - RNA, 17 nt, Human
uacacaaugguuuucuu

SEQ ID NO: 1865736 - RNA, 17 nt, Human
uacacacugcauguuug

SEQ ID NO: 1865737 - RNA, 21 nt, Human
uacacacacacgcgugcacac

SEQ ID NO: 1865738 - RNA, 15 nt, Human
uacacacacauacac

SEQ ID NO: 1865739 - RNA, 16 nt, Human
uacacugugcugaguc

SEQ ID NO: 1865740 - RNA, 14 nt, Human
uacacuguuucaaa

SEQ ID NO: 1865741 - RNA, 22 nt, Human
uacacacugcauguuugugauu

SEQ ID NO: 1865742 - RNA, 17 nt, Human
uaauuuugaaaaacugc

SEQ ID NO: 1865743 - RNA, 13 nt, Human
uaauuuugaaaaa

SEQ ID NO: 1865744 - RNA, 19 nt, Human
uacaagagcuuaacagugu

SEQ ID NO: 1865745 - RNA, 15 nt, Human
uacaagacacaguga

SEQ ID NO: 1865746 - RNA, 22 nt, Human
uacagcuugaccgugaggccag

SEQ ID NO: 1865747 - RNA, 23 nt, Human
uacagcuugaccgugaggccaga

SEQ ID NO: 1865748 - RNA, 17 nt, Human
uacaggaaaagcugcug

SEQ ID NO: 1865749 - RNA, 18 nt, Human
uacaggaaaagcugcuga

SEQ ID NO: 1865750 - RNA, 13 nt, Human
uacaguguacagu

SEQ ID NO: 1865751 - RNA, 22 nt, Human
uacaguguacagucuuguauua

SEQ ID NO: 1865752 - RNA, 15 nt, Human
uacaguguacagucu

SEQ ID NO: 1865753 - RNA, 16 nt, Human
uacaguguacagucuu

SEQ ID NO: 1865754 - RNA, 19 nt, Human
uacaggaaaagcugcugac

SEQ ID NO: 1865755 - RNA, 16 nt, Human
uacaggcacccaccau

SEQ ID NO: 1865756 - RNA, 14 nt, Human
uacaggauuugaaa

SEQ ID NO: 1865757 - RNA, 17 nt, Human
uacacuguuucaaacuu

SEQ ID NO: 1865758 - RNA, 18 nt, Human
uacacuguuucaaacuuu

SEQ ID NO: 1865759 - RNA, 19 nt, Human
uacacuguuucaaacuuua

SEQ ID NO: 1865760 - RNA, 13 nt, Human
uacacuuuaugca

SEQ ID NO: 1865761 - RNA, 24 nt, Human
uacagcaaggagauuuacaacugg

SEQ ID NO: 1865762 - RNA, 13 nt, Human
uacagaauuuuau

SEQ ID NO: 1865763 - RNA, 19 nt, Human
uacccacccccacccaagg

SEQ ID NO: 1865764 - RNA, 17 nt, Human
uacccacccccacccaa

SEQ ID NO: 1865765 - RNA, 23 nt, Human
uacccacccccacccaagggccu

SEQ ID NO: 1865766 - RNA, 15 nt, Human
uacccacccccaccc

SEQ ID NO: 1865767 - RNA, 12 nt, Human
uacccaccccca

SEQ ID NO: 1865768 - RNA, 11 nt, Human
uacccacugcu

SEQ ID NO: 1865769 - RNA, 12 nt, Human
uacccacugcuc

SEQ ID NO: 1865770 - RNA, 13 nt, Human
uacccacugcucu

SEQ ID NO: 1865771 - RNA, 14 nt, Human
uacccacugcucug

SEQ ID NO: 1865772 - RNA, 16 nt, Human
uacccagcgagcccug

SEQ ID NO: 1865773 - RNA, 22 nt, Human
uacccaggugcuaggaacacuc

SEQ ID NO: 1865774 - RNA, 18 nt, Human
uacccagcgagcccuggu

SEQ ID NO: 1865775 - RNA, 13 nt, Human
uaccacagacaua

SEQ ID NO: 1865776 - RNA, 15 nt, Human
uaccaccacgcccgg

SEQ ID NO: 1865777 - RNA, 23 nt, Human
uaccauuuugggguacccacugc

SEQ ID NO: 1865778 - RNA, 19 nt, Human
uacauaagauaaaugugcu

SEQ ID NO: 1865779 - RNA, 18 nt, Human
uacauaagauaaaugugc

SEQ ID NO: 1865780 - RNA, 18 nt, Human
uacaguuccuagguauaa

SEQ ID NO: 1865781 - RNA, 19 nt, Human
uacaguuacucagaauucu

SEQ ID NO: 1865782 - RNA, 23 nt, Human
uacaguuacucagaauucucuag

SEQ ID NO: 1865783 - RNA, 22 nt, Human
uacauaagauaaaugugcugaa

SEQ ID NO: 1865784 - RNA, 21 nt, Human
uacaugagguacugagaguga

SEQ ID NO: 1865785 - RNA, 22 nt, Human
uacaugagguacugagagugaa

SEQ ID NO: 1865786 - RNA, 21 nt, Human
uacauuuuguauauuuguauu

SEQ ID NO: 1865787 - RNA, 17 nt, Human
uacuacaguccucccau

SEQ ID NO: 1865788 - RNA, 12 nt, Human
uacuacaguccu

SEQ ID NO: 1865789 - RNA, 13 nt, Human
uacuaacuuuccu

SEQ ID NO: 1865790 - RNA, 22 nt, Human
uacuaauaaaauuuaaaagucu

SEQ ID NO: 1865791 - RNA, 15 nt, Human
uacuaauagacaauu

SEQ ID NO: 1865792 - RNA, 17 nt, Human
uacuaauagacaauuua

SEQ ID NO: 1865793 - RNA, 19 nt, Human
uacuaaccagcagaaaugc

SEQ ID NO: 1865794 - RNA, 17 nt, Human
uacuaaccagcagaaau

SEQ ID NO: 1865795 - RNA, 18 nt, Human
uacuaaccagcagaaaug

SEQ ID NO: 1865796 - RNA, 22 nt, Human
uaccuuuuuuauacauaaacaa

SEQ ID NO: 1865797 - RNA, 14 nt, Human
uacgacaacuugca

SEQ ID NO: 1865798 - RNA, 15 nt, Human
uacgacaacuugcac

SEQ ID NO: 1865799 - RNA, 18 nt, Human
uaccuuuuuuauacauaa

SEQ ID NO: 1865800 - RNA, 19 nt, Human
uaccuuuuuuauacauaaa

SEQ ID NO: 1865801 - RNA, 20 nt, Human
uaccuuuuuuauacauaaac

SEQ ID NO: 1865802 - RNA, 20 nt, Human
uaccuuuguauucucuccug

SEQ ID NO: 1865803 - RNA, 19 nt, Human
uaccuuugacaaagguaaa

SEQ ID NO: 1865804 - RNA, 22 nt, Human
uacccaucccauaugccugggc

SEQ ID NO: 1865805 - RNA, 20 nt, Human
uacuacaguuuguuaguaug

SEQ ID NO: 1865806 - RNA, 20 nt, Human
uacuacaguccucccaucuc

SEQ ID NO: 1865807 - RNA, 12 nt, Human
uacucaccucac

SEQ ID NO: 1865808 - RNA, 14 nt, Human
uacucaccucaccc

SEQ ID NO: 1865809 - RNA, 16 nt, Human
uacucagaauucucua

SEQ ID NO: 1865810 - RNA, 22 nt, Human
uacucagaauucucuaguuuga

SEQ ID NO: 1865811 - RNA, 15 nt, Human
uacugaggugcuaug

SEQ ID NO: 1865812 - RNA, 17 nt, Human
uacucccaucugugaaa

SEQ ID NO: 1865813 - RNA, 16 nt, Human
uacucccaucugugaa

SEQ ID NO: 1865814 - RNA, 14 nt, Human
uacucccaucugug

SEQ ID NO: 1865815 - RNA, 12 nt, Human
uacucccaucug

SEQ ID NO: 1865816 - RNA, 15 nt, Human
uagaaagaagaugaa

SEQ ID NO: 1865817 - RNA, 23 nt, Human
uagaaauaucugaaaauguaugu

SEQ ID NO: 1865818 - RNA, 21 nt, Human
uagaaauaucugaaaauguau

SEQ ID NO: 1865819 - RNA, 20 nt, Human
uagaaauaucugaaaaugua

SEQ ID NO: 1865820 - RNA, 15 nt, Human
uagaaauauaauuga

SEQ ID NO: 1865821 - RNA, 19 nt, Human
uacuuguggacacagcucu

SEQ ID NO: 1865822 - RNA, 15 nt, Human
uacuuguggacacag

SEQ ID NO: 1865823 - RNA, 18 nt, Human
uacuuguggacacagcuc

SEQ ID NO: 1865824 - RNA, 21 nt, Human
uacuugcucuugaugccuggc

SEQ ID NO: 1865825 - RNA, 17 nt, Human
uacugcauaugaaagga

SEQ ID NO: 1865826 - RNA, 21 nt, Human
uacuguaucaugacaaagacu

SEQ ID NO: 1865827 - RNA, 17 nt, Human
uaauuaaaacacaacau

SEQ ID NO: 1865828 - RNA, 23 nt, Human
uaaugcgcaggcuggcccugccc

SEQ ID NO: 1865829 - RNA, 14 nt, Human
uaaugcgugcauac

SEQ ID NO: 1865830 - RNA, 22 nt, Human
uaaugcgcaggcuggcccugcc

SEQ ID NO: 1865831 - RNA, 19 nt, Human
uaaugcgcaggcuggcccu

SEQ ID NO: 1865832 - RNA, 20 nt, Human
uaauugacaggauuauugga

SEQ ID NO: 1865833 - RNA, 22 nt, Human
uaauugacaggauuauuggaaa

SEQ ID NO: 1865834 - RNA, 18 nt, Human
uaauucuuagcucauucu

SEQ ID NO: 1865835 - RNA, 19 nt, Human
uaauuugugauacaaugcu

SEQ ID NO: 1865836 - RNA, 22 nt, Human
uaauuugugauacaaugcugug

SEQ ID NO: 1865837 - RNA, 14 nt, Human
uaauuugugauaca

SEQ ID NO: 1865838 - RNA, 15 nt, Human
uaauuugugauacaa

SEQ ID NO: 1865839 - RNA, 18 nt, Human
uaauuugugauacaaugc

SEQ ID NO: 1865840 - RNA, 14 nt, Human
uaauacaccacuac

SEQ ID NO: 1865841 - RNA, 21 nt, Human
uaauaguucagguaacaggca

SEQ ID NO: 1865842 - RNA, 11 nt, Human
uaauaaagcug

SEQ ID NO: 1865843 - RNA, 13 nt, Human
uaauaaagacagg

SEQ ID NO: 1865844 - RNA, 20 nt, Human
uaagugguacuaacuuuccu

SEQ ID NO: 1865845 - RNA, 11 nt, Human
uaaucuaaaug

SEQ ID NO: 1865846 - RNA, 23 nt, Human
uaaugaugucguuugaaucacag

SEQ ID NO: 1865847 - RNA, 17 nt, Human
uaaugaugucguuugaa

SEQ ID NO: 1865848 - RNA, 19 nt, Human
uaaugccacuaaauugaca

SEQ ID NO: 1865849 - RNA, 16 nt, Human
uaaucguguccccuau

SEQ ID NO: 1865850 - RNA, 16 nt, Human
uaaucgaccugccucg

SEQ ID NO: 1865851 - RNA, 14 nt, Human
uaaucgaccugccu

SEQ ID NO: 1865852 - RNA, 13 nt, Human
uaaucgaccugcc

SEQ ID NO: 1865853 - RNA, 17 nt, Human
uaagauaaaugugcuga

SEQ ID NO: 1865854 - RNA, 16 nt, Human
uaagauaaaugugcug

SEQ ID NO: 1865855 - RNA, 18 nt, Human
uaagaucguucucugccu

SEQ ID NO: 1865856 - RNA, 23 nt, Human
uaagagggagggagggcuccaga

SEQ ID NO: 1865857 - RNA, 22 nt, Human
uaagagggagggagggcuccag

SEQ ID NO: 1865858 - RNA, 12 nt, Human
uaagagggaggg

SEQ ID NO: 1865859 - RNA, 14 nt, Human
uaagauaaaugugc

SEQ ID NO: 1865860 - RNA, 21 nt, Human
uaacuuuuauaaacuuuaccu

SEQ ID NO: 1865861 - RNA, 22 nt, Human
uaacuuuuauaaacuuuaccuu

SEQ ID NO: 1865862 - RNA, 22 nt, Human
uaagaaccuuuugagugccuua

SEQ ID NO: 1865863 - RNA, 22 nt, Human
uaagaggcagggucucacucug

SEQ ID NO: 1865864 - RNA, 20 nt, Human
uaaggaugcuuguacauaau

SEQ ID NO: 1865865 - RNA, 21 nt, Human
uaaggaugcuuguacauaaug

SEQ ID NO: 1865866 - RNA, 22 nt, Human
uaaggaugcuuguacauaaugc

SEQ ID NO: 1865867 - RNA, 23 nt, Human
uaaggaugcuuguacauaaugcg

SEQ ID NO: 1865868 - RNA, 18 nt, Human
uaaggaugcuuguacaua

SEQ ID NO: 1865869 - RNA, 15 nt, Human
uaaggcaaucauggu

SEQ ID NO: 1865870 - RNA, 19 nt, Human
uaaggaugcuuguacauaa

SEQ ID NO: 1865871 - RNA, 21 nt, Human
uaagccuuuggaaacagcucg

SEQ ID NO: 1865872 - RNA, 17 nt, Human
uaagccuuuggaaacag

SEQ ID NO: 1865873 - RNA, 14 nt, Human
uaagccuuuggaaa

SEQ ID NO: 1865874 - RNA, 20 nt, Human
uaagccagacaucaacagau

SEQ ID NO: 1865875 - RNA, 21 nt, Human
uaagccagacaucaacagaua

SEQ ID NO: 1865876 - RNA, 13 nt, Human
uaagccagacauc

SEQ ID NO: 1865877 - RNA, 15 nt, Human
uaagcaugcacaaau

SEQ ID NO: 1865878 - RNA, 20 nt, Human
uaacuuuuauaaacuuuacc

SEQ ID NO: 1865879 - RNA, 17 nt, Human
uaacugagugccuuuug

SEQ ID NO: 1865880 - RNA, 16 nt, Human
uaacugagugccuuuu

SEQ ID NO: 1865881 - RNA, 14 nt, Human
uaaccagcagaaau

SEQ ID NO: 1865882 - RNA, 16 nt, Human
uaaccagcagaaaugc

SEQ ID NO: 1865883 - RNA, 19 nt, Human
uaaccagcagaaaugccuu

SEQ ID NO: 1865884 - RNA, 19 nt, Human
uaacaggcagauacaggaa

SEQ ID NO: 1865885 - RNA, 14 nt, Human
uaacagaaauguac

SEQ ID NO: 1865886 - RNA, 15 nt, Human
uaacagaaauguaca

SEQ ID NO: 1865887 - RNA, 13 nt, Human
uaacagaaaugua

SEQ ID NO: 1865888 - RNA, 15 nt, Human
uaaauugcuccuuga

SEQ ID NO: 1865889 - RNA, 19 nt, Human
uaaaucagccguguaacca

SEQ ID NO: 1865890 - RNA, 20 nt, Human
uaaaucagacuaugaaguuu

SEQ ID NO: 1865891 - RNA, 19 nt, Human
uaaaucaaguuggcuucua

SEQ ID NO: 1865892 - RNA, 22 nt, Human
uaaauauauuuuaagacgaaac

SEQ ID NO: 1865893 - RNA, 16 nt, Human
uaaauauauuuuaaga

SEQ ID NO: 1865894 - RNA, 18 nt, Human
uaaauauaugcuaagucu

SEQ ID NO: 1865895 - RNA, 22 nt, Human
uaaaguguauuuuuuuacuaau

SEQ ID NO: 1865896 - RNA, 23 nt, Human
uaaaguguauuuuuuuacuaaua

SEQ ID NO: 1865897 - RNA, 21 nt, Human
uaaaguguauuuuuuuacuaa

SEQ ID NO: 1865898 - RNA, 13 nt, Human
uaaaguuucuguu

SEQ ID NO: 1865899 - RNA, 14 nt, Human
uaaaguuuguugaa

SEQ ID NO: 1865900 - RNA, 17 nt, Human
uaaauaaaaauaauccu

SEQ ID NO: 1865901 - RNA, 20 nt, Human
uaaacuuuuuucuuacuguc

SEQ ID NO: 1865902 - RNA, 15 nt, Human
uaaagcuagaaauga

SEQ ID NO: 1865903 - RNA, 14 nt, Human
uaaagcuagaaaug

SEQ ID NO: 1865904 - RNA, 14 nt, Human
uaaaggaauuuaaa

SEQ ID NO: 1865905 - RNA, 21 nt, Human
uaaacacucuugaaaaaugca

SEQ ID NO: 1865906 - RNA, 23 nt, Human
uaaacaagaccacguuucuaaag

SEQ ID NO: 1865907 - RNA, 19 nt, Human
uaaacaagaccacguuucu

SEQ ID NO: 1865908 - RNA, 18 nt, Human
uaaacaagaccacguuuc

SEQ ID NO: 1865909 - RNA, 21 nt, Human
uaaacugcccccucugcccug

SEQ ID NO: 1865910 - RNA, 20 nt, Human
uaaacugcccccucugcccu

SEQ ID NO: 1865911 - RNA, 23 nt, Human
uaaacugcccccucugcccugcg

SEQ ID NO: 1865912 - RNA, 22 nt, Human
uaaacugcccccucugcccugc

SEQ ID NO: 1865913 - RNA, 22 nt, Human
uaaacuuuaccuuuuuuauaca

SEQ ID NO: 1865914 - RNA, 16 nt, Human
uaaacuuuaccuuuuu

SEQ ID NO: 1865915 - RNA, 14 nt, Human
uaaacuuaaucuaa

SEQ ID NO: 1865916 - RNA, 13 nt, Human
uaaacuuaaucua

SEQ ID NO: 1865917 - RNA, 18 nt, Human
uaaacuuaaucuaaaugg

SEQ ID NO: 1865918 - RNA, 19 nt, Human
uaaacuuaaucuaaaugga

SEQ ID NO: 1865919 - RNA, 21 nt, Human
uaaaagggacugagaaauuua

SEQ ID NO: 1865920 - RNA, 20 nt, Human
uaaaagggacugagaaauuu

SEQ ID NO: 1865921 - RNA, 19 nt, Human
uaaaagggacugagaaauu

SEQ ID NO: 1865922 - RNA, 17 nt, Human
uaaaagggacugagaaa

SEQ ID NO: 1865923 - RNA, 15 nt, Human
uaaaaaugguuuaaa

SEQ ID NO: 1865924 - RNA, 16 nt, Human
uaaaaugagaaaucua

SEQ ID NO: 1865925 - RNA, 15 nt, Human
uaaaaugagaaaucu

SEQ ID NO: 1865926 - RNA, 13 nt, Human
uaaaaugagaaau

SEQ ID NO: 1865927 - RNA, 19 nt, Human
guuuguggaaaaugaaaau

SEQ ID NO: 1865928 - RNA, 18 nt, Human
guuuguuccccaagacau

SEQ ID NO: 1865929 - RNA, 17 nt, Human
guuuguaaauuaacuuu

SEQ ID NO: 1865930 - RNA, 19 nt, Human
guuuguaaauuaacuuuua

SEQ ID NO: 1865931 - RNA, 17 nt, Human
guuugauuaaauucuug

SEQ ID NO: 1865932 - RNA, 19 nt, Human
guuugauuaaauucuugca

SEQ ID NO: 1865933 - RNA, 22 nt, Human
guuugauuaaauucuugcaaag

SEQ ID NO: 1865934 - RNA, 14 nt, Human
guuucuuuguaaug

SEQ ID NO: 1865935 - RNA, 17 nt, Human
guuucuuuguaaugaaa

SEQ ID NO: 1865936 - RNA, 16 nt, Human
guuugaaccaagaacu

SEQ ID NO: 1865937 - RNA, 15 nt, Human
guuucuaaagcugcc

SEQ ID NO: 1865938 - RNA, 14 nt, Human
guuucuaaagcugc

SEQ ID NO: 1865939 - RNA, 16 nt, Human
guuucuaaagcugcca

SEQ ID NO: 1865940 - RNA, 20 nt, Human
guuucuaaagcugccagccg

SEQ ID NO: 1865941 - RNA, 20 nt, Human
guuuccuggcacugcuucca

SEQ ID NO: 1865942 - RNA, 16 nt, Human
guuuccuggcacugcu

SEQ ID NO: 1865943 - RNA, 17 nt, Human
guuuccugcccugggag

SEQ ID NO: 1865944 - RNA, 13 nt, Human
guuuccugcccug

SEQ ID NO: 1865945 - RNA, 22 nt, Human
guuuccuggcacugcuuccagu

SEQ ID NO: 1865946 - RNA, 21 nt, Human
guuuccuggcacugcuuccag

SEQ ID NO: 1865947 - RNA, 16 nt, Human
guuuccuuauauuaug

SEQ ID NO: 1865948 - RNA, 22 nt, Human
guuuccugcccugggaggcagu

SEQ ID NO: 1865949 - RNA, 14 nt, Human
guuucagaaaugug

SEQ ID NO: 1865950 - RNA, 18 nt, Human
guuucagaaauguguuau

SEQ ID NO: 1865951 - RNA, 16 nt, Human
guuuaguaaucauauu

SEQ ID NO: 1865952 - RNA, 20 nt, Human
guuuaggauguugaaaaagu

SEQ ID NO: 1865953 - RNA, 13 nt, Human
guuuagaaagcuu

SEQ ID NO: 1865954 - RNA, 17 nt, Human
guuuagaaagcuugccc

SEQ ID NO: 1865955 - RNA, 21 nt, Human
gguuggccccugcccggcugc

SEQ ID NO: 1865956 - RNA, 16 nt, Human
guuuguugugaggauu

SEQ ID NO: 1865957 - RNA, 16 nt, Human
guuuucaguguacaug

SEQ ID NO: 1865958 - RNA, 17 nt, Human
guuuucaguguacaugg

SEQ ID NO: 1865959 - RNA, 19 nt, Human
guuuuuauggcuuuugugc

SEQ ID NO: 1865960 - RNA, 22 nt, Human
guuuuuauggcuuuugugcauu

SEQ ID NO: 1865961 - RNA, 23 nt, Human
guuuuuauggcuuuugugcauua

SEQ ID NO: 1865962 - RNA, 19 nt, Human
guuuucucuugagagggug

SEQ ID NO: 1865963 - RNA, 12 nt, Human
guuuucucuuga

SEQ ID NO: 1865964 - RNA, 12 nt, Human
guuuuucaguuu

SEQ ID NO: 1865965 - RNA, 11 nt, Human
uaaaaaacacu

SEQ ID NO: 1865966 - RNA, 23 nt, Human
uaaaaaacugcugacuguuuucu

SEQ ID NO: 1865967 - RNA, 20 nt, Human
uaaaaaacugcugacuguuu

SEQ ID NO: 1865968 - RNA, 12 nt, Human
uaaaaaacacug

SEQ ID NO: 1865969 - RNA, 13 nt, Human
ucaauaggaaaaa

SEQ ID NO: 1865970 - RNA, 14 nt, Human
ucaauaggaaaaac

SEQ ID NO: 1865971 - RNA, 14 nt, Human
ucaaugcacugaca

SEQ ID NO: 1865972 - RNA, 18 nt, Human
ucaauuacaggaaguacu

SEQ ID NO: 1865973 - RNA, 13 nt, Human
ucaauuacaggaa

SEQ ID NO: 1865974 - RNA, 17 nt, Human
ucaaugcuauaacuaug

SEQ ID NO: 1865975 - RNA, 18 nt, Human
ucaaugcacugacauugu

SEQ ID NO: 1865976 - RNA, 20 nt, Human
ucaauuacaggaaguacugg

SEQ ID NO: 1865977 - RNA, 19 nt, Human
ucaauuacaggaaguacug

SEQ ID NO: 1865978 - RNA, 21 nt, Human
ucacacaguauuacuucugcu

SEQ ID NO: 1865979 - RNA, 22 nt, Human
ucacacaguauuacuucugcua

SEQ ID NO: 1865980 - RNA, 13 nt, Human
ucacacagugagu

SEQ ID NO: 1865981 - RNA, 21 nt, Human
ucacacaugagcaucaggcca

SEQ ID NO: 1865982 - RNA, 22 nt, Human
ucacacagugagucgaggacag

SEQ ID NO: 1865983 - RNA, 23 nt, Human
ucacacagugagucgaggacagg

SEQ ID NO: 1865984 - RNA, 14 nt, Human
ucacaggaaguaga

SEQ ID NO: 1865985 - RNA, 19 nt, Human
ucacaggaaguagaggagg

SEQ ID NO: 1865986 - RNA, 11 nt, Human
ucacaggcagg

SEQ ID NO: 1865987 - RNA, 16 nt, Human
ucaagcgauucuucug

SEQ ID NO: 1865988 - RNA, 17 nt, Human
ucaagcgauucuucugc

SEQ ID NO: 1865989 - RNA, 19 nt, Human
ucaaggauccugagccaga

SEQ ID NO: 1865990 - RNA, 18 nt, Human
ucaaggauccugagccag

SEQ ID NO: 1865991 - RNA, 20 nt, Human
ucaaggauccugagccagau

SEQ ID NO: 1865992 - RNA, 23 nt, Human
ucaaggauccugagccagauuuc

SEQ ID NO: 1865993 - RNA, 22 nt, Human
ucaagugauucuccugccucag

SEQ ID NO: 1865994 - RNA, 16 nt, Human
ucaaacuuuacuaugg

SEQ ID NO: 1865995 - RNA, 15 nt, Human
ucaaacuuuacuaug

SEQ ID NO: 1865996 - RNA, 13 nt, Human
ucaaacuuuacua

SEQ ID NO: 1865997 - RNA, 22 nt, Human
ucaaacucuugaccucagguga

SEQ ID NO: 1865998 - RNA, 13 nt, Human
ucaaccuccuggg

SEQ ID NO: 1865999 - RNA, 14 nt, Human
ucaaccuccugggc

SEQ ID NO: 1866000 - RNA, 15 nt, Human
uauuuuuuuacuaau

SEQ ID NO: 1866001 - RNA, 22 nt, Human
uauuuuuuucugaauuauuuuc

SEQ ID NO: 1866002 - RNA, 15 nt, Human
ucaaaaacauucuua

SEQ ID NO: 1866003 - RNA, 14 nt, Human
ucaaacucuuaaaa

SEQ ID NO: 1866004 - RNA, 16 nt, Human
ucaaacgugaaaaugc

SEQ ID NO: 1866005 - RNA, 15 nt, Human
ucaaacgugaaaaug

SEQ ID NO: 1866006 - RNA, 23 nt, Human
ucaaacggccucacuaggcuucu

SEQ ID NO: 1866007 - RNA, 22 nt, Human
ucaaaacgguuuuacugcagcu

SEQ ID NO: 1866008 - RNA, 16 nt, Human
uauuuuauguugcaua

SEQ ID NO: 1866009 - RNA, 15 nt, Human
uauuuuauguugcau

SEQ ID NO: 1866010 - RNA, 21 nt, Human
uauuuucaacgcagcccugcu

SEQ ID NO: 1866011 - RNA, 23 nt, Human
uauuuauuaaaugcccagccccu

SEQ ID NO: 1866012 - RNA, 20 nt, Human
uaucugaaaauguaugugua

SEQ ID NO: 1866013 - RNA, 15 nt, Human
uaucugaaaauguau

SEQ ID NO: 1866014 - RNA, 14 nt, Human
uaucugaaaaugua

SEQ ID NO: 1866015 - RNA, 20 nt, Human
ucacgccuguaauccuagca

SEQ ID NO: 1866016 - RNA, 19 nt, Human
ucacgccuguaauccuagc

SEQ ID NO: 1866017 - RNA, 16 nt, Human
ucacgccacugcacua

SEQ ID NO: 1866018 - RNA, 13 nt, Human
ucacgccacugca

SEQ ID NO: 1866019 - RNA, 14 nt, Human
ucacgccacugcac

SEQ ID NO: 1866020 - RNA, 18 nt, Human
ucaccuuuguccccaccg

SEQ ID NO: 1866021 - RNA, 17 nt, Human
ucaccuuuguccccacc

SEQ ID NO: 1866022 - RNA, 15 nt, Human
ucaccuuugucccca

SEQ ID NO: 1866023 - RNA, 14 nt, Human
ucaccuuugucccc

SEQ ID NO: 1866024 - RNA, 22 nt, Human
ucaccuuuguccccaccgcaga

SEQ ID NO: 1866025 - RNA, 12 nt, Human
ucacaggcaggu

SEQ ID NO: 1866026 - RNA, 15 nt, Human
ucacaggcaggucca

SEQ ID NO: 1866027 - RNA, 12 nt, Human
ucaccuuugucc

SEQ ID NO: 1866028 - RNA, 14 nt, Human
ucaccuuucccauc

SEQ ID NO: 1866029 - RNA, 13 nt, Human
ucaccuuuauucu

SEQ ID NO: 1866030 - RNA, 20 nt, Human
ucacucuacuuagcaugucc

SEQ ID NO: 1866031 - RNA, 19 nt, Human
ucacucuacuuagcauguc

SEQ ID NO: 1866032 - RNA, 14 nt, Human
ucacucuccuuggu

SEQ ID NO: 1866033 - RNA, 12 nt, Human
ucacucuccuug

SEQ ID NO: 1866034 - RNA, 13 nt, Human
ucacucuggcagc

SEQ ID NO: 1866035 - RNA, 12 nt, Human
ucacucuggcag

SEQ ID NO: 1866036 - RNA, 23 nt, Human
ucacucuccuuggugucgggcau

SEQ ID NO: 1866037 - RNA, 22 nt, Human
ucacucuggcagcucagagagg

SEQ ID NO: 1866038 - RNA, 20 nt, Human
ucacucuggcagcucagaga

SEQ ID NO: 1866039 - RNA, 19 nt, Human
ucacucuggcagcucagag

SEQ ID NO: 1866040 - RNA, 18 nt, Human
ucacucuggcagcucaga

SEQ ID NO: 1866041 - RNA, 17 nt, Human
ucacucuggcagcucag

SEQ ID NO: 1866042 - RNA, 16 nt, Human
ucacucuggcagcuca

SEQ ID NO: 1866043 - RNA, 15 nt, Human
ucacucuggcagcuc

SEQ ID NO: 1866044 - RNA, 14 nt, Human
ucacucuggcagcu

SEQ ID NO: 1866045 - RNA, 17 nt, Human
ucacggaagagccuugc

SEQ ID NO: 1866046 - RNA, 16 nt, Human
ucacggaagagccuug

SEQ ID NO: 1866047 - RNA, 14 nt, Human
ucacggaagagccu

SEQ ID NO: 1866048 - RNA, 13 nt, Human
ucacggcucacug

SEQ ID NO: 1866049 - RNA, 15 nt, Human
ucacggcucacugca

SEQ ID NO: 1866050 - RNA, 20 nt, Human
ucacggcucacugcagccuc

SEQ ID NO: 1866051 - RNA, 13 nt, Human
ucacuccuugaaa

SEQ ID NO: 1866052 - RNA, 18 nt, Human
ucacuccuaccugguaau

SEQ ID NO: 1866053 - RNA, 22 nt, Human
ucagacauagaauuaacacaug

SEQ ID NO: 1866054 - RNA, 19 nt, Human
ucagacauagaauuaacac

SEQ ID NO: 1866055 - RNA, 20 nt, Human
ucagacagcugccugggauc

SEQ ID NO: 1866056 - RNA, 19 nt, Human
ucagacagcugccugggau

SEQ ID NO: 1866057 - RNA, 18 nt, Human
ucagacagcugccuggga

SEQ ID NO: 1866058 - RNA, 17 nt, Human
ucagacagcugccuggg

SEQ ID NO: 1866059 - RNA, 16 nt, Human
ucagacagcugccugg

SEQ ID NO: 1866060 - RNA, 15 nt, Human
ucagacagcugccug

SEQ ID NO: 1866061 - RNA, 18 nt, Human
ucagcacgauuucuguuu

SEQ ID NO: 1866062 - RNA, 19 nt, Human
ucagcacgauuucuguuua

SEQ ID NO: 1866063 - RNA, 22 nt, Human
ucagaguugaugguuguacaua

SEQ ID NO: 1866064 - RNA, 21 nt, Human
ucagaggggaauaaacuguug

SEQ ID NO: 1866065 - RNA, 15 nt, Human
ucacugcuuaacuuc

SEQ ID NO: 1866066 - RNA, 17 nt, Human
ucacugcuuaacuucac

SEQ ID NO: 1866067 - RNA, 18 nt, Human
ucacugcuuaacuucaca

SEQ ID NO: 1866068 - RNA, 20 nt, Human
ucacugcuuaacuucacaua

SEQ ID NO: 1866069 - RNA, 22 nt, Human
ucacucugucgcccagucugga

SEQ ID NO: 1866070 - RNA, 19 nt, Human
ucacucugucgcccagucu

SEQ ID NO: 1866071 - RNA, 12 nt, Human
ucacucugucgc

SEQ ID NO: 1866072 - RNA, 16 nt, Human
ucacucugucgcccag

SEQ ID NO: 1866073 - RNA, 22 nt, Human
ucacuuuuauuuagcaccaggg

SEQ ID NO: 1866074 - RNA, 12 nt, Human
ucacuuuuauuu

SEQ ID NO: 1866075 - RNA, 15 nt, Human
ucagucuggcccuuc

SEQ ID NO: 1866076 - RNA, 20 nt, Human
ucaguggggcccauggaugu

SEQ ID NO: 1866077 - RNA, 24 nt, Human
ucagucugauucccaagcucugcu

SEQ ID NO: 1866078 - RNA, 17 nt, Human
ucagugugacugaucuc

SEQ ID NO: 1866079 - RNA, 13 nt, Human
ucagugugacuga

SEQ ID NO: 1866080 - RNA, 11 nt, Human
ucaguguacau

SEQ ID NO: 1866081 - RNA, 23 nt, Human
ucagugguuggcaauuguuucaa

SEQ ID NO: 1866082 - RNA, 15 nt, Human
ucaguuacucuucag

SEQ ID NO: 1866083 - RNA, 13 nt, Human
ucauaaugacuua

SEQ ID NO: 1866084 - RNA, 17 nt, Human
ucaguuguuaguguguc

SEQ ID NO: 1866085 - RNA, 15 nt, Human
ucauaauuauuauuu

SEQ ID NO: 1866086 - RNA, 13 nt, Human
ucauacccacccc

SEQ ID NO: 1866087 - RNA, 15 nt, Human
ucauacccaccccca

SEQ ID NO: 1866088 - RNA, 14 nt, Human
ucauacccaccccc

SEQ ID NO: 1866089 - RNA, 20 nt, Human
ucauacccacccccacccaa

SEQ ID NO: 1866090 - RNA, 21 nt, Human
ucauacccacccccacccaag

SEQ ID NO: 1866091 - RNA, 16 nt, Human
ucauuaggugugacug

SEQ ID NO: 1866092 - RNA, 18 nt, Human
ucauuaggugugacugaa

SEQ ID NO: 1866093 - RNA, 21 nt, Human
ucauuaggugugacugaauuu

SEQ ID NO: 1866094 - RNA, 22 nt, Human
ucauuaggugugacugaauuuc

SEQ ID NO: 1866095 - RNA, 14 nt, Human
uccaccuacaugag

SEQ ID NO: 1866096 - RNA, 12 nt, Human
uccaccugccag

SEQ ID NO: 1866097 - RNA, 14 nt, Human
uccacaagagccca

SEQ ID NO: 1866098 - RNA, 15 nt, Human
uccacaagagcccag

SEQ ID NO: 1866099 - RNA, 14 nt, Human
uccacaacacacag

SEQ ID NO: 1866100 - RNA, 12 nt, Human
uccacuuggucu

SEQ ID NO: 1866101 - RNA, 13 nt, Human
uccacuuggucug

SEQ ID NO: 1866102 - RNA, 13 nt, Human
uccaccugccagg

SEQ ID NO: 1866103 - RNA, 14 nt, Human
uccacuuggucugu

SEQ ID NO: 1866104 - RNA, 23 nt, Human
uccagccaaagccuccuccagcc

SEQ ID NO: 1866105 - RNA, 20 nt, Human
uccaagaagcccaggaaagg

SEQ ID NO: 1866106 - RNA, 22 nt, Human
uccaagaagcccaggaaaggcu

SEQ ID NO: 1866107 - RNA, 13 nt, Human
uccaagcaaaugu

SEQ ID NO: 1866108 - RNA, 19 nt, Human
uccaagaccuucuccuuca

SEQ ID NO: 1866109 - RNA, 16 nt, Human
uccaaaauaaaacuuu

SEQ ID NO: 1866110 - RNA, 17 nt, Human
uccaaaauaaaacuuuu

SEQ ID NO: 1866111 - RNA, 19 nt, Human
uccaaacuaccuuccaguu

SEQ ID NO: 1866112 - RNA, 15 nt, Human
uccauggacuuuguu

SEQ ID NO: 1866113 - RNA, 14 nt, Human
uccauggacuuugu

SEQ ID NO: 1866114 - RNA, 13 nt, Human
uccauggacuuug

SEQ ID NO: 1866115 - RNA, 16 nt, Human
uccauccaggccauuc

SEQ ID NO: 1866116 - RNA, 23 nt, Human
uccagcucaccagccccagugcc

SEQ ID NO: 1866117 - RNA, 13 nt, Human
ucccaacucaccc

SEQ ID NO: 1866118 - RNA, 15 nt, Human
ucccaacucacccca

SEQ ID NO: 1866119 - RNA, 14 nt, Human
ucccaacucacccc

SEQ ID NO: 1866120 - RNA, 16 nt, Human
ucccaacucaccccag

SEQ ID NO: 1866121 - RNA, 18 nt, Human
ucccaaggcucugagcaa

SEQ ID NO: 1866122 - RNA, 17 nt, Human
ucccaagcucugcuccu

SEQ ID NO: 1866123 - RNA, 12 nt, Human
ucccaagcucug

SEQ ID NO: 1866124 - RNA, 13 nt, Human
ucccaagcucugc

SEQ ID NO: 1866125 - RNA, 14 nt, Human
ucccaagcucugcu

SEQ ID NO: 1866126 - RNA, 15 nt, Human
ucccaagcucugcuc

SEQ ID NO: 1866127 - RNA, 22 nt, Human
ucccaggcauuccccaggaggc

SEQ ID NO: 1866128 - RNA, 15 nt, Human
ucccaggcugagccu

SEQ ID NO: 1866129 - RNA, 21 nt, Human
ucccaggcgccccuucccccu

SEQ ID NO: 1866130 - RNA, 18 nt, Human
ucccaggcgccccuuccc

SEQ ID NO: 1866131 - RNA, 20 nt, Human
ucccaggcgccccuuccccc

SEQ ID NO: 1866132 - RNA, 21 nt, Human
ucccaggcauuccccaggagg

SEQ ID NO: 1866133 - RNA, 20 nt, Human
ucccaggcauuccccaggag

SEQ ID NO: 1866134 - RNA, 22 nt, Human
ucccaaggcucugagcaaaugu

SEQ ID NO: 1866135 - RNA, 13 nt, Human
ucccaccucagcc

SEQ ID NO: 1866136 - RNA, 14 nt, Human
ucccaccucagccu

SEQ ID NO: 1866137 - RNA, 15 nt, Human
ucccaccucagccuc

SEQ ID NO: 1866138 - RNA, 12 nt, Human
ucccaugcccug

SEQ ID NO: 1866139 - RNA, 20 nt, Human
ucccaucucacacaugagca

SEQ ID NO: 1866140 - RNA, 18 nt, Human
ucccaggcugagccucag

SEQ ID NO: 1866141 - RNA, 16 nt, Human
ucccaggcugagccuc

SEQ ID NO: 1866142 - RNA, 23 nt, Human
ucccaucucacacaugagcauca

SEQ ID NO: 1866143 - RNA, 22 nt, Human
uccccacuugagaauuacccuu

SEQ ID NO: 1866144 - RNA, 17 nt, Human
ucccccaucucuucugg

SEQ ID NO: 1866145 - RNA, 13 nt, Human
ucccccugcccca

SEQ ID NO: 1866146 - RNA, 13 nt, Human
ucccccucuggcu

SEQ ID NO: 1866147 - RNA, 13 nt, Human
uccccaggaggcc

SEQ ID NO: 1866148 - RNA, 15 nt, Human
uccccagcuguuuau

SEQ ID NO: 1866149 - RNA, 14 nt, Human
uccccagcuguuua

SEQ ID NO: 1866150 - RNA, 21 nt, Human
ucccccuuccauggacuuugu

SEQ ID NO: 1866151 - RNA, 20 nt, Human
uccccgcacugggcuugggg

SEQ ID NO: 1866152 - RNA, 21 nt, Human
uccccugcuggguguggcgca

SEQ ID NO: 1866153 - RNA, 20 nt, Human
uccccugcuggguguggcgc

SEQ ID NO: 1866154 - RNA, 15 nt, Human
uccccugcugggugu

SEQ ID NO: 1866155 - RNA, 14 nt, Human
uccccugcugggug

SEQ ID NO: 1866156 - RNA, 23 nt, Human
uccccuguccccgcacugggcuu

SEQ ID NO: 1866157 - RNA, 22 nt, Human
uccccuguagagugggagcuga

SEQ ID NO: 1866158 - RNA, 15 nt, Human
uccccuguucacucu

SEQ ID NO: 1866159 - RNA, 19 nt, Human
uccccuguagagugggagc

SEQ ID NO: 1866160 - RNA, 24 nt, Human
uccccugcuggguguggcgcagca

SEQ ID NO: 1866161 - RNA, 15 nt, Human
ucccucccucuuucc

SEQ ID NO: 1866162 - RNA, 16 nt, Human
ucccuacuuccuguga

SEQ ID NO: 1866163 - RNA, 15 nt, Human
ucccuacuuccugug

SEQ ID NO: 1866164 - RNA, 17 nt, Human
ucccucccucuuucccu

SEQ ID NO: 1866165 - RNA, 15 nt, Human
ucccuacuguaauuu

SEQ ID NO: 1866166 - RNA, 13 nt, Human
ucccuaauaaagc

SEQ ID NO: 1866167 - RNA, 12 nt, Human
ucccuaauaaag

SEQ ID NO: 1866168 - RNA, 11 nt, Human
ucccuaauaaa

SEQ ID NO: 1866169 - RNA, 22 nt, Human
uccccuuccuaauuccacagcu

SEQ ID NO: 1866170 - RNA, 21 nt, Human
uccccuuccuaauuccacagc

SEQ ID NO: 1866171 - RNA, 18 nt, Human
uccccuguuuguuucuga

SEQ ID NO: 1866172 - RNA, 15 nt, Human
ucucucgugaguaua

SEQ ID NO: 1866173 - RNA, 13 nt, Human
ucucugaggacac

SEQ ID NO: 1866174 - RNA, 15 nt, Human
ucucuacaaaaagca

SEQ ID NO: 1866175 - RNA, 13 nt, Human
ucuccuguaccuc

SEQ ID NO: 1866176 - RNA, 21 nt, Human
ucucuacugucucaguuuaca

SEQ ID NO: 1866177 - RNA, 18 nt, Human
ucucuaguuugauuaaau

SEQ ID NO: 1866178 - RNA, 19 nt, Human
ucucuaguuugauuaaauu

SEQ ID NO: 1866179 - RNA, 21 nt, Human
ucucagugucaaugcagcccc

SEQ ID NO: 1866180 - RNA, 15 nt, Human
ucucaggucccugca

SEQ ID NO: 1866181 - RNA, 17 nt, Human
ucucccccagccccauc

SEQ ID NO: 1866182 - RNA, 15 nt, Human
ucucccccagcccca

SEQ ID NO: 1866183 - RNA, 14 nt, Human
ucucccccagcccc

SEQ ID NO: 1866184 - RNA, 20 nt, Human
ucucccccagccccauccuc

SEQ ID NO: 1866185 - RNA, 18 nt, Human
ucucccccagccccaucc

SEQ ID NO: 1866186 - RNA, 22 nt, Human
ucucccccagccccauccucug

SEQ ID NO: 1866187 - RNA, 22 nt, Human
ucuccugccucagccucccaaa

SEQ ID NO: 1866188 - RNA, 20 nt, Human
ucugaacuuggcgcugcccc

SEQ ID NO: 1866189 - RNA, 21 nt, Human
ucugaacuuggcgcugccccu

SEQ ID NO: 1866190 - RNA, 14 nt, Human
ucugacccaugcug

SEQ ID NO: 1866191 - RNA, 18 nt, Human
ucugacccaugcugcccu

SEQ ID NO: 1866192 - RNA, 17 nt, Human
ucugacccaugcugccc

SEQ ID NO: 1866193 - RNA, 16 nt, Human
ucugacccaugcugcc

SEQ ID NO: 1866194 - RNA, 15 nt, Human
ucugacccaugcugc

SEQ ID NO: 1866195 - RNA, 20 nt, Human
ucugagcauuagauuucuca

SEQ ID NO: 1866196 - RNA, 14 nt, Human
ucugcacaagcugc

SEQ ID NO: 1866197 - RNA, 19 nt, Human
ucugcacaagcugcacccu

SEQ ID NO: 1866198 - RNA, 23 nt, Human
ucugauucccaagcucugcuccu

SEQ ID NO: 1866199 - RNA, 22 nt, Human
ucugagcauuagauuucucauu

SEQ ID NO: 1866200 - RNA, 16 nt, Human
ucugaggaauccagac

SEQ ID NO: 1866201 - RNA, 17 nt, Human
ucugaggaauccagacc

SEQ ID NO: 1866202 - RNA, 20 nt, Human
ucugaggacacuaaccacgc

SEQ ID NO: 1866203 - RNA, 23 nt, Human
ucugaggacacuaaccacgcugg

SEQ ID NO: 1866204 - RNA, 13 nt, Human
ucugaaagggacg

SEQ ID NO: 1866205 - RNA, 23 nt, Human
ucugaaaauguauguguaaguau

SEQ ID NO: 1866206 - RNA, 17 nt, Human
ucucuuuguucuaaaga

SEQ ID NO: 1866207 - RNA, 15 nt, Human
ucucuuuucaaaaca

SEQ ID NO: 1866208 - RNA, 16 nt, Human
ucucuuuucaaaacau

SEQ ID NO: 1866209 - RNA, 16 nt, Human
ucugaaaauguaugug

SEQ ID NO: 1866210 - RNA, 11 nt, Human
ucucugcaggu

SEQ ID NO: 1866211 - RNA, 18 nt, Human
ucucuucacagucacauu

SEQ ID NO: 1866212 - RNA, 11 nt, Human
ucucuucucca

SEQ ID NO: 1866213 - RNA, 16 nt, Human
ucucuucuccacugga

SEQ ID NO: 1866214 - RNA, 15 nt, Human
ucucuucuccacugg

SEQ ID NO: 1866215 - RNA, 14 nt, Human
ucucuucuccacug

SEQ ID NO: 1866216 - RNA, 13 nt, Human
ucucuucuccacu

SEQ ID NO: 1866217 - RNA, 17 nt, Human
ucuacacuccagugaga

SEQ ID NO: 1866218 - RNA, 14 nt, Human
ucuacacugugcug

SEQ ID NO: 1866219 - RNA, 12 nt, Human
ucuacacugugc

SEQ ID NO: 1866220 - RNA, 19 nt, Human
ucuacugaggugcuauguu

SEQ ID NO: 1866221 - RNA, 18 nt, Human
ucuacugaggugcuaugu

SEQ ID NO: 1866222 - RNA, 15 nt, Human
ucuacacugugcuga

SEQ ID NO: 1866223 - RNA, 21 nt, Human
ucuacacugugcugagucuga

SEQ ID NO: 1866224 - RNA, 22 nt, Human
ucuagggaaaaaccagcgugug

SEQ ID NO: 1866225 - RNA, 22 nt, Human
ucuacugaggugcuauguucuu

SEQ ID NO: 1866226 - RNA, 22 nt, Human
ucuaacuucaccauauuaccac

SEQ ID NO: 1866227 - RNA, 15 nt, Human
ucuaacuucaccaua

SEQ ID NO: 1866228 - RNA, 16 nt, Human
ucuaacuucaccauau

SEQ ID NO: 1866229 - RNA, 22 nt, Human
ucuaaaucuccaaaauaaaacu

SEQ ID NO: 1866230 - RNA, 21 nt, Human
ucucagaaucucaaauaacua

SEQ ID NO: 1866231 - RNA, 17 nt, Human
ucucagaaucucaaaua

SEQ ID NO: 1866232 - RNA, 18 nt, Human
ucucacuguugcccaggc

SEQ ID NO: 1866233 - RNA, 19 nt, Human
ucucacuguugcccaggcu

SEQ ID NO: 1866234 - RNA, 20 nt, Human
ucucacuguugcccaggcug

SEQ ID NO: 1866235 - RNA, 21 nt, Human
ucucacuguugcccaggcugg

SEQ ID NO: 1866236 - RNA, 18 nt, Human
ucucacucugucgcccag

SEQ ID NO: 1866237 - RNA, 22 nt, Human
ucucacucugucgcccagucug

SEQ ID NO: 1866238 - RNA, 17 nt, Human
ucucacucugucgccca

SEQ ID NO: 1866239 - RNA, 19 nt, Human
ucucaaagaaauuuccacu

SEQ ID NO: 1866240 - RNA, 17 nt, Human
ucucaaagaaauuucca

SEQ ID NO: 1866241 - RNA, 22 nt, Human
ucucaaacucuugaccucaggu

SEQ ID NO: 1866242 - RNA, 13 nt, Human
ucucaaacucuug

SEQ ID NO: 1866243 - RNA, 21 nt, Human
ucucaaacucuugaccucagg

SEQ ID NO: 1866244 - RNA, 14 nt, Human
ucucaaacuccuga

SEQ ID NO: 1866245 - RNA, 14 nt, Human
ucgcccaggcugga

SEQ ID NO: 1866246 - RNA, 12 nt, Human
ucgcccaggcug

SEQ ID NO: 1866247 - RNA, 19 nt, Human
ucgcccaggcuggagugca

SEQ ID NO: 1866248 - RNA, 17 nt, Human
ucgcaauguaagacucg

SEQ ID NO: 1866249 - RNA, 23 nt, Human
uccuuuuggagucagacagaugu

SEQ ID NO: 1866250 - RNA, 14 nt, Human
uccuuuuggaguca

SEQ ID NO: 1866251 - RNA, 17 nt, Human
ucgaguuacagacaaag

SEQ ID NO: 1866252 - RNA, 15 nt, Human
ucgaguuacagacaa

SEQ ID NO: 1866253 - RNA, 15 nt, Human
uccugguguggaaga

SEQ ID NO: 1866254 - RNA, 17 nt, Human
uccuggcccacugcauc

SEQ ID NO: 1866255 - RNA, 22 nt, Human
uccuggcaugggaaugaauguc

SEQ ID NO: 1866256 - RNA, 10 nt, Human
ucccucccuu

SEQ ID NO: 1866257 - RNA, 14 nt, Human
uccuuaccagcaga

SEQ ID NO: 1866258 - RNA, 16 nt, Human
uccuucaaagcaaaug

SEQ ID NO: 1866259 - RNA, 12 nt, Human
uccuucuguccu

SEQ ID NO: 1866260 - RNA, 19 nt, Human
uccuucuguccuacucugu

SEQ ID NO: 1866261 - RNA, 13 nt, Human
ugaacugauaaag

SEQ ID NO: 1866262 - RNA, 19 nt, Human
ugaacugaacucugacaac

SEQ ID NO: 1866263 - RNA, 17 nt, Human
ugaacugaacucugaca

SEQ ID NO: 1866264 - RNA, 15 nt, Human
ugaacugauaaagau

SEQ ID NO: 1866265 - RNA, 18 nt, Human
ugaacucuucaaucucuu

SEQ ID NO: 1866266 - RNA, 14 nt, Human
ugaacugaacucug

SEQ ID NO: 1866267 - RNA, 20 nt, Human
ugaaccacaucuugcucugc

SEQ ID NO: 1866268 - RNA, 21 nt, Human
ugaaccacaucuugcucugcu

SEQ ID NO: 1866269 - RNA, 15 nt, Human
ugaacucuucaaucu

SEQ ID NO: 1866270 - RNA, 22 nt, Human
ugaaccacaucuugcucugcug

SEQ ID NO: 1866271 - RNA, 13 nt, Human
ugaacauuccaga

SEQ ID NO: 1866272 - RNA, 14 nt, Human
ugaacauuccagag

SEQ ID NO: 1866273 - RNA, 15 nt, Human
ugaacauugcaauag

SEQ ID NO: 1866274 - RNA, 17 nt, Human
ugaacauugcaauagaa

SEQ ID NO: 1866275 - RNA, 19 nt, Human
ugaaauggacuuuuguaca

SEQ ID NO: 1866276 - RNA, 20 nt, Human
ugaaggcucgagcaugccug

SEQ ID NO: 1866277 - RNA, 21 nt, Human
ugaaggcucgagcaugccugg

SEQ ID NO: 1866278 - RNA, 20 nt, Human
ugaaggagagcccuucauuu

SEQ ID NO: 1866279 - RNA, 12 nt, Human
ugaacuugguuc

SEQ ID NO: 1866280 - RNA, 14 nt, Human
ugaacuuggcgcug

SEQ ID NO: 1866281 - RNA, 19 nt, Human
ugaacuggguacuugugga

SEQ ID NO: 1866282 - RNA, 16 nt, Human
ugaagacagagcuaca

SEQ ID NO: 1866283 - RNA, 14 nt, Human
ugaagacagagcua

SEQ ID NO: 1866284 - RNA, 22 nt, Human
ugaacuuguaaaggaauuuaaa

SEQ ID NO: 1866285 - RNA, 22 nt, Human
ugaagacuuuucuuucagccaa

SEQ ID NO: 1866286 - RNA, 17 nt, Human
ugaagacuuuucuuuca

SEQ ID NO: 1866287 - RNA, 14 nt, Human
ugaagacuuuucuu

SEQ ID NO: 1866288 - RNA, 23 nt, Human
ugaacuggguacuuguggacaca

SEQ ID NO: 1866289 - RNA, 19 nt, Human
ugaaaacuuuaugcuaagu

SEQ ID NO: 1866290 - RNA, 15 nt, Human
ugaaaagaaaaauga

SEQ ID NO: 1866291 - RNA, 16 nt, Human
ucuuuuugcuuugcuu

SEQ ID NO: 1866292 - RNA, 17 nt, Human
ucuuuugccguuauuaa

SEQ ID NO: 1866293 - RNA, 19 nt, Human
ucuuuugccguuauuaaaa

SEQ ID NO: 1866294 - RNA, 21 nt, Human
ucuuuucucccuuuuaauccu

SEQ ID NO: 1866295 - RNA, 23 nt, Human
ugaaaugaggucagagccugcag

SEQ ID NO: 1866296 - RNA, 21 nt, Human
ugaaaugaggucagagccugc

SEQ ID NO: 1866297 - RNA, 22 nt, Human
ugaaaugaggucagagccugca

SEQ ID NO: 1866298 - RNA, 19 nt, Human
ugaaaugaggucagagccu

SEQ ID NO: 1866299 - RNA, 20 nt, Human
ugaaaugaggucagagccug

SEQ ID NO: 1866300 - RNA, 17 nt, Human
ugaaaucuuuuugcuuu

SEQ ID NO: 1866301 - RNA, 15 nt, Human
ugaaaucauucauuu

SEQ ID NO: 1866302 - RNA, 15 nt, Human
ugaaagggcccagag

SEQ ID NO: 1866303 - RNA, 16 nt, Human
ugaaagggcccagaga

SEQ ID NO: 1866304 - RNA, 17 nt, Human
ugaaagggcccagagag

SEQ ID NO: 1866305 - RNA, 18 nt, Human
ugaaagggcccagagagg

SEQ ID NO: 1866306 - RNA, 21 nt, Human
ugaaagauggcugugccucug

SEQ ID NO: 1866307 - RNA, 23 nt, Human
ugaaagauggcugugccucugcc

SEQ ID NO: 1866308 - RNA, 22 nt, Human
ugaaagauggcugugccucugc

SEQ ID NO: 1866309 - RNA, 18 nt, Human
ugaaacccugucucuacu

SEQ ID NO: 1866310 - RNA, 18 nt, Human
ugaaagcagggacuugaa

SEQ ID NO: 1866311 - RNA, 19 nt, Human
ugaaagcagggacuugaac

SEQ ID NO: 1866312 - RNA, 23 nt, Human
ugaaagcagggacuugaacccau

SEQ ID NO: 1866313 - RNA, 17 nt, Human
ugaaaggaaagaggcuc

SEQ ID NO: 1866314 - RNA, 12 nt, Human
ugaaaggaaaga

SEQ ID NO: 1866315 - RNA, 16 nt, Human
ucuggcucuuccaggc

SEQ ID NO: 1866316 - RNA, 15 nt, Human
ucuggcucuuccagg

SEQ ID NO: 1866317 - RNA, 17 nt, Human
ucuggcucuuccaggcu

SEQ ID NO: 1866318 - RNA, 13 nt, Human
ucugggacacagu

SEQ ID NO: 1866319 - RNA, 12 nt, Human
ucugggacacag

SEQ ID NO: 1866320 - RNA, 23 nt, Human
ucuguacagagcccacgccccca

SEQ ID NO: 1866321 - RNA, 23 nt, Human
ucuggagcccacuguacuugcuc

SEQ ID NO: 1866322 - RNA, 14 nt, Human
ucuggcuaugcauu

SEQ ID NO: 1866323 - RNA, 17 nt, Human
ucuggcuaugcauuuga

SEQ ID NO: 1866324 - RNA, 18 nt, Human
ucuuaaaaaguggaaaaa

SEQ ID NO: 1866325 - RNA, 23 nt, Human
ucuguggguuucuaaagcugcca

SEQ ID NO: 1866326 - RNA, 17 nt, Human
ucuguacgucugacagg

SEQ ID NO: 1866327 - RNA, 19 nt, Human
ucuguccgagcuuugaaaa

SEQ ID NO: 1866328 - RNA, 22 nt, Human
ucuguggguuucuaaagcugcc

SEQ ID NO: 1866329 - RNA, 21 nt, Human
ucuuguuuuuuuuuuccacuu

SEQ ID NO: 1866330 - RNA, 18 nt, Human
ucuuguuuuuuuuuucca

SEQ ID NO: 1866331 - RNA, 16 nt, Human
ucuuguauuaaguugu

SEQ ID NO: 1866332 - RNA, 18 nt, Human
ucuuguauuaaguuguua

SEQ ID NO: 1866333 - RNA, 22 nt, Human
ucuuguauuaaguuguuaauaa

SEQ ID NO: 1866334 - RNA, 12 nt, Human
ucuugcucugcu

SEQ ID NO: 1866335 - RNA, 13 nt, Human
ucuugcucugcug

SEQ ID NO: 1866336 - RNA, 11 nt, Human
ucuugcucugc

SEQ ID NO: 1866337 - RNA, 21 nt, Human
ucuugaauuguaaggaaugau

SEQ ID NO: 1866338 - RNA, 15 nt, Human
ucuucuccaggcugu

SEQ ID NO: 1866339 - RNA, 16 nt, Human
ucuugaacuccuggcc

SEQ ID NO: 1866340 - RNA, 17 nt, Human
ucuugaacuccuggccu

SEQ ID NO: 1866341 - RNA, 18 nt, Human
ucuugaacuccuggccuc

SEQ ID NO: 1866342 - RNA, 13 nt, Human
ucuucuccaggcu

SEQ ID NO: 1866343 - RNA, 14 nt, Human
ucuucuccaggcug

SEQ ID NO: 1866344 - RNA, 16 nt, Human
ucuucuccacuggaug

SEQ ID NO: 1866345 - RNA, 12 nt, Human
ucuucuccaggc

SEQ ID NO: 1866346 - RNA, 15 nt, Human
ucuucaguaagccgu

SEQ ID NO: 1866347 - RNA, 13 nt, Human
ucuuaugggcugg

SEQ ID NO: 1866348 - RNA, 14 nt, Human
ucuuauacauuuga

SEQ ID NO: 1866349 - RNA, 15 nt, Human
ucuuauacauuugau

SEQ ID NO: 1866350 - RNA, 16 nt, Human
ucuuaguggauguucu

SEQ ID NO: 1866351 - RNA, 14 nt, Human
ucuuagugugugca

SEQ ID NO: 1866352 - RNA, 13 nt, Human
ucuucuccacugg

SEQ ID NO: 1866353 - RNA, 21 nt, Human
ucuucuccacuuucuagccag

SEQ ID NO: 1866354 - RNA, 19 nt, Human
ucuucuccacuuucuagcc

SEQ ID NO: 1866355 - RNA, 14 nt, Human
ucuuccaggcuggg

SEQ ID NO: 1866356 - RNA, 16 nt, Human
ucuucaguaagccgug

SEQ ID NO: 1866357 - RNA, 21 nt, Human
ucuuccacaagagcccaggcc

SEQ ID NO: 1866358 - RNA, 14 nt, Human
ugcucaggagcccu

SEQ ID NO: 1866359 - RNA, 19 nt, Human
ugcuccucuccccagcaag

SEQ ID NO: 1866360 - RNA, 20 nt, Human
ugcuagaacucccuuucaac

SEQ ID NO: 1866361 - RNA, 21 nt, Human
ugcuagaacucccuuucaaca

SEQ ID NO: 1866362 - RNA, 19 nt, Human
ugcuaggaacacuccuuca

SEQ ID NO: 1866363 - RNA, 17 nt, Human
ugcuaggaacacuccuu

SEQ ID NO: 1866364 - RNA, 16 nt, Human
ugcuaggaacacuccu

SEQ ID NO: 1866365 - RNA, 19 nt, Human
ugcuagaacucccuuucaa

SEQ ID NO: 1866366 - RNA, 18 nt, Human
ugcuagaacucccuuuca

SEQ ID NO: 1866367 - RNA, 15 nt, Human
ugcgugcauaccacu

SEQ ID NO: 1866368 - RNA, 19 nt, Human
ugcuccuggcccacugcau

SEQ ID NO: 1866369 - RNA, 23 nt, Human
ugcugaauacagaggcaacugca

SEQ ID NO: 1866370 - RNA, 18 nt, Human
ugcugaauacagaggcaa

SEQ ID NO: 1866371 - RNA, 22 nt, Human
ugcugaaugguuuucaaaauaa

SEQ ID NO: 1866372 - RNA, 18 nt, Human
ugcugaaugguuuucaaa

SEQ ID NO: 1866373 - RNA, 17 nt, Human
ugcugaaugguuuucaa

SEQ ID NO: 1866374 - RNA, 23 nt, Human
ugcugauggugcaaugaccuuuc

SEQ ID NO: 1866375 - RNA, 20 nt, Human
ugcugauggugcaaugaccu

SEQ ID NO: 1866376 - RNA, 16 nt, Human
ugcugcaguugccagu

SEQ ID NO: 1866377 - RNA, 15 nt, Human
ugcugcaguugccag

SEQ ID NO: 1866378 - RNA, 15 nt, Human
ugcugacagacacag

SEQ ID NO: 1866379 - RNA, 16 nt, Human
ugcugacagacacagg

SEQ ID NO: 1866380 - RNA, 19 nt, Human
ugcugacagacacaggccc

SEQ ID NO: 1866381 - RNA, 22 nt, Human
ugccuuauggaacacucugaga

SEQ ID NO: 1866382 - RNA, 21 nt, Human
ugccuuauggaacacucugag

SEQ ID NO: 1866383 - RNA, 20 nt, Human
ugccuuauggaacacucuga

SEQ ID NO: 1866384 - RNA, 18 nt, Human
ugccuuauggaacacucu

SEQ ID NO: 1866385 - RNA, 18 nt, Human
ugccuucagcucuacagc

SEQ ID NO: 1866386 - RNA, 17 nt, Human
ugccuucagcucuacag

SEQ ID NO: 1866387 - RNA, 13 nt, Human
ugccuucagcucu

SEQ ID NO: 1866388 - RNA, 19 nt, Human
ugcgcaggcuggcccugcc

SEQ ID NO: 1866389 - RNA, 17 nt, Human
ugcgcaggcuggcccug

SEQ ID NO: 1866390 - RNA, 16 nt, Human
ugcgcaggcuggcccu

SEQ ID NO: 1866391 - RNA, 13 nt, Human
ugcgcaggcuggc

SEQ ID NO: 1866392 - RNA, 23 nt, Human
ugcggugcuaucucccccagccc

SEQ ID NO: 1866393 - RNA, 13 nt, Human
ugcgccuacagga

SEQ ID NO: 1866394 - RNA, 19 nt, Human
ugccuaaggcugaacuugu

SEQ ID NO: 1866395 - RNA, 11 nt, Human
ugcccagcccc

SEQ ID NO: 1866396 - RNA, 23 nt, Human
ugcccaggcuggcgugcaguggu

SEQ ID NO: 1866397 - RNA, 22 nt, Human
ugccugaagucacacagugagu

SEQ ID NO: 1866398 - RNA, 18 nt, Human
ugccugaagucacacagu

SEQ ID NO: 1866399 - RNA, 17 nt, Human
ugccugaagucacacag

SEQ ID NO: 1866400 - RNA, 14 nt, Human
ugccucugggacug

SEQ ID NO: 1866401 - RNA, 18 nt, Human
ugccuccuuugugaggaa

SEQ ID NO: 1866402 - RNA, 17 nt, Human
ugccuccuuugugagga

SEQ ID NO: 1866403 - RNA, 16 nt, Human
ugccuccuuugugagg

SEQ ID NO: 1866404 - RNA, 10 nt, Human
ugcccagccc

SEQ ID NO: 1866405 - RNA, 19 nt, Human
ugcccaccuggccucugca

SEQ ID NO: 1866406 - RNA, 18 nt, Human
ugcccaccuggccucugc

SEQ ID NO: 1866407 - RNA, 17 nt, Human
ugcccaccuggccucug

SEQ ID NO: 1866408 - RNA, 15 nt, Human
ugcccaccuggccuc

SEQ ID NO: 1866409 - RNA, 23 nt, Human
ugccaucucaccuccugcugggc

SEQ ID NO: 1866410 - RNA, 22 nt, Human
ugccaucucaccuccugcuggg

SEQ ID NO: 1866411 - RNA, 21 nt, Human
ugccaucucaccuccugcugg

SEQ ID NO: 1866412 - RNA, 20 nt, Human
ugccaucucaccuccugcug

SEQ ID NO: 1866413 - RNA, 22 nt, Human
ugccagggacagaggggguggc

SEQ ID NO: 1866414 - RNA, 11 nt, Human
ugccagggaca

SEQ ID NO: 1866415 - RNA, 14 nt, Human
ugccagucaccccg

SEQ ID NO: 1866416 - RNA, 24 nt, Human
ugccagguuuuuggucugacccac

SEQ ID NO: 1866417 - RNA, 21 nt, Human
ugcauccuccgccucccgggu

SEQ ID NO: 1866418 - RNA, 18 nt, Human
ugcauccuccgccucccg

SEQ ID NO: 1866419 - RNA, 15 nt, Human
ugcaucguuucaucu

SEQ ID NO: 1866420 - RNA, 17 nt, Human
ugcaucguuucaucuuc

SEQ ID NO: 1866421 - RNA, 19 nt, Human
ugcaggcagccaggccaca

SEQ ID NO: 1866422 - RNA, 18 nt, Human
ugcaggcagccaggccac

SEQ ID NO: 1866423 - RNA, 17 nt, Human
ugcaggcagccaggcca

SEQ ID NO: 1866424 - RNA, 16 nt, Human
ugcaggcagccaggcc

SEQ ID NO: 1866425 - RNA, 19 nt, Human
ugcauguuacauaagauaa

SEQ ID NO: 1866426 - RNA, 14 nt, Human
ugcagcaauaaagc

SEQ ID NO: 1866427 - RNA, 15 nt, Human
ugcagcaauaaagca

SEQ ID NO: 1866428 - RNA, 16 nt, Human
ugcagcaauaaagcag

SEQ ID NO: 1866429 - RNA, 13 nt, Human
ugcagcuuuaaaa

SEQ ID NO: 1866430 - RNA, 14 nt, Human
ugcaggaccucagg

SEQ ID NO: 1866431 - RNA, 22 nt, Human
ugcagcuuuaaaaaauuaaucu

SEQ ID NO: 1866432 - RNA, 16 nt, Human
ugcaggaccucaggug

SEQ ID NO: 1866433 - RNA, 15 nt, Human
ugcaggaccucaggu

SEQ ID NO: 1866434 - RNA, 18 nt, Human
ugcaggaccucaggugag

SEQ ID NO: 1866435 - RNA, 16 nt, Human
ugcagauaaacaguag

SEQ ID NO: 1866436 - RNA, 17 nt, Human
ugcagauaaacaguagu

SEQ ID NO: 1866437 - RNA, 20 nt, Human
ugcacuuuguucuggcucuu

SEQ ID NO: 1866438 - RNA, 19 nt, Human
ugcacuuuguucuggcucu

SEQ ID NO: 1866439 - RNA, 18 nt, Human
ugcacuuuguucuggcuc

SEQ ID NO: 1866440 - RNA, 15 nt, Human
ugcacuuuguucugg

SEQ ID NO: 1866441 - RNA, 21 nt, Human
ugcacuugcagacucuacaga

SEQ ID NO: 1866442 - RNA, 16 nt, Human
ugcacuugcagacucu

SEQ ID NO: 1866443 - RNA, 19 nt, Human
ugcacguacacacacauac

SEQ ID NO: 1866444 - RNA, 16 nt, Human
ugcacguacacacaca

SEQ ID NO: 1866445 - RNA, 17 nt, Human
ugcacagcuaacaugga

SEQ ID NO: 1866446 - RNA, 23 nt, Human
ugcacagaguuguuacauuuuua

SEQ ID NO: 1866447 - RNA, 21 nt, Human
ugcacagaguuguuacauuuu

SEQ ID NO: 1866448 - RNA, 22 nt, Human
ugcacagaguuguuacauuuuu

SEQ ID NO: 1866449 - RNA, 22 nt, Human
ugaagucuuuguacagacaaca

SEQ ID NO: 1866450 - RNA, 20 nt, Human
ugaagucuuuguacagacaa

SEQ ID NO: 1866451 - RNA, 17 nt, Human
ugaagucuuuguacaga

SEQ ID NO: 1866452 - RNA, 16 nt, Human
ugaaggcuggguucug

SEQ ID NO: 1866453 - RNA, 23 nt, Human
ugcacagcuaacauggaaguacu

SEQ ID NO: 1866454 - RNA, 20 nt, Human
ugcacagcuaacauggaagu

SEQ ID NO: 1866455 - RNA, 18 nt, Human
ugcacagcuaacauggaa

SEQ ID NO: 1866456 - RNA, 20 nt, Human
ugcacagugcaucucagccc

SEQ ID NO: 1866457 - RNA, 19 nt, Human
ugcacagugcaucucagcc

SEQ ID NO: 1866458 - RNA, 18 nt, Human
ugcacagugcaucucagc

SEQ ID NO: 1866459 - RNA, 15 nt, Human
uggaagacagcucuu

SEQ ID NO: 1866460 - RNA, 14 nt, Human
uggaagacagcucu

SEQ ID NO: 1866461 - RNA, 21 nt, Human
uggaagugugugaucuguggg

SEQ ID NO: 1866462 - RNA, 15 nt, Human
uggaaaauaaaucaa

SEQ ID NO: 1866463 - RNA, 11 nt, Human
uggaaaauaaa

SEQ ID NO: 1866464 - RNA, 20 nt, Human
uggaaaaaccacccccaaau

SEQ ID NO: 1866465 - RNA, 16 nt, Human
uggaaaauaaauuauu

SEQ ID NO: 1866466 - RNA, 15 nt, Human
uggaaaauaaauuau

SEQ ID NO: 1866467 - RNA, 12 nt, Human
uggaagacagcu

SEQ ID NO: 1866468 - RNA, 11 nt, Human
uggaagacagc

SEQ ID NO: 1866469 - RNA, 14 nt, Human
uggaacucucgagc

SEQ ID NO: 1866470 - RNA, 18 nt, Human
ugcuuccagugaggcucu

SEQ ID NO: 1866471 - RNA, 14 nt, Human
ugcugccuccagaa

SEQ ID NO: 1866472 - RNA, 13 nt, Human
ugcugccucaugc

SEQ ID NO: 1866473 - RNA, 20 nt, Human
ugcuuccagugaggcucugc

SEQ ID NO: 1866474 - RNA, 19 nt, Human
ugcuuccagugaggcucug

SEQ ID NO: 1866475 - RNA, 21 nt, Human
ugcuuccagugaggcucugcc

SEQ ID NO: 1866476 - RNA, 12 nt, Human
ugcuucucacug

SEQ ID NO: 1866477 - RNA, 16 nt, Human
ugcuucuucagagacu

SEQ ID NO: 1866478 - RNA, 14 nt, Human
ugcuuguuggauuu

SEQ ID NO: 1866479 - RNA, 18 nt, Human
ugcuuguuaacugagugc

SEQ ID NO: 1866480 - RNA, 13 nt, Human
uggagauguuuag

SEQ ID NO: 1866481 - RNA, 20 nt, Human
uggagaggcccggccucuca

SEQ ID NO: 1866482 - RNA, 12 nt, Human
uggacaggcaug

SEQ ID NO: 1866483 - RNA, 16 nt, Human
uggacaggcauguucu

SEQ ID NO: 1866484 - RNA, 17 nt, Human
uggagacugucucaaga

SEQ ID NO: 1866485 - RNA, 17 nt, Human
uggacaggcauguucuc

SEQ ID NO: 1866486 - RNA, 19 nt, Human
uggauacgacaacuugcac

SEQ ID NO: 1866487 - RNA, 22 nt, Human
uggaggcaugugaugagaggaa

SEQ ID NO: 1866488 - RNA, 23 nt, Human
uggcagcugcgguccacccagga

SEQ ID NO: 1866489 - RNA, 21 nt, Human
uggcagcugcgguccacccag

SEQ ID NO: 1866490 - RNA, 22 nt, Human
uggcagcugcgguccacccagg

SEQ ID NO: 1866491 - RNA, 18 nt, Human
uggcacugcuuccaguga

SEQ ID NO: 1866492 - RNA, 16 nt, Human
uggcacugcuuccagu

SEQ ID NO: 1866493 - RNA, 14 nt, Human
uggcacugcuucca

SEQ ID NO: 1866494 - RNA, 14 nt, Human
uggaugccuggugg

SEQ ID NO: 1866495 - RNA, 14 nt, Human
uggcagugggagcu

SEQ ID NO: 1866496 - RNA, 15 nt, Human
uggcagugggagcug

SEQ ID NO: 1866497 - RNA, 16 nt, Human
uggcagugggagcugc

SEQ ID NO: 1866498 - RNA, 19 nt, Human
uggcagugggagcugccug

SEQ ID NO: 1866499 - RNA, 22 nt, Human
uggccacuccagaccccuggcu

SEQ ID NO: 1866500 - RNA, 20 nt, Human
uggcagugggagcugccugu

SEQ ID NO: 1866501 - RNA, 14 nt, Human
ugggccuccugugu

SEQ ID NO: 1866502 - RNA, 18 nt, Human
ugggccuucagggaguga

SEQ ID NO: 1866503 - RNA, 16 nt, Human
ugggccuccugugugu

SEQ ID NO: 1866504 - RNA, 22 nt, Human
ugggccuccugugugugcgccu

SEQ ID NO: 1866505 - RNA, 24 nt, Human
ugggagcugccuguucagcuccag

SEQ ID NO: 1866506 - RNA, 19 nt, Human
ugggcgugagaccugcccc

SEQ ID NO: 1866507 - RNA, 18 nt, Human
ugggcgugagaccugccc

SEQ ID NO: 1866508 - RNA, 17 nt, Human
ugggcgugagaccugcc

SEQ ID NO: 1866509 - RNA, 18 nt, Human
ugggcuucaguggcagcu

SEQ ID NO: 1866510 - RNA, 19 nt, Human
ugggcuucaguggcagcug

SEQ ID NO: 1866511 - RNA, 19 nt, Human
ugggcuuggggaccagagc

SEQ ID NO: 1866512 - RNA, 20 nt, Human
ugggcuucaguggcagcugc

SEQ ID NO: 1866513 - RNA, 22 nt, Human
ugggcuuggggaccagagcugc

SEQ ID NO: 1866514 - RNA, 21 nt, Human
ugggcuuggggaccagagcug

SEQ ID NO: 1866515 - RNA, 16 nt, Human
uggggcagcuugaggg

SEQ ID NO: 1866516 - RNA, 21 nt, Human
ugggugucaagagggucugag

SEQ ID NO: 1866517 - RNA, 23 nt, Human
ugggugucaagagggucugagga

SEQ ID NO: 1866518 - RNA, 14 nt, Human
uggguguggcgcag

SEQ ID NO: 1866519 - RNA, 23 nt, Human
uggguucaagcgauucuucugcu

SEQ ID NO: 1866520 - RNA, 16 nt, Human
uggguucacugcaacc

SEQ ID NO: 1866521 - RNA, 17 nt, Human
uggguuggaaaacagua

SEQ ID NO: 1866522 - RNA, 22 nt, Human
uggguuccuuccucugagccuu

SEQ ID NO: 1866523 - RNA, 21 nt, Human
uggguuccuuccucugagccu

SEQ ID NO: 1866524 - RNA, 21 nt, Human
uggguuccagcaauucuccug

SEQ ID NO: 1866525 - RNA, 17 nt, Human
ugggguggggaccucag

SEQ ID NO: 1866526 - RNA, 19 nt, Human
ugggguggggggggugcug

SEQ ID NO: 1866527 - RNA, 22 nt, Human
ugggguggggggggugcugggc

SEQ ID NO: 1866528 - RNA, 21 nt, Human
ugggguggggggggugcuggg

SEQ ID NO: 1866529 - RNA, 23 nt, Human
ugggagcugccuguucagcucca

SEQ ID NO: 1866530 - RNA, 16 nt, Human
ugggacaugggaaagg

SEQ ID NO: 1866531 - RNA, 16 nt, Human
ugggacagggcauggc

SEQ ID NO: 1866532 - RNA, 22 nt, Human
ugggaaugaaugucagugugac

SEQ ID NO: 1866533 - RNA, 15 nt, Human
uggcuuuucacugcu

SEQ ID NO: 1866534 - RNA, 14 nt, Human
uggcuuuucacugc

SEQ ID NO: 1866535 - RNA, 22 nt, Human
uggcugguuagagguucccuuu

SEQ ID NO: 1866536 - RNA, 14 nt, Human
uggcugggggccuc

SEQ ID NO: 1866537 - RNA, 15 nt, Human
uggcugggggccuca

SEQ ID NO: 1866538 - RNA, 14 nt, Human
uggcgcugccccug

SEQ ID NO: 1866539 - RNA, 15 nt, Human
uggcgcugccccugg

SEQ ID NO: 1866540 - RNA, 22 nt, Human
uggcgugcaguggugcgaucug

SEQ ID NO: 1866541 - RNA, 20 nt, Human
uggccuucggccuccauccu

SEQ ID NO: 1866542 - RNA, 17 nt, Human
uggccuucggccuccau

SEQ ID NO: 1866543 - RNA, 18 nt, Human
uggccuucggccuccauc

SEQ ID NO: 1866544 - RNA, 15 nt, Human
uggccagaugcacca

SEQ ID NO: 1866545 - RNA, 20 nt, Human
uggcucagguggggucacuc

SEQ ID NO: 1866546 - RNA, 22 nt, Human
uggcucagguggggucacucug

SEQ ID NO: 1866547 - RNA, 20 nt, Human
uggcuccaaacccucgaggc

SEQ ID NO: 1866548 - RNA, 18 nt, Human
uggcuccaaacccucgag

SEQ ID NO: 1866549 - RNA, 16 nt, Human
uggcuccaaacccucg

SEQ ID NO: 1866550 - RNA, 15 nt, Human
uggcucuuccaggcu

SEQ ID NO: 1866551 - RNA, 13 nt, Human
uggcucuuccagg

SEQ ID NO: 1866552 - RNA, 16 nt, Human
uggcucuuccaggcug

SEQ ID NO: 1866553 - RNA, 12 nt, Human
uggcugggggcc

SEQ ID NO: 1866554 - RNA, 16 nt, Human
uuaaacuuaaucuaaa

SEQ ID NO: 1866555 - RNA, 18 nt, Human
uuaaacuuaaucuaaaug

SEQ ID NO: 1866556 - RNA, 20 nt, Human
uuaaacuuaaucuaaaugga

SEQ ID NO: 1866557 - RNA, 22 nt, Human
uuaaacuuaaucuaaauggaac

SEQ ID NO: 1866558 - RNA, 14 nt, Human
uuaaagacuuuuau

SEQ ID NO: 1866559 - RNA, 16 nt, Human
uuaaaugcaccuggaa

SEQ ID NO: 1866560 - RNA, 17 nt, Human
uuaaaugcaccuggaau

SEQ ID NO: 1866561 - RNA, 18 nt, Human
uuaaaugcaccuggaaua

SEQ ID NO: 1866562 - RNA, 18 nt, Human
uuaaauaguaaaaauaaa

SEQ ID NO: 1866563 - RNA, 18 nt, Human
uuaaaugcccagccccuu

SEQ ID NO: 1866564 - RNA, 13 nt, Human
uuaaaugcccagc

SEQ ID NO: 1866565 - RNA, 17 nt, Human
uuaaaugcccagccccu

SEQ ID NO: 1866566 - RNA, 12 nt, Human
uuaaaugcugcu

SEQ ID NO: 1866567 - RNA, 18 nt, Human
uguuuuaaaaugagaaau

SEQ ID NO: 1866568 - RNA, 16 nt, Human
uguuuguugucagcug

SEQ ID NO: 1866569 - RNA, 17 nt, Human
uguuuguugucagcuga

SEQ ID NO: 1866570 - RNA, 22 nt, Human
uguuuccuggcacugcuuccag

SEQ ID NO: 1866571 - RNA, 21 nt, Human
uguuuccuggcacugcuucca

SEQ ID NO: 1866572 - RNA, 20 nt, Human
uguuuccuggcacugcuucc

SEQ ID NO: 1866573 - RNA, 23 nt, Human
uguuuccuggcacugcuuccagu

SEQ ID NO: 1866574 - RNA, 23 nt, Human
uguuuuaaaaugagaaaucuaaa

SEQ ID NO: 1866575 - RNA, 13 nt, Human
uguuuuugucuua

SEQ ID NO: 1866576 - RNA, 17 nt, Human
uuaaggaugcuuguaca

SEQ ID NO: 1866577 - RNA, 18 nt, Human
uuaaggaugcuuguacau

SEQ ID NO: 1866578 - RNA, 19 nt, Human
uuaaggaugcuuguacaua

SEQ ID NO: 1866579 - RNA, 20 nt, Human
uuaaggaugcuuguacauaa

SEQ ID NO: 1866580 - RNA, 21 nt, Human
uuaaggaagacaaugugaaaa

SEQ ID NO: 1866581 - RNA, 22 nt, Human
uuaaggaugcuuguacauaaug

SEQ ID NO: 1866582 - RNA, 18 nt, Human
uuaaugucacaggcaggu

SEQ ID NO: 1866583 - RNA, 14 nt, Human
uuaauggaaauguu

SEQ ID NO: 1866584 - RNA, 17 nt, Human
uuaaugucacaggcagg

SEQ ID NO: 1866585 - RNA, 22 nt, Human
uuaaugucaauucuugccaaau

SEQ ID NO: 1866586 - RNA, 14 nt, Human
uuaccagcagagca

SEQ ID NO: 1866587 - RNA, 20 nt, Human
uuacauuuuuaagugcugca

SEQ ID NO: 1866588 - RNA, 21 nt, Human
uuacauuuuuaagugcugcau

SEQ ID NO: 1866589 - RNA, 22 nt, Human
uuacauuuuuaagugcugcauu

SEQ ID NO: 1866590 - RNA, 23 nt, Human
uuacauuuuuaagugcugcauuu

SEQ ID NO: 1866591 - RNA, 19 nt, Human
uuaccuuuuuuauacauaa

SEQ ID NO: 1866592 - RNA, 20 nt, Human
uuaccuuuuuuauacauaaa

SEQ ID NO: 1866593 - RNA, 22 nt, Human
uuaccuuuuuuauacauaaaca

SEQ ID NO: 1866594 - RNA, 20 nt, Human
uuacgguuuuccagguuuaa

SEQ ID NO: 1866595 - RNA, 20 nt, Human
uuacagagacagaaagcaga

SEQ ID NO: 1866596 - RNA, 23 nt, Human
uuacaauaaaaucuugaaaaugc

SEQ ID NO: 1866597 - RNA, 14 nt, Human
uuacauuuccuaaa

SEQ ID NO: 1866598 - RNA, 13 nt, Human
uguucauaaauaa

SEQ ID NO: 1866599 - RNA, 12 nt, Human
uguucuauagcu

SEQ ID NO: 1866600 - RNA, 16 nt, Human
uguucucugaggacac

SEQ ID NO: 1866601 - RNA, 12 nt, Human
uguucucugccc

SEQ ID NO: 1866602 - RNA, 18 nt, Human
uguucucugaggacacua

SEQ ID NO: 1866603 - RNA, 11 nt, Human
uguugaaagau

SEQ ID NO: 1866604 - RNA, 20 nt, Human
uguucuuucuggcuaugcau

SEQ ID NO: 1866605 - RNA, 22 nt, Human
uguucuuucuggcuaugcauuu

SEQ ID NO: 1866606 - RNA, 14 nt, Human
uguucuuucuggcu

SEQ ID NO: 1866607 - RNA, 17 nt, Human
uguucugcacacagcac

SEQ ID NO: 1866608 - RNA, 18 nt, Human
uguucugacccugcuuca

SEQ ID NO: 1866609 - RNA, 15 nt, Human
uguucugacccugcu

SEQ ID NO: 1866610 - RNA, 19 nt, Human
uguucucugcccuccaaga

SEQ ID NO: 1866611 - RNA, 13 nt, Human
uguugcugccuca

SEQ ID NO: 1866612 - RNA, 17 nt, Human
uguuggauuuuugucuu

SEQ ID NO: 1866613 - RNA, 20 nt, Human
uguuggauuuuugucuugug

SEQ ID NO: 1866614 - RNA, 11 nt, Human
uguuggccagg

SEQ ID NO: 1866615 - RNA, 14 nt, Human
uguugcugccucau

SEQ ID NO: 1866616 - RNA, 17 nt, Human
uguuuacagauccccaa

SEQ ID NO: 1866617 - RNA, 18 nt, Human
uguuggccaggcugcucu

SEQ ID NO: 1866618 - RNA, 13 nt, Human
uguuggccaggcu

SEQ ID NO: 1866619 - RNA, 14 nt, Human
uguuggccaggcug

SEQ ID NO: 1866620 - RNA, 16 nt, Human
uguuacugucuucagu

SEQ ID NO: 1866621 - RNA, 15 nt, Human
uguuacugucuucag

SEQ ID NO: 1866622 - RNA, 22 nt, Human
uguuacauuuuuaagugcugca

SEQ ID NO: 1866623 - RNA, 13 nt, Human
uguuacauuuuua

SEQ ID NO: 1866624 - RNA, 15 nt, Human
uguucagcuccagcu

SEQ ID NO: 1866625 - RNA, 16 nt, Human
uguucagcuccagcuc

SEQ ID NO: 1866626 - RNA, 11 nt, Human
uguucagcugg

SEQ ID NO: 1866627 - RNA, 18 nt, Human
uguucagcuccagcucac

SEQ ID NO: 1866628 - RNA, 14 nt, Human
uguucagcuccagc

SEQ ID NO: 1866629 - RNA, 13 nt, Human
uguguuuauuguc

SEQ ID NO: 1866630 - RNA, 22 nt, Human
uguguuuaggaacuacugagga

SEQ ID NO: 1866631 - RNA, 23 nt, Human
ugucccaaaaagaaaggagggga

SEQ ID NO: 1866632 - RNA, 20 nt, Human
ugucagugugacugaucucu

SEQ ID NO: 1866633 - RNA, 12 nt, Human
ugucagugugac

SEQ ID NO: 1866634 - RNA, 14 nt, Human
uguaugcacuuugu

SEQ ID NO: 1866635 - RNA, 19 nt, Human
uguaucccaugagccucag

SEQ ID NO: 1866636 - RNA, 23 nt, Human
uguaucccaugagccucagcauc

SEQ ID NO: 1866637 - RNA, 13 nt, Human
uguacuccuccca

SEQ ID NO: 1866638 - RNA, 12 nt, Human
uguacuccuccc

SEQ ID NO: 1866639 - RNA, 17 nt, Human
uguacgucugacaggca

SEQ ID NO: 1866640 - RNA, 16 nt, Human
uguacgucugacaggc

SEQ ID NO: 1866641 - RNA, 17 nt, Human
uguagauaauacaguuc

SEQ ID NO: 1866642 - RNA, 15 nt, Human
uguaccgcaauguga

SEQ ID NO: 1866643 - RNA, 22 nt, Human
uguaccucuugagccuugaacu

SEQ ID NO: 1866644 - RNA, 14 nt, Human
uguaccucuugagc

SEQ ID NO: 1866645 - RNA, 23 nt, Human
uguaccucuugagccuugaacuu

SEQ ID NO: 1866646 - RNA, 12 nt, Human
uguacagucuug

SEQ ID NO: 1866647 - RNA, 14 nt, Human
uguacagucuugua

SEQ ID NO: 1866648 - RNA, 15 nt, Human
uguacagucuuguau

SEQ ID NO: 1866649 - RNA, 17 nt, Human
uguacagucuuguauua

SEQ ID NO: 1866650 - RNA, 13 nt, Human
uguaaauuaacuu

SEQ ID NO: 1866651 - RNA, 14 nt, Human
uguaaauuaacuuu

SEQ ID NO: 1866652 - RNA, 15 nt, Human
uguaaauuaacuuuu

SEQ ID NO: 1866653 - RNA, 16 nt, Human
uguaaauuaacuuuua

SEQ ID NO: 1866654 - RNA, 17 nt, Human
uguaaauuaacuuuuau

SEQ ID NO: 1866655 - RNA, 17 nt, Human
ugguaggacuguagaaa

SEQ ID NO: 1866656 - RNA, 18 nt, Human
ugguaggacuguagaaaa

SEQ ID NO: 1866657 - RNA, 15 nt, Human
uguaaucacagcuac

SEQ ID NO: 1866658 - RNA, 14 nt, Human
ugugaaaggaaaga

SEQ ID NO: 1866659 - RNA, 13 nt, Human
ugugaaaggaaag

SEQ ID NO: 1866660 - RNA, 13 nt, Human
ugugaaacauguu

SEQ ID NO: 1866661 - RNA, 18 nt, Human
ugucuuuggacccugagg

SEQ ID NO: 1866662 - RNA, 17 nt, Human
ugucuuuggacccugag

SEQ ID NO: 1866663 - RNA, 22 nt, Human
ugucuuuggacccugaggccca

SEQ ID NO: 1866664 - RNA, 19 nt, Human
ugucuuuggacccugaggc

SEQ ID NO: 1866665 - RNA, 14 nt, Human
ugucuuuuuucuaa

SEQ ID NO: 1866666 - RNA, 16 nt, Human
ugucuuuuuucacuac

SEQ ID NO: 1866667 - RNA, 17 nt, Human
ugucucaggucccugca

SEQ ID NO: 1866668 - RNA, 16 nt, Human
ugucucaggucccugc

SEQ ID NO: 1866669 - RNA, 21 nt, Human
ugucucaagagggcacuggug

SEQ ID NO: 1866670 - RNA, 20 nt, Human
ugucucaagagggcacuggu

SEQ ID NO: 1866671 - RNA, 23 nt, Human
ugucucaagagggcacugguggc

SEQ ID NO: 1866672 - RNA, 13 nt, Human
uguccccaccgca

SEQ ID NO: 1866673 - RNA, 19 nt, Human
ugucucaagagggcacugg

SEQ ID NO: 1866674 - RNA, 21 nt, Human
ugucucaguccaugaagaugu

SEQ ID NO: 1866675 - RNA, 22 nt, Human
ugucucaguccaugaagaugua

SEQ ID NO: 1866676 - RNA, 23 nt, Human
ugugaguacuacaguccucccau

SEQ ID NO: 1866677 - RNA, 20 nt, Human
ugugaguacuacaguccucc

SEQ ID NO: 1866678 - RNA, 19 nt, Human
ugugaguacuacaguccuc

SEQ ID NO: 1866679 - RNA, 18 nt, Human
ugugaguacuacaguccu

SEQ ID NO: 1866680 - RNA, 13 nt, Human
ugugauauaagug

SEQ ID NO: 1866681 - RNA, 21 nt, Human
ugugauacaaugcugugcccu

SEQ ID NO: 1866682 - RNA, 22 nt, Human
ugugaccacugcagaagacagu

SEQ ID NO: 1866683 - RNA, 15 nt, Human
ugugacauguuuuau

SEQ ID NO: 1866684 - RNA, 16 nt, Human
ugugaaucauuuuacc

SEQ ID NO: 1866685 - RNA, 21 nt, Human
ugugacaaggauugcuacugu

SEQ ID NO: 1866686 - RNA, 21 nt, Human
uguggagaagcggcuggcagc

SEQ ID NO: 1866687 - RNA, 12 nt, Human
uguggagaagcg

SEQ ID NO: 1866688 - RNA, 21 nt, Human
uguggcuccuggggguucuuu

SEQ ID NO: 1866689 - RNA, 15 nt, Human
uguggacacagcucu

SEQ ID NO: 1866690 - RNA, 16 nt, Human
uguggacacagcucuu

SEQ ID NO: 1866691 - RNA, 17 nt, Human
uguggaaaaugaaaauu

SEQ ID NO: 1866692 - RNA, 14 nt, Human
uguggacacagcuc

SEQ ID NO: 1866693 - RNA, 13 nt, Human
uguggacacagcu

SEQ ID NO: 1866694 - RNA, 12 nt, Human
ugugggaagggg

SEQ ID NO: 1866695 - RNA, 16 nt, Human
ugugccucugggacug

SEQ ID NO: 1866696 - RNA, 15 nt, Human
ugugccucugggacu

SEQ ID NO: 1866697 - RNA, 13 nt, Human
ugugccucuggga

SEQ ID NO: 1866698 - RNA, 14 nt, Human
ugugccucugccug

SEQ ID NO: 1866699 - RNA, 16 nt, Human
ugugcacaugcacgug

SEQ ID NO: 1866700 - RNA, 22 nt, Human
ugugcacaugcacgugugugca

SEQ ID NO: 1866701 - RNA, 20 nt, Human
ugugcgugcauguguguuca

SEQ ID NO: 1866702 - RNA, 17 nt, Human
ugugccucugggacugg

SEQ ID NO: 1866703 - RNA, 15 nt, Human
ugugccucugccugu

SEQ ID NO: 1866704 - RNA, 22 nt, Human
ugugcuuauguaugagguacaa

SEQ ID NO: 1866705 - RNA, 22 nt, Human
uugaaaacacuguucucugccc

SEQ ID NO: 1866706 - RNA, 18 nt, Human
uucuuuauaauucuacuu

SEQ ID NO: 1866707 - RNA, 21 nt, Human
uugaaaacacuguucucugcc

SEQ ID NO: 1866708 - RNA, 19 nt, Human
uugaaaacacuguucucug

SEQ ID NO: 1866709 - RNA, 15 nt, Human
uugaaaaaugcaugu

SEQ ID NO: 1866710 - RNA, 22 nt, Human
uugaacuuugaccucugcagca

SEQ ID NO: 1866711 - RNA, 16 nt, Human
uugaacugauaaagau

SEQ ID NO: 1866712 - RNA, 19 nt, Human
uugaacucuucaaucucuu

SEQ ID NO: 1866713 - RNA, 17 nt, Human
uugaagacagagcuaca

SEQ ID NO: 1866714 - RNA, 19 nt, Human
uugaagacuuuucuuucag

SEQ ID NO: 1866715 - RNA, 23 nt, Human
uucuguggguuucuaaagcugcc

SEQ ID NO: 1866716 - RNA, 16 nt, Human
uucuguggcucacaga

SEQ ID NO: 1866717 - RNA, 12 nt, Human
uucuguggcuca

SEQ ID NO: 1866718 - RNA, 19 nt, Human
uucuguccuacucuguguc

SEQ ID NO: 1866719 - RNA, 17 nt, Human
uucuguccuacucugug

SEQ ID NO: 1866720 - RNA, 21 nt, Human
uucuguccgagcuuugaaaau

SEQ ID NO: 1866721 - RNA, 17 nt, Human
uucuguccgagcuuuga

SEQ ID NO: 1866722 - RNA, 14 nt, Human
uucugagcauuuaa

SEQ ID NO: 1866723 - RNA, 14 nt, Human
uucuucaacucccu

SEQ ID NO: 1866724 - RNA, 23 nt, Human
uucuuauuuaaugaaagacugua

SEQ ID NO: 1866725 - RNA, 19 nt, Human
uucuuauuuaaugaaagac

SEQ ID NO: 1866726 - RNA, 11 nt, Human
uucuguucuuu

SEQ ID NO: 1866727 - RNA, 17 nt, Human
uucuugguuuguaaauu

SEQ ID NO: 1866728 - RNA, 18 nt, Human
uucuugguuuguaaauua

SEQ ID NO: 1866729 - RNA, 23 nt, Human
uucuugguuuguaaauuaacuuu

SEQ ID NO: 1866730 - RNA, 13 nt, Human
uucuugguuugua

SEQ ID NO: 1866731 - RNA, 16 nt, Human
uucuugguuuguaaau

SEQ ID NO: 1866732 - RNA, 20 nt, Human
uugauagcacagacccugcc

SEQ ID NO: 1866733 - RNA, 19 nt, Human
uugauagcacagacccugc

SEQ ID NO: 1866734 - RNA, 21 nt, Human
uugaccgugaggccagagaca

SEQ ID NO: 1866735 - RNA, 20 nt, Human
uugaccgugaggccagagac

SEQ ID NO: 1866736 - RNA, 15 nt, Human
uugaccucaggugau

SEQ ID NO: 1866737 - RNA, 22 nt, Human
uugaccugaggcccuucucucc

SEQ ID NO: 1866738 - RNA, 19 nt, Human
uugaccugaggcccuucuc

SEQ ID NO: 1866739 - RNA, 12 nt, Human
uugaccugaggc

SEQ ID NO: 1866740 - RNA, 14 nt, Human
uugacgccauccca

SEQ ID NO: 1866741 - RNA, 22 nt, Human
uugacgccaucccagccccaau

SEQ ID NO: 1866742 - RNA, 15 nt, Human
uugacgccaucccag

SEQ ID NO: 1866743 - RNA, 23 nt, Human
uugauagcacagacccugcccug

SEQ ID NO: 1866744 - RNA, 21 nt, Human
uugauagcacagacccugccc

SEQ ID NO: 1866745 - RNA, 18 nt, Human
uugauuuccguuaaaaua

SEQ ID NO: 1866746 - RNA, 14 nt, Human
uugcaacaggcugg

SEQ ID NO: 1866747 - RNA, 17 nt, Human
uugcaacaggcugggcu

SEQ ID NO: 1866748 - RNA, 14 nt, Human
uugcauagaauaaa

SEQ ID NO: 1866749 - RNA, 15 nt, Human
uugccacugccucuu

SEQ ID NO: 1866750 - RNA, 14 nt, Human
uugccacugccucu

SEQ ID NO: 1866751 - RNA, 16 nt, Human
uugcagacaggcaagc

SEQ ID NO: 1866752 - RNA, 22 nt, Human
uugcagacaggcaagcaccucc

SEQ ID NO: 1866753 - RNA, 13 nt, Human
uuggcauucccca

SEQ ID NO: 1866754 - RNA, 14 nt, Human
uuggccaggcuggu

SEQ ID NO: 1866755 - RNA, 24 nt, Human
uuggccaaagccaaagcuaggccu

SEQ ID NO: 1866756 - RNA, 18 nt, Human
uuggcugggggccucagu

SEQ ID NO: 1866757 - RNA, 16 nt, Human
uuggcugcugaaggcu

SEQ ID NO: 1866758 - RNA, 21 nt, Human
uuggcugggggccucagugcc

SEQ ID NO: 1866759 - RNA, 22 nt, Human
uuggcugggggccucagugcca

SEQ ID NO: 1866760 - RNA, 22 nt, Human
uuggcuuuggguugcaggaccu

SEQ ID NO: 1866761 - RNA, 12 nt, Human
uugggaggcuga

SEQ ID NO: 1866762 - RNA, 16 nt, Human
uugggaggccauuugu

SEQ ID NO: 1866763 - RNA, 14 nt, Human
uugguaaaccuuuu

SEQ ID NO: 1866764 - RNA, 12 nt, Human
uugguaaaccuu

SEQ ID NO: 1866765 - RNA, 16 nt, Human
uuggguggaugccugg

SEQ ID NO: 1866766 - RNA, 13 nt, Human
uuguacagacaac

SEQ ID NO: 1866767 - RNA, 12 nt, Human
uuguacagacaa

SEQ ID NO: 1866768 - RNA, 13 nt, Human
uugguccugcugc

SEQ ID NO: 1866769 - RNA, 12 nt, Human
uugguccugcug

SEQ ID NO: 1866770 - RNA, 16 nt, Human
uuggucccccuuccau

SEQ ID NO: 1866771 - RNA, 22 nt, Human
uuggucccccuuccauggacuu

SEQ ID NO: 1866772 - RNA, 16 nt, Human
uuguaaaggaauuuaa

SEQ ID NO: 1866773 - RNA, 14 nt, Human
uuguacauaaugcg

SEQ ID NO: 1866774 - RNA, 16 nt, Human
uuguacaguuuuuauu

SEQ ID NO: 1866775 - RNA, 12 nt, Human
uuguacaguuuu

SEQ ID NO: 1866776 - RNA, 13 nt, Human
uuguacaguuuuu

SEQ ID NO: 1866777 - RNA, 14 nt, Human
uuguagagccaggg

SEQ ID NO: 1866778 - RNA, 15 nt, Human
uuguagagccagggu

SEQ ID NO: 1866779 - RNA, 21 nt, Human
uuguauucucuccuguaccuc

SEQ ID NO: 1866780 - RNA, 14 nt, Human
uuguauucagaguu

SEQ ID NO: 1866781 - RNA, 14 nt, Human
uuguauuacaaauc

SEQ ID NO: 1866782 - RNA, 22 nt, Human
uugcugauggugcaaugaccuu

SEQ ID NO: 1866783 - RNA, 20 nt, Human
uugcugauggugcaaugacc

SEQ ID NO: 1866784 - RNA, 15 nt, Human
uugcugccucaugcu

SEQ ID NO: 1866785 - RNA, 12 nt, Human
uugcugccucau

SEQ ID NO: 1866786 - RNA, 11 nt, Human
uugcugccuca

SEQ ID NO: 1866787 - RNA, 16 nt, Human
uugccucugccucuga

SEQ ID NO: 1866788 - RNA, 18 nt, Human
uugccucugccucugaca

SEQ ID NO: 1866789 - RNA, 11 nt, Human
uugccucugcc

SEQ ID NO: 1866790 - RNA, 14 nt, Human
uugccucugccucu

SEQ ID NO: 1866791 - RNA, 18 nt, Human
uugccagucaccccggcc

SEQ ID NO: 1866792 - RNA, 18 nt, Human
uugccacugccucuuccu

SEQ ID NO: 1866793 - RNA, 23 nt, Human
uugcccacgcuggagugcaguga

SEQ ID NO: 1866794 - RNA, 11 nt, Human
uugcccaggca

SEQ ID NO: 1866795 - RNA, 20 nt, Human
uugcuggggccgaaagaaca

SEQ ID NO: 1866796 - RNA, 20 nt, Human
uugcuguagaagauggcacu

SEQ ID NO: 1866797 - RNA, 17 nt, Human
uuggcaaaaaggcagga

SEQ ID NO: 1866798 - RNA, 14 nt, Human
uuggauuguccccg

SEQ ID NO: 1866799 - RNA, 18 nt, Human
uuggauuuuugucuugug

SEQ ID NO: 1866800 - RNA, 19 nt, Human
uuggaaggaacguccccug

SEQ ID NO: 1866801 - RNA, 11 nt, Human
uuggaaggaac

SEQ ID NO: 1866802 - RNA, 21 nt, Human
uucugacccaugcugcccugu

SEQ ID NO: 1866803 - RNA, 20 nt, Human
uucugacccaugcugcccug

SEQ ID NO: 1866804 - RNA, 18 nt, Human
uucugacccaugcugccc

SEQ ID NO: 1866805 - RNA, 16 nt, Human
uucugacccaugcugc

SEQ ID NO: 1866806 - RNA, 11 nt, Human
uucuccaggcu

SEQ ID NO: 1866807 - RNA, 16 nt, Human
uucuccaagcaggaca

SEQ ID NO: 1866808 - RNA, 13 nt, Human
uucuccacccugc

SEQ ID NO: 1866809 - RNA, 18 nt, Human
uucucuccagccccugga

SEQ ID NO: 1866810 - RNA, 13 nt, Human
uucucaaagaaau

SEQ ID NO: 1866811 - RNA, 15 nt, Human
uucucaaagaaauuu

SEQ ID NO: 1866812 - RNA, 19 nt, Human
uucucaaagaaauuuccac

SEQ ID NO: 1866813 - RNA, 20 nt, Human
uucucaaagaaauuuccacu

SEQ ID NO: 1866814 - RNA, 12 nt, Human
uucucaugccuc

SEQ ID NO: 1866815 - RNA, 11 nt, Human
uucucaugccu

SEQ ID NO: 1866816 - RNA, 21 nt, Human
uucucaugccucagccuccug

SEQ ID NO: 1866817 - RNA, 14 nt, Human
uucucaugccucag

SEQ ID NO: 1866818 - RNA, 14 nt, Human
uucuauuguuucuu

SEQ ID NO: 1866819 - RNA, 16 nt, Human
uucuaugacacaugca

SEQ ID NO: 1866820 - RNA, 17 nt, Human
uucuaugacacaugcaa

SEQ ID NO: 1866821 - RNA, 22 nt, Human
uucggccuccauccugaggcuc

SEQ ID NO: 1866822 - RNA, 18 nt, Human
uucggccuccauccugag

SEQ ID NO: 1866823 - RNA, 19 nt, Human
uucggccuccauccugagg

SEQ ID NO: 1866824 - RNA, 17 nt, Human
uucuaaaggcuaccuuu

SEQ ID NO: 1866825 - RNA, 18 nt, Human
uucuaaaggcuaccuuug

SEQ ID NO: 1866826 - RNA, 16 nt, Human
uucuaaaggcuaccuu

SEQ ID NO: 1866827 - RNA, 13 nt, Human
uucuaaagaugga

SEQ ID NO: 1866828 - RNA, 19 nt, Human
uuccuucauucaacccacc

SEQ ID NO: 1866829 - RNA, 23 nt, Human
uuccuucagugccuuauggaaca

SEQ ID NO: 1866830 - RNA, 19 nt, Human
uuccuucagugccuuaugg

SEQ ID NO: 1866831 - RNA, 16 nt, Human
uuccuucagugccuua

SEQ ID NO: 1866832 - RNA, 11 nt, Human
uuccugcccug

SEQ ID NO: 1866833 - RNA, 22 nt, Human
uuccugcccugggaggcaguga

SEQ ID NO: 1866834 - RNA, 16 nt, Human
uuccugcccugggagg

SEQ ID NO: 1866835 - RNA, 13 nt, Human
uuccugcccuggg

SEQ ID NO: 1866836 - RNA, 17 nt, Human
uuccuuccucugagccu

SEQ ID NO: 1866837 - RNA, 13 nt, Human
uuccuuccucuga

SEQ ID NO: 1866838 - RNA, 22 nt, Human
uuccccacuugagaauuacccu

SEQ ID NO: 1866839 - RNA, 19 nt, Human
uucccuuugacgccauccc

SEQ ID NO: 1866840 - RNA, 21 nt, Human
uuccucccucccucuuucccu

SEQ ID NO: 1866841 - RNA, 19 nt, Human
uuccucccucccucuuucc

SEQ ID NO: 1866842 - RNA, 12 nt, Human
uuccucccuccc

SEQ ID NO: 1866843 - RNA, 22 nt, Human
uuccucccucccucuuucccuc

SEQ ID NO: 1866844 - RNA, 20 nt, Human
uuccuagguauaauucacau

SEQ ID NO: 1866845 - RNA, 23 nt, Human
uuccucauaguaugguggcuggg

SEQ ID NO: 1866846 - RNA, 23 nt, Human
uucauaaugacuuaagcacacuu

SEQ ID NO: 1866847 - RNA, 13 nt, Human
uucauaaugacuu

SEQ ID NO: 1866848 - RNA, 15 nt, Human
uucaucuaggauuuu

SEQ ID NO: 1866849 - RNA, 12 nt, Human
uucaguuuucag

SEQ ID NO: 1866850 - RNA, 21 nt, Human
uucagugccuuauggaacacu

SEQ ID NO: 1866851 - RNA, 19 nt, Human
uucagugccuuauggaaca

SEQ ID NO: 1866852 - RNA, 16 nt, Human
uucaggcucuucuccu

SEQ ID NO: 1866853 - RNA, 13 nt, Human
uucaguggcagcu

SEQ ID NO: 1866854 - RNA, 19 nt, Human
uucauuuaggugaggaagc

SEQ ID NO: 1866855 - RNA, 11 nt, Human
uucaucuugaa

SEQ ID NO: 1866856 - RNA, 20 nt, Human
uucaucuuccaacucaaacu

SEQ ID NO: 1866857 - RNA, 12 nt, Human
uucaucuugaau

SEQ ID NO: 1866858 - RNA, 17 nt, Human
uucaucuugaauuguaa

SEQ ID NO: 1866859 - RNA, 17 nt, Human
uuccaugaguccccugu

SEQ ID NO: 1866860 - RNA, 19 nt, Human
uuccaugucgccucugcau

SEQ ID NO: 1866861 - RNA, 18 nt, Human
uuccaugucgccucugca

SEQ ID NO: 1866862 - RNA, 17 nt, Human
uuccaugucgccucugc

SEQ ID NO: 1866863 - RNA, 14 nt, Human
uuccccaagacauu

SEQ ID NO: 1866864 - RNA, 21 nt, Human
uuccaugucgccucugcauuc

SEQ ID NO: 1866865 - RNA, 20 nt, Human
uuccaugucgccucugcauu

SEQ ID NO: 1866866 - RNA, 19 nt, Human
uuccacuuauaggaauuga

SEQ ID NO: 1866867 - RNA, 21 nt, Human
uuccacuuagaaauugcauuu

SEQ ID NO: 1866868 - RNA, 19 nt, Human
uucaggaagcucagggccu

SEQ ID NO: 1866869 - RNA, 17 nt, Human
uucaggaagcucagggc

SEQ ID NO: 1866870 - RNA, 15 nt, Human
uucaggaagcucagg

SEQ ID NO: 1866871 - RNA, 20 nt, Human
uucaggaagcucagggccug

SEQ ID NO: 1866872 - RNA, 15 nt, Human
uucaggcucuucucc

SEQ ID NO: 1866873 - RNA, 17 nt, Human
uucagcugacuuuucug

SEQ ID NO: 1866874 - RNA, 18 nt, Human
uucagcugcauacaguuu

SEQ ID NO: 1866875 - RNA, 16 nt, Human
uucaggaagcucaggg

SEQ ID NO: 1866876 - RNA, 21 nt, Human
uucagcugguugagguuucaa

SEQ ID NO: 1866877 - RNA, 24 nt, Human
uucagcucugcaagaauugaagca

SEQ ID NO: 1866878 - RNA, 17 nt, Human
uucagcucugcaagaau

SEQ ID NO: 1866879 - RNA, 23 nt, Human
uucagcuccagcucaccagcccc

SEQ ID NO: 1866880 - RNA, 14 nt, Human
uucacucuccuugg

SEQ ID NO: 1866881 - RNA, 15 nt, Human
uucagagacuccugc

SEQ ID NO: 1866882 - RNA, 14 nt, Human
uuacgugaguccug

SEQ ID NO: 1866883 - RNA, 13 nt, Human
uuacgugaguccu

SEQ ID NO: 1866884 - RNA, 13 nt, Human
uucaaagauauuu

SEQ ID NO: 1866885 - RNA, 15 nt, Human
uucaaagcaaauguc

SEQ ID NO: 1866886 - RNA, 23 nt, Human
uucaaauuguaagcaugcacaaa

SEQ ID NO: 1866887 - RNA, 16 nt, Human
uucaaucccaggaugu

SEQ ID NO: 1866888 - RNA, 15 nt, Human
uucaacgcagcccug

SEQ ID NO: 1866889 - RNA, 14 nt, Human
uucaacgcagcccu

SEQ ID NO: 1866890 - RNA, 21 nt, Human
uucaacagguuuuccugaaga

SEQ ID NO: 1866891 - RNA, 13 nt, Human
uucaacgcagccc

SEQ ID NO: 1866892 - RNA, 20 nt, Human
uucaaccauuccccauggga

SEQ ID NO: 1866893 - RNA, 17 nt, Human
uucaaccauuccccaug

SEQ ID NO: 1866894 - RNA, 18 nt, Human
uucaauucucauuuguca

SEQ ID NO: 1866895 - RNA, 16 nt, Human
uuuaucgucacugcuu

SEQ ID NO: 1866896 - RNA, 16 nt, Human
uuuauaaacuuuaccu

SEQ ID NO: 1866897 - RNA, 21 nt, Human
uuuaucgucacugcuuaacuu

SEQ ID NO: 1866898 - RNA, 14 nt, Human
uuuauaaacuuuac

SEQ ID NO: 1866899 - RNA, 16 nt, Human
uuuauugucaaagugg

SEQ ID NO: 1866900 - RNA, 14 nt, Human
uuuauugucaaagu

SEQ ID NO: 1866901 - RNA, 14 nt, Human
uuuaugcauauuau

SEQ ID NO: 1866902 - RNA, 13 nt, Human
uuuauugcuuguu

SEQ ID NO: 1866903 - RNA, 15 nt, Human
uuuacuuuguguuca

SEQ ID NO: 1866904 - RNA, 23 nt, Human
uuguauuuaaaugaaagugagac

SEQ ID NO: 1866905 - RNA, 20 nt, Human
uuguauuuuacuaauaaaau

SEQ ID NO: 1866906 - RNA, 15 nt, Human
uuguauuuauuuagu

SEQ ID NO: 1866907 - RNA, 22 nt, Human
uuucauugcugggcuugucugu

SEQ ID NO: 1866908 - RNA, 16 nt, Human
uuucagccaagaauuc

SEQ ID NO: 1866909 - RNA, 15 nt, Human
uuucagccaagaauu

SEQ ID NO: 1866910 - RNA, 13 nt, Human
uuuccaggaaggc

SEQ ID NO: 1866911 - RNA, 12 nt, Human
uuuccaaaguac

SEQ ID NO: 1866912 - RNA, 15 nt, Human
uuuccaaaguacacu

SEQ ID NO: 1866913 - RNA, 15 nt, Human
uuucagcagcugcag

SEQ ID NO: 1866914 - RNA, 13 nt, Human
uuuauuuccagug

SEQ ID NO: 1866915 - RNA, 22 nt, Human
uuucaauaggaaaaacugauuu

SEQ ID NO: 1866916 - RNA, 20 nt, Human
uuucaauaggaaaaacugau

SEQ ID NO: 1866917 - RNA, 15 nt, Human
uuucuagccagagga

SEQ ID NO: 1866918 - RNA, 15 nt, Human
uuucuaaugugugaa

SEQ ID NO: 1866919 - RNA, 17 nt, Human
uuucuaaagcugccagc

SEQ ID NO: 1866920 - RNA, 14 nt, Human
uuucuaaagcugcc

SEQ ID NO: 1866921 - RNA, 14 nt, Human
uuucuaaaggcuac

SEQ ID NO: 1866922 - RNA, 18 nt, Human
uuucuaaaggcuaccuuu

SEQ ID NO: 1866923 - RNA, 21 nt, Human
uuuccucuuuggucuacacug

SEQ ID NO: 1866924 - RNA, 23 nt, Human
uuuccugacagaaggacucaggu

SEQ ID NO: 1866925 - RNA, 22 nt, Human
uuuccucaaaacuucagacaua

SEQ ID NO: 1866926 - RNA, 20 nt, Human
uuuucacugcuggcugccuu

SEQ ID NO: 1866927 - RNA, 19 nt, Human
uuuucacugcuggcugccu

SEQ ID NO: 1866928 - RNA, 15 nt, Human
uuuucacaguucucu

SEQ ID NO: 1866929 - RNA, 22 nt, Human
uuuucaacgcagcccugcuuug

SEQ ID NO: 1866930 - RNA, 21 nt, Human
uuuucaacgcagcccugcuuu

SEQ ID NO: 1866931 - RNA, 17 nt, Human
uuuucaacgcagcccug

SEQ ID NO: 1866932 - RNA, 19 nt, Human
uuuuccaugaguccccugu

SEQ ID NO: 1866933 - RNA, 18 nt, Human
uuuuccaugaguccccug

SEQ ID NO: 1866934 - RNA, 15 nt, Human
uuuuccuucagugcc

SEQ ID NO: 1866935 - RNA, 17 nt, Human
uuuucuugcaugaggcu

SEQ ID NO: 1866936 - RNA, 14 nt, Human
uuuucuucucccuc

SEQ ID NO: 1866937 - RNA, 20 nt, Human
uuuuauaucaauuuaaaaaa

SEQ ID NO: 1866938 - RNA, 14 nt, Human
uuuuacuguacaga

SEQ ID NO: 1866939 - RNA, 18 nt, Human
uuuuaucgucacugcuua

SEQ ID NO: 1866940 - RNA, 20 nt, Human
uuuuaugauacuugaaaauu

SEQ ID NO: 1866941 - RNA, 16 nt, Human
uuuuaugauacuugaa

SEQ ID NO: 1866942 - RNA, 16 nt, Human
uuuuacagcugccugc

SEQ ID NO: 1866943 - RNA, 22 nt, Human
uuuuaaaaugagaaaucuaaaa

SEQ ID NO: 1866944 - RNA, 15 nt, Human
uuuuaaaaugagaaa

SEQ ID NO: 1866945 - RNA, 15 nt, Human
uuuguaaauuaacuu

SEQ ID NO: 1866946 - RNA, 16 nt, Human
uuuguaaauuaacuuu

SEQ ID NO: 1866947 - RNA, 17 nt, Human
uuuguaaauuaacuuuu

SEQ ID NO: 1866948 - RNA, 19 nt, Human
uuuggugguuucagaaaug

SEQ ID NO: 1866949 - RNA, 22 nt, Human
uuuguaaauuaacuuuuauaaa

SEQ ID NO: 1866950 - RNA, 21 nt, Human
uuuguccccaccgcagacagg

SEQ ID NO: 1866951 - RNA, 13 nt, Human
uuuguccccaccg

SEQ ID NO: 1866952 - RNA, 16 nt, Human
uuuguugucagcugaa

SEQ ID NO: 1866953 - RNA, 13 nt, Human
uuugagugccuua

SEQ ID NO: 1866954 - RNA, 17 nt, Human
uuugaggucuguucuuu

SEQ ID NO: 1866955 - RNA, 22 nt, Human
uuugaggucuguucuuuccaaa

SEQ ID NO: 1866956 - RNA, 14 nt, Human
uuugagcucagccc

SEQ ID NO: 1866957 - RNA, 22 nt, Human
uuucuuacugucuuuuuucuaa

SEQ ID NO: 1866958 - RNA, 15 nt, Human
uuugagcagggcuca

SEQ ID NO: 1866959 - RNA, 23 nt, Human
uuugcauaacguauaaaagccug

SEQ ID NO: 1866960 - RNA, 19 nt, Human
uuugcauaacguauaaaag

SEQ ID NO: 1866961 - RNA, 14 nt, Human
uuugcagacaggca

SEQ ID NO: 1866962 - RNA, 16 nt, Human
uuugccagugggaacu

SEQ ID NO: 1866963 - RNA, 15 nt, Human
uuugccagugggaac

SEQ ID NO: 1866964 - RNA, 18 nt, Human
uuugccauguuggccagg

SEQ ID NO: 1866965 - RNA, 17 nt, Human
uuuuuuccuucagugcc

SEQ ID NO: 1866966 - RNA, 12 nt, Human
uuuuuuacuaau

SEQ ID NO: 1866967 - RNA, 20 nt, Human
uuuuuuauacaggaugauga

SEQ ID NO: 1866968 - RNA, 13 nt, Human
uuuugaaaaacug

SEQ ID NO: 1866969 - RNA, 18 nt, Human
gcaaucaaaucugcuuuu

SEQ ID NO: 1866970 - RNA, 18 nt, Human
gccucaaaugagaaaaug

SEQ ID NO: 1866971 - RNA, 18 nt, Human
gaaaaaguucugcagaua

SEQ ID NO: 1866972 - RNA, 18 nt, Human
gcaccgggccacagagaa

SEQ ID NO: 1866973 - RNA, 20 nt, Human
gaucagaguaauccaagcaa

SEQ ID NO: 1866974 - RNA, 16 nt, Human
ucccaugagccucagc

SEQ ID NO: 1866975 - RNA, 17 nt, Human
ggaaucuuucugcuuug

SEQ ID NO: 1866976 - RNA, 14 nt, Human
gggccaaagaaaca

SEQ ID NO: 1866977 - RNA, 14 nt, Human
ggccacagaaaauu

SEQ ID NO: 1866978 - RNA, 24 nt, Human
ggccacuccagaccccuggcuuuu

SEQ ID NO: 1866979 - RNA, 19 nt, Human
guaaaaauuaaaaguuaug

SEQ ID NO: 1866980 - RNA, 19 nt, Human
gugcauaaaaacaagaaca

SEQ ID NO: 1866981 - RNA, 22 nt, Human
gugccccugcacuccagccuga

SEQ ID NO: 1866982 - RNA, 16 nt, Human
aaugugauaaaacccc

SEQ ID NO: 1866983 - RNA, 17 nt, Human
aauuuuuauuaaauuau

SEQ ID NO: 1866984 - RNA, 13 nt, Human
accagggcuggaa

SEQ ID NO: 1866985 - RNA, 14 nt, Human
aacaggcagauaca

SEQ ID NO: 1866986 - RNA, 20 nt, Human
ccguuauuaaaaaucucaaa

SEQ ID NO: 1866987 - RNA, 10 nt, Human
uuugggcucu

SEQ ID NO: 1866988 - RNA, 15 nt, Human
ccccaggaggccagc

SEQ ID NO: 1866989 - RNA, 18 nt, Human
uuguacagacaacaaacc

SEQ ID NO: 1866990 - RNA, 16 nt, Human
uuucuaaaucuccaaa

SEQ ID NO: 1866991 - RNA, 16 nt, Human
uuugggguaugggaga

SEQ ID NO: 1866992 - RNA, 12 nt, Human
uuaaaaguaucc

SEQ ID NO: 1866993 - RNA, 12 nt, Human
cccacugcuuuu

SEQ ID NO: 1866994 - RNA, 18 nt, Human
cccuggcucccacaggcc

SEQ ID NO: 1866995 - RNA, 16 nt, Human
guauccuucagccuga

SEQ ID NO: 1866996 - RNA, 22 nt, Human
ggugaacauugcaauagaaauc

SEQ ID NO: 1866997 - RNA, 22 nt, Human
gguucuacgccaggggaaaauc

SEQ ID NO: 1866998 - RNA, 15 nt, Human
ggguccuagaaauuc

SEQ ID NO: 1866999 - RNA, 17 nt, Human
guguuagugguuaccca

SEQ ID NO: 1867000 - RNA, 13 nt, Human
gugaaagaaaaua

SEQ ID NO: 1867001 - RNA, 20 nt, Human
ggaaacaugacucguauaug

SEQ ID NO: 1867002 - RNA, 13 nt, Human
ggcagcugcuuuu

SEQ ID NO: 1867003 - RNA, 14 nt, Human
gggcacagaaaaug

SEQ ID NO: 1867004 - RNA, 17 nt, Human
ucugugagaugcuagaa

SEQ ID NO: 1867005 - RNA, 22 nt, Human
uagcauggcugccaaugggagc

SEQ ID NO: 1867006 - RNA, 20 nt, Human
gucgcaauuacuaagaagca

SEQ ID NO: 1867007 - RNA, 15 nt, Human
gguuuuaaaaaaauc

SEQ ID NO: 1867008 - RNA, 19 nt, Human
ucuguugcccaggcuggag

SEQ ID NO: 1867009 - RNA, 15 nt, Human
uccaagaagcccagg

SEQ ID NO: 1867010 - RNA, 19 nt, Human
cugccuguucagcuccagc

SEQ ID NO: 1867011 - RNA, 18 nt, Human
gaaugaaugcuguauaug

SEQ ID NO: 1867012 - RNA, 18 nt, Human
cucccaacucaccccagc

SEQ ID NO: 1867013 - RNA, 19 nt, Human
cugcccauccugccccuga

SEQ ID NO: 1867014 - RNA, 12 nt, Human
gagaguggcucc

SEQ ID NO: 1867015 - RNA, 16 nt, Human
gaucucuugagccugg

SEQ ID NO: 1867016 - RNA, 18 nt, Human
gauaaagguucaugcaaa

SEQ ID NO: 1867017 - RNA, 14 nt, Human
gcaaauguggcucc

SEQ ID NO: 1867018 - RNA, 16 nt, Human
gcagggggcaugaugc

SEQ ID NO: 1867019 - RNA, 11 nt, Human
aaauaaauuau

SEQ ID NO: 1867020 - RNA, 11 nt, Human
aauaaacacuc

SEQ ID NO: 1867021 - RNA, 19 nt, Human
accgggcacucagaagaca

SEQ ID NO: 1867022 - RNA, 21 nt, Human
accauguuggccaggcugguc

SEQ ID NO: 1867023 - RNA, 13 nt, Human
uuaaaacacaaca

SEQ ID NO: 1867024 - RNA, 17 nt, Human
uggugacugugggcucc

SEQ ID NO: 1867025 - RNA, 20 nt, Human
uguaacaccaugauuaacca

SEQ ID NO: 1867026 - RNA, 19 nt, Human
ucugucgcccaggcuggag

SEQ ID NO: 1867027 - RNA, 16 nt, Human
cugccaggaagccagc

SEQ ID NO: 1867028 - RNA, 21 nt, Human
cggugucccccagcagccugg

SEQ ID NO: 1867029 - RNA, 18 nt, Human
cuuccacaagagcccagg

SEQ ID NO: 1867030 - RNA, 22 nt, Human
ccaucccugaaggccccgccca

SEQ ID NO: 1867031 - RNA, 15 nt, Human
ccaucuacccuccga

SEQ ID NO: 1867032 - RNA, 12 nt, Human
ccaaguggcucc

SEQ ID NO: 1867033 - RNA, 16 nt, Human
cgggcucugccuccca

SEQ ID NO: 1867034 - RNA, 18 nt, Human
cgacagccuggcacaggg

SEQ ID NO: 1867035 - RNA, 13 nt, Human
cacuccagccugg

SEQ ID NO: 1867036 - RNA, 17 nt, Human
cacaugauccugcaauu

SEQ ID NO: 1867037 - RNA, 19 nt, Human
cacaaccuucuguggcuca

SEQ ID NO: 1867038 - RNA, 15 nt, Human
cacaccagagcccac

SEQ ID NO: 1867039 - RNA, 13 nt, Human
cagcccugcuuug

SEQ ID NO: 1867040 - RNA, 22 nt, Human
cagcgcuggccgggaccccgag

SEQ ID NO: 1867041 - RNA, 21 nt, Human
caggauucuuccucccucccu

SEQ ID NO: 1867042 - RNA, 14 nt, Human
ccaccacacccagc

SEQ ID NO: 1867043 - RNA, 16 nt, Human
cagagacagaaagcag

SEQ ID NO: 1867044 - RNA, 15 nt, Human
caaaaugggacuugu

SEQ ID NO: 1867045 - RNA, 18 nt, Human
caaaagaaagaaaaucag

SEQ ID NO: 1867046 - RNA, 16 nt, Human
caagaaaugaaagcag

SEQ ID NO: 1867047 - RNA, 18 nt, Human
guuucuuucaaagaagcc

SEQ ID NO: 1867048 - RNA, 14 nt, Human
ucaccaagcccagu

SEQ ID NO: 1867049 - RNA, 16 nt, Human
aguccacaguggaacc

SEQ ID NO: 1867050 - RNA, 18 nt, Human
aguggaaguaguggagcc

SEQ ID NO: 1867051 - RNA, 19 nt, Human
aucugagcagguugcucca

SEQ ID NO: 1867052 - RNA, 15 nt, Human
aaauaaaaaacacug

SEQ ID NO: 1867053 - RNA, 14 nt, Human
acucuuaaaaccca

SEQ ID NO: 1867054 - RNA, 17 nt, Human
aauacacacaaguauac

SEQ ID NO: 1867055 - RNA, 21 nt, Human
aucugguuuauuuuuguucca

SEQ ID NO: 1867056 - RNA, 15 nt, Human
cugccgcagcccugc

SEQ ID NO: 1867057 - RNA, 17 nt, Human
cuuuaaaugcugcuuuu

SEQ ID NO: 1867058 - RNA, 20 nt, Human
gacuguacuccucccaggcg

SEQ ID NO: 1867059 - RNA, 16 nt, Human
gagacagcucugcaua

SEQ ID NO: 1867060 - RNA, 20 nt, Human herpesvirus 3
cucccacgguuugugcacug

SEQ ID NO: 1867061 - RNA, 17 nt, Human herpesvirus 3
auaucucauacucaugc

SEQ ID NO: 1867062 - RNA, 14 nt, Human herpesvirus 3
gaaagcggacacau

SEQ ID NO: 1867063 - RNA, 16 nt, Human herpesvirus 3
caacucuuuucccaaa

SEQ ID NO: 1867064 - RNA, 15 nt, Human herpesvirus 3
guuacaucuauagca

SEQ ID NO: 1867065 - RNA, 12 nt, Human herpesvirus 3
cagccgcucgcu

SEQ ID NO: 1867066 - RNA, 17 nt, Human herpesvirus 3
gaagcuauuggcuccac

SEQ ID NO: 1867067 - RNA, 22 nt, Human herpesvirus 3
accuguuagaauaguaaauacc

SEQ ID NO: 1867068 - RNA, 17 nt, Human herpesvirus 3
aacgcugcugacaaaau

SEQ ID NO: 1867069 - RNA, 21 nt, Human herpesvirus 3
aacuuuugcuuauauuuuaca

SEQ ID NO: 1867070 - RNA, 19 nt, Human herpesvirus 3
cuauauaacgccucccagc

SEQ ID NO: 1867071 - RNA, 20 nt, Human herpesvirus 3
uagauguguugcgaauguaa

SEQ ID NO: 1867072 - RNA, 22 nt, Human herpesvirus 3
agcggaacgguuuuuaugaaaa

SEQ ID NO: 1867073 - RNA, 22 nt, Human herpesvirus 3
auuuuugauuuuuuuaaacaaa

SEQ ID NO: 1867074 - RNA, 18 nt, Human herpesvirus 3
auucaaguaaauaugugc

SEQ ID NO: 1867075 - RNA, 14 nt, Human herpesvirus 3
cgaauaucgccaug

SEQ ID NO: 1867076 - RNA, 16 nt, Human herpesvirus 3
auauacgagcaaaaua

SEQ ID NO: 1867077 - RNA, 17 nt, Human herpesvirus 3
guggugaagaaggacag

SEQ ID NO: 1867078 - RNA, 12 nt, Human herpesvirus 3
ugcauuggaagu

SEQ ID NO: 1867079 - RNA, 14 nt, Human herpesvirus 3
uguuauacuacuua

SEQ ID NO: 1867080 - RNA, 18 nt, Human herpesvirus 3
aacucgccuccacugcau

SEQ ID NO: 1867081 - RNA, 19 nt, Human herpesvirus 3
gcggaucccgcggugagca

SEQ ID NO: 1867082 - RNA, 22 nt, Human herpesvirus 3
cuugggcuguuaggguugggag

SEQ ID NO: 1867083 - RNA, 14 nt, Human herpesvirus 3
caauacguaaaugu

SEQ ID NO: 1867084 - RNA, 15 nt, Human herpesvirus 3
auauuacuuaaaacg

SEQ ID NO: 1867085 - RNA, 20 nt, Human herpesvirus 3
ccaaauaacgccuuaaaagu

SEQ ID NO: 1867086 - RNA, 22 nt, Human herpesvirus 3
acaguggcggauaacugccugu

SEQ ID NO: 1867087 - RNA, 12 nt, Human herpesvirus 3
guuaauuuuaca

SEQ ID NO: 1867088 - RNA, 20 nt, Human herpesvirus 3
gguagacaacugacagaaac

SEQ ID NO: 1867089 - RNA, 13 nt, Human herpesvirus 3
uccgcgcucaauc

SEQ ID NO: 1867090 - RNA, 16 nt, Human herpesvirus 3
uaguaccacgugguau

SEQ ID NO: 1867091 - RNA, 12 nt, Human herpesvirus 3
uuuuuaaucauu

SEQ ID NO: 1867092 - RNA, 16 nt, Human herpesvirus 3
cccaccucggccgcuu

SEQ ID NO: 1867093 - RNA, 16 nt, Human herpesvirus 3
uaaaacauaucaauuu

SEQ ID NO: 1867094 - RNA, 13 nt, Human herpesvirus 3
ucuacgcauuuac

SEQ ID NO: 1867095 - RNA, 14 nt, Human herpesvirus 3
uauuuuugucuacc

SEQ ID NO: 1867096 - RNA, 19 nt, Human herpesvirus 3
aucauuaaacgugcauuuu

SEQ ID NO: 1867097 - RNA, 18 nt, Human herpesvirus 3
ucuauagcaaaauucaga

SEQ ID NO: 1867098 - RNA, 21 nt, Human herpesvirus 3
acaucauccguccaaacagug

SEQ ID NO: 1867099 - RNA, 20 nt, Human herpesvirus 3
uaucaguugaaccaaaucca

SEQ ID NO: 1867100 - RNA, 14 nt, Human herpesvirus 3
cggaucaugaacaa

SEQ ID NO: 1867101 - RNA, 15 nt, Human herpesvirus 3
acguuugcauuuacc

SEQ ID NO: 1867102 - RNA, 18 nt, Human herpesvirus 3
uauauuaaagguuaaauu

SEQ ID NO: 1867103 - RNA, 13 nt, Human herpesvirus 3
uaaauauaaauuu

SEQ ID NO: 1867104 - RNA, 14 nt, Human herpesvirus 3
uauguacauuaaag

SEQ ID NO: 1867105 - RNA, 19 nt, Human herpesvirus 3
aacagucguugggaauuua

SEQ ID NO: 1867106 - RNA, 12 nt, Human herpesvirus 3
guacacccagcu

SEQ ID NO: 1867107 - RNA, 20 nt, Human herpesvirus 3
cgcuggguguggcuauuaga

SEQ ID NO: 1867108 - RNA, 13 nt, Human herpesvirus 3
cucacuguuuucg

SEQ ID NO: 1867109 - RNA, 18 nt, Human herpesvirus 3
ccauuacaacaaggauaa

SEQ ID NO: 1867110 - RNA, 14 nt, Human herpesvirus 3
ggcaguucagagac

SEQ ID NO: 1867111 - RNA, 19 nt, Human herpesvirus 3
gauguuuuuauuagaacgu

SEQ ID NO: 1867112 - RNA, 19 nt, Human herpesvirus 3
auguacugugucucucaaa

SEQ ID NO: 1867113 - RNA, 15 nt, Human herpesvirus 3
uuuaggaaucaagac

SEQ ID NO: 1867114 - RNA, 14 nt, Human herpesvirus 3
ucgcuacuccaggc

SEQ ID NO: 1867115 - RNA, 20 nt, Human herpesvirus 3
cccacgggguccccacacgg

SEQ ID NO: 1867116 - RNA, 12 nt, Human herpesvirus 3
agaucuuacacc

SEQ ID NO: 1867117 - RNA, 21 nt, Human herpesvirus 3
acaucgaucaucgaaaagacu

SEQ ID NO: 1867118 - RNA, 21 nt, Human herpesvirus 3
cagcgccaauaaaagcagaca

SEQ ID NO: 1867119 - RNA, 12 nt, Human herpesvirus 3
accucggccgcu

SEQ ID NO: 1867120 - RNA, 19 nt, Human herpesvirus 3
guacguaaccauauauaag

SEQ ID NO: 1867121 - RNA, 14 nt, Human herpesvirus 3
guggguagguaggg

SEQ ID NO: 1867122 - RNA, 15 nt, Human herpesvirus 3
auaucccaaggcaaa

SEQ ID NO: 1867123 - RNA, 13 nt, Human herpesvirus 3
gcccacaccuacc

SEQ ID NO: 1867124 - RNA, 18 nt, Human herpesvirus 3
cacccauaaaaacgccuu

SEQ ID NO: 1867125 - RNA, 18 nt, Human herpesvirus 3
cccgcgcguuugcggggc

SEQ ID NO: 1867126 - RNA, 13 nt, Human herpesvirus 3
aaacuauuccaaa

SEQ ID NO: 1867127 - RNA, 20 nt, Human herpesvirus 3
auucaagacuaacauuuauc

SEQ ID NO: 1867128 - RNA, 13 nt, Human herpesvirus 3
cagauucuucacc

SEQ ID NO: 1867129 - RNA, 19 nt, Human herpesvirus 3
aggacgaaggggaauuaaa

SEQ ID NO: 1867130 - RNA, 21 nt, Human herpesvirus 3
uguaaaguuauuucuccggga

SEQ ID NO: 1867131 - RNA, 17 nt, Human herpesvirus 3
cauuuuaaaaauaccug

SEQ ID NO: 1867132 - RNA, 16 nt, Human herpesvirus 3
guguucuaaaacacug

SEQ ID NO: 1867133 - RNA, 22 nt, Human herpesvirus 3
ccaacuggaaaugugcugucaa

SEQ ID NO: 1867134 - RNA, 16 nt, Human herpesvirus 3
gggacccgcagcccag

SEQ ID NO: 1867135 - RNA, 16 nt, Human herpesvirus 3
guuaauaaaagcggaa

SEQ ID NO: 1867136 - RNA, 21 nt, Human herpesvirus 3
ccuuuacaagauauaauuugu

SEQ ID NO: 1867137 - RNA, 12 nt, Human herpesvirus 3
ccagaguacagg

SEQ ID NO: 1867138 - RNA, 18 nt, Human herpesvirus 3
aauauuuuguuaauacag

SEQ ID NO: 1867139 - RNA, 23 nt, Human herpesvirus 3
agguuuauuuacuuuacaacccg

SEQ ID NO: 1867140 - RNA, 17 nt, Human herpesvirus 3
auuuuuauuuaaaugug

SEQ ID NO: 1867141 - RNA, 21 nt, Human herpesvirus 3
guuuucguuuugguguuacau

SEQ ID NO: 1867142 - RNA, 18 nt, Human herpesvirus 3
uucuauauuaauaaaaga

SEQ ID NO: 1867143 - RNA, 18 nt, Human herpesvirus 3
ggacuaacaaaguuggaa

SEQ ID NO: 1867144 - RNA, 19 nt, Human herpesvirus 3
uaaaauucuaacaacucug

SEQ ID NO: 1867145 - RNA, 18 nt, Human herpesvirus 3
uuuacaggccggaguguc

SEQ ID NO: 1867146 - RNA, 13 nt, Human herpesvirus 3
gugaaagagcugu

SEQ ID NO: 1867147 - RNA, 14 nt, Human herpesvirus 3
gcgaacaccgcugu

SEQ ID NO: 1867148 - RNA, 15 nt, Human herpesvirus 3
aaacaaauacgauca

SEQ ID NO: 1867149 - RNA, 17 nt, Human herpesvirus 3
auuugccccaaaccacu

SEQ ID NO: 1867150 - RNA, 15 nt, Human herpesvirus 3
gcgcccaccucggcc

SEQ ID NO: 1867151 - RNA, 14 nt, Human herpesvirus 3
cauuaaaguauuug

SEQ ID NO: 1867152 - RNA, 22 nt, Human herpesvirus 3
gauguuuuuaauccaauguuug

SEQ ID NO: 1867153 - RNA, 15 nt, Human herpesvirus 3
ccuucaaguuaaaua

SEQ ID NO: 1867154 - RNA, 12 nt, Human herpesvirus 3
caccgcucugcg

SEQ ID NO: 1867155 - RNA, 12 nt, Human herpesvirus 3
gucagaaacacu

SEQ ID NO: 1867156 - RNA, 21 nt, Human herpesvirus 3
aaauugggggauuugggagaa

SEQ ID NO: 1867157 - RNA, 20 nt, Human herpesvirus 3
uuuaugaaaaaagugucugu

SEQ ID NO: 1867158 - RNA, 13 nt, Human herpesvirus 3
uacauaaauacua

SEQ ID NO: 1867159 - RNA, 20 nt, Human herpesvirus 3
agacaucaccgaacauggac

SEQ ID NO: 1867160 - RNA, 21 nt, Human herpesvirus 3
ccacuggcgcgcggacuguuu

SEQ ID NO: 1867161 - RNA, 15 nt, Human herpesvirus 3
cgaauaaacgacaca

SEQ ID NO: 1867162 - RNA, 16 nt, Human herpesvirus 3
uagguucggcaaaucu

SEQ ID NO: 1867163 - RNA, 16 nt, Human herpesvirus 3
caaauaacugaacauu

SEQ ID NO: 1867164 - RNA, 13 nt, Human herpesvirus 3
ucaggucugucau

SEQ ID NO: 1867165 - RNA, 23 nt, Human herpesvirus 3
auuuuaauguaucuggaaggcau

SEQ ID NO: 1867166 - RNA, 21 nt, Human herpesvirus 3
uuauauacguagaauuuacag

SEQ ID NO: 1867167 - RNA, 16 nt, Human herpesvirus 3
ucgccaugguuucaaa

SEQ ID NO: 1867168 - RNA, 24 nt, Human herpesvirus 3
auaucuuacagauucuucaccaag

SEQ ID NO: 1867169 - RNA, 18 nt, Human herpesvirus 3
uuccacaagguacgaaaa

SEQ ID NO: 1867170 - RNA, 14 nt, Human herpesvirus 3
gaucgucaguaaau

SEQ ID NO: 1867171 - RNA, 23 nt, Human herpesvirus 3
uguucauuuuauuaucccagcac

SEQ ID NO: 1867172 - RNA, 12 nt, Human herpesvirus 3
ggaauacaggca

SEQ ID NO: 1867173 - RNA, 12 nt, Human herpesvirus 3
augacuuccaca

SEQ ID NO: 1867174 - RNA, 16 nt, Human herpesvirus 3
caagguguaaauacug

SEQ ID NO: 1867175 - RNA, 20 nt, Human herpesvirus 3
aaugggguuggggauugcau

SEQ ID NO: 1867176 - RNA, 21 nt, Human herpesvirus 3
cuggaaggccagcguaauaca

SEQ ID NO: 1867177 - RNA, 16 nt, Human herpesvirus 3
aggcauuuguguccca

SEQ ID NO: 1867178 - RNA, 16 nt, Human herpesvirus 3
cguucuaauaaaaaca

SEQ ID NO: 1867179 - RNA, 14 nt, Human herpesvirus 3
ccacauacaacaug

SEQ ID NO: 1867180 - RNA, 18 nt, Human herpesvirus 3
cuugauacccucaaacac

SEQ ID NO: 1867181 - RNA, 15 nt, Human herpesvirus 3
gaauuacuccuuuaa

SEQ ID NO: 1867182 - RNA, 16 nt, Human herpesvirus 3
cacgccgcaacaaccc

SEQ ID NO: 1867183 - RNA, 24 nt, Human herpesvirus 3
guggacaucgcugaugccagaagc

SEQ ID NO: 1867184 - RNA, 20 nt, Human herpesvirus 3
gcggccguugccgcauuaga

SEQ ID NO: 1867185 - RNA, 13 nt, Human herpesvirus 3
uacuuggacuguu

SEQ ID NO: 1867186 - RNA, 22 nt, Human herpesvirus 3
cgcguguacgaaaaccgcagcc

SEQ ID NO: 1867187 - RNA, 16 nt, Human herpesvirus 3
aucagaucaucugaca

SEQ ID NO: 1867188 - RNA, 16 nt, Human herpesvirus 3
ugcacugcaucuggag

SEQ ID NO: 1867189 - RNA, 14 nt, Human herpesvirus 3
aaacuuuacagagg

SEQ ID NO: 1867190 - RNA, 16 nt, Human herpesvirus 3
cgcuucccgaaagccc

SEQ ID NO: 1867191 - RNA, 22 nt, Human herpesvirus 3
acaugcacugcaucuggagaac

SEQ ID NO: 1867192 - RNA, 19 nt, Human herpesvirus 3
augacggcgacuuuaagaa

SEQ ID NO: 1867193 - RNA, 14 nt, Human herpesvirus 3
cugccguauuuugc

SEQ ID NO: 1867194 - RNA, 14 nt, Human herpesvirus 3
cgauaacugcgaua

SEQ ID NO: 1867195 - RNA, 14 nt, Human herpesvirus 3
cuuagaaaagccag

SEQ ID NO: 1867196 - RNA, 20 nt, Human herpesvirus 3
aaauuaacucgcguacaaau

SEQ ID NO: 1867197 - RNA, 14 nt, Human herpesvirus 3
uauuuaaauuuaca

SEQ ID NO: 1867198 - RNA, 17 nt, Human herpesvirus 3
aaauuuauaaaacacuc

SEQ ID NO: 1867199 - RNA, 20 nt, Human herpesvirus 3
auuuccacaaccagguuaaa

SEQ ID NO: 1867200 - RNA, 17 nt, Human herpesvirus 3
cccggcggaccccggga

SEQ ID NO: 1867201 - RNA, 16 nt, Human herpesvirus 3
augaccgcuauuuuca

SEQ ID NO: 1867202 - RNA, 19 nt, Human herpesvirus 3
ucguucgaauccuagaagc

SEQ ID NO: 1867203 - RNA, 13 nt, Human herpesvirus 3
gcucaaugaacag

SEQ ID NO: 1867204 - RNA, 18 nt, Human herpesvirus 3
caguugaaccaaauccac

SEQ ID NO: 1867205 - RNA, 14 nt, Human herpesvirus 3
guucaguaacuuaa

SEQ ID NO: 1867206 - RNA, 23 nt, Human herpesvirus 3
aaaagcggaacgguuuuuaugaa

SEQ ID NO: 1867207 - RNA, 18 nt, Human herpesvirus 3
cagacaagcuuauuuuua

SEQ ID NO: 1867208 - RNA, 21 nt, Human herpesvirus 3
uuugaaguguucuaaaacacu

SEQ ID NO: 1867209 - RNA, 15 nt, Human herpesvirus 3
caaagcaacgguuuc

SEQ ID NO: 1867210 - RNA, 14 nt, Human herpesvirus 3
ucagauauuuugca

SEQ ID NO: 1867211 - RNA, 22 nt, Human herpesvirus 3
gauauaaauccguaucucggag

SEQ ID NO: 1867212 - RNA, 14 nt, Human herpesvirus 3
uguucuaaaacacu

SEQ ID NO: 1867213 - RNA, 17 nt, Human herpesvirus 3
ugcgucuaucugcaggg

SEQ ID NO: 1867214 - RNA, 12 nt, Human herpesvirus 3
acggcugcugcc

SEQ ID NO: 1867215 - RNA, 19 nt, Human herpesvirus 3
uuugucuaccacuaagaac

SEQ ID NO: 1867216 - RNA, 22 nt, Human herpesvirus 3
cgcucgaugugauacaaugagc

SEQ ID NO: 1867217 - RNA, 23 nt, Human herpesvirus 3
ugcuauagccgucagaagguuca

SEQ ID NO: 1867218 - RNA, 20 nt, Human herpesvirus 3
augaaaaaagugucugucug

SEQ ID NO: 1867219 - RNA, 20 nt, Human herpesvirus 3
augcuugucaaaacauacua

SEQ ID NO: 1867220 - RNA, 18 nt, Human herpesvirus 3
uaaugcaacccugucauc

SEQ ID NO: 1867221 - RNA, 13 nt, Human herpesvirus 3
cccacccccgcag

SEQ ID NO: 1867222 - RNA, 14 nt, Human herpesvirus 3
uuaaguguauuugg

SEQ ID NO: 1867223 - RNA, 16 nt, Human herpesvirus 3
cacaauccacagauuc

SEQ ID NO: 1867224 - RNA, 15 nt, Human herpesvirus 3
ucuaaaaauaauguu

SEQ ID NO: 1867225 - RNA, 14 nt, Human herpesvirus 3
caucauacgcauuu

SEQ ID NO: 1867226 - RNA, 20 nt, Human herpesvirus 3
uacuccacggggucuacacc

SEQ ID NO: 1867227 - RNA, 15 nt, Human herpesvirus 3
gcuucccgaaagccc

SEQ ID NO: 1867228 - RNA, 23 nt, Human herpesvirus 3
acugaauuauauaccucggccgc

SEQ ID NO: 1867229 - RNA, 14 nt, Human herpesvirus 3
auaucuguuacauu

SEQ ID NO: 1867230 - RNA, 15 nt, Human herpesvirus 3
uauccucuuaacguu

SEQ ID NO: 1867231 - RNA, 23 nt, Human herpesvirus 3
ggaccggcgucaggucugucaug

SEQ ID NO: 1867232 - RNA, 15 nt, Human herpesvirus 3
uggcgcgcggacugu

SEQ ID NO: 1867233 - RNA, 16 nt, Human herpesvirus 3
ucaggguuuaacauuu

SEQ ID NO: 1867234 - RNA, 21 nt, Human herpesvirus 3
ccacuaagaacuuuauagccc

SEQ ID NO: 1867235 - RNA, 18 nt, Human herpesvirus 3
caugggccaauccgucaa

SEQ ID NO: 1867236 - RNA, 12 nt, Human herpesvirus 3
cgcgggugagug

SEQ ID NO: 1867237 - RNA, 22 nt, Human herpesvirus 3
auucuacagauuuauuuuuaca

SEQ ID NO: 1867238 - RNA, 18 nt, Human herpesvirus 3
uagcauauguucagcagc

SEQ ID NO: 1867239 - RNA, 20 nt, Human herpesvirus 3
gauucaagugagguguccug

SEQ ID NO: 1867240 - RNA, 19 nt, Human herpesvirus 3
ggcaccguagaaccgacug

SEQ ID NO: 1867241 - RNA, 18 nt, Human herpesvirus 3
uggauggccuaucuggau

SEQ ID NO: 1867242 - RNA, 22 nt, Human herpesvirus 3
uaggcggguucuucacuggacu

SEQ ID NO: 1867243 - RNA, 19 nt, Human herpesvirus 3
accaauaugccaucaauau

SEQ ID NO: 1867244 - RNA, 19 nt, Human herpesvirus 3
aagcguacgaccaaacauu

SEQ ID NO: 1867245 - RNA, 13 nt, Human herpesvirus 3
cuguacaccgcua

SEQ ID NO: 1867246 - RNA, 15 nt, Human herpesvirus 3
caauugucuguauau

SEQ ID NO: 1867247 - RNA, 17 nt, Human herpesvirus 3
uauuacauucauaaaag

SEQ ID NO: 1867248 - RNA, 23 nt, Human herpesvirus 3
acuagcuaccguuagaggcuuaa

SEQ ID NO: 1867249 - RNA, 23 nt, Human herpesvirus 3
aaauagcuguaaaaaccauggac

SEQ ID NO: 1867250 - RNA, 22 nt, Human herpesvirus 3
cccgccgucgcgcccaccucgg

SEQ ID NO: 1867251 - RNA, 12 nt, Human herpesvirus 3
auaccccaggcc

SEQ ID NO: 1867252 - RNA, 22 nt, Human herpesvirus 3
gacgcgaacaccgcugugcugu

SEQ ID NO: 1867253 - RNA, 13 nt, Human herpesvirus 3
cguauuguguaau

SEQ ID NO: 1867254 - RNA, 21 nt, Human herpesvirus 3
aucuuguccaacuguaucugu

SEQ ID NO: 1867255 - RNA, 22 nt, Human herpesvirus 3
aucccgccgucgcgcccaccuc

SEQ ID NO: 1867256 - RNA, 12 nt, Human herpesvirus 3
cugucugucugu

SEQ ID NO: 1867257 - RNA, 16 nt, Human herpesvirus 3
caucucuggaccccca

SEQ ID NO: 1867258 - RNA, 19 nt, Human herpesvirus 3
uauaucauuuuauuacauu

SEQ ID NO: 1867259 - RNA, 13 nt, Human herpesvirus 3
ugaccauuuacca

SEQ ID NO: 1867260 - RNA, 21 nt, Human herpesvirus 3
cuggcuggcgugguuauuaca

SEQ ID NO: 1867261 - RNA, 14 nt, Human herpesvirus 3
gugacagacuuugu

SEQ ID NO: 1867262 - RNA, 13 nt, Human herpesvirus 3
cauuuggacacua

SEQ ID NO: 1867263 - RNA, 14 nt, Human herpesvirus 3
cuuugcguauauga

SEQ ID NO: 1867264 - RNA, 20 nt, Human herpesvirus 3
uucaaguuaaauaacauguc

SEQ ID NO: 1867265 - RNA, 21 nt, Human herpesvirus 3
uacaaacgcgcaauguuuuga

SEQ ID NO: 1867266 - RNA, 16 nt, Human herpesvirus 3
aacaacaguaggaggu

SEQ ID NO: 1867267 - RNA, 11 nt, Human herpesvirus 3
gaauuuugcuc

SEQ ID NO: 1867268 - RNA, 23 nt, Human herpesvirus 3
ugagggugaccggcgggguccca

SEQ ID NO: 1867269 - RNA, 19 nt, Human herpesvirus 3
gucuuuuuuugaugucugu

SEQ ID NO: 1867270 - RNA, 14 nt, Human herpesvirus 3
guuccguuuggaaa

SEQ ID NO: 1867271 - RNA, 17 nt, Human herpesvirus 3
auguuuuucuaaauuac

SEQ ID NO: 1867272 - RNA, 18 nt, Human herpesvirus 3
ccauagaggugugugcac

SEQ ID NO: 1867273 - RNA, 21 nt, Human herpesvirus 3
cuuacacccccguugcuuuaa

SEQ ID NO: 1867274 - RNA, 18 nt, Human herpesvirus 3
gcaacugcaaacacgcaa

SEQ ID NO: 1867275 - RNA, 18 nt, Human herpesvirus 3
accgaacauggacugucg

SEQ ID NO: 1867276 - RNA, 13 nt, Human herpesvirus 3
acaagaaaccaug

SEQ ID NO: 1867277 - RNA, 23 nt, Human herpesvirus 3
guauauaaaauuaaaacauugcu

SEQ ID NO: 1867278 - RNA, 14 nt, Human herpesvirus 3
aacauuggcggaag

SEQ ID NO: 1867279 - RNA, 23 nt, Human herpesvirus 3
auagagguauuguuaccaggaga

SEQ ID NO: 1867280 - RNA, 22 nt, Human herpesvirus 3
aggugggguguuaaauaguuuu

SEQ ID NO: 1867281 - RNA, 19 nt, Human herpesvirus 3
ugggcaaaugaugaagcua

SEQ ID NO: 1867282 - RNA, 15 nt, Human herpesvirus 3
augcuuguaaaacau

SEQ ID NO: 1867283 - RNA, 23 nt, Human herpesvirus 3
cagacuccccccgucacacacac

SEQ ID NO: 1867284 - RNA, 20 nt, Human herpesvirus 3
cuauaaaaacauaacaccag

SEQ ID NO: 1867285 - RNA, 20 nt, Human herpesvirus 3
cuauagcugucacuguugcg

SEQ ID NO: 1867286 - RNA, 16 nt, Human herpesvirus 3
gcuguccaugaugaaa

SEQ ID NO: 1867287 - RNA, 23 nt, Human herpesvirus 3
gccaguggaccuuugcaaccugg

SEQ ID NO: 1867288 - RNA, 23 nt, Human herpesvirus 3
agcgccacuggcgcgcggacugu

SEQ ID NO: 1867289 - RNA, 13 nt, Human herpesvirus 3
cacagaacggucu

SEQ ID NO: 1867290 - RNA, 10 nt, Human herpesvirus 3
ucggaccccc

SEQ ID NO: 1867291 - RNA, 14 nt, Human herpesvirus 3
agauguguuauuau

SEQ ID NO: 1867292 - RNA, 20 nt, Human herpesvirus 3
aauaguaaauaccuauuuca

SEQ ID NO: 1867293 - RNA, 14 nt, Human herpesvirus 3
auaaaccaacuccu

SEQ ID NO: 1867294 - RNA, 19 nt, Human herpesvirus 3
cgcguuccaaauuauccaa

SEQ ID NO: 1867295 - RNA, 14 nt, Human herpesvirus 3
augucacaaaucau

SEQ ID NO: 1867296 - RNA, 17 nt, Human herpesvirus 3
ugucaucagacaugauu

SEQ ID NO: 1867297 - RNA, 19 nt, Human herpesvirus 3
uuagacguucaaaauaucu

SEQ ID NO: 1867298 - RNA, 18 nt, Human herpesvirus 3
ggaccuuugcaaccuggu

SEQ ID NO: 1867299 - RNA, 16 nt, Human herpesvirus 3
uauucucccaaaacau

SEQ ID NO: 1867300 - RNA, 17 nt, Human herpesvirus 3
uaacaauagaaucggag

SEQ ID NO: 1867301 - RNA, 20 nt, Human herpesvirus 3
aauaaaacguuuuaaaagcc

SEQ ID NO: 1867302 - RNA, 22 nt, Human herpesvirus 3
gcuucaagucucaaugaaacag

SEQ ID NO: 1867303 - RNA, 21 nt, Human herpesvirus 3
uaaucaguugggauaaauguu

SEQ ID NO: 1867304 - RNA, 18 nt, Human herpesvirus 3
gggucugccguauuuugc

SEQ ID NO: 1867305 - RNA, 16 nt, Human herpesvirus 3
ccaccucggccgcuuc

SEQ ID NO: 1867306 - RNA, 15 nt, Human herpesvirus 3
cgggcuugcuguucu

SEQ ID NO: 1867307 - RNA, 17 nt, Human herpesvirus 3
augcacugcaucuggag

SEQ ID NO: 1867308 - RNA, 21 nt, Human herpesvirus 3
auccucgcgguccguuucaua

SEQ ID NO: 1867309 - RNA, 23 nt, Human herpesvirus 3
gaaucucuucauauguaauuuua

SEQ ID NO: 1867310 - RNA, 19 nt, Human herpesvirus 3
gauggugaugaaaucagag

SEQ ID NO: 1867311 - RNA, 21 nt, Human herpesvirus 3
ugguaagguuuuauuuaaguu

SEQ ID NO: 1867312 - RNA, 21 nt, Human herpesvirus 3
uaauauuaacaggauuugcuu

SEQ ID NO: 1867313 - RNA, 20 nt, Human herpesvirus 3
uaugaucguccuucaacaca

SEQ ID NO: 1867314 - RNA, 14 nt, Human herpesvirus 3
uuuaucugaaaaga

SEQ ID NO: 1867315 - RNA, 13 nt, Human herpesvirus 3
cccggucugcuca

SEQ ID NO: 1867316 - RNA, 19 nt, Human herpesvirus 3
uuagcggugguaauucuuc

SEQ ID NO: 1867317 - RNA, 21 nt, Human herpesvirus 3
agacuuaguacgauagaauuu

SEQ ID NO: 1867318 - RNA, 17 nt, Human herpesvirus 3
caaaccguuuguuuuga

SEQ ID NO: 1867319 - RNA, 18 nt, Human herpesvirus 3
aaauguguauuauauguc

SEQ ID NO: 1867320 - RNA, 15 nt, Human herpesvirus 3
agucugaccauuuac

SEQ ID NO: 1867321 - RNA, 12 nt, Human herpesvirus 3
gacccaccccac

SEQ ID NO: 1867322 - RNA, 20 nt, Human herpesvirus 3
gaauucuuagaaaagccagc

SEQ ID NO: 1867323 - RNA, 15 nt, Human herpesvirus 3
cggcuuaacgagaga

SEQ ID NO: 1867324 - RNA, 21 nt, Human herpesvirus 3
agucaauguuuaaagacagcc

SEQ ID NO: 1867325 - RNA, 21 nt, Human herpesvirus 3
uguuuggugcacucuaccaaa

SEQ ID NO: 1867326 - RNA, 19 nt, Human herpesvirus 3
uucuacaccuuugcaugac

SEQ ID NO: 1867327 - RNA, 20 nt, Human herpesvirus 3
gaaucguugcggguacaaua

SEQ ID NO: 1867328 - RNA, 12 nt, Human herpesvirus 3
aucagaagauau

SEQ ID NO: 1867329 - RNA, 16 nt, Human herpesvirus 3
aaauucuacaacauug

SEQ ID NO: 1867330 - RNA, 19 nt, Human herpesvirus 3
gcggaacgguuuuuaugaa

SEQ ID NO: 1867331 - RNA, 12 nt, Human herpesvirus 3
aaaauuugagau

SEQ ID NO: 1867332 - RNA, 19 nt, Human herpesvirus 3
uuauaucuguuacauuucg

SEQ ID NO: 1867333 - RNA, 16 nt, Human herpesvirus 3
caaaauaaaaacauac

SEQ ID NO: 1867334 - RNA, 13 nt, Human herpesvirus 3
cgcgauauucucc

SEQ ID NO: 1867335 - RNA, 21 nt, Human herpesvirus 3
gccgagaagggggauuuacaa

SEQ ID NO: 1867336 - RNA, 16 nt, Human herpesvirus 3
aaacaggcguguuuau

SEQ ID NO: 1867337 - RNA, 23 nt, Human herpesvirus 3
acaauggcgaccacgacagcagu

SEQ ID NO: 1867338 - RNA, 18 nt, Human herpesvirus 3
cugcguuagacgccuggc

SEQ ID NO: 1867339 - RNA, 13 nt, Human herpesvirus 3
ccgguuuauauuc

SEQ ID NO: 1867340 - RNA, 22 nt, Human herpesvirus 3
cucuguucggugaguuaaacgg

SEQ ID NO: 1867341 - RNA, 17 nt, Human herpesvirus 3
auaauaugauacauaaa

SEQ ID NO: 1867342 - RNA, 19 nt, Human herpesvirus 3
caacguauccgaagccuuu

SEQ ID NO: 1867343 - RNA, 15 nt, Human herpesvirus 3
ucgugagcgccacug

SEQ ID NO: 1867344 - RNA, 14 nt, Human herpesvirus 3
gagcgccacuggcg

SEQ ID NO: 1867345 - RNA, 15 nt, Human herpesvirus 3
caacacaaagggccu

SEQ ID NO: 1867346 - RNA, 18 nt, Human herpesvirus 3
cuuuaugaauuugcuacc

SEQ ID NO: 1867347 - RNA, 14 nt, Human herpesvirus 3
uauagucaaauuca

SEQ ID NO: 1867348 - RNA, 19 nt, Human herpesvirus 3
cuccaagcucguuuuauga

SEQ ID NO: 1867349 - RNA, 21 nt, Human herpesvirus 3
cuauuucaugcuuguaaaaca

SEQ ID NO: 1867350 - RNA, 14 nt, Human herpesvirus 3
ggauccucgagcag

SEQ ID NO: 1867351 - RNA, 21 nt, Human herpesvirus 3
gaauaauuuuaaggcaaggaa

SEQ ID NO: 1867352 - RNA, 22 nt, Human herpesvirus 3
cugauacauaaacacagagucu

SEQ ID NO: 1867353 - RNA, 20 nt, Human herpesvirus 3
uaugaucauuaaacgugcau

SEQ ID NO: 1867354 - RNA, 16 nt, Human herpesvirus 3
acucuacgcauuuacg

SEQ ID NO: 1867355 - RNA, 11 nt, Human herpesvirus 3
ugugacaaauu

SEQ ID NO: 1867356 - RNA, 19 nt, Human herpesvirus 3
aauaugcuauauaacgccu

SEQ ID NO: 1867357 - RNA, 12 nt, Human herpesvirus 3
aaggaaaugccu

SEQ ID NO: 1867358 - RNA, 13 nt, Human herpesvirus 3
cauaacaccgcua

SEQ ID NO: 1867359 - RNA, 18 nt, Human herpesvirus 3
auuuucgguggaagcaau

SEQ ID NO: 1867360 - RNA, 23 nt, Human herpesvirus 3
aagaggccccaagguauuguccc

SEQ ID NO: 1867361 - RNA, 23 nt, Human herpesvirus 3
uucaugguaucaucuauugacga

SEQ ID NO: 1867362 - RNA, 19 nt, Human herpesvirus 3
cauuuucgguggaagcaau

SEQ ID NO: 1867363 - RNA, 14 nt, Human herpesvirus 3
cuuucaauauucca

SEQ ID NO: 1867364 - RNA, 18 nt, Human herpesvirus 3
uuuaugaaaaaagugucu

SEQ ID NO: 1867365 - RNA, 13 nt, Human herpesvirus 3
guaacugucccaa

SEQ ID NO: 1867366 - RNA, 14 nt, Human herpesvirus 3
aagccucuguacaa

SEQ ID NO: 1867367 - RNA, 15 nt, Human herpesvirus 3
uuaaugcaaccauca

SEQ ID NO: 1867368 - RNA, 23 nt, Human herpesvirus 3
guuacauaaauacuaagccucug

SEQ ID NO: 1867369 - RNA, 20 nt, Human herpesvirus 3
aagucgcaacgcugcugaca

SEQ ID NO: 1867370 - RNA, 17 nt, Human herpesvirus 3
guuuuacgucugcccac

SEQ ID NO: 1867371 - RNA, 20 nt, Human herpesvirus 3
auagaaucggagacucgugg

SEQ ID NO: 1867372 - RNA, 20 nt, Human herpesvirus 3
agacgaucucccguuuuuau

SEQ ID NO: 1867373 - RNA, 23 nt, Human herpesvirus 3
ggccgugugguaugaaucucugc

SEQ ID NO: 1867374 - RNA, 22 nt, Human herpesvirus 3
acguaauuugccccaaaccacu

SEQ ID NO: 1867375 - RNA, 17 nt, Human herpesvirus 3
gcgcccaccucggccgc

SEQ ID NO: 1867376 - RNA, 19 nt, Human herpesvirus 3
cauuucgaauaauuuuaag

SEQ ID NO: 1867377 - RNA, 20 nt, Human herpesvirus 3
agaccauguuuuuggagcaa

SEQ ID NO: 1867378 - RNA, 18 nt, Human herpesvirus 3
ccuugguuugcaaccuua

SEQ ID NO: 1867379 - RNA, 16 nt, Human herpesvirus 3
uggguuuuuagaauuu

SEQ ID NO: 1867380 - RNA, 16 nt, Human herpesvirus 3
cguuacgggggugugg

SEQ ID NO: 1867381 - RNA, 14 nt, Human herpesvirus 3
uggauaggucaucu

SEQ ID NO: 1867382 - RNA, 12 nt, Human herpesvirus 3
ccguucugugag

SEQ ID NO: 1867383 - RNA, 15 nt, Human herpesvirus 3
uguuggcucggucug

SEQ ID NO: 1867384 - RNA, 16 nt, Human herpesvirus 3
gaaagagcuguccaug

SEQ ID NO: 1867385 - RNA, 15 nt, Human herpesvirus 3
guguuacuuggaaac

SEQ ID NO: 1867386 - RNA, 19 nt, Human herpesvirus 3
aagucucaaugaaacagua

SEQ ID NO: 1867387 - RNA, 19 nt, Human herpesvirus 3
acgcgucaaaaagccugug

SEQ ID NO: 1867388 - RNA, 16 nt, Human herpesvirus 3
gacagucguguuuuua

SEQ ID NO: 1867389 - RNA, 17 nt, Human herpesvirus 3
cguguuuuuaauagaga

SEQ ID NO: 1867390 - RNA, 16 nt, Human herpesvirus 3
cgugagcgccacuggc

SEQ ID NO: 1867391 - RNA, 16 nt, Human herpesvirus 3
gacaaaccccacgcaa

SEQ ID NO: 1867392 - RNA, 12 nt, Human herpesvirus 3
gcucucaugaac

SEQ ID NO: 1867393 - RNA, 22 nt, Human herpesvirus 3
aaccuuuuauuuuaaggauggg

SEQ ID NO: 1867394 - RNA, 19 nt, Human herpesvirus 3
uuaugaaaaaagugucugu

SEQ ID NO: 1867395 - RNA, 22 nt, Human herpesvirus 3
aagcgauuuuaucauugaagau

SEQ ID NO: 1867396 - RNA, 14 nt, Human herpesvirus 3
ucagcgccaauaaa

SEQ ID NO: 1867397 - RNA, 19 nt, Human herpesvirus 3
cacacauuuuacaguaaac

SEQ ID NO: 1867398 - RNA, 21 nt, Human herpesvirus 3
auuaccaacuguauguaaauu

SEQ ID NO: 1867399 - RNA, 22 nt, Human herpesvirus 3
cauggugcgauuuaaccaccaa

SEQ ID NO: 1867400 - RNA, 22 nt, Human herpesvirus 3
uagauguguugcgaauguaaua

SEQ ID NO: 1867401 - RNA, 17 nt, Human herpesvirus 3
uaagcaacuacuuacaa

SEQ ID NO: 1867402 - RNA, 18 nt, Human herpesvirus 3
uauuaucgggcgacaauc

SEQ ID NO: 1867403 - RNA, 16 nt, Human herpesvirus 3
gaccguaauaugucuc

SEQ ID NO: 1867404 - RNA, 19 nt, Human herpesvirus 3
gguugcguuucccagagac

SEQ ID NO: 1867405 - RNA, 17 nt, Human herpesvirus 3
caccaauuauaacugcu

SEQ ID NO: 1867406 - RNA, 20 nt, Human herpesvirus 3
gauucaaguaaauaugugca

SEQ ID NO: 1867407 - RNA, 22 nt, Human herpesvirus 3
uugauuuuuuuaaacaaauacg

SEQ ID NO: 1867408 - RNA, 19 nt, Human herpesvirus 3
gccgcucgcugagcuccag

SEQ ID NO: 1867409 - RNA, 14 nt, Human herpesvirus 3
ccguggaccccugu

SEQ ID NO: 1867410 - RNA, 22 nt, Human herpesvirus 3
uacgacuuuuaaacgccagugg

SEQ ID NO: 1867411 - RNA, 21 nt, Human herpesvirus 3
ggacuguuuaacggaagauga

SEQ ID NO: 1867412 - RNA, 17 nt, Human herpesvirus 3
guuuccgaauaaaugug

SEQ ID NO: 1867413 - RNA, 16 nt, Human herpesvirus 3
gaugauucagacgacu

SEQ ID NO: 1867414 - RNA, 14 nt, Human herpesvirus 3
ggacauaugucugc

SEQ ID NO: 1867415 - RNA, 16 nt, Human herpesvirus 3
guaggagguccaugug

SEQ ID NO: 1867416 - RNA, 18 nt, Human herpesvirus 3
cucgugagcgccacuggc

SEQ ID NO: 1867417 - RNA, 16 nt, Human herpesvirus 3
aggaucccgugucccc

SEQ ID NO: 1867418 - RNA, 22 nt, Human herpesvirus 3
cgaacgugauuugcccacaccu

SEQ ID NO: 1867419 - RNA, 21 nt, Human herpesvirus 3
cgccgucgcgcccaccucggc

SEQ ID NO: 1867420 - RNA, 16 nt, Human herpesvirus 3
ugagguuuagcaacga

SEQ ID NO: 1867421 - RNA, 14 nt, Human herpesvirus 3
ccuugguuugcaac

SEQ ID NO: 1867422 - RNA, 17 nt, Human herpesvirus 3
cauuugcgaauucuuag

SEQ ID NO: 1867423 - RNA, 15 nt, Human herpesvirus 3
caauuauaacugcua

SEQ ID NO: 1867424 - RNA, 17 nt, Human herpesvirus 3
aaaauguuaaacccuga

SEQ ID NO: 1867425 - RNA, 19 nt, Human herpesvirus 3
ucaugcuuguaaaacauau

SEQ ID NO: 1867426 - RNA, 13 nt, Human herpesvirus 3
aucuauagcaaaa

SEQ ID NO: 1867427 - RNA, 19 nt, Human herpesvirus 3
uggagcaacguuuaagaac

SEQ ID NO: 1867428 - RNA, 22 nt, Human herpesvirus 3
ccuccuuuucucgugagcgcca

SEQ ID NO: 1867429 - RNA, 16 nt, Human herpesvirus 3
ccgcacacguuuacac

SEQ ID NO: 1867430 - RNA, 13 nt, Human herpesvirus 3
ucaugugucucca

SEQ ID NO: 1867431 - RNA, 21 nt, Human herpesvirus 3
aagauguacugugucucucaa

SEQ ID NO: 1867432 - RNA, 13 nt, Human herpesvirus 3
aaguauaacugaa

SEQ ID NO: 1867433 - RNA, 18 nt, Human herpesvirus 3
gcgaagcugccgucaaug

SEQ ID NO: 1867434 - RNA, 14 nt, Human herpesvirus 3
cugauuacauuuca

SEQ ID NO: 1867435 - RNA, 13 nt, Human herpesvirus 3
ucuuuuuguagau

SEQ ID NO: 1867436 - RNA, 19 nt, Human herpesvirus 3
uacaaucgucuuuuaaauu

SEQ ID NO: 1867437 - RNA, 21 nt, Human herpesvirus 3
cuguacgcagaaagcagucaa

SEQ ID NO: 1867438 - RNA, 20 nt, Human herpesvirus 3
caguguucuccugcaggcca

SEQ ID NO: 1867439 - RNA, 17 nt, Human herpesvirus 3
uaacgugauuacuacaa

SEQ ID NO: 1867440 - RNA, 22 nt, Human herpesvirus 3
acuagcuaccguuagaggcuua

SEQ ID NO: 1867441 - RNA, 17 nt, Human herpesvirus 3
cuccggcaucuccauca

SEQ ID NO: 1867442 - RNA, 19 nt, Human herpesvirus 3
acaaaggugccggguuuua

SEQ ID NO: 1867443 - RNA, 18 nt, Human herpesvirus 3
auuguauuguaguacagg

SEQ ID NO: 1867444 - RNA, 19 nt, Human herpesvirus 3
ucgucguuuaaagccccuc

SEQ ID NO: 1867445 - RNA, 14 nt, Human herpesvirus 3
ucuuccgugugguc

SEQ ID NO: 1867446 - RNA, 17 nt, Human herpesvirus 3
ggcgacgggcgggcugg

SEQ ID NO: 1867447 - RNA, 21 nt, Human herpesvirus 3
ucauacgccgacaugccuggc

SEQ ID NO: 1867448 - RNA, 16 nt, Human herpesvirus 3
ucuaacguugucgauc

SEQ ID NO: 1867449 - RNA, 13 nt, Human herpesvirus 3
gucgggucauuau

SEQ ID NO: 1867450 - RNA, 18 nt, Human herpesvirus 3
uucaaaauaucuuacaga

SEQ ID NO: 1867451 - RNA, 18 nt, Human herpesvirus 3
aacacggguuccguugcu

SEQ ID NO: 1867452 - RNA, 13 nt, Human herpesvirus 3
auuguauauacaa

SEQ ID NO: 1867453 - RNA, 21 nt, Human herpesvirus 3
uugaaacgucguuauauucac

SEQ ID NO: 1867454 - RNA, 18 nt, Human herpesvirus 3
auguaaaauaaacugaau

SEQ ID NO: 1867455 - RNA, 18 nt, Human herpesvirus 3
ucucgugagcgccacugg

SEQ ID NO: 1867456 - RNA, 15 nt, Human herpesvirus 3
guccggacuccagca

SEQ ID NO: 1867457 - RNA, 23 nt, Human herpesvirus 3
aacaacgcguacgugccuaggaa

SEQ ID NO: 1867458 - RNA, 13 nt, Human herpesvirus 3
auuuuauuacauu

SEQ ID NO: 1867459 - RNA, 17 nt, Human herpesvirus 3
uacaauacguaaauguc

SEQ ID NO: 1867460 - RNA, 20 nt, Human herpesvirus 3
augccuggcuuaacagugcc

SEQ ID NO: 1867461 - RNA, 19 nt, Human herpesvirus 3
ggucucuccaagcucguuu

SEQ ID NO: 1867462 - RNA, 21 nt, Human herpesvirus 3
gcgcccggcggaccccgggag

SEQ ID NO: 1867463 - RNA, 15 nt, Human herpesvirus 3
uguaaaauaaaaucu

SEQ ID NO: 1867464 - RNA, 23 nt, Human herpesvirus 3
uauuucccaacgcauaaccagcg

SEQ ID NO: 1867465 - RNA, 15 nt, Human herpesvirus 3
cuguuacauuucgaa

SEQ ID NO: 1867466 - RNA, 22 nt, Human herpesvirus 3
guccaguggacaguaacagccc

SEQ ID NO: 1867467 - RNA, 18 nt, Human herpesvirus 3
guugcuuugcguauauga

SEQ ID NO: 1867468 - RNA, 13 nt, Human herpesvirus 3
cguugaacaccau

SEQ ID NO: 1867469 - RNA, 17 nt, Human herpesvirus 3
gacgccuuucuccggga

SEQ ID NO: 1867470 - RNA, 16 nt, Human herpesvirus 3
ccggcggaccccggga

SEQ ID NO: 1867471 - RNA, 20 nt, Human herpesvirus 3
ugacaaauucccccggggcg

SEQ ID NO: 1867472 - RNA, 14 nt, Human herpesvirus 3
auuuggacacuacu

SEQ ID NO: 1867473 - RNA, 18 nt, Human herpesvirus 3
aggauaggugucuucaaa

SEQ ID NO: 1867474 - RNA, 17 nt, Human herpesvirus 3
auaaauucuacaacauu

SEQ ID NO: 1867475 - RNA, 15 nt, Human herpesvirus 3
caaaugaugaagcua

SEQ ID NO: 1867476 - RNA, 21 nt, Human herpesvirus 3
gcuuacguuugcauuuaccga

SEQ ID NO: 1867477 - RNA, 14 nt, Human herpesvirus 3
gugagcacccgggc

SEQ ID NO: 1867478 - RNA, 23 nt, Human herpesvirus 3
cuauuccgcccggauaauguccu

SEQ ID NO: 1867479 - RNA, 20 nt, Human herpesvirus 3
aacauccacagucugcuuua

SEQ ID NO: 1867480 - RNA, 13 nt, Human herpesvirus 3
guacagauuaaaa

SEQ ID NO: 1867481 - RNA, 13 nt, Human herpesvirus 3
auauauucacaac

SEQ ID NO: 1867482 - RNA, 17 nt, Human herpesvirus 3
aaaaacacaguugauuu

SEQ ID NO: 1867483 - RNA, 20 nt, Human herpesvirus 3
cgucaucgagcuucacuggu

SEQ ID NO: 1867484 - RNA, 15 nt, Human herpesvirus 3
agcaacguuuaagaa

SEQ ID NO: 1867485 - RNA, 21 nt, Human herpesvirus 3
gauuuucacaccgaugaagac

SEQ ID NO: 1867486 - RNA, 15 nt, Human herpesvirus 3
cuaacaacucuggag

SEQ ID NO: 1867487 - RNA, 18 nt, Human herpesvirus 3
uucaugcuugucaaaaca

SEQ ID NO: 1867488 - RNA, 19 nt, Human herpesvirus 3
cccgccgucgcgcccaccu

SEQ ID NO: 1867489 - RNA, 13 nt, Human herpesvirus 3
cgcuggcauuucc

SEQ ID NO: 1867490 - RNA, 22 nt, Human herpesvirus 3
ggcgcccggcggaccccgggag

SEQ ID NO: 1867491 - RNA, 23 nt, Human herpesvirus 3
cacugguggauauagcgcugucg

SEQ ID NO: 1867492 - RNA, 19 nt, Human herpesvirus 3
ggacuguuuguuguuaaua

SEQ ID NO: 1867493 - RNA, 23 nt, Human herpesvirus 3
uauuauacauaaccgauuuaccg

SEQ ID NO: 1867494 - RNA, 13 nt, Human herpesvirus 3
gcgaucgaacagg

SEQ ID NO: 1867495 - RNA, 22 nt, Human herpesvirus 3
uuauccaacuguuuacauagau

SEQ ID NO: 1867496 - RNA, 13 nt, Human herpesvirus 3
aguuaauaaaccu

SEQ ID NO: 1867497 - RNA, 16 nt, Human herpesvirus 3
cuccagcaucaucugc

SEQ ID NO: 1867498 - RNA, 21 nt, Human herpesvirus 3
ccacguaauuugccccaaacc

SEQ ID NO: 1867499 - RNA, 14 nt, Human herpesvirus 3
aaacucuguuguau

SEQ ID NO: 1867500 - RNA, 13 nt, Human herpesvirus 3
cauauuacauuaa

SEQ ID NO: 1867501 - RNA, 14 nt, Human herpesvirus 3
agaucuaacguuuu

SEQ ID NO: 1867502 - RNA, 16 nt, Human herpesvirus 3
acggcccccuggacau

SEQ ID NO: 1867503 - RNA, 19 nt, Human herpesvirus 3
aguaccacgugguauuaug

SEQ ID NO: 1867504 - RNA, 17 nt, Human herpesvirus 3
acuguuuuuuauuuaaa

SEQ ID NO: 1867505 - RNA, 16 nt, Human herpesvirus 3
cuguuuguuguuaaua

SEQ ID NO: 1867506 - RNA, 19 nt, Human herpesvirus 3
guuuuucuaaauuacagau

SEQ ID NO: 1867507 - RNA, 23 nt, Human herpesvirus 3
cgaugcguguacgcuccagaacg

SEQ ID NO: 1867508 - RNA, 21 nt, Human herpesvirus 3
auugcagucauuuuuuuuaca

SEQ ID NO: 1867509 - RNA, 22 nt, Human herpesvirus 3
auuauuaagacgaccccuguca

SEQ ID NO: 1867510 - RNA, 22 nt, Human herpesvirus 3
uuucucgugagcgccacuggcg

SEQ ID NO: 1867511 - RNA, 21 nt, Human herpesvirus 3
uacauauguuccacucuacau

SEQ ID NO: 1867512 - RNA, 13 nt, Human herpesvirus 3
aggggagcgugga

SEQ ID NO: 1867513 - RNA, 23 nt, Human herpesvirus 3
ucucuuauauauguaacguuugu

SEQ ID NO: 1867514 - RNA, 20 nt, Human herpesvirus 3
agcugccgucaaugcaacua

SEQ ID NO: 1867515 - RNA, 20 nt, Human herpesvirus 3
ccuccucgaccgcuggauga

SEQ ID NO: 1867516 - RNA, 17 nt, Human herpesvirus 3
ccagcuaaaauuuggaa

SEQ ID NO: 1867517 - RNA, 15 nt, Human herpesvirus 3
caacgucccaaagcg

SEQ ID NO: 1867518 - RNA, 18 nt, Human herpesvirus 3
ggaauuguggaguuuccc

SEQ ID NO: 1867519 - RNA, 13 nt, Human herpesvirus 3
acgggccgugugg

SEQ ID NO: 1867520 - RNA, 21 nt, Human herpesvirus 3
cccaugucacaaaucaugcgg

SEQ ID NO: 1867521 - RNA, 18 nt, Human herpesvirus 3
acuguuuguuguuaauaa

SEQ ID NO: 1867522 - RNA, 12 nt, Human herpesvirus 3
cguuuaaagccc

SEQ ID NO: 1867523 - RNA, 17 nt, Human herpesvirus 3
cgguaugccacauuuac

SEQ ID NO: 1867524 - RNA, 17 nt, Human herpesvirus 3
cucgugagcgccacugg

SEQ ID NO: 1867525 - RNA, 16 nt, Human herpesvirus 3
ccaagguuuuggauuc

SEQ ID NO: 1867526 - RNA, 18 nt, Human herpesvirus 3
ccgcgcguuugcggggcg

SEQ ID NO: 1867527 - RNA, 12 nt, Human herpesvirus 3
ggcauugcuuca

SEQ ID NO: 1867528 - RNA, 21 nt, Human herpesvirus 3
gaauguaauucgugugcaaua

SEQ ID NO: 1867529 - RNA, 23 nt, Human herpesvirus 3
ccacguaauuugccccaaaccac

SEQ ID NO: 1867530 - RNA, 14 nt, Human herpesvirus 3
gguauacacaccca

SEQ ID NO: 1867531 - RNA, 20 nt, Human herpesvirus 3
uuuacggcagucugaccauu

SEQ ID NO: 1867532 - RNA, 20 nt, Human herpesvirus 3
acgccagccagcaauguuuu

SEQ ID NO: 1867533 - RNA, 13 nt, Human herpesvirus 3
agagaccgugcgc

SEQ ID NO: 1867534 - RNA, 17 nt, Human herpesvirus 3
gucgaaccgaucgggcg

SEQ ID NO: 1867535 - RNA, 21 nt, Human herpesvirus 3
gauauaacccggucugcucau

SEQ ID NO: 1867536 - RNA, 15 nt, Human herpesvirus 3
aaaguuugaacauga

SEQ ID NO: 1867537 - RNA, 14 nt, Human herpesvirus 3
cuggucggaccccc

SEQ ID NO: 1867538 - RNA, 22 nt, Human herpesvirus 3
uauaauaaaaagucacuauaaa

SEQ ID NO: 1867539 - RNA, 19 nt, Human herpesvirus 3
gaagcugacgaagagaacu

SEQ ID NO: 1867540 - RNA, 15 nt, Human herpesvirus 3
ugugcgggcgggcga

SEQ ID NO: 1867541 - RNA, 16 nt, Human herpesvirus 3
agcuguccaugaugaa

SEQ ID NO: 1867542 - RNA, 13 nt, Human herpesvirus 3
aucugguaaaugu

SEQ ID NO: 1867543 - RNA, 21 nt, Human herpesvirus 3
gaagcugacgaagagaacugu

SEQ ID NO: 1867544 - RNA, 21 nt, Human herpesvirus 3
ccugcaagcgguuuagcauuu

SEQ ID NO: 1867545 - RNA, 18 nt, Human herpesvirus 3
acuugacgcgaacaccgc

SEQ ID NO: 1867546 - RNA, 16 nt, Human herpesvirus 3
aaacagguagccagcc

SEQ ID NO: 1867547 - RNA, 16 nt, Human herpesvirus 3
uacagaagacaucacc

SEQ ID NO: 1867548 - RNA, 11 nt, Human herpesvirus 3
uauccaauggg

SEQ ID NO: 1867549 - RNA, 18 nt, Human herpesvirus 3
caacguauucgguuggug

SEQ ID NO: 1867550 - RNA, 17 nt, Human herpesvirus 3
aucccgccgacagcgga

SEQ ID NO: 1867551 - RNA, 17 nt, Human herpesvirus 3
uaaacagagaucucugu

SEQ ID NO: 1867552 - RNA, 14 nt, Human herpesvirus 3
aaaacguuguguuu

SEQ ID NO: 1867553 - RNA, 12 nt, Human herpesvirus 3
gcucacagagcu

SEQ ID NO: 1867554 - RNA, 13 nt, Human herpesvirus 3
aggacgaagggga

SEQ ID NO: 1867555 - RNA, 19 nt, Human herpesvirus 3
uaugcgcauggaauuaaug

SEQ ID NO: 1867556 - RNA, 12 nt, Human herpesvirus 3
ccguuaaggcaa

SEQ ID NO: 1867557 - RNA, 13 nt, Human herpesvirus 3
uaagguguuaaua

SEQ ID NO: 1867558 - RNA, 12 nt, Human herpesvirus 3
cgcgccaaacau

SEQ ID NO: 1867559 - RNA, 11 nt, Human herpesvirus 3
cuuuuuaugca

SEQ ID NO: 1867560 - RNA, 22 nt, Human herpesvirus 3
caaacacacagacgcguaaaau

SEQ ID NO: 1867561 - RNA, 21 nt, Human herpesvirus 3
gccgucgcgcccaccucggcc

SEQ ID NO: 1867562 - RNA, 20 nt, Human herpesvirus 3
cuaacaaugcacugaaccac

SEQ ID NO: 1867563 - RNA, 19 nt, Human herpesvirus 3
ggguaaaacacacaccaga

SEQ ID NO: 1867564 - RNA, 22 nt, Human herpesvirus 3
uguaagacccgucgguaaauga

SEQ ID NO: 1867565 - RNA, 18 nt, Human herpesvirus 3
cacuaaaaucacuuugau

SEQ ID NO: 1867566 - RNA, 16 nt, Human herpesvirus 3
uauuauaaauguguau

SEQ ID NO: 1867567 - RNA, 18 nt, Human herpesvirus 3
uaucuguuacauuucgaa

SEQ ID NO: 1867568 - RNA, 17 nt, Human herpesvirus 3
uuccacccccucuuaaa

SEQ ID NO: 1867569 - RNA, 21 nt, Human herpesvirus 3
ugaaucguugcggguacaaua

SEQ ID NO: 1867570 - RNA, 23 nt, Human herpesvirus 3
uuuauuacauucgcaacacaucu

SEQ ID NO: 1867571 - RNA, 17 nt, Human herpesvirus 3
gcgcguguaugcacaac

SEQ ID NO: 1867572 - RNA, 16 nt, Human herpesvirus 3
aucccacauguauaaa

SEQ ID NO: 1867573 - RNA, 17 nt, Human herpesvirus 3
uguugagucauuuucau

SEQ ID NO: 1867574 - RNA, 18 nt, Human herpesvirus 3
cuacugcugcaagcccuc

SEQ ID NO: 1867575 - RNA, 14 nt, Human herpesvirus 3
cgaaaagacugugu

SEQ ID NO: 1867576 - RNA, 20 nt, Human herpesvirus 3
cuguaucgcuaucagauucc

SEQ ID NO: 1867577 - RNA, 20 nt, Human herpesvirus 3
aaaacacgggaucauuuucu

SEQ ID NO: 1867578 - RNA, 19 nt, Human herpesvirus 3
auaucucauacucaugccu

SEQ ID NO: 1867579 - RNA, 18 nt, Human herpesvirus 3
agucuaguuacauuucac

SEQ ID NO: 1867580 - RNA, 14 nt, Human herpesvirus 3
cacgcgggugagug

SEQ ID NO: 1867581 - RNA, 18 nt, Human herpesvirus 3
agaguguuuaacaaccau

SEQ ID NO: 1867582 - RNA, 19 nt, Human herpesvirus 3
acgacucguuggguuacau

SEQ ID NO: 1867583 - RNA, 15 nt, Human herpesvirus 3
aagguccauuuaaca

SEQ ID NO: 1867584 - RNA, 14 nt, Human herpesvirus 3
cgcccaccucggcc

SEQ ID NO: 1867585 - RNA, 15 nt, Human herpesvirus 3
agaugagaaaaauaa

SEQ ID NO: 1867586 - RNA, 18 nt, Human herpesvirus 3
gacaucguuuguuucuuu

SEQ ID NO: 1867587 - RNA, 22 nt, Human herpesvirus 3
uuaugaaaaaagugucugucug

SEQ ID NO: 1867588 - RNA, 20 nt, Human herpesvirus 3
acguauuuuuauuuaaaugu

SEQ ID NO: 1867589 - RNA, 16 nt, Human herpesvirus 3
uuucucuaacgcaauu

SEQ ID NO: 1867590 - RNA, 15 nt, Human herpesvirus 3
cugcuuuauuaccaa

SEQ ID NO: 1867591 - RNA, 19 nt, Human herpesvirus 3
cccuggagacggcugcugc

SEQ ID NO: 1867592 - RNA, 14 nt, Human herpesvirus 3
uaucaauuguuuau

SEQ ID NO: 1867593 - RNA, 15 nt, Human herpesvirus 3
uggugaagaaggaca

SEQ ID NO: 1867594 - RNA, 13 nt, Human herpesvirus 3
aauaaaaaacagu

SEQ ID NO: 1867595 - RNA, 14 nt, Human herpesvirus 3
aagguguaaauacu

SEQ ID NO: 1867596 - RNA, 14 nt, Human herpesvirus 3
uugcgucuguuuug

SEQ ID NO: 1867597 - RNA, 13 nt, Human herpesvirus 3
agucauuuucaua

SEQ ID NO: 1867598 - RNA, 14 nt, Human herpesvirus 3
acgccgagcgugua

SEQ ID NO: 1867599 - RNA, 14 nt, Human herpesvirus 3
acgggcgggcuggu

SEQ ID NO: 1867600 - RNA, 16 nt, Human herpesvirus 3
cgcuacccgaaagccc

SEQ ID NO: 1867601 - RNA, 18 nt, Human herpesvirus 3
cguagauuccgaguccuc

SEQ ID NO: 1867602 - RNA, 15 nt, Human herpesvirus 3
gguggucagacgaac

SEQ ID NO: 1867603 - RNA, 19 nt, Human herpesvirus 3
cuugacgcgaacaccgcug

SEQ ID NO: 1867604 - RNA, 15 nt, Human herpesvirus 3
cgccgucgcgcccac

SEQ ID NO: 1867605 - RNA, 13 nt, Human herpesvirus 3
ugggucagacagu

SEQ ID NO: 1867606 - RNA, 12 nt, Human herpesvirus 3
ugguaagguuuu

SEQ ID NO: 1867607 - RNA, 19 nt, Human herpesvirus 3
caacgccgagcguguaaau

SEQ ID NO: 1867608 - RNA, 20 nt, Human herpesvirus 3
gccggacuuuacugcacacg

SEQ ID NO: 1867609 - RNA, 23 nt, Human herpesvirus 3
acacuuggcguguuaaacacugu

SEQ ID NO: 1867610 - RNA, 16 nt, Human herpesvirus 3
cuuacguuugcauuua

SEQ ID NO: 1867611 - RNA, 16 nt, Human herpesvirus 3
uguuuaagaacaucuu

SEQ ID NO: 1867612 - RNA, 16 nt, Human herpesvirus 3
cggugagcacccgggc

SEQ ID NO: 1867613 - RNA, 18 nt, Human herpesvirus 3
cucuggagucuccaaaug

SEQ ID NO: 1867614 - RNA, 12 nt, Human herpesvirus 3
cgcgcaccaggc

SEQ ID NO: 1867615 - RNA, 21 nt, Human herpesvirus 3
ugggguucggaauuaucacgg

SEQ ID NO: 1867616 - RNA, 14 nt, Human herpesvirus 3
aacaguuauguuuu

SEQ ID NO: 1867617 - RNA, 13 nt, Human herpesvirus 3
cacuacugacagc

SEQ ID NO: 1867618 - RNA, 18 nt, Human herpesvirus 3
uccgccuauagcugucac

SEQ ID NO: 1867619 - RNA, 16 nt, Human herpesvirus 3
caguaagggugagaau

SEQ ID NO: 1867620 - RNA, 21 nt, Human herpesvirus 3
acacucgauuucaacggcuuc

SEQ ID NO: 1867621 - RNA, 21 nt, Human herpesvirus 3
acuacauuggggguacaguug

SEQ ID NO: 1867622 - RNA, 12 nt, Human herpesvirus 3
guuaauaaaagc

SEQ ID NO: 1867623 - RNA, 22 nt, Human herpesvirus 3
gacguccacacagccucaggag

SEQ ID NO: 1867624 - RNA, 22 nt, Human herpesvirus 3
cacauuugggcggggauguuuu

SEQ ID NO: 1867625 - RNA, 22 nt, Human herpesvirus 3
uauaaaccgauuaugucaacau

SEQ ID NO: 1867626 - RNA, 18 nt, Human herpesvirus 3
cuugagaugagcagcgca

SEQ ID NO: 1867627 - RNA, 14 nt, Human herpesvirus 3
cagacgugucuacu

SEQ ID NO: 1867628 - RNA, 21 nt, Human herpesvirus 3
agaaacguuuuuaguuuuuau

SEQ ID NO: 1867629 - RNA, 15 nt, Human herpesvirus 3
cccugucaucagaca

SEQ ID NO: 1867630 - RNA, 23 nt, Human herpesvirus 3
caaaggcauuacccgauauugua

SEQ ID NO: 1867631 - RNA, 18 nt, Human herpesvirus 3
uugagaaaaccaaagacg

SEQ ID NO: 1867632 - RNA, 13 nt, Human herpesvirus 3
aauccaauguuug

SEQ ID NO: 1867633 - RNA, 18 nt, Human herpesvirus 3
uuuaacggaagaugaacu

SEQ ID NO: 1867634 - RNA, 23 nt, Human herpesvirus 3
aguuuagugucguuuccaaauaa

SEQ ID NO: 1867635 - RNA, 13 nt, Human herpesvirus 3
ugcagguuuuacu

SEQ ID NO: 1867636 - RNA, 16 nt, Human herpesvirus 3
uauguuuuuauuuugu

SEQ ID NO: 1867637 - RNA, 18 nt, Human herpesvirus 3
uauaacugcuacaacgga

SEQ ID NO: 1867638 - RNA, 22 nt, Human herpesvirus 3
cugcugaagcugacgaagagaa

SEQ ID NO: 1867639 - RNA, 22 nt, Human herpesvirus 3
augugauacaaugagcgguggu

SEQ ID NO: 1867640 - RNA, 20 nt, Human herpesvirus 3
ccacguuuuacgucugccca

SEQ ID NO: 1867641 - RNA, 15 nt, Human herpesvirus 3
ggcgaggacuccaca

SEQ ID NO: 1867642 - RNA, 14 nt, Human herpesvirus 3
uucuacaccuuugc

SEQ ID NO: 1867643 - RNA, 16 nt, Human herpesvirus 3
ccccuccuuuucucgu

SEQ ID NO: 1867644 - RNA, 19 nt, Human herpesvirus 3
aaagccgguacacagcauu

SEQ ID NO: 1867645 - RNA, 14 nt, Human herpesvirus 3
cagcgccaauaaaa

SEQ ID NO: 1867646 - RNA, 12 nt, Human herpesvirus 3
ccugaugauggu

SEQ ID NO: 1867647 - RNA, 18 nt, Human herpesvirus 3
cgacaucguuuguuucuu

SEQ ID NO: 1867648 - RNA, 21 nt, Human herpesvirus 3
acgacauacauuagaguguuu

SEQ ID NO: 1867649 - RNA, 24 nt, Human herpesvirus 3
gcgcucaaucaauccaaggaugug

SEQ ID NO: 1867650 - RNA, 15 nt, Human herpesvirus 3
auaucauaaauauua

SEQ ID NO: 1867651 - RNA, 22 nt, Human herpesvirus 3
gauuauauacguagaauuuaca

SEQ ID NO: 1867652 - RNA, 14 nt, Human herpesvirus 3
ggaugauauuuuaa

SEQ ID NO: 1867653 - RNA, 21 nt, Human herpesvirus 3
guuacuacauggaguguguua

SEQ ID NO: 1867654 - RNA, 17 nt, Human herpesvirus 3
ccuggcuuaacagugcc

SEQ ID NO: 1867655 - RNA, 13 nt, Human herpesvirus 3
ggcgcccggcgga

SEQ ID NO: 1867656 - RNA, 22 nt, Human herpesvirus 3
uuaaucccgccuuuaucucccu

SEQ ID NO: 1867657 - RNA, 21 nt, Human herpesvirus 3
gggguacuugcaccacaccau

SEQ ID NO: 1867658 - RNA, 19 nt, Human herpesvirus 3
aaguaugcagucgggucau

SEQ ID NO: 1867659 - RNA, 13 nt, Human herpesvirus 3
gacccccccccga

SEQ ID NO: 1867660 - RNA, 19 nt, Human herpesvirus 3
ccguuuccacccccucuua

SEQ ID NO: 1867661 - RNA, 17 nt, Human herpesvirus 3
caacuggaaaugugcug

SEQ ID NO: 1867662 - RNA, 22 nt, Human herpesvirus 3
uccccuccuuuucucgugagcg

SEQ ID NO: 1867663 - RNA, 17 nt, Human herpesvirus 3
uaaaacaaguggaugau

SEQ ID NO: 1867664 - RNA, 19 nt, Human herpesvirus 3
cugauucggguaaaacaca

SEQ ID NO: 1867665 - RNA, 14 nt, Human herpesvirus 3
aacacugucagaaa

SEQ ID NO: 1867666 - RNA, 23 nt, Human herpesvirus 3
ccgcuagacuguuuuucugcuca

SEQ ID NO: 1867667 - RNA, 21 nt, Human herpesvirus 3
gccgguacaauuaccccgcga

SEQ ID NO: 1867668 - RNA, 19 nt, Human herpesvirus 3
caugaucgcccaauagcac

SEQ ID NO: 1867669 - RNA, 15 nt, Human herpesvirus 3
uacaccgcuacgggu

SEQ ID NO: 1867670 - RNA, 15 nt, Human herpesvirus 3
ccauccgccgcagcu

SEQ ID NO: 1867671 - RNA, 19 nt, Human herpesvirus 3
cuccucgaccgcuggauga

SEQ ID NO: 1867672 - RNA, 21 nt, Human herpesvirus 3
gacugcguuauuuaaaggucu

SEQ ID NO: 1867673 - RNA, 11 nt, Human herpesvirus 3
cggucauauaa

SEQ ID NO: 1867674 - RNA, 18 nt, Human herpesvirus 3
aucguaguaaaacggaac

SEQ ID NO: 1867675 - RNA, 11 nt, Human herpesvirus 3
ccguugccgca

SEQ ID NO: 1867676 - RNA, 16 nt, Human herpesvirus 3
uaaauaacauaaccaa

SEQ ID NO: 1867677 - RNA, 18 nt, Human herpesvirus 3
aaacuguuuaaauaguac

SEQ ID NO: 1867678 - RNA, 21 nt, Human herpesvirus 3
cugccuuuggggguuaagcua

SEQ ID NO: 1867679 - RNA, 22 nt, Human herpesvirus 3
agccgccagauguacacccagc

SEQ ID NO: 1867680 - RNA, 22 nt, Human herpesvirus 3
uggaaacacccauacauauguu

SEQ ID NO: 1867681 - RNA, 13 nt, Human herpesvirus 3
ggcgauggccguc

SEQ ID NO: 1867682 - RNA, 14 nt, Human herpesvirus 3
cccaauagccgcca

SEQ ID NO: 1867683 - RNA, 15 nt, Human herpesvirus 3
uguauuaaaucgacu

SEQ ID NO: 1867684 - RNA, 23 nt, Human herpesvirus 3
cuguaagacccgucgguaaauga

SEQ ID NO: 1867685 - RNA, 21 nt, Human herpesvirus 3
guauugcguaccgcgacccug

SEQ ID NO: 1867686 - RNA, 18 nt, Human herpesvirus 3
aaauacgguucaaaggca

SEQ ID NO: 1867687 - RNA, 22 nt, Human herpesvirus 3
cccagcuguccggacuccagca

SEQ ID NO: 1867688 - RNA, 14 nt, Human herpesvirus 3
aaauaaacugaauu

SEQ ID NO: 1867689 - RNA, 22 nt, Human herpesvirus 3
cuggcgugguuauuacauuuaa

SEQ ID NO: 1867690 - RNA, 22 nt, Human herpesvirus 3
acucacguuuguguugugacuu

SEQ ID NO: 1867691 - RNA, 22 nt, Human herpesvirus 3
gaaaauaacccccccccgguuu

SEQ ID NO: 1867692 - RNA, 14 nt, Human herpesvirus 3
cguguauacaauua

SEQ ID NO: 1867693 - RNA, 15 nt, Human herpesvirus 3
uuaccuuauguguua

SEQ ID NO: 1867694 - RNA, 22 nt, Human herpesvirus 3
uagacguucaaaauaucuuaca

SEQ ID NO: 1867695 - RNA, 15 nt, Human herpesvirus 3
uggauucccuggaga

SEQ ID NO: 1867696 - RNA, 15 nt, Human herpesvirus 3
auuugcauuuucagu

SEQ ID NO: 1867697 - RNA, 15 nt, Human herpesvirus 3
caauuguuuauguga

SEQ ID NO: 1867698 - RNA, 22 nt, Human herpesvirus 3
aaaacacugucagaaacacuug

SEQ ID NO: 1867699 - RNA, 15 nt, Human herpesvirus 3
cuaaaaacguuucug

SEQ ID NO: 1867700 - RNA, 22 nt, Human herpesvirus 3
ucggacccccccccgaaaauaa

SEQ ID NO: 1867701 - RNA, 14 nt, Human herpesvirus 3
cucgugagcgccac

SEQ ID NO: 1867702 - RNA, 14 nt, Human herpesvirus 3
auacuaauuuguau

SEQ ID NO: 1867703 - RNA, 18 nt, Human herpesvirus 3
ugucuacgugguaccaaa

SEQ ID NO: 1867704 - RNA, 23 nt, Human herpesvirus 3
cacugcauuuacaucuuguccaa

SEQ ID NO: 1867705 - RNA, 22 nt, Human herpesvirus 3
caaccaauugguauacacaccc

SEQ ID NO: 1867706 - RNA, 19 nt, Human herpesvirus 3
aauaccuuuuucaugcuug

SEQ ID NO: 1867707 - RNA, 11 nt, Human herpesvirus 3
cagauauuguc

SEQ ID NO: 1867708 - RNA, 18 nt, Human herpesvirus 3
cgugguaccaaaaacaca

SEQ ID NO: 1867709 - RNA, 15 nt, Human herpesvirus 3
uauuaccaacuguau

SEQ ID NO: 1867710 - RNA, 17 nt, Human herpesvirus 3
caacugauuacauuuca

SEQ ID NO: 1867711 - RNA, 23 nt, Human herpesvirus 3
uuguguuuauaacguauaacccg

SEQ ID NO: 1867712 - RNA, 16 nt, Human herpesvirus 3
gcgagcgcgugaggga

SEQ ID NO: 1867713 - RNA, 15 nt, Human herpesvirus 3
cauaguccgccgaca

SEQ ID NO: 1867714 - RNA, 12 nt, Human herpesvirus 3
ccacuuauccaa

SEQ ID NO: 1867715 - RNA, 15 nt, Human herpesvirus 3
cgugguaagugcggc

SEQ ID NO: 1867716 - RNA, 19 nt, Human herpesvirus 3
caggcuguacguaaccaua

SEQ ID NO: 1867717 - RNA, 19 nt, Human herpesvirus 3
caauaaaauggauauaauu

SEQ ID NO: 1867718 - RNA, 14 nt, Human herpesvirus 3
agcaacguuuaaga

SEQ ID NO: 1867719 - RNA, 11 nt, Human herpesvirus 3
uuucugggcgc

SEQ ID NO: 1867720 - RNA, 12 nt, Human herpesvirus 3
aaccgagggugg

SEQ ID NO: 1867721 - RNA, 14 nt, Human herpesvirus 3
gagacguauguucu

SEQ ID NO: 1867722 - RNA, 17 nt, Human herpesvirus 3
aagcuauuaaugguaca

SEQ ID NO: 1867723 - RNA, 14 nt, Human herpesvirus 3
aagauguuuccaca

SEQ ID NO: 1867724 - RNA, 13 nt, Human herpesvirus 3
uccagaguacagg

SEQ ID NO: 1867725 - RNA, 17 nt, Human herpesvirus 3
ucuuucccgaagguuuu

SEQ ID NO: 1867726 - RNA, 21 nt, Human herpesvirus 3
aaagguuuauuccggagccua

SEQ ID NO: 1867727 - RNA, 22 nt, Human herpesvirus 3
cacuuuaauuccucuaaacgug

SEQ ID NO: 1867728 - RNA, 16 nt, Human herpesvirus 3
ccaaacacgccuuuua

SEQ ID NO: 1867729 - RNA, 19 nt, Human herpesvirus 3
cucgaacccccgugacucc

SEQ ID NO: 1867730 - RNA, 17 nt, Human herpesvirus 3
auauuaauaaaagacua

SEQ ID NO: 1867731 - RNA, 16 nt, Human herpesvirus 3
uucuacgagaauauuc

SEQ ID NO: 1867732 - RNA, 19 nt, Human herpesvirus 3
gaaaauagcguugaugcaa

SEQ ID NO: 1867733 - RNA, 21 nt, Human herpesvirus 3
cugcuaaccauagacuguucu

SEQ ID NO: 1867734 - RNA, 14 nt, Human herpesvirus 3
auaacgcuguuguu

SEQ ID NO: 1867735 - RNA, 11 nt, Human herpesvirus 3
aaacacgcaug

SEQ ID NO: 1867736 - RNA, 12 nt, Human herpesvirus 3
cacgugaggaaa

SEQ ID NO: 1867737 - RNA, 19 nt, Human herpesvirus 3
aaguguucuaaaacacugu

SEQ ID NO: 1867738 - RNA, 22 nt, Human herpesvirus 3
uccgggaucguggccuugggac

SEQ ID NO: 1867739 - RNA, 14 nt, Human herpesvirus 3
auacguaaauguca

SEQ ID NO: 1867740 - RNA, 22 nt, Human herpesvirus 3
uaugguauaccgcucguguaaa

SEQ ID NO: 1867741 - RNA, 20 nt, Human herpesvirus 3
ugaguugcggcgcugaaggg

SEQ ID NO: 1867742 - RNA, 21 nt, Human herpesvirus 3
ucaugcuugucaaaacauacu

SEQ ID NO: 1867743 - RNA, 15 nt, Human herpesvirus 3
uaaagguuaaauuua

SEQ ID NO: 1867744 - RNA, 15 nt, Human herpesvirus 3
gauauaauuugucca

SEQ ID NO: 1867745 - RNA, 23 nt, Human herpesvirus 3
ggccaagguuuuggauucccugg

SEQ ID NO: 1867746 - RNA, 16 nt, Human herpesvirus 3
cuuuaucugaaaagac

SEQ ID NO: 1867747 - RNA, 22 nt, Human herpesvirus 3
auuauuagcguaauauaacaga

SEQ ID NO: 1867748 - RNA, 14 nt, Human herpesvirus 3
auuuaggaggcugc

SEQ ID NO: 1867749 - RNA, 18 nt, Human herpesvirus 3
uccauaucgcaauguuuu

SEQ ID NO: 1867750 - RNA, 17 nt, Human herpesvirus 3
gucugucugucugugcg

SEQ ID NO: 1867751 - RNA, 15 nt, Human herpesvirus 3
ugugggaggucuaca

SEQ ID NO: 1867752 - RNA, 16 nt, Human herpesvirus 3
uuuagacguucaaaau

SEQ ID NO: 1867753 - RNA, 20 nt, Human herpesvirus 3
ggacuaggcacuuuggcggu

SEQ ID NO: 1867754 - RNA, 12 nt, Human herpesvirus 3
ucauaacaccgc

SEQ ID NO: 1867755 - RNA, 15 nt, Human herpesvirus 3
uaaggggggggcgcg

SEQ ID NO: 1867756 - RNA, 21 nt, Human herpesvirus 3
gcacaucauccguccaaacag

SEQ ID NO: 1867757 - RNA, 19 nt, Human herpesvirus 3
aauaaaacguuuuaaaagc

SEQ ID NO: 1867758 - RNA, 12 nt, Human herpesvirus 3
ugaaaaaagugu

SEQ ID NO: 1867759 - RNA, 18 nt, Human herpesvirus 3
uacacauuuaaauaaaaa

SEQ ID NO: 1867760 - RNA, 21 nt, Human herpesvirus 3
uuucagcaaguuuaacauuuc

SEQ ID NO: 1867761 - RNA, 17 nt, Human herpesvirus 3
ugacuuugaugagaaug

SEQ ID NO: 1867762 - RNA, 20 nt, Human herpesvirus 3
ccacacaacgccgcccacga

SEQ ID NO: 1867763 - RNA, 12 nt, Human herpesvirus 3
guuucugggcgc

SEQ ID NO: 1867764 - RNA, 17 nt, Human herpesvirus 3
ugaucugguaaauguua

SEQ ID NO: 1867765 - RNA, 18 nt, Human herpesvirus 3
cccacgguuugugcacug

SEQ ID NO: 1867766 - RNA, 23 nt, Human herpesvirus 3
cagacaguggcggauaacugccu

SEQ ID NO: 1867767 - RNA, 19 nt, Human herpesvirus 3
gacaucaaccaguggaaua

SEQ ID NO: 1867768 - RNA, 19 nt, Human herpesvirus 3
gaacauccuaguacagaua

SEQ ID NO: 1867769 - RNA, 16 nt, Human herpesvirus 3
acgccgcaacaaccca

SEQ ID NO: 1867770 - RNA, 13 nt, Human herpesvirus 3
guuucccagagac

SEQ ID NO: 1867771 - RNA, 16 nt, Human herpesvirus 3
auaaaccaacuccugu

SEQ ID NO: 1867772 - RNA, 17 nt, Human herpesvirus 3
gcccggcggaccccggg

SEQ ID NO: 1867773 - RNA, 17 nt, Human herpesvirus 3
aauaacgccuuaaaagu

SEQ ID NO: 1867774 - RNA, 13 nt, Human herpesvirus 3
guguuaaacacug

SEQ ID NO: 1867775 - RNA, 15 nt, Human herpesvirus 3
gaaauacuaauauaa

SEQ ID NO: 1867776 - RNA, 15 nt, Human herpesvirus 3
gugagcgccacuggc

SEQ ID NO: 1867777 - RNA, 21 nt, Human herpesvirus 3
ccagaguacaggguaucuaag

SEQ ID NO: 1867778 - RNA, 14 nt, Human herpesvirus 3
gcagauacagcaua

SEQ ID NO: 1867779 - RNA, 22 nt, Human herpesvirus 3
agacacgcuacagaagacauca

SEQ ID NO: 1867780 - RNA, 23 nt, Human herpesvirus 3
uauguggggugcuuguuguauuu

SEQ ID NO: 1867781 - RNA, 21 nt, Human herpesvirus 3
caugacuuccacacucuucaa

SEQ ID NO: 1867782 - RNA, 16 nt, Human herpesvirus 3
uaugccacauuuaccg

SEQ ID NO: 1867783 - RNA, 12 nt, Human herpesvirus 3
auuuucauagac

SEQ ID NO: 1867784 - RNA, 13 nt, Human herpesvirus 3
gguucggugauca

SEQ ID NO: 1867785 - RNA, 23 nt, Human herpesvirus 3
ucaauaugucacggagaacguau

SEQ ID NO: 1867786 - RNA, 20 nt, Human herpesvirus 3
cauaucaauuuauauuuuua

SEQ ID NO: 1867787 - RNA, 17 nt, Human herpesvirus 3
gagcugguauacacgag

SEQ ID NO: 1867788 - RNA, 19 nt, Human herpesvirus 3
acaaauuucugauguuccc

SEQ ID NO: 1867789 - RNA, 21 nt, Human herpesvirus 3
aucagcgccaauaaaagcaga

SEQ ID NO: 1867790 - RNA, 21 nt, Human herpesvirus 3
aaauucaucugccguuucauu

SEQ ID NO: 1867791 - RNA, 22 nt, Human herpesvirus 3
auuguggauccggcaugcauug

SEQ ID NO: 1867792 - RNA, 15 nt, Human herpesvirus 3
gcugcaagcccuccg

SEQ ID NO: 1867793 - RNA, 21 nt, Human herpesvirus 3
cugugcgggcgggcgacgggc

SEQ ID NO: 1867794 - RNA, 15 nt, Human herpesvirus 3
aagcuauacacaagu

SEQ ID NO: 1867795 - RNA, 18 nt, Human herpesvirus 3
acuuguaaacccccaagc

SEQ ID NO: 1867796 - RNA, 13 nt, Human herpesvirus 3
gucgcgcccaccu

SEQ ID NO: 1867797 - RNA, 22 nt, Human herpesvirus 3
cuuuuaaacgccaguggaccuu

SEQ ID NO: 1867798 - RNA, 16 nt, Human herpesvirus 3
gaauaaacgacacaaa

SEQ ID NO: 1867799 - RNA, 19 nt, Human herpesvirus 3
acacgcgggugaguguacg

SEQ ID NO: 1867800 - RNA, 19 nt, Human herpesvirus 3
gccagugaaauaugacggc

SEQ ID NO: 1867801 - RNA, 15 nt, Human herpesvirus 3
gacaauuaacacaga

SEQ ID NO: 1867802 - RNA, 16 nt, Human herpesvirus 3
augcuugucaaaacau

SEQ ID NO: 1867803 - RNA, 13 nt, Human herpesvirus 3
ggucaucccggga

SEQ ID NO: 1867804 - RNA, 18 nt, Human herpesvirus 3
ugaaccggaaccuacaac

SEQ ID NO: 1867805 - RNA, 17 nt, Human herpesvirus 3
gaauccggucagagcau

SEQ ID NO: 1867806 - RNA, 22 nt, Human herpesvirus 3
aaauaacgccuuaaaaguuaca

SEQ ID NO: 1867807 - RNA, 21 nt, Human herpesvirus 3
cgaucucugguauacuuggca

SEQ ID NO: 1867808 - RNA, 13 nt, Human herpesvirus 3
ugacuuugaagac

SEQ ID NO: 1867809 - RNA, 18 nt, Human herpesvirus 3
acaucgugcuugaauugc

SEQ ID NO: 1867810 - RNA, 20 nt, Human herpesvirus 3
auaauuuguccauaucgcaa

SEQ ID NO: 1867811 - RNA, 17 nt, Human herpesvirus 3
gacuguuuguuguuaau

SEQ ID NO: 1867812 - RNA, 20 nt, Human herpesvirus 3
guuaucuuuauuuggaaugc

SEQ ID NO: 1867813 - RNA, 16 nt, Human herpesvirus 3
aaacgcgccaaacauu

SEQ ID NO: 1867814 - RNA, 18 nt, Human herpesvirus 3
aguuagcauccaaauuaa

SEQ ID NO: 1867815 - RNA, 23 nt, Human herpesvirus 3
caggucaaaacgcugacccaccc

SEQ ID NO: 1867816 - RNA, 16 nt, Human herpesvirus 3
uauauuuuuaaucauu

SEQ ID NO: 1867817 - RNA, 14 nt, Human herpesvirus 3
aucguuuaacaaaa

SEQ ID NO: 1867818 - RNA, 13 nt, Human herpesvirus 3
augccagaagcau

SEQ ID NO: 1867819 - RNA, 22 nt, Human herpesvirus 3
cguuauagcaggggucuccaga

SEQ ID NO: 1867820 - RNA, 22 nt, Human herpesvirus 3
cuaggcacuuuggcggucauuu

SEQ ID NO: 1867821 - RNA, 20 nt, Human herpesvirus 3
acaaucgcccgaaaacuuug

SEQ ID NO: 1867822 - RNA, 22 nt, Human herpesvirus 3
agaguuuucuccaaaagaacaa

SEQ ID NO: 1867823 - RNA, 19 nt, Human herpesvirus 3
gucugugcgggcgggcgac

SEQ ID NO: 1867824 - RNA, 22 nt, Human herpesvirus 3
caucgugcuugaauugccaucu

SEQ ID NO: 1867825 - RNA, 16 nt, Human herpesvirus 3
cuguuuaugaacagca

SEQ ID NO: 1867826 - RNA, 15 nt, Human herpesvirus 3
aacgcgcaauguuuu

SEQ ID NO: 1867827 - RNA, 16 nt, Human herpesvirus 3
uuacauugcuuucaaa

SEQ ID NO: 1867828 - RNA, 22 nt, Human herpesvirus 3
cauaguccgccgacagccgcuc

SEQ ID NO: 1867829 - RNA, 23 nt, Human herpesvirus 3
ugcugaguugcggcgcugaaggg

SEQ ID NO: 1867830 - RNA, 20 nt, Human herpesvirus 3
accaagcguacgaccaaaca

SEQ ID NO: 1867831 - RNA, 18 nt, Human herpesvirus 3
cacuguacgcagaaagca

SEQ ID NO: 1867832 - RNA, 15 nt, Human herpesvirus 3
aauacuuuuauuugu

SEQ ID NO: 1867833 - RNA, 20 nt, Human herpesvirus 3
aagguuaaauuuauaaaaca

SEQ ID NO: 1867834 - RNA, 19 nt, Human herpesvirus 3
uggcgcgcggacuguuugu

SEQ ID NO: 1867835 - RNA, 19 nt, Human herpesvirus 3
ccaccucggccgcuucccg

SEQ ID NO: 1867836 - RNA, 20 nt, Human herpesvirus 3
uagaaacgcgccaaacauug

SEQ ID NO: 1867837 - RNA, 23 nt, Human herpesvirus 3
acguaauuugccccaaaccacug

SEQ ID NO: 1867838 - RNA, 17 nt, Human herpesvirus 3
acggcuguggucugcuu

SEQ ID NO: 1867839 - RNA, 21 nt, Human herpesvirus 3
agauucaagacuaacauuuau

SEQ ID NO: 1867840 - RNA, 17 nt, Human herpesvirus 3
aacaaacauucacagua

SEQ ID NO: 1867841 - RNA, 14 nt, Human herpesvirus 3
aagauaggguguau

SEQ ID NO: 1867842 - RNA, 19 nt, Human herpesvirus 3
guaggggaugggggucgca

SEQ ID NO: 1867843 - RNA, 13 nt, Human herpesvirus 3
uuuuaaagcaucu

SEQ ID NO: 1867844 - RNA, 18 nt, Human herpesvirus 3
aauacuaagccucuguac

SEQ ID NO: 1867845 - RNA, 15 nt, Human herpesvirus 3
agauugucccaucgc

SEQ ID NO: 1867846 - RNA, 15 nt, Human herpesvirus 3
aacgcugcugacaaa

SEQ ID NO: 1867847 - RNA, 17 nt, Human herpesvirus 3
acugcagauacagcaua

SEQ ID NO: 1867848 - RNA, 22 nt, Human herpesvirus 3
ugcauaaccuguccauuugcau

SEQ ID NO: 1867849 - RNA, 15 nt, Human herpesvirus 3
aucuaauaacaauuu

SEQ ID NO: 1867850 - RNA, 15 nt, Human herpesvirus 3
ucggaugacuuugca

SEQ ID NO: 1867851 - RNA, 14 nt, Human herpesvirus 3
agccagccaaaaaa

SEQ ID NO: 1867852 - RNA, 15 nt, Human herpesvirus 3
augcacugaaccaca

SEQ ID NO: 1867853 - RNA, 23 nt, Human herpesvirus 3
ccgauauuguauuguaguacagg

SEQ ID NO: 1867854 - RNA, 19 nt, Human herpesvirus 3
cauuuccaaacacauuacg

SEQ ID NO: 1867855 - RNA, 21 nt, Human herpesvirus 3
uugaaaacauagaccauguuu

SEQ ID NO: 1867856 - RNA, 19 nt, Human herpesvirus 3
caugacaacggaaaacacg

SEQ ID NO: 1867857 - RNA, 21 nt, Human herpesvirus 3
aagguguauuuuauuuaguga

SEQ ID NO: 1867858 - RNA, 17 nt, Human herpesvirus 3
uacgccacgcuacaucc

SEQ ID NO: 1867859 - RNA, 17 nt, Human herpesvirus 3
aaccauucagcuuacag

SEQ ID NO: 1867860 - RNA, 12 nt, Human herpesvirus 3
uguauguuuuua

SEQ ID NO: 1867861 - RNA, 23 nt, Human herpesvirus 3
cggcagaugaucugguaaauguu

SEQ ID NO: 1867862 - RNA, 14 nt, Human herpesvirus 3
ugaauuugcuacca

SEQ ID NO: 1867863 - RNA, 19 nt, Human herpesvirus 3
uauucgcguaugaaaugua

SEQ ID NO: 1867864 - RNA, 19 nt, Human herpesvirus 3
gggaauuuaggaggcugca

SEQ ID NO: 1867865 - RNA, 15 nt, Human herpesvirus 3
ucguauaacagcuca

SEQ ID NO: 1867866 - RNA, 21 nt, Human herpesvirus 3
gguggauauagcgcugucguc

SEQ ID NO: 1867867 - RNA, 16 nt, Human herpesvirus 3
ucauguaauuguaaau

SEQ ID NO: 1867868 - RNA, 21 nt, Human herpesvirus 3
caaaaagaauuaaaaaagccg

SEQ ID NO: 1867869 - RNA, 16 nt, Human herpesvirus 3
auucucaucaaaguca

SEQ ID NO: 1867870 - RNA, 13 nt, Human herpesvirus 3
ucguguaaaguuu

SEQ ID NO: 1867871 - RNA, 18 nt, Human herpesvirus 3
aaaaagaggcggggagaa

SEQ ID NO: 1867872 - RNA, 13 nt, Human herpesvirus 3
accgcacccgaua

SEQ ID NO: 1867873 - RNA, 16 nt, Human herpesvirus 3
aauucgugugcaauaa

SEQ ID NO: 1867874 - RNA, 22 nt, Human herpesvirus 3
auauuuacacguuucauuaacu

SEQ ID NO: 1867875 - RNA, 19 nt, Human herpesvirus 3
ugcgaagcugccgucaaug

SEQ ID NO: 1867876 - RNA, 17 nt, Human herpesvirus 3
cccgugacucccuccaa

SEQ ID NO: 1867877 - RNA, 15 nt, Human herpesvirus 3
ccuucaacacaccca

SEQ ID NO: 1867878 - RNA, 19 nt, Human herpesvirus 3
gcccacacgcgggugagug

SEQ ID NO: 1867879 - RNA, 19 nt, Human herpesvirus 3
aagguagacaacugacaga

SEQ ID NO: 1867880 - RNA, 15 nt, Human herpesvirus 3
cccccgguuucuggg

SEQ ID NO: 1867881 - RNA, 22 nt, Human herpesvirus 3
ugauucaagugagguguccugu

SEQ ID NO: 1867882 - RNA, 14 nt, Human herpesvirus 3
guacacccagcugu

SEQ ID NO: 1867883 - RNA, 16 nt, Human herpesvirus 3
gcaccacagucucugu

SEQ ID NO: 1867884 - RNA, 20 nt, Human herpesvirus 3
uauaaauccguaucucggag

SEQ ID NO: 1867885 - RNA, 21 nt, Human herpesvirus 3
uaaacguauucuauuaacaau

SEQ ID NO: 1867886 - RNA, 19 nt, Human herpesvirus 3
ugaucaccgaaccggggca

SEQ ID NO: 1867887 - RNA, 18 nt, Human herpesvirus 3
cgcccggcggaccccggg

SEQ ID NO: 1867888 - RNA, 20 nt, Human herpesvirus 3
uacauuucacgcgucuuguu

SEQ ID NO: 1867889 - RNA, 23 nt, Human herpesvirus 3
cagaaacauuaguugcgguucaa

SEQ ID NO: 1867890 - RNA, 21 nt, Human herpesvirus 3
uuaggguugggagaguggguc

SEQ ID NO: 1867891 - RNA, 14 nt, Human herpesvirus 3
ggucgccuguaaua

SEQ ID NO: 1867892 - RNA, 18 nt, Human herpesvirus 3
auggguuuuuagaauuuc

SEQ ID NO: 1867893 - RNA, 14 nt, Human herpesvirus 3
cccgguuucugggc

SEQ ID NO: 1867894 - RNA, 20 nt, Human herpesvirus 3
caauaucagccgcucgcuga

SEQ ID NO: 1867895 - RNA, 18 nt, Human herpesvirus 3
ccuuaaccgcgacagcca

SEQ ID NO: 1867896 - RNA, 15 nt, Human herpesvirus 3
uauuuaauaggcaua

SEQ ID NO: 1867897 - RNA, 18 nt, Human herpesvirus 3
cucaucaacguuaagagg

SEQ ID NO: 1867898 - RNA, 15 nt, Human herpesvirus 3
uaccucugucagguu

SEQ ID NO: 1867899 - RNA, 16 nt, Human herpesvirus 3
guguggauuauaucca

SEQ ID NO: 1867900 - RNA, 19 nt, Human herpesvirus 3
cagcaaguuuaacauuucc

SEQ ID NO: 1867901 - RNA, 18 nt, Human herpesvirus 3
acacccauacagugaccc

SEQ ID NO: 1867902 - RNA, 15 nt, Human herpesvirus 3
aucauuuuauuacau

SEQ ID NO: 1867903 - RNA, 12 nt, Human herpesvirus 3
caauuaaagccc

SEQ ID NO: 1867904 - RNA, 17 nt, Human herpesvirus 3
gguucuucacuggacuu

SEQ ID NO: 1867905 - RNA, 16 nt, Human herpesvirus 3
uaagccucuguacaac

SEQ ID NO: 1867906 - RNA, 22 nt, Human herpesvirus 3
agacuugauacccucaaacacg

SEQ ID NO: 1867907 - RNA, 13 nt, Human herpesvirus 3
guacgauuagaac

SEQ ID NO: 1867908 - RNA, 17 nt, Human herpesvirus 3
ucguuuugguguuacau

SEQ ID NO: 1867909 - RNA, 17 nt, Human herpesvirus 3
ccgcuucccgaaagccc

SEQ ID NO: 1867910 - RNA, 14 nt, Human herpesvirus 3
uucaacacacccau

SEQ ID NO: 1867911 - RNA, 22 nt, Human herpesvirus 3
cgcagucuauggggggaauaca

SEQ ID NO: 1867912 - RNA, 20 nt, Human herpesvirus 3
aauugggggauuugggagaa

SEQ ID NO: 1867913 - RNA, 18 nt, Human herpesvirus 3
aaauauaacauacaucau

SEQ ID NO: 1867914 - RNA, 19 nt, Human herpesvirus 3
aaaacuuugguuguuguau

SEQ ID NO: 1867915 - RNA, 20 nt, Human herpesvirus 3
cguauuuuuauuuaaaugug

SEQ ID NO: 1867916 - RNA, 21 nt, Human herpesvirus 3
ccauuaaagagccauuuccau

SEQ ID NO: 1867917 - RNA, 19 nt, Human herpesvirus 3
caaaccauucgaggaaaac

SEQ ID NO: 1867918 - RNA, 23 nt, Human herpesvirus 3
aaguuuauacguacaucuuucag

SEQ ID NO: 1867919 - RNA, 14 nt, Human herpesvirus 3
uugcauaugcauau

SEQ ID NO: 1867920 - RNA, 12 nt, Human herpesvirus 3
gcgcauggccaa

SEQ ID NO: 1867921 - RNA, 13 nt, Human herpesvirus 3
ccgcggccagugc

SEQ ID NO: 1867922 - RNA, 18 nt, Human herpesvirus 3
gacgccgauaaauccaca

SEQ ID NO: 1867923 - RNA, 22 nt, Human herpesvirus 3
acccacgggguccccacacggg

SEQ ID NO: 1867924 - RNA, 16 nt, Human herpesvirus 3
aacgaaggcacggaag

SEQ ID NO: 1867925 - RNA, 15 nt, Human herpesvirus 3
cacagagucuguauc

SEQ ID NO: 1867926 - RNA, 13 nt, Human herpesvirus 3
uauuacauuuaau

SEQ ID NO: 1867927 - RNA, 13 nt, Human herpesvirus 3
cgaaacgcuuuga

SEQ ID NO: 1867928 - RNA, 22 nt, Human herpesvirus 3
uugucuaccacuaagaacuuua

SEQ ID NO: 1867929 - RNA, 15 nt, Human herpesvirus 3
uguugauauuuucca

SEQ ID NO: 1867930 - RNA, 14 nt, Human herpesvirus 3
agaaacuuaauaca

SEQ ID NO: 1867931 - RNA, 13 nt, Human herpesvirus 3
auguacacccagc

SEQ ID NO: 1867932 - RNA, 15 nt, Human herpesvirus 3
caggagggguugcgg

SEQ ID NO: 1867933 - RNA, 13 nt, Human herpesvirus 3
gccgcgcuaugcg

SEQ ID NO: 1867934 - RNA, 22 nt, Human herpesvirus 3
cguacaaucgaaaaaaggugua

SEQ ID NO: 1867935 - RNA, 15 nt, Human herpesvirus 3
auuuaaauaaaaaac

SEQ ID NO: 1867936 - RNA, 14 nt, Human herpesvirus 3
ccgaaccggggcaa

SEQ ID NO: 1867937 - RNA, 15 nt, Human herpesvirus 3
gaacguuuaauuaau

SEQ ID NO: 1867938 - RNA, 19 nt, Human herpesvirus 3
auuuaggucucggagguua

SEQ ID NO: 1867939 - RNA, 14 nt, Human herpesvirus 3
auggcuacaaggaa

SEQ ID NO: 1867940 - RNA, 18 nt, Human herpesvirus 3
uucagcaaguuuaacauu

SEQ ID NO: 1867941 - RNA, 18 nt, Human herpesvirus 3
uuacaggacaaaccccac

SEQ ID NO: 1867942 - RNA, 17 nt, Human herpesvirus 3
ggcgcugaagggugcau

SEQ ID NO: 1867943 - RNA, 21 nt, Human herpesvirus 3
agcaauaaaauggauauaauu

SEQ ID NO: 1867944 - RNA, 21 nt, Human herpesvirus 3
ucucaucaaagucaaagucuu

SEQ ID NO: 1867945 - RNA, 20 nt, Human herpesvirus 3
cgaaccuucggaugacuuug

SEQ ID NO: 1867946 - RNA, 13 nt, Human herpesvirus 3
aaauaaacuauau

SEQ ID NO: 1867947 - RNA, 23 nt, Human herpesvirus 3
augauucaaguaaauaugugcau

SEQ ID NO: 1867948 - RNA, 16 nt, Human herpesvirus 3
agaauaccaaaaagaa

SEQ ID NO: 1867949 - RNA, 18 nt, Human herpesvirus 3
ccuugggacaucaaccag

SEQ ID NO: 1867950 - RNA, 15 nt, Human herpesvirus 3
uuccacacucuucaa

SEQ ID NO: 1867951 - RNA, 16 nt, Human herpesvirus 3
gccaugguuucaaaac

SEQ ID NO: 1867952 - RNA, 14 nt, Human herpesvirus 3
uauaugucaacauu

SEQ ID NO: 1867953 - RNA, 15 nt, Human herpesvirus 3
uggcauuaaacccac

SEQ ID NO: 1867954 - RNA, 16 nt, Human herpesvirus 3
aucauacgcauuuacg

SEQ ID NO: 1867955 - RNA, 20 nt, Human herpesvirus 3
uauaugggcgggauuacauu

SEQ ID NO: 1867956 - RNA, 17 nt, Human herpesvirus 3
uauggaaucgucuaaca

SEQ ID NO: 1867957 - RNA, 21 nt, Human herpesvirus 3
gaugguaguuaccaaaguuuu

SEQ ID NO: 1867958 - RNA, 19 nt, Human herpesvirus 3
cuuuguuugcugcagacac

SEQ ID NO: 1867959 - RNA, 18 nt, Human herpesvirus 3
acaugccuggcuuaacag

SEQ ID NO: 1867960 - RNA, 23 nt, Human herpesvirus 3
gcacuaucgucucaaaacuuaag

SEQ ID NO: 1867961 - RNA, 17 nt, Human herpesvirus 3
uaaccauagacuguucu

SEQ ID NO: 1867962 - RNA, 18 nt, Human herpesvirus 3
cacgggguccccacacgg

SEQ ID NO: 1867963 - RNA, 22 nt, Human herpesvirus 3
cuggcuauggaaccuaauuuaa

SEQ ID NO: 1867964 - RNA, 19 nt, Human herpesvirus 3
uucucgugagcgccacugg

SEQ ID NO: 1867965 - RNA, 19 nt, Human herpesvirus 3
caacgcuuugaucuucaag

SEQ ID NO: 1867966 - RNA, 15 nt, Human herpesvirus 3
gcggaccccgggaga

SEQ ID NO: 1867967 - RNA, 13 nt, Human herpesvirus 3
acccgguauuaug

SEQ ID NO: 1867968 - RNA, 21 nt, Human herpesvirus 3
cuuccaacaucuauuccggau

SEQ ID NO: 1867969 - RNA, 17 nt, Human herpesvirus 3
ccccgguuucugggcgc

SEQ ID NO: 1867970 - RNA, 14 nt, Human herpesvirus 3
uaauauggggacag

SEQ ID NO: 1867971 - RNA, 21 nt, Human herpesvirus 3
cuccguuuaucccccuucaaa

SEQ ID NO: 1867972 - RNA, 18 nt, Human herpesvirus 3
gugcgacaaaggcauuug

SEQ ID NO: 1867973 - RNA, 18 nt, Human herpesvirus 3
guuuaucccccuucaaac

SEQ ID NO: 1867974 - RNA, 12 nt, Human herpesvirus 3
uuguaguacagg

SEQ ID NO: 1867975 - RNA, 14 nt, Human herpesvirus 3
gacccgcagcccag

SEQ ID NO: 1867976 - RNA, 21 nt, Human herpesvirus 3
gaucccgccgucgcgcccacc

SEQ ID NO: 1867977 - RNA, 19 nt, Human herpesvirus 3
gccagauguacacccagcu

SEQ ID NO: 1867978 - RNA, 15 nt, Human herpesvirus 3
guuauacuacuuauu

SEQ ID NO: 1867979 - RNA, 19 nt, Human herpesvirus 3
uugcugcagacaccaugac

SEQ ID NO: 1867980 - RNA, 23 nt, Human herpesvirus 3
ggugagcacccgggcggugaaua

SEQ ID NO: 1867981 - RNA, 18 nt, Human herpesvirus 3
guguuuuuaauagagagu

SEQ ID NO: 1867982 - RNA, 13 nt, Human herpesvirus 3
cuuacuugagauu

SEQ ID NO: 1867983 - RNA, 18 nt, Human herpesvirus 3
uaccauauauggacaucc

SEQ ID NO: 1867984 - RNA, 19 nt, Human herpesvirus 3
cuucugucaaguugcaugu

SEQ ID NO: 1867985 - RNA, 19 nt, Human herpesvirus 3
uguuuucggaguugccucc

SEQ ID NO: 1867986 - RNA, 12 nt, Human herpesvirus 3
gcucaauacuug

SEQ ID NO: 1867987 - RNA, 19 nt, Human herpesvirus 3
cccaugucuacgugguacc

SEQ ID NO: 1867988 - RNA, 12 nt, Human herpesvirus 3
auaaagggaugg

SEQ ID NO: 1867989 - RNA, 15 nt, Human herpesvirus 3
aacaccgcugugcug

SEQ ID NO: 1867990 - RNA, 19 nt, Human herpesvirus 3
ugucuacuauuugugaaga

SEQ ID NO: 1867991 - RNA, 18 nt, Human herpesvirus 3
cuacuuagcggacaugcu

SEQ ID NO: 1867992 - RNA, 24 nt, Human herpesvirus 3
ccgguucggugaucaccgggucuu

SEQ ID NO: 1867993 - RNA, 15 nt, Human herpesvirus 3
ccgaucgcguacccc

SEQ ID NO: 1867994 - RNA, 16 nt, Human herpesvirus 3
cgacuccucagccaug

SEQ ID NO: 1867995 - RNA, 21 nt, Human herpesvirus 3
uacacauccuggacacagucc

SEQ ID NO: 1867996 - RNA, 20 nt, Human herpesvirus 3
gaggguccaucaaacacaca

SEQ ID NO: 1867997 - RNA, 12 nt, Human herpesvirus 3
cccgccaugagc

SEQ ID NO: 1867998 - RNA, 23 nt, Human herpesvirus 3
agguauaugucaacauuuacagu

SEQ ID NO: 1867999 - RNA, 19 nt, Human herpesvirus 3
cggucgcguguacgaaaac

SEQ ID NO: 1868000 - RNA, 14 nt, Human herpesvirus 3
gacaugcacugcau

SEQ ID NO: 1868001 - RNA, 18 nt, Human herpesvirus 3
uguagucuuugaucccag

SEQ ID NO: 1868002 - RNA, 19 nt, Human herpesvirus 3
guuaauuaacgcgauuuua

SEQ ID NO: 1868003 - RNA, 13 nt, Human herpesvirus 3
uaguauuuacgua

SEQ ID NO: 1868004 - RNA, 15 nt, Human herpesvirus 3
uaauugucacgcuua

SEQ ID NO: 1868005 - RNA, 18 nt, Human herpesvirus 3
gcuucccgaaagcccgau

SEQ ID NO: 1868006 - RNA, 16 nt, Human herpesvirus 3
auuuuacgucauuucu

SEQ ID NO: 1868007 - RNA, 20 nt, Human herpesvirus 3
ccauguggguugggauuacg

SEQ ID NO: 1868008 - RNA, 14 nt, Human herpesvirus 3
uacgaccaaacauu

SEQ ID NO: 1868009 - RNA, 12 nt, Human herpesvirus 3
uuguauauacaa

SEQ ID NO: 1868010 - RNA, 22 nt, Human herpesvirus 3
accagaaacguuuuuaguuuuu

SEQ ID NO: 1868011 - RNA, 23 nt, Human herpesvirus 3
gugguuauuacauuuaauguuuu

SEQ ID NO: 1868012 - RNA, 20 nt, Human herpesvirus 3
aucggccguuauauuuuaca

SEQ ID NO: 1868013 - RNA, 21 nt, Human herpesvirus 3
guacacgauucggaaugcccg

SEQ ID NO: 1868014 - RNA, 17 nt, Human herpesvirus 3
uguguuuuuaucugcaa

SEQ ID NO: 1868015 - RNA, 22 nt, Human herpesvirus 3
gaaucacggccgugcggucucc

SEQ ID NO: 1868016 - RNA, 23 nt, Human herpesvirus 3
auggcaucuuccgacggugacag

SEQ ID NO: 1868017 - RNA, 12 nt, Human herpesvirus 3
gaacuaacucag

SEQ ID NO: 1868018 - RNA, 13 nt, Human herpesvirus 3
uauucuacagauu

SEQ ID NO: 1868019 - RNA, 18 nt, Human herpesvirus 3
uacaccagaaacguuuuu

SEQ ID NO: 1868020 - RNA, 16 nt, Human herpesvirus 3
agcaucucuggacccc

SEQ ID NO: 1868021 - RNA, 18 nt, Human herpesvirus 3
ucauaaaaacaagaaguu

SEQ ID NO: 1868022 - RNA, 15 nt, Human herpesvirus 3
guguucauaacaccg

SEQ ID NO: 1868023 - RNA, 13 nt, Human herpesvirus 3
gcaauuggccguu

SEQ ID NO: 1868024 - RNA, 17 nt, Human herpesvirus 3
cauuaggaugaaaagaa

SEQ ID NO: 1868025 - RNA, 21 nt, Human herpesvirus 3
cugcagggcggcguccucggc

SEQ ID NO: 1868026 - RNA, 16 nt, Human herpesvirus 3
aaccaauaucuuugca

SEQ ID NO: 1868027 - RNA, 16 nt, Human herpesvirus 3
aauaucuuugcaauuc

SEQ ID NO: 1868028 - RNA, 14 nt, Human herpesvirus 3
caguaacgguuuac

SEQ ID NO: 1868029 - RNA, 22 nt, Human herpesvirus 3
cggcuuuuaauuugaagacacc

SEQ ID NO: 1868030 - RNA, 17 nt, Human herpesvirus 3
guccgccgacagccgcu

SEQ ID NO: 1868031 - RNA, 12 nt, Human herpesvirus 3
uccaauguuuga

SEQ ID NO: 1868032 - RNA, 20 nt, Human herpesvirus 3
caugguugugggaaacauca

SEQ ID NO: 1868033 - RNA, 21 nt, Human herpesvirus 3
acugaauuauauaccucggcc

SEQ ID NO: 1868034 - RNA, 18 nt, Human herpesvirus 3
ugaagauaggguguauac

SEQ ID NO: 1868035 - RNA, 17 nt, Human herpesvirus 3
caacacacccauacagu

SEQ ID NO: 1868036 - RNA, 21 nt, Human herpesvirus 3
gccuucuguuuguuuaacacg

SEQ ID NO: 1868037 - RNA, 17 nt, Human herpesvirus 3
cgcguuugcggggcgac

SEQ ID NO: 1868038 - RNA, 23 nt, Human herpesvirus 3
uguauguggagcguacugcagau

SEQ ID NO: 1868039 - RNA, 17 nt, Human herpesvirus 3
uguucucggucuggaau

SEQ ID NO: 1868040 - RNA, 16 nt, Human herpesvirus 3
gacauggccgugaaug

SEQ ID NO: 1868041 - RNA, 17 nt, Human herpesvirus 3
augcgcguuccaaauua

SEQ ID NO: 1868042 - RNA, 14 nt, Human herpesvirus 3
ugugaugaauguaa

SEQ ID NO: 1868043 - RNA, 14 nt, Human herpesvirus 3
uguucuauuuccca

SEQ ID NO: 1868044 - RNA, 15 nt, Human herpesvirus 3
guuacucaugugucu

SEQ ID NO: 1868045 - RNA, 14 nt, Human herpesvirus 3
cuccagaguacagg

SEQ ID NO: 1868046 - RNA, 12 nt, Human herpesvirus 3
cauaaaacugua

SEQ ID NO: 1868047 - RNA, 22 nt, Human herpesvirus 3
aaauuuguguuuuuaucugcaa

SEQ ID NO: 1868048 - RNA, 13 nt, Human herpesvirus 3
ccgguuucugggc

SEQ ID NO: 1868049 - RNA, 18 nt, Human herpesvirus 3
guacaauacguaaauguc

SEQ ID NO: 1868050 - RNA, 17 nt, Human herpesvirus 3
guuauuguauauacaac

SEQ ID NO: 1868051 - RNA, 21 nt, Human herpesvirus 3
gaagggggauuuacaaugaca

SEQ ID NO: 1868052 - RNA, 16 nt, Human herpesvirus 3
ccgguuucugggcgcc

SEQ ID NO: 1868053 - RNA, 16 nt, Human herpesvirus 3
auauucacaacaguug

SEQ ID NO: 1868054 - RNA, 12 nt, Human herpesvirus 3
auucuauuaaca

SEQ ID NO: 1868055 - RNA, 14 nt, Human herpesvirus 3
auaguaaauaccua

SEQ ID NO: 1868056 - RNA, 16 nt, Human herpesvirus 3
ggugaugaaaucagag

SEQ ID NO: 1868057 - RNA, 12 nt, Human herpesvirus 3
gucugcccaccg

SEQ ID NO: 1868058 - RNA, 20 nt, Human herpesvirus 3
uauucucgcuugcagcuugu

SEQ ID NO: 1868059 - RNA, 23 nt, Human herpesvirus 3
aaaauauacgcucuucugauauu

SEQ ID NO: 1868060 - RNA, 19 nt, Human herpesvirus 3
uguucugcauaagcucugu

SEQ ID NO: 1868061 - RNA, 15 nt, Human herpesvirus 3
cccagcaaccccacc

SEQ ID NO: 1868062 - RNA, 17 nt, Human herpesvirus 3
acuuauccaacaaauug

SEQ ID NO: 1868063 - RNA, 12 nt, Human herpesvirus 3
cggccgcuuccc

SEQ ID NO: 1868064 - RNA, 14 nt, Human herpesvirus 3
cccccgaaaauaac

SEQ ID NO: 1868065 - RNA, 14 nt, Human herpesvirus 3
uaacaacucuggag

SEQ ID NO: 1868066 - RNA, 19 nt, Human herpesvirus 3
uuaccccgccauaaacaga

SEQ ID NO: 1868067 - RNA, 22 nt, Human herpesvirus 3
ugaacuuaccuccgaagacuuu

SEQ ID NO: 1868068 - RNA, 13 nt, Human herpesvirus 3
cuuuuaaagcauc

SEQ ID NO: 1868069 - RNA, 22 nt, Human herpesvirus 3
gaucccgccgucgcgcccaccu

SEQ ID NO: 1868070 - RNA, 15 nt, Human herpesvirus 3
gcuggucggaccccc

SEQ ID NO: 1868071 - RNA, 20 nt, Human herpesvirus 3
agccgcucgcugagcuccag

SEQ ID NO: 1868072 - RNA, 18 nt, Human herpesvirus 3
gcgaacgugauuugccca

SEQ ID NO: 1868073 - RNA, 21 nt, Human herpesvirus 3
agguguuaauaaaaacacaac

SEQ ID NO: 1868074 - RNA, 16 nt, Human herpesvirus 3
gcccacacaaucagaa

SEQ ID NO: 1868075 - RNA, 15 nt, Human herpesvirus 3
ccaucauuuaaauuc

SEQ ID NO: 1868076 - RNA, 20 nt, Human herpesvirus 3
ucaaaaaagcguguaaauca

SEQ ID NO: 1868077 - RNA, 13 nt, Human herpesvirus 3
uauuucuccggga

SEQ ID NO: 1868078 - RNA, 13 nt, Human herpesvirus 3
aguccaguggaca

SEQ ID NO: 1868079 - RNA, 22 nt, Human herpesvirus 3
gagcugguauacacgagagcag

SEQ ID NO: 1868080 - RNA, 15 nt, Human herpesvirus 3
augaaaaccugggug

SEQ ID NO: 1868081 - RNA, 23 nt, Human herpesvirus 3
cuuuaauaggcgcuacuuuauau

SEQ ID NO: 1868082 - RNA, 15 nt, Human herpesvirus 3
guguguugugugggg

SEQ ID NO: 1868083 - RNA, 17 nt, Human herpesvirus 3
aacccaagguguaaaua

SEQ ID NO: 1868084 - RNA, 17 nt, Human herpesvirus 3
aucuauuaacaggaccu

SEQ ID NO: 1868085 - RNA, 15 nt, Human herpesvirus 3
gagacggcugcugcc

SEQ ID NO: 1868086 - RNA, 14 nt, Human herpesvirus 3
uauauucucgaagg

SEQ ID NO: 1868087 - RNA, 15 nt, Human herpesvirus 3
aacgcuguuguugcu

SEQ ID NO: 1868088 - RNA, 17 nt, Human herpesvirus 3
aaccuucggaugacuuu

SEQ ID NO: 1868089 - RNA, 17 nt, Human herpesvirus 3
agcacccuuuuguaaaa

SEQ ID NO: 1868090 - RNA, 22 nt, Human herpesvirus 3
acaugcauggaaucaccagaac

SEQ ID NO: 1868091 - RNA, 19 nt, Human herpesvirus 3
uagacuguucuacugacuu

SEQ ID NO: 1868092 - RNA, 20 nt, Human herpesvirus 3
gauuuuaucauugaagauga

SEQ ID NO: 1868093 - RNA, 14 nt, Human herpesvirus 3
ucgcccgaaaacuu

SEQ ID NO: 1868094 - RNA, 12 nt, Human herpesvirus 3
acaacauuuaaa

SEQ ID NO: 1868095 - RNA, 23 nt, Human herpesvirus 3
acccaagguguaaauacugcccc

SEQ ID NO: 1868096 - RNA, 21 nt, Human herpesvirus 3
aaagaauuuuuaauacgguuc

SEQ ID NO: 1868097 - RNA, 16 nt, Human herpesvirus 3
cagagacucugcgaug

SEQ ID NO: 1868098 - RNA, 13 nt, Human herpesvirus 3
ggcggaccccggg

SEQ ID NO: 1868099 - RNA, 21 nt, Human herpesvirus 3
ccgaaaauaacccccccccgg

SEQ ID NO: 1868100 - RNA, 16 nt, Human herpesvirus 3
cuccgcgccuguuaau

SEQ ID NO: 1868101 - RNA, 18 nt, Human herpesvirus 3
aggaucauuuuuugaaac

SEQ ID NO: 1868102 - RNA, 23 nt, Human herpesvirus 3
agauucgccuuuuacaugaucca

SEQ ID NO: 1868103 - RNA, 16 nt, Human herpesvirus 3
cuccucagccaugcgg

SEQ ID NO: 1868104 - RNA, 20 nt, Human herpesvirus 3
aucugaaaagaccgacagcc

SEQ ID NO: 1868105 - RNA, 14 nt, Human herpesvirus 3
uguccggacuccag

SEQ ID NO: 1868106 - RNA, 22 nt, Human herpesvirus 3
ccgucgcgcccaccucggccgc

SEQ ID NO: 1868107 - RNA, 13 nt, Human herpesvirus 3
ucguuuaucccac

SEQ ID NO: 1868108 - RNA, 19 nt, Human herpesvirus 3
ccaaccuucaaguuaaaua

SEQ ID NO: 1868109 - RNA, 16 nt, Human herpesvirus 3
auggaguucaaaagaa

SEQ ID NO: 1868110 - RNA, 22 nt, Human herpesvirus 3
gcgcgcaaauuaacccccgagg

SEQ ID NO: 1868111 - RNA, 20 nt, Human herpesvirus 3
agaaacuauccgacagagaa

SEQ ID NO: 1868112 - RNA, 14 nt, Human herpesvirus 3
aagguaucccccag

SEQ ID NO: 1868113 - RNA, 22 nt, Human herpesvirus 3
cccuccuuuucucgugagcgcc

SEQ ID NO: 1868114 - RNA, 18 nt, Human herpesvirus 3
aacgccucccagcaaaau

SEQ ID NO: 1868115 - RNA, 19 nt, Human herpesvirus 3
gaauauucauaaaacugua

SEQ ID NO: 1868116 - RNA, 19 nt, Human herpesvirus 3
acauggccgugaaugguga

SEQ ID NO: 1868117 - RNA, 17 nt, Human herpesvirus 3
uucaaaccaauaucuuu

SEQ ID NO: 1868118 - RNA, 21 nt, Human herpesvirus 3
caucuggaguacuacacccag

SEQ ID NO: 1868119 - RNA, 21 nt, Human herpesvirus 3
auccauuaaagagccauuucc

SEQ ID NO: 1868120 - RNA, 11 nt, Human herpesvirus 3
uaucaauaaau

SEQ ID NO: 1868121 - RNA, 15 nt, Human herpesvirus 3
uuugcuuccccacac

SEQ ID NO: 1868122 - RNA, 20 nt, Human herpesvirus 3
uuaacaacucgugucucugg

SEQ ID NO: 1868123 - RNA, 15 nt, Human herpesvirus 3
aucucggagcgggcc

SEQ ID NO: 1868124 - RNA, 21 nt, Human herpesvirus 3
uucccaacgcauaaccagcga

SEQ ID NO: 1868125 - RNA, 19 nt, Human herpesvirus 3
cacaucuacugucuugaca

SEQ ID NO: 1868126 - RNA, 20 nt, Human herpesvirus 3
gacuccccccgucacacaca

SEQ ID NO: 1868127 - RNA, 22 nt, Human herpesvirus 3
cauuguacacccgguaugccac

SEQ ID NO: 1868128 - RNA, 23 nt, Human herpesvirus 3
gauggcaccacagucucuguuug

SEQ ID NO: 1868129 - RNA, 16 nt, Human herpesvirus 3
gcaauucccaguaaac

SEQ ID NO: 1868130 - RNA, 17 nt, Human herpesvirus 3
cugaucgucaggucugu

SEQ ID NO: 1868131 - RNA, 13 nt, Human herpesvirus 3
aauucaaaauacg

SEQ ID NO: 1868132 - RNA, 23 nt, Human herpesvirus 3
cccucuuuauccaauuaaagccc

SEQ ID NO: 1868133 - RNA, 16 nt, Human herpesvirus 3
aguuaaaucguuuaac

SEQ ID NO: 1868134 - RNA, 14 nt, Human herpesvirus 3
ccgggaucguggcc

SEQ ID NO: 1868135 - RNA, 14 nt, Human herpesvirus 3
cacucuacgcauuu

SEQ ID NO: 1868136 - RNA, 21 nt, Human herpesvirus 3
cgcaaggucccccccagaaga

SEQ ID NO: 1868137 - RNA, 19 nt, Human herpesvirus 3
cgggucuuaucuauauaca

SEQ ID NO: 1868138 - RNA, 14 nt, Human herpesvirus 3
cuauacgcauuucg

SEQ ID NO: 1868139 - RNA, 10 nt, Human herpesvirus 3
gugucugucu

SEQ ID NO: 1868140 - RNA, 19 nt, Human herpesvirus 3
caaugcgccguauauggua

SEQ ID NO: 1868141 - RNA, 20 nt, Human herpesvirus 3
acagccuuuacucggcucaa

SEQ ID NO: 1868142 - RNA, 14 nt, Human herpesvirus 3
ccgggauaucucau

SEQ ID NO: 1868143 - RNA, 18 nt, Human herpesvirus 3
cugucauguuuaagaaca

SEQ ID NO: 1868144 - RNA, 16 nt, Human herpesvirus 3
ccgacaugcacugcau

SEQ ID NO: 1868145 - RNA, 19 nt, Human herpesvirus 3
uguucaauaauuggacugc

SEQ ID NO: 1868146 - RNA, 21 nt, Human herpesvirus 3
uagauaucacaccaauuauaa

SEQ ID NO: 1868147 - RNA, 13 nt, Human herpesvirus 3
ugagcgccacugg

SEQ ID NO: 1868148 - RNA, 14 nt, Human herpesvirus 3
aagacauggccgug

SEQ ID NO: 1868149 - RNA, 19 nt, Human herpesvirus 3
ugucuacgugguaccaaaa

SEQ ID NO: 1868150 - RNA, 14 nt, Human herpesvirus 3
ggaaggauuaagaa

SEQ ID NO: 1868151 - RNA, 12 nt, Human herpesvirus 3
cuagccacaccc

SEQ ID NO: 1868152 - RNA, 21 nt, Human herpesvirus 3
ucugccguggaccccuguauu

SEQ ID NO: 1868153 - RNA, 14 nt, Human herpesvirus 3
uuauuuuaauguau

SEQ ID NO: 1868154 - RNA, 16 nt, Human herpesvirus 3
cgaagagaacugugaa

SEQ ID NO: 1868155 - RNA, 22 nt, Human herpesvirus 3
ucccgccgucgcgcccaccucg

SEQ ID NO: 1868156 - RNA, 17 nt, Human herpesvirus 3
auacacauccuggacac

SEQ ID NO: 1868157 - RNA, 13 nt, Human herpesvirus 3
ucaugcuugucaa

SEQ ID NO: 1868158 - RNA, 22 nt, Human herpesvirus 3
gacgggcgggcuggucggaccc

SEQ ID NO: 1868159 - RNA, 18 nt, Human herpesvirus 3
accugcgguauucuguaa

SEQ ID NO: 1868160 - RNA, 22 nt, Human herpesvirus 3
aucauuuaaauuccgcgguggg

SEQ ID NO: 1868161 - RNA, 22 nt, Human herpesvirus 3
aagucgcaacgcugcugacaaa

SEQ ID NO: 1868162 - RNA, 15 nt, Human herpesvirus 3
uuccuuuuccagcga

SEQ ID NO: 1868163 - RNA, 22 nt, Human herpesvirus 3
cauucgcaacacaucuacuguc

SEQ ID NO: 1868164 - RNA, 21 nt, Human herpesvirus 3
ggauaaauguuagucuugaau

SEQ ID NO: 1868165 - RNA, 13 nt, Human herpesvirus 3
ccuuaaaauuugu

SEQ ID NO: 1868166 - RNA, 18 nt, Human herpesvirus 3
ggcggaagauacaggcaa

SEQ ID NO: 1868167 - RNA, 16 nt, Human herpesvirus 3
uggcgcgcggacuguu

SEQ ID NO: 1868168 - RNA, 22 nt, Human herpesvirus 3
auaauucggcgcggaugcauuu

SEQ ID NO: 1868169 - RNA, 18 nt, Human herpesvirus 3
uccccguucgcugggugu

SEQ ID NO: 1868170 - RNA, 21 nt, Human herpesvirus 3
uaugaaaaaagugucugucug

SEQ ID NO: 1868171 - RNA, 19 nt, Human herpesvirus 3
cauaguuauuguauauaca

SEQ ID NO: 1868172 - RNA, 19 nt, Human herpesvirus 3
agauucgccuuuuacauga

SEQ ID NO: 1868173 - RNA, 18 nt, Human herpesvirus 3
augaacugccaauauaca

SEQ ID NO: 1868174 - RNA, 13 nt, Human herpesvirus 3
uccacacaacgcc

SEQ ID NO: 1868175 - RNA, 21 nt, Human herpesvirus 3
aagaaaacauugcagcguaca

SEQ ID NO: 1868176 - RNA, 20 nt, Human herpesvirus 3
ccagguacgcgucaaaaagc

SEQ ID NO: 1868177 - RNA, 14 nt, Human herpesvirus 3
uccgaauaaaugug

SEQ ID NO: 1868178 - RNA, 16 nt, Human herpesvirus 3
caucugcauuacagaa

SEQ ID NO: 1868179 - RNA, 19 nt, Human herpesvirus 3
acuuggcguguuaaacacu

SEQ ID NO: 1868180 - RNA, 20 nt, Human herpesvirus 3
acgagagcaguccaugguuu

SEQ ID NO: 1868181 - RNA, 17 nt, Human herpesvirus 3
cuccacuucgucugugg

SEQ ID NO: 1868182 - RNA, 15 nt, Human herpesvirus 3
uguauuauaugucac

SEQ ID NO: 1868183 - RNA, 19 nt, Human herpesvirus 3
cgcaugccccccucccuca

SEQ ID NO: 1868184 - RNA, 21 nt, Human herpesvirus 3
cccauccgagugaaucuuaaa

SEQ ID NO: 1868185 - RNA, 14 nt, Human herpesvirus 3
uuagcauccaaauu

SEQ ID NO: 1868186 - RNA, 15 nt, Human herpesvirus 3
ccaccagacacgcuc

SEQ ID NO: 1868187 - RNA, 13 nt, Human herpesvirus 3
acacgcggccugu

SEQ ID NO: 1868188 - RNA, 21 nt, Human herpesvirus 3
uaacguuuuaguaaaauacca

SEQ ID NO: 1868189 - RNA, 22 nt, Human herpesvirus 3
aaaucguuuaacaaaauagucu

SEQ ID NO: 1868190 - RNA, 18 nt, Human herpesvirus 3
auacauaaccgauuuacc

SEQ ID NO: 1868191 - RNA, 20 nt, Human herpesvirus 3
gauuccaucauaagcgcagu

SEQ ID NO: 1868192 - RNA, 20 nt, Human herpesvirus 3
uauaaacggccgaaaacgga

SEQ ID NO: 1868193 - RNA, 20 nt, Human herpesvirus 3
auuuauucucgcuugcagcu

SEQ ID NO: 1868194 - RNA, 23 nt, Human herpesvirus 3
gcgcguuuguuugucucgguuau

SEQ ID NO: 1868195 - RNA, 22 nt, Human herpesvirus 3
uuaagaccaacgguuggcuuaa

SEQ ID NO: 1868196 - RNA, 14 nt, Human herpesvirus 3
uggcagaagguuua

SEQ ID NO: 1868197 - RNA, 18 nt, Human herpesvirus 3
auugucccguaaacuaau

SEQ ID NO: 1868198 - RNA, 16 nt, Human herpesvirus 3
aauggucuaaauacuu

SEQ ID NO: 1868199 - RNA, 22 nt, Human herpesvirus 3
cagagaaaacgcgcgaaaugug

SEQ ID NO: 1868200 - RNA, 15 nt, Human herpesvirus 3
uguacaauugucugu

SEQ ID NO: 1868201 - RNA, 13 nt, Human herpesvirus 3
ugacaaaaugaca

SEQ ID NO: 1868202 - RNA, 22 nt, Human herpesvirus 3
acccuggacauugcggauccca

SEQ ID NO: 1868203 - RNA, 22 nt, Human herpesvirus 3
gcaucuggagaaccgcgucuau

SEQ ID NO: 1868204 - RNA, 17 nt, Human herpesvirus 3
cgccgucgcgcccaccu

SEQ ID NO: 1868205 - RNA, 14 nt, Human herpesvirus 3
cuugucaaaacaua

SEQ ID NO: 1868206 - RNA, 22 nt, Human herpesvirus 3
agaugguuaauaauagugacaa

SEQ ID NO: 1868207 - RNA, 16 nt, Human herpesvirus 3
uuccacacucuucaau

SEQ ID NO: 1868208 - RNA, 13 nt, Human herpesvirus 3
cgccacuggcgcg

SEQ ID NO: 1868209 - RNA, 15 nt, Human herpesvirus 3
agguuagauguguua

SEQ ID NO: 1868210 - RNA, 12 nt, Human herpesvirus 3
guuagacagaga

SEQ ID NO: 1868211 - RNA, 22 nt, Human herpesvirus 3
gcuucccgaaagcccgaucccg

SEQ ID NO: 1868212 - RNA, 17 nt, Human herpesvirus 3
cucgccuccacugcauu

SEQ ID NO: 1868213 - RNA, 14 nt, Human herpesvirus 3
cucccacccacugu

SEQ ID NO: 1868214 - RNA, 15 nt, Human herpesvirus 3
aaauugggggauuug

SEQ ID NO: 1868215 - RNA, 13 nt, Human herpesvirus 3
cggccgcuucccg

SEQ ID NO: 1868216 - RNA, 19 nt, Human herpesvirus 3
aacgucuagaacuguguau

SEQ ID NO: 1868217 - RNA, 15 nt, Human herpesvirus 3
uugcauuggaaguca

SEQ ID NO: 1868218 - RNA, 21 nt, Human herpesvirus 3
gugagggugaccggcgggguc

SEQ ID NO: 1868219 - RNA, 14 nt, Human herpesvirus 3
aauuaucgacugaa

SEQ ID NO: 1868220 - RNA, 16 nt, Human herpesvirus 3
cgaauuguucugggaa

SEQ ID NO: 1868221 - RNA, 12 nt, Human herpesvirus 3
uuuacaguaaac

SEQ ID NO: 1868222 - RNA, 13 nt, Human herpesvirus 3
gaagacuccagua

SEQ ID NO: 1868223 - RNA, 16 nt, Human herpesvirus 3
cgcgcaauguuuugaa

SEQ ID NO: 1868224 - RNA, 15 nt, Human herpesvirus 3
cuuuuaaagcaguac

SEQ ID NO: 1868225 - RNA, 15 nt, Human herpesvirus 3
aguuuuagcgguggu

SEQ ID NO: 1868226 - RNA, 16 nt, Human herpesvirus 3
uaccuauuucaugcuu

SEQ ID NO: 1868227 - RNA, 15 nt, Human herpesvirus 3
uuauuagaacguuua

SEQ ID NO: 1868228 - RNA, 22 nt, Human herpesvirus 3
cuucaaguuaaauaacauguca

SEQ ID NO: 1868229 - RNA, 22 nt, Human herpesvirus 3
gcgauggugaugaaaucagaga

SEQ ID NO: 1868230 - RNA, 19 nt, Human herpesvirus 3
ggagcguacugcagauaca

SEQ ID NO: 1868231 - RNA, 15 nt, Human herpesvirus 3
aagguguuucagugg

SEQ ID NO: 1868232 - RNA, 22 nt, Human herpesvirus 3
agacaguggcggauaacugccu

SEQ ID NO: 1868233 - RNA, 13 nt, Human herpesvirus 3
ucaaguugcaugu

SEQ ID NO: 1868234 - RNA, 13 nt, Human herpesvirus 3
caaugaaacagua

SEQ ID NO: 1868235 - RNA, 14 nt, Human herpesvirus 3
ugucugucugugcg

SEQ ID NO: 1868236 - RNA, 21 nt, Human herpesvirus 3
auuuuauauuaaauaaacuau

SEQ ID NO: 1868237 - RNA, 13 nt, Human herpesvirus 3
ccuauaggcuuua

SEQ ID NO: 1868238 - RNA, 21 nt, Human herpesvirus 3
auauuaacacgauuaacguug

SEQ ID NO: 1868239 - RNA, 19 nt, Human herpesvirus 3
uuuaugaaaaaagugucug

SEQ ID NO: 1868240 - RNA, 16 nt, Human herpesvirus 3
uggcaacgcuggcauu

SEQ ID NO: 1868241 - RNA, 22 nt, Human herpesvirus 3
aaucaaccacaccgguggaauu

SEQ ID NO: 1868242 - RNA, 20 nt, Human herpesvirus 3
cuuaaugguucauuguuuua

SEQ ID NO: 1868243 - RNA, 17 nt, Human herpesvirus 3
cgggcuggucggacccc

SEQ ID NO: 1868244 - RNA, 13 nt, Human herpesvirus 3
aaucuuuuacaac

SEQ ID NO: 1868245 - RNA, 15 nt, Human herpesvirus 3
uauccgacagagaaa

SEQ ID NO: 1868246 - RNA, 18 nt, Human herpesvirus 3
auacaccguguaacucga

SEQ ID NO: 1868247 - RNA, 19 nt, Human herpesvirus 3
gccuucggacggaugugcg

SEQ ID NO: 1868248 - RNA, 18 nt, Human herpesvirus 3
ggcgugaaagcuaccacc

SEQ ID NO: 1868249 - RNA, 17 nt, Human herpesvirus 3
agaugccgguauugcuu

SEQ ID NO: 1868250 - RNA, 15 nt, Human herpesvirus 3
auccaauuaaagccc

SEQ ID NO: 1868251 - RNA, 16 nt, Human herpesvirus 3
agccagcaauguuuua

SEQ ID NO: 1868252 - RNA, 21 nt, Human herpesvirus 3
aggggguauuuauacccgaua

SEQ ID NO: 1868253 - RNA, 21 nt, Human herpesvirus 3
cucacugcuauagccgucaga

SEQ ID NO: 1868254 - RNA, 14 nt, Human herpesvirus 3
guauuguguaauug

SEQ ID NO: 1868255 - RNA, 14 nt, Human herpesvirus 3
gauucuauauuaau

SEQ ID NO: 1868256 - RNA, 22 nt, Human herpesvirus 3
auuaccccgccauaaacagaga

SEQ ID NO: 1868257 - RNA, 13 nt, Human herpesvirus 3
cucgugucucugg

SEQ ID NO: 1868258 - RNA, 19 nt, Human herpesvirus 3
cuggacauguguuuaagua

SEQ ID NO: 1868259 - RNA, 23 nt, Human herpesvirus 3
agccaacgucgccaucuggagua

SEQ ID NO: 1868260 - RNA, 13 nt, Human herpesvirus 3
gguuaugcuuuuu

SEQ ID NO: 1868261 - RNA, 12 nt, Human herpesvirus 3
uuaccguacaac

SEQ ID NO: 1868262 - RNA, 17 nt, Human herpesvirus 3
uauaccuuaacucaacc

SEQ ID NO: 1868263 - RNA, 21 nt, Human herpesvirus 3
cuaacauuaacgcgcuacaac

SEQ ID NO: 1868264 - RNA, 21 nt, Human herpesvirus 3
cgagaagggggauuuacaaug

SEQ ID NO: 1868265 - RNA, 18 nt, Human herpesvirus 3
aaguguucuaaaacacug

SEQ ID NO: 1868266 - RNA, 15 nt, Human herpesvirus 3
ucaaaguauuuuccu

SEQ ID NO: 1868267 - RNA, 17 nt, Human herpesvirus 3
ugugguccauuaaaagu

SEQ ID NO: 1868268 - RNA, 21 nt, Human herpesvirus 3
ucccgccgucgcgcccaccuc

SEQ ID NO: 1868269 - RNA, 13 nt, Human herpesvirus 3
uaugaaucucugc

SEQ ID NO: 1868270 - RNA, 23 nt, Human herpesvirus 3
aacacuuggcguguuaaacacug

SEQ ID NO: 1868271 - RNA, 15 nt, Human herpesvirus 3
aguacuaaaaauccu

SEQ ID NO: 1868272 - RNA, 14 nt, Human herpesvirus 3
accuuuucgccuua

SEQ ID NO: 1868273 - RNA, 14 nt, Human herpesvirus 3
uacaaguacaaccc

SEQ ID NO: 1868274 - RNA, 16 nt, Human herpesvirus 3
gaugguaguuaccaaa

SEQ ID NO: 1868275 - RNA, 15 nt, Human herpesvirus 3
cuccuuuucucguga

SEQ ID NO: 1868276 - RNA, 14 nt, Human herpesvirus 3
auuuauaaaacacu

SEQ ID NO: 1868277 - RNA, 16 nt, Human herpesvirus 3
auuaugaacaguuuau

SEQ ID NO: 1868278 - RNA, 23 nt, Human herpesvirus 3
agcugaaaaucgucccauuuaaa

SEQ ID NO: 1868279 - RNA, 17 nt, Human herpesvirus 3
guccaaguccaaucaaa

SEQ ID NO: 1868280 - RNA, 16 nt, Human herpesvirus 3
uaauaaaucuuacgua

SEQ ID NO: 1868281 - RNA, 14 nt, Human herpesvirus 3
aucagagaagcuau

SEQ ID NO: 1868282 - RNA, 20 nt, Human herpesvirus 3
gagcgccacuggcgcgcgga

SEQ ID NO: 1868283 - RNA, 19 nt, Human herpesvirus 3
ucacgcgucuuguuuuuau

SEQ ID NO: 1868284 - RNA, 21 nt, Human herpesvirus 3
uuaaagccccucgaagaacaa

SEQ ID NO: 1868285 - RNA, 23 nt, Human herpesvirus 3
uaaaaaauaccuuuuucaugcuu

SEQ ID NO: 1868286 - RNA, 21 nt, Human herpesvirus 3
ucugcgaagcugccgucaaug

SEQ ID NO: 1868287 - RNA, 15 nt, Human herpesvirus 3
aucggcauuaacaac

SEQ ID NO: 1868288 - RNA, 16 nt, Human herpesvirus 3
cguccuucaacacacc

SEQ ID NO: 1868289 - RNA, 19 nt, Human herpesvirus 3
uacacgauucggaaugccc

SEQ ID NO: 1868290 - RNA, 17 nt, Human herpesvirus 3
aaacgcgccaaacauug

SEQ ID NO: 1868291 - RNA, 15 nt, Human herpesvirus 3
aguuuaggguuuaaa

SEQ ID NO: 1868292 - RNA, 22 nt, Human herpesvirus 3
gacuccaagggacccgcagccc

SEQ ID NO: 1868293 - RNA, 22 nt, Human herpesvirus 3
aagaauuuauccgguugaaaac

SEQ ID NO: 1868294 - RNA, 16 nt, Human herpesvirus 3
cuugaaucugucuuua

SEQ ID NO: 1868295 - RNA, 21 nt, Human herpesvirus 3
cuuguuuuuauuuaauaggca

SEQ ID NO: 1868296 - RNA, 20 nt, Human herpesvirus 3
ccagauguacacccagcugu

SEQ ID NO: 1868297 - RNA, 15 nt, Human herpesvirus 3
ucgcguacccccuuc

SEQ ID NO: 1868298 - RNA, 12 nt, Human herpesvirus 3
gccgucgcgccc

SEQ ID NO: 1868299 - RNA, 13 nt, Human herpesvirus 3
aggucuacagcac

SEQ ID NO: 1868300 - RNA, 18 nt, Human herpesvirus 3
uguaauucgugugcaaua

SEQ ID NO: 1868301 - RNA, 18 nt, Human herpesvirus 3
acuuuguuugcugcagac

SEQ ID NO: 1868302 - RNA, 16 nt, Human herpesvirus 3
auggccgucuugaauc

SEQ ID NO: 1868303 - RNA, 14 nt, Human herpesvirus 3
ucauacgcauuuac

SEQ ID NO: 1868304 - RNA, 15 nt, Human herpesvirus 3
aauugcgcgaguucc

SEQ ID NO: 1868305 - RNA, 23 nt, Human herpesvirus 3
agacuuuaugaauuugcuaccag

SEQ ID NO: 1868306 - RNA, 17 nt, Human herpesvirus 3
uugggggauuugggaga

SEQ ID NO: 1868307 - RNA, 20 nt, Human herpesvirus 3
gguuaaggcgaaaagguuuc

SEQ ID NO: 1868308 - RNA, 21 nt, Human herpesvirus 3
cauucagcuuacaguccagug

SEQ ID NO: 1868309 - RNA, 22 nt, Human herpesvirus 3
ggcgggcuggucggaccccccc

SEQ ID NO: 1868310 - RNA, 20 nt, Human herpesvirus 3
cagauguacacccagcuguc

SEQ ID NO: 1868311 - RNA, 16 nt, Human herpesvirus 3
aaugguucauuguuuu

SEQ ID NO: 1868312 - RNA, 19 nt, Human herpesvirus 3
acccuugccgcguggaaca

SEQ ID NO: 1868313 - RNA, 17 nt, Human herpesvirus 3
gugguaccaaaaacaca

SEQ ID NO: 1868314 - RNA, 14 nt, Human herpesvirus 3
uacuacauugaaca

SEQ ID NO: 1868315 - RNA, 24 nt, Human herpesvirus 3
ucaccaaacggguuuugggugcau

SEQ ID NO: 1868316 - RNA, 16 nt, Human herpesvirus 3
auuacgaguacuaaaa

SEQ ID NO: 1868317 - RNA, 11 nt, Human herpesvirus 3
ugguuaacacc

SEQ ID NO: 1868318 - RNA, 14 nt, Human herpesvirus 3
augcuuguaaaaca

SEQ ID NO: 1868319 - RNA, 17 nt, Human herpesvirus 3
caugcuuguaaaacaua

SEQ ID NO: 1868320 - RNA, 13 nt, Human herpesvirus 3
gagacauaaaagu

SEQ ID NO: 1868321 - RNA, 19 nt, Human herpesvirus 3
cauggccgugaauggugaa

SEQ ID NO: 1868322 - RNA, 14 nt, Human herpesvirus 3
cccggcggaccccg

SEQ ID NO: 1868323 - RNA, 22 nt, Human herpesvirus 3
augcaccgguccaacacuccgc

SEQ ID NO: 1868324 - RNA, 17 nt, Human herpesvirus 3
auggugcgauuuaacca

SEQ ID NO: 1868325 - RNA, 21 nt, Human herpesvirus 3
gcgguauauuaauuaacuggc

SEQ ID NO: 1868326 - RNA, 18 nt, Human herpesvirus 3
uguaaaaaccauggacag

SEQ ID NO: 1868327 - RNA, 14 nt, Human herpesvirus 3
uuaaugguucauug

SEQ ID NO: 1868328 - RNA, 23 nt, Human herpesvirus 3
gugagcgccacuggcgcgcggac

SEQ ID NO: 1868329 - RNA, 23 nt, Human herpesvirus 3
aaccauagacuguucuacugacu

SEQ ID NO: 1868330 - RNA, 22 nt, Human herpesvirus 3
augcggugcuguuugaagcggc

SEQ ID NO: 1868331 - RNA, 15 nt, Human herpesvirus 3
auuuaggaaccgaac

SEQ ID NO: 1868332 - RNA, 18 nt, Human herpesvirus 3
uguguuuuuaucugcaau

SEQ ID NO: 1868333 - RNA, 23 nt, Human herpesvirus 3
cgccaguugacuuuguuugcugc

SEQ ID NO: 1868334 - RNA, 15 nt, Human herpesvirus 3
ccagguacgcgucaa

SEQ ID NO: 1868335 - RNA, 18 nt, Human herpesvirus 3
aguguucuaaaacacugu

SEQ ID NO: 1868336 - RNA, 16 nt, Human herpesvirus 3
ugaccgauccccgggu

SEQ ID NO: 1868337 - RNA, 17 nt, Human herpesvirus 3
cgugagcgccacuggcg

SEQ ID NO: 1868338 - RNA, 15 nt, Human herpesvirus 3
uguccggacuccagc

SEQ ID NO: 1868339 - RNA, 21 nt, Human herpesvirus 3
aucccgcggugagcacccggg

SEQ ID NO: 1868340 - RNA, 15 nt, Human herpesvirus 3
cgggucuuaucuaua

SEQ ID NO: 1868341 - RNA, 20 nt, Human herpesvirus 3
caaauuaacccaagacgaca

SEQ ID NO: 1868342 - RNA, 16 nt, Human herpesvirus 3
ccuuuucucgugagcg

SEQ ID NO: 1868343 - RNA, 17 nt, Human herpesvirus 3
ucaugaacaaacacucu

SEQ ID NO: 1868344 - RNA, 19 nt, Human herpesvirus 3
gacucugcgaugcauuaac

SEQ ID NO: 1868345 - RNA, 16 nt, Human herpesvirus 3
cuccaagggacccgca

SEQ ID NO: 1868346 - RNA, 23 nt, Human herpesvirus 3
aaaaacguuucugguguauguuu

SEQ ID NO: 1868347 - RNA, 13 nt, Human herpesvirus 3
cucuguuacauuc

SEQ ID NO: 1868348 - RNA, 18 nt, Human herpesvirus 3
cauuuuauagacacgcua

SEQ ID NO: 1868349 - RNA, 17 nt, Human herpesvirus 3
gauuacgcguugugaua

SEQ ID NO: 1868350 - RNA, 18 nt, Human herpesvirus 3
ggaagaguuagcauccaa

SEQ ID NO: 1868351 - RNA, 15 nt, Human herpesvirus 3
guuggacaaaggugc

SEQ ID NO: 1868352 - RNA, 14 nt, Human herpesvirus 3
aguaacuuaacaaa

SEQ ID NO: 1868353 - RNA, 19 nt, Human herpesvirus 3
ucauacgccgacaugccug

SEQ ID NO: 1868354 - RNA, 19 nt, Human herpesvirus 3
aacuuuacuguuagggaua

SEQ ID NO: 1868355 - RNA, 18 nt, Human herpesvirus 3
ugcauuacccuaucccag

SEQ ID NO: 1868356 - RNA, 12 nt, Human herpesvirus 3
ugcaagcucgau

SEQ ID NO: 1868357 - RNA, 24 nt, Human herpesvirus 3
ucugucgaugauacacauaugcac

SEQ ID NO: 1868358 - RNA, 21 nt, Human herpesvirus 3
cguuuagccguacagauuaaa

SEQ ID NO: 1868359 - RNA, 19 nt, Human herpesvirus 3
uaaauccguaucucggagc

SEQ ID NO: 1868360 - RNA, 14 nt, Human herpesvirus 3
ucugauugguugau

SEQ ID NO: 1868361 - RNA, 16 nt, Human herpesvirus 3
ucuucaaauuaaaagc

SEQ ID NO: 1868362 - RNA, 16 nt, Human herpesvirus 3
ucaucuggguggcagc

SEQ ID NO: 1868363 - RNA, 18 nt, Human herpesvirus 3
ugguccauuaaaaguuua

SEQ ID NO: 1868364 - RNA, 23 nt, Human herpesvirus 3
ucuaucggacauaugucugcucu

SEQ ID NO: 1868365 - RNA, 18 nt, Human herpesvirus 3
cauguuuucccaugucua

SEQ ID NO: 1868366 - RNA, 17 nt, Human herpesvirus 3
acucacguuuguguugu

SEQ ID NO: 1868367 - RNA, 19 nt, Human herpesvirus 3
uuaacauaccccaggccuu

SEQ ID NO: 1868368 - RNA, 14 nt, Human herpesvirus 3
uaagacguugcaua

SEQ ID NO: 1868369 - RNA, 17 nt, Human herpesvirus 3
gguguucuauuucccaa

SEQ ID NO: 1868370 - RNA, 21 nt, Human herpesvirus 3
guacaauacguaaaugucacu

SEQ ID NO: 1868371 - RNA, 19 nt, Human herpesvirus 3
ugcauaacguugcggugau

SEQ ID NO: 1868372 - RNA, 19 nt, Human herpesvirus 3
cagauguacacccagcugu

SEQ ID NO: 1868373 - RNA, 16 nt, Human herpesvirus 3
acugcagauacagcau

SEQ ID NO: 1868374 - RNA, 15 nt, Human herpesvirus 3
cagacaccaugacgg

SEQ ID NO: 1868375 - RNA, 21 nt, Human herpesvirus 3
agaucgucguuuaaagccccu

SEQ ID NO: 1868376 - RNA, 22 nt, Human herpesvirus 3
ucaaaacauacuaauuuguauu

SEQ ID NO: 1868377 - RNA, 13 nt, Human herpesvirus 3
caaggcguaaaau

SEQ ID NO: 1868378 - RNA, 20 nt, Human herpesvirus 3
aacauaccccaggccuugaa

SEQ ID NO: 1868379 - RNA, 16 nt, Human herpesvirus 3
uacaccggauaaaagc

SEQ ID NO: 1868380 - RNA, 12 nt, Human herpesvirus 3
cuccccccgcga

SEQ ID NO: 1868381 - RNA, 17 nt, Human herpesvirus 3
ccacgugagcuugcaag

SEQ ID NO: 1868382 - RNA, 18 nt, Human herpesvirus 3
aucucuucauauguaauu

SEQ ID NO: 1868383 - RNA, 22 nt, Human herpesvirus 3
uagaugacacgaauaggugaua

SEQ ID NO: 1868384 - RNA, 17 nt, Human herpesvirus 3
uuuaaaagccguucugu

SEQ ID NO: 1868385 - RNA, 14 nt, Human herpesvirus 3
augaaaucagagaa

SEQ ID NO: 1868386 - RNA, 13 nt, Human herpesvirus 3
caccucggccgcu

SEQ ID NO: 1868387 - RNA, 14 nt, Human herpesvirus 3
acucugcgaugcau

SEQ ID NO: 1868388 - RNA, 20 nt, Human herpesvirus 3
uagcauccaaauuaacccaa

SEQ ID NO: 1868389 - RNA, 14 nt, Human herpesvirus 3
gccgagaacagugg

SEQ ID NO: 1868390 - RNA, 17 nt, Human herpesvirus 3
ucuaacccggugacaga

SEQ ID NO: 1868391 - RNA, 17 nt, Human herpesvirus 3
gcccacacaaucagaag

SEQ ID NO: 1868392 - RNA, 17 nt, Human herpesvirus 3
cguacauauccugcgca

SEQ ID NO: 1868393 - RNA, 22 nt, Human herpesvirus 3
ccccauacuccgauacccugga

SEQ ID NO: 1868394 - RNA, 22 nt, Human herpesvirus 3
aacucaaccgccguuguggaaa

SEQ ID NO: 1868395 - RNA, 12 nt, Human herpesvirus 3
ugaaagcuacca

SEQ ID NO: 1868396 - RNA, 15 nt, Human herpesvirus 3
uggaucagaaagauu

SEQ ID NO: 1868397 - RNA, 20 nt, Human herpesvirus 3
cuuaaaccgugugugcggag

SEQ ID NO: 1868398 - RNA, 21 nt, Human herpesvirus 3
gaauuuauccgguugaaaaca

SEQ ID NO: 1868399 - RNA, 15 nt, Human herpesvirus 3
cccaccuccccgcgc

SEQ ID NO: 1868400 - RNA, 20 nt, Human herpesvirus 3
uuaucccaacugauuacauu

SEQ ID NO: 1868401 - RNA, 19 nt, Human herpesvirus 3
guuguuaauaaaagcggaa

SEQ ID NO: 1868402 - RNA, 24 nt, Human herpesvirus 3
acuugggcggagacaauuaaccga

SEQ ID NO: 1868403 - RNA, 20 nt, Human herpesvirus 3
uuuuuaugaaaaaagugucu

SEQ ID NO: 1868404 - RNA, 21 nt, Human herpesvirus 3
ucagaaagauugcagucauuu

SEQ ID NO: 1868405 - RNA, 21 nt, Human herpesvirus 3
uguuguagccacaauuuacau

SEQ ID NO: 1868406 - RNA, 20 nt, Human herpesvirus 3
cgggcgggcgacgggcgggc

SEQ ID NO: 1868407 - RNA, 23 nt, Human herpesvirus 3
aguggaccuuugcaaccugguca

SEQ ID NO: 1868408 - RNA, 19 nt, Human herpesvirus 3
uccccuccuuuucucguga

SEQ ID NO: 1868409 - RNA, 21 nt, Human herpesvirus 3
aggguggacguuuuuccacaa

SEQ ID NO: 1868410 - RNA, 17 nt, Human herpesvirus 3
ccuccuuuucucgugag

SEQ ID NO: 1868411 - RNA, 13 nt, Human herpesvirus 3
uuauuuugaacau

SEQ ID NO: 1868412 - RNA, 21 nt, Human herpesvirus 3
caauuggccguuuguaucaau

SEQ ID NO: 1868413 - RNA, 21 nt, Human herpesvirus 3
cgucuugcgauacgaugauuu

SEQ ID NO: 1868414 - RNA, 16 nt, Human herpesvirus 3
agggacccgcagccca

SEQ ID NO: 1868415 - RNA, 23 nt, Human herpesvirus 3
ccagacucucgcggcuucuguaa

SEQ ID NO: 1868416 - RNA, 17 nt, Human herpesvirus 3
cugauucggguaaaaca

SEQ ID NO: 1868417 - RNA, 17 nt, Human herpesvirus 3
gcgauacgaugauuuuc

SEQ ID NO: 1868418 - RNA, 13 nt, Human herpesvirus 3
acaacccacgcua

SEQ ID NO: 1868419 - RNA, 12 nt, Human herpesvirus 3
caaacagcacca

SEQ ID NO: 1868420 - RNA, 14 nt, Human herpesvirus 3
ucugaccauuuacc

SEQ ID NO: 1868421 - RNA, 20 nt, Human herpesvirus 3
aaacauugcagcguacaagu

SEQ ID NO: 1868422 - RNA, 24 nt, Human herpesvirus 3
uacuaauuuguauuuuuaaucauu

SEQ ID NO: 1868423 - RNA, 10 nt, Human herpesvirus 3
uugaaccacu

SEQ ID NO: 1868424 - RNA, 17 nt, Human herpesvirus 3
uccguuuaucccccuuc

SEQ ID NO: 1868425 - RNA, 15 nt, Human herpesvirus 3
aacacugucagaaac

SEQ ID NO: 1868426 - RNA, 23 nt, Human herpesvirus 3
ucgcgcccaccucggccgcuucc

SEQ ID NO: 1868427 - RNA, 21 nt, Human herpesvirus 3
cuucaaguuaaauaacauguc

SEQ ID NO: 1868428 - RNA, 20 nt, Human herpesvirus 3
cgucauauuacauuaacggu

SEQ ID NO: 1868429 - RNA, 13 nt, Human herpesvirus 3
uggacggcucccg

SEQ ID NO: 1868430 - RNA, 19 nt, Human herpesvirus 3
cuguuguugcuaguauuuu

SEQ ID NO: 1868431 - RNA, 21 nt, Human herpesvirus 3
gacgcgugaaauguaacuaga

SEQ ID NO: 1868432 - RNA, 23 nt, Human herpesvirus 3
acguauguucugugggacagcua

SEQ ID NO: 1868433 - RNA, 20 nt, Human herpesvirus 3
auuuggaaugggagcucuuu

SEQ ID NO: 1868434 - RNA, 15 nt, Human herpesvirus 3
agcaucuauaugauu

SEQ ID NO: 1868435 - RNA, 19 nt, Human herpesvirus 3
acgggcgggcuggucggac

SEQ ID NO: 1868436 - RNA, 19 nt, Human herpesvirus 3
cccgcggugagcacccggg

SEQ ID NO: 1868437 - RNA, 14 nt, Human herpesvirus 3
ggcuucaccagagu

SEQ ID NO: 1868438 - RNA, 14 nt, Human herpesvirus 3
gccgcuucccgaaa

SEQ ID NO: 1868439 - RNA, 15 nt, Human herpesvirus 3
cauuuccauuuuuag

SEQ ID NO: 1868440 - RNA, 20 nt, Human herpesvirus 3
uccccuccuuuucucgugag

SEQ ID NO: 1868441 - RNA, 19 nt, Human herpesvirus 3
agaugaucugguaaauguu

SEQ ID NO: 1868442 - RNA, 23 nt, Human herpesvirus 3
cuaauaaaaauguaauauugugg

SEQ ID NO: 1868443 - RNA, 15 nt, Human herpesvirus 3
auaugauucaaguaa

SEQ ID NO: 1868444 - RNA, 13 nt, Human herpesvirus 3
ucaacugcuuuua

SEQ ID NO: 1868445 - RNA, 19 nt, Human herpesvirus 3
aacgugauuugcccacacc

SEQ ID NO: 1868446 - RNA, 14 nt, Human herpesvirus 3
aauaaccccccccc

SEQ ID NO: 1868447 - RNA, 22 nt, Human herpesvirus 3
cuguaugcguuaccccauguca

SEQ ID NO: 1868448 - RNA, 21 nt, Human herpesvirus 3
gcaucccccauuguaugaauu

SEQ ID NO: 1868449 - RNA, 11 nt, Human herpesvirus 3
uguaauuguaa

SEQ ID NO: 1868450 - RNA, 21 nt, Human herpesvirus 3
uuguaaaccacucaacguuuu

SEQ ID NO: 1868451 - RNA, 22 nt, Human herpesvirus 3
aaagaacucugaguucaaagca

SEQ ID NO: 1868452 - RNA, 13 nt, Human herpesvirus 3
ucauuuauuacca

SEQ ID NO: 1868453 - RNA, 17 nt, Human herpesvirus 3
gaucauuuuuugaaaca

SEQ ID NO: 1868454 - RNA, 21 nt, Human herpesvirus 3
auugguugauuggguuauaaa

SEQ ID NO: 1868455 - RNA, 17 nt, Human herpesvirus 3
uugugaucuauuaacag

SEQ ID NO: 1868456 - RNA, 16 nt, Human herpesvirus 3
uauuugugaagacuuu

SEQ ID NO: 1868457 - RNA, 18 nt, Human herpesvirus 3
gccgucgcgcccaccucg

SEQ ID NO: 1868458 - RNA, 14 nt, Human herpesvirus 3
cgggcgggcugguc

SEQ ID NO: 1868459 - RNA, 17 nt, Human herpesvirus 3
auaugucaacauuuaca

SEQ ID NO: 1868460 - RNA, 17 nt, Human herpesvirus 3
uauguaacguuuguaaa

SEQ ID NO: 1868461 - RNA, 16 nt, Human herpesvirus 3
uguuuuuaucugcaau

SEQ ID NO: 1868462 - RNA, 23 nt, Human herpesvirus 3
aucagccgcucgcugagcuccag

SEQ ID NO: 1868463 - RNA, 14 nt, Human herpesvirus 3
acaauuaacacaga

SEQ ID NO: 1868464 - RNA, 14 nt, Human herpesvirus 3
gccgcuacccgaaa

SEQ ID NO: 1868465 - RNA, 15 nt, Human herpesvirus 3
ccccaggccuugaaa

SEQ ID NO: 1868466 - RNA, 17 nt, Human herpesvirus 3
cguguuacuuggaaaca

SEQ ID NO: 1868467 - RNA, 18 nt, Human herpesvirus 3
auauguucagcagcuuaa

SEQ ID NO: 1868468 - RNA, 19 nt, Human herpesvirus 3
cugggcgcccggcggaccc

SEQ ID NO: 1868469 - RNA, 14 nt, Human herpesvirus 3
auuuuauauacaaa

SEQ ID NO: 1868470 - RNA, 14 nt, Human herpesvirus 3
augccacauuuacc

SEQ ID NO: 1868471 - RNA, 22 nt, Human herpesvirus 3
cgauauuguauuguaguacagg

SEQ ID NO: 1868472 - RNA, 11 nt, Human herpesvirus 3
uugcuggcugg

SEQ ID NO: 1868473 - RNA, 17 nt, Human herpesvirus 3
auuagugucacuauaaa

SEQ ID NO: 1868474 - RNA, 23 nt, Human herpesvirus 3
gugcaucgcauaggguguuauaa

SEQ ID NO: 1868475 - RNA, 19 nt, Human herpesvirus 3
aacauacauuggggauuca

SEQ ID NO: 1868476 - RNA, 13 nt, Human herpesvirus 3
caaacagcaccaa

SEQ ID NO: 1868477 - RNA, 18 nt, Human herpesvirus 3
acaccuuccgguacccca

SEQ ID NO: 1868478 - RNA, 19 nt, Human herpesvirus 3
ugacggcgacuuuaagaau

SEQ ID NO: 1868479 - RNA, 13 nt, Human herpesvirus 3
gauaauguccuag

SEQ ID NO: 1868480 - RNA, 15 nt, Human herpesvirus 3
agcaaaauaaaacaa

SEQ ID NO: 1868481 - RNA, 19 nt, Human herpesvirus 3
uggacaucgcugaugccag

SEQ ID NO: 1868482 - RNA, 14 nt, Human herpesvirus 3
uguauucuggugau

SEQ ID NO: 1868483 - RNA, 14 nt, Human herpesvirus 3
uguuuuaauuccaa

SEQ ID NO: 1868484 - RNA, 19 nt, Human herpesvirus 3
uaacgaucgcguguauaca

SEQ ID NO: 1868485 - RNA, 18 nt, Human herpesvirus 3
gccgugcggucucccgga

SEQ ID NO: 1868486 - RNA, 22 nt, Human herpesvirus 3
uaggcgaccgcgggucaaugga

SEQ ID NO: 1868487 - RNA, 15 nt, Human herpesvirus 3
gagcucccauuccaa

SEQ ID NO: 1868488 - RNA, 17 nt, Human herpesvirus 3
cacuuacaggacaaacc

SEQ ID NO: 1868489 - RNA, 17 nt, Human herpesvirus 3
gacgggcgggcuggucg

SEQ ID NO: 1868490 - RNA, 19 nt, Human herpesvirus 3
gaaaaucuauuaucaggag

SEQ ID NO: 1868491 - RNA, 19 nt, Human herpesvirus 3
aucuucacgcucaaugaac

SEQ ID NO: 1868492 - RNA, 15 nt, Human herpesvirus 3
auuaaagguuaaauu

SEQ ID NO: 1868493 - RNA, 22 nt, Human herpesvirus 3
ucuacaauauuguagaacuaac

SEQ ID NO: 1868494 - RNA, 16 nt, Human herpesvirus 3
uaggggaugggggucg

SEQ ID NO: 1868495 - RNA, 13 nt, Human herpesvirus 3
uuuaaaaauaccu

SEQ ID NO: 1868496 - RNA, 14 nt, Human herpesvirus 3
aacaccgcugugcu

SEQ ID NO: 1868497 - RNA, 16 nt, Human herpesvirus 3
agaucaauggcgguga

SEQ ID NO: 1868498 - RNA, 22 nt, Human herpesvirus 3
cuacuauuugugaagacuuuau

SEQ ID NO: 1868499 - RNA, 18 nt, Human herpesvirus 3
cuggcauuuccaaacaca

SEQ ID NO: 1868500 - RNA, 13 nt, Human herpesvirus 3
gcgugguuauuac

SEQ ID NO: 1868501 - RNA, 17 nt, Human herpesvirus 3
uacguaaaugucacuau

SEQ ID NO: 1868502 - RNA, 17 nt, Human herpesvirus 3
cauaguuauuguauaua

SEQ ID NO: 1868503 - RNA, 20 nt, Human herpesvirus 3
ccgggauuuccacuuacagg

SEQ ID NO: 1868504 - RNA, 17 nt, Human herpesvirus 3
uggcgcgcggacuguuu

SEQ ID NO: 1868505 - RNA, 21 nt, Human herpesvirus 3
aucaugguugguuacugugaa

SEQ ID NO: 1868506 - RNA, 13 nt, Human herpesvirus 3
gcuccguguaugu

SEQ ID NO: 1868507 - RNA, 17 nt, Human herpesvirus 3
caugcauugcucgcgua

SEQ ID NO: 1868508 - RNA, 14 nt, Human herpesvirus 3
cguguccccucugg

SEQ ID NO: 1868509 - RNA, 17 nt, Human herpesvirus 3
uagguucggcaaaucua

SEQ ID NO: 1868510 - RNA, 22 nt, Human herpesvirus 3
uguacaacacaaagggccucua

SEQ ID NO: 1868511 - RNA, 17 nt, Human herpesvirus 3
augcaacccugucauca

SEQ ID NO: 1868512 - RNA, 15 nt, Human herpesvirus 3
augccauuugagaua

SEQ ID NO: 1868513 - RNA, 20 nt, Human herpesvirus 3
aggcugccgccuuugcgaug

SEQ ID NO: 1868514 - RNA, 23 nt, Human herpesvirus 3
gcaacuacuuacaacccccgcgg

SEQ ID NO: 1868515 - RNA, 16 nt, Human herpesvirus 3
uucugggcgcccggcg

SEQ ID NO: 1868516 - RNA, 19 nt, Human herpesvirus 3
ugcgauaacugcgauaaga

SEQ ID NO: 1868517 - RNA, 12 nt, Human herpesvirus 3
auuauacauaac

SEQ ID NO: 1868518 - RNA, 18 nt, Human herpesvirus 3
gaaaacgcgcgaaaugug

SEQ ID NO: 1868519 - RNA, 20 nt, Human herpesvirus 3
caacccccgcggcuuccgaa

SEQ ID NO: 1868520 - RNA, 16 nt, Human herpesvirus 3
agcaaaauucagaaac

SEQ ID NO: 1868521 - RNA, 22 nt, Human herpesvirus 3
ggguacaaacgcgcaauguuuu

SEQ ID NO: 1868522 - RNA, 18 nt, Human herpesvirus 3
agaaucuccuaacuauaa

SEQ ID NO: 1868523 - RNA, 17 nt, Human herpesvirus 3
gguucagcggacgcugc

SEQ ID NO: 1868524 - RNA, 22 nt, Human herpesvirus 3
uaauuccaauauuuuguuaaua

SEQ ID NO: 1868525 - RNA, 13 nt, Human herpesvirus 3
cgcucucgcuguu

SEQ ID NO: 1868526 - RNA, 23 nt, Human herpesvirus 3
uugggagggggaaggaaaugccu

SEQ ID NO: 1868527 - RNA, 16 nt, Human herpesvirus 3
gccgugugguaugaau

SEQ ID NO: 1868528 - RNA, 22 nt, Human herpesvirus 3
guugcacguaacaagcucguug

SEQ ID NO: 1868529 - RNA, 15 nt, Human herpesvirus 3
aaaaagugucugucu

SEQ ID NO: 1868530 - RNA, 20 nt, Human herpesvirus 3
uaaaaacggauauuaacacg

SEQ ID NO: 1868531 - RNA, 15 nt, Human herpesvirus 3
aaucgucuaacauua

SEQ ID NO: 1868532 - RNA, 15 nt, Human herpesvirus 3
auaugucaacauuua

SEQ ID NO: 1868533 - RNA, 21 nt, Human herpesvirus 3
uuuuacgucauuucucccguu

SEQ ID NO: 1868534 - RNA, 13 nt, Human herpesvirus 3
ggccgcuucccga

SEQ ID NO: 1868535 - RNA, 16 nt, Human herpesvirus 3
cauuccaacuggaaau

SEQ ID NO: 1868536 - RNA, 13 nt, Human herpesvirus 3
cagaucccacccc

SEQ ID NO: 1868537 - RNA, 18 nt, Human herpesvirus 3
uuaauuccaauauuuugu

SEQ ID NO: 1868538 - RNA, 18 nt, Human herpesvirus 3
accgguaccaugggagac

SEQ ID NO: 1868539 - RNA, 17 nt, Human herpesvirus 3
gucgugugcuccuugga

SEQ ID NO: 1868540 - RNA, 16 nt, Human herpesvirus 3
agguccauuuaacaau

SEQ ID NO: 1868541 - RNA, 18 nt, Human herpesvirus 3
aaagguauacuuggagau

SEQ ID NO: 1868542 - RNA, 16 nt, Human herpesvirus 3
gcaguccaugguuuua

SEQ ID NO: 1868543 - RNA, 22 nt, Human herpesvirus 3
guacauaguuauuguauauaca

SEQ ID NO: 1868544 - RNA, 22 nt, Human herpesvirus 3
aagcgcuccgcccuaaauuaca

SEQ ID NO: 1868545 - RNA, 20 nt, Human herpesvirus 3
cauacuaauuuguauuuuua

SEQ ID NO: 1868546 - RNA, 23 nt, Human herpesvirus 3
cccuggagacggcugcugccgag

SEQ ID NO: 1868547 - RNA, 15 nt, Human herpesvirus 3
uaacagugccagugc

SEQ ID NO: 1868548 - RNA, 23 nt, Human herpesvirus 3
caaagaacucugaguucaaagca

SEQ ID NO: 1868549 - RNA, 11 nt, Human herpesvirus 3
uuugaagccac

SEQ ID NO: 1868550 - RNA, 15 nt, Human herpesvirus 3
aggcgaaaagguuuc

SEQ ID NO: 1868551 - RNA, 17 nt, Human herpesvirus 3
ugcaucguagguauaaa

SEQ ID NO: 1868552 - RNA, 17 nt, Human herpesvirus 3
gccuguuggugggugag

SEQ ID NO: 1868553 - RNA, 12 nt, Human herpesvirus 3
cacgguguauau

SEQ ID NO: 1868554 - RNA, 18 nt, Human herpesvirus 3
ccuggccccuugaaccac

SEQ ID NO: 1868555 - RNA, 19 nt, Human herpesvirus 3
acacuuggcguguuaaaca

SEQ ID NO: 1868556 - RNA, 14 nt, Human herpesvirus 3
caacgaguguaugc

SEQ ID NO: 1868557 - RNA, 15 nt, Human herpesvirus 3
caauauuuauacaag

SEQ ID NO: 1868558 - RNA, 22 nt, Human herpesvirus 3
cgccaaaauggaugcaagaaac

SEQ ID NO: 1868559 - RNA, 16 nt, Human herpesvirus 3
aagcagacaucccucg

SEQ ID NO: 1868560 - RNA, 17 nt, Human herpesvirus 3
acuguacagcugagaug

SEQ ID NO: 1868561 - RNA, 14 nt, Human herpesvirus 3
aucacguccggguu

SEQ ID NO: 1868562 - RNA, 13 nt, Human herpesvirus 3
auaggugucuuca

SEQ ID NO: 1868563 - RNA, 12 nt, Human herpesvirus 3
auagcugucacu

SEQ ID NO: 1868564 - RNA, 18 nt, Human herpesvirus 3
agguacgcgucaaaaagc

SEQ ID NO: 1868565 - RNA, 16 nt, Human herpesvirus 3
uagauuuaaaaccaau

SEQ ID NO: 1868566 - RNA, 17 nt, Human herpesvirus 3
auacuaauuuguauuuu

SEQ ID NO: 1868567 - RNA, 16 nt, Human herpesvirus 3
acguagcaaagcuaca

SEQ ID NO: 1868568 - RNA, 14 nt, Human herpesvirus 3
uguuaaacaaacag

SEQ ID NO: 1868569 - RNA, 18 nt, Human herpesvirus 3
cgaauguuggaaacuguu

SEQ ID NO: 1868570 - RNA, 12 nt, Human herpesvirus 3
cucguauauaca

SEQ ID NO: 1868571 - RNA, 17 nt, Human herpesvirus 3
cauucagcuuacagucc

SEQ ID NO: 1868572 - RNA, 15 nt, Human herpesvirus 3
auacacauccuggac

SEQ ID NO: 1868573 - RNA, 17 nt, Human herpesvirus 3
cgugucacgacaaaaac

SEQ ID NO: 1868574 - RNA, 17 nt, Human herpesvirus 3
uacaggcaacugcaaac

SEQ ID NO: 1868575 - RNA, 11 nt, Human herpesvirus 3
acuuauccauu

SEQ ID NO: 1868576 - RNA, 17 nt, Human herpesvirus 3
aaccggguggguggcau

SEQ ID NO: 1868577 - RNA, 20 nt, Human herpesvirus 3
cacggaaggcgugaaagcua

SEQ ID NO: 1868578 - RNA, 15 nt, Human herpesvirus 3
caacugacagaaacu

SEQ ID NO: 1868579 - RNA, 14 nt, Human herpesvirus 3
cgagcaugugcaac

SEQ ID NO: 1868580 - RNA, 21 nt, Human herpesvirus 3
auaugagccguauaacccacu

SEQ ID NO: 1868581 - RNA, 17 nt, Human herpesvirus 3
auauacacggacauaau

SEQ ID NO: 1868582 - RNA, 14 nt, Human herpesvirus 3
auauuaacacgauu

SEQ ID NO: 1868583 - RNA, 14 nt, Human herpesvirus 3
auguaauuguaaau

SEQ ID NO: 1868584 - RNA, 15 nt, Human herpesvirus 3
uauaucuguuacauu

SEQ ID NO: 1868585 - RNA, 13 nt, Human herpesvirus 3
acgcgggugagug

SEQ ID NO: 1868586 - RNA, 22 nt, Human herpesvirus 3
aacuguauguaaauuaugauca

SEQ ID NO: 1868587 - RNA, 20 nt, Human herpesvirus 3
gauacacauaugcacgcauc

SEQ ID NO: 1868588 - RNA, 17 nt, Human herpesvirus 3
uuaacacgauuaacguu

SEQ ID NO: 1868589 - RNA, 19 nt, Human herpesvirus 3
ggccgcuacccgaaagccc

SEQ ID NO: 1868590 - RNA, 22 nt, Human herpesvirus 3
aucgcugaugccagaagcauuu

SEQ ID NO: 1868591 - RNA, 12 nt, Human herpesvirus 3
cucgugagcgcc

SEQ ID NO: 1868592 - RNA, 18 nt, Human herpesvirus 3
acucaugugucuccauua

SEQ ID NO: 1868593 - RNA, 21 nt, Human herpesvirus 3
cggcuuaacgagagauccaau

SEQ ID NO: 1868594 - RNA, 20 nt, Human herpesvirus 3
gaacuaauauucuacagauu

SEQ ID NO: 1868595 - RNA, 16 nt, Human herpesvirus 3
cguuauggaguucaaa

SEQ ID NO: 1868596 - RNA, 12 nt, Human herpesvirus 3
guagagcccaca

SEQ ID NO: 1868597 - RNA, 11 nt, Human herpesvirus 3
uacacaacacc

SEQ ID NO: 1868598 - RNA, 12 nt, Human herpesvirus 3
agaugacuuuga

SEQ ID NO: 1868599 - RNA, 19 nt, Human herpesvirus 3
ggccgcuucccgaaagccc

SEQ ID NO: 1868600 - RNA, 17 nt, Human herpesvirus 3
uauuuacguauguacca

SEQ ID NO: 1868601 - RNA, 15 nt, Human herpesvirus 3
cggacccccccccga

SEQ ID NO: 1868602 - RNA, 14 nt, Human herpesvirus 3
ccaggcucucauga

SEQ ID NO: 1868603 - RNA, 23 nt, Human herpesvirus 3
acggauauuaacacgauuaacgu

SEQ ID NO: 1868604 - RNA, 15 nt, Human herpesvirus 3
ugauaugaggggaag

SEQ ID NO: 1868605 - RNA, 16 nt, Human herpesvirus 3
uaacccccccccgguu

SEQ ID NO: 1868606 - RNA, 19 nt, Human herpesvirus 3
cgcccggcggaccccggga

SEQ ID NO: 1868607 - RNA, 19 nt, Human herpesvirus 3
gagugaaucuuaaaccuga

SEQ ID NO: 1868608 - RNA, 14 nt, Human herpesvirus 3
uuggagaaacauua

SEQ ID NO: 1868609 - RNA, 15 nt, Human herpesvirus 3
uacgaccaaacauua

SEQ ID NO: 1868610 - RNA, 13 nt, Human herpesvirus 3
ucguauauacaug

SEQ ID NO: 1868611 - RNA, 17 nt, Human herpesvirus 3
aauucuuagaaaagcca

SEQ ID NO: 1868612 - RNA, 21 nt, Human herpesvirus 3
uuaaauaguuuugguacauua

SEQ ID NO: 1868613 - RNA, 21 nt, Human herpesvirus 3
guuaauaccauauauggacau

SEQ ID NO: 1868614 - RNA, 17 nt, Human herpesvirus 3
guugguuacugugaaug

SEQ ID NO: 1868615 - RNA, 20 nt, Human herpesvirus 3
uggacguuuuuccacaauuu

SEQ ID NO: 1868616 - RNA, 17 nt, Human herpesvirus 3
ccccaaggcccauaucc

SEQ ID NO: 1868617 - RNA, 19 nt, Human herpesvirus 3
aauaccuauuucaugcuug

SEQ ID NO: 1868618 - RNA, 20 nt, Human herpesvirus 3
acauuagaguguuuaacaac

SEQ ID NO: 1868619 - RNA, 22 nt, Human herpesvirus 3
uuuauuuugcucguauauacau

SEQ ID NO: 1868620 - RNA, 19 nt, Human herpesvirus 3
ccccaguaaucucacuguu

SEQ ID NO: 1868621 - RNA, 11 nt, Human herpesvirus 3
uaaucuuuuau

SEQ ID NO: 1868622 - RNA, 14 nt, Human herpesvirus 3
gcucgcugagcucc

SEQ ID NO: 1868623 - RNA, 23 nt, Human herpesvirus 3
ucguuuaaagccccucgaagaac

SEQ ID NO: 1868624 - RNA, 14 nt, Human herpesvirus 3
agaagggggauuua

SEQ ID NO: 1868625 - RNA, 13 nt, Human herpesvirus 3
ucgcgcccaccuc

SEQ ID NO: 1868626 - RNA, 19 nt, Human herpesvirus 3
ugauagaacgcguaaaucu

SEQ ID NO: 1868627 - RNA, 17 nt, Human herpesvirus 3
cuguuacuuaaaccgug

SEQ ID NO: 1868628 - RNA, 13 nt, Human herpesvirus 3
acuauaugcguuu

SEQ ID NO: 1868629 - RNA, 16 nt, Human herpesvirus 3
acugcuuuuauaacuu

SEQ ID NO: 1868630 - RNA, 13 nt, Human herpesvirus 3
ggggguacaguug

SEQ ID NO: 1868631 - RNA, 13 nt, Human herpesvirus 3
gccugcaagcggu

SEQ ID NO: 1868632 - RNA, 12 nt, Human herpesvirus 3
agcccgaucccg

SEQ ID NO: 1868633 - RNA, 17 nt, Human herpesvirus 3
uuuaauccaauguuuga

SEQ ID NO: 1868634 - RNA, 17 nt, Human herpesvirus 3
ucuaaaacacugucaga

SEQ ID NO: 1868635 - RNA, 21 nt, Human herpesvirus 3
cguccccuuauaucugccaua

SEQ ID NO: 1868636 - RNA, 17 nt, Human herpesvirus 3
guagaggguccaucaaa

SEQ ID NO: 1868637 - RNA, 19 nt, Human herpesvirus 3
ggucauuuccacaaccagg

SEQ ID NO: 1868638 - RNA, 19 nt, Human herpesvirus 3
ccggguggguggcauuaaa

SEQ ID NO: 1868639 - RNA, 18 nt, Human herpesvirus 3
caggcgcguuuguuuguc

SEQ ID NO: 1868640 - RNA, 19 nt, Human herpesvirus 3
gguuuuuagaauuuccaaa

SEQ ID NO: 1868641 - RNA, 16 nt, Human herpesvirus 3
cguaauacaugcuuug

SEQ ID NO: 1868642 - RNA, 15 nt, Human herpesvirus 3
cguacgaccaaacau

SEQ ID NO: 1868643 - RNA, 17 nt, Human herpesvirus 3
auucgacgcaaaaauuc

SEQ ID NO: 1868644 - RNA, 18 nt, Human herpesvirus 3
cgacagcaguaaggguga

SEQ ID NO: 1868645 - RNA, 14 nt, Human herpesvirus 3
auaacugccugucg

SEQ ID NO: 1868646 - RNA, 21 nt, Human herpesvirus 3
gaucgucguuuaaagccccuc

SEQ ID NO: 1868647 - RNA, 16 nt, Human herpesvirus 3
gcggaccccgggagag

SEQ ID NO: 1868648 - RNA, 22 nt, Human herpesvirus 3
uaaggggagcguggauguguca

SEQ ID NO: 1868649 - RNA, 20 nt, Human herpesvirus 3
acguagcaaagcuacacuuu

SEQ ID NO: 1868650 - RNA, 22 nt, Human herpesvirus 3
ucaaaccaauaucuuugcaauu

SEQ ID NO: 1868651 - RNA, 13 nt, Human herpesvirus 3
acguuccgggguu

SEQ ID NO: 1868652 - RNA, 13 nt, Human herpesvirus 3
auaagggagucua

SEQ ID NO: 1868653 - RNA, 19 nt, Human herpesvirus 3
guuugaaguguucuaaaac

SEQ ID NO: 1868654 - RNA, 14 nt, Human herpesvirus 3
uuaaauacacccgc

SEQ ID NO: 1868655 - RNA, 20 nt, Human herpesvirus 3
gcgcugguauguauggcuuc

SEQ ID NO: 1868656 - RNA, 15 nt, Human herpesvirus 3
ugaugguaguuacca

SEQ ID NO: 1868657 - RNA, 13 nt, Human herpesvirus 3
ucuggagucucca

SEQ ID NO: 1868658 - RNA, 14 nt, Human herpesvirus 3
aucaggacagcagu

SEQ ID NO: 1868659 - RNA, 16 nt, Human herpesvirus 3
caucuucacgcucaau

SEQ ID NO: 1868660 - RNA, 14 nt, Human herpesvirus 3
aucaaacacacaga

SEQ ID NO: 1868661 - RNA, 12 nt, Human herpesvirus 3
accaugggagac

SEQ ID NO: 1868662 - RNA, 18 nt, Human herpesvirus 3
gacuugacgcgaacaccg

SEQ ID NO: 1868663 - RNA, 12 nt, Human herpesvirus 3
cgauggugauga

SEQ ID NO: 1868664 - RNA, 16 nt, Human herpesvirus 3
gugauauuauauacug

SEQ ID NO: 1868665 - RNA, 23 nt, Human herpesvirus 3
uccauccugaccgauccccgggu

SEQ ID NO: 1868666 - RNA, 18 nt, Human herpesvirus 3
acuuguguguaccauaga

SEQ ID NO: 1868667 - RNA, 12 nt, Human herpesvirus 3
uuuaucccccuu

SEQ ID NO: 1868668 - RNA, 19 nt, Human herpesvirus 3
gacggaugugcggggagcu

SEQ ID NO: 1868669 - RNA, 13 nt, Human herpesvirus 3
uuuuuaauucagg

SEQ ID NO: 1868670 - RNA, 13 nt, Human herpesvirus 3
cugcaucuggaga

SEQ ID NO: 1868671 - RNA, 23 nt, Human herpesvirus 3
gacaaaauuaacucgcguacaaa

SEQ ID NO: 1868672 - RNA, 15 nt, Human herpesvirus 3
caucugauuugcaaa

SEQ ID NO: 1868673 - RNA, 16 nt, Human herpesvirus 3
uaguuaccaaaguuuu

SEQ ID NO: 1868674 - RNA, 15 nt, Human herpesvirus 3
gccccaaaccacugu

SEQ ID NO: 1868675 - RNA, 23 nt, Human herpesvirus 3
cuggaauaaaacguuuuaaaagc

SEQ ID NO: 1868676 - RNA, 15 nt, Human herpesvirus 3
aaaccaaacacgccu

SEQ ID NO: 1868677 - RNA, 20 nt, Human herpesvirus 3
uaguccuuacccauaugacc

SEQ ID NO: 1868678 - RNA, 15 nt, Human herpesvirus 3
caaaauucgaauugu

SEQ ID NO: 1868679 - RNA, 15 nt, Human herpesvirus 3
aacccccccccgguu

SEQ ID NO: 1868680 - RNA, 15 nt, Human herpesvirus 3
uccgauacccuggac

SEQ ID NO: 1868681 - RNA, 15 nt, Human herpesvirus 3
ucccccgaucucugg

SEQ ID NO: 1868682 - RNA, 15 nt, Human herpesvirus 3
cagagaagcuauaca

SEQ ID NO: 1868683 - RNA, 15 nt, Human herpesvirus 3
aaguguucuaaaaca

SEQ ID NO: 1868684 - RNA, 14 nt, Human herpesvirus 3
cuugacaacauuua

SEQ ID NO: 1868685 - RNA, 19 nt, Human herpesvirus 3
gugcauaacguugcgguga

SEQ ID NO: 1868686 - RNA, 15 nt, Human herpesvirus 3
agauuccgaguccuc

SEQ ID NO: 1868687 - RNA, 22 nt, Human herpesvirus 3
cugcguuauuuaaaggucugau

SEQ ID NO: 1868688 - RNA, 12 nt, Human herpesvirus 3
acccccccccgg

SEQ ID NO: 1868689 - RNA, 16 nt, Human herpesvirus 3
acgugaggaaaaagag

SEQ ID NO: 1868690 - RNA, 18 nt, Human herpesvirus 3
aagucuucaaagaacucu

SEQ ID NO: 1868691 - RNA, 20 nt, Human herpesvirus 3
ccacgcccacauacccacuc

SEQ ID NO: 1868692 - RNA, 18 nt, Human herpesvirus 3
cugcauaagcucuguaug

SEQ ID NO: 1868693 - RNA, 21 nt, Human herpesvirus 3
agacaucccucguuuauggaa

SEQ ID NO: 1868694 - RNA, 13 nt, Human herpesvirus 3
gucccaggucggc

SEQ ID NO: 1868695 - RNA, 16 nt, Human herpesvirus 3
auauaaaauuaaaaca

SEQ ID NO: 1868696 - RNA, 12 nt, Human herpesvirus 3
guacaacacaaa

SEQ ID NO: 1868697 - RNA, 12 nt, Human herpesvirus 3
ccaccacauuuu

SEQ ID NO: 1868698 - RNA, 21 nt, Human herpesvirus 3
ugucuacuauuugugaagacu

SEQ ID NO: 1868699 - RNA, 18 nt, Human herpesvirus 3
uacacugguaaaugguca

SEQ ID NO: 1868700 - RNA, 12 nt, Human herpesvirus 3
gccacacccaca

SEQ ID NO: 1868701 - RNA, 15 nt, Human herpesvirus 3
gaaaaaagugucugu

SEQ ID NO: 1868702 - RNA, 15 nt, Human herpesvirus 3
cugaucguauugcug

SEQ ID NO: 1868703 - RNA, 18 nt, Human herpesvirus 3
cagcccgauaacauggaa

SEQ ID NO: 1868704 - RNA, 13 nt, Human herpesvirus 3
gcugaagggugca

SEQ ID NO: 1868705 - RNA, 15 nt, Human herpesvirus 3
uauucuauuaacaau

SEQ ID NO: 1868706 - RNA, 22 nt, Human herpesvirus 3
auuuaaaaauccauuaaagagc

SEQ ID NO: 1868707 - RNA, 14 nt, Human herpesvirus 3
guugcaaaagccgu

SEQ ID NO: 1868708 - RNA, 14 nt, Human herpesvirus 3
gucguuuaaagccc

SEQ ID NO: 1868709 - RNA, 18 nt, Human herpesvirus 3
gguggacguuuuuccaca

SEQ ID NO: 1868710 - RNA, 16 nt, Human herpesvirus 3
gcguguuaaacacugu

SEQ ID NO: 1868711 - RNA, 18 nt, Human herpesvirus 3
acuuggucacaaauuacu

SEQ ID NO: 1868712 - RNA, 16 nt, Human herpesvirus 3
gcguccucuguuacau

SEQ ID NO: 1868713 - RNA, 18 nt, Human herpesvirus 3
aggcgugaaagcuaccac

SEQ ID NO: 1868714 - RNA, 17 nt, Human herpesvirus 3
cugccacggccucggcg

SEQ ID NO: 1868715 - RNA, 18 nt, Human herpesvirus 3
gacauaccgacaguaaaa

SEQ ID NO: 1868716 - RNA, 16 nt, Human herpesvirus 3
agaauuaaaaaagccg

SEQ ID NO: 1868717 - RNA, 15 nt, Human herpesvirus 3
cauuaacccacgggg

SEQ ID NO: 1868718 - RNA, 16 nt, Human herpesvirus 3
guuucaaauaacugaa

SEQ ID NO: 1868719 - RNA, 21 nt, Human herpesvirus 3
cuccaucgcuguuuguacaau

SEQ ID NO: 1868720 - RNA, 22 nt, Human herpesvirus 3
aaacauguauaauaaaaaguca

SEQ ID NO: 1868721 - RNA, 20 nt, Human herpesvirus 3
aaaagcggaacgguuuuuau

SEQ ID NO: 1868722 - RNA, 19 nt, Human herpesvirus 3
cauuguauaaaaacacgca

SEQ ID NO: 1868723 - RNA, 17 nt, Human herpesvirus 3
agggacccgcagcccag

SEQ ID NO: 1868724 - RNA, 17 nt, Human herpesvirus 3
cagcaaguuuaacauuu

SEQ ID NO: 1868725 - RNA, 17 nt, Human herpesvirus 3
gcuacucccacccacug

SEQ ID NO: 1868726 - RNA, 12 nt, Human herpesvirus 3
gacaugcacugc

SEQ ID NO: 1868727 - RNA, 18 nt, Human herpesvirus 3
gaauucuuagaaaagcca

SEQ ID NO: 1868728 - RNA, 19 nt, Human herpesvirus 3
aguccccuccuuuucucgu

SEQ ID NO: 1868729 - RNA, 16 nt, Human herpesvirus 3
cguuauacaagguguu

SEQ ID NO: 1868730 - RNA, 14 nt, Human herpesvirus 3
uuuacacuugaauc

SEQ ID NO: 1868731 - RNA, 13 nt, Human herpesvirus 3
cuuauccaacaaa

SEQ ID NO: 1868732 - RNA, 19 nt, Human herpesvirus 3
uaaagucguuuauaucugu

SEQ ID NO: 1868733 - RNA, 19 nt, Human herpesvirus 3
acagcaguaagggugagaa

SEQ ID NO: 1868734 - RNA, 13 nt, Human herpesvirus 3
aucaaucugagaa

SEQ ID NO: 1868735 - RNA, 23 nt, Human herpesvirus 3
aagcauauacacauccuggacac

SEQ ID NO: 1868736 - RNA, 14 nt, Human herpesvirus 3
gaaaugugcuguca

SEQ ID NO: 1868737 - RNA, 23 nt, Human herpesvirus 3
cgaccacgacagcaguaagggug

SEQ ID NO: 1868738 - RNA, 21 nt, Human herpesvirus 3
ugugggaggucuacagcaccc

SEQ ID NO: 1868739 - RNA, 14 nt, Human herpesvirus 3
ugaguuuaggguuu

SEQ ID NO: 1868740 - RNA, 21 nt, Human herpesvirus 3
caccucggccgcuucccgaaa

SEQ ID NO: 1868741 - RNA, 13 nt, Human herpesvirus 3
cgacgugagggug

SEQ ID NO: 1868742 - RNA, 23 nt, Human herpesvirus 3
gaucgguuagaugcauauuugga

SEQ ID NO: 1868743 - RNA, 23 nt, Human herpesvirus 3
gcauauacacauccuggacacag

SEQ ID NO: 1868744 - RNA, 18 nt, Human herpesvirus 3
agccucuguacaacacaa

SEQ ID NO: 1868745 - RNA, 22 nt, Human herpesvirus 3
uguugggucagaaccgacccag

SEQ ID NO: 1868746 - RNA, 13 nt, Human herpesvirus 3
ucaugcaggcuuu

SEQ ID NO: 1868747 - RNA, 23 nt, Human herpesvirus 3
ggaacccaagguguaaauacugc

SEQ ID NO: 1868748 - RNA, 20 nt, Human herpesvirus 3
cugucuugacaacauuuaaa

SEQ ID NO: 1868749 - RNA, 17 nt, Human herpesvirus 3
uccuauauacagugcuu

SEQ ID NO: 1868750 - RNA, 19 nt, Human herpesvirus 3
uuucauuaggaugaaaaga

SEQ ID NO: 1868751 - RNA, 15 nt, Human herpesvirus 3
auacaccggauaaaa

SEQ ID NO: 1868752 - RNA, 16 nt, Human herpesvirus 3
gaaguguucuaaaaca

SEQ ID NO: 1868753 - RNA, 21 nt, Human herpesvirus 3
auaugucaacauuuacaguaa

SEQ ID NO: 1868754 - RNA, 17 nt, Human herpesvirus 3
agguauuguuaccagga

SEQ ID NO: 1868755 - RNA, 12 nt, Human herpesvirus 3
gggugaaguaau

SEQ ID NO: 1868756 - RNA, 14 nt, Human herpesvirus 3
caucagacaugauu

SEQ ID NO: 1868757 - RNA, 20 nt, Human herpesvirus 3
cgauuacagcugccgggaaa

SEQ ID NO: 1868758 - RNA, 16 nt, Human herpesvirus 3
uuuaucccccuucaaa

SEQ ID NO: 1868759 - RNA, 22 nt, Human herpesvirus 3
guucauaacaccgcuauacgca

SEQ ID NO: 1868760 - RNA, 14 nt, Human herpesvirus 3
ccuacacaacaccc

SEQ ID NO: 1868761 - RNA, 22 nt, Human herpesvirus 3
gugaggaaaaagaggcggggag

SEQ ID NO: 1868762 - RNA, 23 nt, Human herpesvirus 3
ucagguuauccaacuguuuacau

SEQ ID NO: 1868763 - RNA, 15 nt, Human herpesvirus 3
cguguuaaacacugu

SEQ ID NO: 1868764 - RNA, 15 nt, Human herpesvirus 3
aggcaacugcaaaca

SEQ ID NO: 1868765 - RNA, 17 nt, Human herpesvirus 3
uaauaaaaagucacuau

SEQ ID NO: 1868766 - RNA, 19 nt, Human herpesvirus 3
cuuugcauuggaagucacc

SEQ ID NO: 1868767 - RNA, 16 nt, Human herpesvirus 3
uaucaaguggucguuu

SEQ ID NO: 1868768 - RNA, 20 nt, Human herpesvirus 3
cuggucaccguguggacauc

SEQ ID NO: 1868769 - RNA, 16 nt, Human herpesvirus 3
gaugaaauaguuucau

SEQ ID NO: 1868770 - RNA, 15 nt, Human herpesvirus 3
aauaaauguacuaua

SEQ ID NO: 1868771 - RNA, 22 nt, Human herpesvirus 3
ugaguugggagguuccucggga

SEQ ID NO: 1868772 - RNA, 23 nt, Human herpesvirus 3
gcaucuuccgacggugacagacu

SEQ ID NO: 1868773 - RNA, 17 nt, Human herpesvirus 3
acgccaguggucucucu

SEQ ID NO: 1868774 - RNA, 20 nt, Human herpesvirus 3
agaaacuuaauacagaguca

SEQ ID NO: 1868775 - RNA, 18 nt, Human herpesvirus 3
uauaagggagucuacaau

SEQ ID NO: 1868776 - RNA, 21 nt, Human herpesvirus 3
acgugguaccaaaaacacagu

SEQ ID NO: 1868777 - RNA, 19 nt, Human herpesvirus 3
gauuuuuuuaaacaaauac

SEQ ID NO: 1868778 - RNA, 15 nt, Human herpesvirus 3
ugauauaagguguua

SEQ ID NO: 1868779 - RNA, 19 nt, Human herpesvirus 3
gagugggguguuguggaua

SEQ ID NO: 1868780 - RNA, 21 nt, Human herpesvirus 3
cucccaaggcggucccucgga

SEQ ID NO: 1868781 - RNA, 18 nt, Human herpesvirus 3
uucaaaggacgaagggga

SEQ ID NO: 1868782 - RNA, 13 nt, Human herpesvirus 3
uauaacugcuaca

SEQ ID NO: 1868783 - RNA, 18 nt, Human herpesvirus 3
guuucugggcgcccggcg

SEQ ID NO: 1868784 - RNA, 14 nt, Human herpesvirus 3
ucccgauuuggaaa

SEQ ID NO: 1868785 - RNA, 17 nt, Human herpesvirus 3
uugccaugacuuccaca

SEQ ID NO: 1868786 - RNA, 12 nt, Human herpesvirus 3
aucguaugccuc

SEQ ID NO: 1868787 - RNA, 20 nt, Human herpesvirus 3
ccuaggaacgcgacaugacc

SEQ ID NO: 1868788 - RNA, 19 nt, Human herpesvirus 3
cauuuugcgcauuuggaau

SEQ ID NO: 1868789 - RNA, 14 nt, Human herpesvirus 3
gucugcgaagcugc

SEQ ID NO: 1868790 - RNA, 20 nt, Human herpesvirus 3
aauuguucugggaacacgua

SEQ ID NO: 1868791 - RNA, 18 nt, Human herpesvirus 3
gauaaauaaaguuuuuaa

SEQ ID NO: 1868792 - RNA, 16 nt, Human herpesvirus 3
uuguaaaacauaucaa

SEQ ID NO: 1868793 - RNA, 12 nt, Human herpesvirus 3
gcugagcuccag

SEQ ID NO: 1868794 - RNA, 14 nt, Human herpesvirus 3
auaucgcaauguuu

SEQ ID NO: 1868795 - RNA, 22 nt, Human herpesvirus 3
ccacguagcaaagcuacacuuu

SEQ ID NO: 1868796 - RNA, 16 nt, Human herpesvirus 3
aguccccuccuuuucu

SEQ ID NO: 1868797 - RNA, 20 nt, Human herpesvirus 3
gccacaauaacauaagggau

SEQ ID NO: 1868798 - RNA, 17 nt, Human herpesvirus 3
augggugguaagguuuu

SEQ ID NO: 1868799 - RNA, 15 nt, Human herpesvirus 3
caagaaaccauguuu

SEQ ID NO: 1868800 - RNA, 23 nt, Human herpesvirus 3
gggucagaaccgacccaggacau

SEQ ID NO: 1868801 - RNA, 18 nt, Human herpesvirus 3
accucggccgcuucccga

SEQ ID NO: 1868802 - RNA, 16 nt, Human herpesvirus 3
uuucugggcgcccggc

SEQ ID NO: 1868803 - RNA, 20 nt, Human herpesvirus 3
gcgacgguauauuacaaaga

SEQ ID NO: 1868804 - RNA, 18 nt, Human herpesvirus 3
ucugcaaucauaaaugca

SEQ ID NO: 1868805 - RNA, 23 nt, Human herpesvirus 3
ugggucagaaccgacccaggaca

SEQ ID NO: 1868806 - RNA, 22 nt, Human herpesvirus 3
uuaauaaaaacacaaccagucu

SEQ ID NO: 1868807 - RNA, 16 nt, Human herpesvirus 3
uugacuuuguuugcug

SEQ ID NO: 1868808 - RNA, 23 nt, Human herpesvirus 3
uuaugaacgccugugaaauaacg

SEQ ID NO: 1868809 - RNA, 14 nt, Human herpesvirus 3
ucgauguaacacca

SEQ ID NO: 1868810 - RNA, 14 nt, Human herpesvirus 3
aggcuuuaucugaa

SEQ ID NO: 1868811 - RNA, 16 nt, Human herpesvirus 3
gagccgcggccagugc

SEQ ID NO: 1868812 - RNA, 22 nt, Human herpesvirus 3
ucauuaugagcaucuagaagau

SEQ ID NO: 1868813 - RNA, 14 nt, Human herpesvirus 3
uccacugcauuuac

SEQ ID NO: 1868814 - RNA, 20 nt, Human herpesvirus 3
auaaacaagucaauauuaca

SEQ ID NO: 1868815 - RNA, 19 nt, Human herpesvirus 3
acccaguacguugcauaac

SEQ ID NO: 1868816 - RNA, 23 nt, Human herpesvirus 3
aaacaucaaccggaacaguaucc

SEQ ID NO: 1868817 - RNA, 23 nt, Human herpesvirus 3
aacacuuggcguguuaaacacug

SEQ ID NO: 1868818 - RNA, 17 nt, Human herpesvirus 3
cuccgcccuaaauuaca

SEQ ID NO: 1868819 - RNA, 20 nt, Human herpesvirus 3
cucccucauaauaugauaca

SEQ ID NO: 1868820 - RNA, 19 nt, Human herpesvirus 3
cuccguaucccugucuuca

SEQ ID NO: 1868821 - RNA, 23 nt, Human herpesvirus 3
acguacaaucgaaaaaaggugua

SEQ ID NO: 1868822 - RNA, 20 nt, Human herpesvirus 3
caccugcauucgaauuacga

SEQ ID NO: 1868823 - RNA, 13 nt, Human herpesvirus 3
ccucaaacacggg

SEQ ID NO: 1868824 - RNA, 17 nt, Human herpesvirus 3
ccguuuggaaacaacaa

SEQ ID NO: 1868825 - RNA, 13 nt, Human herpesvirus 3
cguuaucggucaa

SEQ ID NO: 1868826 - RNA, 17 nt, Human herpesvirus 3
ccgauguucgucgagac

SEQ ID NO: 1868827 - RNA, 21 nt, Human herpesvirus 3
ccgaucccgccgucgcgccca

SEQ ID NO: 1868828 - RNA, 21 nt, Human herpesvirus 3
guacagauacguggaaucgua

SEQ ID NO: 1868829 - RNA, 20 nt, Human herpesvirus 3
gcauuaccgcaaaucuuggc

SEQ ID NO: 1868830 - RNA, 18 nt, Human herpesvirus 3
gcauagacccgaaacgcu

SEQ ID NO: 1868831 - RNA, 16 nt, Human herpesvirus 3
gcaguuauaacacggg

SEQ ID NO: 1868832 - RNA, 13 nt, Human herpesvirus 3
cuuaaaauaaaag

SEQ ID NO: 1868833 - RNA, 20 nt, Human herpesvirus 3
gacgacauuaaacguauucu

SEQ ID NO: 1868834 - RNA, 20 nt, Human herpesvirus 3
gacgcauuugaugaaucguu

SEQ ID NO: 1868835 - RNA, 22 nt, Human herpesvirus 3
cggcaauccgcuagacuguuuu

SEQ ID NO: 1868836 - RNA, 15 nt, Human herpesvirus 3
ccacuggcgcgcgga

SEQ ID NO: 1868837 - RNA, 18 nt, Human herpesvirus 3
cgacagcggauaucgucu

SEQ ID NO: 1868838 - RNA, 12 nt, Human herpesvirus 3
cgcccaccucgg

SEQ ID NO: 1868839 - RNA, 15 nt, Human herpesvirus 3
cgaucaacugcuuuu

SEQ ID NO: 1868840 - RNA, 15 nt, Human herpesvirus 3
cgaucacaacagaca

SEQ ID NO: 1868841 - RNA, 14 nt, Human herpesvirus 3
cggauaucgucuaa

SEQ ID NO: 1868842 - RNA, 14 nt, Human herpesvirus 3
caugcuuguaaaac

SEQ ID NO: 1868843 - RNA, 13 nt, Human herpesvirus 3
cauaaaaacgccu

SEQ ID NO: 1868844 - RNA, 14 nt, Human herpesvirus 3
cagguuauccaacu

SEQ ID NO: 1868845 - RNA, 12 nt, Human herpesvirus 3
augauauacaca

SEQ ID NO: 1868846 - RNA, 21 nt, Human herpesvirus 3
aguacaggguaucuaaguacc

SEQ ID NO: 1868847 - RNA, 15 nt, Human herpesvirus 3
uuuaagguauggagu

SEQ ID NO: 1868848 - RNA, 19 nt, Human herpesvirus 3
ucgucguucgaauccuaga

SEQ ID NO: 1868849 - RNA, 19 nt, Human herpesvirus 3
ucccccacauacaacauga

SEQ ID NO: 1868850 - RNA, 15 nt, Human herpesvirus 3
caccaaaaauauacg

SEQ ID NO: 1868851 - RNA, 16 nt, Human herpesvirus 3
acuguauguaaauuau

SEQ ID NO: 1868852 - RNA, 17 nt, Human herpesvirus 3
acugcuuuuauaacuuu

SEQ ID NO: 1868853 - RNA, 15 nt, Human herpesvirus 3
acuaaaaacguuucu

SEQ ID NO: 1868854 - RNA, 14 nt, Human herpesvirus 3
acuauaauuguuca

SEQ ID NO: 1868855 - RNA, 16 nt, Human herpesvirus 3
gauuuuacagaaaaua

SEQ ID NO: 1868856 - RNA, 22 nt, Human herpesvirus 3
ccgucucugauucggguaaaac

SEQ ID NO: 1868857 - RNA, 16 nt, Human herpesvirus 3
uugucgaucauacgcc

SEQ ID NO: 1868858 - RNA, 20 nt, Human herpesvirus 3
uugucauaaaaacaagaagu

SEQ ID NO: 1868859 - RNA, 21 nt, Human herpesvirus 3
uucccaaaaggauauucacca

SEQ ID NO: 1868860 - RNA, 22 nt, Human herpesvirus 3
uuauuaccgguaccaugggaga

SEQ ID NO: 1868861 - RNA, 19 nt, Human herpesvirus 3
uuaagacguccacacagcc

SEQ ID NO: 1868862 - RNA, 20 nt, Human herpesvirus 3
uuaauucagggcuuacguuu

SEQ ID NO: 1868863 - RNA, 20 nt, Human herpesvirus 3
uuacacgggaaacuauucca

SEQ ID NO: 1868864 - RNA, 12 nt, Human herpesvirus 3
uuaaaacauaca

SEQ ID NO: 1868865 - RNA, 16 nt, Human herpesvirus 3
uguaaccuacacaaca

SEQ ID NO: 1868866 - RNA, 21 nt, Human herpesvirus 3
uagaaaaucgacaucguuugu

SEQ ID NO: 1868867 - RNA, 16 nt, Human herpesvirus 3
cgucauagcaaauaca

SEQ ID NO: 1868868 - RNA, 18 nt, Human herpesvirus 3
gacauaauuaaugcaacc

SEQ ID NO: 1868869 - RNA, 18 nt, Human herpesvirus 3
cuuuuaaagcaguaccgg

SEQ ID NO: 1868870 - RNA, 17 nt, Human herpesvirus 3
cuuugguuauacgggga

SEQ ID NO: 1868871 - RNA, 15 nt, Human herpesvirus 3
gacguccaaguccaa

SEQ ID NO: 1868872 - RNA, 18 nt, Human herpesvirus 3
gacguuauacaagguguu

SEQ ID NO: 1868873 - RNA, 20 nt, Human herpesvirus 3
guauacacacccaccccaga

SEQ ID NO: 1868874 - RNA, 15 nt, Human herpesvirus 3
gcugccgucaaugca

SEQ ID NO: 1868875 - RNA, 21 nt, Human herpesvirus 3
auauaaaagaagccccaacga

SEQ ID NO: 1868876 - RNA, 18 nt, Human herpesvirus 3
caacgaguguaugcguau

SEQ ID NO: 1868877 - RNA, 20 nt, Human herpesvirus 3
caacuguauguaaauuauga

SEQ ID NO: 1868878 - RNA, 15 nt, Human herpesvirus 3
auccucuuaacguug

SEQ ID NO: 1868879 - RNA, 21 nt, Human herpesvirus 3
aagcgcuccgcccuaaauuac

SEQ ID NO: 1868880 - RNA, 18 nt, Human herpesvirus 3
aaguguucuaaaacacug

SEQ ID NO: 1868881 - RNA, 21 nt, Human herpesvirus 3
aauagauaguuauggacuagg

SEQ ID NO: 1868882 - RNA, 23 nt, Human herpesvirus 3
aagguuaaauuuauaaaacacuc

SEQ ID NO: 1868883 - RNA, 20 nt, Human herpesvirus 3
aaucggagacucguggucag

SEQ ID NO: 1868884 - RNA, 20 nt, Human herpesvirus 3
acagugauacccaauagccg

SEQ ID NO: 1868885 - RNA, 18 nt, Human herpesvirus 3
cgaaaacgugcaugcguu

SEQ ID NO: 1868886 - RNA, 16 nt, Human herpesvirus 3
ccuuaaacaacauggc

SEQ ID NO: 1868887 - RNA, 13 nt, Human herpesvirus 3
ccuuaaacaucca

SEQ ID NO: 1868888 - RNA, 21 nt, Human herpesvirus 3
ccuugccgcguggaacacggg

SEQ ID NO: 1868889 - RNA, 14 nt, Human herpesvirus 3
cccgaaagcccgau

SEQ ID NO: 1868890 - RNA, 17 nt, Human herpesvirus 3
gagcauuucgaaucguu

SEQ ID NO: 1868891 - RNA, 23 nt, Human herpesvirus 3
gagcaucucuggacccccaacga

SEQ ID NO: 1868892 - RNA, 22 nt, Human herpesvirus 3
cucacugcuauagccgucagaa

SEQ ID NO: 1868893 - RNA, 15 nt, Human herpesvirus 3
cuccaucacgauaaa

SEQ ID NO: 1868894 - RNA, 13 nt, Human herpesvirus 3
ccgcgcucaauca

SEQ ID NO: 1868895 - RNA, 15 nt, Human herpesvirus 3
auuagaucuaacguu

SEQ ID NO: 1868896 - RNA, 20 nt, Human herpesvirus 3
auguuuuuggagcaacguuu

SEQ ID NO: 1868897 - RNA, 16 nt, Human herpesvirus 3
auuacauuuaauguuu

SEQ ID NO: 1868898 - RNA, 19 nt, Human herpesvirus 3
auucccaguaaacaacagu

SEQ ID NO: 1868899 - RNA, 20 nt, Human herpesvirus 3
auuguaaauuuuaauuacga

SEQ ID NO: 1868900 - RNA, 21 nt, Human herpesvirus 3
auuuauaaaacacucacguuu

SEQ ID NO: 1868901 - RNA, 15 nt, Human herpesvirus 3
aauugggggauuugg

SEQ ID NO: 1868902 - RNA, 12 nt, Human herpesvirus 3
acccaaggugua

SEQ ID NO: 1868903 - RNA, 19 nt, Human herpesvirus 3
agauucaagacuaacauuu

SEQ ID NO: 1868904 - RNA, 14 nt, Human herpesvirus 3
gcucugcaaauaca

SEQ ID NO: 1868905 - RNA, 18 nt, Human herpesvirus 3
gcuguaggucaacauaca

SEQ ID NO: 1868906 - RNA, 16 nt, Human herpesvirus 3
gcuguauugagaaaac

SEQ ID NO: 1868907 - RNA, 16 nt, Human herpesvirus 3
ggugacguuccggggu

SEQ ID NO: 1868908 - RNA, 21 nt, Human herpesvirus 3
uacaucggcauuaacaacgcg

SEQ ID NO: 1868909 - RNA, 19 nt, Human herpesvirus 3
ugcaucguagguauaaacg

SEQ ID NO: 1868910 - RNA, 14 nt, Human herpesvirus 3
gacaaaccccacgc

SEQ ID NO: 1868911 - RNA, 20 nt, Human herpesvirus 3
gacuccagcaucaucugcug

SEQ ID NO: 1868912 - RNA, 22 nt, Human herpesvirus 3
gaaaauaacccccccccgguuu

SEQ ID NO: 1868913 - RNA, 18 nt, Human herpesvirus 3
cgucaacugcaacaugca

SEQ ID NO: 1868914 - RNA, 18 nt, Human herpesvirus 3
ggcuguaggucaacauac

SEQ ID NO: 1868915 - RNA, 16 nt, Human herpesvirus 3
gagauauggguucgga

SEQ ID NO: 1868916 - RNA, 20 nt, Human herpesvirus 3
cucgcaguuuucuuguuccc

SEQ ID NO: 1868917 - RNA, 18 nt, Human herpesvirus 3
gagcaaacuaaagguaua

SEQ ID NO: 1868918 - RNA, 16 nt, Human herpesvirus 3
gaggggaugaaucguu

SEQ ID NO: 1868919 - RNA, 18 nt, Human
aaaacaagaaaguuuccc

SEQ ID NO: 1868920 - RNA, 17 nt, Human
aaaacaagaaaguuucc

SEQ ID NO: 1868921 - RNA, 14 nt, Human
aaaaauugugauca

SEQ ID NO: 1868922 - RNA, 16 nt, Human
agcuccucacucaccu

SEQ ID NO: 1868923 - RNA, 15 nt, Human
aggaccuccaagcca

SEQ ID NO: 1868924 - RNA, 21 nt, Human
aggaccuccaagccacugagc

SEQ ID NO: 1868925 - RNA, 16 nt, Human
agggcacaaagauggg

SEQ ID NO: 1868926 - RNA, 11 nt, Human
agguucuaaaa

SEQ ID NO: 1868927 - RNA, 17 nt, Human
agguaccccuuucuggc

SEQ ID NO: 1868928 - RNA, 21 nt, Human
agguaccccuuucuggcucuc

SEQ ID NO: 1868929 - RNA, 15 nt, Human
agcagccagccguga

SEQ ID NO: 1868930 - RNA, 21 nt, Human
agcaucuuugaauacaaagaa

SEQ ID NO: 1868931 - RNA, 14 nt, Human
agccgucaccccug

SEQ ID NO: 1868932 - RNA, 21 nt, Human
agauaggucagugcaaauacu

SEQ ID NO: 1868933 - RNA, 16 nt, Human
agagccuggugcugcu

SEQ ID NO: 1868934 - RNA, 18 nt, Human
agagccuggugcugcugc

SEQ ID NO: 1868935 - RNA, 17 nt, Human
agacugaucaggaccuc

SEQ ID NO: 1868936 - RNA, 16 nt, Human
agacugaucaggaccu

SEQ ID NO: 1868937 - RNA, 14 nt, Human
agacugaucaggac

SEQ ID NO: 1868938 - RNA, 19 nt, Human
agacugaucaggaccucca

SEQ ID NO: 1868939 - RNA, 13 nt, Human
agaccauaauguu

SEQ ID NO: 1868940 - RNA, 12 nt, Human
agacuaaaagau

SEQ ID NO: 1868941 - RNA, 22 nt, Human
aucuuauaauuuaaaauaugcu

SEQ ID NO: 1868942 - RNA, 14 nt, Human
auguguagccugug

SEQ ID NO: 1868943 - RNA, 15 nt, Human
auguaaucaauguuu

SEQ ID NO: 1868944 - RNA, 16 nt, Human
auguaaucaauguuuc

SEQ ID NO: 1868945 - RNA, 13 nt, Human
augucuuggacac

SEQ ID NO: 1868946 - RNA, 16 nt, Human
augucuuggacacugu

SEQ ID NO: 1868947 - RNA, 19 nt, Human
augucuuggacacuguaca

SEQ ID NO: 1868948 - RNA, 20 nt, Human
augucuuggacacuguacaa

SEQ ID NO: 1868949 - RNA, 14 nt, Human
augucuuguacaug

SEQ ID NO: 1868950 - RNA, 17 nt, Human
augucuuguacaugugu

SEQ ID NO: 1868951 - RNA, 22 nt, Human
augucuuguacauguguagccu

SEQ ID NO: 1868952 - RNA, 18 nt, Human
augcacauauggacucug

SEQ ID NO: 1868953 - RNA, 19 nt, Human
augcacauauggacucugc

SEQ ID NO: 1868954 - RNA, 18 nt, Human
auggcucuaaaaaguuuu

SEQ ID NO: 1868955 - RNA, 18 nt, Human
augggaaucaagauuuaa

SEQ ID NO: 1868956 - RNA, 16 nt, Human
auaauuauaauauacu

SEQ ID NO: 1868957 - RNA, 16 nt, Human
auaccucugugugcuc

SEQ ID NO: 1868958 - RNA, 17 nt, Human
auaccucugugugcucc

SEQ ID NO: 1868959 - RNA, 21 nt, Human
auauaauguuguuauuuaaag

SEQ ID NO: 1868960 - RNA, 22 nt, Human
auauaauguuguuauuuaaaga

SEQ ID NO: 1868961 - RNA, 15 nt, Human
auauggacucugcac

SEQ ID NO: 1868962 - RNA, 16 nt, Human
accccgacgccacagc

SEQ ID NO: 1868963 - RNA, 16 nt, Human
acauccugugccucca

SEQ ID NO: 1868964 - RNA, 19 nt, Human
acagaacaaauguuuguuu

SEQ ID NO: 1868965 - RNA, 21 nt, Human
acacugcugcuccagugcagg

SEQ ID NO: 1868966 - RNA, 16 nt, Human
aauuauaauauacuau

SEQ ID NO: 1868967 - RNA, 14 nt, Human
agaaaauaacaaua

SEQ ID NO: 1868968 - RNA, 18 nt, Human
acugugaugcccugcccu

SEQ ID NO: 1868969 - RNA, 17 nt, Human
acugucuucucccugca

SEQ ID NO: 1868970 - RNA, 19 nt, Human
acuuguaaaggaauuuaaa

SEQ ID NO: 1868971 - RNA, 20 nt, Human
acuuguaaaggaauuuaaaa

SEQ ID NO: 1868972 - RNA, 18 nt, Human
acuuguaaaggaauuuaa

SEQ ID NO: 1868973 - RNA, 15 nt, Human
acuucuuucagcaga

SEQ ID NO: 1868974 - RNA, 14 nt, Human
acuagcuauggugu

SEQ ID NO: 1868975 - RNA, 18 nt, Human
accuugugucuguacacg

SEQ ID NO: 1868976 - RNA, 21 nt, Human
accuugugucuguacacgugu

SEQ ID NO: 1868977 - RNA, 12 nt, Human
accuugugucug

SEQ ID NO: 1868978 - RNA, 13 nt, Human
accuugugucugu

SEQ ID NO: 1868979 - RNA, 15 nt, Human
accuugugucuguac

SEQ ID NO: 1868980 - RNA, 13 nt, Human
aacagcugccucu

SEQ ID NO: 1868981 - RNA, 21 nt, Human
aacaagaagccacagaccuag

SEQ ID NO: 1868982 - RNA, 16 nt, Human
aacaagaaaguuuccc

SEQ ID NO: 1868983 - RNA, 15 nt, Human
aacaagaaaguuucc

SEQ ID NO: 1868984 - RNA, 21 nt, Human
aaagaaaaauuauuaaaggaa

SEQ ID NO: 1868985 - RNA, 12 nt, Human
aaauaacaauga

SEQ ID NO: 1868986 - RNA, 20 nt, Human
aaauaaagcuugcaacaaaa

SEQ ID NO: 1868987 - RNA, 15 nt, Human
aaagucuugugacua

SEQ ID NO: 1868988 - RNA, 18 nt, Human
aaagucuugugacuagug

SEQ ID NO: 1868989 - RNA, 19 nt, Human
aaagucuugugacuagugc

SEQ ID NO: 1868990 - RNA, 21 nt, Human
aaagucuugugacuagugcug

SEQ ID NO: 1868991 - RNA, 22 nt, Human
aaagucuugugacuagugcuga

SEQ ID NO: 1868992 - RNA, 23 nt, Human
aaagucuugugacuagugcugaa

SEQ ID NO: 1868993 - RNA, 22 nt, Human
aaagucucucauucuaggccuc

SEQ ID NO: 1868994 - RNA, 20 nt, Human
aaauagucuagacuaaaaga

SEQ ID NO: 1868995 - RNA, 21 nt, Human
aaauagucuagacuaaaagau

SEQ ID NO: 1868996 - RNA, 18 nt, Human
aagcuaauaaaauaucau

SEQ ID NO: 1868997 - RNA, 20 nt, Human
aagcuaauaaaauaucauuc

SEQ ID NO: 1868998 - RNA, 21 nt, Human
aagcuaauaaaauaucauuca

SEQ ID NO: 1868999 - RNA, 17 nt, Human
aagcuaauaaaauauca

SEQ ID NO: 1869000 - RNA, 21 nt, Human
aagcuaaauccuuuacuguua

SEQ ID NO: 1869001 - RNA, 19 nt, Human
aagaacacccuauauuuug

SEQ ID NO: 1869002 - RNA, 21 nt, Human
aagaacacccuauauuuugca

SEQ ID NO: 1869003 - RNA, 16 nt, Human
aagcagagaagcucuc

SEQ ID NO: 1869004 - RNA, 14 nt, Human
aagcagagaagcuc

SEQ ID NO: 1869005 - RNA, 21 nt, Human
aauaauccuaaacauaugaau

SEQ ID NO: 1869006 - RNA, 13 nt, Human
aauaaacuaaaga

SEQ ID NO: 1869007 - RNA, 21 nt, Human
aagucucucauucuaggccuc

SEQ ID NO: 1869008 - RNA, 18 nt, Human
cucuucaaggacuuucug

SEQ ID NO: 1869009 - RNA, 21 nt, Human
cugaccugguccacagggcac

SEQ ID NO: 1869010 - RNA, 20 nt, Human
cugaccugguccacagggca

SEQ ID NO: 1869011 - RNA, 18 nt, Human
cugaccugguccacaggg

SEQ ID NO: 1869012 - RNA, 17 nt, Human
cugaccugguccacagg

SEQ ID NO: 1869013 - RNA, 16 nt, Human
cugaccugguccacag

SEQ ID NO: 1869014 - RNA, 13 nt, Human
cucucacauuacu

SEQ ID NO: 1869015 - RNA, 14 nt, Human
cucucacauuacug

SEQ ID NO: 1869016 - RNA, 16 nt, Human
cuccaacucagaaggg

SEQ ID NO: 1869017 - RNA, 14 nt, Human
ccuuucauuuacug

SEQ ID NO: 1869018 - RNA, 16 nt, Human
ccuuucauuuacugug

SEQ ID NO: 1869019 - RNA, 22 nt, Human
ccuuucauuuacuguggcuucu

SEQ ID NO: 1869020 - RNA, 18 nt, Human
ccuuucauuuacuguggc

SEQ ID NO: 1869021 - RNA, 19 nt, Human
ccuuucauuuacuguggcu

SEQ ID NO: 1869022 - RNA, 17 nt, Human
cgacacugggaggccag

SEQ ID NO: 1869023 - RNA, 14 nt, Human
cgaccuuggccgca

SEQ ID NO: 1869024 - RNA, 15 nt, Human
cgacgccacagccca

SEQ ID NO: 1869025 - RNA, 23 nt, Human
cgacgccacagcccagccacgga

SEQ ID NO: 1869026 - RNA, 16 nt, Human
cgaccuuggccgcacc

SEQ ID NO: 1869027 - RNA, 23 nt, Human
cgcaggagcacacccagccccca

SEQ ID NO: 1869028 - RNA, 18 nt, Human
cgcaggagcacacccagc

SEQ ID NO: 1869029 - RNA, 15 nt, Human
cggcuccacuaggac

SEQ ID NO: 1869030 - RNA, 22 nt, Human
cggcucccggggcagggcagcc

SEQ ID NO: 1869031 - RNA, 21 nt, Human
cggcucccggggcagggcagc

SEQ ID NO: 1869032 - RNA, 13 nt, Human
ccauuuccugaga

SEQ ID NO: 1869033 - RNA, 21 nt, Human
ccagucacugugagcucccag

SEQ ID NO: 1869034 - RNA, 21 nt, Human
ccaggaguguggccacguggg

SEQ ID NO: 1869035 - RNA, 23 nt, Human
ccagcguggcgcaguggcccuga

SEQ ID NO: 1869036 - RNA, 20 nt, Human
ccuguaaucauauaauaaau

SEQ ID NO: 1869037 - RNA, 22 nt, Human
ccugccucccgcccccuuggcu

SEQ ID NO: 1869038 - RNA, 22 nt, Human
ccaaucauuuuaauuauuauuc

SEQ ID NO: 1869039 - RNA, 12 nt, Human
ccaaucauuuua

SEQ ID NO: 1869040 - RNA, 14 nt, Human
ccaaucauuuuaau

SEQ ID NO: 1869041 - RNA, 18 nt, Human
cauauggacucugcacau

SEQ ID NO: 1869042 - RNA, 15 nt, Human
cauauggacucugca

SEQ ID NO: 1869043 - RNA, 17 nt, Human
cauauggacucugcaca

SEQ ID NO: 1869044 - RNA, 20 nt, Human
cauauggacucugcacauga

SEQ ID NO: 1869045 - RNA, 22 nt, Human
cauggcuauaaacaauuacaug

SEQ ID NO: 1869046 - RNA, 23 nt, Human
cauucuaggccuccuggcccagg

SEQ ID NO: 1869047 - RNA, 15 nt, Human
cagaucauccagaag

SEQ ID NO: 1869048 - RNA, 14 nt, Human
cagccagccgugag

SEQ ID NO: 1869049 - RNA, 20 nt, Human
cagccaggacaccgggcagg

SEQ ID NO: 1869050 - RNA, 12 nt, Human
cagccaggacac

SEQ ID NO: 1869051 - RNA, 16 nt, Human
cagccaggacaccggg

SEQ ID NO: 1869052 - RNA, 11 nt, Human
cagccaggaca

SEQ ID NO: 1869053 - RNA, 18 nt, Human
cagggcucccacagagac

SEQ ID NO: 1869054 - RNA, 15 nt, Human
cagggcucccacaga

SEQ ID NO: 1869055 - RNA, 19 nt, Human
cagggcucccacagagaca

SEQ ID NO: 1869056 - RNA, 14 nt, Human
caccuaaagcagcc

SEQ ID NO: 1869057 - RNA, 17 nt, Human
caccuaaagcagccagc

SEQ ID NO: 1869058 - RNA, 15 nt, Human
caccuaaagcagcca

SEQ ID NO: 1869059 - RNA, 23 nt, Human
caccucaagaagaagaggggcau

SEQ ID NO: 1869060 - RNA, 15 nt, Human
caccuugugucugua

SEQ ID NO: 1869061 - RNA, 17 nt, Human
caccuugugucuguaca

SEQ ID NO: 1869062 - RNA, 21 nt, Human
caccuugugucuguacacgug

SEQ ID NO: 1869063 - RNA, 15 nt, Human
cacaagccagggugu

SEQ ID NO: 1869064 - RNA, 12 nt, Human
cacaagccaggg

SEQ ID NO: 1869065 - RNA, 17 nt, Human
auucuugccaaauauaa

SEQ ID NO: 1869066 - RNA, 16 nt, Human
auuucagcagcugcag

SEQ ID NO: 1869067 - RNA, 17 nt, Human
cuggcagcucagcuucc

SEQ ID NO: 1869068 - RNA, 13 nt, Human
cuggcagcucagc

SEQ ID NO: 1869069 - RNA, 14 nt, Human
cuggcucccaggac

SEQ ID NO: 1869070 - RNA, 16 nt, Human
cuggcucccaggacac

SEQ ID NO: 1869071 - RNA, 15 nt, Human
cuggcuccccaaagg

SEQ ID NO: 1869072 - RNA, 15 nt, Human
cuggcucccaggaca

SEQ ID NO: 1869073 - RNA, 14 nt, Human
cuggcuccccaaag

SEQ ID NO: 1869074 - RNA, 19 nt, Human
cuggaaacauucaggagcu

SEQ ID NO: 1869075 - RNA, 19 nt, Human
cuguuaucaaaacuuucuu

SEQ ID NO: 1869076 - RNA, 15 nt, Human
cuuuuuuuggcccag

SEQ ID NO: 1869077 - RNA, 16 nt, Human
cuuuuuuuggcccagg

SEQ ID NO: 1869078 - RNA, 21 nt, Human
gaacaagcaaacccagacggc

SEQ ID NO: 1869079 - RNA, 16 nt, Human
gaacaagcaaacccag

SEQ ID NO: 1869080 - RNA, 21 nt, Human
cuuggccgcaccuaaagcagc

SEQ ID NO: 1869081 - RNA, 22 nt, Human
cuuggccgcaccuaaagcagcc

SEQ ID NO: 1869082 - RNA, 16 nt, Human
gaucucugcagggccg

SEQ ID NO: 1869083 - RNA, 15 nt, Human
gaucucugcagggcc

SEQ ID NO: 1869084 - RNA, 20 nt, Human
gaucucugcagggccgccag

SEQ ID NO: 1869085 - RNA, 13 nt, Human
gcagccagccgug

SEQ ID NO: 1869086 - RNA, 22 nt, Human
gcagccagccgugagugcagac

SEQ ID NO: 1869087 - RNA, 23 nt, Human
gcagccagccgugagugcagacc

SEQ ID NO: 1869088 - RNA, 12 nt, Human
gcagccaggaca

SEQ ID NO: 1869089 - RNA, 14 nt, Human
gcaguuggccagag

SEQ ID NO: 1869090 - RNA, 22 nt, Human
gcaguuggccagagagccuggu

SEQ ID NO: 1869091 - RNA, 17 nt, Human
gcagucuguccaggcuc

SEQ ID NO: 1869092 - RNA, 23 nt, Human
gcauccacuucuuucagcagacu

SEQ ID NO: 1869093 - RNA, 18 nt, Human
gcauccuccacaauagca

SEQ ID NO: 1869094 - RNA, 20 nt, Human
gcaucuagcaugucgucaaa

SEQ ID NO: 1869095 - RNA, 23 nt, Human
gacacugggaggccagugagcca

SEQ ID NO: 1869096 - RNA, 17 nt, Human
gacacugggaggccagu

SEQ ID NO: 1869097 - RNA, 16 nt, Human
gacacugggaggccag

SEQ ID NO: 1869098 - RNA, 23 nt, Human
gacgccacagcccagccacggac

SEQ ID NO: 1869099 - RNA, 16 nt, Human
gaccuccaagccacug

SEQ ID NO: 1869100 - RNA, 13 nt, Human
gaccucagggcac

SEQ ID NO: 1869101 - RNA, 20 nt, Human
gaccucaguuuuaucauuuu

SEQ ID NO: 1869102 - RNA, 21 nt, Human
gaccucaguuuuaucauuuuc

SEQ ID NO: 1869103 - RNA, 12 nt, Human
gaggggagaagc

SEQ ID NO: 1869104 - RNA, 20 nt, Human
gagaccuggacacaggccug

SEQ ID NO: 1869105 - RNA, 19 nt, Human
gagaccuggacacaggccu

SEQ ID NO: 1869106 - RNA, 19 nt, Human
gagaccuggcacuggaugc

SEQ ID NO: 1869107 - RNA, 16 nt, Human
gccuggcucccaggac

SEQ ID NO: 1869108 - RNA, 18 nt, Human
gccuggcucccaggacac

SEQ ID NO: 1869109 - RNA, 17 nt, Human
gccuggcucccaggaca

SEQ ID NO: 1869110 - RNA, 13 nt, Human
gcguggacucugc

SEQ ID NO: 1869111 - RNA, 14 nt, Human
gcguggacucugca

SEQ ID NO: 1869112 - RNA, 17 nt, Human
gcguggacucugcacau

SEQ ID NO: 1869113 - RNA, 18 nt, Human
gcguggacucugcacaug

SEQ ID NO: 1869114 - RNA, 15 nt, Human
gcggcucccggggca

SEQ ID NO: 1869115 - RNA, 22 nt, Human
gcggcucccggggcagggcagc

SEQ ID NO: 1869116 - RNA, 12 nt, Human
ggaaucaagauu

SEQ ID NO: 1869117 - RNA, 18 nt, Human
ggacacaggccugcucuc

SEQ ID NO: 1869118 - RNA, 13 nt, Human
ggacacaggccug

SEQ ID NO: 1869119 - RNA, 12 nt, Human
ggacaccgggca

SEQ ID NO: 1869120 - RNA, 16 nt, Human
ggaaaaaauaacaaug

SEQ ID NO: 1869121 - RNA, 19 nt, Human
ggcucccggggcagggcag

SEQ ID NO: 1869122 - RNA, 22 nt, Human
ggcuggcaugauccaagcaaga

SEQ ID NO: 1869123 - RNA, 12 nt, Human
ggcuggcaugau

SEQ ID NO: 1869124 - RNA, 23 nt, Human
aaaaaguuuugcccuuuuuaagg

SEQ ID NO: 1869125 - RNA, 17 nt, Human
ggccgcccgggcccaga

SEQ ID NO: 1869126 - RNA, 21 nt, Human
ggccgcccgggcccagaggag

SEQ ID NO: 1869127 - RNA, 16 nt, Human
ggccuggcagcucagc

SEQ ID NO: 1869128 - RNA, 14 nt, Human
ggccuggcagcuca

SEQ ID NO: 1869129 - RNA, 20 nt, Human
ggcuaagcuucacuguaaaa

SEQ ID NO: 1869130 - RNA, 20 nt, Human
ggauuucaugauuucauuuc

SEQ ID NO: 1869131 - RNA, 22 nt, Human
ggcagggccgcccgggcccaga

SEQ ID NO: 1869132 - RNA, 20 nt, Human
ggcagccuggcucccaggac

SEQ ID NO: 1869133 - RNA, 21 nt, Human
ggcagccuggcucccaggaca

SEQ ID NO: 1869134 - RNA, 14 nt, Human
ggcagccuggcucc

SEQ ID NO: 1869135 - RNA, 18 nt, Human
ggcagccuggcucccagg

SEQ ID NO: 1869136 - RNA, 19 nt, Human
ggcagccuggcucccagga

SEQ ID NO: 1869137 - RNA, 22 nt, Human
ggcagccuggcucccaggacac

SEQ ID NO: 1869138 - RNA, 22 nt, Human
ggccagagagccuggugcugcu

SEQ ID NO: 1869139 - RNA, 18 nt, Human
ggccagagagccuggugc

SEQ ID NO: 1869140 - RNA, 21 nt, Human
ggccagagagccuggugcugc

SEQ ID NO: 1869141 - RNA, 13 nt, Human
ggagugugugucu

SEQ ID NO: 1869142 - RNA, 18 nt, Human
aaauauaugcuaagucuu

SEQ ID NO: 1869143 - RNA, 20 nt, Human
aaauauauuuaagauaauua

SEQ ID NO: 1869144 - RNA, 21 nt, Human
aaauauauuuaagauaauuau

SEQ ID NO: 1869145 - RNA, 12 nt, Human
aaauauauuuaa

SEQ ID NO: 1869146 - RNA, 22 nt, Human
aaauauauuuaagauaauuaua

SEQ ID NO: 1869147 - RNA, 17 nt, Human
aaauaucauucagcaac

SEQ ID NO: 1869148 - RNA, 16 nt, Human
aaauaucauucagcaa

SEQ ID NO: 1869149 - RNA, 13 nt, Human
aaauaucauucag

SEQ ID NO: 1869150 - RNA, 14 nt, Human
aaauaucauucagc

SEQ ID NO: 1869151 - RNA, 15 nt, Human
aaauaucauucagca

SEQ ID NO: 1869152 - RNA, 14 nt, Human
guaaucaauguuuc

SEQ ID NO: 1869153 - RNA, 18 nt, Human
ggguuuuccaaugugacu

SEQ ID NO: 1869154 - RNA, 13 nt, Human
gguaaaauacuuc

SEQ ID NO: 1869155 - RNA, 14 nt, Human
ggucagugcaaaua

SEQ ID NO: 1869156 - RNA, 21 nt, Human
gguccagaaggagacaggcag

SEQ ID NO: 1869157 - RNA, 17 nt, Human
ggguccagaaggagaca

SEQ ID NO: 1869158 - RNA, 13 nt, Human
ggguccagaagga

SEQ ID NO: 1869159 - RNA, 16 nt, Human
aaaauggaaccaggcu

SEQ ID NO: 1869160 - RNA, 13 nt, Human
aaaauaucauuca

SEQ ID NO: 1869161 - RNA, 14 nt, Human
aaaauaucauucag

SEQ ID NO: 1869162 - RNA, 16 nt, Human
aaaauaucauucagca

SEQ ID NO: 1869163 - RNA, 23 nt, Human
gggccgccagggagaccuggaca

SEQ ID NO: 1869164 - RNA, 20 nt, Human
gggccgcccgggcccagagg

SEQ ID NO: 1869165 - RNA, 20 nt, Human
gggccgccagggagaccugg

SEQ ID NO: 1869166 - RNA, 13 nt, Human
auuaaagacagag

SEQ ID NO: 1869167 - RNA, 15 nt, Human
uuuugccauuaaacu

SEQ ID NO: 1869168 - RNA, 19 nt, Human
uuuuugugaaaagcuccau

SEQ ID NO: 1869169 - RNA, 23 nt, Human
auuagucauucaauaaauuguaa

SEQ ID NO: 1869170 - RNA, 13 nt, Human
auguuguuauuua

SEQ ID NO: 1869171 - RNA, 14 nt, Human
auguuguuauuuaa

SEQ ID NO: 1869172 - RNA, 15 nt, Human
auguuguuauuuaaa

SEQ ID NO: 1869173 - RNA, 17 nt, Human
auguuguuauuuaaaga

SEQ ID NO: 1869174 - RNA, 12 nt, Human
auguuguuauuu

SEQ ID NO: 1869175 - RNA, 15 nt, Human
auucuaaaugaaugu

SEQ ID NO: 1869176 - RNA, 17 nt, Human
auucuaaaugaauguuu

SEQ ID NO: 1869177 - RNA, 18 nt, Human
auucuaaaugaauguuua

SEQ ID NO: 1869178 - RNA, 19 nt, Human
auuucauuuuuacccuuac

SEQ ID NO: 1869179 - RNA, 18 nt, Human
auuucauuucaacuguuu

SEQ ID NO: 1869180 - RNA, 23 nt, Human
auugugaucagaccauaauguua

SEQ ID NO: 1869181 - RNA, 22 nt, Human
auuuucaguuauuauauuuaca

SEQ ID NO: 1869182 - RNA, 23 nt, Human
auuuuaauuauuauucuucauaa

SEQ ID NO: 1869183 - RNA, 13 nt, Human
auuuuaauuauua

SEQ ID NO: 1869184 - RNA, 19 nt, Human
auuuuaauuauuauucuuc

SEQ ID NO: 1869185 - RNA, 18 nt, Human
auuuugguccaaguugug

SEQ ID NO: 1869186 - RNA, 15 nt, Human
uugcuaucuauugau

SEQ ID NO: 1869187 - RNA, 15 nt, Human
aucuaauaccucugu

SEQ ID NO: 1869188 - RNA, 17 nt, Human
aucuaauaccucugugu

SEQ ID NO: 1869189 - RNA, 19 nt, Human
aucuaauaccucugugugc

SEQ ID NO: 1869190 - RNA, 17 nt, Human
aucuuuucacaaauaaa

SEQ ID NO: 1869191 - RNA, 13 nt, Human
aucuuuucacaaa

SEQ ID NO: 1869192 - RNA, 14 nt, Human
aucuuuucacaaau

SEQ ID NO: 1869193 - RNA, 15 nt, Human
aucuuuucacaaaua

SEQ ID NO: 1869194 - RNA, 16 nt, Human
aucuuuucacaaauaa

SEQ ID NO: 1869195 - RNA, 15 nt, Human
augcaccuugugucu

SEQ ID NO: 1869196 - RNA, 16 nt, Human
augcaccuugugucug

SEQ ID NO: 1869197 - RNA, 18 nt, Human
augcaccuugugucugua

SEQ ID NO: 1869198 - RNA, 19 nt, Human
augcaccuugugucuguac

SEQ ID NO: 1869199 - RNA, 18 nt, Human
augagaugccugaagcca

SEQ ID NO: 1869200 - RNA, 15 nt, Human
uuucuccagggucag

SEQ ID NO: 1869201 - RNA, 22 nt, Human
uuucuuuucuggaauguaauca

SEQ ID NO: 1869202 - RNA, 18 nt, Human
uuucuggaauguaaucaa

SEQ ID NO: 1869203 - RNA, 19 nt, Human
uuuccuuucauuuacugug

SEQ ID NO: 1869204 - RNA, 16 nt, Human
uuuccuuccagcccag

SEQ ID NO: 1869205 - RNA, 15 nt, Human
uuuccuuccagccca

SEQ ID NO: 1869206 - RNA, 13 nt, Human
uuuauauauguau

SEQ ID NO: 1869207 - RNA, 17 nt, Human
auggaaccaggcuugga

SEQ ID NO: 1869208 - RNA, 16 nt, Human
auggaaccaggcuugg

SEQ ID NO: 1869209 - RNA, 21 nt, Human
uucaguaacccccacuggacu

SEQ ID NO: 1869210 - RNA, 13 nt, Human
auauaugcuaagu

SEQ ID NO: 1869211 - RNA, 15 nt, Human
auauggccucaagau

SEQ ID NO: 1869212 - RNA, 16 nt, Human
auauggccucaagauc

SEQ ID NO: 1869213 - RNA, 19 nt, Human
aucaauguuucuucuaggu

SEQ ID NO: 1869214 - RNA, 13 nt, Human
auauuuacaaaug

SEQ ID NO: 1869215 - RNA, 21 nt, Human
uucuuuucuggaauguaauca

SEQ ID NO: 1869216 - RNA, 19 nt, Human
uugagaggcccugggguuc

SEQ ID NO: 1869217 - RNA, 16 nt, Human
aucauauaauaaaugu

SEQ ID NO: 1869218 - RNA, 20 nt, Human
aucauauaauaaauguacau

SEQ ID NO: 1869219 - RNA, 18 nt, Human
uucucccugcacaagcca

SEQ ID NO: 1869220 - RNA, 21 nt, Human
uucuucuagguucuaaaaauu

SEQ ID NO: 1869221 - RNA, 18 nt, Human
uucuucuagguucuaaaa

SEQ ID NO: 1869222 - RNA, 12 nt, Human
aggcuggcauga

SEQ ID NO: 1869223 - RNA, 18 nt, Human
uggacgagaaaacaauaa

SEQ ID NO: 1869224 - RNA, 23 nt, Human
uggcacccaagaccucagggcac

SEQ ID NO: 1869225 - RNA, 14 nt, Human
uggcacccaagacc

SEQ ID NO: 1869226 - RNA, 23 nt, Human
uggccgcaccuaaagcagccagc

SEQ ID NO: 1869227 - RNA, 21 nt, Human
uggccgcaccuaaagcagcca

SEQ ID NO: 1869228 - RNA, 22 nt, Human
uggccgcaccuaaagcagccag

SEQ ID NO: 1869229 - RNA, 12 nt, Human
uggccuggcaca

SEQ ID NO: 1869230 - RNA, 16 nt, Human
uggccuggcacacauc

SEQ ID NO: 1869231 - RNA, 18 nt, Human
uggccuggcacacaucag

SEQ ID NO: 1869232 - RNA, 21 nt, Human
aggcccaaauuaucaagcuaa

SEQ ID NO: 1869233 - RNA, 14 nt, Human
aggccuccuggccc

SEQ ID NO: 1869234 - RNA, 11 nt, Human
aggaauuuaaa

SEQ ID NO: 1869235 - RNA, 17 nt, Human
aggacuuucugaagccu

SEQ ID NO: 1869236 - RNA, 21 nt, Human
aggacugugaugcccugcccu

SEQ ID NO: 1869237 - RNA, 20 nt, Human
aggacugugaugcccugccc

SEQ ID NO: 1869238 - RNA, 14 nt, Human
aggacugugaugcc

SEQ ID NO: 1869239 - RNA, 12 nt, Human
ugcauucuagua

SEQ ID NO: 1869240 - RNA, 20 nt, Human
agcuccccgcuucugccugc

SEQ ID NO: 1869241 - RNA, 21 nt, Human
agcuccccgcuucugccugca

SEQ ID NO: 1869242 - RNA, 17 nt, Human
ugcagaccccuuggcca

SEQ ID NO: 1869243 - RNA, 19 nt, Human
ugcagaccccuuggccagc

SEQ ID NO: 1869244 - RNA, 11 nt, Human
agcccagccac

SEQ ID NO: 1869245 - RNA, 15 nt, Human
agcccagccacggac

SEQ ID NO: 1869246 - RNA, 15 nt, Human
ugauuucauuaauac

SEQ ID NO: 1869247 - RNA, 18 nt, Human
ugaugaacucuuaaucaa

SEQ ID NO: 1869248 - RNA, 14 nt, Human
agccagaggacugu

SEQ ID NO: 1869249 - RNA, 13 nt, Human
agccagaggacug

SEQ ID NO: 1869250 - RNA, 17 nt, Human
agccagaggacugugau

SEQ ID NO: 1869251 - RNA, 22 nt, Human
aguugcauagguuuaauaauuu

SEQ ID NO: 1869252 - RNA, 15 nt, Human
aguuuuaucauuuuc

SEQ ID NO: 1869253 - RNA, 14 nt, Human
aguuuuaucauuuu

SEQ ID NO: 1869254 - RNA, 20 nt, Human
aguuuuaucauuuucaaaau

SEQ ID NO: 1869255 - RNA, 19 nt, Human
aguuuccuuccagcccaga

SEQ ID NO: 1869256 - RNA, 20 nt, Human
uguuugccuucuacuuuuaa

SEQ ID NO: 1869257 - RNA, 12 nt, Human
aguucuugugcc

SEQ ID NO: 1869258 - RNA, 13 nt, Human
aguucuugugcca

SEQ ID NO: 1869259 - RNA, 14 nt, Human
aguucuugugccau

SEQ ID NO: 1869260 - RNA, 18 nt, Human
uguuauuuuuuaauuauu

SEQ ID NO: 1869261 - RNA, 20 nt, Human
aguuauuauauuuacaaaug

SEQ ID NO: 1869262 - RNA, 16 nt, Human
uguuguaaacauuucu

SEQ ID NO: 1869263 - RNA, 21 nt, Human
uuaucagucauaacuaaauaa

SEQ ID NO: 1869264 - RNA, 23 nt, Human
uuaucagucauaacuaaauaaag

SEQ ID NO: 1869265 - RNA, 13 nt, Human
uuaucaagcuaau

SEQ ID NO: 1869266 - RNA, 20 nt, Human
uuaucaagcuaauaaaauau

SEQ ID NO: 1869267 - RNA, 15 nt, Human
uuaucaacaauagug

SEQ ID NO: 1869268 - RNA, 16 nt, Human
uuaucaaaacuuucuu

SEQ ID NO: 1869269 - RNA, 21 nt, Human
auacaguucggugagcuacaa

SEQ ID NO: 1869270 - RNA, 14 nt, Human
uuauauauguauuu

SEQ ID NO: 1869271 - RNA, 17 nt, Human
uuauauauguauuuaua

SEQ ID NO: 1869272 - RNA, 17 nt, Human
auaaacuaaagaaaaau

SEQ ID NO: 1869273 - RNA, 12 nt, Human
auaaacuaaaga

SEQ ID NO: 1869274 - RNA, 12 nt, Human
auaaaugucugu

SEQ ID NO: 1869275 - RNA, 15 nt, Human
auaaaugucuguuga

SEQ ID NO: 1869276 - RNA, 14 nt, Human
auaaugaauacuuu

SEQ ID NO: 1869277 - RNA, 23 nt, Human
auaaguucuaguugcuuguaaaa

SEQ ID NO: 1869278 - RNA, 21 nt, Human
auaaguuucugggaccucagu

SEQ ID NO: 1869279 - RNA, 19 nt, Human
ugggugaaggcuggcauga

SEQ ID NO: 1869280 - RNA, 16 nt, Human
ugggugaaggcuggca

SEQ ID NO: 1869281 - RNA, 15 nt, Human
ugggugaaggcuggc

SEQ ID NO: 1869282 - RNA, 14 nt, Human
ugggugaaggcugg

SEQ ID NO: 1869283 - RNA, 21 nt, Human
ugguccacagggcaccugcca

SEQ ID NO: 1869284 - RNA, 15 nt, Human
ugguccacagggcac

SEQ ID NO: 1869285 - RNA, 14 nt, Human
ugguccacagggca

SEQ ID NO: 1869286 - RNA, 13 nt, Human
ugguccacagggc

SEQ ID NO: 1869287 - RNA, 21 nt, Human
aggggucgacuucgggcuggc

SEQ ID NO: 1869288 - RNA, 19 nt, Human
aggggucgacuucgggcug

SEQ ID NO: 1869289 - RNA, 14 nt, Human
ugggaaucaagauu

SEQ ID NO: 1869290 - RNA, 15 nt, Human
aggucagugcaaaua

SEQ ID NO: 1869291 - RNA, 22 nt, Human
ugguccaugggccauaugaaaa

SEQ ID NO: 1869292 - RNA, 17 nt, Human
uguacauguguagccug

SEQ ID NO: 1869293 - RNA, 20 nt, Human
uguacauguguagccugugc

SEQ ID NO: 1869294 - RNA, 21 nt, Human
uguacauguguagccugugca

SEQ ID NO: 1869295 - RNA, 14 nt, Human
uguacauuaauuac

SEQ ID NO: 1869296 - RNA, 22 nt, Human
uguacauuagucauucaauaaa

SEQ ID NO: 1869297 - RNA, 17 nt, Human
agugaaagaaaauaaca

SEQ ID NO: 1869298 - RNA, 15 nt, Human
agugagccacuccgg

SEQ ID NO: 1869299 - RNA, 17 nt, Human
ugucuucucccugcaca

SEQ ID NO: 1869300 - RNA, 13 nt, Human
ugucuuggacacu

SEQ ID NO: 1869301 - RNA, 15 nt, Human
ugucuuggacacugu

SEQ ID NO: 1869302 - RNA, 21 nt, Human
agucacagaacaaauguuugu

SEQ ID NO: 1869303 - RNA, 23 nt, Human
agucacauggccuaugcacauau

SEQ ID NO: 1869304 - RNA, 24 nt, Human
uguccuguaguugcguggacucug

SEQ ID NO: 1869305 - RNA, 13 nt, Human
ugaaagaaaauaa

SEQ ID NO: 1869306 - RNA, 17 nt, Human
ucuuuuuuuggcccagg

SEQ ID NO: 1869307 - RNA, 19 nt, Human
agacucuacccauauuaca

SEQ ID NO: 1869308 - RNA, 22 nt, Human
ugaagaagcuaaauccuuuacu

SEQ ID NO: 1869309 - RNA, 13 nt, Human
agcaagucucuuu

SEQ ID NO: 1869310 - RNA, 15 nt, Human
ugacuuaagaagccu

SEQ ID NO: 1869311 - RNA, 20 nt, Human
ugaccugguccacagggcac

SEQ ID NO: 1869312 - RNA, 15 nt, Human
ugaccugguccacag

SEQ ID NO: 1869313 - RNA, 14 nt, Human
ugacuagugcugaa

SEQ ID NO: 1869314 - RNA, 15 nt, Human
ugacuagugcugaag

SEQ ID NO: 1869315 - RNA, 17 nt, Human
ugacuagugcugaagcu

SEQ ID NO: 1869316 - RNA, 18 nt, Human
ugacuagugcugaagcuu

SEQ ID NO: 1869317 - RNA, 22 nt, Human
ugacuagugcugaagcuuauua

SEQ ID NO: 1869318 - RNA, 21 nt, Human
ugacuagugcugaagcuuauu

SEQ ID NO: 1869319 - RNA, 16 nt, Human
acuuauucucaagaag

SEQ ID NO: 1869320 - RNA, 14 nt, Human
ucuaauaccucugu

SEQ ID NO: 1869321 - RNA, 16 nt, Human
ucuaauaccucugugu

SEQ ID NO: 1869322 - RNA, 17 nt, Human
ucuaauaccucugugug

SEQ ID NO: 1869323 - RNA, 20 nt, Human
ucuaauaccucugugugcuc

SEQ ID NO: 1869324 - RNA, 14 nt, Human
ucuagacuaaaaga

SEQ ID NO: 1869325 - RNA, 18 nt, Human
ucuaguugcuuguaaaau

SEQ ID NO: 1869326 - RNA, 21 nt, Human
ucuauugauaauuuagacauu

SEQ ID NO: 1869327 - RNA, 18 nt, Human
ucugggauaaguaaguuu

SEQ ID NO: 1869328 - RNA, 20 nt, Human
ucugcagggccgccagggag

SEQ ID NO: 1869329 - RNA, 13 nt, Human
ucugaagccucac

SEQ ID NO: 1869330 - RNA, 21 nt, Human
agaaauaugcacaauagcagu

SEQ ID NO: 1869331 - RNA, 14 nt, Human
acucuuaaucaaau

SEQ ID NO: 1869332 - RNA, 15 nt, Human
acugacugcagggac

SEQ ID NO: 1869333 - RNA, 22 nt, Human
acugaccugguccacagggcac

SEQ ID NO: 1869334 - RNA, 21 nt, Human
acugaccugguccacagggca

SEQ ID NO: 1869335 - RNA, 17 nt, Human
acugaccugguccacag

SEQ ID NO: 1869336 - RNA, 13 nt, Human
acucuuuguaaga

SEQ ID NO: 1869337 - RNA, 14 nt, Human
acucuuuguaagag

SEQ ID NO: 1869338 - RNA, 14 nt, Human
acugagccuuguaa

SEQ ID NO: 1869339 - RNA, 15 nt, Human
acuaauuuuaaaaug

SEQ ID NO: 1869340 - RNA, 21 nt, Human
acucaauguuacuaucugcuu

SEQ ID NO: 1869341 - RNA, 12 nt, Human
acuaucugcuuu

SEQ ID NO: 1869342 - RNA, 13 nt, Human
acuaucugcuuuu

SEQ ID NO: 1869343 - RNA, 22 nt, Human
acggcuccacuaggacuucaaa

SEQ ID NO: 1869344 - RNA, 24 nt, Human
acgcggcucccggggcagggcagc

SEQ ID NO: 1869345 - RNA, 13 nt, Human
acgaaacccacuc

SEQ ID NO: 1869346 - RNA, 12 nt, Human
acgaaauguuau

SEQ ID NO: 1869347 - RNA, 13 nt, Human
acgaaauguuauu

SEQ ID NO: 1869348 - RNA, 23 nt, Human
acgaaauguuauuuuuuaauuau

SEQ ID NO: 1869349 - RNA, 16 nt, Human
acgaaauguuauuuuu

SEQ ID NO: 1869350 - RNA, 21 nt, Human
ucauauguaccauguacauga

SEQ ID NO: 1869351 - RNA, 22 nt, Human
ucauauguaccauguacaugaa

SEQ ID NO: 1869352 - RNA, 15 nt, Human
ucauauaauaaaugu

SEQ ID NO: 1869353 - RNA, 16 nt, Human
ucauauaauaaaugua

SEQ ID NO: 1869354 - RNA, 17 nt, Human
ucaguuuuugugaaaag

SEQ ID NO: 1869355 - RNA, 15 nt, Human
ucaguuuuugugaaa

SEQ ID NO: 1869356 - RNA, 16 nt, Human
ucaguuuuaucauuuu

SEQ ID NO: 1869357 - RNA, 17 nt, Human
ucaguuuuaucauuuuc

SEQ ID NO: 1869358 - RNA, 19 nt, Human
ucaguuuuaucauuuucaa

SEQ ID NO: 1869359 - RNA, 17 nt, Human
ucaugauuucauuucaa

SEQ ID NO: 1869360 - RNA, 23 nt, Human
ucaugauuucauuucaacuguuu

SEQ ID NO: 1869361 - RNA, 13 nt, Human
accauaauguuac

SEQ ID NO: 1869362 - RNA, 15 nt, Human
accauaauguuacau

SEQ ID NO: 1869363 - RNA, 18 nt, Human
accauaauguuacauuau

SEQ ID NO: 1869364 - RNA, 17 nt, Human
acccaggaguguggcca

SEQ ID NO: 1869365 - RNA, 18 nt, Human
accccagccuggccacgc

SEQ ID NO: 1869366 - RNA, 20 nt, Human
acccgggcagggcucccaca

SEQ ID NO: 1869367 - RNA, 20 nt, Human
acaugaaucccacccacaug

SEQ ID NO: 1869368 - RNA, 21 nt, Human
acaugaaucccacccacaugu

SEQ ID NO: 1869369 - RNA, 23 nt, Human
acaugaaucccacccacauguga

SEQ ID NO: 1869370 - RNA, 20 nt, Human
ucaagucggaucuaguccag

SEQ ID NO: 1869371 - RNA, 16 nt, Human
ucacugugagcuccca

SEQ ID NO: 1869372 - RNA, 16 nt, Human
ucaauucuugccaaau

SEQ ID NO: 1869373 - RNA, 20 nt, Human
uaacgauaaaagacagugaa

SEQ ID NO: 1869374 - RNA, 14 nt, Human
uaacauauaauguu

SEQ ID NO: 1869375 - RNA, 23 nt, Human
uaacauauaauguuguuauuuaa

SEQ ID NO: 1869376 - RNA, 20 nt, Human
aauaucagcaagucucuuua

SEQ ID NO: 1869377 - RNA, 13 nt, Human
aauccuuuacugu

SEQ ID NO: 1869378 - RNA, 19 nt, Human
aaucuuauaauuuaaaaua

SEQ ID NO: 1869379 - RNA, 18 nt, Human
aaucauauaauaaaugua

SEQ ID NO: 1869380 - RNA, 21 nt, Human
aaucauauaauaaauguacau

SEQ ID NO: 1869381 - RNA, 23 nt, Human
aaugaauguuuacacucuuugua

SEQ ID NO: 1869382 - RNA, 15 nt, Human
uaaucuuuucacaaa

SEQ ID NO: 1869383 - RNA, 16 nt, Human
uaaucuuuucacaaau

SEQ ID NO: 1869384 - RNA, 17 nt, Human
uaaucuuuucacaaaua

SEQ ID NO: 1869385 - RNA, 18 nt, Human
uaaucuuuucacaaauaa

SEQ ID NO: 1869386 - RNA, 19 nt, Human
uaaucuuuucacaaauaaa

SEQ ID NO: 1869387 - RNA, 21 nt, Human
aauuaccuugagccaguaauu

SEQ ID NO: 1869388 - RNA, 18 nt, Human
aauuccaagugauugaaa

SEQ ID NO: 1869389 - RNA, 22 nt, Human
aauuauuauuuauauauguauu

SEQ ID NO: 1869390 - RNA, 20 nt, Human
aauugcauuuuuuaaaacaa

SEQ ID NO: 1869391 - RNA, 21 nt, Human
aauugcauuuuuuaaaacaag

SEQ ID NO: 1869392 - RNA, 14 nt, Human
uacuauauuuaugg

SEQ ID NO: 1869393 - RNA, 13 nt, Human
uacacguguccug

SEQ ID NO: 1869394 - RNA, 17 nt, Human
uacacguguccuguagu

SEQ ID NO: 1869395 - RNA, 16 nt, Human
uacauguguagccugu

SEQ ID NO: 1869396 - RNA, 19 nt, Human
uacauguguagccugugca

SEQ ID NO: 1869397 - RNA, 18 nt, Human
uacauguguagccugugc

SEQ ID NO: 1869398 - RNA, 14 nt, Human
uaugucuuggacac

SEQ ID NO: 1869399 - RNA, 17 nt, Human
uaugucuuggacacugu

SEQ ID NO: 1869400 - RNA, 19 nt, Human
uaugucuuggacacuguac

SEQ ID NO: 1869401 - RNA, 21 nt, Human
uaugucuuggacacuguacaa

SEQ ID NO: 1869402 - RNA, 12 nt, Human
uaucaagcuaau

SEQ ID NO: 1869403 - RNA, 13 nt, Human
uaucaagcuaaua

SEQ ID NO: 1869404 - RNA, 15 nt, Human
uaucaagcuaauaaa

SEQ ID NO: 1869405 - RNA, 23 nt, Human
uaucaagcuaauaaaauaucauu

SEQ ID NO: 1869406 - RNA, 13 nt, Human
uaugcuaaucagg

SEQ ID NO: 1869407 - RNA, 16 nt, Human
uaguaccaaucauuuu

SEQ ID NO: 1869408 - RNA, 23 nt, Human
uaguaccaaucauuuuaauuauu

SEQ ID NO: 1869409 - RNA, 17 nt, Human
acacauaccuuugguua

SEQ ID NO: 1869410 - RNA, 14 nt, Human
acacauaccuuugg

SEQ ID NO: 1869411 - RNA, 14 nt, Human
acaaggagggcaca

SEQ ID NO: 1869412 - RNA, 20 nt, Human
uaggaggaccagagcuacug

SEQ ID NO: 1869413 - RNA, 15 nt, Human
uagccagaggacugu

SEQ ID NO: 1869414 - RNA, 18 nt, Human
acaaaaggauaaugaaua

SEQ ID NO: 1869415 - RNA, 18 nt, Human
acaaaggcaaagggucca

SEQ ID NO: 1869416 - RNA, 22 nt, Human
acaaagaugggugaaggcuggc

SEQ ID NO: 1869417 - RNA, 21 nt, Human
acaaagaugggugaaggcugg

SEQ ID NO: 1869418 - RNA, 14 nt, Human
gugcuccuccuugg

SEQ ID NO: 1869419 - RNA, 13 nt, Human
gucuugugacuag

SEQ ID NO: 1869420 - RNA, 19 nt, Human
gucuugugacuagugcuga

SEQ ID NO: 1869421 - RNA, 20 nt, Human
gucuugugacuagugcugaa

SEQ ID NO: 1869422 - RNA, 21 nt, Human
gucuugugacuagugcugaag

SEQ ID NO: 1869423 - RNA, 19 nt, Human
gucuuauauauuguagaua

SEQ ID NO: 1869424 - RNA, 21 nt, Human
gucucuuuuuuuggcccaggc

SEQ ID NO: 1869425 - RNA, 20 nt, Human
gucucuuuuuuuggcccagg

SEQ ID NO: 1869426 - RNA, 17 nt, Human
aaauuccaagugauuga

SEQ ID NO: 1869427 - RNA, 17 nt, Human
aaauuguauuacaaauc

SEQ ID NO: 1869428 - RNA, 13 nt, Human
guauuuauaaaua

SEQ ID NO: 1869429 - RNA, 21 nt, Human
gucacauggccuaugcacaua

SEQ ID NO: 1869430 - RNA, 23 nt, Human
gucacauggccuaugcacauaug

SEQ ID NO: 1869431 - RNA, 15 nt, Human
gucagaaacaggacc

SEQ ID NO: 1869432 - RNA, 13 nt, Human
aacauauaauguu

SEQ ID NO: 1869433 - RNA, 18 nt, Human
aacauauaauguuguuau

SEQ ID NO: 1869434 - RNA, 21 nt, Human
aacauauaauguuguuauuua

SEQ ID NO: 1869435 - RNA, 21 nt, Human
aacaguuuuuuaugcuaauca

SEQ ID NO: 1869436 - RNA, 22 nt, Human
aacauauaauguuguuauuuaa

SEQ ID NO: 1869437 - RNA, 14 nt, Human
aacauucaggagcu

SEQ ID NO: 1869438 - RNA, 13 nt, Human
aacauucaggagc

SEQ ID NO: 1869439 - RNA, 14 nt, Human
uaaaauaucauuca

SEQ ID NO: 1869440 - RNA, 15 nt, Human
uaaaauaucauucag

SEQ ID NO: 1869441 - RNA, 17 nt, Human
uaaaauaucauucagca

SEQ ID NO: 1869442 - RNA, 16 nt, Human
uaaaauaucauucagc

SEQ ID NO: 1869443 - RNA, 15 nt, Human
aaguuugauuucauu

SEQ ID NO: 1869444 - RNA, 16 nt, Human
aaguuugauuucauua

SEQ ID NO: 1869445 - RNA, 21 nt, Human
aaguuuccuuccagcccagaa

SEQ ID NO: 1869446 - RNA, 20 nt, Human
aaguuuccuuccagcccaga

SEQ ID NO: 1869447 - RNA, 19 nt, Human
aaguuuccuuccagcccag

SEQ ID NO: 1869448 - RNA, 18 nt, Human
aaguuuccuuccagccca

SEQ ID NO: 1869449 - RNA, 17 nt, Human
aaguuuccccaccagug

SEQ ID NO: 1869450 - RNA, 22 nt, Human
guuucaauuccaccugcaauca

SEQ ID NO: 1869451 - RNA, 11 nt, Human
aaguauuuugc

SEQ ID NO: 1869452 - RNA, 14 nt, Human
guucuaguugcuug

SEQ ID NO: 1869453 - RNA, 20 nt, Human
guuauuauauuuacaaaugg

SEQ ID NO: 1869454 - RNA, 13 nt, Human
guuauuuaaagaa

SEQ ID NO: 1869455 - RNA, 19 nt, Human
guuauuauauuuacaaaug

SEQ ID NO: 1869456 - RNA, 16 nt, Human
aagcacuaaacaaaga

SEQ ID NO: 1869457 - RNA, 15 nt, Human
aagcacgaaauguua

SEQ ID NO: 1869458 - RNA, 14 nt, Human
gugcugcugcugcu

SEQ ID NO: 1869459 - RNA, 15 nt, Human
gugcugcugcugcug

SEQ ID NO: 1869460 - RNA, 12 nt, Human
gugucuguacac

SEQ ID NO: 1869461 - RNA, 13 nt, Human
gugucuguacacg

SEQ ID NO: 1869462 - RNA, 16 nt, Human
gugucuguacacgugu

SEQ ID NO: 1869463 - RNA, 21 nt, Human
gugucuguacacguguccugu

SEQ ID NO: 1869464 - RNA, 22 nt, Human
gugucuguacacguguccugua

SEQ ID NO: 1869465 - RNA, 18 nt, Human
caaauuaucaagcuaaua

SEQ ID NO: 1869466 - RNA, 20 nt, Human
caaauuaucaagcuaauaaa

SEQ ID NO: 1869467 - RNA, 21 nt, Human
caaauuaucaagcuaauaaaa

SEQ ID NO: 1869468 - RNA, 16 nt, Human
caaauuaucaagcuaa

SEQ ID NO: 1869469 - RNA, 17 nt, Human
caaauuaucaagcuaau

SEQ ID NO: 1869470 - RNA, 22 nt, Human
auuuugguaaaauacuucuuga

SEQ ID NO: 1869471 - RNA, 20 nt, Human
caaggagggcacaggugucu

SEQ ID NO: 1869472 - RNA, 15 nt, Human
caaggagggcacagg

SEQ ID NO: 1869473 - RNA, 19 nt, Human
caauguuacuaucugcuuu

SEQ ID NO: 1869474 - RNA, 18 nt, Human
cacauaugcaccuugugu

SEQ ID NO: 1869475 - RNA, 19 nt, Human
cacauaugcaccuuguguc

SEQ ID NO: 1869476 - RNA, 20 nt, Human
cacauaugcaccuugugucu

SEQ ID NO: 1869477 - RNA, 21 nt, Human
cacauaugcaccuugugucug

SEQ ID NO: 1869478 - RNA, 22 nt, Human
cacauaugcaccuugugucugu

SEQ ID NO: 1869479 - RNA, 20 nt, Human
uuaucuaauaccucugugug

SEQ ID NO: 1869480 - RNA, 19 nt, Human
uuaucuaauaccucugugu

SEQ ID NO: 1869481 - RNA, 16 nt, Human
uuauauuuacaaaugg

SEQ ID NO: 1869482 - RNA, 12 nt, Human
uuauaauuuaaa

SEQ ID NO: 1869483 - RNA, 13 nt, Human
uuauaauauacua

SEQ ID NO: 1869484 - RNA, 11 nt, Human
uuccagaaucc

SEQ ID NO: 1869485 - RNA, 23 nt, Human
uucaguuauuauauuuacaaaug

SEQ ID NO: 1869486 - RNA, 18 nt, Human
uucaauaaaugucuguug

SEQ ID NO: 1869487 - RNA, 19 nt, Human
uucaauaaaugucuguuga

SEQ ID NO: 1869488 - RNA, 11 nt, Human
uucacaaauaa

SEQ ID NO: 1869489 - RNA, 16 nt, Human
uugacaaccaugagac

SEQ ID NO: 1869490 - RNA, 15 nt, Human
uugacucuuuugcca

SEQ ID NO: 1869491 - RNA, 21 nt, Human
uugacucuuuugccauuaaac

SEQ ID NO: 1869492 - RNA, 22 nt, Human
uucuggaauguaaucaauguuu

SEQ ID NO: 1869493 - RNA, 15 nt, Human
uucuggaauguaauc

SEQ ID NO: 1869494 - RNA, 16 nt, Human
uucuggaauguaauca

SEQ ID NO: 1869495 - RNA, 20 nt, Human
uucuggaauguaaucaaugu

SEQ ID NO: 1869496 - RNA, 18 nt, Human
uucggugagcuacaaaug

SEQ ID NO: 1869497 - RNA, 16 nt, Human
uuccuuucauuuacug

SEQ ID NO: 1869498 - RNA, 20 nt, Human
uuccuuucauuuacuguggc

SEQ ID NO: 1869499 - RNA, 14 nt, Human
uuucagcagacuga

SEQ ID NO: 1869500 - RNA, 14 nt, Human
uuucauuuacugug

SEQ ID NO: 1869501 - RNA, 17 nt, Human
uuucauuuacuguggcu

SEQ ID NO: 1869502 - RNA, 12 nt, Human
uuucacaaauaa

SEQ ID NO: 1869503 - RNA, 13 nt, Human
uuucacaaauaaa

SEQ ID NO: 1869504 - RNA, 16 nt, Human
uuuacacucuuuguaa

SEQ ID NO: 1869505 - RNA, 19 nt, Human
uuuaacucuauaauguguu

SEQ ID NO: 1869506 - RNA, 22 nt, Human
uugugccauagucacauggccu

SEQ ID NO: 1869507 - RNA, 16 nt, Human
uuguauuaaagacaga

SEQ ID NO: 1869508 - RNA, 14 nt, Human
uuguauuaaagaca

SEQ ID NO: 1869509 - RNA, 20 nt, Human
uuguacauguguagccugug

SEQ ID NO: 1869510 - RNA, 21 nt, Human
uuguacauguguagccugugc

SEQ ID NO: 1869511 - RNA, 21 nt, Human
uuuuaaaguaacccuacaaaa

SEQ ID NO: 1869512 - RNA, 14 nt, Human
uuuucaaaauggag

SEQ ID NO: 1869513 - RNA, 13 nt, Human
ugcauguaugucu

SEQ ID NO: 1869514 - RNA, 14 nt, Human
ugcauguaugucuu

SEQ ID NO: 1869515 - RNA, 15 nt, Human
ugcauguaugucuug

SEQ ID NO: 1869516 - RNA, 16 nt, Human
ugcauguaugucuugg

SEQ ID NO: 1869517 - RNA, 19 nt, Human
ugccacugacugcagggac

SEQ ID NO: 1869518 - RNA, 16 nt, Human
ugccucccgcccccuu

SEQ ID NO: 1869519 - RNA, 14 nt, Human
ugcaccuugugucu

SEQ ID NO: 1869520 - RNA, 15 nt, Human
ugcaccuugugucug

SEQ ID NO: 1869521 - RNA, 16 nt, Human
ugcaccuugugucugu

SEQ ID NO: 1869522 - RNA, 23 nt, Human
ugagcucccaggugcagccagag

SEQ ID NO: 1869523 - RNA, 21 nt, Human
ugagcucccaggugcagccag

SEQ ID NO: 1869524 - RNA, 19 nt, Human
ugaguuucucucacauuac

SEQ ID NO: 1869525 - RNA, 16 nt, Human
ugaguccuagagcuac

SEQ ID NO: 1869526 - RNA, 14 nt, Human
ugaugcccugcccu

SEQ ID NO: 1869527 - RNA, 18 nt, Human
ugaucagaccauaauguu

SEQ ID NO: 1869528 - RNA, 19 nt, Human
uggacucugcacaugucuu

SEQ ID NO: 1869529 - RNA, 15 nt, Human
uggacucugcacaug

SEQ ID NO: 1869530 - RNA, 16 nt, Human
uggacucugcacauga

SEQ ID NO: 1869531 - RNA, 17 nt, Human
uggacucugcacaugaa

SEQ ID NO: 1869532 - RNA, 17 nt, Human
uggacucugcacauguc

SEQ ID NO: 1869533 - RNA, 18 nt, Human
uggacucugcacaugucu

SEQ ID NO: 1869534 - RNA, 22 nt, Human
uggacucugcacaugucuugua

SEQ ID NO: 1869535 - RNA, 13 nt, Human
uggcacuggaugc

SEQ ID NO: 1869536 - RNA, 15 nt, Human
uggcacuggaugcag

SEQ ID NO: 1869537 - RNA, 18 nt, Human
uggcacuggaugcagaaa

SEQ ID NO: 1869538 - RNA, 19 nt, Human
uggcacugacugggcauag

SEQ ID NO: 1869539 - RNA, 15 nt, Human
uggcuccccaaaggg

SEQ ID NO: 1869540 - RNA, 14 nt, Human
uggcuccccaaagg

SEQ ID NO: 1869541 - RNA, 13 nt, Human
uggccucaagauc

SEQ ID NO: 1869542 - RNA, 21 nt, Human
uggccucaagaucaaugaaau

SEQ ID NO: 1869543 - RNA, 22 nt, Human
uggccucaagaucaaugaaaug

SEQ ID NO: 1869544 - RNA, 18 nt, Human
uguccucccagcuccuca

SEQ ID NO: 1869545 - RNA, 16 nt, Human
uguacacguguccugu

SEQ ID NO: 1869546 - RNA, 17 nt, Human
uguacacguguccugua

SEQ ID NO: 1869547 - RNA, 14 nt, Human
ucccggggcagggc

SEQ ID NO: 1869548 - RNA, 16 nt, Human
ucccggggcagggcag

SEQ ID NO: 1869549 - RNA, 21 nt, Human
ucccggggcagggcagccguc

SEQ ID NO: 1869550 - RNA, 18 nt, Human
ucccugcacaagccaggg

SEQ ID NO: 1869551 - RNA, 15 nt, Human
ucccugcacaagcca

SEQ ID NO: 1869552 - RNA, 16 nt, Human
ucccugcacaagccag

SEQ ID NO: 1869553 - RNA, 16 nt, Human
uccuccuuggugccug

SEQ ID NO: 1869554 - RNA, 17 nt, Human
uccuccuuggugccugg

SEQ ID NO: 1869555 - RNA, 19 nt, Human
uccuccuuggugccuggcc

SEQ ID NO: 1869556 - RNA, 13 nt, Human
uccuauaugcacu

SEQ ID NO: 1869557 - RNA, 14 nt, Human
ucuaauaucagcaa

SEQ ID NO: 1869558 - RNA, 16 nt, Human
ucugcauucuaguacu

SEQ ID NO: 1869559 - RNA, 16 nt, Human
ucugcacaugucuugu

SEQ ID NO: 1869560 - RNA, 17 nt, Human
ucugcacaugucuugua

SEQ ID NO: 1869561 - RNA, 19 nt, Human
ucugcacaugucuuguaca

SEQ ID NO: 1869562 - RNA, 12 nt, Human
ucugcacauguc

SEQ ID NO: 1869563 - RNA, 15 nt, Human
ucugcacaugucuug

SEQ ID NO: 1869564 - RNA, 12 nt, Human
ucugcacaugaa

SEQ ID NO: 1869565 - RNA, 23 nt, Human
ucugcacaugaaucccacccaca

SEQ ID NO: 1869566 - RNA, 19 nt, Human
ucucuuuuuuuggcccagg

SEQ ID NO: 1869567 - RNA, 13 nt, Human
ucugggaccucag

SEQ ID NO: 1869568 - RNA, 16 nt, Human
ucugggaccucaguuu

SEQ ID NO: 1869569 - RNA, 17 nt, Human
ucugguuaggauggcag

SEQ ID NO: 1869570 - RNA, 16 nt, Human
uauuuauauauguauu

SEQ ID NO: 1869571 - RNA, 23 nt, Human
uauuuauauauguauuuauaaau

SEQ ID NO: 1869572 - RNA, 19 nt, Human
ucaauaaacuaaagaaaaa

SEQ ID NO: 1869573 - RNA, 16 nt, Human
ucaauaaaugucuguu

SEQ ID NO: 1869574 - RNA, 15 nt, Human
ucaauaaaugucugu

SEQ ID NO: 1869575 - RNA, 16 nt, Human
uauuuauaaauauauu

SEQ ID NO: 1869576 - RNA, 17 nt, Human
uauuuauaaauauauuu

SEQ ID NO: 1869577 - RNA, 19 nt, Human
uauuuauaaauauauuuaa

SEQ ID NO: 1869578 - RNA, 15 nt, Human
uauuaaugcuaaggg

SEQ ID NO: 1869579 - RNA, 16 nt, Human
uauguaccauguacau

SEQ ID NO: 1869580 - RNA, 12 nt, Human
uauguauuuaua

SEQ ID NO: 1869581 - RNA, 12 nt, Human
uauuaaugcuaa

SEQ ID NO: 1869582 - RNA, 13 nt, Human
uauuaaugcuaag

SEQ ID NO: 1869583 - RNA, 14 nt, Human
uauuaaugcuaagg

SEQ ID NO: 1869584 - RNA, 13 nt, Human
ucauucaauaaau

SEQ ID NO: 1869585 - RNA, 15 nt, Human
ucagggaggucauuu

SEQ ID NO: 1869586 - RNA, 15 nt, Human
ucagaccauaauguu

SEQ ID NO: 1869587 - RNA, 23 nt, Human
ucagaccauaauguuacauuauu

SEQ ID NO: 1869588 - RNA, 14 nt, Human
ucagaaacaggacc

SEQ ID NO: 1869589 - RNA, 13 nt, Human
ucacugccauaua

SEQ ID NO: 1869590 - RNA, 17 nt, Human
gcuauaaacaauuacau

SEQ ID NO: 1869591 - RNA, 13 nt, Human
gccuggcacacau

SEQ ID NO: 1869592 - RNA, 16 nt, Human
gccuggcacacaucag

SEQ ID NO: 1869593 - RNA, 14 nt, Human
gccuggcacacauc

SEQ ID NO: 1869594 - RNA, 17 nt, Human
gccuuguaauucuaaau

SEQ ID NO: 1869595 - RNA, 20 nt, Human
gccuuguaauucuaaaugaa

SEQ ID NO: 1869596 - RNA, 15 nt, Human
gcgcaguggcccuga

SEQ ID NO: 1869597 - RNA, 18 nt, Human
gcgcaguggcccugagca

SEQ ID NO: 1869598 - RNA, 21 nt, Human
gcuggcaugauccaagcaaga

SEQ ID NO: 1869599 - RNA, 23 nt, Human
gcuggccaucugguuaggauggc

SEQ ID NO: 1869600 - RNA, 12 nt, Human
gggaaucaagau

SEQ ID NO: 1869601 - RNA, 21 nt, Human
gggagcuccaacucagaaggg

SEQ ID NO: 1869602 - RNA, 18 nt, Human
gggagcuagccagaggac

SEQ ID NO: 1869603 - RNA, 15 nt, Human
gggagcuagccagag

SEQ ID NO: 1869604 - RNA, 16 nt, Human
gggagccgggccgcag

SEQ ID NO: 1869605 - RNA, 14 nt, Human
ggcucccaggacac

SEQ ID NO: 1869606 - RNA, 12 nt, Human
ggccucaagauc

SEQ ID NO: 1869607 - RNA, 18 nt, Human
ggccucaagaucaaugaa

SEQ ID NO: 1869608 - RNA, 22 nt, Human
ggcccagaggagcugggagccg

SEQ ID NO: 1869609 - RNA, 22 nt, Human
ggcacccaagaccucagggcac

SEQ ID NO: 1869610 - RNA, 18 nt, Human
ggcacccaagaccucagg

SEQ ID NO: 1869611 - RNA, 18 nt, Human
ggcagagcugcuccccuc

SEQ ID NO: 1869612 - RNA, 18 nt, Human
ggcaugauccaagcaaga

SEQ ID NO: 1869613 - RNA, 16 nt, Human
ggcaugauccaagcaa

SEQ ID NO: 1869614 - RNA, 15 nt, Human
ggcaugauccaagca

SEQ ID NO: 1869615 - RNA, 17 nt, Human
ggagcacacccagcccc

SEQ ID NO: 1869616 - RNA, 15 nt, Human
ggagcacacccagcc

SEQ ID NO: 1869617 - RNA, 14 nt, Human
ggagcacacccagc

SEQ ID NO: 1869618 - RNA, 17 nt, Human
ggagacaggcagagcug

SEQ ID NO: 1869619 - RNA, 23 nt, Human
ggagcgaacuggcgccuccgagg

SEQ ID NO: 1869620 - RNA, 20 nt, Human
ggagcuccaacucagaaggg

SEQ ID NO: 1869621 - RNA, 15 nt, Human
ggagcuagccagagg

SEQ ID NO: 1869622 - RNA, 12 nt, Human
ggagcuagccag

SEQ ID NO: 1869623 - RNA, 12 nt, Human
ggagacaggcag

SEQ ID NO: 1869624 - RNA, 13 nt, Human
ggacgcuggcucc

SEQ ID NO: 1869625 - RNA, 23 nt, Human
ggaccaugcgacacugggaggcc

SEQ ID NO: 1869626 - RNA, 13 nt, Human
gccacagcccagc

SEQ ID NO: 1869627 - RNA, 19 nt, Human
gccacagcccagccacgga

SEQ ID NO: 1869628 - RNA, 13 nt, Human
gccacgcagccag

SEQ ID NO: 1869629 - RNA, 14 nt, Human
gccacgcagccagg

SEQ ID NO: 1869630 - RNA, 15 nt, Human
gccacgcagccagga

SEQ ID NO: 1869631 - RNA, 16 nt, Human
gccacgcagccaggac

SEQ ID NO: 1869632 - RNA, 17 nt, Human
gccacgcagccaggaca

SEQ ID NO: 1869633 - RNA, 18 nt, Human
gccacgcagccaggacac

SEQ ID NO: 1869634 - RNA, 16 nt, Human
gccacggacgcuggcu

SEQ ID NO: 1869635 - RNA, 18 nt, Human
gccacggacgcuggcucc

SEQ ID NO: 1869636 - RNA, 22 nt, Human
gcccaaauuaucaagcuaauaa

SEQ ID NO: 1869637 - RNA, 23 nt, Human
gcccaaauuaucaagcuaauaaa

SEQ ID NO: 1869638 - RNA, 15 nt, Human
gccagugagccacuc

SEQ ID NO: 1869639 - RNA, 19 nt, Human
gccagggagaccuggacac

SEQ ID NO: 1869640 - RNA, 18 nt, Human
gccagggagaccuggaca

SEQ ID NO: 1869641 - RNA, 15 nt, Human
gccagggagaccugg

SEQ ID NO: 1869642 - RNA, 22 nt, Human
gccagggagaccuggacacagg

SEQ ID NO: 1869643 - RNA, 21 nt, Human
gccagggagaccuggacacag

SEQ ID NO: 1869644 - RNA, 23 nt, Human
gcccagccacggacgcuggcucc

SEQ ID NO: 1869645 - RNA, 22 nt, Human
gcccagaggagcugggagccgg

SEQ ID NO: 1869646 - RNA, 22 nt, Human
gcauccacuucuuucagcagac

SEQ ID NO: 1869647 - RNA, 17 nt, Human
gcagggcucccacagag

SEQ ID NO: 1869648 - RNA, 12 nt, Human
gcagggcagccg

SEQ ID NO: 1869649 - RNA, 22 nt, Human
gcaggcccaaauuaucaagcua

SEQ ID NO: 1869650 - RNA, 17 nt, Human
gcagagaagcucucggg

SEQ ID NO: 1869651 - RNA, 18 nt, Human
gcagacugaucaggaccu

SEQ ID NO: 1869652 - RNA, 15 nt, Human
gcagcucagcuuccc

SEQ ID NO: 1869653 - RNA, 17 nt, Human
gcaggacgugggcuggg

SEQ ID NO: 1869654 - RNA, 20 nt, Human
gauggcaggacgugggcugg

SEQ ID NO: 1869655 - RNA, 13 nt, Human
gaugcccugcccu

SEQ ID NO: 1869656 - RNA, 21 nt, Human
gaguugaaaaucuuauaauuu

SEQ ID NO: 1869657 - RNA, 15 nt, Human
gaguucuugugccau

SEQ ID NO: 1869658 - RNA, 15 nt, Human
gagccacuccggccc

SEQ ID NO: 1869659 - RNA, 16 nt, Human
gagcacacccagcccc

SEQ ID NO: 1869660 - RNA, 15 nt, Human
gagcacacccagccc

SEQ ID NO: 1869661 - RNA, 13 nt, Human
gagcacacccagc

SEQ ID NO: 1869662 - RNA, 14 nt, Human
gagcuacaaaugca

SEQ ID NO: 1869663 - RNA, 19 nt, Human
gagcuccaacucagaaggg

SEQ ID NO: 1869664 - RNA, 18 nt, Human
gagcuccaacucagaagg

SEQ ID NO: 1869665 - RNA, 19 nt, Human
gagcuuccuguccucccag

SEQ ID NO: 1869666 - RNA, 12 nt, Human
gagcuacaaaug

SEQ ID NO: 1869667 - RNA, 13 nt, Human
gagcuacaaaugc

SEQ ID NO: 1869668 - RNA, 16 nt, Human
gagccuggugcugcug

SEQ ID NO: 1869669 - RNA, 17 nt, Human
gagccuggugcugcugc

SEQ ID NO: 1869670 - RNA, 19 nt, Human
gaggagcugggagccgggc

SEQ ID NO: 1869671 - RNA, 15 nt, Human
gaggccagugagcca

SEQ ID NO: 1869672 - RNA, 22 nt, Human
gagggacgcggcucccggggca

SEQ ID NO: 1869673 - RNA, 14 nt, Human
cucacucaccuuca

SEQ ID NO: 1869674 - RNA, 14 nt, Human
cucaccacccacuu

SEQ ID NO: 1869675 - RNA, 20 nt, Human
cucaagaagaagaggggcau

SEQ ID NO: 1869676 - RNA, 19 nt, Human
cucaagaagaagaggggca

SEQ ID NO: 1869677 - RNA, 18 nt, Human
cgccagggagaccuggac

SEQ ID NO: 1869678 - RNA, 13 nt, Human
cuagguucuaaaa

SEQ ID NO: 1869679 - RNA, 20 nt, Human
cuaugcacauauggacucug

SEQ ID NO: 1869680 - RNA, 21 nt, Human
cuaugcacauauggacucugc

SEQ ID NO: 1869681 - RNA, 18 nt, Human
cuaugcacauauggacuc

SEQ ID NO: 1869682 - RNA, 22 nt, Human
cuaugcacauauggacucugca

SEQ ID NO: 1869683 - RNA, 16 nt, Human
cucccggggcagggca

SEQ ID NO: 1869684 - RNA, 17 nt, Human
cucccggggcagggcag

SEQ ID NO: 1869685 - RNA, 18 nt, Human
cucccggggcagggcagc

SEQ ID NO: 1869686 - RNA, 15 nt, Human
cucccggggcagggc

SEQ ID NO: 1869687 - RNA, 14 nt, Human
cuccuuggugccug

SEQ ID NO: 1869688 - RNA, 15 nt, Human
cuccuuggugccugg

SEQ ID NO: 1869689 - RNA, 19 nt, Human
cuccuuggugccuggccug

SEQ ID NO: 1869690 - RNA, 22 nt, Human
cuccuuggugccuggccuggca

SEQ ID NO: 1869691 - RNA, 12 nt, Human
cucuuuguaaga

SEQ ID NO: 1869692 - RNA, 12 nt, Human
cucugaguguga

SEQ ID NO: 1869693 - RNA, 14 nt, Human
cucugcauucuagu

SEQ ID NO: 1869694 - RNA, 15 nt, Human
cucugcauucuagua

SEQ ID NO: 1869695 - RNA, 13 nt, Human
cucugugugcucc

SEQ ID NO: 1869696 - RNA, 19 nt, Human
cugccacugacugcaggga

SEQ ID NO: 1869697 - RNA, 20 nt, Human
cugccacugacugcagggac

SEQ ID NO: 1869698 - RNA, 21 nt, Human
cugccacugacugcagggaca

SEQ ID NO: 1869699 - RNA, 22 nt, Human
cugcacaugaaucccacccaca

SEQ ID NO: 1869700 - RNA, 23 nt, Human
cugcacaugaaucccacccacau

SEQ ID NO: 1869701 - RNA, 21 nt, Human
cugcacaugucuuguacaugu

SEQ ID NO: 1869702 - RNA, 23 nt, Human
cugcacaugucuuguacaugugu

SEQ ID NO: 1869703 - RNA, 14 nt, Human
cugcacaugucuug

SEQ ID NO: 1869704 - RNA, 16 nt, Human
cugcacaugucuugua

SEQ ID NO: 1869705 - RNA, 18 nt, Human
cugaucaggaccuccaag

SEQ ID NO: 1869706 - RNA, 20 nt, Human
cugagggagcuccaacucag

SEQ ID NO: 1869707 - RNA, 21 nt, Human
gaacuuguaaaggaauuuaaa

SEQ ID NO: 1869708 - RNA, 23 nt, Human
gaagaaaauggaaccaggcuugg

SEQ ID NO: 1869709 - RNA, 15 nt, Human
gaacucaacuuugac

SEQ ID NO: 1869710 - RNA, 15 nt, Human
gaaccguaggaccca

SEQ ID NO: 1869711 - RNA, 18 nt, Human
gaaauaugcacaauagca

SEQ ID NO: 1869712 - RNA, 17 nt, Human
gaaauaugcacaauagc

SEQ ID NO: 1869713 - RNA, 21 nt, Human
gaaauguuauuuuuuaauuau

SEQ ID NO: 1869714 - RNA, 22 nt, Human
gaaauguuauuuuuuaauuauu

SEQ ID NO: 1869715 - RNA, 20 nt, Human
gaauaauccuaaacauauga

SEQ ID NO: 1869716 - RNA, 14 nt, Human
gaauacuuuauaaa

SEQ ID NO: 1869717 - RNA, 15 nt, Human
gaaggcaaagcacga

SEQ ID NO: 1869718 - RNA, 18 nt, Human
gaaggagacaggcagagc

SEQ ID NO: 1869719 - RNA, 16 nt, Human
gaaggagacaggcaga

SEQ ID NO: 1869720 - RNA, 15 nt, Human
gaaggagacaggcag

SEQ ID NO: 1869721 - RNA, 24 nt, Human
gaaggcacuaaaaagagcuguccu

SEQ ID NO: 1869722 - RNA, 22 nt, Human
gaaaacaauaacgauaaaagac

SEQ ID NO: 1869723 - RNA, 19 nt, Human
gaaaaucuuauaauuuaaa

SEQ ID NO: 1869724 - RNA, 19 nt, Human
gaaaauaacgauaaaagac

SEQ ID NO: 1869725 - RNA, 20 nt, Human
gaaaaucuuauaauuuaaaa

SEQ ID NO: 1869726 - RNA, 18 nt, Human
cuuuucuggaauguaauc

SEQ ID NO: 1869727 - RNA, 19 nt, Human
cuuuucuggaauguaauca

SEQ ID NO: 1869728 - RNA, 19 nt, Human
cuuguaaaggaauuuaaaa

SEQ ID NO: 1869729 - RNA, 22 nt, Human
cuuggaaccguaggacccaagc

SEQ ID NO: 1869730 - RNA, 21 nt, Human
cuuuauuuucuauaauuuaaa

SEQ ID NO: 1869731 - RNA, 18 nt, Human
cuuucauuuacuguggcu

SEQ ID NO: 1869732 - RNA, 21 nt, Human
cuuaaucuuuucacaaauaaa

SEQ ID NO: 1869733 - RNA, 17 nt, Human
cuuaaucuuuucacaaa

SEQ ID NO: 1869734 - RNA, 18 nt, Human
cuuaaucuuuucacaaau

SEQ ID NO: 1869735 - RNA, 19 nt, Human
cuuaaucuuuucacaaaua

SEQ ID NO: 1869736 - RNA, 20 nt, Human
cuuaaucuuuucacaaauaa

SEQ ID NO: 1869737 - RNA, 19 nt, Human
cuuaccugggcauucuugu

SEQ ID NO: 1869738 - RNA, 20 nt, Human
cuucaguaacccccacugga

SEQ ID NO: 1869739 - RNA, 22 nt, Human
cuucaguaacccccacuggacu

SEQ ID NO: 1869740 - RNA, 18 nt, Human
cuuccccaacacgcagga

SEQ ID NO: 1869741 - RNA, 18 nt, Human
cuuccuauaugcacuuau

SEQ ID NO: 1869742 - RNA, 23 nt, Human
cugucuucucccugcacaagcca

SEQ ID NO: 1869743 - RNA, 20 nt, Human
cugugagcucccaggugcag

SEQ ID NO: 1869744 - RNA, 14 nt, Human
cugugaugcccugc

SEQ ID NO: 1869745 - RNA, 22 nt, Human
cuguggcuucuuaaucuuuuca

SEQ ID NO: 1869746 - RNA, 20 nt, Human
cugggccuggcagcucagcu

SEQ ID NO: 1869747 - RNA, 18 nt, Human
cugggccuggcagcucag

SEQ ID NO: 1869748 - RNA, 19 nt, Human
cugguuaggauggcaggac

SEQ ID NO: 1869749 - RNA, 18 nt, Human
cugguuaggauggcagga

SEQ ID NO: 1869750 - RNA, 16 nt, Human
cugguuaggauggcag

SEQ ID NO: 1869751 - RNA, 20 nt, Human
cuguaguugcguggacucug

SEQ ID NO: 1869752 - RNA, 17 nt, Human
ccgcaccuaaagcagcc

SEQ ID NO: 1869753 - RNA, 19 nt, Human
ccgcaccuaaagcagccag

SEQ ID NO: 1869754 - RNA, 14 nt, Human
ccuaugcacauaug

SEQ ID NO: 1869755 - RNA, 20 nt, Human
ccuaugcacauauggacucu

SEQ ID NO: 1869756 - RNA, 21 nt, Human
ccuaugcacauauggacucug

SEQ ID NO: 1869757 - RNA, 16 nt, Human
cccugcacaagccagg

SEQ ID NO: 1869758 - RNA, 18 nt, Human
cccggggcagggcagccg

SEQ ID NO: 1869759 - RNA, 16 nt, Human
cccgggcccagaggag

SEQ ID NO: 1869760 - RNA, 13 nt, Human
cccgggcccagag

SEQ ID NO: 1869761 - RNA, 14 nt, Human
cccgggcccagagg

SEQ ID NO: 1869762 - RNA, 12 nt, Human
cccgggcccaga

SEQ ID NO: 1869763 - RNA, 21 nt, Human
cccgggcagggcucccacaga

SEQ ID NO: 1869764 - RNA, 22 nt, Human
cccgggcagggcucccacagag

SEQ ID NO: 1869765 - RNA, 12 nt, Human
cccgggcagggc

SEQ ID NO: 1869766 - RNA, 13 nt, Human
cccgggcagggcu

SEQ ID NO: 1869767 - RNA, 15 nt, Human
cccacaaaggcaaag

SEQ ID NO: 1869768 - RNA, 19 nt, Human
cccacaugugacacauaug

SEQ ID NO: 1869769 - RNA, 13 nt, Human
cgaacuggcgccu

SEQ ID NO: 1869770 - RNA, 15 nt, Human
cgcagccaggacacc

SEQ ID NO: 1869771 - RNA, 12 nt, Human
cgcagccaggac

SEQ ID NO: 1869772 - RNA, 13 nt, Human
cgcagccaggaca

SEQ ID NO: 1869773 - RNA, 14 nt, Human
cgcagccaggacac

SEQ ID NO: 1869774 - RNA, 16 nt, Human
cgccagggagaccugg

SEQ ID NO: 1869775 - RNA, 17 nt, Human
ccuugaagaaccucuca

SEQ ID NO: 1869776 - RNA, 18 nt, Human
ccuugaagaaccucucac

SEQ ID NO: 1869777 - RNA, 17 nt, Human
ccugguccacagggcac

SEQ ID NO: 1869778 - RNA, 14 nt, Human
ccuggcagcucagc

SEQ ID NO: 1869779 - RNA, 20 nt, Human
ccuggacacaggccugcucu

SEQ ID NO: 1869780 - RNA, 16 nt, Human
ccuggacacaggccug

SEQ ID NO: 1869781 - RNA, 13 nt, Human
ccuggacacaggc

SEQ ID NO: 1869782 - RNA, 17 nt, Human
ccacggacgcuggcucc

SEQ ID NO: 1869783 - RNA, 14 nt, Human
ccacaccugccucu

SEQ ID NO: 1869784 - RNA, 22 nt, Human
ccagaggacugugaugcccugc

SEQ ID NO: 1869785 - RNA, 20 nt, Human
ccagaggacugugaugcccu

SEQ ID NO: 1869786 - RNA, 22 nt, Human
ccagaggcaccucaagaagaag

SEQ ID NO: 1869787 - RNA, 20 nt, Human
ccagaggagcugggagccgg

SEQ ID NO: 1869788 - RNA, 21 nt, Human
ccagaggagcugggagccggg

SEQ ID NO: 1869789 - RNA, 22 nt, Human
ccagaggagcugggagccgggc

SEQ ID NO: 1869790 - RNA, 21 nt, Human
ccagccacggacgcuggcucc

SEQ ID NO: 1869791 - RNA, 13 nt, Human
cccaaagggugug

SEQ ID NO: 1869792 - RNA, 15 nt, Human
ccauagucacauggc

SEQ ID NO: 1869793 - RNA, 22 nt, Human
ccagggagaccuggacacaggc

SEQ ID NO: 1869794 - RNA, 21 nt, Human
ccagggagaccuggacacagg

SEQ ID NO: 1869795 - RNA, 23 nt, Human
ccagggagaccuggacacaggcc

SEQ ID NO: 1869796 - RNA, 13 nt, Human
cauucuggaauaa

SEQ ID NO: 1869797 - RNA, 16 nt, Human
cauucaggagcuuccu

SEQ ID NO: 1869798 - RNA, 12 nt, Human
cauuuacugugg

SEQ ID NO: 1869799 - RNA, 13 nt, Human
cauuuacuguggc

SEQ ID NO: 1869800 - RNA, 14 nt, Human
cauuuacuguggcu

SEQ ID NO: 1869801 - RNA, 15 nt, Human
cauuuacuguggcuu

SEQ ID NO: 1869802 - RNA, 20 nt, Human
cauguacaugaagaagcuaa

SEQ ID NO: 1869803 - RNA, 23 nt, Human
cauguacugagccuuguaauucu

SEQ ID NO: 1869804 - RNA, 19 nt, Human
cauguacugagccuuguaa

SEQ ID NO: 1869805 - RNA, 22 nt, Human
cauguacugagccuuguaauuc

SEQ ID NO: 1869806 - RNA, 14 nt, Human
cauguguagccugu

SEQ ID NO: 1869807 - RNA, 16 nt, Human
cauguguagccugugc

SEQ ID NO: 1869808 - RNA, 18 nt, Human
cauguguagccugugcau

SEQ ID NO: 1869809 - RNA, 13 nt, Human
caugucuuguaca

SEQ ID NO: 1869810 - RNA, 14 nt, Human
caugucuuguacau

SEQ ID NO: 1869811 - RNA, 15 nt, Human
caugucuuguacaug

SEQ ID NO: 1869812 - RNA, 17 nt, Human
caugucuuguacaugug

SEQ ID NO: 1869813 - RNA, 23 nt, Human
cauccagucucccaacuuguauu

SEQ ID NO: 1869814 - RNA, 22 nt, Human
cauaguaccaaucauuuuaauu

SEQ ID NO: 1869815 - RNA, 16 nt, Human
cauaguaccaaucauu

SEQ ID NO: 1869816 - RNA, 18 nt, Human
cauaguaccaaucauuuu

SEQ ID NO: 1869817 - RNA, 13 nt, Human
cauagucacaugg

SEQ ID NO: 1869818 - RNA, 19 nt, Human
caugagaccacuguuauca

SEQ ID NO: 1869819 - RNA, 17 nt, Human
caugagaccacuguuau

SEQ ID NO: 1869820 - RNA, 20 nt, Human
caugauccaagcaagacuga

SEQ ID NO: 1869821 - RNA, 22 nt, Human
caucuucuuuuugaaaucagca

SEQ ID NO: 1869822 - RNA, 16 nt, Human
cagggacacgggcagc

SEQ ID NO: 1869823 - RNA, 15 nt, Human
cagggacacgggcag

SEQ ID NO: 1869824 - RNA, 21 nt, Human
cagggacacgggcagccuggc

SEQ ID NO: 1869825 - RNA, 17 nt, Human
cagggacacgggcagcc

SEQ ID NO: 1869826 - RNA, 22 nt, Human
cagggccgccagggagaccugg

SEQ ID NO: 1869827 - RNA, 19 nt, Human
cagggccgcccgggcccag

SEQ ID NO: 1869828 - RNA, 16 nt, Human
cagggccgccagggag

SEQ ID NO: 1869829 - RNA, 14 nt, Human
cagggccgccaggg

SEQ ID NO: 1869830 - RNA, 20 nt, Human
cagggccgcccgggcccaga

SEQ ID NO: 1869831 - RNA, 21 nt, Human
cagggccgcccgggcccagag

SEQ ID NO: 1869832 - RNA, 22 nt, Human
cagggccgcccgggcccagagg

SEQ ID NO: 1869833 - RNA, 23 nt, Human
cagggccgcccgggcccagagga

SEQ ID NO: 1869834 - RNA, 15 nt, Human
cagggcaccugccac

SEQ ID NO: 1869835 - RNA, 20 nt, Human
cagggcagccgucaccccug

SEQ ID NO: 1869836 - RNA, 21 nt, Human
caggcuuuuuuccagacucua

SEQ ID NO: 1869837 - RNA, 12 nt, Human
caggcauccucc

SEQ ID NO: 1869838 - RNA, 17 nt, Human
caggcaguuggccagag

SEQ ID NO: 1869839 - RNA, 23 nt, Human
caggcccaaauuaucaagcuaau

SEQ ID NO: 1869840 - RNA, 16 nt, Human
caggacgugggcuggg

SEQ ID NO: 1869841 - RNA, 17 nt, Human
caggacgugggcugggc

SEQ ID NO: 1869842 - RNA, 19 nt, Human
caggagcacacccagcccc

SEQ ID NO: 1869843 - RNA, 16 nt, Human
caggagcacacccagc

SEQ ID NO: 1869844 - RNA, 15 nt, Human
caggagcacacccag

SEQ ID NO: 1869845 - RNA, 21 nt, Human
caggagcacacccagccccca

SEQ ID NO: 1869846 - RNA, 21 nt, Human
caggaguucaauaaaugucug

SEQ ID NO: 1869847 - RNA, 23 nt, Human
caggaguucaauaaaugucuguu

SEQ ID NO: 1869848 - RNA, 21 nt, Human
caguaauugguccgaucuuug

SEQ ID NO: 1869849 - RNA, 14 nt, Human
caguaacuaaagcu

SEQ ID NO: 1869850 - RNA, 18 nt, Human
caggugucugcccccucu

SEQ ID NO: 1869851 - RNA, 16 nt, Human
cagggucagaaacagg

SEQ ID NO: 1869852 - RNA, 10 nt, Human
cagggucaga

SEQ ID NO: 1869853 - RNA, 19 nt, Human
cagggucagaaacaggacc

SEQ ID NO: 1869854 - RNA, 18 nt, Human
cagggucagaaacaggac

SEQ ID NO: 1869855 - RNA, 16 nt, Human
caggugaaacccaguc

SEQ ID NO: 1869856 - RNA, 16 nt, Human
cagugaaagaaaauaa

SEQ ID NO: 1869857 - RNA, 20 nt, Human
cagugaaagaaaauaacaau

SEQ ID NO: 1869858 - RNA, 13 nt, Human
cagugagccacuc

SEQ ID NO: 1869859 - RNA, 15 nt, Human
cagucauaacuaaau

SEQ ID NO: 1869860 - RNA, 14 nt, Human
cagcucagcuuccc

SEQ ID NO: 1869861 - RNA, 13 nt, Human
cagcucagcuucc

SEQ ID NO: 1869862 - RNA, 17 nt, Human
cagccuggccacgcagc

SEQ ID NO: 1869863 - RNA, 18 nt, Human
cagccuggccacgcagcc

SEQ ID NO: 1869864 - RNA, 20 nt, Human
cagccuggcucccaggacac

SEQ ID NO: 1869865 - RNA, 12 nt, Human
cagccuggcucc

SEQ ID NO: 1869866 - RNA, 13 nt, Human
cagccuggcuccc

SEQ ID NO: 1869867 - RNA, 19 nt, Human
cagccuggcucccaggaca

SEQ ID NO: 1869868 - RNA, 21 nt, Human
cagccuggcucccaggacacg

SEQ ID NO: 1869869 - RNA, 19 nt, Human
cagccuggccacgcagcca

SEQ ID NO: 1869870 - RNA, 20 nt, Human
cagccuggccacgcagccag

SEQ ID NO: 1869871 - RNA, 21 nt, Human
cagccuggccacgcagccagg

SEQ ID NO: 1869872 - RNA, 22 nt, Human
cagccuggccacgcagccagga

SEQ ID NO: 1869873 - RNA, 18 nt, Human
cagccgucaccccugccu

SEQ ID NO: 1869874 - RNA, 20 nt, Human
cagccacggacgcuggcucc

SEQ ID NO: 1869875 - RNA, 15 nt, Human
cagcccagccacgga

SEQ ID NO: 1869876 - RNA, 18 nt, Human
cagcagacugaucaggac

SEQ ID NO: 1869877 - RNA, 11 nt, Human
cagcagacuga

SEQ ID NO: 1869878 - RNA, 14 nt, Human
cagcaagucucuuu

SEQ ID NO: 1869879 - RNA, 13 nt, Human
cagaccccuuggc

SEQ ID NO: 1869880 - RNA, 15 nt, Human
cagaccccuuggcca

SEQ ID NO: 1869881 - RNA, 16 nt, Human
cagaccccuuggccag

SEQ ID NO: 1869882 - RNA, 22 nt, Human
cagaccuaggauuucaugauuu

SEQ ID NO: 1869883 - RNA, 16 nt, Human
cagaccauaauguuac

SEQ ID NO: 1869884 - RNA, 16 nt, Human
cagaagcuucugccca

SEQ ID NO: 1869885 - RNA, 18 nt, Human
cagaaggagacaggcaga

SEQ ID NO: 1869886 - RNA, 17 nt, Human
cagaaggagacaggcag

SEQ ID NO: 1869887 - RNA, 13 nt, Human
cagaaggagacag

SEQ ID NO: 1869888 - RNA, 22 nt, Human
cagaaggagacaggcagagcug

SEQ ID NO: 1869889 - RNA, 21 nt, Human
cagaagggagcuagccagagg

SEQ ID NO: 1869890 - RNA, 20 nt, Human
cagaagggagcuagccagag

SEQ ID NO: 1869891 - RNA, 19 nt, Human
cagaagggagcuagccaga

SEQ ID NO: 1869892 - RNA, 13 nt, Human
cagaaacaggacc

SEQ ID NO: 1869893 - RNA, 19 nt, Human
cagagaagcucucgggcua

SEQ ID NO: 1869894 - RNA, 16 nt, Human
cagagacaaggagggc

SEQ ID NO: 1869895 - RNA, 20 nt, Human
cagagacaaggagggcacag

SEQ ID NO: 1869896 - RNA, 13 nt, Human
cagagacaaggag

SEQ ID NO: 1869897 - RNA, 14 nt, Human
cagaggacugugau

SEQ ID NO: 1869898 - RNA, 21 nt, Human
cagaggacugugaugcccugc

SEQ ID NO: 1869899 - RNA, 20 nt, Human
cagaggagcugggagccggg

SEQ ID NO: 1869900 - RNA, 21 nt, Human
cagaggagcugggagccgggc

SEQ ID NO: 1869901 - RNA, 13 nt, Human
caccgggcagggc

SEQ ID NO: 1869902 - RNA, 14 nt, Human
caccgggcagggcc

SEQ ID NO: 1869903 - RNA, 23 nt, Human
caccugccacccugggccuggca

SEQ ID NO: 1869904 - RNA, 20 nt, Human
caccugccacccugggccug

SEQ ID NO: 1869905 - RNA, 15 nt, Human
caccugccacccugg

SEQ ID NO: 1869906 - RNA, 22 nt, Human
caccccugccucccgcccccuu

SEQ ID NO: 1869907 - RNA, 13 nt, Human
cacuaaacaaaga

SEQ ID NO: 1869908 - RNA, 15 nt, Human
cacguguccuguagu

SEQ ID NO: 1869909 - RNA, 16 nt, Human
cacguguccuguaguu

SEQ ID NO: 1869910 - RNA, 12 nt, Human
cacgggcagccu

SEQ ID NO: 1869911 - RNA, 14 nt, Human
cacgggcagccugg

SEQ ID NO: 1869912 - RNA, 15 nt, Human
cacgggcagccuggc

SEQ ID NO: 1869913 - RNA, 18 nt, Human
cacgggcagccuggcucc

SEQ ID NO: 1869914 - RNA, 22 nt, Human
cacgggcagccuggcucccagg

SEQ ID NO: 1869915 - RNA, 23 nt, Human
caccuucaguaacccccacugga

SEQ ID NO: 1869916 - RNA, 22 nt, Human
caccuugaagaaccucucacuu

SEQ ID NO: 1869917 - RNA, 17 nt, Human
cacgaaauguuauuuuu

SEQ ID NO: 1869918 - RNA, 21 nt, Human
cacgcacaugcgaccccgagg

SEQ ID NO: 1869919 - RNA, 20 nt, Human
cacgcaggagcacacccagc

SEQ ID NO: 1869920 - RNA, 19 nt, Human
cacgcaggagcacacccag

SEQ ID NO: 1869921 - RNA, 12 nt, Human
cacgcaggagca

SEQ ID NO: 1869922 - RNA, 21 nt, Human
cacgcagccaggacaccgggc

SEQ ID NO: 1869923 - RNA, 13 nt, Human
cacgcagccagga

SEQ ID NO: 1869924 - RNA, 15 nt, Human
cacgcagccaggaca

SEQ ID NO: 1869925 - RNA, 16 nt, Human
cacgcagccaggacac

SEQ ID NO: 1869926 - RNA, 19 nt, Human
cacgcagccaggacaccgg

SEQ ID NO: 1869927 - RNA, 14 nt, Human
cacuucacccugga

SEQ ID NO: 1869928 - RNA, 22 nt, Human
cacugugagcucccaggugcag

SEQ ID NO: 1869929 - RNA, 15 nt, Human
cacuguuaucaaaac

SEQ ID NO: 1869930 - RNA, 17 nt, Human
cacugugagcucccagg

SEQ ID NO: 1869931 - RNA, 16 nt, Human
cacugugagcucccag

SEQ ID NO: 1869932 - RNA, 20 nt, Human
cacuguacaagguaccccuu

SEQ ID NO: 1869933 - RNA, 16 nt, Human
cacugacugcagggac

SEQ ID NO: 1869934 - RNA, 16 nt, Human
cacuggacugaccugg

SEQ ID NO: 1869935 - RNA, 17 nt, Human
cacuggacugaccuggu

SEQ ID NO: 1869936 - RNA, 15 nt, Human
cacuggaugcagaaa

SEQ ID NO: 1869937 - RNA, 12 nt, Human
aguccuguaaug

SEQ ID NO: 1869938 - RNA, 22 nt, Human
aguugaaaaucuuauaauuuaa

SEQ ID NO: 1869939 - RNA, 23 nt, Human
aguugaaaaucuuauaauuuaaa

SEQ ID NO: 1869940 - RNA, 18 nt, Human
auaaaggauuaaugucaa

SEQ ID NO: 1869941 - RNA, 12 nt, Human
auaccucugugu

SEQ ID NO: 1869942 - RNA, 13 nt, Human
auaccucugugug

SEQ ID NO: 1869943 - RNA, 14 nt, Human
auaccucugugugc

SEQ ID NO: 1869944 - RNA, 15 nt, Human
auagguuuaauaauu

SEQ ID NO: 1869945 - RNA, 23 nt, Human
auagcaucuuugaauacaaagaa

SEQ ID NO: 1869946 - RNA, 15 nt, Human
auaucauucagcaac

SEQ ID NO: 1869947 - RNA, 13 nt, Human
auaucauucagca

SEQ ID NO: 1869948 - RNA, 14 nt, Human
auaucauucagcaa

SEQ ID NO: 1869949 - RNA, 20 nt, Human
agguaaaagcaucacaugaa

SEQ ID NO: 1869950 - RNA, 21 nt, Human
aggguccagaaggagacaggc

SEQ ID NO: 1869951 - RNA, 19 nt, Human
aggguccagaaggagacag

SEQ ID NO: 1869952 - RNA, 18 nt, Human
aggguccagaaggagaca

SEQ ID NO: 1869953 - RNA, 22 nt, Human
agggacgcggcucccggggcag

SEQ ID NO: 1869954 - RNA, 22 nt, Human
agcuuccccaacacgcaggagc

SEQ ID NO: 1869955 - RNA, 16 nt, Human
aggaguguggccacgu

SEQ ID NO: 1869956 - RNA, 18 nt, Human
aggacccaagcagagaag

SEQ ID NO: 1869957 - RNA, 15 nt, Human
aggacccaagcagag

SEQ ID NO: 1869958 - RNA, 13 nt, Human
aggacccaagcag

SEQ ID NO: 1869959 - RNA, 14 nt, Human
agccgugagugcag

SEQ ID NO: 1869960 - RNA, 14 nt, Human
agccgggccgcaga

SEQ ID NO: 1869961 - RNA, 11 nt, Human
agccgggccgc

SEQ ID NO: 1869962 - RNA, 15 nt, Human
aauccaaugaaauga

SEQ ID NO: 1869963 - RNA, 19 nt, Human
aaugaaagucuugugacua

SEQ ID NO: 1869964 - RNA, 20 nt, Human
aaugaaagucuugugacuag

SEQ ID NO: 1869965 - RNA, 21 nt, Human
aaugaaagucuugugacuagu

SEQ ID NO: 1869966 - RNA, 23 nt, Human
aaugaaagucuugugacuagugc

SEQ ID NO: 1869967 - RNA, 17 nt, Human
aauauacuauauuuaug

SEQ ID NO: 1869968 - RNA, 20 nt, Human
aaucaagauuuaauccuaga

SEQ ID NO: 1869969 - RNA, 20 nt, Human
aauguuuacacucuuuguaa

SEQ ID NO: 1869970 - RNA, 23 nt, Human
aauguuuacacucuuuguaagag

SEQ ID NO: 1869971 - RNA, 22 nt, Human
aauguuucuucuagguucuaaa

SEQ ID NO: 1869972 - RNA, 23 nt, Human
aauguuucuucuagguucuaaaa

SEQ ID NO: 1869973 - RNA, 17 nt, Human
aagggagcuagccagag

SEQ ID NO: 1869974 - RNA, 17 nt, Human
aaguccuacaagcuaaa

SEQ ID NO: 1869975 - RNA, 22 nt, Human
aagucucuuuuuuuggcccagg

SEQ ID NO: 1869976 - RNA, 19 nt, Human
aacuuuccucuuccugccu

SEQ ID NO: 1869977 - RNA, 16 nt, Human
aagcagccagccguga

SEQ ID NO: 1869978 - RNA, 17 nt, Human
aaaucuuauaauuuaaa

SEQ ID NO: 1869979 - RNA, 14 nt, Human
aacacgcaggagca

SEQ ID NO: 1869980 - RNA, 13 nt, Human
aacacgcaggagc

SEQ ID NO: 1869981 - RNA, 18 nt, Human
aacacuaacauauaaugu

SEQ ID NO: 1869982 - RNA, 22 nt, Human
aaccacuggaaaguuuaugguu

SEQ ID NO: 1869983 - RNA, 12 nt, Human
aacucagaaggg

SEQ ID NO: 1869984 - RNA, 21 nt, Human
acaugugacacauaugcaccu

SEQ ID NO: 1869985 - RNA, 21 nt, Human
acaagaaaguuuccccaccag

SEQ ID NO: 1869986 - RNA, 15 nt, Human
acaagaaaguuuccc

SEQ ID NO: 1869987 - RNA, 17 nt, Human
acaagaaaguuucccca

SEQ ID NO: 1869988 - RNA, 17 nt, Human
acuagugcugaagcuua

SEQ ID NO: 1869989 - RNA, 18 nt, Human
acuagugcugaagcuuau

SEQ ID NO: 1869990 - RNA, 19 nt, Human
acuagugcugaagcuuauu

SEQ ID NO: 1869991 - RNA, 14 nt, Human
acuagugcugaagc

SEQ ID NO: 1869992 - RNA, 15 nt, Human
acuagugcugaagcu

SEQ ID NO: 1869993 - RNA, 16 nt, Human
acuagugcugaagcuu

SEQ ID NO: 1869994 - RNA, 20 nt, Human
acgccacagcccagccacgg

SEQ ID NO: 1869995 - RNA, 15 nt, Human
acgccacagcccagc

SEQ ID NO: 1869996 - RNA, 14 nt, Human
acgccacagcccag

SEQ ID NO: 1869997 - RNA, 20 nt, Human
agaaaguuuccccaccagug

SEQ ID NO: 1869998 - RNA, 12 nt, Human
agaaaguuuccc

SEQ ID NO: 1869999 - RNA, 20 nt, Human
agaaaauggaaccaggcuug

SEQ ID NO: 1870000 - RNA, 22 nt, Human
agaaaauggaaccaggcuugga

SEQ ID NO: 1870001 - RNA, 19 nt, Human
agaaaauggaaccaggcuu

SEQ ID NO: 1870002 - RNA, 22 nt, Human
acuuuauuuucuauaauuuaaa

SEQ ID NO: 1870003 - RNA, 23 nt, Human
acuuuaucuaauaccucugugug

SEQ ID NO: 1870004 - RNA, 20 nt, Human
acuuggggagauggaguucu

SEQ ID NO: 1870005 - RNA, 21 nt, Human
acuguuugccuucuacuuuua

SEQ ID NO: 1870006 - RNA, 22 nt, Human
acuguuugccuucuacuuuuaa

SEQ ID NO: 1870007 - RNA, 22 nt, Human
acuguuuggacuuuuauuuugg

SEQ ID NO: 1870008 - RNA, 21 nt, Human
acugugagcucccaggugcag

SEQ ID NO: 1870009 - RNA, 16 nt, Human
cucuuuuuuuggccca

SEQ ID NO: 1870010 - RNA, 18 nt, Human
cucuuuuuuuggcccagg

SEQ ID NO: 1870011 - RNA, 19 nt, Human
cucuuuuuuuggcccaggc

SEQ ID NO: 1870012 - RNA, 13 nt, Human
cgcuggcucccca

SEQ ID NO: 1870013 - RNA, 16 nt, Human
cgcuggcuccccaaag

SEQ ID NO: 1870014 - RNA, 16 nt, Human
cuauaaacaauuacau

SEQ ID NO: 1870015 - RNA, 17 nt, Human
cuauaaacaauuacaug

SEQ ID NO: 1870016 - RNA, 18 nt, Human
cuaggccuccuggcccag

SEQ ID NO: 1870017 - RNA, 17 nt, Human
cuaggccuccuggccca

SEQ ID NO: 1870018 - RNA, 19 nt, Human
cuaggccuccuggcccagg

SEQ ID NO: 1870019 - RNA, 22 nt, Human
cucagaagggagcuagccagag

SEQ ID NO: 1870020 - RNA, 21 nt, Human
cucagaagggagcuagccaga

SEQ ID NO: 1870021 - RNA, 14 nt, Human
cucacuucacccug

SEQ ID NO: 1870022 - RNA, 15 nt, Human
ccuggccuggcacac

SEQ ID NO: 1870023 - RNA, 16 nt, Human
ccuggccuggcacaca

SEQ ID NO: 1870024 - RNA, 19 nt, Human
ccuggccuggcacacauca

SEQ ID NO: 1870025 - RNA, 12 nt, Human
ccuggccuggca

SEQ ID NO: 1870026 - RNA, 13 nt, Human
ccuggccuggcac

SEQ ID NO: 1870027 - RNA, 12 nt, Human
ccuggcacacau

SEQ ID NO: 1870028 - RNA, 13 nt, Human
ccuggcacacauc

SEQ ID NO: 1870029 - RNA, 15 nt, Human
ccuggcacacaucag

SEQ ID NO: 1870030 - RNA, 21 nt, Human
ccuggcacacaucaggaguuc

SEQ ID NO: 1870031 - RNA, 15 nt, Human
ccugagggagcucca

SEQ ID NO: 1870032 - RNA, 13 nt, Human
ccugagggagcuc

SEQ ID NO: 1870033 - RNA, 16 nt, Human
ccuccgagggacgcgg

SEQ ID NO: 1870034 - RNA, 16 nt, Human
ccauguacaugaagaa

SEQ ID NO: 1870035 - RNA, 18 nt, Human
cccaagaccucagggcac

SEQ ID NO: 1870036 - RNA, 15 nt, Human
cccacccacauguga

SEQ ID NO: 1870037 - RNA, 21 nt, Human
ccauugcuaucuauugauaau

SEQ ID NO: 1870038 - RNA, 17 nt, Human
caaucauuuuaauuauu

SEQ ID NO: 1870039 - RNA, 21 nt, Human
cacugggaggccagugagcca

SEQ ID NO: 1870040 - RNA, 14 nt, Human
cacugggaggccag

SEQ ID NO: 1870041 - RNA, 14 nt, Human
cacugccauauacu

SEQ ID NO: 1870042 - RNA, 13 nt, Human
cacgaaauguuau

SEQ ID NO: 1870043 - RNA, 15 nt, Human
cacgaaauguuauuu

SEQ ID NO: 1870044 - RNA, 16 nt, Human
cacgaaauguuauuuu

SEQ ID NO: 1870045 - RNA, 22 nt, Human
caccuacuuuucuuuccucaga

SEQ ID NO: 1870046 - RNA, 21 nt, Human
caaaggguccagaaggagaca

SEQ ID NO: 1870047 - RNA, 17 nt, Human
caaaggguccagaagga

SEQ ID NO: 1870048 - RNA, 11 nt, Human
caaagggugug

SEQ ID NO: 1870049 - RNA, 18 nt, Human
caaccaugagaccacugu

SEQ ID NO: 1870050 - RNA, 23 nt, Human
caaccaugagaccacuguuauca

SEQ ID NO: 1870051 - RNA, 21 nt, Human
caaaaggauaaugaauacuuu

SEQ ID NO: 1870052 - RNA, 18 nt, Human
auuaugggaaucaagauu

SEQ ID NO: 1870053 - RNA, 17 nt, Human
auuaugggaaucaagau

SEQ ID NO: 1870054 - RNA, 13 nt, Human
auucaauaaauug

SEQ ID NO: 1870055 - RNA, 12 nt, Human
auuucacuuaau

SEQ ID NO: 1870056 - RNA, 17 nt, Human
auuucacuuaauaaugu

SEQ ID NO: 1870057 - RNA, 12 nt, Human
cagggugugucu

SEQ ID NO: 1870058 - RNA, 20 nt, Human
caggugaguccuagagcuac

SEQ ID NO: 1870059 - RNA, 23 nt, Human
caggugaguccuagagcuacagg

SEQ ID NO: 1870060 - RNA, 22 nt, Human
caggugaguccuagagcuacag

SEQ ID NO: 1870061 - RNA, 16 nt, Human
caggugcagccagagg

SEQ ID NO: 1870062 - RNA, 15 nt, Human
caggugcagccagag

SEQ ID NO: 1870063 - RNA, 14 nt, Human
caggugcagccaga

SEQ ID NO: 1870064 - RNA, 19 nt, Human
caggugcagccagaggcac

SEQ ID NO: 1870065 - RNA, 17 nt, Human
caggugcagccagaggc

SEQ ID NO: 1870066 - RNA, 23 nt, Human
caggagcuuccuguccucccagc

SEQ ID NO: 1870067 - RNA, 12 nt, Human
caggagcuuccu

SEQ ID NO: 1870068 - RNA, 21 nt, Human
cagcugccucugccacugacu

SEQ ID NO: 1870069 - RNA, 15 nt, Human
cauuuuuuaaaacaa

SEQ ID NO: 1870070 - RNA, 16 nt, Human
cauuuuuuaaaacaag

SEQ ID NO: 1870071 - RNA, 17 nt, Human
cauuuuuuaaaacaaga

SEQ ID NO: 1870072 - RNA, 17 nt, Human
ccacagagacaaggagg

SEQ ID NO: 1870073 - RNA, 20 nt, Human
ccacagcccagccacggacg

SEQ ID NO: 1870074 - RNA, 15 nt, Human
ccacagcccagccac

SEQ ID NO: 1870075 - RNA, 18 nt, Human
ccacagcccagccacgga

SEQ ID NO: 1870076 - RNA, 19 nt, Human
ccacagcccagccacggac

SEQ ID NO: 1870077 - RNA, 17 nt, Human
ccacgcagccaggacac

SEQ ID NO: 1870078 - RNA, 15 nt, Human
ccacgcagccaggac

SEQ ID NO: 1870079 - RNA, 16 nt, Human
ccacgcagccaggaca

SEQ ID NO: 1870080 - RNA, 13 nt, Human
ccacgcagccagg

SEQ ID NO: 1870081 - RNA, 14 nt, Human
ccacgcagccagga

SEQ ID NO: 1870082 - RNA, 21 nt, Human
cugccucccgcccccuuggcu

SEQ ID NO: 1870083 - RNA, 21 nt, Human
cugaugaacucuuaaucaaau

SEQ ID NO: 1870084 - RNA, 14 nt, Human
cuggacugaccugg

SEQ ID NO: 1870085 - RNA, 21 nt, Human
cuggacugaccugguccacag

SEQ ID NO: 1870086 - RNA, 20 nt, Human
cuggcucucccauuuccuga

SEQ ID NO: 1870087 - RNA, 18 nt, Human
cuguuagucauuugcuga

SEQ ID NO: 1870088 - RNA, 14 nt, Human
cuguuagucauuug

SEQ ID NO: 1870089 - RNA, 15 nt, Human
cuguuagucauuugc

SEQ ID NO: 1870090 - RNA, 13 nt, Human
cuguuagucauuu

SEQ ID NO: 1870091 - RNA, 21 nt, Human
cuuugacucuuuugccauuaa

SEQ ID NO: 1870092 - RNA, 20 nt, Human
cuuugguuaaauagucuaga

SEQ ID NO: 1870093 - RNA, 17 nt, Human
cuuucagcagacugauc

SEQ ID NO: 1870094 - RNA, 15 nt, Human
cuugugcaguguuga

SEQ ID NO: 1870095 - RNA, 20 nt, Human
cuugugacuagugcugaagc

SEQ ID NO: 1870096 - RNA, 19 nt, Human
cuugugccauagucacaug

SEQ ID NO: 1870097 - RNA, 11 nt, Human
cuugugccaua

SEQ ID NO: 1870098 - RNA, 14 nt, Human
cuugugacuagugc

SEQ ID NO: 1870099 - RNA, 15 nt, Human
cuugugacuagugcu

SEQ ID NO: 1870100 - RNA, 16 nt, Human
cuugugacuagugcug

SEQ ID NO: 1870101 - RNA, 17 nt, Human
cuugugacuagugcuga

SEQ ID NO: 1870102 - RNA, 18 nt, Human
cuugugacuagugcugaa

SEQ ID NO: 1870103 - RNA, 19 nt, Human
cuugugacuagugcugaag

SEQ ID NO: 1870104 - RNA, 13 nt, Human
cuucucacauuua

SEQ ID NO: 1870105 - RNA, 20 nt, Human
cuucucacauuuauauuuuu

SEQ ID NO: 1870106 - RNA, 16 nt, Human
cuucuagguucuaaaa

SEQ ID NO: 1870107 - RNA, 23 nt, Human
cuucuuaaucuuuucacaaauaa

SEQ ID NO: 1870108 - RNA, 21 nt, Human
cuucuuaaucuuuucacaaau

SEQ ID NO: 1870109 - RNA, 22 nt, Human
cuucuuaaucuuuucacaaaua

SEQ ID NO: 1870110 - RNA, 16 nt, Human
cuucuuaaucuuuuca

SEQ ID NO: 1870111 - RNA, 17 nt, Human
cuucuuaaucuuuucac

SEQ ID NO: 1870112 - RNA, 20 nt, Human
cuucuuaaucuuuucacaaa

SEQ ID NO: 1870113 - RNA, 20 nt, Human
cuugaauugcauuuuuuaaa

SEQ ID NO: 1870114 - RNA, 16 nt, Human
gaacacccuauauuuu

SEQ ID NO: 1870115 - RNA, 13 nt, Human
gaacucuuaauca

SEQ ID NO: 1870116 - RNA, 20 nt, Human
gaacucuuaaucaaauagca

SEQ ID NO: 1870117 - RNA, 15 nt, Human
gaaccaggcuuggaa

SEQ ID NO: 1870118 - RNA, 17 nt, Human
gaaccccuucauccucu

SEQ ID NO: 1870119 - RNA, 12 nt, Human
gacuagugcuga

SEQ ID NO: 1870120 - RNA, 13 nt, Human
gacuagugcugaa

SEQ ID NO: 1870121 - RNA, 14 nt, Human
gacuagugcugaag

SEQ ID NO: 1870122 - RNA, 15 nt, Human
gacuagugcugaagc

SEQ ID NO: 1870123 - RNA, 16 nt, Human
gacuagugcugaagcu

SEQ ID NO: 1870124 - RNA, 17 nt, Human
gacuagugcugaagcuu

SEQ ID NO: 1870125 - RNA, 18 nt, Human
gacuagugcugaagcuua

SEQ ID NO: 1870126 - RNA, 23 nt, Human
gacuagugcugaagcuuauuaau

SEQ ID NO: 1870127 - RNA, 19 nt, Human
gacuagugcugaagcuuau

SEQ ID NO: 1870128 - RNA, 12 nt, Human
gacgcuggcucc

SEQ ID NO: 1870129 - RNA, 23 nt, Human
gaccaggcauccuccacaauagc

SEQ ID NO: 1870130 - RNA, 15 nt, Human
gaccauaauguuaca

SEQ ID NO: 1870131 - RNA, 21 nt, Human
gagaagcucucgggcuaggaa

SEQ ID NO: 1870132 - RNA, 16 nt, Human
gauggaguucuugugc

SEQ ID NO: 1870133 - RNA, 18 nt, Human
gauggaguucuugugcca

SEQ ID NO: 1870134 - RNA, 19 nt, Human
gauggaguucuugugccau

SEQ ID NO: 1870135 - RNA, 14 nt, Human
gcauguaugucuug

SEQ ID NO: 1870136 - RNA, 15 nt, Human
gcauguaugucuugg

SEQ ID NO: 1870137 - RNA, 18 nt, Human
gcagggacacgggcagcc

SEQ ID NO: 1870138 - RNA, 19 nt, Human
gcagggacacgggcagccu

SEQ ID NO: 1870139 - RNA, 22 nt, Human
gcagggacacgggcagccuggc

SEQ ID NO: 1870140 - RNA, 12 nt, Human
gcucccaggaca

SEQ ID NO: 1870141 - RNA, 13 nt, Human
gcucccaggacac

SEQ ID NO: 1870142 - RNA, 19 nt, Human
gcuccugagggagcuccaa

SEQ ID NO: 1870143 - RNA, 17 nt, Human
gcuccugagggagcucc

SEQ ID NO: 1870144 - RNA, 20 nt, Human
gcucccggggcagggcagcc

SEQ ID NO: 1870145 - RNA, 19 nt, Human
gcucccggggcagggcagc

SEQ ID NO: 1870146 - RNA, 20 nt, Human
gcuccccucugcacggacca

SEQ ID NO: 1870147 - RNA, 17 nt, Human
gcucccggggcagggca

SEQ ID NO: 1870148 - RNA, 14 nt, Human
gcuaauaaaauauc

SEQ ID NO: 1870149 - RNA, 17 nt, Human
gcuaauaaaauaucauu

SEQ ID NO: 1870150 - RNA, 23 nt, Human
gcuaauaaaauaucauucagcaa

SEQ ID NO: 1870151 - RNA, 18 nt, Human
gcuaauaaaauaucauuc

SEQ ID NO: 1870152 - RNA, 19 nt, Human
gcuaauaaaauaucauuca

SEQ ID NO: 1870153 - RNA, 20 nt, Human
gcuaauaaaauaucauucag

SEQ ID NO: 1870154 - RNA, 21 nt, Human
gcuaauaaaauaucauucagc

SEQ ID NO: 1870155 - RNA, 22 nt, Human
gcgugguguggagugugugucu

SEQ ID NO: 1870156 - RNA, 15 nt, Human
gccuccaucagcuaa

SEQ ID NO: 1870157 - RNA, 13 nt, Human
gccuggccuggca

SEQ ID NO: 1870158 - RNA, 16 nt, Human
gccuggccuggcacac

SEQ ID NO: 1870159 - RNA, 17 nt, Human
gcccucaccacccacuu

SEQ ID NO: 1870160 - RNA, 15 nt, Human
gccgcccgggcccag

SEQ ID NO: 1870161 - RNA, 16 nt, Human
gccgcccgggcccaga

SEQ ID NO: 1870162 - RNA, 18 nt, Human
gccgcccgggcccagagg

SEQ ID NO: 1870163 - RNA, 21 nt, Human
ggacacgggcagccuggcucc

SEQ ID NO: 1870164 - RNA, 13 nt, Human
ggaauaauaccua

SEQ ID NO: 1870165 - RNA, 13 nt, Human
ggacgugggcugg

SEQ ID NO: 1870166 - RNA, 21 nt, Human
gcuggcuccccaaagggugug

SEQ ID NO: 1870167 - RNA, 13 nt, Human
gcuggcuccccaa

SEQ ID NO: 1870168 - RNA, 17 nt, Human
gcuggcuccccaaaggg

SEQ ID NO: 1870169 - RNA, 19 nt, Human
gcuuauuaaugcuaagggc

SEQ ID NO: 1870170 - RNA, 20 nt, Human
gcuuauuaaugcuaagggca

SEQ ID NO: 1870171 - RNA, 15 nt, Human
gcuuauuaaugcuaa

SEQ ID NO: 1870172 - RNA, 16 nt, Human
gcuuauuaaugcuaag

SEQ ID NO: 1870173 - RNA, 17 nt, Human
ggcagggcucccacaga

SEQ ID NO: 1870174 - RNA, 21 nt, Human
ggcagggcucccacagagaca

SEQ ID NO: 1870175 - RNA, 14 nt, Human
ggcaguuggccaga

SEQ ID NO: 1870176 - RNA, 14 nt, Human
aaaaauaacaauga

SEQ ID NO: 1870177 - RNA, 14 nt, Human
gggacacgggcagc

SEQ ID NO: 1870178 - RNA, 14 nt, Human
gggaggucauuuug

SEQ ID NO: 1870179 - RNA, 16 nt, Human
guacugagccuuguaa

SEQ ID NO: 1870180 - RNA, 21 nt, Human
guaccaaucauuuuaauuauu

SEQ ID NO: 1870181 - RNA, 14 nt, Human
guaccaaucauuuu

SEQ ID NO: 1870182 - RNA, 15 nt, Human
guaccaaucauuuua

SEQ ID NO: 1870183 - RNA, 19 nt, Human
guacauguguagccugugc

SEQ ID NO: 1870184 - RNA, 20 nt, Human
guacauguguagccugugca

SEQ ID NO: 1870185 - RNA, 20 nt, Human
guaauaggcguaacuaauuu

SEQ ID NO: 1870186 - RNA, 14 nt, Human
guacacguguccug

SEQ ID NO: 1870187 - RNA, 15 nt, Human
guacacguguccugu

SEQ ID NO: 1870188 - RNA, 17 nt, Human
guacacguguccuguag

SEQ ID NO: 1870189 - RNA, 17 nt, Human
gggucgacuucgggcug

SEQ ID NO: 1870190 - RNA, 13 nt, Human
aaagacagugaaa

SEQ ID NO: 1870191 - RNA, 20 nt, Human
aaacuuuccucuuccugccu

SEQ ID NO: 1870192 - RNA, 19 nt, Human
aaagcacgaaauguuauuu

SEQ ID NO: 1870193 - RNA, 17 nt, Human
ggucgacuucgggcugg

SEQ ID NO: 1870194 - RNA, 17 nt, Human
ggugcagccagaggcac

SEQ ID NO: 1870195 - RNA, 13 nt, Human
ggugcagccagag

SEQ ID NO: 1870196 - RNA, 20 nt, Human
auuucuugagguaaaagcau

SEQ ID NO: 1870197 - RNA, 19 nt, Human
auuggacaguaaaauccac

SEQ ID NO: 1870198 - RNA, 19 nt, Human
auuuaaagaacacccuaua

SEQ ID NO: 1870199 - RNA, 14 nt, Human
auuuucuauaauuu

SEQ ID NO: 1870200 - RNA, 15 nt, Human
auuuucuauaauuua

SEQ ID NO: 1870201 - RNA, 22 nt, Human
auuuuugugauuuugugauuga

SEQ ID NO: 1870202 - RNA, 15 nt, Human
auuuuuuaaaacaag

SEQ ID NO: 1870203 - RNA, 17 nt, Human
auuuuuuaaaacaagaa

SEQ ID NO: 1870204 - RNA, 15 nt, Human
auuuuuuaauuauua

SEQ ID NO: 1870205 - RNA, 20 nt, Human
auuuuuuaauuauuauuuau

SEQ ID NO: 1870206 - RNA, 15 nt, Human
auuauauuuacaaau

SEQ ID NO: 1870207 - RNA, 15 nt, Human
auuauuauucuucau

SEQ ID NO: 1870208 - RNA, 15 nt, Human
auuaucaagcuaaua

SEQ ID NO: 1870209 - RNA, 13 nt, Human
auuaucaagcuaa

SEQ ID NO: 1870210 - RNA, 14 nt, Human
auuaucaagcuaau

SEQ ID NO: 1870211 - RNA, 16 nt, Human
auuauuauucuucaua

SEQ ID NO: 1870212 - RNA, 20 nt, Human
auucuaggccuccuggccca

SEQ ID NO: 1870213 - RNA, 19 nt, Human
auucuaggccuccuggccc

SEQ ID NO: 1870214 - RNA, 18 nt, Human
auucuaggccuccuggcc

SEQ ID NO: 1870215 - RNA, 15 nt, Human
uuugaaaucagcaua

SEQ ID NO: 1870216 - RNA, 18 nt, Human
augggugaaggcuggcau

SEQ ID NO: 1870217 - RNA, 17 nt, Human
augggugaaggcuggca

SEQ ID NO: 1870218 - RNA, 16 nt, Human
augggugaaggcuggc

SEQ ID NO: 1870219 - RNA, 15 nt, Human
augggugaaggcugg

SEQ ID NO: 1870220 - RNA, 14 nt, Human
augggugaaggcug

SEQ ID NO: 1870221 - RNA, 16 nt, Human
uuucugggauaaguaa

SEQ ID NO: 1870222 - RNA, 14 nt, Human
auguacauuaauua

SEQ ID NO: 1870223 - RNA, 15 nt, Human
auguaccauguacau

SEQ ID NO: 1870224 - RNA, 21 nt, Human
auguaccauguacaugaagaa

SEQ ID NO: 1870225 - RNA, 18 nt, Human
auguacugagccuuguaa

SEQ ID NO: 1870226 - RNA, 19 nt, Human
uuugcugagcauguacuga

SEQ ID NO: 1870227 - RNA, 12 nt, Human
uuugacucuuuu

SEQ ID NO: 1870228 - RNA, 18 nt, Human
uuuaaauauaugcuaagu

SEQ ID NO: 1870229 - RNA, 23 nt, Human
uuuaauuauuauuuauauaugua

SEQ ID NO: 1870230 - RNA, 14 nt, Human
uuuaauuauuauuc

SEQ ID NO: 1870231 - RNA, 23 nt, Human
uuuaauuauuauucuucauaaca

SEQ ID NO: 1870232 - RNA, 22 nt, Human
augcccuuucuugaauugcauu

SEQ ID NO: 1870233 - RNA, 20 nt, Human
uuggugccuggccuggcaca

SEQ ID NO: 1870234 - RNA, 22 nt, Human
uuggugccuggccuggcacaca

SEQ ID NO: 1870235 - RNA, 17 nt, Human
augauccaagcaagacu

SEQ ID NO: 1870236 - RNA, 15 nt, Human
augauccaagcaaga

SEQ ID NO: 1870237 - RNA, 15 nt, Human
uuuaaaacaagaaag

SEQ ID NO: 1870238 - RNA, 20 nt, Human
uuuaaaacaagaaaguuucc

SEQ ID NO: 1870239 - RNA, 12 nt, Human
uuuaucauuuuc

SEQ ID NO: 1870240 - RNA, 20 nt, Human
augcuaagggcaggcccaaa

SEQ ID NO: 1870241 - RNA, 21 nt, Human
uuucauuaauacagggcauuu

SEQ ID NO: 1870242 - RNA, 15 nt, Human
auggacucugcacau

SEQ ID NO: 1870243 - RNA, 21 nt, Human
auggcaggacgugggcugggc

SEQ ID NO: 1870244 - RNA, 20 nt, Human
auggcaggacgugggcuggg

SEQ ID NO: 1870245 - RNA, 16 nt, Human
auccaagcaagacuga

SEQ ID NO: 1870246 - RNA, 19 nt, Human
uucugggcacccucccacc

SEQ ID NO: 1870247 - RNA, 17 nt, Human
uugaaauuguauuacaa

SEQ ID NO: 1870248 - RNA, 23 nt, Human
auccuagagauuugguguacaau

SEQ ID NO: 1870249 - RNA, 21 nt, Human
auccuagagauuugguguaca

SEQ ID NO: 1870250 - RNA, 19 nt, Human
uucuuaaucuuuucacaaa

SEQ ID NO: 1870251 - RNA, 20 nt, Human
uucuuaaucuuuucacaaau

SEQ ID NO: 1870252 - RNA, 21 nt, Human
uucuuaaucuuuucacaaaua

SEQ ID NO: 1870253 - RNA, 19 nt, Human
uuccguagguuauuuucag

SEQ ID NO: 1870254 - RNA, 14 nt, Human
uuccuguccuccca

SEQ ID NO: 1870255 - RNA, 20 nt, Human
uuccuguccucccagcuccu

SEQ ID NO: 1870256 - RNA, 15 nt, Human
aucaagcuaauaaaa

SEQ ID NO: 1870257 - RNA, 13 nt, Human
aucaagcuaauaa

SEQ ID NO: 1870258 - RNA, 21 nt, Human
aucagcaagucucuuuauaug

SEQ ID NO: 1870259 - RNA, 18 nt, Human
aucagggaggucauuuug

SEQ ID NO: 1870260 - RNA, 12 nt, Human
uucuaaaugaau

SEQ ID NO: 1870261 - RNA, 15 nt, Human
uucuaaaugaauguu

SEQ ID NO: 1870262 - RNA, 18 nt, Human
uucuaaaugaauguuuac

SEQ ID NO: 1870263 - RNA, 21 nt, Human
uucuaaaugaauguuuacacu

SEQ ID NO: 1870264 - RNA, 19 nt, Human
aucuagacccaucuucuuu

SEQ ID NO: 1870265 - RNA, 23 nt, Human
uugcauaguaccaaucauuuuaa

SEQ ID NO: 1870266 - RNA, 17 nt, Human
uugaagggaaauuucag

SEQ ID NO: 1870267 - RNA, 18 nt, Human
auccucugagugugacca

SEQ ID NO: 1870268 - RNA, 22 nt, Human
aucuaauaccucugugugcucc

SEQ ID NO: 1870269 - RNA, 18 nt, Human
augaacuuguaaaggaau

SEQ ID NO: 1870270 - RNA, 19 nt, Human
augaagacucgcaauuuca

SEQ ID NO: 1870271 - RNA, 12 nt, Human
uuggugccuggc

SEQ ID NO: 1870272 - RNA, 13 nt, Human
uuggugccuggcc

SEQ ID NO: 1870273 - RNA, 22 nt, Human
uuggccgcaccuaaagcagcca

SEQ ID NO: 1870274 - RNA, 14 nt, Human
aucuuauaauuuaa

SEQ ID NO: 1870275 - RNA, 15 nt, Human
uugccaaaaaggggu

SEQ ID NO: 1870276 - RNA, 18 nt, Human
uugcauuuuuuaaaacaa

SEQ ID NO: 1870277 - RNA, 17 nt, Human
aucugguuaggauggca

SEQ ID NO: 1870278 - RNA, 19 nt, Human
auaaauuguaauuguaaag

SEQ ID NO: 1870279 - RNA, 21 nt, Human
uuaaguuuccuuccagcccag

SEQ ID NO: 1870280 - RNA, 20 nt, Human
uuaaguuuccuuccagccca

SEQ ID NO: 1870281 - RNA, 16 nt, Human
uuaaucuuuucacaaa

SEQ ID NO: 1870282 - RNA, 17 nt, Human
uuaaucuuuucacaaau

SEQ ID NO: 1870283 - RNA, 12 nt, Human
aguuuuaucauu

SEQ ID NO: 1870284 - RNA, 13 nt, Human
aguuuuaucauuu

SEQ ID NO: 1870285 - RNA, 17 nt, Human
aguuuaaauuguaauag

SEQ ID NO: 1870286 - RNA, 20 nt, Human
aguuuaaauuguaauaggcg

SEQ ID NO: 1870287 - RNA, 15 nt, Human
uuauaaauauauuua

SEQ ID NO: 1870288 - RNA, 14 nt, Human
auacuauauuuaug

SEQ ID NO: 1870289 - RNA, 15 nt, Human
uuaucaaaacuuucu

SEQ ID NO: 1870290 - RNA, 23 nt, Human
uuaugggaaccccuucauccucu

SEQ ID NO: 1870291 - RNA, 17 nt, Human
uuaugggaaucaagauu

SEQ ID NO: 1870292 - RNA, 12 nt, Human
uuaucauuuuca

SEQ ID NO: 1870293 - RNA, 16 nt, Human
uuaucauuuucaaaau

SEQ ID NO: 1870294 - RNA, 14 nt, Human
uuauuauauuuaca

SEQ ID NO: 1870295 - RNA, 15 nt, Human
uuauuauauuuacaa

SEQ ID NO: 1870296 - RNA, 13 nt, Human
auagaaguaaaaa

SEQ ID NO: 1870297 - RNA, 18 nt, Human
auagauaggucagugcaa

SEQ ID NO: 1870298 - RNA, 14 nt, Human
auagaguguuauca

SEQ ID NO: 1870299 - RNA, 21 nt, Human
agugcagaccccuuggccagc

SEQ ID NO: 1870300 - RNA, 16 nt, Human
ugugcuccuccuuggu

SEQ ID NO: 1870301 - RNA, 18 nt, Human
agucuuucacauuuaaau

SEQ ID NO: 1870302 - RNA, 16 nt, Human
agucuuucacauuuaa

SEQ ID NO: 1870303 - RNA, 17 nt, Human
agucuugugacuagugc

SEQ ID NO: 1870304 - RNA, 20 nt, Human
agucuugugacuagugcuga

SEQ ID NO: 1870305 - RNA, 21 nt, Human
agucuugugacuagugcugaa

SEQ ID NO: 1870306 - RNA, 23 nt, Human
agucuugugacuagugcugaagc

SEQ ID NO: 1870307 - RNA, 22 nt, Human
agucuugugacuagugcugaag

SEQ ID NO: 1870308 - RNA, 16 nt, Human
ugugaugcccugcccu

SEQ ID NO: 1870309 - RNA, 23 nt, Human
ugugagcucccaggugcagccag

SEQ ID NO: 1870310 - RNA, 19 nt, Human
ugugagcucccaggugcag

SEQ ID NO: 1870311 - RNA, 17 nt, Human
ugugacuuaagaagccu

SEQ ID NO: 1870312 - RNA, 23 nt, Human
agucucuuuuuuuggcccaggcc

SEQ ID NO: 1870313 - RNA, 20 nt, Human
agucucuuuuuuuggcccag

SEQ ID NO: 1870314 - RNA, 21 nt, Human
agucucuuuuuuuggcccagg

SEQ ID NO: 1870315 - RNA, 14 nt, Human
agugugaccaggca

SEQ ID NO: 1870316 - RNA, 11 nt, Human
agugugugucu

SEQ ID NO: 1870317 - RNA, 12 nt, Human
agugugugucuu

SEQ ID NO: 1870318 - RNA, 14 nt, Human
agugugugucuuuc

SEQ ID NO: 1870319 - RNA, 13 nt, Human
ugugucuguacac

SEQ ID NO: 1870320 - RNA, 14 nt, Human
ugugucuguacacg

SEQ ID NO: 1870321 - RNA, 21 nt, Human
ugugucuguacacguguccug

SEQ ID NO: 1870322 - RNA, 22 nt, Human
aguaauugguccgaucuuugac

SEQ ID NO: 1870323 - RNA, 22 nt, Human
uguacaugaagaagcuaaaucc

SEQ ID NO: 1870324 - RNA, 11 nt, Human
uguacaugugu

SEQ ID NO: 1870325 - RNA, 15 nt, Human
uguacauguguagcc

SEQ ID NO: 1870326 - RNA, 16 nt, Human
aguaccaaucauuuua

SEQ ID NO: 1870327 - RNA, 15 nt, Human
aguaccaaucauuuu

SEQ ID NO: 1870328 - RNA, 13 nt, Human
uguaauucuaaau

SEQ ID NO: 1870329 - RNA, 14 nt, Human
uguaauucuaaaug

SEQ ID NO: 1870330 - RNA, 15 nt, Human
uguaauucuaaauga

SEQ ID NO: 1870331 - RNA, 16 nt, Human
uguaauucuaaaugaa

SEQ ID NO: 1870332 - RNA, 20 nt, Human
aguccuacaagcuaaaauua

SEQ ID NO: 1870333 - RNA, 19 nt, Human
agucgcaucucagugcagg

SEQ ID NO: 1870334 - RNA, 24 nt, Human
agucacugugagcucccaggugca

SEQ ID NO: 1870335 - RNA, 23 nt, Human
agucacugugagcucccaggugc

SEQ ID NO: 1870336 - RNA, 16 nt, Human
agggagaccuggacac

SEQ ID NO: 1870337 - RNA, 22 nt, Human
agggagaccuggacacaggccu

SEQ ID NO: 1870338 - RNA, 21 nt, Human
agggagaccuggacacaggcc

SEQ ID NO: 1870339 - RNA, 23 nt, Human
agggagcuagccagaggacugug

SEQ ID NO: 1870340 - RNA, 17 nt, Human
agggagcuagccagagg

SEQ ID NO: 1870341 - RNA, 22 nt, Human
agggagcuccaacucagaaggg

SEQ ID NO: 1870342 - RNA, 16 nt, Human
agggagcuagccagag

SEQ ID NO: 1870343 - RNA, 15 nt, Human
agggagcuagccaga

SEQ ID NO: 1870344 - RNA, 14 nt, Human
ugggcaaacaggca

SEQ ID NO: 1870345 - RNA, 15 nt, Human
ugggcaaacaggcag

SEQ ID NO: 1870346 - RNA, 16 nt, Human
ugggcaaacaggcagu

SEQ ID NO: 1870347 - RNA, 18 nt, Human
ugggaaacaaaaggauaa

SEQ ID NO: 1870348 - RNA, 17 nt, Human
aggcuuuuuuccagacu

SEQ ID NO: 1870349 - RNA, 20 nt, Human
ugggaaccccuucauccucu

SEQ ID NO: 1870350 - RNA, 22 nt, Human
ugggaaccccuucauccucuga

SEQ ID NO: 1870351 - RNA, 19 nt, Human
aggauuucaugauuucauu

SEQ ID NO: 1870352 - RNA, 20 nt, Human
aggauuucaugauuucauuu

SEQ ID NO: 1870353 - RNA, 14 nt, Human
agcuuauuaaugcu

SEQ ID NO: 1870354 - RNA, 15 nt, Human
agcuuauuaaugcua

SEQ ID NO: 1870355 - RNA, 16 nt, Human
agcuuauuaaugcuaa

SEQ ID NO: 1870356 - RNA, 17 nt, Human
agcuuauuaaugcuaag

SEQ ID NO: 1870357 - RNA, 18 nt, Human
agcuuauuaaugcuaagg

SEQ ID NO: 1870358 - RNA, 19 nt, Human
agcuuauuaaugcuaaggg

SEQ ID NO: 1870359 - RNA, 21 nt, Human
agcuuauuaaugcuaagggca

SEQ ID NO: 1870360 - RNA, 22 nt, Human
agcuuauuaaugcuaagggcag

SEQ ID NO: 1870361 - RNA, 21 nt, Human
aggaaacucugcauucuagua

SEQ ID NO: 1870362 - RNA, 19 nt, Human
ugcgacacugggaggccag

SEQ ID NO: 1870363 - RNA, 19 nt, Human
agcugccucugccacugac

SEQ ID NO: 1870364 - RNA, 15 nt, Human
agcugggagccgggc

SEQ ID NO: 1870365 - RNA, 14 nt, Human
agcugggagccggg

SEQ ID NO: 1870366 - RNA, 18 nt, Human
ugcccuuggcacccaaga

SEQ ID NO: 1870367 - RNA, 21 nt, Human
agcguggcgcaguggcccuga

SEQ ID NO: 1870368 - RNA, 22 nt, Human
agcguggcgcaguggcccugag

SEQ ID NO: 1870369 - RNA, 24 nt, Human
agcguggcgcaguggcccugagca

SEQ ID NO: 1870370 - RNA, 18 nt, Human
ugccauagucacauggcc

SEQ ID NO: 1870371 - RNA, 19 nt, Human
ugccauagucacauggccu

SEQ ID NO: 1870372 - RNA, 19 nt, Human
agcuauggugucauaggcu

SEQ ID NO: 1870373 - RNA, 16 nt, Human
ugcccucaccacccac

SEQ ID NO: 1870374 - RNA, 19 nt, Human
ugcacaugucuuguacaug

SEQ ID NO: 1870375 - RNA, 22 nt, Human
ugcacaugucuuguacaugugu

SEQ ID NO: 1870376 - RNA, 15 nt, Human
ugcacaugucuugua

SEQ ID NO: 1870377 - RNA, 23 nt, Human
ugcacaugaaucccacccacaug

SEQ ID NO: 1870378 - RNA, 13 nt, Human
ugcacaagccagg

SEQ ID NO: 1870379 - RNA, 14 nt, Human
ugcacaagccaggg

SEQ ID NO: 1870380 - RNA, 19 nt, Human
ugcagucuguccaggcucg

SEQ ID NO: 1870381 - RNA, 21 nt, Human
ucuggagucucacuugucuca

SEQ ID NO: 1870382 - RNA, 23 nt, Human
agaagaaaauggaaccaggcuug

SEQ ID NO: 1870383 - RNA, 22 nt, Human
agaagaaaauggaaccaggcuu

SEQ ID NO: 1870384 - RNA, 20 nt, Human
agaagaaaauggaaccaggc

SEQ ID NO: 1870385 - RNA, 19 nt, Human
agaagaaaauggaaccagg

SEQ ID NO: 1870386 - RNA, 17 nt, Human
ucuuaaucuuuucacaa

SEQ ID NO: 1870387 - RNA, 18 nt, Human
ucuuaaucuuuucacaaa

SEQ ID NO: 1870388 - RNA, 16 nt, Human
ucuuggacacuguaca

SEQ ID NO: 1870389 - RNA, 17 nt, Human
ucuuggacacuguacaa

SEQ ID NO: 1870390 - RNA, 12 nt, Human
agauaauuauaa

SEQ ID NO: 1870391 - RNA, 16 nt, Human
ugaagcuuauuaaugc

SEQ ID NO: 1870392 - RNA, 17 nt, Human
ugaagcuuauuaaugcu

SEQ ID NO: 1870393 - RNA, 18 nt, Human
ugaagcuuauuaaugcua

SEQ ID NO: 1870394 - RNA, 19 nt, Human
ugaagcuuauuaaugcuaa

SEQ ID NO: 1870395 - RNA, 20 nt, Human
ugaagcuuauuaaugcuaag

SEQ ID NO: 1870396 - RNA, 23 nt, Human
ugaagcuuauuaaugcuaagggc

SEQ ID NO: 1870397 - RNA, 22 nt, Human
ugaagcuuauuaaugcuaaggg

SEQ ID NO: 1870398 - RNA, 19 nt, Human
agauggaguucuugugcca

SEQ ID NO: 1870399 - RNA, 22 nt, Human
ugaccccgacgccacagcccag

SEQ ID NO: 1870400 - RNA, 21 nt, Human
ugaccccgacgccacagccca

SEQ ID NO: 1870401 - RNA, 17 nt, Human
ugaccacaccugccucu

SEQ ID NO: 1870402 - RNA, 18 nt, Human
ugacuuggggagauggag

SEQ ID NO: 1870403 - RNA, 19 nt, Human
ugacuuggggagauggagu

SEQ ID NO: 1870404 - RNA, 18 nt, Human
ugagcaauguauaacccc

SEQ ID NO: 1870405 - RNA, 17 nt, Human
ugagcaauguauaaccc

SEQ ID NO: 1870406 - RNA, 17 nt, Human
agcacgaaauguuauuu

SEQ ID NO: 1870407 - RNA, 18 nt, Human
agcacgaaauguuauuuu

SEQ ID NO: 1870408 - RNA, 19 nt, Human
agcagacugaucaggaccu

SEQ ID NO: 1870409 - RNA, 18 nt, Human
agcagacugaucaggacc

SEQ ID NO: 1870410 - RNA, 17 nt, Human
agcagacugaucaggac

SEQ ID NO: 1870411 - RNA, 16 nt, Human
agcagacugaucagga

SEQ ID NO: 1870412 - RNA, 21 nt, Human
agcagacaguguuuucuggga

SEQ ID NO: 1870413 - RNA, 13 nt, Human
ugagcuacaaaug

SEQ ID NO: 1870414 - RNA, 14 nt, Human
ugagcuacaaaugc

SEQ ID NO: 1870415 - RNA, 13 nt, Human
ugagccuuguaau

SEQ ID NO: 1870416 - RNA, 16 nt, Human
ugagcuacaaaugcau

SEQ ID NO: 1870417 - RNA, 23 nt, Human
ugaggggucgacuucgggcuggc

SEQ ID NO: 1870418 - RNA, 19 nt, Human
acccaagaccucagggcac

SEQ ID NO: 1870419 - RNA, 18 nt, Human
acccaagaccucagggca

SEQ ID NO: 1870420 - RNA, 17 nt, Human
accccuuucuggcucuc

SEQ ID NO: 1870421 - RNA, 18 nt, Human
accugguccacagggcac

SEQ ID NO: 1870422 - RNA, 17 nt, Human
accugguccacagggca

SEQ ID NO: 1870423 - RNA, 16 nt, Human
accugguccacagggc

SEQ ID NO: 1870424 - RNA, 15 nt, Human
accugguccacaggg

SEQ ID NO: 1870425 - RNA, 13 nt, Human
ucauuuuaauuau

SEQ ID NO: 1870426 - RNA, 14 nt, Human
ucauuuuaauuauu

SEQ ID NO: 1870427 - RNA, 19 nt, Human
uccugugccuccaucagcu

SEQ ID NO: 1870428 - RNA, 12 nt, Human
acugcagggaca

SEQ ID NO: 1870429 - RNA, 22 nt, Human
acugcagggacacgggcagccu

SEQ ID NO: 1870430 - RNA, 16 nt, Human
uccuuucauuuacugu

SEQ ID NO: 1870431 - RNA, 20 nt, Human
uccuuucauuuacuguggcu

SEQ ID NO: 1870432 - RNA, 15 nt, Human
acuggcgccuccgag

SEQ ID NO: 1870433 - RNA, 17 nt, Human
ucccaggugcagccaga

SEQ ID NO: 1870434 - RNA, 17 nt, Human
ucccauagccaggaaac

SEQ ID NO: 1870435 - RNA, 14 nt, Human
uccccaaagggugu

SEQ ID NO: 1870436 - RNA, 11 nt, Human
acucugcacau

SEQ ID NO: 1870437 - RNA, 13 nt, Human
acucugcacaugu

SEQ ID NO: 1870438 - RNA, 17 nt, Human
acucugcacaugucuug

SEQ ID NO: 1870439 - RNA, 16 nt, Human
acucugcauucuagua

SEQ ID NO: 1870440 - RNA, 18 nt, Human
acucugcacaugucuugu

SEQ ID NO: 1870441 - RNA, 19 nt, Human
acucugcacaugucuugua

SEQ ID NO: 1870442 - RNA, 21 nt, Human
acucugcacaugucuuguaca

SEQ ID NO: 1870443 - RNA, 22 nt, Human
acucugcacaugucuuguacau

SEQ ID NO: 1870444 - RNA, 19 nt, Human
uccucagaucauccagaag

SEQ ID NO: 1870445 - RNA, 17 nt, Human
acagcccagccacggac

SEQ ID NO: 1870446 - RNA, 16 nt, Human
acagcccagccacgga

SEQ ID NO: 1870447 - RNA, 15 nt, Human
uauauuuacaaaugg

SEQ ID NO: 1870448 - RNA, 14 nt, Human
uauauuuacaaaug

SEQ ID NO: 1870449 - RNA, 12 nt, Human
acacccagcccc

SEQ ID NO: 1870450 - RNA, 17 nt, Human
acacccagcccccacau

SEQ ID NO: 1870451 - RNA, 23 nt, Human
acaguucggugagcuacaaaugc

SEQ ID NO: 1870452 - RNA, 19 nt, Human
acaguucggugagcuacaa

SEQ ID NO: 1870453 - RNA, 22 nt, Human
acaguucggugagcuacaaaug

SEQ ID NO: 1870454 - RNA, 15 nt, Human
acaguucauauguac

SEQ ID NO: 1870455 - RNA, 14 nt, Human
uauucuucauaaca

SEQ ID NO: 1870456 - RNA, 17 nt, Human
uauuuaagauaauuaua

SEQ ID NO: 1870457 - RNA, 20 nt, Human
uauuuaagauaauuauaaua

SEQ ID NO: 1870458 - RNA, 20 nt, Human
acagugaaagaaaauaacaa

SEQ ID NO: 1870459 - RNA, 17 nt, Human
acagggcaccugccacc

SEQ ID NO: 1870460 - RNA, 15 nt, Human
acagggcaccugcca

SEQ ID NO: 1870461 - RNA, 12 nt, Human
uauuaaagacag

SEQ ID NO: 1870462 - RNA, 21 nt, Human
aauucuugccaaauauaaaua

SEQ ID NO: 1870463 - RNA, 22 nt, Human
uacucaauguuacuaucugcuu

SEQ ID NO: 1870464 - RNA, 18 nt, Human
acaagcacuaaacaaaga

SEQ ID NO: 1870465 - RNA, 19 nt, Human
acaagcaaacccagacggc

SEQ ID NO: 1870466 - RNA, 16 nt, Human
acaagcaaacccagac

SEQ ID NO: 1870467 - RNA, 14 nt, Human
acaagcuaaaauua

SEQ ID NO: 1870468 - RNA, 11 nt, Human
acaagccaggg

SEQ ID NO: 1870469 - RNA, 15 nt, Human
acaagccagggugug

SEQ ID NO: 1870470 - RNA, 20 nt, Human
acaagaagccacagaccuag

SEQ ID NO: 1870471 - RNA, 21 nt, Human
uagcaugucgucaaagcugaa

SEQ ID NO: 1870472 - RNA, 18 nt, Human
uagcaugucgucaaagcu

SEQ ID NO: 1870473 - RNA, 18 nt, Human
uaauaccucugugugcuc

SEQ ID NO: 1870474 - RNA, 13 nt, Human
uaauaccucugug

SEQ ID NO: 1870475 - RNA, 14 nt, Human
uaauaccucugugu

SEQ ID NO: 1870476 - RNA, 15 nt, Human
uaauaccucugugug

SEQ ID NO: 1870477 - RNA, 19 nt, Human
uaaucagggaggucauuuu

SEQ ID NO: 1870478 - RNA, 18 nt, Human
aaucuuuucacaaauaaa

SEQ ID NO: 1870479 - RNA, 14 nt, Human
aaucuuuucacaaa

SEQ ID NO: 1870480 - RNA, 15 nt, Human
aaucuuuucacaaau

SEQ ID NO: 1870481 - RNA, 16 nt, Human
aaucuuuucacaaaua

SEQ ID NO: 1870482 - RNA, 17 nt, Human
aaucuuuucacaaauaa

SEQ ID NO: 1870483 - RNA, 16 nt, Human
uaauuaucuaaaguau

SEQ ID NO: 1870484 - RNA, 15 nt, Human
aauguacauuaauua

SEQ ID NO: 1870485 - RNA, 16 nt, Human
aauuaaggcauaagaa

SEQ ID NO: 1870486 - RNA, 18 nt, Human
uaccccuuucuggcucuc

SEQ ID NO: 1870487 - RNA, 18 nt, Human
guugacaguucauaugua

SEQ ID NO: 1870488 - RNA, 16 nt, Human
aaggaaaaaauaacaa

SEQ ID NO: 1870489 - RNA, 19 nt, Human
aaggaaaaaauaacaauga

SEQ ID NO: 1870490 - RNA, 13 nt, Human
aaggauaaugaau

SEQ ID NO: 1870491 - RNA, 16 nt, Human
aaggagacaggcagag

SEQ ID NO: 1870492 - RNA, 14 nt, Human
aaggagacaggcag

SEQ ID NO: 1870493 - RNA, 19 nt, Human
aaggagacaggcagagcug

SEQ ID NO: 1870494 - RNA, 23 nt, Human
guugcugaugaacucuuaaucaa

SEQ ID NO: 1870495 - RNA, 22 nt, Human
aagucuuauauauuguagauaa

SEQ ID NO: 1870496 - RNA, 15 nt, Human
guuuuuuaugcuaau

SEQ ID NO: 1870497 - RNA, 18 nt, Human
guuugccuucuacuuuua

SEQ ID NO: 1870498 - RNA, 19 nt, Human
uaaagaacacccuauauuu

SEQ ID NO: 1870499 - RNA, 15 nt, Human
uaaagacagaggcag

SEQ ID NO: 1870500 - RNA, 17 nt, Human
uaaacuaaagaaaaauu

SEQ ID NO: 1870501 - RNA, 17 nt, Human
uaaauccuuuacuguua

SEQ ID NO: 1870502 - RNA, 21 nt, Human
uaaauagucuagacuaaaaga

SEQ ID NO: 1870503 - RNA, 13 nt, Human
uaaaugaauguuu

SEQ ID NO: 1870504 - RNA, 15 nt, Human
aauaacaauaaaaga

SEQ ID NO: 1870505 - RNA, 12 nt, Human
aauaaaaauaau

SEQ ID NO: 1870506 - RNA, 18 nt, Human
aauaaaauaucauucagc

SEQ ID NO: 1870507 - RNA, 19 nt, Human
aauaaaauaucauucagca

SEQ ID NO: 1870508 - RNA, 20 nt, Human
aauaaaauaucauucagcaa

SEQ ID NO: 1870509 - RNA, 12 nt, Human
aauaaaauauca

SEQ ID NO: 1870510 - RNA, 14 nt, Human
aauaaaauaucauu

SEQ ID NO: 1870511 - RNA, 15 nt, Human
aauaaaauaucauuc

SEQ ID NO: 1870512 - RNA, 16 nt, Human
aauaaaauaucauuca

SEQ ID NO: 1870513 - RNA, 17 nt, Human
aauaaaauaucauucag

SEQ ID NO: 1870514 - RNA, 21 nt, Human
aauaaaauaucauucagcaac

SEQ ID NO: 1870515 - RNA, 14 nt, Human
guggacucugcaca

SEQ ID NO: 1870516 - RNA, 17 nt, Human
guggacucugcacaugu

SEQ ID NO: 1870517 - RNA, 13 nt, Human
aagaaaguuuccc

SEQ ID NO: 1870518 - RNA, 15 nt, Human
aagaaaguuucccca

SEQ ID NO: 1870519 - RNA, 19 nt, Human
aagaagccacagaccuagg

SEQ ID NO: 1870520 - RNA, 23 nt, Human
aagaaaguuuccccaccagugaa

SEQ ID NO: 1870521 - RNA, 17 nt, Human
aacuuguauuaaagaca

SEQ ID NO: 1870522 - RNA, 12 nt, Human
gugccuggccug

SEQ ID NO: 1870523 - RNA, 15 nt, Human
gugccuggccuggca

SEQ ID NO: 1870524 - RNA, 19 nt, Human
gugccuggccuggcacaca

SEQ ID NO: 1870525 - RNA, 19 nt, Human
aagcaaacccagacggcuc

SEQ ID NO: 1870526 - RNA, 16 nt, Human
aagcaaacccagacgg

SEQ ID NO: 1870527 - RNA, 13 nt, Human
aagcaaacccaga

SEQ ID NO: 1870528 - RNA, 16 nt, Human
aagagcuguccuggua

SEQ ID NO: 1870529 - RNA, 14 nt, Human
guggcuucuuaauc

SEQ ID NO: 1870530 - RNA, 17 nt, Human
gugggcaaacaggcagu

SEQ ID NO: 1870531 - RNA, 12 nt, Human
guagccugugca

SEQ ID NO: 1870532 - RNA, 18 nt, Human
gucgacuucgggcuggcc

SEQ ID NO: 1870533 - RNA, 16 nt, Human
gucuagacuaaaagau

SEQ ID NO: 1870534 - RNA, 23 nt, Human
aacuaagaaauaugcacaauagc

SEQ ID NO: 1870535 - RNA, 22 nt, Human
aaccaugagaccacuguuauca

SEQ ID NO: 1870536 - RNA, 19 nt, Human
gugaguccuagagcuacag

SEQ ID NO: 1870537 - RNA, 16 nt, Human
aacucugcauucuagu

SEQ ID NO: 1870538 - RNA, 13 nt, Human
gugaaggcuggca

SEQ ID NO: 1870539 - RNA, 12 nt, Human
gugaaggcuggc

SEQ ID NO: 1870540 - RNA, 14 nt, Human
gugaaggcuggcau

SEQ ID NO: 1870541 - RNA, 17 nt, Human
gugaccaggcauccucc

SEQ ID NO: 1870542 - RNA, 17 nt, Human
caagcacuaaacaaaga

SEQ ID NO: 1870543 - RNA, 15 nt, Human
caaauagcauaaguu

SEQ ID NO: 1870544 - RNA, 22 nt, Human
cacaaagaugggugaaggcugg

SEQ ID NO: 1870545 - RNA, 15 nt, Human
caccacgucacuuca

SEQ ID NO: 1870546 - RNA, 15 nt, Human
cacauggccuaugca

SEQ ID NO: 1870547 - RNA, 15 nt, Human
cacaugucuuguaca

SEQ ID NO: 1870548 - RNA, 20 nt, Human
cacaugucuuguacaugugu

SEQ ID NO: 1870549 - RNA, 13 nt, Human
cacaugugacaca

SEQ ID NO: 1870550 - RNA, 15 nt, Human
cacaugugacacaua

SEQ ID NO: 1870551 - RNA, 21 nt, Human
cacccacaugugacacauaug

SEQ ID NO: 1870552 - RNA, 12 nt, Human
cacccacaugug

SEQ ID NO: 1870553 - RNA, 13 nt, Human
cacccacauguga

SEQ ID NO: 1870554 - RNA, 19 nt, Human
cacccacaugugacacaua

SEQ ID NO: 1870555 - RNA, 21 nt, Human
uugaaaaucuuauaauuuaaa

SEQ ID NO: 1870556 - RNA, 22 nt, Human
uucuugugccauagucacaugg

SEQ ID NO: 1870557 - RNA, 18 nt, Human
uucuucauaacaauuuua

SEQ ID NO: 1870558 - RNA, 21 nt, Human
uucuucauaacaauuuuagga

SEQ ID NO: 1870559 - RNA, 18 nt, Human
uugaucccuucuguuggu

SEQ ID NO: 1870560 - RNA, 23 nt, Human
uugaauugcauuuuuuaaaacaa

SEQ ID NO: 1870561 - RNA, 15 nt, Human
uuggacacuguacaa

SEQ ID NO: 1870562 - RNA, 17 nt, Human
uugccuucuacuuuuaa

SEQ ID NO: 1870563 - RNA, 12 nt, Human
uuuaaaaugucu

SEQ ID NO: 1870564 - RNA, 21 nt, Human
uuuaaaacaagaaaguuuccc

SEQ ID NO: 1870565 - RNA, 22 nt, Human
uuuaaaacaagaaaguuucccc

SEQ ID NO: 1870566 - RNA, 14 nt, Human
uuucauuucaacug

SEQ ID NO: 1870567 - RNA, 22 nt, Human
uuucaauuccaccugcaaucaa

SEQ ID NO: 1870568 - RNA, 20 nt, Human
uuucucuccagccugacuug

SEQ ID NO: 1870569 - RNA, 20 nt, Human
uuugguaaaauacuucuuga

SEQ ID NO: 1870570 - RNA, 21 nt, Human
uuugaaauuguauuacaaauc

SEQ ID NO: 1870571 - RNA, 14 nt, Human
uucaccuugaagaa

SEQ ID NO: 1870572 - RNA, 10 nt, Human
uuauuaaagg

SEQ ID NO: 1870573 - RNA, 13 nt, Human
uuauuaaugcuaa

SEQ ID NO: 1870574 - RNA, 14 nt, Human
uuauuaaugcuaag

SEQ ID NO: 1870575 - RNA, 15 nt, Human
uuauuaaugcuaagg

SEQ ID NO: 1870576 - RNA, 16 nt, Human
uuauuaaugcuaaggg

SEQ ID NO: 1870577 - RNA, 18 nt, Human
uucuaaaaauugugauca

SEQ ID NO: 1870578 - RNA, 14 nt, Human
uucgggcuggccau

SEQ ID NO: 1870579 - RNA, 12 nt, Human
uuccuauaugca

SEQ ID NO: 1870580 - RNA, 16 nt, Human
uuacuguggcuucuua

SEQ ID NO: 1870581 - RNA, 18 nt, Human
uuacuguuagucauuugc

SEQ ID NO: 1870582 - RNA, 15 nt, Human
uuacuuuccauugcu

SEQ ID NO: 1870583 - RNA, 15 nt, Human
uuaggauggcaggac

SEQ ID NO: 1870584 - RNA, 12 nt, Human
uuaaagacagag

SEQ ID NO: 1870585 - RNA, 19 nt, Human
uggacugaccugguccaca

SEQ ID NO: 1870586 - RNA, 17 nt, Human
uggacugaccuggucca

SEQ ID NO: 1870587 - RNA, 14 nt, Human
uggacacuguacaa

SEQ ID NO: 1870588 - RNA, 17 nt, Human
uggcccaggugaguccu

SEQ ID NO: 1870589 - RNA, 20 nt, Human
uggccuaugcacauauggac

SEQ ID NO: 1870590 - RNA, 13 nt, Human
uggccuaugcaca

SEQ ID NO: 1870591 - RNA, 14 nt, Human
uggccuaugcacau

SEQ ID NO: 1870592 - RNA, 15 nt, Human
uggccuaugcacaua

SEQ ID NO: 1870593 - RNA, 17 nt, Human
uggccuaugcacauaug

SEQ ID NO: 1870594 - RNA, 13 nt, Human
uggcucccaggac

SEQ ID NO: 1870595 - RNA, 14 nt, Human
uggcucccaggaca

SEQ ID NO: 1870596 - RNA, 15 nt, Human
uggcucccaggacac

SEQ ID NO: 1870597 - RNA, 19 nt, Human
ugcaguuugagacaggaga

SEQ ID NO: 1870598 - RNA, 20 nt, Human
ugcauaguaccaaucauuuu

SEQ ID NO: 1870599 - RNA, 21 nt, Human
ugcauaguaccaaucauuuua

SEQ ID NO: 1870600 - RNA, 22 nt, Human
ugcauaguaccaaucauuuuaa

SEQ ID NO: 1870601 - RNA, 12 nt, Human
ugcugcugcugc

SEQ ID NO: 1870602 - RNA, 13 nt, Human
ugauuauauguca

SEQ ID NO: 1870603 - RNA, 23 nt, Human
ugaugcuacaggauuugaaauug

SEQ ID NO: 1870604 - RNA, 20 nt, Human
ugaugcuacaggauuugaaa

SEQ ID NO: 1870605 - RNA, 20 nt, Human
ugaucaggaccuccaagcca

SEQ ID NO: 1870606 - RNA, 12 nt, Human
ugaucaggaccu

SEQ ID NO: 1870607 - RNA, 18 nt, Human
ugauccaagcaagacuga

SEQ ID NO: 1870608 - RNA, 14 nt, Human
ugagaccacuguua

SEQ ID NO: 1870609 - RNA, 21 nt, Human
ugagaccacagagagagggga

SEQ ID NO: 1870610 - RNA, 20 nt, Human
ugaaaagcuccauuuuuagu

SEQ ID NO: 1870611 - RNA, 12 nt, Human
ucuuuucacaaa

SEQ ID NO: 1870612 - RNA, 13 nt, Human
ucuuuucacaaau

SEQ ID NO: 1870613 - RNA, 14 nt, Human
ucuuuucacaaaua

SEQ ID NO: 1870614 - RNA, 15 nt, Human
ucuuuucacaaauaa

SEQ ID NO: 1870615 - RNA, 16 nt, Human
ucuuuucacaaauaaa

SEQ ID NO: 1870616 - RNA, 20 nt, Human
ugaaacccagucacugugag

SEQ ID NO: 1870617 - RNA, 11 nt, Human
ugaaacccagu

SEQ ID NO: 1870618 - RNA, 17 nt, Human
ugaaacaagaagccaca

SEQ ID NO: 1870619 - RNA, 23 nt, Human
ugaacaagcaaacccagacggcu

SEQ ID NO: 1870620 - RNA, 12 nt, Human
ucuuugccaagu

SEQ ID NO: 1870621 - RNA, 17 nt, Human
ucuuucacauuuaaaua

SEQ ID NO: 1870622 - RNA, 14 nt, Human
ucuuguuucaauuc

SEQ ID NO: 1870623 - RNA, 22 nt, Human
ugaauugcauuuuuuaaaacaa

SEQ ID NO: 1870624 - RNA, 21 nt, Human
ugaauugcauuuuuuaaaaca

SEQ ID NO: 1870625 - RNA, 16 nt, Human
ugaccaggcauccucc

SEQ ID NO: 1870626 - RNA, 14 nt, Human
ugaacucuuaauca

SEQ ID NO: 1870627 - RNA, 15 nt, Human
ugaacucuuaaucaa

SEQ ID NO: 1870628 - RNA, 20 nt, Human
ugaaugaaagucuugugacu

SEQ ID NO: 1870629 - RNA, 23 nt, Human
ugaaugaaagucuugugacuagu

SEQ ID NO: 1870630 - RNA, 21 nt, Human
ugaaugaaagucuugugacua

SEQ ID NO: 1870631 - RNA, 20 nt, Human
ugaaucccacccacauguga

SEQ ID NO: 1870632 - RNA, 16 nt, Human
uccugagaccacagag

SEQ ID NO: 1870633 - RNA, 20 nt, Human
uccaugggccauaugaaaag

SEQ ID NO: 1870634 - RNA, 12 nt, Human
uccauaaucacu

SEQ ID NO: 1870635 - RNA, 11 nt, Human
ucccaggacac

SEQ ID NO: 1870636 - RNA, 13 nt, Human
ucauuuacugugg

SEQ ID NO: 1870637 - RNA, 15 nt, Human
ucauuuacuguggcu

SEQ ID NO: 1870638 - RNA, 20 nt, Human
ucauuuacuguggcuucuua

SEQ ID NO: 1870639 - RNA, 17 nt, Human
uauuauauuuacaaaug

SEQ ID NO: 1870640 - RNA, 13 nt, Human
uauuauuuauaua

SEQ ID NO: 1870641 - RNA, 15 nt, Human
uauuaucaacaauag

SEQ ID NO: 1870642 - RNA, 15 nt, Human
uauggacucugcaca

SEQ ID NO: 1870643 - RNA, 12 nt, Human
uauggacucugc

SEQ ID NO: 1870644 - RNA, 16 nt, Human
uauggacucugcacau

SEQ ID NO: 1870645 - RNA, 12 nt, Human
ucacauuuaaau

SEQ ID NO: 1870646 - RNA, 14 nt, Human
ucaauuccaccugc

SEQ ID NO: 1870647 - RNA, 18 nt, Human
ucaauguuucuucuaggu

SEQ ID NO: 1870648 - RNA, 20 nt, Human
ucaaggacuuucugaagccu

SEQ ID NO: 1870649 - RNA, 16 nt, Human
uaggucagugcaaaua

SEQ ID NO: 1870650 - RNA, 16 nt, Human
uaggacccaagcagag

SEQ ID NO: 1870651 - RNA, 14 nt, Human
uaggacccaagcag

SEQ ID NO: 1870652 - RNA, 17 nt, Human
uauaauguuguuauuua

SEQ ID NO: 1870653 - RNA, 19 nt, Human
uauaauguuguuauuuaaa

SEQ ID NO: 1870654 - RNA, 18 nt, Human
uauaauguuguuauuuaa

SEQ ID NO: 1870655 - RNA, 20 nt, Human
uauaauauacuauauuuaug

SEQ ID NO: 1870656 - RNA, 16 nt, Human
uauaauaaauguacau

SEQ ID NO: 1870657 - RNA, 17 nt, Human
uauaauauacuauauuu

SEQ ID NO: 1870658 - RNA, 22 nt, Human
uaguugcguggacucugcacau

SEQ ID NO: 1870659 - RNA, 13 nt, Human
uaugcacauaugg

SEQ ID NO: 1870660 - RNA, 14 nt, Human
uaugcaccuugugu

SEQ ID NO: 1870661 - RNA, 19 nt, Human
uaugcacauauggacucug

SEQ ID NO: 1870662 - RNA, 20 nt, Human
uaugcacauauggacucugc

SEQ ID NO: 1870663 - RNA, 18 nt, Human
uaugcaccuugugucugu

SEQ ID NO: 1870664 - RNA, 19 nt, Human
uaugcaccuugugucugua

SEQ ID NO: 1870665 - RNA, 20 nt, Human
uaugcaccuugugucuguac

SEQ ID NO: 1870666 - RNA, 22 nt, Human
uaugcaccuugugucuguacac

SEQ ID NO: 1870667 - RNA, 16 nt, Human
uaucuaauaccucugu

SEQ ID NO: 1870668 - RNA, 15 nt, Human
uaucuaauaccucug

SEQ ID NO: 1870669 - RNA, 20 nt, Human
uaucuaauaccucugugugc

SEQ ID NO: 1870670 - RNA, 23 nt, Human
uaucugcuuuugguuauaaugug

SEQ ID NO: 1870671 - RNA, 21 nt, Human
gugcuuaucccauagccagga

SEQ ID NO: 1870672 - RNA, 14 nt, Human
gugcugaagcuuau

SEQ ID NO: 1870673 - RNA, 15 nt, Human
gugcugaagcuuauu

SEQ ID NO: 1870674 - RNA, 21 nt, Human
gugcugaagcuuauuaaugcu

SEQ ID NO: 1870675 - RNA, 14 nt, Human
gugagcuacaaaug

SEQ ID NO: 1870676 - RNA, 22 nt, Human
gugagcucccaggugcagccag

SEQ ID NO: 1870677 - RNA, 19 nt, Human
gugaaagaaaauaacaaua

SEQ ID NO: 1870678 - RNA, 24 nt, Human
gugaaacccagucacugugagcuc

SEQ ID NO: 1870679 - RNA, 17 nt, Human
gugccauagucacaugg

SEQ ID NO: 1870680 - RNA, 22 nt, Human
gucucacuugugcaguguugac

SEQ ID NO: 1870681 - RNA, 23 nt, Human
guccuguaguugcguggacucug

SEQ ID NO: 1870682 - RNA, 21 nt, Human
guccuguaguugcguggacuc

SEQ ID NO: 1870683 - RNA, 15 nt, Human
guccucccagcuccu

SEQ ID NO: 1870684 - RNA, 20 nt, Human
guccagaaggagacaggcag

SEQ ID NO: 1870685 - RNA, 19 nt, Human
guccagaaggagacaggca

SEQ ID NO: 1870686 - RNA, 17 nt, Human
guccagaaggagacagg

SEQ ID NO: 1870687 - RNA, 16 nt, Human
guccagaaggagacag

SEQ ID NO: 1870688 - RNA, 14 nt, Human
guccagaaggagac

SEQ ID NO: 1870689 - RNA, 11 nt, Human
guccagaagga

SEQ ID NO: 1870690 - RNA, 17 nt, Human
ggggcuggcacugacug

SEQ ID NO: 1870691 - RNA, 13 nt, Human
ggcucccaggaca

SEQ ID NO: 1870692 - RNA, 16 nt, Human
gggccuggcagcucag

SEQ ID NO: 1870693 - RNA, 19 nt, Human
gguaccccuuucuggcucu

SEQ ID NO: 1870694 - RNA, 17 nt, Human
ggugaggggcuggcacu

SEQ ID NO: 1870695 - RNA, 13 nt, Human
ggugaaggcuggc

SEQ ID NO: 1870696 - RNA, 18 nt, Human
guaauucuaaaugaaugu

SEQ ID NO: 1870697 - RNA, 22 nt, Human
guaauucuaaaugaauguuuac

SEQ ID NO: 1870698 - RNA, 12 nt, Human
guaauucuaaau

SEQ ID NO: 1870699 - RNA, 14 nt, Human
guaauucuaaauga

SEQ ID NO: 1870700 - RNA, 15 nt, Human
guaauucuaaaugaa

SEQ ID NO: 1870701 - RNA, 23 nt, Human
guacuuuauuuucuauaauuuaa

SEQ ID NO: 1870702 - RNA, 18 nt, Human
gcuagccagaggacugug

SEQ ID NO: 1870703 - RNA, 15 nt, Human
gcuagccagaggacu

SEQ ID NO: 1870704 - RNA, 13 nt, Human
gcuagccagagga

SEQ ID NO: 1870705 - RNA, 12 nt, Human
gcuagccagagg

SEQ ID NO: 1870706 - RNA, 19 nt, Human
gcuaaauccuuuacuguua

SEQ ID NO: 1870707 - RNA, 19 nt, Human
gccugugcauguaugucuu

SEQ ID NO: 1870708 - RNA, 20 nt, Human
gcuccauuuuuagugaaaua

SEQ ID NO: 1870709 - RNA, 17 nt, Human
gcucucccauuuccuga

SEQ ID NO: 1870710 - RNA, 16 nt, Human
gcugcauacccgggca

SEQ ID NO: 1870711 - RNA, 20 nt, Human
gccuggcagcucagcuuccc

SEQ ID NO: 1870712 - RNA, 20 nt, Human
gccuggccacgcagccagga

SEQ ID NO: 1870713 - RNA, 21 nt, Human
gccuggccacgcagccaggac

SEQ ID NO: 1870714 - RNA, 22 nt, Human
gccuggccacgcagccaggaca

SEQ ID NO: 1870715 - RNA, 23 nt, Human
gccuggccacgcagccaggacac

SEQ ID NO: 1870716 - RNA, 13 nt, Human
gccuggcagcuca

SEQ ID NO: 1870717 - RNA, 15 nt, Human
gccuggccacgcagc

SEQ ID NO: 1870718 - RNA, 17 nt, Human
gccuggccacgcagcca

SEQ ID NO: 1870719 - RNA, 18 nt, Human
gccuggccacgcagccag

SEQ ID NO: 1870720 - RNA, 19 nt, Human
gccuggccacgcagccagg

SEQ ID NO: 1870721 - RNA, 14 nt, Human
gcccuuuuuaagga

SEQ ID NO: 1870722 - RNA, 17 nt, Human
ggagagucacagaacaa

SEQ ID NO: 1870723 - RNA, 14 nt, Human
ggaaccaggcuugg

SEQ ID NO: 1870724 - RNA, 12 nt, Human
gcuucugccugc

SEQ ID NO: 1870725 - RNA, 13 nt, Human
gcuucugccugca

SEQ ID NO: 1870726 - RNA, 12 nt, Human
ggcacccuccca

SEQ ID NO: 1870727 - RNA, 23 nt, Human
ggccacgugggcaaacaggcagu

SEQ ID NO: 1870728 - RNA, 21 nt, Human
ggcccaaauuaucaagcuaau

SEQ ID NO: 1870729 - RNA, 23 nt, Human
ggcccaaauuaucaagcuaauaa

SEQ ID NO: 1870730 - RNA, 21 nt, Human
ggccuaugcacauauggacuc

SEQ ID NO: 1870731 - RNA, 20 nt, Human
ggccuaugcacauauggacu

SEQ ID NO: 1870732 - RNA, 15 nt, Human
ggcucccacagagac

SEQ ID NO: 1870733 - RNA, 17 nt, Human
gaguccuagagcuacag

SEQ ID NO: 1870734 - RNA, 16 nt, Human
gaggccagugagccac

SEQ ID NO: 1870735 - RNA, 15 nt, Human
gaggccuugagaggc

SEQ ID NO: 1870736 - RNA, 21 nt, Human
gaggggucgacuucgggcugg

SEQ ID NO: 1870737 - RNA, 23 nt, Human
gagggagcuccaacucagaaggg

SEQ ID NO: 1870738 - RNA, 14 nt, Human
gcaccuugugucug

SEQ ID NO: 1870739 - RNA, 20 nt, Human
gcaccuugugucuguacacg

SEQ ID NO: 1870740 - RNA, 23 nt, Human
gcacaaagaugggugaaggcugg

SEQ ID NO: 1870741 - RNA, 17 nt, Human
gcacaagccagggugug

SEQ ID NO: 1870742 - RNA, 12 nt, Human
gcacaagccagg

SEQ ID NO: 1870743 - RNA, 13 nt, Human
gcacaagccaggg

SEQ ID NO: 1870744 - RNA, 16 nt, Human
gaucagaccauaaugu

SEQ ID NO: 1870745 - RNA, 21 nt, Human
gaugggugaaggcuggcauga

SEQ ID NO: 1870746 - RNA, 16 nt, Human
gaugggugaaggcugg

SEQ ID NO: 1870747 - RNA, 22 nt, Human
gauugagaaguuacuuuccauu

SEQ ID NO: 1870748 - RNA, 19 nt, Human
gauugauagaguguuauca

SEQ ID NO: 1870749 - RNA, 16 nt, Human
gacaaggaaaaaauaa

SEQ ID NO: 1870750 - RNA, 22 nt, Human
gaaugcagucuguccaggcucg

SEQ ID NO: 1870751 - RNA, 20 nt, Human
gaaugcagucuguccaggcu

SEQ ID NO: 1870752 - RNA, 23 nt, Human
gaaugaaagucuugugacuagug

SEQ ID NO: 1870753 - RNA, 20 nt, Human
gaaugaaagucuugugacua

SEQ ID NO: 1870754 - RNA, 21 nt, Human
gaaugaaagucuugugacuag

SEQ ID NO: 1870755 - RNA, 18 nt, Human
gaaucccacccacaugug

SEQ ID NO: 1870756 - RNA, 22 nt, Human
gaaucccacccacaugugacac

SEQ ID NO: 1870757 - RNA, 20 nt, Human
gaauguuuacacucuuugua

SEQ ID NO: 1870758 - RNA, 21 nt, Human
gaauguuuacacucuuuguaa

SEQ ID NO: 1870759 - RNA, 21 nt, Human
gaauugcauuuuuuaaaacaa

SEQ ID NO: 1870760 - RNA, 23 nt, Human
gaauugcauuuuuuaaaacaaga

SEQ ID NO: 1870761 - RNA, 11 nt, Human
gaauguaauca

SEQ ID NO: 1870762 - RNA, 13 nt, Human
gaauguaaucaau

SEQ ID NO: 1870763 - RNA, 16 nt, Human
gaauguaaucaauguu

SEQ ID NO: 1870764 - RNA, 18 nt, Human
gaauguaaucaauguuuc

SEQ ID NO: 1870765 - RNA, 19 nt, Human
gaauguaaucaauguuucu

SEQ ID NO: 1870766 - RNA, 14 nt, Human
gaccacuguuauca

SEQ ID NO: 1870767 - RNA, 13 nt, Human
gacuugaccccga

SEQ ID NO: 1870768 - RNA, 20 nt, Human
gacuuggggagauggaguuc

SEQ ID NO: 1870769 - RNA, 21 nt, Human
gacugcagggacacgggcagc

SEQ ID NO: 1870770 - RNA, 22 nt, Human
gacugcagggacacgggcagcc

SEQ ID NO: 1870771 - RNA, 19 nt, Human
gagacaggcagagcugcuc

SEQ ID NO: 1870772 - RNA, 16 nt, Human
gagacaggcagagcug

SEQ ID NO: 1870773 - RNA, 14 nt, Human
gagacaggcagagc

SEQ ID NO: 1870774 - RNA, 12 nt, Human
gagacaggcaga

SEQ ID NO: 1870775 - RNA, 17 nt, Human
cugccgcaacaguuuuu

SEQ ID NO: 1870776 - RNA, 18 nt, Human
cuggccuggcacacauca

SEQ ID NO: 1870777 - RNA, 22 nt, Human
cuggccuggcacacaucaggag

SEQ ID NO: 1870778 - RNA, 13 nt, Human
cuggccuggcaca

SEQ ID NO: 1870779 - RNA, 14 nt, Human
cuggccuggcacac

SEQ ID NO: 1870780 - RNA, 16 nt, Human
cuggccuggcacacau

SEQ ID NO: 1870781 - RNA, 17 nt, Human
cuggccuggcacacauc

SEQ ID NO: 1870782 - RNA, 21 nt, Human
cuggcacuggaugcagaaaca

SEQ ID NO: 1870783 - RNA, 22 nt, Human
cuggccaucugguuaggauggc

SEQ ID NO: 1870784 - RNA, 15 nt, Human
cuggacacaggccug

SEQ ID NO: 1870785 - RNA, 14 nt, Human
cuggacacaggccu

SEQ ID NO: 1870786 - RNA, 13 nt, Human
cuggacacaggcc

SEQ ID NO: 1870787 - RNA, 15 nt, Human
cugugcauguauguc

SEQ ID NO: 1870788 - RNA, 16 nt, Human
cugugcauguaugucu

SEQ ID NO: 1870789 - RNA, 17 nt, Human
cugugcauguaugucuu

SEQ ID NO: 1870790 - RNA, 16 nt, Human
cugugccuccaucagc

SEQ ID NO: 1870791 - RNA, 15 nt, Human
cugugccuccaucag

SEQ ID NO: 1870792 - RNA, 16 nt, Human
cuguggggcccccaca

SEQ ID NO: 1870793 - RNA, 18 nt, Human
cugugugcuccuccuugg

SEQ ID NO: 1870794 - RNA, 23 nt, Human
cugugugcuccuccuuggugccu

SEQ ID NO: 1870795 - RNA, 12 nt, Human
cuggugcugcug

SEQ ID NO: 1870796 - RNA, 19 nt, Human
cuguaaucauauaauaaau

SEQ ID NO: 1870797 - RNA, 13 nt, Human
cuguccaggcucg

SEQ ID NO: 1870798 - RNA, 12 nt, Human
cuguccaggcuc

SEQ ID NO: 1870799 - RNA, 16 nt, Human
cuguacacguguccug

SEQ ID NO: 1870800 - RNA, 17 nt, Human
cuguacacguguccugu

SEQ ID NO: 1870801 - RNA, 18 nt, Human
cuguacacguguccugua

SEQ ID NO: 1870802 - RNA, 15 nt, Human
cuucacccuggagcc

SEQ ID NO: 1870803 - RNA, 12 nt, Human
cuucugccugca

SEQ ID NO: 1870804 - RNA, 22 nt, Human
cuucucccugcacaagccaggg

SEQ ID NO: 1870805 - RNA, 16 nt, Human
cuuuaugguaaagaug

SEQ ID NO: 1870806 - RNA, 13 nt, Human
cuuucuggcucuc

SEQ ID NO: 1870807 - RNA, 19 nt, Human
cuugaguuuaaauuguaau

SEQ ID NO: 1870808 - RNA, 13 nt, Human
cuuguacaugugu

SEQ ID NO: 1870809 - RNA, 17 nt, Human
cuuguacuuuauuuucu

SEQ ID NO: 1870810 - RNA, 14 nt, Human
cuuguacaugugua

SEQ ID NO: 1870811 - RNA, 19 nt, Human
cuuguacauguguagccug

SEQ ID NO: 1870812 - RNA, 20 nt, Human
cuuguacauguguagccugu

SEQ ID NO: 1870813 - RNA, 22 nt, Human
cuuguacauguguagccugugc

SEQ ID NO: 1870814 - RNA, 23 nt, Human
cuuguacauguguagccugugca

SEQ ID NO: 1870815 - RNA, 20 nt, Human
cuuuauauggccucaagauc

SEQ ID NO: 1870816 - RNA, 21 nt, Human
cuuuaucuaauaccucugugu

SEQ ID NO: 1870817 - RNA, 22 nt, Human
cuuuaucuaauaccucugugug

SEQ ID NO: 1870818 - RNA, 15 nt, Human
cuuuuugaaaucagc

SEQ ID NO: 1870819 - RNA, 18 nt, Human
cuuuuugaaaucagcaua

SEQ ID NO: 1870820 - RNA, 18 nt, Human
gaaaaucuuauaauuuaa

SEQ ID NO: 1870821 - RNA, 23 nt, Human
ccuguaguugcguggacucugca

SEQ ID NO: 1870822 - RNA, 21 nt, Human
ccuguaguugcguggacucug

SEQ ID NO: 1870823 - RNA, 14 nt, Human
ccuggcucccagga

SEQ ID NO: 1870824 - RNA, 15 nt, Human
ccuggcucccaggac

SEQ ID NO: 1870825 - RNA, 16 nt, Human
ccuggcucccaggaca

SEQ ID NO: 1870826 - RNA, 17 nt, Human
ccuggcucccaggacac

SEQ ID NO: 1870827 - RNA, 15 nt, Human
ccuggccacgcagcc

SEQ ID NO: 1870828 - RNA, 18 nt, Human
ccuggccacgcagccagg

SEQ ID NO: 1870829 - RNA, 19 nt, Human
ccuggccacgcagccagga

SEQ ID NO: 1870830 - RNA, 20 nt, Human
ccuggccacgcagccaggac

SEQ ID NO: 1870831 - RNA, 22 nt, Human
ccuggccacgcagccaggacac

SEQ ID NO: 1870832 - RNA, 15 nt, Human
ccucuuccugccuag

SEQ ID NO: 1870833 - RNA, 21 nt, Human
ccugaagccaggccauggcua

SEQ ID NO: 1870834 - RNA, 21 nt, Human
ccugccacccugggccuggca

SEQ ID NO: 1870835 - RNA, 15 nt, Human
ccugccacccugggc

SEQ ID NO: 1870836 - RNA, 24 nt, Human
ccugccacccugggccuggcagcu

SEQ ID NO: 1870837 - RNA, 15 nt, Human
ccugcacaagccagg

SEQ ID NO: 1870838 - RNA, 16 nt, Human
ccugcacaagccaggg

SEQ ID NO: 1870839 - RNA, 17 nt, Human
ccugcacaagccagggu

SEQ ID NO: 1870840 - RNA, 13 nt, Human
ccugcccuuggca

SEQ ID NO: 1870841 - RNA, 13 nt, Human
cgaaauguuauuu

SEQ ID NO: 1870842 - RNA, 14 nt, Human
cgaaauguuauuuu

SEQ ID NO: 1870843 - RNA, 22 nt, Human
cgaaauguuauuuuuuaauuau

SEQ ID NO: 1870844 - RNA, 23 nt, Human
cgaagucucuuuuuuuggcccag

SEQ ID NO: 1870845 - RNA, 13 nt, Human
ccuuccagcccag

SEQ ID NO: 1870846 - RNA, 14 nt, Human
ccuuccagcccaga

SEQ ID NO: 1870847 - RNA, 23 nt, Human
ccuuggccgcaccuaaagcagcc

SEQ ID NO: 1870848 - RNA, 16 nt, Human
ccuuguaauucuaaau

SEQ ID NO: 1870849 - RNA, 19 nt, Human
ccuuguaauucuaaaugaa

SEQ ID NO: 1870850 - RNA, 13 nt, Human
cgcccgggcccag

SEQ ID NO: 1870851 - RNA, 14 nt, Human
cgcccgggcccaga

SEQ ID NO: 1870852 - RNA, 16 nt, Human
cgcccgggcccagagg

SEQ ID NO: 1870853 - RNA, 17 nt, Human
cgcccgggcccagagga

SEQ ID NO: 1870854 - RNA, 18 nt, Human
cgcccgggcccagaggag

SEQ ID NO: 1870855 - RNA, 14 nt, Human
cgcuucugccugca

SEQ ID NO: 1870856 - RNA, 20 nt, Human
cgcaccuaaagcagccagcc

SEQ ID NO: 1870857 - RNA, 13 nt, Human
cgcaccuaaagca

SEQ ID NO: 1870858 - RNA, 22 nt, Human
cucagcuuccccaacacgcagg

SEQ ID NO: 1870859 - RNA, 17 nt, Human
cucagcuuccccaacac

SEQ ID NO: 1870860 - RNA, 15 nt, Human
cucccacagagacaa

SEQ ID NO: 1870861 - RNA, 13 nt, Human
cucccacagagac

SEQ ID NO: 1870862 - RNA, 14 nt, Human
cucccauuuccuga

SEQ ID NO: 1870863 - RNA, 18 nt, Human
cucaguuuuaucauuuuc

SEQ ID NO: 1870864 - RNA, 17 nt, Human
cucaguuuuaucauuuu

SEQ ID NO: 1870865 - RNA, 12 nt, Human
cuauaauuuaaa

SEQ ID NO: 1870866 - RNA, 13 nt, Human
cuauaauuuaaau

SEQ ID NO: 1870867 - RNA, 12 nt, Human
cuaugcacauau

SEQ ID NO: 1870868 - RNA, 13 nt, Human
cuaugcacauaug

SEQ ID NO: 1870869 - RNA, 16 nt, Human
cuauugauaauuuaga

SEQ ID NO: 1870870 - RNA, 22 nt, Human
cuagaaaacgcgaccuuggccg

SEQ ID NO: 1870871 - RNA, 23 nt, Human
cuacacgagauacagaauuuuau

SEQ ID NO: 1870872 - RNA, 19 nt, Human
cuaaucagggaggucauuu

SEQ ID NO: 1870873 - RNA, 20 nt, Human
cuaaucagggaggucauuuu

SEQ ID NO: 1870874 - RNA, 21 nt, Human
cuaaucagggaggucauuuug

SEQ ID NO: 1870875 - RNA, 21 nt, Human
cuaagcuucacuguaaaauaa

SEQ ID NO: 1870876 - RNA, 13 nt, Human
cuaauaccucugu

SEQ ID NO: 1870877 - RNA, 15 nt, Human
cuaauaccucugugu

SEQ ID NO: 1870878 - RNA, 16 nt, Human
cuaauaccucugugug

SEQ ID NO: 1870879 - RNA, 17 nt, Human
cuaauaccucugugugc

SEQ ID NO: 1870880 - RNA, 12 nt, Human
cuaauaucagca

SEQ ID NO: 1870881 - RNA, 23 nt, Human
cuaaauaaagcuugcaacaaaau

SEQ ID NO: 1870882 - RNA, 12 nt, Human
cuaacauauaau

SEQ ID NO: 1870883 - RNA, 22 nt, Human
cuaacauauaauguuguuauuu

SEQ ID NO: 1870884 - RNA, 23 nt, Human
cuaacauauaauguuguuauuua

SEQ ID NO: 1870885 - RNA, 12 nt, Human
cuaaaugaaugu

SEQ ID NO: 1870886 - RNA, 14 nt, Human
cuaaaugaauguuu

SEQ ID NO: 1870887 - RNA, 20 nt, Human
ccgggcagggcucccacaga

SEQ ID NO: 1870888 - RNA, 21 nt, Human
ccgaggaaacgaaacccacuc

SEQ ID NO: 1870889 - RNA, 18 nt, Human
ccgacgccacagcccagc

SEQ ID NO: 1870890 - RNA, 21 nt, Human
ccgacgccacagcccagccac

SEQ ID NO: 1870891 - RNA, 15 nt, Human
cccgacgccacagcc

SEQ ID NO: 1870892 - RNA, 23 nt, Human
cccgacgccacagcccagccacg

SEQ ID NO: 1870893 - RNA, 18 nt, Human
cccgacgccacagcccag

SEQ ID NO: 1870894 - RNA, 16 nt, Human
ccccuucauccucuga

SEQ ID NO: 1870895 - RNA, 18 nt, Human
ccagcuccucacucaccu

SEQ ID NO: 1870896 - RNA, 20 nt, Human
ccagccgugagugcagaccc

SEQ ID NO: 1870897 - RNA, 18 nt, Human
ccagaaggagacaggcag

SEQ ID NO: 1870898 - RNA, 17 nt, Human
ccagaaggagacaggca

SEQ ID NO: 1870899 - RNA, 14 nt, Human
ccagaaggagacag

SEQ ID NO: 1870900 - RNA, 18 nt, Human
ccacuggacugaccuggu

SEQ ID NO: 1870901 - RNA, 13 nt, Human
ccacuggacugac

SEQ ID NO: 1870902 - RNA, 14 nt, Human
ccacuguuaucaaa

SEQ ID NO: 1870903 - RNA, 16 nt, Human
ccaggugcagccagag

SEQ ID NO: 1870904 - RNA, 15 nt, Human
ccaggugcagccaga

SEQ ID NO: 1870905 - RNA, 14 nt, Human
ccaggugcagccag

SEQ ID NO: 1870906 - RNA, 12 nt, Human
cccacagagaca

SEQ ID NO: 1870907 - RNA, 16 nt, Human
cccacaugugacacau

SEQ ID NO: 1870908 - RNA, 15 nt, Human
acggacgcuggcucc

SEQ ID NO: 1870909 - RNA, 11 nt, Human
acgcuggcucc

SEQ ID NO: 1870910 - RNA, 18 nt, Human
acgcuggcuccccaaagg

SEQ ID NO: 1870911 - RNA, 14 nt, Human
acgcagccaggaca

SEQ ID NO: 1870912 - RNA, 12 nt, Human
acgcagccagga

SEQ ID NO: 1870913 - RNA, 13 nt, Human
acgcagccaggac

SEQ ID NO: 1870914 - RNA, 15 nt, Human
acgcagccaggacac

SEQ ID NO: 1870915 - RNA, 22 nt, Human
acuaaugaccacaccugccucu

SEQ ID NO: 1870916 - RNA, 15 nt, Human
accgggcagggccgc

SEQ ID NO: 1870917 - RNA, 12 nt, Human
accucagggcac

SEQ ID NO: 1870918 - RNA, 17 nt, Human
accucaguuuuaucauu

SEQ ID NO: 1870919 - RNA, 18 nt, Human
accucaguuuuaucauuu

SEQ ID NO: 1870920 - RNA, 20 nt, Human
acuugggagaccuguaauca

SEQ ID NO: 1870921 - RNA, 19 nt, Human
acucuagaaaacgcgaccu

SEQ ID NO: 1870922 - RNA, 23 nt, Human
acucuagaaaacgcgaccuuggc

SEQ ID NO: 1870923 - RNA, 16 nt, Human
acacgggcagccuggc

SEQ ID NO: 1870924 - RNA, 19 nt, Human
acacgggcagccuggcucc

SEQ ID NO: 1870925 - RNA, 20 nt, Human
acacugggaggccagugagc

SEQ ID NO: 1870926 - RNA, 15 nt, Human
acacugggaggccag

SEQ ID NO: 1870927 - RNA, 14 nt, Human
acacugggaggcca

SEQ ID NO: 1870928 - RNA, 14 nt, Human
acaucaggaguuca

SEQ ID NO: 1870929 - RNA, 14 nt, Human
acaugugacacaua

SEQ ID NO: 1870930 - RNA, 15 nt, Human
acaugugacacauau

SEQ ID NO: 1870931 - RNA, 12 nt, Human
acaugugacaca

SEQ ID NO: 1870932 - RNA, 15 nt, Human
acccacaugugacac

SEQ ID NO: 1870933 - RNA, 16 nt, Human
acccacaugugacaca

SEQ ID NO: 1870934 - RNA, 22 nt, Human
aagauugagaaguuacuuucca

SEQ ID NO: 1870935 - RNA, 14 nt, Human
aagauugagaaguu

SEQ ID NO: 1870936 - RNA, 19 nt, Human
aagauugagaaguuacuuu

SEQ ID NO: 1870937 - RNA, 23 nt, Human
aagacagugaaagaaaauaacaa

SEQ ID NO: 1870938 - RNA, 19 nt, Human
aacuuaccugggcauucuu

SEQ ID NO: 1870939 - RNA, 22 nt, Human
aagggcaggcccaaauuaucaa

SEQ ID NO: 1870940 - RNA, 21 nt, Human
aaggcaaaggguccagaagga

SEQ ID NO: 1870941 - RNA, 20 nt, Human
aaggcaaagcacgaaauguu

SEQ ID NO: 1870942 - RNA, 15 nt, Human
aaucauuuuaauuau

SEQ ID NO: 1870943 - RNA, 16 nt, Human
aaucauuuuaauuauu

SEQ ID NO: 1870944 - RNA, 17 nt, Human
aaucauuuuaauuauua

SEQ ID NO: 1870945 - RNA, 19 nt, Human
aaucauuuuaauuauuauu

SEQ ID NO: 1870946 - RNA, 20 nt, Human
aaucauuuuaauuauuauuc

SEQ ID NO: 1870947 - RNA, 22 nt, Human
aaucauuuuaauuauuauucuu

SEQ ID NO: 1870948 - RNA, 17 nt, Human
aaugcuaagggcaggcc

SEQ ID NO: 1870949 - RNA, 18 nt, Human
aauaauaccuaagccuuc

SEQ ID NO: 1870950 - RNA, 16 nt, Human
aacacccuauauuuug

SEQ ID NO: 1870951 - RNA, 17 nt, Human
aacaggaccggguggaa

SEQ ID NO: 1870952 - RNA, 12 nt, Human
aacaggaccggg

SEQ ID NO: 1870953 - RNA, 14 nt, Human
aacgaaacccacuc

SEQ ID NO: 1870954 - RNA, 21 nt, Human
aaagaaccaagaaaaaggaau

SEQ ID NO: 1870955 - RNA, 14 nt, Human
aaacagcugccucu

SEQ ID NO: 1870956 - RNA, 11 nt, Human
aaacaggcagu

SEQ ID NO: 1870957 - RNA, 21 nt, Human
aaacaggcaguuggccagaga

SEQ ID NO: 1870958 - RNA, 12 nt, Human
aggacccaagca

SEQ ID NO: 1870959 - RNA, 18 nt, Human
agcuucacuguaaaauaa

SEQ ID NO: 1870960 - RNA, 21 nt, Human
agcuaauaaaauaucauucag

SEQ ID NO: 1870961 - RNA, 23 nt, Human
agcuaauaaaauaucauucagca

SEQ ID NO: 1870962 - RNA, 17 nt, Human
agcuaauaaaauaucau

SEQ ID NO: 1870963 - RNA, 18 nt, Human
agcuaauaaaauaucauu

SEQ ID NO: 1870964 - RNA, 19 nt, Human
agcuaauaaaauaucauuc

SEQ ID NO: 1870965 - RNA, 20 nt, Human
agcuaauaaaauaucauuca

SEQ ID NO: 1870966 - RNA, 14 nt, Human
agcuaauaaaauau

SEQ ID NO: 1870967 - RNA, 15 nt, Human
agcuaauaaaauauc

SEQ ID NO: 1870968 - RNA, 16 nt, Human
agcuaauaaaauauca

SEQ ID NO: 1870969 - RNA, 17 nt, Human
agccuggcucccaggac

SEQ ID NO: 1870970 - RNA, 18 nt, Human
agccuggcucccaggaca

SEQ ID NO: 1870971 - RNA, 19 nt, Human
agccuggcucccaggacac

SEQ ID NO: 1870972 - RNA, 14 nt, Human
aggguuuuccaaug

SEQ ID NO: 1870973 - RNA, 19 nt, Human
agggucagaaacaggaccg

SEQ ID NO: 1870974 - RNA, 15 nt, Human
agggucagaaacagg

SEQ ID NO: 1870975 - RNA, 14 nt, Human
aggccagugagcca

SEQ ID NO: 1870976 - RNA, 15 nt, Human
agcaaacccagacgg

SEQ ID NO: 1870977 - RNA, 13 nt, Human
agcaaacccagac

SEQ ID NO: 1870978 - RNA, 18 nt, Human
acuuuccucuuccugccu

SEQ ID NO: 1870979 - RNA, 20 nt, Human
agaggagcugggagccgggc

SEQ ID NO: 1870980 - RNA, 15 nt, Human
agacugaggggucga

SEQ ID NO: 1870981 - RNA, 23 nt, Human
aguacuugggagaccuguaauca

SEQ ID NO: 1870982 - RNA, 18 nt, Human
aguaacccccacuggacu

SEQ ID NO: 1870983 - RNA, 14 nt, Human
auaauguuguuauu

SEQ ID NO: 1870984 - RNA, 19 nt, Human
auaauguuguuauuuaaag

SEQ ID NO: 1870985 - RNA, 14 nt, Human
auaacaaugaaagu

SEQ ID NO: 1870986 - RNA, 16 nt, Human
auagcagacaguguuu

SEQ ID NO: 1870987 - RNA, 17 nt, Human
auaguaccaaucauuuu

SEQ ID NO: 1870988 - RNA, 21 nt, Human
auauaauaaauguacauuaau

SEQ ID NO: 1870989 - RNA, 19 nt, Human
auaugcaccuugugucugu

SEQ ID NO: 1870990 - RNA, 20 nt, Human
auaugcaccuugugucugua

SEQ ID NO: 1870991 - RNA, 21 nt, Human
auaugcaccuugugucuguac

SEQ ID NO: 1870992 - RNA, 15 nt, Human
auaugcaccuugugu

SEQ ID NO: 1870993 - RNA, 17 nt, Human
auaugcaccuugugucu

SEQ ID NO: 1870994 - RNA, 16 nt, Human
auauggacucugcaca

SEQ ID NO: 1870995 - RNA, 14 nt, Human
auaucagcaagucu

SEQ ID NO: 1870996 - RNA, 19 nt, Human
auccucaguuuuugugaaa

SEQ ID NO: 1870997 - RNA, 16 nt, Human
auggagggaauaauac

SEQ ID NO: 1870998 - RNA, 17 nt, Human
auguauuuauaaauaua

SEQ ID NO: 1870999 - RNA, 15 nt, Human
auguguagccugugc

SEQ ID NO: 1871000 - RNA, 16 nt, Human
auguguagccugugca

SEQ ID NO: 1871001 - RNA, 17 nt, Human
auguguagccugugcau

SEQ ID NO: 1871002 - RNA, 23 nt, Human
auguguagccugugcauguaugu

SEQ ID NO: 1871003 - RNA, 15 nt, Human
auguuucuucuaggu

SEQ ID NO: 1871004 - RNA, 15 nt, Human
cucugcacaugucuu

SEQ ID NO: 1871005 - RNA, 16 nt, Human
cucugcacaugucuug

SEQ ID NO: 1871006 - RNA, 18 nt, Human
cucugcacaugucuugua

SEQ ID NO: 1871007 - RNA, 20 nt, Human
cugaagcuuauuaaugcuaa

SEQ ID NO: 1871008 - RNA, 21 nt, Human
cugaagcuuauuaaugcuaag

SEQ ID NO: 1871009 - RNA, 12 nt, Human
cugaagcuuauu

SEQ ID NO: 1871010 - RNA, 14 nt, Human
cugaagcuuauuaa

SEQ ID NO: 1871011 - RNA, 16 nt, Human
cugaagcuuauuaaug

SEQ ID NO: 1871012 - RNA, 17 nt, Human
cugaagcuuauuaaugc

SEQ ID NO: 1871013 - RNA, 18 nt, Human
cugaagcuuauuaaugcu

SEQ ID NO: 1871014 - RNA, 23 nt, Human
cugaagcuuauuaaugcuaaggg

SEQ ID NO: 1871015 - RNA, 21 nt, Human
cuccagggucagaaacaggac

SEQ ID NO: 1871016 - RNA, 20 nt, Human
cuccagggucagaaacagga

SEQ ID NO: 1871017 - RNA, 14 nt, Human
cuccccgcuucugc

SEQ ID NO: 1871018 - RNA, 19 nt, Human
cucccugcacaagccaggg

SEQ ID NO: 1871019 - RNA, 20 nt, Human
cucccugcacaagccagggu

SEQ ID NO: 1871020 - RNA, 14 nt, Human
cgccuccgagggac

SEQ ID NO: 1871021 - RNA, 11 nt, Human
cgaccuuggcc

SEQ ID NO: 1871022 - RNA, 16 nt, Human
ccguagguuauuuuca

SEQ ID NO: 1871023 - RNA, 17 nt, Human
ccguaggacccaagcag

SEQ ID NO: 1871024 - RNA, 17 nt, Human
ccucaagaugaaggcaa

SEQ ID NO: 1871025 - RNA, 20 nt, Human
ccgaauguugagguggacuc

SEQ ID NO: 1871026 - RNA, 20 nt, Human
ccgccagggagaccuggaca

SEQ ID NO: 1871027 - RNA, 12 nt, Human
ccugagaccaca

SEQ ID NO: 1871028 - RNA, 18 nt, Human
ccugagaccacagagaga

SEQ ID NO: 1871029 - RNA, 23 nt, Human
ccugacuuggggagauggaguuc

SEQ ID NO: 1871030 - RNA, 19 nt, Human
ccugacuuggggagaugga

SEQ ID NO: 1871031 - RNA, 14 nt, Human
ccccgacgccacag

SEQ ID NO: 1871032 - RNA, 18 nt, Human
ccccgacgccacagccca

SEQ ID NO: 1871033 - RNA, 21 nt, Human
ccccgacgccacagcccagcc

SEQ ID NO: 1871034 - RNA, 14 nt, Human
ccccgcuucugccu

SEQ ID NO: 1871035 - RNA, 22 nt, Human
cccagccacggacgcuggcucc

SEQ ID NO: 1871036 - RNA, 14 nt, Human
cccacccacaugug

SEQ ID NO: 1871037 - RNA, 19 nt, Human
ccagggucagaaacaggac

SEQ ID NO: 1871038 - RNA, 18 nt, Human
ccagggucagaaacagga

SEQ ID NO: 1871039 - RNA, 17 nt, Human
ccagggucagaaacagg

SEQ ID NO: 1871040 - RNA, 10 nt, Human
ccagggucag

SEQ ID NO: 1871041 - RNA, 23 nt, Human
ccaggaaacucugcauucuagua

SEQ ID NO: 1871042 - RNA, 16 nt, Human
cagggaggucauuuug

SEQ ID NO: 1871043 - RNA, 15 nt, Human
caggacaccgggcag

SEQ ID NO: 1871044 - RNA, 22 nt, Human
cagagagaggggagaagccugg

SEQ ID NO: 1871045 - RNA, 19 nt, Human
cagagagccuggugcugcu

SEQ ID NO: 1871046 - RNA, 20 nt, Human
cagagagccuggugcugcug

SEQ ID NO: 1871047 - RNA, 17 nt, Human
cagcccccacauccugu

SEQ ID NO: 1871048 - RNA, 13 nt, Human
cagccagaggcac

SEQ ID NO: 1871049 - RNA, 14 nt, Human
cauuuuuuaaaaca

SEQ ID NO: 1871050 - RNA, 15 nt, Human
cauuucaacuguuug

SEQ ID NO: 1871051 - RNA, 18 nt, Human
ccaaauuaucaagcuaau

SEQ ID NO: 1871052 - RNA, 22 nt, Human
ccaaauuaucaagcuaauaaaa

SEQ ID NO: 1871053 - RNA, 23 nt, Human
ccaacuuguauuaaagacagagg

SEQ ID NO: 1871054 - RNA, 19 nt, Human
ccaaauuaucaagcuaaua

SEQ ID NO: 1871055 - RNA, 23 nt, Human
ccaccuacuuuucuuuccucaga

SEQ ID NO: 1871056 - RNA, 19 nt, Human
cauccugugccuccaucag

SEQ ID NO: 1871057 - RNA, 15 nt, Human
cauagccaggaaacu

SEQ ID NO: 1871058 - RNA, 15 nt, Human
caauucuugccaaau

SEQ ID NO: 1871059 - RNA, 13 nt, Human
cacacaucaggag

SEQ ID NO: 1871060 - RNA, 23 nt, Human
caagcuaauaaaauaucauucag

SEQ ID NO: 1871061 - RNA, 22 nt, Human
caagcuaauaaaauaucauuca

SEQ ID NO: 1871062 - RNA, 16 nt, Human
caagcuaauaaaauau

SEQ ID NO: 1871063 - RNA, 17 nt, Human
caagcuaauaaaauauc

SEQ ID NO: 1871064 - RNA, 19 nt, Human
caagcuaauaaaauaucau

SEQ ID NO: 1871065 - RNA, 21 nt, Human
caagcuaauaaaauaucauuc

SEQ ID NO: 1871066 - RNA, 17 nt, Human
cacuuauucucaagaag

SEQ ID NO: 1871067 - RNA, 15 nt, Human
cacucuuuguaagag

SEQ ID NO: 1871068 - RNA, 12 nt, Human
cacucuuuguaa

SEQ ID NO: 1871069 - RNA, 16 nt, Human
cacccucccacccggc

SEQ ID NO: 1871070 - RNA, 20 nt, Human
caaacccagacggcuccacu

SEQ ID NO: 1871071 - RNA, 24 nt, Human
caaacccagacggcuccacuagga

SEQ ID NO: 1871072 - RNA, 16 nt, Human
caacacgcaggagcac

SEQ ID NO: 1871073 - RNA, 15 nt, Human
caacacgcaggagca

SEQ ID NO: 1871074 - RNA, 22 nt, Human
caaagaugggugaaggcuggca

SEQ ID NO: 1871075 - RNA, 21 nt, Human
caaagaugggugaaggcuggc

SEQ ID NO: 1871076 - RNA, 20 nt, Human
caaagaugggugaaggcugg

SEQ ID NO: 1871077 - RNA, 20 nt, Human
caaagcacgaaauguuauuu

SEQ ID NO: 1871078 - RNA, 22 nt, Human
caaagcacgaaauguuauuuuu

SEQ ID NO: 1871079 - RNA, 17 nt, Human
auuuuauagcuacuaau

SEQ ID NO: 1871080 - RNA, 19 nt, Human
auuuuauagcuacuaauuu

SEQ ID NO: 1871081 - RNA, 19 nt, Human
auuacagaugggcaaauua

SEQ ID NO: 1871082 - RNA, 21 nt, Human
auuacagaugggcaaauuaag

SEQ ID NO: 1871083 - RNA, 22 nt, Human
auguuucuucuagguucuaaaa

SEQ ID NO: 1871084 - RNA, 23 nt, Human
auuguaauaggcguaacuaauuu

SEQ ID NO: 1871085 - RNA, 18 nt, Human
auugauagaguguuauca

SEQ ID NO: 1871086 - RNA, 21 nt, Human
auugcuaucuauugauaauuu

SEQ ID NO: 1871087 - RNA, 17 nt, Human
auugcuaucuauugaua

SEQ ID NO: 1871088 - RNA, 20 nt, Human
gcguggcgcaguggcccuga

SEQ ID NO: 1871089 - RNA, 21 nt, Human
gcguggcgcaguggcccugag

SEQ ID NO: 1871090 - RNA, 16 nt, Human
gccauaugaaaaggcu

SEQ ID NO: 1871091 - RNA, 16 nt, Human
gccauagucacauggc

SEQ ID NO: 1871092 - RNA, 19 nt, Human
gccauauacucuucaagga

SEQ ID NO: 1871093 - RNA, 18 nt, Human
ggaaacgaaacccacucu

SEQ ID NO: 1871094 - RNA, 22 nt, Human
gcuucuuaaucuuuucacaaau

SEQ ID NO: 1871095 - RNA, 23 nt, Human
gcuucuuaaucuuuucacaaaua

SEQ ID NO: 1871096 - RNA, 19 nt, Human
gcuucuuaaucuuuucaca

SEQ ID NO: 1871097 - RNA, 21 nt, Human
gcuucuuaaucuuuucacaaa

SEQ ID NO: 1871098 - RNA, 21 nt, Human
gcuuccuguccucccagcucc

SEQ ID NO: 1871099 - RNA, 16 nt, Human
gcuuccuguccuccca

SEQ ID NO: 1871100 - RNA, 22 nt, Human
gcucccaggugcagccagaggc

SEQ ID NO: 1871101 - RNA, 20 nt, Human
gcucccaggugcagccagag

SEQ ID NO: 1871102 - RNA, 19 nt, Human
gcucccaggugcagccaga

SEQ ID NO: 1871103 - RNA, 14 nt, Human
gcucccaggugcag

SEQ ID NO: 1871104 - RNA, 23 nt, Human
gcucucuuuuucuccagggucag

SEQ ID NO: 1871105 - RNA, 22 nt, Human
gcucucuuuuucuccaggguca

SEQ ID NO: 1871106 - RNA, 21 nt, Human
ggcauagcuccccgcuucugc

SEQ ID NO: 1871107 - RNA, 23 nt, Human
ggccagagagccuggugcugcug

SEQ ID NO: 1871108 - RNA, 22 nt, Human
ggccaucugguuaggauggcag

SEQ ID NO: 1871109 - RNA, 21 nt, Human
ggccaucugguuaggauggca

SEQ ID NO: 1871110 - RNA, 21 nt, Human
ggccgcaccuaaagcagccag

SEQ ID NO: 1871111 - RNA, 22 nt, Human
ggccgcaccuaaagcagccagc

SEQ ID NO: 1871112 - RNA, 15 nt, Human
ggcccaggugagucc

SEQ ID NO: 1871113 - RNA, 23 nt, Human
ggaggugaacaagcaaacccaga

SEQ ID NO: 1871114 - RNA, 22 nt, Human
ggauggcaggacgugggcuggg

SEQ ID NO: 1871115 - RNA, 21 nt, Human
ggauggcaggacgugggcugg

SEQ ID NO: 1871116 - RNA, 19 nt, Human
gggagauggaguucuugug

SEQ ID NO: 1871117 - RNA, 17 nt, Human
gggaggccagugagcca

SEQ ID NO: 1871118 - RNA, 12 nt, Human
gggcagggcagc

SEQ ID NO: 1871119 - RNA, 15 nt, Human
gggcagccuggcucc

SEQ ID NO: 1871120 - RNA, 18 nt, Human
gggcagccuggcucccag

SEQ ID NO: 1871121 - RNA, 20 nt, Human
gggcagccuggcucccagga

SEQ ID NO: 1871122 - RNA, 22 nt, Human
gggcagccuggcucccaggaca

SEQ ID NO: 1871123 - RNA, 23 nt, Human
gggcagccuggcucccaggacac

SEQ ID NO: 1871124 - RNA, 20 nt, Human
aaacaagcacuaaacaaaga

SEQ ID NO: 1871125 - RNA, 14 nt, Human
gggccgccagggag

SEQ ID NO: 1871126 - RNA, 15 nt, Human
gguccacagggcacc

SEQ ID NO: 1871127 - RNA, 14 nt, Human
gguccacagggcac

SEQ ID NO: 1871128 - RNA, 18 nt, Human
gguucucccccuuucucu

SEQ ID NO: 1871129 - RNA, 22 nt, Human
aaaguuuccccaccagugaaug

SEQ ID NO: 1871130 - RNA, 19 nt, Human
gcagccaggacaccgggca

SEQ ID NO: 1871131 - RNA, 14 nt, Human
gcagccagaggcac

SEQ ID NO: 1871132 - RNA, 12 nt, Human
gcagccagaggc

SEQ ID NO: 1871133 - RNA, 13 nt, Human
gcagccaggacac

SEQ ID NO: 1871134 - RNA, 19 nt, Human
gcaagucucuuuauauggc

SEQ ID NO: 1871135 - RNA, 18 nt, Human
gcacauauggacucugca

SEQ ID NO: 1871136 - RNA, 16 nt, Human
gcaccuaaagcagcca

SEQ ID NO: 1871137 - RNA, 17 nt, Human
gcaccuaaagcagccag

SEQ ID NO: 1871138 - RNA, 18 nt, Human
gcaccuaaagcagccagc

SEQ ID NO: 1871139 - RNA, 14 nt, Human
gcaccuaaagcagc

SEQ ID NO: 1871140 - RNA, 16 nt, Human
gcacugacugggcaua

SEQ ID NO: 1871141 - RNA, 17 nt, Human
gcacugacugggcauag

SEQ ID NO: 1871142 - RNA, 17 nt, Human
gaagggagcuagccaga

SEQ ID NO: 1871143 - RNA, 14 nt, Human
gacagugaaagaaa

SEQ ID NO: 1871144 - RNA, 12 nt, Human
gacacuguacaa

SEQ ID NO: 1871145 - RNA, 13 nt, Human
gacacuguacaag

SEQ ID NO: 1871146 - RNA, 14 nt, Human
gacucugcacauga

SEQ ID NO: 1871147 - RNA, 15 nt, Human
gacucugcacauguc

SEQ ID NO: 1871148 - RNA, 19 nt, Human
gacucugcacaugucuugu

SEQ ID NO: 1871149 - RNA, 12 nt, Human
gacucugcacau

SEQ ID NO: 1871150 - RNA, 17 nt, Human
gacucuuuugccauuaa

SEQ ID NO: 1871151 - RNA, 22 nt, Human
gagcauguacugagccuuguaa

SEQ ID NO: 1871152 - RNA, 13 nt, Human
gagcugggagccg

SEQ ID NO: 1871153 - RNA, 14 nt, Human
gagcugggagccgg

SEQ ID NO: 1871154 - RNA, 16 nt, Human
gagcugggagccgggc

SEQ ID NO: 1871155 - RNA, 22 nt, Human
gagcugggagccgggccgcaga

SEQ ID NO: 1871156 - RNA, 18 nt, Human
gagauggaguucuugugc

SEQ ID NO: 1871157 - RNA, 15 nt, Human
cuuugaucccuucug

SEQ ID NO: 1871158 - RNA, 15 nt, Human
gaaaauggaaccagg

SEQ ID NO: 1871159 - RNA, 18 nt, Human
gaaaauggaaccaggcuu

SEQ ID NO: 1871160 - RNA, 17 nt, Human
cuuuugccauuaaacuu

SEQ ID NO: 1871161 - RNA, 13 nt, Human
cuucuacuuuuaa

SEQ ID NO: 1871162 - RNA, 21 nt, Human
cuucuacuuuuaaguugcuga

SEQ ID NO: 1871163 - RNA, 21 nt, Human
cuuggcacccaagaccucagg

SEQ ID NO: 1871164 - RNA, 15 nt, Human
cuucacuguaaaaua

SEQ ID NO: 1871165 - RNA, 15 nt, Human
cuucauaacaauuuu

SEQ ID NO: 1871166 - RNA, 19 nt, Human
cuucauaacaauuuuagga

SEQ ID NO: 1871167 - RNA, 22 nt, Human
cuucaugcaggugaaacccagu

SEQ ID NO: 1871168 - RNA, 12 nt, Human
cuggcagcucag

SEQ ID NO: 1871169 - RNA, 20 nt, Human
cuggacugucuucucccugc

SEQ ID NO: 1871170 - RNA, 14 nt, Human
augaacucaacuuu

SEQ ID NO: 1871171 - RNA, 16 nt, Human
augaacucuuaaucaa

SEQ ID NO: 1871172 - RNA, 11 nt, Human
augaauguuua

SEQ ID NO: 1871173 - RNA, 22 nt, Human
augaauguuuacacucuuugua

SEQ ID NO: 1871174 - RNA, 14 nt, Human
augaccacaccugc

SEQ ID NO: 1871175 - RNA, 21 nt, Human
augagaagaaaauggaaccag

SEQ ID NO: 1871176 - RNA, 18 nt, Human
augagaccacuguuauca

SEQ ID NO: 1871177 - RNA, 23 nt, Human
augagaagaaaauggaaccaggc

SEQ ID NO: 1871178 - RNA, 13 nt, Human
uuucacugccaua

SEQ ID NO: 1871179 - RNA, 18 nt, Human
auggccuaugcacauaug

SEQ ID NO: 1871180 - RNA, 21 nt, Human
auggccucaagaucaaugaaa

SEQ ID NO: 1871181 - RNA, 21 nt, Human
auggcuauaaacaauuacaug

SEQ ID NO: 1871182 - RNA, 17 nt, Human
augcaggugaaacccag

SEQ ID NO: 1871183 - RNA, 18 nt, Human
augcagucuguccaggcu

SEQ ID NO: 1871184 - RNA, 18 nt, Human
augcaggugaaacccagu

SEQ ID NO: 1871185 - RNA, 20 nt, Human
augcagucuguccaggcucg

SEQ ID NO: 1871186 - RNA, 19 nt, Human
augcagucuguccaggcuc

SEQ ID NO: 1871187 - RNA, 14 nt, Human
uuuaagauaauuau

SEQ ID NO: 1871188 - RNA, 15 nt, Human
uuuaagauaauuaua

SEQ ID NO: 1871189 - RNA, 21 nt, Human
augcacauauggacucugcac

SEQ ID NO: 1871190 - RNA, 13 nt, Human
uugugacuagugc

SEQ ID NO: 1871191 - RNA, 16 nt, Human
uugugacuagugcuga

SEQ ID NO: 1871192 - RNA, 17 nt, Human
uugugacuagugcugaa

SEQ ID NO: 1871193 - RNA, 21 nt, Human
uugugacuagugcugaagcuu

SEQ ID NO: 1871194 - RNA, 23 nt, Human
uugugacuagugcugaagcuuau

SEQ ID NO: 1871195 - RNA, 22 nt, Human
uugugacuagugcugaagcuua

SEQ ID NO: 1871196 - RNA, 22 nt, Human
uugugauaaguucuaguugcuu

SEQ ID NO: 1871197 - RNA, 13 nt, Human
uucuauaauuuaa

SEQ ID NO: 1871198 - RNA, 14 nt, Human
uucuauaauuuaaa

SEQ ID NO: 1871199 - RNA, 16 nt, Human
aucagaccauaauguu

SEQ ID NO: 1871200 - RNA, 20 nt, Human
aucagaccauaauguuacau

SEQ ID NO: 1871201 - RNA, 15 nt, Human
aucccacccacaugu

SEQ ID NO: 1871202 - RNA, 18 nt, Human
aucccacccacaugugac

SEQ ID NO: 1871203 - RNA, 20 nt, Human
aucccacccacaugugacac

SEQ ID NO: 1871204 - RNA, 23 nt, Human
aucccacccacaugugacacaua

SEQ ID NO: 1871205 - RNA, 22 nt, Human
uucuuaaucuuuucacaaauaa

SEQ ID NO: 1871206 - RNA, 23 nt, Human
uucuuaaucuuuucacaaauaaa

SEQ ID NO: 1871207 - RNA, 16 nt, Human
uucuggcucucccauu

SEQ ID NO: 1871208 - RNA, 22 nt, Human
uucuggcucucccauuuccuga

SEQ ID NO: 1871209 - RNA, 14 nt, Human
aucccacccacaug

SEQ ID NO: 1871210 - RNA, 14 nt, Human
uuauuuuuuaauua

SEQ ID NO: 1871211 - RNA, 16 nt, Human
uuauuuuuuaauuauu

SEQ ID NO: 1871212 - RNA, 17 nt, Human
auaggcguaacuaauuu

SEQ ID NO: 1871213 - RNA, 19 nt, Human
auagucuagacuaaaagau

SEQ ID NO: 1871214 - RNA, 16 nt, Human
uucauuuacuguggcu

SEQ ID NO: 1871215 - RNA, 19 nt, Human
uucauuuacuguggcuucu

SEQ ID NO: 1871216 - RNA, 13 nt, Human
uucauuuacugug

SEQ ID NO: 1871217 - RNA, 14 nt, Human
auauguaccaugua

SEQ ID NO: 1871218 - RNA, 19 nt, Human
auauguaccauguacauga

SEQ ID NO: 1871219 - RNA, 12 nt, Human
auauauguauuu

SEQ ID NO: 1871220 - RNA, 20 nt, Human
uucauauguaccauguacau

SEQ ID NO: 1871221 - RNA, 21 nt, Human
auugcauuuuuuaaaacaaga

SEQ ID NO: 1871222 - RNA, 18 nt, Human
auugcauuuuuuaaaaca

SEQ ID NO: 1871223 - RNA, 19 nt, Human
auugcauuuuuuaaaacaa

SEQ ID NO: 1871224 - RNA, 20 nt, Human
auugcauuuuuuaaaacaag

SEQ ID NO: 1871225 - RNA, 13 nt, Human
auugacagaagcu

SEQ ID NO: 1871226 - RNA, 16 nt, Human
auuuacaaaugggaaa

SEQ ID NO: 1871227 - RNA, 14 nt, Human
auuguauuacaaau

SEQ ID NO: 1871228 - RNA, 15 nt, Human
auuguauuacaaauc

SEQ ID NO: 1871229 - RNA, 16 nt, Human
auuauauuuacaaaug

SEQ ID NO: 1871230 - RNA, 22 nt, Human
auuauaauauacuauauuuaug

SEQ ID NO: 1871231 - RNA, 17 nt, Human
auuauauuuacaaaugg

SEQ ID NO: 1871232 - RNA, 16 nt, Human
auuaucaagcuaauaa

SEQ ID NO: 1871233 - RNA, 17 nt, Human
auuaucaagcuaauaaa

SEQ ID NO: 1871234 - RNA, 22 nt, Human
auuaucaagcuaauaaaauauc

SEQ ID NO: 1871235 - RNA, 23 nt, Human
auuaucaagcuaauaaaauauca

SEQ ID NO: 1871236 - RNA, 11 nt, Human
auuauuaaagg

SEQ ID NO: 1871237 - RNA, 16 nt, Human
auuauuuauauaugua

SEQ ID NO: 1871238 - RNA, 17 nt, Human
auucagcggaauauuga

SEQ ID NO: 1871239 - RNA, 16 nt, Human
auuccaccugcaauca

SEQ ID NO: 1871240 - RNA, 14 nt, Human
uuuuaaguugcuga

SEQ ID NO: 1871241 - RNA, 13 nt, Human
auguugaggugga

SEQ ID NO: 1871242 - RNA, 22 nt, Human
auguuuacacucuuuguaagag

SEQ ID NO: 1871243 - RNA, 16 nt, Human
augucuguugaugacu

SEQ ID NO: 1871244 - RNA, 22 nt, Human
uuuuaaaacaagaaaguuuccc

SEQ ID NO: 1871245 - RNA, 18 nt, Human
auaauccuaaacauauga

SEQ ID NO: 1871246 - RNA, 15 nt, Human
auaauaaauguacau

SEQ ID NO: 1871247 - RNA, 23 nt, Human
auaaccguuuccuuucauuuacu

SEQ ID NO: 1871248 - RNA, 22 nt, Human
auaacgauaaaagacagugaaa

SEQ ID NO: 1871249 - RNA, 13 nt, Human
auaaauaaaaaua

SEQ ID NO: 1871250 - RNA, 14 nt, Human
auaaauaaaaauaa

SEQ ID NO: 1871251 - RNA, 14 nt, Human
aguuuaaauuguaa

SEQ ID NO: 1871252 - RNA, 14 nt, Human
aguugcuuguaaaa

SEQ ID NO: 1871253 - RNA, 20 nt, Human
auaaaauaucauucagcaac

SEQ ID NO: 1871254 - RNA, 18 nt, Human
uuaaucuuuucacaaaua

SEQ ID NO: 1871255 - RNA, 19 nt, Human
uuaaucuuuucacaaauaa

SEQ ID NO: 1871256 - RNA, 20 nt, Human
uuaaucuuuucacaaauaaa

SEQ ID NO: 1871257 - RNA, 17 nt, Human
aguuuccccaccaguga

SEQ ID NO: 1871258 - RNA, 23 nt, Human
aguuuccccaccagugaaugaaa

SEQ ID NO: 1871259 - RNA, 22 nt, Human
aguuuccccaccagugaaugaa

SEQ ID NO: 1871260 - RNA, 18 nt, Human
auaaaauaucauucagca

SEQ ID NO: 1871261 - RNA, 19 nt, Human
auaaaauaucauucagcaa

SEQ ID NO: 1871262 - RNA, 13 nt, Human
auaaaauaucauu

SEQ ID NO: 1871263 - RNA, 15 nt, Human
auaaaauaucauuca

SEQ ID NO: 1871264 - RNA, 16 nt, Human
auaaaauaucauucag

SEQ ID NO: 1871265 - RNA, 17 nt, Human
auaaaauaucauucagc

SEQ ID NO: 1871266 - RNA, 20 nt, Human
uguuaucaaaacuuucuuuu

SEQ ID NO: 1871267 - RNA, 14 nt, Human
uguuauuuaaagaa

SEQ ID NO: 1871268 - RNA, 16 nt, Human
aguguuaucagucaua

SEQ ID NO: 1871269 - RNA, 23 nt, Human
aguguuaucagucauaacuaaau

SEQ ID NO: 1871270 - RNA, 20 nt, Human
aguucggugagcuacaaaug

SEQ ID NO: 1871271 - RNA, 19 nt, Human
aguucggugagcuacaaau

SEQ ID NO: 1871272 - RNA, 15 nt, Human
aguucuaguugcuug

SEQ ID NO: 1871273 - RNA, 18 nt, Human
aguucaauaaaugucugu

SEQ ID NO: 1871274 - RNA, 19 nt, Human
aguucaauaaaugucuguu

SEQ ID NO: 1871275 - RNA, 21 nt, Human
aguucaauaaaugucuguuga

SEQ ID NO: 1871276 - RNA, 11 nt, Human
uguuguuauuu

SEQ ID NO: 1871277 - RNA, 13 nt, Human
uguuguuauuuaa

SEQ ID NO: 1871278 - RNA, 22 nt, Human
agugccguguguugcaugcagc

SEQ ID NO: 1871279 - RNA, 16 nt, Human
agucuagacuaaaaga

SEQ ID NO: 1871280 - RNA, 13 nt, Human
aggugcagccaga

SEQ ID NO: 1871281 - RNA, 18 nt, Human
aggugcagccagaggcac

SEQ ID NO: 1871282 - RNA, 17 nt, Human
aggugcagccagaggca

SEQ ID NO: 1871283 - RNA, 16 nt, Human
aggugcagccagaggc

SEQ ID NO: 1871284 - RNA, 15 nt, Human
aggugcagccagagg

SEQ ID NO: 1871285 - RNA, 14 nt, Human
aggugcagccagag

SEQ ID NO: 1871286 - RNA, 12 nt, Human
uguaccauguac

SEQ ID NO: 1871287 - RNA, 17 nt, Human
uguaccauguacaugaa

SEQ ID NO: 1871288 - RNA, 15 nt, Human
agggugugcccucac

SEQ ID NO: 1871289 - RNA, 23 nt, Human
ugggauugacagaagcuucugcc

SEQ ID NO: 1871290 - RNA, 23 nt, Human
agggccgccagggagaccuggac

SEQ ID NO: 1871291 - RNA, 20 nt, Human
agggccgccagggagaccug

SEQ ID NO: 1871292 - RNA, 20 nt, Human
agggccgcccgggcccagag

SEQ ID NO: 1871293 - RNA, 19 nt, Human
agggccgcccgggcccaga

SEQ ID NO: 1871294 - RNA, 20 nt, Human
agggcagccgucaccccugc

SEQ ID NO: 1871295 - RNA, 18 nt, Human
ugggcccacaaaggcaaa

SEQ ID NO: 1871296 - RNA, 16 nt, Human
ugggcugggcccacaa

SEQ ID NO: 1871297 - RNA, 19 nt, Human
ugcuccuccuuggugccug

SEQ ID NO: 1871298 - RNA, 16 nt, Human
uggcaugauccaagca

SEQ ID NO: 1871299 - RNA, 20 nt, Human
aggcaaaggguccagaagga

SEQ ID NO: 1871300 - RNA, 19 nt, Human
aggcaaaggguccagaagg

SEQ ID NO: 1871301 - RNA, 16 nt, Human
aggcaaaggguccaga

SEQ ID NO: 1871302 - RNA, 15 nt, Human
uggacacaggccugc

SEQ ID NO: 1871303 - RNA, 13 nt, Human
uggacacaggccu

SEQ ID NO: 1871304 - RNA, 18 nt, Human
aggcaccucaagaagaag

SEQ ID NO: 1871305 - RNA, 12 nt, Human
aggcaccucaag

SEQ ID NO: 1871306 - RNA, 19 nt, Human
uggaagggauggggugcca

SEQ ID NO: 1871307 - RNA, 20 nt, Human
aggagcuuccuguccuccca

SEQ ID NO: 1871308 - RNA, 16 nt, Human
aggagcuuccuguccu

SEQ ID NO: 1871309 - RNA, 11 nt, Human
aggagcuuccu

SEQ ID NO: 1871310 - RNA, 15 nt, Human
aggagcugggagccg

SEQ ID NO: 1871311 - RNA, 18 nt, Human
aggagcugggagccgggc

SEQ ID NO: 1871312 - RNA, 17 nt, Human
aggagcugggagccggg

SEQ ID NO: 1871313 - RNA, 17 nt, Human
ugcacccacccaggagu

SEQ ID NO: 1871314 - RNA, 18 nt, Human
ugcacccacccaggagug

SEQ ID NO: 1871315 - RNA, 19 nt, Human
agcuacuaauuuuaaaaug

SEQ ID NO: 1871316 - RNA, 19 nt, Human
agcuagccagaggacugug

SEQ ID NO: 1871317 - RNA, 17 nt, Human
agcuagccagaggacug

SEQ ID NO: 1871318 - RNA, 12 nt, Human
agcuagccagag

SEQ ID NO: 1871319 - RNA, 14 nt, Human
agccuggugcugcu

SEQ ID NO: 1871320 - RNA, 15 nt, Human
agccuggugcugcug

SEQ ID NO: 1871321 - RNA, 16 nt, Human
agccuggugcugcugc

SEQ ID NO: 1871322 - RNA, 18 nt, Human
agccuuguaauucuaaau

SEQ ID NO: 1871323 - RNA, 16 nt, Human
agccuuguaauucuaa

SEQ ID NO: 1871324 - RNA, 22 nt, Human
agccaggacaccgggcagggcc

SEQ ID NO: 1871325 - RNA, 15 nt, Human
agccacugagcaaug

SEQ ID NO: 1871326 - RNA, 19 nt, Human
agccacggacgcuggcucc

SEQ ID NO: 1871327 - RNA, 22 nt, Human
ugaguaacugauuuguaacaag

SEQ ID NO: 1871328 - RNA, 17 nt, Human
agcauaaguuucuggga

SEQ ID NO: 1871329 - RNA, 23 nt, Human
agcauaaguuucugggaccucag

SEQ ID NO: 1871330 - RNA, 17 nt, Human
agcaugucgucaaagcu

SEQ ID NO: 1871331 - RNA, 20 nt, Human
agcaugucgucaaagcugaa

SEQ ID NO: 1871332 - RNA, 21 nt, Human
agcauguacugagccuuguaa

SEQ ID NO: 1871333 - RNA, 20 nt, Human
agcaucacaugaacuuguaa

SEQ ID NO: 1871334 - RNA, 17 nt, Human
agauggaguucuugugc

SEQ ID NO: 1871335 - RNA, 13 nt, Human
ugacuagugcuga

SEQ ID NO: 1871336 - RNA, 22 nt, Human
ugagaagaaaauggaaccaggc

SEQ ID NO: 1871337 - RNA, 20 nt, Human
ugagaagaaaauggaaccag

SEQ ID NO: 1871338 - RNA, 21 nt, Human
ugacacauaugcaccuugugu

SEQ ID NO: 1871339 - RNA, 22 nt, Human
ugacacauaugcaccuuguguc

SEQ ID NO: 1871340 - RNA, 15 nt, Human
ugaauacuuuauaaa

SEQ ID NO: 1871341 - RNA, 16 nt, Human
ucuucugggcacccuc

SEQ ID NO: 1871342 - RNA, 13 nt, Human
agaccuguaauca

SEQ ID NO: 1871343 - RNA, 20 nt, Human
ugaaaaucuuauaauuuaaa

SEQ ID NO: 1871344 - RNA, 16 nt, Human
agaaggagacaggcag

SEQ ID NO: 1871345 - RNA, 19 nt, Human
agaagcucucgggcuagga

SEQ ID NO: 1871346 - RNA, 15 nt, Human
acuuucuuuucugga

SEQ ID NO: 1871347 - RNA, 19 nt, Human
acuuucuuuucuggaaugu

SEQ ID NO: 1871348 - RNA, 20 nt, Human
acuuugccuuuccauaauca

SEQ ID NO: 1871349 - RNA, 15 nt, Human
ucuacccauauuaca

SEQ ID NO: 1871350 - RNA, 16 nt, Human
acuucaugcaggugaa

SEQ ID NO: 1871351 - RNA, 13 nt, Human
ucuauaauuuaaa

SEQ ID NO: 1871352 - RNA, 22 nt, Human
acuugaccccgacgccacagcc

SEQ ID NO: 1871353 - RNA, 18 nt, Human
acuuguauuaaagacaga

SEQ ID NO: 1871354 - RNA, 15 nt, Human
ucacuucacccugga

SEQ ID NO: 1871355 - RNA, 23 nt, Human
accaugcgacacugggaggccag

SEQ ID NO: 1871356 - RNA, 22 nt, Human
accaugcgacacugggaggcca

SEQ ID NO: 1871357 - RNA, 21 nt, Human
accccagccuggccacgcagc

SEQ ID NO: 1871358 - RNA, 22 nt, Human
accccagccuggccacgcagcc

SEQ ID NO: 1871359 - RNA, 16 nt, Human
ucauaagcgaucacuu

SEQ ID NO: 1871360 - RNA, 17 nt, Human
acccccacuggacugac

SEQ ID NO: 1871361 - RNA, 18 nt, Human
acauuauuaucaacaaua

SEQ ID NO: 1871362 - RNA, 16 nt, Human
ucacauggccuaugca

SEQ ID NO: 1871363 - RNA, 21 nt, Human
ucacauggccuaugcacauau

SEQ ID NO: 1871364 - RNA, 19 nt, Human
ucacauuacuguauauacu

SEQ ID NO: 1871365 - RNA, 13 nt, Human
acaugaagaagcu

SEQ ID NO: 1871366 - RNA, 22 nt, Human
acaugucuuguacauguguagc

SEQ ID NO: 1871367 - RNA, 16 nt, Human
acaugucuuguacaug

SEQ ID NO: 1871368 - RNA, 19 nt, Human
acaugucuuguacaugugu

SEQ ID NO: 1871369 - RNA, 13 nt, Human
acaugucuuguac

SEQ ID NO: 1871370 - RNA, 14 nt, Human
acaugucuuguaca

SEQ ID NO: 1871371 - RNA, 20 nt, Human
acauggcucuaaaaaguuuu

SEQ ID NO: 1871372 - RNA, 17 nt, Human
acauggccuaugcacau

SEQ ID NO: 1871373 - RNA, 18 nt, Human
acauggccuaugcacaua

SEQ ID NO: 1871374 - RNA, 20 nt, Human
acauggccuaugcacauaug

SEQ ID NO: 1871375 - RNA, 15 nt, Human
ucccacccacaugug

SEQ ID NO: 1871376 - RNA, 16 nt, Human
ucccacccacauguga

SEQ ID NO: 1871377 - RNA, 18 nt, Human
ucccacccacaugugaca

SEQ ID NO: 1871378 - RNA, 22 nt, Human
ucccacccacaugugacacaua

SEQ ID NO: 1871379 - RNA, 19 nt, Human
uccacgcacaugcgacccc

SEQ ID NO: 1871380 - RNA, 14 nt, Human
acgacacacuuuga

SEQ ID NO: 1871381 - RNA, 16 nt, Human
ucauaauaaguugcau

SEQ ID NO: 1871382 - RNA, 22 nt, Human
accugauuaacugaggcaucca

SEQ ID NO: 1871383 - RNA, 17 nt, Human
accugauuaacugaggc

SEQ ID NO: 1871384 - RNA, 22 nt, Human
ucauuuugguaaaauacuucuu

SEQ ID NO: 1871385 - RNA, 14 nt, Human
accuggacacaggc

SEQ ID NO: 1871386 - RNA, 17 nt, Human
accuggacacaggccug

SEQ ID NO: 1871387 - RNA, 22 nt, Human
accuucaguaacccccacugga

SEQ ID NO: 1871388 - RNA, 18 nt, Human
uccccgcuucugccugca

SEQ ID NO: 1871389 - RNA, 17 nt, Human
acucagaagggagcuag

SEQ ID NO: 1871390 - RNA, 16 nt, Human
acacaggccugcucuc

SEQ ID NO: 1871391 - RNA, 21 nt, Human
uacuuugccuuuccauaauca

SEQ ID NO: 1871392 - RNA, 16 nt, Human
uaugggaaucaagauu

SEQ ID NO: 1871393 - RNA, 14 nt, Human
acaggagaccuggc

SEQ ID NO: 1871394 - RNA, 21 nt, Human
aauuauuauuuauauauguau

SEQ ID NO: 1871395 - RNA, 11 nt, Human
aauuauuauuu

SEQ ID NO: 1871396 - RNA, 13 nt, Human
aauuauuauuuau

SEQ ID NO: 1871397 - RNA, 16 nt, Human
aauuauuauuuauaua

SEQ ID NO: 1871398 - RNA, 18 nt, Human
aauuauuauuuauauaug

SEQ ID NO: 1871399 - RNA, 13 nt, Human
aauuauuauucuu

SEQ ID NO: 1871400 - RNA, 21 nt, Human
aauuauuauucuucauaacaa

SEQ ID NO: 1871401 - RNA, 15 nt, Human
uacccgggcagggcu

SEQ ID NO: 1871402 - RNA, 19 nt, Human
aauguuauuuuuuaauuau

SEQ ID NO: 1871403 - RNA, 20 nt, Human
aauguuauuuuuuaauuauu

SEQ ID NO: 1871404 - RNA, 15 nt, Human
aauguuacauuauua

SEQ ID NO: 1871405 - RNA, 16 nt, Human
aauguuacauuauuau

SEQ ID NO: 1871406 - RNA, 17 nt, Human
uacagggguucuggaaa

SEQ ID NO: 1871407 - RNA, 21 nt, Human
aauguuauuuuuuaauuauua

SEQ ID NO: 1871408 - RNA, 15 nt, Human
aauguuguuauuuaa

SEQ ID NO: 1871409 - RNA, 21 nt, Human
uacauuagucauucaauaaau

SEQ ID NO: 1871410 - RNA, 22 nt, Human
uaauuccguagguuauuuucag

SEQ ID NO: 1871411 - RNA, 14 nt, Human
uaauuauuauuuau

SEQ ID NO: 1871412 - RNA, 17 nt, Human
uaauuauuauuuauaua

SEQ ID NO: 1871413 - RNA, 22 nt, Human
uaauuauuauuuauauauguau

SEQ ID NO: 1871414 - RNA, 12 nt, Human
uaauuauuauuc

SEQ ID NO: 1871415 - RNA, 14 nt, Human
uaauuauuauucuu

SEQ ID NO: 1871416 - RNA, 12 nt, Human
uaauuauuauuu

SEQ ID NO: 1871417 - RNA, 13 nt, Human
uaauuauuauuua

SEQ ID NO: 1871418 - RNA, 22 nt, Human
aaugagaagaaaauggaaccag

SEQ ID NO: 1871419 - RNA, 19 nt, Human
aauguaaucaauguuucuu

SEQ ID NO: 1871420 - RNA, 17 nt, Human
aauggaaccaggcuugg

SEQ ID NO: 1871421 - RNA, 16 nt, Human
aauggaaccaggcuug

SEQ ID NO: 1871422 - RNA, 14 nt, Human
aauggaaccaggcu

SEQ ID NO: 1871423 - RNA, 20 nt, Human
aauccucaguuuuugugaaa

SEQ ID NO: 1871424 - RNA, 17 nt, Human
aaucccacccacaugug

SEQ ID NO: 1871425 - RNA, 18 nt, Human
aaucccacccacauguga

SEQ ID NO: 1871426 - RNA, 19 nt, Human
uaaguuuccuuccagccca

SEQ ID NO: 1871427 - RNA, 21 nt, Human
uaaguuuccuuccagcccaga

SEQ ID NO: 1871428 - RNA, 19 nt, Human
aaucagggaggucauuuug

SEQ ID NO: 1871429 - RNA, 18 nt, Human
aaucagggaggucauuuu

SEQ ID NO: 1871430 - RNA, 13 nt, Human
aauaccucugugu

SEQ ID NO: 1871431 - RNA, 14 nt, Human
aauaccucugugug

SEQ ID NO: 1871432 - RNA, 15 nt, Human
aauaccucugugugc

SEQ ID NO: 1871433 - RNA, 16 nt, Human
aauaccucugugugcu

SEQ ID NO: 1871434 - RNA, 16 nt, Human
aauacagggcauuuug

SEQ ID NO: 1871435 - RNA, 20 nt, Human
uaaauuaugggaaucaagau

SEQ ID NO: 1871436 - RNA, 21 nt, Human
uaaauuaugggaaucaagauu

SEQ ID NO: 1871437 - RNA, 12 nt, Human
uaaaugaauguu

SEQ ID NO: 1871438 - RNA, 19 nt, Human
aauauauuuaagauaauua

SEQ ID NO: 1871439 - RNA, 20 nt, Human
aauauauuuaagauaauuau

SEQ ID NO: 1871440 - RNA, 15 nt, Human
aauauauuuaagaua

SEQ ID NO: 1871441 - RNA, 19 nt, Human
aauagucuagacuaaaaga

SEQ ID NO: 1871442 - RNA, 20 nt, Human
aauagucuagacuaaaagau

SEQ ID NO: 1871443 - RNA, 18 nt, Human
aagaugggugaaggcugg

SEQ ID NO: 1871444 - RNA, 18 nt, Human
aagaucucugcagggccg

SEQ ID NO: 1871445 - RNA, 16 nt, Human
guuauuuuuuaauuau

SEQ ID NO: 1871446 - RNA, 21 nt, Human
guuauuuuuuaauuauuauuu

SEQ ID NO: 1871447 - RNA, 15 nt, Human
guuaggauggcagga

SEQ ID NO: 1871448 - RNA, 20 nt, Human
uaaaagacagugaaagaaaa

SEQ ID NO: 1871449 - RNA, 18 nt, Human
uaaaauaucauucagcaa

SEQ ID NO: 1871450 - RNA, 19 nt, Human
uaaaauaucauucagcaac

SEQ ID NO: 1871451 - RNA, 16 nt, Human
aagucuuucacauuua

SEQ ID NO: 1871452 - RNA, 21 nt, Human
aagucuugugacuagugcuga

SEQ ID NO: 1871453 - RNA, 22 nt, Human
aagucuugugacuagugcugaa

SEQ ID NO: 1871454 - RNA, 14 nt, Human
aagucuugugacua

SEQ ID NO: 1871455 - RNA, 19 nt, Human
aagucuugugacuagugcu

SEQ ID NO: 1871456 - RNA, 20 nt, Human
aagucuugugacuagugcug

SEQ ID NO: 1871457 - RNA, 23 nt, Human
aagucuugugacuagugcugaag

SEQ ID NO: 1871458 - RNA, 16 nt, Human
guuuacacucuuugua

SEQ ID NO: 1871459 - RNA, 23 nt, Human
guugcguggacucugcacauguc

SEQ ID NO: 1871460 - RNA, 12 nt, Human
aacaauaaaaga

SEQ ID NO: 1871461 - RNA, 18 nt, Human
gucauaacuaaauaaagc

SEQ ID NO: 1871462 - RNA, 15 nt, Human
aaauuauuaaaggaa

SEQ ID NO: 1871463 - RNA, 14 nt, Human
aaauuauuaaagga

SEQ ID NO: 1871464 - RNA, 16 nt, Human
gucuuucacauuuaaa

SEQ ID NO: 1871465 - RNA, 21 nt, Human
gucuguacacguguccuguag

SEQ ID NO: 1871466 - RNA, 14 nt, Human
gucuguacacgugu

SEQ ID NO: 1871467 - RNA, 19 nt, Human
gucuguacacguguccugu

SEQ ID NO: 1871468 - RNA, 20 nt, Human
gucuguacacguguccugua

SEQ ID NO: 1871469 - RNA, 21 nt, Human
aacccagacggcuccacuagg

SEQ ID NO: 1871470 - RNA, 20 nt, Human
aacccccacuggacugaccu

SEQ ID NO: 1871471 - RNA, 16 nt, Human
aacccccacuggacug

SEQ ID NO: 1871472 - RNA, 12 nt, Human
aacccccacugg

SEQ ID NO: 1871473 - RNA, 16 nt, Human
gugcauguaugucuug

SEQ ID NO: 1871474 - RNA, 23 nt, Human
gugcauguaugucuuggacacug

SEQ ID NO: 1871475 - RNA, 16 nt, Human
gugaugcccugcccuu

SEQ ID NO: 1871476 - RNA, 19 nt, Human
caauagcagacaguguuuu

SEQ ID NO: 1871477 - RNA, 14 nt, Human
caauaaaugucugu

SEQ ID NO: 1871478 - RNA, 15 nt, Human
caauaaaugucuguu

SEQ ID NO: 1871479 - RNA, 16 nt, Human
caauaaaugucuguug

SEQ ID NO: 1871480 - RNA, 18 nt, Human
caaggaaaaaauaacaau

SEQ ID NO: 1871481 - RNA, 20 nt, Human
caaggaaaaaauaacaauga

SEQ ID NO: 1871482 - RNA, 13 nt, Human
caauuccaccugc

SEQ ID NO: 1871483 - RNA, 17 nt, Human
caauguuucuucuaggu

SEQ ID NO: 1871484 - RNA, 20 nt, Human
cacaaaggcaaaggguccag

SEQ ID NO: 1871485 - RNA, 23 nt, Human
caacuuguauuaaagacagaggc

SEQ ID NO: 1871486 - RNA, 15 nt, Human
uguuagucauuugcu

SEQ ID NO: 1871487 - RNA, 15 nt, Human
uguuacuaucugcuu

SEQ ID NO: 1871488 - RNA, 16 nt, Human
uguuacuaucugcuuu

SEQ ID NO: 1871489 - RNA, 17 nt, Human
uguugacaguucauaug

SEQ ID NO: 1871490 - RNA, 19 nt, Human
uuacauuauuaucaacaau

SEQ ID NO: 1871491 - RNA, 14 nt, Human
uuacacucuuugua

SEQ ID NO: 1871492 - RNA, 15 nt, Human
uuacacucuuuguaa

SEQ ID NO: 1871493 - RNA, 16 nt, Human
uuaagauaauuauaau

SEQ ID NO: 1871494 - RNA, 14 nt, Human
uuaagauaauuaua

SEQ ID NO: 1871495 - RNA, 19 nt, Human
ugucauguuguaaacauuu

SEQ ID NO: 1871496 - RNA, 21 nt, Human
uguaguugcguggacucugca

SEQ ID NO: 1871497 - RNA, 15 nt, Human
uguaguugcguggac

SEQ ID NO: 1871498 - RNA, 20 nt, Human
uguaguugcguggacucugc

SEQ ID NO: 1871499 - RNA, 20 nt, Human
uguaaucaauguuucuucua

SEQ ID NO: 1871500 - RNA, 14 nt, Human
uguaaucaauguuu

SEQ ID NO: 1871501 - RNA, 22 nt, Human
uguagccugugcauguaugucu

SEQ ID NO: 1871502 - RNA, 16 nt, Human
uguagccugugcaugu

SEQ ID NO: 1871503 - RNA, 20 nt, Human
uguagccugugcauguaugu

SEQ ID NO: 1871504 - RNA, 13 nt, Human
uguagccugugca

SEQ ID NO: 1871505 - RNA, 14 nt, Human
uguagccugugcau

SEQ ID NO: 1871506 - RNA, 15 nt, Human
uguagccugugcaug

SEQ ID NO: 1871507 - RNA, 15 nt, Human
uguguagccugugca

SEQ ID NO: 1871508 - RNA, 16 nt, Human
uguguagccugugcau

SEQ ID NO: 1871509 - RNA, 23 nt, Human
uguguagccugugcauguauguc

SEQ ID NO: 1871510 - RNA, 15 nt, Human
ugugaucagaccaua

SEQ ID NO: 1871511 - RNA, 13 nt, Human
ugucuguacacgu

SEQ ID NO: 1871512 - RNA, 15 nt, Human
ugucuguacacgugu

SEQ ID NO: 1871513 - RNA, 19 nt, Human
ugucuguacacguguccug

SEQ ID NO: 1871514 - RNA, 20 nt, Human
ugucuguacacguguccugu

SEQ ID NO: 1871515 - RNA, 21 nt, Human
ugucuguacacguguccugua

SEQ ID NO: 1871516 - RNA, 23 nt, Human
ugcuccuccuuggugccuggccu

SEQ ID NO: 1871517 - RNA, 20 nt, Human
ugcugaagcuuauuaaugcu

SEQ ID NO: 1871518 - RNA, 21 nt, Human
ugcugaagcuuauuaaugcua

SEQ ID NO: 1871519 - RNA, 22 nt, Human
ugcugaagcuuauuaaugcuaa

SEQ ID NO: 1871520 - RNA, 23 nt, Human
ugcugaagcuuauuaaugcuaag

SEQ ID NO: 1871521 - RNA, 13 nt, Human
ugcugaagcuuau

SEQ ID NO: 1871522 - RNA, 18 nt, Human
ugcugaagcuuauuaaug

SEQ ID NO: 1871523 - RNA, 19 nt, Human
ugcugaagcuuauuaaugc

SEQ ID NO: 1871524 - RNA, 16 nt, Human
ugccuucuacuuuuaa

SEQ ID NO: 1871525 - RNA, 19 nt, Human
ugccaaauauaaauaaaaa

SEQ ID NO: 1871526 - RNA, 22 nt, Human
ugccaaauauaaauaaaaauaa

SEQ ID NO: 1871527 - RNA, 17 nt, Human
ugccaaauauaaauaaa

SEQ ID NO: 1871528 - RNA, 18 nt, Human
ugccaaauauaaauaaaa

SEQ ID NO: 1871529 - RNA, 23 nt, Human
ugggaccucaguuuuaucauuuu

SEQ ID NO: 1871530 - RNA, 14 nt, Human
ugggaguacaaaag

SEQ ID NO: 1871531 - RNA, 17 nt, Human
uggcucucccauuuccu

SEQ ID NO: 1871532 - RNA, 21 nt, Human
uggcuugaguuuaaauuguaa

SEQ ID NO: 1871533 - RNA, 22 nt, Human
ugguaucuagacccaucuucuu

SEQ ID NO: 1871534 - RNA, 13 nt, Human
uggacucugcaca

SEQ ID NO: 1871535 - RNA, 14 nt, Human
uggacucugcacau

SEQ ID NO: 1871536 - RNA, 17 nt, Human
uggccacgcagccagga

SEQ ID NO: 1871537 - RNA, 19 nt, Human
uggccacgcagccaggaca

SEQ ID NO: 1871538 - RNA, 20 nt, Human
uggccacgcagccaggacac

SEQ ID NO: 1871539 - RNA, 14 nt, Human
uggccacgcagcca

SEQ ID NO: 1871540 - RNA, 15 nt, Human
uggccacgcagccag

SEQ ID NO: 1871541 - RNA, 16 nt, Human
uggccacgcagccagg

SEQ ID NO: 1871542 - RNA, 20 nt, Human
uggcaggacgugggcugggc

SEQ ID NO: 1871543 - RNA, 18 nt, Human
uggaaacauucaggagcu

SEQ ID NO: 1871544 - RNA, 22 nt, Human
uggaauaauccuaaacauauga

SEQ ID NO: 1871545 - RNA, 13 nt, Human
uggaaccaggcuu

SEQ ID NO: 1871546 - RNA, 14 nt, Human
uccuuggugccugg

SEQ ID NO: 1871547 - RNA, 18 nt, Human
uccuuggugccuggccug

SEQ ID NO: 1871548 - RNA, 20 nt, Human
ucuaggccuccuggcccagg

SEQ ID NO: 1871549 - RNA, 23 nt, Human
ucuagguucuaaaaauugugauc

SEQ ID NO: 1871550 - RNA, 14 nt, Human
ucuagguucuaaaa

SEQ ID NO: 1871551 - RNA, 17 nt, Human
uccaagccacugagcaa

SEQ ID NO: 1871552 - RNA, 12 nt, Human
uccacagggcac

SEQ ID NO: 1871553 - RNA, 12 nt, Human
uaucauucagca

SEQ ID NO: 1871554 - RNA, 14 nt, Human
uaucauucagcaac

SEQ ID NO: 1871555 - RNA, 13 nt, Human
uaucauucagcaa

SEQ ID NO: 1871556 - RNA, 20 nt, Human
ucaggaccuccaagccacug

SEQ ID NO: 1871557 - RNA, 18 nt, Human
ucaggaccuccaagccac

SEQ ID NO: 1871558 - RNA, 17 nt, Human
ucuguacacguguccug

SEQ ID NO: 1871559 - RNA, 13 nt, Human
ucuguacacgugu

SEQ ID NO: 1871560 - RNA, 15 nt, Human
ucuggaauguaauca

SEQ ID NO: 1871561 - RNA, 16 nt, Human
ucuggaauguaaucaa

SEQ ID NO: 1871562 - RNA, 18 nt, Human
ucuggaauguaaucaaug

SEQ ID NO: 1871563 - RNA, 22 nt, Human
ucuggaauguaaucaauguuuc

SEQ ID NO: 1871564 - RNA, 23 nt, Human
ucuugugacuagugcugaagcuu

SEQ ID NO: 1871565 - RNA, 18 nt, Human
ucuuugaauacaaagaac

SEQ ID NO: 1871566 - RNA, 20 nt, Human
ucuucauaacaauuuuagga

SEQ ID NO: 1871567 - RNA, 13 nt, Human
ucuuauaauuuaa

SEQ ID NO: 1871568 - RNA, 14 nt, Human
ucuuauaauuuaaa

SEQ ID NO: 1871569 - RNA, 21 nt, Human
ucuucuuuuugaaaucagcau

SEQ ID NO: 1871570 - RNA, 19 nt, Human
ucuugccaaauauaaauaa

SEQ ID NO: 1871571 - RNA, 14 nt, Human
ucuuguacaugugu

SEQ ID NO: 1871572 - RNA, 17 nt, Human
ucuuguacauguguagc

SEQ ID NO: 1871573 - RNA, 19 nt, Human
ucuuguacauguguagccu

SEQ ID NO: 1871574 - RNA, 24 nt, Human
ucuuguacauguguagccugugca

SEQ ID NO: 1871575 - RNA, 13 nt, Human
ugagaccacagag

SEQ ID NO: 1871576 - RNA, 23 nt, Human
ugaaugcagucuguccaggcucg

SEQ ID NO: 1871577 - RNA, 19 nt, Human
ugaauguuuacacucuuug

SEQ ID NO: 1871578 - RNA, 22 nt, Human
ugaaugcagucuguccaggcuc

SEQ ID NO: 1871579 - RNA, 22 nt, Human
ugaauguuuacacucuuuguaa

SEQ ID NO: 1871580 - RNA, 19 nt, Human
ugacaaccaugagaccacu

SEQ ID NO: 1871581 - RNA, 23 nt, Human
uacaguucggugagcuacaaaug

SEQ ID NO: 1871582 - RNA, 19 nt, Human
uacaaagaaccaagaaaaa

SEQ ID NO: 1871583 - RNA, 11 nt, Human
uaauucuaaau

SEQ ID NO: 1871584 - RNA, 18 nt, Human
uaauucuaaaugaauguu

SEQ ID NO: 1871585 - RNA, 16 nt, Human
uacacucuuuguaaga

SEQ ID NO: 1871586 - RNA, 12 nt, Human
uaccucugugug

SEQ ID NO: 1871587 - RNA, 14 nt, Human
uaccucugugugcu

SEQ ID NO: 1871588 - RNA, 15 nt, Human
uagacccaucuucuu

SEQ ID NO: 1871589 - RNA, 12 nt, Human
uagacuaaaaga

SEQ ID NO: 1871590 - RNA, 12 nt, Human
uagguucuaaaa

SEQ ID NO: 1871591 - RNA, 19 nt, Human
uaucaaaacuuucuuuucu

SEQ ID NO: 1871592 - RNA, 22 nt, Human
uaucagucauaacuaaauaaag

SEQ ID NO: 1871593 - RNA, 14 nt, Human
uaauguuguuauuu

SEQ ID NO: 1871594 - RNA, 18 nt, Human
uaauguuguuauuuaaag

SEQ ID NO: 1871595 - RNA, 18 nt, Human
uaacccccacuggacuga

SEQ ID NO: 1871596 - RNA, 12 nt, Human
uaaaugucuguu

SEQ ID NO: 1871597 - RNA, 19 nt, Human
uaacaccugauuaacugag

SEQ ID NO: 1871598 - RNA, 18 nt, Human
uaacaccugauuaacuga

SEQ ID NO: 1871599 - RNA, 14 nt, Human
uaaaguguuugaaa

SEQ ID NO: 1871600 - RNA, 19 nt, Human
uaaagcuugcaacaaaauu

SEQ ID NO: 1871601 - RNA, 13 nt, Human
uaaagcagccagc

SEQ ID NO: 1871602 - RNA, 17 nt, Human
uaaaacaagaaaguuuc

SEQ ID NO: 1871603 - RNA, 22 nt, Human
uaaaacaagcacuaaacaaaga

SEQ ID NO: 1871604 - RNA, 17 nt, Human
uaaaaauugugaucaga

SEQ ID NO: 1871605 - RNA, 20 nt, Human
uaaaacaagaaaguuucccc

SEQ ID NO: 1871606 - RNA, 18 nt, Human
uaaaacaagaaaguuucc

SEQ ID NO: 1871607 - RNA, 19 nt, Human
uaaaacaagaaaguuuccc

SEQ ID NO: 1871608 - RNA, 14 nt, Human
uaaaagauugagaa

SEQ ID NO: 1871609 - RNA, 16 nt, Human
guuucuuuagcaguuu

SEQ ID NO: 1871610 - RNA, 17 nt, Human
guuuccccaccagugaa

SEQ ID NO: 1871611 - RNA, 15 nt, Human
guuuccccaccagug

SEQ ID NO: 1871612 - RNA, 20 nt, Human
guuuccccaccagugaauga

SEQ ID NO: 1871613 - RNA, 19 nt, Human
guucuaaaaauugugauca

SEQ ID NO: 1871614 - RNA, 22 nt, Human
guucaccuugaagaaccucuca

SEQ ID NO: 1871615 - RNA, 14 nt, Human
guuacuaucugcuu

SEQ ID NO: 1871616 - RNA, 17 nt, Human
guuauuauauuuacaaa

SEQ ID NO: 1871617 - RNA, 14 nt, Human
guguagccugugca

SEQ ID NO: 1871618 - RNA, 16 nt, Human
guguuaaucauuucau

SEQ ID NO: 1871619 - RNA, 21 nt, Human
guguccuguaguugcguggac

SEQ ID NO: 1871620 - RNA, 14 nt, Human
gugucugcccccuc

SEQ ID NO: 1871621 - RNA, 20 nt, Human
gugcagaccccuuggccagc

SEQ ID NO: 1871622 - RNA, 14 nt, Human
gugcagccagaggc

SEQ ID NO: 1871623 - RNA, 13 nt, Human
gugcagccagagg

SEQ ID NO: 1871624 - RNA, 12 nt, Human
gugcagccagag

SEQ ID NO: 1871625 - RNA, 17 nt, Human
gugcccucaccacccac

SEQ ID NO: 1871626 - RNA, 21 nt, Human
gugacuagugcugaagcuuau

SEQ ID NO: 1871627 - RNA, 11 nt, Human
gugacuagugc

SEQ ID NO: 1871628 - RNA, 13 nt, Human
gugacuagugcug

SEQ ID NO: 1871629 - RNA, 14 nt, Human
gugacuagugcuga

SEQ ID NO: 1871630 - RNA, 15 nt, Human
gugacuagugcugaa

SEQ ID NO: 1871631 - RNA, 17 nt, Human
gugacuagugcugaagc

SEQ ID NO: 1871632 - RNA, 18 nt, Human
gugacuagugcugaagcu

SEQ ID NO: 1871633 - RNA, 22 nt, Human
gugacuagugcugaagcuuauu

SEQ ID NO: 1871634 - RNA, 20 nt, Human
gugaucagaccauaauguua

SEQ ID NO: 1871635 - RNA, 19 nt, Human
gugaacaagcaaacccaga

SEQ ID NO: 1871636 - RNA, 15 nt, Human
gucuuguacaugugu

SEQ ID NO: 1871637 - RNA, 22 nt, Human
gugaaugaaagucuugugacua

SEQ ID NO: 1871638 - RNA, 14 nt, Human
gucuuggacacugu

SEQ ID NO: 1871639 - RNA, 15 nt, Human
gucuuggacacugua

SEQ ID NO: 1871640 - RNA, 18 nt, Human
gucuuggacacuguacaa

SEQ ID NO: 1871641 - RNA, 18 nt, Human
gucgucaaagcugaaaug

SEQ ID NO: 1871642 - RNA, 19 nt, Human
gucucuucugggcacccuc

SEQ ID NO: 1871643 - RNA, 15 nt, Human
gucauucaauaaauu

SEQ ID NO: 1871644 - RNA, 13 nt, Human
guccacagggcac

SEQ ID NO: 1871645 - RNA, 20 nt, Human
guaucuagacccaucuucuu

SEQ ID NO: 1871646 - RNA, 13 nt, Human
guauuaaagacag

SEQ ID NO: 1871647 - RNA, 18 nt, Human
uuugaaucaucaagucuu

SEQ ID NO: 1871648 - RNA, 21 nt, Human
uuuugguccaaguugugcuua

SEQ ID NO: 1871649 - RNA, 11 nt, Human
uuuuaauuauu

SEQ ID NO: 1871650 - RNA, 16 nt, Human
uuuuaauuauuauucu

SEQ ID NO: 1871651 - RNA, 17 nt, Human
uuuuaauuauuauucuu

SEQ ID NO: 1871652 - RNA, 20 nt, Human
uuuuaauuauuauuuauaua

SEQ ID NO: 1871653 - RNA, 23 nt, Human
uuuuaauuauuauuuauauaugu

SEQ ID NO: 1871654 - RNA, 23 nt, Human
gccaucugguuaggauggcagga

SEQ ID NO: 1871655 - RNA, 13 nt, Human
gccagaggcaccu

SEQ ID NO: 1871656 - RNA, 21 nt, Human
gccagagagccuggugcugcu

SEQ ID NO: 1871657 - RNA, 20 nt, Human
gccaggacaccgggcagggc

SEQ ID NO: 1871658 - RNA, 15 nt, Human
gccaggacaccgggc

SEQ ID NO: 1871659 - RNA, 10 nt, Human
gcccaggccu

SEQ ID NO: 1871660 - RNA, 23 nt, Human
gcccccacaauggucccaaacag

SEQ ID NO: 1871661 - RNA, 13 nt, Human
gcccgggcccaga

SEQ ID NO: 1871662 - RNA, 14 nt, Human
gcccgggcccagag

SEQ ID NO: 1871663 - RNA, 15 nt, Human
gcccgggcccagagg

SEQ ID NO: 1871664 - RNA, 13 nt, Human
gccuggugcugcu

SEQ ID NO: 1871665 - RNA, 18 nt, Human
gcgacacugggaggccag

SEQ ID NO: 1871666 - RNA, 20 nt, Human
gccgcaccuaaagcagccag

SEQ ID NO: 1871667 - RNA, 21 nt, Human
gccgcaccuaaagcagccagc

SEQ ID NO: 1871668 - RNA, 14 nt, Human
gccuaugcacauau

SEQ ID NO: 1871669 - RNA, 23 nt, Human
gccuaugcacauauggacucugc

SEQ ID NO: 1871670 - RNA, 20 nt, Human
gccuaugcacauauggacuc

SEQ ID NO: 1871671 - RNA, 22 nt, Human
gccuaugcacauauggacucug

SEQ ID NO: 1871672 - RNA, 18 nt, Human
gccguguguugcaugcag

SEQ ID NO: 1871673 - RNA, 16 nt, Human
gccgucaccccugccu

SEQ ID NO: 1871674 - RNA, 13 nt, Human
gccuccgagggac

SEQ ID NO: 1871675 - RNA, 21 nt, Human
gccuccgagggacgcggcucc

SEQ ID NO: 1871676 - RNA, 16 nt, Human
gccucugccacugacu

SEQ ID NO: 1871677 - RNA, 22 nt, Human
gcaaaggguccagaaggagaca

SEQ ID NO: 1871678 - RNA, 18 nt, Human
gcaaaggguccagaagga

SEQ ID NO: 1871679 - RNA, 19 nt, Human
gauuugguguacaauucag

SEQ ID NO: 1871680 - RNA, 22 nt, Human
gauugcaauuugcacaaguuuu

SEQ ID NO: 1871681 - RNA, 14 nt, Human
gauugcaauuugca

SEQ ID NO: 1871682 - RNA, 21 nt, Human
gauugcaauuugcacaaguuu

SEQ ID NO: 1871683 - RNA, 23 nt, Human
gauagauaggucagugcaaauac

SEQ ID NO: 1871684 - RNA, 13 nt, Human
gaucaaugaaaug

SEQ ID NO: 1871685 - RNA, 23 nt, Human
gaucaagucggaucuaguccagc

SEQ ID NO: 1871686 - RNA, 14 nt, Human
gauaguagcuuccu

SEQ ID NO: 1871687 - RNA, 17 nt, Human
gcauuuuuuaaaacaag

SEQ ID NO: 1871688 - RNA, 18 nt, Human
gcauuuuuuaaaacaaga

SEQ ID NO: 1871689 - RNA, 15 nt, Human
gcauuuuuuaaaaca

SEQ ID NO: 1871690 - RNA, 16 nt, Human
gcauuuuuuaaaacaa

SEQ ID NO: 1871691 - RNA, 23 nt, Human
gcaugauccaagcaagacugagg

SEQ ID NO: 1871692 - RNA, 22 nt, Human
gcaugauccaagcaagacugag

SEQ ID NO: 1871693 - RNA, 19 nt, Human
gcaugauccaagcaagacu

SEQ ID NO: 1871694 - RNA, 18 nt, Human
gcaugauccaagcaagac

SEQ ID NO: 1871695 - RNA, 20 nt, Human
gcaucuuugaauacaaagaa

SEQ ID NO: 1871696 - RNA, 13 nt, Human
gcauagaaguaaa

SEQ ID NO: 1871697 - RNA, 17 nt, Human
gcauagguuuaauaauu

SEQ ID NO: 1871698 - RNA, 20 nt, Human
gcauaguaccaaucauuuua

SEQ ID NO: 1871699 - RNA, 23 nt, Human
gcagggccgccagggagaccugg

SEQ ID NO: 1871700 - RNA, 21 nt, Human
gcagggccgcccgggcccaga

SEQ ID NO: 1871701 - RNA, 22 nt, Human
gcagggccgcccgggcccagag

SEQ ID NO: 1871702 - RNA, 15 nt, Human
gcagggccgccaggg

SEQ ID NO: 1871703 - RNA, 23 nt, Human
gcagggccgcccgggcccagagg

SEQ ID NO: 1871704 - RNA, 20 nt, Human
gcaggugaaacccagucacu

SEQ ID NO: 1871705 - RNA, 17 nt, Human
gcaggugaaacccaguc

SEQ ID NO: 1871706 - RNA, 16 nt, Human
gcaggugaaacccagu

SEQ ID NO: 1871707 - RNA, 21 nt, Human
gcacggaccaugcgacacugg

SEQ ID NO: 1871708 - RNA, 22 nt, Human
gcaccuugugucuguacacgug

SEQ ID NO: 1871709 - RNA, 15 nt, Human
gcacgaaauguuauu

SEQ ID NO: 1871710 - RNA, 21 nt, Human
gcacccaagaccucagggcac

SEQ ID NO: 1871711 - RNA, 17 nt, Human
gcacccaagaccucagg

SEQ ID NO: 1871712 - RNA, 18 nt, Human
gcagaccccuuggccagc

SEQ ID NO: 1871713 - RNA, 18 nt, Human
gaccuggacacaggccug

SEQ ID NO: 1871714 - RNA, 22 nt, Human
gacgccacagcccagccacgga

SEQ ID NO: 1871715 - RNA, 14 nt, Human
gacgccacagccca

SEQ ID NO: 1871716 - RNA, 15 nt, Human
gacgccacagcccag

SEQ ID NO: 1871717 - RNA, 23 nt, Human
gaccugauuucugagcauuuaau

SEQ ID NO: 1871718 - RNA, 22 nt, Human
gaccccgacgccacagcccagc

SEQ ID NO: 1871719 - RNA, 14 nt, Human
gacaggcagagcug

SEQ ID NO: 1871720 - RNA, 18 nt, Human
gacaggagaccuggcacu

SEQ ID NO: 1871721 - RNA, 21 nt, Human
gacaggagaccuggcacugga

SEQ ID NO: 1871722 - RNA, 12 nt, Human
gacacaggccug

SEQ ID NO: 1871723 - RNA, 22 nt, Human
gacacauaugcaccuugugucu

SEQ ID NO: 1871724 - RNA, 17 nt, Human
gagauacagaauuuuau

SEQ ID NO: 1871725 - RNA, 13 nt, Human
gagagccuggugc

SEQ ID NO: 1871726 - RNA, 17 nt, Human
gagagccuggugcugcu

SEQ ID NO: 1871727 - RNA, 19 nt, Human
gagagccuggugcugcugc

SEQ ID NO: 1871728 - RNA, 18 nt, Human
gagacaaggagggcacag

SEQ ID NO: 1871729 - RNA, 20 nt, Human
gagcucccaggugcagccag

SEQ ID NO: 1871730 - RNA, 16 nt, Human
gagcucccaggugcag

SEQ ID NO: 1871731 - RNA, 22 nt, Human
gagcucccaggugcagccagag

SEQ ID NO: 1871732 - RNA, 21 nt, Human
gagcucccaggugcagccaga

SEQ ID NO: 1871733 - RNA, 18 nt, Human
gagcuagccagaggacug

SEQ ID NO: 1871734 - RNA, 15 nt, Human
gagcuagccagagga

SEQ ID NO: 1871735 - RNA, 14 nt, Human
gagcuagccagagg

SEQ ID NO: 1871736 - RNA, 13 nt, Human
gagcuagccagag

SEQ ID NO: 1871737 - RNA, 12 nt, Human
gagcuagccaga

SEQ ID NO: 1871738 - RNA, 14 nt, Human
gagccgggccgcag

SEQ ID NO: 1871739 - RNA, 15 nt, Human
gagccgggccgcaga

SEQ ID NO: 1871740 - RNA, 11 nt, Human
gaaaguuuccc

SEQ ID NO: 1871741 - RNA, 23 nt, Human
gaaaguuuccccaccagugaaug

SEQ ID NO: 1871742 - RNA, 22 nt, Human
gaaaguuuggggacaugugauu

SEQ ID NO: 1871743 - RNA, 20 nt, Human
gaaaguuuccccaccaguga

SEQ ID NO: 1871744 - RNA, 19 nt, Human
gaaagucuugugacuagug

SEQ ID NO: 1871745 - RNA, 20 nt, Human
gaaagucuugugacuagugc

SEQ ID NO: 1871746 - RNA, 21 nt, Human
gaaagucuugugacuagugcu

SEQ ID NO: 1871747 - RNA, 22 nt, Human
gaaagucuugugacuagugcug

SEQ ID NO: 1871748 - RNA, 15 nt, Human
gaaccaacacuaaca

SEQ ID NO: 1871749 - RNA, 14 nt, Human
gaagcuuauuaaug

SEQ ID NO: 1871750 - RNA, 15 nt, Human
gaagcuuauuaaugc

SEQ ID NO: 1871751 - RNA, 16 nt, Human
gaagcuuauuaaugcu

SEQ ID NO: 1871752 - RNA, 17 nt, Human
gaagcuuauuaaugcua

SEQ ID NO: 1871753 - RNA, 19 nt, Human
gaagcuuauuaaugcuaag

SEQ ID NO: 1871754 - RNA, 20 nt, Human
gaagcuuauuaaugcuaagg

SEQ ID NO: 1871755 - RNA, 21 nt, Human
gaagcuuauuaaugcuaaggg

SEQ ID NO: 1871756 - RNA, 23 nt, Human
gaagcuuauuaaugcuaagggca

SEQ ID NO: 1871757 - RNA, 17 nt, Human
gaagccuuaccacgcag

SEQ ID NO: 1871758 - RNA, 18 nt, Human
gaagccuuaccacgcagu

SEQ ID NO: 1871759 - RNA, 22 nt, Human
gaagcuuauuaaugcuaagggc

SEQ ID NO: 1871760 - RNA, 22 nt, Human
gaagaucucugcagggccgcca

SEQ ID NO: 1871761 - RNA, 19 nt, Human
gaagaucucugcagggccg

SEQ ID NO: 1871762 - RNA, 22 nt, Human
gaacuuguaaaggaauuuaaaa

SEQ ID NO: 1871763 - RNA, 22 nt, Human
gaagaacaucuuuaugguaaag

SEQ ID NO: 1871764 - RNA, 17 nt, Human
cuugccaaauauaaaua

SEQ ID NO: 1871765 - RNA, 18 nt, Human
cuuguaaaggaauuuaaa

SEQ ID NO: 1871766 - RNA, 17 nt, Human
cuuguauuaaagacaga

SEQ ID NO: 1871767 - RNA, 13 nt, Human
cuugagccaguaa

SEQ ID NO: 1871768 - RNA, 16 nt, Human
cuugagccaguaauug

SEQ ID NO: 1871769 - RNA, 12 nt, Human
cuuuucacaaau

SEQ ID NO: 1871770 - RNA, 13 nt, Human
cuuuucacaaaua

SEQ ID NO: 1871771 - RNA, 14 nt, Human
cuuuucacaaauaa

SEQ ID NO: 1871772 - RNA, 15 nt, Human
cuuuucacaaauaaa

SEQ ID NO: 1871773 - RNA, 16 nt, Human
cuuucauuuacugugg

SEQ ID NO: 1871774 - RNA, 17 nt, Human
cuuucauuuacuguggc

SEQ ID NO: 1871775 - RNA, 12 nt, Human
cuugugucugua

SEQ ID NO: 1871776 - RNA, 14 nt, Human
cuugugucuguaca

SEQ ID NO: 1871777 - RNA, 15 nt, Human
cuugugucuguacac

SEQ ID NO: 1871778 - RNA, 18 nt, Human
cuugugucuguacacgug

SEQ ID NO: 1871779 - RNA, 22 nt, Human
cuuucaauaaacuaaagaaaaa

SEQ ID NO: 1871780 - RNA, 18 nt, Human
cuuucaauaaacuaaaga

SEQ ID NO: 1871781 - RNA, 22 nt, Human
cuuucuuuucuggaauguaauc

SEQ ID NO: 1871782 - RNA, 19 nt, Human
cugcaguuugagacaggag

SEQ ID NO: 1871783 - RNA, 21 nt, Human
cugcaguuugagacaggagac

SEQ ID NO: 1871784 - RNA, 17 nt, Human
cugcauacccgggcagg

SEQ ID NO: 1871785 - RNA, 17 nt, Human
cugccacccugggccug

SEQ ID NO: 1871786 - RNA, 16 nt, Human
cugccacccugggccu

SEQ ID NO: 1871787 - RNA, 23 nt, Human
cugccacccugggccuggcagcu

SEQ ID NO: 1871788 - RNA, 14 nt, Human
cugcugcugcugug

SEQ ID NO: 1871789 - RNA, 15 nt, Human
cugccugcaccccug

SEQ ID NO: 1871790 - RNA, 22 nt, Human
cugguccacagggcaccugcca

SEQ ID NO: 1871791 - RNA, 16 nt, Human
cugguccacagggcac

SEQ ID NO: 1871792 - RNA, 13 nt, Human
cugguccacaggg

SEQ ID NO: 1871793 - RNA, 15 nt, Human
cuggcgccuccgagg

SEQ ID NO: 1871794 - RNA, 19 nt, Human
cugggagccgggccgcaga

SEQ ID NO: 1871795 - RNA, 18 nt, Human
cuggcaugauccaagcaa

SEQ ID NO: 1871796 - RNA, 17 nt, Human
cuggcaugauccaagca

SEQ ID NO: 1871797 - RNA, 14 nt, Human
cuggccacgcagcc

SEQ ID NO: 1871798 - RNA, 15 nt, Human
cuggccacgcagcca

SEQ ID NO: 1871799 - RNA, 18 nt, Human
cuggccacgcagccagga

SEQ ID NO: 1871800 - RNA, 20 nt, Human
cuggccacgcagccaggaca

SEQ ID NO: 1871801 - RNA, 21 nt, Human
cuggccacgcagccaggacac

SEQ ID NO: 1871802 - RNA, 22 nt, Human
cucuuuauauggccucaagauc

SEQ ID NO: 1871803 - RNA, 15 nt, Human
cugagccuuguaauu

SEQ ID NO: 1871804 - RNA, 16 nt, Human
cugagccuuguaauuc

SEQ ID NO: 1871805 - RNA, 21 nt, Human
cugagccuuguaauucuaaau

SEQ ID NO: 1871806 - RNA, 20 nt, Human
cugacuuggggagauggagu

SEQ ID NO: 1871807 - RNA, 21 nt, Human
cugacuuggggagauggaguu

SEQ ID NO: 1871808 - RNA, 22 nt, Human
cugacuuggggagauggaguuc

SEQ ID NO: 1871809 - RNA, 16 nt, Human
cuccccaaagggugug

SEQ ID NO: 1871810 - RNA, 18 nt, Human
cucccaggugcagccaga

SEQ ID NO: 1871811 - RNA, 23 nt, Human
cucccaggugcagccagaggcac

SEQ ID NO: 1871812 - RNA, 17 nt, Human
cucccaggugcagccag

SEQ ID NO: 1871813 - RNA, 19 nt, Human
cuccuccuuggugccuggc

SEQ ID NO: 1871814 - RNA, 19 nt, Human
cucuacccauauuacagau

SEQ ID NO: 1871815 - RNA, 16 nt, Human
cucuacccauauuaca

SEQ ID NO: 1871816 - RNA, 14 nt, Human
cucuccagccugac

SEQ ID NO: 1871817 - RNA, 17 nt, Human
cggugagcuacaaaugc

SEQ ID NO: 1871818 - RNA, 15 nt, Human
cgguagcugugcgug

SEQ ID NO: 1871819 - RNA, 19 nt, Human
cgcggcucccggggcaggg

SEQ ID NO: 1871820 - RNA, 22 nt, Human
cgcggcucccggggcagggcag

SEQ ID NO: 1871821 - RNA, 13 nt, Human
cgcccccuuggcu

SEQ ID NO: 1871822 - RNA, 15 nt, Human
cuaaaugaauguuua

SEQ ID NO: 1871823 - RNA, 16 nt, Human
cuaaaugaauguuuac

SEQ ID NO: 1871824 - RNA, 17 nt, Human
cuaaauccuuuacuguu

SEQ ID NO: 1871825 - RNA, 21 nt, Human
cuaaauccuuuacuguuaguc

SEQ ID NO: 1871826 - RNA, 22 nt, Human
cgugggcugggcccacaaaggc

SEQ ID NO: 1871827 - RNA, 13 nt, Human
cguggacucugca

SEQ ID NO: 1871828 - RNA, 16 nt, Human
cguggacucugcacau

SEQ ID NO: 1871829 - RNA, 13 nt, Human
cucacauuuauau

SEQ ID NO: 1871830 - RNA, 16 nt, Human
cucaagaugaaggcaa

SEQ ID NO: 1871831 - RNA, 17 nt, Human
cucaagaucaaugaaau

SEQ ID NO: 1871832 - RNA, 18 nt, Human
cucaagaucaaugaaaug

SEQ ID NO: 1871833 - RNA, 22 nt, Human
cuagugcugaagcuuauuaaug

SEQ ID NO: 1871834 - RNA, 16 nt, Human
cuagugcugaagcuua

SEQ ID NO: 1871835 - RNA, 17 nt, Human
cuagugcugaagcuuau

SEQ ID NO: 1871836 - RNA, 20 nt, Human
cuagugcugaagcuuauuaa

SEQ ID NO: 1871837 - RNA, 21 nt, Human
cuagugcugaagcuuauuaau

SEQ ID NO: 1871838 - RNA, 12 nt, Human
cuagugcugaag

SEQ ID NO: 1871839 - RNA, 13 nt, Human
cuagugcugaagc

SEQ ID NO: 1871840 - RNA, 14 nt, Human
cuagugcugaagcu

SEQ ID NO: 1871841 - RNA, 15 nt, Human
cuagugcugaagcuu

SEQ ID NO: 1871842 - RNA, 22 nt, Human
cuaguacuugggagaccuguaa

SEQ ID NO: 1871843 - RNA, 23 nt, Human
cuaggaagaucucugcagggccg

SEQ ID NO: 1871844 - RNA, 17 nt, Human
cuaggacuucaaauugg

SEQ ID NO: 1871845 - RNA, 13 nt, Human
cuaggauuucaug

SEQ ID NO: 1871846 - RNA, 17 nt, Human
cuacaagcuaaaauuag

SEQ ID NO: 1871847 - RNA, 19 nt, Human
cuacaagcuaaaauuagau

SEQ ID NO: 1871848 - RNA, 21 nt, Human
cuagacuaaaagauugagaag

SEQ ID NO: 1871849 - RNA, 13 nt, Human
ccuaaacauauga

SEQ ID NO: 1871850 - RNA, 14 nt, Human
ccggggcagggcag

SEQ ID NO: 1871851 - RNA, 16 nt, Human
ccggggcagggcagcc

SEQ ID NO: 1871852 - RNA, 15 nt, Human
ccucaccacccacuu

SEQ ID NO: 1871853 - RNA, 19 nt, Human
ccucaguuuuaucauuuuc

SEQ ID NO: 1871854 - RNA, 15 nt, Human
ccuccuuggugccug

SEQ ID NO: 1871855 - RNA, 17 nt, Human
ccuccuuggugccuggc

SEQ ID NO: 1871856 - RNA, 16 nt, Human
ccccagccuggccacg

SEQ ID NO: 1871857 - RNA, 21 nt, Human
ccccagccuggccacgcagcc

SEQ ID NO: 1871858 - RNA, 23 nt, Human
ccccagccuggccacgcagccag

SEQ ID NO: 1871859 - RNA, 22 nt, Human
ccccagccuggccacgcagcca

SEQ ID NO: 1871860 - RNA, 12 nt, Human
cccuggagccca

SEQ ID NO: 1871861 - RNA, 22 nt, Human
ccaugcgacacugggaggccag

SEQ ID NO: 1871862 - RNA, 21 nt, Human
ccaugcgacacugggaggcca

SEQ ID NO: 1871863 - RNA, 16 nt, Human
ccaugcgacacuggga

SEQ ID NO: 1871864 - RNA, 21 nt, Human
cccagacggcuccacuaggac

SEQ ID NO: 1871865 - RNA, 20 nt, Human
cccagaggagcugggagccg

SEQ ID NO: 1871866 - RNA, 22 nt, Human
cccagaggagcugggagccggg

SEQ ID NO: 1871867 - RNA, 17 nt, Human
ccagggagaccuggaca

SEQ ID NO: 1871868 - RNA, 16 nt, Human
ccagggagaccuggac

SEQ ID NO: 1871869 - RNA, 18 nt, Human
ccagggagaccuggacac

SEQ ID NO: 1871870 - RNA, 19 nt, Human
ccagccuggccacgcagcc

SEQ ID NO: 1871871 - RNA, 23 nt, Human
ccagccuggccacgcagccagga

SEQ ID NO: 1871872 - RNA, 16 nt, Human
ccagccuggccacgca

SEQ ID NO: 1871873 - RNA, 17 nt, Human
ccaagaccucagggcac

SEQ ID NO: 1871874 - RNA, 16 nt, Human
ccacaaaggcaaaggg

SEQ ID NO: 1871875 - RNA, 20 nt, Human
ccacaaaggcaaagggucca

SEQ ID NO: 1871876 - RNA, 19 nt, Human
ccacaacaugaaaacucca

SEQ ID NO: 1871877 - RNA, 17 nt, Human
cauuuuaauuauuauuc

SEQ ID NO: 1871878 - RNA, 16 nt, Human
caugugacacauaugc

SEQ ID NO: 1871879 - RNA, 14 nt, Human
caugugacacauau

SEQ ID NO: 1871880 - RNA, 15 nt, Human
caugugacacauaug

SEQ ID NO: 1871881 - RNA, 12 nt, Human
caugugacacau

SEQ ID NO: 1871882 - RNA, 13 nt, Human
caugugacacaua

SEQ ID NO: 1871883 - RNA, 23 nt, Human
caugucuuguacauguguagccu

SEQ ID NO: 1871884 - RNA, 15 nt, Human
cauguacaugaagaa

SEQ ID NO: 1871885 - RNA, 22 nt, Human
caugcgacacugggaggccagu

SEQ ID NO: 1871886 - RNA, 22 nt, Human
caguucggugagcuacaaaugc

SEQ ID NO: 1871887 - RNA, 15 nt, Human
caguguuuucuggga

SEQ ID NO: 1871888 - RNA, 22 nt, Human
caguguuuucugggauaaguaa

SEQ ID NO: 1871889 - RNA, 17 nt, Human
caguuggccagagagcc

SEQ ID NO: 1871890 - RNA, 16 nt, Human
caguuggccagagagc

SEQ ID NO: 1871891 - RNA, 16 nt, Human
caguuuuuuaugcuaa

SEQ ID NO: 1871892 - RNA, 19 nt, Human
cauaagaaaacuaagaaau

SEQ ID NO: 1871893 - RNA, 12 nt, Human
cauaaguuucug

SEQ ID NO: 1871894 - RNA, 19 nt, Human
cauacucaauguuacuauc

SEQ ID NO: 1871895 - RNA, 15 nt, Human
cauauaauguuguua

SEQ ID NO: 1871896 - RNA, 17 nt, Human
cauauaauguuguuauu

SEQ ID NO: 1871897 - RNA, 18 nt, Human
cauauaauguuguuauuu

SEQ ID NO: 1871898 - RNA, 22 nt, Human
caucaagucuuucacauuuaaa

SEQ ID NO: 1871899 - RNA, 16 nt, Human
cauaugcaccuugugu

SEQ ID NO: 1871900 - RNA, 17 nt, Human
cauaugcaccuuguguc

SEQ ID NO: 1871901 - RNA, 18 nt, Human
cauaugcaccuugugucu

SEQ ID NO: 1871902 - RNA, 19 nt, Human
cauaugcaccuugugucug

SEQ ID NO: 1871903 - RNA, 20 nt, Human
cauaugcaccuugugucugu

SEQ ID NO: 1871904 - RNA, 21 nt, Human
cauaugcaccuugugucugua

SEQ ID NO: 1871905 - RNA, 23 nt, Human
cauaugcaccuugugucuguaca

SEQ ID NO: 1871906 - RNA, 18 nt, Human
aggagacaggcagagcug

SEQ ID NO: 1871907 - RNA, 13 nt, Human
aggagacaggcag

SEQ ID NO: 1871908 - RNA, 21 nt, Human
aggagaccuggcacuggaugc

SEQ ID NO: 1871909 - RNA, 21 nt, Human
aggagugccguguguugcaug

SEQ ID NO: 1871910 - RNA, 22 nt, Human
aggauggcaggacgugggcugg

SEQ ID NO: 1871911 - RNA, 15 nt, Human
aggauggcaggacgu

SEQ ID NO: 1871912 - RNA, 12 nt, Human
agcuacaaaugc

SEQ ID NO: 1871913 - RNA, 13 nt, Human
agcuacaaaugca

SEQ ID NO: 1871914 - RNA, 13 nt, Human
agcuaaauccuuu

SEQ ID NO: 1871915 - RNA, 11 nt, Human
agccuggcucc

SEQ ID NO: 1871916 - RNA, 16 nt, Human
agccuggccacgcagc

SEQ ID NO: 1871917 - RNA, 20 nt, Human
agccuggccacgcagccagg

SEQ ID NO: 1871918 - RNA, 21 nt, Human
agccuggccacgcagccagga

SEQ ID NO: 1871919 - RNA, 22 nt, Human
agccuggccacgcagccaggac

SEQ ID NO: 1871920 - RNA, 23 nt, Human
agccuggccacgcagccaggaca

SEQ ID NO: 1871921 - RNA, 18 nt, Human
aggaaaaaauaacaauga

SEQ ID NO: 1871922 - RNA, 19 nt, Human
agacaaggaaaaaauaaca

SEQ ID NO: 1871923 - RNA, 13 nt, Human
agaaucucuuucg

SEQ ID NO: 1871924 - RNA, 18 nt, Human
agaagggagcuagccaga

SEQ ID NO: 1871925 - RNA, 19 nt, Human
agaagggagcuagccagag

SEQ ID NO: 1871926 - RNA, 20 nt, Human
agauagauaggucagugcaa

SEQ ID NO: 1871927 - RNA, 21 nt, Human
agaugggugaaggcuggcaug

SEQ ID NO: 1871928 - RNA, 17 nt, Human
agaugggugaaggcugg

SEQ ID NO: 1871929 - RNA, 16 nt, Human
agaucucugcagggcc

SEQ ID NO: 1871930 - RNA, 17 nt, Human
agaucucugcagggccg

SEQ ID NO: 1871931 - RNA, 15 nt, Human
aguguuuucugggau

SEQ ID NO: 1871932 - RNA, 13 nt, Human
aguguuuucuggg

SEQ ID NO: 1871933 - RNA, 18 nt, Human
aguucauauguaccaugu

SEQ ID NO: 1871934 - RNA, 22 nt, Human
aguucauauguaccauguacau

SEQ ID NO: 1871935 - RNA, 16 nt, Human
auaaaagacagugaaa

SEQ ID NO: 1871936 - RNA, 15 nt, Human
auaaaagacagugaa

SEQ ID NO: 1871937 - RNA, 17 nt, Human
aguuucugggaccucag

SEQ ID NO: 1871938 - RNA, 13 nt, Human
auaaguaaguuug

SEQ ID NO: 1871939 - RNA, 20 nt, Human
aguaacccccacuggacuga

SEQ ID NO: 1871940 - RNA, 15 nt, Human
agucuguccaggcuc

SEQ ID NO: 1871941 - RNA, 19 nt, Human
agucauuugcugagcaugu

SEQ ID NO: 1871942 - RNA, 22 nt, Human
agucauuugcugagcauguacu

SEQ ID NO: 1871943 - RNA, 15 nt, Human
auggaguucuugugc

SEQ ID NO: 1871944 - RNA, 22 nt, Human
auccacuucuuucagcagacug

SEQ ID NO: 1871945 - RNA, 14 nt, Human
auccacuucuuuca

SEQ ID NO: 1871946 - RNA, 14 nt, Human
aucauccagaaguu

SEQ ID NO: 1871947 - RNA, 15 nt, Human
aucaaaacuuucuuu

SEQ ID NO: 1871948 - RNA, 21 nt, Human
aucaaaacuuucuuuucugga

SEQ ID NO: 1871949 - RNA, 21 nt, Human
acaagguaccccuuucuggcu

SEQ ID NO: 1871950 - RNA, 12 nt, Human
acacguguccug

SEQ ID NO: 1871951 - RNA, 15 nt, Human
acacgcaggagcaca

SEQ ID NO: 1871952 - RNA, 14 nt, Human
acacgcaggagcac

SEQ ID NO: 1871953 - RNA, 13 nt, Human
acacgcaggagca

SEQ ID NO: 1871954 - RNA, 11 nt, Human
aauuguaauag

SEQ ID NO: 1871955 - RNA, 15 nt, Human
aauuaucaagcuaau

SEQ ID NO: 1871956 - RNA, 16 nt, Human
aauuaucaagcuaaua

SEQ ID NO: 1871957 - RNA, 19 nt, Human
aauuaucaagcuaauaaaa

SEQ ID NO: 1871958 - RNA, 19 nt, Human
aauucuaaaugaauguuua

SEQ ID NO: 1871959 - RNA, 13 nt, Human
aauucuaaaugaa

SEQ ID NO: 1871960 - RNA, 20 nt, Human
acauguguagccugugcaug

SEQ ID NO: 1871961 - RNA, 17 nt, Human
acauguguagccugugc

SEQ ID NO: 1871962 - RNA, 18 nt, Human
acauguguagccugugca

SEQ ID NO: 1871963 - RNA, 14 nt, Human
acaugcgaccccga

SEQ ID NO: 1871964 - RNA, 13 nt, Human
acaggcagagcug

SEQ ID NO: 1871965 - RNA, 15 nt, Human
acgcacaugcgaccc

SEQ ID NO: 1871966 - RNA, 15 nt, Human
accucugugugcucc

SEQ ID NO: 1871967 - RNA, 11 nt, Human
accucugugug

SEQ ID NO: 1871968 - RNA, 12 nt, Human
accucugugugc

SEQ ID NO: 1871969 - RNA, 11 nt, Human
accuguaauca

SEQ ID NO: 1871970 - RNA, 22 nt, Human
acccugggccuggcagcucagc

SEQ ID NO: 1871971 - RNA, 15 nt, Human
acccugggccuggca

SEQ ID NO: 1871972 - RNA, 13 nt, Human
acccuggagccca

SEQ ID NO: 1871973 - RNA, 23 nt, Human
acccuauauuuugcauaguacca

SEQ ID NO: 1871974 - RNA, 17 nt, Human
accuccaagccacugag

SEQ ID NO: 1871975 - RNA, 17 nt, Human
acuguaaaauaauaacu

SEQ ID NO: 1871976 - RNA, 17 nt, Human
acucuacccauauuaca

SEQ ID NO: 1871977 - RNA, 19 nt, Human
acucuacccauauuacaga

SEQ ID NO: 1871978 - RNA, 18 nt, Human
acugaucaggaccuccaa

SEQ ID NO: 1871979 - RNA, 21 nt, Human
aagacaaggaaaaaauaacaa

SEQ ID NO: 1871980 - RNA, 12 nt, Human
aagauaauuaua

SEQ ID NO: 1871981 - RNA, 16 nt, Human
aagccagggugugucu

SEQ ID NO: 1871982 - RNA, 18 nt, Human
aagcgaucacuuccuaua

SEQ ID NO: 1871983 - RNA, 20 nt, Human
aaugaauacuuuauaaagga

SEQ ID NO: 1871984 - RNA, 21 nt, Human
aaauguuauuuuuuaauuauu

SEQ ID NO: 1871985 - RNA, 20 nt, Human
aaauguuauuuuuuaauuau

SEQ ID NO: 1871986 - RNA, 20 nt, Human
aaaagacaaggaaaaaauaa

SEQ ID NO: 1871987 - RNA, 14 nt, Human
cuccuggcccaggu

SEQ ID NO: 1871988 - RNA, 12 nt, Human
cuccuggcccag

SEQ ID NO: 1871989 - RNA, 11 nt, Human
cucccaggaca

SEQ ID NO: 1871990 - RNA, 12 nt, Human
cucccaggacac

SEQ ID NO: 1871991 - RNA, 19 nt, Human
cucugcagggccgccaggg

SEQ ID NO: 1871992 - RNA, 13 nt, Human
cucugcagggccg

SEQ ID NO: 1871993 - RNA, 13 nt, Human
cucugcacauguc

SEQ ID NO: 1871994 - RNA, 14 nt, Human
cucugcacaugucu

SEQ ID NO: 1871995 - RNA, 19 nt, Human
cucaauguuacuaucugcu

SEQ ID NO: 1871996 - RNA, 13 nt, Human
cuaauaaaauauc

SEQ ID NO: 1871997 - RNA, 14 nt, Human
cuaauaaaauauca

SEQ ID NO: 1871998 - RNA, 15 nt, Human
cuaauaaaauaucau

SEQ ID NO: 1871999 - RNA, 16 nt, Human
cuaauaaaauaucauu

SEQ ID NO: 1872000 - RNA, 17 nt, Human
cuaauaaaauaucauuc

SEQ ID NO: 1872001 - RNA, 18 nt, Human
cuaauaaaauaucauuca

SEQ ID NO: 1872002 - RNA, 19 nt, Human
cuaauaaaauaucauucag

SEQ ID NO: 1872003 - RNA, 20 nt, Human
cuaauaaaauaucauucagc

SEQ ID NO: 1872004 - RNA, 21 nt, Human
cuaauaaaauaucauucagca

SEQ ID NO: 1872005 - RNA, 22 nt, Human
cuaauaaaauaucauucagcaa

SEQ ID NO: 1872006 - RNA, 23 nt, Human
cuaauaaaauaucauucagcaac

SEQ ID NO: 1872007 - RNA, 14 nt, Human
cuaaagcagccagc

SEQ ID NO: 1872008 - RNA, 15 nt, Human
cgugagugcagaccc

SEQ ID NO: 1872009 - RNA, 15 nt, Human
cuaaaguaugaagca

SEQ ID NO: 1872010 - RNA, 20 nt, Human
cuaagaaauaugcacaauag

SEQ ID NO: 1872011 - RNA, 21 nt, Human
cgccacagcccagccacggac

SEQ ID NO: 1872012 - RNA, 14 nt, Human
cgccacagcccagc

SEQ ID NO: 1872013 - RNA, 15 nt, Human
cgcaguggcccugag

SEQ ID NO: 1872014 - RNA, 14 nt, Human
cgggcccagaggag

SEQ ID NO: 1872015 - RNA, 15 nt, Human
cgggcccagaggagc

SEQ ID NO: 1872016 - RNA, 14 nt, Human
cccaagcagagaag

SEQ ID NO: 1872017 - RNA, 20 nt, Human
cccauccagucucccaacuu

SEQ ID NO: 1872018 - RNA, 16 nt, Human
ccacugacugcaggga

SEQ ID NO: 1872019 - RNA, 17 nt, Human
ccacugacugcagggac

SEQ ID NO: 1872020 - RNA, 20 nt, Human
ccagacggcuccacuaggac

SEQ ID NO: 1872021 - RNA, 15 nt, Human
ccagacggcuccacu

SEQ ID NO: 1872022 - RNA, 21 nt, Human
ccagagagccuggugcugcug

SEQ ID NO: 1872023 - RNA, 22 nt, Human
ccagagagccuggugcugcugc

SEQ ID NO: 1872024 - RNA, 17 nt, Human
cccugaagcugugcgga

SEQ ID NO: 1872025 - RNA, 19 nt, Human
cccugaagcugugcggagc

SEQ ID NO: 1872026 - RNA, 14 nt, Human
ccaacucagaaggg

SEQ ID NO: 1872027 - RNA, 13 nt, Human
cauuauuaucaac

SEQ ID NO: 1872028 - RNA, 13 nt, Human
cauguaugucuug

SEQ ID NO: 1872029 - RNA, 17 nt, Human
cauguaugucuuggaca

SEQ ID NO: 1872030 - RNA, 18 nt, Human
cauguaugucuuggacac

SEQ ID NO: 1872031 - RNA, 21 nt, Human
cauguaugucuuggacacugu

SEQ ID NO: 1872032 - RNA, 22 nt, Human
cauguaugucuuggacacugua

SEQ ID NO: 1872033 - RNA, 17 nt, Human
cauggccuaugcacaua

SEQ ID NO: 1872034 - RNA, 19 nt, Human
cauggccuaugcacauaug

SEQ ID NO: 1872035 - RNA, 16 nt, Human
cauggccuaugcacau

SEQ ID NO: 1872036 - RNA, 21 nt, Human
caugaaucccacccacaugug

SEQ ID NO: 1872037 - RNA, 17 nt, Human
caguuauuauauuuaca

SEQ ID NO: 1872038 - RNA, 21 nt, Human
caguuauuauauuuacaaaug

SEQ ID NO: 1872039 - RNA, 22 nt, Human
caguuauuauauuuacaaaugg

SEQ ID NO: 1872040 - RNA, 23 nt, Human
caguucauauguaccauguacau

SEQ ID NO: 1872041 - RNA, 20 nt, Human
caucagcuaaacaccacguc

SEQ ID NO: 1872042 - RNA, 18 nt, Human
caucagcuaaacaccacg

SEQ ID NO: 1872043 - RNA, 17 nt, Human
caucugguuaggauggc

SEQ ID NO: 1872044 - RNA, 16 nt, Human
cauagguuuaauaauu

SEQ ID NO: 1872045 - RNA, 15 nt, Human
cauauguaccaugua

SEQ ID NO: 1872046 - RNA, 21 nt, Human
cauauguaccauguacaugaa

SEQ ID NO: 1872047 - RNA, 18 nt, Human
cauaauguuacauuauua

SEQ ID NO: 1872048 - RNA, 15 nt, Human
caguuuuaucauuuu

SEQ ID NO: 1872049 - RNA, 17 nt, Human
cauaauguuacauuauu

SEQ ID NO: 1872050 - RNA, 24 nt, Human
caguuugaaugcagucuguccagg

SEQ ID NO: 1872051 - RNA, 15 nt, Human
caguuugagacagga

SEQ ID NO: 1872052 - RNA, 16 nt, Human
caguuugagacaggag

SEQ ID NO: 1872053 - RNA, 18 nt, Human
caguuugagacaggagac

SEQ ID NO: 1872054 - RNA, 16 nt, Human
cagacugaucaggacc

SEQ ID NO: 1872055 - RNA, 17 nt, Human
cagacugaucaggaccu

SEQ ID NO: 1872056 - RNA, 19 nt, Human
cagacaguguuuucuggga

SEQ ID NO: 1872057 - RNA, 20 nt, Human
cagggagaccuggacacagg

SEQ ID NO: 1872058 - RNA, 21 nt, Human
cagggagaccuggacacaggc

SEQ ID NO: 1872059 - RNA, 23 nt, Human
caggaccuccaagccacugagca

SEQ ID NO: 1872060 - RNA, 20 nt, Human
caggaccuccaagccacuga

SEQ ID NO: 1872061 - RNA, 19 nt, Human
caggaccuccaagccacug

SEQ ID NO: 1872062 - RNA, 17 nt, Human
caggaccuccaagccac

SEQ ID NO: 1872063 - RNA, 14 nt, Human
auuaaugcuaaggg

SEQ ID NO: 1872064 - RNA, 15 nt, Human
auuaaugcuaagggc

SEQ ID NO: 1872065 - RNA, 23 nt, Human
auuaaugcuaagggcaggcccaa

SEQ ID NO: 1872066 - RNA, 17 nt, Human
auuuucuauaauuuaaa

SEQ ID NO: 1872067 - RNA, 18 nt, Human
auuuucuauaauuuaaau

SEQ ID NO: 1872068 - RNA, 19 nt, Human
auuuucuauaauuuaaaua

SEQ ID NO: 1872069 - RNA, 14 nt, Human
auuuauauauguau

SEQ ID NO: 1872070 - RNA, 15 nt, Human
auuuauauauguauu

SEQ ID NO: 1872071 - RNA, 15 nt, Human
auuuaagauaauuau

SEQ ID NO: 1872072 - RNA, 15 nt, Human
auuugcacaaguuuu

SEQ ID NO: 1872073 - RNA, 13 nt, Human
caagcaagacuga

SEQ ID NO: 1872074 - RNA, 14 nt, Human
caagcaagacugag

SEQ ID NO: 1872075 - RNA, 17 nt, Human
caagcaaacccagacgg

SEQ ID NO: 1872076 - RNA, 14 nt, Human
caagcaaacccaga

SEQ ID NO: 1872077 - RNA, 22 nt, Human
caauuucacgacacacuuugau

SEQ ID NO: 1872078 - RNA, 19 nt, Human
cacggacgcuggcucccca

SEQ ID NO: 1872079 - RNA, 16 nt, Human
cacggacgcuggcucc

SEQ ID NO: 1872080 - RNA, 23 nt, Human
cacggacgcuggcuccccaaagg

SEQ ID NO: 1872081 - RNA, 15 nt, Human
gccuccuggcccagg

SEQ ID NO: 1872082 - RNA, 19 nt, Human
gccuccuggcccaggugag

SEQ ID NO: 1872083 - RNA, 23 nt, Human
gccaccccagccuggccacgcag

SEQ ID NO: 1872084 - RNA, 22 nt, Human
gcugaagcuuauuaaugcuaag

SEQ ID NO: 1872085 - RNA, 21 nt, Human
gcugaagcuuauuaaugcuaa

SEQ ID NO: 1872086 - RNA, 12 nt, Human
gcugcugcugcu

SEQ ID NO: 1872087 - RNA, 20 nt, Human
ggaccggguggaagggaugg

SEQ ID NO: 1872088 - RNA, 15 nt, Human
ggacuuuuauuuugg

SEQ ID NO: 1872089 - RNA, 17 nt, Human
ggaggccagugagccac

SEQ ID NO: 1872090 - RNA, 16 nt, Human
ggaggccagugagcca

SEQ ID NO: 1872091 - RNA, 19 nt, Human
ggagcuuccuguccuccca

SEQ ID NO: 1872092 - RNA, 11 nt, Human
ggcccaggccu

SEQ ID NO: 1872093 - RNA, 18 nt, Human
ggcaggacgugggcuggg

SEQ ID NO: 1872094 - RNA, 23 nt, Human
ggcaaacaggcaguuggccagag

SEQ ID NO: 1872095 - RNA, 13 nt, Human
ggcaaacaggcag

SEQ ID NO: 1872096 - RNA, 22 nt, Human
ggcaaagcacgaaauguuauuu

SEQ ID NO: 1872097 - RNA, 19 nt, Human
ggcaaaggguccagaagga

SEQ ID NO: 1872098 - RNA, 19 nt, Human
ggcuccugagggagcucca

SEQ ID NO: 1872099 - RNA, 21 nt, Human
ggcugcauacccgggcagggc

SEQ ID NO: 1872100 - RNA, 22 nt, Human
aaaagcuccauuuuuagugaaa

SEQ ID NO: 1872101 - RNA, 13 nt, Human
gggagaccuggac

SEQ ID NO: 1872102 - RNA, 14 nt, Human
gggcaaacaggcag

SEQ ID NO: 1872103 - RNA, 15 nt, Human
gggcaaacaggcagu

SEQ ID NO: 1872104 - RNA, 13 nt, Human
aaaggaauuuaaa

SEQ ID NO: 1872105 - RNA, 19 nt, Human
aaagcuugcaacaaaauuc

SEQ ID NO: 1872106 - RNA, 19 nt, Human
aaagaugggugaaggcugg

SEQ ID NO: 1872107 - RNA, 20 nt, Human
ggucccaaacagcugccucu

SEQ ID NO: 1872108 - RNA, 20 nt, Human
gguccagaaggagacaggca

SEQ ID NO: 1872109 - RNA, 13 nt, Human
aaaauugugauca

SEQ ID NO: 1872110 - RNA, 16 nt, Human
aaacaagaaaguuucc

SEQ ID NO: 1872111 - RNA, 17 nt, Human
aaacaagaaaguuuccc

SEQ ID NO: 1872112 - RNA, 18 nt, Human
aaacaagaaaguuucccc

SEQ ID NO: 1872113 - RNA, 15 nt, Human
aaacaagaaaguuuc

SEQ ID NO: 1872114 - RNA, 16 nt, Human
gggucagaaacaggac

SEQ ID NO: 1872115 - RNA, 18 nt, Human
gggucagaaacaggaccg

SEQ ID NO: 1872116 - RNA, 22 nt, Human
ggggucgacuucgggcuggcca

SEQ ID NO: 1872117 - RNA, 24 nt, Human
gaccaugcgacacugggaggccag

SEQ ID NO: 1872118 - RNA, 21 nt, Human
gacuuuaucuaauaccucugu

SEQ ID NO: 1872119 - RNA, 22 nt, Human
gacuuuaucuaauaccucugug

SEQ ID NO: 1872120 - RNA, 20 nt, Human
gacucugcacaugucuugua

SEQ ID NO: 1872121 - RNA, 20 nt, Human
gaccauaauguuacauuauu

SEQ ID NO: 1872122 - RNA, 19 nt, Human
gaagcucucgggcuaggaa

SEQ ID NO: 1872123 - RNA, 18 nt, Human
gaaggcuggcaugaucca

SEQ ID NO: 1872124 - RNA, 14 nt, Human
gaaggcuggcauga

SEQ ID NO: 1872125 - RNA, 23 nt, Human
gaggugaacaagcaaacccagac

SEQ ID NO: 1872126 - RNA, 16 nt, Human
gaguuuaaauuguaau

SEQ ID NO: 1872127 - RNA, 13 nt, Human
gcacauauggacu

SEQ ID NO: 1872128 - RNA, 22 nt, Human
cuugugacuagugcugaagcuu

SEQ ID NO: 1872129 - RNA, 18 nt, Human
cugugacuuaagaagccu

SEQ ID NO: 1872130 - RNA, 14 nt, Human
cuuauuaaugcuaa

SEQ ID NO: 1872131 - RNA, 15 nt, Human
cuuauuaaugcuaag

SEQ ID NO: 1872132 - RNA, 19 nt, Human
cuuauuaaugcuaagggca

SEQ ID NO: 1872133 - RNA, 16 nt, Human
cuuauuaaugcuaagg

SEQ ID NO: 1872134 - RNA, 11 nt, Human
cuucauccucu

SEQ ID NO: 1872135 - RNA, 17 nt, Human
cugggcccacaaaggca

SEQ ID NO: 1872136 - RNA, 14 nt, Human
auguuacauuauua

SEQ ID NO: 1872137 - RNA, 17 nt, Human
auguuauuuuuuaauua

SEQ ID NO: 1872138 - RNA, 19 nt, Human
auguuauuuuuuaauuauu

SEQ ID NO: 1872139 - RNA, 20 nt, Human
auguuauuuuuuaauuauua

SEQ ID NO: 1872140 - RNA, 16 nt, Human
uuuucuauaauuuaaa

SEQ ID NO: 1872141 - RNA, 16 nt, Human
auguuuacacucuuug

SEQ ID NO: 1872142 - RNA, 18 nt, Human
auguuuacacucuuugua

SEQ ID NO: 1872143 - RNA, 19 nt, Human
auguuuacacucuuuguaa

SEQ ID NO: 1872144 - RNA, 21 nt, Human
auguuuacacucuuuguaaga

SEQ ID NO: 1872145 - RNA, 18 nt, Human
uuuucuggaauguaauca

SEQ ID NO: 1872146 - RNA, 23 nt, Human
augucgucaaagcugaaauggac

SEQ ID NO: 1872147 - RNA, 11 nt, Human
augugacacau

SEQ ID NO: 1872148 - RNA, 14 nt, Human
uuugauuucauuaa

SEQ ID NO: 1872149 - RNA, 13 nt, Human
uuugagacaggag

SEQ ID NO: 1872150 - RNA, 20 nt, Human
auuauauggcuugaguuuaa

SEQ ID NO: 1872151 - RNA, 17 nt, Human
auuccaagugauugaaa

SEQ ID NO: 1872152 - RNA, 12 nt, Human
uuuuuaauuauu

SEQ ID NO: 1872153 - RNA, 15 nt, Human
uuuuugaagcuguau

SEQ ID NO: 1872154 - RNA, 13 nt, Human
auuacuguuugga

SEQ ID NO: 1872155 - RNA, 12 nt, Human
auugauuagaaa

SEQ ID NO: 1872156 - RNA, 13 nt, Human
auugccuucauuu

SEQ ID NO: 1872157 - RNA, 20 nt, Human
auugccuucauuuuaugaua

SEQ ID NO: 1872158 - RNA, 22 nt, Human
auuuauaaauauauuuaagaua

SEQ ID NO: 1872159 - RNA, 16 nt, Human
auuguaguccuguaau

SEQ ID NO: 1872160 - RNA, 15 nt, Human
auuucaugauuucau

SEQ ID NO: 1872161 - RNA, 18 nt, Human
uuuaaaaaaauuccaagu

SEQ ID NO: 1872162 - RNA, 21 nt, Human
augcaccuugugucuguacac

SEQ ID NO: 1872163 - RNA, 14 nt, Human
augauuucauuuca

SEQ ID NO: 1872164 - RNA, 21 nt, Human
uuuaaauauaugcuaagucuu

SEQ ID NO: 1872165 - RNA, 23 nt, Human
uugugaucagaccauaauguuac

SEQ ID NO: 1872166 - RNA, 13 nt, Human
uugugucuguaca

SEQ ID NO: 1872167 - RNA, 14 nt, Human
uugugucuguacac

SEQ ID NO: 1872168 - RNA, 15 nt, Human
uugugucuguacacg

SEQ ID NO: 1872169 - RNA, 18 nt, Human
augcuacaggauuugaaa

SEQ ID NO: 1872170 - RNA, 20 nt, Human
augcgacacugggaggccag

SEQ ID NO: 1872171 - RNA, 16 nt, Human
aucuuauaauuuaaaa

SEQ ID NO: 1872172 - RNA, 15 nt, Human
aucuuauaauuuaaa

SEQ ID NO: 1872173 - RNA, 18 nt, Human
augaaagucuugugacua

SEQ ID NO: 1872174 - RNA, 19 nt, Human
augaaagucuugugacuag

SEQ ID NO: 1872175 - RNA, 20 nt, Human
augaaagucuugugacuagu

SEQ ID NO: 1872176 - RNA, 21 nt, Human
augaaucccacccacauguga

SEQ ID NO: 1872177 - RNA, 18 nt, Human
augaaucccacccacaug

SEQ ID NO: 1872178 - RNA, 20 nt, Human
uuguaagaguggaaccaaca

SEQ ID NO: 1872179 - RNA, 14 nt, Human
uuguaauucuaaau

SEQ ID NO: 1872180 - RNA, 17 nt, Human
uuguaauucuaaaugaa

SEQ ID NO: 1872181 - RNA, 23 nt, Human
uuguaauucuaaaugaauguuua

SEQ ID NO: 1872182 - RNA, 15 nt, Human
auaugcacaauagca

SEQ ID NO: 1872183 - RNA, 16 nt, Human
uucaaaauggagggaa

SEQ ID NO: 1872184 - RNA, 14 nt, Human
auagcuacuaauuu

SEQ ID NO: 1872185 - RNA, 17 nt, Human
auagcuacuaauuuuaa

SEQ ID NO: 1872186 - RNA, 23 nt, Human
auagcuccccgcuucugccugca

SEQ ID NO: 1872187 - RNA, 20 nt, Human
auagcuccccgcuucugccu

SEQ ID NO: 1872188 - RNA, 18 nt, Human
auagcuacuaauuuuaaa

SEQ ID NO: 1872189 - RNA, 14 nt, Human
aucauuuuaauuau

SEQ ID NO: 1872190 - RNA, 15 nt, Human
aucauuuuaauuauu

SEQ ID NO: 1872191 - RNA, 12 nt, Human
aucauucagcaa

SEQ ID NO: 1872192 - RNA, 13 nt, Human
aucauucagcaac

SEQ ID NO: 1872193 - RNA, 19 nt, Human
aucagucauaacuaaauaa

SEQ ID NO: 1872194 - RNA, 15 nt, Human
uucuagguucuaaaa

SEQ ID NO: 1872195 - RNA, 15 nt, Human
agugaaagaaaauaa

SEQ ID NO: 1872196 - RNA, 16 nt, Human
ugugccauagucacau

SEQ ID NO: 1872197 - RNA, 18 nt, Human
ugugccauagucacaugg

SEQ ID NO: 1872198 - RNA, 21 nt, Human
ugugccauagucacauggccu

SEQ ID NO: 1872199 - RNA, 20 nt, Human
ugugacuagugcugaagcuu

SEQ ID NO: 1872200 - RNA, 22 nt, Human
ugugacuagugcugaagcuuau

SEQ ID NO: 1872201 - RNA, 23 nt, Human
ugugacuagugcugaagcuuauu

SEQ ID NO: 1872202 - RNA, 14 nt, Human
ugugacuagugcug

SEQ ID NO: 1872203 - RNA, 15 nt, Human
ugugacuagugcuga

SEQ ID NO: 1872204 - RNA, 16 nt, Human
ugugacuagugcugaa

SEQ ID NO: 1872205 - RNA, 17 nt, Human
ugugacuagugcugaag

SEQ ID NO: 1872206 - RNA, 19 nt, Human
ugugacuagugcugaagcu

SEQ ID NO: 1872207 - RNA, 16 nt, Human
ugucuuguacaugugu

SEQ ID NO: 1872208 - RNA, 17 nt, Human
ugucuuguacaugugua

SEQ ID NO: 1872209 - RNA, 20 nt, Human
ugucuuguacauguguagcc

SEQ ID NO: 1872210 - RNA, 22 nt, Human
ugucuuguacauguguagccug

SEQ ID NO: 1872211 - RNA, 19 nt, Human
ugucuuggacacuguacaa

SEQ ID NO: 1872212 - RNA, 13 nt, Human
ugucuuguacaug

SEQ ID NO: 1872213 - RNA, 23 nt, Human
agugcugaagcuuauuaaugcua

SEQ ID NO: 1872214 - RNA, 21 nt, Human
agugcugaagcuuauuaaugc

SEQ ID NO: 1872215 - RNA, 22 nt, Human
agugcugaagcuuauuaaugcu

SEQ ID NO: 1872216 - RNA, 12 nt, Human
agugcugaagcu

SEQ ID NO: 1872217 - RNA, 13 nt, Human
agugcugaagcuu

SEQ ID NO: 1872218 - RNA, 15 nt, Human
agugcugaagcuuau

SEQ ID NO: 1872219 - RNA, 16 nt, Human
agugcugaagcuuauu

SEQ ID NO: 1872220 - RNA, 17 nt, Human
aguuucacugccauaua

SEQ ID NO: 1872221 - RNA, 16 nt, Human
aguuggccagagagcc

SEQ ID NO: 1872222 - RNA, 16 nt, Human
aguugcguggacucug

SEQ ID NO: 1872223 - RNA, 20 nt, Human
aguugcguggacucugcaca

SEQ ID NO: 1872224 - RNA, 14 nt, Human
auaacuaaauaaag

SEQ ID NO: 1872225 - RNA, 15 nt, Human
auaaauguacauuaa

SEQ ID NO: 1872226 - RNA, 18 nt, Human
uuaccugggcauucuugu

SEQ ID NO: 1872227 - RNA, 18 nt, Human
uuaaguugcugaugaacu

SEQ ID NO: 1872228 - RNA, 15 nt, Human
agggguaugucuuua

SEQ ID NO: 1872229 - RNA, 22 nt, Human
ugggguccuguggggcccccac

SEQ ID NO: 1872230 - RNA, 23 nt, Human
ugggguccuguggggcccccaca

SEQ ID NO: 1872231 - RNA, 20 nt, Human
agggcaggcccaaauuauca

SEQ ID NO: 1872232 - RNA, 13 nt, Human
agggaaauuucag

SEQ ID NO: 1872233 - RNA, 20 nt, Human
agggacacgggcagccuggc

SEQ ID NO: 1872234 - RNA, 23 nt, Human
agggacacgggcagccuggcucc

SEQ ID NO: 1872235 - RNA, 18 nt, Human
ugggagaccuguaaucau

SEQ ID NO: 1872236 - RNA, 13 nt, Human
aguaaaauccaca

SEQ ID NO: 1872237 - RNA, 22 nt, Human
uguauuacaaauccaaugaaau

SEQ ID NO: 1872238 - RNA, 13 nt, Human
uguauuacaaauc

SEQ ID NO: 1872239 - RNA, 14 nt, Human
uguaugucuuggac

SEQ ID NO: 1872240 - RNA, 19 nt, Human
uguaugucuuggacacugu

SEQ ID NO: 1872241 - RNA, 19 nt, Human
uggugcugcugcugcugug

SEQ ID NO: 1872242 - RNA, 12 nt, Human
uggugccuggcc

SEQ ID NO: 1872243 - RNA, 13 nt, Human
uggugccuggccu

SEQ ID NO: 1872244 - RNA, 14 nt, Human
uggugccuggccug

SEQ ID NO: 1872245 - RNA, 17 nt, Human
uggugccuggccuggca

SEQ ID NO: 1872246 - RNA, 18 nt, Human
uggugccuggccuggcac

SEQ ID NO: 1872247 - RNA, 19 nt, Human
uggugccuggccuggcaca

SEQ ID NO: 1872248 - RNA, 22 nt, Human
uggugccuggccuggcacacau

SEQ ID NO: 1872249 - RNA, 23 nt, Human
uggugccuggccuggcacacauc

SEQ ID NO: 1872250 - RNA, 24 nt, Human
uggugccuggccuggcacacauca

SEQ ID NO: 1872251 - RNA, 16 nt, Human
uguaaaggaauuuaaa

SEQ ID NO: 1872252 - RNA, 22 nt, Human
ugguuaggauggcaggacgugg

SEQ ID NO: 1872253 - RNA, 12 nt, Human
ugguuaggaugg

SEQ ID NO: 1872254 - RNA, 22 nt, Human
ugcuaaucagggaggucauuuu

SEQ ID NO: 1872255 - RNA, 23 nt, Human
ugcuaaucagggaggucauuuug

SEQ ID NO: 1872256 - RNA, 20 nt, Human
aggaagaucucugcagggcc

SEQ ID NO: 1872257 - RNA, 21 nt, Human
aggaagaucucugcagggccg

SEQ ID NO: 1872258 - RNA, 22 nt, Human
agcucccaggugcagccagagg

SEQ ID NO: 1872259 - RNA, 21 nt, Human
agcucccaggugcagccagag

SEQ ID NO: 1872260 - RNA, 20 nt, Human
agcucccaggugcagccaga

SEQ ID NO: 1872261 - RNA, 15 nt, Human
agcucccaggugcag

SEQ ID NO: 1872262 - RNA, 17 nt, Human
ugccauagucacauggc

SEQ ID NO: 1872263 - RNA, 16 nt, Human
ugccauagucacaugg

SEQ ID NO: 1872264 - RNA, 16 nt, Human
uggaguucuugugcca

SEQ ID NO: 1872265 - RNA, 14 nt, Human
uggaguucuugugc

SEQ ID NO: 1872266 - RNA, 15 nt, Human
uggaguucuugugcc

SEQ ID NO: 1872267 - RNA, 14 nt, Human
uggaguugaaaauc

SEQ ID NO: 1872268 - RNA, 22 nt, Human
aggcccaaauuaucaagcuaau

SEQ ID NO: 1872269 - RNA, 23 nt, Human
aggcccaaauuaucaagcuaaua

SEQ ID NO: 1872270 - RNA, 15 nt, Human
aggagcacacccagc

SEQ ID NO: 1872271 - RNA, 17 nt, Human
aggagagucacagaaca

SEQ ID NO: 1872272 - RNA, 19 nt, Human
aggacgugggcugggccca

SEQ ID NO: 1872273 - RNA, 15 nt, Human
aggacgugggcuggg

SEQ ID NO: 1872274 - RNA, 16 nt, Human
ugcaggugaaacccag

SEQ ID NO: 1872275 - RNA, 14 nt, Human
agccuuaccacgca

SEQ ID NO: 1872276 - RNA, 21 nt, Human
agccugugcauguaugucuug

SEQ ID NO: 1872277 - RNA, 13 nt, Human
ugauuucauuuca

SEQ ID NO: 1872278 - RNA, 17 nt, Human
ugauuucauuucaacug

SEQ ID NO: 1872279 - RNA, 13 nt, Human
ugcaacaaaauuc

SEQ ID NO: 1872280 - RNA, 23 nt, Human
ugcacaugucuuguacaugugua

SEQ ID NO: 1872281 - RNA, 12 nt, Human
ugauggccacaa

SEQ ID NO: 1872282 - RNA, 13 nt, Human
ugagugcagaccc

SEQ ID NO: 1872283 - RNA, 21 nt, Human
ugagugcagaccccuuggcca

SEQ ID NO: 1872284 - RNA, 15 nt, Human
ugaaauuguauuaca

SEQ ID NO: 1872285 - RNA, 17 nt, Human
ugaaagucuugugacua

SEQ ID NO: 1872286 - RNA, 18 nt, Human
ugaaagucuugugacuag

SEQ ID NO: 1872287 - RNA, 20 nt, Human
ugaaagucuugugacuagug

SEQ ID NO: 1872288 - RNA, 21 nt, Human
ugaaagucuugugacuagugc

SEQ ID NO: 1872289 - RNA, 22 nt, Human
ugaaagucuugugacuagugcu

SEQ ID NO: 1872290 - RNA, 23 nt, Human
ugaaagucuugugacuagugcug

SEQ ID NO: 1872291 - RNA, 17 nt, Human
ugaacucaacuuugaca

SEQ ID NO: 1872292 - RNA, 15 nt, Human
agaugccugaagcca

SEQ ID NO: 1872293 - RNA, 21 nt, Human
agaucauccagaaguuccuca

SEQ ID NO: 1872294 - RNA, 18 nt, Human
agaccuggacacaggccu

SEQ ID NO: 1872295 - RNA, 16 nt, Human
agaccuggacacaggc

SEQ ID NO: 1872296 - RNA, 19 nt, Human
agaccuggacacaggccug

SEQ ID NO: 1872297 - RNA, 15 nt, Human
agaccucagggcaca

SEQ ID NO: 1872298 - RNA, 14 nt, Human
agaccucagggcac

SEQ ID NO: 1872299 - RNA, 13 nt, Human
agaccucagggca

SEQ ID NO: 1872300 - RNA, 21 nt, Human
ucuuaaucuuuucacaaauaa

SEQ ID NO: 1872301 - RNA, 22 nt, Human
ucuuaaucuuuucacaaauaaa

SEQ ID NO: 1872302 - RNA, 19 nt, Human
ucuuaaucuuuucacaaau

SEQ ID NO: 1872303 - RNA, 20 nt, Human
ucuuaaucuuuucacaaaua

SEQ ID NO: 1872304 - RNA, 17 nt, Human
ucugggguuaugauggc

SEQ ID NO: 1872305 - RNA, 18 nt, Human
ucuccagggucagaaaca

SEQ ID NO: 1872306 - RNA, 21 nt, Human
ucuccagggucagaaacagga

SEQ ID NO: 1872307 - RNA, 14 nt, Human
acuucgggcuggcc

SEQ ID NO: 1872308 - RNA, 13 nt, Human
agaaacaggaccg

SEQ ID NO: 1872309 - RNA, 17 nt, Human
ucgacuucgggcuggcc

SEQ ID NO: 1872310 - RNA, 15 nt, Human
uccuuccagcccaga

SEQ ID NO: 1872311 - RNA, 17 nt, Human
acuggaugcagaaacag

SEQ ID NO: 1872312 - RNA, 18 nt, Human
acuggaugcagaaacagu

SEQ ID NO: 1872313 - RNA, 13 nt, Human
acuuaauaaugug

SEQ ID NO: 1872314 - RNA, 17 nt, Human
acuuaauaauguguaca

SEQ ID NO: 1872315 - RNA, 20 nt, Human
ucuaaagccauuguaguccu

SEQ ID NO: 1872316 - RNA, 16 nt, Human
acgugggcaaacaggc

SEQ ID NO: 1872317 - RNA, 23 nt, Human
acgugggcugggcccacaaaggc

SEQ ID NO: 1872318 - RNA, 19 nt, Human
acgugggcaaacaggcagu

SEQ ID NO: 1872319 - RNA, 22 nt, Human
acgggcagccuggcucccagga

SEQ ID NO: 1872320 - RNA, 17 nt, Human
acgggcagccuggcucc

SEQ ID NO: 1872321 - RNA, 13 nt, Human
uccccaccaguga

SEQ ID NO: 1872322 - RNA, 21 nt, Human
uccccaccagugaaugaaagu

SEQ ID NO: 1872323 - RNA, 15 nt, Human
acuaacauauaaugu

SEQ ID NO: 1872324 - RNA, 17 nt, Human
acuaacauauaauguug

SEQ ID NO: 1872325 - RNA, 14 nt, Human
acgagaaaacaaua

SEQ ID NO: 1872326 - RNA, 22 nt, Human
accugccacccugggccuggca

SEQ ID NO: 1872327 - RNA, 23 nt, Human
acauauaauguuguuauuuaaag

SEQ ID NO: 1872328 - RNA, 23 nt, Human
acauauggacucugcacaugaau

SEQ ID NO: 1872329 - RNA, 19 nt, Human
acauaugcaccuugugucu

SEQ ID NO: 1872330 - RNA, 20 nt, Human
acauaugcaccuugugucug

SEQ ID NO: 1872331 - RNA, 15 nt, Human
acauaugcaccuugu

SEQ ID NO: 1872332 - RNA, 16 nt, Human
acauaugcaccuugug

SEQ ID NO: 1872333 - RNA, 17 nt, Human
acauaugcaccuugugu

SEQ ID NO: 1872334 - RNA, 18 nt, Human
acauaugcaccuuguguc

SEQ ID NO: 1872335 - RNA, 22 nt, Human
ucaagaucaaugaaaugauguc

SEQ ID NO: 1872336 - RNA, 16 nt, Human
ucaagaucaaugaaau

SEQ ID NO: 1872337 - RNA, 13 nt, Human
acauucaggagcu

SEQ ID NO: 1872338 - RNA, 16 nt, Human
acaugaagaagcuaaa

SEQ ID NO: 1872339 - RNA, 14 nt, Human
ucaaagcugaaaug

SEQ ID NO: 1872340 - RNA, 22 nt, Human
ucaaaggagagucacagaacaa

SEQ ID NO: 1872341 - RNA, 23 nt, Human
accauuucuugagguaaaagcau

SEQ ID NO: 1872342 - RNA, 22 nt, Human
acccagacggcuccacuaggac

SEQ ID NO: 1872343 - RNA, 21 nt, Human
acccagacggcuccacuagga

SEQ ID NO: 1872344 - RNA, 17 nt, Human
acccagacggcuccacu

SEQ ID NO: 1872345 - RNA, 17 nt, Human
accauguacaugaagaa

SEQ ID NO: 1872346 - RNA, 11 nt, Human
accauguacau

SEQ ID NO: 1872347 - RNA, 23 nt, Human
ucagaagggagcuagccagagga

SEQ ID NO: 1872348 - RNA, 21 nt, Human
ucagaagggagcuagccagag

SEQ ID NO: 1872349 - RNA, 16 nt, Human
ucaccuucaguaaccc

SEQ ID NO: 1872350 - RNA, 15 nt, Human
ucaauucuugccaaa

SEQ ID NO: 1872351 - RNA, 11 nt, Human
ucacaaauaaa

SEQ ID NO: 1872352 - RNA, 13 nt, Human
accaaucauuuua

SEQ ID NO: 1872353 - RNA, 20 nt, Human
accaaucauuuuaauuauua

SEQ ID NO: 1872354 - RNA, 16 nt, Human
acagaugggcaaauua

SEQ ID NO: 1872355 - RNA, 12 nt, Human
uauauuuacaaa

SEQ ID NO: 1872356 - RNA, 12 nt, Human
acacucuuugua

SEQ ID NO: 1872357 - RNA, 16 nt, Human
acacucuuuguaagag

SEQ ID NO: 1872358 - RNA, 22 nt, Human
uagauaggucagugcaaauacu

SEQ ID NO: 1872359 - RNA, 15 nt, Human
uagaugaacucaacu

SEQ ID NO: 1872360 - RNA, 16 nt, Human
uagcuacuaauuuuaa

SEQ ID NO: 1872361 - RNA, 15 nt, Human
acaagcaaacccaga

SEQ ID NO: 1872362 - RNA, 15 nt, Human
aauaacgauaaaaga

SEQ ID NO: 1872363 - RNA, 21 nt, Human
aauaacaaugaaaguugauaa

SEQ ID NO: 1872364 - RNA, 20 nt, Human
aauaaauuguaauuguaaag

SEQ ID NO: 1872365 - RNA, 21 nt, Human
aauacaaagaaccaagaaaaa

SEQ ID NO: 1872366 - RNA, 18 nt, Human
aauaggcguaacuaauuu

SEQ ID NO: 1872367 - RNA, 13 nt, Human
aauaucauucagc

SEQ ID NO: 1872368 - RNA, 14 nt, Human
aauaucauucagca

SEQ ID NO: 1872369 - RNA, 15 nt, Human
aauaucauucagcaa

SEQ ID NO: 1872370 - RNA, 16 nt, Human
aauaucauucagcaac

SEQ ID NO: 1872371 - RNA, 14 nt, Human
aaucuuauaauuua

SEQ ID NO: 1872372 - RNA, 16 nt, Human
aaucuuauaauuuaaa

SEQ ID NO: 1872373 - RNA, 15 nt, Human
aaucaucaagucuuu

SEQ ID NO: 1872374 - RNA, 20 nt, Human
uaauaaaauaucauucagca

SEQ ID NO: 1872375 - RNA, 21 nt, Human
uaauaaaauaucauucagcaa

SEQ ID NO: 1872376 - RNA, 12 nt, Human
uaauaaaauauc

SEQ ID NO: 1872377 - RNA, 15 nt, Human
uaauaaaauaucauu

SEQ ID NO: 1872378 - RNA, 16 nt, Human
uaauaaaauaucauuc

SEQ ID NO: 1872379 - RNA, 17 nt, Human
uaauaaaauaucauuca

SEQ ID NO: 1872380 - RNA, 18 nt, Human
uaauaaaauaucauucag

SEQ ID NO: 1872381 - RNA, 14 nt, Human
uaaguuucugggac

SEQ ID NO: 1872382 - RNA, 16 nt, Human
uaaguuugauuucauu

SEQ ID NO: 1872383 - RNA, 20 nt, Human
uaaugaccacaccugccucu

SEQ ID NO: 1872384 - RNA, 15 nt, Human
uaaucauauaauaaa

SEQ ID NO: 1872385 - RNA, 20 nt, Human
uaaucauauaauaaauguac

SEQ ID NO: 1872386 - RNA, 22 nt, Human
uaaucauauaauaaauguacau

SEQ ID NO: 1872387 - RNA, 18 nt, Human
uaaucaauguuucuucua

SEQ ID NO: 1872388 - RNA, 19 nt, Human
aaugaccacaccugccucu

SEQ ID NO: 1872389 - RNA, 19 nt, Human
aauggacuuuuguacauag

SEQ ID NO: 1872390 - RNA, 20 nt, Human
aaugcagucuguccaggcuc

SEQ ID NO: 1872391 - RNA, 19 nt, Human
aaugcagucuguccaggcu

SEQ ID NO: 1872392 - RNA, 20 nt, Human
gugccguguguugcaugcag

SEQ ID NO: 1872393 - RNA, 14 nt, Human
gugccucauugcuu

SEQ ID NO: 1872394 - RNA, 13 nt, Human
aagcaagacugag

SEQ ID NO: 1872395 - RNA, 15 nt, Human
aagaccucagggcac

SEQ ID NO: 1872396 - RNA, 15 nt, Human
guuugauuucauuaa

SEQ ID NO: 1872397 - RNA, 22 nt, Human
guuagucauuugcugagcaugu

SEQ ID NO: 1872398 - RNA, 12 nt, Human
guuagucauuug

SEQ ID NO: 1872399 - RNA, 20 nt, Human
gugugucuuuccucccugaa

SEQ ID NO: 1872400 - RNA, 17 nt, Human
aagccugggauugacag

SEQ ID NO: 1872401 - RNA, 19 nt, Human
guucauauguaccauguac

SEQ ID NO: 1872402 - RNA, 22 nt, Human
guucauauguaccauguacaug

SEQ ID NO: 1872403 - RNA, 19 nt, Human
aagcuuauuaaugcuaagg

SEQ ID NO: 1872404 - RNA, 14 nt, Human
aagcuuauuaaugc

SEQ ID NO: 1872405 - RNA, 15 nt, Human
aagcuuauuaaugcu

SEQ ID NO: 1872406 - RNA, 16 nt, Human
aagcuuauuaaugcua

SEQ ID NO: 1872407 - RNA, 17 nt, Human
aagcuuauuaaugcuaa

SEQ ID NO: 1872408 - RNA, 18 nt, Human
aagcuuauuaaugcuaag

SEQ ID NO: 1872409 - RNA, 20 nt, Human
aagcuuauuaaugcuaaggg

SEQ ID NO: 1872410 - RNA, 19 nt, Human
gucccaaacagcugccucu

SEQ ID NO: 1872411 - RNA, 15 nt, Human
guccgaucuuugacu

SEQ ID NO: 1872412 - RNA, 23 nt, Human
aacaauuuuaggaggaccagagc

SEQ ID NO: 1872413 - RNA, 21 nt, Human
aacaagccuccuuuuaaagua

SEQ ID NO: 1872414 - RNA, 21 nt, Human
gucauuugcugagcauguacu

SEQ ID NO: 1872415 - RNA, 22 nt, Human
gucauuugcugagcauguacug

SEQ ID NO: 1872416 - RNA, 18 nt, Human
aaccucucacuucacccu

SEQ ID NO: 1872417 - RNA, 17 nt, Human
aacccagucacugugag

SEQ ID NO: 1872418 - RNA, 14 nt, Human
aaaugcauuucuaa

SEQ ID NO: 1872419 - RNA, 18 nt, Human
guaggacccaagcagaga

SEQ ID NO: 1872420 - RNA, 16 nt, Human
aaauccuuuacuguua

SEQ ID NO: 1872421 - RNA, 17 nt, Human
aaauuucagcagcugca

SEQ ID NO: 1872422 - RNA, 18 nt, Human
aaauuucagcagcugcag

SEQ ID NO: 1872423 - RNA, 14 nt, Human
aaauuagaugaacu

SEQ ID NO: 1872424 - RNA, 15 nt, Human
aaauuaucaagcuaa

SEQ ID NO: 1872425 - RNA, 16 nt, Human
aaauuaucaagcuaau

SEQ ID NO: 1872426 - RNA, 17 nt, Human
aaauuaucaagcuaaua

SEQ ID NO: 1872427 - RNA, 18 nt, Human
aaauuaucaagcuaauaa

SEQ ID NO: 1872428 - RNA, 19 nt, Human
aaauuaucaagcuaauaaa

SEQ ID NO: 1872429 - RNA, 20 nt, Human
aaauuaucaagcuaauaaaa

SEQ ID NO: 1872430 - RNA, 24 nt, Human
caagaccucagggcacaaagaugg

SEQ ID NO: 1872431 - RNA, 23 nt, Human
caagaccucagggcacaaagaug

SEQ ID NO: 1872432 - RNA, 16 nt, Human
caagaccucagggcac

SEQ ID NO: 1872433 - RNA, 15 nt, Human
caagaccucagggca

SEQ ID NO: 1872434 - RNA, 13 nt, Human
caagaaaguuucc

SEQ ID NO: 1872435 - RNA, 14 nt, Human
caagaaaguuuccc

SEQ ID NO: 1872436 - RNA, 14 nt, Human
caagccagggugug

SEQ ID NO: 1872437 - RNA, 18 nt, Human
caagccagggugugucuc

SEQ ID NO: 1872438 - RNA, 22 nt, Human
caacaguuuuuuaugcuaauca

SEQ ID NO: 1872439 - RNA, 19 nt, Human
caaauugccuucauuuuau

SEQ ID NO: 1872440 - RNA, 16 nt, Human
caaaggguccagaagg

SEQ ID NO: 1872441 - RNA, 20 nt, Human
caaaggagagucacagaaca

SEQ ID NO: 1872442 - RNA, 10 nt, Human
cacaaauaaa

SEQ ID NO: 1872443 - RNA, 20 nt, Human
caccagugaaugaaagucuu

SEQ ID NO: 1872444 - RNA, 22 nt, Human
caccagugaaugaaagucuugu

SEQ ID NO: 1872445 - RNA, 24 nt, Human
cacaugaaucccacccacauguga

SEQ ID NO: 1872446 - RNA, 12 nt, Human
cacagcccagcc

SEQ ID NO: 1872447 - RNA, 13 nt, Human
cacagcccagcca

SEQ ID NO: 1872448 - RNA, 16 nt, Human
cacagcccagccacgg

SEQ ID NO: 1872449 - RNA, 23 nt, Human
cacagcccagccacggacgcugg

SEQ ID NO: 1872450 - RNA, 20 nt, Human
cacccaagaccucagggcac

SEQ ID NO: 1872451 - RNA, 13 nt, Human
uuuuuuaugcuaa

SEQ ID NO: 1872452 - RNA, 16 nt, Human
uuuuuuaugcuaauca

SEQ ID NO: 1872453 - RNA, 23 nt, Human
uuugcauaguaccaaucauuuua

SEQ ID NO: 1872454 - RNA, 19 nt, Human
uuuuaucauuuucaaaaug

SEQ ID NO: 1872455 - RNA, 13 nt, Human
uuuucacaaauaa

SEQ ID NO: 1872456 - RNA, 14 nt, Human
uuuucacaaauaaa

SEQ ID NO: 1872457 - RNA, 17 nt, Human
uuuccucuuccugccua

SEQ ID NO: 1872458 - RNA, 20 nt, Human
uuuccugagaccacagagag

SEQ ID NO: 1872459 - RNA, 15 nt, Human
uuucagcagcugcag

SEQ ID NO: 1872460 - RNA, 20 nt, Human
uuuaucuaauaccucugugu

SEQ ID NO: 1872461 - RNA, 23 nt, Human
uucaugauuucauuucaacuguu

SEQ ID NO: 1872462 - RNA, 17 nt, Human
uucaugauuucauuuca

SEQ ID NO: 1872463 - RNA, 15 nt, Human
uucauuucaacuguu

SEQ ID NO: 1872464 - RNA, 21 nt, Human
uuccccaccagugaaugaaag

SEQ ID NO: 1872465 - RNA, 21 nt, Human
uuccuuucauuuacuguggcu

SEQ ID NO: 1872466 - RNA, 14 nt, Human
uuccuuccagccca

SEQ ID NO: 1872467 - RNA, 18 nt, Human
uuccugccgcaacaguuu

SEQ ID NO: 1872468 - RNA, 14 nt, Human
uucuccagggucag

SEQ ID NO: 1872469 - RNA, 15 nt, Human
uugcguggacucugc

SEQ ID NO: 1872470 - RNA, 18 nt, Human
uugcguggacucugcaca

SEQ ID NO: 1872471 - RNA, 14 nt, Human
uuguauuacaaauc

SEQ ID NO: 1872472 - RNA, 16 nt, Human
uuguaaaggaauuuaa

SEQ ID NO: 1872473 - RNA, 22 nt, Human
uugcauaguaccaaucauuuua

SEQ ID NO: 1872474 - RNA, 14 nt, Human
uucugagcauuuaa

SEQ ID NO: 1872475 - RNA, 12 nt, Human
ugugcaguguug

SEQ ID NO: 1872476 - RNA, 20 nt, Human
ugugcauguaugucuuggac

SEQ ID NO: 1872477 - RNA, 23 nt, Human
ugugcauguaugucuuggacacu

SEQ ID NO: 1872478 - RNA, 22 nt, Human
uguggcuucuuaaucuuuucac

SEQ ID NO: 1872479 - RNA, 17 nt, Human
ugugacacauaugcacc

SEQ ID NO: 1872480 - RNA, 22 nt, Human
ugugacacauaugcaccuugug

SEQ ID NO: 1872481 - RNA, 13 nt, Human
ugucugcccccuc

SEQ ID NO: 1872482 - RNA, 17 nt, Human
uguaaucauauaauaaa

SEQ ID NO: 1872483 - RNA, 17 nt, Human
uguaaaauuucacuuaa

SEQ ID NO: 1872484 - RNA, 17 nt, Human
uguagauaauacaguuc

SEQ ID NO: 1872485 - RNA, 17 nt, Human
uguacugagccuuguaa

SEQ ID NO: 1872486 - RNA, 22 nt, Human
uguacugagccuuguaauucua

SEQ ID NO: 1872487 - RNA, 19 nt, Human
uguacugagccuuguaauu

SEQ ID NO: 1872488 - RNA, 20 nt, Human
uguacugagccuuguaauuc

SEQ ID NO: 1872489 - RNA, 14 nt, Human
uguauuuauaaaua

SEQ ID NO: 1872490 - RNA, 21 nt, Human
uguauuuauaaauauauuuaa

SEQ ID NO: 1872491 - RNA, 14 nt, Human
uguguagccugugc

SEQ ID NO: 1872492 - RNA, 15 nt, Human
uguuacauuauuauc

SEQ ID NO: 1872493 - RNA, 19 nt, Human
uguuuacacucuuuguaag

SEQ ID NO: 1872494 - RNA, 16 nt, Human
uguuuacacucuuugu

SEQ ID NO: 1872495 - RNA, 18 nt, Human
uguuuacacucuuuguaa

SEQ ID NO: 1872496 - RNA, 12 nt, Human
uuacauggcucu

SEQ ID NO: 1872497 - RNA, 22 nt, Human
uuaaugucaauucuugccaaau

SEQ ID NO: 1872498 - RNA, 14 nt, Human
uuaauuauuauucu

SEQ ID NO: 1872499 - RNA, 17 nt, Human
uuaauuauuauucuuca

SEQ ID NO: 1872500 - RNA, 14 nt, Human
uuaauuauuauuua

SEQ ID NO: 1872501 - RNA, 13 nt, Human
uuaaugcuaaggg

SEQ ID NO: 1872502 - RNA, 21 nt, Human
uuaaugcuaagggcaggccca

SEQ ID NO: 1872503 - RNA, 11 nt, Human
uuaaaacaaga

SEQ ID NO: 1872504 - RNA, 19 nt, Human
uuaaaacaagaaaguuucc

SEQ ID NO: 1872505 - RNA, 20 nt, Human
uuaaaacaagaaaguuuccc

SEQ ID NO: 1872506 - RNA, 17 nt, Human
uggcgccuccgagggac

SEQ ID NO: 1872507 - RNA, 13 nt, Human
uggccagagagcc

SEQ ID NO: 1872508 - RNA, 23 nt, Human
uggccagagagccuggugcugcu

SEQ ID NO: 1872509 - RNA, 15 nt, Human
uggaaccaggcuugg

SEQ ID NO: 1872510 - RNA, 14 nt, Human
uggaauguaaucaa

SEQ ID NO: 1872511 - RNA, 19 nt, Human
ugcacauauggacucugca

SEQ ID NO: 1872512 - RNA, 14 nt, Human
ugcacauauggacu

SEQ ID NO: 1872513 - RNA, 15 nt, Human
ugcacauauggacuc

SEQ ID NO: 1872514 - RNA, 17 nt, Human
ugcacauauggacucug

SEQ ID NO: 1872515 - RNA, 18 nt, Human
ugcacauauggacucugc

SEQ ID NO: 1872516 - RNA, 20 nt, Human
ugaaggcuggcaugauccaa

SEQ ID NO: 1872517 - RNA, 14 nt, Human
ugcagccagaggca

SEQ ID NO: 1872518 - RNA, 13 nt, Human
ugcagccagaggc

SEQ ID NO: 1872519 - RNA, 11 nt, Human
ugcagccagag

SEQ ID NO: 1872520 - RNA, 15 nt, Human
ugcauuuuuuaaaac

SEQ ID NO: 1872521 - RNA, 17 nt, Human
ugcauuuuuuaaaacaa

SEQ ID NO: 1872522 - RNA, 19 nt, Human
ugcauuuuuuaaaacaaga

SEQ ID NO: 1872523 - RNA, 15 nt, Human
ugccuagaggcccca

SEQ ID NO: 1872524 - RNA, 22 nt, Human
ugccuggccuggcacacaucag

SEQ ID NO: 1872525 - RNA, 17 nt, Human
ugccuggccuggcacac

SEQ ID NO: 1872526 - RNA, 20 nt, Human
ugccuggccuggcacacauc

SEQ ID NO: 1872527 - RNA, 16 nt, Human
ugccuggccuggcaca

SEQ ID NO: 1872528 - RNA, 21 nt, Human
ugcugaugaacucuuaaucaa

SEQ ID NO: 1872529 - RNA, 16 nt, Human
ugcguggacucugcac

SEQ ID NO: 1872530 - RNA, 17 nt, Human
ugcguggacucugcaca

SEQ ID NO: 1872531 - RNA, 23 nt, Human
ugcgugguguggagugugugucu

SEQ ID NO: 1872532 - RNA, 18 nt, Human
ugcguggacucugcacau

SEQ ID NO: 1872533 - RNA, 22 nt, Human
ugcguggacucugcacaugucu

SEQ ID NO: 1872534 - RNA, 17 nt, Human
ucuucuagguucuaaaa

SEQ ID NO: 1872535 - RNA, 16 nt, Human
ucuugugacuagugcu

SEQ ID NO: 1872536 - RNA, 18 nt, Human
ucuugugacuagugcuga

SEQ ID NO: 1872537 - RNA, 19 nt, Human
ucuugugacuagugcugaa

SEQ ID NO: 1872538 - RNA, 21 nt, Human
ucuugugacuagugcugaagc

SEQ ID NO: 1872539 - RNA, 22 nt, Human
ucuugugacuagugcugaagcu

SEQ ID NO: 1872540 - RNA, 11 nt, Human
ucuugugacua

SEQ ID NO: 1872541 - RNA, 14 nt, Human
ucuugugacuagug

SEQ ID NO: 1872542 - RNA, 21 nt, Human
ucugcacaugucuuguacaug

SEQ ID NO: 1872543 - RNA, 22 nt, Human
ucugcacaugucuuguacaugu

SEQ ID NO: 1872544 - RNA, 19 nt, Human
ucuuuucuggaauguaauc

SEQ ID NO: 1872545 - RNA, 19 nt, Human
ucuuucaauaaacuaaaga

SEQ ID NO: 1872546 - RNA, 20 nt, Human
ucuuucaauaaacuaaagaa

SEQ ID NO: 1872547 - RNA, 21 nt, Human
ucuuucaauaaacuaaagaaa

SEQ ID NO: 1872548 - RNA, 22 nt, Human
ugaacuuguaaaggaauuuaaa

SEQ ID NO: 1872549 - RNA, 16 nt, Human
ugaaggcuggcaugau

SEQ ID NO: 1872550 - RNA, 13 nt, Human
ugaaggcuggcau

SEQ ID NO: 1872551 - RNA, 12 nt, Human
ugaaggcuggca

SEQ ID NO: 1872552 - RNA, 11 nt, Human
ugaaggcuggc

SEQ ID NO: 1872553 - RNA, 19 nt, Human
ugaaauggacuuuuguaca

SEQ ID NO: 1872554 - RNA, 21 nt, Human
ugaacucuuaaucaaauagca

SEQ ID NO: 1872555 - RNA, 21 nt, Human
uccuguaguugcguggacucu

SEQ ID NO: 1872556 - RNA, 22 nt, Human
uccuguaguugcguggacucug

SEQ ID NO: 1872557 - RNA, 23 nt, Human
uccuguaguugcguggacucugc

SEQ ID NO: 1872558 - RNA, 22 nt, Human
ucuaguacuugggagaccugua

SEQ ID NO: 1872559 - RNA, 20 nt, Human
ucugcacaugucuuguacau

SEQ ID NO: 1872560 - RNA, 10 nt, Human
ucauucagca

SEQ ID NO: 1872561 - RNA, 19 nt, Human
uccagaaggagacaggcag

SEQ ID NO: 1872562 - RNA, 14 nt, Human
uccagaaggagaca

SEQ ID NO: 1872563 - RNA, 20 nt, Human
uccacuucuuucagcagacu

SEQ ID NO: 1872564 - RNA, 13 nt, Human
ucagcagacugau

SEQ ID NO: 1872565 - RNA, 17 nt, Human
ucacuugugcaguguug

SEQ ID NO: 1872566 - RNA, 12 nt, Human
uauuuuuuaauu

SEQ ID NO: 1872567 - RNA, 15 nt, Human
uauuuuuuaauuauu

SEQ ID NO: 1872568 - RNA, 13 nt, Human
ucaagcuaauaaa

SEQ ID NO: 1872569 - RNA, 19 nt, Human
ucaagcuaauaaaauauca

SEQ ID NO: 1872570 - RNA, 20 nt, Human
ucaagcuaauaaaauaucau

SEQ ID NO: 1872571 - RNA, 22 nt, Human
ucaagcuaauaaaauaucauuc

SEQ ID NO: 1872572 - RNA, 23 nt, Human
ucaagcuaauaaaauaucauuca

SEQ ID NO: 1872573 - RNA, 23 nt, Human
guuuccuuucauuuacuguggcu

SEQ ID NO: 1872574 - RNA, 17 nt, Human
guuuccuuucauuuacu

SEQ ID NO: 1872575 - RNA, 20 nt, Human
guuuccuuucauuuacugug

SEQ ID NO: 1872576 - RNA, 17 nt, Human
guuuccuuccagcccag

SEQ ID NO: 1872577 - RNA, 14 nt, Human
uaaaggaauuuaaa

SEQ ID NO: 1872578 - RNA, 17 nt, Human
uaaauaaaaauaauccu

SEQ ID NO: 1872579 - RNA, 18 nt, Human
uaaauauaugcuaagucu

SEQ ID NO: 1872580 - RNA, 17 nt, Human
uaaauauauuuaagaua

SEQ ID NO: 1872581 - RNA, 22 nt, Human
uaaauauauuuaagauaauuau

SEQ ID NO: 1872582 - RNA, 12 nt, Human
uaagauaauuau

SEQ ID NO: 1872583 - RNA, 13 nt, Human
uaagauaauuaua

SEQ ID NO: 1872584 - RNA, 16 nt, Human
uaauauacuauauuua

SEQ ID NO: 1872585 - RNA, 17 nt, Human
uaauaaauguacauuaa

SEQ ID NO: 1872586 - RNA, 19 nt, Human
uaauaaauguacauuaauu

SEQ ID NO: 1872587 - RNA, 18 nt, Human
uaauugguccgaucuuug

SEQ ID NO: 1872588 - RNA, 15 nt, Human
uacuguggcuucuua

SEQ ID NO: 1872589 - RNA, 21 nt, Human
uacuugggagaccuguaauca

SEQ ID NO: 1872590 - RNA, 23 nt, Human
uacuugggagaccuguaaucaua

SEQ ID NO: 1872591 - RNA, 19 nt, Human
uacugagccuuguaauucu

SEQ ID NO: 1872592 - RNA, 23 nt, Human
uacugagccuuguaauucuaaau

SEQ ID NO: 1872593 - RNA, 15 nt, Human
uacugagccuuguaa

SEQ ID NO: 1872594 - RNA, 18 nt, Human
uacugagccuuguaauuc

SEQ ID NO: 1872595 - RNA, 22 nt, Human
uaccaaucauuuuaauuauuau

SEQ ID NO: 1872596 - RNA, 15 nt, Human
uaccaaucauuuuaa

SEQ ID NO: 1872597 - RNA, 19 nt, Human
uaccaaucauuuuaauuau

SEQ ID NO: 1872598 - RNA, 20 nt, Human
uaccaaucauuuuaauuauu

SEQ ID NO: 1872599 - RNA, 13 nt, Human
uacagaauuuuau

SEQ ID NO: 1872600 - RNA, 22 nt, Human
uacacugugacuuaagaagccu

SEQ ID NO: 1872601 - RNA, 14 nt, Human
uacaggauuugaaa

SEQ ID NO: 1872602 - RNA, 15 nt, Human
uacacacauccacgc

SEQ ID NO: 1872603 - RNA, 21 nt, Human
uagcuccccgcuucugccugc

SEQ ID NO: 1872604 - RNA, 15 nt, Human
uagcagacaguguuu

SEQ ID NO: 1872605 - RNA, 17 nt, Human
uauauggccucaagauc

SEQ ID NO: 1872606 - RNA, 21 nt, Human
uagucacauggccuaugcaca

SEQ ID NO: 1872607 - RNA, 23 nt, Human
uagucacauggccuaugcacaua

SEQ ID NO: 1872608 - RNA, 12 nt, Human
uagugcugaagc

SEQ ID NO: 1872609 - RNA, 14 nt, Human
uagugcugaagcuu

SEQ ID NO: 1872610 - RNA, 15 nt, Human
uagugcugaagcuua

SEQ ID NO: 1872611 - RNA, 17 nt, Human
uagugcugaagcuuauu

SEQ ID NO: 1872612 - RNA, 18 nt, Human
uagugcugaagcuuauua

SEQ ID NO: 1872613 - RNA, 22 nt, Human
uagugcugaagcuuauuaaugc

SEQ ID NO: 1872614 - RNA, 19 nt, Human
uagugcugaagcuuauuaa

SEQ ID NO: 1872615 - RNA, 16 nt, Human
uauacuauauuuaugg

SEQ ID NO: 1872616 - RNA, 15 nt, Human
uauaaauauauuuaa

SEQ ID NO: 1872617 - RNA, 22 nt, Human
ggcaccugccacccugggccug

SEQ ID NO: 1872618 - RNA, 13 nt, Human
ggccacgcagcca

SEQ ID NO: 1872619 - RNA, 14 nt, Human
ggccacgcagccag

SEQ ID NO: 1872620 - RNA, 15 nt, Human
ggccacgcagccagg

SEQ ID NO: 1872621 - RNA, 16 nt, Human
ggccacgcagccagga

SEQ ID NO: 1872622 - RNA, 18 nt, Human
ggccacgcagccaggaca

SEQ ID NO: 1872623 - RNA, 19 nt, Human
ggccacgcagccaggacac

SEQ ID NO: 1872624 - RNA, 15 nt, Human
ggagccgggccgcag

SEQ ID NO: 1872625 - RNA, 21 nt, Human
ggacucugcacaugucuugua

SEQ ID NO: 1872626 - RNA, 15 nt, Human
ggacucugcacauga

SEQ ID NO: 1872627 - RNA, 20 nt, Human
ggacucugcacaugucuugu

SEQ ID NO: 1872628 - RNA, 13 nt, Human
ggacucugcacau

SEQ ID NO: 1872629 - RNA, 21 nt, Human
ggagaccuggacacaggccug

SEQ ID NO: 1872630 - RNA, 13 nt, Human
ggagauggaguuc

SEQ ID NO: 1872631 - RNA, 21 nt, Human
ggaaccguaggacccaagcag

SEQ ID NO: 1872632 - RNA, 16 nt, Human
ggaaccguaggaccca

SEQ ID NO: 1872633 - RNA, 20 nt, Human
ggaagaucucugcagggccg

SEQ ID NO: 1872634 - RNA, 19 nt, Human
ggaagaucucugcagggcc

SEQ ID NO: 1872635 - RNA, 20 nt, Human
ggaaaaaauaacaaugaaag

SEQ ID NO: 1872636 - RNA, 22 nt, Human
ggcuugaguuuaaauuguaaua

SEQ ID NO: 1872637 - RNA, 12 nt, Human
gggcaccugcca

SEQ ID NO: 1872638 - RNA, 14 nt, Human
gggcacccucccac

SEQ ID NO: 1872639 - RNA, 23 nt, Human
gggcacaggugucugcccccucu

SEQ ID NO: 1872640 - RNA, 23 nt, Human
gggcagggccgcccgggcccaga

SEQ ID NO: 1872641 - RNA, 15 nt, Human
gggcagggcucccac

SEQ ID NO: 1872642 - RNA, 18 nt, Human
gggcagggcucccacaga

SEQ ID NO: 1872643 - RNA, 13 nt, Human
gggcagggcagcc

SEQ ID NO: 1872644 - RNA, 14 nt, Human
gggcagggccgccc

SEQ ID NO: 1872645 - RNA, 22 nt, Human
gggcagggccgcccgggcccag

SEQ ID NO: 1872646 - RNA, 12 nt, Human
gggcccagagga

SEQ ID NO: 1872647 - RNA, 14 nt, Human
gggcccagaggagc

SEQ ID NO: 1872648 - RNA, 15 nt, Human
gggugaaggcuggca

SEQ ID NO: 1872649 - RNA, 14 nt, Human
gggugaaggcuggc

SEQ ID NO: 1872650 - RNA, 13 nt, Human
gggugaaggcugg

SEQ ID NO: 1872651 - RNA, 12 nt, Human
gggugaaggcug

SEQ ID NO: 1872652 - RNA, 17 nt, Human
ggucagaaacaggaccg

SEQ ID NO: 1872653 - RNA, 16 nt, Human
ggucagaaacaggacc

SEQ ID NO: 1872654 - RNA, 15 nt, Human
ggucagaaacaggac

SEQ ID NO: 1872655 - RNA, 18 nt, Human
ggucagaaacaggaccgg

SEQ ID NO: 1872656 - RNA, 15 nt, Human
gcgaccuuggccgca

SEQ ID NO: 1872657 - RNA, 15 nt, Human
gccgggccgcagacu

SEQ ID NO: 1872658 - RNA, 21 nt, Human
gcccaggugaguccuagagcu

SEQ ID NO: 1872659 - RNA, 23 nt, Human
gcccacaaaggcaaaggguccag

SEQ ID NO: 1872660 - RNA, 17 nt, Human
gcccaaauuaucaagcu

SEQ ID NO: 1872661 - RNA, 19 nt, Human
gcccaaauuaucaagcuaa

SEQ ID NO: 1872662 - RNA, 20 nt, Human
gcccaaauuaucaagcuaau

SEQ ID NO: 1872663 - RNA, 21 nt, Human
gcccaaauuaucaagcuaaua

SEQ ID NO: 1872664 - RNA, 21 nt, Human
gccacgugggcaaacaggcag

SEQ ID NO: 1872665 - RNA, 19 nt, Human
gccacugacugcagggaca

SEQ ID NO: 1872666 - RNA, 18 nt, Human
gccacugacugcagggac

SEQ ID NO: 1872667 - RNA, 14 nt, Human
gccagcguggcgca

SEQ ID NO: 1872668 - RNA, 16 nt, Human
gccagcguggcgcagu

SEQ ID NO: 1872669 - RNA, 13 nt, Human
gcauucuaguacu

SEQ ID NO: 1872670 - RNA, 21 nt, Human
gcacaugucuuguacaugugu

SEQ ID NO: 1872671 - RNA, 13 nt, Human
gcacaugucuugu

SEQ ID NO: 1872672 - RNA, 20 nt, Human
gcacaugucuuguacaugug

SEQ ID NO: 1872673 - RNA, 20 nt, Human
gcaggagcacacccagcccc

SEQ ID NO: 1872674 - RNA, 17 nt, Human
gcaggagcacacccagc

SEQ ID NO: 1872675 - RNA, 16 nt, Human
gcaggagcacacccag

SEQ ID NO: 1872676 - RNA, 13 nt, Human
gcagccuggcucc

SEQ ID NO: 1872677 - RNA, 19 nt, Human
gcagccuggcucccaggac

SEQ ID NO: 1872678 - RNA, 20 nt, Human
gcagccuggcucccaggaca

SEQ ID NO: 1872679 - RNA, 21 nt, Human
gcagccuggcucccaggacac

SEQ ID NO: 1872680 - RNA, 20 nt, Human
gauuucauuucaacuguuug

SEQ ID NO: 1872681 - RNA, 13 nt, Human
gauuucaugauuu

SEQ ID NO: 1872682 - RNA, 21 nt, Human
gauuucauuucaacuguuugc

SEQ ID NO: 1872683 - RNA, 15 nt, Human
gcaaacccagacggc

SEQ ID NO: 1872684 - RNA, 17 nt, Human
gauaggucagugcaaau

SEQ ID NO: 1872685 - RNA, 14 nt, Human
gauaauuauaauau

SEQ ID NO: 1872686 - RNA, 22 nt, Human
gaguucaauaaaugucuguuga

SEQ ID NO: 1872687 - RNA, 23 nt, Human
gaagucucuuuuuuuggcccagg

SEQ ID NO: 1872688 - RNA, 16 nt, Human
gaacucaacuuugaca

SEQ ID NO: 1872689 - RNA, 16 nt, Human
gaaauuguauuacaaa

SEQ ID NO: 1872690 - RNA, 18 nt, Human
gaaauuguauuacaaauc

SEQ ID NO: 1872691 - RNA, 20 nt, Human
gacgugggcugggcccacaa

SEQ ID NO: 1872692 - RNA, 13 nt, Human
gacgugggcuggg

SEQ ID NO: 1872693 - RNA, 18 nt, Human
gacggcuccacuaggacu

SEQ ID NO: 1872694 - RNA, 12 nt, Human
gacggcuccacu

SEQ ID NO: 1872695 - RNA, 19 nt, Human
gaccugguccacagggcac

SEQ ID NO: 1872696 - RNA, 18 nt, Human
gaccugguccacagggca

SEQ ID NO: 1872697 - RNA, 17 nt, Human
gaccugguccacagggc

SEQ ID NO: 1872698 - RNA, 12 nt, Human
gaccuguaauca

SEQ ID NO: 1872699 - RNA, 18 nt, Human
gaccuggcacuggaugca

SEQ ID NO: 1872700 - RNA, 22 nt, Human
gaccuggcacuggaugcagaaa

SEQ ID NO: 1872701 - RNA, 15 nt, Human
gacugaucaggaccu

SEQ ID NO: 1872702 - RNA, 23 nt, Human
gacugaccugguccacagggcac

SEQ ID NO: 1872703 - RNA, 22 nt, Human
gacugaccugguccacagggca

SEQ ID NO: 1872704 - RNA, 20 nt, Human
gacugaccugguccacaggg

SEQ ID NO: 1872705 - RNA, 19 nt, Human
gacugaccugguccacagg

SEQ ID NO: 1872706 - RNA, 15 nt, Human
gacugaccuggucca

SEQ ID NO: 1872707 - RNA, 17 nt, Human
gaccccgacgccacagc

SEQ ID NO: 1872708 - RNA, 18 nt, Human
gaccccgacgccacagcc

SEQ ID NO: 1872709 - RNA, 21 nt, Human
gaccccgacgccacagcccag

SEQ ID NO: 1872710 - RNA, 12 nt, Human
gaccacaccugc

SEQ ID NO: 1872711 - RNA, 16 nt, Human
gaccacaccugccucu

SEQ ID NO: 1872712 - RNA, 15 nt, Human
gacaguucauaugua

SEQ ID NO: 1872713 - RNA, 17 nt, Human
gacaguucauauguacc

SEQ ID NO: 1872714 - RNA, 20 nt, Human
gacacgggcagccuggcucc

SEQ ID NO: 1872715 - RNA, 17 nt, Human
gacacgggcagccuggc

SEQ ID NO: 1872716 - RNA, 20 nt, Human
cuugcuugauuguauggugg

SEQ ID NO: 1872717 - RNA, 22 nt, Human
cuuguuucaauuccaccugcaa

SEQ ID NO: 1872718 - RNA, 12 nt, Human
cuuguuucaauu

SEQ ID NO: 1872719 - RNA, 13 nt, Human
cuuguaauucuaa

SEQ ID NO: 1872720 - RNA, 15 nt, Human
cuuguaauucuaaau

SEQ ID NO: 1872721 - RNA, 16 nt, Human
cuuguaauucuaaaug

SEQ ID NO: 1872722 - RNA, 23 nt, Human
cuuguaauucuaaaugaauguuu

SEQ ID NO: 1872723 - RNA, 13 nt, Human
cuuggacacugua

SEQ ID NO: 1872724 - RNA, 19 nt, Human
gaaaauaacaauaaaagac

SEQ ID NO: 1872725 - RNA, 20 nt, Human
cuuucugaagccucacuuau

SEQ ID NO: 1872726 - RNA, 19 nt, Human
cuucgggcuggccaucugg

SEQ ID NO: 1872727 - RNA, 13 nt, Human
cuuccagcccaga

SEQ ID NO: 1872728 - RNA, 13 nt, Human
cuuauaauuuaaa

SEQ ID NO: 1872729 - RNA, 14 nt, Human
cuuauaauuuaaaa

SEQ ID NO: 1872730 - RNA, 15 nt, Human
cucuaauaucagcaa

SEQ ID NO: 1872731 - RNA, 14 nt, Human
cucucccauuuccu

SEQ ID NO: 1872732 - RNA, 19 nt, Human
cucugccacugacugcagg

SEQ ID NO: 1872733 - RNA, 20 nt, Human
cucauugcuuggaauucagc

SEQ ID NO: 1872734 - RNA, 17 nt, Human
cuccucacucaccuuca

SEQ ID NO: 1872735 - RNA, 23 nt, Human
cuggaauaauccuaaacauauga

SEQ ID NO: 1872736 - RNA, 14 nt, Human
cuggaauguaauca

SEQ ID NO: 1872737 - RNA, 15 nt, Human
cuggaauguaaucaa

SEQ ID NO: 1872738 - RNA, 20 nt, Human
cuggaauguaaucaauguuu

SEQ ID NO: 1872739 - RNA, 21 nt, Human
cuggaauguaaucaauguuuc

SEQ ID NO: 1872740 - RNA, 21 nt, Human
cuggcacacaucaggaguuca

SEQ ID NO: 1872741 - RNA, 12 nt, Human
cuggcacacauc

SEQ ID NO: 1872742 - RNA, 20 nt, Human
cuggcacugacugggcauag

SEQ ID NO: 1872743 - RNA, 14 nt, Human
cuggugcugcugcu

SEQ ID NO: 1872744 - RNA, 14 nt, Human
cugggaggccagug

SEQ ID NO: 1872745 - RNA, 16 nt, Human
cugggcacccucccac

SEQ ID NO: 1872746 - RNA, 17 nt, Human
cugggcacccucccacc

SEQ ID NO: 1872747 - RNA, 21 nt, Human
cugggcacccucccacccggc

SEQ ID NO: 1872748 - RNA, 15 nt, Human
cugcacaagccaggg

SEQ ID NO: 1872749 - RNA, 18 nt, Human
cugcacaagccagggugu

SEQ ID NO: 1872750 - RNA, 19 nt, Human
cugcacaagccagggugug

SEQ ID NO: 1872751 - RNA, 22 nt, Human
cugcacaagccagggugugucu

SEQ ID NO: 1872752 - RNA, 15 nt, Human
cugcagggacacggg

SEQ ID NO: 1872753 - RNA, 20 nt, Human
cugcagggacacgggcagcc

SEQ ID NO: 1872754 - RNA, 24 nt, Human
cugcucucuuuuucuccaggguca

SEQ ID NO: 1872755 - RNA, 20 nt, Human
cugcucucuuuuucuccagg

SEQ ID NO: 1872756 - RNA, 21 nt, Human
cugcuccccucugcacggacc

SEQ ID NO: 1872757 - RNA, 19 nt, Human
cugcagggccgccagggag

SEQ ID NO: 1872758 - RNA, 18 nt, Human
cugcagggccgccaggga

SEQ ID NO: 1872759 - RNA, 13 nt, Human
ccuagaggcccca

SEQ ID NO: 1872760 - RNA, 15 nt, Human
ccgcuucugccugca

SEQ ID NO: 1872761 - RNA, 18 nt, Human
ccggcugcauacccgggc

SEQ ID NO: 1872762 - RNA, 22 nt, Human
ccggcugcauacccgggcaggg

SEQ ID NO: 1872763 - RNA, 20 nt, Human
ccgggcccagaggagcuggg

SEQ ID NO: 1872764 - RNA, 13 nt, Human
ccgggcccagagg

SEQ ID NO: 1872765 - RNA, 16 nt, Human
ccgggcccagaggagc

SEQ ID NO: 1872766 - RNA, 10 nt, Human
ccgggcccag

SEQ ID NO: 1872767 - RNA, 23 nt, Human
ccguuuccuuucauuuacugugg

SEQ ID NO: 1872768 - RNA, 15 nt, Human
ccuaaagcagccagc

SEQ ID NO: 1872769 - RNA, 14 nt, Human
ccuaaagcagccag

SEQ ID NO: 1872770 - RNA, 14 nt, Human
cccuuggcugggac

SEQ ID NO: 1872771 - RNA, 14 nt, Human
cccuuucuggcucu

SEQ ID NO: 1872772 - RNA, 14 nt, Human
ccgcccgggcccag

SEQ ID NO: 1872773 - RNA, 15 nt, Human
ccgcccgggcccaga

SEQ ID NO: 1872774 - RNA, 16 nt, Human
ccgcccgggcccagag

SEQ ID NO: 1872775 - RNA, 20 nt, Human
ccccacuggacugaccuggu

SEQ ID NO: 1872776 - RNA, 19 nt, Human
ccccacuggacugaccugg

SEQ ID NO: 1872777 - RNA, 12 nt, Human
ccccacuggacu

SEQ ID NO: 1872778 - RNA, 19 nt, Human
ccucugugugcuccuccuu

SEQ ID NO: 1872779 - RNA, 11 nt, Human
ccucagggcac

SEQ ID NO: 1872780 - RNA, 15 nt, Human
ccuccuggcccaggu

SEQ ID NO: 1872781 - RNA, 16 nt, Human
ccugugccuccaucag

SEQ ID NO: 1872782 - RNA, 14 nt, Human
ccugugcauguaug

SEQ ID NO: 1872783 - RNA, 17 nt, Human
ccugugcauguaugucu

SEQ ID NO: 1872784 - RNA, 20 nt, Human
ccugugcauguaugucuugg

SEQ ID NO: 1872785 - RNA, 22 nt, Human
ccuguccucccagcuccucacu

SEQ ID NO: 1872786 - RNA, 13 nt, Human
ccuguccucccag

SEQ ID NO: 1872787 - RNA, 12 nt, Human
ccuggugcugcu

SEQ ID NO: 1872788 - RNA, 13 nt, Human
ccuggugcugcug

SEQ ID NO: 1872789 - RNA, 18 nt, Human
ccuguaguugcguggacu

SEQ ID NO: 1872790 - RNA, 19 nt, Human
ccuguaguugcguggacuc

SEQ ID NO: 1872791 - RNA, 20 nt, Human
ccuguaguugcguggacucu

SEQ ID NO: 1872792 - RNA, 22 nt, Human
ccuucaguaacccccacuggac

SEQ ID NO: 1872793 - RNA, 16 nt, Human
ccuucaguaaccccca

SEQ ID NO: 1872794 - RNA, 14 nt, Human
cggggcagggcagc

SEQ ID NO: 1872795 - RNA, 14 nt, Human
cggacgcuggcucc

SEQ ID NO: 1872796 - RNA, 15 nt, Human
cggacgcuggcuccc

SEQ ID NO: 1872797 - RNA, 13 nt, Human
cgggcagccuggc

SEQ ID NO: 1872798 - RNA, 14 nt, Human
cgggcagccuggcu

SEQ ID NO: 1872799 - RNA, 16 nt, Human
cgggcagccuggcucc

SEQ ID NO: 1872800 - RNA, 18 nt, Human
cgggcagccuggcuccca

SEQ ID NO: 1872801 - RNA, 22 nt, Human
cgggcagccuggcucccaggac

SEQ ID NO: 1872802 - RNA, 23 nt, Human
cgggcagccuggcucccaggaca

SEQ ID NO: 1872803 - RNA, 15 nt, Human
cgggcagggcuccca

SEQ ID NO: 1872804 - RNA, 16 nt, Human
cgggcagggcucccac

SEQ ID NO: 1872805 - RNA, 17 nt, Human
cgggcagggcucccaca

SEQ ID NO: 1872806 - RNA, 14 nt, Human
ccuuucuggcucuc

SEQ ID NO: 1872807 - RNA, 15 nt, Human
ccuuggccgcaccua

SEQ ID NO: 1872808 - RNA, 22 nt, Human
cgaggaaacgaaacccacucua

SEQ ID NO: 1872809 - RNA, 20 nt, Human
cgaggaaacgaaacccacuc

SEQ ID NO: 1872810 - RNA, 14 nt, Human
cgcgaccuuggccg

SEQ ID NO: 1872811 - RNA, 23 nt, Human
ccaucugguuaggauggcaggac

SEQ ID NO: 1872812 - RNA, 22 nt, Human
ccaucugguuaggauggcagga

SEQ ID NO: 1872813 - RNA, 21 nt, Human
ccaggugaguccuagagcuac

SEQ ID NO: 1872814 - RNA, 12 nt, Human
ccaggcuuggaa

SEQ ID NO: 1872815 - RNA, 20 nt, Human
ccaggcauccuccacaauag

SEQ ID NO: 1872816 - RNA, 14 nt, Human
ccaggacaccgggc

SEQ ID NO: 1872817 - RNA, 18 nt, Human
ccaggacaccgggcaggg

SEQ ID NO: 1872818 - RNA, 20 nt, Human
cccaggugcagccagaggca

SEQ ID NO: 1872819 - RNA, 15 nt, Human
cccaggugcagccag

SEQ ID NO: 1872820 - RNA, 21 nt, Human
cccaggugcagccagaggcac

SEQ ID NO: 1872821 - RNA, 20 nt, Human
cccagccuggccacgcagcc

SEQ ID NO: 1872822 - RNA, 21 nt, Human
cccagccuggccacgcagcca

SEQ ID NO: 1872823 - RNA, 23 nt, Human
cccagccuggccacgcagccagg

SEQ ID NO: 1872824 - RNA, 22 nt, Human
cccagccuggccacgcagccag

SEQ ID NO: 1872825 - RNA, 18 nt, Human
cccaacacgcaggagcac

SEQ ID NO: 1872826 - RNA, 19 nt, Human
cccaaauuaucaagcuaau

SEQ ID NO: 1872827 - RNA, 20 nt, Human
cccaaauuaucaagcuaaua

SEQ ID NO: 1872828 - RNA, 21 nt, Human
cccaaauuaucaagcuaauaa

SEQ ID NO: 1872829 - RNA, 15 nt, Human
ccacaugugacacau

SEQ ID NO: 1872830 - RNA, 19 nt, Human
ccacaugugacacauaugc

SEQ ID NO: 1872831 - RNA, 19 nt, Human
ccacagggcaccugccacc

SEQ ID NO: 1872832 - RNA, 11 nt, Human
ccacagggcac

SEQ ID NO: 1872833 - RNA, 13 nt, Human
ccaacacgcagga

SEQ ID NO: 1872834 - RNA, 12 nt, Human
ccaagccacuga

SEQ ID NO: 1872835 - RNA, 13 nt, Human
ccaaguauuuugc

SEQ ID NO: 1872836 - RNA, 15 nt, Human
ccaagcaagacugag

SEQ ID NO: 1872837 - RNA, 19 nt, Human
cauuuccugagaccacaga

SEQ ID NO: 1872838 - RNA, 16 nt, Human
ccaaacagcugccucu

SEQ ID NO: 1872839 - RNA, 17 nt, Human herpesvirus 4 (Epstein-Barr virus)
cagaggacacgcugguc

SEQ ID NO: 1872840 - RNA, 17 nt, Human herpesvirus 4 (Epstein-Barr virus)
gggcagagaggcgggaa

SEQ ID NO: 1872841 - RNA, 17 nt, Human herpesvirus 4 (Epstein-Barr virus)
ugagauuuaacccaccc

SEQ ID NO: 1872842 - RNA, 17 nt, Human herpesvirus 4 (Epstein-Barr virus)
cgcccugucccuggagc

SEQ ID NO: 1872843 - RNA, 19 nt, Human herpesvirus 4 (Epstein-Barr virus)
ccccuggcggcccagcccg

SEQ ID NO: 1872844 - RNA, 10 nt, Human herpesvirus 4 (Epstein-Barr virus)
aaaauucagu

SEQ ID NO: 1872845 - RNA, 16 nt, Human herpesvirus 4 (Epstein-Barr virus)
cggagagggaugggcu

SEQ ID NO: 1872846 - RNA, 23 nt, Human herpesvirus 4 (Epstein-Barr virus)
gauccagggcccguuccaggcuc

SEQ ID NO: 1872847 - RNA, 16 nt, Human herpesvirus 4 (Epstein-Barr virus)
caaacagcagcagcag

SEQ ID NO: 1872848 - RNA, 15 nt, Human herpesvirus 4 (Epstein-Barr virus)
ugcauccgcaccaca

SEQ ID NO: 1872849 - RNA, 14 nt, Human herpesvirus 4 (Epstein-Barr virus)
acucaucucaaggg

SEQ ID NO: 1872850 - RNA, 23 nt, Human herpesvirus 4 (Epstein-Barr virus)
gcucgcccacacagcgccagcag

SEQ ID NO: 1872851 - RNA, 14 nt, Human herpesvirus 4 (Epstein-Barr virus)
gaccaaugccaaag

SEQ ID NO: 1872852 - RNA, 15 nt, Human herpesvirus 4 (Epstein-Barr virus)
ugacaucccaguucu

SEQ ID NO: 1872853 - RNA, 15 nt, Human herpesvirus 4 (Epstein-Barr virus)
acugcgagggggccu

SEQ ID NO: 1872854 - RNA, 22 nt, Human herpesvirus 4 (Epstein-Barr virus)
ggaggagcuccgugagcaggag

SEQ ID NO: 1872855 - RNA, 21 nt, Human herpesvirus 4 (Epstein-Barr virus)
gggcccagagugcuccggcug

SEQ ID NO: 1872856 - RNA, 22 nt, Human herpesvirus 4 (Epstein-Barr virus)
cucuugaagaucgugaggccug

SEQ ID NO: 1872857 - RNA, 18 nt, Human herpesvirus 4 (Epstein-Barr virus)
ccgacaaugagcggggag

SEQ ID NO: 1872858 - RNA, 22 nt, Human herpesvirus 4 (Epstein-Barr virus)
gacauugguguuccacagccug

SEQ ID NO: 1872859 - RNA, 22 nt, Human herpesvirus 4 (Epstein-Barr virus)
acccucgcgccccaucuuggcc

SEQ ID NO: 1872860 - RNA, 15 nt, Human herpesvirus 4 (Epstein-Barr virus)
uagccggccaggcag

SEQ ID NO: 1872861 - RNA, 15 nt, Human herpesvirus 4 (Epstein-Barr virus)
gauggcccugaucug

SEQ ID NO: 1872862 - RNA, 17 nt, Human herpesvirus 4 (Epstein-Barr virus)
cggaagggcaccguggg

SEQ ID NO: 1872863 - RNA, 15 nt, Human herpesvirus 4 (Epstein-Barr virus)
cagauccagggcccg

SEQ ID NO: 1872864 - RNA, 18 nt, Human herpesvirus 4 (Epstein-Barr virus)
accuauagauccugggcc

SEQ ID NO: 1872865 - RNA, 20 nt, Human herpesvirus 4 (Epstein-Barr virus)
gaaggcuccggcggcagugg

SEQ ID NO: 1872866 - RNA, 14 nt, Human herpesvirus 4 (Epstein-Barr virus)
gucuuugccaaccu

SEQ ID NO: 1872867 - RNA, 19 nt, Human herpesvirus 4 (Epstein-Barr virus)
cagcccggccgaggccugc

SEQ ID NO: 1872868 - RNA, 11 nt, Human herpesvirus 4 (Epstein-Barr virus)
gaggggggcag

SEQ ID NO: 1872869 - RNA, 14 nt, Human herpesvirus 4 (Epstein-Barr virus)
auuuagaaaccuug

SEQ ID NO: 1872870 - RNA, 18 nt, Human herpesvirus 4 (Epstein-Barr virus)
acugggcaucgggcuuug

SEQ ID NO: 1872871 - RNA, 12 nt, Human herpesvirus 4 (Epstein-Barr virus)
cccugggcucuc

SEQ ID NO: 1872872 - RNA, 17 nt, Human herpesvirus 4 (Epstein-Barr virus)
aggcgggaauggccgcc

SEQ ID NO: 1872873 - RNA, 17 nt, Human herpesvirus 4 (Epstein-Barr virus)
agaacggacugcggaga

SEQ ID NO: 1872874 - RNA, 18 nt, Human herpesvirus 4 (Epstein-Barr virus)
gccuggauguugacucca

SEQ ID NO: 1872875 - RNA, 21 nt, Human herpesvirus 4 (Epstein-Barr virus)
aauccuugggugaccuggcca

SEQ ID NO: 1872876 - RNA, 23 nt, Human herpesvirus 4 (Epstein-Barr virus)
aguggccgucuggcagggggccg

SEQ ID NO: 1872877 - RNA, 19 nt, Human herpesvirus 4 (Epstein-Barr virus)
gcccccucugccuccggcc

SEQ ID NO: 1872878 - RNA, 20 nt, Human herpesvirus 4 (Epstein-Barr virus)
cagagccucugccacaaggc

SEQ ID NO: 1872879 - RNA, 19 nt, Human herpesvirus 4 (Epstein-Barr virus)
cacggcgucaaacagguga

SEQ ID NO: 1872880 - RNA, 18 nt, Human herpesvirus 4 (Epstein-Barr virus)
aguccggagacugaggcc

SEQ ID NO: 1872881 - RNA, 17 nt, Human herpesvirus 4 (Epstein-Barr virus)
gggccuuccagagcucu

SEQ ID NO: 1872882 - RNA, 14 nt, Human herpesvirus 4 (Epstein-Barr virus)
cggcugugagcgca

SEQ ID NO: 1872883 - RNA, 17 nt, Human herpesvirus 4 (Epstein-Barr virus)
gccacgcaggauguuca

SEQ ID NO: 1872884 - RNA, 22 nt, Human herpesvirus 4 (Epstein-Barr virus)
ccaauguaucccaaauaaaugu

SEQ ID NO: 1872885 - RNA, 18 nt, Human herpesvirus 4 (Epstein-Barr virus)
ggcccuuugccuggggcu

SEQ ID NO: 1872886 - RNA, 16 nt, Human herpesvirus 4 (Epstein-Barr virus)
ugaucugggagaugag

SEQ ID NO: 1872887 - RNA, 14 nt, Human herpesvirus 4 (Epstein-Barr virus)
aacuucagcuccag

SEQ ID NO: 1872888 - RNA, 19 nt, Human herpesvirus 4 (Epstein-Barr virus)
auacucaucugugagacaa

SEQ ID NO: 1872889 - RNA, 22 nt, Human herpesvirus 4 (Epstein-Barr virus)
augcaacaauagaaguggaaac

SEQ ID NO: 1872890 - RNA, 21 nt, Human herpesvirus 4 (Epstein-Barr virus)
cacccuaaaacguaugaccuc

SEQ ID NO: 1872891 - RNA, 13 nt, Human herpesvirus 4 (Epstein-Barr virus)
ugugugacaugcu

SEQ ID NO: 1872892 - RNA, 21 nt, Human herpesvirus 4 (Epstein-Barr virus)
ugggugaccacugagggagug

SEQ ID NO: 1872893 - RNA, 17 nt, Human herpesvirus 4 (Epstein-Barr virus)
agaaugaugguggggga

SEQ ID NO: 1872894 - RNA, 18 nt, Human herpesvirus 4 (Epstein-Barr virus)
ccucagcccccccugugc

SEQ ID NO: 1872895 - RNA, 20 nt, Human herpesvirus 4 (Epstein-Barr virus)
ugaccucccgcccugagcug

SEQ ID NO: 1872896 - RNA, 16 nt, Human herpesvirus 4 (Epstein-Barr virus)
ccugggggccuguguc

SEQ ID NO: 1872897 - RNA, 20 nt, Human herpesvirus 4 (Epstein-Barr virus)
cacaccauccacagccccac

SEQ ID NO: 1872898 - RNA, 19 nt, Human herpesvirus 4 (Epstein-Barr virus)
cccuucugcugcugcuggu

SEQ ID NO: 1872899 - RNA, 16 nt, Human herpesvirus 4 (Epstein-Barr virus)
gugagcccaccugucu

SEQ ID NO: 1872900 - RNA, 17 nt, Human herpesvirus 4 (Epstein-Barr virus)
acaccgagcagaaggcc

SEQ ID NO: 1872901 - RNA, 22 nt, Human herpesvirus 4 (Epstein-Barr virus)
gacagcagcguccuggccccau

SEQ ID NO: 1872902 - RNA, 22 nt, Human herpesvirus 4 (Epstein-Barr virus)
cagcgucaggaaguacagccgg

SEQ ID NO: 1872903 - RNA, 13 nt, Human herpesvirus 4 (Epstein-Barr virus)
cuccguggccccg

SEQ ID NO: 1872904 - RNA, 16 nt, Human herpesvirus 4 (Epstein-Barr virus)
cgugaucaugagggcu

SEQ ID NO: 1872905 - RNA, 16 nt, Human herpesvirus 4 (Epstein-Barr virus)
aggagcaggaggggca

SEQ ID NO: 1872906 - RNA, 15 nt, Human herpesvirus 4 (Epstein-Barr virus)
ggccucgguggcagu

SEQ ID NO: 1872907 - RNA, 21 nt, Human herpesvirus 4 (Epstein-Barr virus)
ucgcacucuuguugcuagccu

SEQ ID NO: 1872908 - RNA, 16 nt, Human herpesvirus 4 (Epstein-Barr virus)
aggcggcuguggccuc

SEQ ID NO: 1872909 - RNA, 15 nt, Human herpesvirus 4 (Epstein-Barr virus)
caugcaggccuggac

SEQ ID NO: 1872910 - RNA, 22 nt, Human herpesvirus 4 (Epstein-Barr virus)
gccagaaucgguaaggaggggc

SEQ ID NO: 1872911 - RNA, 19 nt, Human herpesvirus 4 (Epstein-Barr virus)
cccagccuacucuccacuc

SEQ ID NO: 1872912 - RNA, 20 nt, Human herpesvirus 4 (Epstein-Barr virus)
cuaaggcaguccaggggcca

SEQ ID NO: 1872913 - RNA, 15 nt, Human herpesvirus 4 (Epstein-Barr virus)
cccaggggucucuag

SEQ ID NO: 1872914 - RNA, 15 nt, Human herpesvirus 4 (Epstein-Barr virus)
aacuuuguccagaug

SEQ ID NO: 1872915 - RNA, 16 nt, Human herpesvirus 4 (Epstein-Barr virus)
ggacccuauggagggc

SEQ ID NO: 1872916 - RNA, 19 nt, Human herpesvirus 4 (Epstein-Barr virus)
gcucuggucgcccccucug

SEQ ID NO: 1872917 - RNA, 23 nt, Human herpesvirus 4 (Epstein-Barr virus)
ugccuguggccccggcuggccau

SEQ ID NO: 1872918 - RNA, 19 nt, Human herpesvirus 4 (Epstein-Barr virus)
cugcagugggccucucugg

SEQ ID NO: 1872919 - RNA, 18 nt, Human herpesvirus 4 (Epstein-Barr virus)
ugcuaugaccaugcccag

SEQ ID NO: 1872920 - RNA, 22 nt, Human herpesvirus 4 (Epstein-Barr virus)
agugggccucucuggcugugcu

SEQ ID NO: 1872921 - RNA, 18 nt, Human herpesvirus 4 (Epstein-Barr virus)
cagggugcacagacuagc

SEQ ID NO: 1872922 - RNA, 17 nt, Human herpesvirus 4 (Epstein-Barr virus)
auugguguuccacagcc

SEQ ID NO: 1872923 - RNA, 19 nt, Human herpesvirus 4 (Epstein-Barr virus)
uguucacugcguagaugag

SEQ ID NO: 1872924 - RNA, 22 nt, Human herpesvirus 4 (Epstein-Barr virus)
cggcuagccugacuaaggguga

SEQ ID NO: 1872925 - RNA, 17 nt, Human herpesvirus 4 (Epstein-Barr virus)
cagaggaggccccggcc

SEQ ID NO: 1872926 - RNA, 15 nt, Human herpesvirus 4 (Epstein-Barr virus)
caaaagggcucugac

SEQ ID NO: 1872927 - RNA, 20 nt, Human herpesvirus 4 (Epstein-Barr virus)
gcugcuggucauggcggacu

SEQ ID NO: 1872928 - RNA, 17 nt, Human herpesvirus 4 (Epstein-Barr virus)
uacccggucgcauggug

SEQ ID NO: 1872929 - RNA, 18 nt, Human herpesvirus 4 (Epstein-Barr virus)
ggcccagcccuccucaga

SEQ ID NO: 1872930 - RNA, 17 nt, Human herpesvirus 4 (Epstein-Barr virus)
accccagagcagcccgc

SEQ ID NO: 1872931 - RNA, 14 nt, Human herpesvirus 4 (Epstein-Barr virus)
ccuggccagggcgg

SEQ ID NO: 1872932 - RNA, 20 nt, Human herpesvirus 4 (Epstein-Barr virus)
guagucguuguucagggccg

SEQ ID NO: 1872933 - RNA, 19 nt, Human herpesvirus 4 (Epstein-Barr virus)
ccgcagguggcugcugcca

SEQ ID NO: 1872934 - RNA, 21 nt, Human herpesvirus 4 (Epstein-Barr virus)
gggcaggcccccagcuucuga

SEQ ID NO: 1872935 - RNA, 23 nt, Human herpesvirus 4 (Epstein-Barr virus)
augccccccguaaaacuccacag

SEQ ID NO: 1872936 - RNA, 21 nt, Human herpesvirus 4 (Epstein-Barr virus)
gcguaggucuauggggacccu

SEQ ID NO: 1872937 - RNA, 21 nt, Human herpesvirus 4 (Epstein-Barr virus)
gugacgaagacccaucugagg

SEQ ID NO: 1872938 - RNA, 12 nt, Human herpesvirus 4 (Epstein-Barr virus)
aauaaaguugau

SEQ ID NO: 1872939 - RNA, 20 nt, Human herpesvirus 4 (Epstein-Barr virus)
aguaggcacaucuggaccug

SEQ ID NO: 1872940 - RNA, 20 nt, Human herpesvirus 4 (Epstein-Barr virus)
cuggcuuucguccucuggcu

SEQ ID NO: 1872941 - RNA, 16 nt, Human herpesvirus 4 (Epstein-Barr virus)
gaaucuaguaugaagg

SEQ ID NO: 1872942 - RNA, 15 nt, Human herpesvirus 4 (Epstein-Barr virus)
gcagcuucuccagcg

SEQ ID NO: 1872943 - RNA, 15 nt, Human herpesvirus 4 (Epstein-Barr virus)
cagggccuugagccc

SEQ ID NO: 1872944 - RNA, 16 nt, Human herpesvirus 4 (Epstein-Barr virus)
aucucuugcgcccagg

SEQ ID NO: 1872945 - RNA, 13 nt, Human herpesvirus 4 (Epstein-Barr virus)
ccagcccgacccc

SEQ ID NO: 1872946 - RNA, 14 nt, Human herpesvirus 4 (Epstein-Barr virus)
gaggacgugaguga

SEQ ID NO: 1872947 - RNA, 14 nt, Human herpesvirus 4 (Epstein-Barr virus)
ugacccacuccagu

SEQ ID NO: 1872948 - RNA, 22 nt, Human herpesvirus 4 (Epstein-Barr virus)
ccuccaagcggcacagauuaga

SEQ ID NO: 1872949 - RNA, 15 nt, Human herpesvirus 4 (Epstein-Barr virus)
cagccagagccagcc

SEQ ID NO: 1872950 - RNA, 18 nt, Human herpesvirus 4 (Epstein-Barr virus)
gcugccgucccagggccg

SEQ ID NO: 1872951 - RNA, 17 nt, Human herpesvirus 4 (Epstein-Barr virus)
uacccucuuagggaggu

SEQ ID NO: 1872952 - RNA, 21 nt, Human herpesvirus 4 (Epstein-Barr virus)
ccaggaggaggacgugaguga

SEQ ID NO: 1872953 - RNA, 16 nt, Human herpesvirus 4 (Epstein-Barr virus)
ugcuggccgcagcugg

SEQ ID NO: 1872954 - RNA, 15 nt, Human herpesvirus 4 (Epstein-Barr virus)
gaaaauauauugcaa

SEQ ID NO: 1872955 - RNA, 15 nt, Human herpesvirus 4 (Epstein-Barr virus)
gccuacgcagaggcc

SEQ ID NO: 1872956 - RNA, 22 nt, Human herpesvirus 4 (Epstein-Barr virus)
cccuccucugggccgcccggcc

SEQ ID NO: 1872957 - RNA, 21 nt, Human herpesvirus 4 (Epstein-Barr virus)
guccagaagcagauagccggc

SEQ ID NO: 1872958 - RNA, 17 nt, Human herpesvirus 4 (Epstein-Barr virus)
gcacugcguccaccugg

SEQ ID NO: 1872959 - RNA, 18 nt, Human herpesvirus 4 (Epstein-Barr virus)
acgugcccagcuccgugg

SEQ ID NO: 1872960 - RNA, 17 nt, Human herpesvirus 4 (Epstein-Barr virus)
acugggggcaaagccag

SEQ ID NO: 1872961 - RNA, 17 nt, Human herpesvirus 4 (Epstein-Barr virus)
ggaaaugagggaauuug

SEQ ID NO: 1872962 - RNA, 13 nt, Human herpesvirus 4 (Epstein-Barr virus)
cggcggcugcugc

SEQ ID NO: 1872963 - RNA, 18 nt, Human herpesvirus 4 (Epstein-Barr virus)
gaccggcuacgcgggcca

SEQ ID NO: 1872964 - RNA, 11 nt, Human herpesvirus 4 (Epstein-Barr virus)
ugcgcgccgcc

SEQ ID NO: 1872965 - RNA, 21 nt, Human herpesvirus 4 (Epstein-Barr virus)
gccgucucaaacggggaagga

SEQ ID NO: 1872966 - RNA, 19 nt, Human herpesvirus 4 (Epstein-Barr virus)
gcuagaagugcugggaggu

SEQ ID NO: 1872967 - RNA, 13 nt, Human herpesvirus 4 (Epstein-Barr virus)
ucucaucuccaaa

SEQ ID NO: 1872968 - RNA, 16 nt, Human herpesvirus 4 (Epstein-Barr virus)
auguuuucuggacaca

SEQ ID NO: 1872969 - RNA, 22 nt, Human herpesvirus 4 (Epstein-Barr virus)
cauguaacaagaacugggauga

SEQ ID NO: 1872970 - RNA, 20 nt, Human herpesvirus 4 (Epstein-Barr virus)
gcaccgauagcauggccgcc

SEQ ID NO: 1872971 - RNA, 14 nt, Human herpesvirus 4 (Epstein-Barr virus)
agauugucacagcu

SEQ ID NO: 1872972 - RNA, 14 nt, Human herpesvirus 4 (Epstein-Barr virus)
cgcccccugaccuc

SEQ ID NO: 1872973 - RNA, 20 nt, Human herpesvirus 4 (Epstein-Barr virus)
ugucggcucucuuugaagug

SEQ ID NO: 1872974 - RNA, 18 nt, Human herpesvirus 4 (Epstein-Barr virus)
uccggagacugaggccuu

SEQ ID NO: 1872975 - RNA, 16 nt, Human herpesvirus 4 (Epstein-Barr virus)
agcaggacggggggcu

SEQ ID NO: 1872976 - RNA, 17 nt, Human herpesvirus 4 (Epstein-Barr virus)
ugucucggccuccuggc

SEQ ID NO: 1872977 - RNA, 15 nt, Human herpesvirus 4 (Epstein-Barr virus)
cucggccacacagug

SEQ ID NO: 1872978 - RNA, 22 nt, Human herpesvirus 4 (Epstein-Barr virus)
gugaggacggugucugugguug

SEQ ID NO: 1872979 - RNA, 15 nt, Human herpesvirus 4 (Epstein-Barr virus)
ugcacccggacaugu

SEQ ID NO: 1872980 - RNA, 17 nt, Human herpesvirus 4 (Epstein-Barr virus)
aaacagaggcuggaugc

SEQ ID NO: 1872981 - RNA, 16 nt, Human herpesvirus 4 (Epstein-Barr virus)
gucgcuggcugguggg

SEQ ID NO: 1872982 - RNA, 14 nt, Human herpesvirus 4 (Epstein-Barr virus)
gagcauggcggccu

SEQ ID NO: 1872983 - RNA, 17 nt, Human herpesvirus 4 (Epstein-Barr virus)
gccuucugcguccagac

SEQ ID NO: 1872984 - RNA, 21 nt, Human herpesvirus 4 (Epstein-Barr virus)
uccacagauggagagauuuca

SEQ ID NO: 1872985 - RNA, 21 nt, Human herpesvirus 4 (Epstein-Barr virus)
ccuccacccagcagcagcccg

SEQ ID NO: 1872986 - RNA, 15 nt, Human herpesvirus 4 (Epstein-Barr virus)
uuccgucagccaggg

SEQ ID NO: 1872987 - RNA, 21 nt, Human herpesvirus 4 (Epstein-Barr virus)
ggcccacgccauaccugcacg

SEQ ID NO: 1872988 - RNA, 16 nt, Human herpesvirus 4 (Epstein-Barr virus)
aacugcgagggggccu

SEQ ID NO: 1872989 - RNA, 18 nt, Human herpesvirus 4 (Epstein-Barr virus)
gcauuacaccaucccaug

SEQ ID NO: 1872990 - RNA, 13 nt, Human herpesvirus 4 (Epstein-Barr virus)
ggacccugcugcg

SEQ ID NO: 1872991 - RNA, 12 nt, Human herpesvirus 4 (Epstein-Barr virus)
ugucugacuugg

SEQ ID NO: 1872992 - RNA, 14 nt, Human herpesvirus 4 (Epstein-Barr virus)
cuagagguuuugcu

SEQ ID NO: 1872993 - RNA, 13 nt, Human herpesvirus 4 (Epstein-Barr virus)
cacgacuguuccu

SEQ ID NO: 1872994 - RNA, 20 nt, Human herpesvirus 4 (Epstein-Barr virus)
gccucuggcacgccguggcc

SEQ ID NO: 1872995 - RNA, 21 nt, Human herpesvirus 4 (Epstein-Barr virus)
acgcccaguaugcagucucaa

SEQ ID NO: 1872996 - RNA, 20 nt, Human herpesvirus 4 (Epstein-Barr virus)
aguuguccugggcugccccg

SEQ ID NO: 1872997 - RNA, 16 nt, Human herpesvirus 4 (Epstein-Barr virus)
ccuacaccaccccacc

SEQ ID NO: 1872998 - RNA, 19 nt, Human herpesvirus 4 (Epstein-Barr virus)
ucgagaaccccagcaacau

SEQ ID NO: 1872999 - RNA, 18 nt, Human herpesvirus 4 (Epstein-Barr virus)
gauagugaacguggaggu

SEQ ID NO: 1873000 - RNA, 19 nt, Human herpesvirus 4 (Epstein-Barr virus)
cggcccuuugccuggggcu

SEQ ID NO: 1873001 - RNA, 19 nt, Human herpesvirus 4 (Epstein-Barr virus)
ucaaagaacaaggccaaga

SEQ ID NO: 1873002 - RNA, 17 nt, Human herpesvirus 4 (Epstein-Barr virus)
ugccuccccagcaacag

SEQ ID NO: 1873003 - RNA, 17 nt, Human herpesvirus 4 (Epstein-Barr virus)
ggaggccucaggcaaca

SEQ ID NO: 1873004 - RNA, 15 nt, Human herpesvirus 4 (Epstein-Barr virus)
aucucuauugccucu

SEQ ID NO: 1873005 - RNA, 14 nt, Human herpesvirus 4 (Epstein-Barr virus)
caucuggcucuccu

SEQ ID NO: 1873006 - RNA, 17 nt, Human herpesvirus 4 (Epstein-Barr virus)
ccauucgugaguccagg

SEQ ID NO: 1873007 - RNA, 15 nt, Human herpesvirus 4 (Epstein-Barr virus)
uccgaugcccaccag

SEQ ID NO: 1873008 - RNA, 17 nt, Human herpesvirus 4 (Epstein-Barr virus)
ggccaucgcaagcuccu

SEQ ID NO: 1873009 - RNA, 11 nt, Human herpesvirus 4 (Epstein-Barr virus)
ccggugguggg

SEQ ID NO: 1873010 - RNA, 22 nt, Human herpesvirus 4 (Epstein-Barr virus)
cccgagaccggcuccggauuca

SEQ ID NO: 1873011 - RNA, 15 nt, Human herpesvirus 4 (Epstein-Barr virus)
uaacauuggcagcag

SEQ ID NO: 1873012 - RNA, 15 nt, Human herpesvirus 4 (Epstein-Barr virus)
gaacugacgcuccag

SEQ ID NO: 1873013 - RNA, 16 nt, Human herpesvirus 4 (Epstein-Barr virus)
cgcugcucgccccugg

SEQ ID NO: 1873014 - RNA, 14 nt, Human herpesvirus 4 (Epstein-Barr virus)
cuccccucugcaga

SEQ ID NO: 1873015 - RNA, 14 nt, Human herpesvirus 4 (Epstein-Barr virus)
ugggccaggucaca

SEQ ID NO: 1873016 - RNA, 17 nt, Human herpesvirus 4 (Epstein-Barr virus)
ccuaggagaaggagccu

SEQ ID NO: 1873017 - RNA, 14 nt, Human herpesvirus 4 (Epstein-Barr virus)
cugcccagccuacu

SEQ ID NO: 1873018 - RNA, 18 nt, Human herpesvirus 4 (Epstein-Barr virus)
ggaugcaucuaaggucca

SEQ ID NO: 1873019 - RNA, 20 nt, Human herpesvirus 4 (Epstein-Barr virus)
cucaaggcagucuccaccuu

SEQ ID NO: 1873020 - RNA, 18 nt, Human herpesvirus 4 (Epstein-Barr virus)
caaccaauguaucccaaa

SEQ ID NO: 1873021 - RNA, 10 nt, Human herpesvirus 4 (Epstein-Barr virus)
agcaggagga

SEQ ID NO: 1873022 - RNA, 19 nt, Human herpesvirus 4 (Epstein-Barr virus)
agauagccggccaggcaga

SEQ ID NO: 1873023 - RNA, 21 nt, Human herpesvirus 4 (Epstein-Barr virus)
ucccaaguguuuccagacacc

SEQ ID NO: 1873024 - RNA, 22 nt, Human herpesvirus 4 (Epstein-Barr virus)
cccggggguggaggcugcgccu

SEQ ID NO: 1873025 - RNA, 21 nt, Human herpesvirus 4 (Epstein-Barr virus)
uugcucuguguuuuuugccug

SEQ ID NO: 1873026 - RNA, 14 nt, Human herpesvirus 4 (Epstein-Barr virus)
gggcgccccagggc

SEQ ID NO: 1873027 - RNA, 21 nt, Human herpesvirus 4 (Epstein-Barr virus)
caaggacgggggugggcaccu

SEQ ID NO: 1873028 - RNA, 13 nt, Human herpesvirus 4 (Epstein-Barr virus)
gccugagagccgg

SEQ ID NO: 1873029 - RNA, 15 nt, Human herpesvirus 4 (Epstein-Barr virus)
gcugguuuggagaaa

SEQ ID NO: 1873030 - RNA, 23 nt, Human herpesvirus 4 (Epstein-Barr virus)
cuccucagaaaacucugcaugga

SEQ ID NO: 1873031 - RNA, 17 nt, Human herpesvirus 4 (Epstein-Barr virus)
ucuacgcggagcugcac

SEQ ID NO: 1873032 - RNA, 20 nt, Human herpesvirus 4 (Epstein-Barr virus)
ccaggccugccaaagagcca

SEQ ID NO: 1873033 - RNA, 20 nt, Human herpesvirus 4 (Epstein-Barr virus)
agaaaagagagcggcuguga

SEQ ID NO: 1873034 - RNA, 23 nt, Human herpesvirus 4 (Epstein-Barr virus)
gucucgccgcuaguugguccagg

SEQ ID NO: 1873035 - RNA, 22 nt, Human herpesvirus 4 (Epstein-Barr virus)
ccgagucaguuacacacacagu

SEQ ID NO: 1873036 - RNA, 14 nt, Human herpesvirus 4 (Epstein-Barr virus)
cgagggggccuggu

SEQ ID NO: 1873037 - RNA, 14 nt, Human herpesvirus 4 (Epstein-Barr virus)
cacugggacggggu

SEQ ID NO: 1873038 - RNA, 23 nt, Human herpesvirus 4 (Epstein-Barr virus)
aucaucucgcuggcucgccucau

SEQ ID NO: 1873039 - RNA, 11 nt, Human herpesvirus 4 (Epstein-Barr virus)
ugaccaacaug

SEQ ID NO: 1873040 - RNA, 18 nt, Human herpesvirus 4 (Epstein-Barr virus)
ggauugcugaacuggggc

SEQ ID NO: 1873041 - RNA, 21 nt, Human herpesvirus 4 (Epstein-Barr virus)
guccagcaggcucaggccgcc

SEQ ID NO: 1873042 - RNA, 14 nt, Human herpesvirus 4 (Epstein-Barr virus)
gaggccgagcaggg

SEQ ID NO: 1873043 - RNA, 16 nt, Human herpesvirus 4 (Epstein-Barr virus)
cacacucccuccagaa

SEQ ID NO: 1873044 - RNA, 21 nt, Human herpesvirus 4 (Epstein-Barr virus)
caaccuuuccaucacugaccc

SEQ ID NO: 1873045 - RNA, 18 nt, Human herpesvirus 4 (Epstein-Barr virus)
cagcgaccggcagauccc

SEQ ID NO: 1873046 - RNA, 19 nt, Human herpesvirus 4 (Epstein-Barr virus)
aacuggccaugcaggccug

SEQ ID NO: 1873047 - RNA, 20 nt, Human herpesvirus 4 (Epstein-Barr virus)
ugguagccggcgcugugugg

SEQ ID NO: 1873048 - RNA, 18 nt, Human herpesvirus 4 (Epstein-Barr virus)
ucaacuucagcuccaggg

SEQ ID NO: 1873049 - RNA, 15 nt, Human herpesvirus 4 (Epstein-Barr virus)
cuugggggugguggg

SEQ ID NO: 1873050 - RNA, 19 nt, Human herpesvirus 4 (Epstein-Barr virus)
acguacccauaacugggca

SEQ ID NO: 1873051 - RNA, 14 nt, Human herpesvirus 4 (Epstein-Barr virus)
gguuuggggcaggc

SEQ ID NO: 1873052 - RNA, 15 nt, Human herpesvirus 4 (Epstein-Barr virus)
ccugacggugguggg

SEQ ID NO: 1873053 - RNA, 21 nt, Human herpesvirus 4 (Epstein-Barr virus)
gaguccaacauuaaagccucc

SEQ ID NO: 1873054 - RNA, 17 nt, Human herpesvirus 4 (Epstein-Barr virus)
acgggcucccucccccu

SEQ ID NO: 1873055 - RNA, 21 nt, Human herpesvirus 4 (Epstein-Barr virus)
gauuucaaauaccgagaugua

SEQ ID NO: 1873056 - RNA, 16 nt, Human herpesvirus 4 (Epstein-Barr virus)
cgucuuacugcccagc

SEQ ID NO: 1873057 - RNA, 15 nt, Human herpesvirus 4 (Epstein-Barr virus)
ccaggguccaggaga

SEQ ID NO: 1873058 - RNA, 23 nt, Human herpesvirus 4 (Epstein-Barr virus)
gcugucacccaugccuccccagc

SEQ ID NO: 1873059 - RNA, 17 nt, Human herpesvirus 4 (Epstein-Barr virus)
cagcccgacccccgggc

SEQ ID NO: 1873060 - RNA, 13 nt, Human herpesvirus 4 (Epstein-Barr virus)
uggcuauggucau

SEQ ID NO: 1873061 - RNA, 14 nt, Human herpesvirus 4 (Epstein-Barr virus)
ugagcuggacgagg

SEQ ID NO: 1873062 - RNA, 21 nt, Human herpesvirus 4 (Epstein-Barr virus)
ccagcaaaaccagcccgggga

SEQ ID NO: 1873063 - RNA, 17 nt, Human herpesvirus 4 (Epstein-Barr virus)
cagcuccagggacaggg

SEQ ID NO: 1873064 - RNA, 18 nt, Human herpesvirus 4 (Epstein-Barr virus)
caggagguacaugggcca

SEQ ID NO: 1873065 - RNA, 15 nt, Human herpesvirus 4 (Epstein-Barr virus)
aaucucgcucagagc

SEQ ID NO: 1873066 - RNA, 16 nt, Human herpesvirus 4 (Epstein-Barr virus)
acgcgcagugccaaga

SEQ ID NO: 1873067 - RNA, 19 nt, Human herpesvirus 4 (Epstein-Barr virus)
uugaaaccacgccugcuuc

SEQ ID NO: 1873068 - RNA, 19 nt, Human herpesvirus 4 (Epstein-Barr virus)
cagagcccagaggaggccc

SEQ ID NO: 1873069 - RNA, 16 nt, Human herpesvirus 4 (Epstein-Barr virus)
auaacugccagagcug

SEQ ID NO: 1873070 - RNA, 18 nt, Human herpesvirus 4 (Epstein-Barr virus)
augaccaacaugagggca

SEQ ID NO: 1873071 - RNA, 19 nt, Human herpesvirus 4 (Epstein-Barr virus)
gucuccccucugcagagag

SEQ ID NO: 1873072 - RNA, 23 nt, Human herpesvirus 4 (Epstein-Barr virus)
gcuacacucuggggucucaggcc

SEQ ID NO: 1873073 - RNA, 16 nt, Human herpesvirus 4 (Epstein-Barr virus)
ucaccggcaccgccag

SEQ ID NO: 1873074 - RNA, 16 nt, Human herpesvirus 4 (Epstein-Barr virus)
agggugagcccaccug

SEQ ID NO: 1873075 - RNA, 21 nt, Human herpesvirus 4 (Epstein-Barr virus)
ugaacuggggcugguggccug

SEQ ID NO: 1873076 - RNA, 22 nt, Human herpesvirus 4 (Epstein-Barr virus)
caucugaaaaugacaggcugcg

SEQ ID NO: 1873077 - RNA, 20 nt, Human herpesvirus 4 (Epstein-Barr virus)
cgaaggugcagcuggcccac

SEQ ID NO: 1873078 - RNA, 23 nt, Human herpesvirus 4 (Epstein-Barr virus)
ucagcgagguuaagcugcaccug

SEQ ID NO: 1873079 - RNA, 21 nt, Human herpesvirus 4 (Epstein-Barr virus)
gguuugcccaacucuuauucu

SEQ ID NO: 1873080 - RNA, 23 nt, Human herpesvirus 4 (Epstein-Barr virus)
ccugagcuggacgagguccugga

SEQ ID NO: 1873081 - RNA, 19 nt, Human herpesvirus 4 (Epstein-Barr virus)
gagaggccucuggggucca

SEQ ID NO: 1873082 - RNA, 16 nt, Human herpesvirus 4 (Epstein-Barr virus)
cggcugcucccgccuc

SEQ ID NO: 1873083 - RNA, 13 nt, Human herpesvirus 4 (Epstein-Barr virus)
gaagggcagggcu

SEQ ID NO: 1873084 - RNA, 22 nt, Human herpesvirus 4 (Epstein-Barr virus)
agaagcggggcugggugggaga

SEQ ID NO: 1873085 - RNA, 21 nt, Human herpesvirus 4 (Epstein-Barr virus)
gcuuacaagaauaacaugcca

SEQ ID NO: 1873086 - RNA, 17 nt, Human herpesvirus 4 (Epstein-Barr virus)
acuccggggguccagcc

SEQ ID NO: 1873087 - RNA, 18 nt, Human herpesvirus 4 (Epstein-Barr virus)
gggcgcccccaaacuuug

SEQ ID NO: 1873088 - RNA, 17 nt, Human herpesvirus 4 (Epstein-Barr virus)
agagccccuuuugcccc

SEQ ID NO: 1873089 - RNA, 13 nt, Human herpesvirus 4 (Epstein-Barr virus)
gacgcuguuuugc

SEQ ID NO: 1873090 - RNA, 12 nt, Human herpesvirus 4 (Epstein-Barr virus)
ccgccgccgcag

SEQ ID NO: 1873091 - RNA, 22 nt, Human herpesvirus 4 (Epstein-Barr virus)
caguuucuuuccgcgguggugg

SEQ ID NO: 1873092 - RNA, 18 nt, Human herpesvirus 4 (Epstein-Barr virus)
cgggaggaaacaggagga

SEQ ID NO: 1873093 - RNA, 15 nt, Human herpesvirus 4 (Epstein-Barr virus)
caucucauccccaga

SEQ ID NO: 1873094 - RNA, 13 nt, Human herpesvirus 4 (Epstein-Barr virus)
aggacgaggaggc

SEQ ID NO: 1873095 - RNA, 19 nt, Human herpesvirus 4 (Epstein-Barr virus)
cagcagcucuggcacugcu

SEQ ID NO: 1873096 - RNA, 15 nt, Human herpesvirus 4 (Epstein-Barr virus)
gaaggcuugccaaaa

SEQ ID NO: 1873097 - RNA, 13 nt, Human herpesvirus 4 (Epstein-Barr virus)
auguuacuucuuu

SEQ ID NO: 1873098 - RNA, 15 nt, Human herpesvirus 4 (Epstein-Barr virus)
ggaacaccgggcagg

SEQ ID NO: 1873099 - RNA, 18 nt, Human herpesvirus 4 (Epstein-Barr virus)
guccaggggccacacagc

SEQ ID NO: 1873100 - RNA, 14 nt, Human herpesvirus 4 (Epstein-Barr virus)
ccccuaccucggca

SEQ ID NO: 1873101 - RNA, 23 nt, Human herpesvirus 4 (Epstein-Barr virus)
auucacugggacaacugucacac

SEQ ID NO: 1873102 - RNA, 14 nt, Human herpesvirus 4 (Epstein-Barr virus)
ccaccacucccacc

SEQ ID NO: 1873103 - RNA, 16 nt, Human herpesvirus 4 (Epstein-Barr virus)
gucucuuucuggccaa

SEQ ID NO: 1873104 - RNA, 12 nt, Human herpesvirus 4 (Epstein-Barr virus)
gcgugccaaacu

SEQ ID NO: 1873105 - RNA, 18 nt, Human herpesvirus 4 (Epstein-Barr virus)
ucaugcgugaccaccugg

SEQ ID NO: 1873106 - RNA, 14 nt, Human herpesvirus 4 (Epstein-Barr virus)
gcucaguggccguc

SEQ ID NO: 1873107 - RNA, 14 nt, Human herpesvirus 4 (Epstein-Barr virus)
cagaagacuccugc

SEQ ID NO: 1873108 - RNA, 20 nt, Human herpesvirus 4 (Epstein-Barr virus)
cccucggugggccagauacu

SEQ ID NO: 1873109 - RNA, 17 nt, Human herpesvirus 4 (Epstein-Barr virus)
cgaggcccugcaagcca

SEQ ID NO: 1873110 - RNA, 16 nt, Human herpesvirus 4 (Epstein-Barr virus)
agccagcgcacccggg

SEQ ID NO: 1873111 - RNA, 19 nt, Human herpesvirus 4 (Epstein-Barr virus)
uagccacccgucccgggua

SEQ ID NO: 1873112 - RNA, 22 nt, Human herpesvirus 4 (Epstein-Barr virus)
cuaauggaauauuaauaaauau

SEQ ID NO: 1873113 - RNA, 20 nt, Human herpesvirus 4 (Epstein-Barr virus)
cagcacgucgucagagaggu

SEQ ID NO: 1873114 - RNA, 15 nt, Human herpesvirus 4 (Epstein-Barr virus)
gaugcagcgcaucag

SEQ ID NO: 1873115 - RNA, 19 nt, Human herpesvirus 4 (Epstein-Barr virus)
agccccacucuugccucgg

SEQ ID NO: 1873116 - RNA, 14 nt, Human herpesvirus 4 (Epstein-Barr virus)
gauagauagccacc

SEQ ID NO: 1873117 - RNA, 15 nt, Human herpesvirus 4 (Epstein-Barr virus)
ggaacacccccaccc

SEQ ID NO: 1873118 - RNA, 23 nt, Human herpesvirus 4 (Epstein-Barr virus)
agauggacuugaggugggcugac

SEQ ID NO: 1873119 - RNA, 13 nt, Human herpesvirus 4 (Epstein-Barr virus)
gguggugggcugc

SEQ ID NO: 1873120 - RNA, 15 nt, Human herpesvirus 4 (Epstein-Barr virus)
aucagggccaagaca

SEQ ID NO: 1873121 - RNA, 16 nt, Human herpesvirus 4 (Epstein-Barr virus)
gguagauggcgagacu

SEQ ID NO: 1873122 - RNA, 23 nt, Human herpesvirus 4 (Epstein-Barr virus)
auggccuauggguuaccaggcau

SEQ ID NO: 1873123 - RNA, 23 nt, Human herpesvirus 4 (Epstein-Barr virus)
guuucggcgccgcccgggggcca

SEQ ID NO: 1873124 - RNA, 22 nt, Human herpesvirus 4 (Epstein-Barr virus)
uccaacgagggcagacaccacc

SEQ ID NO: 1873125 - RNA, 22 nt, Human herpesvirus 4 (Epstein-Barr virus)
ggcagaaccaucagcucgccca

SEQ ID NO: 1873126 - RNA, 15 nt, Human herpesvirus 4 (Epstein-Barr virus)
gaacauggaugugaa

SEQ ID NO: 1873127 - RNA, 16 nt, Human herpesvirus 4 (Epstein-Barr virus)
cagaggaggcuggugc

SEQ ID NO: 1873128 - RNA, 14 nt, Human herpesvirus 4 (Epstein-Barr virus)
cagcgcuggcucca

SEQ ID NO: 1873129 - RNA, 22 nt, Human herpesvirus 4 (Epstein-Barr virus)
cgcugauaaaguuguccugggc

SEQ ID NO: 1873130 - RNA, 18 nt, Human herpesvirus 4 (Epstein-Barr virus)
aguuguuauucccaccuc

SEQ ID NO: 1873131 - RNA, 22 nt, Human herpesvirus 4 (Epstein-Barr virus)
gacccuauggagggcagcgaag

SEQ ID NO: 1873132 - RNA, 13 nt, Human herpesvirus 4 (Epstein-Barr virus)
ugauggggacagg

SEQ ID NO: 1873133 - RNA, 18 nt, Human herpesvirus 4 (Epstein-Barr virus)
gcccccgccagcgccucc

SEQ ID NO: 1873134 - RNA, 12 nt, Human herpesvirus 4 (Epstein-Barr virus)
cuguagccaccc

SEQ ID NO: 1873135 - RNA, 16 nt, Human herpesvirus 4 (Epstein-Barr virus)
acgcuguccgccagga

SEQ ID NO: 1873136 - RNA, 12 nt, Human herpesvirus 4 (Epstein-Barr virus)
ucuccccucugc

SEQ ID NO: 1873137 - RNA, 13 nt, Human herpesvirus 4 (Epstein-Barr virus)
cgccugcuucacg

SEQ ID NO: 1873138 - RNA, 13 nt, Human herpesvirus 4 (Epstein-Barr virus)
ccaggcuccugga

SEQ ID NO: 1873139 - RNA, 11 nt, Human herpesvirus 4 (Epstein-Barr virus)
auggccaggcu

SEQ ID NO: 1873140 - RNA, 22 nt, Human herpesvirus 4 (Epstein-Barr virus)
cuuuguggccuuccucugccug

SEQ ID NO: 1873141 - RNA, 14 nt, Human herpesvirus 4 (Epstein-Barr virus)
cacggcccuccagc

SEQ ID NO: 1873142 - RNA, 20 nt, Human herpesvirus 4 (Epstein-Barr virus)
uucgggcaagauggagaggc

SEQ ID NO: 1873143 - RNA, 15 nt, Human herpesvirus 4 (Epstein-Barr virus)
cuggccgagcuggag

SEQ ID NO: 1873144 - RNA, 18 nt, Human herpesvirus 4 (Epstein-Barr virus)
gggccugagacuggaccc

SEQ ID NO: 1873145 - RNA, 20 nt, Human herpesvirus 4 (Epstein-Barr virus)
cuuggccagcggggagaggg

SEQ ID NO: 1873146 - RNA, 16 nt, Human herpesvirus 4 (Epstein-Barr virus)
cggcgugccagaggcc

SEQ ID NO: 1873147 - RNA, 22 nt, Human herpesvirus 4 (Epstein-Barr virus)
gccaauccaugccaauggggga

SEQ ID NO: 1873148 - RNA, 19 nt, Human herpesvirus 4 (Epstein-Barr virus)
gaaugacgggcucccuccc

SEQ ID NO: 1873149 - RNA, 18 nt, Human herpesvirus 4 (Epstein-Barr virus)
cagugccuccgccugagc

SEQ ID NO: 1873150 - RNA, 20 nt, Human herpesvirus 4 (Epstein-Barr virus)
cccguugguggucagcagca

SEQ ID NO: 1873151 - RNA, 18 nt, Human herpesvirus 4 (Epstein-Barr virus)
ccguuccaggcucuccag

SEQ ID NO: 1873152 - RNA, 21 nt, Human herpesvirus 4 (Epstein-Barr virus)
ccaggugugcuucuuuuuggu

SEQ ID NO: 1873153 - RNA, 18 nt, Human herpesvirus 4 (Epstein-Barr virus)
aucucugauuauagcucu

SEQ ID NO: 1873154 - RNA, 15 nt, Human herpesvirus 4 (Epstein-Barr virus)
cuaauucagccaccu

SEQ ID NO: 1873155 - RNA, 17 nt, Human herpesvirus 4 (Epstein-Barr virus)
aaacaggugagucagcc

SEQ ID NO: 1873156 - RNA, 12 nt, Human herpesvirus 4 (Epstein-Barr virus)
gcgcggcagagg

SEQ ID NO: 1873157 - RNA, 20 nt, Human herpesvirus 4 (Epstein-Barr virus)
cuacgagggccucuggcacg

SEQ ID NO: 1873158 - RNA, 22 nt, Human herpesvirus 4 (Epstein-Barr virus)
gcagccgcggccaucaccuggg

SEQ ID NO: 1873159 - RNA, 17 nt, Human herpesvirus 4 (Epstein-Barr virus)
gagacucaggcccucau

SEQ ID NO: 1873160 - RNA, 16 nt, Human herpesvirus 4 (Epstein-Barr virus)
acagcgccagcagggc

SEQ ID NO: 1873161 - RNA, 17 nt, Human herpesvirus 4 (Epstein-Barr virus)
guucagggacuuguccu

SEQ ID NO: 1873162 - RNA, 22 nt, Human herpesvirus 4 (Epstein-Barr virus)
ggcgcccugcgaguccaagcug

SEQ ID NO: 1873163 - RNA, 16 nt, Human herpesvirus 4 (Epstein-Barr virus)
aggccccggccgccgu

SEQ ID NO: 1873164 - RNA, 18 nt, Human herpesvirus 4 (Epstein-Barr virus)
cuguaauucuaugggaau

SEQ ID NO: 1873165 - RNA, 15 nt, Human herpesvirus 4 (Epstein-Barr virus)
caaacacgggccugg

SEQ ID NO: 1873166 - RNA, 17 nt, Human herpesvirus 4 (Epstein-Barr virus)
gcuccgugguccugagg

SEQ ID NO: 1873167 - RNA, 14 nt, Human herpesvirus 4 (Epstein-Barr virus)
agaucgugaggccu

SEQ ID NO: 1873168 - RNA, 13 nt, Human herpesvirus 4 (Epstein-Barr virus)
ccaggcuggugac

SEQ ID NO: 1873169 - RNA, 14 nt, Human herpesvirus 4 (Epstein-Barr virus)
guccugcugaaggg

SEQ ID NO: 1873170 - RNA, 20 nt, Human herpesvirus 4 (Epstein-Barr virus)
accuguccuugucugcugcc

SEQ ID NO: 1873171 - RNA, 17 nt, Human herpesvirus 4 (Epstein-Barr virus)
agcucggccagcaggcc

SEQ ID NO: 1873172 - RNA, 20 nt, Human herpesvirus 4 (Epstein-Barr virus)
ggugcugccugggggcuuug

SEQ ID NO: 1873173 - RNA, 15 nt, Human herpesvirus 4 (Epstein-Barr virus)
uggagcuggacggca

SEQ ID NO: 1873174 - RNA, 19 nt, Human herpesvirus 4 (Epstein-Barr virus)
aggaccauggaugugaaug

SEQ ID NO: 1873175 - RNA, 23 nt, Human herpesvirus 4 (Epstein-Barr virus)
caauguaucccaaauaaauguua

SEQ ID NO: 1873176 - RNA, 18 nt, Human herpesvirus 4 (Epstein-Barr virus)
ggaggaaaugaacccagg

SEQ ID NO: 1873177 - RNA, 16 nt, Human herpesvirus 4 (Epstein-Barr virus)
ccaggcgccgcagggg

SEQ ID NO: 1873178 - RNA, 21 nt, Human herpesvirus 4 (Epstein-Barr virus)
uauggugccggggcccacgug

SEQ ID NO: 1873179 - RNA, 14 nt, Human herpesvirus 4 (Epstein-Barr virus)
ugaggaaggggccu

SEQ ID NO: 1873180 - RNA, 19 nt, Human herpesvirus 4 (Epstein-Barr virus)
uggccucgucaggagggca

SEQ ID NO: 1873181 - RNA, 16 nt, Human herpesvirus 4 (Epstein-Barr virus)
guugucuucccagacu

SEQ ID NO: 1873182 - RNA, 19 nt, Human herpesvirus 4 (Epstein-Barr virus)
gccuguuuguccagcaggg

SEQ ID NO: 1873183 - RNA, 22 nt, Human herpesvirus 4 (Epstein-Barr virus)
cuccgaugcccaccagccagcg

SEQ ID NO: 1873184 - RNA, 12 nt, Human herpesvirus 4 (Epstein-Barr virus)
gcgccggugggg

SEQ ID NO: 1873185 - RNA, 14 nt, Human herpesvirus 4 (Epstein-Barr virus)
cugcguagaugagc

SEQ ID NO: 1873186 - RNA, 14 nt, Human herpesvirus 4 (Epstein-Barr virus)
accguggccaggcc

SEQ ID NO: 1873187 - RNA, 17 nt, Human herpesvirus 4 (Epstein-Barr virus)
gcucggccagcaggccg

SEQ ID NO: 1873188 - RNA, 16 nt, Human herpesvirus 4 (Epstein-Barr virus)
gucaucagccgcugcg

SEQ ID NO: 1873189 - RNA, 15 nt, Human herpesvirus 4 (Epstein-Barr virus)
gaacaggagcaggag

SEQ ID NO: 1873190 - RNA, 23 nt, Human herpesvirus 4 (Epstein-Barr virus)
auagauccugggccccccggagg

SEQ ID NO: 1873191 - RNA, 21 nt, Human herpesvirus 4 (Epstein-Barr virus)
aagcuggacgugaaccucccc

SEQ ID NO: 1873192 - RNA, 23 nt, Human herpesvirus 4 (Epstein-Barr virus)
cugaccucccgcccugagcugga

SEQ ID NO: 1873193 - RNA, 13 nt, Human herpesvirus 4 (Epstein-Barr virus)
gcuucuggcucuu

SEQ ID NO: 1873194 - RNA, 15 nt, Human herpesvirus 4 (Epstein-Barr virus)
cuacgcgggccacag

SEQ ID NO: 1873195 - RNA, 20 nt, Human herpesvirus 4 (Epstein-Barr virus)
caugacagucccguuggugg

SEQ ID NO: 1873196 - RNA, 20 nt, Human herpesvirus 4 (Epstein-Barr virus)
ccgguccccccagaagcccc

SEQ ID NO: 1873197 - RNA, 16 nt, Human herpesvirus 4 (Epstein-Barr virus)
ccucugaugguggccg

SEQ ID NO: 1873198 - RNA, 22 nt, Human herpesvirus 4 (Epstein-Barr virus)
ccuuggcgggucauccgccacc

SEQ ID NO: 1873199 - RNA, 13 nt, Human herpesvirus 4 (Epstein-Barr virus)
gcaacugcguccu

SEQ ID NO: 1873200 - RNA, 16 nt, Human herpesvirus 4 (Epstein-Barr virus)
gccacguccagacucc

SEQ ID NO: 1873201 - RNA, 14 nt, Human herpesvirus 4 (Epstein-Barr virus)
aacaagggaagagg

SEQ ID NO: 1873202 - RNA, 12 nt, Human herpesvirus 4 (Epstein-Barr virus)
cuauaaaaauuc

SEQ ID NO: 1873203 - RNA, 17 nt, Human herpesvirus 4 (Epstein-Barr virus)
gagggccuuccagagcu

SEQ ID NO: 1873204 - RNA, 17 nt, Human herpesvirus 4 (Epstein-Barr virus)
auggagaggggaguggg

SEQ ID NO: 1873205 - RNA, 17 nt, Human herpesvirus 4 (Epstein-Barr virus)
acucucucccccgggcg

SEQ ID NO: 1873206 - RNA, 15 nt, Human herpesvirus 4 (Epstein-Barr virus)
gcgcccuccucuggg

SEQ ID NO: 1873207 - RNA, 17 nt, Human herpesvirus 4 (Epstein-Barr virus)
cgccugcuucacgccuc

SEQ ID NO: 1873208 - RNA, 15 nt, Human herpesvirus 4 (Epstein-Barr virus)
aggaauucuuccaga

SEQ ID NO: 1873209 - RNA, 12 nt, Human herpesvirus 4 (Epstein-Barr virus)
ugcaaggacggg

SEQ ID NO: 1873210 - RNA, 15 nt, Human herpesvirus 4 (Epstein-Barr virus)
gggcuggggagauga

SEQ ID NO: 1873211 - RNA, 12 nt, Human herpesvirus 4 (Epstein-Barr virus)
ccaccacacagc

SEQ ID NO: 1873212 - RNA, 16 nt, Human herpesvirus 4 (Epstein-Barr virus)
ccacacucccuccaga

SEQ ID NO: 1873213 - RNA, 14 nt, Human herpesvirus 4 (Epstein-Barr virus)
ggaaacggcgagca

SEQ ID NO: 1873214 - RNA, 21 nt, Human herpesvirus 4 (Epstein-Barr virus)
aggagccucgccuugagggca

SEQ ID NO: 1873215 - RNA, 17 nt, Human herpesvirus 4 (Epstein-Barr virus)
ugcacgccaacagcgac

SEQ ID NO: 1873216 - RNA, 14 nt, Human herpesvirus 4 (Epstein-Barr virus)
aggccccggccgcc

SEQ ID NO: 1873217 - RNA, 16 nt, Human herpesvirus 4 (Epstein-Barr virus)
ggcggcugcugagacc

SEQ ID NO: 1873218 - RNA, 20 nt, Human herpesvirus 4 (Epstein-Barr virus)
ugcugcggcuaugcagccca

SEQ ID NO: 1873219 - RNA, 16 nt, Human herpesvirus 4 (Epstein-Barr virus)
auuuuauuuacagcca

SEQ ID NO: 1873220 - RNA, 21 nt, Human herpesvirus 4 (Epstein-Barr virus)
aacuggccaugcaggccugga

SEQ ID NO: 1873221 - RNA, 10 nt, Human herpesvirus 4 (Epstein-Barr virus)
ucucaggccu

SEQ ID NO: 1873222 - RNA, 22 nt, Human herpesvirus 4 (Epstein-Barr virus)
gucaugacaauuuuagaugagg

SEQ ID NO: 1873223 - RNA, 20 nt, Human herpesvirus 4 (Epstein-Barr virus)
cuucuggcacgacuguuccu

SEQ ID NO: 1873224 - RNA, 20 nt, Human herpesvirus 4 (Epstein-Barr virus)
ugacagcugucacccaugcc

SEQ ID NO: 1873225 - RNA, 18 nt, Human herpesvirus 4 (Epstein-Barr virus)
agguguccagcgcucugg

SEQ ID NO: 1873226 - RNA, 21 nt, Human herpesvirus 4 (Epstein-Barr virus)
aagcuacaaacacgggccugg

SEQ ID NO: 1873227 - RNA, 22 nt, Human herpesvirus 4 (Epstein-Barr virus)
cucauuucaguggcccucagaa

SEQ ID NO: 1873228 - RNA, 13 nt, Human herpesvirus 4 (Epstein-Barr virus)
aggagcuguuugg

SEQ ID NO: 1873229 - RNA, 20 nt, Human herpesvirus 4 (Epstein-Barr virus)
cugagcaagauccuucuggc

SEQ ID NO: 1873230 - RNA, 13 nt, Human herpesvirus 4 (Epstein-Barr virus)
caugcaggccugg

SEQ ID NO: 1873231 - RNA, 21 nt, Human herpesvirus 4 (Epstein-Barr virus)
uccagagaggcgcagcccagc

SEQ ID NO: 1873232 - RNA, 22 nt, Human herpesvirus 4 (Epstein-Barr virus)
agcacgguagccuugggggccu

SEQ ID NO: 1873233 - RNA, 19 nt, Human herpesvirus 4 (Epstein-Barr virus)
agcccccucccgccccugu

SEQ ID NO: 1873234 - RNA, 14 nt, Human herpesvirus 4 (Epstein-Barr virus)
ugagccacacccac

SEQ ID NO: 1873235 - RNA, 22 nt, Human herpesvirus 4 (Epstein-Barr virus)
agccacccgucccggguacaag

SEQ ID NO: 1873236 - RNA, 23 nt, Human herpesvirus 4 (Epstein-Barr virus)
uggcacacgccagagacaaggca

SEQ ID NO: 1873237 - RNA, 15 nt, Human herpesvirus 4 (Epstein-Barr virus)
ccucuuuuggcuggc

SEQ ID NO: 1873238 - RNA, 21 nt, Human herpesvirus 4 (Epstein-Barr virus)
cgccccgaugcggaggacugc

SEQ ID NO: 1873239 - RNA, 16 nt, Human herpesvirus 4 (Epstein-Barr virus)
agcagcuggauguaca

SEQ ID NO: 1873240 - RNA, 20 nt, Human herpesvirus 4 (Epstein-Barr virus)
caccggagccaccacagcac

SEQ ID NO: 1873241 - RNA, 16 nt, Human herpesvirus 4 (Epstein-Barr virus)
cugccuggggaaaaug

SEQ ID NO: 1873242 - RNA, 19 nt, Human herpesvirus 4 (Epstein-Barr virus)
ccagaguucccggcugcuc

SEQ ID NO: 1873243 - RNA, 21 nt, Human herpesvirus 4 (Epstein-Barr virus)
ucacaccccacggccaugcua

SEQ ID NO: 1873244 - RNA, 12 nt, Human herpesvirus 4 (Epstein-Barr virus)
guaugggggccc

SEQ ID NO: 1873245 - RNA, 18 nt, Human herpesvirus 4 (Epstein-Barr virus)
uggcggcuauugccgccu

SEQ ID NO: 1873246 - RNA, 21 nt, Human herpesvirus 4 (Epstein-Barr virus)
agugcaacaaucuggacucuc

SEQ ID NO: 1873247 - RNA, 16 nt, Human herpesvirus 4 (Epstein-Barr virus)
gcuuugcgaaaacgaa

SEQ ID NO: 1873248 - RNA, 15 nt, Human herpesvirus 4 (Epstein-Barr virus)
cuuucaguggucacc

SEQ ID NO: 1873249 - RNA, 20 nt, Human herpesvirus 4 (Epstein-Barr virus)
ugcgaggaacuggcucagcu

SEQ ID NO: 1873250 - RNA, 17 nt, Human herpesvirus 4 (Epstein-Barr virus)
uuuucugccccucagcc

SEQ ID NO: 1873251 - RNA, 13 nt, Human herpesvirus 4 (Epstein-Barr virus)
augagggaaaagg

SEQ ID NO: 1873252 - RNA, 14 nt, Human herpesvirus 4 (Epstein-Barr virus)
gaccuggaugcugu

SEQ ID NO: 1873253 - RNA, 14 nt, Human herpesvirus 4 (Epstein-Barr virus)
gcgagaaaaugagc

SEQ ID NO: 1873254 - RNA, 16 nt, Human herpesvirus 4 (Epstein-Barr virus)
cuucaggggaaucucu

SEQ ID NO: 1873255 - RNA, 15 nt, Human herpesvirus 4 (Epstein-Barr virus)
gcaacauccggggca

SEQ ID NO: 1873256 - RNA, 16 nt, Human herpesvirus 4 (Epstein-Barr virus)
ucagcuucgaggucuc

SEQ ID NO: 1873257 - RNA, 16 nt, Human herpesvirus 4 (Epstein-Barr virus)
cccuccgcauccuagg

SEQ ID NO: 1873258 - RNA, 13 nt, Human herpesvirus 4 (Epstein-Barr virus)
ugaggagcgccca

SEQ ID NO: 1873259 - RNA, 17 nt, Human herpesvirus 4 (Epstein-Barr virus)
acucccccaaacauguc

SEQ ID NO: 1873260 - RNA, 15 nt, Human herpesvirus 4 (Epstein-Barr virus)
uucccgacgccaaug

SEQ ID NO: 1873261 - RNA, 13 nt, Human herpesvirus 4 (Epstein-Barr virus)
ggcaaaccuccaa

SEQ ID NO: 1873262 - RNA, 13 nt, Human herpesvirus 4 (Epstein-Barr virus)
uagccccuaggcc

SEQ ID NO: 1873263 - RNA, 15 nt, Human herpesvirus 4 (Epstein-Barr virus)
caccaccccccccac

SEQ ID NO: 1873264 - RNA, 16 nt, Human herpesvirus 4 (Epstein-Barr virus)
ggaagacaacgaggua

SEQ ID NO: 1873265 - RNA, 14 nt, Human herpesvirus 4 (Epstein-Barr virus)
caguucuggugaug

SEQ ID NO: 1873266 - RNA, 18 nt, Human herpesvirus 4 (Epstein-Barr virus)
gcacgagaccccugggcu

SEQ ID NO: 1873267 - RNA, 15 nt, Human herpesvirus 4 (Epstein-Barr virus)
ccuuagccacacugu

SEQ ID NO: 1873268 - RNA, 22 nt, Human herpesvirus 4 (Epstein-Barr virus)
ccacggcgaccuguuccgcuuc

SEQ ID NO: 1873269 - RNA, 19 nt, Human herpesvirus 4 (Epstein-Barr virus)
cugcuucuggaccgugcca

SEQ ID NO: 1873270 - RNA, 16 nt, Human herpesvirus 4 (Epstein-Barr virus)
gucgcccccucugccu

SEQ ID NO: 1873271 - RNA, 14 nt, Human herpesvirus 4 (Epstein-Barr virus)
uuugcaaacaaacu

SEQ ID NO: 1873272 - RNA, 13 nt, Human herpesvirus 4 (Epstein-Barr virus)
gugccuccagagc

SEQ ID NO: 1873273 - RNA, 17 nt, Human herpesvirus 4 (Epstein-Barr virus)
ccucuagcaucugcuau

SEQ ID NO: 1873274 - RNA, 17 nt, Human herpesvirus 4 (Epstein-Barr virus)
acacuugugguucuccu

SEQ ID NO: 1873275 - RNA, 19 nt, Human herpesvirus 4 (Epstein-Barr virus)
cucccauguaagccugccu

SEQ ID NO: 1873276 - RNA, 19 nt, Human herpesvirus 4 (Epstein-Barr virus)
auuguaucucggucuuggc

SEQ ID NO: 1873277 - RNA, 15 nt, Human herpesvirus 4 (Epstein-Barr virus)
ccccgggagccacgg

SEQ ID NO: 1873278 - RNA, 18 nt, Human herpesvirus 4 (Epstein-Barr virus)
uaggugccuccagagccc

SEQ ID NO: 1873279 - RNA, 15 nt, Human herpesvirus 4 (Epstein-Barr virus)
ccagggacagggcgc

SEQ ID NO: 1873280 - RNA, 22 nt, Human herpesvirus 4 (Epstein-Barr virus)
ugcuucgcauuacaccauccca

SEQ ID NO: 1873281 - RNA, 17 nt, Human herpesvirus 4 (Epstein-Barr virus)
gugccagaugugccugg

SEQ ID NO: 1873282 - RNA, 16 nt, Human herpesvirus 4 (Epstein-Barr virus)
cuauagauccugggcc

SEQ ID NO: 1873283 - RNA, 15 nt, Human herpesvirus 4 (Epstein-Barr virus)
agcggccuccgccgu

SEQ ID NO: 1873284 - RNA, 22 nt, Human herpesvirus 4 (Epstein-Barr virus)
aggccgagucaguuacacacac

SEQ ID NO: 1873285 - RNA, 20 nt, Human herpesvirus 4 (Epstein-Barr virus)
ugggguccucaaggauggca

SEQ ID NO: 1873286 - RNA, 21 nt, Human herpesvirus 4 (Epstein-Barr virus)
cauucgugaguccagggcccu

SEQ ID NO: 1873287 - RNA, 15 nt, Human herpesvirus 4 (Epstein-Barr virus)
caaggugucaauaau

SEQ ID NO: 1873288 - RNA, 16 nt, Human herpesvirus 4 (Epstein-Barr virus)
gccauucgacaggcca

SEQ ID NO: 1873289 - RNA, 22 nt, Human herpesvirus 4 (Epstein-Barr virus)
cuggccaccacaucggacgggc

SEQ ID NO: 1873290 - RNA, 18 nt, Human herpesvirus 4 (Epstein-Barr virus)
aguugggguccucaagga

SEQ ID NO: 1873291 - RNA, 15 nt, Human herpesvirus 4 (Epstein-Barr virus)
agccagcgcacccgg

SEQ ID NO: 1873292 - RNA, 13 nt, Human herpesvirus 4 (Epstein-Barr virus)
cuccggcugcccg

SEQ ID NO: 1873293 - RNA, 18 nt, Human herpesvirus 4 (Epstein-Barr virus)
uagccuugggggccugga

SEQ ID NO: 1873294 - RNA, 16 nt, Human herpesvirus 4 (Epstein-Barr virus)
cuccucagucuuugca

SEQ ID NO: 1873295 - RNA, 19 nt, Human herpesvirus 4 (Epstein-Barr virus)
uugaucuuugacugacaca

SEQ ID NO: 1873296 - RNA, 22 nt, Human herpesvirus 4 (Epstein-Barr virus)
cuuccacccccuggagccagcg

SEQ ID NO: 1873297 - RNA, 13 nt, Human herpesvirus 4 (Epstein-Barr virus)
aagucaggauucu

SEQ ID NO: 1873298 - RNA, 21 nt, Human herpesvirus 4 (Epstein-Barr virus)
gccaaccugcucucucuggag

SEQ ID NO: 1873299 - RNA, 19 nt, Human herpesvirus 4 (Epstein-Barr virus)
cucuggcugugcugacccu

SEQ ID NO: 1873300 - RNA, 18 nt, Human herpesvirus 4 (Epstein-Barr virus)
cauuggcagcagcucugg

SEQ ID NO: 1873301 - RNA, 15 nt, Human herpesvirus 4 (Epstein-Barr virus)
agagugcccuggagg

SEQ ID NO: 1873302 - RNA, 22 nt, Human herpesvirus 4 (Epstein-Barr virus)
uggccuucucugauggccugga

SEQ ID NO: 1873303 - RNA, 20 nt, Human herpesvirus 4 (Epstein-Barr virus)
uucuggccaaccugccucuc

SEQ ID NO: 1873304 - RNA, 14 nt, Human herpesvirus 4 (Epstein-Barr virus)
guauccaccuagaa

SEQ ID NO: 1873305 - RNA, 22 nt, Human herpesvirus 4 (Epstein-Barr virus)
ccuagagguuuugcuagggagg

SEQ ID NO: 1873306 - RNA, 19 nt, Human herpesvirus 4 (Epstein-Barr virus)
gcccucuuccgugccucgg

SEQ ID NO: 1873307 - RNA, 12 nt, Human herpesvirus 4 (Epstein-Barr virus)
guggcugcugcc

SEQ ID NO: 1873308 - RNA, 23 nt, Human herpesvirus 4 (Epstein-Barr virus)
agccacccgucccggguacaagu

SEQ ID NO: 1873309 - RNA, 16 nt, Human herpesvirus 4 (Epstein-Barr virus)
auucaucagaagcuac

SEQ ID NO: 1873310 - RNA, 16 nt, Human herpesvirus 4 (Epstein-Barr virus)
ccuuccucugcccgcu

SEQ ID NO: 1873311 - RNA, 16 nt, Human herpesvirus 4 (Epstein-Barr virus)
gccugccaaagagcca

SEQ ID NO: 1873312 - RNA, 20 nt, Human herpesvirus 4 (Epstein-Barr virus)
gccucgccuucuccucagcc

SEQ ID NO: 1873313 - RNA, 18 nt, Human herpesvirus 4 (Epstein-Barr virus)
aaccccuaccucggcauc

SEQ ID NO: 1873314 - RNA, 13 nt, Human herpesvirus 4 (Epstein-Barr virus)
cccugucaccagg

SEQ ID NO: 1873315 - RNA, 21 nt, Human herpesvirus 4 (Epstein-Barr virus)
cuacucguuuaagguccgcuc

SEQ ID NO: 1873316 - RNA, 17 nt, Human herpesvirus 4 (Epstein-Barr virus)
aucugacacuuuagagc

SEQ ID NO: 1873317 - RNA, 18 nt, Human herpesvirus 4 (Epstein-Barr virus)
uguacagaaacagagagu

SEQ ID NO: 1873318 - RNA, 23 nt, Human herpesvirus 4 (Epstein-Barr virus)
acuggaugcaggaccuagaaugu

SEQ ID NO: 1873319 - RNA, 17 nt, Human herpesvirus 4 (Epstein-Barr virus)
gcaugagcuccucucca

SEQ ID NO: 1873320 - RNA, 18 nt, Human herpesvirus 4 (Epstein-Barr virus)
aaaacagaggcuggaugc

SEQ ID NO: 1873321 - RNA, 18 nt, Human herpesvirus 4 (Epstein-Barr virus)
cacucuggggucucaggc

SEQ ID NO: 1873322 - RNA, 15 nt, Human herpesvirus 4 (Epstein-Barr virus)
gguccugaggggcgg

SEQ ID NO: 1873323 - RNA, 17 nt, Human herpesvirus 4 (Epstein-Barr virus)
gcuccgagagcuccgcc

SEQ ID NO: 1873324 - RNA, 19 nt, Human herpesvirus 4 (Epstein-Barr virus)
gucuagccacauagcaggu

SEQ ID NO: 1873325 - RNA, 21 nt, Human herpesvirus 4 (Epstein-Barr virus)
aacucugcccuucagugucug

SEQ ID NO: 1873326 - RNA, 13 nt, Human herpesvirus 4 (Epstein-Barr virus)
guaccagaagagu

SEQ ID NO: 1873327 - RNA, 13 nt, Human herpesvirus 4 (Epstein-Barr virus)
cccggcucucagg

SEQ ID NO: 1873328 - RNA, 22 nt, Human herpesvirus 4 (Epstein-Barr virus)
uccgugagagccuacccaugac

SEQ ID NO: 1873329 - RNA, 19 nt, Human herpesvirus 4 (Epstein-Barr virus)
uggacgagggggcgcggcu

SEQ ID NO: 1873330 - RNA, 12 nt, Human herpesvirus 4 (Epstein-Barr virus)
gugcccccacca

SEQ ID NO: 1873331 - RNA, 17 nt, Human herpesvirus 4 (Epstein-Barr virus)
ucaacuucagcuccagg

SEQ ID NO: 1873332 - RNA, 19 nt, Human herpesvirus 4 (Epstein-Barr virus)
ggggcaggaggggcaggag

SEQ ID NO: 1873333 - RNA, 22 nt, Human herpesvirus 4 (Epstein-Barr virus)
ccccauacaugucucagaggcc

SEQ ID NO: 1873334 - RNA, 12 nt, Human herpesvirus 4 (Epstein-Barr virus)
ccagcugguggu

SEQ ID NO: 1873335 - RNA, 13 nt, Human herpesvirus 4 (Epstein-Barr virus)
cugacauuucuca

SEQ ID NO: 1873336 - RNA, 20 nt, Human herpesvirus 4 (Epstein-Barr virus)
gcuuugagcuaaugccauag

SEQ ID NO: 1873337 - RNA, 19 nt, Human herpesvirus 4 (Epstein-Barr virus)
uagccucgcgacucguggg

SEQ ID NO: 1873338 - RNA, 12 nt, Human herpesvirus 4 (Epstein-Barr virus)
ggggcuggccug

SEQ ID NO: 1873339 - RNA, 15 nt, Human herpesvirus 4 (Epstein-Barr virus)
uaacugccagagcug

SEQ ID NO: 1873340 - RNA, 22 nt, Human herpesvirus 4 (Epstein-Barr virus)
acuggcacacacucccuuagcc

SEQ ID NO: 1873341 - RNA, 20 nt, Human herpesvirus 4 (Epstein-Barr virus)
acuuauuggagaugcucugg

SEQ ID NO: 1873342 - RNA, 12 nt, Human herpesvirus 4 (Epstein-Barr virus)
gagcgccguggc

SEQ ID NO: 1873343 - RNA, 11 nt, Human herpesvirus 4 (Epstein-Barr virus)
cgcugcugcua

SEQ ID NO: 1873344 - RNA, 21 nt, Human herpesvirus 4 (Epstein-Barr virus)
gccaagguugaagagcagauu

SEQ ID NO: 1873345 - RNA, 15 nt, Human herpesvirus 4 (Epstein-Barr virus)
cgccuccucgcaggc

SEQ ID NO: 1873346 - RNA, 15 nt, Human herpesvirus 4 (Epstein-Barr virus)
cuaggcgggcgggcu

SEQ ID NO: 1873347 - RNA, 14 nt, Human herpesvirus 4 (Epstein-Barr virus)
caggguccaggaga

SEQ ID NO: 1873348 - RNA, 13 nt, Human herpesvirus 4 (Epstein-Barr virus)
gggggaaugaggg

SEQ ID NO: 1873349 - RNA, 23 nt, Human herpesvirus 4 (Epstein-Barr virus)
cucagaugccggccaugcgcuuu

SEQ ID NO: 1873350 - RNA, 19 nt, Human herpesvirus 4 (Epstein-Barr virus)
ccaggagucugcugcggcu

SEQ ID NO: 1873351 - RNA, 16 nt, Human herpesvirus 4 (Epstein-Barr virus)
gagggcacggcaaggc

SEQ ID NO: 1873352 - RNA, 21 nt, Human herpesvirus 4 (Epstein-Barr virus)
cacacauuucagguaccccaa

SEQ ID NO: 1873353 - RNA, 16 nt, Human herpesvirus 4 (Epstein-Barr virus)
cuaaaagcagccaccu

SEQ ID NO: 1873354 - RNA, 23 nt, Human herpesvirus 4 (Epstein-Barr virus)
caccugcacgagaccccugggcu

SEQ ID NO: 1873355 - RNA, 19 nt, Human herpesvirus 4 (Epstein-Barr virus)
uccagacgcgauggcacac

SEQ ID NO: 1873356 - RNA, 17 nt, Human herpesvirus 4 (Epstein-Barr virus)
ucuggcugugcugaccc

SEQ ID NO: 1873357 - RNA, 17 nt, Human herpesvirus 4 (Epstein-Barr virus)
cugcacggcccuccagc

SEQ ID NO: 1873358 - RNA, 13 nt, Human herpesvirus 4 (Epstein-Barr virus)
agccggccaggca

SEQ ID NO: 1873359 - RNA, 17 nt, Human herpesvirus 4 (Epstein-Barr virus)
ucuacgccccagaugaa

SEQ ID NO: 1873360 - RNA, 20 nt, Human herpesvirus 4 (Epstein-Barr virus)
guccugggccucccaccacc

SEQ ID NO: 1873361 - RNA, 17 nt, Human herpesvirus 4 (Epstein-Barr virus)
gccuugggggugguggg

SEQ ID NO: 1873362 - RNA, 18 nt, Human herpesvirus 4 (Epstein-Barr virus)
ccggcgcuguguggcuga

SEQ ID NO: 1873363 - RNA, 23 nt, Human herpesvirus 4 (Epstein-Barr virus)
acuacuuguuucuggaaugcuuc

SEQ ID NO: 1873364 - RNA, 18 nt, Human herpesvirus 4 (Epstein-Barr virus)
auguaucccaaauaaaug

SEQ ID NO: 1873365 - RNA, 13 nt, Human herpesvirus 4 (Epstein-Barr virus)
ccgugcaccugcc

SEQ ID NO: 1873366 - RNA, 13 nt, Human herpesvirus 4 (Epstein-Barr virus)
acuaauguggugg

SEQ ID NO: 1873367 - RNA, 13 nt, Human herpesvirus 4 (Epstein-Barr virus)
agcaggaggaggg

SEQ ID NO: 1873368 - RNA, 22 nt, Human herpesvirus 4 (Epstein-Barr virus)
gcagauagccggccaggcagag

SEQ ID NO: 1873369 - RNA, 18 nt, Human herpesvirus 4 (Epstein-Barr virus)
gagcauggcggccuggca

SEQ ID NO: 1873370 - RNA, 21 nt, Human herpesvirus 4 (Epstein-Barr virus)
caccuugaggugccacagagc

SEQ ID NO: 1873371 - RNA, 13 nt, Human herpesvirus 4 (Epstein-Barr virus)
gccacauagcagg

SEQ ID NO: 1873372 - RNA, 22 nt, Human herpesvirus 4 (Epstein-Barr virus)
ugccuggaagaaucauggccua

SEQ ID NO: 1873373 - RNA, 15 nt, Human herpesvirus 4 (Epstein-Barr virus)
agugggugggcauug

SEQ ID NO: 1873374 - RNA, 13 nt, Human herpesvirus 4 (Epstein-Barr virus)
uugcuagggagga

SEQ ID NO: 1873375 - RNA, 20 nt, Human herpesvirus 4 (Epstein-Barr virus)
uccgcuuuaagaccaaggcc

SEQ ID NO: 1873376 - RNA, 13 nt, Human herpesvirus 4 (Epstein-Barr virus)
acacaaaaugagg

SEQ ID NO: 1873377 - RNA, 18 nt, Human herpesvirus 4 (Epstein-Barr virus)
ggcaucauguuuuuggca

SEQ ID NO: 1873378 - RNA, 18 nt, Human herpesvirus 4 (Epstein-Barr virus)
cagccccgcccuccccau

SEQ ID NO: 1873379 - RNA, 21 nt, Human herpesvirus 4 (Epstein-Barr virus)
gggccauucgugaguccaggg

SEQ ID NO: 1873380 - RNA, 22 nt, Human herpesvirus 4 (Epstein-Barr virus)
aaggcucuucgggcaagaugga

SEQ ID NO: 1873381 - RNA, 13 nt, Human herpesvirus 4 (Epstein-Barr virus)
caauacccaggau

SEQ ID NO: 1873382 - RNA, 21 nt, Human herpesvirus 4 (Epstein-Barr virus)
gccaucgcaagcuccuuugcc

SEQ ID NO: 1873383 - RNA, 17 nt, Human herpesvirus 4 (Epstein-Barr virus)
aucagaauuagcaucag

SEQ ID NO: 1873384 - RNA, 23 nt, Human herpesvirus 4 (Epstein-Barr virus)
ccaggaccuggaugcuguagugg

SEQ ID NO: 1873385 - RNA, 19 nt, Human herpesvirus 4 (Epstein-Barr virus)
ucaucuauuagcagccucc

SEQ ID NO: 1873386 - RNA, 21 nt, Human herpesvirus 4 (Epstein-Barr virus)
gaaaauaguuccaggugacag

SEQ ID NO: 1873387 - RNA, 20 nt, Human herpesvirus 4 (Epstein-Barr virus)
ugcugcuacuggcuuucguc

SEQ ID NO: 1873388 - RNA, 16 nt, Human herpesvirus 4 (Epstein-Barr virus)
cugcggaguugagccc

SEQ ID NO: 1873389 - RNA, 15 nt, Human herpesvirus 4 (Epstein-Barr virus)
cauuccuaggagaag

SEQ ID NO: 1873390 - RNA, 14 nt, Human herpesvirus 4 (Epstein-Barr virus)
ccaagcggcacaga

SEQ ID NO: 1873391 - RNA, 21 nt, Human herpesvirus 4 (Epstein-Barr virus)
aaauacuucucuagagccagg

SEQ ID NO: 1873392 - RNA, 14 nt, Human herpesvirus 4 (Epstein-Barr virus)
caagugcuaugacc

SEQ ID NO: 1873393 - RNA, 14 nt, Human herpesvirus 4 (Epstein-Barr virus)
cauugcaccuugcc

SEQ ID NO: 1873394 - RNA, 17 nt, Human herpesvirus 4 (Epstein-Barr virus)
ucacauauccagagcug

SEQ ID NO: 1873395 - RNA, 19 nt, Human herpesvirus 4 (Epstein-Barr virus)
gaggcacacaaaaugagga

SEQ ID NO: 1873396 - RNA, 20 nt, Human herpesvirus 4 (Epstein-Barr virus)
gagaugugaauugggauggu

SEQ ID NO: 1873397 - RNA, 18 nt, Human herpesvirus 4 (Epstein-Barr virus)
cggagguggagaggcccg

SEQ ID NO: 1873398 - RNA, 21 nt, Human herpesvirus 4 (Epstein-Barr virus)
cuggcggccgcugcgcccugu

SEQ ID NO: 1873399 - RNA, 20 nt, Human herpesvirus 4 (Epstein-Barr virus)
ccucaacaaggagugccucu

SEQ ID NO: 1873400 - RNA, 14 nt, Human herpesvirus 4 (Epstein-Barr virus)
agguguccagcgcu

SEQ ID NO: 1873401 - RNA, 22 nt, Human herpesvirus 4 (Epstein-Barr virus)
ccgggagaggcagccccaaagc

SEQ ID NO: 1873402 - RNA, 21 nt, Human herpesvirus 4 (Epstein-Barr virus)
gcgacggcuuuagccuggccu

SEQ ID NO: 1873403 - RNA, 14 nt, Human herpesvirus 4 (Epstein-Barr virus)
ucccccccagaccu

SEQ ID NO: 1873404 - RNA, 18 nt, Human herpesvirus 4 (Epstein-Barr virus)
ucucccccgggcgcugcc

SEQ ID NO: 1873405 - RNA, 16 nt, Human herpesvirus 4 (Epstein-Barr virus)
ccagcagauccagggc

SEQ ID NO: 1873406 - RNA, 15 nt, Human herpesvirus 4 (Epstein-Barr virus)
cugccgcuacugcug

SEQ ID NO: 1873407 - RNA, 17 nt, Human herpesvirus 4 (Epstein-Barr virus)
gcuggcucgccucaucc

SEQ ID NO: 1873408 - RNA, 22 nt, Human herpesvirus 4 (Epstein-Barr virus)
cgucccagggccggaaccugag

SEQ ID NO: 1873409 - RNA, 14 nt, Human herpesvirus 4 (Epstein-Barr virus)
cccagccacagcac

SEQ ID NO: 1873410 - RNA, 22 nt, Human herpesvirus 4 (Epstein-Barr virus)
caaauaaauguuacuucuuuug

SEQ ID NO: 1873411 - RNA, 18 nt, Human herpesvirus 4 (Epstein-Barr virus)
ggagguaauuagcacggu

SEQ ID NO: 1873412 - RNA, 17 nt, Human herpesvirus 4 (Epstein-Barr virus)
gaaaccccacggagcag

SEQ ID NO: 1873413 - RNA, 16 nt, Human herpesvirus 4 (Epstein-Barr virus)
acgaccuugaccacga

SEQ ID NO: 1873414 - RNA, 13 nt, Human herpesvirus 4 (Epstein-Barr virus)
gauggcggggccu

SEQ ID NO: 1873415 - RNA, 20 nt, Human herpesvirus 4 (Epstein-Barr virus)
guggcuacuugcucagguuu

SEQ ID NO: 1873416 - RNA, 14 nt, Human herpesvirus 4 (Epstein-Barr virus)
ccauaccaggugcc

SEQ ID NO: 1873417 - RNA, 23 nt, Human herpesvirus 4 (Epstein-Barr virus)
gucugagaauaaggcucugaagc

SEQ ID NO: 1873418 - RNA, 20 nt, Human herpesvirus 4 (Epstein-Barr virus)
ucgcugaaucuaguaugaag

SEQ ID NO: 1873419 - RNA, 13 nt, Human herpesvirus 4 (Epstein-Barr virus)
uggugccggggcc

SEQ ID NO: 1873420 - RNA, 16 nt, Human herpesvirus 4 (Epstein-Barr virus)
uuauucuugauugccu

SEQ ID NO: 1873421 - RNA, 13 nt, Human herpesvirus 4 (Epstein-Barr virus)
ucagaaaagugag

SEQ ID NO: 1873422 - RNA, 19 nt, Human herpesvirus 4 (Epstein-Barr virus)
guaaaacuuggaggcugcu

SEQ ID NO: 1873423 - RNA, 22 nt, Human herpesvirus 4 (Epstein-Barr virus)
acuaucacccauggccaggcuc

SEQ ID NO: 1873424 - RNA, 13 nt, Human herpesvirus 4 (Epstein-Barr virus)
ccgaacaugggua

SEQ ID NO: 1873425 - RNA, 18 nt, Human herpesvirus 4 (Epstein-Barr virus)
auccugcguggcuggacg

SEQ ID NO: 1873426 - RNA, 18 nt, Human herpesvirus 4 (Epstein-Barr virus)
gguccaggguccaggaga

SEQ ID NO: 1873427 - RNA, 13 nt, Human herpesvirus 4 (Epstein-Barr virus)
gcgccccagggca

SEQ ID NO: 1873428 - RNA, 12 nt, Human herpesvirus 4 (Epstein-Barr virus)
gaaucucugcca

SEQ ID NO: 1873429 - RNA, 14 nt, Human herpesvirus 4 (Epstein-Barr virus)
cccgggggcgggag

SEQ ID NO: 1873430 - RNA, 14 nt, Human herpesvirus 4 (Epstein-Barr virus)
gcagccacguccag

SEQ ID NO: 1873431 - RNA, 16 nt, Human herpesvirus 4 (Epstein-Barr virus)
cugcuagcgucacuga

SEQ ID NO: 1873432 - RNA, 20 nt, Human herpesvirus 4 (Epstein-Barr virus)
auguaucccaaauaaauguu

SEQ ID NO: 1873433 - RNA, 14 nt, Human herpesvirus 4 (Epstein-Barr virus)
cuucguauaugugu

SEQ ID NO: 1873434 - RNA, 14 nt, Human herpesvirus 4 (Epstein-Barr virus)
agcuggacgagguc

SEQ ID NO: 1873435 - RNA, 13 nt, Human herpesvirus 4 (Epstein-Barr virus)
cuccuccacccag

SEQ ID NO: 1873436 - RNA, 20 nt, Human herpesvirus 4 (Epstein-Barr virus)
gcaggaggggcaggaggggc

SEQ ID NO: 1873437 - RNA, 16 nt, Human herpesvirus 4 (Epstein-Barr virus)
cggggguggcagcccc

SEQ ID NO: 1873438 - RNA, 17 nt, Human herpesvirus 4 (Epstein-Barr virus)
aggcuggugccuuggcu

SEQ ID NO: 1873439 - RNA, 14 nt, Human herpesvirus 4 (Epstein-Barr virus)
gcugguuggggcug

SEQ ID NO: 1873440 - RNA, 15 nt, Human herpesvirus 4 (Epstein-Barr virus)
aucaauggaacccua

SEQ ID NO: 1873441 - RNA, 23 nt, Human herpesvirus 4 (Epstein-Barr virus)
cugcccauccaucaacuucagcu

SEQ ID NO: 1873442 - RNA, 20 nt, Human herpesvirus 4 (Epstein-Barr virus)
gucaccagcuucgagagcca

SEQ ID NO: 1873443 - RNA, 23 nt, Human herpesvirus 4 (Epstein-Barr virus)
uacagcuacaccgaucaccagac

SEQ ID NO: 1873444 - RNA, 14 nt, Human herpesvirus 4 (Epstein-Barr virus)
agauugccuucugu

SEQ ID NO: 1873445 - RNA, 21 nt, Human herpesvirus 4 (Epstein-Barr virus)
ccaucagcucgcccacacagc

SEQ ID NO: 1873446 - RNA, 17 nt, Human herpesvirus 4 (Epstein-Barr virus)
acaacacauagaauugu

SEQ ID NO: 1873447 - RNA, 19 nt, Human herpesvirus 4 (Epstein-Barr virus)
gguccaucuuaggagcccg

SEQ ID NO: 1873448 - RNA, 17 nt, Human herpesvirus 4 (Epstein-Barr virus)
cccccuggcggcccagc

SEQ ID NO: 1873449 - RNA, 21 nt, Human herpesvirus 4 (Epstein-Barr virus)
uggugggcuccuuagacugag

SEQ ID NO: 1873450 - RNA, 19 nt, Human herpesvirus 4 (Epstein-Barr virus)
ccacggccguagcccaguc

SEQ ID NO: 1873451 - RNA, 22 nt, Human herpesvirus 4 (Epstein-Barr virus)
cucccgccccuguccacugccc

SEQ ID NO: 1873452 - RNA, 19 nt, Human herpesvirus 4 (Epstein-Barr virus)
augagcgauuuuaucacag

SEQ ID NO: 1873453 - RNA, 13 nt, Human herpesvirus 4 (Epstein-Barr virus)
ugcccaagccugg

SEQ ID NO: 1873454 - RNA, 16 nt, Human herpesvirus 4 (Epstein-Barr virus)
ucaggccgccgcaucc

SEQ ID NO: 1873455 - RNA, 16 nt, Human herpesvirus 4 (Epstein-Barr virus)
uuagcuauuccaccaa

SEQ ID NO: 1873456 - RNA, 18 nt, Human herpesvirus 4 (Epstein-Barr virus)
gccccucagccugcuccu

SEQ ID NO: 1873457 - RNA, 15 nt, Human herpesvirus 4 (Epstein-Barr virus)
ucuccaucagggcca

SEQ ID NO: 1873458 - RNA, 18 nt, Human herpesvirus 4 (Epstein-Barr virus)
cucucuggagaucuucuc

SEQ ID NO: 1873459 - RNA, 15 nt, Human herpesvirus 4 (Epstein-Barr virus)
cccaccacccccacc

SEQ ID NO: 1873460 - RNA, 21 nt, Human herpesvirus 4 (Epstein-Barr virus)
uccaggaucucccgcgccgca

SEQ ID NO: 1873461 - RNA, 18 nt, Human herpesvirus 4 (Epstein-Barr virus)
ucaugcagggugcacaga

SEQ ID NO: 1873462 - RNA, 21 nt, Human herpesvirus 4 (Epstein-Barr virus)
agcgccucgcucagcccacua

SEQ ID NO: 1873463 - RNA, 16 nt, Human herpesvirus 4 (Epstein-Barr virus)
ccaagauagugaccaa

SEQ ID NO: 1873464 - RNA, 22 nt, Human herpesvirus 4 (Epstein-Barr virus)
acccaccccuccuacacacauc

SEQ ID NO: 1873465 - RNA, 22 nt, Human herpesvirus 4 (Epstein-Barr virus)
uggaguccaugaccagggggca

SEQ ID NO: 1873466 - RNA, 14 nt, Human herpesvirus 4 (Epstein-Barr virus)
gacugcaaacccug

SEQ ID NO: 1873467 - RNA, 19 nt, Human herpesvirus 4 (Epstein-Barr virus)
cccgagccccgccuggcgg

SEQ ID NO: 1873468 - RNA, 12 nt, Human herpesvirus 4 (Epstein-Barr virus)
cguggagcugga

SEQ ID NO: 1873469 - RNA, 19 nt, Human herpesvirus 4 (Epstein-Barr virus)
ccgguccccccagaagccc

SEQ ID NO: 1873470 - RNA, 15 nt, Human herpesvirus 4 (Epstein-Barr virus)
ugaggccugagagcc

SEQ ID NO: 1873471 - RNA, 19 nt, Human herpesvirus 4 (Epstein-Barr virus)
uccacagccccacucuugc

SEQ ID NO: 1873472 - RNA, 16 nt, Human herpesvirus 4 (Epstein-Barr virus)
acaucugggaguguag

SEQ ID NO: 1873473 - RNA, 21 nt, Human herpesvirus 4 (Epstein-Barr virus)
ggcuguacgccgccgccagca

SEQ ID NO: 1873474 - RNA, 14 nt, Human herpesvirus 4 (Epstein-Barr virus)
agcauggcagccgg

SEQ ID NO: 1873475 - RNA, 17 nt, Human herpesvirus 4 (Epstein-Barr virus)
ggcggagaagacgggcu

SEQ ID NO: 1873476 - RNA, 18 nt, Human herpesvirus 4 (Epstein-Barr virus)
ccguccuuguccaggaga

SEQ ID NO: 1873477 - RNA, 20 nt, Human herpesvirus 4 (Epstein-Barr virus)
gcauuuuuggugcugccugg

SEQ ID NO: 1873478 - RNA, 22 nt, Human herpesvirus 4 (Epstein-Barr virus)
agcccgacccccgggcgccccc

SEQ ID NO: 1873479 - RNA, 23 nt, Human herpesvirus 4 (Epstein-Barr virus)
ugucuucccagacucugcuuucu

SEQ ID NO: 1873480 - RNA, 15 nt, Human herpesvirus 4 (Epstein-Barr virus)
auaccgagauguaca

SEQ ID NO: 1873481 - RNA, 13 nt, Human herpesvirus 4 (Epstein-Barr virus)
ugccaaagcugaa

SEQ ID NO: 1873482 - RNA, 14 nt, Human herpesvirus 4 (Epstein-Barr virus)
gggacauccccaga

SEQ ID NO: 1873483 - RNA, 17 nt, Human herpesvirus 4 (Epstein-Barr virus)
gccuugguuucagccuc

SEQ ID NO: 1873484 - RNA, 14 nt, Human herpesvirus 4 (Epstein-Barr virus)
cagaggaggccccg

SEQ ID NO: 1873485 - RNA, 14 nt, Human herpesvirus 4 (Epstein-Barr virus)
ccggggaggccagg

SEQ ID NO: 1873486 - RNA, 12 nt, Human herpesvirus 4 (Epstein-Barr virus)
ggggaggagaga

SEQ ID NO: 1873487 - RNA, 16 nt, Human herpesvirus 4 (Epstein-Barr virus)
gcuaacaggacauguu

SEQ ID NO: 1873488 - RNA, 12 nt, Human herpesvirus 4 (Epstein-Barr virus)
aggugccacaga

SEQ ID NO: 1873489 - RNA, 15 nt, Human herpesvirus 4 (Epstein-Barr virus)
accaaugccaaagcu

SEQ ID NO: 1873490 - RNA, 19 nt, Human herpesvirus 4 (Epstein-Barr virus)
cgcccugucaccaggccug

SEQ ID NO: 1873491 - RNA, 15 nt, Human herpesvirus 4 (Epstein-Barr virus)
ccgcagggguggugg

SEQ ID NO: 1873492 - RNA, 12 nt, Human herpesvirus 4 (Epstein-Barr virus)
aaugaacacuca

SEQ ID NO: 1873493 - RNA, 13 nt, Human herpesvirus 4 (Epstein-Barr virus)
agcaccacccagc

SEQ ID NO: 1873494 - RNA, 15 nt, Human herpesvirus 4 (Epstein-Barr virus)
ugcugccgcuacugc

SEQ ID NO: 1873495 - RNA, 23 nt, Human herpesvirus 4 (Epstein-Barr virus)
acaccagauguuuuacacgagga

SEQ ID NO: 1873496 - RNA, 20 nt, Human herpesvirus 4 (Epstein-Barr virus)
cacggggugcucccccugga

SEQ ID NO: 1873497 - RNA, 12 nt, Human herpesvirus 4 (Epstein-Barr virus)
cuggcucagcuu

SEQ ID NO: 1873498 - RNA, 19 nt, Human herpesvirus 4 (Epstein-Barr virus)
uauggcagagcuuugcccc

SEQ ID NO: 1873499 - RNA, 18 nt, Human herpesvirus 4 (Epstein-Barr virus)
accgcgaccaagacucaa

SEQ ID NO: 1873500 - RNA, 13 nt, Human herpesvirus 4 (Epstein-Barr virus)
ccuuugccugggg

SEQ ID NO: 1873501 - RNA, 18 nt, Human herpesvirus 4 (Epstein-Barr virus)
cucauggaggggcggcag

SEQ ID NO: 1873502 - RNA, 17 nt, Human herpesvirus 4 (Epstein-Barr virus)
cuggcacgacuguuccu

SEQ ID NO: 1873503 - RNA, 13 nt, Human herpesvirus 4 (Epstein-Barr virus)
gugagggggccug

SEQ ID NO: 1873504 - RNA, 16 nt, Human herpesvirus 4 (Epstein-Barr virus)
agaaguuggugguggg

SEQ ID NO: 1873505 - RNA, 17 nt, Human herpesvirus 4 (Epstein-Barr virus)
cugacccuucugcugcu

SEQ ID NO: 1873506 - RNA, 22 nt, Human herpesvirus 4 (Epstein-Barr virus)
ggggaguaaggccgcugccagg

SEQ ID NO: 1873507 - RNA, 22 nt, Human herpesvirus 4 (Epstein-Barr virus)
aguagcacuggugguggaggag

SEQ ID NO: 1873508 - RNA, 17 nt, Human herpesvirus 4 (Epstein-Barr virus)
cagcaggcucaggccgc

SEQ ID NO: 1873509 - RNA, 13 nt, Human herpesvirus 4 (Epstein-Barr virus)
ucuuuguggccuu

SEQ ID NO: 1873510 - RNA, 14 nt, Human herpesvirus 4 (Epstein-Barr virus)
cuucagcuccaggg

SEQ ID NO: 1873511 - RNA, 17 nt, Human herpesvirus 4 (Epstein-Barr virus)
ugcgcgccgccagcaug

SEQ ID NO: 1873512 - RNA, 15 nt, Human herpesvirus 4 (Epstein-Barr virus)
gcaggguccaagguu

SEQ ID NO: 1873513 - RNA, 20 nt, Human herpesvirus 4 (Epstein-Barr virus)
auggauagauagccacccgc

SEQ ID NO: 1873514 - RNA, 16 nt, Human herpesvirus 4 (Epstein-Barr virus)
gggaauaaucaaccug

SEQ ID NO: 1873515 - RNA, 18 nt, Human herpesvirus 4 (Epstein-Barr virus)
ugccgggcccgggacagc

SEQ ID NO: 1873516 - RNA, 20 nt, Human herpesvirus 4 (Epstein-Barr virus)
agggagacguuugaguccaa

SEQ ID NO: 1873517 - RNA, 16 nt, Human herpesvirus 4 (Epstein-Barr virus)
uggugggcugcugagg

SEQ ID NO: 1873518 - RNA, 13 nt, Human herpesvirus 4 (Epstein-Barr virus)
uuguaaaacuugg

SEQ ID NO: 1873519 - RNA, 19 nt, Human herpesvirus 4 (Epstein-Barr virus)
caggaggggcaggagcagg

SEQ ID NO: 1873520 - RNA, 15 nt, Human herpesvirus 4 (Epstein-Barr virus)
uucugccccucagcc

SEQ ID NO: 1873521 - RNA, 12 nt, Human herpesvirus 4 (Epstein-Barr virus)
cagaugcagugg

SEQ ID NO: 1873522 - RNA, 15 nt, Human herpesvirus 4 (Epstein-Barr virus)
gcaccuguguccugg

SEQ ID NO: 1873523 - RNA, 16 nt, Human herpesvirus 4 (Epstein-Barr virus)
gcccucgagaacccca

SEQ ID NO: 1873524 - RNA, 23 nt, Human herpesvirus 4 (Epstein-Barr virus)
aaccccagcaacauccggggcag

SEQ ID NO: 1873525 - RNA, 15 nt, Human herpesvirus 4 (Epstein-Barr virus)
uggaggcccccggcu

SEQ ID NO: 1873526 - RNA, 19 nt, Human herpesvirus 4 (Epstein-Barr virus)
ucagccuugcccccgccag

SEQ ID NO: 1873527 - RNA, 11 nt, Human herpesvirus 4 (Epstein-Barr virus)
gaccugugugc

SEQ ID NO: 1873528 - RNA, 15 nt, Human herpesvirus 4 (Epstein-Barr virus)
uucugcccccugucu

SEQ ID NO: 1873529 - RNA, 17 nt, Human herpesvirus 4 (Epstein-Barr virus)
caaaacucacaggacau

SEQ ID NO: 1873530 - RNA, 13 nt, Human herpesvirus 4 (Epstein-Barr virus)
acgagaaggagga

SEQ ID NO: 1873531 - RNA, 22 nt, Human herpesvirus 4 (Epstein-Barr virus)
cuucgcccccucuuuguggccu

SEQ ID NO: 1873532 - RNA, 12 nt, Human herpesvirus 4 (Epstein-Barr virus)
caaauaaauguu

SEQ ID NO: 1873533 - RNA, 19 nt, Human herpesvirus 4 (Epstein-Barr virus)
ccccuccauuccacccacu

SEQ ID NO: 1873534 - RNA, 13 nt, Human herpesvirus 4 (Epstein-Barr virus)
uaaccugucuacu

SEQ ID NO: 1873535 - RNA, 16 nt, Human herpesvirus 4 (Epstein-Barr virus)
aagagcuuccuggccg

SEQ ID NO: 1873536 - RNA, 14 nt, Human herpesvirus 4 (Epstein-Barr virus)
ggccgacgaggccc

SEQ ID NO: 1873537 - RNA, 13 nt, Human herpesvirus 4 (Epstein-Barr virus)
gcuccuggaucug

SEQ ID NO: 1873538 - RNA, 20 nt, Human herpesvirus 4 (Epstein-Barr virus)
caaggacgggggugggcacc

SEQ ID NO: 1873539 - RNA, 19 nt, Human herpesvirus 4 (Epstein-Barr virus)
accccacacucccuccaga

SEQ ID NO: 1873540 - RNA, 18 nt, Human herpesvirus 4 (Epstein-Barr virus)
augacgucaacuuuacuu

SEQ ID NO: 1873541 - RNA, 13 nt, Human herpesvirus 4 (Epstein-Barr virus)
caaugccaaagcu

SEQ ID NO: 1873542 - RNA, 17 nt, Human herpesvirus 4 (Epstein-Barr virus)
ggugcucccccuggaca

SEQ ID NO: 1873543 - RNA, 18 nt, Human herpesvirus 4 (Epstein-Barr virus)
acuguuccuauaugcucu

SEQ ID NO: 1873544 - RNA, 16 nt, Human herpesvirus 4 (Epstein-Barr virus)
uguggcuguagccacc

SEQ ID NO: 1873545 - RNA, 16 nt, Human herpesvirus 4 (Epstein-Barr virus)
gugggauggcggggcc

SEQ ID NO: 1873546 - RNA, 24 nt, Human herpesvirus 4 (Epstein-Barr virus)
caauaaaguugaugauauugaauu

SEQ ID NO: 1873547 - RNA, 17 nt, Human herpesvirus 4 (Epstein-Barr virus)
gcacgagaccccugggc

SEQ ID NO: 1873548 - RNA, 22 nt, Human herpesvirus 4 (Epstein-Barr virus)
cccagcccccucucgcccaagc

SEQ ID NO: 1873549 - RNA, 18 nt, Human herpesvirus 4 (Epstein-Barr virus)
cccaccaccccccccacc

SEQ ID NO: 1873550 - RNA, 16 nt, Human herpesvirus 4 (Epstein-Barr virus)
ggccagcaaaaccagc

SEQ ID NO: 1873551 - RNA, 19 nt, Human herpesvirus 4 (Epstein-Barr virus)
ccaacuccggcccacgcca

SEQ ID NO: 1873552 - RNA, 15 nt, Human herpesvirus 4 (Epstein-Barr virus)
ggcugcgguggugcg

SEQ ID NO: 1873553 - RNA, 23 nt, Human herpesvirus 4 (Epstein-Barr virus)
agggguccccgagggugaggccc

SEQ ID NO: 1873554 - RNA, 17 nt, Human herpesvirus 4 (Epstein-Barr virus)
gcagccccaaagcgggu

SEQ ID NO: 1873555 - RNA, 13 nt, Human herpesvirus 4 (Epstein-Barr virus)
cggugccugugga

SEQ ID NO: 1873556 - RNA, 15 nt, Human herpesvirus 4 (Epstein-Barr virus)
cauggccgagaagcu

SEQ ID NO: 1873557 - RNA, 13 nt, Human herpesvirus 4 (Epstein-Barr virus)
aaccugcucucuc

SEQ ID NO: 1873558 - RNA, 13 nt, Human herpesvirus 4 (Epstein-Barr virus)
ccguccucuggac

SEQ ID NO: 1873559 - RNA, 17 nt, Human herpesvirus 4 (Epstein-Barr virus)
acguuggcgggacuggc

SEQ ID NO: 1873560 - RNA, 19 nt, Human herpesvirus 4 (Epstein-Barr virus)
gagcugagugcccagggca

SEQ ID NO: 1873561 - RNA, 14 nt, Human herpesvirus 4 (Epstein-Barr virus)
gagagaggccucug

SEQ ID NO: 1873562 - RNA, 20 nt, Human herpesvirus 4 (Epstein-Barr virus)
ucgugcaaccaggcccacug

SEQ ID NO: 1873563 - RNA, 20 nt, Human herpesvirus 4 (Epstein-Barr virus)
aggauggcccugcaaacuga

SEQ ID NO: 1873564 - RNA, 14 nt, Human herpesvirus 4 (Epstein-Barr virus)
ccgcccccaccacc

SEQ ID NO: 1873565 - RNA, 15 nt, Human herpesvirus 4 (Epstein-Barr virus)
caccguggagccggg

SEQ ID NO: 1873566 - RNA, 17 nt, Human herpesvirus 4 (Epstein-Barr virus)
accccgaguccaaggcc

SEQ ID NO: 1873567 - RNA, 22 nt, Human herpesvirus 4 (Epstein-Barr virus)
ucaaggggcacgagauggccca

SEQ ID NO: 1873568 - RNA, 15 nt, Human herpesvirus 4 (Epstein-Barr virus)
gccugagcugccugg

SEQ ID NO: 1873569 - RNA, 20 nt, Human herpesvirus 4 (Epstein-Barr virus)
agacucccauguaagccugc

SEQ ID NO: 1873570 - RNA, 13 nt, Human herpesvirus 4 (Epstein-Barr virus)
gcugacccuucug

SEQ ID NO: 1873571 - RNA, 18 nt, Human herpesvirus 4 (Epstein-Barr virus)
ccauggugccaagcucag

SEQ ID NO: 1873572 - RNA, 24 nt, Human herpesvirus 4 (Epstein-Barr virus)
cccggggaaaagagagcugaugga

SEQ ID NO: 1873573 - RNA, 23 nt, Human herpesvirus 4 (Epstein-Barr virus)
uugcaaacaaacuucaagaguuu

SEQ ID NO: 1873574 - RNA, 16 nt, Human herpesvirus 4 (Epstein-Barr virus)
uggcuugggcuguggu

SEQ ID NO: 1873575 - RNA, 15 nt, Human herpesvirus 4 (Epstein-Barr virus)
ugcugacccuucugc

SEQ ID NO: 1873576 - RNA, 21 nt, Human herpesvirus 4 (Epstein-Barr virus)
gacucuauugguugaucuccu

SEQ ID NO: 1873577 - RNA, 18 nt, Human herpesvirus 4 (Epstein-Barr virus)
gaugccucuacgccccag

SEQ ID NO: 1873578 - RNA, 15 nt, Human herpesvirus 4 (Epstein-Barr virus)
gcacggcccuccagc

SEQ ID NO: 1873579 - RNA, 14 nt, Human herpesvirus 4 (Epstein-Barr virus)
caggauuccugauu

SEQ ID NO: 1873580 - RNA, 14 nt, Human herpesvirus 4 (Epstein-Barr virus)
aagcuugcuggggc

SEQ ID NO: 1873581 - RNA, 16 nt, Human herpesvirus 4 (Epstein-Barr virus)
cucucgcccaagcugc

SEQ ID NO: 1873582 - RNA, 21 nt, Human herpesvirus 4 (Epstein-Barr virus)
cuacaucaauggaacccuagc

SEQ ID NO: 1873583 - RNA, 15 nt, Human herpesvirus 4 (Epstein-Barr virus)
ccggccaugggggcu

SEQ ID NO: 1873584 - RNA, 20 nt, Human herpesvirus 4 (Epstein-Barr virus)
cacucaggaagcuggccagg

SEQ ID NO: 1873585 - RNA, 14 nt, Human herpesvirus 4 (Epstein-Barr virus)
cuaggagagaaggg

SEQ ID NO: 1873586 - RNA, 23 nt, Human herpesvirus 4 (Epstein-Barr virus)
cagagaggcgggaauggccgcca

SEQ ID NO: 1873587 - RNA, 14 nt, Human herpesvirus 4 (Epstein-Barr virus)
gaauaugaugagga

SEQ ID NO: 1873588 - RNA, 14 nt, Human herpesvirus 4 (Epstein-Barr virus)
gcacaggaugacag

SEQ ID NO: 1873589 - RNA, 13 nt, Human herpesvirus 4 (Epstein-Barr virus)
cuggaggccucag

SEQ ID NO: 1873590 - RNA, 18 nt, Human herpesvirus 4 (Epstein-Barr virus)
accgauagcauggccgcc

SEQ ID NO: 1873591 - RNA, 15 nt, Human herpesvirus 4 (Epstein-Barr virus)
ugugcacccggcugg

SEQ ID NO: 1873592 - RNA, 21 nt, Human herpesvirus 4 (Epstein-Barr virus)
acauuggcagcagcucuggca

SEQ ID NO: 1873593 - RNA, 16 nt, Human herpesvirus 4 (Epstein-Barr virus)
ggugccuccagagccc

SEQ ID NO: 1873594 - RNA, 13 nt, Human herpesvirus 4 (Epstein-Barr virus)
gagcagggcccag

SEQ ID NO: 1873595 - RNA, 16 nt, Human herpesvirus 4 (Epstein-Barr virus)
cgggaugagcuggaga

SEQ ID NO: 1873596 - RNA, 13 nt, Human herpesvirus 4 (Epstein-Barr virus)
caguccuccgcau

SEQ ID NO: 1873597 - RNA, 13 nt, Human herpesvirus 4 (Epstein-Barr virus)
ccuugaucuucuu

SEQ ID NO: 1873598 - RNA, 13 nt, Human herpesvirus 4 (Epstein-Barr virus)
ccccuccacggga

SEQ ID NO: 1873599 - RNA, 17 nt, Human herpesvirus 4 (Epstein-Barr virus)
cucgaaggugcagcugg

SEQ ID NO: 1873600 - RNA, 14 nt, Human herpesvirus 4 (Epstein-Barr virus)
ccgcgcccuccucu

SEQ ID NO: 1873601 - RNA, 19 nt, Human herpesvirus 4 (Epstein-Barr virus)
cgagcucuccagccacggc

SEQ ID NO: 1873602 - RNA, 11 nt, Human herpesvirus 4 (Epstein-Barr virus)
gugaaucaugu

SEQ ID NO: 1873603 - RNA, 16 nt, Human herpesvirus 4 (Epstein-Barr virus)
ccuuguccgcugggcc

SEQ ID NO: 1873604 - RNA, 16 nt, Human herpesvirus 4 (Epstein-Barr virus)
cagaaaaucgcagcag

SEQ ID NO: 1873605 - RNA, 18 nt, Human herpesvirus 4 (Epstein-Barr virus)
uccccgaggucagaaaga

SEQ ID NO: 1873606 - RNA, 22 nt, Human herpesvirus 4 (Epstein-Barr virus)
accugucucucuuugagggggc

SEQ ID NO: 1873607 - RNA, 21 nt, Human herpesvirus 4 (Epstein-Barr virus)
cgcccacacagcgccagcagg

SEQ ID NO: 1873608 - RNA, 18 nt, Human herpesvirus 4 (Epstein-Barr virus)
acccgaggucaagucccg

SEQ ID NO: 1873609 - RNA, 17 nt, Human herpesvirus 4 (Epstein-Barr virus)
auuucaguggcccucag

SEQ ID NO: 1873610 - RNA, 19 nt, Human herpesvirus 4 (Epstein-Barr virus)
agccugcuccugagaaugc

SEQ ID NO: 1873611 - RNA, 21 nt, Human herpesvirus 4 (Epstein-Barr virus)
ucugcacaggcuuggaaacac

SEQ ID NO: 1873612 - RNA, 12 nt, Human herpesvirus 4 (Epstein-Barr virus)
uccuccaccgcc

SEQ ID NO: 1873613 - RNA, 13 nt, Human herpesvirus 4 (Epstein-Barr virus)
gggucucaggccu

SEQ ID NO: 1873614 - RNA, 19 nt, Human herpesvirus 4 (Epstein-Barr virus)
ggugccuccagagccccuu

SEQ ID NO: 1873615 - RNA, 18 nt, Human herpesvirus 4 (Epstein-Barr virus)
ccaccggggaggccaggu

SEQ ID NO: 1873616 - RNA, 16 nt, Human herpesvirus 4 (Epstein-Barr virus)
guagccccuaggccug

SEQ ID NO: 1873617 - RNA, 15 nt, Human herpesvirus 4 (Epstein-Barr virus)
uauugccauguccaa

SEQ ID NO: 1873618 - RNA, 22 nt, Human herpesvirus 4 (Epstein-Barr virus)
gucugugguugucuucccagac

SEQ ID NO: 1873619 - RNA, 15 nt, Human herpesvirus 4 (Epstein-Barr virus)
acguccaccccaccc

SEQ ID NO: 1873620 - RNA, 20 nt, Human herpesvirus 4 (Epstein-Barr virus)
ucagggaaaaacuggccaug

SEQ ID NO: 1873621 - RNA, 16 nt, Human herpesvirus 4 (Epstein-Barr virus)
agagcggguggaggag

SEQ ID NO: 1873622 - RNA, 14 nt, Human herpesvirus 4 (Epstein-Barr virus)
gcaugagccacagg

SEQ ID NO: 1873623 - RNA, 17 nt, Human herpesvirus 4 (Epstein-Barr virus)
gggagccacggcgucaa

SEQ ID NO: 1873624 - RNA, 22 nt, Human herpesvirus 4 (Epstein-Barr virus)
caugacgcugcugcuacuggcu

SEQ ID NO: 1873625 - RNA, 13 nt, Human herpesvirus 4 (Epstein-Barr virus)
agaagugcuggga

SEQ ID NO: 1873626 - RNA, 14 nt, Human herpesvirus 4 (Epstein-Barr virus)
gcggcguggagcug

SEQ ID NO: 1873627 - RNA, 19 nt, Human herpesvirus 4 (Epstein-Barr virus)
ucggcaccuagcccacucc

SEQ ID NO: 1873628 - RNA, 16 nt, Human herpesvirus 4 (Epstein-Barr virus)
ugaagagcccccaccg

SEQ ID NO: 1873629 - RNA, 23 nt, Human herpesvirus 4 (Epstein-Barr virus)
cugcuccaccgccuuaaggccga

SEQ ID NO: 1873630 - RNA, 13 nt, Human herpesvirus 4 (Epstein-Barr virus)
gugucuuggccag

SEQ ID NO: 1873631 - RNA, 12 nt, Human herpesvirus 4 (Epstein-Barr virus)
gaaaagagacug

SEQ ID NO: 1873632 - RNA, 17 nt, Human herpesvirus 4 (Epstein-Barr virus)
ucuacucgaccagcacg

SEQ ID NO: 1873633 - RNA, 13 nt, Human herpesvirus 4 (Epstein-Barr virus)
acugacacacagg

SEQ ID NO: 1873634 - RNA, 20 nt, Human herpesvirus 4 (Epstein-Barr virus)
ugccuuucccccacccugga

SEQ ID NO: 1873635 - RNA, 16 nt, Human herpesvirus 4 (Epstein-Barr virus)
ccuauagauccugggc

SEQ ID NO: 1873636 - RNA, 17 nt, Human herpesvirus 4 (Epstein-Barr virus)
ccccaguggacaaggca

SEQ ID NO: 1873637 - RNA, 21 nt, Human herpesvirus 4 (Epstein-Barr virus)
gccagcgccuccucgcaggcc

SEQ ID NO: 1873638 - RNA, 23 nt, Human herpesvirus 4 (Epstein-Barr virus)
cccggggaaaagagagcugaugg

SEQ ID NO: 1873639 - RNA, 20 nt, Human herpesvirus 4 (Epstein-Barr virus)
cacggcaccgucagccacac

SEQ ID NO: 1873640 - RNA, 13 nt, Human herpesvirus 4 (Epstein-Barr virus)
gagaucaggccaa

SEQ ID NO: 1873641 - RNA, 14 nt, Human herpesvirus 4 (Epstein-Barr virus)
gcgacgcucccggg

SEQ ID NO: 1873642 - RNA, 12 nt, Human herpesvirus 4 (Epstein-Barr virus)
aggcccccggcu

SEQ ID NO: 1873643 - RNA, 23 nt, Human herpesvirus 4 (Epstein-Barr virus)
ucuggucacuaaaguuggucagg

SEQ ID NO: 1873644 - RNA, 19 nt, Human herpesvirus 4 (Epstein-Barr virus)
cugugguugucuucccaga

SEQ ID NO: 1873645 - RNA, 18 nt, Human herpesvirus 4 (Epstein-Barr virus)
uggacucggccacacagu

SEQ ID NO: 1873646 - RNA, 14 nt, Human herpesvirus 4 (Epstein-Barr virus)
guggaacaggagca

SEQ ID NO: 1873647 - RNA, 23 nt, Human herpesvirus 4 (Epstein-Barr virus)
cgccgccccaggggucucuagac

SEQ ID NO: 1873648 - RNA, 18 nt, Human herpesvirus 4 (Epstein-Barr virus)
cuggggcucagacuuagg

SEQ ID NO: 1873649 - RNA, 12 nt, Human herpesvirus 4 (Epstein-Barr virus)
cacagcugcugg

SEQ ID NO: 1873650 - RNA, 15 nt, Human herpesvirus 4 (Epstein-Barr virus)
gguccauggcugcac

SEQ ID NO: 1873651 - RNA, 18 nt, Human herpesvirus 4 (Epstein-Barr virus)
cugggaggugcugaggcc

SEQ ID NO: 1873652 - RNA, 20 nt, Human herpesvirus 4 (Epstein-Barr virus)
aaaacucugcauggagaagc

SEQ ID NO: 1873653 - RNA, 15 nt, Human herpesvirus 4 (Epstein-Barr virus)
cagggcucuguucac

SEQ ID NO: 1873654 - RNA, 10 nt, Human herpesvirus 4 (Epstein-Barr virus)
uaguuggagc

SEQ ID NO: 1873655 - RNA, 13 nt, Human herpesvirus 4 (Epstein-Barr virus)
ccucgguggccug

SEQ ID NO: 1873656 - RNA, 17 nt, Human herpesvirus 4 (Epstein-Barr virus)
agcggcauccucaaggg

SEQ ID NO: 1873657 - RNA, 18 nt, Human herpesvirus 4 (Epstein-Barr virus)
aagucuauacggccacaa

SEQ ID NO: 1873658 - RNA, 21 nt, Human herpesvirus 4 (Epstein-Barr virus)
cggugcugaccggcucggcca

SEQ ID NO: 1873659 - RNA, 15 nt, Human herpesvirus 4 (Epstein-Barr virus)
agccacauucuggaa

SEQ ID NO: 1873660 - RNA, 21 nt, Human herpesvirus 4 (Epstein-Barr virus)
cugagcgugugcacccggcug

SEQ ID NO: 1873661 - RNA, 22 nt, Human herpesvirus 4 (Epstein-Barr virus)
cucugccaacuuugagcugggc

SEQ ID NO: 1873662 - RNA, 21 nt, Human herpesvirus 4 (Epstein-Barr virus)
gugccuaaacgugauggugcu

SEQ ID NO: 1873663 - RNA, 20 nt, Human herpesvirus 4 (Epstein-Barr virus)
ccaaguugcauuggcugcaa

SEQ ID NO: 1873664 - RNA, 17 nt, Human herpesvirus 4 (Epstein-Barr virus)
caggucgcggaccaggg

SEQ ID NO: 1873665 - RNA, 21 nt, Human herpesvirus 4 (Epstein-Barr virus)
aggagaugauaaugaugagga

SEQ ID NO: 1873666 - RNA, 12 nt, Human herpesvirus 4 (Epstein-Barr virus)
aggacaugugca

SEQ ID NO: 1873667 - RNA, 20 nt, Human herpesvirus 4 (Epstein-Barr virus)
gcucuucauguccacugagc

SEQ ID NO: 1873668 - RNA, 17 nt, Human herpesvirus 4 (Epstein-Barr virus)
caaggauggaagagagg

SEQ ID NO: 1873669 - RNA, 13 nt, Human herpesvirus 4 (Epstein-Barr virus)
ccggccugcuggc

SEQ ID NO: 1873670 - RNA, 19 nt, Human herpesvirus 4 (Epstein-Barr virus)
cagcugugugcgcgccgcc

SEQ ID NO: 1873671 - RNA, 17 nt, Human herpesvirus 4 (Epstein-Barr virus)
ugucuaucucuauugcc

SEQ ID NO: 1873672 - RNA, 14 nt, Human herpesvirus 4 (Epstein-Barr virus)
uggagccgggggca

SEQ ID NO: 1873673 - RNA, 18 nt, Human herpesvirus 4 (Epstein-Barr virus)
caugugcauggccugggc

SEQ ID NO: 1873674 - RNA, 22 nt, Human herpesvirus 4 (Epstein-Barr virus)
cgacacgguuauggcagagcuu

SEQ ID NO: 1873675 - RNA, 21 nt, Human herpesvirus 4 (Epstein-Barr virus)
gugggccucucuggcugugcu

SEQ ID NO: 1873676 - RNA, 16 nt, Human herpesvirus 4 (Epstein-Barr virus)
cguggguccccucugc

SEQ ID NO: 1873677 - RNA, 14 nt, Human herpesvirus 4 (Epstein-Barr virus)
gccucugcucuggu

SEQ ID NO: 1873678 - RNA, 17 nt, Human herpesvirus 4 (Epstein-Barr virus)
caccagucccaacaacu

SEQ ID NO: 1873679 - RNA, 12 nt, Human herpesvirus 4 (Epstein-Barr virus)
gcauggccuggg

SEQ ID NO: 1873680 - RNA, 18 nt, Human herpesvirus 4 (Epstein-Barr virus)
gaggggcaggagcaggag

SEQ ID NO: 1873681 - RNA, 16 nt, Human herpesvirus 4 (Epstein-Barr virus)
ccugagacuggacccu

SEQ ID NO: 1873682 - RNA, 13 nt, Human herpesvirus 4 (Epstein-Barr virus)
ugugagacaagcc

SEQ ID NO: 1873683 - RNA, 22 nt, Human herpesvirus 4 (Epstein-Barr virus)
acuucauucucaaacagucccg

SEQ ID NO: 1873684 - RNA, 18 nt, Human herpesvirus 4 (Epstein-Barr virus)
ccugcaccaguggcugcc

SEQ ID NO: 1873685 - RNA, 20 nt, Human herpesvirus 4 (Epstein-Barr virus)
ugcugcgauuuucugaccuu

SEQ ID NO: 1873686 - RNA, 19 nt, Human herpesvirus 4 (Epstein-Barr virus)
aacacggagaucucagaau

SEQ ID NO: 1873687 - RNA, 19 nt, Human herpesvirus 4 (Epstein-Barr virus)
gugucuggcggccgcugcg

SEQ ID NO: 1873688 - RNA, 16 nt, Human herpesvirus 4 (Epstein-Barr virus)
cuggucauggcggacu

SEQ ID NO: 1873689 - RNA, 16 nt, Human herpesvirus 4 (Epstein-Barr virus)
cuaaugccauagucac

SEQ ID NO: 1873690 - RNA, 18 nt, Human herpesvirus 4 (Epstein-Barr virus)
acacccccacuuuuccaa

SEQ ID NO: 1873691 - RNA, 14 nt, Human herpesvirus 4 (Epstein-Barr virus)
aaccuugggggcaa

SEQ ID NO: 1873692 - RNA, 14 nt, Human herpesvirus 4 (Epstein-Barr virus)
guuugcauugcugg

SEQ ID NO: 1873693 - RNA, 18 nt, Human herpesvirus 4 (Epstein-Barr virus)
aggcacggccucgugcaa

SEQ ID NO: 1873694 - RNA, 17 nt, Human herpesvirus 4 (Epstein-Barr virus)
caggagacguggguccc

SEQ ID NO: 1873695 - RNA, 18 nt, Human herpesvirus 4 (Epstein-Barr virus)
ugcggagggucagauuuu

SEQ ID NO: 1873696 - RNA, 24 nt, Human herpesvirus 4 (Epstein-Barr virus)
aggagaugauaaugaugaggagca

SEQ ID NO: 1873697 - RNA, 14 nt, Human herpesvirus 4 (Epstein-Barr virus)
agaccugaucaggg

SEQ ID NO: 1873698 - RNA, 15 nt, Human herpesvirus 4 (Epstein-Barr virus)
ggaggacgugaguga

SEQ ID NO: 1873699 - RNA, 17 nt, Human herpesvirus 4 (Epstein-Barr virus)
ccgccugguggugggug

SEQ ID NO: 1873700 - RNA, 23 nt, Human herpesvirus 4 (Epstein-Barr virus)
gaagcccaagaagaagcccaccu

SEQ ID NO: 1873701 - RNA, 15 nt, Human herpesvirus 4 (Epstein-Barr virus)
aaacucgacuucuga

SEQ ID NO: 1873702 - RNA, 18 nt, Human herpesvirus 4 (Epstein-Barr virus)
caguccaggggccacaca

SEQ ID NO: 1873703 - RNA, 16 nt, Human herpesvirus 4 (Epstein-Barr virus)
ccucgcgacucguggg

SEQ ID NO: 1873704 - RNA, 13 nt, Human herpesvirus 4 (Epstein-Barr virus)
ccauucacagggg

SEQ ID NO: 1873705 - RNA, 15 nt, Human herpesvirus 4 (Epstein-Barr virus)
auauugaauuccaca

SEQ ID NO: 1873706 - RNA, 14 nt, Human herpesvirus 4 (Epstein-Barr virus)
cauuccacccacug

SEQ ID NO: 1873707 - RNA, 21 nt, Human herpesvirus 4 (Epstein-Barr virus)
cagcucgcccacacagcgcca

SEQ ID NO: 1873708 - RNA, 16 nt, Human herpesvirus 4 (Epstein-Barr virus)
cgggaccgcgcccucc

SEQ ID NO: 1873709 - RNA, 14 nt, Human herpesvirus 4 (Epstein-Barr virus)
acgggggucaagca

SEQ ID NO: 1873710 - RNA, 14 nt, Human herpesvirus 4 (Epstein-Barr virus)
aaggcaguccaggg

SEQ ID NO: 1873711 - RNA, 13 nt, Human herpesvirus 4 (Epstein-Barr virus)
ugcugccuggggg

SEQ ID NO: 1873712 - RNA, 22 nt, Human herpesvirus 4 (Epstein-Barr virus)
cuuuaggcguaacuugucuaca

SEQ ID NO: 1873713 - RNA, 22 nt, Human herpesvirus 4 (Epstein-Barr virus)
cccugaccggcgcgggagccgg

SEQ ID NO: 1873714 - RNA, 14 nt, Human herpesvirus 4 (Epstein-Barr virus)
uggccuggagagca

SEQ ID NO: 1873715 - RNA, 15 nt, Human herpesvirus 4 (Epstein-Barr virus)
gcgcuggcuccaggg

SEQ ID NO: 1873716 - RNA, 16 nt, Human herpesvirus 4 (Epstein-Barr virus)
ggccgcgcugcgaggc

SEQ ID NO: 1873717 - RNA, 17 nt, Human herpesvirus 4 (Epstein-Barr virus)
ccgcgacuucgggggcg

SEQ ID NO: 1873718 - RNA, 16 nt, Human herpesvirus 4 (Epstein-Barr virus)
agccuuauuuggacau

SEQ ID NO: 1873719 - RNA, 18 nt, Human herpesvirus 4 (Epstein-Barr virus)
ucccgcgccgcaagcaug

SEQ ID NO: 1873720 - RNA, 20 nt, Human herpesvirus 4 (Epstein-Barr virus)
uuccacccccuggagccagc

SEQ ID NO: 1873721 - RNA, 20 nt, Human herpesvirus 4 (Epstein-Barr virus)
ugcugccagagccucugcca

SEQ ID NO: 1873722 - RNA, 15 nt, Human herpesvirus 4 (Epstein-Barr virus)
accugcacagaucug

SEQ ID NO: 1873723 - RNA, 18 nt, Human herpesvirus 4 (Epstein-Barr virus)
cccaccgacuccgaugcc

SEQ ID NO: 1873724 - RNA, 14 nt, Human herpesvirus 4 (Epstein-Barr virus)
aggagucugcugcg

SEQ ID NO: 1873725 - RNA, 21 nt, Human herpesvirus 4 (Epstein-Barr virus)
cccagcuccgugguccugagg

SEQ ID NO: 1873726 - RNA, 15 nt, Human herpesvirus 4 (Epstein-Barr virus)
cauuucaguggcccu

SEQ ID NO: 1873727 - RNA, 17 nt, Human herpesvirus 4 (Epstein-Barr virus)
gagggccucuggcacgc

SEQ ID NO: 1873728 - RNA, 17 nt, Human herpesvirus 4 (Epstein-Barr virus)
gcguugccagacuccgc

SEQ ID NO: 1873729 - RNA, 22 nt, Human herpesvirus 4 (Epstein-Barr virus)
ccauaccuacaccaccccacca

SEQ ID NO: 1873730 - RNA, 16 nt, Human herpesvirus 4 (Epstein-Barr virus)
cucaugcgccagagcg

SEQ ID NO: 1873731 - RNA, 23 nt, Human herpesvirus 4 (Epstein-Barr virus)
ggggguggaggcugcgccugagc

SEQ ID NO: 1873732 - RNA, 19 nt, Human herpesvirus 4 (Epstein-Barr virus)
cacgggccuggggccauag

SEQ ID NO: 1873733 - RNA, 17 nt, Human herpesvirus 4 (Epstein-Barr virus)
cuggcacacacucccuu

SEQ ID NO: 1873734 - RNA, 23 nt, Human herpesvirus 4 (Epstein-Barr virus)
cccuggggcggcgaugucggggc

SEQ ID NO: 1873735 - RNA, 16 nt, Human herpesvirus 4 (Epstein-Barr virus)
cuacaccaccccacca

SEQ ID NO: 1873736 - RNA, 16 nt, Human herpesvirus 4 (Epstein-Barr virus)
gauggaaagggcaugu

SEQ ID NO: 1873737 - RNA, 12 nt, Human herpesvirus 4 (Epstein-Barr virus)
ccggccucgccu

SEQ ID NO: 1873738 - RNA, 15 nt, Human herpesvirus 4 (Epstein-Barr virus)
ccgucagccagggug

SEQ ID NO: 1873739 - RNA, 15 nt, Human herpesvirus 4 (Epstein-Barr virus)
agugcuccggcugcc

SEQ ID NO: 1873740 - RNA, 19 nt, Human herpesvirus 4 (Epstein-Barr virus)
caacgccggccugcuggcc

SEQ ID NO: 1873741 - RNA, 17 nt, Human herpesvirus 4 (Epstein-Barr virus)
ccgugguccugaggggc

SEQ ID NO: 1873742 - RNA, 16 nt, Human herpesvirus 4 (Epstein-Barr virus)
gccuggcucgccugga

SEQ ID NO: 1873743 - RNA, 20 nt, Human herpesvirus 4 (Epstein-Barr virus)
cuguguacgugccucagaua

SEQ ID NO: 1873744 - RNA, 21 nt, Human herpesvirus 4 (Epstein-Barr virus)
cuagcguacagaaggagaugg

SEQ ID NO: 1873745 - RNA, 16 nt, Human herpesvirus 4 (Epstein-Barr virus)
agaggcccgggggccu

SEQ ID NO: 1873746 - RNA, 13 nt, Human herpesvirus 4 (Epstein-Barr virus)
ucgcccccucugc

SEQ ID NO: 1873747 - RNA, 20 nt, Human herpesvirus 4 (Epstein-Barr virus)
uccaugccaaugggggagga

SEQ ID NO: 1873748 - RNA, 22 nt, Human herpesvirus 4 (Epstein-Barr virus)
caagguucggaaaucuguugac

SEQ ID NO: 1873749 - RNA, 15 nt, Human herpesvirus 4 (Epstein-Barr virus)
ccggccgccccgggc

SEQ ID NO: 1873750 - RNA, 15 nt, Human herpesvirus 4 (Epstein-Barr virus)
ggagaggcagcccca

SEQ ID NO: 1873751 - RNA, 13 nt, Human herpesvirus 4 (Epstein-Barr virus)
cugccuggaucug

SEQ ID NO: 1873752 - RNA, 14 nt, Human herpesvirus 4 (Epstein-Barr virus)
ggcagcagcucugg

SEQ ID NO: 1873753 - RNA, 13 nt, Human herpesvirus 4 (Epstein-Barr virus)
ggaggggcggcag

SEQ ID NO: 1873754 - RNA, 15 nt, Human herpesvirus 4 (Epstein-Barr virus)
cugcaucuuccaggu

SEQ ID NO: 1873755 - RNA, 22 nt, Human herpesvirus 4 (Epstein-Barr virus)
cggcgaugucggggcugcuggc

SEQ ID NO: 1873756 - RNA, 15 nt, Human herpesvirus 4 (Epstein-Barr virus)
aguauuuugcaaaca

SEQ ID NO: 1873757 - RNA, 17 nt, Human herpesvirus 4 (Epstein-Barr virus)
ugcauggagaagcugga

SEQ ID NO: 1873758 - RNA, 12 nt, Human herpesvirus 4 (Epstein-Barr virus)
ccccuggccacc

SEQ ID NO: 1873759 - RNA, 22 nt, Human herpesvirus 4 (Epstein-Barr virus)
gguccccgagggugaggcccag

SEQ ID NO: 1873760 - RNA, 22 nt, Human herpesvirus 4 (Epstein-Barr virus)
uggccaccacaucggacgggca

SEQ ID NO: 1873761 - RNA, 17 nt, Human herpesvirus 4 (Epstein-Barr virus)
ucuuacaccagaggcca

SEQ ID NO: 1873762 - RNA, 14 nt, Human herpesvirus 4 (Epstein-Barr virus)
caugauggugcaga

SEQ ID NO: 1873763 - RNA, 16 nt, Human herpesvirus 4 (Epstein-Barr virus)
guccaggggccacaca

SEQ ID NO: 1873764 - RNA, 12 nt, Human herpesvirus 4 (Epstein-Barr virus)
caggcuccugga

SEQ ID NO: 1873765 - RNA, 22 nt, Human herpesvirus 4 (Epstein-Barr virus)
aggaccggaucgaaggagagcu

SEQ ID NO: 1873766 - RNA, 15 nt, Human herpesvirus 4 (Epstein-Barr virus)
uagggguaacccugu

SEQ ID NO: 1873767 - RNA, 13 nt, Human herpesvirus 4 (Epstein-Barr virus)
cucagccuccaac

SEQ ID NO: 1873768 - RNA, 19 nt, Human herpesvirus 4 (Epstein-Barr virus)
acucgagagaggccucugc

SEQ ID NO: 1873769 - RNA, 17 nt, Human herpesvirus 4 (Epstein-Barr virus)
caggcgacgcucccggg

SEQ ID NO: 1873770 - RNA, 21 nt, Human herpesvirus 4 (Epstein-Barr virus)
gcaucaugcgugaccaccugg

SEQ ID NO: 1873771 - RNA, 14 nt, Human herpesvirus 4 (Epstein-Barr virus)
aauggaauauuaau

SEQ ID NO: 1873772 - RNA, 19 nt, Human herpesvirus 4 (Epstein-Barr virus)
gguacucuuggugcagccc

SEQ ID NO: 1873773 - RNA, 17 nt, Human herpesvirus 4 (Epstein-Barr virus)
ugcucaaggcagucucc

SEQ ID NO: 1873774 - RNA, 15 nt, Human herpesvirus 4 (Epstein-Barr virus)
aagugauuaggagca

SEQ ID NO: 1873775 - RNA, 14 nt, Human herpesvirus 4 (Epstein-Barr virus)
ucgccgccccaggg

SEQ ID NO: 1873776 - RNA, 14 nt, Human herpesvirus 4 (Epstein-Barr virus)
gccacacagccuga

SEQ ID NO: 1873777 - RNA, 19 nt, Human herpesvirus 4 (Epstein-Barr virus)
agucaccuuccagacuaug

SEQ ID NO: 1873778 - RNA, 13 nt, Human herpesvirus 4 (Epstein-Barr virus)
agcagggcccagu

SEQ ID NO: 1873779 - RNA, 21 nt, Human herpesvirus 4 (Epstein-Barr virus)
cucgugcaagcagcaccuguc

SEQ ID NO: 1873780 - RNA, 21 nt, Human herpesvirus 4 (Epstein-Barr virus)
gugguggcccucggugguggg

SEQ ID NO: 1873781 - RNA, 13 nt, Human herpesvirus 4 (Epstein-Barr virus)
gaaccaucagcuc

SEQ ID NO: 1873782 - RNA, 21 nt, Human herpesvirus 4 (Epstein-Barr virus)
ggcccgagguucucuucacua

SEQ ID NO: 1873783 - RNA, 13 nt, Human herpesvirus 4 (Epstein-Barr virus)
gcauggcagccgg

SEQ ID NO: 1873784 - RNA, 18 nt, Human herpesvirus 4 (Epstein-Barr virus)
cgguggccugcucaccau

SEQ ID NO: 1873785 - RNA, 17 nt, Human herpesvirus 4 (Epstein-Barr virus)
uucucuaaucccucugg

SEQ ID NO: 1873786 - RNA, 14 nt, Human herpesvirus 4 (Epstein-Barr virus)
caaggcaguagagg

SEQ ID NO: 1873787 - RNA, 22 nt, Human herpesvirus 4 (Epstein-Barr virus)
gcaccaacaacgaucccaggcc

SEQ ID NO: 1873788 - RNA, 12 nt, Human herpesvirus 4 (Epstein-Barr virus)
agccguggccuu

SEQ ID NO: 1873789 - RNA, 17 nt, Human herpesvirus 4 (Epstein-Barr virus)
acuuuuauuuauugcau

SEQ ID NO: 1873790 - RNA, 12 nt, Human herpesvirus 4 (Epstein-Barr virus)
ccccagccacag

SEQ ID NO: 1873791 - RNA, 16 nt, Human herpesvirus 4 (Epstein-Barr virus)
gaaucugacauuucuc

SEQ ID NO: 1873792 - RNA, 15 nt, Human herpesvirus 4 (Epstein-Barr virus)
agcccggccgaggcc

SEQ ID NO: 1873793 - RNA, 17 nt, Human herpesvirus 4 (Epstein-Barr virus)
aaagucccgagcggccu

SEQ ID NO: 1873794 - RNA, 21 nt, Human herpesvirus 4 (Epstein-Barr virus)
cggaggacugcauccaacgcu

SEQ ID NO: 1873795 - RNA, 15 nt, Human herpesvirus 4 (Epstein-Barr virus)
ugcagcaccucagcu

SEQ ID NO: 1873796 - RNA, 13 nt, Human herpesvirus 4 (Epstein-Barr virus)
ggaggccccggcc

SEQ ID NO: 1873797 - RNA, 19 nt, Human herpesvirus 4 (Epstein-Barr virus)
cccgcaccagggccaggcg

SEQ ID NO: 1873798 - RNA, 21 nt, Human herpesvirus 4 (Epstein-Barr virus)
gucucugaaggauccaugcaa

SEQ ID NO: 1873799 - RNA, 19 nt, Human herpesvirus 4 (Epstein-Barr virus)
aacccccggcucucaggcc

SEQ ID NO: 1873800 - RNA, 19 nt, Human herpesvirus 4 (Epstein-Barr virus)
caggguccaggagaaggcu

SEQ ID NO: 1873801 - RNA, 16 nt, Human herpesvirus 4 (Epstein-Barr virus)
caccuguguccugggc

SEQ ID NO: 1873802 - RNA, 13 nt, Human herpesvirus 4 (Epstein-Barr virus)
ccuagccccgggc

SEQ ID NO: 1873803 - RNA, 16 nt, Human herpesvirus 4 (Epstein-Barr virus)
gccugaguccaacauu

SEQ ID NO: 1873804 - RNA, 22 nt, Human herpesvirus 4 (Epstein-Barr virus)
gccuguggccccggcuggccau

SEQ ID NO: 1873805 - RNA, 15 nt, Human herpesvirus 4 (Epstein-Barr virus)
agcgcggcagaggcc

SEQ ID NO: 1873806 - RNA, 17 nt, Human herpesvirus 4 (Epstein-Barr virus)
uuuauuaggcacaaacu

SEQ ID NO: 1873807 - RNA, 16 nt, Human herpesvirus 4 (Epstein-Barr virus)
cgcuguuuugcagcug

SEQ ID NO: 1873808 - RNA, 13 nt, Human herpesvirus 4 (Epstein-Barr virus)
ucacaggacaugu

SEQ ID NO: 1873809 - RNA, 20 nt, Human herpesvirus 4 (Epstein-Barr virus)
gaagcuggccaggcugguga

SEQ ID NO: 1873810 - RNA, 18 nt, Human herpesvirus 4 (Epstein-Barr virus)
caaacugcgagggggccu

SEQ ID NO: 1873811 - RNA, 13 nt, Human herpesvirus 4 (Epstein-Barr virus)
cuguccugcugaa

SEQ ID NO: 1873812 - RNA, 14 nt, Human herpesvirus 4 (Epstein-Barr virus)
cgggccuggggcca

SEQ ID NO: 1873813 - RNA, 18 nt, Human herpesvirus 4 (Epstein-Barr virus)
uguacgugccucagauag

SEQ ID NO: 1873814 - RNA, 15 nt, Human herpesvirus 4 (Epstein-Barr virus)
ucucuuucuggccaa

SEQ ID NO: 1873815 - RNA, 14 nt, Human herpesvirus 4 (Epstein-Barr virus)
ccugcauggccagg

SEQ ID NO: 1873816 - RNA, 19 nt, Human herpesvirus 4 (Epstein-Barr virus)
gacccgaucagagccccau

SEQ ID NO: 1873817 - RNA, 18 nt, Human herpesvirus 4 (Epstein-Barr virus)
ggugaaacuggcuucugu

SEQ ID NO: 1873818 - RNA, 20 nt, Human herpesvirus 4 (Epstein-Barr virus)
cagcagaagggucagcacag

SEQ ID NO: 1873819 - RNA, 14 nt, Human herpesvirus 4 (Epstein-Barr virus)
cuagguacucuugg

SEQ ID NO: 1873820 - RNA, 18 nt, Human herpesvirus 4 (Epstein-Barr virus)
cuuccagcgcaagcuugc

SEQ ID NO: 1873821 - RNA, 13 nt, Human herpesvirus 4 (Epstein-Barr virus)
uggcuagauuucc

SEQ ID NO: 1873822 - RNA, 21 nt, Human herpesvirus 4 (Epstein-Barr virus)
ccugucucuuucuggccaacc

SEQ ID NO: 1873823 - RNA, 18 nt, Human herpesvirus 4 (Epstein-Barr virus)
ucacuuuguacagacuuu

SEQ ID NO: 1873824 - RNA, 13 nt, Human herpesvirus 4 (Epstein-Barr virus)
ccaugcagcggcg

SEQ ID NO: 1873825 - RNA, 18 nt, Human herpesvirus 4 (Epstein-Barr virus)
cuccgagagcuccgccac

SEQ ID NO: 1873826 - RNA, 15 nt, Human herpesvirus 4 (Epstein-Barr virus)
gucgcguagcucugg

SEQ ID NO: 1873827 - RNA, 15 nt, Human herpesvirus 4 (Epstein-Barr virus)
ccugucucccaccca

SEQ ID NO: 1873828 - RNA, 20 nt, Human herpesvirus 4 (Epstein-Barr virus)
gcauugcuggccgcagcugg

SEQ ID NO: 1873829 - RNA, 14 nt, Human herpesvirus 4 (Epstein-Barr virus)
ucaaaaucaaagua

SEQ ID NO: 1873830 - RNA, 16 nt, Human herpesvirus 4 (Epstein-Barr virus)
cgggagaggcagcccc

SEQ ID NO: 1873831 - RNA, 21 nt, Human herpesvirus 4 (Epstein-Barr virus)
acguggcugcgguggugcgca

SEQ ID NO: 1873832 - RNA, 14 nt, Human herpesvirus 4 (Epstein-Barr virus)
cccgaguuggcauc

SEQ ID NO: 1873833 - RNA, 18 nt, Human herpesvirus 4 (Epstein-Barr virus)
aggagacguguguggcug

SEQ ID NO: 1873834 - RNA, 23 nt, Human herpesvirus 4 (Epstein-Barr virus)
cauggugagacaccuggcccacu

SEQ ID NO: 1873835 - RNA, 13 nt, Human herpesvirus 4 (Epstein-Barr virus)
acacgggccuggg

SEQ ID NO: 1873836 - RNA, 20 nt, Human herpesvirus 4 (Epstein-Barr virus)
gcgagggggccuggugccag

SEQ ID NO: 1873837 - RNA, 13 nt, Human herpesvirus 4 (Epstein-Barr virus)
cacuauauucucc

SEQ ID NO: 1873838 - RNA, 15 nt, Human herpesvirus 4 (Epstein-Barr virus)
aggagaagagaggcu

SEQ ID NO: 1873839 - RNA, 15 nt, Human herpesvirus 4 (Epstein-Barr virus)
acacacaggccuggc

SEQ ID NO: 1873840 - RNA, 22 nt, Human herpesvirus 4 (Epstein-Barr virus)
uuugccaaccugcucucucugg

SEQ ID NO: 1873841 - RNA, 21 nt, Human herpesvirus 4 (Epstein-Barr virus)
gcaacccccggcucucaggcc

SEQ ID NO: 1873842 - RNA, 18 nt, Human herpesvirus 4 (Epstein-Barr virus)
uucccagacucugcuuuc

SEQ ID NO: 1873843 - RNA, 18 nt, Human herpesvirus 4 (Epstein-Barr virus)
caguccacagccaccggc

SEQ ID NO: 1873844 - RNA, 19 nt, Human herpesvirus 4 (Epstein-Barr virus)
ccuggaagaaucauggccu

SEQ ID NO: 1873845 - RNA, 16 nt, Human herpesvirus 4 (Epstein-Barr virus)
acgugaaccucccccc

SEQ ID NO: 1873846 - RNA, 20 nt, Human herpesvirus 4 (Epstein-Barr virus)
aggcagccccaaagcgggug

SEQ ID NO: 1873847 - RNA, 12 nt, Human herpesvirus 4 (Epstein-Barr virus)
aucacuggcaaa

SEQ ID NO: 1873848 - RNA, 16 nt, Human herpesvirus 4 (Epstein-Barr virus)
ugaauuccgucaaggc

SEQ ID NO: 1873849 - RNA, 13 nt, Human herpesvirus 4 (Epstein-Barr virus)
agaagcccaccua

SEQ ID NO: 1873850 - RNA, 20 nt, Human herpesvirus 4 (Epstein-Barr virus)
gggguccggucuugcaggga

SEQ ID NO: 1873851 - RNA, 17 nt, Human herpesvirus 4 (Epstein-Barr virus)
caccuguguccugggca

SEQ ID NO: 1873852 - RNA, 21 nt, Human herpesvirus 4 (Epstein-Barr virus)
aggcacuggacacacauggca

SEQ ID NO: 1873853 - RNA, 17 nt, Human herpesvirus 4 (Epstein-Barr virus)
agcggaugguggggcuu

SEQ ID NO: 1873854 - RNA, 18 nt, Human herpesvirus 4 (Epstein-Barr virus)
cucgugagucugcuggac

SEQ ID NO: 1873855 - RNA, 15 nt, Human herpesvirus 4 (Epstein-Barr virus)
ccucugggguccagg

SEQ ID NO: 1873856 - RNA, 11 nt, Human herpesvirus 4 (Epstein-Barr virus)
uucuccaggcu

SEQ ID NO: 1873857 - RNA, 17 nt, Human herpesvirus 4 (Epstein-Barr virus)
ggagcaggagcaggagc

SEQ ID NO: 1873858 - RNA, 16 nt, Human herpesvirus 4 (Epstein-Barr virus)
cuuggacccugcugcg

SEQ ID NO: 1873859 - RNA, 16 nt, Human herpesvirus 4 (Epstein-Barr virus)
cuuucuggccaaccug

SEQ ID NO: 1873860 - RNA, 15 nt, Human herpesvirus 4 (Epstein-Barr virus)
uaccuggucaagagc

SEQ ID NO: 1873861 - RNA, 18 nt, Human herpesvirus 4 (Epstein-Barr virus)
uauggauagauagccacc

SEQ ID NO: 1873862 - RNA, 17 nt, Human herpesvirus 4 (Epstein-Barr virus)
caggugcccgagccccg

SEQ ID NO: 1873863 - RNA, 17 nt, Human herpesvirus 4 (Epstein-Barr virus)
auucagccaccuccccu

SEQ ID NO: 1873864 - RNA, 15 nt, Human herpesvirus 4 (Epstein-Barr virus)
ugaggcccagccccc

SEQ ID NO: 1873865 - RNA, 12 nt, Human herpesvirus 4 (Epstein-Barr virus)
accccccucuga

SEQ ID NO: 1873866 - RNA, 17 nt, Human herpesvirus 4 (Epstein-Barr virus)
caaugccaacuccccca

SEQ ID NO: 1873867 - RNA, 15 nt, Human herpesvirus 4 (Epstein-Barr virus)
cccaccaccaggcgg

SEQ ID NO: 1873868 - RNA, 16 nt, Human herpesvirus 4 (Epstein-Barr virus)
acgccggccugcuggc

SEQ ID NO: 1873869 - RNA, 13 nt, Human herpesvirus 4 (Epstein-Barr virus)
cuggcagcggccu

SEQ ID NO: 1873870 - RNA, 18 nt, Human herpesvirus 4 (Epstein-Barr virus)
ccggcuggccgccguggc

SEQ ID NO: 1873871 - RNA, 17 nt, Human herpesvirus 4 (Epstein-Barr virus)
gcgccgccucccccagc

SEQ ID NO: 1873872 - RNA, 19 nt, Human herpesvirus 4 (Epstein-Barr virus)
aaggcgacgcggagagguc

SEQ ID NO: 1873873 - RNA, 15 nt, Human herpesvirus 4 (Epstein-Barr virus)
cuucauguccacuga

SEQ ID NO: 1873874 - RNA, 19 nt, Human herpesvirus 4 (Epstein-Barr virus)
cccugcucauaccuccacu

SEQ ID NO: 1873875 - RNA, 13 nt, Human herpesvirus 4 (Epstein-Barr virus)
guggugggcucug

SEQ ID NO: 1873876 - RNA, 15 nt, Human herpesvirus 4 (Epstein-Barr virus)
accgucagccacaca

SEQ ID NO: 1873877 - RNA, 16 nt, Human herpesvirus 4 (Epstein-Barr virus)
agaguaauugcagugg

SEQ ID NO: 1873878 - RNA, 16 nt, Human herpesvirus 4 (Epstein-Barr virus)
cagcaguagcuuggga

SEQ ID NO: 1873879 - RNA, 23 nt, Human herpesvirus 4 (Epstein-Barr virus)
ccugccucucuuaugccuguggc

SEQ ID NO: 1873880 - RNA, 15 nt, Human herpesvirus 4 (Epstein-Barr virus)
cccgcccuccccauc

SEQ ID NO: 1873881 - RNA, 20 nt, Human herpesvirus 4 (Epstein-Barr virus)
cgucagcaacugcguccucu

SEQ ID NO: 1873882 - RNA, 16 nt, Human herpesvirus 4 (Epstein-Barr virus)
gcauauuuucagaccc

SEQ ID NO: 1873883 - RNA, 20 nt, Human herpesvirus 4 (Epstein-Barr virus)
ucuggucgcccccucugccu

SEQ ID NO: 1873884 - RNA, 13 nt, Human herpesvirus 4 (Epstein-Barr virus)
ucuuaucagagag

SEQ ID NO: 1873885 - RNA, 20 nt, Human herpesvirus 4 (Epstein-Barr virus)
ggcggaggagauccgccagg

SEQ ID NO: 1873886 - RNA, 18 nt, Human herpesvirus 4 (Epstein-Barr virus)
ggcacacacucccuuagc

SEQ ID NO: 1873887 - RNA, 17 nt, Human herpesvirus 4 (Epstein-Barr virus)
ccaggcuuucuaugccu

SEQ ID NO: 1873888 - RNA, 14 nt, Human herpesvirus 4 (Epstein-Barr virus)
acccgaucagagcc

SEQ ID NO: 1873889 - RNA, 22 nt, Human herpesvirus 4 (Epstein-Barr virus)
uggcucagcuuggggccaccgg

SEQ ID NO: 1873890 - RNA, 22 nt, Human herpesvirus 4 (Epstein-Barr virus)
gaucagggccaagacauagaga

SEQ ID NO: 1873891 - RNA, 13 nt, Human herpesvirus 4 (Epstein-Barr virus)
caagcucagcccc

SEQ ID NO: 1873892 - RNA, 20 nt, Human herpesvirus 4 (Epstein-Barr virus)
aacccuugcccucuccagca

SEQ ID NO: 1873893 - RNA, 13 nt, Human herpesvirus 4 (Epstein-Barr virus)
gugacgaggaugg

SEQ ID NO: 1873894 - RNA, 18 nt, Human herpesvirus 4 (Epstein-Barr virus)
cuaccugucggcccugcg

SEQ ID NO: 1873895 - RNA, 15 nt, Human herpesvirus 4 (Epstein-Barr virus)
cagggccaggcuguc

SEQ ID NO: 1873896 - RNA, 17 nt, Human herpesvirus 4 (Epstein-Barr virus)
uucccggacaauacacc

SEQ ID NO: 1873897 - RNA, 22 nt, Human herpesvirus 4 (Epstein-Barr virus)
cucugguaguaggcacaucugg

SEQ ID NO: 1873898 - RNA, 19 nt, Human herpesvirus 4 (Epstein-Barr virus)
aacugcgagggggccuggu

SEQ ID NO: 1873899 - RNA, 18 nt, Human herpesvirus 4 (Epstein-Barr virus)
caguagcuugggaacacc

SEQ ID NO: 1873900 - RNA, 18 nt, Human herpesvirus 4 (Epstein-Barr virus)
aggcccccgggugggcug

SEQ ID NO: 1873901 - RNA, 19 nt, Human herpesvirus 4 (Epstein-Barr virus)
ggcccacgucuuuaccacc

SEQ ID NO: 1873902 - RNA, 20 nt, Human herpesvirus 4 (Epstein-Barr virus)
caagaggcagagagccagug

SEQ ID NO: 1873903 - RNA, 15 nt, Human herpesvirus 4 (Epstein-Barr virus)
gcccacgucaaggcc

SEQ ID NO: 1873904 - RNA, 17 nt, Human herpesvirus 4 (Epstein-Barr virus)
acugccuuguccacugg

SEQ ID NO: 1873905 - RNA, 17 nt, Human herpesvirus 4 (Epstein-Barr virus)
cgguuagggaggacacu

SEQ ID NO: 1873906 - RNA, 17 nt, Human herpesvirus 4 (Epstein-Barr virus)
ccagcagggcacagagg

SEQ ID NO: 1873907 - RNA, 22 nt, Human herpesvirus 4 (Epstein-Barr virus)
ccccaaaaguagaggcucaggc

SEQ ID NO: 1873908 - RNA, 14 nt, Human herpesvirus 4 (Epstein-Barr virus)
gcucaaggaggggc

SEQ ID NO: 1873909 - RNA, 18 nt, Human herpesvirus 4 (Epstein-Barr virus)
ggguauguggugccaugu

SEQ ID NO: 1873910 - RNA, 17 nt, Human herpesvirus 4 (Epstein-Barr virus)
cucaugggggaaugagg

SEQ ID NO: 1873911 - RNA, 21 nt, Human herpesvirus 4 (Epstein-Barr virus)
ugagcccaccugucugacuug

SEQ ID NO: 1873912 - RNA, 21 nt, Human herpesvirus 4 (Epstein-Barr virus)
uaguggcaguucgacggccuc

SEQ ID NO: 1873913 - RNA, 20 nt, Human herpesvirus 4 (Epstein-Barr virus)
cggggcuccccagccacagc

SEQ ID NO: 1873914 - RNA, 13 nt, Human herpesvirus 4 (Epstein-Barr virus)
gucaucuggcucu

SEQ ID NO: 1873915 - RNA, 14 nt, Human herpesvirus 4 (Epstein-Barr virus)
ucagcaucacaggu

SEQ ID NO: 1873916 - RNA, 13 nt, Human herpesvirus 4 (Epstein-Barr virus)
guauugcagcugg

SEQ ID NO: 1873917 - RNA, 23 nt, Human herpesvirus 4 (Epstein-Barr virus)
ggaaaaucucgcucagagcuggg

SEQ ID NO: 1873918 - RNA, 12 nt, Human herpesvirus 4 (Epstein-Barr virus)
gcggagauggau

SEQ ID NO: 1873919 - RNA, 16 nt, Human herpesvirus 4 (Epstein-Barr virus)
ggccgcugccaggccg

SEQ ID NO: 1873920 - RNA, 21 nt, Human herpesvirus 4 (Epstein-Barr virus)
ccacagccccacucuugccuc

SEQ ID NO: 1873921 - RNA, 15 nt, Human herpesvirus 4 (Epstein-Barr virus)
ugaaaggggccgagg

SEQ ID NO: 1873922 - RNA, 15 nt, Human herpesvirus 4 (Epstein-Barr virus)
acggaccccccucug

SEQ ID NO: 1873923 - RNA, 21 nt, Human herpesvirus 4 (Epstein-Barr virus)
gcaggaggaggggcaggagca

SEQ ID NO: 1873924 - RNA, 14 nt, Human herpesvirus 4 (Epstein-Barr virus)
uggucacucaggca

SEQ ID NO: 1873925 - RNA, 21 nt, Human herpesvirus 4 (Epstein-Barr virus)
cacugugcacucucucccccg

SEQ ID NO: 1873926 - RNA, 19 nt, Human herpesvirus 4 (Epstein-Barr virus)
aggcggaagaccaggagcc

SEQ ID NO: 1873927 - RNA, 16 nt, Human herpesvirus 4 (Epstein-Barr virus)
ggagucgaagcucuug

SEQ ID NO: 1873928 - RNA, 21 nt, Human herpesvirus 4 (Epstein-Barr virus)
auugcuugccuuuuugccaca

SEQ ID NO: 1873929 - RNA, 16 nt, Human herpesvirus 4 (Epstein-Barr virus)
cagcauggcagccggg

SEQ ID NO: 1873930 - RNA, 17 nt, Human herpesvirus 4 (Epstein-Barr virus)
ggcaagggcucaccagg

SEQ ID NO: 1873931 - RNA, 13 nt, Human herpesvirus 4 (Epstein-Barr virus)
ccagggguccccg

SEQ ID NO: 1873932 - RNA, 22 nt, Human herpesvirus 4 (Epstein-Barr virus)
ugcaccgauagcauggccgcca

SEQ ID NO: 1873933 - RNA, 13 nt, Human herpesvirus 4 (Epstein-Barr virus)
gcaaaagauggac

SEQ ID NO: 1873934 - RNA, 12 nt, Human herpesvirus 4 (Epstein-Barr virus)
ggagcaggagga

SEQ ID NO: 1873935 - RNA, 13 nt, Human herpesvirus 4 (Epstein-Barr virus)
gcagcucuggcac

SEQ ID NO: 1873936 - RNA, 20 nt, Human herpesvirus 4 (Epstein-Barr virus)
gcgaggggcgccccagggca

SEQ ID NO: 1873937 - RNA, 12 nt, Human herpesvirus 4 (Epstein-Barr virus)
cucccucccccu

SEQ ID NO: 1873938 - RNA, 16 nt, Human herpesvirus 4 (Epstein-Barr virus)
uacgcugcccuagagg

SEQ ID NO: 1873939 - RNA, 11 nt, Human herpesvirus 4 (Epstein-Barr virus)
ucagagagcau

SEQ ID NO: 1873940 - RNA, 14 nt, Human herpesvirus 4 (Epstein-Barr virus)
ugccgucccagggc

SEQ ID NO: 1873941 - RNA, 22 nt, Human herpesvirus 4 (Epstein-Barr virus)
guggacaaggcaguagaggaca

SEQ ID NO: 1873942 - RNA, 14 nt, Human herpesvirus 4 (Epstein-Barr virus)
ggcucccucccccu

SEQ ID NO: 1873943 - RNA, 20 nt, Human herpesvirus 4 (Epstein-Barr virus)
ccuggggccauaguggcggc

SEQ ID NO: 1873944 - RNA, 13 nt, Human herpesvirus 4 (Epstein-Barr virus)
aacacgggccugg

SEQ ID NO: 1873945 - RNA, 16 nt, Human herpesvirus 4 (Epstein-Barr virus)
acccuucugcugcugc

SEQ ID NO: 1873946 - RNA, 17 nt, Human herpesvirus 4 (Epstein-Barr virus)
cuguacuuguccgggcu

SEQ ID NO: 1873947 - RNA, 23 nt, Human herpesvirus 4 (Epstein-Barr virus)
ucucuggcugugcugacccuucu

SEQ ID NO: 1873948 - RNA, 15 nt, Human herpesvirus 4 (Epstein-Barr virus)
uccaggugacagcag

SEQ ID NO: 1873949 - RNA, 18 nt, Human herpesvirus 4 (Epstein-Barr virus)
ggacacugccaagguuga

SEQ ID NO: 1873950 - RNA, 13 nt, Human herpesvirus 4 (Epstein-Barr virus)
augcaggccugga

SEQ ID NO: 1873951 - RNA, 21 nt, Human herpesvirus 4 (Epstein-Barr virus)
cauugcaucgcucaccccugu

SEQ ID NO: 1873952 - RNA, 22 nt, Human herpesvirus 4 (Epstein-Barr virus)
uuguauugugaggaaaggccuu

SEQ ID NO: 1873953 - RNA, 12 nt, Human herpesvirus 4 (Epstein-Barr virus)
agguggccacac

SEQ ID NO: 1873954 - RNA, 20 nt, Human herpesvirus 4 (Epstein-Barr virus)
gugaggcuauaacgcagguc

SEQ ID NO: 1873955 - RNA, 16 nt, Human herpesvirus 4 (Epstein-Barr virus)
agacccaucugagggc

SEQ ID NO: 1873956 - RNA, 22 nt, Human herpesvirus 4 (Epstein-Barr virus)
uacacucuggggucucaggccu

SEQ ID NO: 1873957 - RNA, 14 nt, Human herpesvirus 4 (Epstein-Barr virus)
uguacugcgaugag

SEQ ID NO: 1873958 - RNA, 18 nt, Human herpesvirus 4 (Epstein-Barr virus)
ucgcagcuggaggaaugc

SEQ ID NO: 1873959 - RNA, 20 nt, Human herpesvirus 4 (Epstein-Barr virus)
ccgaggcagacaaggccccg

SEQ ID NO: 1873960 - RNA, 21 nt, Human herpesvirus 4 (Epstein-Barr virus)
guagaagugugucccccucca

SEQ ID NO: 1873961 - RNA, 15 nt, Human herpesvirus 4 (Epstein-Barr virus)
cccuuugccuggggc

SEQ ID NO: 1873962 - RNA, 21 nt, Human herpesvirus 4 (Epstein-Barr virus)
uucugaggcggcuguggccuc

SEQ ID NO: 1873963 - RNA, 21 nt, Human herpesvirus 4 (Epstein-Barr virus)
acuuauguuucaagcagcuca

SEQ ID NO: 1873964 - RNA, 22 nt, Human herpesvirus 4 (Epstein-Barr virus)
ugccuaucauguuucaaccgcu

SEQ ID NO: 1873965 - RNA, 22 nt, Human herpesvirus 4 (Epstein-Barr virus)
cucgccucauccuggcccccaa

SEQ ID NO: 1873966 - RNA, 22 nt, Human herpesvirus 4 (Epstein-Barr virus)
gugcgcgccgccagcauggcag

SEQ ID NO: 1873967 - RNA, 17 nt, Human herpesvirus 4 (Epstein-Barr virus)
gcucaccccugugcagg

SEQ ID NO: 1873968 - RNA, 15 nt, Human herpesvirus 4 (Epstein-Barr virus)
gccuguaauuguugc

SEQ ID NO: 1873969 - RNA, 22 nt, Human herpesvirus 4 (Epstein-Barr virus)
agacaccuggcccacuggaugc

SEQ ID NO: 1873970 - RNA, 14 nt, Human herpesvirus 4 (Epstein-Barr virus)
ccugcuucacgccu

SEQ ID NO: 1873971 - RNA, 23 nt, Human herpesvirus 4 (Epstein-Barr virus)
acaccaccccaccauaugaugac

SEQ ID NO: 1873972 - RNA, 19 nt, Human herpesvirus 4 (Epstein-Barr virus)
ugggggcuacaggaggcca

SEQ ID NO: 1873973 - RNA, 22 nt, Human herpesvirus 4 (Epstein-Barr virus)
aaugggacgucuuguaaaacuu

SEQ ID NO: 1873974 - RNA, 14 nt, Human herpesvirus 4 (Epstein-Barr virus)
cucucaggaacucc

SEQ ID NO: 1873975 - RNA, 16 nt, Human herpesvirus 4 (Epstein-Barr virus)
agaaucugggcuggga

SEQ ID NO: 1873976 - RNA, 21 nt, Human herpesvirus 4 (Epstein-Barr virus)
cugucucuuucuggccaaccu

SEQ ID NO: 1873977 - RNA, 21 nt, Human herpesvirus 4 (Epstein-Barr virus)
ucuugccguggcgccugggga

SEQ ID NO: 1873978 - RNA, 23 nt, Human herpesvirus 4 (Epstein-Barr virus)
gcacuuugaaagaugucaaacau

SEQ ID NO: 1873979 - RNA, 20 nt, Human herpesvirus 4 (Epstein-Barr virus)
auacaggcccgcaauuucca

SEQ ID NO: 1873980 - RNA, 16 nt, Human herpesvirus 4 (Epstein-Barr virus)
acgaggacgaggaggc

SEQ ID NO: 1873981 - RNA, 16 nt, Human herpesvirus 4 (Epstein-Barr virus)
aaagggcauguggugg

SEQ ID NO: 1873982 - RNA, 19 nt, Human herpesvirus 4 (Epstein-Barr virus)
aggccucagcgucaggaga

SEQ ID NO: 1873983 - RNA, 18 nt, Human herpesvirus 4 (Epstein-Barr virus)
ggccauucgacaggccau

SEQ ID NO: 1873984 - RNA, 15 nt, Human herpesvirus 4 (Epstein-Barr virus)
gcaguccaggggcca

SEQ ID NO: 1873985 - RNA, 16 nt, Human herpesvirus 4 (Epstein-Barr virus)
gccacccgucccgggu

SEQ ID NO: 1873986 - RNA, 14 nt, Human herpesvirus 4 (Epstein-Barr virus)
gcugagcgugugca

SEQ ID NO: 1873987 - RNA, 13 nt, Human herpesvirus 4 (Epstein-Barr virus)
cagacagccgcgg

SEQ ID NO: 1873988 - RNA, 20 nt, Human herpesvirus 4 (Epstein-Barr virus)
caugccuccccagcaacaga

SEQ ID NO: 1873989 - RNA, 20 nt, Human herpesvirus 4 (Epstein-Barr virus)
agcucauaugccgcugcaca

SEQ ID NO: 1873990 - RNA, 18 nt, Human herpesvirus 4 (Epstein-Barr virus)
ccaucugcuucuggcucu

SEQ ID NO: 1873991 - RNA, 18 nt, Human herpesvirus 4 (Epstein-Barr virus)
uccgcaccacagaaacua

SEQ ID NO: 1873992 - RNA, 14 nt, Human herpesvirus 4 (Epstein-Barr virus)
auuugcugacauau

SEQ ID NO: 1873993 - RNA, 17 nt, Human herpesvirus 4 (Epstein-Barr virus)
uuaauguccaguggggu

SEQ ID NO: 1873994 - RNA, 13 nt, Human herpesvirus 4 (Epstein-Barr virus)
guuuuaacaccug

SEQ ID NO: 1873995 - RNA, 17 nt, Human herpesvirus 4 (Epstein-Barr virus)
aacggcccguggccugc

SEQ ID NO: 1873996 - RNA, 14 nt, Human herpesvirus 4 (Epstein-Barr virus)
guccaggagucugc

SEQ ID NO: 1873997 - RNA, 16 nt, Human herpesvirus 4 (Epstein-Barr virus)
aggggcaggaggggca

SEQ ID NO: 1873998 - RNA, 22 nt, Human herpesvirus 4 (Epstein-Barr virus)
aagcuacaaacacgggccuggg

SEQ ID NO: 1873999 - RNA, 18 nt, Human herpesvirus 4 (Epstein-Barr virus)
ggccaaccugccucucuu

SEQ ID NO: 1874000 - RNA, 18 nt, Human herpesvirus 4 (Epstein-Barr virus)
ccggcgccaccugcaggg

SEQ ID NO: 1874001 - RNA, 19 nt, Human herpesvirus 4 (Epstein-Barr virus)
aagacuccugccugaauca

SEQ ID NO: 1874002 - RNA, 14 nt, Human herpesvirus 4 (Epstein-Barr virus)
cguggguccccucu

SEQ ID NO: 1874003 - RNA, 17 nt, Human herpesvirus 4 (Epstein-Barr virus)
uugucggacgaggagga

SEQ ID NO: 1874004 - RNA, 16 nt, Human herpesvirus 4 (Epstein-Barr virus)
agcaggauuccugauu

SEQ ID NO: 1874005 - RNA, 21 nt, Human herpesvirus 4 (Epstein-Barr virus)
agacccaucugagggcaguga

SEQ ID NO: 1874006 - RNA, 16 nt, Human herpesvirus 4 (Epstein-Barr virus)
cccuagccaccguggc

SEQ ID NO: 1874007 - RNA, 14 nt, Human herpesvirus 4 (Epstein-Barr virus)
cuauggaggccccc

SEQ ID NO: 1874008 - RNA, 13 nt, Human herpesvirus 4 (Epstein-Barr virus)
uggugggacugag

SEQ ID NO: 1874009 - RNA, 14 nt, Human herpesvirus 4 (Epstein-Barr virus)
cuuggcaguguccu

SEQ ID NO: 1874010 - RNA, 12 nt, Human herpesvirus 4 (Epstein-Barr virus)
uauuuacagcca

SEQ ID NO: 1874011 - RNA, 16 nt, Human herpesvirus 4 (Epstein-Barr virus)
ggaaugacgggcuccc

SEQ ID NO: 1874012 - RNA, 21 nt, Human herpesvirus 4 (Epstein-Barr virus)
gaauccaguaugccugccugu

SEQ ID NO: 1874013 - RNA, 17 nt, Human herpesvirus 4 (Epstein-Barr virus)
aacggcgagcaggguga

SEQ ID NO: 1874014 - RNA, 19 nt, Human herpesvirus 4 (Epstein-Barr virus)
uccccgagggugaggccca

SEQ ID NO: 1874015 - RNA, 14 nt, Human herpesvirus 4 (Epstein-Barr virus)
cuuugccagcaacu

SEQ ID NO: 1874016 - RNA, 16 nt, Human herpesvirus 4 (Epstein-Barr virus)
acggggugcucccccu

SEQ ID NO: 1874017 - RNA, 23 nt, Human herpesvirus 4 (Epstein-Barr virus)
aacuuguuaggagacgcccucaa

SEQ ID NO: 1874018 - RNA, 12 nt, Human herpesvirus 4 (Epstein-Barr virus)
cggcucucaggc

SEQ ID NO: 1874019 - RNA, 14 nt, Human herpesvirus 4 (Epstein-Barr virus)
cuggcucuucuggg

SEQ ID NO: 1874020 - RNA, 13 nt, Human herpesvirus 4 (Epstein-Barr virus)
ccaggugguuaca

SEQ ID NO: 1874021 - RNA, 21 nt, Human herpesvirus 4 (Epstein-Barr virus)
gccauaaguccucauggcagg

SEQ ID NO: 1874022 - RNA, 15 nt, Human herpesvirus 4 (Epstein-Barr virus)
caagcuccggcugcc

SEQ ID NO: 1874023 - RNA, 19 nt, Human herpesvirus 4 (Epstein-Barr virus)
cuaugcauuuccugcccuc

SEQ ID NO: 1874024 - RNA, 17 nt, Human herpesvirus 4 (Epstein-Barr virus)
ccaugacaucacagagg

SEQ ID NO: 1874025 - RNA, 14 nt, Human herpesvirus 4 (Epstein-Barr virus)
cgcggugagggccg

SEQ ID NO: 1874026 - RNA, 14 nt, Human herpesvirus 4 (Epstein-Barr virus)
agguggcugcugcc

SEQ ID NO: 1874027 - RNA, 14 nt, Human herpesvirus 4 (Epstein-Barr virus)
caggaucagggcca

SEQ ID NO: 1874028 - RNA, 14 nt, Human herpesvirus 4 (Epstein-Barr virus)
aucugaccacggcc

SEQ ID NO: 1874029 - RNA, 14 nt, Human herpesvirus 4 (Epstein-Barr virus)
uugaugauauugaa

SEQ ID NO: 1874030 - RNA, 18 nt, Human herpesvirus 4 (Epstein-Barr virus)
gcucagcucaaccgccag

SEQ ID NO: 1874031 - RNA, 13 nt, Human herpesvirus 4 (Epstein-Barr virus)
gccuccuggccag

SEQ ID NO: 1874032 - RNA, 19 nt, Human herpesvirus 4 (Epstein-Barr virus)
gccacguccccggccuccc

SEQ ID NO: 1874033 - RNA, 23 nt, Human herpesvirus 4 (Epstein-Barr virus)
ggcaccuguccuugucugcugcc

SEQ ID NO: 1874034 - RNA, 22 nt, Human herpesvirus 4 (Epstein-Barr virus)
uagaaacuaugcaugagccaca

SEQ ID NO: 1874035 - RNA, 20 nt, Human herpesvirus 4 (Epstein-Barr virus)
acucuggggucucaggccuc

SEQ ID NO: 1874036 - RNA, 14 nt, Human herpesvirus 4 (Epstein-Barr virus)
cccugcaagccaag

SEQ ID NO: 1874037 - RNA, 15 nt, Human herpesvirus 4 (Epstein-Barr virus)
aagcuggccaggcug

SEQ ID NO: 1874038 - RNA, 15 nt, Human herpesvirus 4 (Epstein-Barr virus)
cagcuuggggccacc

SEQ ID NO: 1874039 - RNA, 22 nt, Human herpesvirus 4 (Epstein-Barr virus)
ccggucguagucauccgaggcu

SEQ ID NO: 1874040 - RNA, 16 nt, Human herpesvirus 4 (Epstein-Barr virus)
cgcgcagccuguucau

SEQ ID NO: 1874041 - RNA, 16 nt, Human herpesvirus 4 (Epstein-Barr virus)
aaaccagucuacgacc

SEQ ID NO: 1874042 - RNA, 13 nt, Human herpesvirus 4 (Epstein-Barr virus)
gugcguggucggg

SEQ ID NO: 1874043 - RNA, 15 nt, Human herpesvirus 4 (Epstein-Barr virus)
acgugcaaggaugga

SEQ ID NO: 1874044 - RNA, 17 nt, Human herpesvirus 4 (Epstein-Barr virus)
caaguaccagcuggugg

SEQ ID NO: 1874045 - RNA, 14 nt, Human herpesvirus 4 (Epstein-Barr virus)
ccuggcggcccagc

SEQ ID NO: 1874046 - RNA, 17 nt, Human herpesvirus 4 (Epstein-Barr virus)
agcggacgguggggcuc

SEQ ID NO: 1874047 - RNA, 22 nt, Human herpesvirus 4 (Epstein-Barr virus)
gagcagauuuccgucagccagg

SEQ ID NO: 1874048 - RNA, 18 nt, Human herpesvirus 4 (Epstein-Barr virus)
ccuuggggguggugggcu

SEQ ID NO: 1874049 - RNA, 18 nt, Human herpesvirus 4 (Epstein-Barr virus)
cuccguccuuguccagga

SEQ ID NO: 1874050 - RNA, 17 nt, Human herpesvirus 4 (Epstein-Barr virus)
augcagaaggggcccug

SEQ ID NO: 1874051 - RNA, 16 nt, Human herpesvirus 4 (Epstein-Barr virus)
ugcucaccaugguagc

SEQ ID NO: 1874052 - RNA, 15 nt, Human herpesvirus 4 (Epstein-Barr virus)
agagcucuggaggac

SEQ ID NO: 1874053 - RNA, 15 nt, Human herpesvirus 4 (Epstein-Barr virus)
cauccccagcccagc

SEQ ID NO: 1874054 - RNA, 18 nt, Human herpesvirus 4 (Epstein-Barr virus)
cauugggcuaacgggagg

SEQ ID NO: 1874055 - RNA, 22 nt, Human herpesvirus 4 (Epstein-Barr virus)
ccggguuugauguuucuguggc

SEQ ID NO: 1874056 - RNA, 15 nt, Human herpesvirus 4 (Epstein-Barr virus)
cgggcccgggugccu

SEQ ID NO: 1874057 - RNA, 22 nt, Human herpesvirus 4 (Epstein-Barr virus)
augcgugaccaccuggccaggg

SEQ ID NO: 1874058 - RNA, 10 nt, Human herpesvirus 4 (Epstein-Barr virus)
ggcacccagg

SEQ ID NO: 1874059 - RNA, 22 nt, Human herpesvirus 4 (Epstein-Barr virus)
caagggaaaggaagggggcccu

SEQ ID NO: 1874060 - RNA, 17 nt, Human herpesvirus 4 (Epstein-Barr virus)
uauacuaacacgaaugc

SEQ ID NO: 1874061 - RNA, 21 nt, Human herpesvirus 4 (Epstein-Barr virus)
cuguaccugaugagucacacc

SEQ ID NO: 1874062 - RNA, 16 nt, Human herpesvirus 4 (Epstein-Barr virus)
ggacuuccugggaggu

SEQ ID NO: 1874063 - RNA, 13 nt, Human herpesvirus 4 (Epstein-Barr virus)
gugccagaggccc

SEQ ID NO: 1874064 - RNA, 17 nt, Human herpesvirus 4 (Epstein-Barr virus)
cgcagccacguccagac

SEQ ID NO: 1874065 - RNA, 20 nt, Human herpesvirus 4 (Epstein-Barr virus)
ccagaaggcuccggcggcag

SEQ ID NO: 1874066 - RNA, 19 nt, Human herpesvirus 4 (Epstein-Barr virus)
aucugggaguguagaggug

SEQ ID NO: 1874067 - RNA, 14 nt, Human herpesvirus 4 (Epstein-Barr virus)
ccaugagugccaug

SEQ ID NO: 1874068 - RNA, 16 nt, Human herpesvirus 4 (Epstein-Barr virus)
ggcuccccauagacuc

SEQ ID NO: 1874069 - RNA, 17 nt, Human herpesvirus 4 (Epstein-Barr virus)
cgaggacggggaagagg

SEQ ID NO: 1874070 - RNA, 20 nt, Human herpesvirus 4 (Epstein-Barr virus)
ugcagugggccucucuggcu

SEQ ID NO: 1874071 - RNA, 17 nt, Human herpesvirus 4 (Epstein-Barr virus)
ggcccagugcacccagg

SEQ ID NO: 1874072 - RNA, 19 nt, Human herpesvirus 4 (Epstein-Barr virus)
uaugaaggcuggcaaagau

SEQ ID NO: 1874073 - RNA, 19 nt, Human herpesvirus 4 (Epstein-Barr virus)
uuccucauuggcuuugccc

SEQ ID NO: 1874074 - RNA, 23 nt, Human herpesvirus 4 (Epstein-Barr virus)
aggggccagguacaggaccugga

SEQ ID NO: 1874075 - RNA, 21 nt, Human herpesvirus 4 (Epstein-Barr virus)
agguuucugggcauaaauucu

SEQ ID NO: 1874076 - RNA, 15 nt, Human herpesvirus 4 (Epstein-Barr virus)
ugccaucgggacaga

SEQ ID NO: 1874077 - RNA, 17 nt, Human herpesvirus 4 (Epstein-Barr virus)
cggugcaaggacggggg

SEQ ID NO: 1874078 - RNA, 14 nt, Human herpesvirus 4 (Epstein-Barr virus)
uagauauagaggcu

SEQ ID NO: 1874079 - RNA, 20 nt, Human herpesvirus 4 (Epstein-Barr virus)
caggacuaaccaugccaucu

SEQ ID NO: 1874080 - RNA, 12 nt, Human herpesvirus 4 (Epstein-Barr virus)
ugagggaaaagg

SEQ ID NO: 1874081 - RNA, 12 nt, Human herpesvirus 4 (Epstein-Barr virus)
cauggccugggc

SEQ ID NO: 1874082 - RNA, 23 nt, Human herpesvirus 4 (Epstein-Barr virus)
ggcagcgaagaacacuccacaga

SEQ ID NO: 1874083 - RNA, 20 nt, Human herpesvirus 4 (Epstein-Barr virus)
ccacagagcaucagaugaga

SEQ ID NO: 1874084 - RNA, 13 nt, Human herpesvirus 4 (Epstein-Barr virus)
caauauccaucug

SEQ ID NO: 1874085 - RNA, 18 nt, Human herpesvirus 4 (Epstein-Barr virus)
aagaucgugaggccugag

SEQ ID NO: 1874086 - RNA, 20 nt, Human herpesvirus 4 (Epstein-Barr virus)
aagugauuaggagcagggcc

SEQ ID NO: 1874087 - RNA, 19 nt, Human herpesvirus 4 (Epstein-Barr virus)
cugcguggcuggacggagg

SEQ ID NO: 1874088 - RNA, 14 nt, Human herpesvirus 4 (Epstein-Barr virus)
gucucaugggggaa

SEQ ID NO: 1874089 - RNA, 15 nt, Human herpesvirus 4 (Epstein-Barr virus)
cccuccgcagccgcu

SEQ ID NO: 1874090 - RNA, 17 nt, Human herpesvirus 4 (Epstein-Barr virus)
agcuacacucugggguc

SEQ ID NO: 1874091 - RNA, 14 nt, Human herpesvirus 4 (Epstein-Barr virus)
agccccagccccuc

SEQ ID NO: 1874092 - RNA, 16 nt, Human herpesvirus 4 (Epstein-Barr virus)
uaggagacgcccucaa

SEQ ID NO: 1874093 - RNA, 17 nt, Human herpesvirus 4 (Epstein-Barr virus)
cgugguugggcagaacc

SEQ ID NO: 1874094 - RNA, 15 nt, Human herpesvirus 4 (Epstein-Barr virus)
gcaggucaggucccc

SEQ ID NO: 1874095 - RNA, 12 nt, Human herpesvirus 4 (Epstein-Barr virus)
ccaggucacaga

SEQ ID NO: 1874096 - RNA, 15 nt, Human herpesvirus 4 (Epstein-Barr virus)
cccggggguggcagc

SEQ ID NO: 1874097 - RNA, 17 nt, Human herpesvirus 4 (Epstein-Barr virus)
uuuaaggaaugaacacu

SEQ ID NO: 1874098 - RNA, 13 nt, Human herpesvirus 4 (Epstein-Barr virus)
accaaggcccuag

SEQ ID NO: 1874099 - RNA, 14 nt, Human herpesvirus 4 (Epstein-Barr virus)
acucaagagaucag

SEQ ID NO: 1874100 - RNA, 17 nt, Human herpesvirus 4 (Epstein-Barr virus)
ccagaucgccugccacu

SEQ ID NO: 1874101 - RNA, 23 nt, Human herpesvirus 4 (Epstein-Barr virus)
uacccucauugugcugaagccca

SEQ ID NO: 1874102 - RNA, 13 nt, Human herpesvirus 4 (Epstein-Barr virus)
uggggcaggcccc

SEQ ID NO: 1874103 - RNA, 15 nt, Human herpesvirus 4 (Epstein-Barr virus)
ugcaccagcuccagg

SEQ ID NO: 1874104 - RNA, 20 nt, Human herpesvirus 4 (Epstein-Barr virus)
agaggcaaacauacaggagg

SEQ ID NO: 1874105 - RNA, 20 nt, Human herpesvirus 4 (Epstein-Barr virus)
gccuccaacaggugcccgag

SEQ ID NO: 1874106 - RNA, 18 nt, Human herpesvirus 4 (Epstein-Barr virus)
guagccacccgucccggg

SEQ ID NO: 1874107 - RNA, 14 nt, Human herpesvirus 4 (Epstein-Barr virus)
cugcccuucagugu

SEQ ID NO: 1874108 - RNA, 19 nt, Human herpesvirus 4 (Epstein-Barr virus)
ggcuggcaaagauccccag

SEQ ID NO: 1874109 - RNA, 20 nt, Human herpesvirus 4 (Epstein-Barr virus)
gccuccagcucggccagcag

SEQ ID NO: 1874110 - RNA, 16 nt, Human herpesvirus 4 (Epstein-Barr virus)
ggugggggugggugca

SEQ ID NO: 1874111 - RNA, 13 nt, Human herpesvirus 4 (Epstein-Barr virus)
cgagggugaggcc

SEQ ID NO: 1874112 - RNA, 18 nt, Human herpesvirus 4 (Epstein-Barr virus)
ccggcccuuugccugggg

SEQ ID NO: 1874113 - RNA, 13 nt, Human herpesvirus 4 (Epstein-Barr virus)
ucgcucagagcug

SEQ ID NO: 1874114 - RNA, 16 nt, Human herpesvirus 4 (Epstein-Barr virus)
ccucaaaggccucggc

SEQ ID NO: 1874115 - RNA, 20 nt, Human herpesvirus 4 (Epstein-Barr virus)
ccccagcgcuggcuccaggg

SEQ ID NO: 1874116 - RNA, 19 nt, Human herpesvirus 4 (Epstein-Barr virus)
caugcuauggugccggggc

SEQ ID NO: 1874117 - RNA, 18 nt, Human herpesvirus 4 (Epstein-Barr virus)
ccaccacggugcagccua

SEQ ID NO: 1874118 - RNA, 16 nt, Human herpesvirus 4 (Epstein-Barr virus)
gauaaucugggcagcc

SEQ ID NO: 1874119 - RNA, 14 nt, Human herpesvirus 4 (Epstein-Barr virus)
ccagccaucaugcu

SEQ ID NO: 1874120 - RNA, 13 nt, Human herpesvirus 4 (Epstein-Barr virus)
gccuccggccgcc

SEQ ID NO: 1874121 - RNA, 23 nt, Human herpesvirus 4 (Epstein-Barr virus)
ccugaauccgcgcagccuguuca

SEQ ID NO: 1874122 - RNA, 15 nt, Human herpesvirus 4 (Epstein-Barr virus)
aggucuccagagggc

SEQ ID NO: 1874123 - RNA, 19 nt, Human herpesvirus 4 (Epstein-Barr virus)
ccgcuucagacagccgcgg

SEQ ID NO: 1874124 - RNA, 22 nt, Human herpesvirus 4 (Epstein-Barr virus)
caccauccacagccccacucuu

SEQ ID NO: 1874125 - RNA, 16 nt, Human herpesvirus 4 (Epstein-Barr virus)
uauugaugugacuugu

SEQ ID NO: 1874126 - RNA, 15 nt, Human herpesvirus 4 (Epstein-Barr virus)
aguuggcauuggcgu

SEQ ID NO: 1874127 - RNA, 23 nt, Human herpesvirus 4 (Epstein-Barr virus)
ggccugcuggccgagcuggaggc

SEQ ID NO: 1874128 - RNA, 18 nt, Human herpesvirus 4 (Epstein-Barr virus)
gucacuaaaguuggucag

SEQ ID NO: 1874129 - RNA, 19 nt, Human herpesvirus 4 (Epstein-Barr virus)
caauaaaguugaugauauu

SEQ ID NO: 1874130 - RNA, 18 nt, Human herpesvirus 4 (Epstein-Barr virus)
ucccgucauucuuucggg

SEQ ID NO: 1874131 - RNA, 17 nt, Human herpesvirus 4 (Epstein-Barr virus)
cguccuuguccaggaga

SEQ ID NO: 1874132 - RNA, 18 nt, Human herpesvirus 4 (Epstein-Barr virus)
ugucuccugacgccaaug

SEQ ID NO: 1874133 - RNA, 18 nt, Human herpesvirus 4 (Epstein-Barr virus)
ggaggggaccacuagguc

SEQ ID NO: 1874134 - RNA, 19 nt, Human herpesvirus 4 (Epstein-Barr virus)
aguaaggccgcugccaggc

SEQ ID NO: 1874135 - RNA, 19 nt, Human herpesvirus 4 (Epstein-Barr virus)
cugucauugagguaaaaag

SEQ ID NO: 1874136 - RNA, 21 nt, Human herpesvirus 4 (Epstein-Barr virus)
caaaacugguggacucuauug

SEQ ID NO: 1874137 - RNA, 15 nt, Human herpesvirus 4 (Epstein-Barr virus)
uacccccuggccacc

SEQ ID NO: 1874138 - RNA, 16 nt, Human herpesvirus 4 (Epstein-Barr virus)
gggaacgugacaggca

SEQ ID NO: 1874139 - RNA, 11 nt, Human herpesvirus 4 (Epstein-Barr virus)
gccugccaaag

SEQ ID NO: 1874140 - RNA, 15 nt, Human herpesvirus 4 (Epstein-Barr virus)
cuugugcuccugaua

SEQ ID NO: 1874141 - RNA, 18 nt, Human herpesvirus 4 (Epstein-Barr virus)
cccagcccuuaacacacc

SEQ ID NO: 1874142 - RNA, 22 nt, Human herpesvirus 4 (Epstein-Barr virus)
cagucucaaucucucccacgga

SEQ ID NO: 1874143 - RNA, 19 nt, Human herpesvirus 4 (Epstein-Barr virus)
ggccuuccucugccuggcc

SEQ ID NO: 1874144 - RNA, 13 nt, Human herpesvirus 4 (Epstein-Barr virus)
ugacgcuccagga

SEQ ID NO: 1874145 - RNA, 16 nt, Human herpesvirus 4 (Epstein-Barr virus)
ucccgcauugcgccgc

SEQ ID NO: 1874146 - RNA, 18 nt, Human herpesvirus 4 (Epstein-Barr virus)
cuagcucacuuucagugg

SEQ ID NO: 1874147 - RNA, 17 nt, Human herpesvirus 4 (Epstein-Barr virus)
gaccucaaagaagaggg

SEQ ID NO: 1874148 - RNA, 23 nt, Human herpesvirus 4 (Epstein-Barr virus)
ucgaguaggugccuccagagccc

SEQ ID NO: 1874149 - RNA, 20 nt, Human herpesvirus 4 (Epstein-Barr virus)
aggugcagcuggcccaccua

SEQ ID NO: 1874150 - RNA, 21 nt, Human herpesvirus 4 (Epstein-Barr virus)
gccccgaaagcggcccagcag

SEQ ID NO: 1874151 - RNA, 15 nt, Human herpesvirus 4 (Epstein-Barr virus)
cucacaggacauguu

SEQ ID NO: 1874152 - RNA, 15 nt, Human herpesvirus 4 (Epstein-Barr virus)
cacuuugccagcaac

SEQ ID NO: 1874153 - RNA, 19 nt, Human herpesvirus 4 (Epstein-Barr virus)
caggccccccgcaccaggg

SEQ ID NO: 1874154 - RNA, 21 nt, Human herpesvirus 4 (Epstein-Barr virus)
cuaccaggggcgagcagcgcg

SEQ ID NO: 1874155 - RNA, 15 nt, Human herpesvirus 4 (Epstein-Barr virus)
ucuggccaaccugcc

SEQ ID NO: 1874156 - RNA, 17 nt, Human herpesvirus 4 (Epstein-Barr virus)
ccaggccucagcgucag

SEQ ID NO: 1874157 - RNA, 17 nt, Human herpesvirus 4 (Epstein-Barr virus)
acgacuauccaggucuu

SEQ ID NO: 1874158 - RNA, 20 nt, Human herpesvirus 4 (Epstein-Barr virus)
ggaaaaucucgcucagagcu

SEQ ID NO: 1874159 - RNA, 19 nt, Human herpesvirus 4 (Epstein-Barr virus)
ucucuagcaggugcaccag

SEQ ID NO: 1874160 - RNA, 15 nt, Human herpesvirus 4 (Epstein-Barr virus)
aucccaaauaaaugu

SEQ ID NO: 1874161 - RNA, 21 nt, Human herpesvirus 4 (Epstein-Barr virus)
acuggcacgguggcuugggcu

SEQ ID NO: 1874162 - RNA, 18 nt, Human herpesvirus 4 (Epstein-Barr virus)
aacagggguauguggugc

SEQ ID NO: 1874163 - RNA, 17 nt, Human herpesvirus 4 (Epstein-Barr virus)
ccugcucauaccuccac

SEQ ID NO: 1874164 - RNA, 20 nt, Human herpesvirus 4 (Epstein-Barr virus)
cugcgaugagggccuuccag

SEQ ID NO: 1874165 - RNA, 18 nt, Human herpesvirus 4 (Epstein-Barr virus)
ccuuuaggcguaacuugu

SEQ ID NO: 1874166 - RNA, 19 nt, Human herpesvirus 4 (Epstein-Barr virus)
gacucccauguaagccugc

SEQ ID NO: 1874167 - RNA, 19 nt, Human herpesvirus 4 (Epstein-Barr virus)
gggccaggucacagaccag

SEQ ID NO: 1874168 - RNA, 20 nt, Human herpesvirus 4 (Epstein-Barr virus)
gcgaagggugggggugggug

SEQ ID NO: 1874169 - RNA, 21 nt, Human herpesvirus 4 (Epstein-Barr virus)
ggcaccccacggggugcuccc

SEQ ID NO: 1874170 - RNA, 18 nt, Human herpesvirus 4 (Epstein-Barr virus)
ggcacacauuacggugcu

SEQ ID NO: 1874171 - RNA, 13 nt, Human herpesvirus 4 (Epstein-Barr virus)
gugcugccagagc

SEQ ID NO: 1874172 - RNA, 21 nt, Human herpesvirus 4 (Epstein-Barr virus)
gacauggccgcccgccuggcu

SEQ ID NO: 1874173 - RNA, 21 nt, Human herpesvirus 4 (Epstein-Barr virus)
gugauuaggagcagggcccag

SEQ ID NO: 1874174 - RNA, 20 nt, Human herpesvirus 4 (Epstein-Barr virus)
gaguccccuccuuggagcug

SEQ ID NO: 1874175 - RNA, 14 nt, Human herpesvirus 4 (Epstein-Barr virus)
caguagaggacacc

SEQ ID NO: 1874176 - RNA, 17 nt, Human herpesvirus 4 (Epstein-Barr virus)
uuccacagcaauggcac

SEQ ID NO: 1874177 - RNA, 16 nt, Human herpesvirus 4 (Epstein-Barr virus)
ucuuggguuccuagug

SEQ ID NO: 1874178 - RNA, 16 nt, Human herpesvirus 4 (Epstein-Barr virus)
aggccgcugccaggcc

SEQ ID NO: 1874179 - RNA, 20 nt, Human herpesvirus 4 (Epstein-Barr virus)
caccuuaacuggcacacacu

SEQ ID NO: 1874180 - RNA, 11 nt, Human herpesvirus 4 (Epstein-Barr virus)
cgccccagggc

SEQ ID NO: 1874181 - RNA, 18 nt, Human herpesvirus 4 (Epstein-Barr virus)
cuaugcaugagccacagg

SEQ ID NO: 1874182 - RNA, 11 nt, Human herpesvirus 4 (Epstein-Barr virus)
guggccaggcc

SEQ ID NO: 1874183 - RNA, 16 nt, Human herpesvirus 4 (Epstein-Barr virus)
uggccggcagccuggc

SEQ ID NO: 1874184 - RNA, 19 nt, Human herpesvirus 4 (Epstein-Barr virus)
cacucguccgccuacuggu

SEQ ID NO: 1874185 - RNA, 19 nt, Human herpesvirus 4 (Epstein-Barr virus)
acucucccuccauuuacug

SEQ ID NO: 1874186 - RNA, 17 nt, Human herpesvirus 4 (Epstein-Barr virus)
ccaacuuugagcugggc

SEQ ID NO: 1874187 - RNA, 17 nt, Human herpesvirus 4 (Epstein-Barr virus)
gucauccgaggcugaga

SEQ ID NO: 1874188 - RNA, 19 nt, Human herpesvirus 4 (Epstein-Barr virus)
gucucucuuugagggggcc

SEQ ID NO: 1874189 - RNA, 17 nt, Human herpesvirus 4 (Epstein-Barr virus)
cgccaugcucagggcca

SEQ ID NO: 1874190 - RNA, 13 nt, Human herpesvirus 4 (Epstein-Barr virus)
aggacccugggcc

SEQ ID NO: 1874191 - RNA, 21 nt, Human herpesvirus 4 (Epstein-Barr virus)
cacgaccucgggagggacggg

SEQ ID NO: 1874192 - RNA, 19 nt, Human herpesvirus 4 (Epstein-Barr virus)
acucacccccagccugugc

SEQ ID NO: 1874193 - RNA, 23 nt, Human herpesvirus 4 (Epstein-Barr virus)
gccccgguccccccagaagcccc

SEQ ID NO: 1874194 - RNA, 20 nt, Human herpesvirus 4 (Epstein-Barr virus)
caguacuagcauggagaggu

SEQ ID NO: 1874195 - RNA, 18 nt, Human herpesvirus 4 (Epstein-Barr virus)
cccaucugagggcaguga

SEQ ID NO: 1874196 - RNA, 13 nt, Human herpesvirus 4 (Epstein-Barr virus)
aguggcugccccg

SEQ ID NO: 1874197 - RNA, 12 nt, Human herpesvirus 4 (Epstein-Barr virus)
ggccugagagcc

SEQ ID NO: 1874198 - RNA, 19 nt, Human herpesvirus 4 (Epstein-Barr virus)
gccuccauccaguggggcu

SEQ ID NO: 1874199 - RNA, 16 nt, Human herpesvirus 4 (Epstein-Barr virus)
augcaggccuggacag

SEQ ID NO: 1874200 - RNA, 18 nt, Human herpesvirus 4 (Epstein-Barr virus)
uuuguacagacuuuuggc

SEQ ID NO: 1874201 - RNA, 20 nt, Human herpesvirus 4 (Epstein-Barr virus)
cgggggcgacugccgccgcc

SEQ ID NO: 1874202 - RNA, 17 nt, Human herpesvirus 4 (Epstein-Barr virus)
gaugacgccgagaccua

SEQ ID NO: 1874203 - RNA, 19 nt, Human herpesvirus 4 (Epstein-Barr virus)
aaaauggggguuggagaaa

SEQ ID NO: 1874204 - RNA, 19 nt, Human herpesvirus 4 (Epstein-Barr virus)
cgucugcaccccaguggac

SEQ ID NO: 1874205 - RNA, 11 nt, Human herpesvirus 4 (Epstein-Barr virus)
ucugcuucugg

SEQ ID NO: 1874206 - RNA, 12 nt, Human herpesvirus 4 (Epstein-Barr virus)
gaaaaugaugaa

SEQ ID NO: 1874207 - RNA, 20 nt, Human herpesvirus 4 (Epstein-Barr virus)
cuuucuggccaaccugccuc

SEQ ID NO: 1874208 - RNA, 18 nt, Human herpesvirus 4 (Epstein-Barr virus)
uggccugccuggaucuga

SEQ ID NO: 1874209 - RNA, 21 nt, Human herpesvirus 4 (Epstein-Barr virus)
caccggcuuggcccucucacu

SEQ ID NO: 1874210 - RNA, 14 nt, Human herpesvirus 4 (Epstein-Barr virus)
gcuggccugccugg

SEQ ID NO: 1874211 - RNA, 19 nt, Human herpesvirus 4 (Epstein-Barr virus)
aggcacacaaaaugaggaa

SEQ ID NO: 1874212 - RNA, 14 nt, Human herpesvirus 4 (Epstein-Barr virus)
cugggcucucagga

SEQ ID NO: 1874213 - RNA, 22 nt, Human herpesvirus 4 (Epstein-Barr virus)
auaacggggaaugugugacaug

SEQ ID NO: 1874214 - RNA, 12 nt, Human herpesvirus 4 (Epstein-Barr virus)
ggagcaggaggg

SEQ ID NO: 1874215 - RNA, 20 nt, Human herpesvirus 4 (Epstein-Barr virus)
gaggcggaagaccaggagcc

SEQ ID NO: 1874216 - RNA, 15 nt, Human herpesvirus 4 (Epstein-Barr virus)
caaauaaauguuacu

SEQ ID NO: 1874217 - RNA, 15 nt, Human herpesvirus 4 (Epstein-Barr virus)
cgaggauggaaaggg

SEQ ID NO: 1874218 - RNA, 22 nt, Human herpesvirus 4 (Epstein-Barr virus)
uacuggcuuucguccucuggcu

SEQ ID NO: 1874219 - RNA, 22 nt, Human herpesvirus 4 (Epstein-Barr virus)
caaaccuccaaucaccagccac

SEQ ID NO: 1874220 - RNA, 16 nt, Human herpesvirus 4 (Epstein-Barr virus)
ggcgcgggucccccua

SEQ ID NO: 1874221 - RNA, 14 nt, Human herpesvirus 4 (Epstein-Barr virus)
cccuggcggcccag

SEQ ID NO: 1874222 - RNA, 21 nt, Human herpesvirus 4 (Epstein-Barr virus)
ccagcaaccaauguaucccaa

SEQ ID NO: 1874223 - RNA, 17 nt, Human herpesvirus 4 (Epstein-Barr virus)
acgucuuguaaaacuug

SEQ ID NO: 1874224 - RNA, 14 nt, Human herpesvirus 4 (Epstein-Barr virus)
uacagcaggauucc

SEQ ID NO: 1874225 - RNA, 17 nt, Human herpesvirus 4 (Epstein-Barr virus)
gugaagggcagggcucg

SEQ ID NO: 1874226 - RNA, 20 nt, Human herpesvirus 4 (Epstein-Barr virus)
uccucuuacaccagaggcca

SEQ ID NO: 1874227 - RNA, 15 nt, Human herpesvirus 4 (Epstein-Barr virus)
cucaaggcagucucc

SEQ ID NO: 1874228 - RNA, 13 nt, Human herpesvirus 4 (Epstein-Barr virus)
aggaccuggaugc

SEQ ID NO: 1874229 - RNA, 14 nt, Human herpesvirus 4 (Epstein-Barr virus)
uaacuugucuacau

SEQ ID NO: 1874230 - RNA, 13 nt, Human herpesvirus 4 (Epstein-Barr virus)
caucugcuucugg

SEQ ID NO: 1874231 - RNA, 21 nt, Human herpesvirus 4 (Epstein-Barr virus)
gcugcaucuuaccccuggcuu

SEQ ID NO: 1874232 - RNA, 14 nt, Human herpesvirus 4 (Epstein-Barr virus)
gguuuucugccccu

SEQ ID NO: 1874233 - RNA, 15 nt, Human herpesvirus 4 (Epstein-Barr virus)
agucccuccucacca

SEQ ID NO: 1874234 - RNA, 19 nt, Human herpesvirus 4 (Epstein-Barr virus)
ccccgccuuugggcacccc

SEQ ID NO: 1874235 - RNA, 19 nt, Human herpesvirus 4 (Epstein-Barr virus)
gggccuggugccagacucu

SEQ ID NO: 1874236 - RNA, 23 nt, Human herpesvirus 4 (Epstein-Barr virus)
acaggagacguggguccccucug

SEQ ID NO: 1874237 - RNA, 13 nt, Human herpesvirus 4 (Epstein-Barr virus)
acucaggcacggu

SEQ ID NO: 1874238 - RNA, 18 nt, Human herpesvirus 4 (Epstein-Barr virus)
caccacccccgcccccac

SEQ ID NO: 1874239 - RNA, 21 nt, Human herpesvirus 4 (Epstein-Barr virus)
aguugaugaaaggggccgagg

SEQ ID NO: 1874240 - RNA, 13 nt, Human herpesvirus 4 (Epstein-Barr virus)
agcaacugcugca

SEQ ID NO: 1874241 - RNA, 15 nt, Human herpesvirus 4 (Epstein-Barr virus)
acgaggacgaggagg

SEQ ID NO: 1874242 - RNA, 13 nt, Human herpesvirus 4 (Epstein-Barr virus)
gagcggcugugag

SEQ ID NO: 1874243 - RNA, 22 nt, Human herpesvirus 4 (Epstein-Barr virus)
guggguuucugcccccugucuc

SEQ ID NO: 1874244 - RNA, 20 nt, Human herpesvirus 4 (Epstein-Barr virus)
cccccguaaaacuccacaga

SEQ ID NO: 1874245 - RNA, 16 nt, Human herpesvirus 4 (Epstein-Barr virus)
ccguguuucucccacu

SEQ ID NO: 1874246 - RNA, 17 nt, Human herpesvirus 4 (Epstein-Barr virus)
ccuuguccacuggggug

SEQ ID NO: 1874247 - RNA, 20 nt, Human herpesvirus 4 (Epstein-Barr virus)
uauggacacuugguaaguuu

SEQ ID NO: 1874248 - RNA, 16 nt, Human herpesvirus 4 (Epstein-Barr virus)
agcauggcggccuggc

SEQ ID NO: 1874249 - RNA, 16 nt, Human herpesvirus 4 (Epstein-Barr virus)
gcccacacagcgccag

SEQ ID NO: 1874250 - RNA, 22 nt, Human herpesvirus 4 (Epstein-Barr virus)
ccugugccucgucuaccucugu

SEQ ID NO: 1874251 - RNA, 21 nt, Human herpesvirus 4 (Epstein-Barr virus)
agcagugguguuugcuugccc

SEQ ID NO: 1874252 - RNA, 14 nt, Human herpesvirus 4 (Epstein-Barr virus)
ccaaucaccagcca

SEQ ID NO: 1874253 - RNA, 13 nt, Human herpesvirus 4 (Epstein-Barr virus)
gccucggccuggg

SEQ ID NO: 1874254 - RNA, 15 nt, Human herpesvirus 4 (Epstein-Barr virus)
cagcuaacaggacau

SEQ ID NO: 1874255 - RNA, 16 nt, Human herpesvirus 4 (Epstein-Barr virus)
agacugcaaacccugg

SEQ ID NO: 1874256 - RNA, 16 nt, Human herpesvirus 4 (Epstein-Barr virus)
cgcgacucgugggaaa

SEQ ID NO: 1874257 - RNA, 22 nt, Human herpesvirus 4 (Epstein-Barr virus)
aguuccucaacaaggagugccu

SEQ ID NO: 1874258 - RNA, 16 nt, Human herpesvirus 4 (Epstein-Barr virus)
acagcagcuggaugua

SEQ ID NO: 1874259 - RNA, 18 nt, Human herpesvirus 4 (Epstein-Barr virus)
cuguagccacccgucccg

SEQ ID NO: 1874260 - RNA, 16 nt, Human herpesvirus 4 (Epstein-Barr virus)
caggcacggccgggcu

SEQ ID NO: 1874261 - RNA, 13 nt, Human herpesvirus 4 (Epstein-Barr virus)
gacccuucugcug

SEQ ID NO: 1874262 - RNA, 16 nt, Human herpesvirus 4 (Epstein-Barr virus)
uaaagaaugcccacca

SEQ ID NO: 1874263 - RNA, 21 nt, Human herpesvirus 4 (Epstein-Barr virus)
ggccccccgcaccagggccag

SEQ ID NO: 1874264 - RNA, 17 nt, Human herpesvirus 4 (Epstein-Barr virus)
cugaagcaacagguccu

SEQ ID NO: 1874265 - RNA, 22 nt, Human herpesvirus 4 (Epstein-Barr virus)
ccccugugcuucuaccaagacu

SEQ ID NO: 1874266 - RNA, 23 nt, Human herpesvirus 4 (Epstein-Barr virus)
caggaagcuggccaggcugguga

SEQ ID NO: 1874267 - RNA, 20 nt, Human herpesvirus 4 (Epstein-Barr virus)
uguagccacccgucccgggu

SEQ ID NO: 1874268 - RNA, 18 nt, Human herpesvirus 4 (Epstein-Barr virus)
ggcgucgggaaacacagc

SEQ ID NO: 1874269 - RNA, 18 nt, Human herpesvirus 4 (Epstein-Barr virus)
gugggcuucgggggccug

SEQ ID NO: 1874270 - RNA, 13 nt, Human herpesvirus 4 (Epstein-Barr virus)
ccuggcgcuuugc

SEQ ID NO: 1874271 - RNA, 13 nt, Human herpesvirus 4 (Epstein-Barr virus)
aaucgcagcucua

SEQ ID NO: 1874272 - RNA, 13 nt, Human herpesvirus 4 (Epstein-Barr virus)
cgagggccucugg

SEQ ID NO: 1874273 - RNA, 20 nt, Human herpesvirus 4 (Epstein-Barr virus)
agcacaagugauuaggagca

SEQ ID NO: 1874274 - RNA, 19 nt, Human herpesvirus 4 (Epstein-Barr virus)
ugccuggggcucagacuua

SEQ ID NO: 1874275 - RNA, 21 nt, Human herpesvirus 4 (Epstein-Barr virus)
ccaccgccuuaugaggaccca

SEQ ID NO: 1874276 - RNA, 17 nt, Human herpesvirus 4 (Epstein-Barr virus)
cacagaggugauguaga

SEQ ID NO: 1874277 - RNA, 17 nt, Human herpesvirus 4 (Epstein-Barr virus)
augugcccaagccugga

SEQ ID NO: 1874278 - RNA, 14 nt, Human herpesvirus 4 (Epstein-Barr virus)
ccagcgacugaucc

SEQ ID NO: 1874279 - RNA, 18 nt, Human herpesvirus 4 (Epstein-Barr virus)
uggccgagcuggaggcca

SEQ ID NO: 1874280 - RNA, 17 nt, Human herpesvirus 4 (Epstein-Barr virus)
aacaucucauccccaga

SEQ ID NO: 1874281 - RNA, 18 nt, Human herpesvirus 4 (Epstein-Barr virus)
ggaaaauaguuccaggug

SEQ ID NO: 1874282 - RNA, 16 nt, Human herpesvirus 4 (Epstein-Barr virus)
guaacuugucuacauc

SEQ ID NO: 1874283 - RNA, 13 nt, Human herpesvirus 4 (Epstein-Barr virus)
ggacgggcaggca

SEQ ID NO: 1874284 - RNA, 15 nt, Human herpesvirus 4 (Epstein-Barr virus)
cacagccugcaccag

SEQ ID NO: 1874285 - RNA, 20 nt, Human herpesvirus 4 (Epstein-Barr virus)
caaacucucucaucuccaaa

SEQ ID NO: 1874286 - RNA, 14 nt, Human herpesvirus 4 (Epstein-Barr virus)
guccaggagaaggc

SEQ ID NO: 1874287 - RNA, 24 nt, Human herpesvirus 4 (Epstein-Barr virus)
acguggguggauguagggagcacu

SEQ ID NO: 1874288 - RNA, 15 nt, Human herpesvirus 4 (Epstein-Barr virus)
gcgccagcagggcac

SEQ ID NO: 1874289 - RNA, 16 nt, Human herpesvirus 4 (Epstein-Barr virus)
ggucaccccagaugcc

SEQ ID NO: 1874290 - RNA, 18 nt, Human herpesvirus 4 (Epstein-Barr virus)
gccgccgccuccgccgcc

SEQ ID NO: 1874291 - RNA, 20 nt, Human herpesvirus 4 (Epstein-Barr virus)
ggaucccauggaggagauga

SEQ ID NO: 1874292 - RNA, 18 nt, Human herpesvirus 4 (Epstein-Barr virus)
aggcguaacuugucuaca

SEQ ID NO: 1874293 - RNA, 22 nt, Human herpesvirus 4 (Epstein-Barr virus)
cgggggucaagcaaacggccug

SEQ ID NO: 1874294 - RNA, 19 nt, Human herpesvirus 4 (Epstein-Barr virus)
cugagaccaugcucagugg

SEQ ID NO: 1874295 - RNA, 14 nt, Human herpesvirus 4 (Epstein-Barr virus)
ggaccacauacauc

SEQ ID NO: 1874296 - RNA, 22 nt, Human herpesvirus 4 (Epstein-Barr virus)
uggagucugagaauaaggcucu

SEQ ID NO: 1874297 - RNA, 17 nt, Human herpesvirus 4 (Epstein-Barr virus)
gugaguccagggcccug

SEQ ID NO: 1874298 - RNA, 17 nt, Human herpesvirus 4 (Epstein-Barr virus)
guccaggguccaggaga

SEQ ID NO: 1874299 - RNA, 24 nt, Human herpesvirus 4 (Epstein-Barr virus)
ggacguuggcgggacuggcacggu

SEQ ID NO: 1874300 - RNA, 16 nt, Human herpesvirus 4 (Epstein-Barr virus)
caucggacgggcaggc

SEQ ID NO: 1874301 - RNA, 21 nt, Human herpesvirus 4 (Epstein-Barr virus)
cguauauguguugagaugagu

SEQ ID NO: 1874302 - RNA, 12 nt, Human herpesvirus 4 (Epstein-Barr virus)
uguuccuucugc

SEQ ID NO: 1874303 - RNA, 14 nt, Human herpesvirus 4 (Epstein-Barr virus)
uccagccagugguc

SEQ ID NO: 1874304 - RNA, 13 nt, Human herpesvirus 4 (Epstein-Barr virus)
caccaucuggcag

SEQ ID NO: 1874305 - RNA, 21 nt, Human herpesvirus 4 (Epstein-Barr virus)
aguacgugcagaggacuuuug

SEQ ID NO: 1874306 - RNA, 18 nt, Human herpesvirus 4 (Epstein-Barr virus)
ggaggaggacgugaguga

SEQ ID NO: 1874307 - RNA, 18 nt, Human herpesvirus 4 (Epstein-Barr virus)
cugucucuuucuggccaa

SEQ ID NO: 1874308 - RNA, 23 nt, Human herpesvirus 4 (Epstein-Barr virus)
gccucgaguaggugccuccagag

SEQ ID NO: 1874309 - RNA, 13 nt, Human herpesvirus 4 (Epstein-Barr virus)
ucgcaggcccccc

SEQ ID NO: 1874310 - RNA, 19 nt, Human herpesvirus 4 (Epstein-Barr virus)
uuccugcccucccacuuuu

SEQ ID NO: 1874311 - RNA, 18 nt, Human herpesvirus 4 (Epstein-Barr virus)
uggagcuguaacuguggu

SEQ ID NO: 1874312 - RNA, 15 nt, Human herpesvirus 4 (Epstein-Barr virus)
agagaaugacagcaa

SEQ ID NO: 1874313 - RNA, 14 nt, Human herpesvirus 4 (Epstein-Barr virus)
ccaaugugcauggg

SEQ ID NO: 1874314 - RNA, 20 nt, Human herpesvirus 4 (Epstein-Barr virus)
aaauuugcugacauauguac

SEQ ID NO: 1874315 - RNA, 13 nt, Human herpesvirus 4 (Epstein-Barr virus)
agcgaagaacacu

SEQ ID NO: 1874316 - RNA, 14 nt, Human herpesvirus 4 (Epstein-Barr virus)
gcagcucuggcacu

SEQ ID NO: 1874317 - RNA, 15 nt, Human herpesvirus 4 (Epstein-Barr virus)
uguucuacuccuggc

SEQ ID NO: 1874318 - RNA, 14 nt, Human herpesvirus 4 (Epstein-Barr virus)
ccuucuccucagcc

SEQ ID NO: 1874319 - RNA, 22 nt, Human herpesvirus 4 (Epstein-Barr virus)
uaacugugucccacuccaccug

SEQ ID NO: 1874320 - RNA, 14 nt, Human herpesvirus 4 (Epstein-Barr virus)
ugcagacuccaggu

SEQ ID NO: 1874321 - RNA, 19 nt, Human herpesvirus 4 (Epstein-Barr virus)
cugcucuucaaccuuggca

SEQ ID NO: 1874322 - RNA, 20 nt, Human herpesvirus 4 (Epstein-Barr virus)
gugguuuggggcaggccccc

SEQ ID NO: 1874323 - RNA, 21 nt, Human herpesvirus 4 (Epstein-Barr virus)
gcuagucacacccguggaggu

SEQ ID NO: 1874324 - RNA, 17 nt, Human herpesvirus 4 (Epstein-Barr virus)
caucuggaccagaaggc

SEQ ID NO: 1874325 - RNA, 21 nt, Human herpesvirus 4 (Epstein-Barr virus)
gcccgucuuacugcccagccu

SEQ ID NO: 1874326 - RNA, 15 nt, Human herpesvirus 4 (Epstein-Barr virus)
ccuuuggcuccuccu

SEQ ID NO: 1874327 - RNA, 19 nt, Human herpesvirus 4 (Epstein-Barr virus)
acauuacggugcuggagau

SEQ ID NO: 1874328 - RNA, 14 nt, Human herpesvirus 4 (Epstein-Barr virus)
cacugcaggcugga

SEQ ID NO: 1874329 - RNA, 16 nt, Human herpesvirus 4 (Epstein-Barr virus)
agucagauugccuucu

SEQ ID NO: 1874330 - RNA, 18 nt, Human herpesvirus 4 (Epstein-Barr virus)
cuggaccagaaggcuccg

SEQ ID NO: 1874331 - RNA, 16 nt, Human herpesvirus 4 (Epstein-Barr virus)
cuccggauucaccggc

SEQ ID NO: 1874332 - RNA, 18 nt, Human herpesvirus 4 (Epstein-Barr virus)
caguggccagcucauaug

SEQ ID NO: 1874333 - RNA, 16 nt, Human herpesvirus 4 (Epstein-Barr virus)
ggacagggggacucua

SEQ ID NO: 1874334 - RNA, 16 nt, Human herpesvirus 4 (Epstein-Barr virus)
cuggcauacucuucau

SEQ ID NO: 1874335 - RNA, 11 nt, Human herpesvirus 4 (Epstein-Barr virus)
ggcuggccgug

SEQ ID NO: 1874336 - RNA, 22 nt, Human herpesvirus 4 (Epstein-Barr virus)
acaaaauggggguuggagaaag

SEQ ID NO: 1874337 - RNA, 15 nt, Human herpesvirus 4 (Epstein-Barr virus)
cugugugcgcgccgc

SEQ ID NO: 1874338 - RNA, 16 nt, Human herpesvirus 4 (Epstein-Barr virus)
ggcucaggccaugcgc

SEQ ID NO: 1874339 - RNA, 15 nt, Human herpesvirus 4 (Epstein-Barr virus)
gcugaacuggggcug

SEQ ID NO: 1874340 - RNA, 19 nt, Human herpesvirus 4 (Epstein-Barr virus)
uagccguccuguccaagug

SEQ ID NO: 1874341 - RNA, 20 nt, Human herpesvirus 4 (Epstein-Barr virus)
acacuacuuguuucuggaau

SEQ ID NO: 1874342 - RNA, 21 nt, Human herpesvirus 4 (Epstein-Barr virus)
cgccagcgccuccucgcaggc

SEQ ID NO: 1874343 - RNA, 20 nt, Human herpesvirus 4 (Epstein-Barr virus)
gcugaagaugauggacccaa

SEQ ID NO: 1874344 - RNA, 17 nt, Human herpesvirus 4 (Epstein-Barr virus)
cucugcuuucugccguc

SEQ ID NO: 1874345 - RNA, 20 nt, Human herpesvirus 4 (Epstein-Barr virus)
ccagcccccucccgccccug

SEQ ID NO: 1874346 - RNA, 15 nt, Human herpesvirus 4 (Epstein-Barr virus)
agccugagccacacc

SEQ ID NO: 1874347 - RNA, 17 nt, Human herpesvirus 4 (Epstein-Barr virus)
uggcuguacgccgccgc

SEQ ID NO: 1874348 - RNA, 20 nt, Human herpesvirus 4 (Epstein-Barr virus)
ugacuguaaucacuggcaaa

SEQ ID NO: 1874349 - RNA, 16 nt, Human herpesvirus 4 (Epstein-Barr virus)
ugcaccagcuccaggg

SEQ ID NO: 1874350 - RNA, 17 nt, Human herpesvirus 4 (Epstein-Barr virus)
gacauucuucugaagga

SEQ ID NO: 1874351 - RNA, 18 nt, Human herpesvirus 4 (Epstein-Barr virus)
ugcucuucaaccuuggca

SEQ ID NO: 1874352 - RNA, 10 nt, Human herpesvirus 4 (Epstein-Barr virus)
gcccccacca

SEQ ID NO: 1874353 - RNA, 21 nt, Human herpesvirus 4 (Epstein-Barr virus)
ccccgacaucgccgccccagg

SEQ ID NO: 1874354 - RNA, 16 nt, Human herpesvirus 4 (Epstein-Barr virus)
gaugcaacagaggauu

SEQ ID NO: 1874355 - RNA, 15 nt, Human herpesvirus 4 (Epstein-Barr virus)
ugcccaccagccagc

SEQ ID NO: 1874356 - RNA, 19 nt, Human herpesvirus 4 (Epstein-Barr virus)
uguacuugggauugcaaca

SEQ ID NO: 1874357 - RNA, 21 nt, Human herpesvirus 4 (Epstein-Barr virus)
acuugcucagguuucugggca

SEQ ID NO: 1874358 - RNA, 19 nt, Human herpesvirus 4 (Epstein-Barr virus)
cgaagcagcuccgcccuca

SEQ ID NO: 1874359 - RNA, 16 nt, Human herpesvirus 4 (Epstein-Barr virus)
cguguuccacaaugcc

SEQ ID NO: 1874360 - RNA, 23 nt, Human herpesvirus 4 (Epstein-Barr virus)
uaaauguuacuucuuuugcucuu

SEQ ID NO: 1874361 - RNA, 13 nt, Human herpesvirus 4 (Epstein-Barr virus)
ugacacagacuug

SEQ ID NO: 1874362 - RNA, 18 nt, Human herpesvirus 4 (Epstein-Barr virus)
auugcuggccgcagcugg

SEQ ID NO: 1874363 - RNA, 18 nt, Human herpesvirus 4 (Epstein-Barr virus)
uaggcaaaccuccaauca

SEQ ID NO: 1874364 - RNA, 23 nt, Human herpesvirus 4 (Epstein-Barr virus)
cagauagccggccaggcagagga

SEQ ID NO: 1874365 - RNA, 16 nt, Human herpesvirus 4 (Epstein-Barr virus)
uaaggcucugaagcaa

SEQ ID NO: 1874366 - RNA, 22 nt, Human herpesvirus 4 (Epstein-Barr virus)
caugcaggucaggucccccucc

SEQ ID NO: 1874367 - RNA, 20 nt, Human herpesvirus 4 (Epstein-Barr virus)
ucaggagguacaugggccac

SEQ ID NO: 1874368 - RNA, 22 nt, Human herpesvirus 4 (Epstein-Barr virus)
ccucuugauagggauccgcuag

SEQ ID NO: 1874369 - RNA, 22 nt, Human herpesvirus 4 (Epstein-Barr virus)
acugccccgguccccccagaag

SEQ ID NO: 1874370 - RNA, 16 nt, Human herpesvirus 4 (Epstein-Barr virus)
agcggggguucuccag

SEQ ID NO: 1874371 - RNA, 14 nt, Human herpesvirus 4 (Epstein-Barr virus)
ucugcugcugcugg

SEQ ID NO: 1874372 - RNA, 13 nt, Human herpesvirus 4 (Epstein-Barr virus)
caggugacagcag

SEQ ID NO: 1874373 - RNA, 21 nt, Human herpesvirus 4 (Epstein-Barr virus)
ugcccucuccagcaaccaaug

SEQ ID NO: 1874374 - RNA, 19 nt, Human herpesvirus 4 (Epstein-Barr virus)
gcagccuugcguggugcug

SEQ ID NO: 1874375 - RNA, 14 nt, Human herpesvirus 4 (Epstein-Barr virus)
gccuuccagagcuc

SEQ ID NO: 1874376 - RNA, 19 nt, Human herpesvirus 4 (Epstein-Barr virus)
guccgugagagccuaccca

SEQ ID NO: 1874377 - RNA, 15 nt, Human herpesvirus 4 (Epstein-Barr virus)
agugucccugcugcc

SEQ ID NO: 1874378 - RNA, 14 nt, Human herpesvirus 4 (Epstein-Barr virus)
gccccucagccugc

SEQ ID NO: 1874379 - RNA, 16 nt, Human herpesvirus 4 (Epstein-Barr virus)
ccggcucucaggccuc

SEQ ID NO: 1874380 - RNA, 14 nt, Human herpesvirus 4 (Epstein-Barr virus)
caccguggagccgg

SEQ ID NO: 1874381 - RNA, 23 nt, Human herpesvirus 4 (Epstein-Barr virus)
ccacucuugccucggcgcuggga

SEQ ID NO: 1874382 - RNA, 12 nt, Human herpesvirus 4 (Epstein-Barr virus)
acaauaaaguug

SEQ ID NO: 1874383 - RNA, 17 nt, Human herpesvirus 4 (Epstein-Barr virus)
ggaccuacaggacaaga

SEQ ID NO: 1874384 - RNA, 22 nt, Human herpesvirus 4 (Epstein-Barr virus)
ggcccugaucugggagaugaga

SEQ ID NO: 1874385 - RNA, 17 nt, Human herpesvirus 4 (Epstein-Barr virus)
ucaugggggaaugaggg

SEQ ID NO: 1874386 - RNA, 16 nt, Human herpesvirus 4 (Epstein-Barr virus)
ggugccugagacagag

SEQ ID NO: 1874387 - RNA, 15 nt, Human herpesvirus 4 (Epstein-Barr virus)
agggcgccagggauc

SEQ ID NO: 1874388 - RNA, 21 nt, Human herpesvirus 4 (Epstein-Barr virus)
cagccccucaucccugacccu

SEQ ID NO: 1874389 - RNA, 13 nt, Human herpesvirus 4 (Epstein-Barr virus)
ugaagauggccuc

SEQ ID NO: 1874390 - RNA, 17 nt, Human herpesvirus 4 (Epstein-Barr virus)
gaaaaucucgcucagag

SEQ ID NO: 1874391 - RNA, 18 nt, Human herpesvirus 4 (Epstein-Barr virus)
gcuggacgcgcagugcca

SEQ ID NO: 1874392 - RNA, 22 nt, Human herpesvirus 4 (Epstein-Barr virus)
agacuucagguggucauguuuc

SEQ ID NO: 1874393 - RNA, 19 nt, Human herpesvirus 4 (Epstein-Barr virus)
caaccugauucccccugcu

SEQ ID NO: 1874394 - RNA, 20 nt, Human herpesvirus 4 (Epstein-Barr virus)
caguggaccucaaagaagag

SEQ ID NO: 1874395 - RNA, 18 nt, Human herpesvirus 4 (Epstein-Barr virus)
aacugacacacaggccug

SEQ ID NO: 1874396 - RNA, 18 nt, Human herpesvirus 4 (Epstein-Barr virus)
agagugcccuggaggccu

SEQ ID NO: 1874397 - RNA, 18 nt, Human herpesvirus 4 (Epstein-Barr virus)
agauucagacgagucuga

SEQ ID NO: 1874398 - RNA, 16 nt, Human herpesvirus 4 (Epstein-Barr virus)
ugauugagaucagaaa

SEQ ID NO: 1874399 - RNA, 15 nt, Human herpesvirus 4 (Epstein-Barr virus)
gggaucaugaagccc

SEQ ID NO: 1874400 - RNA, 23 nt, Human herpesvirus 4 (Epstein-Barr virus)
uugcuagucacacccguggaggu

SEQ ID NO: 1874401 - RNA, 20 nt, Human herpesvirus 4 (Epstein-Barr virus)
gcggcccagcagauccaggg

SEQ ID NO: 1874402 - RNA, 17 nt, Human herpesvirus 4 (Epstein-Barr virus)
uacggcuuuccaguucc

SEQ ID NO: 1874403 - RNA, 21 nt, Human herpesvirus 4 (Epstein-Barr virus)
uggcgccguuugacuguuugu

SEQ ID NO: 1874404 - RNA, 13 nt, Human herpesvirus 4 (Epstein-Barr virus)
ugggaucaugaag

SEQ ID NO: 1874405 - RNA, 15 nt, Human herpesvirus 4 (Epstein-Barr virus)
uauucucagaugcag

SEQ ID NO: 1874406 - RNA, 21 nt, Human herpesvirus 4 (Epstein-Barr virus)
cuggugagaaguugguggugg

SEQ ID NO: 1874407 - RNA, 15 nt, Human herpesvirus 4 (Epstein-Barr virus)
acacgccagagacaa

SEQ ID NO: 1874408 - RNA, 15 nt, Human herpesvirus 4 (Epstein-Barr virus)
uuaccugguacauug

SEQ ID NO: 1874409 - RNA, 16 nt, Human herpesvirus 4 (Epstein-Barr virus)
guuuuaguguggcauu

SEQ ID NO: 1874410 - RNA, 16 nt, Human herpesvirus 4 (Epstein-Barr virus)
cucggccacacagugg

SEQ ID NO: 1874411 - RNA, 17 nt, Human herpesvirus 4 (Epstein-Barr virus)
cggcgcuugcgucugcc

SEQ ID NO: 1874412 - RNA, 22 nt, Human herpesvirus 4 (Epstein-Barr virus)
ucgcagcucuaacuuggcaucu

SEQ ID NO: 1874413 - RNA, 21 nt, Human herpesvirus 4 (Epstein-Barr virus)
gccaccguggccaggcccgag

SEQ ID NO: 1874414 - RNA, 20 nt, Human herpesvirus 4 (Epstein-Barr virus)
uacaccgucaacagauuucc

SEQ ID NO: 1874415 - RNA, 20 nt, Human herpesvirus 4 (Epstein-Barr virus)
uacgaggcccuggcccaccg

SEQ ID NO: 1874416 - RNA, 22 nt, Human herpesvirus 4 (Epstein-Barr virus)
auuaggcacuggacacacaugg

SEQ ID NO: 1874417 - RNA, 21 nt, Human herpesvirus 4 (Epstein-Barr virus)
acggccucaaaggccucggcg

SEQ ID NO: 1874418 - RNA, 15 nt, Human herpesvirus 4 (Epstein-Barr virus)
gaggggcaggagcag

SEQ ID NO: 1874419 - RNA, 14 nt, Human herpesvirus 4 (Epstein-Barr virus)
ccugcccucccacu

SEQ ID NO: 1874420 - RNA, 20 nt, Human herpesvirus 4 (Epstein-Barr virus)
ucacuuccucugcuuuucuc

SEQ ID NO: 1874421 - RNA, 16 nt, Human herpesvirus 4 (Epstein-Barr virus)
acgcuuccacccccug

SEQ ID NO: 1874422 - RNA, 16 nt, Human herpesvirus 4 (Epstein-Barr virus)
cauggacgaggacggg

SEQ ID NO: 1874423 - RNA, 13 nt, Human herpesvirus 4 (Epstein-Barr virus)
gucccccuagccc

SEQ ID NO: 1874424 - RNA, 19 nt, Human herpesvirus 4 (Epstein-Barr virus)
ugccucgggucucgccgcu

SEQ ID NO: 1874425 - RNA, 20 nt, Human herpesvirus 4 (Epstein-Barr virus)
acgcagaggccugcaccagu

SEQ ID NO: 1874426 - RNA, 16 nt, Human herpesvirus 4 (Epstein-Barr virus)
gaagacuccugccuga

SEQ ID NO: 1874427 - RNA, 17 nt, Human herpesvirus 4 (Epstein-Barr virus)
cucccauguaagccugc

SEQ ID NO: 1874428 - RNA, 13 nt, Human herpesvirus 4 (Epstein-Barr virus)
ucuccagccacgg

SEQ ID NO: 1874429 - RNA, 18 nt, Human herpesvirus 4 (Epstein-Barr virus)
gccuggugccagacucuc

SEQ ID NO: 1874430 - RNA, 11 nt, Human herpesvirus 4 (Epstein-Barr virus)
guccucuggac

SEQ ID NO: 1874431 - RNA, 13 nt, Human herpesvirus 4 (Epstein-Barr virus)
cguagaugagccu

SEQ ID NO: 1874432 - RNA, 20 nt, Human herpesvirus 4 (Epstein-Barr virus)
cgcaccuguguccugggcaa

SEQ ID NO: 1874433 - RNA, 16 nt, Human herpesvirus 4 (Epstein-Barr virus)
cgcaccaccgcagcca

SEQ ID NO: 1874434 - RNA, 17 nt, Human herpesvirus 4 (Epstein-Barr virus)
uggucgcccccucugcc

SEQ ID NO: 1874435 - RNA, 14 nt, Human herpesvirus 4 (Epstein-Barr virus)
ugggcucccucugg

SEQ ID NO: 1874436 - RNA, 21 nt, Human herpesvirus 4 (Epstein-Barr virus)
agaugaggccccuuacuucca

SEQ ID NO: 1874437 - RNA, 16 nt, Human herpesvirus 4 (Epstein-Barr virus)
cccugagcauggcggc

SEQ ID NO: 1874438 - RNA, 19 nt, Human herpesvirus 4 (Epstein-Barr virus)
caggcuacaacaggcugcu

SEQ ID NO: 1874439 - RNA, 23 nt, Human herpesvirus 4 (Epstein-Barr virus)
ggugccugagacagaggugcuca

SEQ ID NO: 1874440 - RNA, 21 nt, Human herpesvirus 4 (Epstein-Barr virus)
cagcccccucccgccccuguc

SEQ ID NO: 1874441 - RNA, 17 nt, Human herpesvirus 4 (Epstein-Barr virus)
gaagauugucacagcug

SEQ ID NO: 1874442 - RNA, 19 nt, Human herpesvirus 4 (Epstein-Barr virus)
ccaucaccuggguacccaa

SEQ ID NO: 1874443 - RNA, 14 nt, Human herpesvirus 4 (Epstein-Barr virus)
acugccgccgccuc

SEQ ID NO: 1874444 - RNA, 15 nt, Human herpesvirus 4 (Epstein-Barr virus)
cuaacacgcaauaaa

SEQ ID NO: 1874445 - RNA, 17 nt, Human herpesvirus 4 (Epstein-Barr virus)
cuaucacccauggccag

SEQ ID NO: 1874446 - RNA, 20 nt, Human herpesvirus 4 (Epstein-Barr virus)
ccauccaucaacuucagcuc

SEQ ID NO: 1874447 - RNA, 17 nt, Human herpesvirus 4 (Epstein-Barr virus)
cuucagcaucaauguca

SEQ ID NO: 1874448 - RNA, 20 nt, Human herpesvirus 4 (Epstein-Barr virus)
acaacggcugugacuacacc

SEQ ID NO: 1874449 - RNA, 12 nt, Human herpesvirus 4 (Epstein-Barr virus)
aggaucagaauc

SEQ ID NO: 1874450 - RNA, 23 nt, Human herpesvirus 4 (Epstein-Barr virus)
gggccuagguacucuuggugcag

SEQ ID NO: 1874451 - RNA, 15 nt, Human herpesvirus 4 (Epstein-Barr virus)
cacgagauggcccag

SEQ ID NO: 1874452 - RNA, 15 nt, Human herpesvirus 4 (Epstein-Barr virus)
uacgcgggccacagg

SEQ ID NO: 1874453 - RNA, 21 nt, Human herpesvirus 4 (Epstein-Barr virus)
ugcgcaacgccggccugcugg

SEQ ID NO: 1874454 - RNA, 17 nt, Human herpesvirus 4 (Epstein-Barr virus)
uucuggccaaccugccu

SEQ ID NO: 1874455 - RNA, 15 nt, Human herpesvirus 4 (Epstein-Barr virus)
ggagcgggaggggca

SEQ ID NO: 1874456 - RNA, 18 nt, Human herpesvirus 4 (Epstein-Barr virus)
ccaggcagccuugcgugg

SEQ ID NO: 1874457 - RNA, 23 nt, Human herpesvirus 4 (Epstein-Barr virus)
ggaaugacgggcucccucccccu

SEQ ID NO: 1874458 - RNA, 19 nt, Human herpesvirus 4 (Epstein-Barr virus)
ggucacagaccagccccuc

SEQ ID NO: 1874459 - RNA, 21 nt, Human herpesvirus 4 (Epstein-Barr virus)
cccucugcagagagccacauu

SEQ ID NO: 1874460 - RNA, 20 nt, Human herpesvirus 4 (Epstein-Barr virus)
uccagagcugagugcccagg

SEQ ID NO: 1874461 - RNA, 18 nt, Human herpesvirus 4 (Epstein-Barr virus)
gaauuguuaguuuaaaca

SEQ ID NO: 1874462 - RNA, 19 nt, Human herpesvirus 4 (Epstein-Barr virus)
ccuugaggugccacagagc

SEQ ID NO: 1874463 - RNA, 20 nt, Human herpesvirus 4 (Epstein-Barr virus)
auugcugaacuggggcuggu

SEQ ID NO: 1874464 - RNA, 21 nt, Human herpesvirus 4 (Epstein-Barr virus)
cuacacucuggggucucaggc

SEQ ID NO: 1874465 - RNA, 20 nt, Human herpesvirus 4 (Epstein-Barr virus)
aggauggcacgggcagagga

SEQ ID NO: 1874466 - RNA, 13 nt, Human herpesvirus 4 (Epstein-Barr virus)
cacccaggcagcc

SEQ ID NO: 1874467 - RNA, 17 nt, Human herpesvirus 4 (Epstein-Barr virus)
auccgccaggaccugga

SEQ ID NO: 1874468 - RNA, 16 nt, Human herpesvirus 4 (Epstein-Barr virus)
cuugaccuugauguac

SEQ ID NO: 1874469 - RNA, 18 nt, Human herpesvirus 4 (Epstein-Barr virus)
gaggcuauaacgcagguc

SEQ ID NO: 1874470 - RNA, 10 nt, Human herpesvirus 4 (Epstein-Barr virus)
aaaggagaaa

SEQ ID NO: 1874471 - RNA, 17 nt, Human herpesvirus 4 (Epstein-Barr virus)
agauuggugugaaagga

SEQ ID NO: 1874472 - RNA, 14 nt, Human herpesvirus 4 (Epstein-Barr virus)
guuggauuggcugu

SEQ ID NO: 1874473 - RNA, 11 nt, Human herpesvirus 4 (Epstein-Barr virus)
uuccagagagg

SEQ ID NO: 1874474 - RNA, 23 nt, Human herpesvirus 4 (Epstein-Barr virus)
uguugcgcccuaccucuuuuggc

SEQ ID NO: 1874475 - RNA, 18 nt, Human herpesvirus 4 (Epstein-Barr virus)
cccagccuacucuccacu

SEQ ID NO: 1874476 - RNA, 21 nt, Human herpesvirus 4 (Epstein-Barr virus)
cuggaacggugggaagcucag

SEQ ID NO: 1874477 - RNA, 20 nt, Human herpesvirus 4 (Epstein-Barr virus)
ccugaauccgcgcagccugu

SEQ ID NO: 1874478 - RNA, 13 nt, Human herpesvirus 4 (Epstein-Barr virus)
ccugggccuuggc

SEQ ID NO: 1874479 - RNA, 12 nt, Human herpesvirus 4 (Epstein-Barr virus)
aaaaguccagcg

SEQ ID NO: 1874480 - RNA, 14 nt, Human herpesvirus 4 (Epstein-Barr virus)
aaauuuacaccuga

SEQ ID NO: 1874481 - RNA, 22 nt, Human herpesvirus 4 (Epstein-Barr virus)
ccacuaucacccauggccaggc

SEQ ID NO: 1874482 - RNA, 14 nt, Human herpesvirus 4 (Epstein-Barr virus)
auauguacaaugag

SEQ ID NO: 1874483 - RNA, 15 nt, Human herpesvirus 4 (Epstein-Barr virus)
accucuguuccuucu

SEQ ID NO: 1874484 - RNA, 23 nt, Human herpesvirus 4 (Epstein-Barr virus)
ucaaaggccuugguuucagccuc

SEQ ID NO: 1874485 - RNA, 21 nt, Human herpesvirus 4 (Epstein-Barr virus)
ccaaggacccccgcgucacug

SEQ ID NO: 1874486 - RNA, 13 nt, Human herpesvirus 4 (Epstein-Barr virus)
ucccaaguacaga

SEQ ID NO: 1874487 - RNA, 17 nt, Human herpesvirus 4 (Epstein-Barr virus)
cucuguuccuucugcuc

SEQ ID NO: 1874488 - RNA, 23 nt, Human herpesvirus 4 (Epstein-Barr virus)
agagauucgagaggaugaggcug

SEQ ID NO: 1874489 - RNA, 15 nt, Human herpesvirus 4 (Epstein-Barr virus)
gagcuggacgagguc

SEQ ID NO: 1874490 - RNA, 17 nt, Human herpesvirus 4 (Epstein-Barr virus)
agucuauacggccacaa

SEQ ID NO: 1874491 - RNA, 19 nt, Human herpesvirus 4 (Epstein-Barr virus)
uuucagacccaccauggaa

SEQ ID NO: 1874492 - RNA, 19 nt, Human herpesvirus 4 (Epstein-Barr virus)
ccuaggccugccacguggg

SEQ ID NO: 1874493 - RNA, 17 nt, Human herpesvirus 4 (Epstein-Barr virus)
cuggagauuuucccacu

SEQ ID NO: 1874494 - RNA, 13 nt, Human herpesvirus 4 (Epstein-Barr virus)
acugcgagggggc

SEQ ID NO: 1874495 - RNA, 21 nt, Human herpesvirus 4 (Epstein-Barr virus)
cuccaggaucucccgcgccgc

SEQ ID NO: 1874496 - RNA, 13 nt, Human herpesvirus 4 (Epstein-Barr virus)
ccccagaagcccc

SEQ ID NO: 1874497 - RNA, 14 nt, Human herpesvirus 4 (Epstein-Barr virus)
agacucuugaagau

SEQ ID NO: 1874498 - RNA, 13 nt, Human herpesvirus 4 (Epstein-Barr virus)
augaggcugauga

SEQ ID NO: 1874499 - RNA, 17 nt, Human herpesvirus 4 (Epstein-Barr virus)
ccagcuaacaggacaug

SEQ ID NO: 1874500 - RNA, 22 nt, Human herpesvirus 4 (Epstein-Barr virus)
ugggcuucgggggccugugugc

SEQ ID NO: 1874501 - RNA, 17 nt, Human herpesvirus 4 (Epstein-Barr virus)
acuggugcuuguggugu

SEQ ID NO: 1874502 - RNA, 19 nt, Human herpesvirus 4 (Epstein-Barr virus)
caugcugcccggacggccu

SEQ ID NO: 1874503 - RNA, 20 nt, Human herpesvirus 4 (Epstein-Barr virus)
cgacccccgggcgcccccaa

SEQ ID NO: 1874504 - RNA, 20 nt, Human herpesvirus 4 (Epstein-Barr virus)
ugcgacggcuuuagccuggc

SEQ ID NO: 1874505 - RNA, 19 nt, Human herpesvirus 4 (Epstein-Barr virus)
ccgucccggguacaagucc

SEQ ID NO: 1874506 - RNA, 18 nt, Human herpesvirus 4 (Epstein-Barr virus)
cgaggacggggaagagga

SEQ ID NO: 1874507 - RNA, 16 nt, Human herpesvirus 4 (Epstein-Barr virus)
aaucaaaacuuuagag

SEQ ID NO: 1874508 - RNA, 19 nt, Human herpesvirus 4 (Epstein-Barr virus)
gugcugccugggggcuuug

SEQ ID NO: 1874509 - RNA, 19 nt, Human herpesvirus 4 (Epstein-Barr virus)
cuggaugcuguaguggccu

SEQ ID NO: 1874510 - RNA, 20 nt, Human herpesvirus 4 (Epstein-Barr virus)
cagccacacaaucagccggg

SEQ ID NO: 1874511 - RNA, 13 nt, Human herpesvirus 4 (Epstein-Barr virus)
gcacaaccuugga

SEQ ID NO: 1874512 - RNA, 21 nt, Human herpesvirus 4 (Epstein-Barr virus)
gcuggacgugaaccucccccc

SEQ ID NO: 1874513 - RNA, 11 nt, Human herpesvirus 4 (Epstein-Barr virus)
uuaaucuggau

SEQ ID NO: 1874514 - RNA, 16 nt, Human herpesvirus 4 (Epstein-Barr virus)
agcuuugaugaggcug

SEQ ID NO: 1874515 - RNA, 23 nt, Human herpesvirus 4 (Epstein-Barr virus)
augggggcucggggcuggggaga

SEQ ID NO: 1874516 - RNA, 23 nt, Human herpesvirus 4 (Epstein-Barr virus)
ggccacgcugggaguccggcccu

SEQ ID NO: 1874517 - RNA, 21 nt, Human herpesvirus 4 (Epstein-Barr virus)
aacuaugcaugagccacaggc

SEQ ID NO: 1874518 - RNA, 20 nt, Human herpesvirus 4 (Epstein-Barr virus)
gauuuugggcacacuuaacu

SEQ ID NO: 1874519 - RNA, 14 nt, Human herpesvirus 4 (Epstein-Barr virus)
gacuggcaacuccu

SEQ ID NO: 1874520 - RNA, 19 nt, Human herpesvirus 4 (Epstein-Barr virus)
aguguccagagaggaagac

SEQ ID NO: 1874521 - RNA, 15 nt, Human herpesvirus 4 (Epstein-Barr virus)
guccauggcugcacc

SEQ ID NO: 1874522 - RNA, 18 nt, Human herpesvirus 4 (Epstein-Barr virus)
ccugucaccaggccugcc

SEQ ID NO: 1874523 - RNA, 17 nt, Human herpesvirus 4 (Epstein-Barr virus)
ugcgcaacgccggccug

SEQ ID NO: 1874524 - RNA, 18 nt, Human herpesvirus 4 (Epstein-Barr virus)
gccaguguggcuggggcu

SEQ ID NO: 1874525 - RNA, 19 nt, Human herpesvirus 4 (Epstein-Barr virus)
ggcggugggaucaugaagc

SEQ ID NO: 1874526 - RNA, 22 nt, Human herpesvirus 4 (Epstein-Barr virus)
ugugucccacuccaccugccgg

SEQ ID NO: 1874527 - RNA, 15 nt, Human herpesvirus 4 (Epstein-Barr virus)
aaaggaagggggccc

SEQ ID NO: 1874528 - RNA, 15 nt, Human herpesvirus 4 (Epstein-Barr virus)
aucgaaggagagcug

SEQ ID NO: 1874529 - RNA, 17 nt, Human herpesvirus 4 (Epstein-Barr virus)
cagccagagccagccgg

SEQ ID NO: 1874530 - RNA, 15 nt, Human herpesvirus 4 (Epstein-Barr virus)
ccugcauggccaggc

SEQ ID NO: 1874531 - RNA, 20 nt, Human herpesvirus 4 (Epstein-Barr virus)
auggauugaguaagcauggg

SEQ ID NO: 1874532 - RNA, 14 nt, Human herpesvirus 4 (Epstein-Barr virus)
aggaggcuggugcc

SEQ ID NO: 1874533 - RNA, 22 nt, Human herpesvirus 4 (Epstein-Barr virus)
ggggaaugagggaaaaggcccu

SEQ ID NO: 1874534 - RNA, 23 nt, Human herpesvirus 4 (Epstein-Barr virus)
acaagaaucggguggcuuccaga

SEQ ID NO: 1874535 - RNA, 14 nt, Human herpesvirus 4 (Epstein-Barr virus)
ccgcuacugcugcu

SEQ ID NO: 1874536 - RNA, 21 nt, Human herpesvirus 4 (Epstein-Barr virus)
cugagaacugacgcuccagga

SEQ ID NO: 1874537 - RNA, 16 nt, Human herpesvirus 4 (Epstein-Barr virus)
acaagaacugggauga

SEQ ID NO: 1874538 - RNA, 13 nt, Human herpesvirus 4 (Epstein-Barr virus)
cagaugaagacga

SEQ ID NO: 1874539 - RNA, 15 nt, Human herpesvirus 4 (Epstein-Barr virus)
ggcguacaccuggcu

SEQ ID NO: 1874540 - RNA, 16 nt, Human herpesvirus 4 (Epstein-Barr virus)
caccgugggaaaauag

SEQ ID NO: 1874541 - RNA, 22 nt, Human herpesvirus 4 (Epstein-Barr virus)
gcagcuaaguuuucuaagggca

SEQ ID NO: 1874542 - RNA, 20 nt, Human herpesvirus 4 (Epstein-Barr virus)
ccucaucguucgguggggug

SEQ ID NO: 1874543 - RNA, 20 nt, Human herpesvirus 4 (Epstein-Barr virus)
cccaauauccaucugcuucu

SEQ ID NO: 1874544 - RNA, 19 nt, Human herpesvirus 4 (Epstein-Barr virus)
gcacaacggcugugacuac

SEQ ID NO: 1874545 - RNA, 13 nt, Human herpesvirus 4 (Epstein-Barr virus)
uagcccccacgcu

SEQ ID NO: 1874546 - RNA, 20 nt, Human herpesvirus 4 (Epstein-Barr virus)
caccuggccagggcggagga

SEQ ID NO: 1874547 - RNA, 23 nt, Human herpesvirus 4 (Epstein-Barr virus)
acucugcauggagaagcuggacg

SEQ ID NO: 1874548 - RNA, 21 nt, Human herpesvirus 4 (Epstein-Barr virus)
cggugucugugguugucuucc

SEQ ID NO: 1874549 - RNA, 13 nt, Human herpesvirus 4 (Epstein-Barr virus)
gcgcuguguggcu

SEQ ID NO: 1874550 - RNA, 14 nt, Human herpesvirus 4 (Epstein-Barr virus)
gcagggacgaggac

SEQ ID NO: 1874551 - RNA, 14 nt, Human herpesvirus 4 (Epstein-Barr virus)
cuuuugucugccug

SEQ ID NO: 1874552 - RNA, 16 nt, Human herpesvirus 4 (Epstein-Barr virus)
gcaguccggagacuga

SEQ ID NO: 1874553 - RNA, 12 nt, Human herpesvirus 4 (Epstein-Barr virus)
agacgcagcugu

SEQ ID NO: 1874554 - RNA, 19 nt, Human herpesvirus 4 (Epstein-Barr virus)
aggcaaacauacaggagga

SEQ ID NO: 1874555 - RNA, 21 nt, Human herpesvirus 4 (Epstein-Barr virus)
agaagcagauagccggccagg

SEQ ID NO: 1874556 - RNA, 17 nt, Human herpesvirus 4 (Epstein-Barr virus)
aaaccugcgaaacuugg

SEQ ID NO: 1874557 - RNA, 22 nt, Human herpesvirus 4 (Epstein-Barr virus)
gaagcagauagccggccaggca

SEQ ID NO: 1874558 - RNA, 16 nt, Human herpesvirus 4 (Epstein-Barr virus)
ugaguccccuccuugg

SEQ ID NO: 1874559 - RNA, 23 nt, Human herpesvirus 4 (Epstein-Barr virus)
aggcccucgagccauuugaggaa

SEQ ID NO: 1874560 - RNA, 14 nt, Human herpesvirus 4 (Epstein-Barr virus)
ucgcccccucuuug

SEQ ID NO: 1874561 - RNA, 13 nt, Human herpesvirus 4 (Epstein-Barr virus)
cuuggaggcugcu

SEQ ID NO: 1874562 - RNA, 18 nt, Human herpesvirus 4 (Epstein-Barr virus)
cccacuuuuaccccaguc

SEQ ID NO: 1874563 - RNA, 22 nt, Human herpesvirus 4 (Epstein-Barr virus)
gacugugguauccaccuagaaa

SEQ ID NO: 1874564 - RNA, 15 nt, Human herpesvirus 4 (Epstein-Barr virus)
ugccuggcgcuuugc

SEQ ID NO: 1874565 - RNA, 20 nt, Human herpesvirus 4 (Epstein-Barr virus)
guagccgaauaucuggaggu

SEQ ID NO: 1874566 - RNA, 23 nt, Human herpesvirus 4 (Epstein-Barr virus)
guucaggaacagccuccgccgcc

SEQ ID NO: 1874567 - RNA, 22 nt, Human herpesvirus 4 (Epstein-Barr virus)
ccaggccugccaaagagccaga

SEQ ID NO: 1874568 - RNA, 23 nt, Human herpesvirus 4 (Epstein-Barr virus)
cgcucuggucgcccccucugccu

SEQ ID NO: 1874569 - RNA, 23 nt, Human herpesvirus 4 (Epstein-Barr virus)
cuggugaugcuugugcuccugau

SEQ ID NO: 1874570 - RNA, 19 nt, Human herpesvirus 4 (Epstein-Barr virus)
uagcguagaauccagccag

SEQ ID NO: 1874571 - RNA, 15 nt, Human herpesvirus 4 (Epstein-Barr virus)
uggugggaggcccag

SEQ ID NO: 1874572 - RNA, 21 nt, Human herpesvirus 4 (Epstein-Barr virus)
uacaacucagccccaucuucc

SEQ ID NO: 1874573 - RNA, 23 nt, Human herpesvirus 4 (Epstein-Barr virus)
cagacaugguguagacagauccc

SEQ ID NO: 1874574 - RNA, 19 nt, Human herpesvirus 4 (Epstein-Barr virus)
gaggcgggaauggccgcca

SEQ ID NO: 1874575 - RNA, 14 nt, Human herpesvirus 4 (Epstein-Barr virus)
ugaucagggagaac

SEQ ID NO: 1874576 - RNA, 21 nt, Human herpesvirus 4 (Epstein-Barr virus)
accacacagguagcaaggacc

SEQ ID NO: 1874577 - RNA, 14 nt, Human herpesvirus 4 (Epstein-Barr virus)
ggacucggggugau

SEQ ID NO: 1874578 - RNA, 19 nt, Human herpesvirus 4 (Epstein-Barr virus)
ggcugcugccgucccaggg

SEQ ID NO: 1874579 - RNA, 22 nt, Human herpesvirus 4 (Epstein-Barr virus)
ggaagucuuuuauaaggcuccg

SEQ ID NO: 1874580 - RNA, 13 nt, Human herpesvirus 4 (Epstein-Barr virus)
agaggauuggcug

SEQ ID NO: 1874581 - RNA, 19 nt, Human herpesvirus 4 (Epstein-Barr virus)
cgcuggcucgccucauccu

SEQ ID NO: 1874582 - RNA, 14 nt, Human herpesvirus 4 (Epstein-Barr virus)
ccacuaggaaccca

SEQ ID NO: 1874583 - RNA, 21 nt, Human herpesvirus 4 (Epstein-Barr virus)
gcuacacucuggggucucagg

SEQ ID NO: 1874584 - RNA, 15 nt, Human herpesvirus 4 (Epstein-Barr virus)
gcgggaggggcagga

SEQ ID NO: 1874585 - RNA, 15 nt, Human herpesvirus 4 (Epstein-Barr virus)
cugcuccagugccuc

SEQ ID NO: 1874586 - RNA, 13 nt, Human herpesvirus 4 (Epstein-Barr virus)
accauccacagcc

SEQ ID NO: 1874587 - RNA, 16 nt, Human herpesvirus 4 (Epstein-Barr virus)
ggccuuuucccucauu

SEQ ID NO: 1874588 - RNA, 11 nt, Human herpesvirus 4 (Epstein-Barr virus)
cagggguggca

SEQ ID NO: 1874589 - RNA, 13 nt, Human herpesvirus 4 (Epstein-Barr virus)
cucauccugcuca

SEQ ID NO: 1874590 - RNA, 21 nt, Human herpesvirus 4 (Epstein-Barr virus)
cugccucgaguaggugccucc

SEQ ID NO: 1874591 - RNA, 14 nt, Human herpesvirus 4 (Epstein-Barr virus)
gugucuucugucuc

SEQ ID NO: 1874592 - RNA, 16 nt, Human herpesvirus 4 (Epstein-Barr virus)
gcuugugcuccugaua

SEQ ID NO: 1874593 - RNA, 12 nt, Human herpesvirus 4 (Epstein-Barr virus)
ucagcuccaggg

SEQ ID NO: 1874594 - RNA, 14 nt, Human herpesvirus 4 (Epstein-Barr virus)
ccaggcacaucugg

SEQ ID NO: 1874595 - RNA, 15 nt, Human herpesvirus 4 (Epstein-Barr virus)
agaucgccugccacu

SEQ ID NO: 1874596 - RNA, 20 nt, Human herpesvirus 4 (Epstein-Barr virus)
ggcacacacucccuuagcca

SEQ ID NO: 1874597 - RNA, 14 nt, Human herpesvirus 4 (Epstein-Barr virus)
gcauggcggccugg

SEQ ID NO: 1874598 - RNA, 13 nt, Human herpesvirus 4 (Epstein-Barr virus)
ccugcggggaacu

SEQ ID NO: 1874599 - RNA, 17 nt, Human herpesvirus 4 (Epstein-Barr virus)
cugcugcugcuggucau

SEQ ID NO: 1874600 - RNA, 18 nt, Human herpesvirus 4 (Epstein-Barr virus)
aacugcgagggggccugg

SEQ ID NO: 1874601 - RNA, 14 nt, Human herpesvirus 4 (Epstein-Barr virus)
cagagccucugcca

SEQ ID NO: 1874602 - RNA, 17 nt, Human herpesvirus 4 (Epstein-Barr virus)
cagcgccguccacggcc

SEQ ID NO: 1874603 - RNA, 19 nt, Human herpesvirus 4 (Epstein-Barr virus)
cccauccccagcccagccg

SEQ ID NO: 1874604 - RNA, 12 nt, Human herpesvirus 4 (Epstein-Barr virus)
cggguacaaguc

SEQ ID NO: 1874605 - RNA, 21 nt, Human herpesvirus 4 (Epstein-Barr virus)
aucaccuggguacccaaacca

SEQ ID NO: 1874606 - RNA, 15 nt, Human herpesvirus 4 (Epstein-Barr virus)
ccuggaucuggggcu

SEQ ID NO: 1874607 - RNA, 17 nt, Human herpesvirus 4 (Epstein-Barr virus)
gccaccggcuuggcccu

SEQ ID NO: 1874608 - RNA, 15 nt, Human herpesvirus 4 (Epstein-Barr virus)
ggcucgacgcgggcc

SEQ ID NO: 1874609 - RNA, 23 nt, Human herpesvirus 4 (Epstein-Barr virus)
ugcuaugaccaugcccagacuca

SEQ ID NO: 1874610 - RNA, 22 nt, Human herpesvirus 4 (Epstein-Barr virus)
ugagaccgugucacucccgagg

SEQ ID NO: 1874611 - RNA, 14 nt, Human herpesvirus 4 (Epstein-Barr virus)
aggaguuuaaccug

SEQ ID NO: 1874612 - RNA, 16 nt, Human herpesvirus 4 (Epstein-Barr virus)
gcacggucgccccucc

SEQ ID NO: 1874613 - RNA, 17 nt, Human herpesvirus 4 (Epstein-Barr virus)
gccuccaacaggugccc

SEQ ID NO: 1874614 - RNA, 22 nt, Human herpesvirus 4 (Epstein-Barr virus)
cuccuacgcgcuaccuccuauc

SEQ ID NO: 1874615 - RNA, 12 nt, Human herpesvirus 4 (Epstein-Barr virus)
ugacugagcgca

SEQ ID NO: 1874616 - RNA, 22 nt, Human herpesvirus 4 (Epstein-Barr virus)
acuggccaugcaggccuggaca

SEQ ID NO: 1874617 - RNA, 21 nt, Human herpesvirus 4 (Epstein-Barr virus)
auaucuggaggucuucucuga

SEQ ID NO: 1874618 - RNA, 21 nt, Human herpesvirus 4 (Epstein-Barr virus)
gccacgcugggaguccggccc

SEQ ID NO: 1874619 - RNA, 14 nt, Human herpesvirus 4 (Epstein-Barr virus)
agcuccgcccucac

SEQ ID NO: 1874620 - RNA, 20 nt, Human herpesvirus 4 (Epstein-Barr virus)
guaaggccgcugccaggccg

SEQ ID NO: 1874621 - RNA, 21 nt, Human herpesvirus 4 (Epstein-Barr virus)
agugguuguauguucagagcu

SEQ ID NO: 1874622 - RNA, 20 nt, Human herpesvirus 4 (Epstein-Barr virus)
ucauauguaugccuuggcau

SEQ ID NO: 1874623 - RNA, 19 nt, Human herpesvirus 4 (Epstein-Barr virus)
uggagacggugaccugacu

SEQ ID NO: 1874624 - RNA, 22 nt, Human herpesvirus 4 (Epstein-Barr virus)
cagcccuuuuaacauuggcagc

SEQ ID NO: 1874625 - RNA, 19 nt, Human herpesvirus 4 (Epstein-Barr virus)
gcccagcagauccagggcc

SEQ ID NO: 1874626 - RNA, 19 nt, Human herpesvirus 4 (Epstein-Barr virus)
uaugaugacgccgagaccu

SEQ ID NO: 1874627 - RNA, 17 nt, Human herpesvirus 4 (Epstein-Barr virus)
agcggggagagggugga

SEQ ID NO: 1874628 - RNA, 19 nt, Human herpesvirus 4 (Epstein-Barr virus)
guucacugcguagaugagc

SEQ ID NO: 1874629 - RNA, 13 nt, Human herpesvirus 4 (Epstein-Barr virus)
caagcggcacaga

SEQ ID NO: 1874630 - RNA, 20 nt, Human herpesvirus 4 (Epstein-Barr virus)
ccugggccccccggaggggc

SEQ ID NO: 1874631 - RNA, 23 nt, Human herpesvirus 4 (Epstein-Barr virus)
aaaguguaacauuuaauguggga

SEQ ID NO: 1874632 - RNA, 21 nt, Human herpesvirus 4 (Epstein-Barr virus)
gaucacuacuacaccgagcag

SEQ ID NO: 1874633 - RNA, 16 nt, Human herpesvirus 4 (Epstein-Barr virus)
gcaagaauuggggcug

SEQ ID NO: 1874634 - RNA, 14 nt, Human herpesvirus 4 (Epstein-Barr virus)
ucucucaucuccaa

SEQ ID NO: 1874635 - RNA, 13 nt, Human herpesvirus 4 (Epstein-Barr virus)
ucgccgccccagg

SEQ ID NO: 1874636 - RNA, 15 nt, Human herpesvirus 4 (Epstein-Barr virus)
acugcagugggccuc

SEQ ID NO: 1874637 - RNA, 14 nt, Human herpesvirus 4 (Epstein-Barr virus)
gccgccccgggccc

SEQ ID NO: 1874638 - RNA, 16 nt, Human herpesvirus 4 (Epstein-Barr virus)
ccgcaccagggccagg

SEQ ID NO: 1874639 - RNA, 15 nt, Human herpesvirus 4 (Epstein-Barr virus)
gagacacggcucugu

SEQ ID NO: 1874640 - RNA, 14 nt, Human herpesvirus 4 (Epstein-Barr virus)
caggacggggggcu

SEQ ID NO: 1874641 - RNA, 22 nt, Human herpesvirus 4 (Epstein-Barr virus)
uccuggcauacuuuuugccacc

SEQ ID NO: 1874642 - RNA, 16 nt, Human herpesvirus 4 (Epstein-Barr virus)
ugacccuucugcugcu

SEQ ID NO: 1874643 - RNA, 14 nt, Human herpesvirus 4 (Epstein-Barr virus)
gucuccgggucagg

SEQ ID NO: 1874644 - RNA, 15 nt, Human herpesvirus 4 (Epstein-Barr virus)
ccccggcucucaggc

SEQ ID NO: 1874645 - RNA, 12 nt, Human herpesvirus 4 (Epstein-Barr virus)
uuugccuggggc

SEQ ID NO: 1874646 - RNA, 14 nt, Human herpesvirus 4 (Epstein-Barr virus)
ucucccgcgccgca

SEQ ID NO: 1874647 - RNA, 18 nt, Human herpesvirus 4 (Epstein-Barr virus)
cucaggccucccagucua

SEQ ID NO: 1874648 - RNA, 12 nt, Human herpesvirus 4 (Epstein-Barr virus)
ggugcucccccu

SEQ ID NO: 1874649 - RNA, 14 nt, Human herpesvirus 4 (Epstein-Barr virus)
cuucuggcucuucu

SEQ ID NO: 1874650 - RNA, 17 nt, Human herpesvirus 4 (Epstein-Barr virus)
accugucuacuucgcca

SEQ ID NO: 1874651 - RNA, 18 nt, Human herpesvirus 4 (Epstein-Barr virus)
cagcucaaccgccagggc

SEQ ID NO: 1874652 - RNA, 19 nt, Human herpesvirus 4 (Epstein-Barr virus)
gccugauauugucccccua

SEQ ID NO: 1874653 - RNA, 14 nt, Human herpesvirus 4 (Epstein-Barr virus)
caggcccucauucc

SEQ ID NO: 1874654 - RNA, 20 nt, Human herpesvirus 4 (Epstein-Barr virus)
agaagacguuguaggugucc

SEQ ID NO: 1874655 - RNA, 23 nt, Human herpesvirus 4 (Epstein-Barr virus)
gacuggggugugaagggcagggc

SEQ ID NO: 1874656 - RNA, 17 nt, Human herpesvirus 4 (Epstein-Barr virus)
uacgauggcggaaacaa

SEQ ID NO: 1874657 - RNA, 16 nt, Human herpesvirus 4 (Epstein-Barr virus)
ugcauggagaagcugg

SEQ ID NO: 1874658 - RNA, 22 nt, Human herpesvirus 4 (Epstein-Barr virus)
caggccucagcgucaggagagg

SEQ ID NO: 1874659 - RNA, 13 nt, Human herpesvirus 4 (Epstein-Barr virus)
cagcagcccggcc

SEQ ID NO: 1874660 - RNA, 13 nt, Human herpesvirus 4 (Epstein-Barr virus)
gcuggacgagguc

SEQ ID NO: 1874661 - RNA, 20 nt, Human herpesvirus 4 (Epstein-Barr virus)
accgccucuacccuccccau

SEQ ID NO: 1874662 - RNA, 17 nt, Human herpesvirus 4 (Epstein-Barr virus)
ugucuuugccaaccugc

SEQ ID NO: 1874663 - RNA, 14 nt, Human herpesvirus 4 (Epstein-Barr virus)
ccaccuccaccacc

SEQ ID NO: 1874664 - RNA, 17 nt, Human herpesvirus 4 (Epstein-Barr virus)
gccuucuccucagccuc

SEQ ID NO: 1874665 - RNA, 14 nt, Human herpesvirus 4 (Epstein-Barr virus)
ucuucugggaacac

SEQ ID NO: 1874666 - RNA, 13 nt, Human herpesvirus 4 (Epstein-Barr virus)
gacaaggcaggcg

SEQ ID NO: 1874667 - RNA, 16 nt, Human herpesvirus 4 (Epstein-Barr virus)
cccggcggcugcugcc

SEQ ID NO: 1874668 - RNA, 23 nt, Human herpesvirus 4 (Epstein-Barr virus)
auuuucugcgugagaugaacacc

SEQ ID NO: 1874669 - RNA, 23 nt, Human herpesvirus 4 (Epstein-Barr virus)
ggugggaucaugaagcccccagg

SEQ ID NO: 1874670 - RNA, 16 nt, Human herpesvirus 4 (Epstein-Barr virus)
gcccuccgcagccgcu

SEQ ID NO: 1874671 - RNA, 20 nt, Human herpesvirus 4 (Epstein-Barr virus)
ccccacggggugcucccccu

SEQ ID NO: 1874672 - RNA, 16 nt, Human herpesvirus 4 (Epstein-Barr virus)
uaaauguuacuucuuu

SEQ ID NO: 1874673 - RNA, 22 nt, Human herpesvirus 4 (Epstein-Barr virus)
gaaauaucuagcacggcacccu

SEQ ID NO: 1874674 - RNA, 16 nt, Human herpesvirus 4 (Epstein-Barr virus)
cagcagcagugguguu

SEQ ID NO: 1874675 - RNA, 12 nt, Human herpesvirus 4 (Epstein-Barr virus)
ccuccuggccag

SEQ ID NO: 1874676 - RNA, 17 nt, Human herpesvirus 4 (Epstein-Barr virus)
ucaccuuccagacuaug

SEQ ID NO: 1874677 - RNA, 13 nt, Human herpesvirus 4 (Epstein-Barr virus)
gaagaagauugaa

SEQ ID NO: 1874678 - RNA, 15 nt, Human herpesvirus 4 (Epstein-Barr virus)
cuuguuucucagaga

SEQ ID NO: 1874679 - RNA, 19 nt, Human herpesvirus 4 (Epstein-Barr virus)
caguggccgucuggcaggg

SEQ ID NO: 1874680 - RNA, 18 nt, Human herpesvirus 4 (Epstein-Barr virus)
cucaucuccaaaaaguug

SEQ ID NO: 1874681 - RNA, 22 nt, Human herpesvirus 4 (Epstein-Barr virus)
aggaggacaugugcauggccug

SEQ ID NO: 1874682 - RNA, 21 nt, Human herpesvirus 4 (Epstein-Barr virus)
auccugcucauuauugcucuc

SEQ ID NO: 1874683 - RNA, 15 nt, Human herpesvirus 4 (Epstein-Barr virus)
aggccgggaggccuu

SEQ ID NO: 1874684 - RNA, 19 nt, Human herpesvirus 4 (Epstein-Barr virus)
aguaaacccgauggccccg

SEQ ID NO: 1874685 - RNA, 15 nt, Human herpesvirus 4 (Epstein-Barr virus)
gacugauccgcagaa

SEQ ID NO: 1874686 - RNA, 14 nt, Human herpesvirus 4 (Epstein-Barr virus)
ccugggcugccccg

SEQ ID NO: 1874687 - RNA, 20 nt, Human herpesvirus 4 (Epstein-Barr virus)
agaaucggguggcuuccaga

SEQ ID NO: 1874688 - RNA, 14 nt, Human herpesvirus 4 (Epstein-Barr virus)
ucggagucuucaag

SEQ ID NO: 1874689 - RNA, 12 nt, Human herpesvirus 4 (Epstein-Barr virus)
acgaugacuccc

SEQ ID NO: 1874690 - RNA, 17 nt, Human herpesvirus 4 (Epstein-Barr virus)
cuguguccgacgccugc

SEQ ID NO: 1874691 - RNA, 16 nt, Human herpesvirus 4 (Epstein-Barr virus)
uaagucaugacaauuu

SEQ ID NO: 1874692 - RNA, 22 nt, Human herpesvirus 4 (Epstein-Barr virus)
ggagcggggguucuccaggcuc

SEQ ID NO: 1874693 - RNA, 12 nt, Human herpesvirus 4 (Epstein-Barr virus)
caggucaggucc

SEQ ID NO: 1874694 - RNA, 21 nt, Human herpesvirus 4 (Epstein-Barr virus)
ccugacggugccgcuccuuug

SEQ ID NO: 1874695 - RNA, 14 nt, Human herpesvirus 4 (Epstein-Barr virus)
agaagagaggcuuc

SEQ ID NO: 1874696 - RNA, 19 nt, Human herpesvirus 4 (Epstein-Barr virus)
cacuucuacucuuggcagc

SEQ ID NO: 1874697 - RNA, 14 nt, Human herpesvirus 4 (Epstein-Barr virus)
ugugcugaagccca

SEQ ID NO: 1874698 - RNA, 18 nt, Human herpesvirus 4 (Epstein-Barr virus)
ucucauccccagagggcg

SEQ ID NO: 1874699 - RNA, 15 nt, Human herpesvirus 4 (Epstein-Barr virus)
gcagcccccuccucc

SEQ ID NO: 1874700 - RNA, 18 nt, Human herpesvirus 4 (Epstein-Barr virus)
ccaggguuucuaggacgc

SEQ ID NO: 1874701 - RNA, 17 nt, Human herpesvirus 4 (Epstein-Barr virus)
caggcaccccaucuucc

SEQ ID NO: 1874702 - RNA, 18 nt, Human herpesvirus 4 (Epstein-Barr virus)
ccacuuacaaccaagcca

SEQ ID NO: 1874703 - RNA, 13 nt, Human herpesvirus 4 (Epstein-Barr virus)
gaggccucaggca

SEQ ID NO: 1874704 - RNA, 23 nt, Human herpesvirus 4 (Epstein-Barr virus)
auuccuaggagaaggagccucgc

SEQ ID NO: 1874705 - RNA, 14 nt, Human herpesvirus 4 (Epstein-Barr virus)
cgggucccgccucu

SEQ ID NO: 1874706 - RNA, 15 nt, Human herpesvirus 4 (Epstein-Barr virus)
ccagaagcagaugga

SEQ ID NO: 1874707 - RNA, 14 nt, Human herpesvirus 4 (Epstein-Barr virus)
cuccaucagggcca

SEQ ID NO: 1874708 - RNA, 17 nt, Human herpesvirus 4 (Epstein-Barr virus)
ugggaacugaguaggcu

SEQ ID NO: 1874709 - RNA, 13 nt, Human herpesvirus 4 (Epstein-Barr virus)
caccacacaggua

SEQ ID NO: 1874710 - RNA, 14 nt, Human herpesvirus 4 (Epstein-Barr virus)
caacacgaccaccu

SEQ ID NO: 1874711 - RNA, 16 nt, Human herpesvirus 4 (Epstein-Barr virus)
ccuacucuccacggga

SEQ ID NO: 1874712 - RNA, 13 nt, Human herpesvirus 4 (Epstein-Barr virus)
gugggcucccucu

SEQ ID NO: 1874713 - RNA, 15 nt, Human herpesvirus 4 (Epstein-Barr virus)
cccuccuccacccag

SEQ ID NO: 1874714 - RNA, 22 nt, Human herpesvirus 4 (Epstein-Barr virus)
aacauguccuguuagcuggugc

SEQ ID NO: 1874715 - RNA, 17 nt, Human herpesvirus 4 (Epstein-Barr virus)
gagucugcuggacuccg

SEQ ID NO: 1874716 - RNA, 17 nt, Human herpesvirus 4 (Epstein-Barr virus)
gcaggagcaggaggagg

SEQ ID NO: 1874717 - RNA, 14 nt, Human herpesvirus 4 (Epstein-Barr virus)
gguaccagaagagu

SEQ ID NO: 1874718 - RNA, 13 nt, Human herpesvirus 4 (Epstein-Barr virus)
gggugggcugguu

SEQ ID NO: 1874719 - RNA, 16 nt, Human herpesvirus 4 (Epstein-Barr virus)
uggcauucagauuucu

SEQ ID NO: 1874720 - RNA, 18 nt, Human herpesvirus 4 (Epstein-Barr virus)
ucagaagaauguccaaaa

SEQ ID NO: 1874721 - RNA, 22 nt, Human herpesvirus 4 (Epstein-Barr virus)
gcccgcuuuugcgaccccucug

SEQ ID NO: 1874722 - RNA, 20 nt, Human herpesvirus 4 (Epstein-Barr virus)
guuaucaccguaccaugagu

SEQ ID NO: 1874723 - RNA, 16 nt, Human herpesvirus 4 (Epstein-Barr virus)
ugacacccccagcgcu

SEQ ID NO: 1874724 - RNA, 18 nt, Human herpesvirus 4 (Epstein-Barr virus)
uggugggggcggaugagg

SEQ ID NO: 1874725 - RNA, 15 nt, Human herpesvirus 4 (Epstein-Barr virus)
cugccuccggccgcc

SEQ ID NO: 1874726 - RNA, 13 nt, Human herpesvirus 4 (Epstein-Barr virus)
cugacgcuccagg

SEQ ID NO: 1874727 - RNA, 13 nt, Human herpesvirus 4 (Epstein-Barr virus)
gaccaagcuacca

SEQ ID NO: 1874728 - RNA, 22 nt, Human herpesvirus 4 (Epstein-Barr virus)
agauccaacuccggcccacgcc

SEQ ID NO: 1874729 - RNA, 15 nt, Human herpesvirus 4 (Epstein-Barr virus)
uccuagagggacagc

SEQ ID NO: 1874730 - RNA, 20 nt, Human herpesvirus 4 (Epstein-Barr virus)
cgaugccucuacgccccaga

SEQ ID NO: 1874731 - RNA, 20 nt, Human herpesvirus 4 (Epstein-Barr virus)
aagucuauacggccacaacc

SEQ ID NO: 1874732 - RNA, 21 nt, Human herpesvirus 4 (Epstein-Barr virus)
aaggcaguccaggggccacac

SEQ ID NO: 1874733 - RNA, 15 nt, Human herpesvirus 4 (Epstein-Barr virus)
aggcucggcccuccg

SEQ ID NO: 1874734 - RNA, 17 nt, Human herpesvirus 4 (Epstein-Barr virus)
uaucacccauggccagg

SEQ ID NO: 1874735 - RNA, 20 nt, Human herpesvirus 4 (Epstein-Barr virus)
cacguccccggccucccgcu

SEQ ID NO: 1874736 - RNA, 11 nt, Human herpesvirus 4 (Epstein-Barr virus)
cgcugcaugca

SEQ ID NO: 1874737 - RNA, 17 nt, Human herpesvirus 4 (Epstein-Barr virus)
cacccgucccggguaca

SEQ ID NO: 1874738 - RNA, 23 nt, Human herpesvirus 4 (Epstein-Barr virus)
gcccgcuuuugcgaccccucuga

SEQ ID NO: 1874739 - RNA, 13 nt, Human herpesvirus 4 (Epstein-Barr virus)
gccggcagccugg

SEQ ID NO: 1874740 - RNA, 21 nt, Human herpesvirus 4 (Epstein-Barr virus)
agcaugggcgaggggcgcccc

SEQ ID NO: 1874741 - RNA, 13 nt, Human herpesvirus 4 (Epstein-Barr virus)
ccuccccuguggc

SEQ ID NO: 1874742 - RNA, 19 nt, Human herpesvirus 4 (Epstein-Barr virus)
gccagcaaaaccagcccgg

SEQ ID NO: 1874743 - RNA, 14 nt, Human herpesvirus 4 (Epstein-Barr virus)
gccuccgccugagc

SEQ ID NO: 1874744 - RNA, 19 nt, Human herpesvirus 4 (Epstein-Barr virus)
cacagugaugaacaccacc

SEQ ID NO: 1874745 - RNA, 16 nt, Human herpesvirus 4 (Epstein-Barr virus)
aaggcccuaauucagc

SEQ ID NO: 1874746 - RNA, 16 nt, Human herpesvirus 4 (Epstein-Barr virus)
aggccucuggggucca

SEQ ID NO: 1874747 - RNA, 20 nt, Human herpesvirus 4 (Epstein-Barr virus)
ccuuggauccccuuaaucua

SEQ ID NO: 1874748 - RNA, 20 nt, Human herpesvirus 4 (Epstein-Barr virus)
aacuggccaugcaggccugg

SEQ ID NO: 1874749 - RNA, 22 nt, Human herpesvirus 4 (Epstein-Barr virus)
acaaggagugccucugggugcu

SEQ ID NO: 1874750 - RNA, 22 nt, Human herpesvirus 4 (Epstein-Barr virus)
accggccaagguccugggccuc

SEQ ID NO: 1874751 - RNA, 18 nt, Human herpesvirus 4 (Epstein-Barr virus)
ucugggccgcccggccuc

SEQ ID NO: 1874752 - RNA, 14 nt, Human herpesvirus 4 (Epstein-Barr virus)
uaauacgcccgaca

SEQ ID NO: 1874753 - RNA, 15 nt, Human herpesvirus 4 (Epstein-Barr virus)
gcuguugacaugagc

SEQ ID NO: 1874754 - RNA, 15 nt, Human herpesvirus 4 (Epstein-Barr virus)
gcaugaucaggaccc

SEQ ID NO: 1874755 - RNA, 15 nt, Human herpesvirus 4 (Epstein-Barr virus)
agcaccacccagccc

SEQ ID NO: 1874756 - RNA, 20 nt, Human herpesvirus 4 (Epstein-Barr virus)
gcaggccccccgcaccaggg

SEQ ID NO: 1874757 - RNA, 22 nt, Human herpesvirus 4 (Epstein-Barr virus)
uguugagaugagucaucccgug

SEQ ID NO: 1874758 - RNA, 19 nt, Human herpesvirus 4 (Epstein-Barr virus)
accagagcccagaggaggc

SEQ ID NO: 1874759 - RNA, 16 nt, Human herpesvirus 4 (Epstein-Barr virus)
ccaggcauacagcagc

SEQ ID NO: 1874760 - RNA, 22 nt, Human herpesvirus 4 (Epstein-Barr virus)
ccugggcugccccgggcccacc

SEQ ID NO: 1874761 - RNA, 19 nt, Human herpesvirus 4 (Epstein-Barr virus)
caccguggagccgggcuuc

SEQ ID NO: 1874762 - RNA, 20 nt, Human herpesvirus 4 (Epstein-Barr virus)
cugccccgguccccccagaa

SEQ ID NO: 1874763 - RNA, 15 nt, Human herpesvirus 4 (Epstein-Barr virus)
cuggucgcccccucu

SEQ ID NO: 1874764 - RNA, 14 nt, Human herpesvirus 4 (Epstein-Barr virus)
gaccaccuggccag

SEQ ID NO: 1874765 - RNA, 17 nt, Human herpesvirus 4 (Epstein-Barr virus)
ugaagauugucacagcu

SEQ ID NO: 1874766 - RNA, 20 nt, Human herpesvirus 4 (Epstein-Barr virus)
caugcaaguggaugcaucua

SEQ ID NO: 1874767 - RNA, 21 nt, Human herpesvirus 4 (Epstein-Barr virus)
uggaggcaauggucgccaggg

SEQ ID NO: 1874768 - RNA, 17 nt, Human herpesvirus 4 (Epstein-Barr virus)
ugcgagcucuccagcca

SEQ ID NO: 1874769 - RNA, 18 nt, Human herpesvirus 4 (Epstein-Barr virus)
acuccggacgcagaggcc

SEQ ID NO: 1874770 - RNA, 20 nt, Human herpesvirus 4 (Epstein-Barr virus)
gucauucuaucaauuaaaca

SEQ ID NO: 1874771 - RNA, 22 nt, Human herpesvirus 4 (Epstein-Barr virus)
cucgguggugggcugcugaggg

SEQ ID NO: 1874772 - RNA, 16 nt, Human herpesvirus 4 (Epstein-Barr virus)
caaggaggggcggcag

SEQ ID NO: 1874773 - RNA, 14 nt, Human herpesvirus 4 (Epstein-Barr virus)
gccgccgccagcag

SEQ ID NO: 1874774 - RNA, 13 nt, Human herpesvirus 4 (Epstein-Barr virus)
ugguggaggagga

SEQ ID NO: 1874775 - RNA, 19 nt, Human herpesvirus 4 (Epstein-Barr virus)
cuucacagagcagcagcua

SEQ ID NO: 1874776 - RNA, 13 nt, Human herpesvirus 4 (Epstein-Barr virus)
gcuggccaggcug

SEQ ID NO: 1874777 - RNA, 18 nt, Human herpesvirus 4 (Epstein-Barr virus)
uuaauggguaaaggggga

SEQ ID NO: 1874778 - RNA, 16 nt, Human herpesvirus 4 (Epstein-Barr virus)
agagccgcuccguggc

SEQ ID NO: 1874779 - RNA, 13 nt, Human herpesvirus 4 (Epstein-Barr virus)
ucaggccucccag

SEQ ID NO: 1874780 - RNA, 21 nt, Human herpesvirus 4 (Epstein-Barr virus)
uggggcuggcaguccuugugu

SEQ ID NO: 1874781 - RNA, 14 nt, Human herpesvirus 4 (Epstein-Barr virus)
caucauuagcccag

SEQ ID NO: 1874782 - RNA, 13 nt, Human herpesvirus 4 (Epstein-Barr virus)
cugccagccucag

SEQ ID NO: 1874783 - RNA, 18 nt, Human herpesvirus 4 (Epstein-Barr virus)
cgcggcccaggucgagca

SEQ ID NO: 1874784 - RNA, 19 nt, Human herpesvirus 4 (Epstein-Barr virus)
cccaaaaguagaggcucag

SEQ ID NO: 1874785 - RNA, 17 nt, Human herpesvirus 4 (Epstein-Barr virus)
aacugucacaccagucc

SEQ ID NO: 1874786 - RNA, 21 nt, Human herpesvirus 4 (Epstein-Barr virus)
ggagcuccgagagcuccgcca

SEQ ID NO: 1874787 - RNA, 19 nt, Human herpesvirus 4 (Epstein-Barr virus)
aggaaguuuuaacaccuga

SEQ ID NO: 1874788 - RNA, 15 nt, Human herpesvirus 4 (Epstein-Barr virus)
caaagucaagggaaa

SEQ ID NO: 1874789 - RNA, 16 nt, Human herpesvirus 4 (Epstein-Barr virus)
ugcccccgccagcgcc

SEQ ID NO: 1874790 - RNA, 18 nt, Human herpesvirus 4 (Epstein-Barr virus)
ggcuccuggaucuggggc

SEQ ID NO: 1874791 - RNA, 13 nt, Human herpesvirus 4 (Epstein-Barr virus)
gcaccagcuccag

SEQ ID NO: 1874792 - RNA, 20 nt, Human herpesvirus 4 (Epstein-Barr virus)
aagagccgcuccguggcccc

SEQ ID NO: 1874793 - RNA, 19 nt, Human herpesvirus 4 (Epstein-Barr virus)
ucagcacuuugccagcaac

SEQ ID NO: 1874794 - RNA, 13 nt, Human herpesvirus 4 (Epstein-Barr virus)
gaugauauugaau

SEQ ID NO: 1874795 - RNA, 16 nt, Human herpesvirus 4 (Epstein-Barr virus)
cagcuccagggccagc

SEQ ID NO: 1874796 - RNA, 13 nt, Human herpesvirus 4 (Epstein-Barr virus)
gagcuggaggcca

SEQ ID NO: 1874797 - RNA, 21 nt, Human herpesvirus 4 (Epstein-Barr virus)
cccauguugcgggugccggcc

SEQ ID NO: 1874798 - RNA, 20 nt, Human herpesvirus 4 (Epstein-Barr virus)
cgcccagggacauccccaga

SEQ ID NO: 1874799 - RNA, 13 nt, Human herpesvirus 4 (Epstein-Barr virus)
guggcugcggugg

SEQ ID NO: 1874800 - RNA, 14 nt, Human herpesvirus 4 (Epstein-Barr virus)
agccaguguggcug

SEQ ID NO: 1874801 - RNA, 20 nt, Human herpesvirus 4 (Epstein-Barr virus)
accuucugucuguaaacuau

SEQ ID NO: 1874802 - RNA, 20 nt, Human herpesvirus 4 (Epstein-Barr virus)
augacucccucccgcacccu

SEQ ID NO: 1874803 - RNA, 17 nt, Human herpesvirus 4 (Epstein-Barr virus)
cagcagauccagggccc

SEQ ID NO: 1874804 - RNA, 18 nt, Human herpesvirus 4 (Epstein-Barr virus)
guccccguggaggaccgc

SEQ ID NO: 1874805 - RNA, 22 nt, Human herpesvirus 4 (Epstein-Barr virus)
ugcagcugaguccccuccuugg

SEQ ID NO: 1874806 - RNA, 14 nt, Human herpesvirus 4 (Epstein-Barr virus)
ucgucagagagguu

SEQ ID NO: 1874807 - RNA, 21 nt, Human herpesvirus 4 (Epstein-Barr virus)
ggggcgauaccuugggcauca

SEQ ID NO: 1874808 - RNA, 11 nt, Human herpesvirus 4 (Epstein-Barr virus)
gccauggccaa

SEQ ID NO: 1874809 - RNA, 18 nt, Human herpesvirus 4 (Epstein-Barr virus)
agguuaaaugugaagccc

SEQ ID NO: 1874810 - RNA, 19 nt, Human herpesvirus 4 (Epstein-Barr virus)
gagcaugaucaggacccug

SEQ ID NO: 1874811 - RNA, 19 nt, Human herpesvirus 4 (Epstein-Barr virus)
ccuugcccucuccagcaac

SEQ ID NO: 1874812 - RNA, 19 nt, Human herpesvirus 4 (Epstein-Barr virus)
ugcugccagagccucugcc

SEQ ID NO: 1874813 - RNA, 20 nt, Human herpesvirus 4 (Epstein-Barr virus)
ggagagauuucauccucaga

SEQ ID NO: 1874814 - RNA, 14 nt, Human herpesvirus 4 (Epstein-Barr virus)
aucccaggccucag

SEQ ID NO: 1874815 - RNA, 16 nt, Human herpesvirus 4 (Epstein-Barr virus)
ucgaagcggucucaga

SEQ ID NO: 1874816 - RNA, 20 nt, Human herpesvirus 4 (Epstein-Barr virus)
cagguuaaaugugaagcccg

SEQ ID NO: 1874817 - RNA, 16 nt, Human herpesvirus 4 (Epstein-Barr virus)
cugucaccaggccugc

SEQ ID NO: 1874818 - RNA, 21 nt, Human herpesvirus 4 (Epstein-Barr virus)
ggccucuaaguacaggucgcg

SEQ ID NO: 1874819 - RNA, 16 nt, Human herpesvirus 4 (Epstein-Barr virus)
agcugaggggcaaccu

SEQ ID NO: 1874820 - RNA, 16 nt, Human herpesvirus 4 (Epstein-Barr virus)
aguaagcauggggcuc

SEQ ID NO: 1874821 - RNA, 19 nt, Human herpesvirus 4 (Epstein-Barr virus)
gugggccucucuggcugug

SEQ ID NO: 1874822 - RNA, 19 nt, Human herpesvirus 4 (Epstein-Barr virus)
ggcagccuugcguggugcu

SEQ ID NO: 1874823 - RNA, 12 nt, Human herpesvirus 4 (Epstein-Barr virus)
cucggcaccucc

SEQ ID NO: 1874824 - RNA, 18 nt, Human herpesvirus 4 (Epstein-Barr virus)
gcagaaaggcuggccgug

SEQ ID NO: 1874825 - RNA, 19 nt, Human herpesvirus 4 (Epstein-Barr virus)
gcaacccccggcucucagg

SEQ ID NO: 1874826 - RNA, 22 nt, Human herpesvirus 4 (Epstein-Barr virus)
cuaguaugaaggcuggcaaaga

SEQ ID NO: 1874827 - RNA, 22 nt, Human herpesvirus 4 (Epstein-Barr virus)
caacgcuuccacccccuggagc

SEQ ID NO: 1874828 - RNA, 19 nt, Human herpesvirus 4 (Epstein-Barr virus)
gagcgcccaccgaccccau

SEQ ID NO: 1874829 - RNA, 19 nt, Human herpesvirus 4 (Epstein-Barr virus)
caucaugcgugaccaccug

SEQ ID NO: 1874830 - RNA, 12 nt, Human herpesvirus 4 (Epstein-Barr virus)
gcuugcuggggc

SEQ ID NO: 1874831 - RNA, 19 nt, Human herpesvirus 4 (Epstein-Barr virus)
gggggccaaaagggcucug

SEQ ID NO: 1874832 - RNA, 16 nt, Human herpesvirus 4 (Epstein-Barr virus)
gccguccucgaaggcu

SEQ ID NO: 1874833 - RNA, 17 nt, Human herpesvirus 4 (Epstein-Barr virus)
augucggggcugcuggc

SEQ ID NO: 1874834 - RNA, 14 nt, Human herpesvirus 4 (Epstein-Barr virus)
ugucuccccucugc

SEQ ID NO: 1874835 - RNA, 17 nt, Human herpesvirus 4 (Epstein-Barr virus)
cagcaccugucccuggg

SEQ ID NO: 1874836 - RNA, 22 nt, Human herpesvirus 4 (Epstein-Barr virus)
cauauccagagcugagugccca

SEQ ID NO: 1874837 - RNA, 15 nt, Human herpesvirus 4 (Epstein-Barr virus)
ccgccuagagcauuu

SEQ ID NO: 1874838 - RNA, 14 nt, Human herpesvirus 4 (Epstein-Barr virus)
guccucuggcucuc

SEQ ID NO: 1874839 - RNA, 17 nt, Human herpesvirus 4 (Epstein-Barr virus)
cuuuuggccuucuuccu

SEQ ID NO: 1874840 - RNA, 21 nt, Human herpesvirus 4 (Epstein-Barr virus)
ugauggccuggagagcaugca

SEQ ID NO: 1874841 - RNA, 18 nt, Human herpesvirus 4 (Epstein-Barr virus)
uccagggcccuggucagg

SEQ ID NO: 1874842 - RNA, 14 nt, Human herpesvirus 4 (Epstein-Barr virus)
ccagggccaggcga

SEQ ID NO: 1874843 - RNA, 16 nt, Human herpesvirus 4 (Epstein-Barr virus)
aggcccccggcuggcc

SEQ ID NO: 1874844 - RNA, 18 nt, Human herpesvirus 4 (Epstein-Barr virus)
cacaucuggaccuggacu

SEQ ID NO: 1874845 - RNA, 18 nt, Human herpesvirus 4 (Epstein-Barr virus)
ccaaacauaaaugcccca

SEQ ID NO: 1874846 - RNA, 15 nt, Human herpesvirus 4 (Epstein-Barr virus)
ccuucucaugcuccu

SEQ ID NO: 1874847 - RNA, 19 nt, Human herpesvirus 4 (Epstein-Barr virus)
accuuaacuggcacacacu

SEQ ID NO: 1874848 - RNA, 20 nt, Human herpesvirus 4 (Epstein-Barr virus)
cuugagcgccguggccaccu

SEQ ID NO: 1874849 - RNA, 15 nt, Human herpesvirus 4 (Epstein-Barr virus)
cgagaaaaugagcca

SEQ ID NO: 1874850 - RNA, 12 nt, Human herpesvirus 4 (Epstein-Barr virus)
ucaauuaaacaa

SEQ ID NO: 1874851 - RNA, 15 nt, Human herpesvirus 4 (Epstein-Barr virus)
ccuggacgagggggc

SEQ ID NO: 1874852 - RNA, 13 nt, Human herpesvirus 4 (Epstein-Barr virus)
cgcuacugcugcu

SEQ ID NO: 1874853 - RNA, 21 nt, Human herpesvirus 4 (Epstein-Barr virus)
gcuaaucgcugguggcaguau

SEQ ID NO: 1874854 - RNA, 22 nt, Human herpesvirus 4 (Epstein-Barr virus)
cgcucgcgggguuccccucccc

SEQ ID NO: 1874855 - RNA, 20 nt, Human herpesvirus 4 (Epstein-Barr virus)
cagcgaagaacacuccacag

SEQ ID NO: 1874856 - RNA, 14 nt, Human herpesvirus 4 (Epstein-Barr virus)
uggugggacugaga

SEQ ID NO: 1874857 - RNA, 22 nt, Human herpesvirus 4 (Epstein-Barr virus)
gccauggugccaagcucagccc

SEQ ID NO: 1874858 - RNA, 17 nt, Human herpesvirus 4 (Epstein-Barr virus)
ucagcgucaggagaggg

SEQ ID NO: 1874859 - RNA, 21 nt, Human herpesvirus 4 (Epstein-Barr virus)
cccacugaaaaaccagacacg

SEQ ID NO: 1874860 - RNA, 18 nt, Human herpesvirus 4 (Epstein-Barr virus)
acgcuguuuugcagcuga

SEQ ID NO: 1874861 - RNA, 17 nt, Human herpesvirus 4 (Epstein-Barr virus)
ccugcacggcccuccag

SEQ ID NO: 1874862 - RNA, 17 nt, Human herpesvirus 4 (Epstein-Barr virus)
ucaggaagcuggccagg

SEQ ID NO: 1874863 - RNA, 16 nt, Human herpesvirus 4 (Epstein-Barr virus)
auggcacgggcagagg

SEQ ID NO: 1874864 - RNA, 12 nt, Human herpesvirus 4 (Epstein-Barr virus)
gcaugugguggc

SEQ ID NO: 1874865 - RNA, 16 nt, Human herpesvirus 4 (Epstein-Barr virus)
cgcugggaccggggcc

SEQ ID NO: 1874866 - RNA, 18 nt, Human herpesvirus 4 (Epstein-Barr virus)
ccgaagauuuggcgucua

SEQ ID NO: 1874867 - RNA, 21 nt, Human herpesvirus 4 (Epstein-Barr virus)
ccuggagagcaugcaggucag

SEQ ID NO: 1874868 - RNA, 14 nt, Human herpesvirus 4 (Epstein-Barr virus)
ggcccguuccaggc

SEQ ID NO: 1874869 - RNA, 20 nt, Human herpesvirus 4 (Epstein-Barr virus)
cacgcuuuugucugccugga

SEQ ID NO: 1874870 - RNA, 17 nt, Human herpesvirus 4 (Epstein-Barr virus)
caugcagggugcacaga

SEQ ID NO: 1874871 - RNA, 14 nt, Human herpesvirus 4 (Epstein-Barr virus)
guuucggacacacc

SEQ ID NO: 1874872 - RNA, 23 nt, Human herpesvirus 4 (Epstein-Barr virus)
ggcguaacuugucuacaucccau

SEQ ID NO: 1874873 - RNA, 16 nt, Human herpesvirus 4 (Epstein-Barr virus)
ccuuuuaauucucuuc

SEQ ID NO: 1874874 - RNA, 20 nt, Human herpesvirus 4 (Epstein-Barr virus)
cucaggccucccagucuauc

SEQ ID NO: 1874875 - RNA, 16 nt, Human herpesvirus 4 (Epstein-Barr virus)
gauaaaguuguccugg

SEQ ID NO: 1874876 - RNA, 15 nt, Human herpesvirus 4 (Epstein-Barr virus)
aucuggggcuggccu

SEQ ID NO: 1874877 - RNA, 22 nt, Human herpesvirus 4 (Epstein-Barr virus)
auggagaugugcgcccugcucu

SEQ ID NO: 1874878 - RNA, 22 nt, Human herpesvirus 4 (Epstein-Barr virus)
ggucccccuccacgggagggcg

SEQ ID NO: 1874879 - RNA, 22 nt, Human herpesvirus 4 (Epstein-Barr virus)
gaaaagagagcugauggaggcc

SEQ ID NO: 1874880 - RNA, 19 nt, Human herpesvirus 4 (Epstein-Barr virus)
gcagaggacuuuuggggug

SEQ ID NO: 1874881 - RNA, 22 nt, Human herpesvirus 4 (Epstein-Barr virus)
ucuuccgugccucgggccucaa

SEQ ID NO: 1874882 - RNA, 20 nt, Human herpesvirus 4 (Epstein-Barr virus)
gaugcugccgcuacugcugc

SEQ ID NO: 1874883 - RNA, 19 nt, Human herpesvirus 4 (Epstein-Barr virus)
aacgaucccaggccucagc

SEQ ID NO: 1874884 - RNA, 16 nt, Human herpesvirus 4 (Epstein-Barr virus)
cggcguggagcugggc

SEQ ID NO: 1874885 - RNA, 21 nt, Human herpesvirus 4 (Epstein-Barr virus)
ucaagagucucgccaucuacc

SEQ ID NO: 1874886 - RNA, 20 nt, Human herpesvirus 4 (Epstein-Barr virus)
cccugaacaucucaucccca

SEQ ID NO: 1874887 - RNA, 18 nt, Human herpesvirus 4 (Epstein-Barr virus)
gaccuguugucccugaga

SEQ ID NO: 1874888 - RNA, 15 nt, Human herpesvirus 4 (Epstein-Barr virus)
agccacguccagacu

SEQ ID NO: 1874889 - RNA, 12 nt, Human herpesvirus 4 (Epstein-Barr virus)
ggaugccuggcg

SEQ ID NO: 1874890 - RNA, 17 nt, Human herpesvirus 4 (Epstein-Barr virus)
gaucuggggcuggccug

SEQ ID NO: 1874891 - RNA, 19 nt, Human herpesvirus 4 (Epstein-Barr virus)
cucagcuuggggccaccgg

SEQ ID NO: 1874892 - RNA, 20 nt, Human herpesvirus 4 (Epstein-Barr virus)
gagcgggaggggcaggagca

SEQ ID NO: 1874893 - RNA, 22 nt, Human herpesvirus 4 (Epstein-Barr virus)
ccacugagcaagauccuucugg

SEQ ID NO: 1874894 - RNA, 17 nt, Human herpesvirus 4 (Epstein-Barr virus)
cagacucugcuuucugc

SEQ ID NO: 1874895 - RNA, 19 nt, Human herpesvirus 4 (Epstein-Barr virus)
uacccagaggaggacaugu

SEQ ID NO: 1874896 - RNA, 13 nt, Human herpesvirus 4 (Epstein-Barr virus)
cacccauggccag

SEQ ID NO: 1874897 - RNA, 18 nt, Human herpesvirus 4 (Epstein-Barr virus)
cuggagaugauucauggg

SEQ ID NO: 1874898 - RNA, 23 nt, Human herpesvirus 4 (Epstein-Barr virus)
gccagggugaccuggcucagguc

SEQ ID NO: 1874899 - RNA, 16 nt, Human herpesvirus 4 (Epstein-Barr virus)
gauagcauggccgcca

SEQ ID NO: 1874900 - RNA, 20 nt, Human herpesvirus 4 (Epstein-Barr virus)
agugacacugaugagucuga

SEQ ID NO: 1874901 - RNA, 23 nt, Human herpesvirus 4 (Epstein-Barr virus)
cggccucgccuucuccucagccu

SEQ ID NO: 1874902 - RNA, 14 nt, Human herpesvirus 4 (Epstein-Barr virus)
aaggagugccucug

SEQ ID NO: 1874903 - RNA, 21 nt, Human herpesvirus 4 (Epstein-Barr virus)
gccaggaccuggaugcuguag

SEQ ID NO: 1874904 - RNA, 15 nt, Human herpesvirus 4 (Epstein-Barr virus)
cccuggaggccucag

SEQ ID NO: 1874905 - RNA, 16 nt, Human herpesvirus 4 (Epstein-Barr virus)
ccagcucggccagcag

SEQ ID NO: 1874906 - RNA, 16 nt, Human herpesvirus 4 (Epstein-Barr virus)
uuccugcccucccacu

SEQ ID NO: 1874907 - RNA, 20 nt, Human herpesvirus 4 (Epstein-Barr virus)
uaauucucuucuguuugcau

SEQ ID NO: 1874908 - RNA, 19 nt, Human herpesvirus 4 (Epstein-Barr virus)
cgggccauucgugagucca

SEQ ID NO: 1874909 - RNA, 16 nt, Human herpesvirus 4 (Epstein-Barr virus)
gccggaaccugagccu

SEQ ID NO: 1874910 - RNA, 18 nt, Human herpesvirus 4 (Epstein-Barr virus)
agcugacggugggcauga

SEQ ID NO: 1874911 - RNA, 20 nt, Human herpesvirus 4 (Epstein-Barr virus)
ggaggcacacaaaaugagga

SEQ ID NO: 1874912 - RNA, 19 nt, Human herpesvirus 4 (Epstein-Barr virus)
ccuccauuccacccacuga

SEQ ID NO: 1874913 - RNA, 18 nt, Human herpesvirus 4 (Epstein-Barr virus)
uggcaucuuccuccuugu

SEQ ID NO: 1874914 - RNA, 15 nt, Human herpesvirus 4 (Epstein-Barr virus)
caggagcuugaggcc

SEQ ID NO: 1874915 - RNA, 24 nt, Human herpesvirus 4 (Epstein-Barr virus)
ccgccauaacgccaucugcguggc

SEQ ID NO: 1874916 - RNA, 23 nt, Human herpesvirus 4 (Epstein-Barr virus)
ccaguguacugcgaugagggccu

SEQ ID NO: 1874917 - RNA, 21 nt, Human herpesvirus 4 (Epstein-Barr virus)
gcuccguccuuguccaggaga

SEQ ID NO: 1874918 - RNA, 12 nt, Human herpesvirus 4 (Epstein-Barr virus)
ucccucugggag

SEQ ID NO: 1874919 - RNA, 14 nt, Human herpesvirus 4 (Epstein-Barr virus)
ccacagccccacuc

SEQ ID NO: 1874920 - RNA, 13 nt, Human herpesvirus 4 (Epstein-Barr virus)
gcggacugcgccu

SEQ ID NO: 1874921 - RNA, 12 nt, Human herpesvirus 4 (Epstein-Barr virus)
agauccuucugg

SEQ ID NO: 1874922 - RNA, 15 nt, Human herpesvirus 4 (Epstein-Barr virus)
cggcaccgucagcca

SEQ ID NO: 1874923 - RNA, 20 nt, Human herpesvirus 4 (Epstein-Barr virus)
ucuccugugcuucagcagua

SEQ ID NO: 1874924 - RNA, 15 nt, Human herpesvirus 4 (Epstein-Barr virus)
auaaaccuuaaaagu

SEQ ID NO: 1874925 - RNA, 13 nt, Human herpesvirus 4 (Epstein-Barr virus)
ggcggcaguggac

SEQ ID NO: 1874926 - RNA, 16 nt, Human herpesvirus 4 (Epstein-Barr virus)
cagcucuaacuuggca

SEQ ID NO: 1874927 - RNA, 14 nt, Human herpesvirus 4 (Epstein-Barr virus)
agacuaugcauaca

SEQ ID NO: 1874928 - RNA, 14 nt, Human herpesvirus 4 (Epstein-Barr virus)
uggauuugaaagug

SEQ ID NO: 1874929 - RNA, 14 nt, Human herpesvirus 4 (Epstein-Barr virus)
ggaaugccuuagcu

SEQ ID NO: 1874930 - RNA, 22 nt, Human herpesvirus 4 (Epstein-Barr virus)
cucaggaagcuggccaggcugg

SEQ ID NO: 1874931 - RNA, 21 nt, Human herpesvirus 4 (Epstein-Barr virus)
caacccccggcucucaggccu

SEQ ID NO: 1874932 - RNA, 12 nt, Human herpesvirus 4 (Epstein-Barr virus)
agcccccucucg

SEQ ID NO: 1874933 - RNA, 24 nt, Human herpesvirus 4 (Epstein-Barr virus)
aagagaggcuucccgccuagagca

SEQ ID NO: 1874934 - RNA, 15 nt, Human herpesvirus 4 (Epstein-Barr virus)
gccucuaccuuccac

SEQ ID NO: 1874935 - RNA, 17 nt, Human herpesvirus 4 (Epstein-Barr virus)
ccucuuccgugccucgg

SEQ ID NO: 1874936 - RNA, 22 nt, Human herpesvirus 4 (Epstein-Barr virus)
aggucuugccguggcgccuggg

SEQ ID NO: 1874937 - RNA, 22 nt, Human herpesvirus 4 (Epstein-Barr virus)
gucaaacaggugagucagccuu

SEQ ID NO: 1874938 - RNA, 15 nt, Human herpesvirus 4 (Epstein-Barr virus)
ccccagagcagcccg

SEQ ID NO: 1874939 - RNA, 19 nt, Human herpesvirus 4 (Epstein-Barr virus)
ugggguauucucagaugca

SEQ ID NO: 1874940 - RNA, 16 nt, Human herpesvirus 4 (Epstein-Barr virus)
gcagaggccugcacca

SEQ ID NO: 1874941 - RNA, 22 nt, Human herpesvirus 4 (Epstein-Barr virus)
ucugggccgcccggccucgccu

SEQ ID NO: 1874942 - RNA, 17 nt, Human herpesvirus 4 (Epstein-Barr virus)
gacccuauggagggcag

SEQ ID NO: 1874943 - RNA, 16 nt, Human herpesvirus 4 (Epstein-Barr virus)
ccauacaugucucaga

SEQ ID NO: 1874944 - RNA, 21 nt, Human herpesvirus 4 (Epstein-Barr virus)
auaaaguugaugauauugaau

SEQ ID NO: 1874945 - RNA, 16 nt, Human herpesvirus 4 (Epstein-Barr virus)
ggggcaggagcaggag

SEQ ID NO: 1874946 - RNA, 21 nt, Human herpesvirus 4 (Epstein-Barr virus)
ccuuuugucuccccucugcag

SEQ ID NO: 1874947 - RNA, 16 nt, Human herpesvirus 4 (Epstein-Barr virus)
gccguagcccaguccg

SEQ ID NO: 1874948 - RNA, 15 nt, Human herpesvirus 4 (Epstein-Barr virus)
gggucgccugacccu

SEQ ID NO: 1874949 - RNA, 13 nt, Human herpesvirus 4 (Epstein-Barr virus)
ggcguggguguca

SEQ ID NO: 1874950 - RNA, 19 nt, Human herpesvirus 4 (Epstein-Barr virus)
cuuucuggccaaccugccu

SEQ ID NO: 1874951 - RNA, 15 nt, Human herpesvirus 4 (Epstein-Barr virus)
caugacgcugcugcu

SEQ ID NO: 1874952 - RNA, 17 nt, Human herpesvirus 4 (Epstein-Barr virus)
cgagcuccgugggccca

SEQ ID NO: 1874953 - RNA, 21 nt, Human herpesvirus 4 (Epstein-Barr virus)
gagcagauuuccgucagccag

SEQ ID NO: 1874954 - RNA, 18 nt, Human herpesvirus 4 (Epstein-Barr virus)
cuugugguucuccugauu

SEQ ID NO: 1874955 - RNA, 21 nt, Human herpesvirus 4 (Epstein-Barr virus)
cccaccacccccaccaccucc

SEQ ID NO: 1874956 - RNA, 21 nt, Human herpesvirus 4 (Epstein-Barr virus)
ugucugugguugucuucccag

SEQ ID NO: 1874957 - RNA, 14 nt, Human herpesvirus 4 (Epstein-Barr virus)
gugacauguccggg

SEQ ID NO: 1874958 - RNA, 17 nt, Human herpesvirus 4 (Epstein-Barr virus)
gccugcggacucaggcc

SEQ ID NO: 1874959 - RNA, 15 nt, Human herpesvirus 4 (Epstein-Barr virus)
uggugcaccugcuag

SEQ ID NO: 1874960 - RNA, 21 nt, Human herpesvirus 4 (Epstein-Barr virus)
gguccuggacgagggggcgcg

SEQ ID NO: 1874961 - RNA, 15 nt, Human herpesvirus 4 (Epstein-Barr virus)
agccccagccccucc

SEQ ID NO: 1874962 - RNA, 18 nt, Human herpesvirus 4 (Epstein-Barr virus)
ucagcucaaccgccaggg

SEQ ID NO: 1874963 - RNA, 21 nt, Human herpesvirus 4 (Epstein-Barr virus)
ccuuccagagcucuacaaccc

SEQ ID NO: 1874964 - RNA, 15 nt, Human herpesvirus 4 (Epstein-Barr virus)
gcaaagauccccagu

SEQ ID NO: 1874965 - RNA, 22 nt, Human herpesvirus 4 (Epstein-Barr virus)
gcagccacguccagacuccggg

SEQ ID NO: 1874966 - RNA, 21 nt, Human herpesvirus 4 (Epstein-Barr virus)
caggaggccaccgacgagcag

SEQ ID NO: 1874967 - RNA, 21 nt, Human herpesvirus 4 (Epstein-Barr virus)
ggagucugagaauaaggcucu

SEQ ID NO: 1874968 - RNA, 23 nt, Human herpesvirus 4 (Epstein-Barr virus)
caguccgccaugaccagcagcag

SEQ ID NO: 1874969 - RNA, 22 nt, Human herpesvirus 4 (Epstein-Barr virus)
cugcgccugagcugccugguga

SEQ ID NO: 1874970 - RNA, 20 nt, Human herpesvirus 4 (Epstein-Barr virus)
gccugaagcuugcuggggcg

SEQ ID NO: 1874971 - RNA, 11 nt, Human herpesvirus 4 (Epstein-Barr virus)
aaaagagacug

SEQ ID NO: 1874972 - RNA, 13 nt, Human herpesvirus 4 (Epstein-Barr virus)
augacgcugcugc

SEQ ID NO: 1874973 - RNA, 18 nt, Human herpesvirus 4 (Epstein-Barr virus)
cguuaacauggacaugcu

SEQ ID NO: 1874974 - RNA, 21 nt, Human herpesvirus 4 (Epstein-Barr virus)
guggaaaaucucgcucagagc

SEQ ID NO: 1874975 - RNA, 21 nt, Human herpesvirus 4 (Epstein-Barr virus)
cugccaacuuugagcugggca

SEQ ID NO: 1874976 - RNA, 22 nt, Human herpesvirus 4 (Epstein-Barr virus)
ccugucgauaucccugcugucu

SEQ ID NO: 1874977 - RNA, 16 nt, Human herpesvirus 4 (Epstein-Barr virus)
acacagcgccagcagg

SEQ ID NO: 1874978 - RNA, 16 nt, Human herpesvirus 4 (Epstein-Barr virus)
aucaccagagcccaga

SEQ ID NO: 1874979 - RNA, 21 nt, Human herpesvirus 4 (Epstein-Barr virus)
auauggcuauacacaggagcc

SEQ ID NO: 1874980 - RNA, 19 nt, Human herpesvirus 4 (Epstein-Barr virus)
ggcagaggccucucucgag

SEQ ID NO: 1874981 - RNA, 16 nt, Human herpesvirus 4 (Epstein-Barr virus)
uucugccccucagccu

SEQ ID NO: 1874982 - RNA, 20 nt, Human herpesvirus 4 (Epstein-Barr virus)
gacacccacccugcacacau

SEQ ID NO: 1874983 - RNA, 20 nt, Human herpesvirus 4 (Epstein-Barr virus)
aggcagaugaggccccuuac

SEQ ID NO: 1874984 - RNA, 19 nt, Human herpesvirus 4 (Epstein-Barr virus)
acuacgagggccucuggca

SEQ ID NO: 1874985 - RNA, 15 nt, Human herpesvirus 4 (Epstein-Barr virus)
caagauggagaggca

SEQ ID NO: 1874986 - RNA, 21 nt, Human herpesvirus 4 (Epstein-Barr virus)
cauuuuuggugcugccugggg

SEQ ID NO: 1874987 - RNA, 16 nt, Human herpesvirus 4 (Epstein-Barr virus)
uggacacccacccugc

SEQ ID NO: 1874988 - RNA, 21 nt, Human herpesvirus 4 (Epstein-Barr virus)
ugacggugggcaugacacagg

SEQ ID NO: 1874989 - RNA, 13 nt, Human herpesvirus 4 (Epstein-Barr virus)
acucggccacaca

SEQ ID NO: 1874990 - RNA, 22 nt, Human herpesvirus 4 (Epstein-Barr virus)
agaggccucugggguccaggag

SEQ ID NO: 1874991 - RNA, 18 nt, Human herpesvirus 4 (Epstein-Barr virus)
acccggguucgggcacgc

SEQ ID NO: 1874992 - RNA, 20 nt, Human herpesvirus 4 (Epstein-Barr virus)
cagcaccucagcuguuccca

SEQ ID NO: 1874993 - RNA, 18 nt, Human herpesvirus 4 (Epstein-Barr virus)
aagaccaauacccaggau

SEQ ID NO: 1874994 - RNA, 22 nt, Human herpesvirus 4 (Epstein-Barr virus)
agcuguguuucccgacgccaau

SEQ ID NO: 1874995 - RNA, 20 nt, Human herpesvirus 4 (Epstein-Barr virus)
acacgggccuggggccauag

SEQ ID NO: 1874996 - RNA, 22 nt, Human herpesvirus 4 (Epstein-Barr virus)
aaguacugaaacgucaggucuu

SEQ ID NO: 1874997 - RNA, 17 nt, Human herpesvirus 4 (Epstein-Barr virus)
cgccuucuccucagccu

SEQ ID NO: 1874998 - RNA, 14 nt, Human herpesvirus 4 (Epstein-Barr virus)
ugcacucugaccag

SEQ ID NO: 1874999 - RNA, 19 nt, Human herpesvirus 4 (Epstein-Barr virus)
cacucaggaagcuggccag

SEQ ID NO: 1875000 - RNA, 23 nt, Human herpesvirus 4 (Epstein-Barr virus)
guugagcccgacgaacuccucca

SEQ ID NO: 1875001 - RNA, 20 nt, Human herpesvirus 4 (Epstein-Barr virus)
gccggcgcuguguggcugac

SEQ ID NO: 1875002 - RNA, 22 nt, Human herpesvirus 4 (Epstein-Barr virus)
aacgcccagggacauccccaga

SEQ ID NO: 1875003 - RNA, 22 nt, Human herpesvirus 4 (Epstein-Barr virus)
gcgccaucuagcgggagauguu

SEQ ID NO: 1875004 - RNA, 16 nt, Human herpesvirus 4 (Epstein-Barr virus)
gacggugaccugacug

SEQ ID NO: 1875005 - RNA, 23 nt, Human herpesvirus 4 (Epstein-Barr virus)
acaaacaccaguguccagagagg

SEQ ID NO: 1875006 - RNA, 17 nt, Human herpesvirus 4 (Epstein-Barr virus)
acaggcugcugaaaacc

SEQ ID NO: 1875007 - RNA, 14 nt, Human herpesvirus 4 (Epstein-Barr virus)
aggccucaggcaac

SEQ ID NO: 1875008 - RNA, 21 nt, Human herpesvirus 4 (Epstein-Barr virus)
ccgugcuuuuugccaggccug

SEQ ID NO: 1875009 - RNA, 15 nt, Human herpesvirus 4 (Epstein-Barr virus)
uccgccaccuccggg

SEQ ID NO: 1875010 - RNA, 17 nt, Human herpesvirus 4 (Epstein-Barr virus)
cuaggccugccacgugg

SEQ ID NO: 1875011 - RNA, 19 nt, Human herpesvirus 4 (Epstein-Barr virus)
agagagguugcgcugcuug

SEQ ID NO: 1875012 - RNA, 22 nt, Human herpesvirus 4 (Epstein-Barr virus)
uggcagaaucaccagagcccag

SEQ ID NO: 1875013 - RNA, 16 nt, Human herpesvirus 4 (Epstein-Barr virus)
augugcauggccuggg

SEQ ID NO: 1875014 - RNA, 11 nt, Human herpesvirus 4 (Epstein-Barr virus)
uccccucugcc

SEQ ID NO: 1875015 - RNA, 17 nt, Human herpesvirus 4 (Epstein-Barr virus)
ccuccaacaggugcccg

SEQ ID NO: 1875016 - RNA, 16 nt, Human herpesvirus 4 (Epstein-Barr virus)
uuaaggaaugaacacu

SEQ ID NO: 1875017 - RNA, 23 nt, Human herpesvirus 4 (Epstein-Barr virus)
acgcuuuugucugccuggauucu

SEQ ID NO: 1875018 - RNA, 19 nt, Human herpesvirus 4 (Epstein-Barr virus)
guccgccggguucucaggg

SEQ ID NO: 1875019 - RNA, 21 nt, Human herpesvirus 4 (Epstein-Barr virus)
gagcaccggagccaccacagc

SEQ ID NO: 1875020 - RNA, 16 nt, Human herpesvirus 4 (Epstein-Barr virus)
ggacgaggaggcggaa

SEQ ID NO: 1875021 - RNA, 15 nt, Human herpesvirus 4 (Epstein-Barr virus)
uuagccccagccccu

SEQ ID NO: 1875022 - RNA, 22 nt, Human herpesvirus 4 (Epstein-Barr virus)
gcagcugaguccccuccuugga

SEQ ID NO: 1875023 - RNA, 17 nt, Human herpesvirus 4 (Epstein-Barr virus)
ugcaacagaggauuggc

SEQ ID NO: 1875024 - RNA, 13 nt, Human herpesvirus 4 (Epstein-Barr virus)
aggacuaauguuc

SEQ ID NO: 1875025 - RNA, 15 nt, Human herpesvirus 4 (Epstein-Barr virus)
cagggcccagugcac

SEQ ID NO: 1875026 - RNA, 20 nt, Human herpesvirus 4 (Epstein-Barr virus)
acucggccacacagugggcu

SEQ ID NO: 1875027 - RNA, 16 nt, Human herpesvirus 4 (Epstein-Barr virus)
cggccacguccccggc

SEQ ID NO: 1875028 - RNA, 22 nt, Human herpesvirus 4 (Epstein-Barr virus)
ugggcugacacagacuuggccu

SEQ ID NO: 1875029 - RNA, 15 nt, Human herpesvirus 4 (Epstein-Barr virus)
uguggccccggcugg

SEQ ID NO: 1875030 - RNA, 22 nt, Human herpesvirus 4 (Epstein-Barr virus)
auccaucaacuucagcuccagg

SEQ ID NO: 1875031 - RNA, 14 nt, Human herpesvirus 4 (Epstein-Barr virus)
cuccugacgccaau

SEQ ID NO: 1875032 - RNA, 21 nt, Human herpesvirus 4 (Epstein-Barr virus)
gugccaaacugcgagggggcc

SEQ ID NO: 1875033 - RNA, 20 nt, Human herpesvirus 4 (Epstein-Barr virus)
aaaaaugugcagcuucucca

SEQ ID NO: 1875034 - RNA, 13 nt, Human herpesvirus 4 (Epstein-Barr virus)
gcauggccaggcc

SEQ ID NO: 1875035 - RNA, 16 nt, Human herpesvirus 4 (Epstein-Barr virus)
gggcucccucccccuc

SEQ ID NO: 1875036 - RNA, 15 nt, Human herpesvirus 4 (Epstein-Barr virus)
aagccugccucaucc

SEQ ID NO: 1875037 - RNA, 13 nt, Human herpesvirus 4 (Epstein-Barr virus)
guccaaggcccaa

SEQ ID NO: 1875038 - RNA, 21 nt, Human herpesvirus 4 (Epstein-Barr virus)
cccaccagaucgccugccacu

SEQ ID NO: 1875039 - RNA, 17 nt, Human herpesvirus 4 (Epstein-Barr virus)
cagagccucugccacaa

SEQ ID NO: 1875040 - RNA, 23 nt, Human herpesvirus 4 (Epstein-Barr virus)
caagcugcuuugauuccugggau

SEQ ID NO: 1875041 - RNA, 12 nt, Human herpesvirus 4 (Epstein-Barr virus)
agcaccaacaca

SEQ ID NO: 1875042 - RNA, 16 nt, Human herpesvirus 4 (Epstein-Barr virus)
aagcaaacggccuggc

SEQ ID NO: 1875043 - RNA, 17 nt, Human herpesvirus 4 (Epstein-Barr virus)
ggcccacgucuuuacca

SEQ ID NO: 1875044 - RNA, 13 nt, Human herpesvirus 4 (Epstein-Barr virus)
ggaacauuugagg

SEQ ID NO: 1875045 - RNA, 16 nt, Human herpesvirus 4 (Epstein-Barr virus)
ccucagcccccccugu

SEQ ID NO: 1875046 - RNA, 19 nt, Human herpesvirus 4 (Epstein-Barr virus)
uccuagcacaaaccagucu

SEQ ID NO: 1875047 - RNA, 17 nt, Human herpesvirus 4 (Epstein-Barr virus)
ugcucagaccccggguu

SEQ ID NO: 1875048 - RNA, 15 nt, Human herpesvirus 4 (Epstein-Barr virus)
acgaugaaggagggc

SEQ ID NO: 1875049 - RNA, 11 nt, Human herpesvirus 4 (Epstein-Barr virus)
gaugcccucau

SEQ ID NO: 1875050 - RNA, 22 nt, Human herpesvirus 4 (Epstein-Barr virus)
gcgggaguauggggccagaggc

SEQ ID NO: 1875051 - RNA, 13 nt, Human herpesvirus 4 (Epstein-Barr virus)
ccggacggccuag

SEQ ID NO: 1875052 - RNA, 14 nt, Human herpesvirus 4 (Epstein-Barr virus)
cucagagagcauuu

SEQ ID NO: 1875053 - RNA, 18 nt, Human herpesvirus 4 (Epstein-Barr virus)
ucagcacuuugccagcaa

SEQ ID NO: 1875054 - RNA, 14 nt, Human herpesvirus 4 (Epstein-Barr virus)
gugucuguaaucuc

SEQ ID NO: 1875055 - RNA, 18 nt, Human herpesvirus 4 (Epstein-Barr virus)
guccuugugucucuauca

SEQ ID NO: 1875056 - RNA, 20 nt, Human herpesvirus 4 (Epstein-Barr virus)
caggccaugcgcgcccuguc

SEQ ID NO: 1875057 - RNA, 13 nt, Human herpesvirus 4 (Epstein-Barr virus)
cugucucucuuug

SEQ ID NO: 1875058 - RNA, 16 nt, Human herpesvirus 4 (Epstein-Barr virus)
uaugcaaugcccaccc

SEQ ID NO: 1875059 - RNA, 14 nt, Human herpesvirus 4 (Epstein-Barr virus)
guccggucagguuu

SEQ ID NO: 1875060 - RNA, 16 nt, Human herpesvirus 4 (Epstein-Barr virus)
uagggagguggccaca

SEQ ID NO: 1875061 - RNA, 13 nt, Human herpesvirus 4 (Epstein-Barr virus)
agaggcucaggcc

SEQ ID NO: 1875062 - RNA, 14 nt, Human herpesvirus 4 (Epstein-Barr virus)
gcacgggcagagga

SEQ ID NO: 1875063 - RNA, 21 nt, Human herpesvirus 4 (Epstein-Barr virus)
cagcaaccaauguaucccaaa

SEQ ID NO: 1875064 - RNA, 18 nt, Human herpesvirus 4 (Epstein-Barr virus)
cgccgccccaggggucuc

SEQ ID NO: 1875065 - RNA, 19 nt, Human herpesvirus 4 (Epstein-Barr virus)
cgcaccuguguccugggca

SEQ ID NO: 1875066 - RNA, 15 nt, Human herpesvirus 4 (Epstein-Barr virus)
cauuaaagccuccuc

SEQ ID NO: 1875067 - RNA, 16 nt, Human herpesvirus 4 (Epstein-Barr virus)
cuuaacuugacuacaa

SEQ ID NO: 1875068 - RNA, 16 nt, Human herpesvirus 4 (Epstein-Barr virus)
aacguccaaguugcau

SEQ ID NO: 1875069 - RNA, 21 nt, Human herpesvirus 4 (Epstein-Barr virus)
ccagauguccagggguccccg

SEQ ID NO: 1875070 - RNA, 16 nt, Human herpesvirus 4 (Epstein-Barr virus)
ggagcaggagcaggag

SEQ ID NO: 1875071 - RNA, 17 nt, Human herpesvirus 4 (Epstein-Barr virus)
cucagguuucugggcau

SEQ ID NO: 1875072 - RNA, 20 nt, Human herpesvirus 4 (Epstein-Barr virus)
gcaugaucaggacccugggc

SEQ ID NO: 1875073 - RNA, 19 nt, Human herpesvirus 4 (Epstein-Barr virus)
aacucccccaaacaugucc

SEQ ID NO: 1875074 - RNA, 18 nt, Human herpesvirus 4 (Epstein-Barr virus)
ccugagccugagccacac

SEQ ID NO: 1875075 - RNA, 13 nt, Human herpesvirus 4 (Epstein-Barr virus)
uaaggcuguugac

SEQ ID NO: 1875076 - RNA, 18 nt, Human herpesvirus 4 (Epstein-Barr virus)
gcugaugugcugccccaa

SEQ ID NO: 1875077 - RNA, 18 nt, Human herpesvirus 4 (Epstein-Barr virus)
ggccgccacccucccccu

SEQ ID NO: 1875078 - RNA, 14 nt, Human herpesvirus 4 (Epstein-Barr virus)
cugagccugagcca

SEQ ID NO: 1875079 - RNA, 15 nt, Human herpesvirus 4 (Epstein-Barr virus)
gaaaaacuggccaug

SEQ ID NO: 1875080 - RNA, 12 nt, Human herpesvirus 4 (Epstein-Barr virus)
ugcuugugcucc

SEQ ID NO: 1875081 - RNA, 23 nt, Human herpesvirus 4 (Epstein-Barr virus)
ucucagacaccaacacagacugc

SEQ ID NO: 1875082 - RNA, 19 nt, Human herpesvirus 4 (Epstein-Barr virus)
ccgcaggggugguggaugu

SEQ ID NO: 1875083 - RNA, 16 nt, Human herpesvirus 4 (Epstein-Barr virus)
ucccucaccagggcug

SEQ ID NO: 1875084 - RNA, 16 nt, Human herpesvirus 4 (Epstein-Barr virus)
ugccaugcacggcccu

SEQ ID NO: 1875085 - RNA, 12 nt, Human herpesvirus 4 (Epstein-Barr virus)
gaggggcaggag

SEQ ID NO: 1875086 - RNA, 12 nt, Human herpesvirus 4 (Epstein-Barr virus)
gccauggccaau

SEQ ID NO: 1875087 - RNA, 15 nt, Human herpesvirus 4 (Epstein-Barr virus)
cacccucccccugcc

SEQ ID NO: 1875088 - RNA, 14 nt, Human herpesvirus 4 (Epstein-Barr virus)
gaggaggcggaaga

SEQ ID NO: 1875089 - RNA, 15 nt, Human herpesvirus 4 (Epstein-Barr virus)
cacaucuggaccugg

SEQ ID NO: 1875090 - RNA, 17 nt, Human herpesvirus 4 (Epstein-Barr virus)
aacaugagaaaauacuu

SEQ ID NO: 1875091 - RNA, 14 nt, Human herpesvirus 4 (Epstein-Barr virus)
ucgcugucgagcug

SEQ ID NO: 1875092 - RNA, 13 nt, Human herpesvirus 4 (Epstein-Barr virus)
uccagccaucaug

SEQ ID NO: 1875093 - RNA, 15 nt, Human herpesvirus 4 (Epstein-Barr virus)
aaacauacaggagga

SEQ ID NO: 1875094 - RNA, 22 nt, Human herpesvirus 4 (Epstein-Barr virus)
guuggcuucugcugcugcuugu

SEQ ID NO: 1875095 - RNA, 13 nt, Human herpesvirus 4 (Epstein-Barr virus)
ggugcucccccug

SEQ ID NO: 1875096 - RNA, 18 nt, Human herpesvirus 4 (Epstein-Barr virus)
guacaggaccaugucggc

SEQ ID NO: 1875097 - RNA, 15 nt, Human herpesvirus 4 (Epstein-Barr virus)
uauccaggaggagga

SEQ ID NO: 1875098 - RNA, 21 nt, Human herpesvirus 4 (Epstein-Barr virus)
ccugcuggccgagcuggaggc

SEQ ID NO: 1875099 - RNA, 18 nt, Human herpesvirus 4 (Epstein-Barr virus)
gcaggaggaggggcagga

SEQ ID NO: 1875100 - RNA, 21 nt, Human herpesvirus 4 (Epstein-Barr virus)
gagugcugcagguaaaccuuc

SEQ ID NO: 1875101 - RNA, 18 nt, Human herpesvirus 4 (Epstein-Barr virus)
ccaucggauaaacagggg

SEQ ID NO: 1875102 - RNA, 13 nt, Human herpesvirus 4 (Epstein-Barr virus)
ccagcaggcucag

SEQ ID NO: 1875103 - RNA, 17 nt, Human herpesvirus 4 (Epstein-Barr virus)
cuggcuucugugacuuu

SEQ ID NO: 1875104 - RNA, 17 nt, Human herpesvirus 4 (Epstein-Barr virus)
aacgccggccugcuggc

SEQ ID NO: 1875105 - RNA, 19 nt, Human herpesvirus 4 (Epstein-Barr virus)
cgaucccaggccucagcgu

SEQ ID NO: 1875106 - RNA, 10 nt, Human herpesvirus 4 (Epstein-Barr virus)
gagggggcca

SEQ ID NO: 1875107 - RNA, 22 nt, Human herpesvirus 4 (Epstein-Barr virus)
ccggaccaaugccaaagcugaa

SEQ ID NO: 1875108 - RNA, 18 nt, Human herpesvirus 4 (Epstein-Barr virus)
ggucgucaucuggcucuc

SEQ ID NO: 1875109 - RNA, 16 nt, Human herpesvirus 4 (Epstein-Barr virus)
cuacucuuggcagcag

SEQ ID NO: 1875110 - RNA, 22 nt, Human herpesvirus 4 (Epstein-Barr virus)
ggaacaugagaaaauacuucuc

SEQ ID NO: 1875111 - RNA, 23 nt, Human herpesvirus 4 (Epstein-Barr virus)
agaggcucaggccaugcgcgccc

SEQ ID NO: 1875112 - RNA, 16 nt, Human herpesvirus 4 (Epstein-Barr virus)
ucuccuuguugaccuc

SEQ ID NO: 1875113 - RNA, 24 nt, Human herpesvirus 4 (Epstein-Barr virus)
cagcuucugaggcggcuguggccu

SEQ ID NO: 1875114 - RNA, 17 nt, Human herpesvirus 4 (Epstein-Barr virus)
guagccgggguggaggg

SEQ ID NO: 1875115 - RNA, 18 nt, Human herpesvirus 4 (Epstein-Barr virus)
ugcacagacuagcgagga

SEQ ID NO: 1875116 - RNA, 21 nt, Human herpesvirus 4 (Epstein-Barr virus)
accauggaugugaaugccccc

SEQ ID NO: 1875117 - RNA, 20 nt, Human herpesvirus 4 (Epstein-Barr virus)
cgggcggcucaggaucaggg

SEQ ID NO: 1875118 - RNA, 15 nt, Human herpesvirus 4 (Epstein-Barr virus)
gaccacggcccacgu

SEQ ID NO: 1875119 - RNA, 19 nt, Human herpesvirus 4 (Epstein-Barr virus)
ugaccucuacacgcuugga

SEQ ID NO: 1875120 - RNA, 18 nt, Human herpesvirus 4 (Epstein-Barr virus)
auucucuaaucccucugg

SEQ ID NO: 1875121 - RNA, 19 nt, Human herpesvirus 4 (Epstein-Barr virus)
caccugucccugggggccu

SEQ ID NO: 1875122 - RNA, 23 nt, Human herpesvirus 4 (Epstein-Barr virus)
uacagcacaaccuuggacccugc

SEQ ID NO: 1875123 - RNA, 21 nt, Human herpesvirus 4 (Epstein-Barr virus)
gccuaaucaccguuccucauu

SEQ ID NO: 1875124 - RNA, 18 nt, Human herpesvirus 4 (Epstein-Barr virus)
aagucaggauucucuaau

SEQ ID NO: 1875125 - RNA, 19 nt, Human herpesvirus 4 (Epstein-Barr virus)
guccugaauccgcgcagcc

SEQ ID NO: 1875126 - RNA, 19 nt, Human herpesvirus 4 (Epstein-Barr virus)
gggcuccauguccuguggu

SEQ ID NO: 1875127 - RNA, 15 nt, Human herpesvirus 4 (Epstein-Barr virus)
agaggaggaggauga

SEQ ID NO: 1875128 - RNA, 15 nt, Human herpesvirus 4 (Epstein-Barr virus)
guccucauggcagga

SEQ ID NO: 1875129 - RNA, 16 nt, Human herpesvirus 4 (Epstein-Barr virus)
cucgcuggcucgccuc

SEQ ID NO: 1875130 - RNA, 15 nt, Human herpesvirus 4 (Epstein-Barr virus)
ccuugagggcaaaga

SEQ ID NO: 1875131 - RNA, 18 nt, Human herpesvirus 4 (Epstein-Barr virus)
acuuuguuuagggacaga

SEQ ID NO: 1875132 - RNA, 20 nt, Human herpesvirus 4 (Epstein-Barr virus)
ugggggcuacaggaggccac

SEQ ID NO: 1875133 - RNA, 21 nt, Human herpesvirus 4 (Epstein-Barr virus)
cccgcuguaugaggaaggggc

SEQ ID NO: 1875134 - RNA, 19 nt, Human herpesvirus 4 (Epstein-Barr virus)
cagaccucugcacaacaca

SEQ ID NO: 1875135 - RNA, 21 nt, Human herpesvirus 4 (Epstein-Barr virus)
ggcggccucggaggugcccgg

SEQ ID NO: 1875136 - RNA, 15 nt, Human herpesvirus 4 (Epstein-Barr virus)
gugggcugacacaga

SEQ ID NO: 1875137 - RNA, 16 nt, Human herpesvirus 4 (Epstein-Barr virus)
agacugcacaggauga

SEQ ID NO: 1875138 - RNA, 19 nt, Human herpesvirus 4 (Epstein-Barr virus)
ccugggagggggcgagcag

SEQ ID NO: 1875139 - RNA, 17 nt, Human herpesvirus 4 (Epstein-Barr virus)
acagauugucuuccaca

SEQ ID NO: 1875140 - RNA, 14 nt, Human herpesvirus 4 (Epstein-Barr virus)
aacaauuacagaua

SEQ ID NO: 1875141 - RNA, 18 nt, Human herpesvirus 4 (Epstein-Barr virus)
gcaacagacugcggggag

SEQ ID NO: 1875142 - RNA, 18 nt, Human herpesvirus 4 (Epstein-Barr virus)
cucgcucagagcugggaa

SEQ ID NO: 1875143 - RNA, 21 nt, Human herpesvirus 4 (Epstein-Barr virus)
cucaggcacggucgccccucc

SEQ ID NO: 1875144 - RNA, 19 nt, Human herpesvirus 4 (Epstein-Barr virus)
cagcacagccagagaggcc

SEQ ID NO: 1875145 - RNA, 20 nt, Human herpesvirus 4 (Epstein-Barr virus)
cucucuggcugugcugaccc

SEQ ID NO: 1875146 - RNA, 15 nt, Human herpesvirus 4 (Epstein-Barr virus)
aagcaccacccagcc

SEQ ID NO: 1875147 - RNA, 17 nt, Human herpesvirus 4 (Epstein-Barr virus)
cuggccggccgcccccu

SEQ ID NO: 1875148 - RNA, 17 nt, Human herpesvirus 4 (Epstein-Barr virus)
gagacaaggcaggcgcu

SEQ ID NO: 1875149 - RNA, 16 nt, Human herpesvirus 4 (Epstein-Barr virus)
ccaaacuuuguccaga

SEQ ID NO: 1875150 - RNA, 19 nt, Human herpesvirus 4 (Epstein-Barr virus)
ggaucagucgcuggcuggu

SEQ ID NO: 1875151 - RNA, 21 nt, Human herpesvirus 4 (Epstein-Barr virus)
gaaaccuugccuacgggcgca

SEQ ID NO: 1875152 - RNA, 18 nt, Human herpesvirus 4 (Epstein-Barr virus)
ugaccaugauggugcaga

SEQ ID NO: 1875153 - RNA, 22 nt, Human herpesvirus 4 (Epstein-Barr virus)
uggccugggaggugcugaggcc

SEQ ID NO: 1875154 - RNA, 16 nt, Human herpesvirus 4 (Epstein-Barr virus)
ccuccucugggccgcc

SEQ ID NO: 1875155 - RNA, 13 nt, Human herpesvirus 4 (Epstein-Barr virus)
uacgcgggccaca

SEQ ID NO: 1875156 - RNA, 19 nt, Human herpesvirus 4 (Epstein-Barr virus)
uaccgccacgcgucagcaa

SEQ ID NO: 1875157 - RNA, 21 nt, Human herpesvirus 4 (Epstein-Barr virus)
gccccggucaccccagaugcc

SEQ ID NO: 1875158 - RNA, 13 nt, Human herpesvirus 4 (Epstein-Barr virus)
cguuggcccauaa

SEQ ID NO: 1875159 - RNA, 18 nt, Human herpesvirus 4 (Epstein-Barr virus)
agagauuucauccucaga

SEQ ID NO: 1875160 - RNA, 14 nt, Human herpesvirus 4 (Epstein-Barr virus)
acccaccacacagc

SEQ ID NO: 1875161 - RNA, 21 nt, Human herpesvirus 4 (Epstein-Barr virus)
gccuucuccucagccuccaac

SEQ ID NO: 1875162 - RNA, 16 nt, Human herpesvirus 4 (Epstein-Barr virus)
agaccaauacccagga

SEQ ID NO: 1875163 - RNA, 20 nt, Human herpesvirus 4 (Epstein-Barr virus)
gcagcucaccuauggucacu

SEQ ID NO: 1875164 - RNA, 13 nt, Human herpesvirus 4 (Epstein-Barr virus)
uguuauucccacc

SEQ ID NO: 1875165 - RNA, 18 nt, Human herpesvirus 4 (Epstein-Barr virus)
acagcagcguccuggccc

SEQ ID NO: 1875166 - RNA, 22 nt, Human herpesvirus 4 (Epstein-Barr virus)
ggaguaaggccgcugccaggcc

SEQ ID NO: 1875167 - RNA, 14 nt, Human herpesvirus 4 (Epstein-Barr virus)
cccuggcugacgga

SEQ ID NO: 1875168 - RNA, 14 nt, Human herpesvirus 4 (Epstein-Barr virus)
aggaagcuggccag

SEQ ID NO: 1875169 - RNA, 14 nt, Human herpesvirus 4 (Epstein-Barr virus)
cugcuacuggcuuu

SEQ ID NO: 1875170 - RNA, 21 nt, Human herpesvirus 4 (Epstein-Barr virus)
guugcauuggcugcaaaggga

SEQ ID NO: 1875171 - RNA, 18 nt, Human herpesvirus 4 (Epstein-Barr virus)
gguagccuugggggccug

SEQ ID NO: 1875172 - RNA, 19 nt, Human herpesvirus 4 (Epstein-Barr virus)
cgauuggaaaagggcccag

SEQ ID NO: 1875173 - RNA, 18 nt, Human herpesvirus 4 (Epstein-Barr virus)
caggggcgccgaaagcag

SEQ ID NO: 1875174 - RNA, 19 nt, Human herpesvirus 4 (Epstein-Barr virus)
cagcuggugguccgcaugu

SEQ ID NO: 1875175 - RNA, 12 nt, Human herpesvirus 4 (Epstein-Barr virus)
gggacugccugg

SEQ ID NO: 1875176 - RNA, 14 nt, Human herpesvirus 4 (Epstein-Barr virus)
caucugcccggcua

SEQ ID NO: 1875177 - RNA, 17 nt, Human herpesvirus 4 (Epstein-Barr virus)
uucccgacggcaugccu

SEQ ID NO: 1875178 - RNA, 17 nt, Human herpesvirus 4 (Epstein-Barr virus)
aggcccaggaccuuggc

SEQ ID NO: 1875179 - RNA, 19 nt, Human herpesvirus 4 (Epstein-Barr virus)
cacaaccacggugacauuc

SEQ ID NO: 1875180 - RNA, 17 nt, Human herpesvirus 4 (Epstein-Barr virus)
acgccugcuucacgccu

SEQ ID NO: 1875181 - RNA, 22 nt, Human herpesvirus 4 (Epstein-Barr virus)
gccuguuuguccagcagggccu

SEQ ID NO: 1875182 - RNA, 18 nt, Human herpesvirus 4 (Epstein-Barr virus)
gcccagcuccgugguccu

SEQ ID NO: 1875183 - RNA, 12 nt, Human herpesvirus 4 (Epstein-Barr virus)
cuggcuccccau

SEQ ID NO: 1875184 - RNA, 12 nt, Human herpesvirus 4 (Epstein-Barr virus)
ucagcuccuugu

SEQ ID NO: 1875185 - RNA, 23 nt, Human herpesvirus 4 (Epstein-Barr virus)
gcgagcuccgugggcccagagug

SEQ ID NO: 1875186 - RNA, 18 nt, Human herpesvirus 4 (Epstein-Barr virus)
cuggcggccgcugcgccc

SEQ ID NO: 1875187 - RNA, 16 nt, Human herpesvirus 4 (Epstein-Barr virus)
cccaacagucuucagg

SEQ ID NO: 1875188 - RNA, 12 nt, Human herpesvirus 4 (Epstein-Barr virus)
ugaaggagggcu

SEQ ID NO: 1875189 - RNA, 14 nt, Human herpesvirus 4 (Epstein-Barr virus)
gcagaaaggcuggc

SEQ ID NO: 1875190 - RNA, 16 nt, Human herpesvirus 4 (Epstein-Barr virus)
cuccgcaguccggaga

SEQ ID NO: 1875191 - RNA, 21 nt, Human herpesvirus 4 (Epstein-Barr virus)
agcgcccugucccuggagcug

SEQ ID NO: 1875192 - RNA, 18 nt, Human herpesvirus 4 (Epstein-Barr virus)
cagggcuucguccagggg

SEQ ID NO: 1875193 - RNA, 18 nt, Human herpesvirus 4 (Epstein-Barr virus)
ggacccacgguggaacag

SEQ ID NO: 1875194 - RNA, 19 nt, Human herpesvirus 4 (Epstein-Barr virus)
cugccaacuuugagcuggg

SEQ ID NO: 1875195 - RNA, 17 nt, Human herpesvirus 4 (Epstein-Barr virus)
gcaggagcgggaggggc

SEQ ID NO: 1875196 - RNA, 17 nt, Human herpesvirus 4 (Epstein-Barr virus)
acgguggaacaggagca

SEQ ID NO: 1875197 - RNA, 21 nt, Human herpesvirus 4 (Epstein-Barr virus)
uccaccuagaaagagccaugg

SEQ ID NO: 1875198 - RNA, 21 nt, Human herpesvirus 4 (Epstein-Barr virus)
caagcagcaccugucccuggg

SEQ ID NO: 1875199 - RNA, 20 nt, Human herpesvirus 4 (Epstein-Barr virus)
ugggaauggagaggggagug

SEQ ID NO: 1875200 - RNA, 16 nt, Human herpesvirus 4 (Epstein-Barr virus)
cggggguucuccaggc

SEQ ID NO: 1875201 - RNA, 14 nt, Human herpesvirus 4 (Epstein-Barr virus)
acccaucugagggc

SEQ ID NO: 1875202 - RNA, 21 nt, Human herpesvirus 4 (Epstein-Barr virus)
ucugagagauugguaccagaa

SEQ ID NO: 1875203 - RNA, 15 nt, Human herpesvirus 4 (Epstein-Barr virus)
caggccuuagcccag

SEQ ID NO: 1875204 - RNA, 21 nt, Human herpesvirus 4 (Epstein-Barr virus)
gacgcagaaugugcagggauu

SEQ ID NO: 1875205 - RNA, 17 nt, Human herpesvirus 4 (Epstein-Barr virus)
gagcacauuccccccgc

SEQ ID NO: 1875206 - RNA, 19 nt, Human herpesvirus 4 (Epstein-Barr virus)
agaacccccugcaggacac

SEQ ID NO: 1875207 - RNA, 21 nt, Human herpesvirus 4 (Epstein-Barr virus)
gggaucuuuacguggguggau

SEQ ID NO: 1875208 - RNA, 18 nt, Human herpesvirus 4 (Epstein-Barr virus)
gggccuagguacucuugg

SEQ ID NO: 1875209 - RNA, 12 nt, Human herpesvirus 4 (Epstein-Barr virus)
cggcccucuucc

SEQ ID NO: 1875210 - RNA, 15 nt, Human herpesvirus 4 (Epstein-Barr virus)
acugcgggugucuca

SEQ ID NO: 1875211 - RNA, 21 nt, Human herpesvirus 4 (Epstein-Barr virus)
cccuugagaagcagcucuucu

SEQ ID NO: 1875212 - RNA, 18 nt, Human herpesvirus 4 (Epstein-Barr virus)
cagcgcggcagaggccuc

SEQ ID NO: 1875213 - RNA, 16 nt, Human herpesvirus 4 (Epstein-Barr virus)
cgguuagugugccucu

SEQ ID NO: 1875214 - RNA, 23 nt, Human herpesvirus 4 (Epstein-Barr virus)
acauucguacaucuccaggcgac

SEQ ID NO: 1875215 - RNA, 12 nt, Human herpesvirus 4 (Epstein-Barr virus)
cccacccccacc

SEQ ID NO: 1875216 - RNA, 15 nt, Human herpesvirus 4 (Epstein-Barr virus)
ccccgcaccagggcc

SEQ ID NO: 1875217 - RNA, 14 nt, Human herpesvirus 4 (Epstein-Barr virus)
cuguguccugggca

SEQ ID NO: 1875218 - RNA, 14 nt, Human herpesvirus 4 (Epstein-Barr virus)
cccucuccagcaac

SEQ ID NO: 1875219 - RNA, 23 nt, Human herpesvirus 4 (Epstein-Barr virus)
cucuacaauugccaaguacugaa

SEQ ID NO: 1875220 - RNA, 15 nt, Human herpesvirus 4 (Epstein-Barr virus)
cgucagccaggguga

SEQ ID NO: 1875221 - RNA, 13 nt, Human herpesvirus 4 (Epstein-Barr virus)
gccaggcucggca

SEQ ID NO: 1875222 - RNA, 22 nt, Human herpesvirus 4 (Epstein-Barr virus)
gaucgauuggaaaagggcccag

SEQ ID NO: 1875223 - RNA, 15 nt, Human herpesvirus 4 (Epstein-Barr virus)
uggguccccucugcc

SEQ ID NO: 1875224 - RNA, 20 nt, Human herpesvirus 4 (Epstein-Barr virus)
uaaugauucaucagaagcua

SEQ ID NO: 1875225 - RNA, 20 nt, Human herpesvirus 4 (Epstein-Barr virus)
cucuggcacgccguggcccu

SEQ ID NO: 1875226 - RNA, 16 nt, Human herpesvirus 4 (Epstein-Barr virus)
gcucgaauaugaugag

SEQ ID NO: 1875227 - RNA, 22 nt, Human herpesvirus 4 (Epstein-Barr virus)
cugcgugagaugaacaccccca

SEQ ID NO: 1875228 - RNA, 16 nt, Human herpesvirus 4 (Epstein-Barr virus)
cuugaccaguguguac

SEQ ID NO: 1875229 - RNA, 16 nt, Human herpesvirus 4 (Epstein-Barr virus)
cggcuuggcccucuca

SEQ ID NO: 1875230 - RNA, 18 nt, Human herpesvirus 4 (Epstein-Barr virus)
uagaaauuuugcauauuu

SEQ ID NO: 1875231 - RNA, 14 nt, Human herpesvirus 4 (Epstein-Barr virus)
acuauaccaaagcu

SEQ ID NO: 1875232 - RNA, 17 nt, Human herpesvirus 4 (Epstein-Barr virus)
aagaucgugaggccuga

SEQ ID NO: 1875233 - RNA, 17 nt, Human herpesvirus 4 (Epstein-Barr virus)
caucccggcccucuucc

SEQ ID NO: 1875234 - RNA, 14 nt, Human herpesvirus 4 (Epstein-Barr virus)
acuccucuuacacc

SEQ ID NO: 1875235 - RNA, 19 nt, Human herpesvirus 4 (Epstein-Barr virus)
ugagccugagccacaccca

SEQ ID NO: 1875236 - RNA, 12 nt, Human herpesvirus 4 (Epstein-Barr virus)
aacccccucccc

SEQ ID NO: 1875237 - RNA, 14 nt, Human herpesvirus 4 (Epstein-Barr virus)
agagcucuggagga

SEQ ID NO: 1875238 - RNA, 21 nt, Human herpesvirus 4 (Epstein-Barr virus)
gucgaugggcagcuauauuca

SEQ ID NO: 1875239 - RNA, 16 nt, Human herpesvirus 4 (Epstein-Barr virus)
caggagacacacgugg

SEQ ID NO: 1875240 - RNA, 13 nt, Human herpesvirus 4 (Epstein-Barr virus)
aaacgcugcuugg

SEQ ID NO: 1875241 - RNA, 19 nt, Human herpesvirus 4 (Epstein-Barr virus)
guggccuuccucugccugg

SEQ ID NO: 1875242 - RNA, 12 nt, Human herpesvirus 4 (Epstein-Barr virus)
gaccacugaggg

SEQ ID NO: 1875243 - RNA, 14 nt, Human herpesvirus 4 (Epstein-Barr virus)
gcugaacuggggcu

SEQ ID NO: 1875244 - RNA, 14 nt, Human herpesvirus 4 (Epstein-Barr virus)
accaagcuaccaga

SEQ ID NO: 1875245 - RNA, 18 nt, Human herpesvirus 4 (Epstein-Barr virus)
ccgccaacgcucagugcg

SEQ ID NO: 1875246 - RNA, 18 nt, Human herpesvirus 4 (Epstein-Barr virus)
cggggguggaggcugcgc

SEQ ID NO: 1875247 - RNA, 21 nt, Human herpesvirus 4 (Epstein-Barr virus)
cucacuucuacucuuggcagc

SEQ ID NO: 1875248 - RNA, 13 nt, Human herpesvirus 4 (Epstein-Barr virus)
cagaagcccccaa

SEQ ID NO: 1875249 - RNA, 20 nt, Human herpesvirus 4 (Epstein-Barr virus)
cugaacaucucauccccaga

SEQ ID NO: 1875250 - RNA, 22 nt, Human herpesvirus 4 (Epstein-Barr virus)
ugcccaccagagggugagccca

SEQ ID NO: 1875251 - RNA, 19 nt, Human herpesvirus 4 (Epstein-Barr virus)
gcccgacccccgggcgccc

SEQ ID NO: 1875252 - RNA, 23 nt, Human herpesvirus 4 (Epstein-Barr virus)
gccccgcccuccccauccccagc

SEQ ID NO: 1875253 - RNA, 17 nt, Human herpesvirus 4 (Epstein-Barr virus)
ucagauagccggaccuc

SEQ ID NO: 1875254 - RNA, 16 nt, Human herpesvirus 4 (Epstein-Barr virus)
gcuugcgucugccccc

SEQ ID NO: 1875255 - RNA, 17 nt, Human herpesvirus 4 (Epstein-Barr virus)
ccuggccgggcgccugc

SEQ ID NO: 1875256 - RNA, 23 nt, Human herpesvirus 4 (Epstein-Barr virus)
gcaggacggggggcuggcgaaga

SEQ ID NO: 1875257 - RNA, 18 nt, Human herpesvirus 4 (Epstein-Barr virus)
ccucauucccccaugaga

SEQ ID NO: 1875258 - RNA, 23 nt, Human herpesvirus 4 (Epstein-Barr virus)
uacugcagugggccucucuggcu

SEQ ID NO: 1875259 - RNA, 16 nt, Human herpesvirus 4 (Epstein-Barr virus)
ugccccucagccugcu

SEQ ID NO: 1875260 - RNA, 17 nt, Human herpesvirus 4 (Epstein-Barr virus)
uaggcacaucuggaccu

SEQ ID NO: 1875261 - RNA, 17 nt, Human herpesvirus 4 (Epstein-Barr virus)
gcagcuggacgcgcagu

SEQ ID NO: 1875262 - RNA, 21 nt, Human herpesvirus 4 (Epstein-Barr virus)
uggacacuuauguuucaagca

SEQ ID NO: 1875263 - RNA, 16 nt, Human herpesvirus 4 (Epstein-Barr virus)
ugggaggcgaauguag

SEQ ID NO: 1875264 - RNA, 14 nt, Human herpesvirus 4 (Epstein-Barr virus)
aggugcugaggccc

SEQ ID NO: 1875265 - RNA, 22 nt, Human herpesvirus 4 (Epstein-Barr virus)
agcaggaggaggggcaggagca

SEQ ID NO: 1875266 - RNA, 17 nt, Human herpesvirus 4 (Epstein-Barr virus)
gucuucccagacucugc

SEQ ID NO: 1875267 - RNA, 16 nt, Human herpesvirus 4 (Epstein-Barr virus)
caggagcaggagcagg

SEQ ID NO: 1875268 - RNA, 16 nt, Human herpesvirus 4 (Epstein-Barr virus)
gccuccucgcaggccc

SEQ ID NO: 1875269 - RNA, 16 nt, Human herpesvirus 4 (Epstein-Barr virus)
gagaaaaugagccaug

SEQ ID NO: 1875270 - RNA, 15 nt, Human herpesvirus 4 (Epstein-Barr virus)
cgggcacugcgucca

SEQ ID NO: 1875271 - RNA, 22 nt, Human herpesvirus 4 (Epstein-Barr virus)
cuauuagcagccuccgggccgc

SEQ ID NO: 1875272 - RNA, 16 nt, Human herpesvirus 4 (Epstein-Barr virus)
ccaggccuuagcccag

SEQ ID NO: 1875273 - RNA, 15 nt, Human herpesvirus 4 (Epstein-Barr virus)
aaggccacaaagagg

SEQ ID NO: 1875274 - RNA, 21 nt, Human herpesvirus 4 (Epstein-Barr virus)
cugagcauggcggccuggcag

SEQ ID NO: 1875275 - RNA, 17 nt, Human herpesvirus 4 (Epstein-Barr virus)
cccuaagcagcugaggg

SEQ ID NO: 1875276 - RNA, 23 nt, Human herpesvirus 4 (Epstein-Barr virus)
uacuggcuuucguccucuggcuc

SEQ ID NO: 1875277 - RNA, 19 nt, Human herpesvirus 4 (Epstein-Barr virus)
uccccucugcagagagcca

SEQ ID NO: 1875278 - RNA, 18 nt, Human herpesvirus 4 (Epstein-Barr virus)
cgucacucggacuaucaa

SEQ ID NO: 1875279 - RNA, 16 nt, Human herpesvirus 4 (Epstein-Barr virus)
cggccgaggccugcga

SEQ ID NO: 1875280 - RNA, 15 nt, Human herpesvirus 4 (Epstein-Barr virus)
ugacccacuccagug

SEQ ID NO: 1875281 - RNA, 17 nt, Human herpesvirus 4 (Epstein-Barr virus)
ggcaccauagcauguca

SEQ ID NO: 1875282 - RNA, 18 nt, Human herpesvirus 4 (Epstein-Barr virus)
cgggcaucuuaucagaga

SEQ ID NO: 1875283 - RNA, 17 nt, Human herpesvirus 4 (Epstein-Barr virus)
ugaccacggcccacguc

SEQ ID NO: 1875284 - RNA, 14 nt, Human herpesvirus 4 (Epstein-Barr virus)
ccaccaccuccacc

SEQ ID NO: 1875285 - RNA, 15 nt, Human herpesvirus 4 (Epstein-Barr virus)
agagccucugccaca

SEQ ID NO: 1875286 - RNA, 19 nt, Human herpesvirus 4 (Epstein-Barr virus)
gcccagccguucacucggc

SEQ ID NO: 1875287 - RNA, 15 nt, Human herpesvirus 4 (Epstein-Barr virus)
ccaccauaugaugac

SEQ ID NO: 1875288 - RNA, 14 nt, Human herpesvirus 4 (Epstein-Barr virus)
caacugcgggcucc

SEQ ID NO: 1875289 - RNA, 17 nt, Human herpesvirus 4 (Epstein-Barr virus)
cugccagagccucugcc

SEQ ID NO: 1875290 - RNA, 15 nt, Human herpesvirus 4 (Epstein-Barr virus)
cuggaucuggggcug

SEQ ID NO: 1875291 - RNA, 14 nt, Human herpesvirus 4 (Epstein-Barr virus)
cuggagcuggugca

SEQ ID NO: 1875292 - RNA, 17 nt, Human herpesvirus 4 (Epstein-Barr virus)
ugcagggugcacagacu

SEQ ID NO: 1875293 - RNA, 19 nt, Human herpesvirus 4 (Epstein-Barr virus)
aggcccgggggccuugucc

SEQ ID NO: 1875294 - RNA, 14 nt, Human herpesvirus 4 (Epstein-Barr virus)
ccggcaccgccagg

SEQ ID NO: 1875295 - RNA, 12 nt, Human herpesvirus 4 (Epstein-Barr virus)
ggaguuucgcuu

SEQ ID NO: 1875296 - RNA, 11 nt, Human herpesvirus 4 (Epstein-Barr virus)
ggccuggugcc

SEQ ID NO: 1875297 - RNA, 13 nt, Human herpesvirus 4 (Epstein-Barr virus)
aagacuccugccu

SEQ ID NO: 1875298 - RNA, 14 nt, Human herpesvirus 4 (Epstein-Barr virus)
ggcagacacccacg

SEQ ID NO: 1875299 - RNA, 14 nt, Human herpesvirus 4 (Epstein-Barr virus)
ugaugguggccggc

SEQ ID NO: 1875300 - RNA, 19 nt, Human herpesvirus 4 (Epstein-Barr virus)
gcacuuuauuaauaaacaa

SEQ ID NO: 1875301 - RNA, 14 nt, Human herpesvirus 4 (Epstein-Barr virus)
ccgcagcuggcgga

SEQ ID NO: 1875302 - RNA, 14 nt, Human herpesvirus 4 (Epstein-Barr virus)
auggcauaauuucc

SEQ ID NO: 1875303 - RNA, 23 nt, Human herpesvirus 4 (Epstein-Barr virus)
cacaggcuuggaaacacccauuc

SEQ ID NO: 1875304 - RNA, 18 nt, Human herpesvirus 4 (Epstein-Barr virus)
cccacggaagcccucugg

SEQ ID NO: 1875305 - RNA, 22 nt, Human herpesvirus 4 (Epstein-Barr virus)
ccaggagccccgggcggcucag

SEQ ID NO: 1875306 - RNA, 19 nt, Human herpesvirus 4 (Epstein-Barr virus)
gcucaugcacaccuuggcg

SEQ ID NO: 1875307 - RNA, 13 nt, Human herpesvirus 4 (Epstein-Barr virus)
cucagagcuggga

SEQ ID NO: 1875308 - RNA, 21 nt, Human herpesvirus 4 (Epstein-Barr virus)
gacaaggcaguagaggacacc

SEQ ID NO: 1875309 - RNA, 16 nt, Human herpesvirus 4 (Epstein-Barr virus)
gcgacauuuaccuggu

SEQ ID NO: 1875310 - RNA, 18 nt, Human herpesvirus 4 (Epstein-Barr virus)
accggcaccgccaggugg

SEQ ID NO: 1875311 - RNA, 14 nt, Human herpesvirus 4 (Epstein-Barr virus)
gcagucgcugcugc

SEQ ID NO: 1875312 - RNA, 15 nt, Human herpesvirus 4 (Epstein-Barr virus)
uguuccacagccugc

SEQ ID NO: 1875313 - RNA, 16 nt, Human herpesvirus 4 (Epstein-Barr virus)
cuugguauugcgcugg

SEQ ID NO: 1875314 - RNA, 15 nt, Human herpesvirus 4 (Epstein-Barr virus)
cgaaggugcagcugg

SEQ ID NO: 1875315 - RNA, 17 nt, Human herpesvirus 4 (Epstein-Barr virus)
aaggcuccggccccacg

SEQ ID NO: 1875316 - RNA, 16 nt, Human herpesvirus 4 (Epstein-Barr virus)
guacaggaccuggaaa

SEQ ID NO: 1875317 - RNA, 12 nt, Human herpesvirus 4 (Epstein-Barr virus)
ugcagacuccag

SEQ ID NO: 1875318 - RNA, 21 nt, Human herpesvirus 4 (Epstein-Barr virus)
aacuggggcugguggccuggg

SEQ ID NO: 1875319 - RNA, 12 nt, Human herpesvirus 4 (Epstein-Barr virus)
cuggcacacacu

SEQ ID NO: 1875320 - RNA, 16 nt, Human herpesvirus 4 (Epstein-Barr virus)
cccacggaccccccuc

SEQ ID NO: 1875321 - RNA, 18 nt, Human herpesvirus 4 (Epstein-Barr virus)
cccugugcagggacgagg

SEQ ID NO: 1875322 - RNA, 23 nt, Human herpesvirus 4 (Epstein-Barr virus)
aggcuccuggaucuggggcuggc

SEQ ID NO: 1875323 - RNA, 21 nt, Human herpesvirus 4 (Epstein-Barr virus)
cccuagccaccguggccaggc

SEQ ID NO: 1875324 - RNA, 16 nt, Human herpesvirus 4 (Epstein-Barr virus)
gcuauagugagccagg

SEQ ID NO: 1875325 - RNA, 14 nt, Human herpesvirus 4 (Epstein-Barr virus)
auagccggccaggc

SEQ ID NO: 1875326 - RNA, 18 nt, Human herpesvirus 4 (Epstein-Barr virus)
ccugccucucuuaugccu

SEQ ID NO: 1875327 - RNA, 17 nt, Human herpesvirus 4 (Epstein-Barr virus)
ugucccuuucagugguc

SEQ ID NO: 1875328 - RNA, 19 nt, Human herpesvirus 4 (Epstein-Barr virus)
gcacacuuaacuugacuac

SEQ ID NO: 1875329 - RNA, 22 nt, Human herpesvirus 4 (Epstein-Barr virus)
agaggucccauguacagcacaa

SEQ ID NO: 1875330 - RNA, 15 nt, Human herpesvirus 4 (Epstein-Barr virus)
ggugcuguccugcug

SEQ ID NO: 1875331 - RNA, 16 nt, Human herpesvirus 4 (Epstein-Barr virus)
agccccuccauaggcc

SEQ ID NO: 1875332 - RNA, 17 nt, Human herpesvirus 4 (Epstein-Barr virus)
gccccgggcccagcccu

SEQ ID NO: 1875333 - RNA, 13 nt, Human herpesvirus 4 (Epstein-Barr virus)
cugacggugaugu

SEQ ID NO: 1875334 - RNA, 14 nt, Human herpesvirus 4 (Epstein-Barr virus)
cugacgaggggcca

SEQ ID NO: 1875335 - RNA, 17 nt, Human herpesvirus 4 (Epstein-Barr virus)
cacuguugcgcccggcc

SEQ ID NO: 1875336 - RNA, 13 nt, Human herpesvirus 4 (Epstein-Barr virus)
ccccugugcuucu

SEQ ID NO: 1875337 - RNA, 21 nt, Human herpesvirus 4 (Epstein-Barr virus)
ccucgugcaaccaggcccacu

SEQ ID NO: 1875338 - RNA, 14 nt, Human herpesvirus 4 (Epstein-Barr virus)
gccguggcgccugg

SEQ ID NO: 1875339 - RNA, 20 nt, Human herpesvirus 4 (Epstein-Barr virus)
acagccagguguacgcccug

SEQ ID NO: 1875340 - RNA, 17 nt, Human herpesvirus 4 (Epstein-Barr virus)
cugucucggccuccugg

SEQ ID NO: 1875341 - RNA, 13 nt, Human herpesvirus 4 (Epstein-Barr virus)
cugggguccagga

SEQ ID NO: 1875342 - RNA, 18 nt, Human herpesvirus 4 (Epstein-Barr virus)
gacacuuuagagcucugg

SEQ ID NO: 1875343 - RNA, 19 nt, Human herpesvirus 4 (Epstein-Barr virus)
ggcccucagaauuucugcu

SEQ ID NO: 1875344 - RNA, 20 nt, Human herpesvirus 4 (Epstein-Barr virus)
ccuuugggcaccccacgggg

SEQ ID NO: 1875345 - RNA, 14 nt, Human herpesvirus 4 (Epstein-Barr virus)
acaugucucagagg

SEQ ID NO: 1875346 - RNA, 18 nt, Human herpesvirus 4 (Epstein-Barr virus)
cgcggacuccgugaccaa

SEQ ID NO: 1875347 - RNA, 15 nt, Human herpesvirus 4 (Epstein-Barr virus)
gcaccugucccuggg

SEQ ID NO: 1875348 - RNA, 22 nt, Human herpesvirus 4 (Epstein-Barr virus)
ucaccugcacagaucugaccac

SEQ ID NO: 1875349 - RNA, 15 nt, Human herpesvirus 4 (Epstein-Barr virus)
gcggcacuguggggg

SEQ ID NO: 1875350 - RNA, 16 nt, Human herpesvirus 4 (Epstein-Barr virus)
uugaggcaauggccac

SEQ ID NO: 1875351 - RNA, 17 nt, Human herpesvirus 4 (Epstein-Barr virus)
cgggcaaacagggcaga

SEQ ID NO: 1875352 - RNA, 19 nt, Human herpesvirus 4 (Epstein-Barr virus)
agcgggaggggcaggagca

SEQ ID NO: 1875353 - RNA, 12 nt, Human herpesvirus 4 (Epstein-Barr virus)
cgccagccaccc

SEQ ID NO: 1875354 - RNA, 14 nt, Human herpesvirus 4 (Epstein-Barr virus)
gagcggcaagggcu

SEQ ID NO: 1875355 - RNA, 18 nt, Human herpesvirus 4 (Epstein-Barr virus)
gagacacaucuggaccag

SEQ ID NO: 1875356 - RNA, 23 nt, Human herpesvirus 4 (Epstein-Barr virus)
uggagagauuucauccucagagg

SEQ ID NO: 1875357 - RNA, 18 nt, Human herpesvirus 4 (Epstein-Barr virus)
aggcucugcaugaggucc

SEQ ID NO: 1875358 - RNA, 17 nt, Human herpesvirus 4 (Epstein-Barr virus)
cgagaagacguuguagg

SEQ ID NO: 1875359 - RNA, 17 nt, Human herpesvirus 4 (Epstein-Barr virus)
gcagcugaguccccucc

SEQ ID NO: 1875360 - RNA, 17 nt, Human herpesvirus 4 (Epstein-Barr virus)
gcuuucguccucuggcu

SEQ ID NO: 1875361 - RNA, 20 nt, Human herpesvirus 4 (Epstein-Barr virus)
gguggcauugcggguggaua

SEQ ID NO: 1875362 - RNA, 15 nt, Human herpesvirus 4 (Epstein-Barr virus)
ccuuguccgcugggc

SEQ ID NO: 1875363 - RNA, 15 nt, Human herpesvirus 4 (Epstein-Barr virus)
gccauggccgagaag

SEQ ID NO: 1875364 - RNA, 20 nt, Human herpesvirus 4 (Epstein-Barr virus)
cuucgaggucuccccugacg

SEQ ID NO: 1875365 - RNA, 20 nt, Human herpesvirus 4 (Epstein-Barr virus)
ucuacugccuuguccacugg

SEQ ID NO: 1875366 - RNA, 13 nt, Human herpesvirus 4 (Epstein-Barr virus)
gccaacuccccca

SEQ ID NO: 1875367 - RNA, 18 nt, Human herpesvirus 4 (Epstein-Barr virus)
gugaugaaaacagaggcu

SEQ ID NO: 1875368 - RNA, 19 nt, Human herpesvirus 4 (Epstein-Barr virus)
guuucuguggcugccgaag

SEQ ID NO: 1875369 - RNA, 15 nt, Human herpesvirus 4 (Epstein-Barr virus)
cgcccaguaugcagu

SEQ ID NO: 1875370 - RNA, 19 nt, Human herpesvirus 4 (Epstein-Barr virus)
gaaggaacggcggagagua

SEQ ID NO: 1875371 - RNA, 13 nt, Human herpesvirus 4 (Epstein-Barr virus)
uccuucuuggccu

SEQ ID NO: 1875372 - RNA, 19 nt, Human herpesvirus 4 (Epstein-Barr virus)
agcgaagcagcuccgcccu

SEQ ID NO: 1875373 - RNA, 18 nt, Human herpesvirus 4 (Epstein-Barr virus)
ccucagaauuucugcuag

SEQ ID NO: 1875374 - RNA, 14 nt, Human herpesvirus 4 (Epstein-Barr virus)
ccugaccaucacau

SEQ ID NO: 1875375 - RNA, 14 nt, Human herpesvirus 4 (Epstein-Barr virus)
ccuuuacccagccc

SEQ ID NO: 1875376 - RNA, 20 nt, Human herpesvirus 4 (Epstein-Barr virus)
gggaucaugaagcccccagg

SEQ ID NO: 1875377 - RNA, 13 nt, Human herpesvirus 4 (Epstein-Barr virus)
gcaggugagggug

SEQ ID NO: 1875378 - RNA, 18 nt, Human herpesvirus 4 (Epstein-Barr virus)
ggagcaggaggaggggca

SEQ ID NO: 1875379 - RNA, 18 nt, Human herpesvirus 4 (Epstein-Barr virus)
ggccacggcgugccagag

SEQ ID NO: 1875380 - RNA, 17 nt, Human herpesvirus 4 (Epstein-Barr virus)
accugcucucucuggag

SEQ ID NO: 1875381 - RNA, 15 nt, Human herpesvirus 4 (Epstein-Barr virus)
ccucuuuguggccuu

SEQ ID NO: 1875382 - RNA, 19 nt, Human herpesvirus 4 (Epstein-Barr virus)
guccucuacugccuugucc

SEQ ID NO: 1875383 - RNA, 14 nt, Human herpesvirus 4 (Epstein-Barr virus)
caggaggaaaggcu

SEQ ID NO: 1875384 - RNA, 22 nt, Human herpesvirus 4 (Epstein-Barr virus)
uggaccaagggcagggcaaugg

SEQ ID NO: 1875385 - RNA, 18 nt, Human herpesvirus 4 (Epstein-Barr virus)
ucucaggcuaugaagaag

SEQ ID NO: 1875386 - RNA, 17 nt, Human herpesvirus 4 (Epstein-Barr virus)
gaacucgagagaggccu

SEQ ID NO: 1875387 - RNA, 15 nt, Human herpesvirus 4 (Epstein-Barr virus)
caacugucacaccag

SEQ ID NO: 1875388 - RNA, 12 nt, Human herpesvirus 4 (Epstein-Barr virus)
ccggggcccacg

SEQ ID NO: 1875389 - RNA, 19 nt, Human herpesvirus 4 (Epstein-Barr virus)
cuuuguccagauguccagg

SEQ ID NO: 1875390 - RNA, 22 nt, Human herpesvirus 4 (Epstein-Barr virus)
aacgggggaaggaaaggccugc

SEQ ID NO: 1875391 - RNA, 12 nt, Human herpesvirus 4 (Epstein-Barr virus)
ucagcacuuugc

SEQ ID NO: 1875392 - RNA, 13 nt, Human herpesvirus 4 (Epstein-Barr virus)
ugggaccggggcc

SEQ ID NO: 1875393 - RNA, 19 nt, Human herpesvirus 4 (Epstein-Barr virus)
ccucggagaucaucccacu

SEQ ID NO: 1875394 - RNA, 16 nt, Human herpesvirus 4 (Epstein-Barr virus)
uccucugccuggccgg

SEQ ID NO: 1875395 - RNA, 23 nt, Human herpesvirus 4 (Epstein-Barr virus)
cccagagggcgaaugggcugcag

SEQ ID NO: 1875396 - RNA, 16 nt, Human herpesvirus 4 (Epstein-Barr virus)
ggccagguagcccagc

SEQ ID NO: 1875397 - RNA, 16 nt, Human herpesvirus 4 (Epstein-Barr virus)
uggcucuccuguguga

SEQ ID NO: 1875398 - RNA, 14 nt, Human herpesvirus 4 (Epstein-Barr virus)
ucugauggccugga

SEQ ID NO: 1875399 - RNA, 19 nt, Human herpesvirus 4 (Epstein-Barr virus)
gcgugaagucgguguccag

SEQ ID NO: 1875400 - RNA, 21 nt, Human herpesvirus 4 (Epstein-Barr virus)
cugauuuuccucauuggcuuu

SEQ ID NO: 1875401 - RNA, 21 nt, Human herpesvirus 4 (Epstein-Barr virus)
agaaaacucugcauggagaag

SEQ ID NO: 1875402 - RNA, 22 nt, Human herpesvirus 4 (Epstein-Barr virus)
guuguagguguccagcgcucug

SEQ ID NO: 1875403 - RNA, 15 nt, Human herpesvirus 4 (Epstein-Barr virus)
ggcgucucaggcuau

SEQ ID NO: 1875404 - RNA, 23 nt, Human herpesvirus 4 (Epstein-Barr virus)
aagucccgggggaggagaagaga

SEQ ID NO: 1875405 - RNA, 22 nt, Human herpesvirus 4 (Epstein-Barr virus)
uuaccaugucauaggcuugccu

SEQ ID NO: 1875406 - RNA, 16 nt, Human herpesvirus 4 (Epstein-Barr virus)
gugcgcggaaucagga

SEQ ID NO: 1875407 - RNA, 15 nt, Human herpesvirus 4 (Epstein-Barr virus)
ccaaagcuaacugua

SEQ ID NO: 1875408 - RNA, 22 nt, Human herpesvirus 4 (Epstein-Barr virus)
gauagcauggccgccagaguuc

SEQ ID NO: 1875409 - RNA, 23 nt, Human herpesvirus 4 (Epstein-Barr virus)
ugcucaaggcagucuccaccuuu

SEQ ID NO: 1875410 - RNA, 13 nt, Human herpesvirus 4 (Epstein-Barr virus)
ccggcggcagugg

SEQ ID NO: 1875411 - RNA, 20 nt, Human herpesvirus 4 (Epstein-Barr virus)
cuuggggguggugggcuccu

SEQ ID NO: 1875412 - RNA, 19 nt, Human herpesvirus 4 (Epstein-Barr virus)
acaaacucucucaucucca

SEQ ID NO: 1875413 - RNA, 16 nt, Human herpesvirus 4 (Epstein-Barr virus)
uugcgccgccuccccc

SEQ ID NO: 1875414 - RNA, 20 nt, Human herpesvirus 4 (Epstein-Barr virus)
cagucuauccaggaggagga

SEQ ID NO: 1875415 - RNA, 14 nt, Human herpesvirus 4 (Epstein-Barr virus)
gcugagugcccagg

SEQ ID NO: 1875416 - RNA, 21 nt, Human herpesvirus 4 (Epstein-Barr virus)
gagugcccuggaggccucagg

SEQ ID NO: 1875417 - RNA, 17 nt, Human herpesvirus 4 (Epstein-Barr virus)
cgguggugggcugcuga

SEQ ID NO: 1875418 - RNA, 23 nt, Human herpesvirus 4 (Epstein-Barr virus)
cauaacugagcagggcaaagcca

SEQ ID NO: 1875419 - RNA, 13 nt, Human herpesvirus 4 (Epstein-Barr virus)
cuaguuaccacag

SEQ ID NO: 1875420 - RNA, 16 nt, Human herpesvirus 4 (Epstein-Barr virus)
gcccggccgaggccug

SEQ ID NO: 1875421 - RNA, 20 nt, Human herpesvirus 4 (Epstein-Barr virus)
cacucuggggucucaggccu

SEQ ID NO: 1875422 - RNA, 14 nt, Human herpesvirus 4 (Epstein-Barr virus)
guaacaggugggac

SEQ ID NO: 1875423 - RNA, 21 nt, Human herpesvirus 4 (Epstein-Barr virus)
acugggaugaacccuggggca

SEQ ID NO: 1875424 - RNA, 21 nt, Human herpesvirus 4 (Epstein-Barr virus)
agggcccguuccaggcucucc

SEQ ID NO: 1875425 - RNA, 15 nt, Human herpesvirus 4 (Epstein-Barr virus)
uaacucuuaaaacuu

SEQ ID NO: 1875426 - RNA, 15 nt, Human herpesvirus 4 (Epstein-Barr virus)
cuaguugguccaggg

SEQ ID NO: 1875427 - RNA, 16 nt, Human herpesvirus 4 (Epstein-Barr virus)
aguaaaagcagaacag

SEQ ID NO: 1875428 - RNA, 20 nt, Human herpesvirus 4 (Epstein-Barr virus)
ggagcaggaggggcaggagc

SEQ ID NO: 1875429 - RNA, 18 nt, Human herpesvirus 4 (Epstein-Barr virus)
agggcugguuggggagcu

SEQ ID NO: 1875430 - RNA, 21 nt, Human herpesvirus 4 (Epstein-Barr virus)
cacucaggaagcuggccaggc

SEQ ID NO: 1875431 - RNA, 21 nt, Human herpesvirus 4 (Epstein-Barr virus)
gcggcagcggaugguggggcu

SEQ ID NO: 1875432 - RNA, 12 nt, Human herpesvirus 4 (Epstein-Barr virus)
caaacacuacaa

SEQ ID NO: 1875433 - RNA, 15 nt, Human herpesvirus 4 (Epstein-Barr virus)
ccauguaagccugcc

SEQ ID NO: 1875434 - RNA, 14 nt, Human herpesvirus 4 (Epstein-Barr virus)
aaucaccuuaacug

SEQ ID NO: 1875435 - RNA, 20 nt, Human herpesvirus 4 (Epstein-Barr virus)
augcacggucauucugccgu

SEQ ID NO: 1875436 - RNA, 22 nt, Human herpesvirus 4 (Epstein-Barr virus)
cuccauuuacugggaaugccuu

SEQ ID NO: 1875437 - RNA, 16 nt, Human herpesvirus 4 (Epstein-Barr virus)
ugccuccagagccccu

SEQ ID NO: 1875438 - RNA, 14 nt, Human herpesvirus 4 (Epstein-Barr virus)
gugugcgcgccgcc

SEQ ID NO: 1875439 - RNA, 22 nt, Human herpesvirus 4 (Epstein-Barr virus)
acagcuagcagacauugguguu

SEQ ID NO: 1875440 - RNA, 18 nt, Human herpesvirus 4 (Epstein-Barr virus)
cggcuggccgccguggcc

SEQ ID NO: 1875441 - RNA, 13 nt, Human herpesvirus 4 (Epstein-Barr virus)
gaacccuggggca

SEQ ID NO: 1875442 - RNA, 16 nt, Human herpesvirus 4 (Epstein-Barr virus)
caagcagcucaccuau

SEQ ID NO: 1875443 - RNA, 17 nt, Human herpesvirus 4 (Epstein-Barr virus)
cacggggugcucccccu

SEQ ID NO: 1875444 - RNA, 16 nt, Human herpesvirus 4 (Epstein-Barr virus)
cuguguacgugccuca

SEQ ID NO: 1875445 - RNA, 15 nt, Human herpesvirus 4 (Epstein-Barr virus)
gccagaucuaaggcc

SEQ ID NO: 1875446 - RNA, 15 nt, Human herpesvirus 4 (Epstein-Barr virus)
aggagcuugaggcca

SEQ ID NO: 1875447 - RNA, 16 nt, Human herpesvirus 4 (Epstein-Barr virus)
ucccggcacaccagac

SEQ ID NO: 1875448 - RNA, 18 nt, Human herpesvirus 4 (Epstein-Barr virus)
ggggauuacccgacccag

SEQ ID NO: 1875449 - RNA, 18 nt, Human herpesvirus 4 (Epstein-Barr virus)
cagcaaaaccagcccggg

SEQ ID NO: 1875450 - RNA, 19 nt, Human herpesvirus 4 (Epstein-Barr virus)
ucuaaaaaucaaaacuuua

SEQ ID NO: 1875451 - RNA, 19 nt, Human herpesvirus 4 (Epstein-Barr virus)
aguacaggauuauugccaa

SEQ ID NO: 1875452 - RNA, 21 nt, Human herpesvirus 4 (Epstein-Barr virus)
gaggaacggugauuaggcacu

SEQ ID NO: 1875453 - RNA, 19 nt, Human herpesvirus 4 (Epstein-Barr virus)
uacacugaauuuagccuga

SEQ ID NO: 1875454 - RNA, 17 nt, Human herpesvirus 4 (Epstein-Barr virus)
agcccagaggaggcccc

SEQ ID NO: 1875455 - RNA, 17 nt, Human herpesvirus 4 (Epstein-Barr virus)
ggccaucauggccgacg

SEQ ID NO: 1875456 - RNA, 13 nt, Human herpesvirus 4 (Epstein-Barr virus)
ugagucucucgag

SEQ ID NO: 1875457 - RNA, 14 nt, Human herpesvirus 4 (Epstein-Barr virus)
ccugucggcccugc

SEQ ID NO: 1875458 - RNA, 18 nt, Human herpesvirus 4 (Epstein-Barr virus)
uucagcuccagggccagc

SEQ ID NO: 1875459 - RNA, 16 nt, Human herpesvirus 4 (Epstein-Barr virus)
aucuuugacugacaca

SEQ ID NO: 1875460 - RNA, 12 nt, Human herpesvirus 4 (Epstein-Barr virus)
augacucaucuc

SEQ ID NO: 1875461 - RNA, 17 nt, Human herpesvirus 4 (Epstein-Barr virus)
uccuagcacaaaccagu

SEQ ID NO: 1875462 - RNA, 17 nt, Human herpesvirus 4 (Epstein-Barr virus)
cuacugccuuacacugg

SEQ ID NO: 1875463 - RNA, 16 nt, Human herpesvirus 4 (Epstein-Barr virus)
ccuggcggcccagccc

SEQ ID NO: 1875464 - RNA, 11 nt, Human herpesvirus 4 (Epstein-Barr virus)
caacugcugca

SEQ ID NO: 1875465 - RNA, 21 nt, Human herpesvirus 4 (Epstein-Barr virus)
gggaugggcuugauggcccug

SEQ ID NO: 1875466 - RNA, 13 nt, Human herpesvirus 4 (Epstein-Barr virus)
aagcaauaaagua

SEQ ID NO: 1875467 - RNA, 19 nt, Human herpesvirus 4 (Epstein-Barr virus)
cacagguagcaaggacccg

SEQ ID NO: 1875468 - RNA, 12 nt, Human herpesvirus 4 (Epstein-Barr virus)
uaagaccaaggc

SEQ ID NO: 1875469 - RNA, 12 nt, Human herpesvirus 4 (Epstein-Barr virus)
uuggcagacacc

SEQ ID NO: 1875470 - RNA, 15 nt, Human herpesvirus 4 (Epstein-Barr virus)
cagugucuggcggcc

SEQ ID NO: 1875471 - RNA, 13 nt, Human herpesvirus 4 (Epstein-Barr virus)
gaagaggacgagg

SEQ ID NO: 1875472 - RNA, 18 nt, Human herpesvirus 4 (Epstein-Barr virus)
cagcccuuuuuccagugg

SEQ ID NO: 1875473 - RNA, 23 nt, Human herpesvirus 4 (Epstein-Barr virus)
uauaaauuacuggcgugaauugu

SEQ ID NO: 1875474 - RNA, 12 nt, Human herpesvirus 4 (Epstein-Barr virus)
aggagagcugga

SEQ ID NO: 1875475 - RNA, 14 nt, Human herpesvirus 4 (Epstein-Barr virus)
cguggcgccugggg

SEQ ID NO: 1875476 - RNA, 14 nt, Human herpesvirus 4 (Epstein-Barr virus)
ucuucccagacucu

SEQ ID NO: 1875477 - RNA, 15 nt, Human herpesvirus 4 (Epstein-Barr virus)
cccggcccucuuccg

SEQ ID NO: 1875478 - RNA, 18 nt, Human herpesvirus 4 (Epstein-Barr virus)
gcaagauccuucuggcac

SEQ ID NO: 1875479 - RNA, 16 nt, Human herpesvirus 4 (Epstein-Barr virus)
aaagucccgagcggcc

SEQ ID NO: 1875480 - RNA, 18 nt, Human herpesvirus 4 (Epstein-Barr virus)
ucaucuggcucuccugug

SEQ ID NO: 1875481 - RNA, 20 nt, Human herpesvirus 4 (Epstein-Barr virus)
gcccccaaaaguagaggcuc

SEQ ID NO: 1875482 - RNA, 19 nt, Human herpesvirus 4 (Epstein-Barr virus)
cuccaaucaccagccaccu

SEQ ID NO: 1875483 - RNA, 22 nt, Human herpesvirus 4 (Epstein-Barr virus)
cagggggcagucugagaaccug

SEQ ID NO: 1875484 - RNA, 20 nt, Human herpesvirus 4 (Epstein-Barr virus)
cugcacgagaccccugggcu

SEQ ID NO: 1875485 - RNA, 21 nt, Human herpesvirus 4 (Epstein-Barr virus)
ucccacuuuuaccccaguccc

SEQ ID NO: 1875486 - RNA, 14 nt, Human herpesvirus 4 (Epstein-Barr virus)
cggaagcccucugg

SEQ ID NO: 1875487 - RNA, 18 nt, Human herpesvirus 4 (Epstein-Barr virus)
uggacccuauggagggca

SEQ ID NO: 1875488 - RNA, 14 nt, Human herpesvirus 4 (Epstein-Barr virus)
cacacgcucagcuc

SEQ ID NO: 1875489 - RNA, 21 nt, Human herpesvirus 4 (Epstein-Barr virus)
uccgcagccgcugaagccagg

SEQ ID NO: 1875490 - RNA, 17 nt, Human herpesvirus 4 (Epstein-Barr virus)
ccuagagguuuugcuag

SEQ ID NO: 1875491 - RNA, 23 nt, Human herpesvirus 4 (Epstein-Barr virus)
uaugguaaggcucuucgggcaag

SEQ ID NO: 1875492 - RNA, 23 nt, Human herpesvirus 4 (Epstein-Barr virus)
cugaacaucucauccccagaggg

SEQ ID NO: 1875493 - RNA, 14 nt, Human herpesvirus 4 (Epstein-Barr virus)
gaucuuugacugac

SEQ ID NO: 1875494 - RNA, 20 nt, Human herpesvirus 4 (Epstein-Barr virus)
acccuguacaccccgaccca

SEQ ID NO: 1875495 - RNA, 22 nt, Human herpesvirus 4 (Epstein-Barr virus)
agcuuuugaccaagcuaccaga

SEQ ID NO: 1875496 - RNA, 15 nt, Human herpesvirus 4 (Epstein-Barr virus)
accuggacuggggug

SEQ ID NO: 1875497 - RNA, 21 nt, Human herpesvirus 4 (Epstein-Barr virus)
agcuggugguccgcauguuuu

SEQ ID NO: 1875498 - RNA, 14 nt, Human herpesvirus 4 (Epstein-Barr virus)
gucaccugcacaga

SEQ ID NO: 1875499 - RNA, 14 nt, Human herpesvirus 4 (Epstein-Barr virus)
cccugucaccaggc

SEQ ID NO: 1875500 - RNA, 18 nt, Human herpesvirus 4 (Epstein-Barr virus)
agcgaggauaaucugggc

SEQ ID NO: 1875501 - RNA, 22 nt, Human herpesvirus 4 (Epstein-Barr virus)
auuggacgucccuuuggaggac

SEQ ID NO: 1875502 - RNA, 23 nt, Human herpesvirus 4 (Epstein-Barr virus)
uccuggccggccgcccccugacc

SEQ ID NO: 1875503 - RNA, 14 nt, Human herpesvirus 4 (Epstein-Barr virus)
gacaugcagacucc

SEQ ID NO: 1875504 - RNA, 15 nt, Human herpesvirus 4 (Epstein-Barr virus)
cagcauggcagccgg

SEQ ID NO: 1875505 - RNA, 21 nt, Human herpesvirus 4 (Epstein-Barr virus)
cuugguaaguuuucccuuccu

SEQ ID NO: 1875506 - RNA, 16 nt, Human herpesvirus 4 (Epstein-Barr virus)
gccuuccucugccugg

SEQ ID NO: 1875507 - RNA, 14 nt, Human herpesvirus 4 (Epstein-Barr virus)
cuccagugcgagga

SEQ ID NO: 1875508 - RNA, 16 nt, Human herpesvirus 4 (Epstein-Barr virus)
cagugggccucucugg

SEQ ID NO: 1875509 - RNA, 18 nt, Human herpesvirus 4 (Epstein-Barr virus)
ugcuguacaugggaccuc

SEQ ID NO: 1875510 - RNA, 19 nt, Human herpesvirus 4 (Epstein-Barr virus)
cucguccaucuugagcgcc

SEQ ID NO: 1875511 - RNA, 12 nt, Human herpesvirus 4 (Epstein-Barr virus)
aucucagggaca

SEQ ID NO: 1875512 - RNA, 21 nt, Human herpesvirus 4 (Epstein-Barr virus)
ccuggucaagagcuuccuggc

SEQ ID NO: 1875513 - RNA, 19 nt, Human herpesvirus 4 (Epstein-Barr virus)
cauuuacguucuggugaug

SEQ ID NO: 1875514 - RNA, 22 nt, Human herpesvirus 4 (Epstein-Barr virus)
cugccagagccucugccacaag

SEQ ID NO: 1875515 - RNA, 20 nt, Human herpesvirus 4 (Epstein-Barr virus)
ggccaccggggaggccaggu

SEQ ID NO: 1875516 - RNA, 14 nt, Human herpesvirus 4 (Epstein-Barr virus)
aaacaauuacagau

SEQ ID NO: 1875517 - RNA, 15 nt, Human herpesvirus 4 (Epstein-Barr virus)
aaggcggagaagacg

SEQ ID NO: 1875518 - RNA, 15 nt, Human herpesvirus 4 (Epstein-Barr virus)
gccucggccuggggu

SEQ ID NO: 1875519 - RNA, 20 nt, Human herpesvirus 4 (Epstein-Barr virus)
cggcggggaacgugacaggc

SEQ ID NO: 1875520 - RNA, 18 nt, Human herpesvirus 4 (Epstein-Barr virus)
aguaagcauggggcucug

SEQ ID NO: 1875521 - RNA, 17 nt, Human herpesvirus 4 (Epstein-Barr virus)
ccaucugcuucuggcuc

SEQ ID NO: 1875522 - RNA, 16 nt, Human herpesvirus 4 (Epstein-Barr virus)
aggcagccccaaagcg

SEQ ID NO: 1875523 - RNA, 16 nt, Human herpesvirus 4 (Epstein-Barr virus)
cuccaggcuccuggau

SEQ ID NO: 1875524 - RNA, 18 nt, Human herpesvirus 4 (Epstein-Barr virus)
accgcagccacguccaga

SEQ ID NO: 1875525 - RNA, 16 nt, Human herpesvirus 4 (Epstein-Barr virus)
caccugcacagaucug

SEQ ID NO: 1875526 - RNA, 17 nt, Human herpesvirus 4 (Epstein-Barr virus)
aagaauaacaugccaau

SEQ ID NO: 1875527 - RNA, 15 nt, Human herpesvirus 4 (Epstein-Barr virus)
aggcacggccgggcu

SEQ ID NO: 1875528 - RNA, 11 nt, Human herpesvirus 4 (Epstein-Barr virus)
agggcaaagac

SEQ ID NO: 1875529 - RNA, 14 nt, Human herpesvirus 4 (Epstein-Barr virus)
cugcuucuccccga

SEQ ID NO: 1875530 - RNA, 16 nt, Human herpesvirus 4 (Epstein-Barr virus)
acaauugccaaguacu

SEQ ID NO: 1875531 - RNA, 16 nt, Human herpesvirus 4 (Epstein-Barr virus)
acagcaauggcacgga

SEQ ID NO: 1875532 - RNA, 14 nt, Human herpesvirus 4 (Epstein-Barr virus)
gcugcugcugguca

SEQ ID NO: 1875533 - RNA, 20 nt, Human herpesvirus 4 (Epstein-Barr virus)
caagugauuaggagcagggc

SEQ ID NO: 1875534 - RNA, 14 nt, Human herpesvirus 4 (Epstein-Barr virus)
cucggccuccuggc

SEQ ID NO: 1875535 - RNA, 17 nt, Human herpesvirus 4 (Epstein-Barr virus)
ccgaugauucuggccau

SEQ ID NO: 1875536 - RNA, 19 nt, Human herpesvirus 4 (Epstein-Barr virus)
ggcgacaguaacacagggu

SEQ ID NO: 1875537 - RNA, 18 nt, Human herpesvirus 4 (Epstein-Barr virus)
cagggaaaaacuggccau

SEQ ID NO: 1875538 - RNA, 17 nt, Human herpesvirus 4 (Epstein-Barr virus)
aggcugcuaagccagga

SEQ ID NO: 1875539 - RNA, 20 nt, Human herpesvirus 4 (Epstein-Barr virus)
guggccucuacgccaggcuc

SEQ ID NO: 1875540 - RNA, 17 nt, Human herpesvirus 4 (Epstein-Barr virus)
agguggaggggggcggc

SEQ ID NO: 1875541 - RNA, 17 nt, Human herpesvirus 4 (Epstein-Barr virus)
ccgugccauccucucgg

SEQ ID NO: 1875542 - RNA, 16 nt, Human herpesvirus 4 (Epstein-Barr virus)
auaauacgcccgacaa

SEQ ID NO: 1875543 - RNA, 21 nt, Human herpesvirus 4 (Epstein-Barr virus)
ucucuggugaaacuggcuucu

SEQ ID NO: 1875544 - RNA, 23 nt, Human herpesvirus 4 (Epstein-Barr virus)
ccucgaguaggugccuccagagc

SEQ ID NO: 1875545 - RNA, 12 nt, Human herpesvirus 4 (Epstein-Barr virus)
uccagggcccug

SEQ ID NO: 1875546 - RNA, 19 nt, Human herpesvirus 4 (Epstein-Barr virus)
cucgaagcggucucagaca

SEQ ID NO: 1875547 - RNA, 21 nt, Human herpesvirus 4 (Epstein-Barr virus)
ugcaauaaauaaaaguacaga

SEQ ID NO: 1875548 - RNA, 21 nt, Human herpesvirus 4 (Epstein-Barr virus)
cauguguacuuguccucaucg

SEQ ID NO: 1875549 - RNA, 21 nt, Human herpesvirus 4 (Epstein-Barr virus)
cugcagugggccucucuggcu

SEQ ID NO: 1875550 - RNA, 14 nt, Human herpesvirus 4 (Epstein-Barr virus)
gcagcaccuguccc

SEQ ID NO: 1875551 - RNA, 15 nt, Human herpesvirus 4 (Epstein-Barr virus)
ucuacucuuggcagc

SEQ ID NO: 1875552 - RNA, 13 nt, Human herpesvirus 4 (Epstein-Barr virus)
aagaccaaggccc

SEQ ID NO: 1875553 - RNA, 13 nt, Human herpesvirus 4 (Epstein-Barr virus)
ggcucucaggccu

SEQ ID NO: 1875554 - RNA, 16 nt, Human herpesvirus 4 (Epstein-Barr virus)
ccuugcucgcagcugg

SEQ ID NO: 1875555 - RNA, 19 nt, Human herpesvirus 4 (Epstein-Barr virus)
ugcuucuggcucuucuggg

SEQ ID NO: 1875556 - RNA, 23 nt, Human herpesvirus 4 (Epstein-Barr virus)
gcaggccccccgcaccagggcca

SEQ ID NO: 1875557 - RNA, 21 nt, Human herpesvirus 4 (Epstein-Barr virus)
ccauggugccaagcucagccc

SEQ ID NO: 1875558 - RNA, 23 nt, Human herpesvirus 4 (Epstein-Barr virus)
cauaaguccucauggcaggagag

SEQ ID NO: 1875559 - RNA, 23 nt, Human herpesvirus 4 (Epstein-Barr virus)
acuggggugugaagggcagggcu

SEQ ID NO: 1875560 - RNA, 13 nt, Human herpesvirus 4 (Epstein-Barr virus)
cacgggccugggg

SEQ ID NO: 1875561 - RNA, 19 nt, Human herpesvirus 4 (Epstein-Barr virus)
augugcagggauugggcuu

SEQ ID NO: 1875562 - RNA, 22 nt, Human herpesvirus 4 (Epstein-Barr virus)
ugcagcgcccugucccuggagc

SEQ ID NO: 1875563 - RNA, 20 nt, Human herpesvirus 4 (Epstein-Barr virus)
cgaugucggggcugcuggcg

SEQ ID NO: 1875564 - RNA, 16 nt, Human herpesvirus 4 (Epstein-Barr virus)
cgauggucgucaucug

SEQ ID NO: 1875565 - RNA, 12 nt, Human herpesvirus 4 (Epstein-Barr virus)
gcccucuccagc

SEQ ID NO: 1875566 - RNA, 22 nt, Human herpesvirus 4 (Epstein-Barr virus)
uggggugcgggugcgggugaug

SEQ ID NO: 1875567 - RNA, 16 nt, Human herpesvirus 4 (Epstein-Barr virus)
cugaccacggcccacg

SEQ ID NO: 1875568 - RNA, 14 nt, Human herpesvirus 4 (Epstein-Barr virus)
cuggccgagcugga

SEQ ID NO: 1875569 - RNA, 14 nt, Human herpesvirus 4 (Epstein-Barr virus)
ucggcccuccgcau

SEQ ID NO: 1875570 - RNA, 20 nt, Human herpesvirus 4 (Epstein-Barr virus)
accccuguuagcuauuugau

SEQ ID NO: 1875571 - RNA, 15 nt, Human herpesvirus 4 (Epstein-Barr virus)
caucucaacacauau

SEQ ID NO: 1875572 - RNA, 14 nt, Human herpesvirus 4 (Epstein-Barr virus)
cguguggaagagga

SEQ ID NO: 1875573 - RNA, 16 nt, Human herpesvirus 4 (Epstein-Barr virus)
acccccuggagccagc

SEQ ID NO: 1875574 - RNA, 15 nt, Human herpesvirus 4 (Epstein-Barr virus)
ccgaagaagggaggg

SEQ ID NO: 1875575 - RNA, 22 nt, Human herpesvirus 4 (Epstein-Barr virus)
cgagacuuggaccaagggcagg

SEQ ID NO: 1875576 - RNA, 13 nt, Human herpesvirus 4 (Epstein-Barr virus)
cucccgcccugag

SEQ ID NO: 1875577 - RNA, 15 nt, Human herpesvirus 4 (Epstein-Barr virus)
ucuggucgcccccuc

SEQ ID NO: 1875578 - RNA, 14 nt, Human herpesvirus 4 (Epstein-Barr virus)
gggcccgggugccu

SEQ ID NO: 1875579 - RNA, 19 nt, Human herpesvirus 4 (Epstein-Barr virus)
uguacugaccacucaggaa

SEQ ID NO: 1875580 - RNA, 13 nt, Human herpesvirus 4 (Epstein-Barr virus)
auguuccuucuca

SEQ ID NO: 1875581 - RNA, 20 nt, Human herpesvirus 4 (Epstein-Barr virus)
cgcucugcgccagccccgcc

SEQ ID NO: 1875582 - RNA, 15 nt, Human herpesvirus 4 (Epstein-Barr virus)
ccuacgcagaggcca

SEQ ID NO: 1875583 - RNA, 14 nt, Human herpesvirus 4 (Epstein-Barr virus)
uggcggcccagccc

SEQ ID NO: 1875584 - RNA, 19 nt, Human herpesvirus 4 (Epstein-Barr virus)
gauuggaaaagggcccagg

SEQ ID NO: 1875585 - RNA, 17 nt, Human herpesvirus 4 (Epstein-Barr virus)
uguuucccgacgccaau

SEQ ID NO: 1875586 - RNA, 16 nt, Human herpesvirus 4 (Epstein-Barr virus)
gcucagugcggugcua

SEQ ID NO: 1875587 - RNA, 19 nt, Human herpesvirus 4 (Epstein-Barr virus)
cccagagggcgaaugggcu

SEQ ID NO: 1875588 - RNA, 18 nt, Human herpesvirus 4 (Epstein-Barr virus)
agugccuccgccugagcc

SEQ ID NO: 1875589 - RNA, 19 nt, Human herpesvirus 4 (Epstein-Barr virus)
ggagcggggguucuccagg

SEQ ID NO: 1875590 - RNA, 15 nt, Human herpesvirus 4 (Epstein-Barr virus)
agcaggagcuugagg

SEQ ID NO: 1875591 - RNA, 14 nt, Human herpesvirus 4 (Epstein-Barr virus)
accacugaccuggu

SEQ ID NO: 1875592 - RNA, 20 nt, Human herpesvirus 4 (Epstein-Barr virus)
gccaccgacgagcagaggac

SEQ ID NO: 1875593 - RNA, 14 nt, Human herpesvirus 4 (Epstein-Barr virus)
acccacuccagugc

SEQ ID NO: 1875594 - RNA, 22 nt, Human herpesvirus 4 (Epstein-Barr virus)
aggagcguguccccguggagga

SEQ ID NO: 1875595 - RNA, 19 nt, Human herpesvirus 4 (Epstein-Barr virus)
gggaacacccccaccccac

SEQ ID NO: 1875596 - RNA, 19 nt, Human herpesvirus 4 (Epstein-Barr virus)
ugcgaugaggcggugggug

SEQ ID NO: 1875597 - RNA, 15 nt, Human herpesvirus 4 (Epstein-Barr virus)
ccucauuggcuuugc

SEQ ID NO: 1875598 - RNA, 22 nt, Human herpesvirus 4 (Epstein-Barr virus)
gcuucucguagagaucaggcca

SEQ ID NO: 1875599 - RNA, 16 nt, Human herpesvirus 4 (Epstein-Barr virus)
uaacggguggaagcau

SEQ ID NO: 1875600 - RNA, 19 nt, Human herpesvirus 4 (Epstein-Barr virus)
ccugaucugggagaugaga

SEQ ID NO: 1875601 - RNA, 18 nt, Human herpesvirus 4 (Epstein-Barr virus)
ggacgcuguccgccagga

SEQ ID NO: 1875602 - RNA, 23 nt, Human herpesvirus 4 (Epstein-Barr virus)
uggcauacuuuuugccacccagg

SEQ ID NO: 1875603 - RNA, 14 nt, Human herpesvirus 4 (Epstein-Barr virus)
ccaaguugcauugg

SEQ ID NO: 1875604 - RNA, 13 nt, Human herpesvirus 4 (Epstein-Barr virus)
ccucggccugggg

SEQ ID NO: 1875605 - RNA, 15 nt, Human herpesvirus 4 (Epstein-Barr virus)
ccgaggccugcgacg

SEQ ID NO: 1875606 - RNA, 18 nt, Human herpesvirus 4 (Epstein-Barr virus)
gggugaggcccagccccc

SEQ ID NO: 1875607 - RNA, 13 nt, Human herpesvirus 4 (Epstein-Barr virus)
aacuugacuacaa

SEQ ID NO: 1875608 - RNA, 17 nt, Human herpesvirus 4 (Epstein-Barr virus)
ggugugaagggcagggc

SEQ ID NO: 1875609 - RNA, 14 nt, Human herpesvirus 4 (Epstein-Barr virus)
caggggagguggcu

SEQ ID NO: 1875610 - RNA, 17 nt, Human herpesvirus 4 (Epstein-Barr virus)
agcaggagcaggagcgg

SEQ ID NO: 1875611 - RNA, 17 nt, Human herpesvirus 4 (Epstein-Barr virus)
gaacacuugggcacgga

SEQ ID NO: 1875612 - RNA, 14 nt, Human herpesvirus 4 (Epstein-Barr virus)
ggacgaggacgaga

SEQ ID NO: 1875613 - RNA, 22 nt, Human herpesvirus 4 (Epstein-Barr virus)
gcggcccagcagauccagggcc

SEQ ID NO: 1875614 - RNA, 18 nt, Human herpesvirus 4 (Epstein-Barr virus)
auacccagagcaaaagca

SEQ ID NO: 1875615 - RNA, 12 nt, Human herpesvirus 4 (Epstein-Barr virus)
cccucugggaga

SEQ ID NO: 1875616 - RNA, 20 nt, Human herpesvirus 4 (Epstein-Barr virus)
caggccggcguugcgcacca

SEQ ID NO: 1875617 - RNA, 13 nt, Human herpesvirus 4 (Epstein-Barr virus)
gccguccucugga

SEQ ID NO: 1875618 - RNA, 19 nt, Human herpesvirus 4 (Epstein-Barr virus)
acacaucuggaccagaagg

SEQ ID NO: 1875619 - RNA, 17 nt, Human herpesvirus 4 (Epstein-Barr virus)
gaaaaugagccaugacu

SEQ ID NO: 1875620 - RNA, 15 nt, Human herpesvirus 4 (Epstein-Barr virus)
cacacucccuccaga

SEQ ID NO: 1875621 - RNA, 20 nt, Human herpesvirus 4 (Epstein-Barr virus)
uggaaacccucagucacggg

SEQ ID NO: 1875622 - RNA, 21 nt, Human herpesvirus 4 (Epstein-Barr virus)
aggaauuauuuaccacacccc

SEQ ID NO: 1875623 - RNA, 15 nt, Human herpesvirus 4 (Epstein-Barr virus)
gucccuuuggaggac

SEQ ID NO: 1875624 - RNA, 23 nt, Human herpesvirus 4 (Epstein-Barr virus)
ggcgguccuccacggggacacgc

SEQ ID NO: 1875625 - RNA, 21 nt, Human herpesvirus 4 (Epstein-Barr virus)
acggcccacgucuuuaccacc

SEQ ID NO: 1875626 - RNA, 14 nt, Human herpesvirus 4 (Epstein-Barr virus)
gcaggaggaggggc

SEQ ID NO: 1875627 - RNA, 20 nt, Human herpesvirus 4 (Epstein-Barr virus)
agagucuaucaggaccuggg

SEQ ID NO: 1875628 - RNA, 22 nt, Human herpesvirus 4 (Epstein-Barr virus)
cuccacuuacaaccaagccacu

SEQ ID NO: 1875629 - RNA, 21 nt, Human herpesvirus 4 (Epstein-Barr virus)
cggcaucaugcgugaccaccu

SEQ ID NO: 1875630 - RNA, 14 nt, Human herpesvirus 4 (Epstein-Barr virus)
agaccccugggcuc

SEQ ID NO: 1875631 - RNA, 13 nt, Human herpesvirus 4 (Epstein-Barr virus)
cuuugccaaccug

SEQ ID NO: 1875632 - RNA, 23 nt, Human herpesvirus 4 (Epstein-Barr virus)
ggggccuuguccgcugggccagg

SEQ ID NO: 1875633 - RNA, 22 nt, Human herpesvirus 4 (Epstein-Barr virus)
cauacucaagagaucagcaacc

SEQ ID NO: 1875634 - RNA, 20 nt, Human herpesvirus 4 (Epstein-Barr virus)
uccuggccggccgcccccug

SEQ ID NO: 1875635 - RNA, 18 nt, Human herpesvirus 4 (Epstein-Barr virus)
agugggcuucgggggccu

SEQ ID NO: 1875636 - RNA, 12 nt, Human herpesvirus 4 (Epstein-Barr virus)
cgacuucuggaa

SEQ ID NO: 1875637 - RNA, 20 nt, Human herpesvirus 4 (Epstein-Barr virus)
gccaauuggggugauccugu

SEQ ID NO: 1875638 - RNA, 12 nt, Human herpesvirus 4 (Epstein-Barr virus)
ccucugccuggc

SEQ ID NO: 1875639 - RNA, 17 nt, Human herpesvirus 4 (Epstein-Barr virus)
agcuccgugggcccaga

SEQ ID NO: 1875640 - RNA, 20 nt, Human herpesvirus 4 (Epstein-Barr virus)
uaugccuguggccccggcug

SEQ ID NO: 1875641 - RNA, 18 nt, Human herpesvirus 4 (Epstein-Barr virus)
uggcuguagccacccguc

SEQ ID NO: 1875642 - RNA, 19 nt, Human herpesvirus 4 (Epstein-Barr virus)
agggggcgcggcuggaugc

SEQ ID NO: 1875643 - RNA, 14 nt, Human herpesvirus 4 (Epstein-Barr virus)
cccacuccccucuc

SEQ ID NO: 1875644 - RNA, 12 nt, Human herpesvirus 4 (Epstein-Barr virus)
gaaccugagccu

SEQ ID NO: 1875645 - RNA, 13 nt, Human herpesvirus 4 (Epstein-Barr virus)
ugccugugccucg

SEQ ID NO: 1875646 - RNA, 15 nt, Human herpesvirus 4 (Epstein-Barr virus)
cucugaccgacgggc

SEQ ID NO: 1875647 - RNA, 15 nt, Human herpesvirus 4 (Epstein-Barr virus)
uaaccauggacgagg

SEQ ID NO: 1875648 - RNA, 15 nt, Human herpesvirus 4 (Epstein-Barr virus)
gcaggaggggcagga

SEQ ID NO: 1875649 - RNA, 22 nt, Human herpesvirus 4 (Epstein-Barr virus)
guugucacgucacucagcuccg

SEQ ID NO: 1875650 - RNA, 23 nt, Human herpesvirus 4 (Epstein-Barr virus)
gcagcagacaaggacaggugcca

SEQ ID NO: 1875651 - RNA, 16 nt, Human herpesvirus 4 (Epstein-Barr virus)
ccgaggcugagggggc

SEQ ID NO: 1875652 - RNA, 12 nt, Human herpesvirus 4 (Epstein-Barr virus)
cgguguccaggu

SEQ ID NO: 1875653 - RNA, 14 nt, Human herpesvirus 4 (Epstein-Barr virus)
ccagcauggcagcc

SEQ ID NO: 1875654 - RNA, 11 nt, Human herpesvirus 4 (Epstein-Barr virus)
guccccucugc

SEQ ID NO: 1875655 - RNA, 15 nt, Human herpesvirus 4 (Epstein-Barr virus)
aucucccgcgccgca

SEQ ID NO: 1875656 - RNA, 19 nt, Human herpesvirus 4 (Epstein-Barr virus)
ugucggcuaaugccaugca

SEQ ID NO: 1875657 - RNA, 19 nt, Human herpesvirus 4 (Epstein-Barr virus)
gggaggcauaacgguggug

SEQ ID NO: 1875658 - RNA, 18 nt, Human herpesvirus 4 (Epstein-Barr virus)
aggacacccaccaccagg

SEQ ID NO: 1875659 - RNA, 17 nt, Human herpesvirus 4 (Epstein-Barr virus)
cccuugcccucuccagc

SEQ ID NO: 1875660 - RNA, 16 nt, Human herpesvirus 4 (Epstein-Barr virus)
gguggcuugggcugug

SEQ ID NO: 1875661 - RNA, 16 nt, Human herpesvirus 4 (Epstein-Barr virus)
acccccacccuucgcc

SEQ ID NO: 1875662 - RNA, 15 nt, Human herpesvirus 4 (Epstein-Barr virus)
gugccucugggugcu

SEQ ID NO: 1875663 - RNA, 23 nt, Human herpesvirus 4 (Epstein-Barr virus)
ccccaaaaguagaggcucaggcc

SEQ ID NO: 1875664 - RNA, 18 nt, Human herpesvirus 4 (Epstein-Barr virus)
gcccucaugcgccagagc

SEQ ID NO: 1875665 - RNA, 14 nt, Human herpesvirus 4 (Epstein-Barr virus)
uuagguaucuggau

SEQ ID NO: 1875666 - RNA, 22 nt, Human herpesvirus 4 (Epstein-Barr virus)
ccuaucacgggggucaagcaaa

SEQ ID NO: 1875667 - RNA, 23 nt, Human herpesvirus 4 (Epstein-Barr virus)
aggcacggccucgugcaaccagg

SEQ ID NO: 1875668 - RNA, 20 nt, Human herpesvirus 4 (Epstein-Barr virus)
gaaggaggauggccuccagc

SEQ ID NO: 1875669 - RNA, 16 nt, Human herpesvirus 4 (Epstein-Barr virus)
caucaaccagugggua

SEQ ID NO: 1875670 - RNA, 19 nt, Human herpesvirus 4 (Epstein-Barr virus)
uccccagcaacagaucuug

SEQ ID NO: 1875671 - RNA, 15 nt, Human herpesvirus 4 (Epstein-Barr virus)
caagguugaagagca

SEQ ID NO: 1875672 - RNA, 18 nt, Human herpesvirus 4 (Epstein-Barr virus)
ccuugguuucagccucac

SEQ ID NO: 1875673 - RNA, 11 nt, Human herpesvirus 4 (Epstein-Barr virus)
cgcgacugagg

SEQ ID NO: 1875674 - RNA, 18 nt, Human herpesvirus 4 (Epstein-Barr virus)
gacaauaaaguugaugau

SEQ ID NO: 1875675 - RNA, 16 nt, Human herpesvirus 4 (Epstein-Barr virus)
gaacgugacaggcaca

SEQ ID NO: 1875676 - RNA, 23 nt, Human herpesvirus 4 (Epstein-Barr virus)
agagaucagcaaccuugggggca

SEQ ID NO: 1875677 - RNA, 20 nt, Human herpesvirus 4 (Epstein-Barr virus)
acugcguccaccuggccacc

SEQ ID NO: 1875678 - RNA, 16 nt, Human herpesvirus 4 (Epstein-Barr virus)
ucgcucaccccugugc

SEQ ID NO: 1875679 - RNA, 20 nt, Human herpesvirus 4 (Epstein-Barr virus)
gauauagcucugcacaggcu

SEQ ID NO: 1875680 - RNA, 22 nt, Human herpesvirus 4 (Epstein-Barr virus)
aggagcaggagcgggaggggca

SEQ ID NO: 1875681 - RNA, 17 nt, Human herpesvirus 4 (Epstein-Barr virus)
ccggcaccgccaggugg

SEQ ID NO: 1875682 - RNA, 21 nt, Human herpesvirus 4 (Epstein-Barr virus)
cuacucaccuacaugucaacc

SEQ ID NO: 1875683 - RNA, 12 nt, Human herpesvirus 4 (Epstein-Barr virus)
ggcuuucguccu

SEQ ID NO: 1875684 - RNA, 21 nt, Human herpesvirus 4 (Epstein-Barr virus)
acccuguagucaccugcacag

SEQ ID NO: 1875685 - RNA, 18 nt, Human herpesvirus 4 (Epstein-Barr virus)
cgagagaagagagcggcg

SEQ ID NO: 1875686 - RNA, 20 nt, Human herpesvirus 4 (Epstein-Barr virus)
caucucugauuauagcucug

SEQ ID NO: 1875687 - RNA, 20 nt, Human herpesvirus 4 (Epstein-Barr virus)
auuggucgucuucuuccccu

SEQ ID NO: 1875688 - RNA, 23 nt, Human herpesvirus 4 (Epstein-Barr virus)
ucacagcugcugguuuggagaaa

SEQ ID NO: 1875689 - RNA, 22 nt, Human herpesvirus 4 (Epstein-Barr virus)
ccaugcgcgcccugucaccagg

SEQ ID NO: 1875690 - RNA, 18 nt, Human herpesvirus 4 (Epstein-Barr virus)
cugacuggcagaaaggcu

SEQ ID NO: 1875691 - RNA, 19 nt, Human herpesvirus 4 (Epstein-Barr virus)
cgccugcggacucaggcca

SEQ ID NO: 1875692 - RNA, 16 nt, Human herpesvirus 4 (Epstein-Barr virus)
ccugguacaggaccau

SEQ ID NO: 1875693 - RNA, 20 nt, Human herpesvirus 4 (Epstein-Barr virus)
aagaacacuccacagaugga

SEQ ID NO: 1875694 - RNA, 18 nt, Human herpesvirus 4 (Epstein-Barr virus)
gugaccggacgggucuca

SEQ ID NO: 1875695 - RNA, 12 nt, Human herpesvirus 4 (Epstein-Barr virus)
ggggaagaggac

SEQ ID NO: 1875696 - RNA, 21 nt, Human herpesvirus 4 (Epstein-Barr virus)
uccccgagggugaggcccagc

SEQ ID NO: 1875697 - RNA, 21 nt, Human herpesvirus 4 (Epstein-Barr virus)
ggugggacaaaauggggucug

SEQ ID NO: 1875698 - RNA, 15 nt, Human herpesvirus 4 (Epstein-Barr virus)
ccucgguggugggcu

SEQ ID NO: 1875699 - RNA, 14 nt, Human herpesvirus 4 (Epstein-Barr virus)
cuacaacucagccc

SEQ ID NO: 1875700 - RNA, 16 nt, Human herpesvirus 4 (Epstein-Barr virus)
gacgcggagaggucca

SEQ ID NO: 1875701 - RNA, 12 nt, Human herpesvirus 4 (Epstein-Barr virus)
agcucaccuaug

SEQ ID NO: 1875702 - RNA, 22 nt, Human herpesvirus 4 (Epstein-Barr virus)
cucgcccacacagcgccagcag

SEQ ID NO: 1875703 - RNA, 16 nt, Human herpesvirus 4 (Epstein-Barr virus)
aaucccucugggagaa

SEQ ID NO: 1875704 - RNA, 21 nt, Human herpesvirus 4 (Epstein-Barr virus)
uggaccgugccauccucucgg

SEQ ID NO: 1875705 - RNA, 13 nt, Human herpesvirus 4 (Epstein-Barr virus)
ggagacgcccuca

SEQ ID NO: 1875706 - RNA, 22 nt, Human herpesvirus 4 (Epstein-Barr virus)
ccgggaccgcgcccuccucugg

SEQ ID NO: 1875707 - RNA, 21 nt, Human herpesvirus 4 (Epstein-Barr virus)
uggggguggacaugaggaggu

SEQ ID NO: 1875708 - RNA, 13 nt, Human herpesvirus 4 (Epstein-Barr virus)
uccgaggcugaga

SEQ ID NO: 1875709 - RNA, 14 nt, Human herpesvirus 4 (Epstein-Barr virus)
gccugagacagagg

SEQ ID NO: 1875710 - RNA, 12 nt, Human herpesvirus 4 (Epstein-Barr virus)
ccaccuggccag

SEQ ID NO: 1875711 - RNA, 19 nt, Human herpesvirus 4 (Epstein-Barr virus)
cagucaccuuccagacuau

SEQ ID NO: 1875712 - RNA, 14 nt, Human herpesvirus 4 (Epstein-Barr virus)
gaaacgucaggucu

SEQ ID NO: 1875713 - RNA, 12 nt, Human herpesvirus 4 (Epstein-Barr virus)
cgaugcggagga

SEQ ID NO: 1875714 - RNA, 18 nt, Human herpesvirus 4 (Epstein-Barr virus)
cacaggguggggguggac

SEQ ID NO: 1875715 - RNA, 22 nt, Human herpesvirus 4 (Epstein-Barr virus)
ggagcaggaggaggggcaggag

SEQ ID NO: 1875716 - RNA, 18 nt, Human herpesvirus 4 (Epstein-Barr virus)
cacgguggaacaggagca

SEQ ID NO: 1875717 - RNA, 13 nt, Human herpesvirus 4 (Epstein-Barr virus)
cgcaccacagaaa

SEQ ID NO: 1875718 - RNA, 23 nt, Human herpesvirus 4 (Epstein-Barr virus)
gcuccggauucaccggcaccgcc

SEQ ID NO: 1875719 - RNA, 20 nt, Human herpesvirus 4 (Epstein-Barr virus)
ggcccacgccauaccugcac

SEQ ID NO: 1875720 - RNA, 13 nt, Human herpesvirus 4 (Epstein-Barr virus)
aagggaggagugc

SEQ ID NO: 1875721 - RNA, 20 nt, Human herpesvirus 4 (Epstein-Barr virus)
gcccgacccccgggcgcccc

SEQ ID NO: 1875722 - RNA, 15 nt, Human herpesvirus 4 (Epstein-Barr virus)
cuugguuucagccuc

SEQ ID NO: 1875723 - RNA, 19 nt, Human herpesvirus 4 (Epstein-Barr virus)
cacaaccuuggacccugcu

SEQ ID NO: 1875724 - RNA, 14 nt, Human herpesvirus 4 (Epstein-Barr virus)
gcuguaacuguggu

SEQ ID NO: 1875725 - RNA, 19 nt, Human herpesvirus 4 (Epstein-Barr virus)
ccuagccaccguggccagg

SEQ ID NO: 1875726 - RNA, 21 nt, Human herpesvirus 4 (Epstein-Barr virus)
cugccggaguuuucuccccca

SEQ ID NO: 1875727 - RNA, 21 nt, Human herpesvirus 4 (Epstein-Barr virus)
caaaggccuugguuucagccu

SEQ ID NO: 1875728 - RNA, 16 nt, Human herpesvirus 4 (Epstein-Barr virus)
ugguugugcggucugu

SEQ ID NO: 1875729 - RNA, 19 nt, Human herpesvirus 4 (Epstein-Barr virus)
uacaagaguucucugguga

SEQ ID NO: 1875730 - RNA, 23 nt, Human herpesvirus 4 (Epstein-Barr virus)
acuccccucuccauucccagccc

SEQ ID NO: 1875731 - RNA, 17 nt, Human herpesvirus 4 (Epstein-Barr virus)
ggccaggcaccccaucu

SEQ ID NO: 1875732 - RNA, 16 nt, Human herpesvirus 4 (Epstein-Barr virus)
ccucugccuggccggc

SEQ ID NO: 1875733 - RNA, 16 nt, Human herpesvirus 4 (Epstein-Barr virus)
ugcaaguuuggccgcu

SEQ ID NO: 1875734 - RNA, 20 nt, Human herpesvirus 4 (Epstein-Barr virus)
accuuuccaucacugaccca

SEQ ID NO: 1875735 - RNA, 15 nt, Human herpesvirus 4 (Epstein-Barr virus)
cgcagguggcugcug

SEQ ID NO: 1875736 - RNA, 14 nt, Human herpesvirus 4 (Epstein-Barr virus)
ggagccggcggccu

SEQ ID NO: 1875737 - RNA, 18 nt, Human herpesvirus 4 (Epstein-Barr virus)
gccaaccugcucucucug

SEQ ID NO: 1875738 - RNA, 17 nt, Human herpesvirus 4 (Epstein-Barr virus)
ggacgauagcccaggca

SEQ ID NO: 1875739 - RNA, 19 nt, Human herpesvirus 4 (Epstein-Barr virus)
caacccuaacacucuuuuu

SEQ ID NO: 1875740 - RNA, 21 nt, Human herpesvirus 4 (Epstein-Barr virus)
ggcgguuagggaggacacugc

SEQ ID NO: 1875741 - RNA, 20 nt, Human herpesvirus 4 (Epstein-Barr virus)
ugcccucaugcgccagagcg

SEQ ID NO: 1875742 - RNA, 16 nt, Human herpesvirus 4 (Epstein-Barr virus)
gaugcaggaccuagaa

SEQ ID NO: 1875743 - RNA, 16 nt, Human herpesvirus 4 (Epstein-Barr virus)
gaccucccgcccugag

SEQ ID NO: 1875744 - RNA, 17 nt, Human herpesvirus 4 (Epstein-Barr virus)
cauucgugaguccaggg

SEQ ID NO: 1875745 - RNA, 22 nt, Human herpesvirus 4 (Epstein-Barr virus)
gugccuaaacgugauggugcug

SEQ ID NO: 1875746 - RNA, 16 nt, Human herpesvirus 4 (Epstein-Barr virus)
aucuguacgggaacau

SEQ ID NO: 1875747 - RNA, 19 nt, Human herpesvirus 4 (Epstein-Barr virus)
gcugccagagccucugcca

SEQ ID NO: 1875748 - RNA, 18 nt, Human herpesvirus 4 (Epstein-Barr virus)
aagcggcccagcagaucc

SEQ ID NO: 1875749 - RNA, 13 nt, Human herpesvirus 4 (Epstein-Barr virus)
uccaccagcuucu

SEQ ID NO: 1875750 - RNA, 13 nt, Human herpesvirus 4 (Epstein-Barr virus)
caccccugugcag

SEQ ID NO: 1875751 - RNA, 16 nt, Human herpesvirus 4 (Epstein-Barr virus)
gcucaccuauggucac

SEQ ID NO: 1875752 - RNA, 17 nt, Human herpesvirus 4 (Epstein-Barr virus)
caggcagaggaaggcca

SEQ ID NO: 1875753 - RNA, 14 nt, Human herpesvirus 4 (Epstein-Barr virus)
agauggacuugagg

SEQ ID NO: 1875754 - RNA, 20 nt, Human herpesvirus 4 (Epstein-Barr virus)
ggccugggaggugcugaggc

SEQ ID NO: 1875755 - RNA, 13 nt, Human herpesvirus 4 (Epstein-Barr virus)
agaucgccugcca

SEQ ID NO: 1875756 - RNA, 21 nt, Human herpesvirus 4 (Epstein-Barr virus)
agaggcaaacauacaggagga

SEQ ID NO: 1875757 - RNA, 15 nt, Human herpesvirus 4 (Epstein-Barr virus)
caagaaucggguggc

SEQ ID NO: 1875758 - RNA, 17 nt, Human herpesvirus 4 (Epstein-Barr virus)
agccacuacggccacgu

SEQ ID NO: 1875759 - RNA, 19 nt, Human herpesvirus 4 (Epstein-Barr virus)
cccggagucuggacguggc

SEQ ID NO: 1875760 - RNA, 13 nt, Human herpesvirus 4 (Epstein-Barr virus)
ucaucucgcuggc

SEQ ID NO: 1875761 - RNA, 16 nt, Human herpesvirus 4 (Epstein-Barr virus)
gguggcaguauuuugc

SEQ ID NO: 1875762 - RNA, 13 nt, Human herpesvirus 4 (Epstein-Barr virus)
ccucaccaaggac

SEQ ID NO: 1875763 - RNA, 18 nt, Human herpesvirus 4 (Epstein-Barr virus)
cggacuacguguccaugu

SEQ ID NO: 1875764 - RNA, 14 nt, Human herpesvirus 4 (Epstein-Barr virus)
cucgaguucucuag

SEQ ID NO: 1875765 - RNA, 21 nt, Human herpesvirus 4 (Epstein-Barr virus)
agaagcaccucaaccuggaga

SEQ ID NO: 1875766 - RNA, 15 nt, Human herpesvirus 4 (Epstein-Barr virus)
accacgaugacuccc

SEQ ID NO: 1875767 - RNA, 19 nt, Human herpesvirus 4 (Epstein-Barr virus)
uuuaacucuuaaaacuugc

SEQ ID NO: 1875768 - RNA, 21 nt, Human herpesvirus 4 (Epstein-Barr virus)
augguguuaacuuucuccccu

SEQ ID NO: 1875769 - RNA, 15 nt, Human herpesvirus 4 (Epstein-Barr virus)
gguucuccaggcucc

SEQ ID NO: 1875770 - RNA, 12 nt, Human herpesvirus 4 (Epstein-Barr virus)
cggggcugggga

SEQ ID NO: 1875771 - RNA, 19 nt, Human herpesvirus 4 (Epstein-Barr virus)
cguggcuuccagagaggcg

SEQ ID NO: 1875772 - RNA, 13 nt, Human herpesvirus 4 (Epstein-Barr virus)
acaacggccgaga

SEQ ID NO: 1875773 - RNA, 14 nt, Human herpesvirus 4 (Epstein-Barr virus)
aucucgcucagagc

SEQ ID NO: 1875774 - RNA, 15 nt, Human herpesvirus 4 (Epstein-Barr virus)
ccggaggcagacacc

SEQ ID NO: 1875775 - RNA, 17 nt, Human herpesvirus 4 (Epstein-Barr virus)
ucuggaccuggacuggg

SEQ ID NO: 1875776 - RNA, 10 nt, Human herpesvirus 4 (Epstein-Barr virus)
uggccgccgu

SEQ ID NO: 1875777 - RNA, 15 nt, Human herpesvirus 4 (Epstein-Barr virus)
ugcccucuccagcaa

SEQ ID NO: 1875778 - RNA, 11 nt, Human herpesvirus 4 (Epstein-Barr virus)
gggccaggcug

SEQ ID NO: 1875779 - RNA, 16 nt, Human herpesvirus 4 (Epstein-Barr virus)
agcuggcggacuacaa

SEQ ID NO: 1875780 - RNA, 15 nt, Human herpesvirus 4 (Epstein-Barr virus)
uguccagcagggccu

SEQ ID NO: 1875781 - RNA, 14 nt, Human herpesvirus 4 (Epstein-Barr virus)
uaccugaugaguca

SEQ ID NO: 1875782 - RNA, 15 nt, Human herpesvirus 4 (Epstein-Barr virus)
aaggcaguccagggg

SEQ ID NO: 1875783 - RNA, 21 nt, Human herpesvirus 4 (Epstein-Barr virus)
ccacggcccggggguggcagc

SEQ ID NO: 1875784 - RNA, 15 nt, Human herpesvirus 4 (Epstein-Barr virus)
acugcgaucuggacc

SEQ ID NO: 1875785 - RNA, 13 nt, Human herpesvirus 4 (Epstein-Barr virus)
gagcuccgugggc

SEQ ID NO: 1875786 - RNA, 17 nt, Human herpesvirus 4 (Epstein-Barr virus)
uccccugacgcuguggc

SEQ ID NO: 1875787 - RNA, 23 nt, Human herpesvirus 4 (Epstein-Barr virus)
aucaccgccguaaucuguggugg

SEQ ID NO: 1875788 - RNA, 15 nt, Human herpesvirus 4 (Epstein-Barr virus)
gaagcuggccaggcu

SEQ ID NO: 1875789 - RNA, 14 nt, Human herpesvirus 4 (Epstein-Barr virus)
ugccuccagagccc

SEQ ID NO: 1875790 - RNA, 12 nt, Human herpesvirus 4 (Epstein-Barr virus)
cagggcggagga

SEQ ID NO: 1875791 - RNA, 20 nt, Human herpesvirus 4 (Epstein-Barr virus)
cacugauuuugggcacacuu

SEQ ID NO: 1875792 - RNA, 13 nt, Human herpesvirus 4 (Epstein-Barr virus)
caguguggcccga

SEQ ID NO: 1875793 - RNA, 13 nt, Human herpesvirus 4 (Epstein-Barr virus)
ccagcccuccuca

SEQ ID NO: 1875794 - RNA, 12 nt, Human herpesvirus 4 (Epstein-Barr virus)
uccuggccccca

SEQ ID NO: 1875795 - RNA, 19 nt, Human herpesvirus 4 (Epstein-Barr virus)
aaucuucuucauagccuga

SEQ ID NO: 1875796 - RNA, 22 nt, Human herpesvirus 4 (Epstein-Barr virus)
uugucuucccagacucugcuuu

SEQ ID NO: 1875797 - RNA, 11 nt, Human herpesvirus 4 (Epstein-Barr virus)
caccaccccac

SEQ ID NO: 1875798 - RNA, 23 nt, Human herpesvirus 4 (Epstein-Barr virus)
agcgcucuggucgcccccucugc

SEQ ID NO: 1875799 - RNA, 13 nt, Human herpesvirus 4 (Epstein-Barr virus)
ccacucaggaagc

SEQ ID NO: 1875800 - RNA, 16 nt, Human herpesvirus 4 (Epstein-Barr virus)
cccagggacaucccca

SEQ ID NO: 1875801 - RNA, 20 nt, Human herpesvirus 4 (Epstein-Barr virus)
uugcucuucgugcucuucau

SEQ ID NO: 1875802 - RNA, 15 nt, Human herpesvirus 4 (Epstein-Barr virus)
ucccccccagaccug

SEQ ID NO: 1875803 - RNA, 13 nt, Human herpesvirus 4 (Epstein-Barr virus)
caggcucuccagc

SEQ ID NO: 1875804 - RNA, 22 nt, Human herpesvirus 4 (Epstein-Barr virus)
acagccagguguacgcccuggc

SEQ ID NO: 1875805 - RNA, 17 nt, Human herpesvirus 4 (Epstein-Barr virus)
cuaaugccaugcagcgg

SEQ ID NO: 1875806 - RNA, 13 nt, Human herpesvirus 4 (Epstein-Barr virus)
aggggcaggagca

SEQ ID NO: 1875807 - RNA, 17 nt, Human herpesvirus 4 (Epstein-Barr virus)
uaaggaacacggucugg

SEQ ID NO: 1875808 - RNA, 23 nt, Human herpesvirus 4 (Epstein-Barr virus)
ccucacgcgaagggaaacguggg

SEQ ID NO: 1875809 - RNA, 20 nt, Human herpesvirus 4 (Epstein-Barr virus)
gcagcacacgaagccugccu

SEQ ID NO: 1875810 - RNA, 13 nt, Human herpesvirus 4 (Epstein-Barr virus)
cggccgaggccug

SEQ ID NO: 1875811 - RNA, 21 nt, Human herpesvirus 4 (Epstein-Barr virus)
aggggcggugggcgcgugcac

SEQ ID NO: 1875812 - RNA, 17 nt, Human herpesvirus 4 (Epstein-Barr virus)
acacuuuagagcucugg

SEQ ID NO: 1875813 - RNA, 20 nt, Human herpesvirus 4 (Epstein-Barr virus)
ccggaaccugagccugagcc

SEQ ID NO: 1875814 - RNA, 22 nt, Human herpesvirus 4 (Epstein-Barr virus)
agcggcacagauuagaagauga

SEQ ID NO: 1875815 - RNA, 18 nt, Human herpesvirus 4 (Epstein-Barr virus)
gaccucccgcccugagcu

SEQ ID NO: 1875816 - RNA, 22 nt, Human herpesvirus 4 (Epstein-Barr virus)
ugugucccccuccauuccaccc

SEQ ID NO: 1875817 - RNA, 16 nt, Human herpesvirus 4 (Epstein-Barr virus)
cgugccauccucucgg

SEQ ID NO: 1875818 - RNA, 13 nt, Human herpesvirus 4 (Epstein-Barr virus)
aguucccuucucc

SEQ ID NO: 1875819 - RNA, 21 nt, Human herpesvirus 4 (Epstein-Barr virus)
cucucgaggucugcgaugagg

SEQ ID NO: 1875820 - RNA, 16 nt, Human herpesvirus 4 (Epstein-Barr virus)
cgagcggccuccgccg

SEQ ID NO: 1875821 - RNA, 17 nt, Human herpesvirus 4 (Epstein-Barr virus)
cucagcucaaccgccag

SEQ ID NO: 1875822 - RNA, 23 nt, Human herpesvirus 4 (Epstein-Barr virus)
agagccagccggguccgugcggc

SEQ ID NO: 1875823 - RNA, 12 nt, Human herpesvirus 4 (Epstein-Barr virus)
uguccucccggg

SEQ ID NO: 1875824 - RNA, 14 nt, Human herpesvirus 4 (Epstein-Barr virus)
agaggaugauccug

SEQ ID NO: 1875825 - RNA, 16 nt, Human herpesvirus 4 (Epstein-Barr virus)
cgaagcggucucagac

SEQ ID NO: 1875826 - RNA, 17 nt, Human herpesvirus 4 (Epstein-Barr virus)
ccuaaugcauccgcacc

SEQ ID NO: 1875827 - RNA, 20 nt, Human herpesvirus 4 (Epstein-Barr virus)
ccugagcauggcggccuggc

SEQ ID NO: 1875828 - RNA, 14 nt, Human herpesvirus 4 (Epstein-Barr virus)
cuggagccagcgcu

SEQ ID NO: 1875829 - RNA, 13 nt, Human herpesvirus 4 (Epstein-Barr virus)
cagcuggcccacc

SEQ ID NO: 1875830 - RNA, 19 nt, Human herpesvirus 4 (Epstein-Barr virus)
cuggugccagacucucuuc

SEQ ID NO: 1875831 - RNA, 22 nt, Human herpesvirus 4 (Epstein-Barr virus)
ccaaagcgggugcaguaacagg

SEQ ID NO: 1875832 - RNA, 15 nt, Human herpesvirus 4 (Epstein-Barr virus)
acuugaggugggcug

SEQ ID NO: 1875833 - RNA, 22 nt, Human herpesvirus 4 (Epstein-Barr virus)
acucgaagcggucucagacacc

SEQ ID NO: 1875834 - RNA, 16 nt, Human herpesvirus 4 (Epstein-Barr virus)
uacuuucaagccacgc

SEQ ID NO: 1875835 - RNA, 14 nt, Human herpesvirus 4 (Epstein-Barr virus)
accaguggcugccc

SEQ ID NO: 1875836 - RNA, 16 nt, Human herpesvirus 4 (Epstein-Barr virus)
cauaccuacaccaccc

SEQ ID NO: 1875837 - RNA, 12 nt, Human herpesvirus 4 (Epstein-Barr virus)
cugcauggccag

SEQ ID NO: 1875838 - RNA, 18 nt, Human herpesvirus 4 (Epstein-Barr virus)
accaggggcgagcagcgc

SEQ ID NO: 1875839 - RNA, 23 nt, Human herpesvirus 4 (Epstein-Barr virus)
ccucgcaggccccccgcaccagg

SEQ ID NO: 1875840 - RNA, 20 nt, Human herpesvirus 4 (Epstein-Barr virus)
gccucgcgacucgugggaaa

SEQ ID NO: 1875841 - RNA, 10 nt, Human herpesvirus 4 (Epstein-Barr virus)
caggccccca

SEQ ID NO: 1875842 - RNA, 21 nt, Human herpesvirus 4 (Epstein-Barr virus)
gcccugaucugggagaugaga

SEQ ID NO: 1875843 - RNA, 15 nt, Human herpesvirus 4 (Epstein-Barr virus)
ccucugcacaacaca

SEQ ID NO: 1875844 - RNA, 20 nt, Human herpesvirus 4 (Epstein-Barr virus)
cagcagcccggccgaggccu

SEQ ID NO: 1875845 - RNA, 23 nt, Human herpesvirus 4 (Epstein-Barr virus)
uacucuccgccguuccuucagaa

SEQ ID NO: 1875846 - RNA, 23 nt, Human herpesvirus 4 (Epstein-Barr virus)
ggccaccacaucggacgggcagg

SEQ ID NO: 1875847 - RNA, 13 nt, Human herpesvirus 4 (Epstein-Barr virus)
ccuggccagggcg

SEQ ID NO: 1875848 - RNA, 17 nt, Human herpesvirus 4 (Epstein-Barr virus)
ugucuccugacgccaau

SEQ ID NO: 1875849 - RNA, 21 nt, Human herpesvirus 4 (Epstein-Barr virus)
cagccagguguacgcccuggc

SEQ ID NO: 1875850 - RNA, 16 nt, Human herpesvirus 4 (Epstein-Barr virus)
acguccgugagagccu

SEQ ID NO: 1875851 - RNA, 18 nt, Human herpesvirus 4 (Epstein-Barr virus)
ccagggccggaaccugag

SEQ ID NO: 1875852 - RNA, 22 nt, Human herpesvirus 4 (Epstein-Barr virus)
ccguggccccgggagccacggc

SEQ ID NO: 1875853 - RNA, 15 nt, Human herpesvirus 4 (Epstein-Barr virus)
gagcaugcaggucag

SEQ ID NO: 1875854 - RNA, 19 nt, Human herpesvirus 4 (Epstein-Barr virus)
caccuagaaagagccaugg

SEQ ID NO: 1875855 - RNA, 14 nt, Human herpesvirus 4 (Epstein-Barr virus)
gagagcauuucagg

SEQ ID NO: 1875856 - RNA, 14 nt, Human herpesvirus 4 (Epstein-Barr virus)
ugcauggccaggcc

SEQ ID NO: 1875857 - RNA, 13 nt, Human herpesvirus 4 (Epstein-Barr virus)
gucaagagcuucc

SEQ ID NO: 1875858 - RNA, 14 nt, Human herpesvirus 4 (Epstein-Barr virus)
uugaucuucuucuc

SEQ ID NO: 1875859 - RNA, 16 nt, Human herpesvirus 4 (Epstein-Barr virus)
gaguucucuagcaggu

SEQ ID NO: 1875860 - RNA, 15 nt, Human herpesvirus 4 (Epstein-Barr virus)
accggggccuuggca

SEQ ID NO: 1875861 - RNA, 12 nt, Human herpesvirus 4 (Epstein-Barr virus)
ccggcuggccau

SEQ ID NO: 1875862 - RNA, 15 nt, Human herpesvirus 4 (Epstein-Barr virus)
gaguaauugcagugg

SEQ ID NO: 1875863 - RNA, 14 nt, Human herpesvirus 4 (Epstein-Barr virus)
acucuuaaaacuug

SEQ ID NO: 1875864 - RNA, 14 nt, Human herpesvirus 4 (Epstein-Barr virus)
caucgccgccccag

SEQ ID NO: 1875865 - RNA, 18 nt, Human herpesvirus 4 (Epstein-Barr virus)
ccccacacucccuccaga

SEQ ID NO: 1875866 - RNA, 16 nt, Human herpesvirus 4 (Epstein-Barr virus)
agcccaagaagaagcc

SEQ ID NO: 1875867 - RNA, 16 nt, Human herpesvirus 4 (Epstein-Barr virus)
ccaccuccccuguggc

SEQ ID NO: 1875868 - RNA, 11 nt, Human herpesvirus 4 (Epstein-Barr virus)
gggcaccccac

SEQ ID NO: 1875869 - RNA, 22 nt, Human herpesvirus 4 (Epstein-Barr virus)
uacucuuggcagcaguggccag

SEQ ID NO: 1875870 - RNA, 17 nt, Human herpesvirus 4 (Epstein-Barr virus)
uauaacugccagagcug

SEQ ID NO: 1875871 - RNA, 15 nt, Human herpesvirus 4 (Epstein-Barr virus)
agcaaacggccuggc

SEQ ID NO: 1875872 - RNA, 15 nt, Human herpesvirus 4 (Epstein-Barr virus)
ccggcauccagugcg

SEQ ID NO: 1875873 - RNA, 17 nt, Human herpesvirus 4 (Epstein-Barr virus)
cgcuccgcgcucggccu

SEQ ID NO: 1875874 - RNA, 23 nt, Human herpesvirus 4 (Epstein-Barr virus)
acuucgggggcgacugccgccgc

SEQ ID NO: 1875875 - RNA, 22 nt, Human herpesvirus 4 (Epstein-Barr virus)
gcucagacuuagggccggggcc

SEQ ID NO: 1875876 - RNA, 17 nt, Human herpesvirus 4 (Epstein-Barr virus)
uggccagguacgggcug

SEQ ID NO: 1875877 - RNA, 11 nt, Human herpesvirus 4 (Epstein-Barr virus)
acguuggcuuc

SEQ ID NO: 1875878 - RNA, 16 nt, Human herpesvirus 4 (Epstein-Barr virus)
gccacagagcaucaga

SEQ ID NO: 1875879 - RNA, 13 nt, Human herpesvirus 4 (Epstein-Barr virus)
cagaccacccgga

SEQ ID NO: 1875880 - RNA, 14 nt, Human herpesvirus 4 (Epstein-Barr virus)
ccaucugcuucugg

SEQ ID NO: 1875881 - RNA, 22 nt, Human herpesvirus 4 (Epstein-Barr virus)
gggcccuuagcaugggaggcgc

SEQ ID NO: 1875882 - RNA, 15 nt, Human herpesvirus 4 (Epstein-Barr virus)
ugcuguaguggccuu

SEQ ID NO: 1875883 - RNA, 18 nt, Human herpesvirus 4 (Epstein-Barr virus)
acacgcuuuugucugccu

SEQ ID NO: 1875884 - RNA, 17 nt, Human herpesvirus 4 (Epstein-Barr virus)
gcucuucaaccuuggca

SEQ ID NO: 1875885 - RNA, 18 nt, Human herpesvirus 4 (Epstein-Barr virus)
gcuccuggaucuggggcu
